United States Patent 8,969,254 (OLIGONUCLEOTIDE ARRAY FOR TISSUE TYPING) - sequence listing, part 3

SEQ ID NO: 48225 - DNA, 22 bp, Artificial Sequence
  Description of Artificial Sequence: Synthetic oligonucleotide
ctccgcgggtgtgaccagtccg

SEQ ID NO: 48226 - DNA, 22 bp, Artificial Sequence
  Description of Artificial Sequence: Synthetic oligonucleotide
tccgcgggtgtgaccagtccgc

SEQ ID NO: 48227 - DNA, 21 bp, Artificial Sequence
  Description of Artificial Sequence: Synthetic oligonucleotide
ccgcgggtgtgaccagtccgc

SEQ ID NO: 48228 - DNA, 23 bp, Artificial Sequence
  Description of Artificial Sequence: Synthetic oligonucleotide
cgcgggtgtgaccagtccgccta

SEQ ID NO: 48229 - DNA, 23 bp, Artificial Sequence
  Description of Artificial Sequence: Synthetic oligonucleotide
gcgggtgtgaccagtccgcctac

SEQ ID NO: 48230 - DNA, 24 bp, Artificial Sequence
  Description of Artificial Sequence: Synthetic oligonucleotide
cgggtgtgaccagtccgcctacga

SEQ ID NO: 48231 - DNA, 24 bp, Artificial Sequence
  Description of Artificial Sequence: Synthetic oligonucleotide
gggtgtgaccagtccgcctacgac

SEQ ID NO: 48232 - DNA, 24 bp, Artificial Sequence
  Description of Artificial Sequence: Synthetic oligonucleotide
ggtgtgaccagtccgcctacgacg

SEQ ID NO: 48233 - DNA, 24 bp, Artificial Sequence
  Description of Artificial Sequence: Synthetic oligonucleotide
gtgtgaccagtccgcctacgacgg

SEQ ID NO: 48234 - DNA, 26 bp, Artificial Sequence
  Description of Artificial Sequence: Synthetic oligonucleotide
tgtgaccagtccgcctacgacggcaa

SEQ ID NO: 48235 - DNA, 25 bp, Artificial Sequence
  Description of Artificial Sequence: Synthetic oligonucleotide
gtgaccagtccgcctacgacggcaa

SEQ ID NO: 48236 - DNA, 20 bp, Artificial Sequence
  Description of Artificial Sequence: Synthetic oligonucleotide
ccgtgtcccggcccggccat

SEQ ID NO: 48237 - DNA, 20 bp, Artificial Sequence
  Description of Artificial Sequence: Synthetic oligonucleotide
cgtgtcccggcccggccact

SEQ ID NO: 48238 - DNA, 20 bp, Artificial Sequence
  Description of Artificial Sequence: Synthetic oligonucleotide
gtgtcccggcccggccacgt

SEQ ID NO: 48239 - DNA, 20 bp, Artificial Sequence
  Description of Artificial Sequence: Synthetic oligonucleotide
tgtcccggcccggccacgga

SEQ ID NO: 48240 - DNA, 20 bp, Artificial Sequence
  Description of Artificial Sequence: Synthetic oligonucleotide
gtcccggcccggccacggat

SEQ ID NO: 48241 - DNA, 20 bp, Artificial Sequence
  Description of Artificial Sequence: Synthetic oligonucleotide
tcccggcccggccacggaga

SEQ ID NO: 48242 - DNA, 20 bp, Artificial Sequence
  Description of Artificial Sequence: Synthetic oligonucleotide
cccggcccggccacggagat

SEQ ID NO: 48243 - DNA, 20 bp, Artificial Sequence
  Description of Artificial Sequence: Synthetic oligonucleotide
ccggcccggccacggagagt

SEQ ID NO: 48244 - DNA, 20 bp, Artificial Sequence
  Description of Artificial Sequence: Synthetic oligonucleotide
cggcccggccacggagagct

SEQ ID NO: 48245 - DNA, 20 bp, Artificial Sequence
  Description of Artificial Sequence: Synthetic oligonucleotide
ggcccggccacggagagcct

SEQ ID NO: 48246 - DNA, 20 bp, Artificial Sequence
  Description of Artificial Sequence: Synthetic oligonucleotide
gcccggccacggagagccct

SEQ ID NO: 48247 - DNA, 20 bp, Artificial Sequence
  Description of Artificial Sequence: Synthetic oligonucleotide
cccggccacggagagcccct

SEQ ID NO: 48248 - DNA, 20 bp, Artificial Sequence
  Description of Artificial Sequence: Synthetic oligonucleotide
ccggccacggagagccccgt

SEQ ID NO: 48249 - DNA, 21 bp, Artificial Sequence
  Description of Artificial Sequence: Synthetic oligonucleotide
cggccacggagagccccgctt

SEQ ID NO: 48250 - DNA, 23 bp, Artificial Sequence
  Description of Artificial Sequence: Synthetic oligonucleotide
ggccacggagagccccgcttcat

SEQ ID NO: 48251 - DNA, 24 bp, Artificial Sequence
  Description of Artificial Sequence: Synthetic oligonucleotide
gccacggagagccccgcttcatct

SEQ ID NO: 48252 - DNA, 25 bp, Artificial Sequence
  Description of Artificial Sequence: Synthetic oligonucleotide
ccacggagagccccgcttcatctca

SEQ ID NO: 48253 - DNA, 26 bp, Artificial Sequence
  Description of Artificial Sequence: Synthetic oligonucleotide
cacggagagccccgcttcatctcagt

SEQ ID NO: 48254 - DNA, 26 bp, Artificial Sequence
  Description of Artificial Sequence: Synthetic oligonucleotide
acggagagccccgcttcatctcagtg

SEQ ID NO: 48255 - DNA, 24 bp, Artificial Sequence
  Description of Artificial Sequence: Synthetic oligonucleotide
gggaaggacaagctggagcgcgca

SEQ ID NO: 48256 - DNA, 24 bp, Artificial Sequence
  Description of Artificial Sequence: Synthetic oligonucleotide
ggaaggacaagctggagcgcgcag

SEQ ID NO: 48257 - DNA, 21 bp, Artificial Sequence
  Description of Artificial Sequence: Synthetic oligonucleotide
gggcgcctcctccgcgggttt

SEQ ID NO: 48258 - DNA, 22 bp, Artificial Sequence
  Description of Artificial Sequence: Synthetic oligonucleotide
ggcgcctcctccgcgggtttga

SEQ ID NO: 48259 - DNA, 22 bp, Artificial Sequence
  Description of Artificial Sequence: Synthetic oligonucleotide
gcgcctcctccgcgggtttgac

SEQ ID NO: 48260 - DNA, 23 bp, Artificial Sequence
  Description of Artificial Sequence: Synthetic oligonucleotide
cgcctcctccgcgggtttgacca

SEQ ID NO: 48261 - DNA, 24 bp, Artificial Sequence
  Description of Artificial Sequence: Synthetic oligonucleotide
gcctcctccgcgggtttgaccagt

SEQ ID NO: 48262 - DNA, 24 bp, Artificial Sequence
  Description of Artificial Sequence: Synthetic oligonucleotide
cctcctccgcgggtttgaccagtc

SEQ ID NO: 48263 - DNA, 24 bp, Artificial Sequence
  Description of Artificial Sequence: Synthetic oligonucleotide
ctcctccgcgggtttgaccagtcc

SEQ ID NO: 48264 - DNA, 24 bp, Artificial Sequence
  Description of Artificial Sequence: Synthetic oligonucleotide
tcctccgcgggtttgaccagtccg

SEQ ID NO: 48265 - DNA, 23 bp, Artificial Sequence
  Description of Artificial Sequence: Synthetic oligonucleotide
cctccgcgggtttgaccagtccg

SEQ ID NO: 48266 - DNA, 23 bp, Artificial Sequence
  Description of Artificial Sequence: Synthetic oligonucleotide
ctccgcgggtttgaccagtccgc

SEQ ID NO: 48267 - DNA, 25 bp, Artificial Sequence
  Description of Artificial Sequence: Synthetic oligonucleotide
tccgcgggtttgaccagtccgccta

SEQ ID NO: 48268 - DNA, 24 bp, Artificial Sequence
  Description of Artificial Sequence: Synthetic oligonucleotide
ccgcgggtttgaccagtccgccta

SEQ ID NO: 48269 - DNA, 24 bp, Artificial Sequence
  Description of Artificial Sequence: Synthetic oligonucleotide
cgcgggtttgaccagtccgcctac

SEQ ID NO: 48270 - DNA, 25 bp, Artificial Sequence
  Description of Artificial Sequence: Synthetic oligonucleotide
gcgggtttgaccagtccgcctacga

SEQ ID NO: 48271 - DNA, 25 bp, Artificial Sequence
  Description of Artificial Sequence: Synthetic oligonucleotide
cgggtttgaccagtccgcctacgac

SEQ ID NO: 48272 - DNA, 25 bp, Artificial Sequence
  Description of Artificial Sequence: Synthetic oligonucleotide
gggtttgaccagtccgcctacgacg

SEQ ID NO: 48273 - DNA, 25 bp, Artificial Sequence
  Description of Artificial Sequence: Synthetic oligonucleotide
ggtttgaccagtccgcctacgacgg

SEQ ID NO: 48274 - DNA, 27 bp, Artificial Sequence
  Description of Artificial Sequence: Synthetic oligonucleotide
gtttgaccagtccgcctacgacggcaa

SEQ ID NO: 48275 - DNA, 27 bp, Artificial Sequence
  Description of Artificial Sequence: Synthetic oligonucleotide
tttgaccagtccgcctacgacggcaag

SEQ ID NO: 48276 - DNA, 26 bp, Artificial Sequence
  Description of Artificial Sequence: Synthetic oligonucleotide
ttgaccagtccgcctacgacggcaag

SEQ ID NO: 48277 - DNA, 22 bp, Artificial Sequence
  Description of Artificial Sequence: Synthetic oligonucleotide
gctcctggaccgccgcggacta

SEQ ID NO: 48278 - DNA, 22 bp, Artificial Sequence
  Description of Artificial Sequence: Synthetic oligonucleotide
ctcctggaccgccgcggactac

SEQ ID NO: 48279 - DNA, 22 bp, Artificial Sequence
  Description of Artificial Sequence: Synthetic oligonucleotide
tcctggaccgccgcggactacg

SEQ ID NO: 48280 - DNA, 21 bp, Artificial Sequence
  Description of Artificial Sequence: Synthetic oligonucleotide
cctggaccgccgcggactacg

SEQ ID NO: 48281 - DNA, 21 bp, Artificial Sequence
  Description of Artificial Sequence: Synthetic oligonucleotide
ctggaccgccgcggactacgc

SEQ ID NO: 48282 - DNA, 21 bp, Artificial Sequence
  Description of Artificial Sequence: Synthetic oligonucleotide
tggaccgccgcggactacgcg

SEQ ID NO: 48283 - DNA, 20 bp, Artificial Sequence
  Description of Artificial Sequence: Synthetic oligonucleotide
ggaccgccgcggactacgcg

SEQ ID NO: 48284 - DNA, 20 bp, Artificial Sequence
  Description of Artificial Sequence: Synthetic oligonucleotide
gaccgccgcggactacgcgg

SEQ ID NO: 48285 - DNA, 21 bp, Artificial Sequence
  Description of Artificial Sequence: Synthetic oligonucleotide
accgccgcggactacgcggct

SEQ ID NO: 48286 - DNA, 20 bp, Artificial Sequence
  Description of Artificial Sequence: Synthetic oligonucleotide
ccgccgcggactacgcggct

SEQ ID NO: 48287 - DNA, 21 bp, Artificial Sequence
  Description of Artificial Sequence: Synthetic oligonucleotide
cgccgcggactacgcggctca

SEQ ID NO: 48288 - DNA, 23 bp, Artificial Sequence
  Description of Artificial Sequence: Synthetic oligonucleotide
gccgcggactacgcggctcagat

SEQ ID NO: 48289 - DNA, 24 bp, Artificial Sequence
  Description of Artificial Sequence: Synthetic oligonucleotide
ccgcggactacgcggctcagatca

SEQ ID NO: 48290 - DNA, 24 bp, Artificial Sequence
  Description of Artificial Sequence: Synthetic oligonucleotide
cgcggactacgcggctcagatcac

SEQ ID NO: 48291 - DNA, 24 bp, Artificial Sequence
  Description of Artificial Sequence: Synthetic oligonucleotide
gcggactacgcggctcagatcacc

SEQ ID NO: 48292 - DNA, 25 bp, Artificial Sequence
  Description of Artificial Sequence: Synthetic oligonucleotide
cggactacgcggctcagatcaccca

SEQ ID NO: 48293 - DNA, 25 bp, Artificial Sequence
  Description of Artificial Sequence: Synthetic oligonucleotide
ggactacgcggctcagatcacccag

SEQ ID NO: 48294 - DNA, 25 bp, Artificial Sequence
  Description of Artificial Sequence: Synthetic oligonucleotide
gactacgcggctcagatcacccagc

SEQ ID NO: 48295 - DNA, 25 bp, Artificial Sequence
  Description of Artificial Sequence: Synthetic oligonucleotide
actacgcggctcagatcacccagcg

SEQ ID NO: 48296 - DNA, 24 bp, Artificial Sequence
  Description of Artificial Sequence: Synthetic oligonucleotide
ctacgcggctcagatcacccagcg

SEQ ID NO: 48297 - DNA, 26 bp, Artificial Sequence
  Description of Artificial Sequence: Synthetic oligonucleotide
tacgcggctcagatcacccagcgcaa

SEQ ID NO: 48298 - DNA, 22 bp, Artificial Sequence
  Description of Artificial Sequence: Synthetic oligonucleotide
tggctgcgacctggggcccgaa

SEQ ID NO: 48299 - DNA, 21 bp, Artificial Sequence
  Description of Artificial Sequence: Synthetic oligonucleotide
ggctgcgacctggggcccgaa

SEQ ID NO: 48300 - DNA, 21 bp, Artificial Sequence
  Description of Artificial Sequence: Synthetic oligonucleotide
gctgcgacctggggcccgaag

SEQ ID NO: 48301 - DNA, 21 bp, Artificial Sequence
  Description of Artificial Sequence: Synthetic oligonucleotide
ctgcgacctggggcccgaagg

SEQ ID NO: 48302 - DNA, 21 bp, Artificial Sequence
  Description of Artificial Sequence: Synthetic oligonucleotide
tgcgacctggggcccgaaggg

SEQ ID NO: 48303 - DNA, 20 bp, Artificial Sequence
  Description of Artificial Sequence: Synthetic oligonucleotide
gcgacctggggcccgaaggg

SEQ ID NO: 48304 - DNA, 20 bp, Artificial Sequence
  Description of Artificial Sequence: Synthetic oligonucleotide
cgacctggggcccgaagggc

SEQ ID NO: 48305 - DNA, 20 bp, Artificial Sequence
  Description of Artificial Sequence: Synthetic oligonucleotide
gacctggggcccgaagggcg

SEQ ID NO: 48306 - DNA, 20 bp, Artificial Sequence
  Description of Artificial Sequence: Synthetic oligonucleotide
acctggggcccgaagggcgc

SEQ ID NO: 48307 - DNA, 20 bp, Artificial Sequence
  Description of Artificial Sequence: Synthetic oligonucleotide
cctggggcccgaagggcgct

SEQ ID NO: 48308 - DNA, 20 bp, Artificial Sequence
  Description of Artificial Sequence: Synthetic oligonucleotide
ctggggcccgaagggcgcct

SEQ ID NO: 48309 - DNA, 20 bp, Artificial Sequence
  Description of Artificial Sequence: Synthetic oligonucleotide
tggggcccgaagggcgcctc

SEQ ID NO: 48310 - DNA, 20 bp, Artificial Sequence
  Description of Artificial Sequence: Synthetic oligonucleotide
ggggcccgaagggcgcctct

SEQ ID NO: 48311 - DNA, 20 bp, Artificial Sequence
  Description of Artificial Sequence: Synthetic oligonucleotide
gggcccgaagggcgcctcct

SEQ ID NO: 48312 - DNA, 20 bp, Artificial Sequence
  Description of Artificial Sequence: Synthetic oligonucleotide
ggcccgaagggcgcctcctc

SEQ ID NO: 48313 - DNA, 20 bp, Artificial Sequence
  Description of Artificial Sequence: Synthetic oligonucleotide
gcccgaagggcgcctcctcc

SEQ ID NO: 48314 - DNA, 20 bp, Artificial Sequence
  Description of Artificial Sequence: Synthetic oligonucleotide
cccgaagggcgcctcctccg

SEQ ID NO: 48315 - DNA, 20 bp, Artificial Sequence
  Description of Artificial Sequence: Synthetic oligonucleotide
ccgaagggcgcctcctccgc

SEQ ID NO: 48316 - DNA, 20 bp, Artificial Sequence
  Description of Artificial Sequence: Synthetic oligonucleotide
cgaagggcgcctcctccgcg

SEQ ID NO: 48317 - DNA, 24 bp, Artificial Sequence
  Description of Artificial Sequence: Synthetic oligonucleotide
gaagggcgcctcctccgcggatat

SEQ ID NO: 48318 - DNA, 25 bp, Artificial Sequence
  Description of Artificial Sequence: Synthetic oligonucleotide
aagggcgcctcctccgcggatatga

SEQ ID NO: 48319 - DNA, 24 bp, Artificial Sequence
  Description of Artificial Sequence: Synthetic oligonucleotide
agggcgcctcctccgcggatatga

SEQ ID NO: 48320 - DNA, 23 bp, Artificial Sequence
  Description of Artificial Sequence: Synthetic oligonucleotide
gggcgcctcctccgcggatatga

SEQ ID NO: 48321 - DNA, 23 bp, Artificial Sequence
  Description of Artificial Sequence: Synthetic oligonucleotide
ggcgcctcctccgcggatatgac

SEQ ID NO: 48322 - DNA, 24 bp, Artificial Sequence
  Description of Artificial Sequence: Synthetic oligonucleotide
gcgcctcctccgcggatatgacca

SEQ ID NO: 48323 - DNA, 25 bp, Artificial Sequence
  Description of Artificial Sequence: Synthetic oligonucleotide
cgcctcctccgcggatatgaccagt

SEQ ID NO: 48324 - DNA, 25 bp, Artificial Sequence
  Description of Artificial Sequence: Synthetic oligonucleotide
gcctcctccgcggatatgaccagtc

SEQ ID NO: 48325 - DNA, 25 bp, Artificial Sequence
  Description of Artificial Sequence: Synthetic oligonucleotide
cctcctccgcggatatgaccagtcc

SEQ ID NO: 48326 - DNA, 25 bp, Artificial Sequence
  Description of Artificial Sequence: Synthetic oligonucleotide
ctcctccgcggatatgaccagtccg

SEQ ID NO: 48327 - DNA, 25 bp, Artificial Sequence
  Description of Artificial Sequence: Synthetic oligonucleotide
tcctccgcggatatgaccagtccgc

SEQ ID NO: 48328 - DNA, 24 bp, Artificial Sequence
  Description of Artificial Sequence: Synthetic oligonucleotide
cctccgcggatatgaccagtccgc

SEQ ID NO: 48329 - DNA, 26 bp, Artificial Sequence
  Description of Artificial Sequence: Synthetic oligonucleotide
ctccgcggatatgaccagtccgccta

SEQ ID NO: 48330 - DNA, 26 bp, Artificial Sequence
  Description of Artificial Sequence: Synthetic oligonucleotide
tccgcggatatgaccagtccgcctac

SEQ ID NO: 48331 - DNA, 25 bp, Artificial Sequence
  Description of Artificial Sequence: Synthetic oligonucleotide
ccgcggatatgaccagtccgcctac

SEQ ID NO: 48332 - DNA, 26 bp, Artificial Sequence
  Description of Artificial Sequence: Synthetic oligonucleotide
cgcggatatgaccagtccgcctacga

SEQ ID NO: 48333 - DNA, 26 bp, Artificial Sequence
  Description of Artificial Sequence: Synthetic oligonucleotide
gcggatatgaccagtccgcctacgac

SEQ ID NO: 48334 - DNA, 26 bp, Artificial Sequence
  Description of Artificial Sequence: Synthetic oligonucleotide
cggatatgaccagtccgcctacgacg

SEQ ID NO: 48335 - DNA, 26 bp, Artificial Sequence
  Description of Artificial Sequence: Synthetic oligonucleotide
ggatatgaccagtccgcctacgacgg

SEQ ID NO: 48336 - DNA, 27 bp, Artificial Sequence
  Description of Artificial Sequence: Synthetic oligonucleotide
gatatgaccagtccgcctacgacggca

SEQ ID NO: 48337 - DNA, 28 bp, Artificial Sequence
  Description of Artificial Sequence: Synthetic oligonucleotide
atatgaccagtccgcctacgacggcaag

SEQ ID NO: 48338 - DNA, 20 bp, Artificial Sequence
  Description of Artificial Sequence: Synthetic oligonucleotide
gaccgccgcggacaccgcga

SEQ ID NO: 48339 - DNA, 21 bp, Artificial Sequence
  Description of Artificial Sequence: Synthetic oligonucleotide
accgccgcggacaccgcgact

SEQ ID NO: 48340 - DNA, 20 bp, Artificial Sequence
  Description of Artificial Sequence: Synthetic oligonucleotide
ccgccgcggacaccgcgact

SEQ ID NO: 48341 - DNA, 21 bp, Artificial Sequence
  Description of Artificial Sequence: Synthetic oligonucleotide
cgccgcggacaccgcgactca

SEQ ID NO: 48342 - DNA, 23 bp, Artificial Sequence
  Description of Artificial Sequence: Synthetic oligonucleotide
gccgcggacaccgcgactcagat

SEQ ID NO: 48343 - DNA, 24 bp, Artificial Sequence
  Description of Artificial Sequence: Synthetic oligonucleotide
ccgcggacaccgcgactcagatca

SEQ ID NO: 48344 - DNA, 24 bp, Artificial Sequence
  Description of Artificial Sequence: Synthetic oligonucleotide
cgcggacaccgcgactcagatcac

SEQ ID NO: 48345 - DNA, 24 bp, Artificial Sequence
  Description of Artificial Sequence: Synthetic oligonucleotide
gcggacaccgcgactcagatcacc

SEQ ID NO: 48346 - DNA, 25 bp, Artificial Sequence
  Description of Artificial Sequence: Synthetic oligonucleotide
cggacaccgcgactcagatcaccca

SEQ ID NO: 48347 - DNA, 25 bp, Artificial Sequence
  Description of Artificial Sequence: Synthetic oligonucleotide
ggacaccgcgactcagatcacccag

SEQ ID NO: 48348 - DNA, 25 bp, Artificial Sequence
  Description of Artificial Sequence: Synthetic oligonucleotide
gacaccgcgactcagatcacccagc

SEQ ID NO: 48349 - DNA, 25 bp, Artificial Sequence
  Description of Artificial Sequence: Synthetic oligonucleotide
acaccgcgactcagatcacccagcg

SEQ ID NO: 48350 - DNA, 24 bp, Artificial Sequence
  Description of Artificial Sequence: Synthetic oligonucleotide
caccgcgactcagatcacccagcg

SEQ ID NO: 48351 - DNA, 26 bp, Artificial Sequence
  Description of Artificial Sequence: Synthetic oligonucleotide
accgcgactcagatcacccagcgcaa

SEQ ID NO: 48352 - DNA, 25 bp, Artificial Sequence
  Description of Artificial Sequence: Synthetic oligonucleotide
ccgcgactcagatcacccagcgcaa

SEQ ID NO: 48353 - DNA, 27 bp, Artificial Sequence
  Description of Artificial Sequence: Synthetic oligonucleotide
cgcgactcagatcacccagcgcaagtt

SEQ ID NO: 48354 - DNA, 27 bp, Artificial Sequence
  Description of Artificial Sequence: Synthetic oligonucleotide
gcgactcagatcacccagcgcaagttg

SEQ ID NO: 48355 - DNA, 27 bp, Artificial Sequence
  Description of Artificial Sequence: Synthetic oligonucleotide
cgactcagatcacccagcgcaagttgg

SEQ ID NO: 48356 - DNA, 28 bp, Artificial Sequence
  Description of Artificial Sequence: Synthetic oligonucleotide
gactcagatcacccagcgcaagttggag

SEQ ID NO: 48357 - DNA, 28 bp, Artificial Sequence
  Description of Artificial Sequence: Synthetic oligonucleotide
actcagatcacccagcgcaagttggagg

SEQ ID NO: 48358 - DNA, 26 bp, Artificial Sequence
  Description of Artificial Sequence: Synthetic oligonucleotide
caggctgaccgagtgaacctgcggaa

SEQ ID NO: 48359 - DNA, 26 bp, Artificial Sequence
  Description of Artificial Sequence: Synthetic oligonucleotide
aggctgaccgagtgaacctgcggaac

SEQ ID NO: 48360 - DNA, 25 bp, Artificial Sequence
  Description of Artificial Sequence: Synthetic oligonucleotide
ggctgaccgagtgaacctgcggaac

SEQ ID NO: 48361 - DNA, 26 bp, Artificial Sequence
  Description of Artificial Sequence: Synthetic oligonucleotide
gctgaccgagtgaacctgcggaacct

SEQ ID NO: 48362 - DNA, 26 bp, Artificial Sequence
  Description of Artificial Sequence: Synthetic oligonucleotide
caccaccccctctctgaccatgaggt

SEQ ID NO: 48363 - DNA, 27 bp, Artificial Sequence
  Description of Artificial Sequence: Synthetic oligonucleotide
accaccccctctctgaccatgaggtca

SEQ ID NO: 48364 - DNA, 26 bp, Artificial Sequence
  Description of Artificial Sequence: Synthetic oligonucleotide
ccaccccctctctgaccatgaggtca

SEQ ID NO: 48365 - DNA, 26 bp, Artificial Sequence
  Description of Artificial Sequence: Synthetic oligonucleotide
caccccctctctgaccatgaggtcac

SEQ ID NO: 48366 - DNA, 26 bp, Artificial Sequence
  Description of Artificial Sequence: Synthetic oligonucleotide
accccctctctgaccatgaggtcacc

SEQ ID NO: 48367 - DNA, 25 bp, Artificial Sequence
  Description of Artificial Sequence: Synthetic oligonucleotide
ccccctctctgaccatgaggtcacc

SEQ ID NO: 48368 - DNA, 26 bp, Artificial Sequence
  Description of Artificial Sequence: Synthetic oligonucleotide
cccctctctgaccatgaggtcaccct

SEQ ID NO: 48369 - DNA, 27 bp, Artificial Sequence
  Description of Artificial Sequence: Synthetic oligonucleotide
ccctctctgaccatgaggtcaccctga

SEQ ID NO: 48370 - DNA, 27 bp, Artificial Sequence
  Description of Artificial Sequence: Synthetic oligonucleotide
cctctctgaccatgaggtcaccctgag

SEQ ID NO: 48371 - DNA, 27 bp, Artificial Sequence
  Description of Artificial Sequence: Synthetic oligonucleotide
ctctctgaccatgaggtcaccctgagg

SEQ ID NO: 48372 - DNA, 25 bp, Artificial Sequence
  Description of Artificial Sequence: Synthetic oligonucleotide
gcgggtatgaccagtccgcctacca

SEQ ID NO: 48373 - DNA, 25 bp, Artificial Sequence
  Description of Artificial Sequence: Synthetic oligonucleotide
cgggtatgaccagtccgcctaccac

SEQ ID NO: 48374 - DNA, 25 bp, Artificial Sequence
  Description of Artificial Sequence: Synthetic oligonucleotide
gggtatgaccagtccgcctaccacg

SEQ ID NO: 48375 - DNA, 25 bp, Artificial Sequence
  Description of Artificial Sequence: Synthetic oligonucleotide
ggtatgaccagtccgcctaccacgg

SEQ ID NO: 48376 - DNA, 27 bp, Artificial Sequence
  Description of Artificial Sequence: Synthetic oligonucleotide
gtatgaccagtccgcctaccacggcaa

SEQ ID NO: 48377 - DNA, 27 bp, Artificial Sequence
  Description of Artificial Sequence: Synthetic oligonucleotide
tatgaccagtccgcctaccacggcaag

SEQ ID NO: 48378 - DNA, 26 bp, Artificial Sequence
  Description of Artificial Sequence: Synthetic oligonucleotide
atgaccagtccgcctaccacggcaag

SEQ ID NO: 48379 - DNA, 25 bp, Artificial Sequence
  Description of Artificial Sequence: Synthetic oligonucleotide
tgaccagtccgcctaccacggcaag

SEQ ID NO: 48380 - DNA, 24 bp, Artificial Sequence
  Description of Artificial Sequence: Synthetic oligonucleotide
gaccagtccgcctaccacggcaag

SEQ ID NO: 48381 - DNA, 27 bp, Artificial Sequence
  Description of Artificial Sequence: Synthetic oligonucleotide
accagtccgcctaccacggcaaggatt

SEQ ID NO: 48382 - DNA, 27 bp, Artificial Sequence
  Description of Artificial Sequence: Synthetic oligonucleotide
ccagtccgcctaccacggcaaggatta

SEQ ID NO: 48383 - DNA, 27 bp, Artificial Sequence
  Description of Artificial Sequence: Synthetic oligonucleotide
cagtccgcctaccacggcaaggattac

SEQ ID NO: 48384 - DNA, 29 bp, Artificial Sequence
  Description of Artificial Sequence: Synthetic oligonucleotide
agtccgcctaccacggcaaggattacatc

SEQ ID NO: 48385 - DNA, 28 bp, Artificial Sequence
  Description of Artificial Sequence: Synthetic oligonucleotide
gtccgcctaccacggcaaggattacatc

SEQ ID NO: 48386 - DNA, 28 bp, Artificial Sequence
  Description of Artificial Sequence: Synthetic oligonucleotide
tccgcctaccacggcaaggattacatcg

SEQ ID NO: 48387 - DNA, 27 bp, Artificial Sequence
  Description of Artificial Sequence: Synthetic oligonucleotide
ccgcctaccacggcaaggattacatcg

SEQ ID NO: 48388 - DNA, 20 bp, Artificial Sequence
  Description of Artificial Sequence: Synthetic oligonucleotide
ggcgcctcctccgcgggtag

SEQ ID NO: 48389 - DNA, 21 bp, Artificial Sequence
  Description of Artificial Sequence: Synthetic oligonucleotide
gcgcctcctccgcgggtagga

SEQ ID NO: 48390 - DNA, 21 bp, Artificial Sequence
  Description of Artificial Sequence: Synthetic oligonucleotide
cgcctcctccgcgggtaggac

SEQ ID NO: 48391 - DNA, 22 bp, Artificial Sequence
  Description of Artificial Sequence: Synthetic oligonucleotide
gcctcctccgcgggtaggacca

SEQ ID NO: 48392 - DNA, 23 bp, Artificial Sequence
  Description of Artificial Sequence: Synthetic oligonucleotide
cctcctccgcgggtaggaccagt

SEQ ID NO: 48393 - DNA, 23 bp, Artificial Sequence
  Description of Artificial Sequence: Synthetic oligonucleotide
ctcctccgcgggtaggaccagtc

SEQ ID NO: 48394 - DNA, 23 bp, Artificial Sequence
  Description of Artificial Sequence: Synthetic oligonucleotide
tcctccgcgggtaggaccagtcc

SEQ ID NO: 48395 - DNA, 22 bp, Artificial Sequence
  Description of Artificial Sequence: Synthetic oligonucleotide
cctccgcgggtaggaccagtcc

SEQ ID NO: 48396 - DNA, 22 bp, Artificial Sequence
  Description of Artificial Sequence: Synthetic oligonucleotide
ctccgcgggtaggaccagtccg

SEQ ID NO: 48397 - DNA, 22 bp, Artificial Sequence
  Description of Artificial Sequence: Synthetic oligonucleotide
tccgcgggtaggaccagtccgc

SEQ ID NO: 48398 - DNA, 21 bp, Artificial Sequence
  Description of Artificial Sequence: Synthetic oligonucleotide
ccgcgggtaggaccagtccgc

SEQ ID NO: 48399 - DNA, 23 bp, Artificial Sequence
  Description of Artificial Sequence: Synthetic oligonucleotide
cgcgggtaggaccagtccgccta

SEQ ID NO: 48400 - DNA, 23 bp, Artificial Sequence
  Description of Artificial Sequence: Synthetic oligonucleotide
gcgggtaggaccagtccgcctac

SEQ ID NO: 48401 - DNA, 24 bp, Artificial Sequence
  Description of Artificial Sequence: Synthetic oligonucleotide
cgggtaggaccagtccgcctacga

SEQ ID NO: 48402 - DNA, 24 bp, Artificial Sequence
  Description of Artificial Sequence: Synthetic oligonucleotide
gggtaggaccagtccgcctacgac

SEQ ID NO: 48403 - DNA, 24 bp, Artificial Sequence
  Description of Artificial Sequence: Synthetic oligonucleotide
ggtaggaccagtccgcctacgacg

SEQ ID NO: 48404 - DNA, 24 bp, Artificial Sequence
  Description of Artificial Sequence: Synthetic oligonucleotide
gtaggaccagtccgcctacgacgg

SEQ ID NO: 48405 - DNA, 26 bp, Artificial Sequence
  Description of Artificial Sequence: Synthetic oligonucleotide
taggaccagtccgcctacgacggcaa

SEQ ID NO: 48406 - DNA, 25 bp, Artificial Sequence
  Description of Artificial Sequence: Synthetic oligonucleotide
aggaccagtccgcctacgacggcaa

SEQ ID NO: 48407 - DNA, 24 bp, Artificial Sequence
  Description of Artificial Sequence: Synthetic oligonucleotide
ggaccagtccgcctacgacggcaa

SEQ ID NO: 48408 - DNA, 28 bp, Artificial Sequence
  Description of Artificial Sequence: Synthetic oligonucleotide
acaggtctcacaccctccagaggatgtc

SEQ ID NO: 48409 - DNA, 27 bp, Artificial Sequence
  Description of Artificial Sequence: Synthetic oligonucleotide
caggtctcacaccctccagaggatgtc

SEQ ID NO: 48410 - DNA, 28 bp, Artificial Sequence
  Description of Artificial Sequence: Synthetic oligonucleotide
aggtctcacaccctccagaggatgtctg

SEQ ID NO: 48411 - DNA, 26 bp, Artificial Sequence
  Description of Artificial Sequence: Synthetic oligonucleotide
ccggtctcacaccctccagaggatgt

SEQ ID NO: 48412 - DNA, 27 bp, Artificial Sequence
  Description of Artificial Sequence: Synthetic oligonucleotide
cggtctcacaccctccagaggatgtct

SEQ ID NO: 48413 - DNA, 25 bp, Artificial Sequence
  Description of Artificial Sequence: Synthetic oligonucleotide
gaaggagacgctgcagcgcacggaa

SEQ ID NO: 48414 - DNA, 25 bp, Artificial Sequence
  Description of Artificial Sequence: Synthetic oligonucleotide
aaggagacgctgcagcgcacggaac

SEQ ID NO: 48415 - DNA, 24 bp, Artificial Sequence
  Description of Artificial Sequence: Synthetic oligonucleotide
aggagacgctgcagcgcacggaac

SEQ ID NO: 48416 - DNA, 23 bp, Artificial Sequence
  Description of Artificial Sequence: Synthetic oligonucleotide
ggagacgctgcagcgcacggaac

SEQ ID NO: 48417 - DNA, 23 bp, Artificial Sequence
  Description of Artificial Sequence: Synthetic oligonucleotide
gagacgctgcagcgcacggaacc

SEQ ID NO: 48418 - DNA, 23 bp, Artificial Sequence
  Description of Artificial Sequence: Synthetic oligonucleotide
agacgctgcagcgcacggaaccc

SEQ ID NO: 48419 - DNA, 22 bp, Artificial Sequence
  Description of Artificial Sequence: Synthetic oligonucleotide
gacgctgcagcgcacggaaccc

SEQ ID NO: 48420 - DNA, 22 bp, Artificial Sequence
  Description of Artificial Sequence: Synthetic oligonucleotide
acgctgcagcgcacggaacccc

SEQ ID NO: 48421 - DNA, 21 bp, Artificial Sequence
  Description of Artificial Sequence: Synthetic oligonucleotide
cgctgcagcgcacggaacccc

SEQ ID NO: 48422 - DNA, 24 bp, Artificial Sequence
  Description of Artificial Sequence: Synthetic oligonucleotide
gctgcagcgcacggaacccccaaa

SEQ ID NO: 48423 - DNA, 25 bp, Artificial Sequence
  Description of Artificial Sequence: Synthetic oligonucleotide
ctgcagcgcacggaacccccaaaga

SEQ ID NO: 48424 - DNA, 26 bp, Artificial Sequence
  Description of Artificial Sequence: Synthetic oligonucleotide
tgcagcgcacggaacccccaaagaca

SEQ ID NO: 48425 - DNA, 25 bp, Artificial Sequence
  Description of Artificial Sequence: Synthetic oligonucleotide
gcagcgcacggaacccccaaagaca

SEQ ID NO: 48426 - DNA, 26 bp, Artificial Sequence
  Description of Artificial Sequence: Synthetic oligonucleotide
cagcgcacggaacccccaaagacaca

SEQ ID NO: 48427 - DNA, 26 bp, Artificial Sequence
  Description of Artificial Sequence: Synthetic oligonucleotide
agcgcacggaacccccaaagacacac

SEQ ID NO: 48428 - DNA, 25 bp, Artificial Sequence
  Description of Artificial Sequence: Synthetic oligonucleotide
gcgcacggaacccccaaagacacac

SEQ ID NO: 48429 - DNA, 26 bp, Artificial Sequence
  Description of Artificial Sequence: Synthetic oligonucleotide
cgcacggaacccccaaagacacacgt

SEQ ID NO: 48430 - DNA, 27 bp, Artificial Sequence
  Description of Artificial Sequence: Synthetic oligonucleotide
gcacggaacccccaaagacacacgtga

SEQ ID NO: 48431 - DNA, 27 bp, Artificial Sequence
  Description of Artificial Sequence: Synthetic oligonucleotide
cacggaacccccaaagacacacgtgac

SEQ ID NO: 48432 - DNA, 27 bp, Artificial Sequence
  Description of Artificial Sequence: Synthetic oligonucleotide
acggaacccccaaagacacacgtgacc

SEQ ID NO: 48433 - DNA, 23 bp, Artificial Sequence
  Description of Artificial Sequence: Synthetic oligonucleotide
agcgcaagttggaggcggcccct

SEQ ID NO: 48434 - DNA, 22 bp, Artificial Sequence
  Description of Artificial Sequence: Synthetic oligonucleotide
gcgcaagttggaggcggcccct

SEQ ID NO: 48435 - DNA, 22 bp, Artificial Sequence
  Description of Artificial Sequence: Synthetic oligonucleotide
cgcaagttggaggcggcccctg

SEQ ID NO: 48436 - DNA, 22 bp, Artificial Sequence
  Description of Artificial Sequence: Synthetic oligonucleotide
gcaagttggaggcggcccctgc

SEQ ID NO: 48437 - DNA, 22 bp, Artificial Sequence
  Description of Artificial Sequence: Synthetic oligonucleotide
caagttggaggcggcccctgcg

SEQ ID NO: 48438 - DNA, 22 bp, Artificial Sequence
  Description of Artificial Sequence: Synthetic oligonucleotide
aagttggaggcggcccctgcgg

SEQ ID NO: 48439 - DNA, 21 bp, Artificial Sequence
  Description of Artificial Sequence: Synthetic oligonucleotide
agttggaggcggcccctgcgg

SEQ ID NO: 48440 - DNA, 20 bp, Artificial Sequence
  Description of Artificial Sequence: Synthetic oligonucleotide
gttggaggcggcccctgcgg

SEQ ID NO: 48441 - DNA, 20 bp, Artificial Sequence
  Description of Artificial Sequence: Synthetic oligonucleotide
ttggaggcggcccctgcggc

SEQ ID NO: 48442 - DNA, 20 bp, Artificial Sequence
  Description of Artificial Sequence: Synthetic oligonucleotide
tggaggcggcccctgcggct

SEQ ID NO: 48443 - DNA, 20 bp, Artificial Sequence
  Description of Artificial Sequence: Synthetic oligonucleotide
ggaggcggcccctgcggctt

SEQ ID NO: 48444 - DNA, 20 bp, Artificial Sequence
  Description of Artificial Sequence: Synthetic oligonucleotide
gaggcggcccctgcggcgtt

SEQ ID NO: 48445 - DNA, 20 bp, Artificial Sequence
  Description of Artificial Sequence: Synthetic oligonucleotide
aggcggcccctgcggcggat

SEQ ID NO: 48446 - DNA, 20 bp, Artificial Sequence
  Description of Artificial Sequence: Synthetic oligonucleotide
ggcggcccctgcggcggatt

SEQ ID NO: 48447 - DNA, 20 bp, Artificial Sequence
  Description of Artificial Sequence: Synthetic oligonucleotide
gcggcccctgcggcggagtt

SEQ ID NO: 48448 - DNA, 20 bp, Artificial Sequence
  Description of Artificial Sequence: Synthetic oligonucleotide
cggcccctgcggcggagcat

SEQ ID NO: 48449 - DNA, 20 bp, Artificial Sequence
  Description of Artificial Sequence: Synthetic oligonucleotide
ggcccctgcggcggagcagt

SEQ ID NO: 48450 - DNA, 20 bp, Artificial Sequence
  Description of Artificial Sequence: Synthetic oligonucleotide
gcccctgcggcggagcagct

SEQ ID NO: 48451 - DNA, 21 bp, Artificial Sequence
  Description of Artificial Sequence: Synthetic oligonucleotide
cccctgcggcggagcagctga

SEQ ID NO: 48452 - DNA, 22 bp, Artificial Sequence
  Description of Artificial Sequence: Synthetic oligonucleotide
ccctgcggcggagcagctgaga

SEQ ID NO: 48453 - DNA, 22 bp, Artificial Sequence
  Description of Artificial Sequence: Synthetic oligonucleotide
cctgcggcggagcagctgagag

SEQ ID NO: 48454 - DNA, 22 bp, Artificial Sequence
  Description of Artificial Sequence: Synthetic oligonucleotide
ctgcggcggagcagctgagagc

SEQ ID NO: 48455 - DNA, 20 bp, Artificial Sequence
  Description of Artificial Sequence: Synthetic oligonucleotide
tgtcccggcccggccgcgta

SEQ ID NO: 48456 - DNA, 20 bp, Artificial Sequence
  Description of Artificial Sequence: Synthetic oligonucleotide
gtcccggcccggccgcgtat

SEQ ID NO: 48457 - DNA, 20 bp, Artificial Sequence
  Description of Artificial Sequence: Synthetic oligonucleotide
tcccggcccggccgcgtaga

SEQ ID NO: 48458 - DNA, 20 bp, Artificial Sequence
  Description of Artificial Sequence: Synthetic oligonucleotide
cccggcccggccgcgtagat

SEQ ID NO: 48459 - DNA, 20 bp, Artificial Sequence
  Description of Artificial Sequence: Synthetic oligonucleotide
ccggcccggccgcgtagagt

SEQ ID NO: 48460 - DNA, 20 bp, Artificial Sequence
  Description of Artificial Sequence: Synthetic oligonucleotide
cggcccggccgcgtagagct

SEQ ID NO: 48461 - DNA, 20 bp, Artificial Sequence
  Description of Artificial Sequence: Synthetic oligonucleotide
ggcccggccgcgtagagcct

SEQ ID NO: 48462 - DNA, 20 bp, Artificial Sequence
  Description of Artificial Sequence: Synthetic oligonucleotide
gcccggccgcgtagagccct

SEQ ID NO: 48463 - DNA, 20 bp, Artificial Sequence
  Description of Artificial Sequence: Synthetic oligonucleotide
cccggccgcgtagagcccct

SEQ ID NO: 48464 - DNA, 20 bp, Artificial Sequence
  Description of Artificial Sequence: Synthetic oligonucleotide
ccggccgcgtagagccccgt

SEQ ID NO: 48465 - DNA, 21 bp, Artificial Sequence
  Description of Artificial Sequence: Synthetic oligonucleotide
cggccgcgtagagccccgctt

SEQ ID NO: 48466 - DNA, 23 bp, Artificial Sequence
  Description of Artificial Sequence: Synthetic oligonucleotide
ggccgcgtagagccccgcttcat

SEQ ID NO: 48467 - DNA, 24 bp, Artificial Sequence
  Description of Artificial Sequence: Synthetic oligonucleotide
gccgcgtagagccccgcttcatct

SEQ ID NO: 48468 - DNA, 25 bp, Artificial Sequence
  Description of Artificial Sequence: Synthetic oligonucleotide
ccgcgtagagccccgcttcatctca

SEQ ID NO: 48469 - DNA, 26 bp, Artificial Sequence
  Description of Artificial Sequence: Synthetic oligonucleotide
cgcgtagagccccgcttcatctcagt

SEQ ID NO: 48470 - DNA, 26 bp, Artificial Sequence
  Description of Artificial Sequence: Synthetic oligonucleotide
gcgtagagccccgcttcatctcagtg

SEQ ID NO: 48471 - DNA, 26 bp, Artificial Sequence
  Description of Artificial Sequence: Synthetic oligonucleotide
cgtagagccccgcttcatctcagtgg

SEQ ID NO: 48472 - DNA, 26 bp, Artificial Sequence
  Description of Artificial Sequence: Synthetic oligonucleotide
gtagagccccgcttcatctcagtggg

SEQ ID NO: 48473 - DNA, 27 bp, Artificial Sequence
  Description of Artificial Sequence: Synthetic oligonucleotide
tagagccccgcttcatctcagtgggct

SEQ ID NO: 48474 - DNA, 29 bp, Artificial Sequence
  Description of Artificial Sequence: Synthetic oligonucleotide
accgggagacacagaagtacaagcgctag

SEQ ID NO: 48475 - DNA, 28 bp, Artificial Sequence
  Description of Artificial Sequence: Synthetic oligonucleotide
ccgggagacacagaagtacaagcgctag

SEQ ID NO: 48476 - DNA, 28 bp, Artificial Sequence
  Description of Artificial Sequence: Synthetic oligonucleotide
cgggagacacagaagtacaagcgctagg

SEQ ID NO: 48477 - DNA, 28 bp, Artificial Sequence
  Description of Artificial Sequence: Synthetic oligonucleotide
gggagacacagaagtacaagcgctaggc

SEQ ID NO: 48478 - DNA, 29 bp, Artificial Sequence
  Description of Artificial Sequence: Synthetic oligonucleotide
ggagacacagaagtacaagcgctaggcac

SEQ ID NO: 48479 - DNA, 30 bp, Artificial Sequence
  Description of Artificial Sequence: Synthetic oligonucleotide
gagacacagaagtacaagcgctaggcacag

SEQ ID NO: 48480 - DNA, 30 bp, Artificial Sequence
  Description of Artificial Sequence: Synthetic oligonucleotide
agacacagaagtacaagcgctaggcacagg

SEQ ID NO: 48481 - DNA, 29 bp, Artificial Sequence
  Description of Artificial Sequence: Synthetic oligonucleotide
gacacagaagtacaagcgctaggcacagg

SEQ ID NO: 48482 - DNA, 29 bp, Artificial Sequence
  Description of Artificial Sequence: Synthetic oligonucleotide
acacagaagtacaagcgctaggcacaggc

SEQ ID NO: 48483 - DNA, 28 bp, Artificial Sequence
  Description of Artificial Sequence: Synthetic oligonucleotide
cacagaagtacaagcgctaggcacaggc

SEQ ID NO: 48484 - DNA, 29 bp, Artificial Sequence
  Description of Artificial Sequence: Synthetic oligonucleotide
acagaagtacaagcgctaggcacaggctg

SEQ ID NO: 48485 - DNA, 28 bp, Artificial Sequence
  Description of Artificial Sequence: Synthetic oligonucleotide
cagaagtacaagcgctaggcacaggctg

SEQ ID NO: 48486 - DNA, 29 bp, Artificial Sequence
  Description of Artificial Sequence: Synthetic oligonucleotide
agaagtacaagcgctaggcacaggctgac

SEQ ID NO: 48487 - DNA, 28 bp, Artificial Sequence
  Description of Artificial Sequence: Synthetic oligonucleotide
gaagtacaagcgctaggcacaggctgac

SEQ ID NO: 48488 - DNA, 28 bp, Artificial Sequence
  Description of Artificial Sequence: Synthetic oligonucleotide
aagtacaagcgctaggcacaggctgacc

SEQ ID NO: 48489 - DNA, 27 bp, Artificial Sequence
  Description of Artificial Sequence: Synthetic oligonucleotide
agtacaagcgctaggcacaggctgacc

SEQ ID NO: 48490 - DNA, 26 bp, Artificial Sequence
  Description of Artificial Sequence: Synthetic oligonucleotide
gtacaagcgctaggcacaggctgacc

SEQ ID NO: 48491 - DNA, 27 bp, Artificial Sequence
  Description of Artificial Sequence: Synthetic oligonucleotide
tacaagcgctaggcacaggctgaccga

SEQ ID NO: 48492 - DNA, 26 bp, Artificial Sequence
  Description of Artificial Sequence: Synthetic oligonucleotide
acaagcgctaggcacaggctgaccga

SEQ ID NO: 48493 - DNA, 25 bp, Artificial Sequence
  Description of Artificial Sequence: Synthetic oligonucleotide
caagcgctaggcacaggctgaccga

SEQ ID NO: 48494 - DNA, 26 bp, Artificial Sequence
  Description of Artificial Sequence: Synthetic oligonucleotide
aagcgctaggcacaggctgaccgagt

SEQ ID NO: 48495 - DNA, 25 bp, Artificial Sequence
  Description of Artificial Sequence: Synthetic oligonucleotide
agcgctaggcacaggctgaccgagt

SEQ ID NO: 48496 - DNA, 24 bp, Artificial Sequence
  Description of Artificial Sequence: Synthetic oligonucleotide
gcgctaggcacaggctgaccgagt

SEQ ID NO: 48497 - DNA, 25 bp, Artificial Sequence
  Description of Artificial Sequence: Synthetic oligonucleotide
cgctaggcacaggctgaccgagtga

SEQ ID NO: 48498 - DNA, 25 bp, Artificial Sequence
  Description of Artificial Sequence: Synthetic oligonucleotide
gctaggcacaggctgaccgagtgag

SEQ ID NO: 48499 - DNA, 25 bp, Artificial Sequence
  Description of Artificial Sequence: Synthetic oligonucleotide
ctaggcacaggctgaccgagtgagc

SEQ ID NO: 48500 - DNA, 26 bp, Artificial Sequence
  Description of Artificial Sequence: Synthetic oligonucleotide
taggcacaggctgaccgagtgagcct

SEQ ID NO: 48501 - DNA, 30 bp, Artificial Sequence
  Description of Artificial Sequence: Synthetic oligonucleotide
gctcctactccatgaggtatttcgacaccg

SEQ ID NO: 48502 - DNA, 30 bp, Artificial Sequence
  Description of Artificial Sequence: Synthetic oligonucleotide
ctcctactccatgaggtatttcgacaccgc

SEQ ID NO: 48503 - DNA, 30 bp, Artificial Sequence
  Description of Artificial Sequence: Synthetic oligonucleotide
tcctactccatgaggtatttcgacaccgcc

SEQ ID NO: 48504 - DNA, 29 bp, Artificial Sequence
  Description of Artificial Sequence: Synthetic oligonucleotide
cctactccatgaggtatttcgacaccgcc

SEQ ID NO: 48505 - DNA, 29 bp, Artificial Sequence
  Description of Artificial Sequence: Synthetic oligonucleotide
ctactccatgaggtatttcgacaccgccg

SEQ ID NO: 48506 - DNA, 30 bp, Artificial Sequence
  Description of Artificial Sequence: Synthetic oligonucleotide
tactccatgaggtatttcgacaccgccgtg

SEQ ID NO: 48507 - DNA, 20 bp, Artificial Sequence
  Description of Artificial Sequence: Synthetic oligonucleotide
acctggggccctacgggcgc

SEQ ID NO: 48508 - DNA, 20 bp, Artificial Sequence
  Description of Artificial Sequence: Synthetic oligonucleotide
cctggggccctacgggcgct

SEQ ID NO: 48509 - DNA, 20 bp, Artificial Sequence
  Description of Artificial Sequence: Synthetic oligonucleotide
ctggggccctacgggcgcct

SEQ ID NO: 48510 - DNA, 20 bp, Artificial Sequence
  Description of Artificial Sequence: Synthetic oligonucleotide
tggggccctacgggcgcctc

SEQ ID NO: 48511 - DNA, 20 bp, Artificial Sequence
  Description of Artificial Sequence: Synthetic oligonucleotide
ggggccctacgggcgcctct

SEQ ID NO: 48512 - DNA, 20 bp, Artificial Sequence
  Description of Artificial Sequence: Synthetic oligonucleotide
gggccctacgggcgcctcct

SEQ ID NO: 48513 - DNA, 20 bp, Artificial Sequence
  Description of Artificial Sequence: Synthetic oligonucleotide
ggccctacgggcgcctcctc

SEQ ID NO: 48514 - DNA, 20 bp, Artificial Sequence
  Description of Artificial Sequence: Synthetic oligonucleotide
gccctacgggcgcctcctcc

SEQ ID NO: 48515 - DNA, 20 bp, Artificial Sequence
  Description of Artificial Sequence: Synthetic oligonucleotide
ccctacgggcgcctcctccg

SEQ ID NO: 48516 - DNA, 20 bp, Artificial Sequence
  Description of Artificial Sequence: Synthetic oligonucleotide
cctacgggcgcctcctccgc

SEQ ID NO: 48517 - DNA, 20 bp, Artificial Sequence
  Description of Artificial Sequence: Synthetic oligonucleotide
ctacgggcgcctcctccgcg

SEQ ID NO: 48518 - DNA, 20 bp, Artificial Sequence
  Description of Artificial Sequence: Synthetic oligonucleotide
tacgggcgcctcctccgcgg

SEQ ID NO: 48519 - DNA, 29 bp, Artificial Sequence
  Description of Artificial Sequence: Synthetic oligonucleotide
gcctgctcccactccatgaggtatttctc

SEQ ID NO: 48520 - DNA, 29 bp, Artificial Sequence
  Description of Artificial Sequence: Synthetic oligonucleotide
cctgctcccactccatgaggtatttctcc

SEQ ID NO: 48521 - DNA, 30 bp, Artificial Sequence
  Description of Artificial Sequence: Synthetic oligonucleotide
ctgctcccactccatgaggtatttctccac

SEQ ID NO: 48522 - DNA, 32 bp, Artificial Sequence
  Description of Artificial Sequence: Synthetic oligonucleotide
tgctcccactccatgaggtatttctccacatc

SEQ ID NO: 48523 - DNA, 29 bp, Artificial Sequence
  Description of Artificial Sequence: Synthetic oligonucleotide
attacatcgccctgaacgaggacctgctc

SEQ ID NO: 48524 - DNA, 28 bp, Artificial Sequence
  Description of Artificial Sequence: Synthetic oligonucleotide
ttacatcgccctgaacgaggacctgctc

SEQ ID NO: 48525 - DNA, 27 bp, Artificial Sequence
  Description of Artificial Sequence: Synthetic oligonucleotide
tacatcgccctgaacgaggacctgctc

SEQ ID NO: 48526 - DNA, 27 bp, Artificial Sequence
  Description of Artificial Sequence: Synthetic oligonucleotide
acatcgccctgaacgaggacctgctct

SEQ ID NO: 48527 - DNA, 26 bp, Artificial Sequence
  Description of Artificial Sequence: Synthetic oligonucleotide
catcgccctgaacgaggacctgctct

SEQ ID NO: 48528 - DNA, 26 bp, Artificial Sequence
  Description of Artificial Sequence: Synthetic oligonucleotide
atcgccctgaacgaggacctgctctc

SEQ ID NO: 48529 - DNA, 25 bp, Artificial Sequence
  Description of Artificial Sequence: Synthetic oligonucleotide
tcgccctgaacgaggacctgctctc

SEQ ID NO: 48530 - DNA, 24 bp, Artificial Sequence
  Description of Artificial Sequence: Synthetic oligonucleotide
cgccctgaacgaggacctgctctc

SEQ ID NO: 48531 - DNA, 25 bp, Artificial Sequence
  Description of Artificial Sequence: Synthetic oligonucleotide
gccctgaacgaggacctgctctcct

SEQ ID NO: 48532 - DNA, 25 bp, Artificial Sequence
  Description of Artificial Sequence: Synthetic oligonucleotide
ccctgaacgaggacctgctctcctg

SEQ ID NO: 48533 - DNA, 26 bp, Artificial Sequence
  Description of Artificial Sequence: Synthetic oligonucleotide
cctgaacgaggacctgctctcctgga

SEQ ID NO: 48534 - DNA, 26 bp, Artificial Sequence
  Description of Artificial Sequence: Synthetic oligonucleotide
ctgaacgaggacctgctctcctggac

SEQ ID NO: 48535 - DNA, 26 bp, Artificial Sequence
  Description of Artificial Sequence: Synthetic oligonucleotide
tgaacgaggacctgctctcctggacc

SEQ ID NO: 48536 - DNA, 25 bp, Artificial Sequence
  Description of Artificial Sequence: Synthetic oligonucleotide
gaacgaggacctgctctcctggacc

SEQ ID NO: 48537 - DNA, 25 bp, Artificial Sequence
  Description of Artificial Sequence: Synthetic oligonucleotide
aacgaggacctgctctcctggaccg

SEQ ID NO: 48538 - DNA, 24 bp, Artificial Sequence
  Description of Artificial Sequence: Synthetic oligonucleotide
acgaggacctgctctcctggaccg

SEQ ID NO: 48539 - DNA, 23 bp, Artificial Sequence
  Description of Artificial Sequence: Synthetic oligonucleotide
cgaggacctgctctcctggaccg

SEQ ID NO: 48540 - DNA, 23 bp, Artificial Sequence
  Description of Artificial Sequence: Synthetic oligonucleotide
gaggacctgctctcctggaccgc

SEQ ID NO: 48541 - DNA, 23 bp, Artificial Sequence
  Description of Artificial Sequence: Synthetic oligonucleotide
aggacctgctctcctggaccgcc

SEQ ID NO: 48542 - DNA, 22 bp, Artificial Sequence
  Description of Artificial Sequence: Synthetic oligonucleotide
ggacctgctctcctggaccgcc

SEQ ID NO: 48543 - DNA, 22 bp, Artificial Sequence
  Description of Artificial Sequence: Synthetic oligonucleotide
gacctgctctcctggaccgccg

SEQ ID NO: 48544 - DNA, 22 bp, Artificial Sequence
  Description of Artificial Sequence: Synthetic oligonucleotide
acctgctctcctggaccgccgc

SEQ ID NO: 48545 - DNA, 21 bp, Artificial Sequence
  Description of Artificial Sequence: Synthetic oligonucleotide
cctgctctcctggaccgccgc

SEQ ID NO: 48546 - DNA, 21 bp, Artificial Sequence
  Description of Artificial Sequence: Synthetic oligonucleotide
ctgctctcctggaccgccgcg

SEQ ID NO: 48547 - DNA, 22 bp, Artificial Sequence
  Description of Artificial Sequence: Synthetic oligonucleotide
tgctctcctggaccgccgcgga

SEQ ID NO: 48548 - DNA, 21 bp, Artificial Sequence
  Description of Artificial Sequence: Synthetic oligonucleotide
gctctcctggaccgccgcgga

SEQ ID NO: 48549 - DNA, 22 bp, Artificial Sequence
  Description of Artificial Sequence: Synthetic oligonucleotide
ctctcctggaccgccgcggaca

SEQ ID NO: 48550 - DNA, 22 bp, Artificial Sequence
  Description of Artificial Sequence: Synthetic oligonucleotide
tctcctggaccgccgcggacac

SEQ ID NO: 48551 - DNA, 23 bp, Artificial Sequence
  Description of Artificial Sequence: Synthetic oligonucleotide
gccaccctgaggtgctgggccat

SEQ ID NO: 48552 - DNA, 23 bp, Artificial Sequence
  Description of Artificial Sequence: Synthetic oligonucleotide
ccaccctgaggtgctgggccatg

SEQ ID NO: 48553 - DNA, 23 bp, Artificial Sequence
  Description of Artificial Sequence: Synthetic oligonucleotide
caccctgaggtgctgggccatgg

SEQ ID NO: 48554 - DNA, 23 bp, Artificial Sequence
  Description of Artificial Sequence: Synthetic oligonucleotide
accctgaggtgctgggccatggg

SEQ ID NO: 48555 - DNA, 22 bp, Artificial Sequence
  Description of Artificial Sequence: Synthetic oligonucleotide
ccctgaggtgctgggccatggg

SEQ ID NO: 48556 - DNA, 24 bp, Artificial Sequence
  Description of Artificial Sequence: Synthetic oligonucleotide
cctgaggtgctgggccatgggctt

SEQ ID NO: 48557 - DNA, 26 bp, Artificial Sequence
  Description of Artificial Sequence: Synthetic oligonucleotide
ctgaggtgctgggccatgggcttcta

SEQ ID NO: 48558 - DNA, 26 bp, Artificial Sequence
  Description of Artificial Sequence: Synthetic oligonucleotide
tgaggtgctgggccatgggcttctac

SEQ ID NO: 48559 - DNA, 25 bp, Artificial Sequence
  Description of Artificial Sequence: Synthetic oligonucleotide
gaggtgctgggccatgggcttctac

SEQ ID NO: 48560 - DNA, 25 bp, Artificial Sequence
  Description of Artificial Sequence: Synthetic oligonucleotide
aggtgctgggccatgggcttctacc

SEQ ID NO: 48561 - DNA, 24 bp, Artificial Sequence
  Description of Artificial Sequence: Synthetic oligonucleotide
ggtgctgggccatgggcttctacc

SEQ ID NO: 48562 - DNA, 25 bp, Artificial Sequence
  Description of Artificial Sequence: Synthetic oligonucleotide
gtgctgggccatgggcttctaccct

SEQ ID NO: 48563 - DNA, 25 bp, Artificial Sequence
  Description of Artificial Sequence: Synthetic oligonucleotide
tgctgggccatgggcttctaccctg

SEQ ID NO: 48564 - DNA, 24 bp, Artificial Sequence
  Description of Artificial Sequence: Synthetic oligonucleotide
gctgggccatgggcttctaccctg

SEQ ID NO: 48565 - DNA, 24 bp, Artificial Sequence
  Description of Artificial Sequence: Synthetic oligonucleotide
ctgggccatgggcttctaccctgc

SEQ ID NO: 48566 - DNA, 24 bp, Artificial Sequence
  Description of Artificial Sequence: Synthetic oligonucleotide
tgggccatgggcttctaccctgcg

SEQ ID NO: 48567 - DNA, 23 bp, Artificial Sequence
  Description of Artificial Sequence: Synthetic oligonucleotide
gggccatgggcttctaccctgcg

SEQ ID NO: 48568 - DNA, 24 bp, Artificial Sequence
  Description of Artificial Sequence: Synthetic oligonucleotide
ggccatgggcttctaccctgcgga

SEQ ID NO: 48569 - DNA, 26 bp, Artificial Sequence
  Description of Artificial Sequence: Synthetic oligonucleotide
gccatgggcttctaccctgcggagat

SEQ ID NO: 48570 - DNA, 27 bp, Artificial Sequence
  Description of Artificial Sequence: Synthetic oligonucleotide
ccatgggcttctaccctgcggagatca

SEQ ID NO: 48571 - DNA, 27 bp, Artificial Sequence
  Description of Artificial Sequence: Synthetic oligonucleotide
catgggcttctaccctgcggagatcac

SEQ ID NO: 48572 - DNA, 28 bp, Artificial Sequence
  Description of Artificial Sequence: Synthetic oligonucleotide
atgggcttctaccctgcggagatcacac

SEQ ID NO: 48573 - DNA, 25 bp, Artificial Sequence
  Description of Artificial Sequence: Synthetic oligonucleotide
cggagcagctgagagcctacctggt

SEQ ID NO: 48574 - DNA, 25 bp, Artificial Sequence
  Description of Artificial Sequence: Synthetic oligonucleotide
ggagcagctgagagcctacctggtg

SEQ ID NO: 48575 - DNA, 25 bp, Artificial Sequence
  Description of Artificial Sequence: Synthetic oligonucleotide
gagcagctgagagcctacctggtgg

SEQ ID NO: 48576 - DNA, 25 bp, Artificial Sequence
  Description of Artificial Sequence: Synthetic oligonucleotide
agcagctgagagcctacctggtggg

SEQ ID NO: 48577 - DNA, 24 bp, Artificial Sequence
  Description of Artificial Sequence: Synthetic oligonucleotide
gcagctgagagcctacctggtggg

SEQ ID NO: 48578 - DNA, 25 bp, Artificial Sequence
  Description of Artificial Sequence: Synthetic oligonucleotide
cagctgagagcctacctggtgggca

SEQ ID NO: 48579 - DNA, 25 bp, Artificial Sequence
  Description of Artificial Sequence: Synthetic oligonucleotide
agctgagagcctacctggtgggcac

SEQ ID NO: 48580 - DNA, 24 bp, Artificial Sequence
  Description of Artificial Sequence: Synthetic oligonucleotide
gctgagagcctacctggtgggcac

SEQ ID NO: 48581 - DNA, 25 bp, Artificial Sequence
  Description of Artificial Sequence: Synthetic oligonucleotide
ctgagagcctacctggtgggcacgt

SEQ ID NO: 48582 - DNA, 25 bp, Artificial Sequence
  Description of Artificial Sequence: Synthetic oligonucleotide
tgagagcctacctggtgggcacgtg

SEQ ID NO: 48583 - DNA, 24 bp, Artificial Sequence
  Description of Artificial Sequence: Synthetic oligonucleotide
gagagcctacctggtgggcacgtg

SEQ ID NO: 48584 - DNA, 24 bp, Artificial Sequence
  Description of Artificial Sequence: Synthetic oligonucleotide
agagcctacctggtgggcacgtgc

SEQ ID NO: 48585 - DNA, 23 bp, Artificial Sequence
  Description of Artificial Sequence: Synthetic oligonucleotide
gagcctacctggtgggcacgtgc

SEQ ID NO: 48586 - DNA, 24 bp, Artificial Sequence
  Description of Artificial Sequence: Synthetic oligonucleotide
agcctacctggtgggcacgtgcgt

SEQ ID NO: 48587 - DNA, 23 bp, Artificial Sequence
  Description of Artificial Sequence: Synthetic oligonucleotide
gcctacctggtgggcacgtgcgt

SEQ ID NO: 48588 - DNA, 23 bp, Artificial Sequence
  Description of Artificial Sequence: Synthetic oligonucleotide
cctacctggtgggcacgtgcgtg

SEQ ID NO: 48589 - DNA, 24 bp, Artificial Sequence
  Description of Artificial Sequence: Synthetic oligonucleotide
ctacctggtgggcacgtgcgtgga

SEQ ID NO: 48590 - DNA, 25 bp, Artificial Sequence
  Description of Artificial Sequence: Synthetic oligonucleotide
tacctggtgggcacgtgcgtggagt

SEQ ID NO: 48591 - DNA, 24 bp, Artificial Sequence
  Description of Artificial Sequence: Synthetic oligonucleotide
acctggtgggcacgtgcgtggagt

SEQ ID NO: 48592 - DNA, 23 bp, Artificial Sequence
  Description of Artificial Sequence: Synthetic oligonucleotide
cctggtgggcacgtgcgtggagt

SEQ ID NO: 48593 - DNA, 23 bp, Artificial Sequence
  Description of Artificial Sequence: Synthetic oligonucleotide
ctggtgggcacgtgcgtggagtg

SEQ ID NO: 48594 - DNA, 23 bp, Artificial Sequence
  Description of Artificial Sequence: Synthetic oligonucleotide
tggtgggcacgtgcgtggagtgg

SEQ ID NO: 48595 - DNA, 22 bp, Artificial Sequence
  Description of Artificial Sequence: Synthetic oligonucleotide
ggtgggcacgtgcgtggagtgg

SEQ ID NO: 48596 - DNA, 23 bp, Artificial Sequence
  Description of Artificial Sequence: Synthetic oligonucleotide
gtgggcacgtgcgtggagtggct

SEQ ID NO: 48597 - DNA, 23 bp, Artificial Sequence
  Description of Artificial Sequence: Synthetic oligonucleotide
tgggcacgtgcgtggagtggctc

SEQ ID NO: 48598 - DNA, 24 bp, Artificial Sequence
  Description of Artificial Sequence: Synthetic oligonucleotide
acagcgacgccacgagtccgagag

SEQ ID NO: 48599 - DNA, 23 bp, Artificial Sequence
  Description of Artificial Sequence: Synthetic oligonucleotide
cagcgacgccacgagtccgagag

SEQ ID NO: 48600 - DNA, 23 bp, Artificial Sequence
  Description of Artificial Sequence: Synthetic oligonucleotide
agcgacgccacgagtccgagagg

SEQ ID NO: 48601 - DNA, 22 bp, Artificial Sequence
  Description of Artificial Sequence: Synthetic oligonucleotide
gcgacgccacgagtccgagagg

SEQ ID NO: 48602 - DNA, 22 bp, Artificial Sequence
  Description of Artificial Sequence: Synthetic oligonucleotide
cgacgccacgagtccgagaggg

SEQ ID NO: 48603 - DNA, 23 bp, Artificial Sequence
  Description of Artificial Sequence: Synthetic oligonucleotide
gacgccacgagtccgagagggga

SEQ ID NO: 48604 - DNA, 23 bp, Artificial Sequence
  Description of Artificial Sequence: Synthetic oligonucleotide
acgccacgagtccgagaggggag

SEQ ID NO: 48605 - DNA, 22 bp, Artificial Sequence
  Description of Artificial Sequence: Synthetic oligonucleotide
cgccacgagtccgagaggggag

SEQ ID NO: 48606 - DNA, 22 bp, Artificial Sequence
  Description of Artificial Sequence: Synthetic oligonucleotide
gccacgagtccgagaggggagc

SEQ ID NO: 48607 - DNA, 22 bp, Artificial Sequence
  Description of Artificial Sequence: Synthetic oligonucleotide
ccacgagtccgagaggggagcc

SEQ ID NO: 48608 - DNA, 22 bp, Artificial Sequence
  Description of Artificial Sequence: Synthetic oligonucleotide
cacgagtccgagaggggagccg

SEQ ID NO: 48609 - DNA, 22 bp, Artificial Sequence
  Description of Artificial Sequence: Synthetic oligonucleotide
acgagtccgagaggggagccgc

SEQ ID NO: 48610 - DNA, 21 bp, Artificial Sequence
  Description of Artificial Sequence: Synthetic oligonucleotide
ggcgccgtgggtggagcagca

SEQ ID NO: 48611 - DNA, 21 bp, Artificial Sequence
  Description of Artificial Sequence: Synthetic oligonucleotide
gcgccgtgggtggagcagcag

SEQ ID NO: 48612 - DNA, 21 bp, Artificial Sequence
  Description of Artificial Sequence: Synthetic oligonucleotide
cgccgtgggtggagcagcagg

SEQ ID NO: 48613 - DNA, 21 bp, Artificial Sequence
  Description of Artificial Sequence: Synthetic oligonucleotide
gccgtgggtggagcagcaggg

SEQ ID NO: 48614 - DNA, 21 bp, Artificial Sequence
  Description of Artificial Sequence: Synthetic oligonucleotide
ccgtgggtggagcagcagggg

SEQ ID NO: 48615 - DNA, 21 bp, Artificial Sequence
  Description of Artificial Sequence: Synthetic oligonucleotide
cgtgggtggagcagcaggggc

SEQ ID NO: 48616 - DNA, 21 bp, Artificial Sequence
  Description of Artificial Sequence: Synthetic oligonucleotide
gtgggtggagcagcaggggcc

SEQ ID NO: 48617 - DNA, 21 bp, Artificial Sequence
  Description of Artificial Sequence: Synthetic oligonucleotide
tgggtggagcagcaggggccg

SEQ ID NO: 48618 - DNA, 20 bp, Artificial Sequence
  Description of Artificial Sequence: Synthetic oligonucleotide
gggtggagcagcaggggccg

SEQ ID NO: 48619 - DNA, 21 bp, Artificial Sequence
  Description of Artificial Sequence: Synthetic oligonucleotide
ggtggagcagcaggggccgga

SEQ ID NO: 48620 - DNA, 25 bp, Artificial Sequence
  Description of Artificial Sequence: Synthetic oligonucleotide
gtggagcagcaggggccggagtatt

SEQ ID NO: 48621 - DNA, 25 bp, Artificial Sequence
  Description of Artificial Sequence: Synthetic oligonucleotide
tggagcagcaggggccggagtattg

SEQ ID NO: 48622 - DNA, 24 bp, Artificial Sequence
  Description of Artificial Sequence: Synthetic oligonucleotide
ggagcagcaggggccggagtattg

SEQ ID NO: 48623 - DNA, 24 bp, Artificial Sequence
  Description of Artificial Sequence: Synthetic oligonucleotide
agcaggggccggagtattgggacc

SEQ ID NO: 48624 - DNA, 23 bp, Artificial Sequence
  Description of Artificial Sequence: Synthetic oligonucleotide
gcaggggccggagtattgggacc

SEQ ID NO: 48625 - DNA, 23 bp, Artificial Sequence
  Description of Artificial Sequence: Synthetic oligonucleotide
caggggccggagtattgggaccg

SEQ ID NO: 48626 - DNA, 24 bp, Artificial Sequence
  Description of Artificial Sequence: Synthetic oligonucleotide
cggttcgacagcgacgccgcgaat

SEQ ID NO: 48627 - DNA, 24 bp, Artificial Sequence
  Description of Artificial Sequence: Synthetic oligonucleotide
ggttcgacagcgacgccgcgaatc

SEQ ID NO: 48628 - DNA, 24 bp, Artificial Sequence
  Description of Artificial Sequence: Synthetic oligonucleotide
gttcgacagcgacgccgcgaatcc

SEQ ID NO: 48629 - DNA, 25 bp, Artificial Sequence
  Description of Artificial Sequence: Synthetic oligonucleotide
ttcgacagcgacgccgcgaatccga

SEQ ID NO: 48630 - DNA, 24 bp, Artificial Sequence
  Description of Artificial Sequence: Synthetic oligonucleotide
tcgacagcgacgccgcgaatccga

SEQ ID NO: 48631 - DNA, 23 bp, Artificial Sequence
  Description of Artificial Sequence: Synthetic oligonucleotide
cgacagcgacgccgcgaatccga

SEQ ID NO: 48632 - DNA, 24 bp, Artificial Sequence
  Description of Artificial Sequence: Synthetic oligonucleotide
gacagcgacgccgcgaatccgaga

SEQ ID NO: 48633 - DNA, 24 bp, Artificial Sequence
  Description of Artificial Sequence: Synthetic oligonucleotide
acagcgacgccgcgaatccgagag

SEQ ID NO: 48634 - DNA, 23 bp, Artificial Sequence
  Description of Artificial Sequence: Synthetic oligonucleotide
cagcgacgccgcgaatccgagag

SEQ ID NO: 48635 - DNA, 23 bp, Artificial Sequence
  Description of Artificial Sequence: Synthetic oligonucleotide
agcgacgccgcgaatccgagagg

SEQ ID NO: 48636 - DNA, 22 bp, Artificial Sequence
  Description of Artificial Sequence: Synthetic oligonucleotide
gcgacgccgcgaatccgagagg

SEQ ID NO: 48637 - DNA, 22 bp, Artificial Sequence
  Description of Artificial Sequence: Synthetic oligonucleotide
cgacgccgcgaatccgagaggg

SEQ ID NO: 48638 - DNA, 23 bp, Artificial Sequence
  Description of Artificial Sequence: Synthetic oligonucleotide
gacgccgcgaatccgagagggga

SEQ ID NO: 48639 - DNA, 23 bp, Artificial Sequence
  Description of Artificial Sequence: Synthetic oligonucleotide
acgccgcgaatccgagaggggag

SEQ ID NO: 48640 - DNA, 22 bp, Artificial Sequence
  Description of Artificial Sequence: Synthetic oligonucleotide
cgccgcgaatccgagaggggag

SEQ ID NO: 48641 - DNA, 22 bp, Artificial Sequence
  Description of Artificial Sequence: Synthetic oligonucleotide
gccgcgaatccgagaggggagc

SEQ ID NO: 48642 - DNA, 22 bp, Artificial Sequence
  Description of Artificial Sequence: Synthetic oligonucleotide
ccgcgaatccgagaggggagcc

SEQ ID NO: 48643 - DNA, 22 bp, Artificial Sequence
  Description of Artificial Sequence: Synthetic oligonucleotide
cgcgaatccgagaggggagccg

SEQ ID NO: 48644 - DNA, 22 bp, Artificial Sequence
  Description of Artificial Sequence: Synthetic oligonucleotide
gcgaatccgagaggggagccgc

SEQ ID NO: 48645 - DNA, 22 bp, Artificial Sequence
  Description of Artificial Sequence: Synthetic oligonucleotide
cgaatccgagaggggagccgcg

SEQ ID NO: 48646 - DNA, 22 bp, Artificial Sequence
  Description of Artificial Sequence: Synthetic oligonucleotide
gaatccgagaggggagccgcgg

SEQ ID NO: 48647 - DNA, 22 bp, Artificial Sequence
  Description of Artificial Sequence: Synthetic oligonucleotide
aatccgagaggggagccgcggg

SEQ ID NO: 48648 - DNA, 21 bp, Artificial Sequence
  Description of Artificial Sequence: Synthetic oligonucleotide
atccgagaggggagccgcggg

SEQ ID NO: 48649 - DNA, 26 bp, Artificial Sequence
  Description of Artificial Sequence: Synthetic oligonucleotide
gaccaggccagcaggagatggaacct

SEQ ID NO: 48650 - DNA, 26 bp, Artificial Sequence
  Description of Artificial Sequence: Synthetic oligonucleotide
accaggccagcaggagatggaacctc

SEQ ID NO: 48651 - DNA, 25 bp, Artificial Sequence
  Description of Artificial Sequence: Synthetic oligonucleotide
ccaggccagcaggagatggaacctc

SEQ ID NO: 48652 - DNA, 25 bp, Artificial Sequence
  Description of Artificial Sequence: Synthetic oligonucleotide
caggccagcaggagatggaacctcc

SEQ ID NO: 48653 - DNA, 26 bp, Artificial Sequence
  Description of Artificial Sequence: Synthetic oligonucleotide
aggccagcaggagatggaacctccca

SEQ ID NO: 48654 - DNA, 25 bp, Artificial Sequence
  Description of Artificial Sequence: Synthetic oligonucleotide
ggccagcaggagatggaacctccca

SEQ ID NO: 48655 - DNA, 27 bp, Artificial Sequence
  Description of Artificial Sequence: Synthetic oligonucleotide
gccagcaggagatggaacctcccagaa

SEQ ID NO: 48656 - DNA, 27 bp, Artificial Sequence
  Description of Artificial Sequence: Synthetic oligonucleotide
ccagcaggagatggaacctcccagaag

SEQ ID NO: 48657 - DNA, 28 bp, Artificial Sequence
  Description of Artificial Sequence: Synthetic oligonucleotide
cagcaggagatggaacctcccagaagtg

SEQ ID NO: 48658 - DNA, 28 bp, Artificial Sequence
  Description of Artificial Sequence: Synthetic oligonucleotide
agcaggagatggaacctcccagaagtgg

SEQ ID NO: 48659 - DNA, 27 bp, Artificial Sequence
  Description of Artificial Sequence: Synthetic oligonucleotide
gcaggagatggaacctcccagaagtgg

SEQ ID NO: 48660 - DNA, 27 bp, Artificial Sequence
  Description of Artificial Sequence: Synthetic oligonucleotide
caggagatggaacctcccagaagtggg

SEQ ID NO: 48661 - DNA, 27 bp, Artificial Sequence
  Description of Artificial Sequence: Synthetic oligonucleotide
aggagatggaacctcccagaagtgggc

SEQ ID NO: 48662 - DNA, 27 bp, Artificial Sequence
  Description of Artificial Sequence: Synthetic oligonucleotide
ggagatggaacctcccagaagtgggca

SEQ ID NO: 48663 - DNA, 27 bp, Artificial Sequence
  Description of Artificial Sequence: Synthetic oligonucleotide
gagatggaacctcccagaagtgggcag

SEQ ID NO: 48664 - DNA, 27 bp, Artificial Sequence
  Description of Artificial Sequence: Synthetic oligonucleotide
agatggaacctcccagaagtgggcagc

SEQ ID NO: 48665 - DNA, 27 bp, Artificial Sequence
  Description of Artificial Sequence: Synthetic oligonucleotide
gatggaacctcccagaagtgggcagct

SEQ ID NO: 48666 - DNA, 27 bp, Artificial Sequence
  Description of Artificial Sequence: Synthetic oligonucleotide
atggaacctcccagaagtgggcagctg

SEQ ID NO: 48667 - DNA, 27 bp, Artificial Sequence
  Description of Artificial Sequence: Synthetic oligonucleotide
tggaacctcccagaagtgggcagctgt

SEQ ID NO: 48668 - DNA, 26 bp, Artificial Sequence
  Description of Artificial Sequence: Synthetic oligonucleotide
ggaacctcccagaagtgggcagctgt

SEQ ID NO: 48669 - DNA, 26 bp, Artificial Sequence
  Description of Artificial Sequence: Synthetic oligonucleotide
gaacctcccagaagtgggcagctgtg

SEQ ID NO: 48670 - DNA, 27 bp, Artificial Sequence
  Description of Artificial Sequence: Synthetic oligonucleotide
aacctcccagaagtgggcagctgtggt

SEQ ID NO: 48671 - DNA, 26 bp, Artificial Sequence
  Description of Artificial Sequence: Synthetic oligonucleotide
acctcccagaagtgggcagctgtggt

SEQ ID NO: 48672 - DNA, 25 bp, Artificial Sequence
  Description of Artificial Sequence: Synthetic oligonucleotide
cctcccagaagtgggcagctgtggt

SEQ ID NO: 48673 - DNA, 25 bp, Artificial Sequence
  Description of Artificial Sequence: Synthetic oligonucleotide
ctcccagaagtgggcagctgtggtg

SEQ ID NO: 48674 - DNA, 26 bp, Artificial Sequence
  Description of Artificial Sequence: Synthetic oligonucleotide
tcccagaagtgggcagctgtggtggt

SEQ ID NO: 48675 - DNA, 25 bp, Artificial Sequence
  Description of Artificial Sequence: Synthetic oligonucleotide
cccagaagtgggcagctgtggtggt

SEQ ID NO: 48676 - DNA, 25 bp, Artificial Sequence
  Description of Artificial Sequence: Synthetic oligonucleotide
gccactacaaccagagcgaggacgg

SEQ ID NO: 48677 - DNA, 26 bp, Artificial Sequence
  Description of Artificial Sequence: Synthetic oligonucleotide
ccactacaaccagagcgaggacgggt

SEQ ID NO: 48678 - DNA, 27 bp, Artificial Sequence
  Description of Artificial Sequence: Synthetic oligonucleotide
cactacaaccagagcgaggacgggtct

SEQ ID NO: 48679 - DNA, 29 bp, Artificial Sequence
  Description of Artificial Sequence: Synthetic oligonucleotide
gattacatcgccctgaacgaggacctgtg

SEQ ID NO: 48680 - DNA, 29 bp, Artificial Sequence
  Description of Artificial Sequence: Synthetic oligonucleotide
attacatcgccctgaacgaggacctgtgc

SEQ ID NO: 48681 - DNA, 28 bp, Artificial Sequence
  Description of Artificial Sequence: Synthetic oligonucleotide
ttacatcgccctgaacgaggacctgtgc

SEQ ID NO: 48682 - DNA, 27 bp, Artificial Sequence
  Description of Artificial Sequence: Synthetic oligonucleotide
tacatcgccctgaacgaggacctgtgc

SEQ ID NO: 48683 - DNA, 27 bp, Artificial Sequence
  Description of Artificial Sequence: Synthetic oligonucleotide
acatcgccctgaacgaggacctgtgct

SEQ ID NO: 48684 - DNA, 26 bp, Artificial Sequence
  Description of Artificial Sequence: Synthetic oligonucleotide
catcgccctgaacgaggacctgtgct

SEQ ID NO: 48685 - DNA, 26 bp, Artificial Sequence
  Description of Artificial Sequence: Synthetic oligonucleotide
atcgccctgaacgaggacctgtgctc

SEQ ID NO: 48686 - DNA, 25 bp, Artificial Sequence
  Description of Artificial Sequence: Synthetic oligonucleotide
tcgccctgaacgaggacctgtgctc

SEQ ID NO: 48687 - DNA, 24 bp, Artificial Sequence
  Description of Artificial Sequence: Synthetic oligonucleotide
cgccctgaacgaggacctgtgctc

SEQ ID NO: 48688 - DNA, 25 bp, Artificial Sequence
  Description of Artificial Sequence: Synthetic oligonucleotide
gccctgaacgaggacctgtgctcct

SEQ ID NO: 48689 - DNA, 25 bp, Artificial Sequence
  Description of Artificial Sequence: Synthetic oligonucleotide
ccctgaacgaggacctgtgctcctg

SEQ ID NO: 48690 - DNA, 26 bp, Artificial Sequence
  Description of Artificial Sequence: Synthetic oligonucleotide
cctgaacgaggacctgtgctcctgga

SEQ ID NO: 48691 - DNA, 26 bp, Artificial Sequence
  Description of Artificial Sequence: Synthetic oligonucleotide
ctgaacgaggacctgtgctcctggac

SEQ ID NO: 48692 - DNA, 26 bp, Artificial Sequence
  Description of Artificial Sequence: Synthetic oligonucleotide
tgaacgaggacctgtgctcctggacc

SEQ ID NO: 48693 - DNA, 25 bp, Artificial Sequence
  Description of Artificial Sequence: Synthetic oligonucleotide
gaacgaggacctgtgctcctggacc

SEQ ID NO: 48694 - DNA, 25 bp, Artificial Sequence
  Description of Artificial Sequence: Synthetic oligonucleotide
aacgaggacctgtgctcctggaccg

SEQ ID NO: 48695 - DNA, 24 bp, Artificial Sequence
  Description of Artificial Sequence: Synthetic oligonucleotide
acgaggacctgtgctcctggaccg

SEQ ID NO: 48696 - DNA, 23 bp, Artificial Sequence
  Description of Artificial Sequence: Synthetic oligonucleotide
cgaggacctgtgctcctggaccg

SEQ ID NO: 48697 - DNA, 23 bp, Artificial Sequence
  Description of Artificial Sequence: Synthetic oligonucleotide
gaggacctgtgctcctggaccgc

SEQ ID NO: 48698 - DNA, 23 bp, Artificial Sequence
  Description of Artificial Sequence: Synthetic oligonucleotide
aggacctgtgctcctggaccgcc

SEQ ID NO: 48699 - DNA, 22 bp, Artificial Sequence
  Description of Artificial Sequence: Synthetic oligonucleotide
ggacctgtgctcctggaccgcc

SEQ ID NO: 48700 - DNA, 22 bp, Artificial Sequence
  Description of Artificial Sequence: Synthetic oligonucleotide
gacctgtgctcctggaccgccg

SEQ ID NO: 48701 - DNA, 22 bp, Artificial Sequence
  Description of Artificial Sequence: Synthetic oligonucleotide
acctgtgctcctggaccgccgc

SEQ ID NO: 48702 - DNA, 21 bp, Artificial Sequence
  Description of Artificial Sequence: Synthetic oligonucleotide
cctgtgctcctggaccgccgc

SEQ ID NO: 48703 - DNA, 21 bp, Artificial Sequence
  Description of Artificial Sequence: Synthetic oligonucleotide
ctgtgctcctggaccgccgcg

SEQ ID NO: 48704 - DNA, 22 bp, Artificial Sequence
  Description of Artificial Sequence: Synthetic oligonucleotide
tgtgctcctggaccgccgcgga

SEQ ID NO: 48705 - DNA, 21 bp, Artificial Sequence
  Description of Artificial Sequence: Synthetic oligonucleotide
gtgctcctggaccgccgcgga

SEQ ID NO: 48706 - DNA, 22 bp, Artificial Sequence
  Description of Artificial Sequence: Synthetic oligonucleotide
tgctcctggaccgccgcggaca

SEQ ID NO: 48707 - DNA, 25 bp, Artificial Sequence
  Description of Artificial Sequence: Synthetic oligonucleotide
accgagtgagcctgcggaacctgct

SEQ ID NO: 48708 - DNA, 24 bp, Artificial Sequence
  Description of Artificial Sequence: Synthetic oligonucleotide
ccgagtgagcctgcggaacctgct

SEQ ID NO: 48709 - DNA, 24 bp, Artificial Sequence
  Description of Artificial Sequence: Synthetic oligonucleotide
cgagtgagcctgcggaacctgctc

SEQ ID NO: 48710 - DNA, 24 bp, Artificial Sequence
  Description of Artificial Sequence: Synthetic oligonucleotide
gagtgagcctgcggaacctgctcg

SEQ ID NO: 48711 - DNA, 24 bp, Artificial Sequence
  Description of Artificial Sequence: Synthetic oligonucleotide
agtgagcctgcggaacctgctcgg

SEQ ID NO: 48712 - DNA, 23 bp, Artificial Sequence
  Description of Artificial Sequence: Synthetic oligonucleotide
gtgagcctgcggaacctgctcgg

SEQ ID NO: 48713 - DNA, 25 bp, Artificial Sequence
  Description of Artificial Sequence: Synthetic oligonucleotide
tgagcctgcggaacctgctcggcta

SEQ ID NO: 48714 - DNA, 24 bp, Artificial Sequence
  Description of Artificial Sequence: Synthetic oligonucleotide
gagcctgcggaacctgctcggcta

SEQ ID NO: 48715 - DNA, 26 bp, Artificial Sequence
  Description of Artificial Sequence: Synthetic oligonucleotide
agcctgcggaacctgctcggctacta

SEQ ID NO: 48716 - DNA, 25 bp, Artificial Sequence
  Description of Artificial Sequence: Synthetic oligonucleotide
gcctgcggaacctgctcggctacta

SEQ ID NO: 48717 - DNA, 27 bp, Artificial Sequence
  Description of Artificial Sequence: Synthetic oligonucleotide
cctgcggaacctgctcggctactacaa

SEQ ID NO: 48718 - DNA, 27 bp, Artificial Sequence
  Description of Artificial Sequence: Synthetic oligonucleotide
ctgcggaacctgctcggctactacaac

SEQ ID NO: 48719 - DNA, 27 bp, Artificial Sequence
  Description of Artificial Sequence: Synthetic oligonucleotide
tgcggaacctgctcggctactacaacc

SEQ ID NO: 48720 - DNA, 27 bp, Artificial Sequence
  Description of Artificial Sequence: Synthetic oligonucleotide
gcggaacctgctcggctactacaacca

SEQ ID NO: 48721 - DNA, 27 bp, Artificial Sequence
  Description of Artificial Sequence: Synthetic oligonucleotide
cggaacctgctcggctactacaaccag

SEQ ID NO: 48722 - DNA, 28 bp, Artificial Sequence
  Description of Artificial Sequence: Synthetic oligonucleotide
ggaacctgctcggctactacaaccagag

SEQ ID NO: 48723 - DNA, 28 bp, Artificial Sequence
  Description of Artificial Sequence: Synthetic oligonucleotide
gaacctgctcggctactacaaccagagc

SEQ ID NO: 48724 - DNA, 28 bp, Artificial Sequence
  Description of Artificial Sequence: Synthetic oligonucleotide
aacctgctcggctactacaaccagagcg

SEQ ID NO: 48725 - DNA, 27 bp, Artificial Sequence
  Description of Artificial Sequence: Synthetic oligonucleotide
acctgctcggctactacaaccagagcg

SEQ ID NO: 48726 - DNA, 27 bp, Artificial Sequence
  Description of Artificial Sequence: Synthetic oligonucleotide
cctgctcggctactacaaccagagcga

SEQ ID NO: 48727 - DNA, 27 bp, Artificial Sequence
  Description of Artificial Sequence: Synthetic oligonucleotide
ctgctcggctactacaaccagagcgag

SEQ ID NO: 48728 - DNA, 27 bp, Artificial Sequence
  Description of Artificial Sequence: Synthetic oligonucleotide
tgctcggctactacaaccagagcgagg

SEQ ID NO: 48729 - DNA, 27 bp, Artificial Sequence
  Description of Artificial Sequence: Synthetic oligonucleotide
gctcggctactacaaccagagcgagga

SEQ ID NO: 48730 - DNA, 27 bp, Artificial Sequence
  Description of Artificial Sequence: Synthetic oligonucleotide
ctcggctactacaaccagagcgaggac

SEQ ID NO: 48731 - DNA, 27 bp, Artificial Sequence
  Description of Artificial Sequence: Synthetic oligonucleotide
tcggctactacaaccagagcgaggacg

SEQ ID NO: 48732 - DNA, 20 bp, Artificial Sequence
  Description of Artificial Sequence: Synthetic oligonucleotide
gggcgccgtgggtggagcgt

SEQ ID NO: 48733 - DNA, 20 bp, Artificial Sequence
  Description of Artificial Sequence: Synthetic oligonucleotide
ggcgccgtgggtggagcggt

SEQ ID NO: 48734 - DNA, 20 bp, Artificial Sequence
  Description of Artificial Sequence: Synthetic oligonucleotide
gcgccgtgggtggagcggga

SEQ ID NO: 48735 - DNA, 20 bp, Artificial Sequence
  Description of Artificial Sequence: Synthetic oligonucleotide
cgccgtgggtggagcgggag

SEQ ID NO: 48736 - DNA, 20 bp, Artificial Sequence
  Description of Artificial Sequence: Synthetic oligonucleotide
gccgtgggtggagcgggagg

SEQ ID NO: 48737 - DNA, 20 bp, Artificial Sequence
  Description of Artificial Sequence: Synthetic oligonucleotide
ccgtgggtggagcgggaggg

SEQ ID NO: 48738 - DNA, 20 bp, Artificial Sequence
  Description of Artificial Sequence: Synthetic oligonucleotide
cgtgggtggagcgggagggg

SEQ ID NO: 48739 - DNA, 20 bp, Artificial Sequence
  Description of Artificial Sequence: Synthetic oligonucleotide
gtgggtggagcgggaggggc

SEQ ID NO: 48740 - DNA, 20 bp, Artificial Sequence
  Description of Artificial Sequence: Synthetic oligonucleotide
tgggtggagcgggaggggcc

SEQ ID NO: 48741 - DNA, 20 bp, Artificial Sequence
  Description of Artificial Sequence: Synthetic oligonucleotide
gggtggagcgggaggggcct

SEQ ID NO: 48742 - DNA, 20 bp, Artificial Sequence
  Description of Artificial Sequence: Synthetic oligonucleotide
ggtggagcgggaggggccgt

SEQ ID NO: 48743 - DNA, 20 bp, Artificial Sequence
  Description of Artificial Sequence: Synthetic oligonucleotide
gtggagcgggaggggccgga

SEQ ID NO: 48744 - DNA, 29 bp, Artificial Sequence
  Description of Artificial Sequence: Synthetic oligonucleotide
tccgcctacgacggcaaggattacatctc

SEQ ID NO: 48745 - DNA, 28 bp, Artificial Sequence
  Description of Artificial Sequence: Synthetic oligonucleotide
ccgcctacgacggcaaggattacatctc

SEQ ID NO: 48746 - DNA, 31 bp, Artificial Sequence
  Description of Artificial Sequence: Synthetic oligonucleotide
ctacgacggcaaggattacatctccctgaac

SEQ ID NO: 48747 - DNA, 32 bp, Artificial Sequence
  Description of Artificial Sequence: Synthetic oligonucleotide
aaggattacatctccctgaacgaggacctgag

SEQ ID NO: 48748 - DNA, 31 bp, Artificial Sequence
  Description of Artificial Sequence: Synthetic oligonucleotide
aggattacatctccctgaacgaggacctgag

SEQ ID NO: 48749 - DNA, 30 bp, Artificial Sequence
  Description of Artificial Sequence: Synthetic oligonucleotide
ggattacatctccctgaacgaggacctgag

SEQ ID NO: 48750 - DNA, 26 bp, Artificial Sequence
  Description of Artificial Sequence: Synthetic oligonucleotide
gggtatgaccagtccgcctacgacgt

SEQ ID NO: 48751 - DNA, 27 bp, Artificial Sequence
  Description of Artificial Sequence: Synthetic oligonucleotide
ggtatgaccagtccgcctacgacgtca

SEQ ID NO: 48752 - DNA, 28 bp, Artificial Sequence
  Description of Artificial Sequence: Synthetic oligonucleotide
gtatgaccagtccgcctacgacgtcaag

SEQ ID NO: 48753 - DNA, 28 bp, Artificial Sequence
  Description of Artificial Sequence: Synthetic oligonucleotide
tatgaccagtccgcctacgacgtcaagg

SEQ ID NO: 48754 - DNA, 27 bp, Artificial Sequence
  Description of Artificial Sequence: Synthetic oligonucleotide
atgaccagtccgcctacgacgtcaagg

SEQ ID NO: 48755 - DNA, 27 bp, Artificial Sequence
  Description of Artificial Sequence: Synthetic oligonucleotide
tgaccagtccgcctacgacgtcaagga

SEQ ID NO: 48756 - DNA, 27 bp, Artificial Sequence
  Description of Artificial Sequence: Synthetic oligonucleotide
gaccagtccgcctacgacgtcaaggat

SEQ ID NO: 48757 - DNA, 29 bp, Artificial Sequence
  Description of Artificial Sequence: Synthetic oligonucleotide
accagtccgcctacgacgtcaaggattac

SEQ ID NO: 48758 - DNA, 28 bp, Artificial Sequence
  Description of Artificial Sequence: Synthetic oligonucleotide
ccagtccgcctacgacgtcaaggattac

SEQ ID NO: 48759 - DNA, 30 bp, Artificial Sequence
  Description of Artificial Sequence: Synthetic oligonucleotide
cagtccgcctacgacgtcaaggattacatc

SEQ ID NO: 48760 - DNA, 30 bp, Artificial Sequence
  Description of Artificial Sequence: Synthetic oligonucleotide
agtccgcctacgacgtcaaggattacatcg

SEQ ID NO: 48761 - DNA, 29 bp, Artificial Sequence
  Description of Artificial Sequence: Synthetic oligonucleotide
gtccgcctacgacgtcaaggattacatcg

SEQ ID NO: 48762 - DNA, 29 bp, Artificial Sequence
  Description of Artificial Sequence: Synthetic oligonucleotide
tccgcctacgacgtcaaggattacatcgc

SEQ ID NO: 48763 - DNA, 28 bp, Artificial Sequence
  Description of Artificial Sequence: Synthetic oligonucleotide
ccgcctacgacgtcaaggattacatcgc

SEQ ID NO: 48764 - DNA, 28 bp, Artificial Sequence
  Description of Artificial Sequence: Synthetic oligonucleotide
cgcctacgacgtcaaggattacatcgcc

SEQ ID NO: 48765 - DNA, 28 bp, Artificial Sequence
  Description of Artificial Sequence: Synthetic oligonucleotide
gcctacgacgtcaaggattacatcgccc

SEQ ID NO: 48766 - DNA, 29 bp, Artificial Sequence
  Description of Artificial Sequence: Synthetic oligonucleotide
cctacgacgtcaaggattacatcgccctg

SEQ ID NO: 48767 - DNA, 31 bp, Artificial Sequence
  Description of Artificial Sequence: Synthetic oligonucleotide
ctacgacgtcaaggattacatcgccctgaac

SEQ ID NO: 48768 - DNA, 31 bp, Artificial Sequence
  Description of Artificial Sequence: Synthetic oligonucleotide
tacgacgtcaaggattacatcgccctgaacg

SEQ ID NO: 48769 - DNA, 30 bp, Artificial Sequence
  Description of Artificial Sequence: Synthetic oligonucleotide
acgacgtcaaggattacatcgccctgaacg

SEQ ID NO: 48770 - DNA, 29 bp, Artificial Sequence
  Description of Artificial Sequence: Synthetic oligonucleotide
cgacgtcaaggattacatcgccctgaacg

SEQ ID NO: 48771 - DNA, 30 bp, Artificial Sequence
  Description of Artificial Sequence: Synthetic oligonucleotide
gacgtcaaggattacatcgccctgaacgag

SEQ ID NO: 48772 - DNA, 30 bp, Artificial Sequence
  Description of Artificial Sequence: Synthetic oligonucleotide
acgtcaaggattacatcgccctgaacgagg

SEQ ID NO: 48773 - DNA, 29 bp, Artificial Sequence
  Description of Artificial Sequence: Synthetic oligonucleotide
cgtcaaggattacatcgccctgaacgagg

SEQ ID NO: 48774 - DNA, 30 bp, Artificial Sequence
  Description of Artificial Sequence: Synthetic oligonucleotide
gtcaaggattacatcgccctgaacgaggac

SEQ ID NO: 48775 - DNA, 30 bp, Artificial Sequence
  Description of Artificial Sequence: Synthetic oligonucleotide
tcaaggattacatcgccctgaacgaggacc

SEQ ID NO: 48776 - DNA, 28 bp, Artificial Sequence
  Description of Artificial Sequence: Synthetic oligonucleotide
gcaaggattacatcgccctgaacgaggg

SEQ ID NO: 48777 - DNA, 28 bp, Artificial Sequence
  Description of Artificial Sequence: Synthetic oligonucleotide
caaggattacatcgccctgaacgagggc

SEQ ID NO: 48778 - DNA, 28 bp, Artificial Sequence
  Description of Artificial Sequence: Synthetic oligonucleotide
aaggattacatcgccctgaacgagggcc

SEQ ID NO: 48779 - DNA, 27 bp, Artificial Sequence
  Description of Artificial Sequence: Synthetic oligonucleotide
aggattacatcgccctgaacgagggcc

SEQ ID NO: 48780 - DNA, 27 bp, Artificial Sequence
  Description of Artificial Sequence: Synthetic oligonucleotide
ggattacatcgccctgaacgagggcct

SEQ ID NO: 48781 - DNA, 27 bp, Artificial Sequence
  Description of Artificial Sequence: Synthetic oligonucleotide
gattacatcgccctgaacgagggcctg

SEQ ID NO: 48782 - DNA, 27 bp, Artificial Sequence
  Description of Artificial Sequence: Synthetic oligonucleotide
attacatcgccctgaacgagggcctgc

SEQ ID NO: 48783 - DNA, 26 bp, Artificial Sequence
  Description of Artificial Sequence: Synthetic oligonucleotide
ttacatcgccctgaacgagggcctgc

SEQ ID NO: 48784 - DNA, 25 bp, Artificial Sequence
  Description of Artificial Sequence: Synthetic oligonucleotide
tacatcgccctgaacgagggcctgc

SEQ ID NO: 48785 - DNA, 24 bp, Artificial Sequence
  Description of Artificial Sequence: Synthetic oligonucleotide
acatcgccctgaacgagggcctgc

SEQ ID NO: 48786 - DNA, 23 bp, Artificial Sequence
  Description of Artificial Sequence: Synthetic oligonucleotide
catcgccctgaacgagggcctgc

SEQ ID NO: 48787 - DNA, 23 bp, Artificial Sequence
  Description of Artificial Sequence: Synthetic oligonucleotide
atcgccctgaacgagggcctgcg

SEQ ID NO: 48788 - DNA, 22 bp, Artificial Sequence
  Description of Artificial Sequence: Synthetic oligonucleotide
tcgccctgaacgagggcctgcg

SEQ ID NO: 48789 - DNA, 21 bp, Artificial Sequence
  Description of Artificial Sequence: Synthetic oligonucleotide
cgccctgaacgagggcctgcg

SEQ ID NO: 48790 - DNA, 22 bp, Artificial Sequence
  Description of Artificial Sequence: Synthetic oligonucleotide
gccctgaacgagggcctgcgct

SEQ ID NO: 48791 - DNA, 22 bp, Artificial Sequence
  Description of Artificial Sequence: Synthetic oligonucleotide
ccctgaacgagggcctgcgctc

SEQ ID NO: 48792 - DNA, 23 bp, Artificial Sequence
  Description of Artificial Sequence: Synthetic oligonucleotide
cctgaacgagggcctgcgctcct

SEQ ID NO: 48793 - DNA, 23 bp, Artificial Sequence
  Description of Artificial Sequence: Synthetic oligonucleotide
ctgaacgagggcctgcgctcctg

SEQ ID NO: 48794 - DNA, 24 bp, Artificial Sequence
  Description of Artificial Sequence: Synthetic oligonucleotide
tgaacgagggcctgcgctcctgga

SEQ ID NO: 48795 - DNA, 23 bp, Artificial Sequence
  Description of Artificial Sequence: Synthetic oligonucleotide
gaacgagggcctgcgctcctgga

SEQ ID NO: 48796 - DNA, 23 bp, Artificial Sequence
  Description of Artificial Sequence: Synthetic oligonucleotide
aacgagggcctgcgctcctggac

SEQ ID NO: 48797 - DNA, 22 bp, Artificial Sequence
  Description of Artificial Sequence: Synthetic oligonucleotide
acgagggcctgcgctcctggac

SEQ ID NO: 48798 - DNA, 21 bp, Artificial Sequence
  Description of Artificial Sequence: Synthetic oligonucleotide
cgagggcctgcgctcctggac

SEQ ID NO: 48799 - DNA, 21 bp, Artificial Sequence
  Description of Artificial Sequence: Synthetic oligonucleotide
gagggcctgcgctcctggacc

SEQ ID NO: 48800 - DNA, 21 bp, Artificial Sequence
  Description of Artificial Sequence: Synthetic oligonucleotide
agggcctgcgctcctggaccg

SEQ ID NO: 48801 - DNA, 20 bp, Artificial Sequence
  Description of Artificial Sequence: Synthetic oligonucleotide
gggcctgcgctcctggaccg

SEQ ID NO: 48802 - DNA, 20 bp, Artificial Sequence
  Description of Artificial Sequence: Synthetic oligonucleotide
ggcctgcgctcctggaccgc

SEQ ID NO: 48803 - DNA, 20 bp, Artificial Sequence
  Description of Artificial Sequence: Synthetic oligonucleotide
gcctgcgctcctggaccgcc

SEQ ID NO: 48804 - DNA, 26 bp, Artificial Sequence
  Description of Artificial Sequence: Synthetic oligonucleotide
tacgtggacgacacgcagttcgtgcc

SEQ ID NO: 48805 - DNA, 25 bp, Artificial Sequence
  Description of Artificial Sequence: Synthetic oligonucleotide
acgtggacgacacgcagttcgtgcc

SEQ ID NO: 48806 - DNA, 24 bp, Artificial Sequence
  Description of Artificial Sequence: Synthetic oligonucleotide
cgtggacgacacgcagttcgtgcc

SEQ ID NO: 48807 - DNA, 26 bp, Artificial Sequence
  Description of Artificial Sequence: Synthetic oligonucleotide
gtggacgacacgcagttcgtgccgtt

SEQ ID NO: 48808 - DNA, 26 bp, Artificial Sequence
  Description of Artificial Sequence: Synthetic oligonucleotide
tggacgacacgcagttcgtgccgttc

SEQ ID NO: 48809 - DNA, 25 bp, Artificial Sequence
  Description of Artificial Sequence: Synthetic oligonucleotide
ggacgacacgcagttcgtgccgttc

SEQ ID NO: 48810 - DNA, 26 bp, Artificial Sequence
  Description of Artificial Sequence: Synthetic oligonucleotide
gacgacacgcagttcgtgccgttcga

SEQ ID NO: 48811 - DNA, 27 bp, Artificial Sequence
  Description of Artificial Sequence: Synthetic oligonucleotide
acgacacgcagttcgtgccgttcgaca

SEQ ID NO: 48812 - DNA, 26 bp, Artificial Sequence
  Description of Artificial Sequence: Synthetic oligonucleotide
cgacacgcagttcgtgccgttcgaca

SEQ ID NO: 48813 - DNA, 26 bp, Artificial Sequence
  Description of Artificial Sequence: Synthetic oligonucleotide
gacacgcagttcgtgccgttcgacag

SEQ ID NO: 48814 - DNA, 26 bp, Artificial Sequence
  Description of Artificial Sequence: Synthetic oligonucleotide
acacgcagttcgtgccgttcgacagc

SEQ ID NO: 48815 - DNA, 25 bp, Artificial Sequence
  Description of Artificial Sequence: Synthetic oligonucleotide
cacgcagttcgtgccgttcgacagc

SEQ ID NO: 48816 - DNA, 26 bp, Artificial Sequence
  Description of Artificial Sequence: Synthetic oligonucleotide
acgcagttcgtgccgttcgacagcga

SEQ ID NO: 48817 - DNA, 25 bp, Artificial Sequence
  Description of Artificial Sequence: Synthetic oligonucleotide
cgcagttcgtgccgttcgacagcga

SEQ ID NO: 48818 - DNA, 25 bp, Artificial Sequence
  Description of Artificial Sequence: Synthetic oligonucleotide
gcagttcgtgccgttcgacagcgac

SEQ ID NO: 48819 - DNA, 25 bp, Artificial Sequence
  Description of Artificial Sequence: Synthetic oligonucleotide
cagttcgtgccgttcgacagcgacg

SEQ ID NO: 48820 - DNA, 25 bp, Artificial Sequence
  Description of Artificial Sequence: Synthetic oligonucleotide
agttcgtgccgttcgacagcgacgc

SEQ ID NO: 48821 - DNA, 24 bp, Artificial Sequence
  Description of Artificial Sequence: Synthetic oligonucleotide
gttcgtgccgttcgacagcgacgc

SEQ ID NO: 48822 - DNA, 24 bp, Artificial Sequence
  Description of Artificial Sequence: Synthetic oligonucleotide
ttcgtgccgttcgacagcgacgcc

SEQ ID NO: 48823 - DNA, 23 bp, Artificial Sequence
  Description of Artificial Sequence: Synthetic oligonucleotide
tcgtgccgttcgacagcgacgcc

SEQ ID NO: 48824 - DNA, 22 bp, Artificial Sequence
  Description of Artificial Sequence: Synthetic oligonucleotide
cgtgccgttcgacagcgacgcc

SEQ ID NO: 48825 - DNA, 22 bp, Artificial Sequence
  Description of Artificial Sequence: Synthetic oligonucleotide
gtgccgttcgacagcgacgccg

SEQ ID NO: 48826 - DNA, 22 bp, Artificial Sequence
  Description of Artificial Sequence: Synthetic oligonucleotide
tgccgttcgacagcgacgccgc

SEQ ID NO: 48827 - DNA, 21 bp, Artificial Sequence
  Description of Artificial Sequence: Synthetic oligonucleotide
gccgttcgacagcgacgccgc

SEQ ID NO: 48828 - DNA, 22 bp, Artificial Sequence
  Description of Artificial Sequence: Synthetic oligonucleotide
ccgttcgacagcgacgccgcga

SEQ ID NO: 48829 - DNA, 23 bp, Artificial Sequence
  Description of Artificial Sequence: Synthetic oligonucleotide
cgttcgacagcgacgccgcgagt

SEQ ID NO: 48830 - DNA, 31 bp, Artificial Sequence
  Description of Artificial Sequence: Synthetic oligonucleotide
agtattgggaccgggagacacagaactacag

SEQ ID NO: 48831 - DNA, 30 bp, Artificial Sequence
  Description of Artificial Sequence: Synthetic oligonucleotide
gtattgggaccgggagacacagaactacag

SEQ ID NO: 48832 - DNA, 30 bp, Artificial Sequence
  Description of Artificial Sequence: Synthetic oligonucleotide
tattgggaccgggagacacagaactacagg

SEQ ID NO: 48833 - DNA, 29 bp, Artificial Sequence
  Description of Artificial Sequence: Synthetic oligonucleotide
attgggaccgggagacacagaactacagg

SEQ ID NO: 48834 - DNA, 28 bp, Artificial Sequence
  Description of Artificial Sequence: Synthetic oligonucleotide
ttgggaccgggagacacagaactacagg

SEQ ID NO: 48835 - DNA, 27 bp, Artificial Sequence
  Description of Artificial Sequence: Synthetic oligonucleotide
tgggaccgggagacacagaactacagg

SEQ ID NO: 48836 - DNA, 26 bp, Artificial Sequence
  Description of Artificial Sequence: Synthetic oligonucleotide
gggaccgggagacacagaactacagg

SEQ ID NO: 48837 - DNA, 26 bp, Artificial Sequence
  Description of Artificial Sequence: Synthetic oligonucleotide
ggaccgggagacacagaactacaggc

SEQ ID NO: 48838 - DNA, 26 bp, Artificial Sequence
  Description of Artificial Sequence: Synthetic oligonucleotide
gaccgggagacacagaactacaggcg

SEQ ID NO: 48839 - DNA, 26 bp, Artificial Sequence
  Description of Artificial Sequence: Synthetic oligonucleotide
accgggagacacagaactacaggcgc

SEQ ID NO: 48840 - DNA, 25 bp, Artificial Sequence
  Description of Artificial Sequence: Synthetic oligonucleotide
ccgggagacacagaactacaggcgc

SEQ ID NO: 48841 - DNA, 26 bp, Artificial Sequence
  Description of Artificial Sequence: Synthetic oligonucleotide
cgggagacacagaactacaggcgcca

SEQ ID NO: 48842 - DNA, 26 bp, Artificial Sequence
  Description of Artificial Sequence: Synthetic oligonucleotide
gggagacacagaactacaggcgccag

SEQ ID NO: 48843 - DNA, 26 bp, Artificial Sequence
  Description of Artificial Sequence: Synthetic oligonucleotide
ggagacacagaactacaggcgccagg

SEQ ID NO: 48844 - DNA, 27 bp, Artificial Sequence
  Description of Artificial Sequence: Synthetic oligonucleotide
gagacacagaactacaggcgccaggca

SEQ ID NO: 48845 - DNA, 27 bp, Artificial Sequence
  Description of Artificial Sequence: Synthetic oligonucleotide
agacacagaactacaggcgccaggcac

SEQ ID NO: 48846 - DNA, 27 bp, Artificial Sequence
  Description of Artificial Sequence: Synthetic oligonucleotide
gacacagaactacaggcgccaggcaca

SEQ ID NO: 48847 - DNA, 27 bp, Artificial Sequence
  Description of Artificial Sequence: Synthetic oligonucleotide
acacagaactacaggcgccaggcacag

SEQ ID NO: 48848 - DNA, 26 bp, Artificial Sequence
  Description of Artificial Sequence: Synthetic oligonucleotide
cacagaactacaggcgccaggcacag

SEQ ID NO: 48849 - DNA, 26 bp, Artificial Sequence
  Description of Artificial Sequence: Synthetic oligonucleotide
acagaactacaggcgccaggcacagg

SEQ ID NO: 48850 - DNA, 25 bp, Artificial Sequence
  Description of Artificial Sequence: Synthetic oligonucleotide
cagaactacaggcgccaggcacagg

SEQ ID NO: 48851 - DNA, 26 bp, Artificial Sequence
  Description of Artificial Sequence: Synthetic oligonucleotide
agaactacaggcgccaggcacaggct

SEQ ID NO: 48852 - DNA, 25 bp, Artificial Sequence
  Description of Artificial Sequence: Synthetic oligonucleotide
gaactacaggcgccaggcacaggct

SEQ ID NO: 48853 - DNA, 26 bp, Artificial Sequence
  Description of Artificial Sequence: Synthetic oligonucleotide
aactacaggcgccaggcacaggctga

SEQ ID NO: 48854 - DNA, 25 bp, Artificial Sequence
  Description of Artificial Sequence: Synthetic oligonucleotide
actacaggcgccaggcacaggctga

SEQ ID NO: 48855 - DNA, 24 bp, Artificial Sequence
  Description of Artificial Sequence: Synthetic oligonucleotide
ctacaggcgccaggcacaggctga

SEQ ID NO: 48856 - DNA, 24 bp, Artificial Sequence
  Description of Artificial Sequence: Synthetic oligonucleotide
tacaggcgccaggcacaggctgac

SEQ ID NO: 48857 - DNA, 23 bp, Artificial Sequence
  Description of Artificial Sequence: Synthetic oligonucleotide
acaggcgccaggcacaggctgac

SEQ ID NO: 48858 - DNA, 22 bp, Artificial Sequence
  Description of Artificial Sequence: Synthetic oligonucleotide
caggcgccaggcacaggctgac

SEQ ID NO: 48859 - DNA, 22 bp, Artificial Sequence
  Description of Artificial Sequence: Synthetic oligonucleotide
aggcgccaggcacaggctgacc

SEQ ID NO: 48860 - DNA, 21 bp, Artificial Sequence
  Description of Artificial Sequence: Synthetic oligonucleotide
ggcgccaggcacaggctgacc

SEQ ID NO: 48861 - DNA, 23 bp, Artificial Sequence
  Description of Artificial Sequence: Synthetic oligonucleotide
gccctgaacgagcacctgcgctc

SEQ ID NO: 48862 - DNA, 24 bp, Artificial Sequence
  Description of Artificial Sequence: Synthetic oligonucleotide
ccctgaacgagcacctgcgctcct

SEQ ID NO: 48863 - DNA, 24 bp, Artificial Sequence
  Description of Artificial Sequence: Synthetic oligonucleotide
cctgaacgagcacctgcgctcctg

SEQ ID NO: 48864 - DNA, 25 bp, Artificial Sequence
  Description of Artificial Sequence: Synthetic oligonucleotide
ctgaacgagcacctgcgctcctgga

SEQ ID NO: 48865 - DNA, 25 bp, Artificial Sequence
  Description of Artificial Sequence: Synthetic oligonucleotide
tgaacgagcacctgcgctcctggac

SEQ ID NO: 48866 - DNA, 24 bp, Artificial Sequence
  Description of Artificial Sequence: Synthetic oligonucleotide
gaacgagcacctgcgctcctggac

SEQ ID NO: 48867 - DNA, 24 bp, Artificial Sequence
  Description of Artificial Sequence: Synthetic oligonucleotide
aacgagcacctgcgctcctggacc

SEQ ID NO: 48868 - DNA, 23 bp, Artificial Sequence
  Description of Artificial Sequence: Synthetic oligonucleotide
acgagcacctgcgctcctggacc

SEQ ID NO: 48869 - DNA, 22 bp, Artificial Sequence
  Description of Artificial Sequence: Synthetic oligonucleotide
cgagcacctgcgctcctggacc

SEQ ID NO: 48870 - DNA, 22 bp, Artificial Sequence
  Description of Artificial Sequence: Synthetic oligonucleotide
gagcacctgcgctcctggaccg

SEQ ID NO: 48871 - DNA, 22 bp, Artificial Sequence
  Description of Artificial Sequence: Synthetic oligonucleotide
agcacctgcgctcctggaccgc

SEQ ID NO: 48872 - DNA, 21 bp, Artificial Sequence
  Description of Artificial Sequence: Synthetic oligonucleotide
gcacctgcgctcctggaccgc

SEQ ID NO: 48873 - DNA, 21 bp, Artificial Sequence
  Description of Artificial Sequence: Synthetic oligonucleotide
cacctgcgctcctggaccgcc

SEQ ID NO: 48874 - DNA, 26 bp, Artificial Sequence
  Description of Artificial Sequence: Synthetic oligonucleotide
accagtccgcctacgacggcaaggat

SEQ ID NO: 48875 - DNA, 25 bp, Artificial Sequence
  Description of Artificial Sequence: Synthetic oligonucleotide
ccagtccgcctacgacggcaaggat

SEQ ID NO: 48876 - DNA, 26 bp, Artificial Sequence
  Description of Artificial Sequence: Synthetic oligonucleotide
cagtccgcctacgacggcaaggatca

SEQ ID NO: 48877 - DNA, 27 bp, Artificial Sequence
  Description of Artificial Sequence: Synthetic oligonucleotide
agtccgcctacgacggcaaggatcaca

SEQ ID NO: 48878 - DNA, 27 bp, Artificial Sequence
  Description of Artificial Sequence: Synthetic oligonucleotide
gtccgcctacgacggcaaggatcacat

SEQ ID NO: 48879 - DNA, 27 bp, Artificial Sequence
  Description of Artificial Sequence: Synthetic oligonucleotide
tccgcctacgacggcaaggatcacatc

SEQ ID NO: 48880 - DNA, 26 bp, Artificial Sequence
  Description of Artificial Sequence: Synthetic oligonucleotide
ccgcctacgacggcaaggatcacatc

SEQ ID NO: 48881 - DNA, 26 bp, Artificial Sequence
  Description of Artificial Sequence: Synthetic oligonucleotide
cgcctacgacggcaaggatcacatcg

SEQ ID NO: 48882 - DNA, 26 bp, Artificial Sequence
  Description of Artificial Sequence: Synthetic oligonucleotide
gcctacgacggcaaggatcacatcgc

SEQ ID NO: 48883 - DNA, 26 bp, Artificial Sequence
  Description of Artificial Sequence: Synthetic oligonucleotide
cctacgacggcaaggatcacatcgcc

SEQ ID NO: 48884 - DNA, 27 bp, Artificial Sequence
  Description of Artificial Sequence: Synthetic oligonucleotide
ctacgacggcaaggatcacatcgccct

SEQ ID NO: 48885 - DNA, 27 bp, Artificial Sequence
  Description of Artificial Sequence: Synthetic oligonucleotide
tacgacggcaaggatcacatcgccctg

SEQ ID NO: 48886 - DNA, 27 bp, Artificial Sequence
  Description of Artificial Sequence: Synthetic oligonucleotide
acgacggcaaggatcacatcgccctga

SEQ ID NO: 48887 - DNA, 27 bp, Artificial Sequence
  Description of Artificial Sequence: Synthetic oligonucleotide
cgacggcaaggatcacatcgccctgaa

SEQ ID NO: 48888 - DNA, 27 bp, Artificial Sequence
  Description of Artificial Sequence: Synthetic oligonucleotide
gacggcaaggatcacatcgccctgaac

SEQ ID NO: 48889 - DNA, 27 bp, Artificial Sequence
  Description of Artificial Sequence: Synthetic oligonucleotide
acggcaaggatcacatcgccctgaacg

SEQ ID NO: 48890 - DNA, 27 bp, Artificial Sequence
  Description of Artificial Sequence: Synthetic oligonucleotide
cggcaaggatcacatcgccctgaacga

SEQ ID NO: 48891 - DNA, 27 bp, Artificial Sequence
  Description of Artificial Sequence: Synthetic oligonucleotide
ggcaaggatcacatcgccctgaacgag

SEQ ID NO: 48892 - DNA, 27 bp, Artificial Sequence
  Description of Artificial Sequence: Synthetic oligonucleotide
gcaaggatcacatcgccctgaacgagg

SEQ ID NO: 48893 - DNA, 28 bp, Artificial Sequence
  Description of Artificial Sequence: Synthetic oligonucleotide
caaggatcacatcgccctgaacgaggac

SEQ ID NO: 48894 - DNA, 28 bp, Artificial Sequence
  Description of Artificial Sequence: Synthetic oligonucleotide
aaggatcacatcgccctgaacgaggacc

SEQ ID NO: 48895 - DNA, 27 bp, Artificial Sequence
  Description of Artificial Sequence: Synthetic oligonucleotide
aggatcacatcgccctgaacgaggacc

SEQ ID NO: 48896 - DNA, 27 bp, Artificial Sequence
  Description of Artificial Sequence: Synthetic oligonucleotide
ggatcacatcgccctgaacgaggacct

SEQ ID NO: 48897 - DNA, 27 bp, Artificial Sequence
  Description of Artificial Sequence: Synthetic oligonucleotide
gatcacatcgccctgaacgaggacctg

SEQ ID NO: 48898 - DNA, 27 bp, Artificial Sequence
  Description of Artificial Sequence: Synthetic oligonucleotide
atcacatcgccctgaacgaggacctgc

SEQ ID NO: 48899 - DNA, 26 bp, Artificial Sequence
  Description of Artificial Sequence: Synthetic oligonucleotide
tcacatcgccctgaacgaggacctgc

SEQ ID NO: 48900 - DNA, 25 bp, Artificial Sequence
  Description of Artificial Sequence: Synthetic oligonucleotide
cacatcgccctgaacgaggacctgc

SEQ ID NO: 48901 - DNA, 20 bp, Artificial Sequence
  Description of Artificial Sequence: Synthetic oligonucleotide
tgtcccggcccggccgcgaa

SEQ ID NO: 48902 - DNA, 20 bp, Artificial Sequence
  Description of Artificial Sequence: Synthetic oligonucleotide
gtcccggcccggccgcgaat

SEQ ID NO: 48903 - DNA, 20 bp, Artificial Sequence
  Description of Artificial Sequence: Synthetic oligonucleotide
tcccggcccggccgcgaaga

SEQ ID NO: 48904 - DNA, 20 bp, Artificial Sequence
  Description of Artificial Sequence: Synthetic oligonucleotide
cccggcccggccgcgaagat

SEQ ID NO: 48905 - DNA, 20 bp, Artificial Sequence
  Description of Artificial Sequence: Synthetic oligonucleotide
ccggcccggccgcgaagagt

SEQ ID NO: 48906 - DNA, 20 bp, Artificial Sequence
  Description of Artificial Sequence: Synthetic oligonucleotide
cggcccggccgcgaagagct

SEQ ID NO: 48907 - DNA, 20 bp, Artificial Sequence
  Description of Artificial Sequence: Synthetic oligonucleotide
ggcccggccgcgaagagcct

SEQ ID NO: 48908 - DNA, 20 bp, Artificial Sequence
  Description of Artificial Sequence: Synthetic oligonucleotide
gcccggccgcgaagagccct

SEQ ID NO: 48909 - DNA, 20 bp, Artificial Sequence
  Description of Artificial Sequence: Synthetic oligonucleotide
cccggccgcgaagagcccct

SEQ ID NO: 48910 - DNA, 20 bp, Artificial Sequence
  Description of Artificial Sequence: Synthetic oligonucleotide
ccggccgcgaagagccccgt

SEQ ID NO: 48911 - DNA, 21 bp, Artificial Sequence
  Description of Artificial Sequence: Synthetic oligonucleotide
cggccgcgaagagccccgctt

SEQ ID NO: 48912 - DNA, 23 bp, Artificial Sequence
  Description of Artificial Sequence: Synthetic oligonucleotide
ggccgcgaagagccccgcttcat

SEQ ID NO: 48913 - DNA, 24 bp, Artificial Sequence
  Description of Artificial Sequence: Synthetic oligonucleotide
gccgcgaagagccccgcttcatct

SEQ ID NO: 48914 - DNA, 25 bp, Artificial Sequence
  Description of Artificial Sequence: Synthetic oligonucleotide
ccgcgaagagccccgcttcatctca

SEQ ID NO: 48915 - DNA, 26 bp, Artificial Sequence
  Description of Artificial Sequence: Synthetic oligonucleotide
cgcgaagagccccgcttcatctcagt

SEQ ID NO: 48916 - DNA, 26 bp, Artificial Sequence
  Description of Artificial Sequence: Synthetic oligonucleotide
gcgaagagccccgcttcatctcagtg

SEQ ID NO: 48917 - DNA, 26 bp, Artificial Sequence
  Description of Artificial Sequence: Synthetic oligonucleotide
cgaagagccccgcttcatctcagtgg

SEQ ID NO: 48918 - DNA, 26 bp, Artificial Sequence
  Description of Artificial Sequence: Synthetic oligonucleotide
gaagagccccgcttcatctcagtggg

SEQ ID NO: 48919 - DNA, 27 bp, Artificial Sequence
  Description of Artificial Sequence: Synthetic oligonucleotide
aagagccccgcttcatctcagtgggct

SEQ ID NO: 48920 - DNA, 27 bp, Artificial Sequence
  Description of Artificial Sequence: Synthetic oligonucleotide
acctgcgcggctactacaaccagagca

SEQ ID NO: 48921 - DNA, 27 bp, Artificial Sequence
  Description of Artificial Sequence: Synthetic oligonucleotide
cctgcgcggctactacaaccagagcaa

SEQ ID NO: 48922 - DNA, 27 bp, Artificial Sequence
  Description of Artificial Sequence: Synthetic oligonucleotide
ctgcgcggctactacaaccagagcaag

SEQ ID NO: 48923 - DNA, 27 bp, Artificial Sequence
  Description of Artificial Sequence: Synthetic oligonucleotide
tgcgcggctactacaaccagagcaagg

SEQ ID NO: 48924 - DNA, 27 bp, Artificial Sequence
  Description of Artificial Sequence: Synthetic oligonucleotide
gcgcggctactacaaccagagcaagga

SEQ ID NO: 48925 - DNA, 27 bp, Artificial Sequence
  Description of Artificial Sequence: Synthetic oligonucleotide
cgcggctactacaaccagagcaaggac

SEQ ID NO: 48926 - DNA, 27 bp, Artificial Sequence
  Description of Artificial Sequence: Synthetic oligonucleotide
gcggctactacaaccagagcaaggacg

SEQ ID NO: 48927 - DNA, 27 bp, Artificial Sequence
  Description of Artificial Sequence: Synthetic oligonucleotide
cggctactacaaccagagcaaggacgg

SEQ ID NO: 48928 - DNA, 27 bp, Artificial Sequence
  Description of Artificial Sequence: Synthetic oligonucleotide
ggctactacaaccagagcaaggacggg

SEQ ID NO: 48929 - DNA, 28 bp, Artificial Sequence
  Description of Artificial Sequence: Synthetic oligonucleotide
gctactacaaccagagcaaggacgggtc

SEQ ID NO: 48930 - DNA, 29 bp, Artificial Sequence
  Description of Artificial Sequence: Synthetic oligonucleotide
ctactacaaccagagcaaggacgggtctc

SEQ ID NO: 48931 - DNA, 30 bp, Artificial Sequence
  Description of Artificial Sequence: Synthetic oligonucleotide
tactacaaccagagcaaggacgggtctcac

SEQ ID NO: 48932 - DNA, 29 bp, Artificial Sequence
  Description of Artificial Sequence: Synthetic oligonucleotide
actacaaccagagcaaggacgggtctcac

SEQ ID NO: 48933 - DNA, 28 bp, Artificial Sequence
  Description of Artificial Sequence: Synthetic oligonucleotide
ctacaaccagagcaaggacgggtctcac

SEQ ID NO: 48934 - DNA, 29 bp, Artificial Sequence
  Description of Artificial Sequence: Synthetic oligonucleotide
tacaaccagagcaaggacgggtctcacac

SEQ ID NO: 48935 - DNA, 28 bp, Artificial Sequence
  Description of Artificial Sequence: Synthetic oligonucleotide
acaaccagagcaaggacgggtctcacac

SEQ ID NO: 48936 - DNA, 27 bp, Artificial Sequence
  Description of Artificial Sequence: Synthetic oligonucleotide
caaccagagcaaggacgggtctcacac

SEQ ID NO: 48937 - DNA, 27 bp, Artificial Sequence
  Description of Artificial Sequence: Synthetic oligonucleotide
aaccagagcaaggacgggtctcacacc

SEQ ID NO: 48938 - DNA, 26 bp, Artificial Sequence
  Description of Artificial Sequence: Synthetic oligonucleotide
accagagcaaggacgggtctcacacc

SEQ ID NO: 48939 - DNA, 25 bp, Artificial Sequence
  Description of Artificial Sequence: Synthetic oligonucleotide
ccagagcaaggacgggtctcacacc

SEQ ID NO: 48940 - DNA, 26 bp, Artificial Sequence
  Description of Artificial Sequence: Synthetic oligonucleotide
cagagcaaggacgggtctcacaccct

SEQ ID NO: 48941 - DNA, 26 bp, Artificial Sequence
  Description of Artificial Sequence: Synthetic oligonucleotide
agagcaaggacgggtctcacaccctc

SEQ ID NO: 48942 - DNA, 25 bp, Artificial Sequence
  Description of Artificial Sequence: Synthetic oligonucleotide
gagcaaggacgggtctcacaccctc

SEQ ID NO: 48943 - DNA, 26 bp, Artificial Sequence
  Description of Artificial Sequence: Synthetic oligonucleotide
agcaaggacgggtctcacaccctcca

SEQ ID NO: 48944 - DNA, 25 bp, Artificial Sequence
  Description of Artificial Sequence: Synthetic oligonucleotide
gcaaggacgggtctcacaccctcca

SEQ ID NO: 48945 - DNA, 26 bp, Artificial Sequence
  Description of Artificial Sequence: Synthetic oligonucleotide
caaggacgggtctcacaccctccaga

SEQ ID NO: 48946 - DNA, 26 bp, Artificial Sequence
  Description of Artificial Sequence: Synthetic oligonucleotide
aaggacgggtctcacaccctccagag

SEQ ID NO: 48947 - DNA, 20 bp, Artificial Sequence
  Description of Artificial Sequence: Synthetic oligonucleotide
agccgcgggcgccgtggttg

SEQ ID NO: 48948 - DNA, 20 bp, Artificial Sequence
  Description of Artificial Sequence: Synthetic oligonucleotide
gccgcgggcgccgtggttgt

SEQ ID NO: 48949 - DNA, 20 bp, Artificial Sequence
  Description of Artificial Sequence: Synthetic oligonucleotide
ccgcgggcgccgtggttgga

SEQ ID NO: 48950 - DNA, 20 bp, Artificial Sequence
  Description of Artificial Sequence: Synthetic oligonucleotide
cgcgggcgccgtggttggag

SEQ ID NO: 48951 - DNA, 21 bp, Artificial Sequence
  Description of Artificial Sequence: Synthetic oligonucleotide
gcgggcgccgtggttggagca

SEQ ID NO: 48952 - DNA, 21 bp, Artificial Sequence
  Description of Artificial Sequence: Synthetic oligonucleotide
cgggcgccgtggttggagcag

SEQ ID NO: 48953 - DNA, 22 bp, Artificial Sequence
  Description of Artificial Sequence: Synthetic oligonucleotide
gggcgccgtggttggagcagga

SEQ ID NO: 48954 - DNA, 22 bp, Artificial Sequence
  Description of Artificial Sequence: Synthetic oligonucleotide
ggcgccgtggttggagcaggag

SEQ ID NO: 48955 - DNA, 22 bp, Artificial Sequence
  Description of Artificial Sequence: Synthetic oligonucleotide
gcgccgtggttggagcaggagg

SEQ ID NO: 48956 - DNA, 22 bp, Artificial Sequence
  Description of Artificial Sequence: Synthetic oligonucleotide
cgccgtggttggagcaggaggg

SEQ ID NO: 48957 - DNA, 22 bp, Artificial Sequence
  Description of Artificial Sequence: Synthetic oligonucleotide
gccgtggttggagcaggagggg

SEQ ID NO: 48958 - DNA, 22 bp, Artificial Sequence
  Description of Artificial Sequence: Synthetic oligonucleotide
ccgtggttggagcaggaggggc

SEQ ID NO: 48959 - DNA, 22 bp, Artificial Sequence
  Description of Artificial Sequence: Synthetic oligonucleotide
cgtggttggagcaggaggggcc

SEQ ID NO: 48960 - DNA, 22 bp, Artificial Sequence
  Description of Artificial Sequence: Synthetic oligonucleotide
gtggttggagcaggaggggccg

SEQ ID NO: 48961 - DNA, 23 bp, Artificial Sequence
  Description of Artificial Sequence: Synthetic oligonucleotide
tggttggagcaggaggggccgga

SEQ ID NO: 48962 - DNA, 22 bp, Artificial Sequence
  Description of Artificial Sequence: Synthetic oligonucleotide
ggttggagcaggaggggccgga

SEQ ID NO: 48963 - DNA, 26 bp, Artificial Sequence
  Description of Artificial Sequence: Synthetic oligonucleotide
gttggagcaggaggggccggagtatt

SEQ ID NO: 48964 - DNA, 26 bp, Artificial Sequence
  Description of Artificial Sequence: Synthetic oligonucleotide
ttggagcaggaggggccggagtattg

SEQ ID NO: 48965 - DNA, 27 bp, Artificial Sequence
  Description of Artificial Sequence: Synthetic oligonucleotide
agatcacccagcgcaagttggaggcga

SEQ ID NO: 48966 - DNA, 26 bp, Artificial Sequence
  Description of Artificial Sequence: Synthetic oligonucleotide
gatcacccagcgcaagttggaggcga

SEQ ID NO: 48967 - DNA, 26 bp, Artificial Sequence
  Description of Artificial Sequence: Synthetic oligonucleotide
atcacccagcgcaagttggaggcgac

SEQ ID NO: 48968 - DNA, 25 bp, Artificial Sequence
  Description of Artificial Sequence: Synthetic oligonucleotide
tcacccagcgcaagttggaggcgac

SEQ ID NO: 48969 - DNA, 24 bp, Artificial Sequence
  Description of Artificial Sequence: Synthetic oligonucleotide
cacccagcgcaagttggaggcgac

SEQ ID NO: 48970 - DNA, 24 bp, Artificial Sequence
  Description of Artificial Sequence: Synthetic oligonucleotide
acccagcgcaagttggaggcgacc

SEQ ID NO: 48971 - DNA, 23 bp, Artificial Sequence
  Description of Artificial Sequence: Synthetic oligonucleotide
cccagcgcaagttggaggcgacc

SEQ ID NO: 48972 - DNA, 23 bp, Artificial Sequence
  Description of Artificial Sequence: Synthetic oligonucleotide
ccagcgcaagttggaggcgaccc

SEQ ID NO: 48973 - DNA, 24 bp, Artificial Sequence
  Description of Artificial Sequence: Synthetic oligonucleotide
cagcgcaagttggaggcgacccgt

SEQ ID NO: 48974 - DNA, 24 bp, Artificial Sequence
  Description of Artificial Sequence: Synthetic oligonucleotide
agcgcaagttggaggcgacccgtg

SEQ ID NO: 48975 - DNA, 23 bp, Artificial Sequence
  Description of Artificial Sequence: Synthetic oligonucleotide
gcgcaagttggaggcgacccgtg

SEQ ID NO: 48976 - DNA, 23 bp, Artificial Sequence
  Description of Artificial Sequence: Synthetic oligonucleotide
cgcaagttggaggcgacccgtgc

SEQ ID NO: 48977 - DNA, 23 bp, Artificial Sequence
  Description of Artificial Sequence: Synthetic oligonucleotide
gcaagttggaggcgacccgtgcg

SEQ ID NO: 48978 - DNA, 23 bp, Artificial Sequence
  Description of Artificial Sequence: Synthetic oligonucleotide
caagttggaggcgacccgtgcgg

SEQ ID NO: 48979 - DNA, 23 bp, Artificial Sequence
  Description of Artificial Sequence: Synthetic oligonucleotide
aagttggaggcgacccgtgcggc

SEQ ID NO: 48980 - DNA, 22 bp, Artificial Sequence
  Description of Artificial Sequence: Synthetic oligonucleotide
agttggaggcgacccgtgcggc

SEQ ID NO: 48981 - DNA, 21 bp, Artificial Sequence
  Description of Artificial Sequence: Synthetic oligonucleotide
gttggaggcgacccgtgcggc

SEQ ID NO: 48982 - DNA, 21 bp, Artificial Sequence
  Description of Artificial Sequence: Synthetic oligonucleotide
ttggaggcgacccgtgcggcg

SEQ ID NO: 48983 - DNA, 20 bp, Artificial Sequence
  Description of Artificial Sequence: Synthetic oligonucleotide
tggaggcgacccgtgcggcg

SEQ ID NO: 48984 - DNA, 20 bp, Artificial Sequence
  Description of Artificial Sequence: Synthetic oligonucleotide
ggaggcgacccgtgcggcgt

SEQ ID NO: 48985 - DNA, 20 bp, Artificial Sequence
  Description of Artificial Sequence: Synthetic oligonucleotide
gaggcgacccgtgcggcgga

SEQ ID NO: 48986 - DNA, 20 bp, Artificial Sequence
  Description of Artificial Sequence: Synthetic oligonucleotide
aggcgacccgtgcggcggag

SEQ ID NO: 48987 - DNA, 20 bp, Artificial Sequence
  Description of Artificial Sequence: Synthetic oligonucleotide
ggcgacccgtgcggcggagt

SEQ ID NO: 48988 - DNA, 20 bp, Artificial Sequence
  Description of Artificial Sequence: Synthetic oligonucleotide
gcgacccgtgcggcggagca

SEQ ID NO: 48989 - DNA, 20 bp, Artificial Sequence
  Description of Artificial Sequence: Synthetic oligonucleotide
cgacccgtgcggcggagcag

SEQ ID NO: 48990 - DNA, 21 bp, Artificial Sequence
  Description of Artificial Sequence: Synthetic oligonucleotide
gacccgtgcggcggagcagct

SEQ ID NO: 48991 - DNA, 22 bp, Artificial Sequence
  Description of Artificial Sequence: Synthetic oligonucleotide
acccgtgcggcggagcagctga

SEQ ID NO: 48992 - DNA, 29 bp, Artificial Sequence
  Description of Artificial Sequence: Synthetic oligonucleotide
tccgcctacgacggcaaggattacatcac

SEQ ID NO: 48993 - DNA, 28 bp, Artificial Sequence
  Description of Artificial Sequence: Synthetic oligonucleotide
ccgcctacgacggcaaggattacatcac

SEQ ID NO: 48994 - DNA, 31 bp, Artificial Sequence
  Description of Artificial Sequence: Synthetic oligonucleotide
aaggattacatcaccctgaacgaggacctgc

SEQ ID NO: 48995 - DNA, 30 bp, Artificial Sequence
  Description of Artificial Sequence: Synthetic oligonucleotide
aggattacatcaccctgaacgaggacctgc

SEQ ID NO: 48996 - DNA, 29 bp, Artificial Sequence
  Description of Artificial Sequence: Synthetic oligonucleotide
ggattacatcaccctgaacgaggacctgc

SEQ ID NO: 48997 - DNA, 29 bp, Artificial Sequence
  Description of Artificial Sequence: Synthetic oligonucleotide
gattacatcaccctgaacgaggacctgcg

SEQ ID NO: 48998 - DNA, 29 bp, Artificial Sequence
  Description of Artificial Sequence: Synthetic oligonucleotide
attacatcaccctgaacgaggacctgcgc

SEQ ID NO: 48999 - DNA, 28 bp, Artificial Sequence
  Description of Artificial Sequence: Synthetic oligonucleotide
ttacatcaccctgaacgaggacctgcgc

SEQ ID NO: 49000 - DNA, 27 bp, Artificial Sequence
  Description of Artificial Sequence: Synthetic oligonucleotide
tacatcaccctgaacgaggacctgcgc

SEQ ID NO: 49001 - DNA, 27 bp, Artificial Sequence
  Description of Artificial Sequence: Synthetic oligonucleotide
acatcaccctgaacgaggacctgcgct

SEQ ID NO: 49002 - DNA, 26 bp, Artificial Sequence
  Description of Artificial Sequence: Synthetic oligonucleotide
catcaccctgaacgaggacctgcgct

SEQ ID NO: 49003 - DNA, 26 bp, Artificial Sequence
  Description of Artificial Sequence: Synthetic oligonucleotide
atcaccctgaacgaggacctgcgctc

SEQ ID NO: 49004 - DNA, 25 bp, Artificial Sequence
  Description of Artificial Sequence: Synthetic oligonucleotide
tcaccctgaacgaggacctgcgctc

SEQ ID NO: 49005 - DNA, 24 bp, Artificial Sequence
  Description of Artificial Sequence: Synthetic oligonucleotide
caccctgaacgaggacctgcgctc

SEQ ID NO: 49006 - DNA, 25 bp, Artificial Sequence
  Description of Artificial Sequence: Synthetic oligonucleotide
accctgaacgaggacctgcgctcct

SEQ ID NO: 49007 - DNA, 27 bp, Artificial Sequence
  Description of Artificial Sequence: Synthetic oligonucleotide
ctgcggaacctgcgcggctactacaaa

SEQ ID NO: 49008 - DNA, 27 bp, Artificial Sequence
  Description of Artificial Sequence: Synthetic oligonucleotide
tgcggaacctgcgcggctactacaaac

SEQ ID NO: 49009 - DNA, 27 bp, Artificial Sequence
  Description of Artificial Sequence: Synthetic oligonucleotide
gcggaacctgcgcggctactacaaaca

SEQ ID NO: 49010 - DNA, 27 bp, Artificial Sequence
  Description of Artificial Sequence: Synthetic oligonucleotide
cggaacctgcgcggctactacaaacag

SEQ ID NO: 49011 - DNA, 28 bp, Artificial Sequence
  Description of Artificial Sequence: Synthetic oligonucleotide
ggaacctgcgcggctactacaaacagag

SEQ ID NO: 49012 - DNA, 28 bp, Artificial Sequence
  Description of Artificial Sequence: Synthetic oligonucleotide
gaacctgcgcggctactacaaacagagc

SEQ ID NO: 49013 - DNA, 28 bp, Artificial Sequence
  Description of Artificial Sequence: Synthetic oligonucleotide
aacctgcgcggctactacaaacagagcg

SEQ ID NO: 49014 - DNA, 27 bp, Artificial Sequence
  Description of Artificial Sequence: Synthetic oligonucleotide
acctgcgcggctactacaaacagagcg

SEQ ID NO: 49015 - DNA, 27 bp, Artificial Sequence
  Description of Artificial Sequence: Synthetic oligonucleotide
gcgcggctactacaaacagagcgagga

SEQ ID NO: 49016 - DNA, 27 bp, Artificial Sequence
  Description of Artificial Sequence: Synthetic oligonucleotide
cgcggctactacaaacagagcgaggac

SEQ ID NO: 49017 - DNA, 27 bp, Artificial Sequence
  Description of Artificial Sequence: Synthetic oligonucleotide
gcggctactacaaacagagcgaggacg

SEQ ID NO: 49018 - DNA, 27 bp, Artificial Sequence
  Description of Artificial Sequence: Synthetic oligonucleotide
cggctactacaaacagagcgaggacgg

SEQ ID NO: 49019 - DNA, 27 bp, Artificial Sequence
  Description of Artificial Sequence: Synthetic oligonucleotide
ggctactacaaacagagcgaggacggg

SEQ ID NO: 49020 - DNA, 28 bp, Artificial Sequence
  Description of Artificial Sequence: Synthetic oligonucleotide
gctactacaaacagagcgaggacgggtc

SEQ ID NO: 49021 - DNA, 29 bp, Artificial Sequence
  Description of Artificial Sequence: Synthetic oligonucleotide
ctactacaaacagagcgaggacgggtctc

SEQ ID NO: 49022 - DNA, 30 bp, Artificial Sequence
  Description of Artificial Sequence: Synthetic oligonucleotide
tactacaaacagagcgaggacgggtctcac

SEQ ID NO: 49023 - DNA, 29 bp, Artificial Sequence
  Description of Artificial Sequence: Synthetic oligonucleotide
actacaaacagagcgaggacgggtctcac

SEQ ID NO: 49024 - DNA, 28 bp, Artificial Sequence
  Description of Artificial Sequence: Synthetic oligonucleotide
ctacaaacagagcgaggacgggtctcac

SEQ ID NO: 49025 - DNA, 29 bp, Artificial Sequence
  Description of Artificial Sequence: Synthetic oligonucleotide
tacaaacagagcgaggacgggtctcacac

SEQ ID NO: 49026 - DNA, 28 bp, Artificial Sequence
  Description of Artificial Sequence: Synthetic oligonucleotide
acaaacagagcgaggacgggtctcacac

SEQ ID NO: 49027 - DNA, 27 bp, Artificial Sequence
  Description of Artificial Sequence: Synthetic oligonucleotide
caaacagagcgaggacgggtctcacac

SEQ ID NO: 49028 - DNA, 27 bp, Artificial Sequence
  Description of Artificial Sequence: Synthetic oligonucleotide
aaacagagcgaggacgggtctcacacc

SEQ ID NO: 49029 - DNA, 26 bp, Artificial Sequence
  Description of Artificial Sequence: Synthetic oligonucleotide
aacagagcgaggacgggtctcacacc

SEQ ID NO: 49030 - DNA, 25 bp, Artificial Sequence
  Description of Artificial Sequence: Synthetic oligonucleotide
acagagcgaggacgggtctcacacc

SEQ ID NO: 49031 - DNA, 21 bp, Artificial Sequence
  Description of Artificial Sequence: Synthetic oligonucleotide
cgccgcggacaccgcggctta

SEQ ID NO: 49032 - DNA, 23 bp, Artificial Sequence
  Description of Artificial Sequence: Synthetic oligonucleotide
gccgcggacaccgcggcttagat

SEQ ID NO: 49033 - DNA, 24 bp, Artificial Sequence
  Description of Artificial Sequence: Synthetic oligonucleotide
ccgcggacaccgcggcttagatca

SEQ ID NO: 49034 - DNA, 24 bp, Artificial Sequence
  Description of Artificial Sequence: Synthetic oligonucleotide
cgcggacaccgcggcttagatcac

SEQ ID NO: 49035 - DNA, 27 bp, Artificial Sequence
  Description of Artificial Sequence: Synthetic oligonucleotide
cgcggcttagatcacccagcgcaagtt

SEQ ID NO: 49036 - DNA, 27 bp, Artificial Sequence
  Description of Artificial Sequence: Synthetic oligonucleotide
gcggcttagatcacccagcgcaagttg

SEQ ID NO: 49037 - DNA, 27 bp, Artificial Sequence
  Description of Artificial Sequence: Synthetic oligonucleotide
cggcttagatcacccagcgcaagttgg

SEQ ID NO: 49038 - DNA, 28 bp, Artificial Sequence
  Description of Artificial Sequence: Synthetic oligonucleotide
ggcttagatcacccagcgcaagttggag

SEQ ID NO: 49039 - DNA, 28 bp, Artificial Sequence
  Description of Artificial Sequence: Synthetic oligonucleotide
gcttagatcacccagcgcaagttggagg

SEQ ID NO: 49040 - DNA, 28 bp, Artificial Sequence
  Description of Artificial Sequence: Synthetic oligonucleotide
cttagatcacccagcgcaagttggaggc

SEQ ID NO: 49041 - DNA, 28 bp, Artificial Sequence
  Description of Artificial Sequence: Synthetic oligonucleotide
ttagatcacccagcgcaagttggaggcg

SEQ ID NO: 49042 - DNA, 27 bp, Artificial Sequence
  Description of Artificial Sequence: Synthetic oligonucleotide
tagatcacccagcgcaagttggaggcg

SEQ ID NO: 49043 - DNA, 23 bp, Artificial Sequence
  Description of Artificial Sequence: Synthetic oligonucleotide
ggaaggagacgctgcagggcgca

SEQ ID NO: 49044 - DNA, 23 bp, Artificial Sequence
  Description of Artificial Sequence: Synthetic oligonucleotide
gaaggagacgctgcagggcgcag

SEQ ID NO: 49045 - DNA, 27 bp, Artificial Sequence
  Description of Artificial Sequence: Synthetic oligonucleotide
ctgaatgaggacctgcgctcctggact

SEQ ID NO: 49046 - DNA, 27 bp, Artificial Sequence
  Description of Artificial Sequence: Synthetic oligonucleotide
tgaatgaggacctgcgctcctggactg

SEQ ID NO: 49047 - DNA, 26 bp, Artificial Sequence
  Description of Artificial Sequence: Synthetic oligonucleotide
gaatgaggacctgcgctcctggactg

SEQ ID NO: 49048 - DNA, 26 bp, Artificial Sequence
  Description of Artificial Sequence: Synthetic oligonucleotide
aatgaggacctgcgctcctggactgc

SEQ ID NO: 49049 - DNA, 25 bp, Artificial Sequence
  Description of Artificial Sequence: Synthetic oligonucleotide
atgaggacctgcgctcctggactgc

SEQ ID NO: 49050 - DNA, 24 bp, Artificial Sequence
  Description of Artificial Sequence: Synthetic oligonucleotide
tgaggacctgcgctcctggactgc

SEQ ID NO: 49051 - DNA, 23 bp, Artificial Sequence
  Description of Artificial Sequence: Synthetic oligonucleotide
cgctcctggactgccgcggacaa

SEQ ID NO: 49052 - DNA, 23 bp, Artificial Sequence
  Description of Artificial Sequence: Synthetic oligonucleotide
gctcctggactgccgcggacaag

SEQ ID NO: 49053 - DNA, 23 bp, Artificial Sequence
  Description of Artificial Sequence: Synthetic oligonucleotide
ctcctggactgccgcggacaagg

SEQ ID NO: 49054 - DNA, 23 bp, Artificial Sequence
  Description of Artificial Sequence: Synthetic oligonucleotide
tcctggactgccgcggacaaggc

SEQ ID NO: 49055 - DNA, 22 bp, Artificial Sequence
  Description of Artificial Sequence: Synthetic oligonucleotide
cctggactgccgcggacaaggc

SEQ ID NO: 49056 - DNA, 22 bp, Artificial Sequence
  Description of Artificial Sequence: Synthetic oligonucleotide
ctggactgccgcggacaaggcg

SEQ ID NO: 49057 - DNA, 22 bp, Artificial Sequence
  Description of Artificial Sequence: Synthetic oligonucleotide
tggactgccgcggacaaggcgg

SEQ ID NO: 49058 - DNA, 21 bp, Artificial Sequence
  Description of Artificial Sequence: Synthetic oligonucleotide
ggactgccgcggacaaggcgg

SEQ ID NO: 49059 - DNA, 22 bp, Artificial Sequence
  Description of Artificial Sequence: Synthetic oligonucleotide
gactgccgcggacaaggcggct

SEQ ID NO: 49060 - DNA, 23 bp, Artificial Sequence
  Description of Artificial Sequence: Synthetic oligonucleotide
actgccgcggacaaggcggctca

SEQ ID NO: 49061 - DNA, 22 bp, Artificial Sequence
  Description of Artificial Sequence: Synthetic oligonucleotide
ctgccgcggacaaggcggctca

SEQ ID NO: 49062 - DNA, 24 bp, Artificial Sequence
  Description of Artificial Sequence: Synthetic oligonucleotide
tgccgcggacaaggcggctcagat

SEQ ID NO: 49063 - DNA, 36 bp, Artificial Sequence
  Description of Artificial Sequence: Synthetic oligonucleotide
tataaccagttcgcctacgacggcaaggattatatc

SEQ ID NO: 49064 - DNA, 35 bp, Artificial Sequence
  Description of Artificial Sequence: Synthetic oligonucleotide
ataaccagttcgcctacgacggcaaggattatatc

SEQ ID NO: 49065 - DNA, 34 bp, Artificial Sequence
  Description of Artificial Sequence: Synthetic oligonucleotide
taaccagttcgcctacgacggcaaggattatatc

SEQ ID NO: 49066 - DNA, 33 bp, Artificial Sequence
  Description of Artificial Sequence: Synthetic oligonucleotide
aaccagttcgcctacgacggcaaggattatatc

SEQ ID NO: 49067 - DNA, 32 bp, Artificial Sequence
  Description of Artificial Sequence: Synthetic oligonucleotide
accagttcgcctacgacggcaaggattatatc

SEQ ID NO: 49068 - DNA, 31 bp, Artificial Sequence
  Description of Artificial Sequence: Synthetic oligonucleotide
ccagttcgcctacgacggcaaggattatatc

SEQ ID NO: 49069 - DNA, 31 bp, Artificial Sequence
  Description of Artificial Sequence: Synthetic oligonucleotide
cagttcgcctacgacggcaaggattatatcg

SEQ ID NO: 49070 - DNA, 31 bp, Artificial Sequence
  Description of Artificial Sequence: Synthetic oligonucleotide
agttcgcctacgacggcaaggattatatcgc

SEQ ID NO: 49071 - DNA, 30 bp, Artificial Sequence
  Description of Artificial Sequence: Synthetic oligonucleotide
gttcgcctacgacggcaaggattatatcgc

SEQ ID NO: 49072 - DNA, 30 bp, Artificial Sequence
  Description of Artificial Sequence: Synthetic oligonucleotide
ttcgcctacgacggcaaggattatatcgcc

SEQ ID NO: 49073 - DNA, 29 bp, Artificial Sequence
  Description of Artificial Sequence: Synthetic oligonucleotide
tcgcctacgacggcaaggattatatcgcc

SEQ ID NO: 49074 - DNA, 28 bp, Artificial Sequence
  Description of Artificial Sequence: Synthetic oligonucleotide
cgcctacgacggcaaggattatatcgcc

SEQ ID NO: 49075 - DNA, 28 bp, Artificial Sequence
  Description of Artificial Sequence: Synthetic oligonucleotide
gcctacgacggcaaggattatatcgccc

SEQ ID NO: 49076 - DNA, 29 bp, Artificial Sequence
  Description of Artificial Sequence: Synthetic oligonucleotide
cctacgacggcaaggattatatcgccctg

SEQ ID NO: 49077 - DNA, 32 bp, Artificial Sequence
  Description of Artificial Sequence: Synthetic oligonucleotide
ctacgacggcaaggattatatcgccctgaatg

SEQ ID NO: 49078 - DNA, 33 bp, Artificial Sequence
  Description of Artificial Sequence: Synthetic oligonucleotide
tacgacggcaaggattatatcgccctgaatgag

SEQ ID NO: 49079 - DNA, 32 bp, Artificial Sequence
  Description of Artificial Sequence: Synthetic oligonucleotide
acgacggcaaggattatatcgccctgaatgag

SEQ ID NO: 49080 - DNA, 31 bp, Artificial Sequence
  Description of Artificial Sequence: Synthetic oligonucleotide
cgacggcaaggattatatcgccctgaatgag

SEQ ID NO: 49081 - DNA, 31 bp, Artificial Sequence
  Description of Artificial Sequence: Synthetic oligonucleotide
gacggcaaggattatatcgccctgaatgagg

SEQ ID NO: 49082 - DNA, 32 bp, Artificial Sequence
  Description of Artificial Sequence: Synthetic oligonucleotide
acggcaaggattatatcgccctgaatgaggac

SEQ ID NO: 49083 - DNA, 31 bp, Artificial Sequence
  Description of Artificial Sequence: Synthetic oligonucleotide
cggcaaggattatatcgccctgaatgaggac

SEQ ID NO: 49084 - DNA, 31 bp, Artificial Sequence
  Description of Artificial Sequence: Synthetic oligonucleotide
ggcaaggattatatcgccctgaatgaggacc

SEQ ID NO: 49085 - DNA, 32 bp, Artificial Sequence
  Description of Artificial Sequence: Synthetic oligonucleotide
gcaaggattatatcgccctgaatgaggacctg

SEQ ID NO: 49086 - DNA, 32 bp, Artificial Sequence
  Description of Artificial Sequence: Synthetic oligonucleotide
caaggattatatcgccctgaatgaggacctgc

SEQ ID NO: 49087 - DNA, 32 bp, Artificial Sequence
  Description of Artificial Sequence: Synthetic oligonucleotide
aaggattatatcgccctgaatgaggacctgcg

SEQ ID NO: 49088 - DNA, 31 bp, Artificial Sequence
  Description of Artificial Sequence: Synthetic oligonucleotide
aggattatatcgccctgaatgaggacctgcg

SEQ ID NO: 49089 - DNA, 30 bp, Artificial Sequence
  Description of Artificial Sequence: Synthetic oligonucleotide
ggattatatcgccctgaatgaggacctgcg

SEQ ID NO: 49090 - DNA, 30 bp, Artificial Sequence
  Description of Artificial Sequence: Synthetic oligonucleotide
gattatatcgccctgaatgaggacctgcgc

SEQ ID NO: 49091 - DNA, 31 bp, Artificial Sequence
  Description of Artificial Sequence: Synthetic oligonucleotide
attatatcgccctgaatgaggacctgcgctc

SEQ ID NO: 49092 - DNA, 30 bp, Artificial Sequence
  Description of Artificial Sequence: Synthetic oligonucleotide
ttatatcgccctgaatgaggacctgcgctc

SEQ ID NO: 49093 - DNA, 29 bp, Artificial Sequence
  Description of Artificial Sequence: Synthetic oligonucleotide
tatatcgccctgaatgaggacctgcgctc

SEQ ID NO: 49094 - DNA, 28 bp, Artificial Sequence
  Description of Artificial Sequence: Synthetic oligonucleotide
atatcgccctgaatgaggacctgcgctc

SEQ ID NO: 49095 - DNA, 27 bp, Artificial Sequence
  Description of Artificial Sequence: Synthetic oligonucleotide
tatcgccctgaatgaggacctgcgctc

SEQ ID NO: 49096 - DNA, 23 bp, Artificial Sequence
  Description of Artificial Sequence: Synthetic oligonucleotide
ctgagagcctacctggagggcgc

SEQ ID NO: 49097 - DNA, 24 bp, Artificial Sequence
  Description of Artificial Sequence: Synthetic oligonucleotide
tgagagcctacctggagggcgcgt

SEQ ID NO: 49098 - DNA, 23 bp, Artificial Sequence
  Description of Artificial Sequence: Synthetic oligonucleotide
gagagcctacctggagggcgcgt

SEQ ID NO: 49099 - DNA, 27 bp, Artificial Sequence
  Description of Artificial Sequence: Synthetic oligonucleotide
cctccagagcatgtatggctgcgacct

SEQ ID NO: 49100 - DNA, 27 bp, Artificial Sequence
  Description of Artificial Sequence: Synthetic oligonucleotide
ctccagagcatgtatggctgcgacctg

SEQ ID NO: 49101 - DNA, 27 bp, Artificial Sequence
  Description of Artificial Sequence: Synthetic oligonucleotide
tccagagcatgtatggctgcgacctgg

SEQ ID NO: 49102 - DNA, 26 bp, Artificial Sequence
  Description of Artificial Sequence: Synthetic oligonucleotide
ccagagcatgtatggctgcgacctgg

SEQ ID NO: 49103 - DNA, 26 bp, Artificial Sequence
  Description of Artificial Sequence: Synthetic oligonucleotide
cagagcatgtatggctgcgacctggg

SEQ ID NO: 49104 - DNA, 26 bp, Artificial Sequence
  Description of Artificial Sequence: Synthetic oligonucleotide
agagcatgtatggctgcgacctgggg

SEQ ID NO: 49105 - DNA, 25 bp, Artificial Sequence
  Description of Artificial Sequence: Synthetic oligonucleotide
gagcatgtatggctgcgacctgggg

SEQ ID NO: 49106 - DNA, 25 bp, Artificial Sequence
  Description of Artificial Sequence: Synthetic oligonucleotide
agcatgtatggctgcgacctggggc

SEQ ID NO: 49107 - DNA, 24 bp, Artificial Sequence
  Description of Artificial Sequence: Synthetic oligonucleotide
gcatgtatggctgcgacctggggc

SEQ ID NO: 49108 - DNA, 24 bp, Artificial Sequence
  Description of Artificial Sequence: Synthetic oligonucleotide
catgtatggctgcgacctggggcc

SEQ ID NO: 49109 - DNA, 23 bp, Artificial Sequence
  Description of Artificial Sequence: Synthetic oligonucleotide
ggtcatggcgccccgaaccctca

SEQ ID NO: 49110 - DNA, 23 bp, Artificial Sequence
  Description of Artificial Sequence: Synthetic oligonucleotide
gtcatggcgccccgaaccctcac

SEQ ID NO: 49111 - DNA, 23 bp, Artificial Sequence
  Description of Artificial Sequence: Synthetic oligonucleotide
tcatggcgccccgaaccctcacc

SEQ ID NO: 49112 - DNA, 22 bp, Artificial Sequence
  Description of Artificial Sequence: Synthetic oligonucleotide
catggcgccccgaaccctcacc

SEQ ID NO: 49113 - DNA, 23 bp, Artificial Sequence
  Description of Artificial Sequence: Synthetic oligonucleotide
atggcgccccgaaccctcaccct

SEQ ID NO: 49114 - DNA, 22 bp, Artificial Sequence
  Description of Artificial Sequence: Synthetic oligonucleotide
tggcgccccgaaccctcaccct

SEQ ID NO: 49115 - DNA, 21 bp, Artificial Sequence
  Description of Artificial Sequence: Synthetic oligonucleotide
ggcgccccgaaccctcaccct

SEQ ID NO: 49116 - DNA, 21 bp, Artificial Sequence
  Description of Artificial Sequence: Synthetic oligonucleotide
gcgccccgaaccctcaccctg

SEQ ID NO: 49117 - DNA, 22 bp, Artificial Sequence
  Description of Artificial Sequence: Synthetic oligonucleotide
cgccccgaaccctcaccctgct

SEQ ID NO: 49118 - DNA, 22 bp, Artificial Sequence
  Description of Artificial Sequence: Synthetic oligonucleotide
gccccgaaccctcaccctgctg

SEQ ID NO: 49119 - DNA, 23 bp, Artificial Sequence
  Description of Artificial Sequence: Synthetic oligonucleotide
ccccgaaccctcaccctgctgct

SEQ ID NO: 49120 - DNA, 24 bp, Artificial Sequence
  Description of Artificial Sequence: Synthetic oligonucleotide
cccgaaccctcaccctgctgctct

SEQ ID NO: 49121 - DNA, 24 bp, Artificial Sequence
  Description of Artificial Sequence: Synthetic oligonucleotide
ccgaaccctcaccctgctgctctc

SEQ ID NO: 49122 - DNA, 24 bp, Artificial Sequence
  Description of Artificial Sequence: Synthetic oligonucleotide
cgaaccctcaccctgctgctctcg

SEQ ID NO: 49123 - DNA, 24 bp, Artificial Sequence
  Description of Artificial Sequence: Synthetic oligonucleotide
gaaccctcaccctgctgctctcgg

SEQ ID NO: 49124 - DNA, 25 bp, Artificial Sequence
  Description of Artificial Sequence: Synthetic oligonucleotide
aaccctcaccctgctgctctcggga

SEQ ID NO: 49125 - DNA, 24 bp, Artificial Sequence
  Description of Artificial Sequence: Synthetic oligonucleotide
accctcaccctgctgctctcggga

SEQ ID NO: 49126 - DNA, 23 bp, Artificial Sequence
  Description of Artificial Sequence: Synthetic oligonucleotide
ccctcaccctgctgctctcggga

SEQ ID NO: 49127 - DNA, 23 bp, Artificial Sequence
  Description of Artificial Sequence: Synthetic oligonucleotide
cctcaccctgctgctctcgggag

SEQ ID NO: 49128 - DNA, 23 bp, Artificial Sequence
  Description of Artificial Sequence: Synthetic oligonucleotide
ctcaccctgctgctctcgggagc

SEQ ID NO: 49129 - DNA, 23 bp, Artificial Sequence
  Description of Artificial Sequence: Synthetic oligonucleotide
tcaccctgctgctctcgggagcc

SEQ ID NO: 49130 - DNA, 22 bp, Artificial Sequence
  Description of Artificial Sequence: Synthetic oligonucleotide
caccctgctgctctcgggagcc

SEQ ID NO: 49131 - DNA, 23 bp, Artificial Sequence
  Description of Artificial Sequence: Synthetic oligonucleotide
accctgctgctctcgggagccct

SEQ ID NO: 49132 - DNA, 22 bp, Artificial Sequence
  Description of Artificial Sequence: Synthetic oligonucleotide
ccctgctgctctcgggagccct

SEQ ID NO: 49133 - DNA, 25 bp, Artificial Sequence
  Description of Artificial Sequence: Synthetic oligonucleotide
gctccgcagatacctggagaacggg

SEQ ID NO: 49134 - DNA, 26 bp, Artificial Sequence
  Description of Artificial Sequence: Synthetic oligonucleotide
ctccgcagatacctggagaacgggga

SEQ ID NO: 49135 - DNA, 27 bp, Artificial Sequence
  Description of Artificial Sequence: Synthetic oligonucleotide
tccgcagatacctggagaacggggaga

SEQ ID NO: 49136 - DNA, 27 bp, Artificial Sequence
  Description of Artificial Sequence: Synthetic oligonucleotide
ccgcagatacctggagaacggggagaa

SEQ ID NO: 49137 - DNA, 27 bp, Artificial Sequence
  Description of Artificial Sequence: Synthetic oligonucleotide
cgcagatacctggagaacggggagaag

SEQ ID NO: 49138 - DNA, 28 bp, Artificial Sequence
  Description of Artificial Sequence: Synthetic oligonucleotide
gcagatacctggagaacggggagaagac

SEQ ID NO: 49139 - DNA, 28 bp, Artificial Sequence
  Description of Artificial Sequence: Synthetic oligonucleotide
cagatacctggagaacggggagaagacg

SEQ ID NO: 49140 - DNA, 28 bp, Artificial Sequence
  Description of Artificial Sequence: Synthetic oligonucleotide
agatacctggagaacggggagaagacgc

SEQ ID NO: 49141 - DNA, 27 bp, Artificial Sequence
  Description of Artificial Sequence: Synthetic oligonucleotide
gatacctggagaacggggagaagacgc

SEQ ID NO: 49142 - DNA, 28 bp, Artificial Sequence
  Description of Artificial Sequence: Synthetic oligonucleotide
atacctggagaacggggagaagacgctg

SEQ ID NO: 49143 - DNA, 27 bp, Artificial Sequence
  Description of Artificial Sequence: Synthetic oligonucleotide
tacctggagaacggggagaagacgctg

SEQ ID NO: 49144 - DNA, 26 bp, Artificial Sequence
  Description of Artificial Sequence: Synthetic oligonucleotide
acctggagaacggggagaagacgctg

SEQ ID NO: 49145 - DNA, 25 bp, Artificial Sequence
  Description of Artificial Sequence: Synthetic oligonucleotide
cctggagaacggggagaagacgctg

SEQ ID NO: 49146 - DNA, 26 bp, Artificial Sequence
  Description of Artificial Sequence: Synthetic oligonucleotide
ctggagaacggggagaagacgctgca

SEQ ID NO: 49147 - DNA, 26 bp, Artificial Sequence
  Description of Artificial Sequence: Synthetic oligonucleotide
tggagaacggggagaagacgctgcag

SEQ ID NO: 49148 - DNA, 25 bp, Artificial Sequence
  Description of Artificial Sequence: Synthetic oligonucleotide
ggagaacggggagaagacgctgcag

SEQ ID NO: 49149 - DNA, 25 bp, Artificial Sequence
  Description of Artificial Sequence: Synthetic oligonucleotide
gagaacggggagaagacgctgcagc

SEQ ID NO: 49150 - DNA, 25 bp, Artificial Sequence
  Description of Artificial Sequence: Synthetic oligonucleotide
agaacggggagaagacgctgcagcg

SEQ ID NO: 49151 - DNA, 24 bp, Artificial Sequence
  Description of Artificial Sequence: Synthetic oligonucleotide
gaacggggagaagacgctgcagcg

SEQ ID NO: 49152 - DNA, 24 bp, Artificial Sequence
  Description of Artificial Sequence: Synthetic oligonucleotide
aacggggagaagacgctgcagcgc

SEQ ID NO: 49153 - DNA, 23 bp, Artificial Sequence
  Description of Artificial Sequence: Synthetic oligonucleotide
acggggagaagacgctgcagcgc

SEQ ID NO: 49154 - DNA, 22 bp, Artificial Sequence
  Description of Artificial Sequence: Synthetic oligonucleotide
cggggagaagacgctgcagcgc

SEQ ID NO: 49155 - DNA, 22 bp, Artificial Sequence
  Description of Artificial Sequence: Synthetic oligonucleotide
ggggagaagacgctgcagcgcg

SEQ ID NO: 49156 - DNA, 22 bp, Artificial Sequence
  Description of Artificial Sequence: Synthetic oligonucleotide
gggagaagacgctgcagcgcgc

SEQ ID NO: 49157 - DNA, 22 bp, Artificial Sequence
  Description of Artificial Sequence: Synthetic oligonucleotide
ggagaagacgctgcagcgcgcg

SEQ ID NO: 49158 - DNA, 24 bp, Artificial Sequence
  Description of Artificial Sequence: Synthetic oligonucleotide
gagaagacgctgcagcgcgcggaa

SEQ ID NO: 49159 - DNA, 32 bp, Artificial Sequence
  Description of Artificial Sequence: Synthetic oligonucleotide
tattgggaccgggagacacagaagtacaagtg

SEQ ID NO: 49160 - DNA, 31 bp, Artificial Sequence
  Description of Artificial Sequence: Synthetic oligonucleotide
attgggaccgggagacacagaagtacaagtg

SEQ ID NO: 49161 - DNA, 30 bp, Artificial Sequence
  Description of Artificial Sequence: Synthetic oligonucleotide
ttgggaccgggagacacagaagtacaagtg

SEQ ID NO: 49162 - DNA, 29 bp, Artificial Sequence
  Description of Artificial Sequence: Synthetic oligonucleotide
tgggaccgggagacacagaagtacaagtg

SEQ ID NO: 49163 - DNA, 28 bp, Artificial Sequence
  Description of Artificial Sequence: Synthetic oligonucleotide
gggaccgggagacacagaagtacaagtg

SEQ ID NO: 49164 - DNA, 28 bp, Artificial Sequence
  Description of Artificial Sequence: Synthetic oligonucleotide
ggaccgggagacacagaagtacaagtgc

SEQ ID NO: 49165 - DNA, 28 bp, Artificial Sequence
  Description of Artificial Sequence: Synthetic oligonucleotide
gaccgggagacacagaagtacaagtgcc

SEQ ID NO: 49166 - DNA, 29 bp, Artificial Sequence
  Description of Artificial Sequence: Synthetic oligonucleotide
accgggagacacagaagtacaagtgccag

SEQ ID NO: 49167 - DNA, 28 bp, Artificial Sequence
  Description of Artificial Sequence: Synthetic oligonucleotide
ccgggagacacagaagtacaagtgccag

SEQ ID NO: 49168 - DNA, 28 bp, Artificial Sequence
  Description of Artificial Sequence: Synthetic oligonucleotide
cgggagacacagaagtacaagtgccagg

SEQ ID NO: 49169 - DNA, 28 bp, Artificial Sequence
  Description of Artificial Sequence: Synthetic oligonucleotide
gggagacacagaagtacaagtgccaggc

SEQ ID NO: 49170 - DNA, 29 bp, Artificial Sequence
  Description of Artificial Sequence: Synthetic oligonucleotide
ggagacacagaagtacaagtgccaggcac

SEQ ID NO: 49171 - DNA, 30 bp, Artificial Sequence
  Description of Artificial Sequence: Synthetic oligonucleotide
gagacacagaagtacaagtgccaggcacag

SEQ ID NO: 49172 - DNA, 31 bp, Artificial Sequence
  Description of Artificial Sequence: Synthetic oligonucleotide
agacacagaagtacaagtgccaggcacagac

SEQ ID NO: 49173 - DNA, 30 bp, Artificial Sequence
  Description of Artificial Sequence: Synthetic oligonucleotide
gacacagaagtacaagtgccaggcacagac

SEQ ID NO: 49174 - DNA, 31 bp, Artificial Sequence
  Description of Artificial Sequence: Synthetic oligonucleotide
acacagaagtacaagtgccaggcacagactg

SEQ ID NO: 49175 - DNA, 30 bp, Artificial Sequence
  Description of Artificial Sequence: Synthetic oligonucleotide
cacagaagtacaagtgccaggcacagactg

SEQ ID NO: 49176 - DNA, 31 bp, Artificial Sequence
  Description of Artificial Sequence: Synthetic oligonucleotide
acagaagtacaagtgccaggcacagactgac

SEQ ID NO: 49177 - DNA, 30 bp, Artificial Sequence
  Description of Artificial Sequence: Synthetic oligonucleotide
cagaagtacaagtgccaggcacagactgac

SEQ ID NO: 49178 - DNA, 30 bp, Artificial Sequence
  Description of Artificial Sequence: Synthetic oligonucleotide
agaagtacaagtgccaggcacagactgacc

SEQ ID NO: 49179 - DNA, 29 bp, Artificial Sequence
  Description of Artificial Sequence: Synthetic oligonucleotide
gaagtacaagtgccaggcacagactgacc

SEQ ID NO: 49180 - DNA, 29 bp, Artificial Sequence
  Description of Artificial Sequence: Synthetic oligonucleotide
aagtacaagtgccaggcacagactgaccg

SEQ ID NO: 49181 - DNA, 28 bp, Artificial Sequence
  Description of Artificial Sequence: Synthetic oligonucleotide
agtacaagtgccaggcacagactgaccg

SEQ ID NO: 49182 - DNA, 27 bp, Artificial Sequence
  Description of Artificial Sequence: Synthetic oligonucleotide
gtacaagtgccaggcacagactgaccg

SEQ ID NO: 49183 - DNA, 28 bp, Artificial Sequence
  Description of Artificial Sequence: Synthetic oligonucleotide
tacaagtgccaggcacagactgaccgag

SEQ ID NO: 49184 - DNA, 27 bp, Artificial Sequence
  Description of Artificial Sequence: Synthetic oligonucleotide
acaagtgccaggcacagactgaccgag

SEQ ID NO: 49185 - DNA, 27 bp, Artificial Sequence
  Description of Artificial Sequence: Synthetic oligonucleotide
caagtgccaggcacagactgaccgagt

SEQ ID NO: 49186 - DNA, 27 bp, Artificial Sequence
  Description of Artificial Sequence: Synthetic oligonucleotide
aagtgccaggcacagactgaccgagtg

SEQ ID NO: 49187 - DNA, 27 bp, Artificial Sequence
  Description of Artificial Sequence: Synthetic oligonucleotide
agtgccaggcacagactgaccgagtga

SEQ ID NO: 49188 - DNA, 26 bp, Artificial Sequence
  Description of Artificial Sequence: Synthetic oligonucleotide
gtgccaggcacagactgaccgagtga

SEQ ID NO: 49189 - DNA, 26 bp, Artificial Sequence
  Description of Artificial Sequence: Synthetic oligonucleotide
tgccaggcacagactgaccgagtgag

SEQ ID NO: 49190 - DNA, 25 bp, Artificial Sequence
  Description of Artificial Sequence: Synthetic oligonucleotide
ggctacgtggacgacacgcagttcg

SEQ ID NO: 49191 - DNA, 25 bp, Artificial Sequence
  Description of Artificial Sequence: Synthetic oligonucleotide
gctacgtggacgacacgcagttcgc

SEQ ID NO: 49192 - DNA, 25 bp, Artificial Sequence
  Description of Artificial Sequence: Synthetic oligonucleotide
ctacgtggacgacacgcagttcgcg

SEQ ID NO: 49193 - DNA, 26 bp, Artificial Sequence
  Description of Artificial Sequence: Synthetic oligonucleotide
tacgtggacgacacgcagttcgcgca

SEQ ID NO: 49194 - DNA, 25 bp, Artificial Sequence
  Description of Artificial Sequence: Synthetic oligonucleotide
acgtggacgacacgcagttcgcgca

SEQ ID NO: 49195 - DNA, 24 bp, Artificial Sequence
  Description of Artificial Sequence: Synthetic oligonucleotide
cgtggacgacacgcagttcgcgca

SEQ ID NO: 49196 - DNA, 26 bp, Artificial Sequence
  Description of Artificial Sequence: Synthetic oligonucleotide
gtggacgacacgcagttcgcgcagtt

SEQ ID NO: 49197 - DNA, 26 bp, Artificial Sequence
  Description of Artificial Sequence: Synthetic oligonucleotide
tggacgacacgcagttcgcgcagttc

SEQ ID NO: 49198 - DNA, 25 bp, Artificial Sequence
  Description of Artificial Sequence: Synthetic oligonucleotide
ggacgacacgcagttcgcgcagttc

SEQ ID NO: 49199 - DNA, 26 bp, Artificial Sequence
  Description of Artificial Sequence: Synthetic oligonucleotide
gacgacacgcagttcgcgcagttcga

SEQ ID NO: 49200 - DNA, 27 bp, Artificial Sequence
  Description of Artificial Sequence: Synthetic oligonucleotide
acgacacgcagttcgcgcagttcgaca

SEQ ID NO: 49201 - DNA, 26 bp, Artificial Sequence
  Description of Artificial Sequence: Synthetic oligonucleotide
cgacacgcagttcgcgcagttcgaca

SEQ ID NO: 49202 - DNA, 26 bp, Artificial Sequence
  Description of Artificial Sequence: Synthetic oligonucleotide
gacacgcagttcgcgcagttcgacag

SEQ ID NO: 49203 - DNA, 26 bp, Artificial Sequence
  Description of Artificial Sequence: Synthetic oligonucleotide
acacgcagttcgcgcagttcgacagc

SEQ ID NO: 49204 - DNA, 25 bp, Artificial Sequence
  Description of Artificial Sequence: Synthetic oligonucleotide
cacgcagttcgcgcagttcgacagc

SEQ ID NO: 49205 - DNA, 26 bp, Artificial Sequence
  Description of Artificial Sequence: Synthetic oligonucleotide
acgcagttcgcgcagttcgacagcga

SEQ ID NO: 49206 - DNA, 25 bp, Artificial Sequence
  Description of Artificial Sequence: Synthetic oligonucleotide
cgcagttcgcgcagttcgacagcga

SEQ ID NO: 49207 - DNA, 25 bp, Artificial Sequence
  Description of Artificial Sequence: Synthetic oligonucleotide
gcagttcgcgcagttcgacagcgac

SEQ ID NO: 49208 - DNA, 25 bp, Artificial Sequence
  Description of Artificial Sequence: Synthetic oligonucleotide
cagttcgcgcagttcgacagcgacg

SEQ ID NO: 49209 - DNA, 25 bp, Artificial Sequence
  Description of Artificial Sequence: Synthetic oligonucleotide
agttcgcgcagttcgacagcgacgc

SEQ ID NO: 49210 - DNA, 24 bp, Artificial Sequence
  Description of Artificial Sequence: Synthetic oligonucleotide
gttcgcgcagttcgacagcgacgc

SEQ ID NO: 49211 - DNA, 24 bp, Artificial Sequence
  Description of Artificial Sequence: Synthetic oligonucleotide
ttcgcgcagttcgacagcgacgcc

SEQ ID NO: 49212 - DNA, 23 bp, Artificial Sequence
  Description of Artificial Sequence: Synthetic oligonucleotide
tcgcgcagttcgacagcgacgcc

SEQ ID NO: 49213 - DNA, 22 bp, Artificial Sequence
  Description of Artificial Sequence: Synthetic oligonucleotide
cgcgcagttcgacagcgacgcc

SEQ ID NO: 49214 - DNA, 22 bp, Artificial Sequence
  Description of Artificial Sequence: Synthetic oligonucleotide
gcgcagttcgacagcgacgccg

SEQ ID NO: 49215 - DNA, 22 bp, Artificial Sequence
  Description of Artificial Sequence: Synthetic oligonucleotide
cgcagttcgacagcgacgccgc

SEQ ID NO: 49216 - DNA, 29 bp, Artificial Sequence
  Description of Artificial Sequence: Synthetic oligonucleotide
caaagacacacgtgacccaccatcccatc

SEQ ID NO: 49217 - DNA, 30 bp, Artificial Sequence
  Description of Artificial Sequence: Synthetic oligonucleotide
aaagacacacgtgacccaccatcccatctc

SEQ ID NO: 49218 - DNA, 29 bp, Artificial Sequence
  Description of Artificial Sequence: Synthetic oligonucleotide
aagacacacgtgacccaccatcccatctc

SEQ ID NO: 49219 - DNA, 28 bp, Artificial Sequence
  Description of Artificial Sequence: Synthetic oligonucleotide
agacacacgtgacccaccatcccatctc

SEQ ID NO: 49220 - DNA, 27 bp, Artificial Sequence
  Description of Artificial Sequence: Synthetic oligonucleotide
gacacacgtgacccaccatcccatctc

SEQ ID NO: 49221 - DNA, 28 bp, Artificial Sequence
  Description of Artificial Sequence: Synthetic oligonucleotide
acacacgtgacccaccatcccatctctg

SEQ ID NO: 49222 - DNA, 27 bp, Artificial Sequence
  Description of Artificial Sequence: Synthetic oligonucleotide
cacacgtgacccaccatcccatctctg

SEQ ID NO: 49223 - DNA, 28 bp, Artificial Sequence
  Description of Artificial Sequence: Synthetic oligonucleotide
acacgtgacccaccatcccatctctgac

SEQ ID NO: 49224 - DNA, 27 bp, Artificial Sequence
  Description of Artificial Sequence: Synthetic oligonucleotide
cacgtgacccaccatcccatctctgac

SEQ ID NO: 49225 - DNA, 27 bp, Artificial Sequence
  Description of Artificial Sequence: Synthetic oligonucleotide
acgtgacccaccatcccatctctgacc

SEQ ID NO: 49226 - DNA, 27 bp, Artificial Sequence
  Description of Artificial Sequence: Synthetic oligonucleotide
cgtgacccaccatcccatctctgacca

SEQ ID NO: 49227 - DNA, 28 bp, Artificial Sequence
  Description of Artificial Sequence: Synthetic oligonucleotide
gtgacccaccatcccatctctgaccatg

SEQ ID NO: 49228 - DNA, 29 bp, Artificial Sequence
  Description of Artificial Sequence: Synthetic oligonucleotide
tgacccaccatcccatctctgaccatgag

SEQ ID NO: 49229 - DNA, 28 bp, Artificial Sequence
  Description of Artificial Sequence: Synthetic oligonucleotide
gacccaccatcccatctctgaccatgag

SEQ ID NO: 49230 - DNA, 28 bp, Artificial Sequence
  Description of Artificial Sequence: Synthetic oligonucleotide
acccaccatcccatctctgaccatgagg

SEQ ID NO: 49231 - DNA, 27 bp, Artificial Sequence
  Description of Artificial Sequence: Synthetic oligonucleotide
cccaccatcccatctctgaccatgagg

SEQ ID NO: 49232 - DNA, 27 bp, Artificial Sequence
  Description of Artificial Sequence: Synthetic oligonucleotide
ccaccatcccatctctgaccatgaggc

SEQ ID NO: 49233 - DNA, 27 bp, Artificial Sequence
  Description of Artificial Sequence: Synthetic oligonucleotide
caccatcccatctctgaccatgaggcc

SEQ ID NO: 49234 - DNA, 28 bp, Artificial Sequence
  Description of Artificial Sequence: Synthetic oligonucleotide
accatcccatctctgaccatgaggccac

SEQ ID NO: 49235 - DNA, 27 bp, Artificial Sequence
  Description of Artificial Sequence: Synthetic oligonucleotide
ccatcccatctctgaccatgaggccac

SEQ ID NO: 49236 - DNA, 27 bp, Artificial Sequence
  Description of Artificial Sequence: Synthetic oligonucleotide
catcccatctctgaccatgaggccacc

SEQ ID NO: 49237 - DNA, 27 bp, Artificial Sequence
  Description of Artificial Sequence: Synthetic oligonucleotide
atcccatctctgaccatgaggccaccc

SEQ ID NO: 49238 - DNA, 27 bp, Artificial Sequence
  Description of Artificial Sequence: Synthetic oligonucleotide
tcccatctctgaccatgaggccaccct

SEQ ID NO: 49239 - DNA, 27 bp, Artificial Sequence
  Description of Artificial Sequence: Synthetic oligonucleotide
gagctactctcaggctgcgtccagcaa

SEQ ID NO: 49240 - DNA, 27 bp, Artificial Sequence
  Description of Artificial Sequence: Synthetic oligonucleotide
agctactctcaggctgcgtccagcaac

SEQ ID NO: 49241 - DNA, 27 bp, Artificial Sequence
  Description of Artificial Sequence: Synthetic oligonucleotide
gctactctcaggctgcgtccagcaaca

SEQ ID NO: 49242 - DNA, 27 bp, Artificial Sequence
  Description of Artificial Sequence: Synthetic oligonucleotide
ctactctcaggctgcgtccagcaacag

SEQ ID NO: 49243 - DNA, 28 bp, Artificial Sequence
  Description of Artificial Sequence: Synthetic oligonucleotide
tactctcaggctgcgtccagcaacagtg

SEQ ID NO: 49244 - DNA, 27 bp, Artificial Sequence
  Description of Artificial Sequence: Synthetic oligonucleotide
actctcaggctgcgtccagcaacagtg

SEQ ID NO: 49245 - DNA, 26 bp, Artificial Sequence
  Description of Artificial Sequence: Synthetic oligonucleotide
gctccgcagatacctggagaacggga

SEQ ID NO: 49246 - DNA, 26 bp, Artificial Sequence
  Description of Artificial Sequence: Synthetic oligonucleotide
ctccgcagatacctggagaacgggag

SEQ ID NO: 49247 - DNA, 27 bp, Artificial Sequence
  Description of Artificial Sequence: Synthetic oligonucleotide
tccgcagatacctggagaacgggagga

SEQ ID NO: 49248 - DNA, 27 bp, Artificial Sequence
  Description of Artificial Sequence: Synthetic oligonucleotide
ccgcagatacctggagaacgggaggaa

SEQ ID NO: 49249 - DNA, 27 bp, Artificial Sequence
  Description of Artificial Sequence: Synthetic oligonucleotide
cgcagatacctggagaacgggaggaag

SEQ ID NO: 49250 - DNA, 28 bp, Artificial Sequence
  Description of Artificial Sequence: Synthetic oligonucleotide
gcagatacctggagaacgggaggaagac

SEQ ID NO: 49251 - DNA, 28 bp, Artificial Sequence
  Description of Artificial Sequence: Synthetic oligonucleotide
cagatacctggagaacgggaggaagacg

SEQ ID NO: 49252 - DNA, 28 bp, Artificial Sequence
  Description of Artificial Sequence: Synthetic oligonucleotide
agatacctggagaacgggaggaagacgc

SEQ ID NO: 49253 - DNA, 27 bp, Artificial Sequence
  Description of Artificial Sequence: Synthetic oligonucleotide
gatacctggagaacgggaggaagacgc

SEQ ID NO: 49254 - DNA, 28 bp, Artificial Sequence
  Description of Artificial Sequence: Synthetic oligonucleotide
atacctggagaacgggaggaagacgctg

SEQ ID NO: 49255 - DNA, 27 bp, Artificial Sequence
  Description of Artificial Sequence: Synthetic oligonucleotide
tacctggagaacgggaggaagacgctg

SEQ ID NO: 49256 - DNA, 26 bp, Artificial Sequence
  Description of Artificial Sequence: Synthetic oligonucleotide
acctggagaacgggaggaagacgctg

SEQ ID NO: 49257 - DNA, 25 bp, Artificial Sequence
  Description of Artificial Sequence: Synthetic oligonucleotide
cctggagaacgggaggaagacgctg

SEQ ID NO: 49258 - DNA, 26 bp, Artificial Sequence
  Description of Artificial Sequence: Synthetic oligonucleotide
ctggagaacgggaggaagacgctgca

SEQ ID NO: 49259 - DNA, 26 bp, Artificial Sequence
  Description of Artificial Sequence: Synthetic oligonucleotide
tggagaacgggaggaagacgctgcag

SEQ ID NO: 49260 - DNA, 25 bp, Artificial Sequence
  Description of Artificial Sequence: Synthetic oligonucleotide
ggagaacgggaggaagacgctgcag

SEQ ID NO: 49261 - DNA, 25 bp, Artificial Sequence
  Description of Artificial Sequence: Synthetic oligonucleotide
gagaacgggaggaagacgctgcagc

SEQ ID NO: 49262 - DNA, 25 bp, Artificial Sequence
  Description of Artificial Sequence: Synthetic oligonucleotide
agaacgggaggaagacgctgcagcg

SEQ ID NO: 49263 - DNA, 24 bp, Artificial Sequence
  Description of Artificial Sequence: Synthetic oligonucleotide
gaacgggaggaagacgctgcagcg

SEQ ID NO: 49264 - DNA, 24 bp, Artificial Sequence
  Description of Artificial Sequence: Synthetic oligonucleotide
aacgggaggaagacgctgcagcgc

SEQ ID NO: 49265 - DNA, 23 bp, Artificial Sequence
  Description of Artificial Sequence: Synthetic oligonucleotide
acgggaggaagacgctgcagcgc

SEQ ID NO: 49266 - DNA, 22 bp, Artificial Sequence
  Description of Artificial Sequence: Synthetic oligonucleotide
cgggaggaagacgctgcagcgc

SEQ ID NO: 49267 - DNA, 22 bp, Artificial Sequence
  Description of Artificial Sequence: Synthetic oligonucleotide
gggaggaagacgctgcagcgcg

SEQ ID NO: 49268 - DNA, 22 bp, Artificial Sequence
  Description of Artificial Sequence: Synthetic oligonucleotide
ggaggaagacgctgcagcgcgc

SEQ ID NO: 49269 - DNA, 22 bp, Artificial Sequence
  Description of Artificial Sequence: Synthetic oligonucleotide
gaggaagacgctgcagcgcgcg

SEQ ID NO: 49270 - DNA, 22 bp, Artificial Sequence
  Description of Artificial Sequence: Synthetic oligonucleotide
aggaagacgctgcagcgcgcgg

SEQ ID NO: 49271 - DNA, 28 bp, Artificial Sequence
  Description of Artificial Sequence: Synthetic oligonucleotide
ggatggcaaggaccaaactcaggacacc

SEQ ID NO: 49272 - DNA, 28 bp, Artificial Sequence
  Description of Artificial Sequence: Synthetic oligonucleotide
gatggcaaggaccaaactcaggacaccg

SEQ ID NO: 49273 - DNA, 29 bp, Artificial Sequence
  Description of Artificial Sequence: Synthetic oligonucleotide
atggcaaggaccaaactcaggacaccgag

SEQ ID NO: 49274 - DNA, 28 bp, Artificial Sequence
  Description of Artificial Sequence: Synthetic oligonucleotide
tggcaaggaccaaactcaggacaccgag

SEQ ID NO: 49275 - DNA, 27 bp, Artificial Sequence
  Description of Artificial Sequence: Synthetic oligonucleotide
ggcaaggaccaaactcaggacaccgag

SEQ ID NO: 49276 - DNA, 27 bp, Artificial Sequence
  Description of Artificial Sequence: Synthetic oligonucleotide
gcaaggaccaaactcaggacaccgagc

SEQ ID NO: 49277 - DNA, 29 bp, Artificial Sequence
  Description of Artificial Sequence: Synthetic oligonucleotide
caaggaccaaactcaggacaccgagcttg

SEQ ID NO: 49278 - DNA, 30 bp, Artificial Sequence
  Description of Artificial Sequence: Synthetic oligonucleotide
aaggaccaaactcaggacaccgagcttgtg

SEQ ID NO: 49279 - DNA, 33 bp, Artificial Sequence
  Description of Artificial Sequence: Synthetic oligonucleotide
tataaccagttcgcctacgacggcaaggattag

SEQ ID NO: 49280 - DNA, 32 bp, Artificial Sequence
  Description of Artificial Sequence: Synthetic oligonucleotide
ataaccagttcgcctacgacggcaaggattag

SEQ ID NO: 49281 - DNA, 31 bp, Artificial Sequence
  Description of Artificial Sequence: Synthetic oligonucleotide
taaccagttcgcctacgacggcaaggattag

SEQ ID NO: 49282 - DNA, 30 bp, Artificial Sequence
  Description of Artificial Sequence: Synthetic oligonucleotide
aaccagttcgcctacgacggcaaggattag

SEQ ID NO: 49283 - DNA, 29 bp, Artificial Sequence
  Description of Artificial Sequence: Synthetic oligonucleotide
accagttcgcctacgacggcaaggattag

SEQ ID NO: 49284 - DNA, 28 bp, Artificial Sequence
  Description of Artificial Sequence: Synthetic oligonucleotide
ccagttcgcctacgacggcaaggattag

SEQ ID NO: 49285 - DNA, 30 bp, Artificial Sequence
  Description of Artificial Sequence: Synthetic oligonucleotide
cagttcgcctacgacggcaaggattagatc

SEQ ID NO: 49286 - DNA, 30 bp, Artificial Sequence
  Description of Artificial Sequence: Synthetic oligonucleotide
agttcgcctacgacggcaaggattagatcg

SEQ ID NO: 49287 - DNA, 29 bp, Artificial Sequence
  Description of Artificial Sequence: Synthetic oligonucleotide
gttcgcctacgacggcaaggattagatcg

SEQ ID NO: 49288 - DNA, 29 bp, Artificial Sequence
  Description of Artificial Sequence: Synthetic oligonucleotide
ttcgcctacgacggcaaggattagatcgc

SEQ ID NO: 49289 - DNA, 28 bp, Artificial Sequence
  Description of Artificial Sequence: Synthetic oligonucleotide
tcgcctacgacggcaaggattagatcgc

SEQ ID NO: 49290 - DNA, 27 bp, Artificial Sequence
  Description of Artificial Sequence: Synthetic oligonucleotide
cgcctacgacggcaaggattagatcgc

SEQ ID NO: 49291 - DNA, 27 bp, Artificial Sequence
  Description of Artificial Sequence: Synthetic oligonucleotide
gcctacgacggcaaggattagatcgcc

SEQ ID NO: 49292 - DNA, 27 bp, Artificial Sequence
  Description of Artificial Sequence: Synthetic oligonucleotide
cctacgacggcaaggattagatcgccc

SEQ ID NO: 49293 - DNA, 28 bp, Artificial Sequence
  Description of Artificial Sequence: Synthetic oligonucleotide
ctacgacggcaaggattagatcgccctg

SEQ ID NO: 49294 - DNA, 31 bp, Artificial Sequence
  Description of Artificial Sequence: Synthetic oligonucleotide
tacgacggcaaggattagatcgccctgaatg

SEQ ID NO: 49295 - DNA, 30 bp, Artificial Sequence
  Description of Artificial Sequence: Synthetic oligonucleotide
acgacggcaaggattagatcgccctgaatg

SEQ ID NO: 49296 - DNA, 29 bp, Artificial Sequence
  Description of Artificial Sequence: Synthetic oligonucleotide
cgacggcaaggattagatcgccctgaatg

SEQ ID NO: 49297 - DNA, 30 bp, Artificial Sequence
  Description of Artificial Sequence: Synthetic oligonucleotide
gacggcaaggattagatcgccctgaatgag

SEQ ID NO: 49298 - DNA, 30 bp, Artificial Sequence
  Description of Artificial Sequence: Synthetic oligonucleotide
acggcaaggattagatcgccctgaatgagg

SEQ ID NO: 49299 - DNA, 29 bp, Artificial Sequence
  Description of Artificial Sequence: Synthetic oligonucleotide
cggcaaggattagatcgccctgaatgagg

SEQ ID NO: 49300 - DNA, 30 bp, Artificial Sequence
  Description of Artificial Sequence: Synthetic oligonucleotide
ggcaaggattagatcgccctgaatgaggac

SEQ ID NO: 49301 - DNA, 30 bp, Artificial Sequence
  Description of Artificial Sequence: Synthetic oligonucleotide
gcaaggattagatcgccctgaatgaggacc

SEQ ID NO: 49302 - DNA, 31 bp, Artificial Sequence
  Description of Artificial Sequence: Synthetic oligonucleotide
caaggattagatcgccctgaatgaggacctg

SEQ ID NO: 49303 - DNA, 31 bp, Artificial Sequence
  Description of Artificial Sequence: Synthetic oligonucleotide
aaggattagatcgccctgaatgaggacctgc

SEQ ID NO: 49304 - DNA, 30 bp, Artificial Sequence
  Description of Artificial Sequence: Synthetic oligonucleotide
aggattagatcgccctgaatgaggacctgc

SEQ ID NO: 49305 - DNA, 29 bp, Artificial Sequence
  Description of Artificial Sequence: Synthetic oligonucleotide
ggattagatcgccctgaatgaggacctgc

SEQ ID NO: 49306 - DNA, 29 bp, Artificial Sequence
  Description of Artificial Sequence: Synthetic oligonucleotide
gattagatcgccctgaatgaggacctgcg

SEQ ID NO: 49307 - DNA, 29 bp, Artificial Sequence
  Description of Artificial Sequence: Synthetic oligonucleotide
attagatcgccctgaatgaggacctgcgc

SEQ ID NO: 49308 - DNA, 28 bp, Artificial Sequence
  Description of Artificial Sequence: Synthetic oligonucleotide
ttagatcgccctgaatgaggacctgcgc

SEQ ID NO: 49309 - DNA, 27 bp, Artificial Sequence
  Description of Artificial Sequence: Synthetic oligonucleotide
tagatcgccctgaatgaggacctgcgc

SEQ ID NO: 49310 - DNA, 27 bp, Artificial Sequence
  Description of Artificial Sequence: Synthetic oligonucleotide
agatcgccctgaatgaggacctgcgct

SEQ ID NO: 49311 - DNA, 26 bp, Artificial Sequence
  Description of Artificial Sequence: Synthetic oligonucleotide
gatcgccctgaatgaggacctgcgct

SEQ ID NO: 49312 - DNA, 22 bp, Artificial Sequence
  Description of Artificial Sequence: Synthetic oligonucleotide
acccagcgcaagtgggaggcgc

SEQ ID NO: 49313 - DNA, 21 bp, Artificial Sequence
  Description of Artificial Sequence: Synthetic oligonucleotide
cccagcgcaagtgggaggcgc

SEQ ID NO: 49314 - DNA, 21 bp, Artificial Sequence
  Description of Artificial Sequence: Synthetic oligonucleotide
ccagcgcaagtgggaggcgcc

SEQ ID NO: 49315 - DNA, 21 bp, Artificial Sequence
  Description of Artificial Sequence: Synthetic oligonucleotide
cagcgcaagtgggaggcgccc

SEQ ID NO: 49316 - DNA, 21 bp, Artificial Sequence
  Description of Artificial Sequence: Synthetic oligonucleotide
agcgcaagtgggaggcgcccc

SEQ ID NO: 49317 - DNA, 20 bp, Artificial Sequence
  Description of Artificial Sequence: Synthetic oligonucleotide
gcgcaagtgggaggcgcccc

SEQ ID NO: 49318 - DNA, 21 bp, Artificial Sequence
  Description of Artificial Sequence: Synthetic oligonucleotide
cgcaagtgggaggcgccccgt

SEQ ID NO: 49319 - DNA, 22 bp, Artificial Sequence
  Description of Artificial Sequence: Synthetic oligonucleotide
gcaagtgggaggcgccccgtga

SEQ ID NO: 49320 - DNA, 22 bp, Artificial Sequence
  Description of Artificial Sequence: Synthetic oligonucleotide
caagtgggaggcgccccgtgag

SEQ ID NO: 49321 - DNA, 22 bp, Artificial Sequence
  Description of Artificial Sequence: Synthetic oligonucleotide
aagtgggaggcgccccgtgagg

SEQ ID NO: 49322 - DNA, 21 bp, Artificial Sequence
  Description of Artificial Sequence: Synthetic oligonucleotide
agtgggaggcgccccgtgagg

SEQ ID NO: 49323 - DNA, 20 bp, Artificial Sequence
  Description of Artificial Sequence: Synthetic oligonucleotide
gtgggaggcgccccgtgagg

SEQ ID NO: 49324 - DNA, 20 bp, Artificial Sequence
  Description of Artificial Sequence: Synthetic oligonucleotide
tgggaggcgccccgtgaggc

SEQ ID NO: 49325 - DNA, 20 bp, Artificial Sequence
  Description of Artificial Sequence: Synthetic oligonucleotide
gggaggcgccccgtgaggct

SEQ ID NO: 49326 - DNA, 20 bp, Artificial Sequence
  Description of Artificial Sequence: Synthetic oligonucleotide
ggaggcgccccgtgaggcgt

SEQ ID NO: 49327 - DNA, 20 bp, Artificial Sequence
  Description of Artificial Sequence: Synthetic oligonucleotide
gaggcgccccgtgaggcgga

SEQ ID NO: 49328 - DNA, 20 bp, Artificial Sequence
  Description of Artificial Sequence: Synthetic oligonucleotide
aggcgccccgtgaggcggag

SEQ ID NO: 49329 - DNA, 20 bp, Artificial Sequence
  Description of Artificial Sequence: Synthetic oligonucleotide
ggcgccccgtgaggcggagt

SEQ ID NO: 49330 - DNA, 20 bp, Artificial Sequence
  Description of Artificial Sequence: Synthetic oligonucleotide
gcgccccgtgaggcggagca

SEQ ID NO: 49331 - DNA, 20 bp, Artificial Sequence
  Description of Artificial Sequence: Synthetic oligonucleotide
cgccccgtgaggcggagcag

SEQ ID NO: 49332 - DNA, 20 bp, Artificial Sequence
  Description of Artificial Sequence: Synthetic oligonucleotide
gccccgtgaggcggagcagc

SEQ ID NO: 49333 - DNA, 20 bp, Artificial Sequence
  Description of Artificial Sequence: Synthetic oligonucleotide
ccccgtgaggcggagcagcg

SEQ ID NO: 49334 - DNA, 21 bp, Artificial Sequence
  Description of Artificial Sequence: Synthetic oligonucleotide
gctgcgacctggggcccgact

SEQ ID NO: 49335 - DNA, 21 bp, Artificial Sequence
  Description of Artificial Sequence: Synthetic oligonucleotide
ctgcgacctggggcccgactg

SEQ ID NO: 49336 - DNA, 21 bp, Artificial Sequence
  Description of Artificial Sequence: Synthetic oligonucleotide
tgcgacctggggcccgactgg

SEQ ID NO: 49337 - DNA, 20 bp, Artificial Sequence
  Description of Artificial Sequence: Synthetic oligonucleotide
gcgacctggggcccgactgg

SEQ ID NO: 49338 - DNA, 20 bp, Artificial Sequence
  Description of Artificial Sequence: Synthetic oligonucleotide
cgacctggggcccgactggc

SEQ ID NO: 49339 - DNA, 20 bp, Artificial Sequence
  Description of Artificial Sequence: Synthetic oligonucleotide
gacctggggcccgactggcg

SEQ ID NO: 49340 - DNA, 20 bp, Artificial Sequence
  Description of Artificial Sequence: Synthetic oligonucleotide
acctggggcccgactggcgc

SEQ ID NO: 49341 - DNA, 20 bp, Artificial Sequence
  Description of Artificial Sequence: Synthetic oligonucleotide
cctggggcccgactggcgct

SEQ ID NO: 49342 - DNA, 20 bp, Artificial Sequence
  Description of Artificial Sequence: Synthetic oligonucleotide
ctggggcccgactggcgcct

SEQ ID NO: 49343 - DNA, 20 bp, Artificial Sequence
  Description of Artificial Sequence: Synthetic oligonucleotide
tggggcccgactggcgcctc

SEQ ID NO: 49344 - DNA, 20 bp, Artificial Sequence
  Description of Artificial Sequence: Synthetic oligonucleotide
ggggcccgactggcgcctct

SEQ ID NO: 49345 - DNA, 20 bp, Artificial Sequence
  Description of Artificial Sequence: Synthetic oligonucleotide
gggcccgactggcgcctcct

SEQ ID NO: 49346 - DNA, 20 bp, Artificial Sequence
  Description of Artificial Sequence: Synthetic oligonucleotide
ggcccgactggcgcctcctc

SEQ ID NO: 49347 - DNA, 20 bp, Artificial Sequence
  Description of Artificial Sequence: Synthetic oligonucleotide
gcccgactggcgcctcctcc

SEQ ID NO: 49348 - DNA, 20 bp, Artificial Sequence
  Description of Artificial Sequence: Synthetic oligonucleotide
cccgactggcgcctcctccg

SEQ ID NO: 49349 - DNA, 20 bp, Artificial Sequence
  Description of Artificial Sequence: Synthetic oligonucleotide
ccgactggcgcctcctccgc

SEQ ID NO: 49350 - DNA, 20 bp, Artificial Sequence
  Description of Artificial Sequence: Synthetic oligonucleotide
cgactggcgcctcctccgcg

SEQ ID NO: 49351 - DNA, 20 bp, Artificial Sequence
  Description of Artificial Sequence: Synthetic oligonucleotide
gactggcgcctcctccgcgg

SEQ ID NO: 49352 - DNA, 25 bp, Artificial Sequence
  Description of Artificial Sequence: Synthetic oligonucleotide
actggcgcctcctccgcgggtataa

SEQ ID NO: 49353 - DNA, 24 bp, Artificial Sequence
  Description of Artificial Sequence: Synthetic oligonucleotide
ctggcgcctcctccgcgggtataa

SEQ ID NO: 49354 - DNA, 24 bp, Artificial Sequence
  Description of Artificial Sequence: Synthetic oligonucleotide
tggcgcctcctccgcgggtataac

SEQ ID NO: 49355 - DNA, 27 bp, Artificial Sequence
  Description of Artificial Sequence: Synthetic oligonucleotide
tacaaccagagcgaggccgggtctcaa

SEQ ID NO: 49356 - DNA, 27 bp, Artificial Sequence
  Description of Artificial Sequence: Synthetic oligonucleotide
acaaccagagcgaggccgggtctcaaa

SEQ ID NO: 49357 - DNA, 26 bp, Artificial Sequence
  Description of Artificial Sequence: Synthetic oligonucleotide
caaccagagcgaggccgggtctcaaa

SEQ ID NO: 49358 - DNA, 26 bp, Artificial Sequence
  Description of Artificial Sequence: Synthetic oligonucleotide
aaccagagcgaggccgggtctcaaac

SEQ ID NO: 49359 - DNA, 25 bp, Artificial Sequence
  Description of Artificial Sequence: Synthetic oligonucleotide
accagagcgaggccgggtctcaaac

SEQ ID NO: 49360 - DNA, 24 bp, Artificial Sequence
  Description of Artificial Sequence: Synthetic oligonucleotide
ccagagcgaggccgggtctcaaac

SEQ ID NO: 49361 - DNA, 24 bp, Artificial Sequence
  Description of Artificial Sequence: Synthetic oligonucleotide
cagagcgaggccgggtctcaaacc

SEQ ID NO: 49362 - DNA, 25 bp, Artificial Sequence
  Description of Artificial Sequence: Synthetic oligonucleotide
agagcgaggccgggtctcaaaccct

SEQ ID NO: 49363 - DNA, 24 bp, Artificial Sequence
  Description of Artificial Sequence: Synthetic oligonucleotide
gagcgaggccgggtctcaaaccct

SEQ ID NO: 49364 - DNA, 24 bp, Artificial Sequence
  Description of Artificial Sequence: Synthetic oligonucleotide
agcgaggccgggtctcaaaccctc

SEQ ID NO: 49365 - DNA, 23 bp, Artificial Sequence
  Description of Artificial Sequence: Synthetic oligonucleotide
gcgaggccgggtctcaaaccctc

SEQ ID NO: 49366 - DNA, 24 bp, Artificial Sequence
  Description of Artificial Sequence: Synthetic oligonucleotide
cgaggccgggtctcaaaccctcca

SEQ ID NO: 49367 - DNA, 25 bp, Artificial Sequence
  Description of Artificial Sequence: Synthetic oligonucleotide
gaggccgggtctcaaaccctccaga

SEQ ID NO: 49368 - DNA, 25 bp, Artificial Sequence
  Description of Artificial Sequence: Synthetic oligonucleotide
aggccgggtctcaaaccctccagag

SEQ ID NO: 49369 - DNA, 24 bp, Artificial Sequence
  Description of Artificial Sequence: Synthetic oligonucleotide
ggccgggtctcaaaccctccagag

SEQ ID NO: 49370 - DNA, 26 bp, Artificial Sequence
  Description of Artificial Sequence: Synthetic oligonucleotide
gccgggtctcaaaccctccagaggat

SEQ ID NO: 49371 - DNA, 27 bp, Artificial Sequence
  Description of Artificial Sequence: Synthetic oligonucleotide
ccgggtctcaaaccctccagaggatgt

SEQ ID NO: 49372 - DNA, 29 bp, Artificial Sequence
  Description of Artificial Sequence: Synthetic oligonucleotide
cgggtctcaaaccctccagaggatgtatg

SEQ ID NO: 49373 - DNA, 29 bp, Artificial Sequence
  Description of Artificial Sequence: Synthetic oligonucleotide
gggtctcaaaccctccagaggatgtatgg

SEQ ID NO: 49374 - DNA, 29 bp, Artificial Sequence
  Description of Artificial Sequence: Synthetic oligonucleotide
ggtctcaaaccctccagaggatgtatggc

SEQ ID NO: 49375 - DNA, 30 bp, Artificial Sequence
  Description of Artificial Sequence: Synthetic oligonucleotide
gtctcaaaccctccagaggatgtatggctg

SEQ ID NO: 49376 - DNA, 30 bp, Artificial Sequence
  Description of Artificial Sequence: Synthetic oligonucleotide
tctcaaaccctccagaggatgtatggctgc

SEQ ID NO: 49377 - DNA, 29 bp, Artificial Sequence
  Description of Artificial Sequence: Synthetic oligonucleotide
ctcaaaccctccagaggatgtatggctgc

SEQ ID NO: 49378 - DNA, 29 bp, Artificial Sequence
  Description of Artificial Sequence: Synthetic oligonucleotide
tcaaaccctccagaggatgtatggctgcg

SEQ ID NO: 49379 - DNA, 28 bp, Artificial Sequence
  Description of Artificial Sequence: Synthetic oligonucleotide
caaaccctccagaggatgtatggctgcg

SEQ ID NO: 49380 - DNA, 29 bp, Artificial Sequence
  Description of Artificial Sequence: Synthetic oligonucleotide
aaaccctccagaggatgtatggctgcgac

SEQ ID NO: 49381 - DNA, 28 bp, Artificial Sequence
  Description of Artificial Sequence: Synthetic oligonucleotide
aaccctccagaggatgtatggctgcgac

SEQ ID NO: 49382 - DNA, 21 bp, Artificial Sequence
  Description of Artificial Sequence: Synthetic oligonucleotide
gtggagcaggaggggccggag

SEQ ID NO: 49383 - DNA, 21 bp, Artificial Sequence
  Description of Artificial Sequence: Synthetic oligonucleotide
tggagcaggaggggccggagc

SEQ ID NO: 49384 - DNA, 20 bp, Artificial Sequence
  Description of Artificial Sequence: Synthetic oligonucleotide
ggagcaggaggggccggagc

SEQ ID NO: 49385 - DNA, 21 bp, Artificial Sequence
  Description of Artificial Sequence: Synthetic oligonucleotide
gagcaggaggggccggagcca

SEQ ID NO: 49386 - DNA, 25 bp, Artificial Sequence
  Description of Artificial Sequence: Synthetic oligonucleotide
agcaggaggggccggagccagtatt

SEQ ID NO: 49387 - DNA, 24 bp, Artificial Sequence
  Description of Artificial Sequence: Synthetic oligonucleotide
gcaggaggggccggagccagtatt

SEQ ID NO: 49388 - DNA, 24 bp, Artificial Sequence
  Description of Artificial Sequence: Synthetic oligonucleotide
caggaggggccggagccagtattg

SEQ ID NO: 49389 - DNA, 24 bp, Artificial Sequence
  Description of Artificial Sequence: Synthetic oligonucleotide
aggaggggccggagccagtattgg

SEQ ID NO: 49390 - DNA, 23 bp, Artificial Sequence
  Description of Artificial Sequence: Synthetic oligonucleotide
ggaggggccggagccagtattgg

SEQ ID NO: 49391 - DNA, 24 bp, Artificial Sequence
  Description of Artificial Sequence: Synthetic oligonucleotide
gaggggccggagccagtattggga

SEQ ID NO: 49392 - DNA, 24 bp, Artificial Sequence
  Description of Artificial Sequence: Synthetic oligonucleotide
aggggccggagccagtattgggac

SEQ ID NO: 49393 - DNA, 23 bp, Artificial Sequence
  Description of Artificial Sequence: Synthetic oligonucleotide
ggggccggagccagtattgggac

SEQ ID NO: 49394 - DNA, 23 bp, Artificial Sequence
  Description of Artificial Sequence: Synthetic oligonucleotide
gggccggagccagtattgggacc

SEQ ID NO: 49395 - DNA, 23 bp, Artificial Sequence
  Description of Artificial Sequence: Synthetic oligonucleotide
ggccggagccagtattgggaccg

SEQ ID NO: 49396 - DNA, 23 bp, Artificial Sequence
  Description of Artificial Sequence: Synthetic oligonucleotide
gccggagccagtattgggaccgg

SEQ ID NO: 49397 - DNA, 24 bp, Artificial Sequence
  Description of Artificial Sequence: Synthetic oligonucleotide
ccggagccagtattgggaccggga

SEQ ID NO: 49398 - DNA, 25 bp, Artificial Sequence
  Description of Artificial Sequence: Synthetic oligonucleotide
cggagccagtattgggaccgggaga

SEQ ID NO: 49399 - DNA, 26 bp, Artificial Sequence
  Description of Artificial Sequence: Synthetic oligonucleotide
ggagccagtattgggaccgggagaca

SEQ ID NO: 49400 - DNA, 27 bp, Artificial Sequence
  Description of Artificial Sequence: Synthetic oligonucleotide
gagccagtattgggaccgggagacaca

SEQ ID NO: 49401 - DNA, 27 bp, Artificial Sequence
  Description of Artificial Sequence: Synthetic oligonucleotide
agccagtattgggaccgggagacacag

SEQ ID NO: 49402 - DNA, 27 bp, Artificial Sequence
  Description of Artificial Sequence: Synthetic oligonucleotide
gccagtattgggaccgggagacacaga

SEQ ID NO: 49403 - DNA, 28 bp, Artificial Sequence
  Description of Artificial Sequence: Synthetic oligonucleotide
ccagtattgggaccgggagacacagaag

SEQ ID NO: 49404 - DNA, 26 bp, Artificial Sequence
  Description of Artificial Sequence: Synthetic oligonucleotide
gtgaggcggagcagtggagagcctat

SEQ ID NO: 49405 - DNA, 27 bp, Artificial Sequence
  Description of Artificial Sequence: Synthetic oligonucleotide
tgaggcggagcagtggagagcctatct

SEQ ID NO: 49406 - DNA, 26 bp, Artificial Sequence
  Description of Artificial Sequence: Synthetic oligonucleotide
gaggcggagcagtggagagcctatct

SEQ ID NO: 49407 - DNA, 26 bp, Artificial Sequence
  Description of Artificial Sequence: Synthetic oligonucleotide
aggcggagcagtggagagcctatctg

SEQ ID NO: 49408 - DNA, 25 bp, Artificial Sequence
  Description of Artificial Sequence: Synthetic oligonucleotide
ggcggagcagtggagagcctatctg

SEQ ID NO: 49409 - DNA, 26 bp, Artificial Sequence
  Description of Artificial Sequence: Synthetic oligonucleotide
gcggagcagtggagagcctatctgga

SEQ ID NO: 49410 - DNA, 26 bp, Artificial Sequence
  Description of Artificial Sequence: Synthetic oligonucleotide
cggagcagtggagagcctatctggag

SEQ ID NO: 49411 - DNA, 26 bp, Artificial Sequence
  Description of Artificial Sequence: Synthetic oligonucleotide
ggagcagtggagagcctatctggagg

SEQ ID NO: 49412 - DNA, 26 bp, Artificial Sequence
  Description of Artificial Sequence: Synthetic oligonucleotide
gagcagtggagagcctatctggaggg

SEQ ID NO: 49413 - DNA, 27 bp, Artificial Sequence
  Description of Artificial Sequence: Synthetic oligonucleotide
agcagtggagagcctatctggagggca

SEQ ID NO: 49414 - DNA, 26 bp, Artificial Sequence
  Description of Artificial Sequence: Synthetic oligonucleotide
gcagtggagagcctatctggagggca

SEQ ID NO: 49415 - DNA, 26 bp, Artificial Sequence
  Description of Artificial Sequence: Synthetic oligonucleotide
cagtggagagcctatctggagggcac

SEQ ID NO: 49416 - DNA, 27 bp, Artificial Sequence
  Description of Artificial Sequence: Synthetic oligonucleotide
agtggagagcctatctggagggcacgt

SEQ ID NO: 49417 - DNA, 26 bp, Artificial Sequence
  Description of Artificial Sequence: Synthetic oligonucleotide
gtggagagcctatctggagggcacgt

SEQ ID NO: 49418 - DNA, 26 bp, Artificial Sequence
  Description of Artificial Sequence: Synthetic oligonucleotide
tggagagcctatctggagggcacgtg

SEQ ID NO: 49419 - DNA, 25 bp, Artificial Sequence
  Description of Artificial Sequence: Synthetic oligonucleotide
ggagagcctatctggagggcacgtg

SEQ ID NO: 49420 - DNA, 25 bp, Artificial Sequence
  Description of Artificial Sequence: Synthetic oligonucleotide
gagagcctatctggagggcacgtgc

SEQ ID NO: 49421 - DNA, 26 bp, Artificial Sequence
  Description of Artificial Sequence: Synthetic oligonucleotide
agagcctatctggagggcacgtgcgt

SEQ ID NO: 49422 - DNA, 25 bp, Artificial Sequence
  Description of Artificial Sequence: Synthetic oligonucleotide
gagcctatctggagggcacgtgcgt

SEQ ID NO: 49423 - DNA, 25 bp, Artificial Sequence
  Description of Artificial Sequence: Synthetic oligonucleotide
agcctatctggagggcacgtgcgtg

SEQ ID NO: 49424 - DNA, 24 bp, Artificial Sequence
  Description of Artificial Sequence: Synthetic oligonucleotide
gcctatctggagggcacgtgcgtg

SEQ ID NO: 49425 - DNA, 25 bp, Artificial Sequence
  Description of Artificial Sequence: Synthetic oligonucleotide
cctatctggagggcacgtgcgtgga

SEQ ID NO: 49426 - DNA, 26 bp, Artificial Sequence
  Description of Artificial Sequence: Synthetic oligonucleotide
ctatctggagggcacgtgcgtggagt

SEQ ID NO: 49427 - DNA, 26 bp, Artificial Sequence
  Description of Artificial Sequence: Synthetic oligonucleotide
tatctggagggcacgtgcgtggagtg

SEQ ID NO: 49428 - DNA, 25 bp, Artificial Sequence
  Description of Artificial Sequence: Synthetic oligonucleotide
atctggagggcacgtgcgtggagtg

SEQ ID NO: 49429 - DNA, 24 bp, Artificial Sequence
  Description of Artificial Sequence: Synthetic oligonucleotide
tctggagggcacgtgcgtggagtg

SEQ ID NO: 49430 - DNA, 23 bp, Artificial Sequence
  Description of Artificial Sequence: Synthetic oligonucleotide
cgagtccaagaggggagccgcga

SEQ ID NO: 49431 - DNA, 23 bp, Artificial Sequence
  Description of Artificial Sequence: Synthetic oligonucleotide
gagtccaagaggggagccgcgag

SEQ ID NO: 49432 - DNA, 23 bp, Artificial Sequence
  Description of Artificial Sequence: Synthetic oligonucleotide
agtccaagaggggagccgcgagc

SEQ ID NO: 49433 - DNA, 22 bp, Artificial Sequence
  Description of Artificial Sequence: Synthetic oligonucleotide
gtccaagaggggagccgcgagc

SEQ ID NO: 49434 - DNA, 22 bp, Artificial Sequence
  Description of Artificial Sequence: Synthetic oligonucleotide
tccaagaggggagccgcgagcg

SEQ ID NO: 49435 - DNA, 21 bp, Artificial Sequence
  Description of Artificial Sequence: Synthetic oligonucleotide
ccaagaggggagccgcgagcg

SEQ ID NO: 49436 - DNA, 21 bp, Artificial Sequence
  Description of Artificial Sequence: Synthetic oligonucleotide
caagaggggagccgcgagcgc

SEQ ID NO: 49437 - DNA, 21 bp, Artificial Sequence
  Description of Artificial Sequence: Synthetic oligonucleotide
aagaggggagccgcgagcgcc

SEQ ID NO: 49438 - DNA, 30 bp, Artificial Sequence
  Description of Artificial Sequence: Synthetic oligonucleotide
cactccatgaggtatttctacaccgccgtc

SEQ ID NO: 49439 - DNA, 31 bp, Artificial Sequence
  Description of Artificial Sequence: Synthetic oligonucleotide
actccatgaggtatttctacaccgccgtctc

SEQ ID NO: 49440 - DNA, 30 bp, Artificial Sequence
  Description of Artificial Sequence: Synthetic oligonucleotide
ctccatgaggtatttctacaccgccgtctc

SEQ ID NO: 49441 - DNA, 30 bp, Artificial Sequence
  Description of Artificial Sequence: Synthetic oligonucleotide
tccatgaggtatttctacaccgccgtctcc

SEQ ID NO: 49442 - DNA, 29 bp, Artificial Sequence
  Description of Artificial Sequence: Synthetic oligonucleotide
ccatgaggtatttctacaccgccgtctcc

SEQ ID NO: 49443 - DNA, 29 bp, Artificial Sequence
  Description of Artificial Sequence: Synthetic oligonucleotide
catgaggtatttctacaccgccgtctccc

SEQ ID NO: 49444 - DNA, 29 bp, Artificial Sequence
  Description of Artificial Sequence: Synthetic oligonucleotide
atgaggtatttctacaccgccgtctcccg

SEQ ID NO: 49445 - DNA, 28 bp, Artificial Sequence
  Description of Artificial Sequence: Synthetic oligonucleotide
tgaggtatttctacaccgccgtctcccg

SEQ ID NO: 49446 - DNA, 27 bp, Artificial Sequence
  Description of Artificial Sequence: Synthetic oligonucleotide
gaggtatttctacaccgccgtctcccg

SEQ ID NO: 49447 - DNA, 27 bp, Artificial Sequence
  Description of Artificial Sequence: Synthetic oligonucleotide
aggtatttctacaccgccgtctcccgg

SEQ ID NO: 49448 - DNA, 26 bp, Artificial Sequence
  Description of Artificial Sequence: Synthetic oligonucleotide
ggtatttctacaccgccgtctcccgg

SEQ ID NO: 49449 - DNA, 26 bp, Artificial Sequence
  Description of Artificial Sequence: Synthetic oligonucleotide
gtatttctacaccgccgtctcccggc

SEQ ID NO: 49450 - DNA, 26 bp, Artificial Sequence
  Description of Artificial Sequence: Synthetic oligonucleotide
tatttctacaccgccgtctcccggcc

SEQ ID NO: 49451 - DNA, 25 bp, Artificial Sequence
  Description of Artificial Sequence: Synthetic oligonucleotide
atttctacaccgccgtctcccggcc

SEQ ID NO: 49452 - DNA, 24 bp, Artificial Sequence
  Description of Artificial Sequence: Synthetic oligonucleotide
tttctacaccgccgtctcccggcc

SEQ ID NO: 49453 - DNA, 23 bp, Artificial Sequence
  Description of Artificial Sequence: Synthetic oligonucleotide
ttctacaccgccgtctcccggcc

SEQ ID NO: 49454 - DNA, 22 bp, Artificial Sequence
  Description of Artificial Sequence: Synthetic oligonucleotide
tctacaccgccgtctcccggcc

SEQ ID NO: 49455 - DNA, 21 bp, Artificial Sequence
  Description of Artificial Sequence: Synthetic oligonucleotide
ctacaccgccgtctcccggcc

SEQ ID NO: 49456 - DNA, 21 bp, Artificial Sequence
  Description of Artificial Sequence: Synthetic oligonucleotide
tacaccgccgtctcccggccc

SEQ ID NO: 49457 - DNA, 26 bp, Artificial Sequence
  Description of Artificial Sequence: Synthetic oligonucleotide
agcctgcggaacctgcgcggctatta

SEQ ID NO: 49458 - DNA, 25 bp, Artificial Sequence
  Description of Artificial Sequence: Synthetic oligonucleotide
gcctgcggaacctgcgcggctatta

SEQ ID NO: 49459 - DNA, 27 bp, Artificial Sequence
  Description of Artificial Sequence: Synthetic oligonucleotide
cctgcggaacctgcgcggctattacaa

SEQ ID NO: 49460 - DNA, 27 bp, Artificial Sequence
  Description of Artificial Sequence: Synthetic oligonucleotide
ctgcggaacctgcgcggctattacaac

SEQ ID NO: 49461 - DNA, 27 bp, Artificial Sequence
  Description of Artificial Sequence: Synthetic oligonucleotide
tgcggaacctgcgcggctattacaacc

SEQ ID NO: 49462 - DNA, 27 bp, Artificial Sequence
  Description of Artificial Sequence: Synthetic oligonucleotide
gcggaacctgcgcggctattacaacca

SEQ ID NO: 49463 - DNA, 27 bp, Artificial Sequence
  Description of Artificial Sequence: Synthetic oligonucleotide
cggaacctgcgcggctattacaaccag

SEQ ID NO: 49464 - DNA, 28 bp, Artificial Sequence
  Description of Artificial Sequence: Synthetic oligonucleotide
ggaacctgcgcggctattacaaccagag

SEQ ID NO: 49465 - DNA, 28 bp, Artificial Sequence
  Description of Artificial Sequence: Synthetic oligonucleotide
gaacctgcgcggctattacaaccagagc

SEQ ID NO: 49466 - DNA, 28 bp, Artificial Sequence
  Description of Artificial Sequence: Synthetic oligonucleotide
aacctgcgcggctattacaaccagagcg

SEQ ID NO: 49467 - DNA, 27 bp, Artificial Sequence
  Description of Artificial Sequence: Synthetic oligonucleotide
acctgcgcggctattacaaccagagcg

SEQ ID NO: 49468 - DNA, 27 bp, Artificial Sequence
  Description of Artificial Sequence: Synthetic oligonucleotide
cctgcgcggctattacaaccagagcga

SEQ ID NO: 49469 - DNA, 27 bp, Artificial Sequence
  Description of Artificial Sequence: Synthetic oligonucleotide
ctgcgcggctattacaaccagagcgag

SEQ ID NO: 49470 - DNA, 27 bp, Artificial Sequence
  Description of Artificial Sequence: Synthetic oligonucleotide
tgcgcggctattacaaccagagcgagg

SEQ ID NO: 49471 - DNA, 26 bp, Artificial Sequence
  Description of Artificial Sequence: Synthetic oligonucleotide
gcgcggctattacaaccagagcgagg

SEQ ID NO: 49472 - DNA, 26 bp, Artificial Sequence
  Description of Artificial Sequence: Synthetic oligonucleotide
cgcggctattacaaccagagcgaggc

SEQ ID NO: 49473 - DNA, 26 bp, Artificial Sequence
  Description of Artificial Sequence: Synthetic oligonucleotide
gcggctattacaaccagagcgaggcc

SEQ ID NO: 49474 - DNA, 26 bp, Artificial Sequence
  Description of Artificial Sequence: Synthetic oligonucleotide
cggctattacaaccagagcgaggccg

SEQ ID NO: 49475 - DNA, 26 bp, Artificial Sequence
  Description of Artificial Sequence: Synthetic oligonucleotide
ggctattacaaccagagcgaggccgg

SEQ ID NO: 49476 - DNA, 27 bp, Artificial Sequence
  Description of Artificial Sequence: Synthetic oligonucleotide
gctattacaaccagagcgaggccgggt

SEQ ID NO: 49477 - DNA, 27 bp, Artificial Sequence
  Description of Artificial Sequence: Synthetic oligonucleotide
ctattacaaccagagcgaggccgggtc

SEQ ID NO: 49478 - DNA, 28 bp, Artificial Sequence
  Description of Artificial Sequence: Synthetic oligonucleotide
tattacaaccagagcgaggccgggtctc

SEQ ID NO: 49479 - DNA, 27 bp, Artificial Sequence
  Description of Artificial Sequence: Synthetic oligonucleotide
attacaaccagagcgaggccgggtctc

SEQ ID NO: 49480 - DNA, 27 bp, Artificial Sequence
  Description of Artificial Sequence: Synthetic oligonucleotide
ttacaaccagagcgaggccgggtctca

SEQ ID NO: 49481 - DNA, 22 bp, Artificial Sequence
  Description of Artificial Sequence: Synthetic oligonucleotide
gcggcccgtgaggcggagcaat

SEQ ID NO: 49482 - DNA, 22 bp, Artificial Sequence
  Description of Artificial Sequence: Synthetic oligonucleotide
cggcccgtgaggcggagcaatg

SEQ ID NO: 49483 - DNA, 23 bp, Artificial Sequence
  Description of Artificial Sequence: Synthetic oligonucleotide
ggcccgtgaggcggagcaatgga

SEQ ID NO: 49484 - DNA, 24 bp, Artificial Sequence
  Description of Artificial Sequence: Synthetic oligonucleotide
gcccgtgaggcggagcaatggaga

SEQ ID NO: 49485 - DNA, 24 bp, Artificial Sequence
  Description of Artificial Sequence: Synthetic oligonucleotide
cccgtgaggcggagcaatggagag

SEQ ID NO: 49486 - DNA, 24 bp, Artificial Sequence
  Description of Artificial Sequence: Synthetic oligonucleotide
ccgtgaggcggagcaatggagagc

SEQ ID NO: 49487 - DNA, 26 bp, Artificial Sequence
  Description of Artificial Sequence: Synthetic oligonucleotide
cgtgaggcggagcaatggagagccta

SEQ ID NO: 49488 - DNA, 26 bp, Artificial Sequence
  Description of Artificial Sequence: Synthetic oligonucleotide
gtgaggcggagcaatggagagcctac

SEQ ID NO: 49489 - DNA, 27 bp, Artificial Sequence
  Description of Artificial Sequence: Synthetic oligonucleotide
tgaggcggagcaatggagagcctacct

SEQ ID NO: 49490 - DNA, 26 bp, Artificial Sequence
  Description of Artificial Sequence: Synthetic oligonucleotide
gaggcggagcaatggagagcctacct

SEQ ID NO: 49491 - DNA, 26 bp, Artificial Sequence
  Description of Artificial Sequence: Synthetic oligonucleotide
aggcggagcaatggagagcctacctg

SEQ ID NO: 49492 - DNA, 25 bp, Artificial Sequence
  Description of Artificial Sequence: Synthetic oligonucleotide
ggcggagcaatggagagcctacctg

SEQ ID NO: 49493 - DNA, 26 bp, Artificial Sequence
  Description of Artificial Sequence: Synthetic oligonucleotide
gcggagcaatggagagcctacctgga

SEQ ID NO: 49494 - DNA, 26 bp, Artificial Sequence
  Description of Artificial Sequence: Synthetic oligonucleotide
cggagcaatggagagcctacctggag

SEQ ID NO: 49495 - DNA, 26 bp, Artificial Sequence
  Description of Artificial Sequence: Synthetic oligonucleotide
ggagcaatggagagcctacctggagg

SEQ ID NO: 49496 - DNA, 26 bp, Artificial Sequence
  Description of Artificial Sequence: Synthetic oligonucleotide
gagcaatggagagcctacctggaggg

SEQ ID NO: 49497 - DNA, 27 bp, Artificial Sequence
  Description of Artificial Sequence: Synthetic oligonucleotide
agcaatggagagcctacctggagggca

SEQ ID NO: 49498 - DNA, 26 bp, Artificial Sequence
  Description of Artificial Sequence: Synthetic oligonucleotide
gcaatggagagcctacctggagggca

SEQ ID NO: 49499 - DNA, 26 bp, Artificial Sequence
  Description of Artificial Sequence: Synthetic oligonucleotide
caatggagagcctacctggagggcac

SEQ ID NO: 49500 - DNA, 27 bp, Artificial Sequence
  Description of Artificial Sequence: Synthetic oligonucleotide
aatggagagcctacctggagggcacgt

SEQ ID NO: 49501 - DNA, 26 bp, Artificial Sequence
  Description of Artificial Sequence: Synthetic oligonucleotide
atggagagcctacctggagggcacgt

SEQ ID NO: 49502 - DNA, 25 bp, Artificial Sequence
  Description of Artificial Sequence: Synthetic oligonucleotide
tgaccatgaggccaccctgaggtgc

SEQ ID NO: 49503 - DNA, 23 bp, Artificial Sequence
  Description of Artificial Sequence: Synthetic oligonucleotide
gccaggcacaggctgaccgagtg

SEQ ID NO: 49504 - DNA, 23 bp, Artificial Sequence
  Description of Artificial Sequence: Synthetic oligonucleotide
ccaggcacaggctgaccgagtgg

SEQ ID NO: 49505 - DNA, 23 bp, Artificial Sequence
  Description of Artificial Sequence: Synthetic oligonucleotide
caggcacaggctgaccgagtggg

SEQ ID NO: 49506 - DNA, 23 bp, Artificial Sequence
  Description of Artificial Sequence: Synthetic oligonucleotide
aggcacaggctgaccgagtgggc

SEQ ID NO: 49507 - DNA, 22 bp, Artificial Sequence
  Description of Artificial Sequence: Synthetic oligonucleotide
ggcacaggctgaccgagtgggc

SEQ ID NO: 49508 - DNA, 23 bp, Artificial Sequence
  Description of Artificial Sequence: Synthetic oligonucleotide
gcacaggctgaccgagtgggcct

SEQ ID NO: 49509 - DNA, 23 bp, Artificial Sequence
  Description of Artificial Sequence: Synthetic oligonucleotide
cacaggctgaccgagtgggcctg

SEQ ID NO: 49510 - DNA, 23 bp, Artificial Sequence
  Description of Artificial Sequence: Synthetic oligonucleotide
acaggctgaccgagtgggcctgc

SEQ ID NO: 49511 - DNA, 22 bp, Artificial Sequence
  Description of Artificial Sequence: Synthetic oligonucleotide
caggctgaccgagtgggcctgc

SEQ ID NO: 49512 - DNA, 22 bp, Artificial Sequence
  Description of Artificial Sequence: Synthetic oligonucleotide
aggctgaccgagtgggcctgcg

SEQ ID NO: 49513 - DNA, 21 bp, Artificial Sequence
  Description of Artificial Sequence: Synthetic oligonucleotide
ggctgaccgagtgggcctgcg

SEQ ID NO: 49514 - DNA, 23 bp, Artificial Sequence
  Description of Artificial Sequence: Synthetic oligonucleotide
gctgaccgagtgggcctgcggaa

SEQ ID NO: 49515 - DNA, 27 bp, Artificial Sequence
  Description of Artificial Sequence: Synthetic oligonucleotide
gggtctcacaccctccagtggatgtct

SEQ ID NO: 49516 - DNA, 27 bp, Artificial Sequence
  Description of Artificial Sequence: Synthetic oligonucleotide
ggtctcacaccctccagtggatgtctg

SEQ ID NO: 49517 - DNA, 27 bp, Artificial Sequence
  Description of Artificial Sequence: Synthetic oligonucleotide
gtctcacaccctccagtggatgtctgg

SEQ ID NO: 49518 - DNA, 27 bp, Artificial Sequence
  Description of Artificial Sequence: Synthetic oligonucleotide
tctcacaccctccagtggatgtctggc

SEQ ID NO: 49519 - DNA, 27 bp, Artificial Sequence
  Description of Artificial Sequence: Synthetic oligonucleotide
ctcacaccctccagtggatgtctggct

SEQ ID NO: 49520 - DNA, 27 bp, Artificial Sequence
  Description of Artificial Sequence: Synthetic oligonucleotide
tcacaccctccagtggatgtctggctg

SEQ ID NO: 49521 - DNA, 26 bp, Artificial Sequence
  Description of Artificial Sequence: Synthetic oligonucleotide
cacaccctccagtggatgtctggctg

SEQ ID NO: 49522 - DNA, 26 bp, Artificial Sequence
  Description of Artificial Sequence: Synthetic oligonucleotide
acaccctccagtggatgtctggctgc

SEQ ID NO: 49523 - DNA, 25 bp, Artificial Sequence
  Description of Artificial Sequence: Synthetic oligonucleotide
caccctccagtggatgtctggctgc

SEQ ID NO: 49524 - DNA, 26 bp, Artificial Sequence
  Description of Artificial Sequence: Synthetic oligonucleotide
accctccagtggatgtctggctgcga

SEQ ID NO: 49525 - DNA, 25 bp, Artificial Sequence
  Description of Artificial Sequence: Synthetic oligonucleotide
ccctccagtggatgtctggctgcga

SEQ ID NO: 49526 - DNA, 25 bp, Artificial Sequence
  Description of Artificial Sequence: Synthetic oligonucleotide
cctccagtggatgtctggctgcgac

SEQ ID NO: 49527 - DNA, 26 bp, Artificial Sequence
  Description of Artificial Sequence: Synthetic oligonucleotide
ctccagtggatgtctggctgcgacct

SEQ ID NO: 49528 - DNA, 26 bp, Artificial Sequence
  Description of Artificial Sequence: Synthetic oligonucleotide
tccagtggatgtctggctgcgacctg

SEQ ID NO: 49529 - DNA, 25 bp, Artificial Sequence
  Description of Artificial Sequence: Synthetic oligonucleotide
ccagtggatgtctggctgcgacctg

SEQ ID NO: 49530 - DNA, 25 bp, Artificial Sequence
  Description of Artificial Sequence: Synthetic oligonucleotide
cagtggatgtctggctgcgacctgg

SEQ ID NO: 49531 - DNA, 25 bp, Artificial Sequence
  Description of Artificial Sequence: Synthetic oligonucleotide
agtggatgtctggctgcgacctggg

SEQ ID NO: 49532 - DNA, 24 bp, Artificial Sequence
  Description of Artificial Sequence: Synthetic oligonucleotide
gtggatgtctggctgcgacctggg

SEQ ID NO: 49533 - DNA, 24 bp, Artificial Sequence
  Description of Artificial Sequence: Synthetic oligonucleotide
tggatgtctggctgcgacctgggg

SEQ ID NO: 49534 - DNA, 27 bp, Artificial Sequence
  Description of Artificial Sequence: Synthetic oligonucleotide
ctgaacgaggacctgcgctcctggatt

SEQ ID NO: 49535 - DNA, 27 bp, Artificial Sequence
  Description of Artificial Sequence: Synthetic oligonucleotide
tgaacgaggacctgcgctcctggattg

SEQ ID NO: 49536 - DNA, 26 bp, Artificial Sequence
  Description of Artificial Sequence: Synthetic oligonucleotide
gaacgaggacctgcgctcctggattg

SEQ ID NO: 49537 - DNA, 26 bp, Artificial Sequence
  Description of Artificial Sequence: Synthetic oligonucleotide
aacgaggacctgcgctcctggattgc

SEQ ID NO: 49538 - DNA, 25 bp, Artificial Sequence
  Description of Artificial Sequence: Synthetic oligonucleotide
acgaggacctgcgctcctggattgc

SEQ ID NO: 49539 - DNA, 24 bp, Artificial Sequence
  Description of Artificial Sequence: Synthetic oligonucleotide
cgaggacctgcgctcctggattgc

SEQ ID NO: 49540 - DNA, 24 bp, Artificial Sequence
  Description of Artificial Sequence: Synthetic oligonucleotide
gaggacctgcgctcctggattgcc

SEQ ID NO: 49541 - DNA, 24 bp, Artificial Sequence
  Description of Artificial Sequence: Synthetic oligonucleotide
aggacctgcgctcctggattgccg

SEQ ID NO: 49542 - DNA, 23 bp, Artificial Sequence
  Description of Artificial Sequence: Synthetic oligonucleotide
ggacctgcgctcctggattgccg

SEQ ID NO: 49543 - DNA, 23 bp, Artificial Sequence
  Description of Artificial Sequence: Synthetic oligonucleotide
gacctgcgctcctggattgccgc

SEQ ID NO: 49544 - DNA, 23 bp, Artificial Sequence
  Description of Artificial Sequence: Synthetic oligonucleotide
acctgcgctcctggattgccgcg

SEQ ID NO: 49545 - DNA, 22 bp, Artificial Sequence
  Description of Artificial Sequence: Synthetic oligonucleotide
cctgcgctcctggattgccgcg

SEQ ID NO: 49546 - DNA, 23 bp, Artificial Sequence
  Description of Artificial Sequence: Synthetic oligonucleotide
ctgcgctcctggattgccgcgga

SEQ ID NO: 49547 - DNA, 24 bp, Artificial Sequence
  Description of Artificial Sequence: Synthetic oligonucleotide
tgcgctcctggattgccgcggaca

SEQ ID NO: 49548 - DNA, 23 bp, Artificial Sequence
  Description of Artificial Sequence: Synthetic oligonucleotide
gcgctcctggattgccgcggaca

SEQ ID NO: 49549 - DNA, 23 bp, Artificial Sequence
  Description of Artificial Sequence: Synthetic oligonucleotide
cgctcctggattgccgcggacac

SEQ ID NO: 49550 - DNA, 23 bp, Artificial Sequence
  Description of Artificial Sequence: Synthetic oligonucleotide
gctcctggattgccgcggacacg

SEQ ID NO: 49551 - DNA, 23 bp, Artificial Sequence
  Description of Artificial Sequence: Synthetic oligonucleotide
ctcctggattgccgcggacacgg

SEQ ID NO: 49552 - DNA, 23 bp, Artificial Sequence
  Description of Artificial Sequence: Synthetic oligonucleotide
tcctggattgccgcggacacggc

SEQ ID NO: 49553 - DNA, 22 bp, Artificial Sequence
  Description of Artificial Sequence: Synthetic oligonucleotide
cctggattgccgcggacacggc

SEQ ID NO: 49554 - DNA, 22 bp, Artificial Sequence
  Description of Artificial Sequence: Synthetic oligonucleotide
ctggattgccgcggacacggcg

SEQ ID NO: 49555 - DNA, 22 bp, Artificial Sequence
  Description of Artificial Sequence: Synthetic oligonucleotide
tggattgccgcggacacggcgg

SEQ ID NO: 49556 - DNA, 21 bp, Artificial Sequence
  Description of Artificial Sequence: Synthetic oligonucleotide
ggattgccgcggacacggcgg

SEQ ID NO: 49557 - DNA, 22 bp, Artificial Sequence
  Description of Artificial Sequence: Synthetic oligonucleotide
gattgccgcggacacggcggct

SEQ ID NO: 49558 - DNA, 23 bp, Artificial Sequence
  Description of Artificial Sequence: Synthetic oligonucleotide
attgccgcggacacggcggctca

SEQ ID NO: 49559 - DNA, 22 bp, Artificial Sequence
  Description of Artificial Sequence: Synthetic oligonucleotide
ttgccgcggacacggcggctca

SEQ ID NO: 49560 - DNA, 24 bp, Artificial Sequence
  Description of Artificial Sequence: Synthetic oligonucleotide
gccaggcacaggctgacggagtga

SEQ ID NO: 49561 - DNA, 24 bp, Artificial Sequence
  Description of Artificial Sequence: Synthetic oligonucleotide
ccaggcacaggctgacggagtgag

SEQ ID NO: 49562 - DNA, 24 bp, Artificial Sequence
  Description of Artificial Sequence: Synthetic oligonucleotide
caggcacaggctgacggagtgagc

SEQ ID NO: 49563 - DNA, 25 bp, Artificial Sequence
  Description of Artificial Sequence: Synthetic oligonucleotide
aggcacaggctgacggagtgagcct

SEQ ID NO: 49564 - DNA, 24 bp, Artificial Sequence
  Description of Artificial Sequence: Synthetic oligonucleotide
ggcacaggctgacggagtgagcct

SEQ ID NO: 49565 - DNA, 24 bp, Artificial Sequence
  Description of Artificial Sequence: Synthetic oligonucleotide
gcacaggctgacggagtgagcctg

SEQ ID NO: 49566 - DNA, 24 bp, Artificial Sequence
  Description of Artificial Sequence: Synthetic oligonucleotide
cacaggctgacggagtgagcctgc

SEQ ID NO: 49567 - DNA, 24 bp, Artificial Sequence
  Description of Artificial Sequence: Synthetic oligonucleotide
acaggctgacggagtgagcctgcg

SEQ ID NO: 49568 - DNA, 23 bp, Artificial Sequence
  Description of Artificial Sequence: Synthetic oligonucleotide
caggctgacggagtgagcctgcg

SEQ ID NO: 49569 - DNA, 25 bp, Artificial Sequence
  Description of Artificial Sequence: Synthetic oligonucleotide
aggctgacggagtgagcctgcggaa

SEQ ID NO: 49570 - DNA, 24 bp, Artificial Sequence
  Description of Artificial Sequence: Synthetic oligonucleotide
ggctgacggagtgagcctgcggaa

SEQ ID NO: 49571 - DNA, 24 bp, Artificial Sequence
  Description of Artificial Sequence: Synthetic oligonucleotide
gctgacggagtgagcctgcggaac

SEQ ID NO: 49572 - DNA, 23 bp, Artificial Sequence
  Description of Artificial Sequence: Synthetic oligonucleotide
tatggctgcgacctggggcccca

SEQ ID NO: 49573 - DNA, 22 bp, Artificial Sequence
  Description of Artificial Sequence: Synthetic oligonucleotide
atggctgcgacctggggcccca

SEQ ID NO: 49574 - DNA, 21 bp, Artificial Sequence
  Description of Artificial Sequence: Synthetic oligonucleotide
tggctgcgacctggggcccca

SEQ ID NO: 49575 - DNA, 20 bp, Artificial Sequence
  Description of Artificial Sequence: Synthetic oligonucleotide
ggctgcgacctggggcccca

SEQ ID NO: 49576 - DNA, 20 bp, Artificial Sequence
  Description of Artificial Sequence: Synthetic oligonucleotide
gctgcgacctggggccccac

SEQ ID NO: 49577 - DNA, 20 bp, Artificial Sequence
  Description of Artificial Sequence: Synthetic oligonucleotide
ctgcgacctggggccccacg

SEQ ID NO: 49578 - DNA, 20 bp, Artificial Sequence
  Description of Artificial Sequence: Synthetic oligonucleotide
tgcgacctggggccccacgg

SEQ ID NO: 49579 - DNA, 20 bp, Artificial Sequence
  Description of Artificial Sequence: Synthetic oligonucleotide
gcgacctggggccccacggt

SEQ ID NO: 49580 - DNA, 20 bp, Artificial Sequence
  Description of Artificial Sequence: Synthetic oligonucleotide
cgacctggggccccacgggt

SEQ ID NO: 49581 - DNA, 20 bp, Artificial Sequence
  Description of Artificial Sequence: Synthetic oligonucleotide
gacctggggccccacgggct

SEQ ID NO: 49582 - DNA, 20 bp, Artificial Sequence
  Description of Artificial Sequence: Synthetic oligonucleotide
acctggggccccacgggcgt

SEQ ID NO: 49583 - DNA, 20 bp, Artificial Sequence
  Description of Artificial Sequence: Synthetic oligonucleotide
cctggggccccacgggcgtt

SEQ ID NO: 49584 - DNA, 20 bp, Artificial Sequence
  Description of Artificial Sequence: Synthetic oligonucleotide
ctggggccccacgggcgctt

SEQ ID NO: 49585 - DNA, 20 bp, Artificial Sequence
  Description of Artificial Sequence: Synthetic oligonucleotide
tggggccccacgggcgcctt

SEQ ID NO: 49586 - DNA, 20 bp, Artificial Sequence
  Description of Artificial Sequence: Synthetic oligonucleotide
ggggccccacgggcgccttt

SEQ ID NO: 49587 - DNA, 20 bp, Artificial Sequence
  Description of Artificial Sequence: Synthetic oligonucleotide
gggccccacgggcgcctctt

SEQ ID NO: 49588 - DNA, 20 bp, Artificial Sequence
  Description of Artificial Sequence: Synthetic oligonucleotide
ggccccacgggcgcctcctt

SEQ ID NO: 49589 - DNA, 20 bp, Artificial Sequence
  Description of Artificial Sequence: Synthetic oligonucleotide
gccccacgggcgcctcctct

SEQ ID NO: 49590 - DNA, 20 bp, Artificial Sequence
  Description of Artificial Sequence: Synthetic oligonucleotide
ccccacgggcgcctcctcct

SEQ ID NO: 49591 - DNA, 20 bp, Artificial Sequence
  Description of Artificial Sequence: Synthetic oligonucleotide
cccacgggcgcctcctccgt

SEQ ID NO: 49592 - DNA, 20 bp, Artificial Sequence
  Description of Artificial Sequence: Synthetic oligonucleotide
ccacgggcgcctcctccgct

SEQ ID NO: 49593 - DNA, 20 bp, Artificial Sequence
  Description of Artificial Sequence: Synthetic oligonucleotide
cacgggcgcctcctccgcgt

SEQ ID NO: 49594 - DNA, 22 bp, Artificial Sequence
  Description of Artificial Sequence: Synthetic oligonucleotide
gcccgtgaggcggagcagtgca

SEQ ID NO: 49595 - DNA, 23 bp, Artificial Sequence
  Description of Artificial Sequence: Synthetic oligonucleotide
cccgtgaggcggagcagtgcaga

SEQ ID NO: 49596 - DNA, 23 bp, Artificial Sequence
  Description of Artificial Sequence: Synthetic oligonucleotide
ccgtgaggcggagcagtgcagag

SEQ ID NO: 49597 - DNA, 23 bp, Artificial Sequence
  Description of Artificial Sequence: Synthetic oligonucleotide
cgtgaggcggagcagtgcagagc

SEQ ID NO: 49598 - DNA, 25 bp, Artificial Sequence
  Description of Artificial Sequence: Synthetic oligonucleotide
gtgaggcggagcagtgcagagccta

SEQ ID NO: 49599 - DNA, 25 bp, Artificial Sequence
  Description of Artificial Sequence: Synthetic oligonucleotide
tgaggcggagcagtgcagagcctac

SEQ ID NO: 49600 - DNA, 24 bp, Artificial Sequence
  Description of Artificial Sequence: Synthetic oligonucleotide
gaggcggagcagtgcagagcctac

SEQ ID NO: 49601 - DNA, 25 bp, Artificial Sequence
  Description of Artificial Sequence: Synthetic oligonucleotide
aggcggagcagtgcagagcctacct

SEQ ID NO: 49602 - DNA, 24 bp, Artificial Sequence
  Description of Artificial Sequence: Synthetic oligonucleotide
ggcggagcagtgcagagcctacct

SEQ ID NO: 49603 - DNA, 24 bp, Artificial Sequence
  Description of Artificial Sequence: Synthetic oligonucleotide
gcggagcagtgcagagcctacctg

SEQ ID NO: 49604 - DNA, 25 bp, Artificial Sequence
  Description of Artificial Sequence: Synthetic oligonucleotide
cggagcagtgcagagcctacctgga

SEQ ID NO: 49605 - DNA, 25 bp, Artificial Sequence
  Description of Artificial Sequence: Synthetic oligonucleotide
ggagcagtgcagagcctacctggag

SEQ ID NO: 49606 - DNA, 25 bp, Artificial Sequence
  Description of Artificial Sequence: Synthetic oligonucleotide
gagcagtgcagagcctacctggagg

SEQ ID NO: 49607 - DNA, 25 bp, Artificial Sequence
  Description of Artificial Sequence: Synthetic oligonucleotide
agcagtgcagagcctacctggaggg

SEQ ID NO: 49608 - DNA, 24 bp, Artificial Sequence
  Description of Artificial Sequence: Synthetic oligonucleotide
gcagtgcagagcctacctggaggg

SEQ ID NO: 49609 - DNA, 25 bp, Artificial Sequence
  Description of Artificial Sequence: Synthetic oligonucleotide
cagtgcagagcctacctggagggca

SEQ ID NO: 49610 - DNA, 25 bp, Artificial Sequence
  Description of Artificial Sequence: Synthetic oligonucleotide
agtgcagagcctacctggagggcac

SEQ ID NO: 49611 - DNA, 24 bp, Artificial Sequence
  Description of Artificial Sequence: Synthetic oligonucleotide
gtgcagagcctacctggagggcac

SEQ ID NO: 49612 - DNA, 25 bp, Artificial Sequence
  Description of Artificial Sequence: Synthetic oligonucleotide
tgcagagcctacctggagggcacgt

SEQ ID NO: 49613 - DNA, 24 bp, Artificial Sequence
  Description of Artificial Sequence: Synthetic oligonucleotide
gcagagcctacctggagggcacgt

SEQ ID NO: 49614 - DNA, 22 bp, Artificial Sequence
  Description of Artificial Sequence: Synthetic oligonucleotide
cggagcgaggccgggtctcaca

SEQ ID NO: 49615 - DNA, 22 bp, Artificial Sequence
  Description of Artificial Sequence: Synthetic oligonucleotide
ggagcgaggccgggtctcacac

SEQ ID NO: 49616 - DNA, 27 bp, Artificial Sequence
  Description of Artificial Sequence: Synthetic oligonucleotide
acacgtgacccaccatcccgtctctca

SEQ ID NO: 49617 - DNA, 26 bp, Artificial Sequence
  Description of Artificial Sequence: Synthetic oligonucleotide
cacgtgacccaccatcccgtctctca

SEQ ID NO: 49618 - DNA, 26 bp, Artificial Sequence
  Description of Artificial Sequence: Synthetic oligonucleotide
acgtgacccaccatcccgtctctcac

SEQ ID NO: 49619 - DNA, 25 bp, Artificial Sequence
  Description of Artificial Sequence: Synthetic oligonucleotide
cgtgacccaccatcccgtctctcac

SEQ ID NO: 49620 - DNA, 27 bp, Artificial Sequence
  Description of Artificial Sequence: Synthetic oligonucleotide
gtgacccaccatcccgtctctcaccat

SEQ ID NO: 49621 - DNA, 27 bp, Artificial Sequence
  Description of Artificial Sequence: Synthetic oligonucleotide
tgacccaccatcccgtctctcaccatg

SEQ ID NO: 49622 - DNA, 27 bp, Artificial Sequence
  Description of Artificial Sequence: Synthetic oligonucleotide
gacccaccatcccgtctctcaccatga

SEQ ID NO: 49623 - DNA, 27 bp, Artificial Sequence
  Description of Artificial Sequence: Synthetic oligonucleotide
acccaccatcccgtctctcaccatgag

SEQ ID NO: 49624 - DNA, 26 bp, Artificial Sequence
  Description of Artificial Sequence: Synthetic oligonucleotide
cccaccatcccgtctctcaccatgag

SEQ ID NO: 49625 - DNA, 26 bp, Artificial Sequence
  Description of Artificial Sequence: Synthetic oligonucleotide
ccaccatcccgtctctcaccatgagg

SEQ ID NO: 49626 - DNA, 26 bp, Artificial Sequence
  Description of Artificial Sequence: Synthetic oligonucleotide
caccatcccgtctctcaccatgaggc

SEQ ID NO: 49627 - DNA, 27 bp, Artificial Sequence
  Description of Artificial Sequence: Synthetic oligonucleotide
accatcccgtctctcaccatgaggcca

SEQ ID NO: 49628 - DNA, 26 bp, Artificial Sequence
  Description of Artificial Sequence: Synthetic oligonucleotide
ccatcccgtctctcaccatgaggcca

SEQ ID NO: 49629 - DNA, 26 bp, Artificial Sequence
  Description of Artificial Sequence: Synthetic oligonucleotide
catcccgtctctcaccatgaggccac

SEQ ID NO: 49630 - DNA, 26 bp, Artificial Sequence
  Description of Artificial Sequence: Synthetic oligonucleotide
atcccgtctctcaccatgaggccacc

SEQ ID NO: 49631 - DNA, 25 bp, Artificial Sequence
  Description of Artificial Sequence: Synthetic oligonucleotide
tcccgtctctcaccatgaggccacc

SEQ ID NO: 49632 - DNA, 24 bp, Artificial Sequence
  Description of Artificial Sequence: Synthetic oligonucleotide
cccgtctctcaccatgaggccacc

SEQ ID NO: 49633 - DNA, 25 bp, Artificial Sequence
  Description of Artificial Sequence: Synthetic oligonucleotide
ccgtctctcaccatgaggccaccct

SEQ ID NO: 49634 - DNA, 26 bp, Artificial Sequence
  Description of Artificial Sequence: Synthetic oligonucleotide
cgtctctcaccatgaggccaccctga

SEQ ID NO: 49635 - DNA, 26 bp, Artificial Sequence
  Description of Artificial Sequence: Synthetic oligonucleotide
gtctctcaccatgaggccaccctgag

SEQ ID NO: 49636 - DNA, 27 bp, Artificial Sequence
  Description of Artificial Sequence: Synthetic oligonucleotide
tctctcaccatgaggccaccctgaggt

SEQ ID NO: 49637 - DNA, 26 bp, Artificial Sequence
  Description of Artificial Sequence: Synthetic oligonucleotide
ctctcaccatgaggccaccctgaggt

SEQ ID NO: 49638 - DNA, 26 bp, Artificial Sequence
  Description of Artificial Sequence: Synthetic oligonucleotide
tctcaccatgaggccaccctgaggtg

SEQ ID NO: 49639 - DNA, 25 bp, Artificial Sequence
  Description of Artificial Sequence: Synthetic oligonucleotide
ctcaccatgaggccaccctgaggtg

SEQ ID NO: 49640 - DNA, 26 bp, Artificial Sequence
  Description of Artificial Sequence: Synthetic oligonucleotide
tcaccatgaggccaccctgaggtgct

SEQ ID NO: 49641 - DNA, 25 bp, Artificial Sequence
  Description of Artificial Sequence: Synthetic oligonucleotide
caccatgaggccaccctgaggtgct

SEQ ID NO: 49642 - DNA, 28 bp, Artificial Sequence
  Description of Artificial Sequence: Synthetic oligonucleotide
ggagtattgggacccggagacacagaag

SEQ ID NO: 49643 - DNA, 30 bp, Artificial Sequence
  Description of Artificial Sequence: Synthetic oligonucleotide
gagtattgggacccggagacacagaagtac

SEQ ID NO: 49644 - DNA, 32 bp, Artificial Sequence
  Description of Artificial Sequence: Synthetic oligonucleotide
agtattgggacccggagacacagaagtacaag

SEQ ID NO: 49645 - DNA, 31 bp, Artificial Sequence
  Description of Artificial Sequence: Synthetic oligonucleotide
gtattgggacccggagacacagaagtacaag

SEQ ID NO: 49646 - DNA, 31 bp, Artificial Sequence
  Description of Artificial Sequence: Synthetic oligonucleotide
tattgggacccggagacacagaagtacaagc

SEQ ID NO: 49647 - DNA, 30 bp, Artificial Sequence
  Description of Artificial Sequence: Synthetic oligonucleotide
attgggacccggagacacagaagtacaagc

SEQ ID NO: 49648 - DNA, 29 bp, Artificial Sequence
  Description of Artificial Sequence: Synthetic oligonucleotide
ttgggacccggagacacagaagtacaagc

SEQ ID NO: 49649 - DNA, 28 bp, Artificial Sequence
  Description of Artificial Sequence: Synthetic oligonucleotide
tgggacccggagacacagaagtacaagc

SEQ ID NO: 49650 - DNA, 27 bp, Artificial Sequence
  Description of Artificial Sequence: Synthetic oligonucleotide
gggacccggagacacagaagtacaagc

SEQ ID NO: 49651 - DNA, 27 bp, Artificial Sequence
  Description of Artificial Sequence: Synthetic oligonucleotide
ggacccggagacacagaagtacaagcg

SEQ ID NO: 49652 - DNA, 27 bp, Artificial Sequence
  Description of Artificial Sequence: Synthetic oligonucleotide
gacccggagacacagaagtacaagcgc

SEQ ID NO: 49653 - DNA, 27 bp, Artificial Sequence
  Description of Artificial Sequence: Synthetic oligonucleotide
acccggagacacagaagtacaagcgcc

SEQ ID NO: 49654 - DNA, 27 bp, Artificial Sequence
  Description of Artificial Sequence: Synthetic oligonucleotide
cccggagacacagaagtacaagcgcca

SEQ ID NO: 49655 - DNA, 27 bp, Artificial Sequence
  Description of Artificial Sequence: Synthetic oligonucleotide
ccggagacacagaagtacaagcgccag

SEQ ID NO: 49656 - DNA, 27 bp, Artificial Sequence
  Description of Artificial Sequence: Synthetic oligonucleotide
cggagacacagaagtacaagcgccagg

SEQ ID NO: 49657 - DNA, 26 bp, Artificial Sequence
  Description of Artificial Sequence: Synthetic oligonucleotide
aacgaggacctgcgctcctggactgt

SEQ ID NO: 49658 - DNA, 25 bp, Artificial Sequence
  Description of Artificial Sequence: Synthetic oligonucleotide
acgaggacctgcgctcctggactgt

SEQ ID NO: 49659 - DNA, 24 bp, Artificial Sequence
  Description of Artificial Sequence: Synthetic oligonucleotide
cgaggacctgcgctcctggactgt

SEQ ID NO: 49660 - DNA, 24 bp, Artificial Sequence
  Description of Artificial Sequence: Synthetic oligonucleotide
gaggacctgcgctcctggactgtc

SEQ ID NO: 49661 - DNA, 24 bp, Artificial Sequence
  Description of Artificial Sequence: Synthetic oligonucleotide
aggacctgcgctcctggactgtcg

SEQ ID NO: 49662 - DNA, 23 bp, Artificial Sequence
  Description of Artificial Sequence: Synthetic oligonucleotide
ggacctgcgctcctggactgtcg

SEQ ID NO: 49663 - DNA, 23 bp, Artificial Sequence
  Description of Artificial Sequence: Synthetic oligonucleotide
gacctgcgctcctggactgtcgc

SEQ ID NO: 49664 - DNA, 23 bp, Artificial Sequence
  Description of Artificial Sequence: Synthetic oligonucleotide
acctgcgctcctggactgtcgcg

SEQ ID NO: 49665 - DNA, 22 bp, Artificial Sequence
  Description of Artificial Sequence: Synthetic oligonucleotide
cctgcgctcctggactgtcgcg

SEQ ID NO: 49666 - DNA, 23 bp, Artificial Sequence
  Description of Artificial Sequence: Synthetic oligonucleotide
ctgcgctcctggactgtcgcgga

SEQ ID NO: 49667 - DNA, 24 bp, Artificial Sequence
  Description of Artificial Sequence: Synthetic oligonucleotide
tgcgctcctggactgtcgcggaca

SEQ ID NO: 49668 - DNA, 23 bp, Artificial Sequence
  Description of Artificial Sequence: Synthetic oligonucleotide
gcgctcctggactgtcgcggaca

SEQ ID NO: 49669 - DNA, 23 bp, Artificial Sequence
  Description of Artificial Sequence: Synthetic oligonucleotide
cgctcctggactgtcgcggacac

SEQ ID NO: 49670 - DNA, 23 bp, Artificial Sequence
  Description of Artificial Sequence: Synthetic oligonucleotide
gctcctggactgtcgcggacacg

SEQ ID NO: 49671 - DNA, 23 bp, Artificial Sequence
  Description of Artificial Sequence: Synthetic oligonucleotide
ctcctggactgtcgcggacacgg

SEQ ID NO: 49672 - DNA, 23 bp, Artificial Sequence
  Description of Artificial Sequence: Synthetic oligonucleotide
tcctggactgtcgcggacacggc

SEQ ID NO: 49673 - DNA, 22 bp, Artificial Sequence
  Description of Artificial Sequence: Synthetic oligonucleotide
cctggactgtcgcggacacggc

SEQ ID NO: 49674 - DNA, 22 bp, Artificial Sequence
  Description of Artificial Sequence: Synthetic oligonucleotide
ctggactgtcgcggacacggcg

SEQ ID NO: 49675 - DNA, 22 bp, Artificial Sequence
  Description of Artificial Sequence: Synthetic oligonucleotide
tggactgtcgcggacacggcgg

SEQ ID NO: 49676 - DNA, 21 bp, Artificial Sequence
  Description of Artificial Sequence: Synthetic oligonucleotide
ggactgtcgcggacacggcgg

SEQ ID NO: 49677 - DNA, 22 bp, Artificial Sequence
  Description of Artificial Sequence: Synthetic oligonucleotide
gactgtcgcggacacggcggct

SEQ ID NO: 49678 - DNA, 23 bp, Artificial Sequence
  Description of Artificial Sequence: Synthetic oligonucleotide
actgtcgcggacacggcggctca

SEQ ID NO: 49679 - DNA, 22 bp, Artificial Sequence
  Description of Artificial Sequence: Synthetic oligonucleotide
ctgtcgcggacacggcggctca

SEQ ID NO: 49680 - DNA, 24 bp, Artificial Sequence
  Description of Artificial Sequence: Synthetic oligonucleotide
tgtcgcggacacggcggctcagat

SEQ ID NO: 49681 - DNA, 24 bp, Artificial Sequence
  Description of Artificial Sequence: Synthetic oligonucleotide
acaggctgaccgagtgagcctgcc

SEQ ID NO: 49682 - DNA, 23 bp, Artificial Sequence
  Description of Artificial Sequence: Synthetic oligonucleotide
caggctgaccgagtgagcctgcc

SEQ ID NO: 49683 - DNA, 25 bp, Artificial Sequence
  Description of Artificial Sequence: Synthetic oligonucleotide
aggctgaccgagtgagcctgccgaa

SEQ ID NO: 49684 - DNA, 24 bp, Artificial Sequence
  Description of Artificial Sequence: Synthetic oligonucleotide
ggctgaccgagtgagcctgccgaa

SEQ ID NO: 49685 - DNA, 24 bp, Artificial Sequence
  Description of Artificial Sequence: Synthetic oligonucleotide
gctgaccgagtgagcctgccgaac

SEQ ID NO: 49686 - DNA, 25 bp, Artificial Sequence
  Description of Artificial Sequence: Synthetic oligonucleotide
ctgaccgagtgagcctgccgaacct

SEQ ID NO: 49687 - DNA, 25 bp, Artificial Sequence
  Description of Artificial Sequence: Synthetic oligonucleotide
tgaccgagtgagcctgccgaacctg

SEQ ID NO: 49688 - DNA, 24 bp, Artificial Sequence
  Description of Artificial Sequence: Synthetic oligonucleotide
gaccgagtgagcctgccgaacctg

SEQ ID NO: 49689 - DNA, 24 bp, Artificial Sequence
  Description of Artificial Sequence: Synthetic oligonucleotide
accgagtgagcctgccgaacctgc

SEQ ID NO: 49690 - DNA, 23 bp, Artificial Sequence
  Description of Artificial Sequence: Synthetic oligonucleotide
ccgagtgagcctgccgaacctgc

SEQ ID NO: 49691 - DNA, 23 bp, Artificial Sequence
  Description of Artificial Sequence: Synthetic oligonucleotide
cgagtgagcctgccgaacctgcg

SEQ ID NO: 49692 - DNA, 23 bp, Artificial Sequence
  Description of Artificial Sequence: Synthetic oligonucleotide
gagtgagcctgccgaacctgcgc

SEQ ID NO: 49693 - DNA, 23 bp, Artificial Sequence
  Description of Artificial Sequence: Synthetic oligonucleotide
agtgagcctgccgaacctgcgcg

SEQ ID NO: 49694 - DNA, 22 bp, Artificial Sequence
  Description of Artificial Sequence: Synthetic oligonucleotide
gtgagcctgccgaacctgcgcg

SEQ ID NO: 49695 - DNA, 22 bp, Artificial Sequence
  Description of Artificial Sequence: Synthetic oligonucleotide
tgagcctgccgaacctgcgcgg

SEQ ID NO: 49696 - DNA, 21 bp, Artificial Sequence
  Description of Artificial Sequence: Synthetic oligonucleotide
gagcctgccgaacctgcgcgg

SEQ ID NO: 49697 - DNA, 23 bp, Artificial Sequence
  Description of Artificial Sequence: Synthetic oligonucleotide
agcctgccgaacctgcgcggcta

SEQ ID NO: 49698 - DNA, 22 bp, Artificial Sequence
  Description of Artificial Sequence: Synthetic oligonucleotide
gcctgccgaacctgcgcggcta

SEQ ID NO: 49699 - DNA, 24 bp, Artificial Sequence
  Description of Artificial Sequence: Synthetic oligonucleotide
cctgccgaacctgcgcggctacta

SEQ ID NO: 49700 - DNA, 26 bp, Artificial Sequence
  Description of Artificial Sequence: Synthetic oligonucleotide
ctgccgaacctgcgcggctactacaa

SEQ ID NO: 49701 - DNA, 26 bp, Artificial Sequence
  Description of Artificial Sequence: Synthetic oligonucleotide
tgccgaacctgcgcggctactacaac

SEQ ID NO: 49702 - DNA, 25 bp, Artificial Sequence
  Description of Artificial Sequence: Synthetic oligonucleotide
gccgaacctgcgcggctactacaac

SEQ ID NO: 49703 - DNA, 26 bp, Artificial Sequence
  Description of Artificial Sequence: Synthetic oligonucleotide
ccgaacctgcgcggctactacaacca

SEQ ID NO: 49704 - DNA, 27 bp, Artificial Sequence
  Description of Artificial Sequence: Synthetic oligonucleotide
cgaacctgcgcggctactacaaccaga

SEQ ID NO: 49705 - DNA, 25 bp, Artificial Sequence
  Description of Artificial Sequence: Synthetic oligonucleotide
tgcgtggagtggctccgcagatacc

SEQ ID NO: 49706 - DNA, 24 bp, Artificial Sequence
  Description of Artificial Sequence: Synthetic oligonucleotide
gcgtggagtggctccgcagatacc

SEQ ID NO: 49707 - DNA, 24 bp, Artificial Sequence
  Description of Artificial Sequence: Synthetic oligonucleotide
cgtggagtggctccgcagataccg

SEQ ID NO: 49708 - DNA, 24 bp, Artificial Sequence
  Description of Artificial Sequence: Synthetic oligonucleotide
gtggagtggctccgcagataccgg

SEQ ID NO: 49709 - DNA, 25 bp, Artificial Sequence
  Description of Artificial Sequence: Synthetic oligonucleotide
tggagtggctccgcagataccggga

SEQ ID NO: 49710 - DNA, 24 bp, Artificial Sequence
  Description of Artificial Sequence: Synthetic oligonucleotide
ggagtggctccgcagataccggga

SEQ ID NO: 49711 - DNA, 26 bp, Artificial Sequence
  Description of Artificial Sequence: Synthetic oligonucleotide
gagtggctccgcagataccgggagaa

SEQ ID NO: 49712 - DNA, 26 bp, Artificial Sequence
  Description of Artificial Sequence: Synthetic oligonucleotide
agtggctccgcagataccgggagaac

SEQ ID NO: 49713 - DNA, 25 bp, Artificial Sequence
  Description of Artificial Sequence: Synthetic oligonucleotide
gtggctccgcagataccgggagaac

SEQ ID NO: 49714 - DNA, 25 bp, Artificial Sequence
  Description of Artificial Sequence: Synthetic oligonucleotide
tggctccgcagataccgggagaacg

SEQ ID NO: 49715 - DNA, 22 bp, Artificial Sequence
  Description of Artificial Sequence: Synthetic oligonucleotide
tggactgccgcggacacggcgt

SEQ ID NO: 49716 - DNA, 21 bp, Artificial Sequence
  Description of Artificial Sequence: Synthetic oligonucleotide
ggactgccgcggacacggcgt

SEQ ID NO: 49717 - DNA, 22 bp, Artificial Sequence
  Description of Artificial Sequence: Synthetic oligonucleotide
gactgccgcggacacggcgtct

SEQ ID NO: 49718 - DNA, 23 bp, Artificial Sequence
  Description of Artificial Sequence: Synthetic oligonucleotide
actgccgcggacacggcgtctca

SEQ ID NO: 49719 - DNA, 22 bp, Artificial Sequence
  Description of Artificial Sequence: Synthetic oligonucleotide
ctgccgcggacacggcgtctca

SEQ ID NO: 49720 - DNA, 24 bp, Artificial Sequence
  Description of Artificial Sequence: Synthetic oligonucleotide
tgccgcggacacggcgtctcagat

SEQ ID NO: 49721 - DNA, 27 bp, Artificial Sequence
  Description of Artificial Sequence: Synthetic oligonucleotide
tactacaaccagagcgaggccgggtgt

SEQ ID NO: 49722 - DNA, 26 bp, Artificial Sequence
  Description of Artificial Sequence: Synthetic oligonucleotide
actacaaccagagcgaggccgggtgt

SEQ ID NO: 49723 - DNA, 25 bp, Artificial Sequence
  Description of Artificial Sequence: Synthetic oligonucleotide
ctacaaccagagcgaggccgggtgt

SEQ ID NO: 49724 - DNA, 26 bp, Artificial Sequence
  Description of Artificial Sequence: Synthetic oligonucleotide
tacaaccagagcgaggccgggtgtca

SEQ ID NO: 49725 - DNA, 25 bp, Artificial Sequence
  Description of Artificial Sequence: Synthetic oligonucleotide
acaaccagagcgaggccgggtgtca

SEQ ID NO: 49726 - DNA, 24 bp, Artificial Sequence
  Description of Artificial Sequence: Synthetic oligonucleotide
caaccagagcgaggccgggtgtca

SEQ ID NO: 49727 - DNA, 25 bp, Artificial Sequence
  Description of Artificial Sequence: Synthetic oligonucleotide
aaccagagcgaggccgggtgtcaca

SEQ ID NO: 49728 - DNA, 24 bp, Artificial Sequence
  Description of Artificial Sequence: Synthetic oligonucleotide
accagagcgaggccgggtgtcaca

SEQ ID NO: 49729 - DNA, 23 bp, Artificial Sequence
  Description of Artificial Sequence: Synthetic oligonucleotide
ccagagcgaggccgggtgtcaca

SEQ ID NO: 49730 - DNA, 23 bp, Artificial Sequence
  Description of Artificial Sequence: Synthetic oligonucleotide
cagagcgaggccgggtgtcacac

SEQ ID NO: 49731 - DNA, 23 bp, Artificial Sequence
  Description of Artificial Sequence: Synthetic oligonucleotide
agagcgaggccgggtgtcacacc

SEQ ID NO: 49732 - DNA, 22 bp, Artificial Sequence
  Description of Artificial Sequence: Synthetic oligonucleotide
gagcgaggccgggtgtcacacc

SEQ ID NO: 49733 - DNA, 23 bp, Artificial Sequence
  Description of Artificial Sequence: Synthetic oligonucleotide
agcgaggccgggtgtcacaccct

SEQ ID NO: 49734 - DNA, 22 bp, Artificial Sequence
  Description of Artificial Sequence: Synthetic oligonucleotide
gcgaggccgggtgtcacaccct

SEQ ID NO: 49735 - DNA, 22 bp, Artificial Sequence
  Description of Artificial Sequence: Synthetic oligonucleotide
cgaggccgggtgtcacaccctc

SEQ ID NO: 49736 - DNA, 23 bp, Artificial Sequence
  Description of Artificial Sequence: Synthetic oligonucleotide
gaggccgggtgtcacaccctcca

SEQ ID NO: 49737 - DNA, 24 bp, Artificial Sequence
  Description of Artificial Sequence: Synthetic oligonucleotide
aggccgggtgtcacaccctccagt

SEQ ID NO: 49738 - DNA, 23 bp, Artificial Sequence
  Description of Artificial Sequence: Synthetic oligonucleotide
ggccgggtgtcacaccctccagt

SEQ ID NO: 49739 - DNA, 23 bp, Artificial Sequence
  Description of Artificial Sequence: Synthetic oligonucleotide
gccgggtgtcacaccctccagtg

SEQ ID NO: 49740 - DNA, 25 bp, Artificial Sequence
  Description of Artificial Sequence: Synthetic oligonucleotide
ccgggtgtcacaccctccagtggat

SEQ ID NO: 49741 - DNA, 27 bp, Artificial Sequence
  Description of Artificial Sequence: Synthetic oligonucleotide
cgggtgtcacaccctccagtggatgta

SEQ ID NO: 49742 - DNA, 28 bp, Artificial Sequence
  Description of Artificial Sequence: Synthetic oligonucleotide
gggtgtcacaccctccagtggatgtatg

SEQ ID NO: 49743 - DNA, 28 bp, Artificial Sequence
  Description of Artificial Sequence: Synthetic oligonucleotide
ggtgtcacaccctccagtggatgtatgg

SEQ ID NO: 49744 - DNA, 28 bp, Artificial Sequence
  Description of Artificial Sequence: Synthetic oligonucleotide
gtgtcacaccctccagtggatgtatggc

SEQ ID NO: 49745 - DNA, 29 bp, Artificial Sequence
  Description of Artificial Sequence: Synthetic oligonucleotide
tgtcacaccctccagtggatgtatggctg

SEQ ID NO: 49746 - DNA, 28 bp, Artificial Sequence
  Description of Artificial Sequence: Synthetic oligonucleotide
gtcacaccctccagtggatgtatggctg

SEQ ID NO: 49747 - DNA, 23 bp, Artificial Sequence
  Description of Artificial Sequence: Synthetic oligonucleotide
cctgcggaacctgcgcggctact

SEQ ID NO: 49748 - DNA, 23 bp, Artificial Sequence
  Description of Artificial Sequence: Synthetic oligonucleotide
ctgcggaacctgcgcggctactg

SEQ ID NO: 49749 - DNA, 25 bp, Artificial Sequence
  Description of Artificial Sequence: Synthetic oligonucleotide
tgcggaacctgcgcggctactgcaa

SEQ ID NO: 49750 - DNA, 24 bp, Artificial Sequence
  Description of Artificial Sequence: Synthetic oligonucleotide
gcggaacctgcgcggctactgcaa

SEQ ID NO: 49751 - DNA, 24 bp, Artificial Sequence
  Description of Artificial Sequence: Synthetic oligonucleotide
cggaacctgcgcggctactgcaac

SEQ ID NO: 49752 - DNA, 25 bp, Artificial Sequence
  Description of Artificial Sequence: Synthetic oligonucleotide
ggaacctgcgcggctactgcaacca

SEQ ID NO: 49753 - DNA, 26 bp, Artificial Sequence
  Description of Artificial Sequence: Synthetic oligonucleotide
gaacctgcgcggctactgcaaccaga

SEQ ID NO: 49754 - DNA, 26 bp, Artificial Sequence
  Description of Artificial Sequence: Synthetic oligonucleotide
aacctgcgcggctactgcaaccagag

SEQ ID NO: 49755 - DNA, 25 bp, Artificial Sequence
  Description of Artificial Sequence: Synthetic oligonucleotide
acctgcgcggctactgcaaccagag

SEQ ID NO: 49756 - DNA, 24 bp, Artificial Sequence
  Description of Artificial Sequence: Synthetic oligonucleotide
cctgcgcggctactgcaaccagag

SEQ ID NO: 49757 - DNA, 24 bp, Artificial Sequence
  Description of Artificial Sequence: Synthetic oligonucleotide
ctgcgcggctactgcaaccagagc

SEQ ID NO: 49758 - DNA, 25 bp, Artificial Sequence
  Description of Artificial Sequence: Synthetic oligonucleotide
tgcgcggctactgcaaccagagcga

SEQ ID NO: 49759 - DNA, 24 bp, Artificial Sequence
  Description of Artificial Sequence: Synthetic oligonucleotide
gcgcggctactgcaaccagagcga

SEQ ID NO: 49760 - DNA, 24 bp, Artificial Sequence
  Description of Artificial Sequence: Synthetic oligonucleotide
cgcggctactgcaaccagagcgag

SEQ ID NO: 49761 - DNA, 24 bp, Artificial Sequence
  Description of Artificial Sequence: Synthetic oligonucleotide
gcggctactgcaaccagagcgagg

SEQ ID NO: 49762 - DNA, 24 bp, Artificial Sequence
  Description of Artificial Sequence: Synthetic oligonucleotide
cggctactgcaaccagagcgaggc

SEQ ID NO: 49763 - DNA, 24 bp, Artificial Sequence
  Description of Artificial Sequence: Synthetic oligonucleotide
ggctactgcaaccagagcgaggcc

SEQ ID NO: 49764 - DNA, 24 bp, Artificial Sequence
  Description of Artificial Sequence: Synthetic oligonucleotide
gctactgcaaccagagcgaggccg

SEQ ID NO: 49765 - DNA, 24 bp, Artificial Sequence
  Description of Artificial Sequence: Synthetic oligonucleotide
ctactgcaaccagagcgaggccgg

SEQ ID NO: 49766 - DNA, 25 bp, Artificial Sequence
  Description of Artificial Sequence: Synthetic oligonucleotide
tactgcaaccagagcgaggccgggt

SEQ ID NO: 49767 - DNA, 24 bp, Artificial Sequence
  Description of Artificial Sequence: Synthetic oligonucleotide
actgcaaccagagcgaggccgggt

SEQ ID NO: 49768 - DNA, 23 bp, Artificial Sequence
  Description of Artificial Sequence: Synthetic oligonucleotide
ctgcaaccagagcgaggccgggt

SEQ ID NO: 49769 - DNA, 24 bp, Artificial Sequence
  Description of Artificial Sequence: Synthetic oligonucleotide
tgcaaccagagcgaggccgggtct

SEQ ID NO: 49770 - DNA, 23 bp, Artificial Sequence
  Description of Artificial Sequence: Synthetic oligonucleotide
gcaaccagagcgaggccgggtct

SEQ ID NO: 49771 - DNA, 20 bp, Artificial Sequence
  Description of Artificial Sequence: Synthetic oligonucleotide
ccggcccggccgcggacatt

SEQ ID NO: 49772 - DNA, 20 bp, Artificial Sequence
  Description of Artificial Sequence: Synthetic oligonucleotide
cggcccggccgcggacagtt

SEQ ID NO: 49773 - DNA, 20 bp, Artificial Sequence
  Description of Artificial Sequence: Synthetic oligonucleotide
ggcccggccgcggacagctt

SEQ ID NO: 49774 - DNA, 20 bp, Artificial Sequence
  Description of Artificial Sequence: Synthetic oligonucleotide
gcccggccgcggacagcctt

SEQ ID NO: 49775 - DNA, 20 bp, Artificial Sequence
  Description of Artificial Sequence: Synthetic oligonucleotide
cccggccgcggacagccctt

SEQ ID NO: 49776 - DNA, 20 bp, Artificial Sequence
  Description of Artificial Sequence: Synthetic oligonucleotide
ccggccgcggacagcccctt

SEQ ID NO: 49777 - DNA, 20 bp, Artificial Sequence
  Description of Artificial Sequence: Synthetic oligonucleotide
cggccgcggacagccccgtt

SEQ ID NO: 49778 - DNA, 20 bp, Artificial Sequence
  Description of Artificial Sequence: Synthetic oligonucleotide
ggccgcggacagccccgctt

SEQ ID NO: 49779 - DNA, 22 bp, Artificial Sequence
  Description of Artificial Sequence: Synthetic oligonucleotide
gccgcggacagccccgcttcat

SEQ ID NO: 49780 - DNA, 22 bp, Artificial Sequence
  Description of Artificial Sequence: Synthetic oligonucleotide
ccgcggacagccccgcttcatc

SEQ ID NO: 49781 - DNA, 22 bp, Artificial Sequence
  Description of Artificial Sequence: Synthetic oligonucleotide
cgcggacagccccgcttcatcg

SEQ ID NO: 49782 - DNA, 23 bp, Artificial Sequence
  Description of Artificial Sequence: Synthetic oligonucleotide
gcggacagccccgcttcatcgca

SEQ ID NO: 49783 - DNA, 24 bp, Artificial Sequence
  Description of Artificial Sequence: Synthetic oligonucleotide
cggacagccccgcttcatcgcagt

SEQ ID NO: 49784 - DNA, 24 bp, Artificial Sequence
  Description of Artificial Sequence: Synthetic oligonucleotide
ggacagccccgcttcatcgcagtg

SEQ ID NO: 49785 - DNA, 24 bp, Artificial Sequence
  Description of Artificial Sequence: Synthetic oligonucleotide
gacagccccgcttcatcgcagtgg

SEQ ID NO: 49786 - DNA, 24 bp, Artificial Sequence
  Description of Artificial Sequence: Synthetic oligonucleotide
acagccccgcttcatcgcagtggg

SEQ ID NO: 49787 - DNA, 27 bp, Artificial Sequence
  Description of Artificial Sequence: Synthetic oligonucleotide
ctgaaagaggacctgcgctcctggact

SEQ ID NO: 49788 - DNA, 27 bp, Artificial Sequence
  Description of Artificial Sequence: Synthetic oligonucleotide
tgaaagaggacctgcgctcctggactg

SEQ ID NO: 49789 - DNA, 26 bp, Artificial Sequence
  Description of Artificial Sequence: Synthetic oligonucleotide
gaaagaggacctgcgctcctggactg

SEQ ID NO: 49790 - DNA, 26 bp, Artificial Sequence
  Description of Artificial Sequence: Synthetic oligonucleotide
aaagaggacctgcgctcctggactgc

SEQ ID NO: 49791 - DNA, 25 bp, Artificial Sequence
  Description of Artificial Sequence: Synthetic oligonucleotide
aagaggacctgcgctcctggactgc

SEQ ID NO: 49792 - DNA, 24 bp, Artificial Sequence
  Description of Artificial Sequence: Synthetic oligonucleotide
agaggacctgcgctcctggactgc

SEQ ID NO: 49793 - DNA, 26 bp, Artificial Sequence
  Description of Artificial Sequence: Synthetic oligonucleotide
tggagcaggaggggccggagtattga

SEQ ID NO: 49794 - DNA, 25 bp, Artificial Sequence
  Description of Artificial Sequence: Synthetic oligonucleotide
ggagcaggaggggccggagtattga

SEQ ID NO: 49795 - DNA, 24 bp, Artificial Sequence
  Description of Artificial Sequence: Synthetic oligonucleotide
gaggggccggagtattgagaccgg

SEQ ID NO: 49796 - DNA, 25 bp, Artificial Sequence
  Description of Artificial Sequence: Synthetic oligonucleotide
aggggccggagtattgagaccggga

SEQ ID NO: 49797 - DNA, 24 bp, Artificial Sequence
  Description of Artificial Sequence: Synthetic oligonucleotide
ggggccggagtattgagaccggga

SEQ ID NO: 49798 - DNA, 25 bp, Artificial Sequence
  Description of Artificial Sequence: Synthetic oligonucleotide
gggccggagtattgagaccgggaga

SEQ ID NO: 49799 - DNA, 26 bp, Artificial Sequence
  Description of Artificial Sequence: Synthetic oligonucleotide
ggccggagtattgagaccgggagaca

SEQ ID NO: 49800 - DNA, 27 bp, Artificial Sequence
  Description of Artificial Sequence: Synthetic oligonucleotide
gccggagtattgagaccgggagacaca

SEQ ID NO: 49801 - DNA, 27 bp, Artificial Sequence
  Description of Artificial Sequence: Synthetic oligonucleotide
ccggagtattgagaccgggagacacag

SEQ ID NO: 49802 - DNA, 29 bp, Artificial Sequence
  Description of Artificial Sequence: Synthetic oligonucleotide
cggagtattgagaccgggagacacagaag

SEQ ID NO: 49803 - DNA, 31 bp, Artificial Sequence
  Description of Artificial Sequence: Synthetic oligonucleotide
ggagtattgagaccgggagacacagaagtac

SEQ ID NO: 49804 - DNA, 33 bp, Artificial Sequence
  Description of Artificial Sequence: Synthetic oligonucleotide
gagtattgagaccgggagacacagaagtacaag

SEQ ID NO: 49805 - DNA, 33 bp, Artificial Sequence
  Description of Artificial Sequence: Synthetic oligonucleotide
agtattgagaccgggagacacagaagtacaagc

SEQ ID NO: 49806 - DNA, 32 bp, Artificial Sequence
  Description of Artificial Sequence: Synthetic oligonucleotide
gtattgagaccgggagacacagaagtacaagc

SEQ ID NO: 49807 - DNA, 32 bp, Artificial Sequence
  Description of Artificial Sequence: Synthetic oligonucleotide
tattgagaccgggagacacagaagtacaagcg

SEQ ID NO: 49808 - DNA, 31 bp, Artificial Sequence
  Description of Artificial Sequence: Synthetic oligonucleotide
attgagaccgggagacacagaagtacaagcg

SEQ ID NO: 49809 - DNA, 30 bp, Artificial Sequence
  Description of Artificial Sequence: Synthetic oligonucleotide
ttgagaccgggagacacagaagtacaagcg

SEQ ID NO: 49810 - DNA, 29 bp, Artificial Sequence
  Description of Artificial Sequence: Synthetic oligonucleotide
tgagaccgggagacacagaagtacaagcg

SEQ ID NO: 49811 - DNA, 28 bp, Artificial Sequence
  Description of Artificial Sequence: Synthetic oligonucleotide
gagaccgggagacacagaagtacaagcg

SEQ ID NO: 49812 - DNA, 28 bp, Artificial Sequence
  Description of Artificial Sequence: Synthetic oligonucleotide
agaccgggagacacagaagtacaagcgc

SEQ ID NO: 49813 - DNA, 23 bp, Artificial Sequence
  Description of Artificial Sequence: Synthetic oligonucleotide
cgcgagtccaagaggggagccgt

SEQ ID NO: 49814 - DNA, 23 bp, Artificial Sequence
  Description of Artificial Sequence: Synthetic oligonucleotide
gcgagtccaagaggggagccgtg

SEQ ID NO: 49815 - DNA, 23 bp, Artificial Sequence
  Description of Artificial Sequence: Synthetic oligonucleotide
cgagtccaagaggggagccgtgg

SEQ ID NO: 49816 - DNA, 23 bp, Artificial Sequence
  Description of Artificial Sequence: Synthetic oligonucleotide
gagtccaagaggggagccgtggg

SEQ ID NO: 49817 - DNA, 23 bp, Artificial Sequence
  Description of Artificial Sequence: Synthetic oligonucleotide
agtccaagaggggagccgtgggc

SEQ ID NO: 49818 - DNA, 22 bp, Artificial Sequence
  Description of Artificial Sequence: Synthetic oligonucleotide
gtccaagaggggagccgtgggc

SEQ ID NO: 49819 - DNA, 22 bp, Artificial Sequence
  Description of Artificial Sequence: Synthetic oligonucleotide
tccaagaggggagccgtgggcg

SEQ ID NO: 49820 - DNA, 21 bp, Artificial Sequence
  Description of Artificial Sequence: Synthetic oligonucleotide
ccaagaggggagccgtgggcg

SEQ ID NO: 49821 - DNA, 21 bp, Artificial Sequence
  Description of Artificial Sequence: Synthetic oligonucleotide
caagaggggagccgtgggcgc

SEQ ID NO: 49822 - DNA, 21 bp, Artificial Sequence
  Description of Artificial Sequence: Synthetic oligonucleotide
aagaggggagccgtgggcgcc

SEQ ID NO: 49823 - DNA, 20 bp, Artificial Sequence
  Description of Artificial Sequence: Synthetic oligonucleotide
agaggggagccgtgggcgcc

SEQ ID NO: 49824 - DNA, 20 bp, Artificial Sequence
  Description of Artificial Sequence: Synthetic oligonucleotide
gaggggagccgtgggcgcct

SEQ ID NO: 49825 - DNA, 20 bp, Artificial Sequence
  Description of Artificial Sequence: Synthetic oligonucleotide
aggggagccgtgggcgccgt

SEQ ID NO: 49826 - DNA, 20 bp, Artificial Sequence
  Description of Artificial Sequence: Synthetic oligonucleotide
ggggagccgtgggcgccgtt

SEQ ID NO: 49827 - DNA, 20 bp, Artificial Sequence
  Description of Artificial Sequence: Synthetic oligonucleotide
gggagccgtgggcgccgtgt

SEQ ID NO: 49828 - DNA, 20 bp, Artificial Sequence
  Description of Artificial Sequence: Synthetic oligonucleotide
ggagccgtgggcgccgtggt

SEQ ID NO: 49829 - DNA, 20 bp, Artificial Sequence
  Description of Artificial Sequence: Synthetic oligonucleotide
gagccgtgggcgccgtgggt

SEQ ID NO: 49830 - DNA, 20 bp, Artificial Sequence
  Description of Artificial Sequence: Synthetic oligonucleotide
agccgtgggcgccgtgggtg

SEQ ID NO: 49831 - DNA, 20 bp, Artificial Sequence
  Description of Artificial Sequence: Synthetic oligonucleotide
gccgtgggcgccgtgggtgt

SEQ ID NO: 49832 - DNA, 20 bp, Artificial Sequence
  Description of Artificial Sequence: Synthetic oligonucleotide
ccgtgggcgccgtgggtgga

SEQ ID NO: 49833 - DNA, 20 bp, Artificial Sequence
  Description of Artificial Sequence: Synthetic oligonucleotide
cgtgggcgccgtgggtggag

SEQ ID NO: 49834 - DNA, 21 bp, Artificial Sequence
  Description of Artificial Sequence: Synthetic oligonucleotide
gtgggcgccgtgggtggagca

SEQ ID NO: 49835 - DNA, 24 bp, Artificial Sequence
  Description of Artificial Sequence: Synthetic oligonucleotide
agagcctacctggagggcacgtgg

SEQ ID NO: 49836 - DNA, 23 bp, Artificial Sequence
  Description of Artificial Sequence: Synthetic oligonucleotide
gagcctacctggagggcacgtgg

SEQ ID NO: 49837 - DNA, 24 bp, Artificial Sequence
  Description of Artificial Sequence: Synthetic oligonucleotide
agcctacctggagggcacgtgggt

SEQ ID NO: 49838 - DNA, 23 bp, Artificial Sequence
  Description of Artificial Sequence: Synthetic oligonucleotide
gcctacctggagggcacgtgggt

SEQ ID NO: 49839 - DNA, 23 bp, Artificial Sequence
  Description of Artificial Sequence: Synthetic oligonucleotide
cctacctggagggcacgtgggtg

SEQ ID NO: 49840 - DNA, 24 bp, Artificial Sequence
  Description of Artificial Sequence: Synthetic oligonucleotide
ctacctggagggcacgtgggtgga

SEQ ID NO: 49841 - DNA, 25 bp, Artificial Sequence
  Description of Artificial Sequence: Synthetic oligonucleotide
tacctggagggcacgtgggtggagt

SEQ ID NO: 49842 - DNA, 24 bp, Artificial Sequence
  Description of Artificial Sequence: Synthetic oligonucleotide
acctggagggcacgtgggtggagt

SEQ ID NO: 49843 - DNA, 23 bp, Artificial Sequence
  Description of Artificial Sequence: Synthetic oligonucleotide
cctggagggcacgtgggtggagt

SEQ ID NO: 49844 - DNA, 23 bp, Artificial Sequence
  Description of Artificial Sequence: Synthetic oligonucleotide
ctggagggcacgtgggtggagtg

SEQ ID NO: 49845 - DNA, 23 bp, Artificial Sequence
  Description of Artificial Sequence: Synthetic oligonucleotide
tggagggcacgtgggtggagtgg

SEQ ID NO: 49846 - DNA, 22 bp, Artificial Sequence
  Description of Artificial Sequence: Synthetic oligonucleotide
ggagggcacgtgggtggagtgg

SEQ ID NO: 49847 - DNA, 23 bp, Artificial Sequence
  Description of Artificial Sequence: Synthetic oligonucleotide
gagggcacgtgggtggagtggct

SEQ ID NO: 49848 - DNA, 23 bp, Artificial Sequence
  Description of Artificial Sequence: Synthetic oligonucleotide
agggcacgtgggtggagtggctc

SEQ ID NO: 49849 - DNA, 22 bp, Artificial Sequence
  Description of Artificial Sequence: Synthetic oligonucleotide
gggcacgtgggtggagtggctc

SEQ ID NO: 49850 - DNA, 22 bp, Artificial Sequence
  Description of Artificial Sequence: Synthetic oligonucleotide
ggcacgtgggtggagtggctcc

SEQ ID NO: 49851 - DNA, 22 bp, Artificial Sequence
  Description of Artificial Sequence: Synthetic oligonucleotide
gcacgtgggtggagtggctccg

SEQ ID NO: 49852 - DNA, 23 bp, Artificial Sequence
  Description of Artificial Sequence: Synthetic oligonucleotide
cacgtgggtggagtggctccgca

SEQ ID NO: 49853 - DNA, 26 bp, Artificial Sequence
  Description of Artificial Sequence: Synthetic oligonucleotide
acgtgggtggagtggctccgcagata

SEQ ID NO: 49854 - DNA, 25 bp, Artificial Sequence
  Description of Artificial Sequence: Synthetic oligonucleotide
cgtgggtggagtggctccgcagata

SEQ ID NO: 49855 - DNA, 22 bp, Artificial Sequence
  Description of Artificial Sequence: Synthetic oligonucleotide
ccgtgggtggagcaggagggga

SEQ ID NO: 49856 - DNA, 22 bp, Artificial Sequence
  Description of Artificial Sequence: Synthetic oligonucleotide
cgtgggtggagcaggaggggac

SEQ ID NO: 49857 - DNA, 22 bp, Artificial Sequence
  Description of Artificial Sequence: Synthetic oligonucleotide
gtgggtggagcaggaggggacg

SEQ ID NO: 49858 - DNA, 23 bp, Artificial Sequence
  Description of Artificial Sequence: Synthetic oligonucleotide
tgggtggagcaggaggggacgga

SEQ ID NO: 49859 - DNA, 22 bp, Artificial Sequence
  Description of Artificial Sequence: Synthetic oligonucleotide
gggtggagcaggaggggacgga

SEQ ID NO: 49860 - DNA, 26 bp, Artificial Sequence
  Description of Artificial Sequence: Synthetic oligonucleotide
ggtggagcaggaggggacggagtatt

SEQ ID NO: 49861 - DNA, 26 bp, Artificial Sequence
  Description of Artificial Sequence: Synthetic oligonucleotide
gtggagcaggaggggacggagtattg

SEQ ID NO: 49862 - DNA, 26 bp, Artificial Sequence
  Description of Artificial Sequence: Synthetic oligonucleotide
tggagcaggaggggacggagtattgg

SEQ ID NO: 49863 - DNA, 25 bp, Artificial Sequence
  Description of Artificial Sequence: Synthetic oligonucleotide
ggagcaggaggggacggagtattgg

SEQ ID NO: 49864 - DNA, 26 bp, Artificial Sequence
  Description of Artificial Sequence: Synthetic oligonucleotide
gagcaggaggggacggagtattggga

SEQ ID NO: 49865 - DNA, 26 bp, Artificial Sequence
  Description of Artificial Sequence: Synthetic oligonucleotide
agcaggaggggacggagtattgggac

SEQ ID NO: 49866 - DNA, 25 bp, Artificial Sequence
  Description of Artificial Sequence: Synthetic oligonucleotide
gcaggaggggacggagtattgggac

SEQ ID NO: 49867 - DNA, 25 bp, Artificial Sequence
  Description of Artificial Sequence: Synthetic oligonucleotide
caggaggggacggagtattgggacc

SEQ ID NO: 49868 - DNA, 25 bp, Artificial Sequence
  Description of Artificial Sequence: Synthetic oligonucleotide
aggaggggacggagtattgggaccg

SEQ ID NO: 49869 - DNA, 24 bp, Artificial Sequence
  Description of Artificial Sequence: Synthetic oligonucleotide
ggaggggacggagtattgggaccg

SEQ ID NO: 49870 - DNA, 24 bp, Artificial Sequence
  Description of Artificial Sequence: Synthetic oligonucleotide
gaggggacggagtattgggaccgg

SEQ ID NO: 49871 - DNA, 25 bp, Artificial Sequence
  Description of Artificial Sequence: Synthetic oligonucleotide
aggggacggagtattgggaccggga

SEQ ID NO: 49872 - DNA, 24 bp, Artificial Sequence
  Description of Artificial Sequence: Synthetic oligonucleotide
ggggacggagtattgggaccggga

SEQ ID NO: 49873 - DNA, 25 bp, Artificial Sequence
  Description of Artificial Sequence: Synthetic oligonucleotide
gggacggagtattgggaccgggaga

SEQ ID NO: 49874 - DNA, 26 bp, Artificial Sequence
  Description of Artificial Sequence: Synthetic oligonucleotide
ggacggagtattgggaccgggagaca

SEQ ID NO: 49875 - DNA, 27 bp, Artificial Sequence
  Description of Artificial Sequence: Synthetic oligonucleotide
gacggagtattgggaccgggagacaca

SEQ ID NO: 49876 - DNA, 27 bp, Artificial Sequence
  Description of Artificial Sequence: Synthetic oligonucleotide
acggagtattgggaccgggagacacag

SEQ ID NO: 49877 - DNA, 20 bp, Artificial Sequence
  Description of Artificial Sequence: Synthetic oligonucleotide
ctggggcccgacgggcgtct

SEQ ID NO: 49878 - DNA, 20 bp, Artificial Sequence
  Description of Artificial Sequence: Synthetic oligonucleotide
tggggcccgacgggcgtctc

SEQ ID NO: 49879 - DNA, 20 bp, Artificial Sequence
  Description of Artificial Sequence: Synthetic oligonucleotide
ggggcccgacgggcgtctct

SEQ ID NO: 49880 - DNA, 20 bp, Artificial Sequence
  Description of Artificial Sequence: Synthetic oligonucleotide
gggcccgacgggcgtctcct

SEQ ID NO: 49881 - DNA, 20 bp, Artificial Sequence
  Description of Artificial Sequence: Synthetic oligonucleotide
ggcccgacgggcgtctcctc

SEQ ID NO: 49882 - DNA, 20 bp, Artificial Sequence
  Description of Artificial Sequence: Synthetic oligonucleotide
gcccgacgggcgtctcctcc

SEQ ID NO: 49883 - DNA, 20 bp, Artificial Sequence
  Description of Artificial Sequence: Synthetic oligonucleotide
cccgacgggcgtctcctccg

SEQ ID NO: 49884 - DNA, 20 bp, Artificial Sequence
  Description of Artificial Sequence: Synthetic oligonucleotide
ccgacgggcgtctcctccgc

SEQ ID NO: 49885 - DNA, 20 bp, Artificial Sequence
  Description of Artificial Sequence: Synthetic oligonucleotide
cgacgggcgtctcctccgcg

SEQ ID NO: 49886 - DNA, 20 bp, Artificial Sequence
  Description of Artificial Sequence: Synthetic oligonucleotide
gacgggcgtctcctccgcgg

SEQ ID NO: 49887 - DNA, 23 bp, Artificial Sequence
  Description of Artificial Sequence: Synthetic oligonucleotide
acgggcgtctcctccgcgggtat

SEQ ID NO: 49888 - DNA, 22 bp, Artificial Sequence
  Description of Artificial Sequence: Synthetic oligonucleotide
cgggcgtctcctccgcgggtat

SEQ ID NO: 49889 - DNA, 23 bp, Artificial Sequence
  Description of Artificial Sequence: Synthetic oligonucleotide
gggcgtctcctccgcgggtatga

SEQ ID NO: 49890 - DNA, 23 bp, Artificial Sequence
  Description of Artificial Sequence: Synthetic oligonucleotide
ggcgtctcctccgcgggtatgac

SEQ ID NO: 49891 - DNA, 24 bp, Artificial Sequence
  Description of Artificial Sequence: Synthetic oligonucleotide
gcgtctcctccgcgggtatgacca

SEQ ID NO: 49892 - DNA, 25 bp, Artificial Sequence
  Description of Artificial Sequence: Synthetic oligonucleotide
cgtctcctccgcgggtatgaccagt

SEQ ID NO: 49893 - DNA, 25 bp, Artificial Sequence
  Description of Artificial Sequence: Synthetic oligonucleotide
gtctcctccgcgggtatgaccagtc

SEQ ID NO: 49894 - DNA, 25 bp, Artificial Sequence
  Description of Artificial Sequence: Synthetic oligonucleotide
tctcctccgcgggtatgaccagtcc

SEQ ID NO: 49895 - DNA, 27 bp, Artificial Sequence
  Description of Artificial Sequence: Synthetic oligonucleotide
acgtgcgtggagtggctccgcagataa

SEQ ID NO: 49896 - DNA, 26 bp, Artificial Sequence
  Description of Artificial Sequence: Synthetic oligonucleotide
cgtgcgtggagtggctccgcagataa

SEQ ID NO: 49897 - DNA, 27 bp, Artificial Sequence
  Description of Artificial Sequence: Synthetic oligonucleotide
gtgcgtggagtggctccgcagataact

SEQ ID NO: 49898 - DNA, 27 bp, Artificial Sequence
  Description of Artificial Sequence: Synthetic oligonucleotide
tgcgtggagtggctccgcagataactg

SEQ ID NO: 49899 - DNA, 26 bp, Artificial Sequence
  Description of Artificial Sequence: Synthetic oligonucleotide
gcgtggagtggctccgcagataactg

SEQ ID NO: 49900 - DNA, 27 bp, Artificial Sequence
  Description of Artificial Sequence: Synthetic oligonucleotide
cgtggagtggctccgcagataactgga

SEQ ID NO: 49901 - DNA, 27 bp, Artificial Sequence
  Description of Artificial Sequence: Synthetic oligonucleotide
gtggagtggctccgcagataactggag

SEQ ID NO: 49902 - DNA, 29 bp, Artificial Sequence
  Description of Artificial Sequence: Synthetic oligonucleotide
tggagtggctccgcagataactggagaac

SEQ ID NO: 49903 - DNA, 28 bp, Artificial Sequence
  Description of Artificial Sequence: Synthetic oligonucleotide
ggagtggctccgcagataactggagaac

SEQ ID NO: 49904 - DNA, 28 bp, Artificial Sequence
  Description of Artificial Sequence: Synthetic oligonucleotide
gagtggctccgcagataactggagaacg

SEQ ID NO: 49905 - DNA, 28 bp, Artificial Sequence
  Description of Artificial Sequence: Synthetic oligonucleotide
agtggctccgcagataactggagaacgg

SEQ ID NO: 49906 - DNA, 27 bp, Artificial Sequence
  Description of Artificial Sequence: Synthetic oligonucleotide
gtggctccgcagataactggagaacgg

SEQ ID NO: 49907 - DNA, 27 bp, Artificial Sequence
  Description of Artificial Sequence: Synthetic oligonucleotide
tggctccgcagataactggagaacggg

SEQ ID NO: 49908 - DNA, 27 bp, Artificial Sequence
  Description of Artificial Sequence: Synthetic oligonucleotide
ggctccgcagataactggagaacggga

SEQ ID NO: 49909 - DNA, 28 bp, Artificial Sequence
  Description of Artificial Sequence: Synthetic oligonucleotide
gctccgcagataactggagaacgggaag

SEQ ID NO: 49910 - DNA, 28 bp, Artificial Sequence
  Description of Artificial Sequence: Synthetic oligonucleotide
ctccgcagataactggagaacgggaagg

SEQ ID NO: 49911 - DNA, 29 bp, Artificial Sequence
  Description of Artificial Sequence: Synthetic oligonucleotide
tccgcagataactggagaacgggaaggag

SEQ ID NO: 49912 - DNA, 28 bp, Artificial Sequence
  Description of Artificial Sequence: Synthetic oligonucleotide
ccgcagataactggagaacgggaaggag

SEQ ID NO: 49913 - DNA, 29 bp, Artificial Sequence
  Description of Artificial Sequence: Synthetic oligonucleotide
cgcagataactggagaacgggaaggagac

SEQ ID NO: 49914 - DNA, 29 bp, Artificial Sequence
  Description of Artificial Sequence: Synthetic oligonucleotide
gcagataactggagaacgggaaggagacg

SEQ ID NO: 49915 - DNA, 29 bp, Artificial Sequence
  Description of Artificial Sequence: Synthetic oligonucleotide
cagataactggagaacgggaaggagacgc

SEQ ID NO: 49916 - DNA, 30 bp, Artificial Sequence
  Description of Artificial Sequence: Synthetic oligonucleotide
agataactggagaacgggaaggagacgctg

SEQ ID NO: 49917 - DNA, 29 bp, Artificial Sequence
  Description of Artificial Sequence: Synthetic oligonucleotide
gataactggagaacgggaaggagacgctg

SEQ ID NO: 49918 - DNA, 29 bp, Artificial Sequence
  Description of Artificial Sequence: Synthetic oligonucleotide
ataactggagaacgggaaggagacgctgc

SEQ ID NO: 49919 - DNA, 28 bp, Artificial Sequence
  Description of Artificial Sequence: Synthetic oligonucleotide
taactggagaacgggaaggagacgctgc

SEQ ID NO: 49920 - DNA, 27 bp, Artificial Sequence
  Description of Artificial Sequence: Synthetic oligonucleotide
aactggagaacgggaaggagacgctgc

SEQ ID NO: 49921 - DNA, 27 bp, Artificial Sequence
  Description of Artificial Sequence: Synthetic oligonucleotide
actggagaacgggaaggagacgctgca

SEQ ID NO: 49922 - DNA, 22 bp, Artificial Sequence
  Description of Artificial Sequence: Synthetic oligonucleotide
agcgaggccgggtctcacaccc

SEQ ID NO: 49923 - DNA, 21 bp, Artificial Sequence
  Description of Artificial Sequence: Synthetic oligonucleotide
gcgaggccgggtctcacaccc

SEQ ID NO: 49924 - DNA, 21 bp, Artificial Sequence
  Description of Artificial Sequence: Synthetic oligonucleotide
cgaggccgggtctcacacccc

SEQ ID NO: 49925 - DNA, 21 bp, Artificial Sequence
  Description of Artificial Sequence: Synthetic oligonucleotide
gaggccgggtctcacaccccc

SEQ ID NO: 49926 - DNA, 22 bp, Artificial Sequence
  Description of Artificial Sequence: Synthetic oligonucleotide
aggccgggtctcacacccccca

SEQ ID NO: 49927 - DNA, 21 bp, Artificial Sequence
  Description of Artificial Sequence: Synthetic oligonucleotide
ggccgggtctcacacccccca

SEQ ID NO: 49928 - DNA, 22 bp, Artificial Sequence
  Description of Artificial Sequence: Synthetic oligonucleotide
gccgggtctcacaccccccagt

SEQ ID NO: 49929 - DNA, 22 bp, Artificial Sequence
  Description of Artificial Sequence: Synthetic oligonucleotide
ccgggtctcacaccccccagtg

SEQ ID NO: 49930 - DNA, 24 bp, Artificial Sequence
  Description of Artificial Sequence: Synthetic oligonucleotide
cgggtctcacaccccccagtggat

SEQ ID NO: 49931 - DNA, 27 bp, Artificial Sequence
  Description of Artificial Sequence: Synthetic oligonucleotide
gggtctcacaccccccagtggatgttt

SEQ ID NO: 49932 - DNA, 27 bp, Artificial Sequence
  Description of Artificial Sequence: Synthetic oligonucleotide
ggtctcacaccccccagtggatgtttg

SEQ ID NO: 49933 - DNA, 27 bp, Artificial Sequence
  Description of Artificial Sequence: Synthetic oligonucleotide
gtctcacaccccccagtggatgtttgg

SEQ ID NO: 49934 - DNA, 27 bp, Artificial Sequence
  Description of Artificial Sequence: Synthetic oligonucleotide
tctcacaccccccagtggatgtttggc

SEQ ID NO: 49935 - DNA, 27 bp, Artificial Sequence
  Description of Artificial Sequence: Synthetic oligonucleotide
ctcacaccccccagtggatgtttggct

SEQ ID NO: 49936 - DNA, 27 bp, Artificial Sequence
  Description of Artificial Sequence: Synthetic oligonucleotide
tcacaccccccagtggatgtttggctg

SEQ ID NO: 49937 - DNA, 26 bp, Artificial Sequence
  Description of Artificial Sequence: Synthetic oligonucleotide
cacaccccccagtggatgtttggctg

SEQ ID NO: 49938 - DNA, 26 bp, Artificial Sequence
  Description of Artificial Sequence: Synthetic oligonucleotide
acaccccccagtggatgtttggctgc

SEQ ID NO: 49939 - DNA, 25 bp, Artificial Sequence
  Description of Artificial Sequence: Synthetic oligonucleotide
caccccccagtggatgtttggctgc

SEQ ID NO: 49940 - DNA, 26 bp, Artificial Sequence
  Description of Artificial Sequence: Synthetic oligonucleotide
accccccagtggatgtttggctgcga

SEQ ID NO: 49941 - DNA, 25 bp, Artificial Sequence
  Description of Artificial Sequence: Synthetic oligonucleotide
ccccccagtggatgtttggctgcga

SEQ ID NO: 49942 - DNA, 25 bp, Artificial Sequence
  Description of Artificial Sequence: Synthetic oligonucleotide
cccccagtggatgtttggctgcgac

SEQ ID NO: 49943 - DNA, 26 bp, Artificial Sequence
  Description of Artificial Sequence: Synthetic oligonucleotide
ccccagtggatgtttggctgcgacct

SEQ ID NO: 49944 - DNA, 26 bp, Artificial Sequence
  Description of Artificial Sequence: Synthetic oligonucleotide
cccagtggatgtttggctgcgacctg

SEQ ID NO: 49945 - DNA, 29 bp, Artificial Sequence
  Description of Artificial Sequence: Synthetic oligonucleotide
caggtctcacaccctccagtggatgtttg

SEQ ID NO: 49946 - DNA, 29 bp, Artificial Sequence
  Description of Artificial Sequence: Synthetic oligonucleotide
aggtctcacaccctccagtggatgtttgg

SEQ ID NO: 49947 - DNA, 20 bp, Artificial Sequence
  Description of Artificial Sequence: Synthetic oligonucleotide
gacctggggcccgacgggca

SEQ ID NO: 49948 - DNA, 20 bp, Artificial Sequence
  Description of Artificial Sequence: Synthetic oligonucleotide
acctggggcccgacgggcac

SEQ ID NO: 49949 - DNA, 20 bp, Artificial Sequence
  Description of Artificial Sequence: Synthetic oligonucleotide
cctggggcccgacgggcact

SEQ ID NO: 49950 - DNA, 20 bp, Artificial Sequence
  Description of Artificial Sequence: Synthetic oligonucleotide
ctggggcccgacgggcacct

SEQ ID NO: 49951 - DNA, 25 bp, Artificial Sequence
  Description of Artificial Sequence: Synthetic oligonucleotide
cacctcctccgcgggtatgaccagt

SEQ ID NO: 49952 - DNA, 25 bp, Artificial Sequence
  Description of Artificial Sequence: Synthetic oligonucleotide
acctcctccgcgggtatgaccagtc

SEQ ID NO: 49953 - DNA, 26 bp, Artificial Sequence
  Description of Artificial Sequence: Synthetic oligonucleotide
tccgcgggtatgaccagtccgcctaa

SEQ ID NO: 49954 - DNA, 25 bp, Artificial Sequence
  Description of Artificial Sequence: Synthetic oligonucleotide
ccgcgggtatgaccagtccgcctaa

SEQ ID NO: 49955 - DNA, 26 bp, Artificial Sequence
  Description of Artificial Sequence: Synthetic oligonucleotide
cgcgggtatgaccagtccgcctaaga

SEQ ID NO: 49956 - DNA, 26 bp, Artificial Sequence
  Description of Artificial Sequence: Synthetic oligonucleotide
gcgggtatgaccagtccgcctaagac

SEQ ID NO: 49957 - DNA, 26 bp, Artificial Sequence
  Description of Artificial Sequence: Synthetic oligonucleotide
cgggtatgaccagtccgcctaagacg

SEQ ID NO: 49958 - DNA, 26 bp, Artificial Sequence
  Description of Artificial Sequence: Synthetic oligonucleotide
gggtatgaccagtccgcctaagacgg

SEQ ID NO: 49959 - DNA, 27 bp, Artificial Sequence
  Description of Artificial Sequence: Synthetic oligonucleotide
ggtatgaccagtccgcctaagacggca

SEQ ID NO: 49960 - DNA, 28 bp, Artificial Sequence
  Description of Artificial Sequence: Synthetic oligonucleotide
gtatgaccagtccgcctaagacggcaag

SEQ ID NO: 49961 - DNA, 28 bp, Artificial Sequence
  Description of Artificial Sequence: Synthetic oligonucleotide
tatgaccagtccgcctaagacggcaagg

SEQ ID NO: 49962 - DNA, 27 bp, Artificial Sequence
  Description of Artificial Sequence: Synthetic oligonucleotide
atgaccagtccgcctaagacggcaagg

SEQ ID NO: 49963 - DNA, 27 bp, Artificial Sequence
  Description of Artificial Sequence: Synthetic oligonucleotide
tgaccagtccgcctaagacggcaagga

SEQ ID NO: 49964 - DNA, 27 bp, Artificial Sequence
  Description of Artificial Sequence: Synthetic oligonucleotide
gaccagtccgcctaagacggcaaggat

SEQ ID NO: 49965 - DNA, 29 bp, Artificial Sequence
  Description of Artificial Sequence: Synthetic oligonucleotide
accagtccgcctaagacggcaaggattac

SEQ ID NO: 49966 - DNA, 28 bp, Artificial Sequence
  Description of Artificial Sequence: Synthetic oligonucleotide
ccagtccgcctaagacggcaaggattac

SEQ ID NO: 49967 - DNA, 30 bp, Artificial Sequence
  Description of Artificial Sequence: Synthetic oligonucleotide
cagtccgcctaagacggcaaggattacatc

SEQ ID NO: 49968 - DNA, 30 bp, Artificial Sequence
  Description of Artificial Sequence: Synthetic oligonucleotide
agtccgcctaagacggcaaggattacatcg

SEQ ID NO: 49969 - DNA, 29 bp, Artificial Sequence
  Description of Artificial Sequence: Synthetic oligonucleotide
gtccgcctaagacggcaaggattacatcg

SEQ ID NO: 49970 - DNA, 29 bp, Artificial Sequence
  Description of Artificial Sequence: Synthetic oligonucleotide
tccgcctaagacggcaaggattacatcgc

SEQ ID NO: 49971 - DNA, 28 bp, Artificial Sequence
  Description of Artificial Sequence: Synthetic oligonucleotide
ccgcctaagacggcaaggattacatcgc

SEQ ID NO: 49972 - DNA, 31 bp, Artificial Sequence
  Description of Artificial Sequence: Synthetic oligonucleotide
gctcccattccatgaggtatttctacaccgc

SEQ ID NO: 49973 - DNA, 32 bp, Artificial Sequence
  Description of Artificial Sequence: Synthetic oligonucleotide
ctcccattccatgaggtatttctacaccgctg

SEQ ID NO: 49974 - DNA, 33 bp, Artificial Sequence
  Description of Artificial Sequence: Synthetic oligonucleotide
tcccattccatgaggtatttctacaccgctgtg

SEQ ID NO: 49975 - DNA, 32 bp, Artificial Sequence
  Description of Artificial Sequence: Synthetic oligonucleotide
cccattccatgaggtatttctacaccgctgtg

SEQ ID NO: 49976 - DNA, 33 bp, Artificial Sequence
  Description of Artificial Sequence: Synthetic oligonucleotide
ccattccatgaggtatttctacaccgctgtgtc

SEQ ID NO: 49977 - DNA, 33 bp, Artificial Sequence
  Description of Artificial Sequence: Synthetic oligonucleotide
cattccatgaggtatttctacaccgctgtgtcc

SEQ ID NO: 49978 - DNA, 33 bp, Artificial Sequence
  Description of Artificial Sequence: Synthetic oligonucleotide
attccatgaggtatttctacaccgctgtgtccc

SEQ ID NO: 49979 - DNA, 32 bp, Artificial Sequence
  Description of Artificial Sequence: Synthetic oligonucleotide
ttccatgaggtatttctacaccgctgtgtccc

SEQ ID NO: 49980 - DNA, 24 bp, Artificial Sequence
  Description of Artificial Sequence: Synthetic oligonucleotide
ggccgcggagagccccacttcatt

SEQ ID NO: 49981 - DNA, 24 bp, Artificial Sequence
  Description of Artificial Sequence: Synthetic oligonucleotide
gccgcggagagccccacttcattg

SEQ ID NO: 49982 - DNA, 25 bp, Artificial Sequence
  Description of Artificial Sequence: Synthetic oligonucleotide
ccgcggagagccccacttcattgca

SEQ ID NO: 49983 - DNA, 26 bp, Artificial Sequence
  Description of Artificial Sequence: Synthetic oligonucleotide
cgcggagagccccacttcattgcagt

SEQ ID NO: 49984 - DNA, 26 bp, Artificial Sequence
  Description of Artificial Sequence: Synthetic oligonucleotide
gcggagagccccacttcattgcagtg

SEQ ID NO: 49985 - DNA, 26 bp, Artificial Sequence
  Description of Artificial Sequence: Synthetic oligonucleotide
cggagagccccacttcattgcagtgg

SEQ ID NO: 49986 - DNA, 26 bp, Artificial Sequence
  Description of Artificial Sequence: Synthetic oligonucleotide
ggagagccccacttcattgcagtggg

SEQ ID NO: 49987 - DNA, 27 bp, Artificial Sequence
  Description of Artificial Sequence: Synthetic oligonucleotide
gagagccccacttcattgcagtgggct

SEQ ID NO: 49988 - DNA, 28 bp, Artificial Sequence
  Description of Artificial Sequence: Synthetic oligonucleotide
agagccccacttcattgcagtgggctac

SEQ ID NO: 49989 - DNA, 27 bp, Artificial Sequence
  Description of Artificial Sequence: Synthetic oligonucleotide
gagccccacttcattgcagtgggctac

SEQ ID NO: 49990 - DNA, 27 bp, Artificial Sequence
  Description of Artificial Sequence: Synthetic oligonucleotide
agccccacttcattgcagtgggctacg

SEQ ID NO: 49991 - DNA, 27 bp, Artificial Sequence
  Description of Artificial Sequence: Synthetic oligonucleotide
gccccacttcattgcagtgggctacgt

SEQ ID NO: 49992 - DNA, 27 bp, Artificial Sequence
  Description of Artificial Sequence: Synthetic oligonucleotide
ccccacttcattgcagtgggctacgtg

SEQ ID NO: 49993 - DNA, 27 bp, Artificial Sequence
  Description of Artificial Sequence: Synthetic oligonucleotide
cccacttcattgcagtgggctacgtgg

SEQ ID NO: 49994 - DNA, 28 bp, Artificial Sequence
  Description of Artificial Sequence: Synthetic oligonucleotide
ccacttcattgcagtgggctacgtggac

SEQ ID NO: 49995 - DNA, 28 bp, Artificial Sequence
  Description of Artificial Sequence: Synthetic oligonucleotide
cacttcattgcagtgggctacgtggacg

SEQ ID NO: 49996 - DNA, 29 bp, Artificial Sequence
  Description of Artificial Sequence: Synthetic oligonucleotide
acttcattgcagtgggctacgtggacgac

SEQ ID NO: 49997 - DNA, 22 bp, Artificial Sequence
  Description of Artificial Sequence: Synthetic oligonucleotide
gagtccaagaggggagccgcgc

SEQ ID NO: 49998 - DNA, 22 bp, Artificial Sequence
  Description of Artificial Sequence: Synthetic oligonucleotide
agtccaagaggggagccgcgcg

SEQ ID NO: 49999 - DNA, 21 bp, Artificial Sequence
  Description of Artificial Sequence: Synthetic oligonucleotide
gtccaagaggggagccgcgcg

SEQ ID NO: 50000 - DNA, 21 bp, Artificial Sequence
  Description of Artificial Sequence: Synthetic oligonucleotide
tccaagaggggagccgcgcgc

SEQ ID NO: 50001 - DNA, 20 bp, Artificial Sequence
  Description of Artificial Sequence: Synthetic oligonucleotide
ccaagaggggagccgcgcgc

SEQ ID NO: 50002 - DNA, 20 bp, Artificial Sequence
  Description of Artificial Sequence: Synthetic oligonucleotide
caagaggggagccgcgcgcg

SEQ ID NO: 50003 - DNA, 20 bp, Artificial Sequence
  Description of Artificial Sequence: Synthetic oligonucleotide
aagaggggagccgcgcgcgc

SEQ ID NO: 50004 - DNA, 20 bp, Artificial Sequence
  Description of Artificial Sequence: Synthetic oligonucleotide
agaggggagccgcgcgcgct

SEQ ID NO: 50005 - DNA, 20 bp, Artificial Sequence
  Description of Artificial Sequence: Synthetic oligonucleotide
gaggggagccgcgcgcgctt

SEQ ID NO: 50006 - DNA, 20 bp, Artificial Sequence
  Description of Artificial Sequence: Synthetic oligonucleotide
aggggagccgcgcgcgcctt

SEQ ID NO: 50007 - DNA, 20 bp, Artificial Sequence
  Description of Artificial Sequence: Synthetic oligonucleotide
ggggagccgcgcgcgccttt

SEQ ID NO: 50008 - DNA, 20 bp, Artificial Sequence
  Description of Artificial Sequence: Synthetic oligonucleotide
gggagccgcgcgcgccgttt

SEQ ID NO: 50009 - DNA, 20 bp, Artificial Sequence
  Description of Artificial Sequence: Synthetic oligonucleotide
ggagccgcgcgcgccgtgtt

SEQ ID NO: 50010 - DNA, 20 bp, Artificial Sequence
  Description of Artificial Sequence: Synthetic oligonucleotide
gagccgcgcgcgccgtggtt

SEQ ID NO: 50011 - DNA, 20 bp, Artificial Sequence
  Description of Artificial Sequence: Synthetic oligonucleotide
agccgcgcgcgccgtgggtt

SEQ ID NO: 50012 - DNA, 20 bp, Artificial Sequence
  Description of Artificial Sequence: Synthetic oligonucleotide
gccgcgcgcgccgtgggttt

SEQ ID NO: 50013 - DNA, 20 bp, Artificial Sequence
  Description of Artificial Sequence: Synthetic oligonucleotide
ccgcgcgcgccgtgggtgtt

SEQ ID NO: 50014 - DNA, 20 bp, Artificial Sequence
  Description of Artificial Sequence: Synthetic oligonucleotide
cgcgcgcgccgtgggtggat

SEQ ID NO: 50015 - DNA, 20 bp, Artificial Sequence
  Description of Artificial Sequence: Synthetic oligonucleotide
gcgcgcgccgtgggtggagt

SEQ ID NO: 50016 - DNA, 20 bp, Artificial Sequence
  Description of Artificial Sequence: Synthetic oligonucleotide
cgcgcgccgtgggtggagca

SEQ ID NO: 50017 - DNA, 20 bp, Artificial Sequence
  Description of Artificial Sequence: Synthetic oligonucleotide
gcgcgccgtgggtggagcag

SEQ ID NO: 50018 - DNA, 21 bp, Artificial Sequence
  Description of Artificial Sequence: Synthetic oligonucleotide
cgcgccgtgggtggagcagga

SEQ ID NO: 50019 - DNA, 24 bp, Artificial Sequence
  Description of Artificial Sequence: Synthetic oligonucleotide
atgcgggtcatggcgccccgaact

SEQ ID NO: 50020 - DNA, 23 bp, Artificial Sequence
  Description of Artificial Sequence: Synthetic oligonucleotide
tgcgggtcatggcgccccgaact

SEQ ID NO: 50021 - DNA, 22 bp, Artificial Sequence
  Description of Artificial Sequence: Synthetic oligonucleotide
gcgggtcatggcgccccgaact

SEQ ID NO: 50022 - DNA, 23 bp, Artificial Sequence
  Description of Artificial Sequence: Synthetic oligonucleotide
cgggtcatggcgccccgaactct

SEQ ID NO: 50023 - DNA, 23 bp, Artificial Sequence
  Description of Artificial Sequence: Synthetic oligonucleotide
gggtcatggcgccccgaactctc

SEQ ID NO: 50024 - DNA, 24 bp, Artificial Sequence
  Description of Artificial Sequence: Synthetic oligonucleotide
ggtcatggcgccccgaactctcct

SEQ ID NO: 50025 - DNA, 24 bp, Artificial Sequence
  Description of Artificial Sequence: Synthetic oligonucleotide
gtcatggcgccccgaactctcctc

SEQ ID NO: 50026 - DNA, 25 bp, Artificial Sequence
  Description of Artificial Sequence: Synthetic oligonucleotide
tcatggcgccccgaactctcctcct

SEQ ID NO: 50027 - DNA, 24 bp, Artificial Sequence
  Description of Artificial Sequence: Synthetic oligonucleotide
catggcgccccgaactctcctcct

SEQ ID NO: 50028 - DNA, 24 bp, Artificial Sequence
  Description of Artificial Sequence: Synthetic oligonucleotide
atggcgccccgaactctcctcctg

SEQ ID NO: 50029 - DNA, 23 bp, Artificial Sequence
  Description of Artificial Sequence: Synthetic oligonucleotide
tggcgccccgaactctcctcctg

SEQ ID NO: 50030 - DNA, 22 bp, Artificial Sequence
  Description of Artificial Sequence: Synthetic oligonucleotide
ggcgccccgaactctcctcctg

SEQ ID NO: 50031 - DNA, 23 bp, Artificial Sequence
  Description of Artificial Sequence: Synthetic oligonucleotide
gcgccccgaactctcctcctgct

SEQ ID NO: 50032 - DNA, 23 bp, Artificial Sequence
  Description of Artificial Sequence: Synthetic oligonucleotide
cgccccgaactctcctcctgctg

SEQ ID NO: 50033 - DNA, 24 bp, Artificial Sequence
  Description of Artificial Sequence: Synthetic oligonucleotide
gccccgaactctcctcctgctgct

SEQ ID NO: 50034 - DNA, 25 bp, Artificial Sequence
  Description of Artificial Sequence: Synthetic oligonucleotide
ccccgaactctcctcctgctgctct

SEQ ID NO: 50035 - DNA, 25 bp, Artificial Sequence
  Description of Artificial Sequence: Synthetic oligonucleotide
cccgaactctcctcctgctgctctc

SEQ ID NO: 50036 - DNA, 25 bp, Artificial Sequence
  Description of Artificial Sequence: Synthetic oligonucleotide
ccgaactctcctcctgctgctctcg

SEQ ID NO: 50037 - DNA, 25 bp, Artificial Sequence
  Description of Artificial Sequence: Synthetic oligonucleotide
cgaactctcctcctgctgctctcgg

SEQ ID NO: 50038 - DNA, 26 bp, Artificial Sequence
  Description of Artificial Sequence: Synthetic oligonucleotide
gaactctcctcctgctgctctcggga

SEQ ID NO: 50039 - DNA, 26 bp, Artificial Sequence
  Description of Artificial Sequence: Synthetic oligonucleotide
aactctcctcctgctgctctcgggag

SEQ ID NO: 50040 - DNA, 25 bp, Artificial Sequence
  Description of Artificial Sequence: Synthetic oligonucleotide
actctcctcctgctgctctcgggag

SEQ ID NO: 50041 - DNA, 24 bp, Artificial Sequence
  Description of Artificial Sequence: Synthetic oligonucleotide
ctctcctcctgctgctctcgggag

SEQ ID NO: 50042 - DNA, 24 bp, Artificial Sequence
  Description of Artificial Sequence: Synthetic oligonucleotide
tctcctcctgctgctctcgggagc

SEQ ID NO: 50043 - DNA, 27 bp, Artificial Sequence
  Description of Artificial Sequence: Synthetic oligonucleotide
gtctctgaccatgaggccaccctgaga

SEQ ID NO: 50044 - DNA, 28 bp, Artificial Sequence
  Description of Artificial Sequence: Synthetic oligonucleotide
tctctgaccatgaggccaccctgagatg

SEQ ID NO: 50045 - DNA, 27 bp, Artificial Sequence
  Description of Artificial Sequence: Synthetic oligonucleotide
ctctgaccatgaggccaccctgagatg

SEQ ID NO: 50046 - DNA, 27 bp, Artificial Sequence
  Description of Artificial Sequence: Synthetic oligonucleotide
tctgaccatgaggccaccctgagatgc

SEQ ID NO: 50047 - DNA, 27 bp, Artificial Sequence
  Description of Artificial Sequence: Synthetic oligonucleotide
ctgaccatgaggccaccctgagatgct

SEQ ID NO: 50048 - DNA, 27 bp, Artificial Sequence
  Description of Artificial Sequence: Synthetic oligonucleotide
tgaccatgaggccaccctgagatgctg

SEQ ID NO: 50049 - DNA, 26 bp, Artificial Sequence
  Description of Artificial Sequence: Synthetic oligonucleotide
gaccatgaggccaccctgagatgctg

SEQ ID NO: 50050 - DNA, 26 bp, Artificial Sequence
  Description of Artificial Sequence: Synthetic oligonucleotide
accatgaggccaccctgagatgctgg

SEQ ID NO: 50051 - DNA, 25 bp, Artificial Sequence
  Description of Artificial Sequence: Synthetic oligonucleotide
ccatgaggccaccctgagatgctgg

SEQ ID NO: 50052 - DNA, 25 bp, Artificial Sequence
  Description of Artificial Sequence: Synthetic oligonucleotide
catgaggccaccctgagatgctggg

SEQ ID NO: 50053 - DNA, 25 bp, Artificial Sequence
  Description of Artificial Sequence: Synthetic oligonucleotide
atgaggccaccctgagatgctgggc

SEQ ID NO: 50054 - DNA, 24 bp, Artificial Sequence
  Description of Artificial Sequence: Synthetic oligonucleotide
tgaggccaccctgagatgctgggc

SEQ ID NO: 50055 - DNA, 23 bp, Artificial Sequence
  Description of Artificial Sequence: Synthetic oligonucleotide
gaggccaccctgagatgctgggc

SEQ ID NO: 50056 - DNA, 23 bp, Artificial Sequence
  Description of Artificial Sequence: Synthetic oligonucleotide
aggccaccctgagatgctgggcc

SEQ ID NO: 50057 - DNA, 22 bp, Artificial Sequence
  Description of Artificial Sequence: Synthetic oligonucleotide
ggccaccctgagatgctgggcc

SEQ ID NO: 50058 - DNA, 23 bp, Artificial Sequence
  Description of Artificial Sequence: Synthetic oligonucleotide
gccaccctgagatgctgggccct

SEQ ID NO: 50059 - DNA, 23 bp, Artificial Sequence
  Description of Artificial Sequence: Synthetic oligonucleotide
ccaccctgagatgctgggccctg

SEQ ID NO: 50060 - DNA, 23 bp, Artificial Sequence
  Description of Artificial Sequence: Synthetic oligonucleotide
caccctgagatgctgggccctgg

SEQ ID NO: 50061 - DNA, 23 bp, Artificial Sequence
  Description of Artificial Sequence: Synthetic oligonucleotide
accctgagatgctgggccctggg

SEQ ID NO: 50062 - DNA, 22 bp, Artificial Sequence
  Description of Artificial Sequence: Synthetic oligonucleotide
ccctgagatgctgggccctggg

SEQ ID NO: 50063 - DNA, 24 bp, Artificial Sequence
  Description of Artificial Sequence: Synthetic oligonucleotide
cctgagatgctgggccctgggctt

SEQ ID NO: 50064 - DNA, 26 bp, Artificial Sequence
  Description of Artificial Sequence: Synthetic oligonucleotide
acgtgccatgtgcagcacgaggggtt

SEQ ID NO: 50065 - DNA, 25 bp, Artificial Sequence
  Description of Artificial Sequence: Synthetic oligonucleotide
cgtgccatgtgcagcacgaggggtt

SEQ ID NO: 50066 - DNA, 25 bp, Artificial Sequence
  Description of Artificial Sequence: Synthetic oligonucleotide
gtgccatgtgcagcacgaggggttg

SEQ ID NO: 50067 - DNA, 25 bp, Artificial Sequence
  Description of Artificial Sequence: Synthetic oligonucleotide
tgccatgtgcagcacgaggggttgc

SEQ ID NO: 50068 - DNA, 24 bp, Artificial Sequence
  Description of Artificial Sequence: Synthetic oligonucleotide
gccatgtgcagcacgaggggttgc

SEQ ID NO: 50069 - DNA, 24 bp, Artificial Sequence
  Description of Artificial Sequence: Synthetic oligonucleotide
ccatgtgcagcacgaggggttgcc

SEQ ID NO: 50070 - DNA, 24 bp, Artificial Sequence
  Description of Artificial Sequence: Synthetic oligonucleotide
catgtgcagcacgaggggttgccg

SEQ ID NO: 50071 - DNA, 25 bp, Artificial Sequence
  Description of Artificial Sequence: Synthetic oligonucleotide
atgtgcagcacgaggggttgccgga

SEQ ID NO: 50072 - DNA, 24 bp, Artificial Sequence
  Description of Artificial Sequence: Synthetic oligonucleotide
tgtgcagcacgaggggttgccgga

SEQ ID NO: 50073 - DNA, 23 bp, Artificial Sequence
  Description of Artificial Sequence: Synthetic oligonucleotide
gtgcagcacgaggggttgccgga

SEQ ID NO: 50074 - DNA, 23 bp, Artificial Sequence
  Description of Artificial Sequence: Synthetic oligonucleotide
tgcagcacgaggggttgccggag

SEQ ID NO: 50075 - DNA, 22 bp, Artificial Sequence
  Description of Artificial Sequence: Synthetic oligonucleotide
gcagcacgaggggttgccggag

SEQ ID NO: 50076 - DNA, 22 bp, Artificial Sequence
  Description of Artificial Sequence: Synthetic oligonucleotide
cagcacgaggggttgccggagc

SEQ ID NO: 50077 - DNA, 22 bp, Artificial Sequence
  Description of Artificial Sequence: Synthetic oligonucleotide
agcacgaggggttgccggagcc

SEQ ID NO: 50078 - DNA, 21 bp, Artificial Sequence
  Description of Artificial Sequence: Synthetic oligonucleotide
gcacgaggggttgccggagcc

SEQ ID NO: 50079 - DNA, 21 bp, Artificial Sequence
  Description of Artificial Sequence: Synthetic oligonucleotide
cacgaggggttgccggagccc

SEQ ID NO: 50080 - DNA, 22 bp, Artificial Sequence
  Description of Artificial Sequence: Synthetic oligonucleotide
acgaggggttgccggagcccct

SEQ ID NO: 50081 - DNA, 21 bp, Artificial Sequence
  Description of Artificial Sequence: Synthetic oligonucleotide
cgaggggttgccggagcccct

SEQ ID NO: 50082 - DNA, 22 bp, Artificial Sequence
  Description of Artificial Sequence: Synthetic oligonucleotide
gaggggttgccggagcccctca

SEQ ID NO: 50083 - DNA, 22 bp, Artificial Sequence
  Description of Artificial Sequence: Synthetic oligonucleotide
aggggttgccggagcccctcac

SEQ ID NO: 50084 - DNA, 21 bp, Artificial Sequence
  Description of Artificial Sequence: Synthetic oligonucleotide
ggggttgccggagcccctcac

SEQ ID NO: 50085 - DNA, 21 bp, Artificial Sequence
  Description of Artificial Sequence: Synthetic oligonucleotide
gggttgccggagcccctcacc

SEQ ID NO: 50086 - DNA, 22 bp, Artificial Sequence
  Description of Artificial Sequence: Synthetic oligonucleotide
ggttgccggagcccctcaccct

SEQ ID NO: 50087 - DNA, 23 bp, Artificial Sequence
  Description of Artificial Sequence: Synthetic oligonucleotide
gttgccggagcccctcaccctga

SEQ ID NO: 50088 - DNA, 25 bp, Artificial Sequence
  Description of Artificial Sequence: Synthetic oligonucleotide
ttgccggagcccctcaccctgagat

SEQ ID NO: 50089 - DNA, 21 bp, Artificial Sequence
  Description of Artificial Sequence: Synthetic oligonucleotide
gcggcccgtgaggcagagcag

SEQ ID NO: 50090 - DNA, 22 bp, Artificial Sequence
  Description of Artificial Sequence: Synthetic oligonucleotide
cggcccgtgaggcagagcagct

SEQ ID NO: 50091 - DNA, 23 bp, Artificial Sequence
  Description of Artificial Sequence: Synthetic oligonucleotide
ggcccgtgaggcagagcagctga

SEQ ID NO: 50092 - DNA, 24 bp, Artificial Sequence
  Description of Artificial Sequence: Synthetic oligonucleotide
gcccgtgaggcagagcagctgaga

SEQ ID NO: 50093 - DNA, 24 bp, Artificial Sequence
  Description of Artificial Sequence: Synthetic oligonucleotide
cccgtgaggcagagcagctgagag

SEQ ID NO: 50094 - DNA, 24 bp, Artificial Sequence
  Description of Artificial Sequence: Synthetic oligonucleotide
ccgtgaggcagagcagctgagagc

SEQ ID NO: 50095 - DNA, 26 bp, Artificial Sequence
  Description of Artificial Sequence: Synthetic oligonucleotide
cgtgaggcagagcagctgagagccta

SEQ ID NO: 50096 - DNA, 26 bp, Artificial Sequence
  Description of Artificial Sequence: Synthetic oligonucleotide
gtgaggcagagcagctgagagcctac

SEQ ID NO: 50097 - DNA, 27 bp, Artificial Sequence
  Description of Artificial Sequence: Synthetic oligonucleotide
tgaggcagagcagctgagagcctacct

SEQ ID NO: 50098 - DNA, 26 bp, Artificial Sequence
  Description of Artificial Sequence: Synthetic oligonucleotide
gaggcagagcagctgagagcctacct

SEQ ID NO: 50099 - DNA, 26 bp, Artificial Sequence
  Description of Artificial Sequence: Synthetic oligonucleotide
aggcagagcagctgagagcctacctg

SEQ ID NO: 50100 - DNA, 25 bp, Artificial Sequence
  Description of Artificial Sequence: Synthetic oligonucleotide
ggcagagcagctgagagcctacctg

SEQ ID NO: 50101 - DNA, 26 bp, Artificial Sequence
  Description of Artificial Sequence: Synthetic oligonucleotide
gcagagcagctgagagcctacctgga

SEQ ID NO: 50102 - DNA, 26 bp, Artificial Sequence
  Description of Artificial Sequence: Synthetic oligonucleotide
cagagcagctgagagcctacctggag

SEQ ID NO: 50103 - DNA, 26 bp, Artificial Sequence
  Description of Artificial Sequence: Synthetic oligonucleotide
agagcagctgagagcctacctggagg

SEQ ID NO: 50104 - DNA, 26 bp, Artificial Sequence
  Description of Artificial Sequence: Synthetic oligonucleotide
gttcgacagcgacgctgcgagtccaa

SEQ ID NO: 50105 - DNA, 27 bp, Artificial Sequence
  Description of Artificial Sequence: Synthetic oligonucleotide
ttcgacagcgacgctgcgagtccaaga

SEQ ID NO: 50106 - DNA, 26 bp, Artificial Sequence
  Description of Artificial Sequence: Synthetic oligonucleotide
tcgacagcgacgctgcgagtccaaga

SEQ ID NO: 50107 - DNA, 25 bp, Artificial Sequence
  Description of Artificial Sequence: Synthetic oligonucleotide
cgacagcgacgctgcgagtccaaga

SEQ ID NO: 50108 - DNA, 25 bp, Artificial Sequence
  Description of Artificial Sequence: Synthetic oligonucleotide
gacagcgacgctgcgagtccaagag

SEQ ID NO: 50109 - DNA, 25 bp, Artificial Sequence
  Description of Artificial Sequence: Synthetic oligonucleotide
acagcgacgctgcgagtccaagagg

SEQ ID NO: 50110 - DNA, 24 bp, Artificial Sequence
  Description of Artificial Sequence: Synthetic oligonucleotide
cagcgacgctgcgagtccaagagg

SEQ ID NO: 50111 - DNA, 24 bp, Artificial Sequence
  Description of Artificial Sequence: Synthetic oligonucleotide
agcgacgctgcgagtccaagaggg

SEQ ID NO: 50112 - DNA, 23 bp, Artificial Sequence
  Description of Artificial Sequence: Synthetic oligonucleotide
gcgacgctgcgagtccaagaggg

SEQ ID NO: 50113 - DNA, 24 bp, Artificial Sequence
  Description of Artificial Sequence: Synthetic oligonucleotide
cgacgctgcgagtccaagagggga

SEQ ID NO: 50114 - DNA, 24 bp, Artificial Sequence
  Description of Artificial Sequence: Synthetic oligonucleotide
gacgctgcgagtccaagaggggag

SEQ ID NO: 50115 - DNA, 24 bp, Artificial Sequence
  Description of Artificial Sequence: Synthetic oligonucleotide
acgctgcgagtccaagaggggagc

SEQ ID NO: 50116 - DNA, 23 bp, Artificial Sequence
  Description of Artificial Sequence: Synthetic oligonucleotide
cgctgcgagtccaagaggggagc

SEQ ID NO: 50117 - DNA, 23 bp, Artificial Sequence
  Description of Artificial Sequence: Synthetic oligonucleotide
gctgcgagtccaagaggggagcc

SEQ ID NO: 50118 - DNA, 23 bp, Artificial Sequence
  Description of Artificial Sequence: Synthetic oligonucleotide
ctgcgagtccaagaggggagccg

SEQ ID NO: 50119 - DNA, 23 bp, Artificial Sequence
  Description of Artificial Sequence: Synthetic oligonucleotide
tgcgagtccaagaggggagccgc

SEQ ID NO: 50120 - DNA, 27 bp, Artificial Sequence
  Description of Artificial Sequence: Synthetic oligonucleotide
atggcgaggaccaaactcaggacaccc

SEQ ID NO: 50121 - DNA, 27 bp, Artificial Sequence
  Description of Artificial Sequence: Synthetic oligonucleotide
tggcgaggaccaaactcaggacaccca

SEQ ID NO: 50122 - DNA, 26 bp, Artificial Sequence
  Description of Artificial Sequence: Synthetic oligonucleotide
ggcgaggaccaaactcaggacaccca

SEQ ID NO: 50123 - DNA, 26 bp, Artificial Sequence
  Description of Artificial Sequence: Synthetic oligonucleotide
gcgaggaccaaactcaggacacccag

SEQ ID NO: 50124 - DNA, 27 bp, Artificial Sequence
  Description of Artificial Sequence: Synthetic oligonucleotide
cgaggaccaaactcaggacacccagct

SEQ ID NO: 50125 - DNA, 28 bp, Artificial Sequence
  Description of Artificial Sequence: Synthetic oligonucleotide
gaggaccaaactcaggacacccagcttg

SEQ ID NO: 50126 - DNA, 29 bp, Artificial Sequence
  Description of Artificial Sequence: Synthetic oligonucleotide
aggaccaaactcaggacacccagcttgtg

SEQ ID NO: 50127 - DNA, 28 bp, Artificial Sequence
  Description of Artificial Sequence: Synthetic oligonucleotide
ggaccaaactcaggacacccagcttgtg

SEQ ID NO: 50128 - DNA, 28 bp, Artificial Sequence
  Description of Artificial Sequence: Synthetic oligonucleotide
gaccaaactcaggacacccagcttgtgg

SEQ ID NO: 50129 - DNA, 29 bp, Artificial Sequence
  Description of Artificial Sequence: Synthetic oligonucleotide
accaaactcaggacacccagcttgtggag

SEQ ID NO: 50130 - DNA, 28 bp, Artificial Sequence
  Description of Artificial Sequence: Synthetic oligonucleotide
ccaaactcaggacacccagcttgtggag

SEQ ID NO: 50131 - DNA, 29 bp, Artificial Sequence
  Description of Artificial Sequence: Synthetic oligonucleotide
caaactcaggacacccagcttgtggagac

SEQ ID NO: 50132 - DNA, 29 bp, Artificial Sequence
  Description of Artificial Sequence: Synthetic oligonucleotide
aaactcaggacacccagcttgtggagacc

SEQ ID NO: 50133 - DNA, 28 bp, Artificial Sequence
  Description of Artificial Sequence: Synthetic oligonucleotide
aactcaggacacccagcttgtggagacc

SEQ ID NO: 50134 - DNA, 27 bp, Artificial Sequence
  Description of Artificial Sequence: Synthetic oligonucleotide
actcaggacacccagcttgtggagacc

SEQ ID NO: 50135 - DNA, 27 bp, Artificial Sequence
  Description of Artificial Sequence: Synthetic oligonucleotide
ctcaggacacccagcttgtggagacca

SEQ ID NO: 50136 - DNA, 27 bp, Artificial Sequence
  Description of Artificial Sequence: Synthetic oligonucleotide
tcaggacacccagcttgtggagaccag

SEQ ID NO: 50137 - DNA, 26 bp, Artificial Sequence
  Description of Artificial Sequence: Synthetic oligonucleotide
caggacacccagcttgtggagaccag

SEQ ID NO: 50138 - DNA, 26 bp, Artificial Sequence
  Description of Artificial Sequence: Synthetic oligonucleotide
aggacacccagcttgtggagaccagg

SEQ ID NO: 50139 - DNA, 25 bp, Artificial Sequence
  Description of Artificial Sequence: Synthetic oligonucleotide
ggacacccagcttgtggagaccagg

SEQ ID NO: 50140 - DNA, 25 bp, Artificial Sequence
  Description of Artificial Sequence: Synthetic oligonucleotide
gacacccagcttgtggagaccaggc

SEQ ID NO: 50141 - DNA, 26 bp, Artificial Sequence
  Description of Artificial Sequence: Synthetic oligonucleotide
acacccagcttgtggagaccaggcca

SEQ ID NO: 50142 - DNA, 25 bp, Artificial Sequence
  Description of Artificial Sequence: Synthetic oligonucleotide
cacccagcttgtggagaccaggcca

SEQ ID NO: 50143 - DNA, 25 bp, Artificial Sequence
  Description of Artificial Sequence: Synthetic oligonucleotide
acccagcttgtggagaccaggccag

SEQ ID NO: 50144 - DNA, 24 bp, Artificial Sequence
  Description of Artificial Sequence: Synthetic oligonucleotide
cccagcttgtggagaccaggccag

SEQ ID NO: 50145 - DNA, 25 bp, Artificial Sequence
  Description of Artificial Sequence: Synthetic oligonucleotide
ccagcttgtggagaccaggccagca

SEQ ID NO: 50146 - DNA, 25 bp, Artificial Sequence
  Description of Artificial Sequence: Synthetic oligonucleotide
cagcttgtggagaccaggccagcag

SEQ ID NO: 50147 - DNA, 26 bp, Artificial Sequence
  Description of Artificial Sequence: Synthetic oligonucleotide
cgggcatgaccagttagcctacgacc

SEQ ID NO: 50148 - DNA, 26 bp, Artificial Sequence
  Description of Artificial Sequence: Synthetic oligonucleotide
gggcatgaccagttagcctacgaccg

SEQ ID NO: 50149 - DNA, 27 bp, Artificial Sequence
  Description of Artificial Sequence: Synthetic oligonucleotide
ggcatgaccagttagcctacgaccgca

SEQ ID NO: 50150 - DNA, 28 bp, Artificial Sequence
  Description of Artificial Sequence: Synthetic oligonucleotide
gcatgaccagttagcctacgaccgcaag

SEQ ID NO: 50151 - DNA, 28 bp, Artificial Sequence
  Description of Artificial Sequence: Synthetic oligonucleotide
catgaccagttagcctacgaccgcaagg

SEQ ID NO: 50152 - DNA, 32 bp, Artificial Sequence
  Description of Artificial Sequence: Synthetic oligonucleotide
atgaccagttagcctacgaccgcaaggattac

SEQ ID NO: 50153 - DNA, 31 bp, Artificial Sequence
  Description of Artificial Sequence: Synthetic oligonucleotide
tgaccagttagcctacgaccgcaaggattac

SEQ ID NO: 50154 - DNA, 30 bp, Artificial Sequence
  Description of Artificial Sequence: Synthetic oligonucleotide
gaccagttagcctacgaccgcaaggattac

SEQ ID NO: 50155 - DNA, 32 bp, Artificial Sequence
  Description of Artificial Sequence: Synthetic oligonucleotide
accagttagcctacgaccgcaaggattacatc

SEQ ID NO: 50156 - DNA, 31 bp, Artificial Sequence
  Description of Artificial Sequence: Synthetic oligonucleotide
ccagttagcctacgaccgcaaggattacatc

SEQ ID NO: 50157 - DNA, 31 bp, Artificial Sequence
  Description of Artificial Sequence: Synthetic oligonucleotide
cagttagcctacgaccgcaaggattacatcg

SEQ ID NO: 50158 - DNA, 31 bp, Artificial Sequence
  Description of Artificial Sequence: Synthetic oligonucleotide
agttagcctacgaccgcaaggattacatcgc

SEQ ID NO: 50159 - DNA, 30 bp, Artificial Sequence
  Description of Artificial Sequence: Synthetic oligonucleotide
gttagcctacgaccgcaaggattacatcgc

SEQ ID NO: 50160 - DNA, 30 bp, Artificial Sequence
  Description of Artificial Sequence: Synthetic oligonucleotide
ttagcctacgaccgcaaggattacatcgcc

SEQ ID NO: 50161 - DNA, 29 bp, Artificial Sequence
  Description of Artificial Sequence: Synthetic oligonucleotide
tagcctacgaccgcaaggattacatcgcc

SEQ ID NO: 50162 - DNA, 28 bp, Artificial Sequence
  Description of Artificial Sequence: Synthetic oligonucleotide
agcctacgaccgcaaggattacatcgcc

SEQ ID NO: 50163 - DNA, 20 bp, Artificial Sequence
  Description of Artificial Sequence: Synthetic oligonucleotide
cccggccgcgaagagcccca

SEQ ID NO: 50164 - DNA, 22 bp, Artificial Sequence
  Description of Artificial Sequence: Synthetic oligonucleotide
ccggccgcgaagagccccactt

SEQ ID NO: 50165 - DNA, 24 bp, Artificial Sequence
  Description of Artificial Sequence: Synthetic oligonucleotide
cggccgcgaagagccccacttcat

SEQ ID NO: 50166 - DNA, 24 bp, Artificial Sequence
  Description of Artificial Sequence: Synthetic oligonucleotide
ggccgcgaagagccccacttcatc

SEQ ID NO: 50167 - DNA, 29 bp, Artificial Sequence
  Description of Artificial Sequence: Synthetic oligonucleotide
cggagtattgggaccggaacacacagaag

SEQ ID NO: 50168 - DNA, 31 bp, Artificial Sequence
  Description of Artificial Sequence: Synthetic oligonucleotide
ggagtattgggaccggaacacacagaagtac

SEQ ID NO: 50169 - DNA, 33 bp, Artificial Sequence
  Description of Artificial Sequence: Synthetic oligonucleotide
gagtattgggaccggaacacacagaagtacaag

SEQ ID NO: 50170 - DNA, 33 bp, Artificial Sequence
  Description of Artificial Sequence: Synthetic oligonucleotide
agtattgggaccggaacacacagaagtacaagc

SEQ ID NO: 50171 - DNA, 32 bp, Artificial Sequence
  Description of Artificial Sequence: Synthetic oligonucleotide
gtattgggaccggaacacacagaagtacaagc

SEQ ID NO: 50172 - DNA, 32 bp, Artificial Sequence
  Description of Artificial Sequence: Synthetic oligonucleotide
tattgggaccggaacacacagaagtacaagcg

SEQ ID NO: 50173 - DNA, 31 bp, Artificial Sequence
  Description of Artificial Sequence: Synthetic oligonucleotide
attgggaccggaacacacagaagtacaagcg

SEQ ID NO: 50174 - DNA, 30 bp, Artificial Sequence
  Description of Artificial Sequence: Synthetic oligonucleotide
ttgggaccggaacacacagaagtacaagcg

SEQ ID NO: 50175 - DNA, 29 bp, Artificial Sequence
  Description of Artificial Sequence: Synthetic oligonucleotide
tgggaccggaacacacagaagtacaagcg

SEQ ID NO: 50176 - DNA, 28 bp, Artificial Sequence
  Description of Artificial Sequence: Synthetic oligonucleotide
gggaccggaacacacagaagtacaagcg

SEQ ID NO: 50177 - DNA, 28 bp, Artificial Sequence
  Description of Artificial Sequence: Synthetic oligonucleotide
ggaccggaacacacagaagtacaagcgc

SEQ ID NO: 50178 - DNA, 28 bp, Artificial Sequence
  Description of Artificial Sequence: Synthetic oligonucleotide
gaccggaacacacagaagtacaagcgcc

SEQ ID NO: 50179 - DNA, 29 bp, Artificial Sequence
  Description of Artificial Sequence: Synthetic oligonucleotide
accggaacacacagaagtacaagcgccag

SEQ ID NO: 50180 - DNA, 28 bp, Artificial Sequence
  Description of Artificial Sequence: Synthetic oligonucleotide
ccggaacacacagaagtacaagcgccag

SEQ ID NO: 50181 - DNA, 28 bp, Artificial Sequence
  Description of Artificial Sequence: Synthetic oligonucleotide
cggaacacacagaagtacaagcgccagg

SEQ ID NO: 50182 - DNA, 28 bp, Artificial Sequence
  Description of Artificial Sequence: Synthetic oligonucleotide
ggaacacacagaagtacaagcgccaggc

SEQ ID NO: 50183 - DNA, 29 bp, Artificial Sequence
  Description of Artificial Sequence: Synthetic oligonucleotide
gaacacacagaagtacaagcgccaggcac

SEQ ID NO: 50184 - DNA, 30 bp, Artificial Sequence
  Description of Artificial Sequence: Synthetic oligonucleotide
aacacacagaagtacaagcgccaggcacag

SEQ ID NO: 50185 - DNA, 29 bp, Artificial Sequence
  Description of Artificial Sequence: Synthetic oligonucleotide
acacacagaagtacaagcgccaggcacag

SEQ ID NO: 50186 - DNA, 28 bp, Artificial Sequence
  Description of Artificial Sequence: Synthetic oligonucleotide
cacacagaagtacaagcgccaggcacag

SEQ ID NO: 50187 - DNA, 27 bp, Artificial Sequence
  Description of Artificial Sequence: Synthetic oligonucleotide
catcgcagtgggctacgtggacgacat

SEQ ID NO: 50188 - DNA, 27 bp, Artificial Sequence
  Description of Artificial Sequence: Synthetic oligonucleotide
atcgcagtgggctacgtggacgacatg

SEQ ID NO: 50189 - DNA, 26 bp, Artificial Sequence
  Description of Artificial Sequence: Synthetic oligonucleotide
tcgcagtgggctacgtggacgacatg

SEQ ID NO: 50190 - DNA, 25 bp, Artificial Sequence
  Description of Artificial Sequence: Synthetic oligonucleotide
cgcagtgggctacgtggacgacatg

SEQ ID NO: 50191 - DNA, 26 bp, Artificial Sequence
  Description of Artificial Sequence: Synthetic oligonucleotide
gcagtgggctacgtggacgacatgca

SEQ ID NO: 50192 - DNA, 20 bp, Artificial Sequence
  Description of Artificial Sequence: Synthetic oligonucleotide
cccgacgggcgcctcctcca

SEQ ID NO: 50193 - DNA, 20 bp, Artificial Sequence
  Description of Artificial Sequence: Synthetic oligonucleotide
ccgacgggcgcctcctccac

SEQ ID NO: 50194 - DNA, 20 bp, Artificial Sequence
  Description of Artificial Sequence: Synthetic oligonucleotide
cgacgggcgcctcctccacg

SEQ ID NO: 50195 - DNA, 20 bp, Artificial Sequence
  Description of Artificial Sequence: Synthetic oligonucleotide
gacgggcgcctcctccacgg

SEQ ID NO: 50196 - DNA, 23 bp, Artificial Sequence
  Description of Artificial Sequence: Synthetic oligonucleotide
acgggcgcctcctccacgggtat

SEQ ID NO: 50197 - DNA, 22 bp, Artificial Sequence
  Description of Artificial Sequence: Synthetic oligonucleotide
cgggcgcctcctccacgggtat

SEQ ID NO: 50198 - DNA, 23 bp, Artificial Sequence
  Description of Artificial Sequence: Synthetic oligonucleotide
gggcgcctcctccacgggtatga

SEQ ID NO: 50199 - DNA, 23 bp, Artificial Sequence
  Description of Artificial Sequence: Synthetic oligonucleotide
ggcgcctcctccacgggtatgac

SEQ ID NO: 50200 - DNA, 24 bp, Artificial Sequence
  Description of Artificial Sequence: Synthetic oligonucleotide
gcgcctcctccacgggtatgacca

SEQ ID NO: 50201 - DNA, 25 bp, Artificial Sequence
  Description of Artificial Sequence: Synthetic oligonucleotide
cgcctcctccacgggtatgaccagt

SEQ ID NO: 50202 - DNA, 25 bp, Artificial Sequence
  Description of Artificial Sequence: Synthetic oligonucleotide
gcctcctccacgggtatgaccagtc

SEQ ID NO: 50203 - DNA, 25 bp, Artificial Sequence
  Description of Artificial Sequence: Synthetic oligonucleotide
cctcctccacgggtatgaccagtcc

SEQ ID NO: 50204 - DNA, 25 bp, Artificial Sequence
  Description of Artificial Sequence: Synthetic oligonucleotide
ctcctccacgggtatgaccagtccg

SEQ ID NO: 50205 - DNA, 25 bp, Artificial Sequence
  Description of Artificial Sequence: Synthetic oligonucleotide
tcctccacgggtatgaccagtccgc

SEQ ID NO: 50206 - DNA, 24 bp, Artificial Sequence
  Description of Artificial Sequence: Synthetic oligonucleotide
cctccacgggtatgaccagtccgc

SEQ ID NO: 50207 - DNA, 26 bp, Artificial Sequence
  Description of Artificial Sequence: Synthetic oligonucleotide
ctccacgggtatgaccagtccgccta

SEQ ID NO: 50208 - DNA, 26 bp, Artificial Sequence
  Description of Artificial Sequence: Synthetic oligonucleotide
tccacgggtatgaccagtccgcctac

SEQ ID NO: 50209 - DNA, 25 bp, Artificial Sequence
  Description of Artificial Sequence: Synthetic oligonucleotide
ccacgggtatgaccagtccgcctac

SEQ ID NO: 50210 - DNA, 26 bp, Artificial Sequence
  Description of Artificial Sequence: Synthetic oligonucleotide
cacgggtatgaccagtccgcctacga

SEQ ID NO: 50211 - DNA, 26 bp, Artificial Sequence
  Description of Artificial Sequence: Synthetic oligonucleotide
acgggtatgaccagtccgcctacgac

SEQ ID NO: 50212 - DNA, 24 bp, Artificial Sequence
  Description of Artificial Sequence: Synthetic oligonucleotide
ctgagagcctacctggagggcacg

SEQ ID NO: 50213 - DNA, 24 bp, Artificial Sequence
  Description of Artificial Sequence: Synthetic oligonucleotide
tgagagcctacctggagggcacgg

SEQ ID NO: 50214 - DNA, 23 bp, Artificial Sequence
  Description of Artificial Sequence: Synthetic oligonucleotide
gagagcctacctggagggcacgg

SEQ ID NO: 50215 - DNA, 23 bp, Artificial Sequence
  Description of Artificial Sequence: Synthetic oligonucleotide
agagcctacctggagggcacggg

SEQ ID NO: 50216 - DNA, 22 bp, Artificial Sequence
  Description of Artificial Sequence: Synthetic oligonucleotide
gagcctacctggagggcacggg

SEQ ID NO: 50217 - DNA, 22 bp, Artificial Sequence
  Description of Artificial Sequence: Synthetic oligonucleotide
agcctacctggagggcacgggc

SEQ ID NO: 50218 - DNA, 21 bp, Artificial Sequence
  Description of Artificial Sequence: Synthetic oligonucleotide
gcctacctggagggcacgggc

SEQ ID NO: 50219 - DNA, 22 bp, Artificial Sequence
  Description of Artificial Sequence: Synthetic oligonucleotide
cctacctggagggcacgggcgt

SEQ ID NO: 50220 - DNA, 22 bp, Artificial Sequence
  Description of Artificial Sequence: Synthetic oligonucleotide
ctacctggagggcacgggcgtg

SEQ ID NO: 50221 - DNA, 23 bp, Artificial Sequence
  Description of Artificial Sequence: Synthetic oligonucleotide
tacctggagggcacgggcgtgga

SEQ ID NO: 50222 - DNA, 22 bp, Artificial Sequence
  Description of Artificial Sequence: Synthetic oligonucleotide
acctggagggcacgggcgtgga

SEQ ID NO: 50223 - DNA, 21 bp, Artificial Sequence
  Description of Artificial Sequence: Synthetic oligonucleotide
cctggagggcacgggcgtgga

SEQ ID NO: 50224 - DNA, 22 bp, Artificial Sequence
  Description of Artificial Sequence: Synthetic oligonucleotide
ctggagggcacgggcgtggagt

SEQ ID NO: 50225 - DNA, 22 bp, Artificial Sequence
  Description of Artificial Sequence: Synthetic oligonucleotide
tggagggcacgggcgtggagtg

SEQ ID NO: 50226 - DNA, 21 bp, Artificial Sequence
  Description of Artificial Sequence: Synthetic oligonucleotide
ggagggcacgggcgtggagtg

SEQ ID NO: 50227 - DNA, 21 bp, Artificial Sequence
  Description of Artificial Sequence: Synthetic oligonucleotide
gagggcacgggcgtggagtgg

SEQ ID NO: 50228 - DNA, 22 bp, Artificial Sequence
  Description of Artificial Sequence: Synthetic oligonucleotide
agggcacgggcgtggagtggct

SEQ ID NO: 50229 - DNA, 21 bp, Artificial Sequence
  Description of Artificial Sequence: Synthetic oligonucleotide
gggcacgggcgtggagtggct

SEQ ID NO: 50230 - DNA, 21 bp, Artificial Sequence
  Description of Artificial Sequence: Synthetic oligonucleotide
ggcacgggcgtggagtggctc

SEQ ID NO: 50231 - DNA, 21 bp, Artificial Sequence
  Description of Artificial Sequence: Synthetic oligonucleotide
gcacgggcgtggagtggctcc

SEQ ID NO: 50232 - DNA, 21 bp, Artificial Sequence
  Description of Artificial Sequence: Synthetic oligonucleotide
cacgggcgtggagtggctccg

SEQ ID NO: 50233 - DNA, 22 bp, Artificial Sequence
  Description of Artificial Sequence: Synthetic oligonucleotide
acgggcgtggagtggctccgca

SEQ ID NO: 50234 - DNA, 21 bp, Artificial Sequence
  Description of Artificial Sequence: Synthetic oligonucleotide
cgggcgtggagtggctccgca

SEQ ID NO: 50235 - DNA, 24 bp, Artificial Sequence
  Description of Artificial Sequence: Synthetic oligonucleotide
gggcgtggagtggctccgcagata

SEQ ID NO: 50236 - DNA, 24 bp, Artificial Sequence
  Description of Artificial Sequence: Synthetic oligonucleotide
ggcgtggagtggctccgcagatac

SEQ ID NO: 50237 - DNA, 23 bp, Artificial Sequence
  Description of Artificial Sequence: Synthetic oligonucleotide
gccctgaacgtggacctgcgctc

SEQ ID NO: 50238 - DNA, 24 bp, Artificial Sequence
  Description of Artificial Sequence: Synthetic oligonucleotide
ccctgaacgtggacctgcgctcct

SEQ ID NO: 50239 - DNA, 24 bp, Artificial Sequence
  Description of Artificial Sequence: Synthetic oligonucleotide
cctgaacgtggacctgcgctcctg

SEQ ID NO: 50240 - DNA, 25 bp, Artificial Sequence
  Description of Artificial Sequence: Synthetic oligonucleotide
ctgaacgtggacctgcgctcctgga

SEQ ID NO: 50241 - DNA, 25 bp, Artificial Sequence
  Description of Artificial Sequence: Synthetic oligonucleotide
tgaacgtggacctgcgctcctggac

SEQ ID NO: 50242 - DNA, 24 bp, Artificial Sequence
  Description of Artificial Sequence: Synthetic oligonucleotide
gaacgtggacctgcgctcctggac

SEQ ID NO: 50243 - DNA, 24 bp, Artificial Sequence
  Description of Artificial Sequence: Synthetic oligonucleotide
aacgtggacctgcgctcctggacc

SEQ ID NO: 50244 - DNA, 23 bp, Artificial Sequence
  Description of Artificial Sequence: Synthetic oligonucleotide
acgtggacctgcgctcctggacc

SEQ ID NO: 50245 - DNA, 22 bp, Artificial Sequence
  Description of Artificial Sequence: Synthetic oligonucleotide
cgtggacctgcgctcctggacc

SEQ ID NO: 50246 - DNA, 22 bp, Artificial Sequence
  Description of Artificial Sequence: Synthetic oligonucleotide
gtggacctgcgctcctggaccg

SEQ ID NO: 50247 - DNA, 22 bp, Artificial Sequence
  Description of Artificial Sequence: Synthetic oligonucleotide
tggacctgcgctcctggaccgc

SEQ ID NO: 50248 - DNA, 27 bp, Artificial Sequence
  Description of Artificial Sequence: Synthetic oligonucleotide
tccgcgggcatgaccagttagcctaca

SEQ ID NO: 50249 - DNA, 27 bp, Artificial Sequence
  Description of Artificial Sequence: Synthetic oligonucleotide
ccgcgggcatgaccagttagcctacaa

SEQ ID NO: 50250 - DNA, 27 bp, Artificial Sequence
  Description of Artificial Sequence: Synthetic oligonucleotide
cgcgggcatgaccagttagcctacaac

SEQ ID NO: 50251 - DNA, 27 bp, Artificial Sequence
  Description of Artificial Sequence: Synthetic oligonucleotide
gcgggcatgaccagttagcctacaacg

SEQ ID NO: 50252 - DNA, 27 bp, Artificial Sequence
  Description of Artificial Sequence: Synthetic oligonucleotide
cgggcatgaccagttagcctacaacgg

SEQ ID NO: 50253 - DNA, 27 bp, Artificial Sequence
  Description of Artificial Sequence: Synthetic oligonucleotide
gggcatgaccagttagcctacaacggc

SEQ ID NO: 50254 - DNA, 29 bp, Artificial Sequence
  Description of Artificial Sequence: Synthetic oligonucleotide
ggcatgaccagttagcctacaacggcaag

SEQ ID NO: 50255 - DNA, 29 bp, Artificial Sequence
  Description of Artificial Sequence: Synthetic oligonucleotide
gcatgaccagttagcctacaacggcaagg

SEQ ID NO: 50256 - DNA, 33 bp, Artificial Sequence
  Description of Artificial Sequence: Synthetic oligonucleotide
catgaccagttagcctacaacggcaaggattac

SEQ ID NO: 50257 - DNA, 35 bp, Artificial Sequence
  Description of Artificial Sequence: Synthetic oligonucleotide
atgaccagttagcctacaacggcaaggattacatc

SEQ ID NO: 50258 - DNA, 34 bp, Artificial Sequence
  Description of Artificial Sequence: Synthetic oligonucleotide
tgaccagttagcctacaacggcaaggattacatc

SEQ ID NO: 50259 - DNA, 33 bp, Artificial Sequence
  Description of Artificial Sequence: Synthetic oligonucleotide
gaccagttagcctacaacggcaaggattacatc

SEQ ID NO: 50260 - DNA, 33 bp, Artificial Sequence
  Description of Artificial Sequence: Synthetic oligonucleotide
accagttagcctacaacggcaaggattacatcg

SEQ ID NO: 50261 - DNA, 32 bp, Artificial Sequence
  Description of Artificial Sequence: Synthetic oligonucleotide
ccagttagcctacaacggcaaggattacatcg

SEQ ID NO: 50262 - DNA, 32 bp, Artificial Sequence
  Description of Artificial Sequence: Synthetic oligonucleotide
cagttagcctacaacggcaaggattacatcgc

SEQ ID NO: 50263 - DNA, 32 bp, Artificial Sequence
  Description of Artificial Sequence: Synthetic oligonucleotide
agttagcctacaacggcaaggattacatcgcc

SEQ ID NO: 50264 - DNA, 31 bp, Artificial Sequence
  Description of Artificial Sequence: Synthetic oligonucleotide
gttagcctacaacggcaaggattacatcgcc

SEQ ID NO: 50265 - DNA, 31 bp, Artificial Sequence
  Description of Artificial Sequence: Synthetic oligonucleotide
ttagcctacaacggcaaggattacatcgccc

SEQ ID NO: 50266 - DNA, 30 bp, Artificial Sequence
  Description of Artificial Sequence: Synthetic oligonucleotide
tagcctacaacggcaaggattacatcgccc

SEQ ID NO: 50267 - DNA, 29 bp, Artificial Sequence
  Description of Artificial Sequence: Synthetic oligonucleotide
agcctacaacggcaaggattacatcgccc

SEQ ID NO: 50268 - DNA, 31 bp, Artificial Sequence
  Description of Artificial Sequence: Synthetic oligonucleotide
ctacaacggcaaggattacatcgccctgaac

SEQ ID NO: 50269 - DNA, 31 bp, Artificial Sequence
  Description of Artificial Sequence: Synthetic oligonucleotide
tacaacggcaaggattacatcgccctgaacg

SEQ ID NO: 50270 - DNA, 30 bp, Artificial Sequence
  Description of Artificial Sequence: Synthetic oligonucleotide
acaacggcaaggattacatcgccctgaacg

SEQ ID NO: 50271 - DNA, 29 bp, Artificial Sequence
  Description of Artificial Sequence: Synthetic oligonucleotide
caacggcaaggattacatcgccctgaacg

SEQ ID NO: 50272 - DNA, 30 bp, Artificial Sequence
  Description of Artificial Sequence: Synthetic oligonucleotide
aacggcaaggattacatcgccctgaacgag

SEQ ID NO: 50273 - DNA, 29 bp, Artificial Sequence
  Description of Artificial Sequence: Synthetic oligonucleotide
acccaaagacacacgtgacccaccatctc

SEQ ID NO: 50274 - DNA, 28 bp, Artificial Sequence
  Description of Artificial Sequence: Synthetic oligonucleotide
cccaaagacacacgtgacccaccatctc

SEQ ID NO: 50275 - DNA, 28 bp, Artificial Sequence
  Description of Artificial Sequence: Synthetic oligonucleotide
ccaaagacacacgtgacccaccatctcg

SEQ ID NO: 50276 - DNA, 29 bp, Artificial Sequence
  Description of Artificial Sequence: Synthetic oligonucleotide
caaagacacacgtgacccaccatctcgtc

SEQ ID NO: 50277 - DNA, 30 bp, Artificial Sequence
  Description of Artificial Sequence: Synthetic oligonucleotide
aaagacacacgtgacccaccatctcgtctc

SEQ ID NO: 50278 - DNA, 29 bp, Artificial Sequence
  Description of Artificial Sequence: Synthetic oligonucleotide
aagacacacgtgacccaccatctcgtctc

SEQ ID NO: 50279 - DNA, 28 bp, Artificial Sequence
  Description of Artificial Sequence: Synthetic oligonucleotide
agacacacgtgacccaccatctcgtctc

SEQ ID NO: 50280 - DNA, 27 bp, Artificial Sequence
  Description of Artificial Sequence: Synthetic oligonucleotide
gacacacgtgacccaccatctcgtctc

SEQ ID NO: 50281 - DNA, 28 bp, Artificial Sequence
  Description of Artificial Sequence: Synthetic oligonucleotide
acacacgtgacccaccatctcgtctctg

SEQ ID NO: 50282 - DNA, 27 bp, Artificial Sequence
  Description of Artificial Sequence: Synthetic oligonucleotide
cacacgtgacccaccatctcgtctctg

SEQ ID NO: 50283 - DNA, 28 bp, Artificial Sequence
  Description of Artificial Sequence: Synthetic oligonucleotide
acacgtgacccaccatctcgtctctgac

SEQ ID NO: 50284 - DNA, 27 bp, Artificial Sequence
  Description of Artificial Sequence: Synthetic oligonucleotide
cacgtgacccaccatctcgtctctgac

SEQ ID NO: 50285 - DNA, 27 bp, Artificial Sequence
  Description of Artificial Sequence: Synthetic oligonucleotide
acgtgacccaccatctcgtctctgacc

SEQ ID NO: 50286 - DNA, 27 bp, Artificial Sequence
  Description of Artificial Sequence: Synthetic oligonucleotide
cgtgacccaccatctcgtctctgacca

SEQ ID NO: 50287 - DNA, 28 bp, Artificial Sequence
  Description of Artificial Sequence: Synthetic oligonucleotide
gtgacccaccatctcgtctctgaccatg

SEQ ID NO: 50288 - DNA, 29 bp, Artificial Sequence
  Description of Artificial Sequence: Synthetic oligonucleotide
tgacccaccatctcgtctctgaccatgag

SEQ ID NO: 50289 - DNA, 28 bp, Artificial Sequence
  Description of Artificial Sequence: Synthetic oligonucleotide
gacccaccatctcgtctctgaccatgag

SEQ ID NO: 50290 - DNA, 28 bp, Artificial Sequence
  Description of Artificial Sequence: Synthetic oligonucleotide
acccaccatctcgtctctgaccatgagg

SEQ ID NO: 50291 - DNA, 27 bp, Artificial Sequence
  Description of Artificial Sequence: Synthetic oligonucleotide
cccaccatctcgtctctgaccatgagg

SEQ ID NO: 50292 - DNA, 27 bp, Artificial Sequence
  Description of Artificial Sequence: Synthetic oligonucleotide
ccaccatctcgtctctgaccatgaggc

SEQ ID NO: 50293 - DNA, 27 bp, Artificial Sequence
  Description of Artificial Sequence: Synthetic oligonucleotide
caccatctcgtctctgaccatgaggcc

SEQ ID NO: 50294 - DNA, 28 bp, Artificial Sequence
  Description of Artificial Sequence: Synthetic oligonucleotide
accatctcgtctctgaccatgaggccac

SEQ ID NO: 50295 - DNA, 27 bp, Artificial Sequence
  Description of Artificial Sequence: Synthetic oligonucleotide
ccatctcgtctctgaccatgaggccac

SEQ ID NO: 50296 - DNA, 27 bp, Artificial Sequence
  Description of Artificial Sequence: Synthetic oligonucleotide
catctcgtctctgaccatgaggccacc

SEQ ID NO: 50297 - DNA, 27 bp, Artificial Sequence
  Description of Artificial Sequence: Synthetic oligonucleotide
atctcgtctctgaccatgaggccaccc

SEQ ID NO: 50298 - DNA, 27 bp, Artificial Sequence
  Description of Artificial Sequence: Synthetic oligonucleotide
tctcgtctctgaccatgaggccaccct

SEQ ID NO: 50299 - DNA, 26 bp, Artificial Sequence
  Description of Artificial Sequence: Synthetic oligonucleotide
ctcgtctctgaccatgaggccaccct

SEQ ID NO: 50300 - DNA, 27 bp, Artificial Sequence
  Description of Artificial Sequence: Synthetic oligonucleotide
tcgtctctgaccatgaggccaccctga

SEQ ID NO: 50301 - DNA, 31 bp, Artificial Sequence
  Description of Artificial Sequence: Synthetic oligonucleotide
tgtcctaggagctgtggtggctgttgttatg

SEQ ID NO: 50302 - DNA, 30 bp, Artificial Sequence
  Description of Artificial Sequence: Synthetic oligonucleotide
gtcctaggagctgtggtggctgttgttatg

SEQ ID NO: 50303 - DNA, 31 bp, Artificial Sequence
  Description of Artificial Sequence: Synthetic oligonucleotide
tcctaggagctgtggtggctgttgttatgtg

SEQ ID NO: 50304 - DNA, 30 bp, Artificial Sequence
  Description of Artificial Sequence: Synthetic oligonucleotide
cctaggagctgtggtggctgttgttatgtg

SEQ ID NO: 50305 - DNA, 32 bp, Artificial Sequence
  Description of Artificial Sequence: Synthetic oligonucleotide
ctaggagctgtggtggctgttgttatgtgtag

SEQ ID NO: 50306 - DNA, 32 bp, Artificial Sequence
  Description of Artificial Sequence: Synthetic oligonucleotide
taggagctgtggtggctgttgttatgtgtagg

SEQ ID NO: 50307 - DNA, 31 bp, Artificial Sequence
  Description of Artificial Sequence: Synthetic oligonucleotide
aggagctgtggtggctgttgttatgtgtagg

SEQ ID NO: 50308 - DNA, 30 bp, Artificial Sequence
  Description of Artificial Sequence: Synthetic oligonucleotide
ggagctgtggtggctgttgttatgtgtagg

SEQ ID NO: 50309 - DNA, 31 bp, Artificial Sequence
  Description of Artificial Sequence: Synthetic oligonucleotide
gagctgtggtggctgttgttatgtgtaggag

SEQ ID NO: 50310 - DNA, 31 bp, Artificial Sequence
  Description of Artificial Sequence: Synthetic oligonucleotide
agctgtggtggctgttgttatgtgtaggagg

SEQ ID NO: 50311 - DNA, 30 bp, Artificial Sequence
  Description of Artificial Sequence: Synthetic oligonucleotide
gctgtggtggctgttgttatgtgtaggagg

SEQ ID NO: 50312 - DNA, 32 bp, Artificial Sequence
  Description of Artificial Sequence: Synthetic oligonucleotide
ctgtggtggctgttgttatgtgtaggaggaag

SEQ ID NO: 50313 - DNA, 33 bp, Artificial Sequence
  Description of Artificial Sequence: Synthetic oligonucleotide
tgtggtggctgttgttatgtgtaggaggaagag

SEQ ID NO: 50314 - DNA, 32 bp, Artificial Sequence
  Description of Artificial Sequence: Synthetic oligonucleotide
gtggtggctgttgttatgtgtaggaggaagag

SEQ ID NO: 50315 - DNA, 32 bp, Artificial Sequence
  Description of Artificial Sequence: Synthetic oligonucleotide
tggtggctgttgttatgtgtaggaggaagagc

SEQ ID NO: 50316 - DNA, 31 bp, Artificial Sequence
  Description of Artificial Sequence: Synthetic oligonucleotide
ggtggctgttgttatgtgtaggaggaagagc

SEQ ID NO: 50317 - DNA, 32 bp, Artificial Sequence
  Description of Artificial Sequence: Synthetic oligonucleotide
gtggctgttgttatgtgtaggaggaagagctc

SEQ ID NO: 50318 - DNA, 33 bp, Artificial Sequence
  Description of Artificial Sequence: Synthetic oligonucleotide
tggctgttgttatgtgtaggaggaagagctcag

SEQ ID NO: 50319 - DNA, 32 bp, Artificial Sequence
  Description of Artificial Sequence: Synthetic oligonucleotide
ggctgttgttatgtgtaggaggaagagctcag

SEQ ID NO: 50320 - DNA, 32 bp, Artificial Sequence
  Description of Artificial Sequence: Synthetic oligonucleotide
gctgttgttatgtgtaggaggaagagctcagg

SEQ ID NO: 50321 - DNA, 33 bp, Artificial Sequence
  Description of Artificial Sequence: Synthetic oligonucleotide
ctgttgttatgtgtaggaggaagagctcaggtg

SEQ ID NO: 50322 - DNA, 33 bp, Artificial Sequence
  Description of Artificial Sequence: Synthetic oligonucleotide
tgttgttatgtgtaggaggaagagctcaggtgg

SEQ ID NO: 50323 - DNA, 32 bp, Artificial Sequence
  Description of Artificial Sequence: Synthetic oligonucleotide
gttgttatgtgtaggaggaagagctcaggtgg

SEQ ID NO: 50324 - DNA, 36 bp, Artificial Sequence
  Description of Artificial Sequence: Synthetic oligonucleotide
ttgttatgtgtaggaggaagagctcaggtggaaaag

SEQ ID NO: 50325 - DNA, 35 bp, Artificial Sequence
  Description of Artificial Sequence: Synthetic oligonucleotide
tgttatgtgtaggaggaagagctcaggtggaaaag

SEQ ID NO: 50326 - DNA, 34 bp, Artificial Sequence
  Description of Artificial Sequence: Synthetic oligonucleotide
gttatgtgtaggaggaagagctcaggtggaaaag

SEQ ID NO: 50327 - DNA, 34 bp, Artificial Sequence
  Description of Artificial Sequence: Synthetic oligonucleotide
ttatgtgtaggaggaagagctcaggtggaaaagg

SEQ ID NO: 50328 - DNA, 33 bp, Artificial Sequence
  Description of Artificial Sequence: Synthetic oligonucleotide
tatgtgtaggaggaagagctcaggtggaaaagg

SEQ ID NO: 50329 - DNA, 22 bp, Artificial Sequence
  Description of Artificial Sequence: Synthetic oligonucleotide
tccaagaggggagccgcgggct

SEQ ID NO: 50330 - DNA, 21 bp, Artificial Sequence
  Description of Artificial Sequence: Synthetic oligonucleotide
ccaagaggggagccgcgggct

SEQ ID NO: 50331 - DNA, 21 bp, Artificial Sequence
  Description of Artificial Sequence: Synthetic oligonucleotide
caagaggggagccgcgggctc

SEQ ID NO: 50332 - DNA, 21 bp, Artificial Sequence
  Description of Artificial Sequence: Synthetic oligonucleotide
aagaggggagccgcgggctcc

SEQ ID NO: 50333 - DNA, 20 bp, Artificial Sequence
  Description of Artificial Sequence: Synthetic oligonucleotide
agaggggagccgcgggctcc

SEQ ID NO: 50334 - DNA, 20 bp, Artificial Sequence
  Description of Artificial Sequence: Synthetic oligonucleotide
gaggggagccgcgggctcct

SEQ ID NO: 50335 - DNA, 20 bp, Artificial Sequence
  Description of Artificial Sequence: Synthetic oligonucleotide
aggggagccgcgggctccgt

SEQ ID NO: 50336 - DNA, 20 bp, Artificial Sequence
  Description of Artificial Sequence: Synthetic oligonucleotide
ggggagccgcgggctccgtt

SEQ ID NO: 50337 - DNA, 20 bp, Artificial Sequence
  Description of Artificial Sequence: Synthetic oligonucleotide
gggagccgcgggctccgtgt

SEQ ID NO: 50338 - DNA, 20 bp, Artificial Sequence
  Description of Artificial Sequence: Synthetic oligonucleotide
ggagccgcgggctccgtggt

SEQ ID NO: 50339 - DNA, 20 bp, Artificial Sequence
  Description of Artificial Sequence: Synthetic oligonucleotide
gagccgcgggctccgtgggt

SEQ ID NO: 50340 - DNA, 20 bp, Artificial Sequence
  Description of Artificial Sequence: Synthetic oligonucleotide
agccgcgggctccgtgggtg

SEQ ID NO: 50341 - DNA, 20 bp, Artificial Sequence
  Description of Artificial Sequence: Synthetic oligonucleotide
gccgcgggctccgtgggtgt

SEQ ID NO: 50342 - DNA, 20 bp, Artificial Sequence
  Description of Artificial Sequence: Synthetic oligonucleotide
ccgcgggctccgtgggtgga

SEQ ID NO: 50343 - DNA, 20 bp, Artificial Sequence
  Description of Artificial Sequence: Synthetic oligonucleotide
cgcgggctccgtgggtggag

SEQ ID NO: 50344 - DNA, 21 bp, Artificial Sequence
  Description of Artificial Sequence: Synthetic oligonucleotide
gcgggctccgtgggtggagca

SEQ ID NO: 50345 - DNA, 27 bp, Artificial Sequence
  Description of Artificial Sequence: Synthetic oligonucleotide
tacaaccagagcgaggccgggtctcat

SEQ ID NO: 50346 - DNA, 27 bp, Artificial Sequence
  Description of Artificial Sequence: Synthetic oligonucleotide
acaaccagagcgaggccgggtctcata

SEQ ID NO: 50347 - DNA, 26 bp, Artificial Sequence
  Description of Artificial Sequence: Synthetic oligonucleotide
caaccagagcgaggccgggtctcata

SEQ ID NO: 50348 - DNA, 26 bp, Artificial Sequence
  Description of Artificial Sequence: Synthetic oligonucleotide
aaccagagcgaggccgggtctcatac

SEQ ID NO: 50349 - DNA, 25 bp, Artificial Sequence
  Description of Artificial Sequence: Synthetic oligonucleotide
accagagcgaggccgggtctcatac

SEQ ID NO: 50350 - DNA, 24 bp, Artificial Sequence
  Description of Artificial Sequence: Synthetic oligonucleotide
ccagagcgaggccgggtctcatac

SEQ ID NO: 50351 - DNA, 24 bp, Artificial Sequence
  Description of Artificial Sequence: Synthetic oligonucleotide
cagagcgaggccgggtctcatacc

SEQ ID NO: 50352 - DNA, 25 bp, Artificial Sequence
  Description of Artificial Sequence: Synthetic oligonucleotide
agagcgaggccgggtctcataccct

SEQ ID NO: 50353 - DNA, 24 bp, Artificial Sequence
  Description of Artificial Sequence: Synthetic oligonucleotide
gagcgaggccgggtctcataccct

SEQ ID NO: 50354 - DNA, 24 bp, Artificial Sequence
  Description of Artificial Sequence: Synthetic oligonucleotide
agcgaggccgggtctcataccctc

SEQ ID NO: 50355 - DNA, 23 bp, Artificial Sequence
  Description of Artificial Sequence: Synthetic oligonucleotide
gcgaggccgggtctcataccctc

SEQ ID NO: 50356 - DNA, 24 bp, Artificial Sequence
  Description of Artificial Sequence: Synthetic oligonucleotide
cgaggccgggtctcataccctcca

SEQ ID NO: 50357 - DNA, 25 bp, Artificial Sequence
  Description of Artificial Sequence: Synthetic oligonucleotide
gaggccgggtctcataccctccagt

SEQ ID NO: 50358 - DNA, 25 bp, Artificial Sequence
  Description of Artificial Sequence: Synthetic oligonucleotide
aggccgggtctcataccctccagtg

SEQ ID NO: 50359 - DNA, 24 bp, Artificial Sequence
  Description of Artificial Sequence: Synthetic oligonucleotide
ggccgggtctcataccctccagtg

SEQ ID NO: 50360 - DNA, 26 bp, Artificial Sequence
  Description of Artificial Sequence: Synthetic oligonucleotide
gccgggtctcataccctccagtggat

SEQ ID NO: 50361 - DNA, 27 bp, Artificial Sequence
  Description of Artificial Sequence: Synthetic oligonucleotide
ccgggtctcataccctccagtggatgt

SEQ ID NO: 50362 - DNA, 29 bp, Artificial Sequence
  Description of Artificial Sequence: Synthetic oligonucleotide
cgggtctcataccctccagtggatgtatg

SEQ ID NO: 50363 - DNA, 29 bp, Artificial Sequence
  Description of Artificial Sequence: Synthetic oligonucleotide
gggtctcataccctccagtggatgtatgg

SEQ ID NO: 50364 - DNA, 29 bp, Artificial Sequence
  Description of Artificial Sequence: Synthetic oligonucleotide
ggtctcataccctccagtggatgtatggc

SEQ ID NO: 50365 - DNA, 30 bp, Artificial Sequence
  Description of Artificial Sequence: Synthetic oligonucleotide
gtctcataccctccagtggatgtatggctg

SEQ ID NO: 50366 - DNA, 30 bp, Artificial Sequence
  Description of Artificial Sequence: Synthetic oligonucleotide
tctcataccctccagtggatgtatggctgc

SEQ ID NO: 50367 - DNA, 29 bp, Artificial Sequence
  Description of Artificial Sequence: Synthetic oligonucleotide
ctcataccctccagtggatgtatggctgc

SEQ ID NO: 50368 - DNA, 29 bp, Artificial Sequence
  Description of Artificial Sequence: Synthetic oligonucleotide
tcataccctccagtggatgtatggctgcg

SEQ ID NO: 50369 - DNA, 28 bp, Artificial Sequence
  Description of Artificial Sequence: Synthetic oligonucleotide
cataccctccagtggatgtatggctgcg

SEQ ID NO: 50370 - DNA, 29 bp, Artificial Sequence
  Description of Artificial Sequence: Synthetic oligonucleotide
ataccctccagtggatgtatggctgcgac

SEQ ID NO: 50371 - DNA, 28 bp, Artificial Sequence
  Description of Artificial Sequence: Synthetic oligonucleotide
taccctccagtggatgtatggctgcgac

SEQ ID NO: 50372 - DNA, 21 bp, Artificial Sequence
  Description of Artificial Sequence: Synthetic oligonucleotide
caagaggggagccgcgggcgt

SEQ ID NO: 50373 - DNA, 21 bp, Artificial Sequence
  Description of Artificial Sequence: Synthetic oligonucleotide
aagaggggagccgcgggcgtc

SEQ ID NO: 50374 - DNA, 20 bp, Artificial Sequence
  Description of Artificial Sequence: Synthetic oligonucleotide
agaggggagccgcgggcgtc

SEQ ID NO: 50375 - DNA, 20 bp, Artificial Sequence
  Description of Artificial Sequence: Synthetic oligonucleotide
gaggggagccgcgggcgtct

SEQ ID NO: 50376 - DNA, 20 bp, Artificial Sequence
  Description of Artificial Sequence: Synthetic oligonucleotide
aggggagccgcgggcgtcgt

SEQ ID NO: 50377 - DNA, 20 bp, Artificial Sequence
  Description of Artificial Sequence: Synthetic oligonucleotide
ggggagccgcgggcgtcgtt

SEQ ID NO: 50378 - DNA, 20 bp, Artificial Sequence
  Description of Artificial Sequence: Synthetic oligonucleotide
gggagccgcgggcgtcgtgt

SEQ ID NO: 50379 - DNA, 20 bp, Artificial Sequence
  Description of Artificial Sequence: Synthetic oligonucleotide
ggagccgcgggcgtcgtggt

SEQ ID NO: 50380 - DNA, 20 bp, Artificial Sequence
  Description of Artificial Sequence: Synthetic oligonucleotide
gagccgcgggcgtcgtgggt

SEQ ID NO: 50381 - DNA, 20 bp, Artificial Sequence
  Description of Artificial Sequence: Synthetic oligonucleotide
agccgcgggcgtcgtgggtg

SEQ ID NO: 50382 - DNA, 20 bp, Artificial Sequence
  Description of Artificial Sequence: Synthetic oligonucleotide
gccgcgggcgtcgtgggtgt

SEQ ID NO: 50383 - DNA, 20 bp, Artificial Sequence
  Description of Artificial Sequence: Synthetic oligonucleotide
ccgcgggcgtcgtgggtgga

SEQ ID NO: 50384 - DNA, 20 bp, Artificial Sequence
  Description of Artificial Sequence: Synthetic oligonucleotide
cgcgggcgtcgtgggtggag

SEQ ID NO: 50385 - DNA, 21 bp, Artificial Sequence
  Description of Artificial Sequence: Synthetic oligonucleotide
gcgggcgtcgtgggtggagca

SEQ ID NO: 50386 - DNA, 21 bp, Artificial Sequence
  Description of Artificial Sequence: Synthetic oligonucleotide
cgggcgtcgtgggtggagcag

SEQ ID NO: 50387 - DNA, 22 bp, Artificial Sequence
  Description of Artificial Sequence: Synthetic oligonucleotide
gggcgtcgtgggtggagcagga

SEQ ID NO: 50388 - DNA, 22 bp, Artificial Sequence
  Description of Artificial Sequence: Synthetic oligonucleotide
ggcgtcgtgggtggagcaggag

SEQ ID NO: 50389 - DNA, 22 bp, Artificial Sequence
  Description of Artificial Sequence: Synthetic oligonucleotide
gcgtcgtgggtggagcaggagg

SEQ ID NO: 50390 - DNA, 22 bp, Artificial Sequence
  Description of Artificial Sequence: Synthetic oligonucleotide
cgtcgtgggtggagcaggaggg

SEQ ID NO: 50391 - DNA, 22 bp, Artificial Sequence
  Description of Artificial Sequence: Synthetic oligonucleotide
gtcgtgggtggagcaggagggg

SEQ ID NO: 50392 - DNA, 22 bp, Artificial Sequence
  Description of Artificial Sequence: Synthetic oligonucleotide
tcgtgggtggagcaggaggggc

SEQ ID NO: 50393 - DNA, 27 bp, Artificial Sequence
  Description of Artificial Sequence: Synthetic oligonucleotide
agtggatgtatggctgcgacctggggt

SEQ ID NO: 50394 - DNA, 26 bp, Artificial Sequence
  Description of Artificial Sequence: Synthetic oligonucleotide
gtggatgtatggctgcgacctggggt

SEQ ID NO: 50395 - DNA, 26 bp, Artificial Sequence
  Description of Artificial Sequence: Synthetic oligonucleotide
tggatgtatggctgcgacctggggtc

SEQ ID NO: 50396 - DNA, 26 bp, Artificial Sequence
  Description of Artificial Sequence: Synthetic oligonucleotide
cagagagcctacctggagggcacgta

SEQ ID NO: 50397 - DNA, 26 bp, Artificial Sequence
  Description of Artificial Sequence: Synthetic oligonucleotide
agagagcctacctggagggcacgtac

SEQ ID NO: 50398 - DNA, 26 bp, Artificial Sequence
  Description of Artificial Sequence: Synthetic oligonucleotide
cgcgggtatgaccagtccgcctacta

SEQ ID NO: 50399 - DNA, 26 bp, Artificial Sequence
  Description of Artificial Sequence: Synthetic oligonucleotide
gcgggtatgaccagtccgcctactac

SEQ ID NO: 50400 - DNA, 26 bp, Artificial Sequence
  Description of Artificial Sequence: Synthetic oligonucleotide
cgggtatgaccagtccgcctactacg

SEQ ID NO: 50401 - DNA, 26 bp, Artificial Sequence
  Description of Artificial Sequence: Synthetic oligonucleotide
gggtatgaccagtccgcctactacgg

SEQ ID NO: 50402 - DNA, 27 bp, Artificial Sequence
  Description of Artificial Sequence: Synthetic oligonucleotide
ggtatgaccagtccgcctactacggca

SEQ ID NO: 50403 - DNA, 28 bp, Artificial Sequence
  Description of Artificial Sequence: Synthetic oligonucleotide
gtatgaccagtccgcctactacggcaag

SEQ ID NO: 50404 - DNA, 28 bp, Artificial Sequence
  Description of Artificial Sequence: Synthetic oligonucleotide
tatgaccagtccgcctactacggcaagg

SEQ ID NO: 50405 - DNA, 27 bp, Artificial Sequence
  Description of Artificial Sequence: Synthetic oligonucleotide
atgaccagtccgcctactacggcaagg

SEQ ID NO: 50406 - DNA, 27 bp, Artificial Sequence
  Description of Artificial Sequence: Synthetic oligonucleotide
tgaccagtccgcctactacggcaagga

SEQ ID NO: 50407 - DNA, 27 bp, Artificial Sequence
  Description of Artificial Sequence: Synthetic oligonucleotide
gaccagtccgcctactacggcaaggat

SEQ ID NO: 50408 - DNA, 29 bp, Artificial Sequence
  Description of Artificial Sequence: Synthetic oligonucleotide
accagtccgcctactacggcaaggattac

SEQ ID NO: 50409 - DNA, 28 bp, Artificial Sequence
  Description of Artificial Sequence: Synthetic oligonucleotide
ccagtccgcctactacggcaaggattac

SEQ ID NO: 50410 - DNA, 30 bp, Artificial Sequence
  Description of Artificial Sequence: Synthetic oligonucleotide
cagtccgcctactacggcaaggattacatc

SEQ ID NO: 50411 - DNA, 30 bp, Artificial Sequence
  Description of Artificial Sequence: Synthetic oligonucleotide
agtccgcctactacggcaaggattacatcg

SEQ ID NO: 50412 - DNA, 29 bp, Artificial Sequence
  Description of Artificial Sequence: Synthetic oligonucleotide
gtccgcctactacggcaaggattacatcg

SEQ ID NO: 50413 - DNA, 29 bp, Artificial Sequence
  Description of Artificial Sequence: Synthetic oligonucleotide
tccgcctactacggcaaggattacatcgc

SEQ ID NO: 50414 - DNA, 28 bp, Artificial Sequence
  Description of Artificial Sequence: Synthetic oligonucleotide
ccgcctactacggcaaggattacatcgc

SEQ ID NO: 50415 - DNA, 21 bp, Artificial Sequence
  Description of Artificial Sequence: Synthetic oligonucleotide
gcaagtgggaggcggccggtg

SEQ ID NO: 50416 - DNA, 21 bp, Artificial Sequence
  Description of Artificial Sequence: Synthetic oligonucleotide
caagtgggaggcggccggtgc

SEQ ID NO: 50417 - DNA, 21 bp, Artificial Sequence
  Description of Artificial Sequence: Synthetic oligonucleotide
aagtgggaggcggccggtgcg

SEQ ID NO: 50418 - DNA, 20 bp, Artificial Sequence
  Description of Artificial Sequence: Synthetic oligonucleotide
agtgggaggcggccggtgcg

SEQ ID NO: 50419 - DNA, 20 bp, Artificial Sequence
  Description of Artificial Sequence: Synthetic oligonucleotide
gtgggaggcggccggtgcgt

SEQ ID NO: 50420 - DNA, 20 bp, Artificial Sequence
  Description of Artificial Sequence: Synthetic oligonucleotide
tgggaggcggccggtgcggt

SEQ ID NO: 50421 - DNA, 20 bp, Artificial Sequence
  Description of Artificial Sequence: Synthetic oligonucleotide
gggaggcggccggtgcggtt

SEQ ID NO: 50422 - DNA, 20 bp, Artificial Sequence
  Description of Artificial Sequence: Synthetic oligonucleotide
gccggtgcggcggagcagca

SEQ ID NO: 50423 - DNA, 21 bp, Artificial Sequence
  Description of Artificial Sequence: Synthetic oligonucleotide
ccggtgcggcggagcagcaga

SEQ ID NO: 50424 - DNA, 22 bp, Artificial Sequence
  Description of Artificial Sequence: Synthetic oligonucleotide
cggtgcggcggagcagcagaga

SEQ ID NO: 50425 - DNA, 22 bp, Artificial Sequence
  Description of Artificial Sequence: Synthetic oligonucleotide
ggtgcggcggagcagcagagag

SEQ ID NO: 50426 - DNA, 21 bp, Artificial Sequence
  Description of Artificial Sequence: Synthetic oligonucleotide
ggcccgtgcggtggagcagca

SEQ ID NO: 50427 - DNA, 22 bp, Artificial Sequence
  Description of Artificial Sequence: Synthetic oligonucleotide
gcccgtgcggtggagcagcaga

SEQ ID NO: 50428 - DNA, 23 bp, Artificial Sequence
  Description of Artificial Sequence: Synthetic oligonucleotide
cccgtgcggtggagcagcagaga

SEQ ID NO: 50429 - DNA, 23 bp, Artificial Sequence
  Description of Artificial Sequence: Synthetic oligonucleotide
ccgtgcggtggagcagcagagag

SEQ ID NO: 50430 - DNA, 23 bp, Artificial Sequence
  Description of Artificial Sequence: Synthetic oligonucleotide
cgtgcggtggagcagcagagagc

SEQ ID NO: 50431 - DNA, 25 bp, Artificial Sequence
  Description of Artificial Sequence: Synthetic oligonucleotide
gtgcggtggagcagcagagagccta

SEQ ID NO: 50432 - DNA, 25 bp, Artificial Sequence
  Description of Artificial Sequence: Synthetic oligonucleotide
tgcggtggagcagcagagagcctac

SEQ ID NO: 50433 - DNA, 24 bp, Artificial Sequence
  Description of Artificial Sequence: Synthetic oligonucleotide
gcggtggagcagcagagagcctac

SEQ ID NO: 50434 - DNA, 25 bp, Artificial Sequence
  Description of Artificial Sequence: Synthetic oligonucleotide
cggtggagcagcagagagcctacct

SEQ ID NO: 50435 - DNA, 23 bp, Artificial Sequence
  Description of Artificial Sequence: Synthetic oligonucleotide
atgcgggtcatggcgccccaagc

SEQ ID NO: 50436 - DNA, 22 bp, Artificial Sequence
  Description of Artificial Sequence: Synthetic oligonucleotide
tgcgggtcatggcgccccaagc

SEQ ID NO: 50437 - DNA, 21 bp, Artificial Sequence
  Description of Artificial Sequence: Synthetic oligonucleotide
gcgggtcatggcgccccaagc

SEQ ID NO: 50438 - DNA, 21 bp, Artificial Sequence
  Description of Artificial Sequence: Synthetic oligonucleotide
cgggtcatggcgccccaagcc

SEQ ID NO: 50439 - DNA, 22 bp, Artificial Sequence
  Description of Artificial Sequence: Synthetic oligonucleotide
gggtcatggcgccccaagccct

SEQ ID NO: 50440 - DNA, 22 bp, Artificial Sequence
  Description of Artificial Sequence: Synthetic oligonucleotide
ggtcatggcgccccaagccctc

SEQ ID NO: 50441 - DNA, 23 bp, Artificial Sequence
  Description of Artificial Sequence: Synthetic oligonucleotide
gtcatggcgccccaagccctcct

SEQ ID NO: 50442 - DNA, 23 bp, Artificial Sequence
  Description of Artificial Sequence: Synthetic oligonucleotide
tcatggcgccccaagccctcctc

SEQ ID NO: 50443 - DNA, 22 bp, Artificial Sequence
  Description of Artificial Sequence: Synthetic oligonucleotide
catggcgccccaagccctcctc

SEQ ID NO: 50444 - DNA, 23 bp, Artificial Sequence
  Description of Artificial Sequence: Synthetic oligonucleotide
atggcgccccaagccctcctcct

SEQ ID NO: 50445 - DNA, 22 bp, Artificial Sequence
  Description of Artificial Sequence: Synthetic oligonucleotide
tggcgccccaagccctcctcct

SEQ ID NO: 50446 - DNA, 21 bp, Artificial Sequence
  Description of Artificial Sequence: Synthetic oligonucleotide
ggcgccccaagccctcctcct

SEQ ID NO: 50447 - DNA, 21 bp, Artificial Sequence
  Description of Artificial Sequence: Synthetic oligonucleotide
gcgccccaagccctcctcctg

SEQ ID NO: 50448 - DNA, 22 bp, Artificial Sequence
  Description of Artificial Sequence: Synthetic oligonucleotide
cgccccaagccctcctcctgct

SEQ ID NO: 50449 - DNA, 22 bp, Artificial Sequence
  Description of Artificial Sequence: Synthetic oligonucleotide
gccccaagccctcctcctgctg

SEQ ID NO: 50450 - DNA, 23 bp, Artificial Sequence
  Description of Artificial Sequence: Synthetic oligonucleotide
ccccaagccctcctcctgctgct

SEQ ID NO: 50451 - DNA, 24 bp, Artificial Sequence
  Description of Artificial Sequence: Synthetic oligonucleotide
cccaagccctcctcctgctgctct

SEQ ID NO: 50452 - DNA, 24 bp, Artificial Sequence
  Description of Artificial Sequence: Synthetic oligonucleotide
ccaagccctcctcctgctgctctc

SEQ ID NO: 50453 - DNA, 24 bp, Artificial Sequence
  Description of Artificial Sequence: Synthetic oligonucleotide
caagccctcctcctgctgctctcg

SEQ ID NO: 50454 - DNA, 24 bp, Artificial Sequence
  Description of Artificial Sequence: Synthetic oligonucleotide
aagccctcctcctgctgctctcgg

SEQ ID NO: 50455 - DNA, 23 bp, Artificial Sequence
  Description of Artificial Sequence: Synthetic oligonucleotide
ctctcgggagccctggccctgat

SEQ ID NO: 50456 - DNA, 23 bp, Artificial Sequence
  Description of Artificial Sequence: Synthetic oligonucleotide
tctcgggagccctggccctgatc

SEQ ID NO: 50457 - DNA, 22 bp, Artificial Sequence
  Description of Artificial Sequence: Synthetic oligonucleotide
ctcgggagccctggccctgatc

SEQ ID NO: 50458 - DNA, 23 bp, Artificial Sequence
  Description of Artificial Sequence: Synthetic oligonucleotide
tcgggagccctggccctgatcga

SEQ ID NO: 50459 - DNA, 22 bp, Artificial Sequence
  Description of Artificial Sequence: Synthetic oligonucleotide
cgggagccctggccctgatcga

SEQ ID NO: 50460 - DNA, 23 bp, Artificial Sequence
  Description of Artificial Sequence: Synthetic oligonucleotide
gggagccctggccctgatcgaga

SEQ ID NO: 50461 - DNA, 23 bp, Artificial Sequence
  Description of Artificial Sequence: Synthetic oligonucleotide
ggagccctggccctgatcgagac

SEQ ID NO: 50462 - DNA, 24 bp, Artificial Sequence
  Description of Artificial Sequence: Synthetic oligonucleotide
gagccctggccctgatcgagacct

SEQ ID NO: 50463 - DNA, 24 bp, Artificial Sequence
  Description of Artificial Sequence: Synthetic oligonucleotide
agccctggccctgatcgagacctg

SEQ ID NO: 50464 - DNA, 23 bp, Artificial Sequence
  Description of Artificial Sequence: Synthetic oligonucleotide
gccctggccctgatcgagacctg

SEQ ID NO: 50465 - DNA, 23 bp, Artificial Sequence
  Description of Artificial Sequence: Synthetic oligonucleotide
ccctggccctgatcgagacctgg

SEQ ID NO: 50466 - DNA, 23 bp, Artificial Sequence
  Description of Artificial Sequence: Synthetic oligonucleotide
cctggccctgatcgagacctggg

SEQ ID NO: 50467 - DNA, 23 bp, Artificial Sequence
  Description of Artificial Sequence: Synthetic oligonucleotide
ctggccctgatcgagacctgggc

SEQ ID NO: 50468 - DNA, 23 bp, Artificial Sequence
  Description of Artificial Sequence: Synthetic oligonucleotide
tggccctgatcgagacctgggcc

SEQ ID NO: 50469 - DNA, 22 bp, Artificial Sequence
  Description of Artificial Sequence: Synthetic oligonucleotide
ggccctgatcgagacctgggcc

SEQ ID NO: 50470 - DNA, 22 bp, Artificial Sequence
  Description of Artificial Sequence: Synthetic oligonucleotide
gccctgatcgagacctgggccg

SEQ ID NO: 50471 - DNA, 22 bp, Artificial Sequence
  Description of Artificial Sequence: Synthetic oligonucleotide
ccctgatcgagacctgggccgg

SEQ ID NO: 50472 - DNA, 23 bp, Artificial Sequence
  Description of Artificial Sequence: Synthetic oligonucleotide
cctgatcgagacctgggccggct

SEQ ID NO: 50473 - DNA, 23 bp, Artificial Sequence
  Description of Artificial Sequence: Synthetic oligonucleotide
ctgatcgagacctgggccggctc

SEQ ID NO: 50474 - DNA, 23 bp, Artificial Sequence
  Description of Artificial Sequence: Synthetic oligonucleotide
tgatcgagacctgggccggctcc

SEQ ID NO: 50475 - DNA, 22 bp, Artificial Sequence
  Description of Artificial Sequence: Synthetic oligonucleotide
gatcgagacctgggccggctcc

SEQ ID NO: 50476 - DNA, 23 bp, Artificial Sequence
  Description of Artificial Sequence: Synthetic oligonucleotide
atcgagacctgggccggctccca

SEQ ID NO: 50477 - DNA, 22 bp, Artificial Sequence
  Description of Artificial Sequence: Synthetic oligonucleotide
tcgagacctgggccggctccca

SEQ ID NO: 50478 - DNA, 28 bp, Artificial Sequence
  Description of Artificial Sequence: Synthetic oligonucleotide
accatccagaggatgtatggctgcgacc

SEQ ID NO: 50479 - DNA, 27 bp, Artificial Sequence
  Description of Artificial Sequence: Synthetic oligonucleotide
ccatccagaggatgtatggctgcgacc

SEQ ID NO: 50480 - DNA, 22 bp, Artificial Sequence
  Description of Artificial Sequence: Synthetic oligonucleotide
agacgctgcagcgcgcggaacg

SEQ ID NO: 50481 - DNA, 21 bp, Artificial Sequence
  Description of Artificial Sequence: Synthetic oligonucleotide
gacgctgcagcgcgcggaacg

SEQ ID NO: 50482 - DNA, 21 bp, Artificial Sequence
  Description of Artificial Sequence: Synthetic oligonucleotide
acgctgcagcgcgcggaacgc

SEQ ID NO: 50483 - DNA, 20 bp, Artificial Sequence
  Description of Artificial Sequence: Synthetic oligonucleotide
cgctgcagcgcgcggaacgc

SEQ ID NO: 50484 - DNA, 20 bp, Artificial Sequence
  Description of Artificial Sequence: Synthetic oligonucleotide
gctgcagcgcgcggaacgcc

SEQ ID NO: 50485 - DNA, 23 bp, Artificial Sequence
  Description of Artificial Sequence: Synthetic oligonucleotide
ctgcagcgcgcggaacgcccaaa

SEQ ID NO: 50486 - DNA, 24 bp, Artificial Sequence
  Description of Artificial Sequence: Synthetic oligonucleotide
tgcagcgcgcggaacgcccaaaga

SEQ ID NO: 50487 - DNA, 23 bp, Artificial Sequence
  Description of Artificial Sequence: Synthetic oligonucleotide
gcagcgcgcggaacgcccaaaga

SEQ ID NO: 50488 - DNA, 24 bp, Artificial Sequence
  Description of Artificial Sequence: Synthetic oligonucleotide
cagcgcgcggaacgcccaaagaca

SEQ ID NO: 50489 - DNA, 25 bp, Artificial Sequence
  Description of Artificial Sequence: Synthetic oligonucleotide
agcgcgcggaacgcccaaagacaca

SEQ ID NO: 50490 - DNA, 24 bp, Artificial Sequence
  Description of Artificial Sequence: Synthetic oligonucleotide
gcgcgcggaacgcccaaagacaca

SEQ ID NO: 50491 - DNA, 24 bp, Artificial Sequence
  Description of Artificial Sequence: Synthetic oligonucleotide
cgcgcggaacgcccaaagacacac

SEQ ID NO: 50492 - DNA, 25 bp, Artificial Sequence
  Description of Artificial Sequence: Synthetic oligonucleotide
gcgcggaacgcccaaagacacacgt

SEQ ID NO: 50493 - DNA, 26 bp, Artificial Sequence
  Description of Artificial Sequence: Synthetic oligonucleotide
cgcggaacgcccaaagacacacgtga

SEQ ID NO: 50494 - DNA, 26 bp, Artificial Sequence
  Description of Artificial Sequence: Synthetic oligonucleotide
gcggaacgcccaaagacacacgtgac

SEQ ID NO: 50495 - DNA, 26 bp, Artificial Sequence
  Description of Artificial Sequence: Synthetic oligonucleotide
cggaacgcccaaagacacacgtgacc

SEQ ID NO: 50496 - DNA, 27 bp, Artificial Sequence
  Description of Artificial Sequence: Synthetic oligonucleotide
ggaacgcccaaagacacacgtgaccca

SEQ ID NO: 50497 - DNA, 27 bp, Artificial Sequence
  Description of Artificial Sequence: Synthetic oligonucleotide
gaacgcccaaagacacacgtgacccac

SEQ ID NO: 50498 - DNA, 27 bp, Artificial Sequence
  Description of Artificial Sequence: Synthetic oligonucleotide
aacgcccaaagacacacgtgacccacc

SEQ ID NO: 50499 - DNA, 27 bp, Artificial Sequence
  Description of Artificial Sequence: Synthetic oligonucleotide
acgcccaaagacacacgtgacccacca

SEQ ID NO: 50500 - DNA, 27 bp, Artificial Sequence
  Description of Artificial Sequence: Synthetic oligonucleotide
cgcccaaagacacacgtgacccaccat

SEQ ID NO: 50501 - DNA, 27 bp, Artificial Sequence
  Description of Artificial Sequence: Synthetic oligonucleotide
gcccaaagacacacgtgacccaccatc

SEQ ID NO: 50502 - DNA, 25 bp, Artificial Sequence
  Description of Artificial Sequence: Synthetic oligonucleotide
tggcagcgggatggggaggaccaaa

SEQ ID NO: 50503 - DNA, 24 bp, Artificial Sequence
  Description of Artificial Sequence: Synthetic oligonucleotide
ggcagcgggatggggaggaccaaa

SEQ ID NO: 50504 - DNA, 25 bp, Artificial Sequence
  Description of Artificial Sequence: Synthetic oligonucleotide
gcagcgggatggggaggaccaaact

SEQ ID NO: 50505 - DNA, 26 bp, Artificial Sequence
  Description of Artificial Sequence: Synthetic oligonucleotide
cagcgggatggggaggaccaaactca

SEQ ID NO: 50506 - DNA, 26 bp, Artificial Sequence
  Description of Artificial Sequence: Synthetic oligonucleotide
agcgggatggggaggaccaaactcag

SEQ ID NO: 50507 - DNA, 25 bp, Artificial Sequence
  Description of Artificial Sequence: Synthetic oligonucleotide
gcgggatggggaggaccaaactcag

SEQ ID NO: 50508 - DNA, 26 bp, Artificial Sequence
  Description of Artificial Sequence: Synthetic oligonucleotide
cgggatggggaggaccaaactcagga

SEQ ID NO: 50509 - DNA, 25 bp, Artificial Sequence
  Description of Artificial Sequence: Synthetic oligonucleotide
agccctgcaccctgagatggaagcc

SEQ ID NO: 50510 - DNA, 24 bp, Artificial Sequence
  Description of Artificial Sequence: Synthetic oligonucleotide
gccctgcaccctgagatggaagcc

SEQ ID NO: 50511 - DNA, 25 bp, Artificial Sequence
  Description of Artificial Sequence: Synthetic oligonucleotide
ccctgcaccctgagatggaagccgt

SEQ ID NO: 50512 - DNA, 27 bp, Artificial Sequence
  Description of Artificial Sequence: Synthetic oligonucleotide
cctgcaccctgagatggaagccgtctt

SEQ ID NO: 50513 - DNA, 27 bp, Artificial Sequence
  Description of Artificial Sequence: Synthetic oligonucleotide
ctgcaccctgagatggaagccgtcttc

SEQ ID NO: 50514 - DNA, 27 bp, Artificial Sequence
  Description of Artificial Sequence: Synthetic oligonucleotide
tgcaccctgagatggaagccgtcttcc

SEQ ID NO: 50515 - DNA, 26 bp, Artificial Sequence
  Description of Artificial Sequence: Synthetic oligonucleotide
gcaccctgagatggaagccgtcttcc

SEQ ID NO: 50516 - DNA, 25 bp, Artificial Sequence
  Description of Artificial Sequence: Synthetic oligonucleotide
cgtcttcccagcccaccatccccaa

SEQ ID NO: 50517 - DNA, 27 bp, Artificial Sequence
  Description of Artificial Sequence: Synthetic oligonucleotide
gtcttcccagcccaccatccccaactt

SEQ ID NO: 50518 - DNA, 27 bp, Artificial Sequence
  Description of Artificial Sequence: Synthetic oligonucleotide
tcttcccagcccaccatccccaacttg

SEQ ID NO: 50519 - DNA, 26 bp, Artificial Sequence
  Description of Artificial Sequence: Synthetic oligonucleotide
cttcccagcccaccatccccaacttg

SEQ ID NO: 50520 - DNA, 26 bp, Artificial Sequence
  Description of Artificial Sequence: Synthetic oligonucleotide
ttcccagcccaccatccccaacttgg

SEQ ID NO: 50521 - DNA, 25 bp, Artificial Sequence
  Description of Artificial Sequence: Synthetic oligonucleotide
tcccagcccaccatccccaacttgg

SEQ ID NO: 50522 - DNA, 24 bp, Artificial Sequence
  Description of Artificial Sequence: Synthetic oligonucleotide
cccagcccaccatccccaacttgg

SEQ ID NO: 50523 - DNA, 24 bp, Artificial Sequence
  Description of Artificial Sequence: Synthetic oligonucleotide
ccagcccaccatccccaacttggg

SEQ ID NO: 50524 - DNA, 26 bp, Artificial Sequence
  Description of Artificial Sequence: Synthetic oligonucleotide
cagcccaccatccccaacttgggcat

SEQ ID NO: 50525 - DNA, 26 bp, Artificial Sequence
  Description of Artificial Sequence: Synthetic oligonucleotide
agcccaccatccccaacttgggcatc

SEQ ID NO: 50526 - DNA, 25 bp, Artificial Sequence
  Description of Artificial Sequence: Synthetic oligonucleotide
gcccaccatccccaacttgggcatc

SEQ ID NO: 50527 - DNA, 27 bp, Artificial Sequence
  Description of Artificial Sequence: Synthetic oligonucleotide
cccaccatccccaacttgggcatcgtt

SEQ ID NO: 50528 - DNA, 28 bp, Artificial Sequence
  Description of Artificial Sequence: Synthetic oligonucleotide
ccaccatccccaacttgggcatcgtttc

SEQ ID NO: 50529 - DNA, 29 bp, Artificial Sequence
  Description of Artificial Sequence: Synthetic oligonucleotide
caccatccccaacttgggcatcgtttctg

SEQ ID NO: 50530 - DNA, 29 bp, Artificial Sequence
  Description of Artificial Sequence: Synthetic oligonucleotide
accatccccaacttgggcatcgtttctgg

SEQ ID NO: 50531 - DNA, 28 bp, Artificial Sequence
  Description of Artificial Sequence: Synthetic oligonucleotide
ccatccccaacttgggcatcgtttctgg

SEQ ID NO: 50532 - DNA, 28 bp, Artificial Sequence
  Description of Artificial Sequence: Synthetic oligonucleotide
catccccaacttgggcatcgtttctggc

SEQ ID NO: 50533 - DNA, 28 bp, Artificial Sequence
  Description of Artificial Sequence: Synthetic oligonucleotide
atccccaacttgggcatcgtttctggcc

SEQ ID NO: 50534 - DNA, 27 bp, Artificial Sequence
  Description of Artificial Sequence: Synthetic oligonucleotide
tccccaacttgggcatcgtttctggcc

SEQ ID NO: 50535 - DNA, 26 bp, Artificial Sequence
  Description of Artificial Sequence: Synthetic oligonucleotide
ccccaacttgggcatcgtttctggcc

SEQ ID NO: 50536 - DNA, 27 bp, Artificial Sequence
  Description of Artificial Sequence: Synthetic oligonucleotide
cccaacttgggcatcgtttctggccca

SEQ ID NO: 50537 - DNA, 27 bp, Artificial Sequence
  Description of Artificial Sequence: Synthetic oligonucleotide
ccaacttgggcatcgtttctggcccag

SEQ ID NO: 50538 - DNA, 27 bp, Artificial Sequence
  Description of Artificial Sequence: Synthetic oligonucleotide
caacttgggcatcgtttctggcccagc

SEQ ID NO: 50539 - DNA, 28 bp, Artificial Sequence
  Description of Artificial Sequence: Synthetic oligonucleotide
aacttgggcatcgtttctggcccagctg

SEQ ID NO: 50540 - DNA, 27 bp, Artificial Sequence
  Description of Artificial Sequence: Synthetic oligonucleotide
acttgggcatcgtttctggcccagctg

SEQ ID NO: 50541 - DNA, 27 bp, Artificial Sequence
  Description of Artificial Sequence: Synthetic oligonucleotide
cttgggcatcgtttctggcccagctgt

SEQ ID NO: 50542 - DNA, 27 bp, Artificial Sequence
  Description of Artificial Sequence: Synthetic oligonucleotide
ttgggcatcgtttctggcccagctgtc

SEQ ID NO: 50543 - DNA, 26 bp, Artificial Sequence
  Description of Artificial Sequence: Synthetic oligonucleotide
tgggcatcgtttctggcccagctgtc

SEQ ID NO: 50544 - DNA, 25 bp, Artificial Sequence
  Description of Artificial Sequence: Synthetic oligonucleotide
gggcatcgtttctggcccagctgtc

SEQ ID NO: 50545 - DNA, 26 bp, Artificial Sequence
  Description of Artificial Sequence: Synthetic oligonucleotide
ggcatcgtttctggcccagctgtcct

SEQ ID NO: 50546 - DNA, 26 bp, Artificial Sequence
  Description of Artificial Sequence: Synthetic oligonucleotide
gcatcgtttctggcccagctgtcctg

SEQ ID NO: 50547 - DNA, 26 bp, Artificial Sequence
  Description of Artificial Sequence: Synthetic oligonucleotide
catcgtttctggcccagctgtcctgg

SEQ ID NO: 50548 - DNA, 27 bp, Artificial Sequence
  Description of Artificial Sequence: Synthetic oligonucleotide
atcgtttctggcccagctgtcctggct

SEQ ID NO: 50549 - DNA, 26 bp, Artificial Sequence
  Description of Artificial Sequence: Synthetic oligonucleotide
tcgtttctggcccagctgtcctggct

SEQ ID NO: 50550 - DNA, 25 bp, Artificial Sequence
  Description of Artificial Sequence: Synthetic oligonucleotide
cgtttctggcccagctgtcctggct

SEQ ID NO: 50551 - DNA, 26 bp, Artificial Sequence
  Description of Artificial Sequence: Synthetic oligonucleotide
gtttctggcccagctgtcctggctgt

SEQ ID NO: 50552 - DNA, 26 bp, Artificial Sequence
  Description of Artificial Sequence: Synthetic oligonucleotide
tttctggcccagctgtcctggctgtc

SEQ ID NO: 50553 - DNA, 25 bp, Artificial Sequence
  Description of Artificial Sequence: Synthetic oligonucleotide
ttctggcccagctgtcctggctgtc

SEQ ID NO: 50554 - DNA, 24 bp, Artificial Sequence
  Description of Artificial Sequence: Synthetic oligonucleotide
tctggcccagctgtcctggctgtc

SEQ ID NO: 50555 - DNA, 23 bp, Artificial Sequence
  Description of Artificial Sequence: Synthetic oligonucleotide
ctggcccagctgtcctggctgtc

SEQ ID NO: 50556 - DNA, 24 bp, Artificial Sequence
  Description of Artificial Sequence: Synthetic oligonucleotide
tggcccagctgtcctggctgtcct

SEQ ID NO: 50557 - DNA, 23 bp, Artificial Sequence
  Description of Artificial Sequence: Synthetic oligonucleotide
ggcccagctgtcctggctgtcct

SEQ ID NO: 50558 - DNA, 23 bp, Artificial Sequence
  Description of Artificial Sequence: Synthetic oligonucleotide
gcccagctgtcctggctgtcctg

SEQ ID NO: 50559 - DNA, 23 bp, Artificial Sequence
  Description of Artificial Sequence: Synthetic oligonucleotide
cccagctgtcctggctgtcctgg

SEQ ID NO: 50560 - DNA, 24 bp, Artificial Sequence
  Description of Artificial Sequence: Synthetic oligonucleotide
ccagctgtcctggctgtcctggct

SEQ ID NO: 50561 - DNA, 25 bp, Artificial Sequence
  Description of Artificial Sequence: Synthetic oligonucleotide
cagctgtcctggctgtcctggctgt

SEQ ID NO: 50562 - DNA, 25 bp, Artificial Sequence
  Description of Artificial Sequence: Synthetic oligonucleotide
agctgtcctggctgtcctggctgtc

SEQ ID NO: 50563 - DNA, 24 bp, Artificial Sequence
  Description of Artificial Sequence: Synthetic oligonucleotide
gctgtcctggctgtcctggctgtc

SEQ ID NO: 50564 - DNA, 25 bp, Artificial Sequence
  Description of Artificial Sequence: Synthetic oligonucleotide
ctgtcctggctgtcctggctgtcct

SEQ ID NO: 50565 - DNA, 25 bp, Artificial Sequence
  Description of Artificial Sequence: Synthetic oligonucleotide
tgtcctggctgtcctggctgtcctg

SEQ ID NO: 50566 - DNA, 24 bp, Artificial Sequence
  Description of Artificial Sequence: Synthetic oligonucleotide
gtcctggctgtcctggctgtcctg

SEQ ID NO: 50567 - DNA, 24 bp, Artificial Sequence
  Description of Artificial Sequence: Synthetic oligonucleotide
tcctggctgtcctggctgtcctgg

SEQ ID NO: 50568 - DNA, 23 bp, Artificial Sequence
  Description of Artificial Sequence: Synthetic oligonucleotide
cctggctgtcctggctgtcctgg

SEQ ID NO: 50569 - DNA, 24 bp, Artificial Sequence
  Description of Artificial Sequence: Synthetic oligonucleotide
ctggctgtcctggctgtcctggct

SEQ ID NO: 50570 - DNA, 25 bp, Artificial Sequence
  Description of Artificial Sequence: Synthetic oligonucleotide
tggctgtcctggctgtcctggctgt

SEQ ID NO: 50571 - DNA, 24 bp, Artificial Sequence
  Description of Artificial Sequence: Synthetic oligonucleotide
ggctgtcctggctgtcctggctgt

SEQ ID NO: 50572 - DNA, 26 bp, Artificial Sequence
  Description of Artificial Sequence: Synthetic oligonucleotide
ctgtcctggctgtcctggctgtccta

SEQ ID NO: 50573 - DNA, 26 bp, Artificial Sequence
  Description of Artificial Sequence: Synthetic oligonucleotide
tgtcctggctgtcctggctgtcctag

SEQ ID NO: 50574 - DNA, 25 bp, Artificial Sequence
  Description of Artificial Sequence: Synthetic oligonucleotide
gtcctggctgtcctggctgtcctag

SEQ ID NO: 50575 - DNA, 26 bp, Artificial Sequence
  Description of Artificial Sequence: Synthetic oligonucleotide
tcctggctgtcctggctgtcctagct

SEQ ID NO: 50576 - DNA, 28 bp, Artificial Sequence
  Description of Artificial Sequence: Synthetic oligonucleotide
tgtcctagctgtcctaggagctgtggtc

SEQ ID NO: 50577 - DNA, 27 bp, Artificial Sequence
  Description of Artificial Sequence: Synthetic oligonucleotide
gtcctagctgtcctaggagctgtggtc

SEQ ID NO: 50578 - DNA, 27 bp, Artificial Sequence
  Description of Artificial Sequence: Synthetic oligonucleotide
tcctagctgtcctaggagctgtggtcg

SEQ ID NO: 50579 - DNA, 26 bp, Artificial Sequence
  Description of Artificial Sequence: Synthetic oligonucleotide
cctagctgtcctaggagctgtggtcg

SEQ ID NO: 50580 - DNA, 27 bp, Artificial Sequence
  Description of Artificial Sequence: Synthetic oligonucleotide
ctagctgtcctaggagctgtggtcgct

SEQ ID NO: 50581 - DNA, 27 bp, Artificial Sequence
  Description of Artificial Sequence: Synthetic oligonucleotide
tagctgtcctaggagctgtggtcgctg

SEQ ID NO: 50582 - DNA, 26 bp, Artificial Sequence
  Description of Artificial Sequence: Synthetic oligonucleotide
agctgtcctaggagctgtggtcgctg

SEQ ID NO: 50583 - DNA, 25 bp, Artificial Sequence
  Description of Artificial Sequence: Synthetic oligonucleotide
gctgtcctaggagctgtggtcgctg

SEQ ID NO: 50584 - DNA, 26 bp, Artificial Sequence
  Description of Artificial Sequence: Synthetic oligonucleotide
ctgtcctaggagctgtggtcgctgct

SEQ ID NO: 50585 - DNA, 27 bp, Artificial Sequence
  Description of Artificial Sequence: Synthetic oligonucleotide
tgtcctaggagctgtggtcgctgctgt

SEQ ID NO: 50586 - DNA, 26 bp, Artificial Sequence
  Description of Artificial Sequence: Synthetic oligonucleotide
gtcctaggagctgtggtcgctgctgt

SEQ ID NO: 50587 - DNA, 27 bp, Artificial Sequence
  Description of Artificial Sequence: Synthetic oligonucleotide
tcctaggagctgtggtcgctgctgtga

SEQ ID NO: 50588 - DNA, 27 bp, Artificial Sequence
  Description of Artificial Sequence: Synthetic oligonucleotide
cctaggagctgtggtcgctgctgtgat

SEQ ID NO: 50589 - DNA, 28 bp, Artificial Sequence
  Description of Artificial Sequence: Synthetic oligonucleotide
ctaggagctgtggtcgctgctgtgatac

SEQ ID NO: 50590 - DNA, 31 bp, Artificial Sequence
  Description of Artificial Sequence: Synthetic oligonucleotide
taggagctgtggtcgctgctgtgatacatag

SEQ ID NO: 50591 - DNA, 30 bp, Artificial Sequence
  Description of Artificial Sequence: Synthetic oligonucleotide
aggagctgtggtcgctgctgtgatacatag

SEQ ID NO: 50592 - DNA, 29 bp, Artificial Sequence
  Description of Artificial Sequence: Synthetic oligonucleotide
ggagctgtggtcgctgctgtgatacatag

SEQ ID NO: 50593 - DNA, 29 bp, Artificial Sequence
  Description of Artificial Sequence: Synthetic oligonucleotide
gagctgtggtcgctgctgtgatacatagg

SEQ ID NO: 50594 - DNA, 30 bp, Artificial Sequence
  Description of Artificial Sequence: Synthetic oligonucleotide
agctgtggtcgctgctgtgatacataggag

SEQ ID NO: 50595 - DNA, 29 bp, Artificial Sequence
  Description of Artificial Sequence: Synthetic oligonucleotide
gctgtggtcgctgctgtgatacataggag

SEQ ID NO: 50596 - DNA, 29 bp, Artificial Sequence
  Description of Artificial Sequence: Synthetic oligonucleotide
ctgtggtcgctgctgtgatacataggagg

SEQ ID NO: 50597 - DNA, 31 bp, Artificial Sequence
  Description of Artificial Sequence: Synthetic oligonucleotide
tgtggtcgctgctgtgatacataggaggaag

SEQ ID NO: 50598 - DNA, 30 bp, Artificial Sequence
  Description of Artificial Sequence: Synthetic oligonucleotide
gtggtcgctgctgtgatacataggaggaag

SEQ ID NO: 50599 - DNA, 31 bp, Artificial Sequence
  Description of Artificial Sequence: Synthetic oligonucleotide
tggtcgctgctgtgatacataggaggaagag

SEQ ID NO: 50600 - DNA, 30 bp, Artificial Sequence
  Description of Artificial Sequence: Synthetic oligonucleotide
ggtcgctgctgtgatacataggaggaagag

SEQ ID NO: 50601 - DNA, 30 bp, Artificial Sequence
  Description of Artificial Sequence: Synthetic oligonucleotide
gtcgctgctgtgatacataggaggaagagc

SEQ ID NO: 50602 - DNA, 31 bp, Artificial Sequence
  Description of Artificial Sequence: Synthetic oligonucleotide
tcgctgctgtgatacataggaggaagagctc

SEQ ID NO: 50603 - DNA, 30 bp, Artificial Sequence
  Description of Artificial Sequence: Synthetic oligonucleotide
cgctgctgtgatacataggaggaagagctc

SEQ ID NO: 50604 - DNA, 31 bp, Artificial Sequence
  Description of Artificial Sequence: Synthetic oligonucleotide
gctgctgtgatacataggaggaagagctcag

SEQ ID NO: 50605 - DNA, 31 bp, Artificial Sequence
  Description of Artificial Sequence: Synthetic oligonucleotide
ctgctgtgatacataggaggaagagctcagg

SEQ ID NO: 50606 - DNA, 32 bp, Artificial Sequence
  Description of Artificial Sequence: Synthetic oligonucleotide
tgctgtgatacataggaggaagagctcaggtg

SEQ ID NO: 50607 - DNA, 31 bp, Artificial Sequence
  Description of Artificial Sequence: Synthetic oligonucleotide
gctgtgatacataggaggaagagctcaggtg

SEQ ID NO: 50608 - DNA, 31 bp, Artificial Sequence
  Description of Artificial Sequence: Synthetic oligonucleotide
ctgtgatacataggaggaagagctcaggtgg

SEQ ID NO: 50609 - DNA, 35 bp, Artificial Sequence
  Description of Artificial Sequence: Synthetic oligonucleotide
tgtgatacataggaggaagagctcaggtggaaaag

SEQ ID NO: 50610 - DNA, 34 bp, Artificial Sequence
  Description of Artificial Sequence: Synthetic oligonucleotide
gtgatacataggaggaagagctcaggtggaaaag

SEQ ID NO: 50611 - DNA, 34 bp, Artificial Sequence
  Description of Artificial Sequence: Synthetic oligonucleotide
tgatacataggaggaagagctcaggtggaaaagg

SEQ ID NO: 50612 - DNA, 33 bp, Artificial Sequence
  Description of Artificial Sequence: Synthetic oligonucleotide
gatacataggaggaagagctcaggtggaaaagg

SEQ ID NO: 50613 - DNA, 34 bp, Artificial Sequence
  Description of Artificial Sequence: Synthetic oligonucleotide
atacataggaggaagagctcaggtggaaaaggag

SEQ ID NO: 50614 - DNA, 33 bp, Artificial Sequence
  Description of Artificial Sequence: Synthetic oligonucleotide
tacataggaggaagagctcaggtggaaaaggag

SEQ ID NO: 50615 - DNA, 32 bp, Artificial Sequence
  Description of Artificial Sequence: Synthetic oligonucleotide
acataggaggaagagctcaggtggaaaaggag

SEQ ID NO: 50616 - DNA, 31 bp, Artificial Sequence
  Description of Artificial Sequence: Synthetic oligonucleotide
cataggaggaagagctcaggtggaaaaggag

SEQ ID NO: 50617 - DNA, 31 bp, Artificial Sequence
  Description of Artificial Sequence: Synthetic oligonucleotide
ataggaggaagagctcaggtggaaaaggagg

SEQ ID NO: 50618 - DNA, 25 bp, Artificial Sequence
  Description of Artificial Sequence: Synthetic oligonucleotide
caggagccctgcaccctgagatgga

SEQ ID NO: 50619 - DNA, 24 bp, Artificial Sequence
  Description of Artificial Sequence: Synthetic oligonucleotide
ccctggccctgatcgagacctgga

SEQ ID NO: 50620 - DNA, 24 bp, Artificial Sequence
  Description of Artificial Sequence: Synthetic oligonucleotide
cctggccctgatcgagacctggac

SEQ ID NO: 50621 - DNA, 24 bp, Artificial Sequence
  Description of Artificial Sequence: Synthetic oligonucleotide
ctggccctgatcgagacctggacc

SEQ ID NO: 50622 - DNA, 24 bp, Artificial Sequence
  Description of Artificial Sequence: Synthetic oligonucleotide
tggccctgatcgagacctggaccg

SEQ ID NO: 50623 - DNA, 23 bp, Artificial Sequence
  Description of Artificial Sequence: Synthetic oligonucleotide
ggccctgatcgagacctggaccg

SEQ ID NO: 50624 - DNA, 23 bp, Artificial Sequence
  Description of Artificial Sequence: Synthetic oligonucleotide
gccctgatcgagacctggaccgg

SEQ ID NO: 50625 - DNA, 24 bp, Artificial Sequence
  Description of Artificial Sequence: Synthetic oligonucleotide
ccctgatcgagacctggaccggct

SEQ ID NO: 50626 - DNA, 24 bp, Artificial Sequence
  Description of Artificial Sequence: Synthetic oligonucleotide
cctgatcgagacctggaccggctc

SEQ ID NO: 50627 - DNA, 24 bp, Artificial Sequence
  Description of Artificial Sequence: Synthetic oligonucleotide
ctgatcgagacctggaccggctcc

SEQ ID NO: 50628 - DNA, 25 bp, Artificial Sequence
  Description of Artificial Sequence: Synthetic oligonucleotide
tgatcgagacctggaccggctccca

SEQ ID NO: 50629 - DNA, 24 bp, Artificial Sequence
  Description of Artificial Sequence: Synthetic oligonucleotide
gatcgagacctggaccggctccca

SEQ ID NO: 50630 - DNA, 25 bp, Artificial Sequence
  Description of Artificial Sequence: Synthetic oligonucleotide
atcgagacctggaccggctcccact

SEQ ID NO: 50631 - DNA, 24 bp, Artificial Sequence
  Description of Artificial Sequence: Synthetic oligonucleotide
tcgagacctggaccggctcccact

SEQ ID NO: 50632 - DNA, 23 bp, Artificial Sequence
  Description of Artificial Sequence: Synthetic oligonucleotide
cgagacctggaccggctcccact

SEQ ID NO: 50633 - DNA, 23 bp, Artificial Sequence
  Description of Artificial Sequence: Synthetic oligonucleotide
gagacctggaccggctcccactc

SEQ ID NO: 50634 - DNA, 25 bp, Artificial Sequence
  Description of Artificial Sequence: Synthetic oligonucleotide
agacctggaccggctcccactccat

SEQ ID NO: 50635 - DNA, 24 bp, Artificial Sequence
  Description of Artificial Sequence: Synthetic oligonucleotide
gacctggaccggctcccactccat

SEQ ID NO: 50636 - DNA, 25 bp, Artificial Sequence
  Description of Artificial Sequence: Synthetic oligonucleotide
acctggaccggctcccactccatga

SEQ ID NO: 50637 - DNA, 24 bp, Artificial Sequence
  Description of Artificial Sequence: Synthetic oligonucleotide
cctggaccggctcccactccatga

SEQ ID NO: 50638 - DNA, 24 bp, Artificial Sequence
  Description of Artificial Sequence: Synthetic oligonucleotide
ctggaccggctcccactccatgag

SEQ ID NO: 50639 - DNA, 27 bp, Artificial Sequence
  Description of Artificial Sequence: Synthetic oligonucleotide
tggaccggctcccactccatgaggtat

SEQ ID NO: 50640 - DNA, 27 bp, Artificial Sequence
  Description of Artificial Sequence: Synthetic oligonucleotide
ggaccggctcccactccatgaggtatt

SEQ ID NO: 50641 - DNA, 28 bp, Artificial Sequence
  Description of Artificial Sequence: Synthetic oligonucleotide
gaccggctcccactccatgaggtatttc

SEQ ID NO: 50642 - DNA, 30 bp, Artificial Sequence
  Description of Artificial Sequence: Synthetic oligonucleotide
accggctcccactccatgaggtatttctac

SEQ ID NO: 50643 - DNA, 21 bp, Artificial Sequence
  Description of Artificial Sequence: Synthetic oligonucleotide
gccgtgggtggagcaggaggc

SEQ ID NO: 50644 - DNA, 21 bp, Artificial Sequence
  Description of Artificial Sequence: Synthetic oligonucleotide
ccgtgggtggagcaggaggcg

SEQ ID NO: 50645 - DNA, 21 bp, Artificial Sequence
  Description of Artificial Sequence: Synthetic oligonucleotide
cgtgggtggagcaggaggcgc

SEQ ID NO: 50646 - DNA, 21 bp, Artificial Sequence
  Description of Artificial Sequence: Synthetic oligonucleotide
gtgggtggagcaggaggcgcc

SEQ ID NO: 50647 - DNA, 21 bp, Artificial Sequence
  Description of Artificial Sequence: Synthetic oligonucleotide
tgggtggagcaggaggcgccg

SEQ ID NO: 50648 - DNA, 20 bp, Artificial Sequence
  Description of Artificial Sequence: Synthetic oligonucleotide
gggtggagcaggaggcgccg

SEQ ID NO: 50649 - DNA, 21 bp, Artificial Sequence
  Description of Artificial Sequence: Synthetic oligonucleotide
ggtggagcaggaggcgccgga

SEQ ID NO: 50650 - DNA, 25 bp, Artificial Sequence
  Description of Artificial Sequence: Synthetic oligonucleotide
gtggagcaggaggcgccggagtatt

SEQ ID NO: 50651 - DNA, 25 bp, Artificial Sequence
  Description of Artificial Sequence: Synthetic oligonucleotide
tggagcaggaggcgccggagtattg

SEQ ID NO: 50652 - DNA, 24 bp, Artificial Sequence
  Description of Artificial Sequence: Synthetic oligonucleotide
ggagcaggaggcgccggagtattg

SEQ ID NO: 50653 - DNA, 24 bp, Artificial Sequence
  Description of Artificial Sequence: Synthetic oligonucleotide
aggaggcgccggagtattgggacc

SEQ ID NO: 50654 - DNA, 23 bp, Artificial Sequence
  Description of Artificial Sequence: Synthetic oligonucleotide
ggaggcgccggagtattgggacc

SEQ ID NO: 50655 - DNA, 23 bp, Artificial Sequence
  Description of Artificial Sequence: Synthetic oligonucleotide
gaggcgccggagtattgggaccg

SEQ ID NO: 50656 - DNA, 23 bp, Artificial Sequence
  Description of Artificial Sequence: Synthetic oligonucleotide
aggcgccggagtattgggaccgg

SEQ ID NO: 50657 - DNA, 22 bp, Artificial Sequence
  Description of Artificial Sequence: Synthetic oligonucleotide
ggcgccggagtattgggaccgg

SEQ ID NO: 50658 - DNA, 23 bp, Artificial Sequence
  Description of Artificial Sequence: Synthetic oligonucleotide
gcgccggagtattgggaccggga

SEQ ID NO: 50659 - DNA, 24 bp, Artificial Sequence
  Description of Artificial Sequence: Synthetic oligonucleotide
cgccggagtattgggaccgggaga

SEQ ID NO: 50660 - DNA, 23 bp, Artificial Sequence
  Description of Artificial Sequence: Synthetic oligonucleotide
gcggcggacacggcggctcatat

SEQ ID NO: 50661 - DNA, 24 bp, Artificial Sequence
  Description of Artificial Sequence: Synthetic oligonucleotide
cggcggacacggcggctcatatct

SEQ ID NO: 50662 - DNA, 24 bp, Artificial Sequence
  Description of Artificial Sequence: Synthetic oligonucleotide
ggcggacacggcggctcatatctc

SEQ ID NO: 50663 - DNA, 24 bp, Artificial Sequence
  Description of Artificial Sequence: Synthetic oligonucleotide
gcggacacggcggctcatatctcc

SEQ ID NO: 50664 - DNA, 25 bp, Artificial Sequence
  Description of Artificial Sequence: Synthetic oligonucleotide
cggacacggcggctcatatctccca

SEQ ID NO: 50665 - DNA, 25 bp, Artificial Sequence
  Description of Artificial Sequence: Synthetic oligonucleotide
ggacacggcggctcatatctcccag

SEQ ID NO: 50666 - DNA, 25 bp, Artificial Sequence
  Description of Artificial Sequence: Synthetic oligonucleotide
gacacggcggctcatatctcccagc

SEQ ID NO: 50667 - DNA, 25 bp, Artificial Sequence
  Description of Artificial Sequence: Synthetic oligonucleotide
acacggcggctcatatctcccagcg

SEQ ID NO: 50668 - DNA, 24 bp, Artificial Sequence
  Description of Artificial Sequence: Synthetic oligonucleotide
cacggcggctcatatctcccagcg

SEQ ID NO: 50669 - DNA, 26 bp, Artificial Sequence
  Description of Artificial Sequence: Synthetic oligonucleotide
acggcggctcatatctcccagcgcaa

SEQ ID NO: 50670 - DNA, 25 bp, Artificial Sequence
  Description of Artificial Sequence: Synthetic oligonucleotide
cggcggctcatatctcccagcgcaa

SEQ ID NO: 50671 - DNA, 27 bp, Artificial Sequence
  Description of Artificial Sequence: Synthetic oligonucleotide
ggcggctcatatctcccagcgcaagtt

SEQ ID NO: 50672 - DNA, 27 bp, Artificial Sequence
  Description of Artificial Sequence: Synthetic oligonucleotide
gcggctcatatctcccagcgcaagttg

SEQ ID NO: 50673 - DNA, 27 bp, Artificial Sequence
  Description of Artificial Sequence: Synthetic oligonucleotide
cggctcatatctcccagcgcaagttgg

SEQ ID NO: 50674 - DNA, 28 bp, Artificial Sequence
  Description of Artificial Sequence: Synthetic oligonucleotide
ggctcatatctcccagcgcaagttggag

SEQ ID NO: 50675 - DNA, 28 bp, Artificial Sequence
  Description of Artificial Sequence: Synthetic oligonucleotide
gctcatatctcccagcgcaagttggagg

SEQ ID NO: 50676 - DNA, 28 bp, Artificial Sequence
  Description of Artificial Sequence: Synthetic oligonucleotide
ctcatatctcccagcgcaagttggaggc

SEQ ID NO: 50677 - DNA, 28 bp, Artificial Sequence
  Description of Artificial Sequence: Synthetic oligonucleotide
tcatatctcccagcgcaagttggaggcg

SEQ ID NO: 50678 - DNA, 27 bp, Artificial Sequence
  Description of Artificial Sequence: Synthetic oligonucleotide
catatctcccagcgcaagttggaggcg

SEQ ID NO: 50679 - DNA, 27 bp, Artificial Sequence
  Description of Artificial Sequence: Synthetic oligonucleotide
atatctcccagcgcaagttggaggcgg

SEQ ID NO: 50680 - DNA, 26 bp, Artificial Sequence
  Description of Artificial Sequence: Synthetic oligonucleotide
tatctcccagcgcaagttggaggcgg

SEQ ID NO: 50681 - DNA, 28 bp, Artificial Sequence
  Description of Artificial Sequence: Synthetic oligonucleotide
gctgtcctggttgtcctagctgtcctag

SEQ ID NO: 50682 - DNA, 28 bp, Artificial Sequence
  Description of Artificial Sequence: Synthetic oligonucleotide
ctgtcctggttgtcctagctgtcctagg

SEQ ID NO: 50683 - DNA, 29 bp, Artificial Sequence
  Description of Artificial Sequence: Synthetic oligonucleotide
tgtcctggttgtcctagctgtcctaggag

SEQ ID NO: 50684 - DNA, 28 bp, Artificial Sequence
  Description of Artificial Sequence: Synthetic oligonucleotide
gtcctggttgtcctagctgtcctaggag

SEQ ID NO: 50685 - DNA, 28 bp, Artificial Sequence
  Description of Artificial Sequence: Synthetic oligonucleotide
tcctggttgtcctagctgtcctaggagc

SEQ ID NO: 50686 - DNA, 27 bp, Artificial Sequence
  Description of Artificial Sequence: Synthetic oligonucleotide
cctggttgtcctagctgtcctaggagc

SEQ ID NO: 50687 - DNA, 28 bp, Artificial Sequence
  Description of Artificial Sequence: Synthetic oligonucleotide
ctggttgtcctagctgtcctaggagctg

SEQ ID NO: 50688 - DNA, 29 bp, Artificial Sequence
  Description of Artificial Sequence: Synthetic oligonucleotide
tggttgtcctagctgtcctaggagctgtg

SEQ ID NO: 50689 - DNA, 28 bp, Artificial Sequence
  Description of Artificial Sequence: Synthetic oligonucleotide
ggttgtcctagctgtcctaggagctgtg

SEQ ID NO: 50690 - DNA, 28 bp, Artificial Sequence
  Description of Artificial Sequence: Synthetic oligonucleotide
gttgtcctagctgtcctaggagctgtgg

SEQ ID NO: 50691 - DNA, 29 bp, Artificial Sequence
  Description of Artificial Sequence: Synthetic oligonucleotide
ttgtcctagctgtcctaggagctgtggtg

SEQ ID NO: 50692 - DNA, 34 bp, Artificial Sequence
  Description of Artificial Sequence: Synthetic oligonucleotide
atgcgccctgaagacagaatgttccatatcagag

SEQ ID NO: 50693 - DNA, 33 bp, Artificial Sequence
  Description of Artificial Sequence: Synthetic oligonucleotide
tgcgccctgaagacagaatgttccatatcagag

SEQ ID NO: 50694 - DNA, 32 bp, Artificial Sequence
  Description of Artificial Sequence: Synthetic oligonucleotide
gcgccctgaagacagaatgttccatatcagag

SEQ ID NO: 50695 - DNA, 32 bp, Artificial Sequence
  Description of Artificial Sequence: Synthetic oligonucleotide
cgccctgaagacagaatgttccatatcagagc

SEQ ID NO: 50696 - DNA, 33 bp, Artificial Sequence
  Description of Artificial Sequence: Synthetic oligonucleotide
gccctgaagacagaatgttccatatcagagctg

SEQ ID NO: 50697 - DNA, 34 bp, Artificial Sequence
  Description of Artificial Sequence: Synthetic oligonucleotide
ccctgaagacagaatgttccatatcagagctgtg

SEQ ID NO: 50698 - DNA, 36 bp, Artificial Sequence
  Description of Artificial Sequence: Synthetic oligonucleotide
cctgaagacagaatgttccatatcagagctgtgatc

SEQ ID NO: 50699 - DNA, 38 bp, Artificial Sequence
  Description of Artificial Sequence: Synthetic oligonucleotide
ctgaagacagaatgttccatatcagagctgtgatcttg

SEQ ID NO: 50700 - DNA, 39 bp, Artificial Sequence
  Description of Artificial Sequence: Synthetic oligonucleotide
tgaagacagaatgttccatatcagagctgtgatcttgag

SEQ ID NO: 50701 - DNA, 38 bp, Artificial Sequence
  Description of Artificial Sequence: Synthetic oligonucleotide
gaagacagaatgttccatatcagagctgtgatcttgag

SEQ ID NO: 50702 - DNA, 39 bp, Artificial Sequence
  Description of Artificial Sequence: Synthetic oligonucleotide
aagacagaatgttccatatcagagctgtgatcttgagag

SEQ ID NO: 50703 - DNA, 38 bp, Artificial Sequence
  Description of Artificial Sequence: Synthetic oligonucleotide
agacagaatgttccatatcagagctgtgatcttgagag

SEQ ID NO: 50704 - DNA, 37 bp, Artificial Sequence
  Description of Artificial Sequence: Synthetic oligonucleotide
gacagaatgttccatatcagagctgtgatcttgagag

SEQ ID NO: 50705 - DNA, 37 bp, Artificial Sequence
  Description of Artificial Sequence: Synthetic oligonucleotide
acagaatgttccatatcagagctgtgatcttgagagc

SEQ ID NO: 50706 - DNA, 36 bp, Artificial Sequence
  Description of Artificial Sequence: Synthetic oligonucleotide
cagaatgttccatatcagagctgtgatcttgagagc

SEQ ID NO: 50707 - DNA, 36 bp, Artificial Sequence
  Description of Artificial Sequence: Synthetic oligonucleotide
agaatgttccatatcagagctgtgatcttgagagcc

SEQ ID NO: 50708 - DNA, 35 bp, Artificial Sequence
  Description of Artificial Sequence: Synthetic oligonucleotide
gaatgttccatatcagagctgtgatcttgagagcc

SEQ ID NO: 50709 - DNA, 35 bp, Artificial Sequence
  Description of Artificial Sequence: Synthetic oligonucleotide
aatgttccatatcagagctgtgatcttgagagccc

SEQ ID NO: 50710 - DNA, 34 bp, Artificial Sequence
  Description of Artificial Sequence: Synthetic oligonucleotide
atgttccatatcagagctgtgatcttgagagccc

SEQ ID NO: 50711 - DNA, 33 bp, Artificial Sequence
  Description of Artificial Sequence: Synthetic oligonucleotide
tgttccatatcagagctgtgatcttgagagccc

SEQ ID NO: 50712 - DNA, 32 bp, Artificial Sequence
  Description of Artificial Sequence: Synthetic oligonucleotide
gttccatatcagagctgtgatcttgagagccc

SEQ ID NO: 50713 - DNA, 33 bp, Artificial Sequence
  Description of Artificial Sequence: Synthetic oligonucleotide
ttccatatcagagctgtgatcttgagagccctc

SEQ ID NO: 50714 - DNA, 32 bp, Artificial Sequence
  Description of Artificial Sequence: Synthetic oligonucleotide
tccatatcagagctgtgatcttgagagccctc

SEQ ID NO: 50715 - DNA, 31 bp, Artificial Sequence
  Description of Artificial Sequence: Synthetic oligonucleotide
ccatatcagagctgtgatcttgagagccctc

SEQ ID NO: 50716 - DNA, 32 bp, Artificial Sequence
  Description of Artificial Sequence: Synthetic oligonucleotide
catatcagagctgtgatcttgagagccctctc

SEQ ID NO: 50717 - DNA, 32 bp, Artificial Sequence
  Description of Artificial Sequence: Synthetic oligonucleotide
atatcagagctgtgatcttgagagccctctcc

SEQ ID NO: 50718 - DNA, 31 bp, Artificial Sequence
  Description of Artificial Sequence: Synthetic oligonucleotide
tatcagagctgtgatcttgagagccctctcc

SEQ ID NO: 50719 - DNA, 30 bp, Artificial Sequence
  Description of Artificial Sequence: Synthetic oligonucleotide
atcagagctgtgatcttgagagccctctcc

SEQ ID NO: 50720 - DNA, 29 bp, Artificial Sequence
  Description of Artificial Sequence: Synthetic oligonucleotide
tcagagctgtgatcttgagagccctctcc

SEQ ID NO: 50721 - DNA, 28 bp, Artificial Sequence
  Description of Artificial Sequence: Synthetic oligonucleotide
cagagctgtgatcttgagagccctctcc

SEQ ID NO: 50722 - DNA, 30 bp, Artificial Sequence
  Description of Artificial Sequence: Synthetic oligonucleotide
agagctgtgatcttgagagccctctccttg

SEQ ID NO: 50723 - DNA, 29 bp, Artificial Sequence
  Description of Artificial Sequence: Synthetic oligonucleotide
gagctgtgatcttgagagccctctccttg

SEQ ID NO: 50724 - DNA, 29 bp, Artificial Sequence
  Description of Artificial Sequence: Synthetic oligonucleotide
agctgtgatcttgagagccctctccttgg

SEQ ID NO: 50725 - DNA, 28 bp, Artificial Sequence
  Description of Artificial Sequence: Synthetic oligonucleotide
gctgtgatcttgagagccctctccttgg

SEQ ID NO: 50726 - DNA, 28 bp, Artificial Sequence
  Description of Artificial Sequence: Synthetic oligonucleotide
ctgtgatcttgagagccctctccttggc

SEQ ID NO: 50727 - DNA, 31 bp, Artificial Sequence
  Description of Artificial Sequence: Synthetic oligonucleotide
tgtgatcttgagagccctctccttggctttc

SEQ ID NO: 50728 - DNA, 30 bp, Artificial Sequence
  Description of Artificial Sequence: Synthetic oligonucleotide
gtgatcttgagagccctctccttggctttc

SEQ ID NO: 50729 - DNA, 30 bp, Artificial Sequence
  Description of Artificial Sequence: Synthetic oligonucleotide
tgatcttgagagccctctccttggctttcc

SEQ ID NO: 50730 - DNA, 29 bp, Artificial Sequence
  Description of Artificial Sequence: Synthetic oligonucleotide
gatcttgagagccctctccttggctttcc

SEQ ID NO: 50731 - DNA, 30 bp, Artificial Sequence
  Description of Artificial Sequence: Synthetic oligonucleotide
atcttgagagccctctccttggctttcctg

SEQ ID NO: 50732 - DNA, 29 bp, Artificial Sequence
  Description of Artificial Sequence: Synthetic oligonucleotide
tcttgagagccctctccttggctttcctg

SEQ ID NO: 50733 - DNA, 28 bp, Artificial Sequence
  Description of Artificial Sequence: Synthetic oligonucleotide
cttgagagccctctccttggctttcctg

SEQ ID NO: 50734 - DNA, 28 bp, Artificial Sequence
  Description of Artificial Sequence: Synthetic oligonucleotide
ttgagagccctctccttggctttcctgc

SEQ ID NO: 50735 - DNA, 27 bp, Artificial Sequence
  Description of Artificial Sequence: Synthetic oligonucleotide
tgagagccctctccttggctttcctgc

SEQ ID NO: 50736 - DNA, 27 bp, Artificial Sequence
  Description of Artificial Sequence: Synthetic oligonucleotide
gagagccctctccttggctttcctgct

SEQ ID NO: 50737 - DNA, 27 bp, Artificial Sequence
  Description of Artificial Sequence: Synthetic oligonucleotide
agagccctctccttggctttcctgctg

SEQ ID NO: 50738 - DNA, 27 bp, Artificial Sequence
  Description of Artificial Sequence: Synthetic oligonucleotide
gagccctctccttggctttcctgctga

SEQ ID NO: 50739 - DNA, 27 bp, Artificial Sequence
  Description of Artificial Sequence: Synthetic oligonucleotide
agccctctccttggctttcctgctgag

SEQ ID NO: 50740 - DNA, 27 bp, Artificial Sequence
  Description of Artificial Sequence: Synthetic oligonucleotide
gccctctccttggctttcctgctgagt

SEQ ID NO: 50741 - DNA, 27 bp, Artificial Sequence
  Description of Artificial Sequence: Synthetic oligonucleotide
ccctctccttggctttcctgctgagtc

SEQ ID NO: 50742 - DNA, 28 bp, Artificial Sequence
  Description of Artificial Sequence: Synthetic oligonucleotide
cctctccttggctttcctgctgagtctc

SEQ ID NO: 50743 - DNA, 28 bp, Artificial Sequence
  Description of Artificial Sequence: Synthetic oligonucleotide
ctctccttggctttcctgctgagtctcc

SEQ ID NO: 50744 - DNA, 28 bp, Artificial Sequence
  Description of Artificial Sequence: Synthetic oligonucleotide
tctccttggctttcctgctgagtctccg

SEQ ID NO: 50745 - DNA, 27 bp, Artificial Sequence
  Description of Artificial Sequence: Synthetic oligonucleotide
ctccttggctttcctgctgagtctccg

SEQ ID NO: 50746 - DNA, 28 bp, Artificial Sequence
  Description of Artificial Sequence: Synthetic oligonucleotide
tccttggctttcctgctgagtctccgag

SEQ ID NO: 50747 - DNA, 27 bp, Artificial Sequence
  Description of Artificial Sequence: Synthetic oligonucleotide
ccttggctttcctgctgagtctccgag

SEQ ID NO: 50748 - DNA, 27 bp, Artificial Sequence
  Description of Artificial Sequence: Synthetic oligonucleotide
cttggctttcctgctgagtctccgagg

SEQ ID NO: 50749 - DNA, 28 bp, Artificial Sequence
  Description of Artificial Sequence: Synthetic oligonucleotide
ttggctttcctgctgagtctccgaggag

SEQ ID NO: 50750 - DNA, 27 bp, Artificial Sequence
  Description of Artificial Sequence: Synthetic oligonucleotide
tggctttcctgctgagtctccgaggag

SEQ ID NO: 50751 - DNA, 26 bp, Artificial Sequence
  Description of Artificial Sequence: Synthetic oligonucleotide
ggctttcctgctgagtctccgaggag

SEQ ID NO: 50752 - DNA, 27 bp, Artificial Sequence
  Description of Artificial Sequence: Synthetic oligonucleotide
gctttcctgctgagtctccgaggagct

SEQ ID NO: 50753 - DNA, 27 bp, Artificial Sequence
  Description of Artificial Sequence: Synthetic oligonucleotide
ctttcctgctgagtctccgaggagctg

SEQ ID NO: 50754 - DNA, 27 bp, Artificial Sequence
  Description of Artificial Sequence: Synthetic oligonucleotide
tttcctgctgagtctccgaggagctgg

SEQ ID NO: 50755 - DNA, 26 bp, Artificial Sequence
  Description of Artificial Sequence: Synthetic oligonucleotide
ttcctgctgagtctccgaggagctgg

SEQ ID NO: 50756 - DNA, 25 bp, Artificial Sequence
  Description of Artificial Sequence: Synthetic oligonucleotide
tcctgctgagtctccgaggagctgg

SEQ ID NO: 50757 - DNA, 24 bp, Artificial Sequence
  Description of Artificial Sequence: Synthetic oligonucleotide
cctgctgagtctccgaggagctgg

SEQ ID NO: 50758 - DNA, 24 bp, Artificial Sequence
  Description of Artificial Sequence: Synthetic oligonucleotide
ctgctgagtctccgaggagctggg

SEQ ID NO: 50759 - DNA, 24 bp, Artificial Sequence
  Description of Artificial Sequence: Synthetic oligonucleotide
tgctgagtctccgaggagctgggg

SEQ ID NO: 50760 - DNA, 23 bp, Artificial Sequence
  Description of Artificial Sequence: Synthetic oligonucleotide
gctgagtctccgaggagctgggg

SEQ ID NO: 50761 - DNA, 23 bp, Artificial Sequence
  Description of Artificial Sequence: Synthetic oligonucleotide
ctgagtctccgaggagctggggc

SEQ ID NO: 50762 - DNA, 25 bp, Artificial Sequence
  Description of Artificial Sequence: Synthetic oligonucleotide
tgagtctccgaggagctggggccat

SEQ ID NO: 50763 - DNA, 24 bp, Artificial Sequence
  Description of Artificial Sequence: Synthetic oligonucleotide
gagtctccgaggagctggggccat

SEQ ID NO: 50764 - DNA, 26 bp, Artificial Sequence
  Description of Artificial Sequence: Synthetic oligonucleotide
agtctccgaggagctggggccatcaa

SEQ ID NO: 50765 - DNA, 25 bp, Artificial Sequence
  Description of Artificial Sequence: Synthetic oligonucleotide
gtctccgaggagctggggccatcaa

SEQ ID NO: 50766 - DNA, 25 bp, Artificial Sequence
  Description of Artificial Sequence: Synthetic oligonucleotide
tctccgaggagctggggccatcaag

SEQ ID NO: 50767 - DNA, 24 bp, Artificial Sequence
  Description of Artificial Sequence: Synthetic oligonucleotide
ctccgaggagctggggccatcaag

SEQ ID NO: 50768 - DNA, 24 bp, Artificial Sequence
  Description of Artificial Sequence: Synthetic oligonucleotide
tccgaggagctggggccatcaagg

SEQ ID NO: 50769 - DNA, 23 bp, Artificial Sequence
  Description of Artificial Sequence: Synthetic oligonucleotide
ccgaggagctggggccatcaagg

SEQ ID NO: 50770 - DNA, 23 bp, Artificial Sequence
  Description of Artificial Sequence: Synthetic oligonucleotide
cgaggagctggggccatcaaggc

SEQ ID NO: 50771 - DNA, 23 bp, Artificial Sequence
  Description of Artificial Sequence: Synthetic oligonucleotide
gaggagctggggccatcaaggcg

SEQ ID NO: 50772 - DNA, 24 bp, Artificial Sequence
  Description of Artificial Sequence: Synthetic oligonucleotide
aggagctggggccatcaaggcgga

SEQ ID NO: 50773 - DNA, 23 bp, Artificial Sequence
  Description of Artificial Sequence: Synthetic oligonucleotide
ggagctggggccatcaaggcgga

SEQ ID NO: 50774 - DNA, 23 bp, Artificial Sequence
  Description of Artificial Sequence: Synthetic oligonucleotide
gagctggggccatcaaggcggac

SEQ ID NO: 50775 - DNA, 25 bp, Artificial Sequence
  Description of Artificial Sequence: Synthetic oligonucleotide
agctggggccatcaaggcggaccat

SEQ ID NO: 50776 - DNA, 24 bp, Artificial Sequence
  Description of Artificial Sequence: Synthetic oligonucleotide
gctggggccatcaaggcggaccat

SEQ ID NO: 50777 - DNA, 25 bp, Artificial Sequence
  Description of Artificial Sequence: Synthetic oligonucleotide
ctggggccatcaaggcggaccatgt

SEQ ID NO: 50778 - DNA, 26 bp, Artificial Sequence
  Description of Artificial Sequence: Synthetic oligonucleotide
tggggccatcaaggcggaccatgtgt

SEQ ID NO: 50779 - DNA, 25 bp, Artificial Sequence
  Description of Artificial Sequence: Synthetic oligonucleotide
ggggccatcaaggcggaccatgtgt

SEQ ID NO: 50780 - DNA, 27 bp, Artificial Sequence
  Description of Artificial Sequence: Synthetic oligonucleotide
gggccatcaaggcggaccatgtgtcaa

SEQ ID NO: 50781 - DNA, 27 bp, Artificial Sequence
  Description of Artificial Sequence: Synthetic oligonucleotide
ggccatcaaggcggaccatgtgtcaac

SEQ ID NO: 50782 - DNA, 31 bp, Artificial Sequence
  Description of Artificial Sequence: Synthetic oligonucleotide
gccatcaaggcggaccatgtgtcaacttatg

SEQ ID NO: 50783 - DNA, 31 bp, Artificial Sequence
  Description of Artificial Sequence: Synthetic oligonucleotide
ccatcaaggcggaccatgtgtcaacttatgc

SEQ ID NO: 50784 - DNA, 31 bp, Artificial Sequence
  Description of Artificial Sequence: Synthetic oligonucleotide
catcaaggcggaccatgtgtcaacttatgcc

SEQ ID NO: 50785 - DNA, 31 bp, Artificial Sequence
  Description of Artificial Sequence: Synthetic oligonucleotide
atcaaggcggaccatgtgtcaacttatgccg

SEQ ID NO: 50786 - DNA, 30 bp, Artificial Sequence
  Description of Artificial Sequence: Synthetic oligonucleotide
tcaaggcggaccatgtgtcaacttatgccg

SEQ ID NO: 50787 - DNA, 29 bp, Artificial Sequence
  Description of Artificial Sequence: Synthetic oligonucleotide
caaggcggaccatgtgtcaacttatgccg

SEQ ID NO: 50788 - DNA, 29 bp, Artificial Sequence
  Description of Artificial Sequence: Synthetic oligonucleotide
aaggcggaccatgtgtcaacttatgccgc

SEQ ID NO: 50789 - DNA, 28 bp, Artificial Sequence
  Description of Artificial Sequence: Synthetic oligonucleotide
aggcggaccatgtgtcaacttatgccgc

SEQ ID NO: 50790 - DNA, 27 bp, Artificial Sequence
  Description of Artificial Sequence: Synthetic oligonucleotide
ggcggaccatgtgtcaacttatgccgc

SEQ ID NO: 50791 - DNA, 27 bp, Artificial Sequence
  Description of Artificial Sequence: Synthetic oligonucleotide
gcggaccatgtgtcaacttatgccgcg

SEQ ID NO: 50792 - DNA, 30 bp, Artificial Sequence
  Description of Artificial Sequence: Synthetic oligonucleotide
cggaccatgtgtcaacttatgccgcgtttg

SEQ ID NO: 50793 - DNA, 32 bp, Artificial Sequence
  Description of Artificial Sequence: Synthetic oligonucleotide
ggaccatgtgtcaacttatgccgcgtttgtac

SEQ ID NO: 50794 - DNA, 33 bp, Artificial Sequence
  Description of Artificial Sequence: Synthetic oligonucleotide
gaccatgtgtcaacttatgccgcgtttgtacag

SEQ ID NO: 50795 - DNA, 34 bp, Artificial Sequence
  Description of Artificial Sequence: Synthetic oligonucleotide
accatgtgtcaacttatgccgcgtttgtacagac

SEQ ID NO: 50796 - DNA, 33 bp, Artificial Sequence
  Description of Artificial Sequence: Synthetic oligonucleotide
ccatgtgtcaacttatgccgcgtttgtacagac

SEQ ID NO: 50797 - DNA, 33 bp, Artificial Sequence
  Description of Artificial Sequence: Synthetic oligonucleotide
catgtgtcaacttatgccgcgtttgtacagacg

SEQ ID NO: 50798 - DNA, 33 bp, Artificial Sequence
  Description of Artificial Sequence: Synthetic oligonucleotide
atgtgtcaacttatgccgcgtttgtacagacgc

SEQ ID NO: 50799 - DNA, 32 bp, Artificial Sequence
  Description of Artificial Sequence: Synthetic oligonucleotide
tgtgtcaacttatgccgcgtttgtacagacgc

SEQ ID NO: 50800 - DNA, 31 bp, Artificial Sequence
  Description of Artificial Sequence: Synthetic oligonucleotide
gtgtcaacttatgccgcgtttgtacagacgc

SEQ ID NO: 50801 - DNA, 34 bp, Artificial Sequence
  Description of Artificial Sequence: Synthetic oligonucleotide
tgtcaacttatgccgcgtttgtacagacgcatag

SEQ ID NO: 50802 - DNA, 33 bp, Artificial Sequence
  Description of Artificial Sequence: Synthetic oligonucleotide
gtcaacttatgccgcgtttgtacagacgcatag

SEQ ID NO: 50803 - DNA, 34 bp, Artificial Sequence
  Description of Artificial Sequence: Synthetic oligonucleotide
tcaacttatgccgcgtttgtacagacgcatagac

SEQ ID NO: 50804 - DNA, 33 bp, Artificial Sequence
  Description of Artificial Sequence: Synthetic oligonucleotide
caacttatgccgcgtttgtacagacgcatagac

SEQ ID NO: 50805 - DNA, 33 bp, Artificial Sequence
  Description of Artificial Sequence: Synthetic oligonucleotide
aacttatgccgcgtttgtacagacgcatagacc

SEQ ID NO: 50806 - DNA, 32 bp, Artificial Sequence
  Description of Artificial Sequence: Synthetic oligonucleotide
acttatgccgcgtttgtacagacgcatagacc

SEQ ID NO: 50807 - DNA, 31 bp, Artificial Sequence
  Description of Artificial Sequence: Synthetic oligonucleotide
cttatgccgcgtttgtacagacgcatagacc

SEQ ID NO: 50808 - DNA, 33 bp, Artificial Sequence
  Description of Artificial Sequence: Synthetic oligonucleotide
ttatgccgcgtttgtacagacgcatagaccaac

SEQ ID NO: 50809 - DNA, 32 bp, Artificial Sequence
  Description of Artificial Sequence: Synthetic oligonucleotide
tatgccgcgtttgtacagacgcatagaccaac

SEQ ID NO: 50810 - DNA, 31 bp, Artificial Sequence
  Description of Artificial Sequence: Synthetic oligonucleotide
atgccgcgtttgtacagacgcatagaccaac

SEQ ID NO: 50811 - DNA, 30 bp, Artificial Sequence
  Description of Artificial Sequence: Synthetic oligonucleotide
tgccgcgtttgtacagacgcatagaccaac

SEQ ID NO: 50812 - DNA, 29 bp, Artificial Sequence
  Description of Artificial Sequence: Synthetic oligonucleotide
gccgcgtttgtacagacgcatagaccaac

SEQ ID NO: 50813 - DNA, 30 bp, Artificial Sequence
  Description of Artificial Sequence: Synthetic oligonucleotide
ccgcgtttgtacagacgcatagaccaacag

SEQ ID NO: 50814 - DNA, 30 bp, Artificial Sequence
  Description of Artificial Sequence: Synthetic oligonucleotide
cgcgtttgtacagacgcatagaccaacagg

SEQ ID NO: 50815 - DNA, 30 bp, Artificial Sequence
  Description of Artificial Sequence: Synthetic oligonucleotide
gcgtttgtacagacgcatagaccaacaggg

SEQ ID NO: 50816 - DNA, 30 bp, Artificial Sequence
  Description of Artificial Sequence: Synthetic oligonucleotide
cgtttgtacagacgcatagaccaacagggg

SEQ ID NO: 50817 - DNA, 31 bp, Artificial Sequence
  Description of Artificial Sequence: Synthetic oligonucleotide
gtttgtacagacgcatagaccaacaggggag

SEQ ID NO: 50818 - DNA, 36 bp, Artificial Sequence
  Description of Artificial Sequence: Synthetic oligonucleotide
tttgtacagacgcatagaccaacaggggagtttatg

SEQ ID NO: 50819 - DNA, 35 bp, Artificial Sequence
  Description of Artificial Sequence: Synthetic oligonucleotide
ttgtacagacgcatagaccaacaggggagtttatg

SEQ ID NO: 50820 - DNA, 34 bp, Artificial Sequence
  Description of Artificial Sequence: Synthetic oligonucleotide
tgtacagacgcatagaccaacaggggagtttatg

SEQ ID NO: 50821 - DNA, 33 bp, Artificial Sequence
  Description of Artificial Sequence: Synthetic oligonucleotide
gtacagacgcatagaccaacaggggagtttatg

SEQ ID NO: 50822 - DNA, 36 bp, Artificial Sequence
  Description of Artificial Sequence: Synthetic oligonucleotide
tacagacgcatagaccaacaggggagtttatgtttg

SEQ ID NO: 50823 - DNA, 35 bp, Artificial Sequence
  Description of Artificial Sequence: Synthetic oligonucleotide
acagacgcatagaccaacaggggagtttatgtttg

SEQ ID NO: 50824 - DNA, 34 bp, Artificial Sequence
  Description of Artificial Sequence: Synthetic oligonucleotide
cagacgcatagaccaacaggggagtttatgtttg

SEQ ID NO: 50825 - DNA, 39 bp, Artificial Sequence
  Description of Artificial Sequence: Synthetic oligonucleotide
agacgcatagaccaacaggggagtttatgtttgaatttg

SEQ ID NO: 50826 - DNA, 38 bp, Artificial Sequence
  Description of Artificial Sequence: Synthetic oligonucleotide
gacgcatagaccaacaggggagtttatgtttgaatttg

SEQ ID NO: 50827 - DNA, 40 bp, Artificial Sequence
  Description of Artificial Sequence: Synthetic oligonucleotide
acgcatagaccaacaggggagtttatgtttgaatttgatg

SEQ ID NO: 50828 - DNA, 39 bp, Artificial Sequence
  Description of Artificial Sequence: Synthetic oligonucleotide
cgcatagaccaacaggggagtttatgtttgaatttgatg

SEQ ID NO: 50829 - DNA, 41 bp, Artificial Sequence
  Description of Artificial Sequence: Synthetic oligonucleotide
gcatagaccaacaggggagtttatgtttgaatttgatgaag

SEQ ID NO: 50830 - DNA, 43 bp, Artificial Sequence
  Description of Artificial Sequence: Synthetic oligonucleotide
catagaccaacaggggagtttatgtttgaatttgatgaagatg

SEQ ID NO: 50831 - DNA, 44 bp, Artificial Sequence
  Description of Artificial Sequence: Synthetic oligonucleotide
atagaccaacaggggagtttatgtttgaatttgatgaagatgag

SEQ ID NO: 50832 - DNA, 43 bp, Artificial Sequence
  Description of Artificial Sequence: Synthetic oligonucleotide
tagaccaacaggggagtttatgtttgaatttgatgaagatgag

SEQ ID NO: 50833 - DNA, 42 bp, Artificial Sequence
  Description of Artificial Sequence: Synthetic oligonucleotide
agaccaacaggggagtttatgtttgaatttgatgaagatgag

SEQ ID NO: 50834 - DNA, 41 bp, Artificial Sequence
  Description of Artificial Sequence: Synthetic oligonucleotide
gaccaacaggggagtttatgtttgaatttgatgaagatgag

SEQ ID NO: 50835 - DNA, 43 bp, Artificial Sequence
  Description of Artificial Sequence: Synthetic oligonucleotide
accaacaggggagtttatgtttgaatttgatgaagatgagatg

SEQ ID NO: 50836 - DNA, 42 bp, Artificial Sequence
  Description of Artificial Sequence: Synthetic oligonucleotide
ccaacaggggagtttatgtttgaatttgatgaagatgagatg

SEQ ID NO: 50837 - DNA, 44 bp, Artificial Sequence
  Description of Artificial Sequence: Synthetic oligonucleotide
caacaggggagtttatgtttgaatttgatgaagatgagatgttc

SEQ ID NO: 50838 - DNA, 47 bp, Artificial Sequence
  Description of Artificial Sequence: Synthetic oligonucleotide
aacaggggagtttatgtttgaatttgatgaagatgagatgttctatg

SEQ ID NO: 50839 - DNA, 46 bp, Artificial Sequence
  Description of Artificial Sequence: Synthetic oligonucleotide
acaggggagtttatgtttgaatttgatgaagatgagatgttctatg

SEQ ID NO: 50840 - DNA, 45 bp, Artificial Sequence
  Description of Artificial Sequence: Synthetic oligonucleotide
caggggagtttatgtttgaatttgatgaagatgagatgttctatg

SEQ ID NO: 50841 - DNA, 46 bp, Artificial Sequence
  Description of Artificial Sequence: Synthetic oligonucleotide
aggggagtttatgtttgaatttgatgaagatgagatgttctatgtg

SEQ ID NO: 50842 - DNA, 45 bp, Artificial Sequence
  Description of Artificial Sequence: Synthetic oligonucleotide
ggggagtttatgtttgaatttgatgaagatgagatgttctatgtg

SEQ ID NO: 50843 - DNA, 45 bp, Artificial Sequence
  Description of Artificial Sequence: Synthetic oligonucleotide
gggagtttatgtttgaatttgatgaagatgagatgttctatgtgg

SEQ ID NO: 50844 - DNA, 47 bp, Artificial Sequence
  Description of Artificial Sequence: Synthetic oligonucleotide
ggagtttatgtttgaatttgatgaagatgagatgttctatgtggatc

SEQ ID NO: 50845 - DNA, 48 bp, Artificial Sequence
  Description of Artificial Sequence: Synthetic oligonucleotide
gagtttatgtttgaatttgatgaagatgagatgttctatgtggatctg

SEQ ID NO: 50846 - DNA, 48 bp, Artificial Sequence
  Description of Artificial Sequence: Synthetic oligonucleotide
agtttatgtttgaatttgatgaagatgagatgttctatgtggatctgg

SEQ ID NO: 50847 - DNA, 47 bp, Artificial Sequence
  Description of Artificial Sequence: Synthetic oligonucleotide
gtttatgtttgaatttgatgaagatgagatgttctatgtggatctgg

SEQ ID NO: 50848 - DNA, 48 bp, Artificial Sequence
  Description of Artificial Sequence: Synthetic oligonucleotide
tttatgtttgaatttgatgaagatgagatgttctatgtggatctggac

SEQ ID NO: 50849 - DNA, 47 bp, Artificial Sequence
  Description of Artificial Sequence: Synthetic oligonucleotide
ttatgtttgaatttgatgaagatgagatgttctatgtggatctggac

SEQ ID NO: 50850 - DNA, 46 bp, Artificial Sequence
  Description of Artificial Sequence: Synthetic oligonucleotide
tatgtttgaatttgatgaagatgagatgttctatgtggatctggac

SEQ ID NO: 50851 - DNA, 45 bp, Artificial Sequence
  Description of Artificial Sequence: Synthetic oligonucleotide
atgtttgaatttgatgaagatgagatgttctatgtggatctggac

SEQ ID NO: 50852 - DNA, 44 bp, Artificial Sequence
  Description of Artificial Sequence: Synthetic oligonucleotide
tgtttgaatttgatgaagatgagatgttctatgtggatctggac

SEQ ID NO: 50853 - DNA, 43 bp, Artificial Sequence
  Description of Artificial Sequence: Synthetic oligonucleotide
gtttgaatttgatgaagatgagatgttctatgtggatctggac

SEQ ID NO: 50854 - DNA, 45 bp, Artificial Sequence
  Description of Artificial Sequence: Synthetic oligonucleotide
tttgaatttgatgaagatgagatgttctatgtggatctggacaag

SEQ ID NO: 50855 - DNA, 44 bp, Artificial Sequence
  Description of Artificial Sequence: Synthetic oligonucleotide
ttgaatttgatgaagatgagatgttctatgtggatctggacaag

SEQ ID NO: 50856 - DNA, 43 bp, Artificial Sequence
  Description of Artificial Sequence: Synthetic oligonucleotide
tgaatttgatgaagatgagatgttctatgtggatctggacaag

SEQ ID NO: 50857 - DNA, 42 bp, Artificial Sequence
  Description of Artificial Sequence: Synthetic oligonucleotide
gaatttgatgaagatgagatgttctatgtggatctggacaag

SEQ ID NO: 50858 - DNA, 44 bp, Artificial Sequence
  Description of Artificial Sequence: Synthetic oligonucleotide
aatttgatgaagatgagatgttctatgtggatctggacaagaag

SEQ ID NO: 50859 - DNA, 43 bp, Artificial Sequence
  Description of Artificial Sequence: Synthetic oligonucleotide
atttgatgaagatgagatgttctatgtggatctggacaagaag

SEQ ID NO: 50860 - DNA, 42 bp, Artificial Sequence
  Description of Artificial Sequence: Synthetic oligonucleotide
tttgatgaagatgagatgttctatgtggatctggacaagaag

SEQ ID NO: 50861 - DNA, 41 bp, Artificial Sequence
  Description of Artificial Sequence: Synthetic oligonucleotide
ttgatgaagatgagatgttctatgtggatctggacaagaag

SEQ ID NO: 50862 - DNA, 40 bp, Artificial Sequence
  Description of Artificial Sequence: Synthetic oligonucleotide
tgatgaagatgagatgttctatgtggatctggacaagaag

SEQ ID NO: 50863 - DNA, 39 bp, Artificial Sequence
  Description of Artificial Sequence: Synthetic oligonucleotide
gatgaagatgagatgttctatgtggatctggacaagaag

SEQ ID NO: 50864 - DNA, 39 bp, Artificial Sequence
  Description of Artificial Sequence: Synthetic oligonucleotide
atgaagatgagatgttctatgtggatctggacaagaagg

SEQ ID NO: 50865 - DNA, 38 bp, Artificial Sequence
  Description of Artificial Sequence: Synthetic oligonucleotide
tgaagatgagatgttctatgtggatctggacaagaagg

SEQ ID NO: 50866 - DNA, 37 bp, Artificial Sequence
  Description of Artificial Sequence: Synthetic oligonucleotide
gaagatgagatgttctatgtggatctggacaagaagg

SEQ ID NO: 50867 - DNA, 38 bp, Artificial Sequence
  Description of Artificial Sequence: Synthetic oligonucleotide
aagatgagatgttctatgtggatctggacaagaaggag

SEQ ID NO: 50868 - DNA, 37 bp, Artificial Sequence
  Description of Artificial Sequence: Synthetic oligonucleotide
agatgagatgttctatgtggatctggacaagaaggag

SEQ ID NO: 50869 - DNA, 36 bp, Artificial Sequence
  Description of Artificial Sequence: Synthetic oligonucleotide
gatgagatgttctatgtggatctggacaagaaggag

SEQ ID NO: 50870 - DNA, 37 bp, Artificial Sequence
  Description of Artificial Sequence: Synthetic oligonucleotide
atgagatgttctatgtggatctggacaagaaggagac

SEQ ID NO: 50871 - DNA, 36 bp, Artificial Sequence
  Description of Artificial Sequence: Synthetic oligonucleotide
tgagatgttctatgtggatctggacaagaaggagac

SEQ ID NO: 50872 - DNA, 35 bp, Artificial Sequence
  Description of Artificial Sequence: Synthetic oligonucleotide
gagatgttctatgtggatctggacaagaaggagac

SEQ ID NO: 50873 - DNA, 35 bp, Artificial Sequence
  Description of Artificial Sequence: Synthetic oligonucleotide
agatgttctatgtggatctggacaagaaggagacc

SEQ ID NO: 50874 - DNA, 34 bp, Artificial Sequence
  Description of Artificial Sequence: Synthetic oligonucleotide
gatgttctatgtggatctggacaagaaggagacc

SEQ ID NO: 50875 - DNA, 34 bp, Artificial Sequence
  Description of Artificial Sequence: Synthetic oligonucleotide
atgttctatgtggatctggacaagaaggagaccg

SEQ ID NO: 50876 - DNA, 33 bp, Artificial Sequence
  Description of Artificial Sequence: Synthetic oligonucleotide
tgttctatgtggatctggacaagaaggagaccg

SEQ ID NO: 50877 - DNA, 32 bp, Artificial Sequence
  Description of Artificial Sequence: Synthetic oligonucleotide
gttctatgtggatctggacaagaaggagaccg

SEQ ID NO: 50878 - DNA, 33 bp, Artificial Sequence
  Description of Artificial Sequence: Synthetic oligonucleotide
ttctatgtggatctggacaagaaggagaccgtc

SEQ ID NO: 50879 - DNA, 32 bp, Artificial Sequence
  Description of Artificial Sequence: Synthetic oligonucleotide
tctatgtggatctggacaagaaggagaccgtc

SEQ ID NO: 50880 - DNA, 31 bp, Artificial Sequence
  Description of Artificial Sequence: Synthetic oligonucleotide
ctatgtggatctggacaagaaggagaccgtc

SEQ ID NO: 50881 - DNA, 32 bp, Artificial Sequence
  Description of Artificial Sequence: Synthetic oligonucleotide
tatgtggatctggacaagaaggagaccgtctg

SEQ ID NO: 50882 - DNA, 31 bp, Artificial Sequence
  Description of Artificial Sequence: Synthetic oligonucleotide
atgtggatctggacaagaaggagaccgtctg

SEQ ID NO: 50883 - DNA, 30 bp, Artificial Sequence
  Description of Artificial Sequence: Synthetic oligonucleotide
tgtggatctggacaagaaggagaccgtctg

SEQ ID NO: 50884 - DNA, 29 bp, Artificial Sequence
  Description of Artificial Sequence: Synthetic oligonucleotide
gtggatctggacaagaaggagaccgtctg

SEQ ID NO: 50885 - DNA, 29 bp, Artificial Sequence
  Description of Artificial Sequence: Synthetic oligonucleotide
tggatctggacaagaaggagaccgtctgg

SEQ ID NO: 50886 - DNA, 28 bp, Artificial Sequence
  Description of Artificial Sequence: Synthetic oligonucleotide
ggatctggacaagaaggagaccgtctgg

SEQ ID NO: 50887 - DNA, 28 bp, Artificial Sequence
  Description of Artificial Sequence: Synthetic oligonucleotide
gatctggacaagaaggagaccgtctggc

SEQ ID NO: 50888 - DNA, 30 bp, Artificial Sequence
  Description of Artificial Sequence: Synthetic oligonucleotide
atctggacaagaaggagaccgtctggcatc

SEQ ID NO: 50889 - DNA, 29 bp, Artificial Sequence
  Description of Artificial Sequence: Synthetic oligonucleotide
tctggacaagaaggagaccgtctggcatc

SEQ ID NO: 50890 - DNA, 28 bp, Artificial Sequence
  Description of Artificial Sequence: Synthetic oligonucleotide
ctggacaagaaggagaccgtctggcatc

SEQ ID NO: 50891 - DNA, 29 bp, Artificial Sequence
  Description of Artificial Sequence: Synthetic oligonucleotide
tggacaagaaggagaccgtctggcatctg

SEQ ID NO: 50892 - DNA, 28 bp, Artificial Sequence
  Description of Artificial Sequence: Synthetic oligonucleotide
ggacaagaaggagaccgtctggcatctg

SEQ ID NO: 50893 - DNA, 28 bp, Artificial Sequence
  Description of Artificial Sequence: Synthetic oligonucleotide
gacaagaaggagaccgtctggcatctgg

SEQ ID NO: 50894 - DNA, 29 bp, Artificial Sequence
  Description of Artificial Sequence: Synthetic oligonucleotide
acaagaaggagaccgtctggcatctggag

SEQ ID NO: 50895 - DNA, 28 bp, Artificial Sequence
  Description of Artificial Sequence: Synthetic oligonucleotide
caagaaggagaccgtctggcatctggag

SEQ ID NO: 50896 - DNA, 28 bp, Artificial Sequence
  Description of Artificial Sequence: Synthetic oligonucleotide
aagaaggagaccgtctggcatctggagg

SEQ ID NO: 50897 - DNA, 27 bp, Artificial Sequence
  Description of Artificial Sequence: Synthetic oligonucleotide
agaaggagaccgtctggcatctggagg

SEQ ID NO: 50898 - DNA, 27 bp, Artificial Sequence
  Description of Artificial Sequence: Synthetic oligonucleotide
gaaggagaccgtctggcatctggagga

SEQ ID NO: 50899 - DNA, 27 bp, Artificial Sequence
  Description of Artificial Sequence: Synthetic oligonucleotide
aaggagaccgtctggcatctggaggag

SEQ ID NO: 50900 - DNA, 27 bp, Artificial Sequence
  Description of Artificial Sequence: Synthetic oligonucleotide
aggagaccgtctggcatctggaggagt

SEQ ID NO: 50901 - DNA, 27 bp, Artificial Sequence
  Description of Artificial Sequence: Synthetic oligonucleotide
ggagaccgtctggcatctggaggagtt

SEQ ID NO: 50902 - DNA, 28 bp, Artificial Sequence
  Description of Artificial Sequence: Synthetic oligonucleotide
gagaccgtctggcatctggaggagtttg

SEQ ID NO: 50903 - DNA, 28 bp, Artificial Sequence
  Description of Artificial Sequence: Synthetic oligonucleotide
agaccgtctggcatctggaggagtttgg

SEQ ID NO: 50904 - DNA, 27 bp, Artificial Sequence
  Description of Artificial Sequence: Synthetic oligonucleotide
gaccgtctggcatctggaggagtttgg

SEQ ID NO: 50905 - DNA, 27 bp, Artificial Sequence
  Description of Artificial Sequence: Synthetic oligonucleotide
accgtctggcatctggaggagtttggc

SEQ ID NO: 50906 - DNA, 26 bp, Artificial Sequence
  Description of Artificial Sequence: Synthetic oligonucleotide
ccgtctggcatctggaggagtttggc

SEQ ID NO: 50907 - DNA, 27 bp, Artificial Sequence
  Description of Artificial Sequence: Synthetic oligonucleotide
cgtctggcatctggaggagtttggcca

SEQ ID NO: 50908 - DNA, 28 bp, Artificial Sequence
  Description of Artificial Sequence: Synthetic oligonucleotide
gtctggcatctggaggagtttggccaag

SEQ ID NO: 50909 - DNA, 28 bp, Artificial Sequence
  Description of Artificial Sequence: Synthetic oligonucleotide
tctggcatctggaggagtttggccaagc

SEQ ID NO: 50910 - DNA, 27 bp, Artificial Sequence
  Description of Artificial Sequence: Synthetic oligonucleotide
ctggcatctggaggagtttggccaagc

SEQ ID NO: 50911 - DNA, 27 bp, Artificial Sequence
  Description of Artificial Sequence: Synthetic oligonucleotide
tggcatctggaggagtttggccaagcc

SEQ ID NO: 50912 - DNA, 27 bp, Artificial Sequence
  Description of Artificial Sequence: Synthetic oligonucleotide
ggcatctggaggagtttggccaagcct

SEQ ID NO: 50913 - DNA, 30 bp, Artificial Sequence
  Description of Artificial Sequence: Synthetic oligonucleotide
gcatctggaggagtttggccaagccttttc

SEQ ID NO: 50914 - DNA, 30 bp, Artificial Sequence
  Description of Artificial Sequence: Synthetic oligonucleotide
catctggaggagtttggccaagccttttcc

SEQ ID NO: 50915 - DNA, 33 bp, Artificial Sequence
  Description of Artificial Sequence: Synthetic oligonucleotide
atctggaggagtttggccaagccttttcctttg

SEQ ID NO: 50916 - DNA, 32 bp, Artificial Sequence
  Description of Artificial Sequence: Synthetic oligonucleotide
tctggaggagtttggccaagccttttcctttg

SEQ ID NO: 50917 - DNA, 31 bp, Artificial Sequence
  Description of Artificial Sequence: Synthetic oligonucleotide
ctggaggagtttggccaagccttttcctttg

SEQ ID NO: 50918 - DNA, 32 bp, Artificial Sequence
  Description of Artificial Sequence: Synthetic oligonucleotide
tggaggagtttggccaagccttttcctttgag

SEQ ID NO: 50919 - DNA, 31 bp, Artificial Sequence
  Description of Artificial Sequence: Synthetic oligonucleotide
ggaggagtttggccaagccttttcctttgag

SEQ ID NO: 50920 - DNA, 31 bp, Artificial Sequence
  Description of Artificial Sequence: Synthetic oligonucleotide
gaggagtttggccaagccttttcctttgagg

SEQ ID NO: 50921 - DNA, 31 bp, Artificial Sequence
  Description of Artificial Sequence: Synthetic oligonucleotide
aggagtttggccaagccttttcctttgaggc

SEQ ID NO: 50922 - DNA, 30 bp, Artificial Sequence
  Description of Artificial Sequence: Synthetic oligonucleotide
ggagtttggccaagccttttcctttgaggc

SEQ ID NO: 50923 - DNA, 31 bp, Artificial Sequence
  Description of Artificial Sequence: Synthetic oligonucleotide
gagtttggccaagccttttcctttgaggctc

SEQ ID NO: 50924 - DNA, 32 bp, Artificial Sequence
  Description of Artificial Sequence: Synthetic oligonucleotide
agtttggccaagccttttcctttgaggctcag

SEQ ID NO: 50925 - DNA, 31 bp, Artificial Sequence
  Description of Artificial Sequence: Synthetic oligonucleotide
gtttggccaagccttttcctttgaggctcag

SEQ ID NO: 50926 - DNA, 31 bp, Artificial Sequence
  Description of Artificial Sequence: Synthetic oligonucleotide
tttggccaagccttttcctttgaggctcagg

SEQ ID NO: 50927 - DNA, 30 bp, Artificial Sequence
  Description of Artificial Sequence: Synthetic oligonucleotide
ttggccaagccttttcctttgaggctcagg

SEQ ID NO: 50928 - DNA, 29 bp, Artificial Sequence
  Description of Artificial Sequence: Synthetic oligonucleotide
tggccaagccttttcctttgaggctcagg

SEQ ID NO: 50929 - DNA, 28 bp, Artificial Sequence
  Description of Artificial Sequence: Synthetic oligonucleotide
ggccaagccttttcctttgaggctcagg

SEQ ID NO: 50930 - DNA, 28 bp, Artificial Sequence
  Description of Artificial Sequence: Synthetic oligonucleotide
gccaagccttttcctttgaggctcaggg

SEQ ID NO: 50931 - DNA, 28 bp, Artificial Sequence
  Description of Artificial Sequence: Synthetic oligonucleotide
ccaagccttttcctttgaggctcagggc

SEQ ID NO: 50932 - DNA, 28 bp, Artificial Sequence
  Description of Artificial Sequence: Synthetic oligonucleotide
caagccttttcctttgaggctcagggcg

SEQ ID NO: 50933 - DNA, 28 bp, Artificial Sequence
  Description of Artificial Sequence: Synthetic oligonucleotide
aagccttttcctttgaggctcagggcgg

SEQ ID NO: 50934 - DNA, 27 bp, Artificial Sequence
  Description of Artificial Sequence: Synthetic oligonucleotide
agccttttcctttgaggctcagggcgg

SEQ ID NO: 50935 - DNA, 26 bp, Artificial Sequence
  Description of Artificial Sequence: Synthetic oligonucleotide
gccttttcctttgaggctcagggcgg

SEQ ID NO: 50936 - DNA, 26 bp, Artificial Sequence
  Description of Artificial Sequence: Synthetic oligonucleotide
ccttttcctttgaggctcagggcggg

SEQ ID NO: 50937 - DNA, 27 bp, Artificial Sequence
  Description of Artificial Sequence: Synthetic oligonucleotide
cttttcctttgaggctcagggcgggct

SEQ ID NO: 50938 - DNA, 27 bp, Artificial Sequence
  Description of Artificial Sequence: Synthetic oligonucleotide
ttttcctttgaggctcagggcgggctg

SEQ ID NO: 50939 - DNA, 26 bp, Artificial Sequence
  Description of Artificial Sequence: Synthetic oligonucleotide
tttcctttgaggctcagggcgggctg

SEQ ID NO: 50940 - DNA, 25 bp, Artificial Sequence
  Description of Artificial Sequence: Synthetic oligonucleotide
ttcctttgaggctcagggcgggctg

SEQ ID NO: 50941 - DNA, 24 bp, Artificial Sequence
  Description of Artificial Sequence: Synthetic oligonucleotide
tcctttgaggctcagggcgggctg

SEQ ID NO: 50942 - DNA, 23 bp, Artificial Sequence
  Description of Artificial Sequence: Synthetic oligonucleotide
cctttgaggctcagggcgggctg

SEQ ID NO: 50943 - DNA, 23 bp, Artificial Sequence
  Description of Artificial Sequence: Synthetic oligonucleotide
ctttgaggctcagggcgggctgg

SEQ ID NO: 50944 - DNA, 26 bp, Artificial Sequence
  Description of Artificial Sequence: Synthetic oligonucleotide
tttgaggctcagggcgggctggctaa

SEQ ID NO: 50945 - DNA, 25 bp, Artificial Sequence
  Description of Artificial Sequence: Synthetic oligonucleotide
ttgaggctcagggcgggctggctaa

SEQ ID NO: 50946 - DNA, 24 bp, Artificial Sequence
  Description of Artificial Sequence: Synthetic oligonucleotide
tgaggctcagggcgggctggctaa

SEQ ID NO: 50947 - DNA, 23 bp, Artificial Sequence
  Description of Artificial Sequence: Synthetic oligonucleotide
gaggctcagggcgggctggctaa

SEQ ID NO: 50948 - DNA, 26 bp, Artificial Sequence
  Description of Artificial Sequence: Synthetic oligonucleotide
aggctcagggcgggctggctaacatt

SEQ ID NO: 50949 - DNA, 25 bp, Artificial Sequence
  Description of Artificial Sequence: Synthetic oligonucleotide
ggctcagggcgggctggctaacatt

SEQ ID NO: 50950 - DNA, 25 bp, Artificial Sequence
  Description of Artificial Sequence: Synthetic oligonucleotide
gctcagggcgggctggctaacattg

SEQ ID NO: 50951 - DNA, 27 bp, Artificial Sequence
  Description of Artificial Sequence: Synthetic oligonucleotide
ctcagggcgggctggctaacattgcta

SEQ ID NO: 50952 - DNA, 31 bp, Artificial Sequence
  Description of Artificial Sequence: Synthetic oligonucleotide
tcagggcgggctggctaacattgctatattg

SEQ ID NO: 50953 - DNA, 30 bp, Artificial Sequence
  Description of Artificial Sequence: Synthetic oligonucleotide
cagggcgggctggctaacattgctatattg

SEQ ID NO: 50954 - DNA, 32 bp, Artificial Sequence
  Description of Artificial Sequence: Synthetic oligonucleotide
agggcgggctggctaacattgctatattgaac

SEQ ID NO: 50955 - DNA, 31 bp, Artificial Sequence
  Description of Artificial Sequence: Synthetic oligonucleotide
gggcgggctggctaacattgctatattgaac

SEQ ID NO: 50956 - DNA, 33 bp, Artificial Sequence
  Description of Artificial Sequence: Synthetic oligonucleotide
ggcgggctggctaacattgctatattgaacaac

SEQ ID NO: 50957 - DNA, 35 bp, Artificial Sequence
  Description of Artificial Sequence: Synthetic oligonucleotide
gcgggctggctaacattgctatattgaacaacaac

SEQ ID NO: 50958 - DNA, 37 bp, Artificial Sequence
  Description of Artificial Sequence: Synthetic oligonucleotide
cgggctggctaacattgctatattgaacaacaacttg

SEQ ID NO: 50959 - DNA, 41 bp, Artificial Sequence
  Description of Artificial Sequence: Synthetic oligonucleotide
gggctggctaacattgctatattgaacaacaacttgaatac

SEQ ID NO: 50960 - DNA, 41 bp, Artificial Sequence
  Description of Artificial Sequence: Synthetic oligonucleotide
ggctggctaacattgctatattgaacaacaacttgaatacc

SEQ ID NO: 50961 - DNA, 43 bp, Artificial Sequence
  Description of Artificial Sequence: Synthetic oligonucleotide
gctggctaacattgctatattgaacaacaacttgaataccttg

SEQ ID NO: 50962 - DNA, 45 bp, Artificial Sequence
  Description of Artificial Sequence: Synthetic oligonucleotide
ctggctaacattgctatattgaacaacaacttgaataccttgatc

SEQ ID NO: 50963 - DNA, 45 bp, Artificial Sequence
  Description of Artificial Sequence: Synthetic oligonucleotide
tggctaacattgctatattgaacaacaacttgaataccttgatcc

SEQ ID NO: 50964 - DNA, 44 bp, Artificial Sequence
  Description of Artificial Sequence: Synthetic oligonucleotide
ggctaacattgctatattgaacaacaacttgaataccttgatcc

SEQ ID NO: 50965 - DNA, 45 bp, Artificial Sequence
  Description of Artificial Sequence: Synthetic oligonucleotide
gctaacattgctatattgaacaacaacttgaataccttgatccag

SEQ ID NO: 50966 - DNA, 45 bp, Artificial Sequence
  Description of Artificial Sequence: Synthetic oligonucleotide
ctaacattgctatattgaacaacaacttgaataccttgatccagc

SEQ ID NO: 50967 - DNA, 45 bp, Artificial Sequence
  Description of Artificial Sequence: Synthetic oligonucleotide
taacattgctatattgaacaacaacttgaataccttgatccagcg

SEQ ID NO: 50968 - DNA, 44 bp, Artificial Sequence
  Description of Artificial Sequence: Synthetic oligonucleotide
aacattgctatattgaacaacaacttgaataccttgatccagcg

SEQ ID NO: 50969 - DNA, 43 bp, Artificial Sequence
  Description of Artificial Sequence: Synthetic oligonucleotide
acattgctatattgaacaacaacttgaataccttgatccagcg

SEQ ID NO: 50970 - DNA, 42 bp, Artificial Sequence
  Description of Artificial Sequence: Synthetic oligonucleotide
cattgctatattgaacaacaacttgaataccttgatccagcg

SEQ ID NO: 50971 - DNA, 44 bp, Artificial Sequence
  Description of Artificial Sequence: Synthetic oligonucleotide
attgctatattgaacaacaacttgaataccttgatccagcgttc

SEQ ID NO: 50972 - DNA, 43 bp, Artificial Sequence
  Description of Artificial Sequence: Synthetic oligonucleotide
ttgctatattgaacaacaacttgaataccttgatccagcgttc

SEQ ID NO: 50973 - DNA, 42 bp, Artificial Sequence
  Description of Artificial Sequence: Synthetic oligonucleotide
tgctatattgaacaacaacttgaataccttgatccagcgttc

SEQ ID NO: 50974 - DNA, 41 bp, Artificial Sequence
  Description of Artificial Sequence: Synthetic oligonucleotide
gctatattgaacaacaacttgaataccttgatccagcgttc

SEQ ID NO: 50975 - DNA, 41 bp, Artificial Sequence
  Description of Artificial Sequence: Synthetic oligonucleotide
ctatattgaacaacaacttgaataccttgatccagcgttcc

SEQ ID NO: 50976 - DNA, 43 bp, Artificial Sequence
  Description of Artificial Sequence: Synthetic oligonucleotide
tatattgaacaacaacttgaataccttgatccagcgttccaac

SEQ ID NO: 50977 - DNA, 42 bp, Artificial Sequence
  Description of Artificial Sequence: Synthetic oligonucleotide
atattgaacaacaacttgaataccttgatccagcgttccaac

SEQ ID NO: 50978 - DNA, 41 bp, Artificial Sequence
  Description of Artificial Sequence: Synthetic oligonucleotide
tattgaacaacaacttgaataccttgatccagcgttccaac

SEQ ID NO: 50979 - DNA, 40 bp, Artificial Sequence
  Description of Artificial Sequence: Synthetic oligonucleotide
attgaacaacaacttgaataccttgatccagcgttccaac

SEQ ID NO: 50980 - DNA, 39 bp, Artificial Sequence
  Description of Artificial Sequence: Synthetic oligonucleotide
ttgaacaacaacttgaataccttgatccagcgttccaac

SEQ ID NO: 50981 - DNA, 38 bp, Artificial Sequence
  Description of Artificial Sequence: Synthetic oligonucleotide
tgaacaacaacttgaataccttgatccagcgttccaac

SEQ ID NO: 50982 - DNA, 37 bp, Artificial Sequence
  Description of Artificial Sequence: Synthetic oligonucleotide
gaacaacaacttgaataccttgatccagcgttccaac

SEQ ID NO: 50983 - DNA, 37 bp, Artificial Sequence
  Description of Artificial Sequence: Synthetic oligonucleotide
aacaacaacttgaataccttgatccagcgttccaacc

SEQ ID NO: 50984 - DNA, 36 bp, Artificial Sequence
  Description of Artificial Sequence: Synthetic oligonucleotide
acaacaacttgaataccttgatccagcgttccaacc

SEQ ID NO: 50985 - DNA, 35 bp, Artificial Sequence
  Description of Artificial Sequence: Synthetic oligonucleotide
caacaacttgaataccttgatccagcgttccaacc

SEQ ID NO: 50986 - DNA, 36 bp, Artificial Sequence
  Description of Artificial Sequence: Synthetic oligonucleotide
aacaacttgaataccttgatccagcgttccaaccac

SEQ ID NO: 50987 - DNA, 35 bp, Artificial Sequence
  Description of Artificial Sequence: Synthetic oligonucleotide
acaacttgaataccttgatccagcgttccaaccac

SEQ ID NO: 50988 - DNA, 34 bp, Artificial Sequence
  Description of Artificial Sequence: Synthetic oligonucleotide
caacttgaataccttgatccagcgttccaaccac

SEQ ID NO: 50989 - DNA, 35 bp, Artificial Sequence
  Description of Artificial Sequence: Synthetic oligonucleotide
aacttgaataccttgatccagcgttccaaccacac

SEQ ID NO: 50990 - DNA, 34 bp, Artificial Sequence
  Description of Artificial Sequence: Synthetic oligonucleotide
acttgaataccttgatccagcgttccaaccacac

SEQ ID NO: 50991 - DNA, 33 bp, Artificial Sequence
  Description of Artificial Sequence: Synthetic oligonucleotide
cttgaataccttgatccagcgttccaaccacac

SEQ ID NO: 50992 - DNA, 34 bp, Artificial Sequence
  Description of Artificial Sequence: Synthetic oligonucleotide
ttgaataccttgatccagcgttccaaccacactc

SEQ ID NO: 50993 - DNA, 33 bp, Artificial Sequence
  Description of Artificial Sequence: Synthetic oligonucleotide
tgaataccttgatccagcgttccaaccacactc

SEQ ID NO: 50994 - DNA, 32 bp, Artificial Sequence
  Description of Artificial Sequence: Synthetic oligonucleotide
gaataccttgatccagcgttccaaccacactc

SEQ ID NO: 50995 - DNA, 33 bp, Artificial Sequence
  Description of Artificial Sequence: Synthetic oligonucleotide
aataccttgatccagcgttccaaccacactcag

SEQ ID NO: 50996 - DNA, 32 bp, Artificial Sequence
  Description of Artificial Sequence: Synthetic oligonucleotide
ataccttgatccagcgttccaaccacactcag

SEQ ID NO: 50997 - DNA, 31 bp, Artificial Sequence
  Description of Artificial Sequence: Synthetic oligonucleotide
taccttgatccagcgttccaaccacactcag

SEQ ID NO: 50998 - DNA, 30 bp, Artificial Sequence
  Description of Artificial Sequence: Synthetic oligonucleotide
accttgatccagcgttccaaccacactcag

SEQ ID NO: 50999 - DNA, 29 bp, Artificial Sequence
  Description of Artificial Sequence: Synthetic oligonucleotide
ccttgatccagcgttccaaccacactcag

SEQ ID NO: 51000 - DNA, 29 bp, Artificial Sequence
  Description of Artificial Sequence: Synthetic oligonucleotide
cttgatccagcgttccaaccacactcagg

SEQ ID NO: 51001 - DNA, 29 bp, Artificial Sequence
  Description of Artificial Sequence: Synthetic oligonucleotide
ttgatccagcgttccaaccacactcaggc

SEQ ID NO: 51002 - DNA, 28 bp, Artificial Sequence
  Description of Artificial Sequence: Synthetic oligonucleotide
tgatccagcgttccaaccacactcaggc

SEQ ID NO: 51003 - DNA, 27 bp, Artificial Sequence
  Description of Artificial Sequence: Synthetic oligonucleotide
gatccagcgttccaaccacactcaggc

SEQ ID NO: 51004 - DNA, 27 bp, Artificial Sequence
  Description of Artificial Sequence: Synthetic oligonucleotide
atccagcgttccaaccacactcaggcc

SEQ ID NO: 51005 - DNA, 27 bp, Artificial Sequence
  Description of Artificial Sequence: Synthetic oligonucleotide
tccagcgttccaaccacactcaggcca

SEQ ID NO: 51006 - DNA, 26 bp, Artificial Sequence
  Description of Artificial Sequence: Synthetic oligonucleotide
ccagcgttccaaccacactcaggcca

SEQ ID NO: 51007 - DNA, 26 bp, Artificial Sequence
  Description of Artificial Sequence: Synthetic oligonucleotide
cagcgttccaaccacactcaggccac

SEQ ID NO: 51008 - DNA, 27 bp, Artificial Sequence
  Description of Artificial Sequence: Synthetic oligonucleotide
agcgttccaaccacactcaggccacca

SEQ ID NO: 51009 - DNA, 27 bp, Artificial Sequence
  Description of Artificial Sequence: Synthetic oligonucleotide
gcgttccaaccacactcaggccaccaa

SEQ ID NO: 51010 - DNA, 27 bp, Artificial Sequence
  Description of Artificial Sequence: Synthetic oligonucleotide
cgttccaaccacactcaggccaccaac

SEQ ID NO: 51011 - DNA, 27 bp, Artificial Sequence
  Description of Artificial Sequence: Synthetic oligonucleotide
gttccaaccacactcaggccaccaacg

SEQ ID NO: 51012 - DNA, 29 bp, Artificial Sequence
  Description of Artificial Sequence: Synthetic oligonucleotide
ttccaaccacactcaggccaccaacgatc

SEQ ID NO: 51013 - DNA, 28 bp, Artificial Sequence
  Description of Artificial Sequence: Synthetic oligonucleotide
tccaaccacactcaggccaccaacgatc

SEQ ID NO: 51014 - DNA, 27 bp, Artificial Sequence
  Description of Artificial Sequence: Synthetic oligonucleotide
ccaaccacactcaggccaccaacgatc

SEQ ID NO: 51015 - DNA, 27 bp, Artificial Sequence
  Description of Artificial Sequence: Synthetic oligonucleotide
caaccacactcaggccaccaacgatcc

SEQ ID NO: 51016 - DNA, 27 bp, Artificial Sequence
  Description of Artificial Sequence: Synthetic oligonucleotide
aaccacactcaggccaccaacgatccc

SEQ ID NO: 51017 - DNA, 26 bp, Artificial Sequence
  Description of Artificial Sequence: Synthetic oligonucleotide
accacactcaggccaccaacgatccc

SEQ ID NO: 51018 - DNA, 25 bp, Artificial Sequence
  Description of Artificial Sequence: Synthetic oligonucleotide
ccacactcaggccaccaacgatccc

SEQ ID NO: 51019 - DNA, 25 bp, Artificial Sequence
  Description of Artificial Sequence: Synthetic oligonucleotide
cacactcaggccaccaacgatcccc

SEQ ID NO: 51020 - DNA, 26 bp, Artificial Sequence
  Description of Artificial Sequence: Synthetic oligonucleotide
acactcaggccaccaacgatccccct

SEQ ID NO: 51021 - DNA, 25 bp, Artificial Sequence
  Description of Artificial Sequence: Synthetic oligonucleotide
cactcaggccaccaacgatccccct

SEQ ID NO: 51022 - DNA, 26 bp, Artificial Sequence
  Description of Artificial Sequence: Synthetic oligonucleotide
actcaggccaccaacgatccccctga

SEQ ID NO: 51023 - DNA, 25 bp, Artificial Sequence
  Description of Artificial Sequence: Synthetic oligonucleotide
ctcaggccaccaacgatccccctga

SEQ ID NO: 51024 - DNA, 25 bp, Artificial Sequence
  Description of Artificial Sequence: Synthetic oligonucleotide
tcaggccaccaacgatccccctgag

SEQ ID NO: 51025 - DNA, 24 bp, Artificial Sequence
  Description of Artificial Sequence: Synthetic oligonucleotide
caggccaccaacgatccccctgag

SEQ ID NO: 51026 - DNA, 25 bp, Artificial Sequence
  Description of Artificial Sequence: Synthetic oligonucleotide
aggccaccaacgatccccctgaggt

SEQ ID NO: 51027 - DNA, 24 bp, Artificial Sequence
  Description of Artificial Sequence: Synthetic oligonucleotide
ggccaccaacgatccccctgaggt

SEQ ID NO: 51028 - DNA, 25 bp, Artificial Sequence
  Description of Artificial Sequence: Synthetic oligonucleotide
gccaccaacgatccccctgaggtga

SEQ ID NO: 51029 - DNA, 25 bp, Artificial Sequence
  Description of Artificial Sequence: Synthetic oligonucleotide
ccaccaacgatccccctgaggtgac

SEQ ID NO: 51030 - DNA, 25 bp, Artificial Sequence
  Description of Artificial Sequence: Synthetic oligonucleotide
caccaacgatccccctgaggtgacc

SEQ ID NO: 51031 - DNA, 26 bp, Artificial Sequence
  Description of Artificial Sequence: Synthetic oligonucleotide
accaacgatccccctgaggtgaccgt

SEQ ID NO: 51032 - DNA, 25 bp, Artificial Sequence
  Description of Artificial Sequence: Synthetic oligonucleotide
ccaacgatccccctgaggtgaccgt

SEQ ID NO: 51033 - DNA, 27 bp, Artificial Sequence
  Description of Artificial Sequence: Synthetic oligonucleotide
caacgatccccctgaggtgaccgtgtt

SEQ ID NO: 51034 - DNA, 28 bp, Artificial Sequence
  Description of Artificial Sequence: Synthetic oligonucleotide
aacgatccccctgaggtgaccgtgtttc

SEQ ID NO: 51035 - DNA, 27 bp, Artificial Sequence
  Description of Artificial Sequence: Synthetic oligonucleotide
acgatccccctgaggtgaccgtgtttc

SEQ ID NO: 51036 - DNA, 26 bp, Artificial Sequence
  Description of Artificial Sequence: Synthetic oligonucleotide
cgatccccctgaggtgaccgtgtttc

SEQ ID NO: 51037 - DNA, 26 bp, Artificial Sequence
  Description of Artificial Sequence: Synthetic oligonucleotide
gatccccctgaggtgaccgtgtttcc

SEQ ID NO: 51038 - DNA, 27 bp, Artificial Sequence
  Description of Artificial Sequence: Synthetic oligonucleotide
atccccctgaggtgaccgtgtttccca

SEQ ID NO: 51039 - DNA, 27 bp, Artificial Sequence
  Description of Artificial Sequence: Synthetic oligonucleotide
tccccctgaggtgaccgtgtttcccaa

SEQ ID NO: 51040 - DNA, 26 bp, Artificial Sequence
  Description of Artificial Sequence: Synthetic oligonucleotide
ccccctgaggtgaccgtgtttcccaa

SEQ ID NO: 51041 - DNA, 26 bp, Artificial Sequence
  Description of Artificial Sequence: Synthetic oligonucleotide
cccctgaggtgaccgtgtttcccaag

SEQ ID NO: 51042 - DNA, 27 bp, Artificial Sequence
  Description of Artificial Sequence: Synthetic oligonucleotide
ccctgaggtgaccgtgtttcccaagga

SEQ ID NO: 51043 - DNA, 27 bp, Artificial Sequence
  Description of Artificial Sequence: Synthetic oligonucleotide
cctgaggtgaccgtgtttcccaaggag

SEQ ID NO: 51044 - DNA, 27 bp, Artificial Sequence
  Description of Artificial Sequence: Synthetic oligonucleotide
ctgaggtgaccgtgtttcccaaggagc

SEQ ID NO: 51045 - DNA, 27 bp, Artificial Sequence
  Description of Artificial Sequence: Synthetic oligonucleotide
tgaggtgaccgtgtttcccaaggagcc

SEQ ID NO: 51046 - DNA, 27 bp, Artificial Sequence
  Description of Artificial Sequence: Synthetic oligonucleotide
gaggtgaccgtgtttcccaaggagcct

SEQ ID NO: 51047 - DNA, 27 bp, Artificial Sequence
  Description of Artificial Sequence: Synthetic oligonucleotide
aggtgaccgtgtttcccaaggagcctg

SEQ ID NO: 51048 - DNA, 27 bp, Artificial Sequence
  Description of Artificial Sequence: Synthetic oligonucleotide
ggtgaccgtgtttcccaaggagcctgt

SEQ ID NO: 51049 - DNA, 27 bp, Artificial Sequence
  Description of Artificial Sequence: Synthetic oligonucleotide
gtgaccgtgtttcccaaggagcctgtg

SEQ ID NO: 51050 - DNA, 27 bp, Artificial Sequence
  Description of Artificial Sequence: Synthetic oligonucleotide
tgaccgtgtttcccaaggagcctgtgg

SEQ ID NO: 51051 - DNA, 27 bp, Artificial Sequence
  Description of Artificial Sequence: Synthetic oligonucleotide
gaccgtgtttcccaaggagcctgtgga

SEQ ID NO: 51052 - DNA, 27 bp, Artificial Sequence
  Description of Artificial Sequence: Synthetic oligonucleotide
accgtgtttcccaaggagcctgtggag

SEQ ID NO: 51053 - DNA, 26 bp, Artificial Sequence
  Description of Artificial Sequence: Synthetic oligonucleotide
ccgtgtttcccaaggagcctgtggag

SEQ ID NO: 51054 - DNA, 27 bp, Artificial Sequence
  Description of Artificial Sequence: Synthetic oligonucleotide
cgtgtttcccaaggagcctgtggagct

SEQ ID NO: 51055 - DNA, 27 bp, Artificial Sequence
  Description of Artificial Sequence: Synthetic oligonucleotide
gtgtttcccaaggagcctgtggagctg

SEQ ID NO: 51056 - DNA, 27 bp, Artificial Sequence
  Description of Artificial Sequence: Synthetic oligonucleotide
tgtttcccaaggagcctgtggagctgg

SEQ ID NO: 51057 - DNA, 26 bp, Artificial Sequence
  Description of Artificial Sequence: Synthetic oligonucleotide
gtttcccaaggagcctgtggagctgg

SEQ ID NO: 51058 - DNA, 26 bp, Artificial Sequence
  Description of Artificial Sequence: Synthetic oligonucleotide
tttcccaaggagcctgtggagctggg

SEQ ID NO: 51059 - DNA, 25 bp, Artificial Sequence
  Description of Artificial Sequence: Synthetic oligonucleotide
ttcccaaggagcctgtggagctggg

SEQ ID NO: 51060 - DNA, 24 bp, Artificial Sequence
  Description of Artificial Sequence: Synthetic oligonucleotide
tcccaaggagcctgtggagctggg

SEQ ID NO: 51061 - DNA, 23 bp, Artificial Sequence
  Description of Artificial Sequence: Synthetic oligonucleotide
cccaaggagcctgtggagctggg

SEQ ID NO: 51062 - DNA, 23 bp, Artificial Sequence
  Description of Artificial Sequence: Synthetic oligonucleotide
ccaaggagcctgtggagctgggc

SEQ ID NO: 51063 - DNA, 24 bp, Artificial Sequence
  Description of Artificial Sequence: Synthetic oligonucleotide
caaggagcctgtggagctgggcca

SEQ ID NO: 51064 - DNA, 24 bp, Artificial Sequence
  Description of Artificial Sequence: Synthetic oligonucleotide
aaggagcctgtggagctgggccag

SEQ ID NO: 51065 - DNA, 23 bp, Artificial Sequence
  Description of Artificial Sequence: Synthetic oligonucleotide
aggagcctgtggagctgggccag

SEQ ID NO: 51066 - DNA, 22 bp, Artificial Sequence
  Description of Artificial Sequence: Synthetic oligonucleotide
ggagcctgtggagctgggccag

SEQ ID NO: 51067 - DNA, 22 bp, Artificial Sequence
  Description of Artificial Sequence: Synthetic oligonucleotide
gagcctgtggagctgggccagc

SEQ ID NO: 51068 - DNA, 22 bp, Artificial Sequence
  Description of Artificial Sequence: Synthetic oligonucleotide
agcctgtggagctgggccagcc

SEQ ID NO: 51069 - DNA, 21 bp, Artificial Sequence
  Description of Artificial Sequence: Synthetic oligonucleotide
gcctgtggagctgggccagcc

SEQ ID NO: 51070 - DNA, 23 bp, Artificial Sequence
  Description of Artificial Sequence: Synthetic oligonucleotide
cctgtggagctgggccagcccaa

SEQ ID NO: 51071 - DNA, 24 bp, Artificial Sequence
  Description of Artificial Sequence: Synthetic oligonucleotide
ctgtggagctgggccagcccaaca

SEQ ID NO: 51072 - DNA, 24 bp, Artificial Sequence
  Description of Artificial Sequence: Synthetic oligonucleotide
tgtggagctgggccagcccaacac

SEQ ID NO: 51073 - DNA, 23 bp, Artificial Sequence
  Description of Artificial Sequence: Synthetic oligonucleotide
gtggagctgggccagcccaacac

SEQ ID NO: 51074 - DNA, 23 bp, Artificial Sequence
  Description of Artificial Sequence: Synthetic oligonucleotide
tggagctgggccagcccaacacc

SEQ ID NO: 51075 - DNA, 22 bp, Artificial Sequence
  Description of Artificial Sequence: Synthetic oligonucleotide
ggagctgggccagcccaacacc

SEQ ID NO: 51076 - DNA, 23 bp, Artificial Sequence
  Description of Artificial Sequence: Synthetic oligonucleotide
gagctgggccagcccaacaccct

SEQ ID NO: 51077 - DNA, 25 bp, Artificial Sequence
  Description of Artificial Sequence: Synthetic oligonucleotide
agctgggccagcccaacaccctcat

SEQ ID NO: 51078 - DNA, 24 bp, Artificial Sequence
  Description of Artificial Sequence: Synthetic oligonucleotide
gctgggccagcccaacaccctcat

SEQ ID NO: 51079 - DNA, 25 bp, Artificial Sequence
  Description of Artificial Sequence: Synthetic oligonucleotide
ctgggccagcccaacaccctcatct

SEQ ID NO: 51080 - DNA, 25 bp, Artificial Sequence
  Description of Artificial Sequence: Synthetic oligonucleotide
tgggccagcccaacaccctcatctg

SEQ ID NO: 51081 - DNA, 24 bp, Artificial Sequence
  Description of Artificial Sequence: Synthetic oligonucleotide
gggccagcccaacaccctcatctg

SEQ ID NO: 51082 - DNA, 24 bp, Artificial Sequence
  Description of Artificial Sequence: Synthetic oligonucleotide
ggccagcccaacaccctcatctgc

SEQ ID NO: 51083 - DNA, 25 bp, Artificial Sequence
  Description of Artificial Sequence: Synthetic oligonucleotide
gccagcccaacaccctcatctgcca

SEQ ID NO: 51084 - DNA, 27 bp, Artificial Sequence
  Description of Artificial Sequence: Synthetic oligonucleotide
ccagcccaacaccctcatctgccacat

SEQ ID NO: 51085 - DNA, 28 bp, Artificial Sequence
  Description of Artificial Sequence: Synthetic oligonucleotide
cagcccaacaccctcatctgccacattg

SEQ ID NO: 51086 - DNA, 29 bp, Artificial Sequence
  Description of Artificial Sequence: Synthetic oligonucleotide
agcccaacaccctcatctgccacattgac

SEQ ID NO: 51087 - DNA, 28 bp, Artificial Sequence
  Description of Artificial Sequence: Synthetic oligonucleotide
gcccaacaccctcatctgccacattgac

SEQ ID NO: 51088 - DNA, 30 bp, Artificial Sequence
  Description of Artificial Sequence: Synthetic oligonucleotide
cccaacaccctcatctgccacattgacaag

SEQ ID NO: 51089 - DNA, 32 bp, Artificial Sequence
  Description of Artificial Sequence: Synthetic oligonucleotide
ccaacaccctcatctgccacattgacaagttc

SEQ ID NO: 51090 - DNA, 34 bp, Artificial Sequence
  Description of Artificial Sequence: Synthetic oligonucleotide
caacaccctcatctgccacattgacaagttcttc

SEQ ID NO: 51091 - DNA, 34 bp, Artificial Sequence
  Description of Artificial Sequence: Synthetic oligonucleotide
aacaccctcatctgccacattgacaagttcttcc

SEQ ID NO: 51092 - DNA, 33 bp, Artificial Sequence
  Description of Artificial Sequence: Synthetic oligonucleotide
acaccctcatctgccacattgacaagttcttcc

SEQ ID NO: 51093 - DNA, 32 bp, Artificial Sequence
  Description of Artificial Sequence: Synthetic oligonucleotide
caccctcatctgccacattgacaagttcttcc

SEQ ID NO: 51094 - DNA, 32 bp, Artificial Sequence
  Description of Artificial Sequence: Synthetic oligonucleotide
accctcatctgccacattgacaagttcttccc

SEQ ID NO: 51095 - DNA, 31 bp, Artificial Sequence
  Description of Artificial Sequence: Synthetic oligonucleotide
ccctcatctgccacattgacaagttcttccc

SEQ ID NO: 51096 - DNA, 32 bp, Artificial Sequence
  Description of Artificial Sequence: Synthetic oligonucleotide
cctcatctgccacattgacaagttcttcccac

SEQ ID NO: 51097 - DNA, 32 bp, Artificial Sequence
  Description of Artificial Sequence: Synthetic oligonucleotide
ctcatctgccacattgacaagttcttcccacc

SEQ ID NO: 51098 - DNA, 33 bp, Artificial Sequence
  Description of Artificial Sequence: Synthetic oligonucleotide
tcatctgccacattgacaagttcttcccaccag

SEQ ID NO: 51099 - DNA, 32 bp, Artificial Sequence
  Description of Artificial Sequence: Synthetic oligonucleotide
catctgccacattgacaagttcttcccaccag

SEQ ID NO: 51100 - DNA, 33 bp, Artificial Sequence
  Description of Artificial Sequence: Synthetic oligonucleotide
atctgccacattgacaagttcttcccaccagtg

SEQ ID NO: 51101 - DNA, 32 bp, Artificial Sequence
  Description of Artificial Sequence: Synthetic oligonucleotide
tctgccacattgacaagttcttcccaccagtg

SEQ ID NO: 51102 - DNA, 31 bp, Artificial Sequence
  Description of Artificial Sequence: Synthetic oligonucleotide
ctgccacattgacaagttcttcccaccagtg

SEQ ID NO: 51103 - DNA, 31 bp, Artificial Sequence
  Description of Artificial Sequence: Synthetic oligonucleotide
tgccacattgacaagttcttcccaccagtgc

SEQ ID NO: 51104 - DNA, 30 bp, Artificial Sequence
  Description of Artificial Sequence: Synthetic oligonucleotide
gccacattgacaagttcttcccaccagtgc

SEQ ID NO: 51105 - DNA, 31 bp, Artificial Sequence
  Description of Artificial Sequence: Synthetic oligonucleotide
ccacattgacaagttcttcccaccagtgctc

SEQ ID NO: 51106 - DNA, 33 bp, Artificial Sequence
  Description of Artificial Sequence: Synthetic oligonucleotide
cacattgacaagttcttcccaccagtgctcaac

SEQ ID NO: 51107 - DNA, 33 bp, Artificial Sequence
  Description of Artificial Sequence: Synthetic oligonucleotide
acattgacaagttcttcccaccagtgctcaacg

SEQ ID NO: 51108 - DNA, 32 bp, Artificial Sequence
  Description of Artificial Sequence: Synthetic oligonucleotide
cattgacaagttcttcccaccagtgctcaacg

SEQ ID NO: 51109 - DNA, 33 bp, Artificial Sequence
  Description of Artificial Sequence: Synthetic oligonucleotide
attgacaagttcttcccaccagtgctcaacgtc

SEQ ID NO: 51110 - DNA, 32 bp, Artificial Sequence
  Description of Artificial Sequence: Synthetic oligonucleotide
ttgacaagttcttcccaccagtgctcaacgtc

SEQ ID NO: 51111 - DNA, 31 bp, Artificial Sequence
  Description of Artificial Sequence: Synthetic oligonucleotide
tgacaagttcttcccaccagtgctcaacgtc

SEQ ID NO: 51112 - DNA, 30 bp, Artificial Sequence
  Description of Artificial Sequence: Synthetic oligonucleotide
gacaagttcttcccaccagtgctcaacgtc

SEQ ID NO: 51113 - DNA, 31 bp, Artificial Sequence
  Description of Artificial Sequence: Synthetic oligonucleotide
acaagttcttcccaccagtgctcaacgtcac

SEQ ID NO: 51114 - DNA, 30 bp, Artificial Sequence
  Description of Artificial Sequence: Synthetic oligonucleotide
caagttcttcccaccagtgctcaacgtcac

SEQ ID NO: 51115 - DNA, 30 bp, Artificial Sequence
  Description of Artificial Sequence: Synthetic oligonucleotide
aagttcttcccaccagtgctcaacgtcacg

SEQ ID NO: 51116 - DNA, 29 bp, Artificial Sequence
  Description of Artificial Sequence: Synthetic oligonucleotide
agttcttcccaccagtgctcaacgtcacg

SEQ ID NO: 51117 - DNA, 28 bp, Artificial Sequence
  Description of Artificial Sequence: Synthetic oligonucleotide
gttcttcccaccagtgctcaacgtcacg

SEQ ID NO: 51118 - DNA, 29 bp, Artificial Sequence
  Description of Artificial Sequence: Synthetic oligonucleotide
ttcttcccaccagtgctcaacgtcacgtg

SEQ ID NO: 51119 - DNA, 28 bp, Artificial Sequence
  Description of Artificial Sequence: Synthetic oligonucleotide
tcttcccaccagtgctcaacgtcacgtg

SEQ ID NO: 51120 - DNA, 27 bp, Artificial Sequence
  Description of Artificial Sequence: Synthetic oligonucleotide
cttcccaccagtgctcaacgtcacgtg

SEQ ID NO: 51121 - DNA, 27 bp, Artificial Sequence
  Description of Artificial Sequence: Synthetic oligonucleotide
ttcccaccagtgctcaacgtcacgtgg

SEQ ID NO: 51122 - DNA, 26 bp, Artificial Sequence
  Description of Artificial Sequence: Synthetic oligonucleotide
tcccaccagtgctcaacgtcacgtgg

SEQ ID NO: 51123 - DNA, 25 bp, Artificial Sequence
  Description of Artificial Sequence: Synthetic oligonucleotide
cccaccagtgctcaacgtcacgtgg

SEQ ID NO: 51124 - DNA, 26 bp, Artificial Sequence
  Description of Artificial Sequence: Synthetic oligonucleotide
ccaccagtgctcaacgtcacgtggct

SEQ ID NO: 51125 - DNA, 27 bp, Artificial Sequence
  Description of Artificial Sequence: Synthetic oligonucleotide
caccagtgctcaacgtcacgtggctgt

SEQ ID NO: 51126 - DNA, 27 bp, Artificial Sequence
  Description of Artificial Sequence: Synthetic oligonucleotide
accagtgctcaacgtcacgtggctgtg

SEQ ID NO: 51127 - DNA, 26 bp, Artificial Sequence
  Description of Artificial Sequence: Synthetic oligonucleotide
ccagtgctcaacgtcacgtggctgtg

SEQ ID NO: 51128 - DNA, 27 bp, Artificial Sequence
  Description of Artificial Sequence: Synthetic oligonucleotide
cagtgctcaacgtcacgtggctgtgca

SEQ ID NO: 51129 - DNA, 28 bp, Artificial Sequence
  Description of Artificial Sequence: Synthetic oligonucleotide
agtgctcaacgtcacgtggctgtgcaac

SEQ ID NO: 51130 - DNA, 27 bp, Artificial Sequence
  Description of Artificial Sequence: Synthetic oligonucleotide
gtgctcaacgtcacgtggctgtgcaac

SEQ ID NO: 51131 - DNA, 27 bp, Artificial Sequence
  Description of Artificial Sequence: Synthetic oligonucleotide
tgctcaacgtcacgtggctgtgcaacg

SEQ ID NO: 51132 - DNA, 26 bp, Artificial Sequence
  Description of Artificial Sequence: Synthetic oligonucleotide
gctcaacgtcacgtggctgtgcaacg

SEQ ID NO: 51133 - DNA, 26 bp, Artificial Sequence
  Description of Artificial Sequence: Synthetic oligonucleotide
ctcaacgtcacgtggctgtgcaacgg

SEQ ID NO: 51134 - DNA, 26 bp, Artificial Sequence
  Description of Artificial Sequence: Synthetic oligonucleotide
tcaacgtcacgtggctgtgcaacggg

SEQ ID NO: 51135 - DNA, 25 bp, Artificial Sequence
  Description of Artificial Sequence: Synthetic oligonucleotide
caacgtcacgtggctgtgcaacggg

SEQ ID NO: 51136 - DNA, 26 bp, Artificial Sequence
  Description of Artificial Sequence: Synthetic oligonucleotide
aacgtcacgtggctgtgcaacgggga

SEQ ID NO: 51137 - DNA, 25 bp, Artificial Sequence
  Description of Artificial Sequence: Synthetic oligonucleotide
acgtcacgtggctgtgcaacgggga

SEQ ID NO: 51138 - DNA, 24 bp, Artificial Sequence
  Description of Artificial Sequence: Synthetic oligonucleotide
cgtcacgtggctgtgcaacgggga

SEQ ID NO: 51139 - DNA, 24 bp, Artificial Sequence
  Description of Artificial Sequence: Synthetic oligonucleotide
gtcacgtggctgtgcaacggggag

SEQ ID NO: 51140 - DNA, 25 bp, Artificial Sequence
  Description of Artificial Sequence: Synthetic oligonucleotide
tcacgtggctgtgcaacggggagct

SEQ ID NO: 51141 - DNA, 24 bp, Artificial Sequence
  Description of Artificial Sequence: Synthetic oligonucleotide
cacgtggctgtgcaacggggagct

SEQ ID NO: 51142 - DNA, 24 bp, Artificial Sequence
  Description of Artificial Sequence: Synthetic oligonucleotide
acgtggctgtgcaacggggagctg

SEQ ID NO: 51143 - DNA, 23 bp, Artificial Sequence
  Description of Artificial Sequence: Synthetic oligonucleotide
cgtggctgtgcaacggggagctg

SEQ ID NO: 51144 - DNA, 24 bp, Artificial Sequence
  Description of Artificial Sequence: Synthetic oligonucleotide
gtggctgtgcaacggggagctggt

SEQ ID NO: 51145 - DNA, 25 bp, Artificial Sequence
  Description of Artificial Sequence: Synthetic oligonucleotide
tggctgtgcaacggggagctggtca

SEQ ID NO: 51146 - DNA, 24 bp, Artificial Sequence
  Description of Artificial Sequence: Synthetic oligonucleotide
ggctgtgcaacggggagctggtca

SEQ ID NO: 51147 - DNA, 25 bp, Artificial Sequence
  Description of Artificial Sequence: Synthetic oligonucleotide
gctgtgcaacggggagctggtcact

SEQ ID NO: 51148 - DNA, 26 bp, Artificial Sequence
  Description of Artificial Sequence: Synthetic oligonucleotide
ctgtgcaacggggagctggtcactga

SEQ ID NO: 51149 - DNA, 26 bp, Artificial Sequence
  Description of Artificial Sequence: Synthetic oligonucleotide
tgtgcaacggggagctggtcactgag

SEQ ID NO: 51150 - DNA, 25 bp, Artificial Sequence
  Description of Artificial Sequence: Synthetic oligonucleotide
gtgcaacggggagctggtcactgag

SEQ ID NO: 51151 - DNA, 25 bp, Artificial Sequence
  Description of Artificial Sequence: Synthetic oligonucleotide
tgcaacggggagctggtcactgagg

SEQ ID NO: 51152 - DNA, 24 bp, Artificial Sequence
  Description of Artificial Sequence: Synthetic oligonucleotide
gcaacggggagctggtcactgagg

SEQ ID NO: 51153 - DNA, 25 bp, Artificial Sequence
  Description of Artificial Sequence: Synthetic oligonucleotide
caacggggagctggtcactgagggt

SEQ ID NO: 51154 - DNA, 26 bp, Artificial Sequence
  Description of Artificial Sequence: Synthetic oligonucleotide
aacggggagctggtcactgagggtgt

SEQ ID NO: 51155 - DNA, 25 bp, Artificial Sequence
  Description of Artificial Sequence: Synthetic oligonucleotide
acggggagctggtcactgagggtgt

SEQ ID NO: 51156 - DNA, 24 bp, Artificial Sequence
  Description of Artificial Sequence: Synthetic oligonucleotide
cggggagctggtcactgagggtgt

SEQ ID NO: 51157 - DNA, 24 bp, Artificial Sequence
  Description of Artificial Sequence: Synthetic oligonucleotide
ggggagctggtcactgagggtgtc

SEQ ID NO: 51158 - DNA, 24 bp, Artificial Sequence
  Description of Artificial Sequence: Synthetic oligonucleotide
gggagctggtcactgagggtgtcg

SEQ ID NO: 51159 - DNA, 25 bp, Artificial Sequence
  Description of Artificial Sequence: Synthetic oligonucleotide
ggagctggtcactgagggtgtcgct

SEQ ID NO: 51160 - DNA, 26 bp, Artificial Sequence
  Description of Artificial Sequence: Synthetic oligonucleotide
gagctggtcactgagggtgtcgctga

SEQ ID NO: 51161 - DNA, 27 bp, Artificial Sequence
  Description of Artificial Sequence: Synthetic oligonucleotide
agctggtcactgagggtgtcgctgaga

SEQ ID NO: 51162 - DNA, 26 bp, Artificial Sequence
  Description of Artificial Sequence: Synthetic oligonucleotide
gctggtcactgagggtgtcgctgaga

SEQ ID NO: 51163 - DNA, 26 bp, Artificial Sequence
  Description of Artificial Sequence: Synthetic oligonucleotide
ctggtcactgagggtgtcgctgagag

SEQ ID NO: 51164 - DNA, 26 bp, Artificial Sequence
  Description of Artificial Sequence: Synthetic oligonucleotide
tggtcactgagggtgtcgctgagagc

SEQ ID NO: 51165 - DNA, 25 bp, Artificial Sequence
  Description of Artificial Sequence: Synthetic oligonucleotide
ggtcactgagggtgtcgctgagagc

SEQ ID NO: 51166 - DNA, 26 bp, Artificial Sequence
  Description of Artificial Sequence: Synthetic oligonucleotide
gtcactgagggtgtcgctgagagcct

SEQ ID NO: 51167 - DNA, 27 bp, Artificial Sequence
  Description of Artificial Sequence: Synthetic oligonucleotide
tcactgagggtgtcgctgagagcctct

SEQ ID NO: 51168 - DNA, 27 bp, Artificial Sequence
  Description of Artificial Sequence: Synthetic oligonucleotide
cactgagggtgtcgctgagagcctctt

SEQ ID NO: 51169 - DNA, 27 bp, Artificial Sequence
  Description of Artificial Sequence: Synthetic oligonucleotide
actgagggtgtcgctgagagcctcttc

SEQ ID NO: 51170 - DNA, 26 bp, Artificial Sequence
  Description of Artificial Sequence: Synthetic oligonucleotide
ctgagggtgtcgctgagagcctcttc

SEQ ID NO: 51171 - DNA, 27 bp, Artificial Sequence
  Description of Artificial Sequence: Synthetic oligonucleotide
tgagggtgtcgctgagagcctcttcct

SEQ ID NO: 51172 - DNA, 26 bp, Artificial Sequence
  Description of Artificial Sequence: Synthetic oligonucleotide
gagggtgtcgctgagagcctcttcct

SEQ ID NO: 51173 - DNA, 26 bp, Artificial Sequence
  Description of Artificial Sequence: Synthetic oligonucleotide
agggtgtcgctgagagcctcttcctg

SEQ ID NO: 51174 - DNA, 25 bp, Artificial Sequence
  Description of Artificial Sequence: Synthetic oligonucleotide
gggtgtcgctgagagcctcttcctg

SEQ ID NO: 51175 - DNA, 25 bp, Artificial Sequence
  Description of Artificial Sequence: Synthetic oligonucleotide
ggtgtcgctgagagcctcttcctgc

SEQ ID NO: 51176 - DNA, 25 bp, Artificial Sequence
  Description of Artificial Sequence: Synthetic oligonucleotide
gtgtcgctgagagcctcttcctgcc

SEQ ID NO: 51177 - DNA, 26 bp, Artificial Sequence
  Description of Artificial Sequence: Synthetic oligonucleotide
tgtcgctgagagcctcttcctgccca

SEQ ID NO: 51178 - DNA, 25 bp, Artificial Sequence
  Description of Artificial Sequence: Synthetic oligonucleotide
gtcgctgagagcctcttcctgccca

SEQ ID NO: 51179 - DNA, 27 bp, Artificial Sequence
  Description of Artificial Sequence: Synthetic oligonucleotide
tcgctgagagcctcttcctgcccagaa

SEQ ID NO: 51180 - DNA, 26 bp, Artificial Sequence
  Description of Artificial Sequence: Synthetic oligonucleotide
cgctgagagcctcttcctgcccagaa

SEQ ID NO: 51181 - DNA, 27 bp, Artificial Sequence
  Description of Artificial Sequence: Synthetic oligonucleotide
gctgagagcctcttcctgcccagaaca

SEQ ID NO: 51182 - DNA, 27 bp, Artificial Sequence
  Description of Artificial Sequence: Synthetic oligonucleotide
ctgagagcctcttcctgcccagaacag

SEQ ID NO: 51183 - DNA, 31 bp, Artificial Sequence
  Description of Artificial Sequence: Synthetic oligonucleotide
tgagagcctcttcctgcccagaacagattac

SEQ ID NO: 51184 - DNA, 30 bp, Artificial Sequence
  Description of Artificial Sequence: Synthetic oligonucleotide
gagagcctcttcctgcccagaacagattac

SEQ ID NO: 51185 - DNA, 31 bp, Artificial Sequence
  Description of Artificial Sequence: Synthetic oligonucleotide
agagcctcttcctgcccagaacagattacag

SEQ ID NO: 51186 - DNA, 30 bp, Artificial Sequence
  Description of Artificial Sequence: Synthetic oligonucleotide
gagcctcttcctgcccagaacagattacag

SEQ ID NO: 51187 - DNA, 30 bp, Artificial Sequence
  Description of Artificial Sequence: Synthetic oligonucleotide
agcctcttcctgcccagaacagattacagc

SEQ ID NO: 51188 - DNA, 29 bp, Artificial Sequence
  Description of Artificial Sequence: Synthetic oligonucleotide
gcctcttcctgcccagaacagattacagc

SEQ ID NO: 51189 - DNA, 31 bp, Artificial Sequence
  Description of Artificial Sequence: Synthetic oligonucleotide
cctcttcctgcccagaacagattacagcttc

SEQ ID NO: 51190 - DNA, 31 bp, Artificial Sequence
  Description of Artificial Sequence: Synthetic oligonucleotide
ctcttcctgcccagaacagattacagcttcc

SEQ ID NO: 51191 - DNA, 32 bp, Artificial Sequence
  Description of Artificial Sequence: Synthetic oligonucleotide
tcttcctgcccagaacagattacagcttccac

SEQ ID NO: 51192 - DNA, 31 bp, Artificial Sequence
  Description of Artificial Sequence: Synthetic oligonucleotide
cttcctgcccagaacagattacagcttccac

SEQ ID NO: 51193 - DNA, 33 bp, Artificial Sequence
  Description of Artificial Sequence: Synthetic oligonucleotide
ttcctgcccagaacagattacagcttccacaag

SEQ ID NO: 51194 - DNA, 32 bp, Artificial Sequence
  Description of Artificial Sequence: Synthetic oligonucleotide
tcctgcccagaacagattacagcttccacaag

SEQ ID NO: 51195 - DNA, 31 bp, Artificial Sequence
  Description of Artificial Sequence: Synthetic oligonucleotide
cctgcccagaacagattacagcttccacaag

SEQ ID NO: 51196 - DNA, 33 bp, Artificial Sequence
  Description of Artificial Sequence: Synthetic oligonucleotide
ctgcccagaacagattacagcttccacaagttc

SEQ ID NO: 51197 - DNA, 33 bp, Artificial Sequence
  Description of Artificial Sequence: Synthetic oligonucleotide
tgcccagaacagattacagcttccacaagttcc

SEQ ID NO: 51198 - DNA, 32 bp, Artificial Sequence
  Description of Artificial Sequence: Synthetic oligonucleotide
gcccagaacagattacagcttccacaagttcc

SEQ ID NO: 51199 - DNA, 36 bp, Artificial Sequence
  Description of Artificial Sequence: Synthetic oligonucleotide
cccagaacagattacagcttccacaagttccattac

SEQ ID NO: 51200 - DNA, 36 bp, Artificial Sequence
  Description of Artificial Sequence: Synthetic oligonucleotide
ccagaacagattacagcttccacaagttccattacc

SEQ ID NO: 51201 - DNA, 37 bp, Artificial Sequence
  Description of Artificial Sequence: Synthetic oligonucleotide
cagaacagattacagcttccacaagttccattacctg

SEQ ID NO: 51202 - DNA, 38 bp, Artificial Sequence
  Description of Artificial Sequence: Synthetic oligonucleotide
agaacagattacagcttccacaagttccattacctgac

SEQ ID NO: 51203 - DNA, 37 bp, Artificial Sequence
  Description of Artificial Sequence: Synthetic oligonucleotide
gaacagattacagcttccacaagttccattacctgac

SEQ ID NO: 51204 - DNA, 37 bp, Artificial Sequence
  Description of Artificial Sequence: Synthetic oligonucleotide
aacagattacagcttccacaagttccattacctgacc

SEQ ID NO: 51205 - DNA, 36 bp, Artificial Sequence
  Description of Artificial Sequence: Synthetic oligonucleotide
acagattacagcttccacaagttccattacctgacc

SEQ ID NO: 51206 - DNA, 35 bp, Artificial Sequence
  Description of Artificial Sequence: Synthetic oligonucleotide
cagattacagcttccacaagttccattacctgacc

SEQ ID NO: 51207 - DNA, 38 bp, Artificial Sequence
  Description of Artificial Sequence: Synthetic oligonucleotide
agattacagcttccacaagttccattacctgacctttg

SEQ ID NO: 51208 - DNA, 37 bp, Artificial Sequence
  Description of Artificial Sequence: Synthetic oligonucleotide
gattacagcttccacaagttccattacctgacctttg

SEQ ID NO: 51209 - DNA, 38 bp, Artificial Sequence
  Description of Artificial Sequence: Synthetic oligonucleotide
attacagcttccacaagttccattacctgacctttgtg

SEQ ID NO: 51210 - DNA, 37 bp, Artificial Sequence
  Description of Artificial Sequence: Synthetic oligonucleotide
ttacagcttccacaagttccattacctgacctttgtg

SEQ ID NO: 51211 - DNA, 36 bp, Artificial Sequence
  Description of Artificial Sequence: Synthetic oligonucleotide
tacagcttccacaagttccattacctgacctttgtg

SEQ ID NO: 51212 - DNA, 35 bp, Artificial Sequence
  Description of Artificial Sequence: Synthetic oligonucleotide
acagcttccacaagttccattacctgacctttgtg

SEQ ID NO: 51213 - DNA, 34 bp, Artificial Sequence
  Description of Artificial Sequence: Synthetic oligonucleotide
cagcttccacaagttccattacctgacctttgtg

SEQ ID NO: 51214 - DNA, 34 bp, Artificial Sequence
  Description of Artificial Sequence: Synthetic oligonucleotide
agcttccacaagttccattacctgacctttgtgc

SEQ ID NO: 51215 - DNA, 33 bp, Artificial Sequence
  Description of Artificial Sequence: Synthetic oligonucleotide
gcttccacaagttccattacctgacctttgtgc

SEQ ID NO: 51216 - DNA, 33 bp, Artificial Sequence
  Description of Artificial Sequence: Synthetic oligonucleotide
cttccacaagttccattacctgacctttgtgcc

SEQ ID NO: 51217 - DNA, 33 bp, Artificial Sequence
  Description of Artificial Sequence: Synthetic oligonucleotide
ttccacaagttccattacctgacctttgtgccc

SEQ ID NO: 51218 - DNA, 32 bp, Artificial Sequence
  Description of Artificial Sequence: Synthetic oligonucleotide
tccacaagttccattacctgacctttgtgccc

SEQ ID NO: 51219 - DNA, 31 bp, Artificial Sequence
  Description of Artificial Sequence: Synthetic oligonucleotide
ccacaagttccattacctgacctttgtgccc

SEQ ID NO: 51220 - DNA, 32 bp, Artificial Sequence
  Description of Artificial Sequence: Synthetic oligonucleotide
cacaagttccattacctgacctttgtgccctc

SEQ ID NO: 51221 - DNA, 33 bp, Artificial Sequence
  Description of Artificial Sequence: Synthetic oligonucleotide
acaagttccattacctgacctttgtgccctcag

SEQ ID NO: 51222 - DNA, 32 bp, Artificial Sequence
  Description of Artificial Sequence: Synthetic oligonucleotide
caagttccattacctgacctttgtgccctcag

SEQ ID NO: 51223 - DNA, 32 bp, Artificial Sequence
  Description of Artificial Sequence: Synthetic oligonucleotide
aagttccattacctgacctttgtgccctcagc

SEQ ID NO: 51224 - DNA, 31 bp, Artificial Sequence
  Description of Artificial Sequence: Synthetic oligonucleotide
agttccattacctgacctttgtgccctcagc

SEQ ID NO: 51225 - DNA, 30 bp, Artificial Sequence
  Description of Artificial Sequence: Synthetic oligonucleotide
gttccattacctgacctttgtgccctcagc

SEQ ID NO: 51226 - DNA, 31 bp, Artificial Sequence
  Description of Artificial Sequence: Synthetic oligonucleotide
ttccattacctgacctttgtgccctcagcag

SEQ ID NO: 51227 - DNA, 30 bp, Artificial Sequence
  Description of Artificial Sequence: Synthetic oligonucleotide
tccattacctgacctttgtgccctcagcag

SEQ ID NO: 51228 - DNA, 29 bp, Artificial Sequence
  Description of Artificial Sequence: Synthetic oligonucleotide
ccattacctgacctttgtgccctcagcag

SEQ ID NO: 51229 - DNA, 30 bp, Artificial Sequence
  Description of Artificial Sequence: Synthetic oligonucleotide
cattacctgacctttgtgccctcagcagag

SEQ ID NO: 51230 - DNA, 30 bp, Artificial Sequence
  Description of Artificial Sequence: Synthetic oligonucleotide
attacctgacctttgtgccctcagcagagg

SEQ ID NO: 51231 - DNA, 29 bp, Artificial Sequence
  Description of Artificial Sequence: Synthetic oligonucleotide
ttacctgacctttgtgccctcagcagagg

SEQ ID NO: 51232 - DNA, 28 bp, Artificial Sequence
  Description of Artificial Sequence: Synthetic oligonucleotide
tacctgacctttgtgccctcagcagagg

SEQ ID NO: 51233 - DNA, 27 bp, Artificial Sequence
  Description of Artificial Sequence: Synthetic oligonucleotide
acctgacctttgtgccctcagcagagg

SEQ ID NO: 51234 - DNA, 27 bp, Artificial Sequence
  Description of Artificial Sequence: Synthetic oligonucleotide
cctgacctttgtgccctcagcagagga

SEQ ID NO: 51235 - DNA, 27 bp, Artificial Sequence
  Description of Artificial Sequence: Synthetic oligonucleotide
ctgacctttgtgccctcagcagaggac

SEQ ID NO: 51236 - DNA, 29 bp, Artificial Sequence
  Description of Artificial Sequence: Synthetic oligonucleotide
tgacctttgtgccctcagcagaggacttc

SEQ ID NO: 51237 - DNA, 28 bp, Artificial Sequence
  Description of Artificial Sequence: Synthetic oligonucleotide
gacctttgtgccctcagcagaggacttc

SEQ ID NO: 51238 - DNA, 31 bp, Artificial Sequence
  Description of Artificial Sequence: Synthetic oligonucleotide
acctttgtgccctcagcagaggacttctatg

SEQ ID NO: 51239 - DNA, 30 bp, Artificial Sequence
  Description of Artificial Sequence: Synthetic oligonucleotide
cctttgtgccctcagcagaggacttctatg

SEQ ID NO: 51240 - DNA, 31 bp, Artificial Sequence
  Description of Artificial Sequence: Synthetic oligonucleotide
ctttgtgccctcagcagaggacttctatgac

SEQ ID NO: 51241 - DNA, 32 bp, Artificial Sequence
  Description of Artificial Sequence: Synthetic oligonucleotide
tttgtgccctcagcagaggacttctatgactg

SEQ ID NO: 51242 - DNA, 31 bp, Artificial Sequence
  Description of Artificial Sequence: Synthetic oligonucleotide
ttgtgccctcagcagaggacttctatgactg

SEQ ID NO: 51243 - DNA, 30 bp, Artificial Sequence
  Description of Artificial Sequence: Synthetic oligonucleotide
tgtgccctcagcagaggacttctatgactg

SEQ ID NO: 51244 - DNA, 29 bp, Artificial Sequence
  Description of Artificial Sequence: Synthetic oligonucleotide
gtgccctcagcagaggacttctatgactg

SEQ ID NO: 51245 - DNA, 29 bp, Artificial Sequence
  Description of Artificial Sequence: Synthetic oligonucleotide
tgccctcagcagaggacttctatgactgc

SEQ ID NO: 51246 - DNA, 28 bp, Artificial Sequence
  Description of Artificial Sequence: Synthetic oligonucleotide
gccctcagcagaggacttctatgactgc

SEQ ID NO: 51247 - DNA, 29 bp, Artificial Sequence
  Description of Artificial Sequence: Synthetic oligonucleotide
ccctcagcagaggacttctatgactgcag

SEQ ID NO: 51248 - DNA, 29 bp, Artificial Sequence
  Description of Artificial Sequence: Synthetic oligonucleotide
cctcagcagaggacttctatgactgcagg

SEQ ID NO: 51249 - DNA, 29 bp, Artificial Sequence
  Description of Artificial Sequence: Synthetic oligonucleotide
ctcagcagaggacttctatgactgcaggg

SEQ ID NO: 51250 - DNA, 30 bp, Artificial Sequence
  Description of Artificial Sequence: Synthetic oligonucleotide
tcagcagaggacttctatgactgcagggtg

SEQ ID NO: 51251 - DNA, 29 bp, Artificial Sequence
  Description of Artificial Sequence: Synthetic oligonucleotide
cagcagaggacttctatgactgcagggtg

SEQ ID NO: 51252 - DNA, 29 bp, Artificial Sequence
  Description of Artificial Sequence: Synthetic oligonucleotide
agcagaggacttctatgactgcagggtgg

SEQ ID NO: 51253 - DNA, 28 bp, Artificial Sequence
  Description of Artificial Sequence: Synthetic oligonucleotide
gcagaggacttctatgactgcagggtgg

SEQ ID NO: 51254 - DNA, 29 bp, Artificial Sequence
  Description of Artificial Sequence: Synthetic oligonucleotide
cagaggacttctatgactgcagggtggag

SEQ ID NO: 51255 - DNA, 29 bp, Artificial Sequence
  Description of Artificial Sequence: Synthetic oligonucleotide
agaggacttctatgactgcagggtggagc

SEQ ID NO: 51256 - DNA, 28 bp, Artificial Sequence
  Description of Artificial Sequence: Synthetic oligonucleotide
gaggacttctatgactgcagggtggagc

SEQ ID NO: 51257 - DNA, 29 bp, Artificial Sequence
  Description of Artificial Sequence: Synthetic oligonucleotide
aggacttctatgactgcagggtggagcac

SEQ ID NO: 51258 - DNA, 28 bp, Artificial Sequence
  Description of Artificial Sequence: Synthetic oligonucleotide
ggacttctatgactgcagggtggagcac

SEQ ID NO: 51259 - DNA, 29 bp, Artificial Sequence
  Description of Artificial Sequence: Synthetic oligonucleotide
gacttctatgactgcagggtggagcactg

SEQ ID NO: 51260 - DNA, 29 bp, Artificial Sequence
  Description of Artificial Sequence: Synthetic oligonucleotide
acttctatgactgcagggtggagcactgg

SEQ ID NO: 51261 - DNA, 28 bp, Artificial Sequence
  Description of Artificial Sequence: Synthetic oligonucleotide
cttctatgactgcagggtggagcactgg

SEQ ID NO: 51262 - DNA, 28 bp, Artificial Sequence
  Description of Artificial Sequence: Synthetic oligonucleotide
ttctatgactgcagggtggagcactggg

SEQ ID NO: 51263 - DNA, 27 bp, Artificial Sequence
  Description of Artificial Sequence: Synthetic oligonucleotide
tctatgactgcagggtggagcactggg

SEQ ID NO: 51264 - DNA, 26 bp, Artificial Sequence
  Description of Artificial Sequence: Synthetic oligonucleotide
ctatgactgcagggtggagcactggg

SEQ ID NO: 51265 - DNA, 26 bp, Artificial Sequence
  Description of Artificial Sequence: Synthetic oligonucleotide
tatgactgcagggtggagcactgggg

SEQ ID NO: 51266 - DNA, 25 bp, Artificial Sequence
  Description of Artificial Sequence: Synthetic oligonucleotide
atgactgcagggtggagcactgggg

SEQ ID NO: 51267 - DNA, 24 bp, Artificial Sequence
  Description of Artificial Sequence: Synthetic oligonucleotide
tgactgcagggtggagcactgggg

SEQ ID NO: 51268 - DNA, 23 bp, Artificial Sequence
  Description of Artificial Sequence: Synthetic oligonucleotide
gactgcagggtggagcactgggg

SEQ ID NO: 51269 - DNA, 25 bp, Artificial Sequence
  Description of Artificial Sequence: Synthetic oligonucleotide
actgcagggtggagcactggggctt

SEQ ID NO: 51270 - DNA, 24 bp, Artificial Sequence
  Description of Artificial Sequence: Synthetic oligonucleotide
ctgcagggtggagcactggggctt

SEQ ID NO: 51271 - DNA, 24 bp, Artificial Sequence
  Description of Artificial Sequence: Synthetic oligonucleotide
tgcagggtggagcactggggcttg

SEQ ID NO: 51272 - DNA, 23 bp, Artificial Sequence
  Description of Artificial Sequence: Synthetic oligonucleotide
gcagggtggagcactggggcttg

SEQ ID NO: 51273 - DNA, 24 bp, Artificial Sequence
  Description of Artificial Sequence: Synthetic oligonucleotide
cagggtggagcactggggcttgga

SEQ ID NO: 51274 - DNA, 24 bp, Artificial Sequence
  Description of Artificial Sequence: Synthetic oligonucleotide
agggtggagcactggggcttggac

SEQ ID NO: 51275 - DNA, 23 bp, Artificial Sequence
  Description of Artificial Sequence: Synthetic oligonucleotide
gggtggagcactggggcttggac

SEQ ID NO: 51276 - DNA, 24 bp, Artificial Sequence
  Description of Artificial Sequence: Synthetic oligonucleotide
ggtggagcactggggcttggacca

SEQ ID NO: 51277 - DNA, 24 bp, Artificial Sequence
  Description of Artificial Sequence: Synthetic oligonucleotide
gtggagcactggggcttggaccag

SEQ ID NO: 51278 - DNA, 24 bp, Artificial Sequence
  Description of Artificial Sequence: Synthetic oligonucleotide
tggagcactggggcttggaccagc

SEQ ID NO: 51279 - DNA, 23 bp, Artificial Sequence
  Description of Artificial Sequence: Synthetic oligonucleotide
ggagcactggggcttggaccagc

SEQ ID NO: 51280 - DNA, 23 bp, Artificial Sequence
  Description of Artificial Sequence: Synthetic oligonucleotide
gagcactggggcttggaccagcc

SEQ ID NO: 51281 - DNA, 23 bp, Artificial Sequence
  Description of Artificial Sequence: Synthetic oligonucleotide
agcactggggcttggaccagccg

SEQ ID NO: 51282 - DNA, 22 bp, Artificial Sequence
  Description of Artificial Sequence: Synthetic oligonucleotide
gcactggggcttggaccagccg

SEQ ID NO: 51283 - DNA, 23 bp, Artificial Sequence
  Description of Artificial Sequence: Synthetic oligonucleotide
cactggggcttggaccagccgct

SEQ ID NO: 51284 - DNA, 23 bp, Artificial Sequence
  Description of Artificial Sequence: Synthetic oligonucleotide
actggggcttggaccagccgctc

SEQ ID NO: 51285 - DNA, 22 bp, Artificial Sequence
  Description of Artificial Sequence: Synthetic oligonucleotide
ctggggcttggaccagccgctc

SEQ ID NO: 51286 - DNA, 23 bp, Artificial Sequence
  Description of Artificial Sequence: Synthetic oligonucleotide
tggggcttggaccagccgctcct

SEQ ID NO: 51287 - DNA, 22 bp, Artificial Sequence
  Description of Artificial Sequence: Synthetic oligonucleotide
ggggcttggaccagccgctcct

SEQ ID NO: 51288 - DNA, 24 bp, Artificial Sequence
  Description of Artificial Sequence: Synthetic oligonucleotide
gggcttggaccagccgctcctcaa

SEQ ID NO: 51289 - DNA, 24 bp, Artificial Sequence
  Description of Artificial Sequence: Synthetic oligonucleotide
ggcttggaccagccgctcctcaag

SEQ ID NO: 51290 - DNA, 25 bp, Artificial Sequence
  Description of Artificial Sequence: Synthetic oligonucleotide
gcttggaccagccgctcctcaagca

SEQ ID NO: 51291 - DNA, 26 bp, Artificial Sequence
  Description of Artificial Sequence: Synthetic oligonucleotide
cttggaccagccgctcctcaagcact

SEQ ID NO: 51292 - DNA, 26 bp, Artificial Sequence
  Description of Artificial Sequence: Synthetic oligonucleotide
ttggaccagccgctcctcaagcactg

SEQ ID NO: 51293 - DNA, 25 bp, Artificial Sequence
  Description of Artificial Sequence: Synthetic oligonucleotide
tggaccagccgctcctcaagcactg

SEQ ID NO: 51294 - DNA, 24 bp, Artificial Sequence
  Description of Artificial Sequence: Synthetic oligonucleotide
ggaccagccgctcctcaagcactg

SEQ ID NO: 51295 - DNA, 24 bp, Artificial Sequence
  Description of Artificial Sequence: Synthetic oligonucleotide
gaccagccgctcctcaagcactgg

SEQ ID NO: 51296 - DNA, 25 bp, Artificial Sequence
  Description of Artificial Sequence: Synthetic oligonucleotide
accagccgctcctcaagcactggga

SEQ ID NO: 51297 - DNA, 24 bp, Artificial Sequence
  Description of Artificial Sequence: Synthetic oligonucleotide
ccagccgctcctcaagcactggga

SEQ ID NO: 51298 - DNA, 24 bp, Artificial Sequence
  Description of Artificial Sequence: Synthetic oligonucleotide
cagccgctcctcaagcactgggag

SEQ ID NO: 51299 - DNA, 24 bp, Artificial Sequence
  Description of Artificial Sequence: Synthetic oligonucleotide
agccgctcctcaagcactgggagg

SEQ ID NO: 51300 - DNA, 23 bp, Artificial Sequence
  Description of Artificial Sequence: Synthetic oligonucleotide
gccgctcctcaagcactgggagg

SEQ ID NO: 51301 - DNA, 23 bp, Artificial Sequence
  Description of Artificial Sequence: Synthetic oligonucleotide
ccgctcctcaagcactgggaggc

SEQ ID NO: 51302 - DNA, 23 bp, Artificial Sequence
  Description of Artificial Sequence: Synthetic oligonucleotide
cgctcctcaagcactgggaggcc

SEQ ID NO: 51303 - DNA, 25 bp, Artificial Sequence
  Description of Artificial Sequence: Synthetic oligonucleotide
gctcctcaagcactgggaggcccaa

SEQ ID NO: 51304 - DNA, 26 bp, Artificial Sequence
  Description of Artificial Sequence: Synthetic oligonucleotide
ctcctcaagcactgggaggcccaaga

SEQ ID NO: 51305 - DNA, 26 bp, Artificial Sequence
  Description of Artificial Sequence: Synthetic oligonucleotide
tcctcaagcactgggaggcccaagag

SEQ ID NO: 51306 - DNA, 25 bp, Artificial Sequence
  Description of Artificial Sequence: Synthetic oligonucleotide
cctcaagcactgggaggcccaagag

SEQ ID NO: 51307 - DNA, 25 bp, Artificial Sequence
  Description of Artificial Sequence: Synthetic oligonucleotide
ctcaagcactgggaggcccaagagc

SEQ ID NO: 51308 - DNA, 27 bp, Artificial Sequence
  Description of Artificial Sequence: Synthetic oligonucleotide
tcaagcactgggaggcccaagagccaa

SEQ ID NO: 51309 - DNA, 27 bp, Artificial Sequence
  Description of Artificial Sequence: Synthetic oligonucleotide
caagcactgggaggcccaagagccaat

SEQ ID NO: 51310 - DNA, 27 bp, Artificial Sequence
  Description of Artificial Sequence: Synthetic oligonucleotide
aagcactgggaggcccaagagccaatc

SEQ ID NO: 51311 - DNA, 26 bp, Artificial Sequence
  Description of Artificial Sequence: Synthetic oligonucleotide
agcactgggaggcccaagagccaatc

SEQ ID NO: 51312 - DNA, 25 bp, Artificial Sequence
  Description of Artificial Sequence: Synthetic oligonucleotide
gcactgggaggcccaagagccaatc

SEQ ID NO: 51313 - DNA, 26 bp, Artificial Sequence
  Description of Artificial Sequence: Synthetic oligonucleotide
cactgggaggcccaagagccaatcca

SEQ ID NO: 51314 - DNA, 27 bp, Artificial Sequence
  Description of Artificial Sequence: Synthetic oligonucleotide
actgggaggcccaagagccaatccaga

SEQ ID NO: 51315 - DNA, 27 bp, Artificial Sequence
  Description of Artificial Sequence: Synthetic oligonucleotide
ctgggaggcccaagagccaatccagat

SEQ ID NO: 51316 - DNA, 27 bp, Artificial Sequence
  Description of Artificial Sequence: Synthetic oligonucleotide
tgggaggcccaagagccaatccagatg

SEQ ID NO: 51317 - DNA, 26 bp, Artificial Sequence
  Description of Artificial Sequence: Synthetic oligonucleotide
gggaggcccaagagccaatccagatg

SEQ ID NO: 51318 - DNA, 26 bp, Artificial Sequence
  Description of Artificial Sequence: Synthetic oligonucleotide
ggaggcccaagagccaatccagatgc

SEQ ID NO: 51319 - DNA, 27 bp, Artificial Sequence
  Description of Artificial Sequence: Synthetic oligonucleotide
gaggcccaagagccaatccagatgcct

SEQ ID NO: 51320 - DNA, 27 bp, Artificial Sequence
  Description of Artificial Sequence: Synthetic oligonucleotide
aggcccaagagccaatccagatgcctg

SEQ ID NO: 51321 - DNA, 27 bp, Artificial Sequence
  Description of Artificial Sequence: Synthetic oligonucleotide
ggcccaagagccaatccagatgcctga

SEQ ID NO: 51322 - DNA, 27 bp, Artificial Sequence
  Description of Artificial Sequence: Synthetic oligonucleotide
gcccaagagccaatccagatgcctgag

SEQ ID NO: 51323 - DNA, 28 bp, Artificial Sequence
  Description of Artificial Sequence: Synthetic oligonucleotide
cccaagagccaatccagatgcctgagac

SEQ ID NO: 51324 - DNA, 30 bp, Artificial Sequence
  Description of Artificial Sequence: Synthetic oligonucleotide
ccaagagccaatccagatgcctgagacaac

SEQ ID NO: 51325 - DNA, 30 bp, Artificial Sequence
  Description of Artificial Sequence: Synthetic oligonucleotide
caagagccaatccagatgcctgagacaacg

SEQ ID NO: 51326 - DNA, 30 bp, Artificial Sequence
  Description of Artificial Sequence: Synthetic oligonucleotide
aagagccaatccagatgcctgagacaacgg

SEQ ID NO: 51327 - DNA, 29 bp, Artificial Sequence
  Description of Artificial Sequence: Synthetic oligonucleotide
agagccaatccagatgcctgagacaacgg

SEQ ID NO: 51328 - DNA, 28 bp, Artificial Sequence
  Description of Artificial Sequence: Synthetic oligonucleotide
gagccaatccagatgcctgagacaacgg

SEQ ID NO: 51329 - DNA, 29 bp, Artificial Sequence
  Description of Artificial Sequence: Synthetic oligonucleotide
agccaatccagatgcctgagacaacggag

SEQ ID NO: 51330 - DNA, 28 bp, Artificial Sequence
  Description of Artificial Sequence: Synthetic oligonucleotide
gccaatccagatgcctgagacaacggag

SEQ ID NO: 51331 - DNA, 29 bp, Artificial Sequence
  Description of Artificial Sequence: Synthetic oligonucleotide
ccaatccagatgcctgagacaacggagac

SEQ ID NO: 51332 - DNA, 30 bp, Artificial Sequence
  Description of Artificial Sequence: Synthetic oligonucleotide
caatccagatgcctgagacaacggagactg

SEQ ID NO: 51333 - DNA, 31 bp, Artificial Sequence
  Description of Artificial Sequence: Synthetic oligonucleotide
aatccagatgcctgagacaacggagactgtg

SEQ ID NO: 51334 - DNA, 30 bp, Artificial Sequence
  Description of Artificial Sequence: Synthetic oligonucleotide
atccagatgcctgagacaacggagactgtg

SEQ ID NO: 51335 - DNA, 29 bp, Artificial Sequence
  Description of Artificial Sequence: Synthetic oligonucleotide
tccagatgcctgagacaacggagactgtg

SEQ ID NO: 51336 - DNA, 28 bp, Artificial Sequence
  Description of Artificial Sequence: Synthetic oligonucleotide
ccagatgcctgagacaacggagactgtg

SEQ ID NO: 51337 - DNA, 28 bp, Artificial Sequence
  Description of Artificial Sequence: Synthetic oligonucleotide
cagatgcctgagacaacggagactgtgc

SEQ ID NO: 51338 - DNA, 29 bp, Artificial Sequence
  Description of Artificial Sequence: Synthetic oligonucleotide
agatgcctgagacaacggagactgtgctc

SEQ ID NO: 51339 - DNA, 28 bp, Artificial Sequence
  Description of Artificial Sequence: Synthetic oligonucleotide
gatgcctgagacaacggagactgtgctc

SEQ ID NO: 51340 - DNA, 29 bp, Artificial Sequence
  Description of Artificial Sequence: Synthetic oligonucleotide
atgcctgagacaacggagactgtgctctg

SEQ ID NO: 51341 - DNA, 28 bp, Artificial Sequence
  Description of Artificial Sequence: Synthetic oligonucleotide
tgcctgagacaacggagactgtgctctg

SEQ ID NO: 51342 - DNA, 27 bp, Artificial Sequence
  Description of Artificial Sequence: Synthetic oligonucleotide
gcctgagacaacggagactgtgctctg

SEQ ID NO: 51343 - DNA, 28 bp, Artificial Sequence
  Description of Artificial Sequence: Synthetic oligonucleotide
cctgagacaacggagactgtgctctgtg

SEQ ID NO: 51344 - DNA, 28 bp, Artificial Sequence
  Description of Artificial Sequence: Synthetic oligonucleotide
ctgagacaacggagactgtgctctgtgc

SEQ ID NO: 51345 - DNA, 28 bp, Artificial Sequence
  Description of Artificial Sequence: Synthetic oligonucleotide
tgagacaacggagactgtgctctgtgcc

SEQ ID NO: 51346 - DNA, 27 bp, Artificial Sequence
  Description of Artificial Sequence: Synthetic oligonucleotide
gagacaacggagactgtgctctgtgcc

SEQ ID NO: 51347 - DNA, 27 bp, Artificial Sequence
  Description of Artificial Sequence: Synthetic oligonucleotide
agacaacggagactgtgctctgtgccc

SEQ ID NO: 51348 - DNA, 27 bp, Artificial Sequence
  Description of Artificial Sequence: Synthetic oligonucleotide
gacaacggagactgtgctctgtgccct

SEQ ID NO: 51349 - DNA, 27 bp, Artificial Sequence
  Description of Artificial Sequence: Synthetic oligonucleotide
acaacggagactgtgctctgtgccctg

SEQ ID NO: 51350 - DNA, 26 bp, Artificial Sequence
  Description of Artificial Sequence: Synthetic oligonucleotide
caacggagactgtgctctgtgccctg

SEQ ID NO: 51351 - DNA, 26 bp, Artificial Sequence
  Description of Artificial Sequence: Synthetic oligonucleotide
aacggagactgtgctctgtgccctgg

SEQ ID NO: 51352 - DNA, 25 bp, Artificial Sequence
  Description of Artificial Sequence: Synthetic oligonucleotide
acggagactgtgctctgtgccctgg

SEQ ID NO: 51353 - DNA, 24 bp, Artificial Sequence
  Description of Artificial Sequence: Synthetic oligonucleotide
cggagactgtgctctgtgccctgg

SEQ ID NO: 51354 - DNA, 24 bp, Artificial Sequence
  Description of Artificial Sequence: Synthetic oligonucleotide
ggagactgtgctctgtgccctggg

SEQ ID NO: 51355 - DNA, 24 bp, Artificial Sequence
  Description of Artificial Sequence: Synthetic oligonucleotide
gagactgtgctctgtgccctgggc

SEQ ID NO: 51356 - DNA, 25 bp, Artificial Sequence
  Description of Artificial Sequence: Synthetic oligonucleotide
agactgtgctctgtgccctgggcct

SEQ ID NO: 51357 - DNA, 24 bp, Artificial Sequence
  Description of Artificial Sequence: Synthetic oligonucleotide
gactgtgctctgtgccctgggcct

SEQ ID NO: 51358 - DNA, 24 bp, Artificial Sequence
  Description of Artificial Sequence: Synthetic oligonucleotide
actgtgctctgtgccctgggcctg

SEQ ID NO: 51359 - DNA, 23 bp, Artificial Sequence
  Description of Artificial Sequence: Synthetic oligonucleotide
ctgtgctctgtgccctgggcctg

SEQ ID NO: 51360 - DNA, 24 bp, Artificial Sequence
  Description of Artificial Sequence: Synthetic oligonucleotide
tgtgctctgtgccctgggcctggt

SEQ ID NO: 51361 - DNA, 23 bp, Artificial Sequence
  Description of Artificial Sequence: Synthetic oligonucleotide
gtgctctgtgccctgggcctggt

SEQ ID NO: 51362 - DNA, 23 bp, Artificial Sequence
  Description of Artificial Sequence: Synthetic oligonucleotide
tgctctgtgccctgggcctggtg

SEQ ID NO: 51363 - DNA, 22 bp, Artificial Sequence
  Description of Artificial Sequence: Synthetic oligonucleotide
gctctgtgccctgggcctggtg

SEQ ID NO: 51364 - DNA, 23 bp, Artificial Sequence
  Description of Artificial Sequence: Synthetic oligonucleotide
ctctgtgccctgggcctggtgct

SEQ ID NO: 51365 - DNA, 23 bp, Artificial Sequence
  Description of Artificial Sequence: Synthetic oligonucleotide
tctgtgccctgggcctggtgctg

SEQ ID NO: 51366 - DNA, 22 bp, Artificial Sequence
  Description of Artificial Sequence: Synthetic oligonucleotide
ctgtgccctgggcctggtgctg

SEQ ID NO: 51367 - DNA, 22 bp, Artificial Sequence
  Description of Artificial Sequence: Synthetic oligonucleotide
tgtgccctgggcctggtgctgg

SEQ ID NO: 51368 - DNA, 21 bp, Artificial Sequence
  Description of Artificial Sequence: Synthetic oligonucleotide
gtgccctgggcctggtgctgg

SEQ ID NO: 51369 - DNA, 21 bp, Artificial Sequence
  Description of Artificial Sequence: Synthetic oligonucleotide
tgccctgggcctggtgctggg

SEQ ID NO: 51370 - DNA, 20 bp, Artificial Sequence
  Description of Artificial Sequence: Synthetic oligonucleotide
gccctgggcctggtgctggg

SEQ ID NO: 51371 - DNA, 20 bp, Artificial Sequence
  Description of Artificial Sequence: Synthetic oligonucleotide
ccctgggcctggtgctgggc

SEQ ID NO: 51372 - DNA, 22 bp, Artificial Sequence
  Description of Artificial Sequence: Synthetic oligonucleotide
cctgggcctggtgctgggccta

SEQ ID NO: 51373 - DNA, 23 bp, Artificial Sequence
  Description of Artificial Sequence: Synthetic oligonucleotide
ctgggcctggtgctgggcctagt

SEQ ID NO: 51374 - DNA, 23 bp, Artificial Sequence
  Description of Artificial Sequence: Synthetic oligonucleotide
tgggcctggtgctgggcctagtc

SEQ ID NO: 51375 - DNA, 22 bp, Artificial Sequence
  Description of Artificial Sequence: Synthetic oligonucleotide
gggcctggtgctgggcctagtc

SEQ ID NO: 51376 - DNA, 22 bp, Artificial Sequence
  Description of Artificial Sequence: Synthetic oligonucleotide
ggcctggtgctgggcctagtcg

SEQ ID NO: 51377 - DNA, 22 bp, Artificial Sequence
  Description of Artificial Sequence: Synthetic oligonucleotide
gcctggtgctgggcctagtcgg

SEQ ID NO: 51378 - DNA, 24 bp, Artificial Sequence
  Description of Artificial Sequence: Synthetic oligonucleotide
cctggtgctgggcctagtcggcat

SEQ ID NO: 51379 - DNA, 26 bp, Artificial Sequence
  Description of Artificial Sequence: Synthetic oligonucleotide
ctggtgctgggcctagtcggcatcat

SEQ ID NO: 51380 - DNA, 26 bp, Artificial Sequence
  Description of Artificial Sequence: Synthetic oligonucleotide
tggtgctgggcctagtcggcatcatc

SEQ ID NO: 51381 - DNA, 25 bp, Artificial Sequence
  Description of Artificial Sequence: Synthetic oligonucleotide
ggtgctgggcctagtcggcatcatc

SEQ ID NO: 51382 - DNA, 26 bp, Artificial Sequence
  Description of Artificial Sequence: Synthetic oligonucleotide
gtgctgggcctagtcggcatcatcgt

SEQ ID NO: 51383 - DNA, 26 bp, Artificial Sequence
  Description of Artificial Sequence: Synthetic oligonucleotide
tgctgggcctagtcggcatcatcgtg

SEQ ID NO: 51384 - DNA, 25 bp, Artificial Sequence
  Description of Artificial Sequence: Synthetic oligonucleotide
gctgggcctagtcggcatcatcgtg

SEQ ID NO: 51385 - DNA, 25 bp, Artificial Sequence
  Description of Artificial Sequence: Synthetic oligonucleotide
ctgggcctagtcggcatcatcgtgg

SEQ ID NO: 51386 - DNA, 25 bp, Artificial Sequence
  Description of Artificial Sequence: Synthetic oligonucleotide
tgggcctagtcggcatcatcgtggg

SEQ ID NO: 51387 - DNA, 24 bp, Artificial Sequence
  Description of Artificial Sequence: Synthetic oligonucleotide
gggcctagtcggcatcatcgtggg

SEQ ID NO: 51388 - DNA, 25 bp, Artificial Sequence
  Description of Artificial Sequence: Synthetic oligonucleotide
ggcctagtcggcatcatcgtgggca

SEQ ID NO: 51389 - DNA, 25 bp, Artificial Sequence
  Description of Artificial Sequence: Synthetic oligonucleotide
gcctagtcggcatcatcgtgggcac

SEQ ID NO: 51390 - DNA, 25 bp, Artificial Sequence
  Description of Artificial Sequence: Synthetic oligonucleotide
cctagtcggcatcatcgtgggcacc

SEQ ID NO: 51391 - DNA, 26 bp, Artificial Sequence
  Description of Artificial Sequence: Synthetic oligonucleotide
ctagtcggcatcatcgtgggcaccgt

SEQ ID NO: 51392 - DNA, 26 bp, Artificial Sequence
  Description of Artificial Sequence: Synthetic oligonucleotide
tagtcggcatcatcgtgggcaccgtc

SEQ ID NO: 51393 - DNA, 25 bp, Artificial Sequence
  Description of Artificial Sequence: Synthetic oligonucleotide
agtcggcatcatcgtgggcaccgtc

SEQ ID NO: 51394 - DNA, 24 bp, Artificial Sequence
  Description of Artificial Sequence: Synthetic oligonucleotide
gtcggcatcatcgtgggcaccgtc

SEQ ID NO: 51395 - DNA, 25 bp, Artificial Sequence
  Description of Artificial Sequence: Synthetic oligonucleotide
tcggcatcatcgtgggcaccgtcct

SEQ ID NO: 51396 - DNA, 24 bp, Artificial Sequence
  Description of Artificial Sequence: Synthetic oligonucleotide
cggcatcatcgtgggcaccgtcct

SEQ ID NO: 51397 - DNA, 26 bp, Artificial Sequence
  Description of Artificial Sequence: Synthetic oligonucleotide
ggcatcatcgtgggcaccgtcctcat

SEQ ID NO: 51398 - DNA, 27 bp, Artificial Sequence
  Description of Artificial Sequence: Synthetic oligonucleotide
gcatcatcgtgggcaccgtcctcatca

SEQ ID NO: 51399 - DNA, 31 bp, Artificial Sequence
  Description of Artificial Sequence: Synthetic oligonucleotide
catcatcgtgggcaccgtcctcatcataaag

SEQ ID NO: 51400 - DNA, 32 bp, Artificial Sequence
  Description of Artificial Sequence: Synthetic oligonucleotide
atcatcgtgggcaccgtcctcatcataaagtc

SEQ ID NO: 51401 - DNA, 31 bp, Artificial Sequence
  Description of Artificial Sequence: Synthetic oligonucleotide
tcatcgtgggcaccgtcctcatcataaagtc

SEQ ID NO: 51402 - DNA, 30 bp, Artificial Sequence
  Description of Artificial Sequence: Synthetic oligonucleotide
catcgtgggcaccgtcctcatcataaagtc

SEQ ID NO: 51403 - DNA, 31 bp, Artificial Sequence
  Description of Artificial Sequence: Synthetic oligonucleotide
atcgtgggcaccgtcctcatcataaagtctc

SEQ ID NO: 51404 - DNA, 30 bp, Artificial Sequence
  Description of Artificial Sequence: Synthetic oligonucleotide
tcgtgggcaccgtcctcatcataaagtctc

SEQ ID NO: 51405 - DNA, 29 bp, Artificial Sequence
  Description of Artificial Sequence: Synthetic oligonucleotide
cgtgggcaccgtcctcatcataaagtctc

SEQ ID NO: 51406 - DNA, 30 bp, Artificial Sequence
  Description of Artificial Sequence: Synthetic oligonucleotide
gtgggcaccgtcctcatcataaagtctctg

SEQ ID NO: 51407 - DNA, 30 bp, Artificial Sequence
  Description of Artificial Sequence: Synthetic oligonucleotide
tgggcaccgtcctcatcataaagtctctgc

SEQ ID NO: 51408 - DNA, 29 bp, Artificial Sequence
  Description of Artificial Sequence: Synthetic oligonucleotide
gggcaccgtcctcatcataaagtctctgc

SEQ ID NO: 51409 - DNA, 29 bp, Artificial Sequence
  Description of Artificial Sequence: Synthetic oligonucleotide
ggcaccgtcctcatcataaagtctctgcg

SEQ ID NO: 51410 - DNA, 31 bp, Artificial Sequence
  Description of Artificial Sequence: Synthetic oligonucleotide
gcaccgtcctcatcataaagtctctgcgttc

SEQ ID NO: 51411 - DNA, 32 bp, Artificial Sequence
  Description of Artificial Sequence: Synthetic oligonucleotide
caccgtcctcatcataaagtctctgcgttctg

SEQ ID NO: 51412 - DNA, 32 bp, Artificial Sequence
  Description of Artificial Sequence: Synthetic oligonucleotide
accgtcctcatcataaagtctctgcgttctgg

SEQ ID NO: 51413 - DNA, 31 bp, Artificial Sequence
  Description of Artificial Sequence: Synthetic oligonucleotide
ccgtcctcatcataaagtctctgcgttctgg

SEQ ID NO: 51414 - DNA, 31 bp, Artificial Sequence
  Description of Artificial Sequence: Synthetic oligonucleotide
cgtcctcatcataaagtctctgcgttctggc

SEQ ID NO: 51415 - DNA, 31 bp, Artificial Sequence
  Description of Artificial Sequence: Synthetic oligonucleotide
gtcctcatcataaagtctctgcgttctggcc

SEQ ID NO: 51416 - DNA, 33 bp, Artificial Sequence
  Description of Artificial Sequence: Synthetic oligonucleotide
tcctcatcataaagtctctgcgttctggccatg

SEQ ID NO: 51417 - DNA, 32 bp, Artificial Sequence
  Description of Artificial Sequence: Synthetic oligonucleotide
cctcatcataaagtctctgcgttctggccatg

SEQ ID NO: 51418 - DNA, 33 bp, Artificial Sequence
  Description of Artificial Sequence: Synthetic oligonucleotide
ctcatcataaagtctctgcgttctggccatgac

SEQ ID NO: 51419 - DNA, 33 bp, Artificial Sequence
  Description of Artificial Sequence: Synthetic oligonucleotide
tcatcataaagtctctgcgttctggccatgacc

SEQ ID NO: 51420 - DNA, 32 bp, Artificial Sequence
  Description of Artificial Sequence: Synthetic oligonucleotide
catcataaagtctctgcgttctggccatgacc

SEQ ID NO: 51421 - DNA, 32 bp, Artificial Sequence
  Description of Artificial Sequence: Synthetic oligonucleotide
atcataaagtctctgcgttctggccatgaccc

SEQ ID NO: 51422 - DNA, 31 bp, Artificial Sequence
  Description of Artificial Sequence: Synthetic oligonucleotide
tcataaagtctctgcgttctggccatgaccc

SEQ ID NO: 51423 - DNA, 30 bp, Artificial Sequence
  Description of Artificial Sequence: Synthetic oligonucleotide
cataaagtctctgcgttctggccatgaccc

SEQ ID NO: 51424 - DNA, 30 bp, Artificial Sequence
  Description of Artificial Sequence: Synthetic oligonucleotide
ataaagtctctgcgttctggccatgacccc

SEQ ID NO: 51425 - DNA, 29 bp, Artificial Sequence
  Description of Artificial Sequence: Synthetic oligonucleotide
taaagtctctgcgttctggccatgacccc

SEQ ID NO: 51426 - DNA, 28 bp, Artificial Sequence
  Description of Artificial Sequence: Synthetic oligonucleotide
aaagtctctgcgttctggccatgacccc

SEQ ID NO: 51427 - DNA, 27 bp, Artificial Sequence
  Description of Artificial Sequence: Synthetic oligonucleotide
aagtctctgcgttctggccatgacccc

SEQ ID NO: 51428 - DNA, 26 bp, Artificial Sequence
  Description of Artificial Sequence: Synthetic oligonucleotide
agtctctgcgttctggccatgacccc

SEQ ID NO: 51429 - DNA, 25 bp, Artificial Sequence
  Description of Artificial Sequence: Synthetic oligonucleotide
gtctctgcgttctggccatgacccc

SEQ ID NO: 51430 - DNA, 25 bp, Artificial Sequence
  Description of Artificial Sequence: Synthetic oligonucleotide
tctctgcgttctggccatgaccccc

SEQ ID NO: 51431 - DNA, 24 bp, Artificial Sequence
  Description of Artificial Sequence: Synthetic oligonucleotide
ctctgcgttctggccatgaccccc

SEQ ID NO: 51432 - DNA, 24 bp, Artificial Sequence
  Description of Artificial Sequence: Synthetic oligonucleotide
tctgcgttctggccatgacccccg

SEQ ID NO: 51433 - DNA, 23 bp, Artificial Sequence
  Description of Artificial Sequence: Synthetic oligonucleotide
ctgcgttctggccatgacccccg

SEQ ID NO: 51434 - DNA, 23 bp, Artificial Sequence
  Description of Artificial Sequence: Synthetic oligonucleotide
tgcgttctggccatgacccccgg

SEQ ID NO: 51435 - DNA, 22 bp, Artificial Sequence
  Description of Artificial Sequence: Synthetic oligonucleotide
gcgttctggccatgacccccgg

SEQ ID NO: 51436 - DNA, 22 bp, Artificial Sequence
  Description of Artificial Sequence: Synthetic oligonucleotide
cgttctggccatgacccccggg

SEQ ID NO: 51437 - DNA, 22 bp, Artificial Sequence
  Description of Artificial Sequence: Synthetic oligonucleotide
gttctggccatgacccccgggc

SEQ ID NO: 51438 - DNA, 22 bp, Artificial Sequence
  Description of Artificial Sequence: Synthetic oligonucleotide
ttctggccatgacccccgggcc

SEQ ID NO: 51439 - DNA, 21 bp, Artificial Sequence
  Description of Artificial Sequence: Synthetic oligonucleotide
tctggccatgacccccgggcc

SEQ ID NO: 51440 - DNA, 20 bp, Artificial Sequence
  Description of Artificial Sequence: Synthetic oligonucleotide
ctggccatgacccccgggcc

SEQ ID NO: 51441 - DNA, 21 bp, Artificial Sequence
  Description of Artificial Sequence: Synthetic oligonucleotide
tggccatgacccccgggccca

SEQ ID NO: 51442 - DNA, 20 bp, Artificial Sequence
  Description of Artificial Sequence: Synthetic oligonucleotide
ggccatgacccccgggccca

SEQ ID NO: 51443 - DNA, 20 bp, Artificial Sequence
  Description of Artificial Sequence: Synthetic oligonucleotide
gccatgacccccgggcccag

SEQ ID NO: 51444 - DNA, 20 bp, Artificial Sequence
  Description of Artificial Sequence: Synthetic oligonucleotide
ccatgacccccgggcccagg

SEQ ID NO: 51445 - DNA, 20 bp, Artificial Sequence
  Description of Artificial Sequence: Synthetic oligonucleotide
catgacccccgggcccaggg

SEQ ID NO: 51446 - DNA, 21 bp, Artificial Sequence
  Description of Artificial Sequence: Synthetic oligonucleotide
atgacccccgggcccagggga

SEQ ID NO: 51447 - DNA, 20 bp, Artificial Sequence
  Description of Artificial Sequence: Synthetic oligonucleotide
tgacccccgggcccagggga

SEQ ID NO: 51448 - DNA, 20 bp, Artificial Sequence
  Description of Artificial Sequence: Synthetic oligonucleotide
gacccccgggcccaggggat

SEQ ID NO: 51449 - DNA, 20 bp, Artificial Sequence
  Description of Artificial Sequence: Synthetic oligonucleotide
acccccgggcccaggggact

SEQ ID NO: 51450 - DNA, 20 bp, Artificial Sequence
  Description of Artificial Sequence: Synthetic oligonucleotide
cccccgggcccaggggactt

SEQ ID NO: 51451 - DNA, 20 bp, Artificial Sequence
  Description of Artificial Sequence: Synthetic oligonucleotide
ccccgggcccaggggacctt

SEQ ID NO: 51452 - DNA, 20 bp, Artificial Sequence
  Description of Artificial Sequence: Synthetic oligonucleotide
cccgggcccaggggaccctt

SEQ ID NO: 51453 - DNA, 20 bp, Artificial Sequence
  Description of Artificial Sequence: Synthetic oligonucleotide
ccgggcccaggggaccctgt

SEQ ID NO: 51454 - DNA, 21 bp, Artificial Sequence
  Description of Artificial Sequence: Synthetic oligonucleotide
cgggcccaggggaccctgtga

SEQ ID NO: 51455 - DNA, 31 bp, Artificial Sequence
  Description of Artificial Sequence: Synthetic oligonucleotide
gcgtttgtacagacgcatagaccaacaggag

SEQ ID NO: 51456 - DNA, 32 bp, Artificial Sequence
  Description of Artificial Sequence: Synthetic oligonucleotide
cgtttgtacagacgcatagaccaacaggagag

SEQ ID NO: 51457 - DNA, 37 bp, Artificial Sequence
  Description of Artificial Sequence: Synthetic oligonucleotide
gtttgtacagacgcatagaccaacaggagagtttatg

SEQ ID NO: 51458 - DNA, 40 bp, Artificial Sequence
  Description of Artificial Sequence: Synthetic oligonucleotide
tttgtacagacgcatagaccaacaggagagtttatgtttg

SEQ ID NO: 51459 - DNA, 39 bp, Artificial Sequence
  Description of Artificial Sequence: Synthetic oligonucleotide
ttgtacagacgcatagaccaacaggagagtttatgtttg

SEQ ID NO: 51460 - DNA, 38 bp, Artificial Sequence
  Description of Artificial Sequence: Synthetic oligonucleotide
tgtacagacgcatagaccaacaggagagtttatgtttg

SEQ ID NO: 51461 - DNA, 37 bp, Artificial Sequence
  Description of Artificial Sequence: Synthetic oligonucleotide
gtacagacgcatagaccaacaggagagtttatgtttg

SEQ ID NO: 51462 - DNA, 42 bp, Artificial Sequence
  Description of Artificial Sequence: Synthetic oligonucleotide
tacagacgcatagaccaacaggagagtttatgtttgaatttg

SEQ ID NO: 51463 - DNA, 41 bp, Artificial Sequence
  Description of Artificial Sequence: Synthetic oligonucleotide
acagacgcatagaccaacaggagagtttatgtttgaatttg

SEQ ID NO: 51464 - DNA, 40 bp, Artificial Sequence
  Description of Artificial Sequence: Synthetic oligonucleotide
cagacgcatagaccaacaggagagtttatgtttgaatttg

SEQ ID NO: 51465 - DNA, 42 bp, Artificial Sequence
  Description of Artificial Sequence: Synthetic oligonucleotide
agacgcatagaccaacaggagagtttatgtttgaatttgatg

SEQ ID NO: 51466 - DNA, 41 bp, Artificial Sequence
  Description of Artificial Sequence: Synthetic oligonucleotide
gacgcatagaccaacaggagagtttatgtttgaatttgatg

SEQ ID NO: 51467 - DNA, 43 bp, Artificial Sequence
  Description of Artificial Sequence: Synthetic oligonucleotide
acgcatagaccaacaggagagtttatgtttgaatttgatgaag

SEQ ID NO: 51468 - DNA, 42 bp, Artificial Sequence
  Description of Artificial Sequence: Synthetic oligonucleotide
cgcatagaccaacaggagagtttatgtttgaatttgatgaag

SEQ ID NO: 51469 - DNA, 44 bp, Artificial Sequence
  Description of Artificial Sequence: Synthetic oligonucleotide
gcatagaccaacaggagagtttatgtttgaatttgatgaagatg

SEQ ID NO: 51470 - DNA, 45 bp, Artificial Sequence
  Description of Artificial Sequence: Synthetic oligonucleotide
catagaccaacaggagagtttatgtttgaatttgatgaagatgag

SEQ ID NO: 51471 - DNA, 47 bp, Artificial Sequence
  Description of Artificial Sequence: Synthetic oligonucleotide
atagaccaacaggagagtttatgtttgaatttgatgaagatgagatg

SEQ ID NO: 51472 - DNA, 46 bp, Artificial Sequence
  Description of Artificial Sequence: Synthetic oligonucleotide
tagaccaacaggagagtttatgtttgaatttgatgaagatgagatg

SEQ ID NO: 51473 - DNA, 45 bp, Artificial Sequence
  Description of Artificial Sequence: Synthetic oligonucleotide
agaccaacaggagagtttatgtttgaatttgatgaagatgagatg

SEQ ID NO: 51474 - DNA, 44 bp, Artificial Sequence
  Description of Artificial Sequence: Synthetic oligonucleotide
gaccaacaggagagtttatgtttgaatttgatgaagatgagatg

SEQ ID NO: 51475 - DNA, 46 bp, Artificial Sequence
  Description of Artificial Sequence: Synthetic oligonucleotide
accaacaggagagtttatgtttgaatttgatgaagatgagatgttc

SEQ ID NO: 51476 - DNA, 45 bp, Artificial Sequence
  Description of Artificial Sequence: Synthetic oligonucleotide
ccaacaggagagtttatgtttgaatttgatgaagatgagatgttc

SEQ ID NO: 51477 - DNA, 48 bp, Artificial Sequence
  Description of Artificial Sequence: Synthetic oligonucleotide
caacaggagagtttatgtttgaatttgatgaagatgagatgttctatg

SEQ ID NO: 51478 - DNA, 49 bp, Artificial Sequence
  Description of Artificial Sequence: Synthetic oligonucleotide
aacaggagagtttatgtttgaatttgatgaagatgagatgttctatgtg

SEQ ID NO: 51479 - DNA, 48 bp, Artificial Sequence
  Description of Artificial Sequence: Synthetic oligonucleotide
acaggagagtttatgtttgaatttgatgaagatgagatgttctatgtg

SEQ ID NO: 51480 - DNA, 47 bp, Artificial Sequence
  Description of Artificial Sequence: Synthetic oligonucleotide
caggagagtttatgtttgaatttgatgaagatgagatgttctatgtg

SEQ ID NO: 51481 - DNA, 47 bp, Artificial Sequence
  Description of Artificial Sequence: Synthetic oligonucleotide
aggagagtttatgtttgaatttgatgaagatgagatgttctatgtgg

SEQ ID NO: 51482 - DNA, 46 bp, Artificial Sequence
  Description of Artificial Sequence: Synthetic oligonucleotide
ggagagtttatgtttgaatttgatgaagatgagatgttctatgtgg

SEQ ID NO: 51483 - DNA, 48 bp, Artificial Sequence
  Description of Artificial Sequence: Synthetic oligonucleotide
gagagtttatgtttgaatttgatgaagatgagatgttctatgtggatc

SEQ ID NO: 51484 - DNA, 49 bp, Artificial Sequence
  Description of Artificial Sequence: Synthetic oligonucleotide
agagtttatgtttgaatttgatgaagatgagatgttctatgtggatctg

SEQ ID NO: 51485 - DNA, 33 bp, Artificial Sequence
  Description of Artificial Sequence: Synthetic oligonucleotide
catgtgtcaacttatgccgcgtttgtacagacc

SEQ ID NO: 51486 - DNA, 33 bp, Artificial Sequence
  Description of Artificial Sequence: Synthetic oligonucleotide
atgtgtcaacttatgccgcgtttgtacagaccc

SEQ ID NO: 51487 - DNA, 32 bp, Artificial Sequence
  Description of Artificial Sequence: Synthetic oligonucleotide
tgtgtcaacttatgccgcgtttgtacagaccc

SEQ ID NO: 51488 - DNA, 31 bp, Artificial Sequence
  Description of Artificial Sequence: Synthetic oligonucleotide
gtgtcaacttatgccgcgtttgtacagaccc

SEQ ID NO: 51489 - DNA, 34 bp, Artificial Sequence
  Description of Artificial Sequence: Synthetic oligonucleotide
tgtcaacttatgccgcgtttgtacagacccatag

SEQ ID NO: 51490 - DNA, 33 bp, Artificial Sequence
  Description of Artificial Sequence: Synthetic oligonucleotide
gtcaacttatgccgcgtttgtacagacccatag

SEQ ID NO: 51491 - DNA, 34 bp, Artificial Sequence
  Description of Artificial Sequence: Synthetic oligonucleotide
tcaacttatgccgcgtttgtacagacccatagac

SEQ ID NO: 51492 - DNA, 33 bp, Artificial Sequence
  Description of Artificial Sequence: Synthetic oligonucleotide
caacttatgccgcgtttgtacagacccatagac

SEQ ID NO: 51493 - DNA, 33 bp, Artificial Sequence
  Description of Artificial Sequence: Synthetic oligonucleotide
aacttatgccgcgtttgtacagacccatagacc

SEQ ID NO: 51494 - DNA, 32 bp, Artificial Sequence
  Description of Artificial Sequence: Synthetic oligonucleotide
acttatgccgcgtttgtacagacccatagacc

SEQ ID NO: 51495 - DNA, 31 bp, Artificial Sequence
  Description of Artificial Sequence: Synthetic oligonucleotide
cttatgccgcgtttgtacagacccatagacc

SEQ ID NO: 51496 - DNA, 33 bp, Artificial Sequence
  Description of Artificial Sequence: Synthetic oligonucleotide
ttatgccgcgtttgtacagacccatagaccaac

SEQ ID NO: 51497 - DNA, 32 bp, Artificial Sequence
  Description of Artificial Sequence: Synthetic oligonucleotide
tatgccgcgtttgtacagacccatagaccaac

SEQ ID NO: 51498 - DNA, 31 bp, Artificial Sequence
  Description of Artificial Sequence: Synthetic oligonucleotide
atgccgcgtttgtacagacccatagaccaac

SEQ ID NO: 51499 - DNA, 30 bp, Artificial Sequence
  Description of Artificial Sequence: Synthetic oligonucleotide
tgccgcgtttgtacagacccatagaccaac

SEQ ID NO: 51500 - DNA, 29 bp, Artificial Sequence
  Description of Artificial Sequence: Synthetic oligonucleotide
gccgcgtttgtacagacccatagaccaac

SEQ ID NO: 51501 - DNA, 30 bp, Artificial Sequence
  Description of Artificial Sequence: Synthetic oligonucleotide
ccgcgtttgtacagacccatagaccaacag

SEQ ID NO: 51502 - DNA, 30 bp, Artificial Sequence
  Description of Artificial Sequence: Synthetic oligonucleotide
cgcgtttgtacagacccatagaccaacagg

SEQ ID NO: 51503 - DNA, 30 bp, Artificial Sequence
  Description of Artificial Sequence: Synthetic oligonucleotide
gcgtttgtacagacccatagaccaacaggg

SEQ ID NO: 51504 - DNA, 30 bp, Artificial Sequence
  Description of Artificial Sequence: Synthetic oligonucleotide
cgtttgtacagacccatagaccaacagggg

SEQ ID NO: 51505 - DNA, 31 bp, Artificial Sequence
  Description of Artificial Sequence: Synthetic oligonucleotide
gtttgtacagacccatagaccaacaggggag

SEQ ID NO: 51506 - DNA, 36 bp, Artificial Sequence
  Description of Artificial Sequence: Synthetic oligonucleotide
tttgtacagacccatagaccaacaggggagtttatg

SEQ ID NO: 51507 - DNA, 35 bp, Artificial Sequence
  Description of Artificial Sequence: Synthetic oligonucleotide
ttgtacagacccatagaccaacaggggagtttatg

SEQ ID NO: 51508 - DNA, 34 bp, Artificial Sequence
  Description of Artificial Sequence: Synthetic oligonucleotide
tgtacagacccatagaccaacaggggagtttatg

SEQ ID NO: 51509 - DNA, 33 bp, Artificial Sequence
  Description of Artificial Sequence: Synthetic oligonucleotide
gtacagacccatagaccaacaggggagtttatg

SEQ ID NO: 51510 - DNA, 36 bp, Artificial Sequence
  Description of Artificial Sequence: Synthetic oligonucleotide
tacagacccatagaccaacaggggagtttatgtttg

SEQ ID NO: 51511 - DNA, 35 bp, Artificial Sequence
  Description of Artificial Sequence: Synthetic oligonucleotide
acagacccatagaccaacaggggagtttatgtttg

SEQ ID NO: 51512 - DNA, 34 bp, Artificial Sequence
  Description of Artificial Sequence: Synthetic oligonucleotide
cagacccatagaccaacaggggagtttatgtttg

SEQ ID NO: 51513 - DNA, 39 bp, Artificial Sequence
  Description of Artificial Sequence: Synthetic oligonucleotide
agacccatagaccaacaggggagtttatgtttgaatttg

SEQ ID NO: 51514 - DNA, 38 bp, Artificial Sequence
  Description of Artificial Sequence: Synthetic oligonucleotide
gacccatagaccaacaggggagtttatgtttgaatttg

SEQ ID NO: 51515 - DNA, 40 bp, Artificial Sequence
  Description of Artificial Sequence: Synthetic oligonucleotide
acccatagaccaacaggggagtttatgtttgaatttgatg

SEQ ID NO: 51516 - DNA, 39 bp, Artificial Sequence
  Description of Artificial Sequence: Synthetic oligonucleotide
cccatagaccaacaggggagtttatgtttgaatttgatg

SEQ ID NO: 51517 - DNA, 41 bp, Artificial Sequence
  Description of Artificial Sequence: Synthetic oligonucleotide
ccatagaccaacaggggagtttatgtttgaatttgatgaag

SEQ ID NO: 51518 - DNA, 29 bp, Artificial Sequence
  Description of Artificial Sequence: Synthetic oligonucleotide
ccaagccttttcctttgaggctcagggtg

SEQ ID NO: 51519 - DNA, 29 bp, Artificial Sequence
  Description of Artificial Sequence: Synthetic oligonucleotide
caagccttttcctttgaggctcagggtgg

SEQ ID NO: 51520 - DNA, 29 bp, Artificial Sequence
  Description of Artificial Sequence: Synthetic oligonucleotide
aagccttttcctttgaggctcagggtggg

SEQ ID NO: 51521 - DNA, 28 bp, Artificial Sequence
  Description of Artificial Sequence: Synthetic oligonucleotide
agccttttcctttgaggctcagggtggg

SEQ ID NO: 51522 - DNA, 27 bp, Artificial Sequence
  Description of Artificial Sequence: Synthetic oligonucleotide
gccttttcctttgaggctcagggtggg

SEQ ID NO: 51523 - DNA, 27 bp, Artificial Sequence
  Description of Artificial Sequence: Synthetic oligonucleotide
ccttttcctttgaggctcagggtgggc

SEQ ID NO: 51524 - DNA, 28 bp, Artificial Sequence
  Description of Artificial Sequence: Synthetic oligonucleotide
cttttcctttgaggctcagggtgggctg

SEQ ID NO: 51525 - DNA, 28 bp, Artificial Sequence
  Description of Artificial Sequence: Synthetic oligonucleotide
ttttcctttgaggctcagggtgggctgg

SEQ ID NO: 51526 - DNA, 27 bp, Artificial Sequence
  Description of Artificial Sequence: Synthetic oligonucleotide
tttcctttgaggctcagggtgggctgg

SEQ ID NO: 51527 - DNA, 26 bp, Artificial Sequence
  Description of Artificial Sequence: Synthetic oligonucleotide
ttcctttgaggctcagggtgggctgg

SEQ ID NO: 51528 - DNA, 25 bp, Artificial Sequence
  Description of Artificial Sequence: Synthetic oligonucleotide
tcctttgaggctcagggtgggctgg

SEQ ID NO: 51529 - DNA, 24 bp, Artificial Sequence
  Description of Artificial Sequence: Synthetic oligonucleotide
cctttgaggctcagggtgggctgg

SEQ ID NO: 51530 - DNA, 27 bp, Artificial Sequence
  Description of Artificial Sequence: Synthetic oligonucleotide
ctttgaggctcagggtgggctggctaa

SEQ ID NO: 51531 - DNA, 27 bp, Artificial Sequence
  Description of Artificial Sequence: Synthetic oligonucleotide
tttgaggctcagggtgggctggctaac

SEQ ID NO: 51532 - DNA, 27 bp, Artificial Sequence
  Description of Artificial Sequence: Synthetic oligonucleotide
ttgaggctcagggtgggctggctaaca

SEQ ID NO: 51533 - DNA, 27 bp, Artificial Sequence
  Description of Artificial Sequence: Synthetic oligonucleotide
tgaggctcagggtgggctggctaacat

SEQ ID NO: 51534 - DNA, 27 bp, Artificial Sequence
  Description of Artificial Sequence: Synthetic oligonucleotide
gaggctcagggtgggctggctaacatt

SEQ ID NO: 51535 - DNA, 27 bp, Artificial Sequence
  Description of Artificial Sequence: Synthetic oligonucleotide
aggctcagggtgggctggctaacattg

SEQ ID NO: 51536 - DNA, 26 bp, Artificial Sequence
  Description of Artificial Sequence: Synthetic oligonucleotide
ggctcagggtgggctggctaacattg

SEQ ID NO: 51537 - DNA, 27 bp, Artificial Sequence
  Description of Artificial Sequence: Synthetic oligonucleotide
gctcagggtgggctggctaacattgct

SEQ ID NO: 51538 - DNA, 32 bp, Artificial Sequence
  Description of Artificial Sequence: Synthetic oligonucleotide
ctcagggtgggctggctaacattgctatattg

SEQ ID NO: 51539 - DNA, 34 bp, Artificial Sequence
  Description of Artificial Sequence: Synthetic oligonucleotide
tcagggtgggctggctaacattgctatattgaac

SEQ ID NO: 51540 - DNA, 33 bp, Artificial Sequence
  Description of Artificial Sequence: Synthetic oligonucleotide
cagggtgggctggctaacattgctatattgaac

SEQ ID NO: 51541 - DNA, 35 bp, Artificial Sequence
  Description of Artificial Sequence: Synthetic oligonucleotide
agggtgggctggctaacattgctatattgaacaac

SEQ ID NO: 51542 - DNA, 34 bp, Artificial Sequence
  Description of Artificial Sequence: Synthetic oligonucleotide
gggtgggctggctaacattgctatattgaacaac

SEQ ID NO: 51543 - DNA, 36 bp, Artificial Sequence
  Description of Artificial Sequence: Synthetic oligonucleotide
ggtgggctggctaacattgctatattgaacaacaac

SEQ ID NO: 51544 - DNA, 38 bp, Artificial Sequence
  Description of Artificial Sequence: Synthetic oligonucleotide
gtgggctggctaacattgctatattgaacaacaacttg

SEQ ID NO: 51545 - DNA, 42 bp, Artificial Sequence
  Description of Artificial Sequence: Synthetic oligonucleotide
tgggctggctaacattgctatattgaacaacaacttgaatac

SEQ ID NO: 51546 - DNA, 40 bp, Artificial Sequence
  Description of Artificial Sequence: Synthetic oligonucleotide
gcatagaccaacaggggagtttatgtttgaatttgatgac

SEQ ID NO: 51547 - DNA, 40 bp, Artificial Sequence
  Description of Artificial Sequence: Synthetic oligonucleotide
catagaccaacaggggagtttatgtttgaatttgatgacg

SEQ ID NO: 51548 - DNA, 42 bp, Artificial Sequence
  Description of Artificial Sequence: Synthetic oligonucleotide
atagaccaacaggggagtttatgtttgaatttgatgacgatg

SEQ ID NO: 51549 - DNA, 41 bp, Artificial Sequence
  Description of Artificial Sequence: Synthetic oligonucleotide
tagaccaacaggggagtttatgtttgaatttgatgacgatg

SEQ ID NO: 51550 - DNA, 40 bp, Artificial Sequence
  Description of Artificial Sequence: Synthetic oligonucleotide
agaccaacaggggagtttatgtttgaatttgatgacgatg

SEQ ID NO: 51551 - DNA, 39 bp, Artificial Sequence
  Description of Artificial Sequence: Synthetic oligonucleotide
gaccaacaggggagtttatgtttgaatttgatgacgatg

SEQ ID NO: 51552 - DNA, 40 bp, Artificial Sequence
  Description of Artificial Sequence: Synthetic oligonucleotide
accaacaggggagtttatgtttgaatttgatgacgatgag

SEQ ID NO: 51553 - DNA, 39 bp, Artificial Sequence
  Description of Artificial Sequence: Synthetic oligonucleotide
ccaacaggggagtttatgtttgaatttgatgacgatgag

SEQ ID NO: 51554 - DNA, 41 bp, Artificial Sequence
  Description of Artificial Sequence: Synthetic oligonucleotide
caacaggggagtttatgtttgaatttgatgacgatgagatg

SEQ ID NO: 51555 - DNA, 43 bp, Artificial Sequence
  Description of Artificial Sequence: Synthetic oligonucleotide
aacaggggagtttatgtttgaatttgatgacgatgagatgttc

SEQ ID NO: 51556 - DNA, 42 bp, Artificial Sequence
  Description of Artificial Sequence: Synthetic oligonucleotide
acaggggagtttatgtttgaatttgatgacgatgagatgttc

SEQ ID NO: 51557 - DNA, 41 bp, Artificial Sequence
  Description of Artificial Sequence: Synthetic oligonucleotide
caggggagtttatgtttgaatttgatgacgatgagatgttc

SEQ ID NO: 51558 - DNA, 44 bp, Artificial Sequence
  Description of Artificial Sequence: Synthetic oligonucleotide
aggggagtttatgtttgaatttgatgacgatgagatgttctatg

SEQ ID NO: 51559 - DNA, 43 bp, Artificial Sequence
  Description of Artificial Sequence: Synthetic oligonucleotide
ggggagtttatgtttgaatttgatgacgatgagatgttctatg

SEQ ID NO: 51560 - DNA, 44 bp, Artificial Sequence
  Description of Artificial Sequence: Synthetic oligonucleotide
gggagtttatgtttgaatttgatgacgatgagatgttctatgtg

SEQ ID NO: 51561 - DNA, 44 bp, Artificial Sequence
  Description of Artificial Sequence: Synthetic oligonucleotide
ggagtttatgtttgaatttgatgacgatgagatgttctatgtgg

SEQ ID NO: 51562 - DNA, 46 bp, Artificial Sequence
  Description of Artificial Sequence: Synthetic oligonucleotide
gagtttatgtttgaatttgatgacgatgagatgttctatgtggatc

SEQ ID NO: 51563 - DNA, 47 bp, Artificial Sequence
  Description of Artificial Sequence: Synthetic oligonucleotide
agtttatgtttgaatttgatgacgatgagatgttctatgtggatctg

SEQ ID NO: 51564 - DNA, 46 bp, Artificial Sequence
  Description of Artificial Sequence: Synthetic oligonucleotide
gtttatgtttgaatttgatgacgatgagatgttctatgtggatctg

SEQ ID NO: 51565 - DNA, 46 bp, Artificial Sequence
  Description of Artificial Sequence: Synthetic oligonucleotide
tttatgtttgaatttgatgacgatgagatgttctatgtggatctgg

SEQ ID NO: 51566 - DNA, 45 bp, Artificial Sequence
  Description of Artificial Sequence: Synthetic oligonucleotide
ttatgtttgaatttgatgacgatgagatgttctatgtggatctgg

SEQ ID NO: 51567 - DNA, 44 bp, Artificial Sequence
  Description of Artificial Sequence: Synthetic oligonucleotide
tatgtttgaatttgatgacgatgagatgttctatgtggatctgg

SEQ ID NO: 51568 - DNA, 43 bp, Artificial Sequence
  Description of Artificial Sequence: Synthetic oligonucleotide
atgtttgaatttgatgacgatgagatgttctatgtggatctgg

SEQ ID NO: 51569 - DNA, 42 bp, Artificial Sequence
  Description of Artificial Sequence: Synthetic oligonucleotide
tgtttgaatttgatgacgatgagatgttctatgtggatctgg

SEQ ID NO: 51570 - DNA, 41 bp, Artificial Sequence
  Description of Artificial Sequence: Synthetic oligonucleotide
gtttgaatttgatgacgatgagatgttctatgtggatctgg

SEQ ID NO: 51571 - DNA, 42 bp, Artificial Sequence
  Description of Artificial Sequence: Synthetic oligonucleotide
tttgaatttgatgacgatgagatgttctatgtggatctggac

SEQ ID NO: 51572 - DNA, 41 bp, Artificial Sequence
  Description of Artificial Sequence: Synthetic oligonucleotide
ttgaatttgatgacgatgagatgttctatgtggatctggac

SEQ ID NO: 51573 - DNA, 40 bp, Artificial Sequence
  Description of Artificial Sequence: Synthetic oligonucleotide
tgaatttgatgacgatgagatgttctatgtggatctggac

SEQ ID NO: 51574 - DNA, 39 bp, Artificial Sequence
  Description of Artificial Sequence: Synthetic oligonucleotide
gaatttgatgacgatgagatgttctatgtggatctggac

SEQ ID NO: 51575 - DNA, 41 bp, Artificial Sequence
  Description of Artificial Sequence: Synthetic oligonucleotide
aatttgatgacgatgagatgttctatgtggatctggacaag

SEQ ID NO: 51576 - DNA, 40 bp, Artificial Sequence
  Description of Artificial Sequence: Synthetic oligonucleotide
atttgatgacgatgagatgttctatgtggatctggacaag

SEQ ID NO: 51577 - DNA, 39 bp, Artificial Sequence
  Description of Artificial Sequence: Synthetic oligonucleotide
tttgatgacgatgagatgttctatgtggatctggacaag

SEQ ID NO: 51578 - DNA, 38 bp, Artificial Sequence
  Description of Artificial Sequence: Synthetic oligonucleotide
ttgatgacgatgagatgttctatgtggatctggacaag

SEQ ID NO: 51579 - DNA, 37 bp, Artificial Sequence
  Description of Artificial Sequence: Synthetic oligonucleotide
tgatgacgatgagatgttctatgtggatctggacaag

SEQ ID NO: 51580 - DNA, 36 bp, Artificial Sequence
  Description of Artificial Sequence: Synthetic oligonucleotide
gatgacgatgagatgttctatgtggatctggacaag

SEQ ID NO: 51581 - DNA, 38 bp, Artificial Sequence
  Description of Artificial Sequence: Synthetic oligonucleotide
atgacgatgagatgttctatgtggatctggacaagaag

SEQ ID NO: 51582 - DNA, 37 bp, Artificial Sequence
  Description of Artificial Sequence: Synthetic oligonucleotide
tgacgatgagatgttctatgtggatctggacaagaag

SEQ ID NO: 51583 - DNA, 36 bp, Artificial Sequence
  Description of Artificial Sequence: Synthetic oligonucleotide
gacgatgagatgttctatgtggatctggacaagaag

SEQ ID NO: 51584 - DNA, 36 bp, Artificial Sequence
  Description of Artificial Sequence: Synthetic oligonucleotide
acgatgagatgttctatgtggatctggacaagaagg

SEQ ID NO: 51585 - DNA, 35 bp, Artificial Sequence
  Description of Artificial Sequence: Synthetic oligonucleotide
cgatgagatgttctatgtggatctggacaagaagg

SEQ ID NO: 51586 - DNA, 26 bp, Artificial Sequence
  Description of Artificial Sequence: Synthetic oligonucleotide
tccagcgttccaaccacactcaggcc

SEQ ID NO: 51587 - DNA, 25 bp, Artificial Sequence
  Description of Artificial Sequence: Synthetic oligonucleotide
ccagcgttccaaccacactcaggcc

SEQ ID NO: 51588 - DNA, 25 bp, Artificial Sequence
  Description of Artificial Sequence: Synthetic oligonucleotide
cagcgttccaaccacactcaggccg

SEQ ID NO: 51589 - DNA, 25 bp, Artificial Sequence
  Description of Artificial Sequence: Synthetic oligonucleotide
agcgttccaaccacactcaggccgc

SEQ ID NO: 51590 - DNA, 24 bp, Artificial Sequence
  Description of Artificial Sequence: Synthetic oligonucleotide
gcgttccaaccacactcaggccgc

SEQ ID NO: 51591 - DNA, 27 bp, Artificial Sequence
  Description of Artificial Sequence: Synthetic oligonucleotide
cgttccaaccacactcaggccgccaat

SEQ ID NO: 51592 - DNA, 41 bp, Artificial Sequence
  Description of Artificial Sequence: Synthetic oligonucleotide
accaacaggggagtttatgtttgaatttgatgaagatgagc

SEQ ID NO: 51593 - DNA, 40 bp, Artificial Sequence
  Description of Artificial Sequence: Synthetic oligonucleotide
ccaacaggggagtttatgtttgaatttgatgaagatgagc

SEQ ID NO: 51594 - DNA, 41 bp, Artificial Sequence
  Description of Artificial Sequence: Synthetic oligonucleotide
caacaggggagtttatgtttgaatttgatgaagatgagcag

SEQ ID NO: 51595 - DNA, 43 bp, Artificial Sequence
  Description of Artificial Sequence: Synthetic oligonucleotide
aacaggggagtttatgtttgaatttgatgaagatgagcagttc

SEQ ID NO: 51596 - DNA, 42 bp, Artificial Sequence
  Description of Artificial Sequence: Synthetic oligonucleotide
acaggggagtttatgtttgaatttgatgaagatgagcagttc

SEQ ID NO: 51597 - DNA, 41 bp, Artificial Sequence
  Description of Artificial Sequence: Synthetic oligonucleotide
caggggagtttatgtttgaatttgatgaagatgagcagttc

SEQ ID NO: 51598 - DNA, 44 bp, Artificial Sequence
  Description of Artificial Sequence: Synthetic oligonucleotide
aggggagtttatgtttgaatttgatgaagatgagcagttctatg

SEQ ID NO: 51599 - DNA, 43 bp, Artificial Sequence
  Description of Artificial Sequence: Synthetic oligonucleotide
ggggagtttatgtttgaatttgatgaagatgagcagttctatg

SEQ ID NO: 51600 - DNA, 44 bp, Artificial Sequence
  Description of Artificial Sequence: Synthetic oligonucleotide
gggagtttatgtttgaatttgatgaagatgagcagttctatgtg

SEQ ID NO: 51601 - DNA, 44 bp, Artificial Sequence
  Description of Artificial Sequence: Synthetic oligonucleotide
ggagtttatgtttgaatttgatgaagatgagcagttctatgtgg

SEQ ID NO: 51602 - DNA, 46 bp, Artificial Sequence
  Description of Artificial Sequence: Synthetic oligonucleotide
gagtttatgtttgaatttgatgaagatgagcagttctatgtggatc

SEQ ID NO: 51603 - DNA, 47 bp, Artificial Sequence
  Description of Artificial Sequence: Synthetic oligonucleotide
agtttatgtttgaatttgatgaagatgagcagttctatgtggatctg

SEQ ID NO: 51604 - DNA, 46 bp, Artificial Sequence
  Description of Artificial Sequence: Synthetic oligonucleotide
gtttatgtttgaatttgatgaagatgagcagttctatgtggatctg

SEQ ID NO: 51605 - DNA, 46 bp, Artificial Sequence
  Description of Artificial Sequence: Synthetic oligonucleotide
tttatgtttgaatttgatgaagatgagcagttctatgtggatctgg

SEQ ID NO: 51606 - DNA, 45 bp, Artificial Sequence
  Description of Artificial Sequence: Synthetic oligonucleotide
ttatgtttgaatttgatgaagatgagcagttctatgtggatctgg

SEQ ID NO: 51607 - DNA, 44 bp, Artificial Sequence
  Description of Artificial Sequence: Synthetic oligonucleotide
tatgtttgaatttgatgaagatgagcagttctatgtggatctgg

SEQ ID NO: 51608 - DNA, 43 bp, Artificial Sequence
  Description of Artificial Sequence: Synthetic oligonucleotide
atgtttgaatttgatgaagatgagcagttctatgtggatctgg

SEQ ID NO: 51609 - DNA, 42 bp, Artificial Sequence
  Description of Artificial Sequence: Synthetic oligonucleotide
tgtttgaatttgatgaagatgagcagttctatgtggatctgg

SEQ ID NO: 51610 - DNA, 41 bp, Artificial Sequence
  Description of Artificial Sequence: Synthetic oligonucleotide
gtttgaatttgatgaagatgagcagttctatgtggatctgg

SEQ ID NO: 51611 - DNA, 48 bp, Artificial Sequence
  Description of Artificial Sequence: Synthetic oligonucleotide
tttgaatttgatgaagatgagcagttctatgtggatctggataaaaag

SEQ ID NO: 51612 - DNA, 47 bp, Artificial Sequence
  Description of Artificial Sequence: Synthetic oligonucleotide
ttgaatttgatgaagatgagcagttctatgtggatctggataaaaag

SEQ ID NO: 51613 - DNA, 46 bp, Artificial Sequence
  Description of Artificial Sequence: Synthetic oligonucleotide
tgaatttgatgaagatgagcagttctatgtggatctggataaaaag

SEQ ID NO: 51614 - DNA, 45 bp, Artificial Sequence
  Description of Artificial Sequence: Synthetic oligonucleotide
gaatttgatgaagatgagcagttctatgtggatctggataaaaag

SEQ ID NO: 51615 - DNA, 45 bp, Artificial Sequence
  Description of Artificial Sequence: Synthetic oligonucleotide
aatttgatgaagatgagcagttctatgtggatctggataaaaagg

SEQ ID NO: 51616 - DNA, 44 bp, Artificial Sequence
  Description of Artificial Sequence: Synthetic oligonucleotide
atttgatgaagatgagcagttctatgtggatctggataaaaagg

SEQ ID NO: 51617 - DNA, 43 bp, Artificial Sequence
  Description of Artificial Sequence: Synthetic oligonucleotide
tttgatgaagatgagcagttctatgtggatctggataaaaagg

SEQ ID NO: 51618 - DNA, 42 bp, Artificial Sequence
  Description of Artificial Sequence: Synthetic oligonucleotide
ttgatgaagatgagcagttctatgtggatctggataaaaagg

SEQ ID NO: 51619 - DNA, 41 bp, Artificial Sequence
  Description of Artificial Sequence: Synthetic oligonucleotide
tgatgaagatgagcagttctatgtggatctggataaaaagg

SEQ ID NO: 51620 - DNA, 40 bp, Artificial Sequence
  Description of Artificial Sequence: Synthetic oligonucleotide
gatgaagatgagcagttctatgtggatctggataaaaagg

SEQ ID NO: 51621 - DNA, 41 bp, Artificial Sequence
  Description of Artificial Sequence: Synthetic oligonucleotide
atgaagatgagcagttctatgtggatctggataaaaaggag

SEQ ID NO: 51622 - DNA, 40 bp, Artificial Sequence
  Description of Artificial Sequence: Synthetic oligonucleotide
tgaagatgagcagttctatgtggatctggataaaaaggag

SEQ ID NO: 51623 - DNA, 39 bp, Artificial Sequence
  Description of Artificial Sequence: Synthetic oligonucleotide
gaagatgagcagttctatgtggatctggataaaaaggag

SEQ ID NO: 51624 - DNA, 40 bp, Artificial Sequence
  Description of Artificial Sequence: Synthetic oligonucleotide
aagatgagcagttctatgtggatctggataaaaaggagac

SEQ ID NO: 51625 - DNA, 39 bp, Artificial Sequence
  Description of Artificial Sequence: Synthetic oligonucleotide
agatgagcagttctatgtggatctggataaaaaggagac

SEQ ID NO: 51626 - DNA, 38 bp, Artificial Sequence
  Description of Artificial Sequence: Synthetic oligonucleotide
gatgagcagttctatgtggatctggataaaaaggagac

SEQ ID NO: 51627 - DNA, 38 bp, Artificial Sequence
  Description of Artificial Sequence: Synthetic oligonucleotide
atgagcagttctatgtggatctggataaaaaggagacc

SEQ ID NO: 51628 - DNA, 37 bp, Artificial Sequence
  Description of Artificial Sequence: Synthetic oligonucleotide
tgagcagttctatgtggatctggataaaaaggagacc

SEQ ID NO: 51629 - DNA, 36 bp, Artificial Sequence
  Description of Artificial Sequence: Synthetic oligonucleotide
gagcagttctatgtggatctggataaaaaggagacc

SEQ ID NO: 51630 - DNA, 36 bp, Artificial Sequence
  Description of Artificial Sequence: Synthetic oligonucleotide
agcagttctatgtggatctggataaaaaggagaccg

SEQ ID NO: 51631 - DNA, 35 bp, Artificial Sequence
  Description of Artificial Sequence: Synthetic oligonucleotide
gcagttctatgtggatctggataaaaaggagaccg

SEQ ID NO: 51632 - DNA, 36 bp, Artificial Sequence
  Description of Artificial Sequence: Synthetic oligonucleotide
cagttctatgtggatctggataaaaaggagaccgtc

SEQ ID NO: 51633 - DNA, 37 bp, Artificial Sequence
  Description of Artificial Sequence: Synthetic oligonucleotide
agttctatgtggatctggataaaaaggagaccgtctg

SEQ ID NO: 51634 - DNA, 36 bp, Artificial Sequence
  Description of Artificial Sequence: Synthetic oligonucleotide
gttctatgtggatctggataaaaaggagaccgtctg

SEQ ID NO: 51635 - DNA, 36 bp, Artificial Sequence
  Description of Artificial Sequence: Synthetic oligonucleotide
ttctatgtggatctggataaaaaggagaccgtctgg

SEQ ID NO: 51636 - DNA, 35 bp, Artificial Sequence
  Description of Artificial Sequence: Synthetic oligonucleotide
tctatgtggatctggataaaaaggagaccgtctgg

SEQ ID NO: 51637 - DNA, 34 bp, Artificial Sequence
  Description of Artificial Sequence: Synthetic oligonucleotide
ctatgtggatctggataaaaaggagaccgtctgg

SEQ ID NO: 51638 - DNA, 34 bp, Artificial Sequence
  Description of Artificial Sequence: Synthetic oligonucleotide
tatgtggatctggataaaaaggagaccgtctggc

SEQ ID NO: 51639 - DNA, 33 bp, Artificial Sequence
  Description of Artificial Sequence: Synthetic oligonucleotide
atgtggatctggataaaaaggagaccgtctggc

SEQ ID NO: 51640 - DNA, 32 bp, Artificial Sequence
  Description of Artificial Sequence: Synthetic oligonucleotide
tgtggatctggataaaaaggagaccgtctggc

SEQ ID NO: 51641 - DNA, 31 bp, Artificial Sequence
  Description of Artificial Sequence: Synthetic oligonucleotide
gtggatctggataaaaaggagaccgtctggc

SEQ ID NO: 51642 - DNA, 33 bp, Artificial Sequence
  Description of Artificial Sequence: Synthetic oligonucleotide
tggatctggataaaaaggagaccgtctggcatc

SEQ ID NO: 51643 - DNA, 32 bp, Artificial Sequence
  Description of Artificial Sequence: Synthetic oligonucleotide
ggatctggataaaaaggagaccgtctggcatc

SEQ ID NO: 51644 - DNA, 33 bp, Artificial Sequence
  Description of Artificial Sequence: Synthetic oligonucleotide
gatctggataaaaaggagaccgtctggcatctg

SEQ ID NO: 51645 - DNA, 33 bp, Artificial Sequence
  Description of Artificial Sequence: Synthetic oligonucleotide
atctggataaaaaggagaccgtctggcatctgg

SEQ ID NO: 51646 - DNA, 32 bp, Artificial Sequence
  Description of Artificial Sequence: Synthetic oligonucleotide
tctggataaaaaggagaccgtctggcatctgg

SEQ ID NO: 51647 - DNA, 31 bp, Artificial Sequence
  Description of Artificial Sequence: Synthetic oligonucleotide
ctggataaaaaggagaccgtctggcatctgg

SEQ ID NO: 51648 - DNA, 32 bp, Artificial Sequence
  Description of Artificial Sequence: Synthetic oligonucleotide
tggataaaaaggagaccgtctggcatctggag

SEQ ID NO: 51649 - DNA, 31 bp, Artificial Sequence
  Description of Artificial Sequence: Synthetic oligonucleotide
ggataaaaaggagaccgtctggcatctggag

SEQ ID NO: 51650 - DNA, 31 bp, Artificial Sequence
  Description of Artificial Sequence: Synthetic oligonucleotide
gataaaaaggagaccgtctggcatctggagg

SEQ ID NO: 51651 - DNA, 32 bp, Artificial Sequence
  Description of Artificial Sequence: Synthetic oligonucleotide
ataaaaaggagaccgtctggcatctggaggag

SEQ ID NO: 51652 - DNA, 31 bp, Artificial Sequence
  Description of Artificial Sequence: Synthetic oligonucleotide
taaaaaggagaccgtctggcatctggaggag

SEQ ID NO: 51653 - DNA, 30 bp, Artificial Sequence
  Description of Artificial Sequence: Synthetic oligonucleotide
aaaaaggagaccgtctggcatctggaggag

SEQ ID NO: 51654 - DNA, 29 bp, Artificial Sequence
  Description of Artificial Sequence: Synthetic oligonucleotide
aaaaggagaccgtctggcatctggaggag

SEQ ID NO: 51655 - DNA, 28 bp, Artificial Sequence
  Description of Artificial Sequence: Synthetic oligonucleotide
aaaggagaccgtctggcatctggaggag

SEQ ID NO: 51656 - DNA, 42 bp, Artificial Sequence
  Description of Artificial Sequence: Synthetic oligonucleotide
tttgaatttgatgaagatgagcagttctatgtggatctggac

SEQ ID NO: 51657 - DNA, 41 bp, Artificial Sequence
  Description of Artificial Sequence: Synthetic oligonucleotide
ttgaatttgatgaagatgagcagttctatgtggatctggac

SEQ ID NO: 51658 - DNA, 40 bp, Artificial Sequence
  Description of Artificial Sequence: Synthetic oligonucleotide
tgaatttgatgaagatgagcagttctatgtggatctggac

SEQ ID NO: 51659 - DNA, 39 bp, Artificial Sequence
  Description of Artificial Sequence: Synthetic oligonucleotide
gaatttgatgaagatgagcagttctatgtggatctggac

SEQ ID NO: 51660 - DNA, 41 bp, Artificial Sequence
  Description of Artificial Sequence: Synthetic oligonucleotide
aatttgatgaagatgagcagttctatgtggatctggacaag

SEQ ID NO: 51661 - DNA, 40 bp, Artificial Sequence
  Description of Artificial Sequence: Synthetic oligonucleotide
atttgatgaagatgagcagttctatgtggatctggacaag

SEQ ID NO: 51662 - DNA, 39 bp, Artificial Sequence
  Description of Artificial Sequence: Synthetic oligonucleotide
tttgatgaagatgagcagttctatgtggatctggacaag

SEQ ID NO: 51663 - DNA, 38 bp, Artificial Sequence
  Description of Artificial Sequence: Synthetic oligonucleotide
ttgatgaagatgagcagttctatgtggatctggacaag

SEQ ID NO: 51664 - DNA, 37 bp, Artificial Sequence
  Description of Artificial Sequence: Synthetic oligonucleotide
tgatgaagatgagcagttctatgtggatctggacaag

SEQ ID NO: 51665 - DNA, 36 bp, Artificial Sequence
  Description of Artificial Sequence: Synthetic oligonucleotide
gatgaagatgagcagttctatgtggatctggacaag

SEQ ID NO: 51666 - DNA, 38 bp, Artificial Sequence
  Description of Artificial Sequence: Synthetic oligonucleotide
atgaagatgagcagttctatgtggatctggacaagaag

SEQ ID NO: 51667 - DNA, 37 bp, Artificial Sequence
  Description of Artificial Sequence: Synthetic oligonucleotide
tgaagatgagcagttctatgtggatctggacaagaag

SEQ ID NO: 51668 - DNA, 36 bp, Artificial Sequence
  Description of Artificial Sequence: Synthetic oligonucleotide
gaagatgagcagttctatgtggatctggacaagaag

SEQ ID NO: 51669 - DNA, 36 bp, Artificial Sequence
  Description of Artificial Sequence: Synthetic oligonucleotide
aagatgagcagttctatgtggatctggacaagaagg

SEQ ID NO: 51670 - DNA, 35 bp, Artificial Sequence
  Description of Artificial Sequence: Synthetic oligonucleotide
agatgagcagttctatgtggatctggacaagaagg

SEQ ID NO: 51671 - DNA, 34 bp, Artificial Sequence
  Description of Artificial Sequence: Synthetic oligonucleotide
gatgagcagttctatgtggatctggacaagaagg

SEQ ID NO: 51672 - DNA, 35 bp, Artificial Sequence
  Description of Artificial Sequence: Synthetic oligonucleotide
atgagcagttctatgtggatctggacaagaaggag

SEQ ID NO: 51673 - DNA, 34 bp, Artificial Sequence
  Description of Artificial Sequence: Synthetic oligonucleotide
tgagcagttctatgtggatctggacaagaaggag

SEQ ID NO: 51674 - DNA, 33 bp, Artificial Sequence
  Description of Artificial Sequence: Synthetic oligonucleotide
gagcagttctatgtggatctggacaagaaggag

SEQ ID NO: 51675 - DNA, 34 bp, Artificial Sequence
  Description of Artificial Sequence: Synthetic oligonucleotide
agcagttctatgtggatctggacaagaaggagac

SEQ ID NO: 51676 - DNA, 33 bp, Artificial Sequence
  Description of Artificial Sequence: Synthetic oligonucleotide
gcagttctatgtggatctggacaagaaggagac

SEQ ID NO: 51677 - DNA, 33 bp, Artificial Sequence
  Description of Artificial Sequence: Synthetic oligonucleotide
cagttctatgtggatctggacaagaaggagacc

SEQ ID NO: 51678 - DNA, 33 bp, Artificial Sequence
  Description of Artificial Sequence: Synthetic oligonucleotide
agttctatgtggatctggacaagaaggagaccg

SEQ ID NO: 51679 - DNA, 29 bp, Artificial Sequence
  Description of Artificial Sequence: Synthetic oligonucleotide
gtctggcatctggaggagtttggccaaac

SEQ ID NO: 51680 - DNA, 29 bp, Artificial Sequence
  Description of Artificial Sequence: Synthetic oligonucleotide
tctggcatctggaggagtttggccaaacc

SEQ ID NO: 51681 - DNA, 28 bp, Artificial Sequence
  Description of Artificial Sequence: Synthetic oligonucleotide
ctggcatctggaggagtttggccaaacc

SEQ ID NO: 51682 - DNA, 32 bp, Artificial Sequence
  Description of Artificial Sequence: Synthetic oligonucleotide
tggcatctggaggagtttggccaaaccttttc

SEQ ID NO: 51683 - DNA, 31 bp, Artificial Sequence
  Description of Artificial Sequence: Synthetic oligonucleotide
ggcatctggaggagtttggccaaaccttttc

SEQ ID NO: 51684 - DNA, 31 bp, Artificial Sequence
  Description of Artificial Sequence: Synthetic oligonucleotide
gcatctggaggagtttggccaaaccttttcc

SEQ ID NO: 51685 - DNA, 34 bp, Artificial Sequence
  Description of Artificial Sequence: Synthetic oligonucleotide
catctggaggagtttggccaaaccttttcctttg

SEQ ID NO: 51686 - DNA, 35 bp, Artificial Sequence
  Description of Artificial Sequence: Synthetic oligonucleotide
atctggaggagtttggccaaaccttttcctttgag

SEQ ID NO: 51687 - DNA, 34 bp, Artificial Sequence
  Description of Artificial Sequence: Synthetic oligonucleotide
tctggaggagtttggccaaaccttttcctttgag

SEQ ID NO: 51688 - DNA, 33 bp, Artificial Sequence
  Description of Artificial Sequence: Synthetic oligonucleotide
ctggaggagtttggccaaaccttttcctttgag

SEQ ID NO: 51689 - DNA, 33 bp, Artificial Sequence
  Description of Artificial Sequence: Synthetic oligonucleotide
tggaggagtttggccaaaccttttcctttgagg

SEQ ID NO: 51690 - DNA, 32 bp, Artificial Sequence
  Description of Artificial Sequence: Synthetic oligonucleotide
ggaggagtttggccaaaccttttcctttgagg

SEQ ID NO: 51691 - DNA, 32 bp, Artificial Sequence
  Description of Artificial Sequence: Synthetic oligonucleotide
gaggagtttggccaaaccttttcctttgaggc

SEQ ID NO: 51692 - DNA, 33 bp, Artificial Sequence
  Description of Artificial Sequence: Synthetic oligonucleotide
aggagtttggccaaaccttttcctttgaggctc

SEQ ID NO: 51693 - DNA, 32 bp, Artificial Sequence
  Description of Artificial Sequence: Synthetic oligonucleotide
ggagtttggccaaaccttttcctttgaggctc

SEQ ID NO: 51694 - DNA, 33 bp, Artificial Sequence
  Description of Artificial Sequence: Synthetic oligonucleotide
gagtttggccaaaccttttcctttgaggctcag

SEQ ID NO: 51695 - DNA, 33 bp, Artificial Sequence
  Description of Artificial Sequence: Synthetic oligonucleotide
agtttggccaaaccttttcctttgaggctcagg

SEQ ID NO: 51696 - DNA, 32 bp, Artificial Sequence
  Description of Artificial Sequence: Synthetic oligonucleotide
gtttggccaaaccttttcctttgaggctcagg

SEQ ID NO: 51697 - DNA, 32 bp, Artificial Sequence
  Description of Artificial Sequence: Synthetic oligonucleotide
tttggccaaaccttttcctttgaggctcaggg

SEQ ID NO: 51698 - DNA, 31 bp, Artificial Sequence
  Description of Artificial Sequence: Synthetic oligonucleotide
ttggccaaaccttttcctttgaggctcaggg

SEQ ID NO: 51699 - DNA, 30 bp, Artificial Sequence
  Description of Artificial Sequence: Synthetic oligonucleotide
tggccaaaccttttcctttgaggctcaggg

SEQ ID NO: 51700 - DNA, 29 bp, Artificial Sequence
  Description of Artificial Sequence: Synthetic oligonucleotide
ggccaaaccttttcctttgaggctcaggg

SEQ ID NO: 51701 - DNA, 29 bp, Artificial Sequence
  Description of Artificial Sequence: Synthetic oligonucleotide
gccaaaccttttcctttgaggctcagggc

SEQ ID NO: 51702 - DNA, 29 bp, Artificial Sequence
  Description of Artificial Sequence: Synthetic oligonucleotide
ccaaaccttttcctttgaggctcagggcg

SEQ ID NO: 51703 - DNA, 29 bp, Artificial Sequence
  Description of Artificial Sequence: Synthetic oligonucleotide
caaaccttttcctttgaggctcagggcgg

SEQ ID NO: 51704 - DNA, 29 bp, Artificial Sequence
  Description of Artificial Sequence: Synthetic oligonucleotide
aaaccttttcctttgaggctcagggcggg

SEQ ID NO: 51705 - DNA, 28 bp, Artificial Sequence
  Description of Artificial Sequence: Synthetic oligonucleotide
aaccttttcctttgaggctcagggcggg

SEQ ID NO: 51706 - DNA, 27 bp, Artificial Sequence
  Description of Artificial Sequence: Synthetic oligonucleotide
accttttcctttgaggctcagggcggg

SEQ ID NO: 51707 - DNA, 26 bp, Artificial Sequence
  Description of Artificial Sequence: Synthetic oligonucleotide
cgtctggcatctggaggagtttggcc

SEQ ID NO: 51708 - DNA, 27 bp, Artificial Sequence
  Description of Artificial Sequence: Synthetic oligonucleotide
gtctggcatctggaggagtttggccga

SEQ ID NO: 51709 - DNA, 27 bp, Artificial Sequence
  Description of Artificial Sequence: Synthetic oligonucleotide
tctggcatctggaggagtttggccgag

SEQ ID NO: 51710 - DNA, 26 bp, Artificial Sequence
  Description of Artificial Sequence: Synthetic oligonucleotide
ctggcatctggaggagtttggccgag

SEQ ID NO: 51711 - DNA, 26 bp, Artificial Sequence
  Description of Artificial Sequence: Synthetic oligonucleotide
tggcatctggaggagtttggccgagc

SEQ ID NO: 51712 - DNA, 25 bp, Artificial Sequence
  Description of Artificial Sequence: Synthetic oligonucleotide
ggcatctggaggagtttggccgagc

SEQ ID NO: 51713 - DNA, 27 bp, Artificial Sequence
  Description of Artificial Sequence: Synthetic oligonucleotide
gcatctggaggagtttggccgagcctt

SEQ ID NO: 51714 - DNA, 29 bp, Artificial Sequence
  Description of Artificial Sequence: Synthetic oligonucleotide
catctggaggagtttggccgagccttttc

SEQ ID NO: 51715 - DNA, 29 bp, Artificial Sequence
  Description of Artificial Sequence: Synthetic oligonucleotide
atctggaggagtttggccgagccttttcc

SEQ ID NO: 51716 - DNA, 28 bp, Artificial Sequence
  Description of Artificial Sequence: Synthetic oligonucleotide
tctggaggagtttggccgagccttttcc

SEQ ID NO: 51717 - DNA, 27 bp, Artificial Sequence
  Description of Artificial Sequence: Synthetic oligonucleotide
ctggaggagtttggccgagccttttcc

SEQ ID NO: 51718 - DNA, 30 bp, Artificial Sequence
  Description of Artificial Sequence: Synthetic oligonucleotide
tggaggagtttggccgagccttttcctttg

SEQ ID NO: 51719 - DNA, 29 bp, Artificial Sequence
  Description of Artificial Sequence: Synthetic oligonucleotide
ggaggagtttggccgagccttttcctttg

SEQ ID NO: 51720 - DNA, 30 bp, Artificial Sequence
  Description of Artificial Sequence: Synthetic oligonucleotide
gaggagtttggccgagccttttcctttgag

SEQ ID NO: 51721 - DNA, 30 bp, Artificial Sequence
  Description of Artificial Sequence: Synthetic oligonucleotide
aggagtttggccgagccttttcctttgagg

SEQ ID NO: 51722 - DNA, 29 bp, Artificial Sequence
  Description of Artificial Sequence: Synthetic oligonucleotide
ggagtttggccgagccttttcctttgagg

SEQ ID NO: 51723 - DNA, 29 bp, Artificial Sequence
  Description of Artificial Sequence: Synthetic oligonucleotide
gagtttggccgagccttttcctttgaggc

SEQ ID NO: 51724 - DNA, 30 bp, Artificial Sequence
  Description of Artificial Sequence: Synthetic oligonucleotide
agtttggccgagccttttcctttgaggctc

SEQ ID NO: 51725 - DNA, 29 bp, Artificial Sequence
  Description of Artificial Sequence: Synthetic oligonucleotide
gtttggccgagccttttcctttgaggctc

SEQ ID NO: 51726 - DNA, 30 bp, Artificial Sequence
  Description of Artificial Sequence: Synthetic oligonucleotide
tttggccgagccttttcctttgaggctcag

SEQ ID NO: 51727 - DNA, 29 bp, Artificial Sequence
  Description of Artificial Sequence: Synthetic oligonucleotide
ttggccgagccttttcctttgaggctcag

SEQ ID NO: 51728 - DNA, 28 bp, Artificial Sequence
  Description of Artificial Sequence: Synthetic oligonucleotide
tggccgagccttttcctttgaggctcag

SEQ ID NO: 51729 - DNA, 27 bp, Artificial Sequence
  Description of Artificial Sequence: Synthetic oligonucleotide
ggccgagccttttcctttgaggctcag

SEQ ID NO: 51730 - DNA, 27 bp, Artificial Sequence
  Description of Artificial Sequence: Synthetic oligonucleotide
gccgagccttttcctttgaggctcagg

SEQ ID NO: 51731 - DNA, 27 bp, Artificial Sequence
  Description of Artificial Sequence: Synthetic oligonucleotide
ccgagccttttcctttgaggctcaggg

SEQ ID NO: 51732 - DNA, 27 bp, Artificial Sequence
  Description of Artificial Sequence: Synthetic oligonucleotide
cgagccttttcctttgaggctcagggc

SEQ ID NO: 51733 - DNA, 27 bp, Artificial Sequence
  Description of Artificial Sequence: Synthetic oligonucleotide
gagccttttcctttgaggctcagggcg

SEQ ID NO: 51734 - DNA, 35 bp, Artificial Sequence
  Description of Artificial Sequence: Synthetic oligonucleotide
tttgtacagacgcatagaccaacaggggagtttac

SEQ ID NO: 51735 - DNA, 34 bp, Artificial Sequence
  Description of Artificial Sequence: Synthetic oligonucleotide
ttgtacagacgcatagaccaacaggggagtttac

SEQ ID NO: 51736 - DNA, 33 bp, Artificial Sequence
  Description of Artificial Sequence: Synthetic oligonucleotide
tgtacagacgcatagaccaacaggggagtttac

SEQ ID NO: 51737 - DNA, 32 bp, Artificial Sequence
  Description of Artificial Sequence: Synthetic oligonucleotide
gtacagacgcatagaccaacaggggagtttac

SEQ ID NO: 51738 - DNA, 32 bp, Artificial Sequence
  Description of Artificial Sequence: Synthetic oligonucleotide
tacagacgcatagaccaacaggggagtttacg

SEQ ID NO: 51739 - DNA, 31 bp, Artificial Sequence
  Description of Artificial Sequence: Synthetic oligonucleotide
acagacgcatagaccaacaggggagtttacg

SEQ ID NO: 51740 - DNA, 30 bp, Artificial Sequence
  Description of Artificial Sequence: Synthetic oligonucleotide
cagacgcatagaccaacaggggagtttacg

SEQ ID NO: 51741 - DNA, 33 bp, Artificial Sequence
  Description of Artificial Sequence: Synthetic oligonucleotide
agacgcatagaccaacaggggagtttacgtttg

SEQ ID NO: 51742 - DNA, 32 bp, Artificial Sequence
  Description of Artificial Sequence: Synthetic oligonucleotide
gacgcatagaccaacaggggagtttacgtttg

SEQ ID NO: 51743 - DNA, 37 bp, Artificial Sequence
  Description of Artificial Sequence: Synthetic oligonucleotide
acgcatagaccaacaggggagtttacgtttgaatttg

SEQ ID NO: 51744 - DNA, 36 bp, Artificial Sequence
  Description of Artificial Sequence: Synthetic oligonucleotide
cgcatagaccaacaggggagtttacgtttgaatttg

SEQ ID NO: 51745 - DNA, 38 bp, Artificial Sequence
  Description of Artificial Sequence: Synthetic oligonucleotide
gcatagaccaacaggggagtttacgtttgaatttgatg

SEQ ID NO: 51746 - DNA, 40 bp, Artificial Sequence
  Description of Artificial Sequence: Synthetic oligonucleotide
catagaccaacaggggagtttacgtttgaatttgatgaag

SEQ ID NO: 51747 - DNA, 42 bp, Artificial Sequence
  Description of Artificial Sequence: Synthetic oligonucleotide
atagaccaacaggggagtttacgtttgaatttgatgaagatg

SEQ ID NO: 51748 - DNA, 41 bp, Artificial Sequence
  Description of Artificial Sequence: Synthetic oligonucleotide
tagaccaacaggggagtttacgtttgaatttgatgaagatg

SEQ ID NO: 51749 - DNA, 40 bp, Artificial Sequence
  Description of Artificial Sequence: Synthetic oligonucleotide
agaccaacaggggagtttacgtttgaatttgatgaagatg

SEQ ID NO: 51750 - DNA, 39 bp, Artificial Sequence
  Description of Artificial Sequence: Synthetic oligonucleotide
gaccaacaggggagtttacgtttgaatttgatgaagatg

SEQ ID NO: 51751 - DNA, 40 bp, Artificial Sequence
  Description of Artificial Sequence: Synthetic oligonucleotide
accaacaggggagtttacgtttgaatttgatgaagatgag

SEQ ID NO: 51752 - DNA, 39 bp, Artificial Sequence
  Description of Artificial Sequence: Synthetic oligonucleotide
ccaacaggggagtttacgtttgaatttgatgaagatgag

SEQ ID NO: 51753 - DNA, 41 bp, Artificial Sequence
  Description of Artificial Sequence: Synthetic oligonucleotide
caacaggggagtttacgtttgaatttgatgaagatgagatg

SEQ ID NO: 51754 - DNA, 43 bp, Artificial Sequence
  Description of Artificial Sequence: Synthetic oligonucleotide
aacaggggagtttacgtttgaatttgatgaagatgagatgttc

SEQ ID NO: 51755 - DNA, 42 bp, Artificial Sequence
  Description of Artificial Sequence: Synthetic oligonucleotide
acaggggagtttacgtttgaatttgatgaagatgagatgttc

SEQ ID NO: 51756 - DNA, 41 bp, Artificial Sequence
  Description of Artificial Sequence: Synthetic oligonucleotide
caggggagtttacgtttgaatttgatgaagatgagatgttc

SEQ ID NO: 51757 - DNA, 44 bp, Artificial Sequence
  Description of Artificial Sequence: Synthetic oligonucleotide
aggggagtttacgtttgaatttgatgaagatgagatgttctatg

SEQ ID NO: 51758 - DNA, 43 bp, Artificial Sequence
  Description of Artificial Sequence: Synthetic oligonucleotide
ggggagtttacgtttgaatttgatgaagatgagatgttctatg

SEQ ID NO: 51759 - DNA, 44 bp, Artificial Sequence
  Description of Artificial Sequence: Synthetic oligonucleotide
gggagtttacgtttgaatttgatgaagatgagatgttctatgtg

SEQ ID NO: 51760 - DNA, 44 bp, Artificial Sequence
  Description of Artificial Sequence: Synthetic oligonucleotide
ggagtttacgtttgaatttgatgaagatgagatgttctatgtgg

SEQ ID NO: 51761 - DNA, 46 bp, Artificial Sequence
  Description of Artificial Sequence: Synthetic oligonucleotide
gagtttacgtttgaatttgatgaagatgagatgttctatgtggatc

SEQ ID NO: 51762 - DNA, 47 bp, Artificial Sequence
  Description of Artificial Sequence: Synthetic oligonucleotide
agtttacgtttgaatttgatgaagatgagatgttctatgtggatctg

SEQ ID NO: 51763 - DNA, 46 bp, Artificial Sequence
  Description of Artificial Sequence: Synthetic oligonucleotide
gtttacgtttgaatttgatgaagatgagatgttctatgtggatctg

SEQ ID NO: 51764 - DNA, 46 bp, Artificial Sequence
  Description of Artificial Sequence: Synthetic oligonucleotide
tttacgtttgaatttgatgaagatgagatgttctatgtggatctgg

SEQ ID NO: 51765 - DNA, 45 bp, Artificial Sequence
  Description of Artificial Sequence: Synthetic oligonucleotide
ttacgtttgaatttgatgaagatgagatgttctatgtggatctgg

SEQ ID NO: 51766 - DNA, 44 bp, Artificial Sequence
  Description of Artificial Sequence: Synthetic oligonucleotide
tacgtttgaatttgatgaagatgagatgttctatgtggatctgg

SEQ ID NO: 51767 - DNA, 43 bp, Artificial Sequence
  Description of Artificial Sequence: Synthetic oligonucleotide
acgtttgaatttgatgaagatgagatgttctatgtggatctgg

SEQ ID NO: 51768 - DNA, 42 bp, Artificial Sequence
  Description of Artificial Sequence: Synthetic oligonucleotide
cgtttgaatttgatgaagatgagatgttctatgtggatctgg

SEQ ID NO: 51769 - DNA, 30 bp, Artificial Sequence
  Description of Artificial Sequence: Synthetic oligonucleotide
tggatctggacaagaaggagaccgtctgtc

SEQ ID NO: 51770 - DNA, 29 bp, Artificial Sequence
  Description of Artificial Sequence: Synthetic oligonucleotide
ggatctggacaagaaggagaccgtctgtc

SEQ ID NO: 51771 - DNA, 31 bp, Artificial Sequence
  Description of Artificial Sequence: Synthetic oligonucleotide
gatctggacaagaaggagaccgtctgtcatc

SEQ ID NO: 51772 - DNA, 32 bp, Artificial Sequence
  Description of Artificial Sequence: Synthetic oligonucleotide
atctggacaagaaggagaccgtctgtcatctg

SEQ ID NO: 51773 - DNA, 31 bp, Artificial Sequence
  Description of Artificial Sequence: Synthetic oligonucleotide
tctggacaagaaggagaccgtctgtcatctg

SEQ ID NO: 51774 - DNA, 30 bp, Artificial Sequence
  Description of Artificial Sequence: Synthetic oligonucleotide
ctggacaagaaggagaccgtctgtcatctg

SEQ ID NO: 51775 - DNA, 30 bp, Artificial Sequence
  Description of Artificial Sequence: Synthetic oligonucleotide
tggacaagaaggagaccgtctgtcatctgg

SEQ ID NO: 51776 - DNA, 29 bp, Artificial Sequence
  Description of Artificial Sequence: Synthetic oligonucleotide
ggacaagaaggagaccgtctgtcatctgg

SEQ ID NO: 51777 - DNA, 30 bp, Artificial Sequence
  Description of Artificial Sequence: Synthetic oligonucleotide
gacaagaaggagaccgtctgtcatctggag

SEQ ID NO: 51778 - DNA, 30 bp, Artificial Sequence
  Description of Artificial Sequence: Synthetic oligonucleotide
acaagaaggagaccgtctgtcatctggagg

SEQ ID NO: 51779 - DNA, 29 bp, Artificial Sequence
  Description of Artificial Sequence: Synthetic oligonucleotide
caagaaggagaccgtctgtcatctggagg

SEQ ID NO: 51780 - DNA, 30 bp, Artificial Sequence
  Description of Artificial Sequence: Synthetic oligonucleotide
aagaaggagaccgtctgtcatctggaggag

SEQ ID NO: 51781 - DNA, 29 bp, Artificial Sequence
  Description of Artificial Sequence: Synthetic oligonucleotide
agaaggagaccgtctgtcatctggaggag

SEQ ID NO: 51782 - DNA, 28 bp, Artificial Sequence
  Description of Artificial Sequence: Synthetic oligonucleotide
gaaggagaccgtctgtcatctggaggag

SEQ ID NO: 51783 - DNA, 31 bp, Artificial Sequence
  Description of Artificial Sequence: Synthetic oligonucleotide
aaggagaccgtctgtcatctggaggagtttg

SEQ ID NO: 51784 - DNA, 30 bp, Artificial Sequence
  Description of Artificial Sequence: Synthetic oligonucleotide
aggagaccgtctgtcatctggaggagtttg

SEQ ID NO: 51785 - DNA, 29 bp, Artificial Sequence
  Description of Artificial Sequence: Synthetic oligonucleotide
ggagaccgtctgtcatctggaggagtttg

SEQ ID NO: 51786 - DNA, 29 bp, Artificial Sequence
  Description of Artificial Sequence: Synthetic oligonucleotide
gagaccgtctgtcatctggaggagtttgg

SEQ ID NO: 51787 - DNA, 29 bp, Artificial Sequence
  Description of Artificial Sequence: Synthetic oligonucleotide
agaccgtctgtcatctggaggagtttggc

SEQ ID NO: 51788 - DNA, 28 bp, Artificial Sequence
  Description of Artificial Sequence: Synthetic oligonucleotide
gaccgtctgtcatctggaggagtttggc

SEQ ID NO: 51789 - DNA, 28 bp, Artificial Sequence
  Description of Artificial Sequence: Synthetic oligonucleotide
accgtctgtcatctggaggagtttggcc

SEQ ID NO: 51790 - DNA, 27 bp, Artificial Sequence
  Description of Artificial Sequence: Synthetic oligonucleotide
ccgtctgtcatctggaggagtttggcc

SEQ ID NO: 51791 - DNA, 29 bp, Artificial Sequence
  Description of Artificial Sequence: Synthetic oligonucleotide
cgtctgtcatctggaggagtttggccaag

SEQ ID NO: 51792 - DNA, 29 bp, Artificial Sequence
  Description of Artificial Sequence: Synthetic oligonucleotide
gtctgtcatctggaggagtttggccaagc

SEQ ID NO: 51793 - DNA, 29 bp, Artificial Sequence
  Description of Artificial Sequence: Synthetic oligonucleotide
tctgtcatctggaggagtttggccaagcc

SEQ ID NO: 51794 - DNA, 28 bp, Artificial Sequence
  Description of Artificial Sequence: Synthetic oligonucleotide
ctgtcatctggaggagtttggccaagcc

SEQ ID NO: 51795 - DNA, 32 bp, Artificial Sequence
  Description of Artificial Sequence: Synthetic oligonucleotide
tgtcatctggaggagtttggccaagccttttc

SEQ ID NO: 51796 - DNA, 31 bp, Artificial Sequence
  Description of Artificial Sequence: Synthetic oligonucleotide
gtcatctggaggagtttggccaagccttttc

SEQ ID NO: 51797 - DNA, 31 bp, Artificial Sequence
  Description of Artificial Sequence: Synthetic oligonucleotide
tcatctggaggagtttggccaagccttttcc

SEQ ID NO: 51798 - DNA, 27 bp, Artificial Sequence
  Description of Artificial Sequence: Synthetic oligonucleotide
gttccaaccacactcaggccgccaatg

SEQ ID NO: 51799 - DNA, 29 bp, Artificial Sequence
  Description of Artificial Sequence: Synthetic oligonucleotide
ttccaaccacactcaggccgccaatgatc

SEQ ID NO: 51800 - DNA, 28 bp, Artificial Sequence
  Description of Artificial Sequence: Synthetic oligonucleotide
tccaaccacactcaggccgccaatgatc

SEQ ID NO: 51801 - DNA, 27 bp, Artificial Sequence
  Description of Artificial Sequence: Synthetic oligonucleotide
ccaaccacactcaggccgccaatgatc

SEQ ID NO: 51802 - DNA, 27 bp, Artificial Sequence
  Description of Artificial Sequence: Synthetic oligonucleotide
caaccacactcaggccgccaatgatcc

SEQ ID NO: 51803 - DNA, 27 bp, Artificial Sequence
  Description of Artificial Sequence: Synthetic oligonucleotide
aaccacactcaggccgccaatgatccc

SEQ ID NO: 51804 - DNA, 26 bp, Artificial Sequence
  Description of Artificial Sequence: Synthetic oligonucleotide
accacactcaggccgccaatgatccc

SEQ ID NO: 51805 - DNA, 25 bp, Artificial Sequence
  Description of Artificial Sequence: Synthetic oligonucleotide
ccacactcaggccgccaatgatccc

SEQ ID NO: 51806 - DNA, 25 bp, Artificial Sequence
  Description of Artificial Sequence: Synthetic oligonucleotide
cacactcaggccgccaatgatcccc

SEQ ID NO: 51807 - DNA, 26 bp, Artificial Sequence
  Description of Artificial Sequence: Synthetic oligonucleotide
acactcaggccgccaatgatccccct

SEQ ID NO: 51808 - DNA, 25 bp, Artificial Sequence
  Description of Artificial Sequence: Synthetic oligonucleotide
cactcaggccgccaatgatccccct

SEQ ID NO: 51809 - DNA, 26 bp, Artificial Sequence
  Description of Artificial Sequence: Synthetic oligonucleotide
actcaggccgccaatgatccccctga

SEQ ID NO: 51810 - DNA, 25 bp, Artificial Sequence
  Description of Artificial Sequence: Synthetic oligonucleotide
ctcaggccgccaatgatccccctga

SEQ ID NO: 51811 - DNA, 25 bp, Artificial Sequence
  Description of Artificial Sequence: Synthetic oligonucleotide
tcaggccgccaatgatccccctgag

SEQ ID NO: 51812 - DNA, 24 bp, Artificial Sequence
  Description of Artificial Sequence: Synthetic oligonucleotide
caggccgccaatgatccccctgag

SEQ ID NO: 51813 - DNA, 25 bp, Artificial Sequence
  Description of Artificial Sequence: Synthetic oligonucleotide
aggccgccaatgatccccctgaggt

SEQ ID NO: 51814 - DNA, 24 bp, Artificial Sequence
  Description of Artificial Sequence: Synthetic oligonucleotide
ggccgccaatgatccccctgaggt

SEQ ID NO: 51815 - DNA, 25 bp, Artificial Sequence
  Description of Artificial Sequence: Synthetic oligonucleotide
gccgccaatgatccccctgaggtga

SEQ ID NO: 51816 - DNA, 25 bp, Artificial Sequence
  Description of Artificial Sequence: Synthetic oligonucleotide
ccgccaatgatccccctgaggtgac

SEQ ID NO: 51817 - DNA, 25 bp, Artificial Sequence
  Description of Artificial Sequence: Synthetic oligonucleotide
cgccaatgatccccctgaggtgacc

SEQ ID NO: 51818 - DNA, 26 bp, Artificial Sequence
  Description of Artificial Sequence: Synthetic oligonucleotide
gccaatgatccccctgaggtgaccgt

SEQ ID NO: 51819 - DNA, 27 bp, Artificial Sequence
  Description of Artificial Sequence: Synthetic oligonucleotide
ccaatgatccccctgaggtgaccgtgt

SEQ ID NO: 51820 - DNA, 29 bp, Artificial Sequence
  Description of Artificial Sequence: Synthetic oligonucleotide
caatgatccccctgaggtgaccgtgtttc

SEQ ID NO: 51821 - DNA, 29 bp, Artificial Sequence
  Description of Artificial Sequence: Synthetic oligonucleotide
aatgatccccctgaggtgaccgtgtttcc

SEQ ID NO: 51822 - DNA, 28 bp, Artificial Sequence
  Description of Artificial Sequence: Synthetic oligonucleotide
atgatccccctgaggtgaccgtgtttcc

SEQ ID NO: 51823 - DNA, 27 bp, Artificial Sequence
  Description of Artificial Sequence: Synthetic oligonucleotide
tgatccccctgaggtgaccgtgtttcc

SEQ ID NO: 51824 - DNA, 29 bp, Artificial Sequence
  Description of Artificial Sequence: Synthetic oligonucleotide
cccaacaccctcatctgccacattgacag

SEQ ID NO: 51825 - DNA, 29 bp, Artificial Sequence
  Description of Artificial Sequence: Synthetic oligonucleotide
ccaacaccctcatctgccacattgacagg

SEQ ID NO: 51826 - DNA, 31 bp, Artificial Sequence
  Description of Artificial Sequence: Synthetic oligonucleotide
caacaccctcatctgccacattgacaggttc

SEQ ID NO: 51827 - DNA, 33 bp, Artificial Sequence
  Description of Artificial Sequence: Synthetic oligonucleotide
aacaccctcatctgccacattgacaggttcttc

SEQ ID NO: 51828 - DNA, 32 bp, Artificial Sequence
  Description of Artificial Sequence: Synthetic oligonucleotide
acaccctcatctgccacattgacaggttcttc

SEQ ID NO: 51829 - DNA, 31 bp, Artificial Sequence
  Description of Artificial Sequence: Synthetic oligonucleotide
caccctcatctgccacattgacaggttcttc

SEQ ID NO: 51830 - DNA, 31 bp, Artificial Sequence
  Description of Artificial Sequence: Synthetic oligonucleotide
accctcatctgccacattgacaggttcttcc

SEQ ID NO: 51831 - DNA, 30 bp, Artificial Sequence
  Description of Artificial Sequence: Synthetic oligonucleotide
ccctcatctgccacattgacaggttcttcc

SEQ ID NO: 51832 - DNA, 30 bp, Artificial Sequence
  Description of Artificial Sequence: Synthetic oligonucleotide
cctcatctgccacattgacaggttcttccc

SEQ ID NO: 51833 - DNA, 31 bp, Artificial Sequence
  Description of Artificial Sequence: Synthetic oligonucleotide
ctcatctgccacattgacaggttcttcccac

SEQ ID NO: 51834 - DNA, 31 bp, Artificial Sequence
  Description of Artificial Sequence: Synthetic oligonucleotide
tcatctgccacattgacaggttcttcccacc

SEQ ID NO: 51835 - DNA, 30 bp, Artificial Sequence
  Description of Artificial Sequence: Synthetic oligonucleotide
catctgccacattgacaggttcttcccacc

SEQ ID NO: 51836 - DNA, 31 bp, Artificial Sequence
  Description of Artificial Sequence: Synthetic oligonucleotide
atctgccacattgacaggttcttcccaccag

SEQ ID NO: 51837 - DNA, 30 bp, Artificial Sequence
  Description of Artificial Sequence: Synthetic oligonucleotide
tctgccacattgacaggttcttcccaccag

SEQ ID NO: 51838 - DNA, 29 bp, Artificial Sequence
  Description of Artificial Sequence: Synthetic oligonucleotide
ctgccacattgacaggttcttcccaccag

SEQ ID NO: 51839 - DNA, 30 bp, Artificial Sequence
  Description of Artificial Sequence: Synthetic oligonucleotide
tgccacattgacaggttcttcccaccagtg

SEQ ID NO: 51840 - DNA, 29 bp, Artificial Sequence
  Description of Artificial Sequence: Synthetic oligonucleotide
gccacattgacaggttcttcccaccagtg

SEQ ID NO: 51841 - DNA, 29 bp, Artificial Sequence
  Description of Artificial Sequence: Synthetic oligonucleotide
ccacattgacaggttcttcccaccagtgc

SEQ ID NO: 51842 - DNA, 30 bp, Artificial Sequence
  Description of Artificial Sequence: Synthetic oligonucleotide
cacattgacaggttcttcccaccagtgctc

SEQ ID NO: 51843 - DNA, 32 bp, Artificial Sequence
  Description of Artificial Sequence: Synthetic oligonucleotide
acattgacaggttcttcccaccagtgctcaac

SEQ ID NO: 51844 - DNA, 31 bp, Artificial Sequence
  Description of Artificial Sequence: Synthetic oligonucleotide
cattgacaggttcttcccaccagtgctcaac

SEQ ID NO: 51845 - DNA, 31 bp, Artificial Sequence
  Description of Artificial Sequence: Synthetic oligonucleotide
attgacaggttcttcccaccagtgctcaacg

SEQ ID NO: 51846 - DNA, 30 bp, Artificial Sequence
  Description of Artificial Sequence: Synthetic oligonucleotide
ttgacaggttcttcccaccagtgctcaacg

SEQ ID NO: 51847 - DNA, 29 bp, Artificial Sequence
  Description of Artificial Sequence: Synthetic oligonucleotide
tgacaggttcttcccaccagtgctcaacg

SEQ ID NO: 51848 - DNA, 28 bp, Artificial Sequence
  Description of Artificial Sequence: Synthetic oligonucleotide
gacaggttcttcccaccagtgctcaacg

SEQ ID NO: 51849 - DNA, 29 bp, Artificial Sequence
  Description of Artificial Sequence: Synthetic oligonucleotide
acaggttcttcccaccagtgctcaacgtc

SEQ ID NO: 51850 - DNA, 28 bp, Artificial Sequence
  Description of Artificial Sequence: Synthetic oligonucleotide
caggttcttcccaccagtgctcaacgtc

SEQ ID NO: 51851 - DNA, 29 bp, Artificial Sequence
  Description of Artificial Sequence: Synthetic oligonucleotide
aggttcttcccaccagtgctcaacgtcac

SEQ ID NO: 51852 - DNA, 28 bp, Artificial Sequence
  Description of Artificial Sequence: Synthetic oligonucleotide
ggttcttcccaccagtgctcaacgtcac

SEQ ID NO: 51853 - DNA, 30 bp, Artificial Sequence
  Description of Artificial Sequence: Synthetic oligonucleotide
gttcttcccaccagtgctcaacgtcacatg

SEQ ID NO: 51854 - DNA, 30 bp, Artificial Sequence
  Description of Artificial Sequence: Synthetic oligonucleotide
ttcttcccaccagtgctcaacgtcacatgg

SEQ ID NO: 51855 - DNA, 29 bp, Artificial Sequence
  Description of Artificial Sequence: Synthetic oligonucleotide
tcttcccaccagtgctcaacgtcacatgg

SEQ ID NO: 51856 - DNA, 28 bp, Artificial Sequence
  Description of Artificial Sequence: Synthetic oligonucleotide
cttcccaccagtgctcaacgtcacatgg

SEQ ID NO: 51857 - DNA, 28 bp, Artificial Sequence
  Description of Artificial Sequence: Synthetic oligonucleotide
ttcccaccagtgctcaacgtcacatggc

SEQ ID NO: 51858 - DNA, 27 bp, Artificial Sequence
  Description of Artificial Sequence: Synthetic oligonucleotide
tcccaccagtgctcaacgtcacatggc

SEQ ID NO: 51859 - DNA, 27 bp, Artificial Sequence
  Description of Artificial Sequence: Synthetic oligonucleotide
cccaccagtgctcaacgtcacatggct

SEQ ID NO: 51860 - DNA, 27 bp, Artificial Sequence
  Description of Artificial Sequence: Synthetic oligonucleotide
ccaccagtgctcaacgtcacatggctg

SEQ ID NO: 51861 - DNA, 28 bp, Artificial Sequence
  Description of Artificial Sequence: Synthetic oligonucleotide
caccagtgctcaacgtcacatggctgtg

SEQ ID NO: 51862 - DNA, 28 bp, Artificial Sequence
  Description of Artificial Sequence: Synthetic oligonucleotide
accagtgctcaacgtcacatggctgtgc

SEQ ID NO: 51863 - DNA, 27 bp, Artificial Sequence
  Description of Artificial Sequence: Synthetic oligonucleotide
ccagtgctcaacgtcacatggctgtgc

SEQ ID NO: 51864 - DNA, 30 bp, Artificial Sequence
  Description of Artificial Sequence: Synthetic oligonucleotide
cagtgctcaacgtcacatggctgtgcaatg

SEQ ID NO: 51865 - DNA, 30 bp, Artificial Sequence
  Description of Artificial Sequence: Synthetic oligonucleotide
agtgctcaacgtcacatggctgtgcaatgg

SEQ ID NO: 51866 - DNA, 29 bp, Artificial Sequence
  Description of Artificial Sequence: Synthetic oligonucleotide
gtgctcaacgtcacatggctgtgcaatgg

SEQ ID NO: 51867 - DNA, 29 bp, Artificial Sequence
  Description of Artificial Sequence: Synthetic oligonucleotide
tgctcaacgtcacatggctgtgcaatggg

SEQ ID NO: 51868 - DNA, 28 bp, Artificial Sequence
  Description of Artificial Sequence: Synthetic oligonucleotide
gctcaacgtcacatggctgtgcaatggg

SEQ ID NO: 51869 - DNA, 28 bp, Artificial Sequence
  Description of Artificial Sequence: Synthetic oligonucleotide
ctcaacgtcacatggctgtgcaatgggg

SEQ ID NO: 51870 - DNA, 29 bp, Artificial Sequence
  Description of Artificial Sequence: Synthetic oligonucleotide
tcaacgtcacatggctgtgcaatggggag

SEQ ID NO: 51871 - DNA, 28 bp, Artificial Sequence
  Description of Artificial Sequence: Synthetic oligonucleotide
caacgtcacatggctgtgcaatggggag

SEQ ID NO: 51872 - DNA, 28 bp, Artificial Sequence
  Description of Artificial Sequence: Synthetic oligonucleotide
aacgtcacatggctgtgcaatggggagc

SEQ ID NO: 51873 - DNA, 27 bp, Artificial Sequence
  Description of Artificial Sequence: Synthetic oligonucleotide
acgtcacatggctgtgcaatggggagc

SEQ ID NO: 51874 - DNA, 26 bp, Artificial Sequence
  Description of Artificial Sequence: Synthetic oligonucleotide
cgtcacatggctgtgcaatggggagc

SEQ ID NO: 51875 - DNA, 27 bp, Artificial Sequence
  Description of Artificial Sequence: Synthetic oligonucleotide
gtcacatggctgtgcaatggggagcca

SEQ ID NO: 51876 - DNA, 27 bp, Artificial Sequence
  Description of Artificial Sequence: Synthetic oligonucleotide
tcacatggctgtgcaatggggagccag

SEQ ID NO: 51877 - DNA, 27 bp, Artificial Sequence
  Description of Artificial Sequence: Synthetic oligonucleotide
cacatggctgtgcaatggggagccagt

SEQ ID NO: 51878 - DNA, 27 bp, Artificial Sequence
  Description of Artificial Sequence: Synthetic oligonucleotide
acatggctgtgcaatggggagccagtc

SEQ ID NO: 51879 - DNA, 27 bp, Artificial Sequence
  Description of Artificial Sequence: Synthetic oligonucleotide
catggctgtgcaatggggagccagtca

SEQ ID NO: 51880 - DNA, 27 bp, Artificial Sequence
  Description of Artificial Sequence: Synthetic oligonucleotide
atggctgtgcaatggggagccagtcac

SEQ ID NO: 51881 - DNA, 27 bp, Artificial Sequence
  Description of Artificial Sequence: Synthetic oligonucleotide
tggctgtgcaatggggagccagtcact

SEQ ID NO: 51882 - DNA, 26 bp, Artificial Sequence
  Description of Artificial Sequence: Synthetic oligonucleotide
ggctgtgcaatggggagccagtcact

SEQ ID NO: 51883 - DNA, 27 bp, Artificial Sequence
  Description of Artificial Sequence: Synthetic oligonucleotide
gctgtgcaatggggagccagtcactga

SEQ ID NO: 51884 - DNA, 27 bp, Artificial Sequence
  Description of Artificial Sequence: Synthetic oligonucleotide
ctgtgcaatggggagccagtcactgag

SEQ ID NO: 51885 - DNA, 27 bp, Artificial Sequence
  Description of Artificial Sequence: Synthetic oligonucleotide
tgtgcaatggggagccagtcactgagg

SEQ ID NO: 51886 - DNA, 26 bp, Artificial Sequence
  Description of Artificial Sequence: Synthetic oligonucleotide
gtgcaatggggagccagtcactgagg

SEQ ID NO: 51887 - DNA, 27 bp, Artificial Sequence
  Description of Artificial Sequence: Synthetic oligonucleotide
tgcaatggggagccagtcactgagggt

SEQ ID NO: 51888 - DNA, 26 bp, Artificial Sequence
  Description of Artificial Sequence: Synthetic oligonucleotide
gcaatggggagccagtcactgagggt

SEQ ID NO: 51889 - DNA, 27 bp, Artificial Sequence
  Description of Artificial Sequence: Synthetic oligonucleotide
caatggggagccagtcactgagggtgt

SEQ ID NO: 51890 - DNA, 27 bp, Artificial Sequence
  Description of Artificial Sequence: Synthetic oligonucleotide
aatggggagccagtcactgagggtgtc

SEQ ID NO: 51891 - DNA, 26 bp, Artificial Sequence
  Description of Artificial Sequence: Synthetic oligonucleotide
atggggagccagtcactgagggtgtc

SEQ ID NO: 51892 - DNA, 25 bp, Artificial Sequence
  Description of Artificial Sequence: Synthetic oligonucleotide
tggggagccagtcactgagggtgtc

SEQ ID NO: 51893 - DNA, 24 bp, Artificial Sequence
  Description of Artificial Sequence: Synthetic oligonucleotide
ggggagccagtcactgagggtgtc

SEQ ID NO: 51894 - DNA, 24 bp, Artificial Sequence
  Description of Artificial Sequence: Synthetic oligonucleotide
gggagccagtcactgagggtgtcg

SEQ ID NO: 51895 - DNA, 25 bp, Artificial Sequence
  Description of Artificial Sequence: Synthetic oligonucleotide
ggagccagtcactgagggtgtcgct

SEQ ID NO: 51896 - DNA, 26 bp, Artificial Sequence
  Description of Artificial Sequence: Synthetic oligonucleotide
gagccagtcactgagggtgtcgctga

SEQ ID NO: 51897 - DNA, 27 bp, Artificial Sequence
  Description of Artificial Sequence: Synthetic oligonucleotide
agccagtcactgagggtgtcgctgaga

SEQ ID NO: 51898 - DNA, 26 bp, Artificial Sequence
  Description of Artificial Sequence: Synthetic oligonucleotide
gccagtcactgagggtgtcgctgaga

SEQ ID NO: 51899 - DNA, 26 bp, Artificial Sequence
  Description of Artificial Sequence: Synthetic oligonucleotide
ccagtcactgagggtgtcgctgagag

SEQ ID NO: 51900 - DNA, 26 bp, Artificial Sequence
  Description of Artificial Sequence: Synthetic oligonucleotide
cagtcactgagggtgtcgctgagagc

SEQ ID NO: 51901 - DNA, 27 bp, Artificial Sequence
  Description of Artificial Sequence: Synthetic oligonucleotide
agtcactgagggtgtcgctgagagcct

SEQ ID NO: 51902 - DNA, 27 bp, Artificial Sequence
  Description of Artificial Sequence: Synthetic oligonucleotide
tgacctttgtgccctcagcagaggacg

SEQ ID NO: 51903 - DNA, 27 bp, Artificial Sequence
  Description of Artificial Sequence: Synthetic oligonucleotide
gacctttgtgccctcagcagaggacgt

SEQ ID NO: 51904 - DNA, 27 bp, Artificial Sequence
  Description of Artificial Sequence: Synthetic oligonucleotide
acctttgtgccctcagcagaggacgtc

SEQ ID NO: 51905 - DNA, 27 bp, Artificial Sequence
  Description of Artificial Sequence: Synthetic oligonucleotide
cctttgtgccctcagcagaggacgtct

SEQ ID NO: 51906 - DNA, 29 bp, Artificial Sequence
  Description of Artificial Sequence: Synthetic oligonucleotide
ctttgtgccctcagcagaggacgtctatg

SEQ ID NO: 51907 - DNA, 30 bp, Artificial Sequence
  Description of Artificial Sequence: Synthetic oligonucleotide
tttgtgccctcagcagaggacgtctatgac

SEQ ID NO: 51908 - DNA, 29 bp, Artificial Sequence
  Description of Artificial Sequence: Synthetic oligonucleotide
ttgtgccctcagcagaggacgtctatgac

SEQ ID NO: 51909 - DNA, 28 bp, Artificial Sequence
  Description of Artificial Sequence: Synthetic oligonucleotide
tgtgccctcagcagaggacgtctatgac

SEQ ID NO: 51910 - DNA, 27 bp, Artificial Sequence
  Description of Artificial Sequence: Synthetic oligonucleotide
gtgccctcagcagaggacgtctatgac

SEQ ID NO: 51911 - DNA, 28 bp, Artificial Sequence
  Description of Artificial Sequence: Synthetic oligonucleotide
tgccctcagcagaggacgtctatgactg

SEQ ID NO: 51912 - DNA, 27 bp, Artificial Sequence
  Description of Artificial Sequence: Synthetic oligonucleotide
gccctcagcagaggacgtctatgactg

SEQ ID NO: 51913 - DNA, 27 bp, Artificial Sequence
  Description of Artificial Sequence: Synthetic oligonucleotide
ccctcagcagaggacgtctatgactgc

SEQ ID NO: 51914 - DNA, 28 bp, Artificial Sequence
  Description of Artificial Sequence: Synthetic oligonucleotide
cctcagcagaggacgtctatgactgcag

SEQ ID NO: 51915 - DNA, 28 bp, Artificial Sequence
  Description of Artificial Sequence: Synthetic oligonucleotide
ctcagcagaggacgtctatgactgcagg

SEQ ID NO: 51916 - DNA, 28 bp, Artificial Sequence
  Description of Artificial Sequence: Synthetic oligonucleotide
tcagcagaggacgtctatgactgcaggg

SEQ ID NO: 51917 - DNA, 27 bp, Artificial Sequence
  Description of Artificial Sequence: Synthetic oligonucleotide
cagcagaggacgtctatgactgcaggg

SEQ ID NO: 51918 - DNA, 28 bp, Artificial Sequence
  Description of Artificial Sequence: Synthetic oligonucleotide
agcagaggacgtctatgactgcagggtg

SEQ ID NO: 51919 - DNA, 27 bp, Artificial Sequence
  Description of Artificial Sequence: Synthetic oligonucleotide
gcagaggacgtctatgactgcagggtg

SEQ ID NO: 51920 - DNA, 27 bp, Artificial Sequence
  Description of Artificial Sequence: Synthetic oligonucleotide
cagaggacgtctatgactgcagggtgg

SEQ ID NO: 51921 - DNA, 28 bp, Artificial Sequence
  Description of Artificial Sequence: Synthetic oligonucleotide
agaggacgtctatgactgcagggtggag

SEQ ID NO: 51922 - DNA, 27 bp, Artificial Sequence
  Description of Artificial Sequence: Synthetic oligonucleotide
gaggacgtctatgactgcagggtggag

SEQ ID NO: 51923 - DNA, 27 bp, Artificial Sequence
  Description of Artificial Sequence: Synthetic oligonucleotide
aggacgtctatgactgcagggtggagc

SEQ ID NO: 51924 - DNA, 27 bp, Artificial Sequence
  Description of Artificial Sequence: Synthetic oligonucleotide
ggacgtctatgactgcagggtggagca

SEQ ID NO: 51925 - DNA, 27 bp, Artificial Sequence
  Description of Artificial Sequence: Synthetic oligonucleotide
gacgtctatgactgcagggtggagcac

SEQ ID NO: 51926 - DNA, 28 bp, Artificial Sequence
  Description of Artificial Sequence: Synthetic oligonucleotide
acgtctatgactgcagggtggagcactg

SEQ ID NO: 51927 - DNA, 27 bp, Artificial Sequence
  Description of Artificial Sequence: Synthetic oligonucleotide
cgtctatgactgcagggtggagcactg

SEQ ID NO: 51928 - DNA, 27 bp, Artificial Sequence
  Description of Artificial Sequence: Synthetic oligonucleotide
gtctatgactgcagggtggagcactgg

SEQ ID NO: 51929 - DNA, 23 bp, Artificial Sequence
  Description of Artificial Sequence: Synthetic oligonucleotide
tgggcctggtgctgggcctagtg

SEQ ID NO: 51930 - DNA, 22 bp, Artificial Sequence
  Description of Artificial Sequence: Synthetic oligonucleotide
gggcctggtgctgggcctagtg

SEQ ID NO: 51931 - DNA, 22 bp, Artificial Sequence
  Description of Artificial Sequence: Synthetic oligonucleotide
ggcctggtgctgggcctagtgg

SEQ ID NO: 51932 - DNA, 22 bp, Artificial Sequence
  Description of Artificial Sequence: Synthetic oligonucleotide
gcctggtgctgggcctagtggg

SEQ ID NO: 51933 - DNA, 24 bp, Artificial Sequence
  Description of Artificial Sequence: Synthetic oligonucleotide
cctggtgctgggcctagtgggcat

SEQ ID NO: 51934 - DNA, 26 bp, Artificial Sequence
  Description of Artificial Sequence: Synthetic oligonucleotide
ctggtgctgggcctagtgggcatcat

SEQ ID NO: 51935 - DNA, 26 bp, Artificial Sequence
  Description of Artificial Sequence: Synthetic oligonucleotide
tggtgctgggcctagtgggcatcatc

SEQ ID NO: 51936 - DNA, 25 bp, Artificial Sequence
  Description of Artificial Sequence: Synthetic oligonucleotide
ggtgctgggcctagtgggcatcatc

SEQ ID NO: 51937 - DNA, 26 bp, Artificial Sequence
  Description of Artificial Sequence: Synthetic oligonucleotide
gtgctgggcctagtgggcatcatcgt

SEQ ID NO: 51938 - DNA, 26 bp, Artificial Sequence
  Description of Artificial Sequence: Synthetic oligonucleotide
tgctgggcctagtgggcatcatcgtg

SEQ ID NO: 51939 - DNA, 25 bp, Artificial Sequence
  Description of Artificial Sequence: Synthetic oligonucleotide
gctgggcctagtgggcatcatcgtg

SEQ ID NO: 51940 - DNA, 25 bp, Artificial Sequence
  Description of Artificial Sequence: Synthetic oligonucleotide
ctgggcctagtgggcatcatcgtgg

SEQ ID NO: 51941 - DNA, 25 bp, Artificial Sequence
  Description of Artificial Sequence: Synthetic oligonucleotide
tgggcctagtgggcatcatcgtggg

SEQ ID NO: 51942 - DNA, 24 bp, Artificial Sequence
  Description of Artificial Sequence: Synthetic oligonucleotide
gggcctagtgggcatcatcgtggg

SEQ ID NO: 51943 - DNA, 25 bp, Artificial Sequence
  Description of Artificial Sequence: Synthetic oligonucleotide
ggcctagtgggcatcatcgtgggca

SEQ ID NO: 51944 - DNA, 25 bp, Artificial Sequence
  Description of Artificial Sequence: Synthetic oligonucleotide
gcctagtgggcatcatcgtgggcac

SEQ ID NO: 51945 - DNA, 25 bp, Artificial Sequence
  Description of Artificial Sequence: Synthetic oligonucleotide
cctagtgggcatcatcgtgggcacc

SEQ ID NO: 51946 - DNA, 26 bp, Artificial Sequence
  Description of Artificial Sequence: Synthetic oligonucleotide
ctagtgggcatcatcgtgggcaccgt

SEQ ID NO: 51947 - DNA, 26 bp, Artificial Sequence
  Description of Artificial Sequence: Synthetic oligonucleotide
tagtgggcatcatcgtgggcaccgtc

SEQ ID NO: 51948 - DNA, 25 bp, Artificial Sequence
  Description of Artificial Sequence: Synthetic oligonucleotide
agtgggcatcatcgtgggcaccgtc

SEQ ID NO: 51949 - DNA, 24 bp, Artificial Sequence
  Description of Artificial Sequence: Synthetic oligonucleotide
gtgggcatcatcgtgggcaccgtc

SEQ ID NO: 51950 - DNA, 25 bp, Artificial Sequence
  Description of Artificial Sequence: Synthetic oligonucleotide
tgggcatcatcgtgggcaccgtcct

SEQ ID NO: 51951 - DNA, 24 bp, Artificial Sequence
  Description of Artificial Sequence: Synthetic oligonucleotide
gggcatcatcgtgggcaccgtcct

SEQ ID NO: 51952 - DNA, 20 bp, Artificial Sequence
  Description of Artificial Sequence: Synthetic oligonucleotide
atgacccccgggcccagggg

SEQ ID NO: 51953 - DNA, 20 bp, Artificial Sequence
  Description of Artificial Sequence: Synthetic oligonucleotide
tgacccccgggcccaggggt

SEQ ID NO: 51954 - DNA, 20 bp, Artificial Sequence
  Description of Artificial Sequence: Synthetic oligonucleotide
gacccccgggcccaggggtt

SEQ ID NO: 51955 - DNA, 20 bp, Artificial Sequence
  Description of Artificial Sequence: Synthetic oligonucleotide
acccccgggcccaggggctt

SEQ ID NO: 51956 - DNA, 20 bp, Artificial Sequence
  Description of Artificial Sequence: Synthetic oligonucleotide
cccccgggcccaggggcttt

SEQ ID NO: 51957 - DNA, 20 bp, Artificial Sequence
  Description of Artificial Sequence: Synthetic oligonucleotide
ccccgggcccaggggccttt

SEQ ID NO: 51958 - DNA, 20 bp, Artificial Sequence
  Description of Artificial Sequence: Synthetic oligonucleotide
cccgggcccaggggcccttt

SEQ ID NO: 51959 - DNA, 20 bp, Artificial Sequence
  Description of Artificial Sequence: Synthetic oligonucleotide
ccgggcccaggggccccttt

SEQ ID NO: 51960 - DNA, 20 bp, Artificial Sequence
  Description of Artificial Sequence: Synthetic oligonucleotide
cgggcccaggggcccctgtt

SEQ ID NO: 51961 - DNA, 20 bp, Artificial Sequence
  Description of Artificial Sequence: Synthetic oligonucleotide
gggcccaggggcccctgtga

SEQ ID NO: 51962 - DNA, 31 bp, Artificial Sequence
  Description of Artificial Sequence: Synthetic oligonucleotide
gcgtttgtacaaacccatagaccaacagggg

SEQ ID NO: 51963 - DNA, 32 bp, Artificial Sequence
  Description of Artificial Sequence: Synthetic oligonucleotide
cgtttgtacaaacccatagaccaacaggggag

SEQ ID NO: 51964 - DNA, 37 bp, Artificial Sequence
  Description of Artificial Sequence: Synthetic oligonucleotide
gtttgtacaaacccatagaccaacaggggagtttatg

SEQ ID NO: 51965 - DNA, 40 bp, Artificial Sequence
  Description of Artificial Sequence: Synthetic oligonucleotide
tttgtacaaacccatagaccaacaggggagtttatgtttg

SEQ ID NO: 51966 - DNA, 39 bp, Artificial Sequence
  Description of Artificial Sequence: Synthetic oligonucleotide
ttgtacaaacccatagaccaacaggggagtttatgtttg

SEQ ID NO: 51967 - DNA, 38 bp, Artificial Sequence
  Description of Artificial Sequence: Synthetic oligonucleotide
tgtacaaacccatagaccaacaggggagtttatgtttg

SEQ ID NO: 51968 - DNA, 37 bp, Artificial Sequence
  Description of Artificial Sequence: Synthetic oligonucleotide
gtacaaacccatagaccaacaggggagtttatgtttg

SEQ ID NO: 51969 - DNA, 42 bp, Artificial Sequence
  Description of Artificial Sequence: Synthetic oligonucleotide
tacaaacccatagaccaacaggggagtttatgtttgaatttg

SEQ ID NO: 51970 - DNA, 41 bp, Artificial Sequence
  Description of Artificial Sequence: Synthetic oligonucleotide
acaaacccatagaccaacaggggagtttatgtttgaatttg

SEQ ID NO: 51971 - DNA, 40 bp, Artificial Sequence
  Description of Artificial Sequence: Synthetic oligonucleotide
caaacccatagaccaacaggggagtttatgtttgaatttg

SEQ ID NO: 51972 - DNA, 42 bp, Artificial Sequence
  Description of Artificial Sequence: Synthetic oligonucleotide
aaacccatagaccaacaggggagtttatgtttgaatttgatg

SEQ ID NO: 51973 - DNA, 41 bp, Artificial Sequence
  Description of Artificial Sequence: Synthetic oligonucleotide
aacccatagaccaacaggggagtttatgtttgaatttgatg

SEQ ID NO: 51974 - DNA, 45 bp, Artificial Sequence
  Description of Artificial Sequence: Synthetic oligonucleotide
atagaccaacaggagagtttatgtttgaatttgatgaagatgagc

SEQ ID NO: 51975 - DNA, 44 bp, Artificial Sequence
  Description of Artificial Sequence: Synthetic oligonucleotide
tagaccaacaggagagtttatgtttgaatttgatgaagatgagc

SEQ ID NO: 51976 - DNA, 43 bp, Artificial Sequence
  Description of Artificial Sequence: Synthetic oligonucleotide
agaccaacaggagagtttatgtttgaatttgatgaagatgagc

SEQ ID NO: 51977 - DNA, 42 bp, Artificial Sequence
  Description of Artificial Sequence: Synthetic oligonucleotide
gaccaacaggagagtttatgtttgaatttgatgaagatgagc

SEQ ID NO: 51978 - DNA, 43 bp, Artificial Sequence
  Description of Artificial Sequence: Synthetic oligonucleotide
accaacaggagagtttatgtttgaatttgatgaagatgagcag

SEQ ID NO: 51979 - DNA, 42 bp, Artificial Sequence
  Description of Artificial Sequence: Synthetic oligonucleotide
ccaacaggagagtttatgtttgaatttgatgaagatgagcag

SEQ ID NO: 51980 - DNA, 44 bp, Artificial Sequence
  Description of Artificial Sequence: Synthetic oligonucleotide
caacaggagagtttatgtttgaatttgatgaagatgagcagttc

SEQ ID NO: 51981 - DNA, 47 bp, Artificial Sequence
  Description of Artificial Sequence: Synthetic oligonucleotide
aacaggagagtttatgtttgaatttgatgaagatgagcagttctatg

SEQ ID NO: 51982 - DNA, 46 bp, Artificial Sequence
  Description of Artificial Sequence: Synthetic oligonucleotide
acaggagagtttatgtttgaatttgatgaagatgagcagttctatg

SEQ ID NO: 51983 - DNA, 45 bp, Artificial Sequence
  Description of Artificial Sequence: Synthetic oligonucleotide
caggagagtttatgtttgaatttgatgaagatgagcagttctatg

SEQ ID NO: 51984 - DNA, 46 bp, Artificial Sequence
  Description of Artificial Sequence: Synthetic oligonucleotide
aggagagtttatgtttgaatttgatgaagatgagcagttctatgtg

SEQ ID NO: 51985 - DNA, 45 bp, Artificial Sequence
  Description of Artificial Sequence: Synthetic oligonucleotide
ggagagtttatgtttgaatttgatgaagatgagcagttctatgtg

SEQ ID NO: 51986 - DNA, 45 bp, Artificial Sequence
  Description of Artificial Sequence: Synthetic oligonucleotide
gagagtttatgtttgaatttgatgaagatgagcagttctatgtgg

SEQ ID NO: 51987 - DNA, 47 bp, Artificial Sequence
  Description of Artificial Sequence: Synthetic oligonucleotide
agagtttatgtttgaatttgatgaagatgagcagttctatgtggatc

SEQ ID NO: 51988 - DNA, 45 bp, Artificial Sequence
  Description of Artificial Sequence: Synthetic oligonucleotide
tttgaatttgatgaagatgagcagttctatgtggatctggataag

SEQ ID NO: 51989 - DNA, 44 bp, Artificial Sequence
  Description of Artificial Sequence: Synthetic oligonucleotide
ttgaatttgatgaagatgagcagttctatgtggatctggataag

SEQ ID NO: 51990 - DNA, 43 bp, Artificial Sequence
  Description of Artificial Sequence: Synthetic oligonucleotide
tgaatttgatgaagatgagcagttctatgtggatctggataag

SEQ ID NO: 51991 - DNA, 42 bp, Artificial Sequence
  Description of Artificial Sequence: Synthetic oligonucleotide
gaatttgatgaagatgagcagttctatgtggatctggataag

SEQ ID NO: 51992 - DNA, 44 bp, Artificial Sequence
  Description of Artificial Sequence: Synthetic oligonucleotide
aatttgatgaagatgagcagttctatgtggatctggataagaag

SEQ ID NO: 51993 - DNA, 43 bp, Artificial Sequence
  Description of Artificial Sequence: Synthetic oligonucleotide
atttgatgaagatgagcagttctatgtggatctggataagaag

SEQ ID NO: 51994 - DNA, 42 bp, Artificial Sequence
  Description of Artificial Sequence: Synthetic oligonucleotide
tttgatgaagatgagcagttctatgtggatctggataagaag

SEQ ID NO: 51995 - DNA, 41 bp, Artificial Sequence
  Description of Artificial Sequence: Synthetic oligonucleotide
ttgatgaagatgagcagttctatgtggatctggataagaag

SEQ ID NO: 51996 - DNA, 40 bp, Artificial Sequence
  Description of Artificial Sequence: Synthetic oligonucleotide
tgatgaagatgagcagttctatgtggatctggataagaag

SEQ ID NO: 51997 - DNA, 39 bp, Artificial Sequence
  Description of Artificial Sequence: Synthetic oligonucleotide
gatgaagatgagcagttctatgtggatctggataagaag

SEQ ID NO: 51998 - DNA, 39 bp, Artificial Sequence
  Description of Artificial Sequence: Synthetic oligonucleotide
atgaagatgagcagttctatgtggatctggataagaagg

SEQ ID NO: 51999 - DNA, 38 bp, Artificial Sequence
  Description of Artificial Sequence: Synthetic oligonucleotide
tgaagatgagcagttctatgtggatctggataagaagg

SEQ ID NO: 52000 - DNA, 37 bp, Artificial Sequence
  Description of Artificial Sequence: Synthetic oligonucleotide
gaagatgagcagttctatgtggatctggataagaagg

SEQ ID NO: 52001 - DNA, 38 bp, Artificial Sequence
  Description of Artificial Sequence: Synthetic oligonucleotide
aagatgagcagttctatgtggatctggataagaaggag

SEQ ID NO: 52002 - DNA, 37 bp, Artificial Sequence
  Description of Artificial Sequence: Synthetic oligonucleotide
agatgagcagttctatgtggatctggataagaaggag

SEQ ID NO: 52003 - DNA, 36 bp, Artificial Sequence
  Description of Artificial Sequence: Synthetic oligonucleotide
gatgagcagttctatgtggatctggataagaaggag

SEQ ID NO: 52004 - DNA, 37 bp, Artificial Sequence
  Description of Artificial Sequence: Synthetic oligonucleotide
atgagcagttctatgtggatctggataagaaggagac

SEQ ID NO: 52005 - DNA, 36 bp, Artificial Sequence
  Description of Artificial Sequence: Synthetic oligonucleotide
tgagcagttctatgtggatctggataagaaggagac

SEQ ID NO: 52006 - DNA, 35 bp, Artificial Sequence
  Description of Artificial Sequence: Synthetic oligonucleotide
gagcagttctatgtggatctggataagaaggagac

SEQ ID NO: 52007 - DNA, 35 bp, Artificial Sequence
  Description of Artificial Sequence: Synthetic oligonucleotide
agcagttctatgtggatctggataagaaggagacc

SEQ ID NO: 52008 - DNA, 34 bp, Artificial Sequence
  Description of Artificial Sequence: Synthetic oligonucleotide
gcagttctatgtggatctggataagaaggagacc

SEQ ID NO: 52009 - DNA, 34 bp, Artificial Sequence
  Description of Artificial Sequence: Synthetic oligonucleotide
cagttctatgtggatctggataagaaggagaccg

SEQ ID NO: 52010 - DNA, 35 bp, Artificial Sequence
  Description of Artificial Sequence: Synthetic oligonucleotide
agttctatgtggatctggataagaaggagaccgtc

SEQ ID NO: 52011 - DNA, 34 bp, Artificial Sequence
  Description of Artificial Sequence: Synthetic oligonucleotide
gttctatgtggatctggataagaaggagaccgtc

SEQ ID NO: 52012 - DNA, 35 bp, Artificial Sequence
  Description of Artificial Sequence: Synthetic oligonucleotide
ttctatgtggatctggataagaaggagaccgtctg

SEQ ID NO: 52013 - DNA, 34 bp, Artificial Sequence
  Description of Artificial Sequence: Synthetic oligonucleotide
tctatgtggatctggataagaaggagaccgtctg

SEQ ID NO: 52014 - DNA, 33 bp, Artificial Sequence
  Description of Artificial Sequence: Synthetic oligonucleotide
ctatgtggatctggataagaaggagaccgtctg

SEQ ID NO: 52015 - DNA, 33 bp, Artificial Sequence
  Description of Artificial Sequence: Synthetic oligonucleotide
tatgtggatctggataagaaggagaccgtctgg

SEQ ID NO: 52016 - DNA, 32 bp, Artificial Sequence
  Description of Artificial Sequence: Synthetic oligonucleotide
atgtggatctggataagaaggagaccgtctgg

SEQ ID NO: 52017 - DNA, 31 bp, Artificial Sequence
  Description of Artificial Sequence: Synthetic oligonucleotide
tgtggatctggataagaaggagaccgtctgg

SEQ ID NO: 52018 - DNA, 30 bp, Artificial Sequence
  Description of Artificial Sequence: Synthetic oligonucleotide
gtggatctggataagaaggagaccgtctgg

SEQ ID NO: 52019 - DNA, 30 bp, Artificial Sequence
  Description of Artificial Sequence: Synthetic oligonucleotide
tggatctggataagaaggagaccgtctggc

SEQ ID NO: 52020 - DNA, 29 bp, Artificial Sequence
  Description of Artificial Sequence: Synthetic oligonucleotide
ggatctggataagaaggagaccgtctggc

SEQ ID NO: 52021 - DNA, 31 bp, Artificial Sequence
  Description of Artificial Sequence: Synthetic oligonucleotide
gatctggataagaaggagaccgtctggcatc

SEQ ID NO: 52022 - DNA, 32 bp, Artificial Sequence
  Description of Artificial Sequence: Synthetic oligonucleotide
atctggataagaaggagaccgtctggcatctg

SEQ ID NO: 52023 - DNA, 31 bp, Artificial Sequence
  Description of Artificial Sequence: Synthetic oligonucleotide
tctggataagaaggagaccgtctggcatctg

SEQ ID NO: 52024 - DNA, 30 bp, Artificial Sequence
  Description of Artificial Sequence: Synthetic oligonucleotide
ctggataagaaggagaccgtctggcatctg

SEQ ID NO: 52025 - DNA, 30 bp, Artificial Sequence
  Description of Artificial Sequence: Synthetic oligonucleotide
tggataagaaggagaccgtctggcatctgg

SEQ ID NO: 52026 - DNA, 29 bp, Artificial Sequence
  Description of Artificial Sequence: Synthetic oligonucleotide
ggataagaaggagaccgtctggcatctgg

SEQ ID NO: 52027 - DNA, 30 bp, Artificial Sequence
  Description of Artificial Sequence: Synthetic oligonucleotide
gataagaaggagaccgtctggcatctggag

SEQ ID NO: 52028 - DNA, 30 bp, Artificial Sequence
  Description of Artificial Sequence: Synthetic oligonucleotide
ataagaaggagaccgtctggcatctggagg

SEQ ID NO: 52029 - DNA, 29 bp, Artificial Sequence
  Description of Artificial Sequence: Synthetic oligonucleotide
taagaaggagaccgtctggcatctggagg

SEQ ID NO: 52030 - DNA, 28 bp, Artificial Sequence
  Description of Artificial Sequence: Synthetic oligonucleotide
cgagccttttcctttgaggctcagggtg

SEQ ID NO: 52031 - DNA, 28 bp, Artificial Sequence
  Description of Artificial Sequence: Synthetic oligonucleotide
gagccttttcctttgaggctcagggtgg

SEQ ID NO: 52032 - DNA, 38 bp, Artificial Sequence
  Description of Artificial Sequence: Synthetic oligonucleotide
aacttatgccatgtttgtacagacccatagaccaacag

SEQ ID NO: 52033 - DNA, 37 bp, Artificial Sequence
  Description of Artificial Sequence: Synthetic oligonucleotide
acttatgccatgtttgtacagacccatagaccaacag

SEQ ID NO: 52034 - DNA, 36 bp, Artificial Sequence
  Description of Artificial Sequence: Synthetic oligonucleotide
cttatgccatgtttgtacagacccatagaccaacag

SEQ ID NO: 52035 - DNA, 36 bp, Artificial Sequence
  Description of Artificial Sequence: Synthetic oligonucleotide
ttatgccatgtttgtacagacccatagaccaacagg

SEQ ID NO: 52036 - DNA, 35 bp, Artificial Sequence
  Description of Artificial Sequence: Synthetic oligonucleotide
tatgccatgtttgtacagacccatagaccaacagg

SEQ ID NO: 52037 - DNA, 34 bp, Artificial Sequence
  Description of Artificial Sequence: Synthetic oligonucleotide
atgccatgtttgtacagacccatagaccaacagg

SEQ ID NO: 52038 - DNA, 33 bp, Artificial Sequence
  Description of Artificial Sequence: Synthetic oligonucleotide
tgccatgtttgtacagacccatagaccaacagg

SEQ ID NO: 52039 - DNA, 32 bp, Artificial Sequence
  Description of Artificial Sequence: Synthetic oligonucleotide
gccatgtttgtacagacccatagaccaacagg

SEQ ID NO: 52040 - DNA, 33 bp, Artificial Sequence
  Description of Artificial Sequence: Synthetic oligonucleotide
ccatgtttgtacagacccatagaccaacaggag

SEQ ID NO: 52041 - DNA, 34 bp, Artificial Sequence
  Description of Artificial Sequence: Synthetic oligonucleotide
catgtttgtacagacccatagaccaacaggagag

SEQ ID NO: 52042 - DNA, 39 bp, Artificial Sequence
  Description of Artificial Sequence: Synthetic oligonucleotide
atgtttgtacagacccatagaccaacaggagagtttatg

SEQ ID NO: 52043 - DNA, 38 bp, Artificial Sequence
  Description of Artificial Sequence: Synthetic oligonucleotide
tgtttgtacagacccatagaccaacaggagagtttatg

SEQ ID NO: 52044 - DNA, 37 bp, Artificial Sequence
  Description of Artificial Sequence: Synthetic oligonucleotide
gtttgtacagacccatagaccaacaggagagtttatg

SEQ ID NO: 52045 - DNA, 40 bp, Artificial Sequence
  Description of Artificial Sequence: Synthetic oligonucleotide
tttgtacagacccatagaccaacaggagagtttatgtttg

SEQ ID NO: 52046 - DNA, 39 bp, Artificial Sequence
  Description of Artificial Sequence: Synthetic oligonucleotide
ttgtacagacccatagaccaacaggagagtttatgtttg

SEQ ID NO: 52047 - DNA, 38 bp, Artificial Sequence
  Description of Artificial Sequence: Synthetic oligonucleotide
tgtacagacccatagaccaacaggagagtttatgtttg

SEQ ID NO: 52048 - DNA, 37 bp, Artificial Sequence
  Description of Artificial Sequence: Synthetic oligonucleotide
gtacagacccatagaccaacaggagagtttatgtttg

SEQ ID NO: 52049 - DNA, 42 bp, Artificial Sequence
  Description of Artificial Sequence: Synthetic oligonucleotide
tacagacccatagaccaacaggagagtttatgtttgaatttg

SEQ ID NO: 52050 - DNA, 41 bp, Artificial Sequence
  Description of Artificial Sequence: Synthetic oligonucleotide
acagacccatagaccaacaggagagtttatgtttgaatttg

SEQ ID NO: 52051 - DNA, 40 bp, Artificial Sequence
  Description of Artificial Sequence: Synthetic oligonucleotide
cagacccatagaccaacaggagagtttatgtttgaatttg

SEQ ID NO: 52052 - DNA, 42 bp, Artificial Sequence
  Description of Artificial Sequence: Synthetic oligonucleotide
agacccatagaccaacaggagagtttatgtttgaatttgatg

SEQ ID NO: 52053 - DNA, 41 bp, Artificial Sequence
  Description of Artificial Sequence: Synthetic oligonucleotide
gacccatagaccaacaggagagtttatgtttgaatttgatg

SEQ ID NO: 52054 - DNA, 43 bp, Artificial Sequence
  Description of Artificial Sequence: Synthetic oligonucleotide
acccatagaccaacaggagagtttatgtttgaatttgatgaag

SEQ ID NO: 52055 - DNA, 42 bp, Artificial Sequence
  Description of Artificial Sequence: Synthetic oligonucleotide
cccatagaccaacaggagagtttatgtttgaatttgatgaag

SEQ ID NO: 52056 - DNA, 44 bp, Artificial Sequence
  Description of Artificial Sequence: Synthetic oligonucleotide
ccatagaccaacaggagagtttatgtttgaatttgatgaagatg

SEQ ID NO: 52057 - DNA, 39 bp, Artificial Sequence
  Description of Artificial Sequence: Synthetic oligonucleotide
attacagcttccacaagttccattacctgacctttgtac

SEQ ID NO: 52058 - DNA, 38 bp, Artificial Sequence
  Description of Artificial Sequence: Synthetic oligonucleotide
ttacagcttccacaagttccattacctgacctttgtac

SEQ ID NO: 52059 - DNA, 37 bp, Artificial Sequence
  Description of Artificial Sequence: Synthetic oligonucleotide
tacagcttccacaagttccattacctgacctttgtac

SEQ ID NO: 52060 - DNA, 36 bp, Artificial Sequence
  Description of Artificial Sequence: Synthetic oligonucleotide
acagcttccacaagttccattacctgacctttgtac

SEQ ID NO: 52061 - DNA, 35 bp, Artificial Sequence
  Description of Artificial Sequence: Synthetic oligonucleotide
cagcttccacaagttccattacctgacctttgtac

SEQ ID NO: 52062 - DNA, 35 bp, Artificial Sequence
  Description of Artificial Sequence: Synthetic oligonucleotide
agcttccacaagttccattacctgacctttgtacc

SEQ ID NO: 52063 - DNA, 34 bp, Artificial Sequence
  Description of Artificial Sequence: Synthetic oligonucleotide
gcttccacaagttccattacctgacctttgtacc

SEQ ID NO: 52064 - DNA, 34 bp, Artificial Sequence
  Description of Artificial Sequence: Synthetic oligonucleotide
cttccacaagttccattacctgacctttgtaccc

SEQ ID NO: 52065 - DNA, 35 bp, Artificial Sequence
  Description of Artificial Sequence: Synthetic oligonucleotide
ttccacaagttccattacctgacctttgtaccctc

SEQ ID NO: 52066 - DNA, 34 bp, Artificial Sequence
  Description of Artificial Sequence: Synthetic oligonucleotide
tccacaagttccattacctgacctttgtaccctc

SEQ ID NO: 52067 - DNA, 33 bp, Artificial Sequence
  Description of Artificial Sequence: Synthetic oligonucleotide
ccacaagttccattacctgacctttgtaccctc

SEQ ID NO: 52068 - DNA, 34 bp, Artificial Sequence
  Description of Artificial Sequence: Synthetic oligonucleotide
cacaagttccattacctgacctttgtaccctcag

SEQ ID NO: 52069 - DNA, 34 bp, Artificial Sequence
  Description of Artificial Sequence: Synthetic oligonucleotide
acaagttccattacctgacctttgtaccctcagc

SEQ ID NO: 52070 - DNA, 33 bp, Artificial Sequence
  Description of Artificial Sequence: Synthetic oligonucleotide
caagttccattacctgacctttgtaccctcagc

SEQ ID NO: 52071 - DNA, 34 bp, Artificial Sequence
  Description of Artificial Sequence: Synthetic oligonucleotide
aagttccattacctgacctttgtaccctcagcag

SEQ ID NO: 52072 - DNA, 33 bp, Artificial Sequence
  Description of Artificial Sequence: Synthetic oligonucleotide
agttccattacctgacctttgtaccctcagcag

SEQ ID NO: 52073 - DNA, 32 bp, Artificial Sequence
  Description of Artificial Sequence: Synthetic oligonucleotide
gttccattacctgacctttgtaccctcagcag

SEQ ID NO: 52074 - DNA, 33 bp, Artificial Sequence
  Description of Artificial Sequence: Synthetic oligonucleotide
ttccattacctgacctttgtaccctcagcagag

SEQ ID NO: 52075 - DNA, 32 bp, Artificial Sequence
  Description of Artificial Sequence: Synthetic oligonucleotide
tccattacctgacctttgtaccctcagcagag

SEQ ID NO: 52076 - DNA, 31 bp, Artificial Sequence
  Description of Artificial Sequence: Synthetic oligonucleotide
ccattacctgacctttgtaccctcagcagag

SEQ ID NO: 52077 - DNA, 31 bp, Artificial Sequence
  Description of Artificial Sequence: Synthetic oligonucleotide
cattacctgacctttgtaccctcagcagagg

SEQ ID NO: 52078 - DNA, 32 bp, Artificial Sequence
  Description of Artificial Sequence: Synthetic oligonucleotide
attacctgacctttgtaccctcagcagaggac

SEQ ID NO: 52079 - DNA, 31 bp, Artificial Sequence
  Description of Artificial Sequence: Synthetic oligonucleotide
ttacctgacctttgtaccctcagcagaggac

SEQ ID NO: 52080 - DNA, 30 bp, Artificial Sequence
  Description of Artificial Sequence: Synthetic oligonucleotide
tacctgacctttgtaccctcagcagaggac

SEQ ID NO: 52081 - DNA, 29 bp, Artificial Sequence
  Description of Artificial Sequence: Synthetic oligonucleotide
acctgacctttgtaccctcagcagaggac

SEQ ID NO: 52082 - DNA, 28 bp, Artificial Sequence
  Description of Artificial Sequence: Synthetic oligonucleotide
cctgacctttgtaccctcagcagaggac

SEQ ID NO: 52083 - DNA, 28 bp, Artificial Sequence
  Description of Artificial Sequence: Synthetic oligonucleotide
ctgacctttgtaccctcagcagaggacg

SEQ ID NO: 52084 - DNA, 29 bp, Artificial Sequence
  Description of Artificial Sequence: Synthetic oligonucleotide
tgacctttgtaccctcagcagaggacgtc

SEQ ID NO: 52085 - DNA, 28 bp, Artificial Sequence
  Description of Artificial Sequence: Synthetic oligonucleotide
gacctttgtaccctcagcagaggacgtc

SEQ ID NO: 52086 - DNA, 31 bp, Artificial Sequence
  Description of Artificial Sequence: Synthetic oligonucleotide
acctttgtaccctcagcagaggacgtctatg

SEQ ID NO: 52087 - DNA, 30 bp, Artificial Sequence
  Description of Artificial Sequence: Synthetic oligonucleotide
cctttgtaccctcagcagaggacgtctatg

SEQ ID NO: 52088 - DNA, 31 bp, Artificial Sequence
  Description of Artificial Sequence: Synthetic oligonucleotide
ctttgtaccctcagcagaggacgtctatgac

SEQ ID NO: 52089 - DNA, 32 bp, Artificial Sequence
  Description of Artificial Sequence: Synthetic oligonucleotide
tttgtaccctcagcagaggacgtctatgactg

SEQ ID NO: 52090 - DNA, 31 bp, Artificial Sequence
  Description of Artificial Sequence: Synthetic oligonucleotide
ttgtaccctcagcagaggacgtctatgactg

SEQ ID NO: 52091 - DNA, 30 bp, Artificial Sequence
  Description of Artificial Sequence: Synthetic oligonucleotide
tgtaccctcagcagaggacgtctatgactg

SEQ ID NO: 52092 - DNA, 29 bp, Artificial Sequence
  Description of Artificial Sequence: Synthetic oligonucleotide
gtaccctcagcagaggacgtctatgactg

SEQ ID NO: 52093 - DNA, 29 bp, Artificial Sequence
  Description of Artificial Sequence: Synthetic oligonucleotide
taccctcagcagaggacgtctatgactgc

SEQ ID NO: 52094 - DNA, 28 bp, Artificial Sequence
  Description of Artificial Sequence: Synthetic oligonucleotide
accctcagcagaggacgtctatgactgc

SEQ ID NO: 52095 - DNA, 35 bp, Artificial Sequence
  Description of Artificial Sequence: Synthetic oligonucleotide
cggaccatgtgtcaacttatgccatgtttgtacag

SEQ ID NO: 52096 - DNA, 36 bp, Artificial Sequence
  Description of Artificial Sequence: Synthetic oligonucleotide
ggaccatgtgtcaacttatgccatgtttgtacagac

SEQ ID NO: 52097 - DNA, 36 bp, Artificial Sequence
  Description of Artificial Sequence: Synthetic oligonucleotide
gaccatgtgtcaacttatgccatgtttgtacagacc

SEQ ID NO: 52098 - DNA, 36 bp, Artificial Sequence
  Description of Artificial Sequence: Synthetic oligonucleotide
accatgtgtcaacttatgccatgtttgtacagaccc

SEQ ID NO: 52099 - DNA, 35 bp, Artificial Sequence
  Description of Artificial Sequence: Synthetic oligonucleotide
ccatgtgtcaacttatgccatgtttgtacagaccc

SEQ ID NO: 52100 - DNA, 38 bp, Artificial Sequence
  Description of Artificial Sequence: Synthetic oligonucleotide
catgtgtcaacttatgccatgtttgtacagacccatag

SEQ ID NO: 52101 - DNA, 39 bp, Artificial Sequence
  Description of Artificial Sequence: Synthetic oligonucleotide
atgtgtcaacttatgccatgtttgtacagacccatagac

SEQ ID NO: 52102 - DNA, 38 bp, Artificial Sequence
  Description of Artificial Sequence: Synthetic oligonucleotide
tgtgtcaacttatgccatgtttgtacagacccatagac

SEQ ID NO: 52103 - DNA, 37 bp, Artificial Sequence
  Description of Artificial Sequence: Synthetic oligonucleotide
gtgtcaacttatgccatgtttgtacagacccatagac

SEQ ID NO: 52104 - DNA, 37 bp, Artificial Sequence
  Description of Artificial Sequence: Synthetic oligonucleotide
tgtcaacttatgccatgtttgtacagacccatagacc

SEQ ID NO: 52105 - DNA, 36 bp, Artificial Sequence
  Description of Artificial Sequence: Synthetic oligonucleotide
gtcaacttatgccatgtttgtacagacccatagacc

SEQ ID NO: 52106 - DNA, 38 bp, Artificial Sequence
  Description of Artificial Sequence: Synthetic oligonucleotide
tcaacttatgccatgtttgtacagacccatagaccaac

SEQ ID NO: 52107 - DNA, 37 bp, Artificial Sequence
  Description of Artificial Sequence: Synthetic oligonucleotide
caacttatgccatgtttgtacagacccatagaccaac

SEQ ID NO: 52108 - DNA, 25 bp, Artificial Sequence
  Description of Artificial Sequence: Synthetic oligonucleotide
cgccaatgatccccctgaggtgacg

SEQ ID NO: 52109 - DNA, 26 bp, Artificial Sequence
  Description of Artificial Sequence: Synthetic oligonucleotide
gccaatgatccccctgaggtgacggt

SEQ ID NO: 52110 - DNA, 27 bp, Artificial Sequence
  Description of Artificial Sequence: Synthetic oligonucleotide
ccaatgatccccctgaggtgacggtgt

SEQ ID NO: 52111 - DNA, 29 bp, Artificial Sequence
  Description of Artificial Sequence: Synthetic oligonucleotide
caatgatccccctgaggtgacggtgtttc

SEQ ID NO: 52112 - DNA, 29 bp, Artificial Sequence
  Description of Artificial Sequence: Synthetic oligonucleotide
aatgatccccctgaggtgacggtgtttcc

SEQ ID NO: 52113 - DNA, 28 bp, Artificial Sequence
  Description of Artificial Sequence: Synthetic oligonucleotide
atgatccccctgaggtgacggtgtttcc

SEQ ID NO: 52114 - DNA, 27 bp, Artificial Sequence
  Description of Artificial Sequence: Synthetic oligonucleotide
tgatccccctgaggtgacggtgtttcc

SEQ ID NO: 52115 - DNA, 26 bp, Artificial Sequence
  Description of Artificial Sequence: Synthetic oligonucleotide
gatccccctgaggtgacggtgtttcc

SEQ ID NO: 52116 - DNA, 27 bp, Artificial Sequence
  Description of Artificial Sequence: Synthetic oligonucleotide
atccccctgaggtgacggtgtttccca

SEQ ID NO: 52117 - DNA, 27 bp, Artificial Sequence
  Description of Artificial Sequence: Synthetic oligonucleotide
tccccctgaggtgacggtgtttcccaa

SEQ ID NO: 52118 - DNA, 26 bp, Artificial Sequence
  Description of Artificial Sequence: Synthetic oligonucleotide
ccccctgaggtgacggtgtttcccaa

SEQ ID NO: 52119 - DNA, 26 bp, Artificial Sequence
  Description of Artificial Sequence: Synthetic oligonucleotide
cccctgaggtgacggtgtttcccaag

SEQ ID NO: 52120 - DNA, 27 bp, Artificial Sequence
  Description of Artificial Sequence: Synthetic oligonucleotide
ccctgaggtgacggtgtttcccaagga

SEQ ID NO: 52121 - DNA, 27 bp, Artificial Sequence
  Description of Artificial Sequence: Synthetic oligonucleotide
cctgaggtgacggtgtttcccaaggag

SEQ ID NO: 52122 - DNA, 27 bp, Artificial Sequence
  Description of Artificial Sequence: Synthetic oligonucleotide
ctgaggtgacggtgtttcccaaggagc

SEQ ID NO: 52123 - DNA, 27 bp, Artificial Sequence
  Description of Artificial Sequence: Synthetic oligonucleotide
tgaggtgacggtgtttcccaaggagcc

SEQ ID NO: 52124 - DNA, 27 bp, Artificial Sequence
  Description of Artificial Sequence: Synthetic oligonucleotide
gaggtgacggtgtttcccaaggagcct

SEQ ID NO: 52125 - DNA, 27 bp, Artificial Sequence
  Description of Artificial Sequence: Synthetic oligonucleotide
aggtgacggtgtttcccaaggagcctg

SEQ ID NO: 52126 - DNA, 27 bp, Artificial Sequence
  Description of Artificial Sequence: Synthetic oligonucleotide
ggtgacggtgtttcccaaggagcctgt

SEQ ID NO: 52127 - DNA, 27 bp, Artificial Sequence
  Description of Artificial Sequence: Synthetic oligonucleotide
gtgacggtgtttcccaaggagcctgtg

SEQ ID NO: 52128 - DNA, 27 bp, Artificial Sequence
  Description of Artificial Sequence: Synthetic oligonucleotide
tgacggtgtttcccaaggagcctgtgg

SEQ ID NO: 52129 - DNA, 27 bp, Artificial Sequence
  Description of Artificial Sequence: Synthetic oligonucleotide
gacggtgtttcccaaggagcctgtgga

SEQ ID NO: 52130 - DNA, 27 bp, Artificial Sequence
  Description of Artificial Sequence: Synthetic oligonucleotide
acggtgtttcccaaggagcctgtggag

SEQ ID NO: 52131 - DNA, 26 bp, Artificial Sequence
  Description of Artificial Sequence: Synthetic oligonucleotide
cggtgtttcccaaggagcctgtggag

SEQ ID NO: 52132 - DNA, 27 bp, Artificial Sequence
  Description of Artificial Sequence: Synthetic oligonucleotide
ggtgtttcccaaggagcctgtggagct

SEQ ID NO: 52133 - DNA, 33 bp, Artificial Sequence
  Description of Artificial Sequence: Synthetic oligonucleotide
acattgacaggttcttcccaccagtgctcaatg

SEQ ID NO: 52134 - DNA, 32 bp, Artificial Sequence
  Description of Artificial Sequence: Synthetic oligonucleotide
cattgacaggttcttcccaccagtgctcaatg

SEQ ID NO: 52135 - DNA, 33 bp, Artificial Sequence
  Description of Artificial Sequence: Synthetic oligonucleotide
attgacaggttcttcccaccagtgctcaatgtc

SEQ ID NO: 52136 - DNA, 32 bp, Artificial Sequence
  Description of Artificial Sequence: Synthetic oligonucleotide
ttgacaggttcttcccaccagtgctcaatgtc

SEQ ID NO: 52137 - DNA, 31 bp, Artificial Sequence
  Description of Artificial Sequence: Synthetic oligonucleotide
tgacaggttcttcccaccagtgctcaatgtc

SEQ ID NO: 52138 - DNA, 30 bp, Artificial Sequence
  Description of Artificial Sequence: Synthetic oligonucleotide
gacaggttcttcccaccagtgctcaatgtc

SEQ ID NO: 52139 - DNA, 31 bp, Artificial Sequence
  Description of Artificial Sequence: Synthetic oligonucleotide
acaggttcttcccaccagtgctcaatgtcac

SEQ ID NO: 52140 - DNA, 30 bp, Artificial Sequence
  Description of Artificial Sequence: Synthetic oligonucleotide
caggttcttcccaccagtgctcaatgtcac

SEQ ID NO: 52141 - DNA, 32 bp, Artificial Sequence
  Description of Artificial Sequence: Synthetic oligonucleotide
aggttcttcccaccagtgctcaatgtcacatg

SEQ ID NO: 52142 - DNA, 31 bp, Artificial Sequence
  Description of Artificial Sequence: Synthetic oligonucleotide
ggttcttcccaccagtgctcaatgtcacatg

SEQ ID NO: 52143 - DNA, 31 bp, Artificial Sequence
  Description of Artificial Sequence: Synthetic oligonucleotide
gttcttcccaccagtgctcaatgtcacatgg

SEQ ID NO: 52144 - DNA, 31 bp, Artificial Sequence
  Description of Artificial Sequence: Synthetic oligonucleotide
ttcttcccaccagtgctcaatgtcacatggc

SEQ ID NO: 52145 - DNA, 30 bp, Artificial Sequence
  Description of Artificial Sequence: Synthetic oligonucleotide
tcttcccaccagtgctcaatgtcacatggc

SEQ ID NO: 52146 - DNA, 29 bp, Artificial Sequence
  Description of Artificial Sequence: Synthetic oligonucleotide
cttcccaccagtgctcaatgtcacatggc

SEQ ID NO: 52147 - DNA, 30 bp, Artificial Sequence
  Description of Artificial Sequence: Synthetic oligonucleotide
ttcccaccagtgctcaatgtcacatggctg

SEQ ID NO: 52148 - DNA, 29 bp, Artificial Sequence
  Description of Artificial Sequence: Synthetic oligonucleotide
tcccaccagtgctcaatgtcacatggctg

SEQ ID NO: 52149 - DNA, 28 bp, Artificial Sequence
  Description of Artificial Sequence: Synthetic oligonucleotide
cccaccagtgctcaatgtcacatggctg

SEQ ID NO: 52150 - DNA, 29 bp, Artificial Sequence
  Description of Artificial Sequence: Synthetic oligonucleotide
ccaccagtgctcaatgtcacatggctgtg

SEQ ID NO: 52151 - DNA, 29 bp, Artificial Sequence
  Description of Artificial Sequence: Synthetic oligonucleotide
caccagtgctcaatgtcacatggctgtgc

SEQ ID NO: 52152 - DNA, 32 bp, Artificial Sequence
  Description of Artificial Sequence: Synthetic oligonucleotide
accagtgctcaatgtcacatggctgtgcaatg

SEQ ID NO: 52153 - DNA, 31 bp, Artificial Sequence
  Description of Artificial Sequence: Synthetic oligonucleotide
ccagtgctcaatgtcacatggctgtgcaatg

SEQ ID NO: 52154 - DNA, 31 bp, Artificial Sequence
  Description of Artificial Sequence: Synthetic oligonucleotide
cagtgctcaatgtcacatggctgtgcaatgg

SEQ ID NO: 52155 - DNA, 31 bp, Artificial Sequence
  Description of Artificial Sequence: Synthetic oligonucleotide
agtgctcaatgtcacatggctgtgcaatggg

SEQ ID NO: 52156 - DNA, 30 bp, Artificial Sequence
  Description of Artificial Sequence: Synthetic oligonucleotide
gtgctcaatgtcacatggctgtgcaatggg

SEQ ID NO: 52157 - DNA, 30 bp, Artificial Sequence
  Description of Artificial Sequence: Synthetic oligonucleotide
tgctcaatgtcacatggctgtgcaatgggg

SEQ ID NO: 52158 - DNA, 29 bp, Artificial Sequence
  Description of Artificial Sequence: Synthetic oligonucleotide
gctcaatgtcacatggctgtgcaatgggg

SEQ ID NO: 52159 - DNA, 30 bp, Artificial Sequence
  Description of Artificial Sequence: Synthetic oligonucleotide
ctcaatgtcacatggctgtgcaatggggag

SEQ ID NO: 52160 - DNA, 30 bp, Artificial Sequence
  Description of Artificial Sequence: Synthetic oligonucleotide
tcaatgtcacatggctgtgcaatggggagc

SEQ ID NO: 52161 - DNA, 29 bp, Artificial Sequence
  Description of Artificial Sequence: Synthetic oligonucleotide
caatgtcacatggctgtgcaatggggagc

SEQ ID NO: 52162 - DNA, 29 bp, Artificial Sequence
  Description of Artificial Sequence: Synthetic oligonucleotide
aatgtcacatggctgtgcaatggggagcc

SEQ ID NO: 52163 - DNA, 28 bp, Artificial Sequence
  Description of Artificial Sequence: Synthetic oligonucleotide
atgtcacatggctgtgcaatggggagcc

SEQ ID NO: 52164 - DNA, 27 bp, Artificial Sequence
  Description of Artificial Sequence: Synthetic oligonucleotide
tgtcacatggctgtgcaatggggagcc

SEQ ID NO: 52165 - DNA, 26 bp, Artificial Sequence
  Description of Artificial Sequence: Synthetic oligonucleotide
gtcacatggctgtgcaatggggagcc

SEQ ID NO: 52166 - DNA, 26 bp, Artificial Sequence
  Description of Artificial Sequence: Synthetic oligonucleotide
tcacatggctgtgcaatggggagccg

SEQ ID NO: 52167 - DNA, 25 bp, Artificial Sequence
  Description of Artificial Sequence: Synthetic oligonucleotide
cacatggctgtgcaatggggagccg

SEQ ID NO: 52168 - DNA, 26 bp, Artificial Sequence
  Description of Artificial Sequence: Synthetic oligonucleotide
acatggctgtgcaatggggagccggt

SEQ ID NO: 52169 - DNA, 25 bp, Artificial Sequence
  Description of Artificial Sequence: Synthetic oligonucleotide
catggctgtgcaatggggagccggt

SEQ ID NO: 52170 - DNA, 26 bp, Artificial Sequence
  Description of Artificial Sequence: Synthetic oligonucleotide
atggctgtgcaatggggagccggtca

SEQ ID NO: 52171 - DNA, 25 bp, Artificial Sequence
  Description of Artificial Sequence: Synthetic oligonucleotide
tggctgtgcaatggggagccggtca

SEQ ID NO: 52172 - DNA, 24 bp, Artificial Sequence
  Description of Artificial Sequence: Synthetic oligonucleotide
ggctgtgcaatggggagccggtca

SEQ ID NO: 52173 - DNA, 25 bp, Artificial Sequence
  Description of Artificial Sequence: Synthetic oligonucleotide
gctgtgcaatggggagccggtcact

SEQ ID NO: 52174 - DNA, 26 bp, Artificial Sequence
  Description of Artificial Sequence: Synthetic oligonucleotide
ctgtgcaatggggagccggtcactga

SEQ ID NO: 52175 - DNA, 26 bp, Artificial Sequence
  Description of Artificial Sequence: Synthetic oligonucleotide
tgtgcaatggggagccggtcactgag

SEQ ID NO: 52176 - DNA, 25 bp, Artificial Sequence
  Description of Artificial Sequence: Synthetic oligonucleotide
gtgcaatggggagccggtcactgag

SEQ ID NO: 52177 - DNA, 25 bp, Artificial Sequence
  Description of Artificial Sequence: Synthetic oligonucleotide
tgcaatggggagccggtcactgagg

SEQ ID NO: 52178 - DNA, 24 bp, Artificial Sequence
  Description of Artificial Sequence: Synthetic oligonucleotide
gcaatggggagccggtcactgagg

SEQ ID NO: 52179 - DNA, 25 bp, Artificial Sequence
  Description of Artificial Sequence: Synthetic oligonucleotide
caatggggagccggtcactgagggt

SEQ ID NO: 52180 - DNA, 26 bp, Artificial Sequence
  Description of Artificial Sequence: Synthetic oligonucleotide
aatggggagccggtcactgagggtgt

SEQ ID NO: 52181 - DNA, 25 bp, Artificial Sequence
  Description of Artificial Sequence: Synthetic oligonucleotide
atggggagccggtcactgagggtgt

SEQ ID NO: 52182 - DNA, 24 bp, Artificial Sequence
  Description of Artificial Sequence: Synthetic oligonucleotide
tggggagccggtcactgagggtgt

SEQ ID NO: 52183 - DNA, 23 bp, Artificial Sequence
  Description of Artificial Sequence: Synthetic oligonucleotide
ggggagccggtcactgagggtgt

SEQ ID NO: 52184 - DNA, 23 bp, Artificial Sequence
  Description of Artificial Sequence: Synthetic oligonucleotide
gggagccggtcactgagggtgtc

SEQ ID NO: 52185 - DNA, 23 bp, Artificial Sequence
  Description of Artificial Sequence: Synthetic oligonucleotide
ggagccggtcactgagggtgtcg

SEQ ID NO: 52186 - DNA, 24 bp, Artificial Sequence
  Description of Artificial Sequence: Synthetic oligonucleotide
gagccggtcactgagggtgtcgct

SEQ ID NO: 52187 - DNA, 25 bp, Artificial Sequence
  Description of Artificial Sequence: Synthetic oligonucleotide
agccggtcactgagggtgtcgctga

SEQ ID NO: 52188 - DNA, 24 bp, Artificial Sequence
  Description of Artificial Sequence: Synthetic oligonucleotide
gccggtcactgagggtgtcgctga

SEQ ID NO: 52189 - DNA, 25 bp, Artificial Sequence
  Description of Artificial Sequence: Synthetic oligonucleotide
ccggtcactgagggtgtcgctgaga

SEQ ID NO: 52190 - DNA, 25 bp, Artificial Sequence
  Description of Artificial Sequence: Synthetic oligonucleotide
cggtcactgagggtgtcgctgagag

SEQ ID NO: 52191 - DNA, 32 bp, Artificial Sequence
  Description of Artificial Sequence: Synthetic oligonucleotide
ccatgtttgtacagacccatagaccaacaggg

SEQ ID NO: 52192 - DNA, 32 bp, Artificial Sequence
  Description of Artificial Sequence: Synthetic oligonucleotide
catgtttgtacagacccatagaccaacagggg

SEQ ID NO: 52193 - DNA, 33 bp, Artificial Sequence
  Description of Artificial Sequence: Synthetic oligonucleotide
atgtttgtacagacccatagaccaacaggggag

SEQ ID NO: 52194 - DNA, 32 bp, Artificial Sequence
  Description of Artificial Sequence: Synthetic oligonucleotide
tgtttgtacagacccatagaccaacaggggag

SEQ ID NO: 52195 - DNA, 33 bp, Artificial Sequence
  Description of Artificial Sequence: Synthetic oligonucleotide
gcgggctggctaacattgctatattgaacaacg

SEQ ID NO: 52196 - DNA, 34 bp, Artificial Sequence
  Description of Artificial Sequence: Synthetic oligonucleotide
cgggctggctaacattgctatattgaacaacgac

SEQ ID NO: 52197 - DNA, 36 bp, Artificial Sequence
  Description of Artificial Sequence: Synthetic oligonucleotide
gggctggctaacattgctatattgaacaacgacttg

SEQ ID NO: 52198 - DNA, 40 bp, Artificial Sequence
  Description of Artificial Sequence: Synthetic oligonucleotide
ggctggctaacattgctatattgaacaacgacttgaatac

SEQ ID NO: 52199 - DNA, 40 bp, Artificial Sequence
  Description of Artificial Sequence: Synthetic oligonucleotide
gctggctaacattgctatattgaacaacgacttgaatacc

SEQ ID NO: 52200 - DNA, 42 bp, Artificial Sequence
  Description of Artificial Sequence: Synthetic oligonucleotide
ctggctaacattgctatattgaacaacgacttgaataccttg

SEQ ID NO: 52201 - DNA, 44 bp, Artificial Sequence
  Description of Artificial Sequence: Synthetic oligonucleotide
tggctaacattgctatattgaacaacgacttgaataccttgatc

SEQ ID NO: 52202 - DNA, 43 bp, Artificial Sequence
  Description of Artificial Sequence: Synthetic oligonucleotide
ggctaacattgctatattgaacaacgacttgaataccttgatc

SEQ ID NO: 52203 - DNA, 43 bp, Artificial Sequence
  Description of Artificial Sequence: Synthetic oligonucleotide
gctaacattgctatattgaacaacgacttgaataccttgatcc

SEQ ID NO: 52204 - DNA, 44 bp, Artificial Sequence
  Description of Artificial Sequence: Synthetic oligonucleotide
ctaacattgctatattgaacaacgacttgaataccttgatccag

SEQ ID NO: 52205 - DNA, 44 bp, Artificial Sequence
  Description of Artificial Sequence: Synthetic oligonucleotide
taacattgctatattgaacaacgacttgaataccttgatccagc

SEQ ID NO: 52206 - DNA, 43 bp, Artificial Sequence
  Description of Artificial Sequence: Synthetic oligonucleotide
aacattgctatattgaacaacgacttgaataccttgatccagc

SEQ ID NO: 52207 - DNA, 42 bp, Artificial Sequence
  Description of Artificial Sequence: Synthetic oligonucleotide
acattgctatattgaacaacgacttgaataccttgatccagc

SEQ ID NO: 52208 - DNA, 41 bp, Artificial Sequence
  Description of Artificial Sequence: Synthetic oligonucleotide
cattgctatattgaacaacgacttgaataccttgatccagc

SEQ ID NO: 52209 - DNA, 41 bp, Artificial Sequence
  Description of Artificial Sequence: Synthetic oligonucleotide
attgctatattgaacaacgacttgaataccttgatccagcg

SEQ ID NO: 52210 - DNA, 40 bp, Artificial Sequence
  Description of Artificial Sequence: Synthetic oligonucleotide
ttgctatattgaacaacgacttgaataccttgatccagcg

SEQ ID NO: 52211 - DNA, 39 bp, Artificial Sequence
  Description of Artificial Sequence: Synthetic oligonucleotide
tgctatattgaacaacgacttgaataccttgatccagcg

SEQ ID NO: 52212 - DNA, 38 bp, Artificial Sequence
  Description of Artificial Sequence: Synthetic oligonucleotide
gctatattgaacaacgacttgaataccttgatccagcg

SEQ ID NO: 52213 - DNA, 40 bp, Artificial Sequence
  Description of Artificial Sequence: Synthetic oligonucleotide
ctatattgaacaacgacttgaataccttgatccagcgttc

SEQ ID NO: 52214 - DNA, 40 bp, Artificial Sequence
  Description of Artificial Sequence: Synthetic oligonucleotide
tatattgaacaacgacttgaataccttgatccagcgttcc

SEQ ID NO: 52215 - DNA, 39 bp, Artificial Sequence
  Description of Artificial Sequence: Synthetic oligonucleotide
atattgaacaacgacttgaataccttgatccagcgttcc

SEQ ID NO: 52216 - DNA, 38 bp, Artificial Sequence
  Description of Artificial Sequence: Synthetic oligonucleotide
tattgaacaacgacttgaataccttgatccagcgttcc

SEQ ID NO: 52217 - DNA, 37 bp, Artificial Sequence
  Description of Artificial Sequence: Synthetic oligonucleotide
attgaacaacgacttgaataccttgatccagcgttcc

SEQ ID NO: 52218 - DNA, 36 bp, Artificial Sequence
  Description of Artificial Sequence: Synthetic oligonucleotide
ttgaacaacgacttgaataccttgatccagcgttcc

SEQ ID NO: 52219 - DNA, 35 bp, Artificial Sequence
  Description of Artificial Sequence: Synthetic oligonucleotide
tgaacaacgacttgaataccttgatccagcgttcc

SEQ ID NO: 52220 - DNA, 34 bp, Artificial Sequence
  Description of Artificial Sequence: Synthetic oligonucleotide
gaacaacgacttgaataccttgatccagcgttcc

SEQ ID NO: 52221 - DNA, 36 bp, Artificial Sequence
  Description of Artificial Sequence: Synthetic oligonucleotide
aacaacgacttgaataccttgatccagcgttccaac

SEQ ID NO: 52222 - DNA, 35 bp, Artificial Sequence
  Description of Artificial Sequence: Synthetic oligonucleotide
acaacgacttgaataccttgatccagcgttccaac

SEQ ID NO: 52223 - DNA, 34 bp, Artificial Sequence
  Description of Artificial Sequence: Synthetic oligonucleotide
caacgacttgaataccttgatccagcgttccaac

SEQ ID NO: 52224 - DNA, 34 bp, Artificial Sequence
  Description of Artificial Sequence: Synthetic oligonucleotide
aacgacttgaataccttgatccagcgttccaacc

SEQ ID NO: 52225 - DNA, 33 bp, Artificial Sequence
  Description of Artificial Sequence: Synthetic oligonucleotide
acgacttgaataccttgatccagcgttccaacc

SEQ ID NO: 52226 - DNA, 32 bp, Artificial Sequence
  Description of Artificial Sequence: Synthetic oligonucleotide
cgacttgaataccttgatccagcgttccaacc

SEQ ID NO: 52227 - DNA, 33 bp, Artificial Sequence
  Description of Artificial Sequence: Synthetic oligonucleotide
gacttgaataccttgatccagcgttccaaccac

SEQ ID NO: 52228 - DNA, 30 bp, Artificial Sequence
  Description of Artificial Sequence: Synthetic oligonucleotide
tcagggcgggctggctaacattgctatatc

SEQ ID NO: 52229 - DNA, 29 bp, Artificial Sequence
  Description of Artificial Sequence: Synthetic oligonucleotide
cagggcgggctggctaacattgctatatc

SEQ ID NO: 52230 - DNA, 29 bp, Artificial Sequence
  Description of Artificial Sequence: Synthetic oligonucleotide
agggcgggctggctaacattgctatatcg

SEQ ID NO: 52231 - DNA, 28 bp, Artificial Sequence
  Description of Artificial Sequence: Synthetic oligonucleotide
gggcgggctggctaacattgctatatcg

SEQ ID NO: 52232 - DNA, 30 bp, Artificial Sequence
  Description of Artificial Sequence: Synthetic oligonucleotide
ggcgggctggctaacattgctatatcgaac

SEQ ID NO: 52233 - DNA, 32 bp, Artificial Sequence
  Description of Artificial Sequence: Synthetic oligonucleotide
gcgggctggctaacattgctatatcgaacaac

SEQ ID NO: 52234 - DNA, 34 bp, Artificial Sequence
  Description of Artificial Sequence: Synthetic oligonucleotide
cgggctggctaacattgctatatcgaacaacaac

SEQ ID NO: 52235 - DNA, 36 bp, Artificial Sequence
  Description of Artificial Sequence: Synthetic oligonucleotide
gggctggctaacattgctatatcgaacaacaacttg

SEQ ID NO: 52236 - DNA, 40 bp, Artificial Sequence
  Description of Artificial Sequence: Synthetic oligonucleotide
ggctggctaacattgctatatcgaacaacaacttgaatac

SEQ ID NO: 52237 - DNA, 40 bp, Artificial Sequence
  Description of Artificial Sequence: Synthetic oligonucleotide
gctggctaacattgctatatcgaacaacaacttgaatacc

SEQ ID NO: 52238 - DNA, 42 bp, Artificial Sequence
  Description of Artificial Sequence: Synthetic oligonucleotide
ctggctaacattgctatatcgaacaacaacttgaataccttg

SEQ ID NO: 52239 - DNA, 44 bp, Artificial Sequence
  Description of Artificial Sequence: Synthetic oligonucleotide
tggctaacattgctatatcgaacaacaacttgaataccttgatc

SEQ ID NO: 52240 - DNA, 43 bp, Artificial Sequence
  Description of Artificial Sequence: Synthetic oligonucleotide
ggctaacattgctatatcgaacaacaacttgaataccttgatc

SEQ ID NO: 52241 - DNA, 43 bp, Artificial Sequence
  Description of Artificial Sequence: Synthetic oligonucleotide
gctaacattgctatatcgaacaacaacttgaataccttgatcc

SEQ ID NO: 52242 - DNA, 44 bp, Artificial Sequence
  Description of Artificial Sequence: Synthetic oligonucleotide
ctaacattgctatatcgaacaacaacttgaataccttgatccag

SEQ ID NO: 52243 - DNA, 44 bp, Artificial Sequence
  Description of Artificial Sequence: Synthetic oligonucleotide
taacattgctatatcgaacaacaacttgaataccttgatccagc

SEQ ID NO: 52244 - DNA, 43 bp, Artificial Sequence
  Description of Artificial Sequence: Synthetic oligonucleotide
aacattgctatatcgaacaacaacttgaataccttgatccagc

SEQ ID NO: 52245 - DNA, 42 bp, Artificial Sequence
  Description of Artificial Sequence: Synthetic oligonucleotide
acattgctatatcgaacaacaacttgaataccttgatccagc

SEQ ID NO: 52246 - DNA, 41 bp, Artificial Sequence
  Description of Artificial Sequence: Synthetic oligonucleotide
cattgctatatcgaacaacaacttgaataccttgatccagc

SEQ ID NO: 52247 - DNA, 41 bp, Artificial Sequence
  Description of Artificial Sequence: Synthetic oligonucleotide
attgctatatcgaacaacaacttgaataccttgatccagcg

SEQ ID NO: 52248 - DNA, 40 bp, Artificial Sequence
  Description of Artificial Sequence: Synthetic oligonucleotide
ttgctatatcgaacaacaacttgaataccttgatccagcg

SEQ ID NO: 52249 - DNA, 39 bp, Artificial Sequence
  Description of Artificial Sequence: Synthetic oligonucleotide
tgctatatcgaacaacaacttgaataccttgatccagcg

SEQ ID NO: 52250 - DNA, 38 bp, Artificial Sequence
  Description of Artificial Sequence: Synthetic oligonucleotide
gctatatcgaacaacaacttgaataccttgatccagcg

SEQ ID NO: 52251 - DNA, 40 bp, Artificial Sequence
  Description of Artificial Sequence: Synthetic oligonucleotide
ctatatcgaacaacaacttgaataccttgatccagcgttc

SEQ ID NO: 52252 - DNA, 40 bp, Artificial Sequence
  Description of Artificial Sequence: Synthetic oligonucleotide
tatatcgaacaacaacttgaataccttgatccagcgttcc

SEQ ID NO: 52253 - DNA, 39 bp, Artificial Sequence
  Description of Artificial Sequence: Synthetic oligonucleotide
atatcgaacaacaacttgaataccttgatccagcgttcc

SEQ ID NO: 52254 - DNA, 38 bp, Artificial Sequence
  Description of Artificial Sequence: Synthetic oligonucleotide
tatcgaacaacaacttgaataccttgatccagcgttcc

SEQ ID NO: 52255 - DNA, 37 bp, Artificial Sequence
  Description of Artificial Sequence: Synthetic oligonucleotide
atcgaacaacaacttgaataccttgatccagcgttcc

SEQ ID NO: 52256 - DNA, 36 bp, Artificial Sequence
  Description of Artificial Sequence: Synthetic oligonucleotide
tcgaacaacaacttgaataccttgatccagcgttcc

SEQ ID NO: 52257 - DNA, 35 bp, Artificial Sequence
  Description of Artificial Sequence: Synthetic oligonucleotide
cgaacaacaacttgaataccttgatccagcgttcc

SEQ ID NO: 52258 - DNA, 40 bp, Artificial Sequence
  Description of Artificial Sequence: Synthetic oligonucleotide
ccatagaccaacaggggagtttatgtttgaatttgatgac

SEQ ID NO: 52259 - DNA, 31 bp, Artificial Sequence
  Description of Artificial Sequence: Synthetic oligonucleotide
gccgcgtttgtacagacgcatagaacaacag

SEQ ID NO: 52260 - DNA, 31 bp, Artificial Sequence
  Description of Artificial Sequence: Synthetic oligonucleotide
ccgcgtttgtacagacgcatagaacaacagg

SEQ ID NO: 52261 - DNA, 32 bp, Artificial Sequence
  Description of Artificial Sequence: Synthetic oligonucleotide
cgcgtttgtacagacgcatagaacaacaggag

SEQ ID NO: 52262 - DNA, 33 bp, Artificial Sequence
  Description of Artificial Sequence: Synthetic oligonucleotide
gcgtttgtacagacgcatagaacaacaggagag

SEQ ID NO: 52263 - DNA, 38 bp, Artificial Sequence
  Description of Artificial Sequence: Synthetic oligonucleotide
cgtttgtacagacgcatagaacaacaggagagtttatg

SEQ ID NO: 52264 - DNA, 41 bp, Artificial Sequence
  Description of Artificial Sequence: Synthetic oligonucleotide
gtttgtacagacgcatagaacaacaggagagtttatgtttg

SEQ ID NO: 52265 - DNA, 42 bp, Artificial Sequence
  Description of Artificial Sequence: Synthetic oligonucleotide
tttgtacagacgcatagaacaacaggagagtttatgtttgag

SEQ ID NO: 52266 - DNA, 41 bp, Artificial Sequence
  Description of Artificial Sequence: Synthetic oligonucleotide
ttgtacagacgcatagaacaacaggagagtttatgtttgag

SEQ ID NO: 52267 - DNA, 40 bp, Artificial Sequence
  Description of Artificial Sequence: Synthetic oligonucleotide
tgtacagacgcatagaacaacaggagagtttatgtttgag

SEQ ID NO: 52268 - DNA, 39 bp, Artificial Sequence
  Description of Artificial Sequence: Synthetic oligonucleotide
gtacagacgcatagaacaacaggagagtttatgtttgag

SEQ ID NO: 52269 - DNA, 42 bp, Artificial Sequence
  Description of Artificial Sequence: Synthetic oligonucleotide
tacagacgcatagaacaacaggagagtttatgtttgagtttg

SEQ ID NO: 52270 - DNA, 41 bp, Artificial Sequence
  Description of Artificial Sequence: Synthetic oligonucleotide
acagacgcatagaacaacaggagagtttatgtttgagtttg

SEQ ID NO: 52271 - DNA, 40 bp, Artificial Sequence
  Description of Artificial Sequence: Synthetic oligonucleotide
cagacgcatagaacaacaggagagtttatgtttgagtttg

SEQ ID NO: 52272 - DNA, 42 bp, Artificial Sequence
  Description of Artificial Sequence: Synthetic oligonucleotide
agacgcatagaacaacaggagagtttatgtttgagtttgatg

SEQ ID NO: 52273 - DNA, 41 bp, Artificial Sequence
  Description of Artificial Sequence: Synthetic oligonucleotide
gacgcatagaacaacaggagagtttatgtttgagtttgatg

SEQ ID NO: 52274 - DNA, 43 bp, Artificial Sequence
  Description of Artificial Sequence: Synthetic oligonucleotide
acgcatagaacaacaggagagtttatgtttgagtttgatgatg

SEQ ID NO: 52275 - DNA, 42 bp, Artificial Sequence
  Description of Artificial Sequence: Synthetic oligonucleotide
cgcatagaacaacaggagagtttatgtttgagtttgatgatg

SEQ ID NO: 52276 - DNA, 44 bp, Artificial Sequence
  Description of Artificial Sequence: Synthetic oligonucleotide
gcatagaacaacaggagagtttatgtttgagtttgatgatgatg

SEQ ID NO: 52277 - DNA, 45 bp, Artificial Sequence
  Description of Artificial Sequence: Synthetic oligonucleotide
catagaacaacaggagagtttatgtttgagtttgatgatgatgag

SEQ ID NO: 52278 - DNA, 47 bp, Artificial Sequence
  Description of Artificial Sequence: Synthetic oligonucleotide
atagaacaacaggagagtttatgtttgagtttgatgatgatgagatg

SEQ ID NO: 52279 - DNA, 46 bp, Artificial Sequence
  Description of Artificial Sequence: Synthetic oligonucleotide
tagaacaacaggagagtttatgtttgagtttgatgatgatgagatg

SEQ ID NO: 52280 - DNA, 45 bp, Artificial Sequence
  Description of Artificial Sequence: Synthetic oligonucleotide
agaacaacaggagagtttatgtttgagtttgatgatgatgagatg

SEQ ID NO: 52281 - DNA, 44 bp, Artificial Sequence
  Description of Artificial Sequence: Synthetic oligonucleotide
gaacaacaggagagtttatgtttgagtttgatgatgatgagatg

SEQ ID NO: 52282 - DNA, 46 bp, Artificial Sequence
  Description of Artificial Sequence: Synthetic oligonucleotide
aacaacaggagagtttatgtttgagtttgatgatgatgagatgttc

SEQ ID NO: 52283 - DNA, 45 bp, Artificial Sequence
  Description of Artificial Sequence: Synthetic oligonucleotide
acaacaggagagtttatgtttgagtttgatgatgatgagatgttc

SEQ ID NO: 52284 - DNA, 44 bp, Artificial Sequence
  Description of Artificial Sequence: Synthetic oligonucleotide
caacaggagagtttatgtttgagtttgatgatgatgagatgttc

SEQ ID NO: 52285 - DNA, 47 bp, Artificial Sequence
  Description of Artificial Sequence: Synthetic oligonucleotide
aacaggagagtttatgtttgagtttgatgatgatgagatgttctatg

SEQ ID NO: 52286 - DNA, 46 bp, Artificial Sequence
  Description of Artificial Sequence: Synthetic oligonucleotide
acaggagagtttatgtttgagtttgatgatgatgagatgttctatg

SEQ ID NO: 52287 - DNA, 45 bp, Artificial Sequence
  Description of Artificial Sequence: Synthetic oligonucleotide
caggagagtttatgtttgagtttgatgatgatgagatgttctatg

SEQ ID NO: 52288 - DNA, 46 bp, Artificial Sequence
  Description of Artificial Sequence: Synthetic oligonucleotide
aggagagtttatgtttgagtttgatgatgatgagatgttctatgtg

SEQ ID NO: 52289 - DNA, 45 bp, Artificial Sequence
  Description of Artificial Sequence: Synthetic oligonucleotide
ggagagtttatgtttgagtttgatgatgatgagatgttctatgtg

SEQ ID NO: 52290 - DNA, 45 bp, Artificial Sequence
  Description of Artificial Sequence: Synthetic oligonucleotide
gagagtttatgtttgagtttgatgatgatgagatgttctatgtgg

SEQ ID NO: 52291 - DNA, 47 bp, Artificial Sequence
  Description of Artificial Sequence: Synthetic oligonucleotide
agagtttatgtttgagtttgatgatgatgagatgttctatgtggatc

SEQ ID NO: 52292 - DNA, 46 bp, Artificial Sequence
  Description of Artificial Sequence: Synthetic oligonucleotide
gagtttatgtttgagtttgatgatgatgagatgttctatgtggatc

SEQ ID NO: 52293 - DNA, 47 bp, Artificial Sequence
  Description of Artificial Sequence: Synthetic oligonucleotide
agtttatgtttgagtttgatgatgatgagatgttctatgtggatctg

SEQ ID NO: 52294 - DNA, 46 bp, Artificial Sequence
  Description of Artificial Sequence: Synthetic oligonucleotide
gtttatgtttgagtttgatgatgatgagatgttctatgtggatctg

SEQ ID NO: 52295 - DNA, 46 bp, Artificial Sequence
  Description of Artificial Sequence: Synthetic oligonucleotide
tttatgtttgagtttgatgatgatgagatgttctatgtggatctgg

SEQ ID NO: 52296 - DNA, 45 bp, Artificial Sequence
  Description of Artificial Sequence: Synthetic oligonucleotide
ttatgtttgagtttgatgatgatgagatgttctatgtggatctgg

SEQ ID NO: 52297 - DNA, 44 bp, Artificial Sequence
  Description of Artificial Sequence: Synthetic oligonucleotide
tatgtttgagtttgatgatgatgagatgttctatgtggatctgg

SEQ ID NO: 52298 - DNA, 43 bp, Artificial Sequence
  Description of Artificial Sequence: Synthetic oligonucleotide
atgtttgagtttgatgatgatgagatgttctatgtggatctgg

SEQ ID NO: 52299 - DNA, 42 bp, Artificial Sequence
  Description of Artificial Sequence: Synthetic oligonucleotide
tgtttgagtttgatgatgatgagatgttctatgtggatctgg

SEQ ID NO: 52300 - DNA, 41 bp, Artificial Sequence
  Description of Artificial Sequence: Synthetic oligonucleotide
gtttgagtttgatgatgatgagatgttctatgtggatctgg

SEQ ID NO: 52301 - DNA, 42 bp, Artificial Sequence
  Description of Artificial Sequence: Synthetic oligonucleotide
tttgagtttgatgatgatgagatgttctatgtggatctggac

SEQ ID NO: 52302 - DNA, 41 bp, Artificial Sequence
  Description of Artificial Sequence: Synthetic oligonucleotide
ttgagtttgatgatgatgagatgttctatgtggatctggac

SEQ ID NO: 52303 - DNA, 40 bp, Artificial Sequence
  Description of Artificial Sequence: Synthetic oligonucleotide
tgagtttgatgatgatgagatgttctatgtggatctggac

SEQ ID NO: 52304 - DNA, 39 bp, Artificial Sequence
  Description of Artificial Sequence: Synthetic oligonucleotide
gagtttgatgatgatgagatgttctatgtggatctggac

SEQ ID NO: 52305 - DNA, 41 bp, Artificial Sequence
  Description of Artificial Sequence: Synthetic oligonucleotide
agtttgatgatgatgagatgttctatgtggatctggacaag

SEQ ID NO: 52306 - DNA, 40 bp, Artificial Sequence
  Description of Artificial Sequence: Synthetic oligonucleotide
gtttgatgatgatgagatgttctatgtggatctggacaag

SEQ ID NO: 52307 - DNA, 42 bp, Artificial Sequence
  Description of Artificial Sequence: Synthetic oligonucleotide
tttgatgatgatgagatgttctatgtggatctggacaagaag

SEQ ID NO: 52308 - DNA, 41 bp, Artificial Sequence
  Description of Artificial Sequence: Synthetic oligonucleotide
ttgatgatgatgagatgttctatgtggatctggacaagaag

SEQ ID NO: 52309 - DNA, 40 bp, Artificial Sequence
  Description of Artificial Sequence: Synthetic oligonucleotide
tgatgatgatgagatgttctatgtggatctggacaagaag

SEQ ID NO: 52310 - DNA, 39 bp, Artificial Sequence
  Description of Artificial Sequence: Synthetic oligonucleotide
gatgatgatgagatgttctatgtggatctggacaagaag

SEQ ID NO: 52311 - DNA, 39 bp, Artificial Sequence
  Description of Artificial Sequence: Synthetic oligonucleotide
atgatgatgagatgttctatgtggatctggacaagaagg

SEQ ID NO: 52312 - DNA, 38 bp, Artificial Sequence
  Description of Artificial Sequence: Synthetic oligonucleotide
tgatgatgagatgttctatgtggatctggacaagaagg

SEQ ID NO: 52313 - DNA, 37 bp, Artificial Sequence
  Description of Artificial Sequence: Synthetic oligonucleotide
gatgatgagatgttctatgtggatctggacaagaagg

SEQ ID NO: 52314 - DNA, 38 bp, Artificial Sequence
  Description of Artificial Sequence: Synthetic oligonucleotide
atgatgagatgttctatgtggatctggacaagaaggag

SEQ ID NO: 52315 - DNA, 37 bp, Artificial Sequence
  Description of Artificial Sequence: Synthetic oligonucleotide
tgatgagatgttctatgtggatctggacaagaaggag

SEQ ID NO: 52316 - DNA, 42 bp, Artificial Sequence
  Description of Artificial Sequence: Synthetic oligonucleotide
gggctggctaacattgctatattgaacaacaacttgaatatc

SEQ ID NO: 52317 - DNA, 42 bp, Artificial Sequence
  Description of Artificial Sequence: Synthetic oligonucleotide
ggctggctaacattgctatattgaacaacaacttgaatatcg

SEQ ID NO: 52318 - DNA, 42 bp, Artificial Sequence
  Description of Artificial Sequence: Synthetic oligonucleotide
gctggctaacattgctatattgaacaacaacttgaatatcgc

SEQ ID NO: 52319 - DNA, 45 bp, Artificial Sequence
  Description of Artificial Sequence: Synthetic oligonucleotide
ctggctaacattgctatattgaacaacaacttgaatatcgctatc

SEQ ID NO: 52320 - DNA, 45 bp, Artificial Sequence
  Description of Artificial Sequence: Synthetic oligonucleotide
tggctaacattgctatattgaacaacaacttgaatatcgctatcc

SEQ ID NO: 52321 - DNA, 44 bp, Artificial Sequence
  Description of Artificial Sequence: Synthetic oligonucleotide
ggctaacattgctatattgaacaacaacttgaatatcgctatcc

SEQ ID NO: 52322 - DNA, 45 bp, Artificial Sequence
  Description of Artificial Sequence: Synthetic oligonucleotide
gctaacattgctatattgaacaacaacttgaatatcgctatccag

SEQ ID NO: 52323 - DNA, 45 bp, Artificial Sequence
  Description of Artificial Sequence: Synthetic oligonucleotide
ctaacattgctatattgaacaacaacttgaatatcgctatccagc

SEQ ID NO: 52324 - DNA, 45 bp, Artificial Sequence
  Description of Artificial Sequence: Synthetic oligonucleotide
taacattgctatattgaacaacaacttgaatatcgctatccagcg

SEQ ID NO: 52325 - DNA, 44 bp, Artificial Sequence
  Description of Artificial Sequence: Synthetic oligonucleotide
aacattgctatattgaacaacaacttgaatatcgctatccagcg

SEQ ID NO: 52326 - DNA, 43 bp, Artificial Sequence
  Description of Artificial Sequence: Synthetic oligonucleotide
acattgctatattgaacaacaacttgaatatcgctatccagcg

SEQ ID NO: 52327 - DNA, 42 bp, Artificial Sequence
  Description of Artificial Sequence: Synthetic oligonucleotide
cattgctatattgaacaacaacttgaatatcgctatccagcg

SEQ ID NO: 52328 - DNA, 44 bp, Artificial Sequence
  Description of Artificial Sequence: Synthetic oligonucleotide
attgctatattgaacaacaacttgaatatcgctatccagcgttc

SEQ ID NO: 52329 - DNA, 43 bp, Artificial Sequence
  Description of Artificial Sequence: Synthetic oligonucleotide
ttgctatattgaacaacaacttgaatatcgctatccagcgttc

SEQ ID NO: 52330 - DNA, 42 bp, Artificial Sequence
  Description of Artificial Sequence: Synthetic oligonucleotide
tgctatattgaacaacaacttgaatatcgctatccagcgttc

SEQ ID NO: 52331 - DNA, 41 bp, Artificial Sequence
  Description of Artificial Sequence: Synthetic oligonucleotide
gctatattgaacaacaacttgaatatcgctatccagcgttc

SEQ ID NO: 52332 - DNA, 41 bp, Artificial Sequence
  Description of Artificial Sequence: Synthetic oligonucleotide
ctatattgaacaacaacttgaatatcgctatccagcgttcc

SEQ ID NO: 52333 - DNA, 43 bp, Artificial Sequence
  Description of Artificial Sequence: Synthetic oligonucleotide
tatattgaacaacaacttgaatatcgctatccagcgttccaac

SEQ ID NO: 52334 - DNA, 42 bp, Artificial Sequence
  Description of Artificial Sequence: Synthetic oligonucleotide
atattgaacaacaacttgaatatcgctatccagcgttccaac

SEQ ID NO: 52335 - DNA, 41 bp, Artificial Sequence
  Description of Artificial Sequence: Synthetic oligonucleotide
tattgaacaacaacttgaatatcgctatccagcgttccaac

SEQ ID NO: 52336 - DNA, 40 bp, Artificial Sequence
  Description of Artificial Sequence: Synthetic oligonucleotide
attgaacaacaacttgaatatcgctatccagcgttccaac

SEQ ID NO: 52337 - DNA, 39 bp, Artificial Sequence
  Description of Artificial Sequence: Synthetic oligonucleotide
ttgaacaacaacttgaatatcgctatccagcgttccaac

SEQ ID NO: 52338 - DNA, 38 bp, Artificial Sequence
  Description of Artificial Sequence: Synthetic oligonucleotide
tgaacaacaacttgaatatcgctatccagcgttccaac

SEQ ID NO: 52339 - DNA, 37 bp, Artificial Sequence
  Description of Artificial Sequence: Synthetic oligonucleotide
gaacaacaacttgaatatcgctatccagcgttccaac

SEQ ID NO: 52340 - DNA, 37 bp, Artificial Sequence
  Description of Artificial Sequence: Synthetic oligonucleotide
aacaacaacttgaatatcgctatccagcgttccaacc

SEQ ID NO: 52341 - DNA, 36 bp, Artificial Sequence
  Description of Artificial Sequence: Synthetic oligonucleotide
acaacaacttgaatatcgctatccagcgttccaacc

SEQ ID NO: 52342 - DNA, 35 bp, Artificial Sequence
  Description of Artificial Sequence: Synthetic oligonucleotide
caacaacttgaatatcgctatccagcgttccaacc

SEQ ID NO: 52343 - DNA, 36 bp, Artificial Sequence
  Description of Artificial Sequence: Synthetic oligonucleotide
aacaacttgaatatcgctatccagcgttccaaccac

SEQ ID NO: 52344 - DNA, 35 bp, Artificial Sequence
  Description of Artificial Sequence: Synthetic oligonucleotide
acaacttgaatatcgctatccagcgttccaaccac

SEQ ID NO: 52345 - DNA, 34 bp, Artificial Sequence
  Description of Artificial Sequence: Synthetic oligonucleotide
caacttgaatatcgctatccagcgttccaaccac

SEQ ID NO: 52346 - DNA, 35 bp, Artificial Sequence
  Description of Artificial Sequence: Synthetic oligonucleotide
aacttgaatatcgctatccagcgttccaaccacac

SEQ ID NO: 52347 - DNA, 34 bp, Artificial Sequence
  Description of Artificial Sequence: Synthetic oligonucleotide
acttgaatatcgctatccagcgttccaaccacac

SEQ ID NO: 52348 - DNA, 33 bp, Artificial Sequence
  Description of Artificial Sequence: Synthetic oligonucleotide
cttgaatatcgctatccagcgttccaaccacac

SEQ ID NO: 52349 - DNA, 34 bp, Artificial Sequence
  Description of Artificial Sequence: Synthetic oligonucleotide
ttgaatatcgctatccagcgttccaaccacactc

SEQ ID NO: 52350 - DNA, 33 bp, Artificial Sequence
  Description of Artificial Sequence: Synthetic oligonucleotide
tgaatatcgctatccagcgttccaaccacactc

SEQ ID NO: 52351 - DNA, 32 bp, Artificial Sequence
  Description of Artificial Sequence: Synthetic oligonucleotide
gaatatcgctatccagcgttccaaccacactc

SEQ ID NO: 52352 - DNA, 33 bp, Artificial Sequence
  Description of Artificial Sequence: Synthetic oligonucleotide
aatatcgctatccagcgttccaaccacactcag

SEQ ID NO: 52353 - DNA, 32 bp, Artificial Sequence
  Description of Artificial Sequence: Synthetic oligonucleotide
atatcgctatccagcgttccaaccacactcag

SEQ ID NO: 52354 - DNA, 31 bp, Artificial Sequence
  Description of Artificial Sequence: Synthetic oligonucleotide
tatcgctatccagcgttccaaccacactcag

SEQ ID NO: 52355 - DNA, 30 bp, Artificial Sequence
  Description of Artificial Sequence: Synthetic oligonucleotide
atcgctatccagcgttccaaccacactcag

SEQ ID NO: 52356 - DNA, 29 bp, Artificial Sequence
  Description of Artificial Sequence: Synthetic oligonucleotide
tcgctatccagcgttccaaccacactcag

SEQ ID NO: 52357 - DNA, 28 bp, Artificial Sequence
  Description of Artificial Sequence: Synthetic oligonucleotide
cgctatccagcgttccaaccacactcag

SEQ ID NO: 52358 - DNA, 28 bp, Artificial Sequence
  Description of Artificial Sequence: Synthetic oligonucleotide
gctatccagcgttccaaccacactcagg

SEQ ID NO: 52359 - DNA, 28 bp, Artificial Sequence
  Description of Artificial Sequence: Synthetic oligonucleotide
ctatccagcgttccaaccacactcaggc

SEQ ID NO: 52360 - DNA, 28 bp, Artificial Sequence
  Description of Artificial Sequence: Synthetic oligonucleotide
tatccagcgttccaaccacactcaggcc

SEQ ID NO: 52361 - DNA, 27 bp, Artificial Sequence
  Description of Artificial Sequence: Synthetic oligonucleotide
ctgaggtgaccgtgtttcccaaggagg

SEQ ID NO: 52362 - DNA, 27 bp, Artificial Sequence
  Description of Artificial Sequence: Synthetic oligonucleotide
tgaggtgaccgtgtttcccaaggaggc

SEQ ID NO: 52363 - DNA, 27 bp, Artificial Sequence
  Description of Artificial Sequence: Synthetic oligonucleotide
gaggtgaccgtgtttcccaaggaggct

SEQ ID NO: 52364 - DNA, 27 bp, Artificial Sequence
  Description of Artificial Sequence: Synthetic oligonucleotide
aggtgaccgtgtttcccaaggaggctg

SEQ ID NO: 52365 - DNA, 27 bp, Artificial Sequence
  Description of Artificial Sequence: Synthetic oligonucleotide
ggtgaccgtgtttcccaaggaggctgt

SEQ ID NO: 52366 - DNA, 27 bp, Artificial Sequence
  Description of Artificial Sequence: Synthetic oligonucleotide
gtgaccgtgtttcccaaggaggctgtg

SEQ ID NO: 52367 - DNA, 27 bp, Artificial Sequence
  Description of Artificial Sequence: Synthetic oligonucleotide
tgaccgtgtttcccaaggaggctgtgg

SEQ ID NO: 52368 - DNA, 27 bp, Artificial Sequence
  Description of Artificial Sequence: Synthetic oligonucleotide
gaccgtgtttcccaaggaggctgtgga

SEQ ID NO: 52369 - DNA, 27 bp, Artificial Sequence
  Description of Artificial Sequence: Synthetic oligonucleotide
accgtgtttcccaaggaggctgtggag

SEQ ID NO: 52370 - DNA, 26 bp, Artificial Sequence
  Description of Artificial Sequence: Synthetic oligonucleotide
ccgtgtttcccaaggaggctgtggag

SEQ ID NO: 52371 - DNA, 27 bp, Artificial Sequence
  Description of Artificial Sequence: Synthetic oligonucleotide
cgtgtttcccaaggaggctgtggagct

SEQ ID NO: 52372 - DNA, 27 bp, Artificial Sequence
  Description of Artificial Sequence: Synthetic oligonucleotide
gtgtttcccaaggaggctgtggagctg

SEQ ID NO: 52373 - DNA, 27 bp, Artificial Sequence
  Description of Artificial Sequence: Synthetic oligonucleotide
tgtttcccaaggaggctgtggagctgg

SEQ ID NO: 52374 - DNA, 26 bp, Artificial Sequence
  Description of Artificial Sequence: Synthetic oligonucleotide
gtttcccaaggaggctgtggagctgg

SEQ ID NO: 52375 - DNA, 26 bp, Artificial Sequence
  Description of Artificial Sequence: Synthetic oligonucleotide
tttcccaaggaggctgtggagctggg

SEQ ID NO: 52376 - DNA, 25 bp, Artificial Sequence
  Description of Artificial Sequence: Synthetic oligonucleotide
ttcccaaggaggctgtggagctggg

SEQ ID NO: 52377 - DNA, 24 bp, Artificial Sequence
  Description of Artificial Sequence: Synthetic oligonucleotide
tcccaaggaggctgtggagctggg

SEQ ID NO: 52378 - DNA, 23 bp, Artificial Sequence
  Description of Artificial Sequence: Synthetic oligonucleotide
cccaaggaggctgtggagctggg

SEQ ID NO: 52379 - DNA, 23 bp, Artificial Sequence
  Description of Artificial Sequence: Synthetic oligonucleotide
ccaaggaggctgtggagctgggc

SEQ ID NO: 52380 - DNA, 24 bp, Artificial Sequence
  Description of Artificial Sequence: Synthetic oligonucleotide
caaggaggctgtggagctgggcca

SEQ ID NO: 52381 - DNA, 24 bp, Artificial Sequence
  Description of Artificial Sequence: Synthetic oligonucleotide
aaggaggctgtggagctgggccag

SEQ ID NO: 52382 - DNA, 23 bp, Artificial Sequence
  Description of Artificial Sequence: Synthetic oligonucleotide
aggaggctgtggagctgggccag

SEQ ID NO: 52383 - DNA, 22 bp, Artificial Sequence
  Description of Artificial Sequence: Synthetic oligonucleotide
ggaggctgtggagctgggccag

SEQ ID NO: 52384 - DNA, 22 bp, Artificial Sequence
  Description of Artificial Sequence: Synthetic oligonucleotide
gaggctgtggagctgggccagc

SEQ ID NO: 52385 - DNA, 22 bp, Artificial Sequence
  Description of Artificial Sequence: Synthetic oligonucleotide
aggctgtggagctgggccagcc

SEQ ID NO: 52386 - DNA, 21 bp, Artificial Sequence
  Description of Artificial Sequence: Synthetic oligonucleotide
ggctgtggagctgggccagcc

SEQ ID NO: 52387 - DNA, 23 bp, Artificial Sequence
  Description of Artificial Sequence: Synthetic oligonucleotide
gctgtggagctgggccagcccaa

SEQ ID NO: 52388 - DNA, 32 bp, Artificial Sequence
  Description of Artificial Sequence: Synthetic oligonucleotide
aagttcttcccaccagtgctcaacgtcacatg

SEQ ID NO: 52389 - DNA, 31 bp, Artificial Sequence
  Description of Artificial Sequence: Synthetic oligonucleotide
agttcttcccaccagtgctcaacgtcacatg

SEQ ID NO: 52390 - DNA, 29 bp, Artificial Sequence
  Description of Artificial Sequence: Synthetic oligonucleotide
ccaagagccaatccagatgcctgagacag

SEQ ID NO: 52391 - DNA, 29 bp, Artificial Sequence
  Description of Artificial Sequence: Synthetic oligonucleotide
caagagccaatccagatgcctgagacagc

SEQ ID NO: 52392 - DNA, 29 bp, Artificial Sequence
  Description of Artificial Sequence: Synthetic oligonucleotide
aagagccaatccagatgcctgagacagcg

SEQ ID NO: 52393 - DNA, 28 bp, Artificial Sequence
  Description of Artificial Sequence: Synthetic oligonucleotide
agagccaatccagatgcctgagacagcg

SEQ ID NO: 52394 - DNA, 27 bp, Artificial Sequence
  Description of Artificial Sequence: Synthetic oligonucleotide
gagccaatccagatgcctgagacagcg

SEQ ID NO: 52395 - DNA, 27 bp, Artificial Sequence
  Description of Artificial Sequence: Synthetic oligonucleotide
agccaatccagatgcctgagacagcgg

SEQ ID NO: 52396 - DNA, 27 bp, Artificial Sequence
  Description of Artificial Sequence: Synthetic oligonucleotide
gccaatccagatgcctgagacagcgga

SEQ ID NO: 52397 - DNA, 27 bp, Artificial Sequence
  Description of Artificial Sequence: Synthetic oligonucleotide
ccaatccagatgcctgagacagcggag

SEQ ID NO: 52398 - DNA, 28 bp, Artificial Sequence
  Description of Artificial Sequence: Synthetic oligonucleotide
caatccagatgcctgagacagcggagac

SEQ ID NO: 52399 - DNA, 29 bp, Artificial Sequence
  Description of Artificial Sequence: Synthetic oligonucleotide
aatccagatgcctgagacagcggagactg

SEQ ID NO: 52400 - DNA, 28 bp, Artificial Sequence
  Description of Artificial Sequence: Synthetic oligonucleotide
atccagatgcctgagacagcggagactg

SEQ ID NO: 52401 - DNA, 27 bp, Artificial Sequence
  Description of Artificial Sequence: Synthetic oligonucleotide
tccagatgcctgagacagcggagactg

SEQ ID NO: 52402 - DNA, 27 bp, Artificial Sequence
  Description of Artificial Sequence: Synthetic oligonucleotide
ccagatgcctgagacagcggagactgt

SEQ ID NO: 52403 - DNA, 27 bp, Artificial Sequence
  Description of Artificial Sequence: Synthetic oligonucleotide
cagatgcctgagacagcggagactgtg

SEQ ID NO: 52404 - DNA, 27 bp, Artificial Sequence
  Description of Artificial Sequence: Synthetic oligonucleotide
agatgcctgagacagcggagactgtgc

SEQ ID NO: 52405 - DNA, 27 bp, Artificial Sequence
  Description of Artificial Sequence: Synthetic oligonucleotide
gatgcctgagacagcggagactgtgct

SEQ ID NO: 52406 - DNA, 27 bp, Artificial Sequence
  Description of Artificial Sequence: Synthetic oligonucleotide
atgcctgagacagcggagactgtgctc

SEQ ID NO: 52407 - DNA, 27 bp, Artificial Sequence
  Description of Artificial Sequence: Synthetic oligonucleotide
tgcctgagacagcggagactgtgctct

SEQ ID NO: 52408 - DNA, 26 bp, Artificial Sequence
  Description of Artificial Sequence: Synthetic oligonucleotide
gcctgagacagcggagactgtgctct

SEQ ID NO: 52409 - DNA, 27 bp, Artificial Sequence
  Description of Artificial Sequence: Synthetic oligonucleotide
cctgagacagcggagactgtgctctgt

SEQ ID NO: 52410 - DNA, 27 bp, Artificial Sequence
  Description of Artificial Sequence: Synthetic oligonucleotide
ctgagacagcggagactgtgctctgtg

SEQ ID NO: 52411 - DNA, 27 bp, Artificial Sequence
  Description of Artificial Sequence: Synthetic oligonucleotide
tgagacagcggagactgtgctctgtgc

SEQ ID NO: 52412 - DNA, 26 bp, Artificial Sequence
  Description of Artificial Sequence: Synthetic oligonucleotide
gagacagcggagactgtgctctgtgc

SEQ ID NO: 52413 - DNA, 26 bp, Artificial Sequence
  Description of Artificial Sequence: Synthetic oligonucleotide
agacagcggagactgtgctctgtgcc

SEQ ID NO: 52414 - DNA, 25 bp, Artificial Sequence
  Description of Artificial Sequence: Synthetic oligonucleotide
gacagcggagactgtgctctgtgcc

SEQ ID NO: 52415 - DNA, 26 bp, Artificial Sequence
  Description of Artificial Sequence: Synthetic oligonucleotide
acagcggagactgtgctctgtgccct

SEQ ID NO: 52416 - DNA, 25 bp, Artificial Sequence
  Description of Artificial Sequence: Synthetic oligonucleotide
cagcggagactgtgctctgtgccct

SEQ ID NO: 52417 - DNA, 25 bp, Artificial Sequence
  Description of Artificial Sequence: Synthetic oligonucleotide
agcggagactgtgctctgtgccctg

SEQ ID NO: 52418 - DNA, 24 bp, Artificial Sequence
  Description of Artificial Sequence: Synthetic oligonucleotide
gcggagactgtgctctgtgccctg

SEQ ID NO: 52419 - DNA, 28 bp, Artificial Sequence
  Description of Artificial Sequence: Synthetic oligonucleotide
atgatggttctgcaggtttctgcggccc

SEQ ID NO: 52420 - DNA, 27 bp, Artificial Sequence
  Description of Artificial Sequence: Synthetic oligonucleotide
tgatggttctgcaggtttctgcggccc

SEQ ID NO: 52421 - DNA, 26 bp, Artificial Sequence
  Description of Artificial Sequence: Synthetic oligonucleotide
gatggttctgcaggtttctgcggccc

SEQ ID NO: 52422 - DNA, 26 bp, Artificial Sequence
  Description of Artificial Sequence: Synthetic oligonucleotide
atggttctgcaggtttctgcggcccc

SEQ ID NO: 52423 - DNA, 25 bp, Artificial Sequence
  Description of Artificial Sequence: Synthetic oligonucleotide
tggttctgcaggtttctgcggcccc

SEQ ID NO: 52424 - DNA, 24 bp, Artificial Sequence
  Description of Artificial Sequence: Synthetic oligonucleotide
ggttctgcaggtttctgcggcccc

SEQ ID NO: 52425 - DNA, 24 bp, Artificial Sequence
  Description of Artificial Sequence: Synthetic oligonucleotide
gttctgcaggtttctgcggccccc

SEQ ID NO: 52426 - DNA, 24 bp, Artificial Sequence
  Description of Artificial Sequence: Synthetic oligonucleotide
ttctgcaggtttctgcggcccccc

SEQ ID NO: 52427 - DNA, 23 bp, Artificial Sequence
  Description of Artificial Sequence: Synthetic oligonucleotide
tctgcaggtttctgcggcccccc

SEQ ID NO: 52428 - DNA, 22 bp, Artificial Sequence
  Description of Artificial Sequence: Synthetic oligonucleotide
ctgcaggtttctgcggcccccc

SEQ ID NO: 52429 - DNA, 22 bp, Artificial Sequence
  Description of Artificial Sequence: Synthetic oligonucleotide
tgcaggtttctgcggccccccg

SEQ ID NO: 52430 - DNA, 21 bp, Artificial Sequence
  Description of Artificial Sequence: Synthetic oligonucleotide
gcaggtttctgcggccccccg

SEQ ID NO: 52431 - DNA, 22 bp, Artificial Sequence
  Description of Artificial Sequence: Synthetic oligonucleotide
caggtttctgcggccccccgga

SEQ ID NO: 52432 - DNA, 23 bp, Artificial Sequence
  Description of Artificial Sequence: Synthetic oligonucleotide
aggtttctgcggccccccggaca

SEQ ID NO: 52433 - DNA, 22 bp, Artificial Sequence
  Description of Artificial Sequence: Synthetic oligonucleotide
ggtttctgcggccccccggaca

SEQ ID NO: 52434 - DNA, 23 bp, Artificial Sequence
  Description of Artificial Sequence: Synthetic oligonucleotide
gtttctgcggccccccggacagt

SEQ ID NO: 52435 - DNA, 23 bp, Artificial Sequence
  Description of Artificial Sequence: Synthetic oligonucleotide
tttctgcggccccccggacagtg

SEQ ID NO: 52436 - DNA, 22 bp, Artificial Sequence
  Description of Artificial Sequence: Synthetic oligonucleotide
ttctgcggccccccggacagtg

SEQ ID NO: 52437 - DNA, 21 bp, Artificial Sequence
  Description of Artificial Sequence: Synthetic oligonucleotide
tctgcggccccccggacagtg

SEQ ID NO: 52438 - DNA, 20 bp, Artificial Sequence
  Description of Artificial Sequence: Synthetic oligonucleotide
ctgcggccccccggacagtg

SEQ ID NO: 52439 - DNA, 20 bp, Artificial Sequence
  Description of Artificial Sequence: Synthetic oligonucleotide
tgcggccccccggacagtgg

SEQ ID NO: 52440 - DNA, 20 bp, Artificial Sequence
  Description of Artificial Sequence: Synthetic oligonucleotide
gcggccccccggacagtggt

SEQ ID NO: 52441 - DNA, 20 bp, Artificial Sequence
  Description of Artificial Sequence: Synthetic oligonucleotide
cggccccccggacagtggct

SEQ ID NO: 52442 - DNA, 21 bp, Artificial Sequence
  Description of Artificial Sequence: Synthetic oligonucleotide
ggccccccggacagtggctct

SEQ ID NO: 52443 - DNA, 22 bp, Artificial Sequence
  Description of Artificial Sequence: Synthetic oligonucleotide
gccccccggacagtggctctga

SEQ ID NO: 52444 - DNA, 22 bp, Artificial Sequence
  Description of Artificial Sequence: Synthetic oligonucleotide
ccccccggacagtggctctgac

SEQ ID NO: 52445 - DNA, 22 bp, Artificial Sequence
  Description of Artificial Sequence: Synthetic oligonucleotide
cccccggacagtggctctgacg

SEQ ID NO: 52446 - DNA, 22 bp, Artificial Sequence
  Description of Artificial Sequence: Synthetic oligonucleotide
ccccggacagtggctctgacgg

SEQ ID NO: 52447 - DNA, 22 bp, Artificial Sequence
  Description of Artificial Sequence: Synthetic oligonucleotide
cccggacagtggctctgacggc

SEQ ID NO: 52448 - DNA, 25 bp, Artificial Sequence
  Description of Artificial Sequence: Synthetic oligonucleotide
ccggacagtggctctgacggcgtta

SEQ ID NO: 52449 - DNA, 26 bp, Artificial Sequence
  Description of Artificial Sequence: Synthetic oligonucleotide
cggacagtggctctgacggcgttact

SEQ ID NO: 52450 - DNA, 27 bp, Artificial Sequence
  Description of Artificial Sequence: Synthetic oligonucleotide
ggacagtggctctgacggcgttactga

SEQ ID NO: 52451 - DNA, 28 bp, Artificial Sequence
  Description of Artificial Sequence: Synthetic oligonucleotide
gacagtggctctgacggcgttactgatg

SEQ ID NO: 52452 - DNA, 28 bp, Artificial Sequence
  Description of Artificial Sequence: Synthetic oligonucleotide
acagtggctctgacggcgttactgatgg

SEQ ID NO: 52453 - DNA, 27 bp, Artificial Sequence
  Description of Artificial Sequence: Synthetic oligonucleotide
cagtggctctgacggcgttactgatgg

SEQ ID NO: 52454 - DNA, 28 bp, Artificial Sequence
  Description of Artificial Sequence: Synthetic oligonucleotide
agtggctctgacggcgttactgatggtg

SEQ ID NO: 52455 - DNA, 27 bp, Artificial Sequence
  Description of Artificial Sequence: Synthetic oligonucleotide
gtggctctgacggcgttactgatggtg

SEQ ID NO: 52456 - DNA, 27 bp, Artificial Sequence
  Description of Artificial Sequence: Synthetic oligonucleotide
tggctctgacggcgttactgatggtgc

SEQ ID NO: 52457 - DNA, 27 bp, Artificial Sequence
  Description of Artificial Sequence: Synthetic oligonucleotide
ggctctgacggcgttactgatggtgct

SEQ ID NO: 52458 - DNA, 27 bp, Artificial Sequence
  Description of Artificial Sequence: Synthetic oligonucleotide
gctctgacggcgttactgatggtgctg

SEQ ID NO: 52459 - DNA, 27 bp, Artificial Sequence
  Description of Artificial Sequence: Synthetic oligonucleotide
ctctgacggcgttactgatggtgctgc

SEQ ID NO: 52460 - DNA, 28 bp, Artificial Sequence
  Description of Artificial Sequence: Synthetic oligonucleotide
tctgacggcgttactgatggtgctgctc

SEQ ID NO: 52461 - DNA, 27 bp, Artificial Sequence
  Description of Artificial Sequence: Synthetic oligonucleotide
ctgacggcgttactgatggtgctgctc

SEQ ID NO: 52462 - DNA, 28 bp, Artificial Sequence
  Description of Artificial Sequence: Synthetic oligonucleotide
tgacggcgttactgatggtgctgctcac

SEQ ID NO: 52463 - DNA, 27 bp, Artificial Sequence
  Description of Artificial Sequence: Synthetic oligonucleotide
gacggcgttactgatggtgctgctcac

SEQ ID NO: 52464 - DNA, 29 bp, Artificial Sequence
  Description of Artificial Sequence: Synthetic oligonucleotide
acggcgttactgatggtgctgctcacatc

SEQ ID NO: 52465 - DNA, 28 bp, Artificial Sequence
  Description of Artificial Sequence: Synthetic oligonucleotide
cggcgttactgatggtgctgctcacatc

SEQ ID NO: 52466 - DNA, 29 bp, Artificial Sequence
  Description of Artificial Sequence: Synthetic oligonucleotide
ggcgttactgatggtgctgctcacatctg

SEQ ID NO: 52467 - DNA, 30 bp, Artificial Sequence
  Description of Artificial Sequence: Synthetic oligonucleotide
gcgttactgatggtgctgctcacatctgtg

SEQ ID NO: 52468 - DNA, 30 bp, Artificial Sequence
  Description of Artificial Sequence: Synthetic oligonucleotide
cgttactgatggtgctgctcacatctgtgg

SEQ ID NO: 52469 - DNA, 31 bp, Artificial Sequence
  Description of Artificial Sequence: Synthetic oligonucleotide
gttactgatggtgctgctcacatctgtggtc

SEQ ID NO: 52470 - DNA, 31 bp, Artificial Sequence
  Description of Artificial Sequence: Synthetic oligonucleotide
ttactgatggtgctgctcacatctgtggtcc

SEQ ID NO: 52471 - DNA, 30 bp, Artificial Sequence
  Description of Artificial Sequence: Synthetic oligonucleotide
tactgatggtgctgctcacatctgtggtcc

SEQ ID NO: 52472 - DNA, 29 bp, Artificial Sequence
  Description of Artificial Sequence: Synthetic oligonucleotide
actgatggtgctgctcacatctgtggtcc

SEQ ID NO: 52473 - DNA, 28 bp, Artificial Sequence
  Description of Artificial Sequence: Synthetic oligonucleotide
ctgatggtgctgctcacatctgtggtcc

SEQ ID NO: 52474 - DNA, 29 bp, Artificial Sequence
  Description of Artificial Sequence: Synthetic oligonucleotide
tgatggtgctgctcacatctgtggtccag

SEQ ID NO: 52475 - DNA, 28 bp, Artificial Sequence
  Description of Artificial Sequence: Synthetic oligonucleotide
gatggtgctgctcacatctgtggtccag

SEQ ID NO: 52476 - DNA, 28 bp, Artificial Sequence
  Description of Artificial Sequence: Synthetic oligonucleotide
atggtgctgctcacatctgtggtccagg

SEQ ID NO: 52477 - DNA, 27 bp, Artificial Sequence
  Description of Artificial Sequence: Synthetic oligonucleotide
tggtgctgctcacatctgtggtccagg

SEQ ID NO: 52478 - DNA, 26 bp, Artificial Sequence
  Description of Artificial Sequence: Synthetic oligonucleotide
ggtgctgctcacatctgtggtccagg

SEQ ID NO: 52479 - DNA, 26 bp, Artificial Sequence
  Description of Artificial Sequence: Synthetic oligonucleotide
gtgctgctcacatctgtggtccaggg

SEQ ID NO: 52480 - DNA, 27 bp, Artificial Sequence
  Description of Artificial Sequence: Synthetic oligonucleotide
tgctgctcacatctgtggtccagggca

SEQ ID NO: 52481 - DNA, 26 bp, Artificial Sequence
  Description of Artificial Sequence: Synthetic oligonucleotide
gctgctcacatctgtggtccagggca

SEQ ID NO: 52482 - DNA, 26 bp, Artificial Sequence
  Description of Artificial Sequence: Synthetic oligonucleotide
ctgctcacatctgtggtccagggcag

SEQ ID NO: 52483 - DNA, 26 bp, Artificial Sequence
  Description of Artificial Sequence: Synthetic oligonucleotide
tgctcacatctgtggtccagggcagg

SEQ ID NO: 52484 - DNA, 25 bp, Artificial Sequence
  Description of Artificial Sequence: Synthetic oligonucleotide
gctcacatctgtggtccagggcagg

SEQ ID NO: 52485 - DNA, 25 bp, Artificial Sequence
  Description of Artificial Sequence: Synthetic oligonucleotide
ctcacatctgtggtccagggcaggg

SEQ ID NO: 52486 - DNA, 25 bp, Artificial Sequence
  Description of Artificial Sequence: Synthetic oligonucleotide
tcacatctgtggtccagggcagggc

SEQ ID NO: 52487 - DNA, 24 bp, Artificial Sequence
  Description of Artificial Sequence: Synthetic oligonucleotide
cacatctgtggtccagggcagggc

SEQ ID NO: 52488 - DNA, 25 bp, Artificial Sequence
  Description of Artificial Sequence: Synthetic oligonucleotide
acatctgtggtccagggcagggcca

SEQ ID NO: 52489 - DNA, 24 bp, Artificial Sequence
  Description of Artificial Sequence: Synthetic oligonucleotide
catctgtggtccagggcagggcca

SEQ ID NO: 52490 - DNA, 25 bp, Artificial Sequence
  Description of Artificial Sequence: Synthetic oligonucleotide
atctgtggtccagggcagggccact

SEQ ID NO: 52491 - DNA, 24 bp, Artificial Sequence
  Description of Artificial Sequence: Synthetic oligonucleotide
tctgtggtccagggcagggccact

SEQ ID NO: 52492 - DNA, 23 bp, Artificial Sequence
  Description of Artificial Sequence: Synthetic oligonucleotide
ctgtggtccagggcagggccact

SEQ ID NO: 52493 - DNA, 23 bp, Artificial Sequence
  Description of Artificial Sequence: Synthetic oligonucleotide
tgtggtccagggcagggccactc

SEQ ID NO: 52494 - DNA, 22 bp, Artificial Sequence
  Description of Artificial Sequence: Synthetic oligonucleotide
gtggtccagggcagggccactc

SEQ ID NO: 52495 - DNA, 23 bp, Artificial Sequence
  Description of Artificial Sequence: Synthetic oligonucleotide
tggtccagggcagggccactcca

SEQ ID NO: 52496 - DNA, 22 bp, Artificial Sequence
  Description of Artificial Sequence: Synthetic oligonucleotide
ggtccagggcagggccactcca

SEQ ID NO: 52497 - DNA, 23 bp, Artificial Sequence
  Description of Artificial Sequence: Synthetic oligonucleotide
gtccagggcagggccactccaga

SEQ ID NO: 52498 - DNA, 27 bp, Artificial Sequence
  Description of Artificial Sequence: Synthetic oligonucleotide
tccagggcagggccactccagagaatt

SEQ ID NO: 52499 - DNA, 27 bp, Artificial Sequence
  Description of Artificial Sequence: Synthetic oligonucleotide
ccagggcagggccactccagagaatta

SEQ ID NO: 52500 - DNA, 27 bp, Artificial Sequence
  Description of Artificial Sequence: Synthetic oligonucleotide
cagggcagggccactccagagaattac

SEQ ID NO: 52501 - DNA, 27 bp, Artificial Sequence
  Description of Artificial Sequence: Synthetic oligonucleotide
agggcagggccactccagagaattacg

SEQ ID NO: 52502 - DNA, 27 bp, Artificial Sequence
  Description of Artificial Sequence: Synthetic oligonucleotide
gggcagggccactccagagaattacgt

SEQ ID NO: 52503 - DNA, 27 bp, Artificial Sequence
  Description of Artificial Sequence: Synthetic oligonucleotide
ggcagggccactccagagaattacgtg

SEQ ID NO: 52504 - DNA, 29 bp, Artificial Sequence
  Description of Artificial Sequence: Synthetic oligonucleotide
gcagggccactccagagaattacgtgtac

SEQ ID NO: 52505 - DNA, 29 bp, Artificial Sequence
  Description of Artificial Sequence: Synthetic oligonucleotide
cagggccactccagagaattacgtgtacc

SEQ ID NO: 52506 - DNA, 30 bp, Artificial Sequence
  Description of Artificial Sequence: Synthetic oligonucleotide
agggccactccagagaattacgtgtaccag

SEQ ID NO: 52507 - DNA, 29 bp, Artificial Sequence
  Description of Artificial Sequence: Synthetic oligonucleotide
gggccactccagagaattacgtgtaccag

SEQ ID NO: 52508 - DNA, 29 bp, Artificial Sequence
  Description of Artificial Sequence: Synthetic oligonucleotide
ggccactccagagaattacgtgtaccagg

SEQ ID NO: 52509 - DNA, 29 bp, Artificial Sequence
  Description of Artificial Sequence: Synthetic oligonucleotide
gccactccagagaattacgtgtaccaggg

SEQ ID NO: 52510 - DNA, 30 bp, Artificial Sequence
  Description of Artificial Sequence: Synthetic oligonucleotide
ccactccagagaattacgtgtaccagggac

SEQ ID NO: 52511 - DNA, 30 bp, Artificial Sequence
  Description of Artificial Sequence: Synthetic oligonucleotide
cactccagagaattacgtgtaccagggacg

SEQ ID NO: 52512 - DNA, 30 bp, Artificial Sequence
  Description of Artificial Sequence: Synthetic oligonucleotide
actccagagaattacgtgtaccagggacgg

SEQ ID NO: 52513 - DNA, 29 bp, Artificial Sequence
  Description of Artificial Sequence: Synthetic oligonucleotide
ctccagagaattacgtgtaccagggacgg

SEQ ID NO: 52514 - DNA, 29 bp, Artificial Sequence
  Description of Artificial Sequence: Synthetic oligonucleotide
tccagagaattacgtgtaccagggacggc

SEQ ID NO: 52515 - DNA, 28 bp, Artificial Sequence
  Description of Artificial Sequence: Synthetic oligonucleotide
ccagagaattacgtgtaccagggacggc

SEQ ID NO: 52516 - DNA, 29 bp, Artificial Sequence
  Description of Artificial Sequence: Synthetic oligonucleotide
cagagaattacgtgtaccagggacggcag

SEQ ID NO: 52517 - DNA, 29 bp, Artificial Sequence
  Description of Artificial Sequence: Synthetic oligonucleotide
agagaattacgtgtaccagggacggcagg

SEQ ID NO: 52518 - DNA, 28 bp, Artificial Sequence
  Description of Artificial Sequence: Synthetic oligonucleotide
gagaattacgtgtaccagggacggcagg

SEQ ID NO: 52519 - DNA, 31 bp, Artificial Sequence
  Description of Artificial Sequence: Synthetic oligonucleotide
agaattacgtgtaccagggacggcaggaatg

SEQ ID NO: 52520 - DNA, 30 bp, Artificial Sequence
  Description of Artificial Sequence: Synthetic oligonucleotide
gaattacgtgtaccagggacggcaggaatg

SEQ ID NO: 52521 - DNA, 30 bp, Artificial Sequence
  Description of Artificial Sequence: Synthetic oligonucleotide
aattacgtgtaccagggacggcaggaatgc

SEQ ID NO: 52522 - DNA, 29 bp, Artificial Sequence
  Description of Artificial Sequence: Synthetic oligonucleotide
attacgtgtaccagggacggcaggaatgc

SEQ ID NO: 52523 - DNA, 28 bp, Artificial Sequence
  Description of Artificial Sequence: Synthetic oligonucleotide
ttacgtgtaccagggacggcaggaatgc

SEQ ID NO: 52524 - DNA, 27 bp, Artificial Sequence
  Description of Artificial Sequence: Synthetic oligonucleotide
tacgtgtaccagggacggcaggaatgc

SEQ ID NO: 52525 - DNA, 27 bp, Artificial Sequence
  Description of Artificial Sequence: Synthetic oligonucleotide
acgtgtaccagggacggcaggaatgct

SEQ ID NO: 52526 - DNA, 27 bp, Artificial Sequence
  Description of Artificial Sequence: Synthetic oligonucleotide
cgtgtaccagggacggcaggaatgcta

SEQ ID NO: 52527 - DNA, 27 bp, Artificial Sequence
  Description of Artificial Sequence: Synthetic oligonucleotide
gtgtaccagggacggcaggaatgctac

SEQ ID NO: 52528 - DNA, 27 bp, Artificial Sequence
  Description of Artificial Sequence: Synthetic oligonucleotide
tgtaccagggacggcaggaatgctacg

SEQ ID NO: 52529 - DNA, 26 bp, Artificial Sequence
  Description of Artificial Sequence: Synthetic oligonucleotide
gtaccagggacggcaggaatgctacg

SEQ ID NO: 52530 - DNA, 26 bp, Artificial Sequence
  Description of Artificial Sequence: Synthetic oligonucleotide
taccagggacggcaggaatgctacgc

SEQ ID NO: 52531 - DNA, 25 bp, Artificial Sequence
  Description of Artificial Sequence: Synthetic oligonucleotide
accagggacggcaggaatgctacgc

SEQ ID NO: 52532 - DNA, 24 bp, Artificial Sequence
  Description of Artificial Sequence: Synthetic oligonucleotide
ccagggacggcaggaatgctacgc

SEQ ID NO: 52533 - DNA, 27 bp, Artificial Sequence
  Description of Artificial Sequence: Synthetic oligonucleotide
cagggacggcaggaatgctacgcgttt

SEQ ID NO: 52534 - DNA, 30 bp, Artificial Sequence
  Description of Artificial Sequence: Synthetic oligonucleotide
agggacggcaggaatgctacgcgtttaatg

SEQ ID NO: 52535 - DNA, 29 bp, Artificial Sequence
  Description of Artificial Sequence: Synthetic oligonucleotide
gggacggcaggaatgctacgcgtttaatg

SEQ ID NO: 52536 - DNA, 29 bp, Artificial Sequence
  Description of Artificial Sequence: Synthetic oligonucleotide
ggacggcaggaatgctacgcgtttaatgg

SEQ ID NO: 52537 - DNA, 29 bp, Artificial Sequence
  Description of Artificial Sequence: Synthetic oligonucleotide
gacggcaggaatgctacgcgtttaatggg

SEQ ID NO: 52538 - DNA, 30 bp, Artificial Sequence
  Description of Artificial Sequence: Synthetic oligonucleotide
acggcaggaatgctacgcgtttaatgggac

SEQ ID NO: 52539 - DNA, 29 bp, Artificial Sequence
  Description of Artificial Sequence: Synthetic oligonucleotide
cggcaggaatgctacgcgtttaatgggac

SEQ ID NO: 52540 - DNA, 30 bp, Artificial Sequence
  Description of Artificial Sequence: Synthetic oligonucleotide
ggcaggaatgctacgcgtttaatgggacac

SEQ ID NO: 52541 - DNA, 31 bp, Artificial Sequence
  Description of Artificial Sequence: Synthetic oligonucleotide
gcaggaatgctacgcgtttaatgggacacag

SEQ ID NO: 52542 - DNA, 31 bp, Artificial Sequence
  Description of Artificial Sequence: Synthetic oligonucleotide
caggaatgctacgcgtttaatgggacacagc

SEQ ID NO: 52543 - DNA, 31 bp, Artificial Sequence
  Description of Artificial Sequence: Synthetic oligonucleotide
aggaatgctacgcgtttaatgggacacagcg

SEQ ID NO: 52544 - DNA, 30 bp, Artificial Sequence
  Description of Artificial Sequence: Synthetic oligonucleotide
ggaatgctacgcgtttaatgggacacagcg

SEQ ID NO: 52545 - DNA, 30 bp, Artificial Sequence
  Description of Artificial Sequence: Synthetic oligonucleotide
gaatgctacgcgtttaatgggacacagcgc

SEQ ID NO: 52546 - DNA, 32 bp, Artificial Sequence
  Description of Artificial Sequence: Synthetic oligonucleotide
aatgctacgcgtttaatgggacacagcgcttc

SEQ ID NO: 52547 - DNA, 31 bp, Artificial Sequence
  Description of Artificial Sequence: Synthetic oligonucleotide
atgctacgcgtttaatgggacacagcgcttc

SEQ ID NO: 52548 - DNA, 30 bp, Artificial Sequence
  Description of Artificial Sequence: Synthetic oligonucleotide
tgctacgcgtttaatgggacacagcgcttc

SEQ ID NO: 52549 - DNA, 29 bp, Artificial Sequence
  Description of Artificial Sequence: Synthetic oligonucleotide
gctacgcgtttaatgggacacagcgcttc

SEQ ID NO: 52550 - DNA, 29 bp, Artificial Sequence
  Description of Artificial Sequence: Synthetic oligonucleotide
ctacgcgtttaatgggacacagcgcttcc

SEQ ID NO: 52551 - DNA, 30 bp, Artificial Sequence
  Description of Artificial Sequence: Synthetic oligonucleotide
tacgcgtttaatgggacacagcgcttcctg

SEQ ID NO: 52552 - DNA, 29 bp, Artificial Sequence
  Description of Artificial Sequence: Synthetic oligonucleotide
acgcgtttaatgggacacagcgcttcctg

SEQ ID NO: 52553 - DNA, 28 bp, Artificial Sequence
  Description of Artificial Sequence: Synthetic oligonucleotide
cgcgtttaatgggacacagcgcttcctg

SEQ ID NO: 52554 - DNA, 28 bp, Artificial Sequence
  Description of Artificial Sequence: Synthetic oligonucleotide
gcgtttaatgggacacagcgcttcctgg

SEQ ID NO: 52555 - DNA, 29 bp, Artificial Sequence
  Description of Artificial Sequence: Synthetic oligonucleotide
cgtttaatgggacacagcgcttcctggag

SEQ ID NO: 52556 - DNA, 30 bp, Artificial Sequence
  Description of Artificial Sequence: Synthetic oligonucleotide
gtttaatgggacacagcgcttcctggagag

SEQ ID NO: 52557 - DNA, 33 bp, Artificial Sequence
  Description of Artificial Sequence: Synthetic oligonucleotide
tttaatgggacacagcgcttcctggagagatac

SEQ ID NO: 52558 - DNA, 32 bp, Artificial Sequence
  Description of Artificial Sequence: Synthetic oligonucleotide
ttaatgggacacagcgcttcctggagagatac

SEQ ID NO: 52559 - DNA, 31 bp, Artificial Sequence
  Description of Artificial Sequence: Synthetic oligonucleotide
taatgggacacagcgcttcctggagagatac

SEQ ID NO: 52560 - DNA, 30 bp, Artificial Sequence
  Description of Artificial Sequence: Synthetic oligonucleotide
aatgggacacagcgcttcctggagagatac

SEQ ID NO: 52561 - DNA, 29 bp, Artificial Sequence
  Description of Artificial Sequence: Synthetic oligonucleotide
atgggacacagcgcttcctggagagatac

SEQ ID NO: 52562 - DNA, 28 bp, Artificial Sequence
  Description of Artificial Sequence: Synthetic oligonucleotide
tgggacacagcgcttcctggagagatac

SEQ ID NO: 52563 - DNA, 27 bp, Artificial Sequence
  Description of Artificial Sequence: Synthetic oligonucleotide
gggacacagcgcttcctggagagatac

SEQ ID NO: 52564 - DNA, 29 bp, Artificial Sequence
  Description of Artificial Sequence: Synthetic oligonucleotide
ggacacagcgcttcctggagagatacatc

SEQ ID NO: 52565 - DNA, 31 bp, Artificial Sequence
  Description of Artificial Sequence: Synthetic oligonucleotide
gacacagcgcttcctggagagatacatctac

SEQ ID NO: 52566 - DNA, 33 bp, Artificial Sequence
  Description of Artificial Sequence: Synthetic oligonucleotide
acacagcgcttcctggagagatacatctacaac

SEQ ID NO: 52567 - DNA, 32 bp, Artificial Sequence
  Description of Artificial Sequence: Synthetic oligonucleotide
cacagcgcttcctggagagatacatctacaac

SEQ ID NO: 52568 - DNA, 32 bp, Artificial Sequence
  Description of Artificial Sequence: Synthetic oligonucleotide
acagcgcttcctggagagatacatctacaacc

SEQ ID NO: 52569 - DNA, 31 bp, Artificial Sequence
  Description of Artificial Sequence: Synthetic oligonucleotide
cagcgcttcctggagagatacatctacaacc

SEQ ID NO: 52570 - DNA, 31 bp, Artificial Sequence
  Description of Artificial Sequence: Synthetic oligonucleotide
agcgcttcctggagagatacatctacaaccg

SEQ ID NO: 52571 - DNA, 30 bp, Artificial Sequence
  Description of Artificial Sequence: Synthetic oligonucleotide
gcgcttcctggagagatacatctacaaccg

SEQ ID NO: 52572 - DNA, 30 bp, Artificial Sequence
  Description of Artificial Sequence: Synthetic oligonucleotide
cgcttcctggagagatacatctacaaccgg

SEQ ID NO: 52573 - DNA, 30 bp, Artificial Sequence
  Description of Artificial Sequence: Synthetic oligonucleotide
gcttcctggagagatacatctacaaccggg

SEQ ID NO: 52574 - DNA, 31 bp, Artificial Sequence
  Description of Artificial Sequence: Synthetic oligonucleotide
cttcctggagagatacatctacaaccgggag

SEQ ID NO: 52575 - DNA, 31 bp, Artificial Sequence
  Description of Artificial Sequence: Synthetic oligonucleotide
ttcctggagagatacatctacaaccgggagg

SEQ ID NO: 52576 - DNA, 30 bp, Artificial Sequence
  Description of Artificial Sequence: Synthetic oligonucleotide
tcctggagagatacatctacaaccgggagg

SEQ ID NO: 52577 - DNA, 29 bp, Artificial Sequence
  Description of Artificial Sequence: Synthetic oligonucleotide
cctggagagatacatctacaaccgggagg

SEQ ID NO: 52578 - DNA, 30 bp, Artificial Sequence
  Description of Artificial Sequence: Synthetic oligonucleotide
ctggagagatacatctacaaccgggaggag

SEQ ID NO: 52579 - DNA, 32 bp, Artificial Sequence
  Description of Artificial Sequence: Synthetic oligonucleotide
tggagagatacatctacaaccgggaggagtac

SEQ ID NO: 52580 - DNA, 31 bp, Artificial Sequence
  Description of Artificial Sequence: Synthetic oligonucleotide
ggagagatacatctacaaccgggaggagtac

SEQ ID NO: 52581 - DNA, 31 bp, Artificial Sequence
  Description of Artificial Sequence: Synthetic oligonucleotide
gagagatacatctacaaccgggaggagtacg

SEQ ID NO: 52582 - DNA, 31 bp, Artificial Sequence
  Description of Artificial Sequence: Synthetic oligonucleotide
agagatacatctacaaccgggaggagtacgc

SEQ ID NO: 52583 - DNA, 30 bp, Artificial Sequence
  Description of Artificial Sequence: Synthetic oligonucleotide
gagatacatctacaaccgggaggagtacgc

SEQ ID NO: 52584 - DNA, 30 bp, Artificial Sequence
  Description of Artificial Sequence: Synthetic oligonucleotide
agatacatctacaaccgggaggagtacgcg

SEQ ID NO: 52585 - DNA, 29 bp, Artificial Sequence
  Description of Artificial Sequence: Synthetic oligonucleotide
gatacatctacaaccgggaggagtacgcg

SEQ ID NO: 52586 - DNA, 29 bp, Artificial Sequence
  Description of Artificial Sequence: Synthetic oligonucleotide
atacatctacaaccgggaggagtacgcgc

SEQ ID NO: 52587 - DNA, 28 bp, Artificial Sequence
  Description of Artificial Sequence: Synthetic oligonucleotide
tacatctacaaccgggaggagtacgcgc

SEQ ID NO: 52588 - DNA, 27 bp, Artificial Sequence
  Description of Artificial Sequence: Synthetic oligonucleotide
acatctacaaccgggaggagtacgcgc

SEQ ID NO: 52589 - DNA, 26 bp, Artificial Sequence
  Description of Artificial Sequence: Synthetic oligonucleotide
catctacaaccgggaggagtacgcgc

SEQ ID NO: 52590 - DNA, 26 bp, Artificial Sequence
  Description of Artificial Sequence: Synthetic oligonucleotide
atctacaaccgggaggagtacgcgcg

SEQ ID NO: 52591 - DNA, 25 bp, Artificial Sequence
  Description of Artificial Sequence: Synthetic oligonucleotide
tctacaaccgggaggagtacgcgcg

SEQ ID NO: 52592 - DNA, 24 bp, Artificial Sequence
  Description of Artificial Sequence: Synthetic oligonucleotide
ctacaaccgggaggagtacgcgcg

SEQ ID NO: 52593 - DNA, 26 bp, Artificial Sequence
  Description of Artificial Sequence: Synthetic oligonucleotide
tacaaccgggaggagtacgcgcgctt

SEQ ID NO: 52594 - DNA, 25 bp, Artificial Sequence
  Description of Artificial Sequence: Synthetic oligonucleotide
acaaccgggaggagtacgcgcgctt

SEQ ID NO: 52595 - DNA, 24 bp, Artificial Sequence
  Description of Artificial Sequence: Synthetic oligonucleotide
caaccgggaggagtacgcgcgctt

SEQ ID NO: 52596 - DNA, 24 bp, Artificial Sequence
  Description of Artificial Sequence: Synthetic oligonucleotide
aaccgggaggagtacgcgcgcttc

SEQ ID NO: 52597 - DNA, 23 bp, Artificial Sequence
  Description of Artificial Sequence: Synthetic oligonucleotide
accgggaggagtacgcgcgcttc

SEQ ID NO: 52598 - DNA, 22 bp, Artificial Sequence
  Description of Artificial Sequence: Synthetic oligonucleotide
ccgggaggagtacgcgcgcttc

SEQ ID NO: 52599 - DNA, 23 bp, Artificial Sequence
  Description of Artificial Sequence: Synthetic oligonucleotide
cgggaggagtacgcgcgcttcga

SEQ ID NO: 52600 - DNA, 24 bp, Artificial Sequence
  Description of Artificial Sequence: Synthetic oligonucleotide
gggaggagtacgcgcgcttcgaca

SEQ ID NO: 52601 - DNA, 24 bp, Artificial Sequence
  Description of Artificial Sequence: Synthetic oligonucleotide
ggaggagtacgcgcgcttcgacag

SEQ ID NO: 52602 - DNA, 24 bp, Artificial Sequence
  Description of Artificial Sequence: Synthetic oligonucleotide
gaggagtacgcgcgcttcgacagc

SEQ ID NO: 52603 - DNA, 25 bp, Artificial Sequence
  Description of Artificial Sequence: Synthetic oligonucleotide
aggagtacgcgcgcttcgacagcga

SEQ ID NO: 52604 - DNA, 24 bp, Artificial Sequence
  Description of Artificial Sequence: Synthetic oligonucleotide
ggagtacgcgcgcttcgacagcga

SEQ ID NO: 52605 - DNA, 24 bp, Artificial Sequence
  Description of Artificial Sequence: Synthetic oligonucleotide
gagtacgcgcgcttcgacagcgac

SEQ ID NO: 52606 - DNA, 25 bp, Artificial Sequence
  Description of Artificial Sequence: Synthetic oligonucleotide
agtacgcgcgcttcgacagcgacgt

SEQ ID NO: 52607 - DNA, 24 bp, Artificial Sequence
  Description of Artificial Sequence: Synthetic oligonucleotide
gtacgcgcgcttcgacagcgacgt

SEQ ID NO: 52608 - DNA, 24 bp, Artificial Sequence
  Description of Artificial Sequence: Synthetic oligonucleotide
tacgcgcgcttcgacagcgacgtg

SEQ ID NO: 52609 - DNA, 23 bp, Artificial Sequence
  Description of Artificial Sequence: Synthetic oligonucleotide
acgcgcgcttcgacagcgacgtg

SEQ ID NO: 52610 - DNA, 22 bp, Artificial Sequence
  Description of Artificial Sequence: Synthetic oligonucleotide
cgcgcgcttcgacagcgacgtg

SEQ ID NO: 52611 - DNA, 22 bp, Artificial Sequence
  Description of Artificial Sequence: Synthetic oligonucleotide
gcgcgcttcgacagcgacgtgg

SEQ ID NO: 52612 - DNA, 22 bp, Artificial Sequence
  Description of Artificial Sequence: Synthetic oligonucleotide
cgcgcttcgacagcgacgtggg

SEQ ID NO: 52613 - DNA, 22 bp, Artificial Sequence
  Description of Artificial Sequence: Synthetic oligonucleotide
gcgcttcgacagcgacgtgggg

SEQ ID NO: 52614 - DNA, 23 bp, Artificial Sequence
  Description of Artificial Sequence: Synthetic oligonucleotide
cgcttcgacagcgacgtggggga

SEQ ID NO: 52615 - DNA, 25 bp, Artificial Sequence
  Description of Artificial Sequence: Synthetic oligonucleotide
gcttcgacagcgacgtgggggagtt

SEQ ID NO: 52616 - DNA, 25 bp, Artificial Sequence
  Description of Artificial Sequence: Synthetic oligonucleotide
cttcgacagcgacgtgggggagttc

SEQ ID NO: 52617 - DNA, 25 bp, Artificial Sequence
  Description of Artificial Sequence: Synthetic oligonucleotide
ttcgacagcgacgtgggggagttcc

SEQ ID NO: 52618 - DNA, 24 bp, Artificial Sequence
  Description of Artificial Sequence: Synthetic oligonucleotide
tcgacagcgacgtgggggagttcc

SEQ ID NO: 52619 - DNA, 23 bp, Artificial Sequence
  Description of Artificial Sequence: Synthetic oligonucleotide
cgacagcgacgtgggggagttcc

SEQ ID NO: 52620 - DNA, 23 bp, Artificial Sequence
  Description of Artificial Sequence: Synthetic oligonucleotide
gacagcgacgtgggggagttccg

SEQ ID NO: 52621 - DNA, 23 bp, Artificial Sequence
  Description of Artificial Sequence: Synthetic oligonucleotide
acagcgacgtgggggagttccgg

SEQ ID NO: 52622 - DNA, 22 bp, Artificial Sequence
  Description of Artificial Sequence: Synthetic oligonucleotide
cagcgacgtgggggagttccgg

SEQ ID NO: 52623 - DNA, 22 bp, Artificial Sequence
  Description of Artificial Sequence: Synthetic oligonucleotide
agcgacgtgggggagttccggg

SEQ ID NO: 52624 - DNA, 21 bp, Artificial Sequence
  Description of Artificial Sequence: Synthetic oligonucleotide
gcgacgtgggggagttccggg

SEQ ID NO: 52625 - DNA, 21 bp, Artificial Sequence
  Description of Artificial Sequence: Synthetic oligonucleotide
cgacgtgggggagttccgggc

SEQ ID NO: 52626 - DNA, 21 bp, Artificial Sequence
  Description of Artificial Sequence: Synthetic oligonucleotide
gacgtgggggagttccgggcg

SEQ ID NO: 52627 - DNA, 22 bp, Artificial Sequence
  Description of Artificial Sequence: Synthetic oligonucleotide
acgtgggggagttccgggcggt

SEQ ID NO: 52628 - DNA, 21 bp, Artificial Sequence
  Description of Artificial Sequence: Synthetic oligonucleotide
cgtgggggagttccgggcggt

SEQ ID NO: 52629 - DNA, 22 bp, Artificial Sequence
  Description of Artificial Sequence: Synthetic oligonucleotide
gtgggggagttccgggcggtga

SEQ ID NO: 52630 - DNA, 22 bp, Artificial Sequence
  Description of Artificial Sequence: Synthetic oligonucleotide
tgggggagttccgggcggtgac

SEQ ID NO: 52631 - DNA, 21 bp, Artificial Sequence
  Description of Artificial Sequence: Synthetic oligonucleotide
gggggagttccgggcggtgac

SEQ ID NO: 52632 - DNA, 21 bp, Artificial Sequence
  Description of Artificial Sequence: Synthetic oligonucleotide
ggggagttccgggcggtgacg

SEQ ID NO: 52633 - DNA, 22 bp, Artificial Sequence
  Description of Artificial Sequence: Synthetic oligonucleotide
gggagttccgggcggtgacgga

SEQ ID NO: 52634 - DNA, 22 bp, Artificial Sequence
  Description of Artificial Sequence: Synthetic oligonucleotide
ggagttccgggcggtgacggag

SEQ ID NO: 52635 - DNA, 23 bp, Artificial Sequence
  Description of Artificial Sequence: Synthetic oligonucleotide
gagttccgggcggtgacggagct

SEQ ID NO: 52636 - DNA, 23 bp, Artificial Sequence
  Description of Artificial Sequence: Synthetic oligonucleotide
agttccgggcggtgacggagctg

SEQ ID NO: 52637 - DNA, 22 bp, Artificial Sequence
  Description of Artificial Sequence: Synthetic oligonucleotide
gttccgggcggtgacggagctg

SEQ ID NO: 52638 - DNA, 22 bp, Artificial Sequence
  Description of Artificial Sequence: Synthetic oligonucleotide
ttccgggcggtgacggagctgg

SEQ ID NO: 52639 - DNA, 21 bp, Artificial Sequence
  Description of Artificial Sequence: Synthetic oligonucleotide
tccgggcggtgacggagctgg

SEQ ID NO: 52640 - DNA, 20 bp, Artificial Sequence
  Description of Artificial Sequence: Synthetic oligonucleotide
ccgggcggtgacggagctgg

SEQ ID NO: 52641 - DNA, 20 bp, Artificial Sequence
  Description of Artificial Sequence: Synthetic oligonucleotide
cgggcggtgacggagctggg

SEQ ID NO: 52642 - DNA, 20 bp, Artificial Sequence
  Description of Artificial Sequence: Synthetic oligonucleotide
gggcggtgacggagctgggg

SEQ ID NO: 52643 - DNA, 20 bp, Artificial Sequence
  Description of Artificial Sequence: Synthetic oligonucleotide
ggcggtgacggagctggggc

SEQ ID NO: 52644 - DNA, 20 bp, Artificial Sequence
  Description of Artificial Sequence: Synthetic oligonucleotide
gcggtgacggagctggggcg

SEQ ID NO: 52645 - DNA, 20 bp, Artificial Sequence
  Description of Artificial Sequence: Synthetic oligonucleotide
cggtgacggagctggggcgg

SEQ ID NO: 52646 - DNA, 20 bp, Artificial Sequence
  Description of Artificial Sequence: Synthetic oligonucleotide
ggtgacggagctggggcggc

SEQ ID NO: 52647 - DNA, 21 bp, Artificial Sequence
  Description of Artificial Sequence: Synthetic oligonucleotide
gtgacggagctggggcggcct

SEQ ID NO: 52648 - DNA, 21 bp, Artificial Sequence
  Description of Artificial Sequence: Synthetic oligonucleotide
tgacggagctggggcggcctg

SEQ ID NO: 52649 - DNA, 20 bp, Artificial Sequence
  Description of Artificial Sequence: Synthetic oligonucleotide
gacggagctggggcggcctg

SEQ ID NO: 52650 - DNA, 21 bp, Artificial Sequence
  Description of Artificial Sequence: Synthetic oligonucleotide
acggagctggggcggcctgct

SEQ ID NO: 52651 - DNA, 20 bp, Artificial Sequence
  Description of Artificial Sequence: Synthetic oligonucleotide
cggagctggggcggcctgct

SEQ ID NO: 52652 - DNA, 20 bp, Artificial Sequence
  Description of Artificial Sequence: Synthetic oligonucleotide
ggagctggggcggcctgctg

SEQ ID NO: 52653 - DNA, 20 bp, Artificial Sequence
  Description of Artificial Sequence: Synthetic oligonucleotide
gagctggggcggcctgctgc

SEQ ID NO: 52654 - DNA, 20 bp, Artificial Sequence
  Description of Artificial Sequence: Synthetic oligonucleotide
agctggggcggcctgctgcg

SEQ ID NO: 52655 - DNA, 20 bp, Artificial Sequence
  Description of Artificial Sequence: Synthetic oligonucleotide
gctggggcggcctgctgcgt

SEQ ID NO: 52656 - DNA, 20 bp, Artificial Sequence
  Description of Artificial Sequence: Synthetic oligonucleotide
ctggggcggcctgctgcgga

SEQ ID NO: 52657 - DNA, 22 bp, Artificial Sequence
  Description of Artificial Sequence: Synthetic oligonucleotide
tggggcggcctgctgcggagta

SEQ ID NO: 52658 - DNA, 21 bp, Artificial Sequence
  Description of Artificial Sequence: Synthetic oligonucleotide
ggggcggcctgctgcggagta

SEQ ID NO: 52659 - DNA, 22 bp, Artificial Sequence
  Description of Artificial Sequence: Synthetic oligonucleotide
gggcggcctgctgcggagtact

SEQ ID NO: 52660 - DNA, 22 bp, Artificial Sequence
  Description of Artificial Sequence: Synthetic oligonucleotide
ggcggcctgctgcggagtactg

SEQ ID NO: 52661 - DNA, 24 bp, Artificial Sequence
  Description of Artificial Sequence: Synthetic oligonucleotide
gcggcctgctgcggagtactggaa

SEQ ID NO: 52662 - DNA, 25 bp, Artificial Sequence
  Description of Artificial Sequence: Synthetic oligonucleotide
cggcctgctgcggagtactggaaca

SEQ ID NO: 52663 - DNA, 25 bp, Artificial Sequence
  Description of Artificial Sequence: Synthetic oligonucleotide
ggcctgctgcggagtactggaacag

SEQ ID NO: 52664 - DNA, 25 bp, Artificial Sequence
  Description of Artificial Sequence: Synthetic oligonucleotide
gcctgctgcggagtactggaacagc

SEQ ID NO: 52665 - DNA, 26 bp, Artificial Sequence
  Description of Artificial Sequence: Synthetic oligonucleotide
cctgctgcggagtactggaacagcca

SEQ ID NO: 52666 - DNA, 27 bp, Artificial Sequence
  Description of Artificial Sequence: Synthetic oligonucleotide
ctgctgcggagtactggaacagccaga

SEQ ID NO: 52667 - DNA, 28 bp, Artificial Sequence
  Description of Artificial Sequence: Synthetic oligonucleotide
tgctgcggagtactggaacagccagaag

SEQ ID NO: 52668 - DNA, 27 bp, Artificial Sequence
  Description of Artificial Sequence: Synthetic oligonucleotide
gctgcggagtactggaacagccagaag

SEQ ID NO: 52669 - DNA, 27 bp, Artificial Sequence
  Description of Artificial Sequence: Synthetic oligonucleotide
ctgcggagtactggaacagccagaagg

SEQ ID NO: 52670 - DNA, 28 bp, Artificial Sequence
  Description of Artificial Sequence: Synthetic oligonucleotide
tgcggagtactggaacagccagaaggac

SEQ ID NO: 52671 - DNA, 27 bp, Artificial Sequence
  Description of Artificial Sequence: Synthetic oligonucleotide
gcggagtactggaacagccagaaggac

SEQ ID NO: 52672 - DNA, 29 bp, Artificial Sequence
  Description of Artificial Sequence: Synthetic oligonucleotide
cggagtactggaacagccagaaggacatc

SEQ ID NO: 52673 - DNA, 29 bp, Artificial Sequence
  Description of Artificial Sequence: Synthetic oligonucleotide
ggagtactggaacagccagaaggacatcc

SEQ ID NO: 52674 - DNA, 30 bp, Artificial Sequence
  Description of Artificial Sequence: Synthetic oligonucleotide
gagtactggaacagccagaaggacatcctg

SEQ ID NO: 52675 - DNA, 30 bp, Artificial Sequence
  Description of Artificial Sequence: Synthetic oligonucleotide
agtactggaacagccagaaggacatcctgg

SEQ ID NO: 52676 - DNA, 29 bp, Artificial Sequence
  Description of Artificial Sequence: Synthetic oligonucleotide
gtactggaacagccagaaggacatcctgg

SEQ ID NO: 52677 - DNA, 30 bp, Artificial Sequence
  Description of Artificial Sequence: Synthetic oligonucleotide
tactggaacagccagaaggacatcctggag

SEQ ID NO: 52678 - DNA, 29 bp, Artificial Sequence
  Description of Artificial Sequence: Synthetic oligonucleotide
actggaacagccagaaggacatcctggag

SEQ ID NO: 52679 - DNA, 28 bp, Artificial Sequence
  Description of Artificial Sequence: Synthetic oligonucleotide
ctggaacagccagaaggacatcctggag

SEQ ID NO: 52680 - DNA, 28 bp, Artificial Sequence
  Description of Artificial Sequence: Synthetic oligonucleotide
tggaacagccagaaggacatcctggagg

SEQ ID NO: 52681 - DNA, 27 bp, Artificial Sequence
  Description of Artificial Sequence: Synthetic oligonucleotide
ggaacagccagaaggacatcctggagg

SEQ ID NO: 52682 - DNA, 28 bp, Artificial Sequence
  Description of Artificial Sequence: Synthetic oligonucleotide
gaacagccagaaggacatcctggaggag

SEQ ID NO: 52683 - DNA, 30 bp, Artificial Sequence
  Description of Artificial Sequence: Synthetic oligonucleotide
aacagccagaaggacatcctggaggagaag

SEQ ID NO: 52684 - DNA, 29 bp, Artificial Sequence
  Description of Artificial Sequence: Synthetic oligonucleotide
acagccagaaggacatcctggaggagaag

SEQ ID NO: 52685 - DNA, 28 bp, Artificial Sequence
  Description of Artificial Sequence: Synthetic oligonucleotide
cagccagaaggacatcctggaggagaag

SEQ ID NO: 52686 - DNA, 28 bp, Artificial Sequence
  Description of Artificial Sequence: Synthetic oligonucleotide
agccagaaggacatcctggaggagaagc

SEQ ID NO: 52687 - DNA, 27 bp, Artificial Sequence
  Description of Artificial Sequence: Synthetic oligonucleotide
gccagaaggacatcctggaggagaagc

SEQ ID NO: 52688 - DNA, 27 bp, Artificial Sequence
  Description of Artificial Sequence: Synthetic oligonucleotide
ccagaaggacatcctggaggagaagcg

SEQ ID NO: 52689 - DNA, 27 bp, Artificial Sequence
  Description of Artificial Sequence: Synthetic oligonucleotide
cagaaggacatcctggaggagaagcgg

SEQ ID NO: 52690 - DNA, 27 bp, Artificial Sequence
  Description of Artificial Sequence: Synthetic oligonucleotide
agaaggacatcctggaggagaagcggg

SEQ ID NO: 52691 - DNA, 26 bp, Artificial Sequence
  Description of Artificial Sequence: Synthetic oligonucleotide
gaaggacatcctggaggagaagcggg

SEQ ID NO: 52692 - DNA, 27 bp, Artificial Sequence
  Description of Artificial Sequence: Synthetic oligonucleotide
aaggacatcctggaggagaagcgggca

SEQ ID NO: 52693 - DNA, 26 bp, Artificial Sequence
  Description of Artificial Sequence: Synthetic oligonucleotide
aggacatcctggaggagaagcgggca

SEQ ID NO: 52694 - DNA, 25 bp, Artificial Sequence
  Description of Artificial Sequence: Synthetic oligonucleotide
ggacatcctggaggagaagcgggca

SEQ ID NO: 52695 - DNA, 26 bp, Artificial Sequence
  Description of Artificial Sequence: Synthetic oligonucleotide
gacatcctggaggagaagcgggcagt

SEQ ID NO: 52696 - DNA, 26 bp, Artificial Sequence
  Description of Artificial Sequence: Synthetic oligonucleotide
acatcctggaggagaagcgggcagtg

SEQ ID NO: 52697 - DNA, 25 bp, Artificial Sequence
  Description of Artificial Sequence: Synthetic oligonucleotide
catcctggaggagaagcgggcagtg

SEQ ID NO: 52698 - DNA, 25 bp, Artificial Sequence
  Description of Artificial Sequence: Synthetic oligonucleotide
atcctggaggagaagcgggcagtgc

SEQ ID NO: 52699 - DNA, 24 bp, Artificial Sequence
  Description of Artificial Sequence: Synthetic oligonucleotide
tcctggaggagaagcgggcagtgc

SEQ ID NO: 52700 - DNA, 23 bp, Artificial Sequence
  Description of Artificial Sequence: Synthetic oligonucleotide
cctggaggagaagcgggcagtgc

SEQ ID NO: 52701 - DNA, 23 bp, Artificial Sequence
  Description of Artificial Sequence: Synthetic oligonucleotide
ctggaggagaagcgggcagtgcc

SEQ ID NO: 52702 - DNA, 23 bp, Artificial Sequence
  Description of Artificial Sequence: Synthetic oligonucleotide
tggaggagaagcgggcagtgccg

SEQ ID NO: 52703 - DNA, 22 bp, Artificial Sequence
  Description of Artificial Sequence: Synthetic oligonucleotide
ggaggagaagcgggcagtgccg

SEQ ID NO: 52704 - DNA, 23 bp, Artificial Sequence
  Description of Artificial Sequence: Synthetic oligonucleotide
gaggagaagcgggcagtgccgga

SEQ ID NO: 52705 - DNA, 24 bp, Artificial Sequence
  Description of Artificial Sequence: Synthetic oligonucleotide
aggagaagcgggcagtgccggaca

SEQ ID NO: 52706 - DNA, 23 bp, Artificial Sequence
  Description of Artificial Sequence: Synthetic oligonucleotide
ggagaagcgggcagtgccggaca

SEQ ID NO: 52707 - DNA, 23 bp, Artificial Sequence
  Description of Artificial Sequence: Synthetic oligonucleotide
gagaagcgggcagtgccggacag

SEQ ID NO: 52708 - DNA, 23 bp, Artificial Sequence
  Description of Artificial Sequence: Synthetic oligonucleotide
agaagcgggcagtgccggacagg

SEQ ID NO: 52709 - DNA, 22 bp, Artificial Sequence
  Description of Artificial Sequence: Synthetic oligonucleotide
gaagcgggcagtgccggacagg

SEQ ID NO: 52710 - DNA, 25 bp, Artificial Sequence
  Description of Artificial Sequence: Synthetic oligonucleotide
aagcgggcagtgccggacagggtat

SEQ ID NO: 52711 - DNA, 24 bp, Artificial Sequence
  Description of Artificial Sequence: Synthetic oligonucleotide
agcgggcagtgccggacagggtat

SEQ ID NO: 52712 - DNA, 23 bp, Artificial Sequence
  Description of Artificial Sequence: Synthetic oligonucleotide
gcgggcagtgccggacagggtat

SEQ ID NO: 52713 - DNA, 23 bp, Artificial Sequence
  Description of Artificial Sequence: Synthetic oligonucleotide
cgggcagtgccggacagggtatg

SEQ ID NO: 52714 - DNA, 24 bp, Artificial Sequence
  Description of Artificial Sequence: Synthetic oligonucleotide
gggcagtgccggacagggtatgca

SEQ ID NO: 52715 - DNA, 25 bp, Artificial Sequence
  Description of Artificial Sequence: Synthetic oligonucleotide
ggcagtgccggacagggtatgcaga

SEQ ID NO: 52716 - DNA, 26 bp, Artificial Sequence
  Description of Artificial Sequence: Synthetic oligonucleotide
gcagtgccggacagggtatgcagaca

SEQ ID NO: 52717 - DNA, 27 bp, Artificial Sequence
  Description of Artificial Sequence: Synthetic oligonucleotide
cagtgccggacagggtatgcagacaca

SEQ ID NO: 52718 - DNA, 28 bp, Artificial Sequence
  Description of Artificial Sequence: Synthetic oligonucleotide
agtgccggacagggtatgcagacacaac

SEQ ID NO: 52719 - DNA, 27 bp, Artificial Sequence
  Description of Artificial Sequence: Synthetic oligonucleotide
gtgccggacagggtatgcagacacaac

SEQ ID NO: 52720 - DNA, 29 bp, Artificial Sequence
  Description of Artificial Sequence: Synthetic oligonucleotide
tgccggacagggtatgcagacacaactac

SEQ ID NO: 52721 - DNA, 28 bp, Artificial Sequence
  Description of Artificial Sequence: Synthetic oligonucleotide
gccggacagggtatgcagacacaactac

SEQ ID NO: 52722 - DNA, 28 bp, Artificial Sequence
  Description of Artificial Sequence: Synthetic oligonucleotide
ccggacagggtatgcagacacaactacg

SEQ ID NO: 52723 - DNA, 29 bp, Artificial Sequence
  Description of Artificial Sequence: Synthetic oligonucleotide
cggacagggtatgcagacacaactacgag

SEQ ID NO: 52724 - DNA, 29 bp, Artificial Sequence
  Description of Artificial Sequence: Synthetic oligonucleotide
ggacagggtatgcagacacaactacgagc

SEQ ID NO: 52725 - DNA, 30 bp, Artificial Sequence
  Description of Artificial Sequence: Synthetic oligonucleotide
gacagggtatgcagacacaactacgagctg

SEQ ID NO: 52726 - DNA, 30 bp, Artificial Sequence
  Description of Artificial Sequence: Synthetic oligonucleotide
acagggtatgcagacacaactacgagctgg

SEQ ID NO: 52727 - DNA, 29 bp, Artificial Sequence
  Description of Artificial Sequence: Synthetic oligonucleotide
cagggtatgcagacacaactacgagctgg

SEQ ID NO: 52728 - DNA, 30 bp, Artificial Sequence
  Description of Artificial Sequence: Synthetic oligonucleotide
agggtatgcagacacaactacgagctggac

SEQ ID NO: 52729 - DNA, 29 bp, Artificial Sequence
  Description of Artificial Sequence: Synthetic oligonucleotide
gggtatgcagacacaactacgagctggac

SEQ ID NO: 52730 - DNA, 29 bp, Artificial Sequence
  Description of Artificial Sequence: Synthetic oligonucleotide
ggtatgcagacacaactacgagctggacg

SEQ ID NO: 52731 - DNA, 30 bp, Artificial Sequence
  Description of Artificial Sequence: Synthetic oligonucleotide
gtatgcagacacaactacgagctggacgag

SEQ ID NO: 52732 - DNA, 30 bp, Artificial Sequence
  Description of Artificial Sequence: Synthetic oligonucleotide
tatgcagacacaactacgagctggacgagg

SEQ ID NO: 52733 - DNA, 29 bp, Artificial Sequence
  Description of Artificial Sequence: Synthetic oligonucleotide
atgcagacacaactacgagctggacgagg

SEQ ID NO: 52734 - DNA, 28 bp, Artificial Sequence
  Description of Artificial Sequence: Synthetic oligonucleotide
tgcagacacaactacgagctggacgagg

SEQ ID NO: 52735 - DNA, 27 bp, Artificial Sequence
  Description of Artificial Sequence: Synthetic oligonucleotide
gcagacacaactacgagctggacgagg

SEQ ID NO: 52736 - DNA, 27 bp, Artificial Sequence
  Description of Artificial Sequence: Synthetic oligonucleotide
cagacacaactacgagctggacgaggc

SEQ ID NO: 52737 - DNA, 27 bp, Artificial Sequence
  Description of Artificial Sequence: Synthetic oligonucleotide
agacacaactacgagctggacgaggcc

SEQ ID NO: 52738 - DNA, 26 bp, Artificial Sequence
  Description of Artificial Sequence: Synthetic oligonucleotide
gacacaactacgagctggacgaggcc

SEQ ID NO: 52739 - DNA, 27 bp, Artificial Sequence
  Description of Artificial Sequence: Synthetic oligonucleotide
acacaactacgagctggacgaggccgt

SEQ ID NO: 52740 - DNA, 26 bp, Artificial Sequence
  Description of Artificial Sequence: Synthetic oligonucleotide
cacaactacgagctggacgaggccgt

SEQ ID NO: 52741 - DNA, 27 bp, Artificial Sequence
  Description of Artificial Sequence: Synthetic oligonucleotide
acaactacgagctggacgaggccgtga

SEQ ID NO: 52742 - DNA, 26 bp, Artificial Sequence
  Description of Artificial Sequence: Synthetic oligonucleotide
caactacgagctggacgaggccgtga

SEQ ID NO: 52743 - DNA, 26 bp, Artificial Sequence
  Description of Artificial Sequence: Synthetic oligonucleotide
aactacgagctggacgaggccgtgac

SEQ ID NO: 52744 - DNA, 25 bp, Artificial Sequence
  Description of Artificial Sequence: Synthetic oligonucleotide
actacgagctggacgaggccgtgac

SEQ ID NO: 52745 - DNA, 24 bp, Artificial Sequence
  Description of Artificial Sequence: Synthetic oligonucleotide
ctacgagctggacgaggccgtgac

SEQ ID NO: 52746 - DNA, 24 bp, Artificial Sequence
  Description of Artificial Sequence: Synthetic oligonucleotide
tacgagctggacgaggccgtgacc

SEQ ID NO: 52747 - DNA, 23 bp, Artificial Sequence
  Description of Artificial Sequence: Synthetic oligonucleotide
acgagctggacgaggccgtgacc

SEQ ID NO: 52748 - DNA, 22 bp, Artificial Sequence
  Description of Artificial Sequence: Synthetic oligonucleotide
cgagctggacgaggccgtgacc

SEQ ID NO: 52749 - DNA, 23 bp, Artificial Sequence
  Description of Artificial Sequence: Synthetic oligonucleotide
gagctggacgaggccgtgaccct

SEQ ID NO: 52750 - DNA, 23 bp, Artificial Sequence
  Description of Artificial Sequence: Synthetic oligonucleotide
agctggacgaggccgtgaccctg

SEQ ID NO: 52751 - DNA, 22 bp, Artificial Sequence
  Description of Artificial Sequence: Synthetic oligonucleotide
gctggacgaggccgtgaccctg

SEQ ID NO: 52752 - DNA, 23 bp, Artificial Sequence
  Description of Artificial Sequence: Synthetic oligonucleotide
ctggacgaggccgtgaccctgca

SEQ ID NO: 52753 - DNA, 23 bp, Artificial Sequence
  Description of Artificial Sequence: Synthetic oligonucleotide
tggacgaggccgtgaccctgcag

SEQ ID NO: 52754 - DNA, 22 bp, Artificial Sequence
  Description of Artificial Sequence: Synthetic oligonucleotide
ggacgaggccgtgaccctgcag

SEQ ID NO: 52755 - DNA, 22 bp, Artificial Sequence
  Description of Artificial Sequence: Synthetic oligonucleotide
gacgaggccgtgaccctgcagc

SEQ ID NO: 52756 - DNA, 22 bp, Artificial Sequence
  Description of Artificial Sequence: Synthetic oligonucleotide
acgaggccgtgaccctgcagcg

SEQ ID NO: 52757 - DNA, 21 bp, Artificial Sequence
  Description of Artificial Sequence: Synthetic oligonucleotide
cgaggccgtgaccctgcagcg

SEQ ID NO: 52758 - DNA, 21 bp, Artificial Sequence
  Description of Artificial Sequence: Synthetic oligonucleotide
gaggccgtgaccctgcagcgc

SEQ ID NO: 52759 - DNA, 21 bp, Artificial Sequence
  Description of Artificial Sequence: Synthetic oligonucleotide
aggccgtgaccctgcagcgcc

SEQ ID NO: 52760 - DNA, 20 bp, Artificial Sequence
  Description of Artificial Sequence: Synthetic oligonucleotide
ggccgtgaccctgcagcgcc

SEQ ID NO: 52761 - DNA, 21 bp, Artificial Sequence
  Description of Artificial Sequence: Synthetic oligonucleotide
gccgtgaccctgcagcgccga

SEQ ID NO: 52762 - DNA, 22 bp, Artificial Sequence
  Description of Artificial Sequence: Synthetic oligonucleotide
ccgtgaccctgcagcgccgagt

SEQ ID NO: 52763 - DNA, 22 bp, Artificial Sequence
  Description of Artificial Sequence: Synthetic oligonucleotide
cgtgaccctgcagcgccgagtc

SEQ ID NO: 52764 - DNA, 23 bp, Artificial Sequence
  Description of Artificial Sequence: Synthetic oligonucleotide
gtgaccctgcagcgccgagtcca

SEQ ID NO: 52765 - DNA, 23 bp, Artificial Sequence
  Description of Artificial Sequence: Synthetic oligonucleotide
tgaccctgcagcgccgagtccag

SEQ ID NO: 52766 - DNA, 22 bp, Artificial Sequence
  Description of Artificial Sequence: Synthetic oligonucleotide
gaccctgcagcgccgagtccag

SEQ ID NO: 52767 - DNA, 22 bp, Artificial Sequence
  Description of Artificial Sequence: Synthetic oligonucleotide
accctgcagcgccgagtccagc

SEQ ID NO: 52768 - DNA, 21 bp, Artificial Sequence
  Description of Artificial Sequence: Synthetic oligonucleotide
ccctgcagcgccgagtccagc

SEQ ID NO: 52769 - DNA, 24 bp, Artificial Sequence
  Description of Artificial Sequence: Synthetic oligonucleotide
cctgcagcgccgagtccagcctaa

SEQ ID NO: 52770 - DNA, 24 bp, Artificial Sequence
  Description of Artificial Sequence: Synthetic oligonucleotide
ctgcagcgccgagtccagcctaag

SEQ ID NO: 52771 - DNA, 25 bp, Artificial Sequence
  Description of Artificial Sequence: Synthetic oligonucleotide
tgcagcgccgagtccagcctaaggt

SEQ ID NO: 52772 - DNA, 24 bp, Artificial Sequence
  Description of Artificial Sequence: Synthetic oligonucleotide
gcagcgccgagtccagcctaaggt

SEQ ID NO: 52773 - DNA, 26 bp, Artificial Sequence
  Description of Artificial Sequence: Synthetic oligonucleotide
cagcgccgagtccagcctaaggtgaa

SEQ ID NO: 52774 - DNA, 26 bp, Artificial Sequence
  Description of Artificial Sequence: Synthetic oligonucleotide
agcgccgagtccagcctaaggtgaac

SEQ ID NO: 52775 - DNA, 25 bp, Artificial Sequence
  Description of Artificial Sequence: Synthetic oligonucleotide
gcgccgagtccagcctaaggtgaac

SEQ ID NO: 52776 - DNA, 27 bp, Artificial Sequence
  Description of Artificial Sequence: Synthetic oligonucleotide
cgccgagtccagcctaaggtgaacgtt

SEQ ID NO: 52777 - DNA, 28 bp, Artificial Sequence
  Description of Artificial Sequence: Synthetic oligonucleotide
gccgagtccagcctaaggtgaacgtttc

SEQ ID NO: 52778 - DNA, 28 bp, Artificial Sequence
  Description of Artificial Sequence: Synthetic oligonucleotide
ccgagtccagcctaaggtgaacgtttcc

SEQ ID NO: 52779 - DNA, 28 bp, Artificial Sequence
  Description of Artificial Sequence: Synthetic oligonucleotide
cgagtccagcctaaggtgaacgtttccc

SEQ ID NO: 52780 - DNA, 28 bp, Artificial Sequence
  Description of Artificial Sequence: Synthetic oligonucleotide
gagtccagcctaaggtgaacgtttcccc

SEQ ID NO: 52781 - DNA, 28 bp, Artificial Sequence
  Description of Artificial Sequence: Synthetic oligonucleotide
agtccagcctaaggtgaacgtttccccc

SEQ ID NO: 52782 - DNA, 27 bp, Artificial Sequence
  Description of Artificial Sequence: Synthetic oligonucleotide
gtccagcctaaggtgaacgtttccccc

SEQ ID NO: 52783 - DNA, 28 bp, Artificial Sequence
  Description of Artificial Sequence: Synthetic oligonucleotide
tccagcctaaggtgaacgtttccccctc

SEQ ID NO: 52784 - DNA, 27 bp, Artificial Sequence
  Description of Artificial Sequence: Synthetic oligonucleotide
ccagcctaaggtgaacgtttccccctc

SEQ ID NO: 52785 - DNA, 27 bp, Artificial Sequence
  Description of Artificial Sequence: Synthetic oligonucleotide
cagcctaaggtgaacgtttccccctcc

SEQ ID NO: 52786 - DNA, 29 bp, Artificial Sequence
  Description of Artificial Sequence: Synthetic oligonucleotide
agcctaaggtgaacgtttccccctccaag

SEQ ID NO: 52787 - DNA, 28 bp, Artificial Sequence
  Description of Artificial Sequence: Synthetic oligonucleotide
gcctaaggtgaacgtttccccctccaag

SEQ ID NO: 52788 - DNA, 30 bp, Artificial Sequence
  Description of Artificial Sequence: Synthetic oligonucleotide
cctaaggtgaacgtttccccctccaagaag

SEQ ID NO: 52789 - DNA, 30 bp, Artificial Sequence
  Description of Artificial Sequence: Synthetic oligonucleotide
ctaaggtgaacgtttccccctccaagaagg

SEQ ID NO: 52790 - DNA, 30 bp, Artificial Sequence
  Description of Artificial Sequence: Synthetic oligonucleotide
taaggtgaacgtttccccctccaagaaggg

SEQ ID NO: 52791 - DNA, 29 bp, Artificial Sequence
  Description of Artificial Sequence: Synthetic oligonucleotide
aaggtgaacgtttccccctccaagaaggg

SEQ ID NO: 52792 - DNA, 28 bp, Artificial Sequence
  Description of Artificial Sequence: Synthetic oligonucleotide
aggtgaacgtttccccctccaagaaggg

SEQ ID NO: 52793 - DNA, 27 bp, Artificial Sequence
  Description of Artificial Sequence: Synthetic oligonucleotide
ggtgaacgtttccccctccaagaaggg

SEQ ID NO: 52794 - DNA, 27 bp, Artificial Sequence
  Description of Artificial Sequence: Synthetic oligonucleotide
gtgaacgtttccccctccaagaagggg

SEQ ID NO: 52795 - DNA, 27 bp, Artificial Sequence
  Description of Artificial Sequence: Synthetic oligonucleotide
tgaacgtttccccctccaagaaggggc

SEQ ID NO: 52796 - DNA, 26 bp, Artificial Sequence
  Description of Artificial Sequence: Synthetic oligonucleotide
gaacgtttccccctccaagaaggggc

SEQ ID NO: 52797 - DNA, 26 bp, Artificial Sequence
  Description of Artificial Sequence: Synthetic oligonucleotide
aacgtttccccctccaagaaggggcc

SEQ ID NO: 52798 - DNA, 25 bp, Artificial Sequence
  Description of Artificial Sequence: Synthetic oligonucleotide
acgtttccccctccaagaaggggcc

SEQ ID NO: 52799 - DNA, 24 bp, Artificial Sequence
  Description of Artificial Sequence: Synthetic oligonucleotide
cgtttccccctccaagaaggggcc

SEQ ID NO: 52800 - DNA, 24 bp, Artificial Sequence
  Description of Artificial Sequence: Synthetic oligonucleotide
gtttccccctccaagaaggggccc

SEQ ID NO: 52801 - DNA, 25 bp, Artificial Sequence
  Description of Artificial Sequence: Synthetic oligonucleotide
tttccccctccaagaaggggcccct

SEQ ID NO: 52802 - DNA, 24 bp, Artificial Sequence
  Description of Artificial Sequence: Synthetic oligonucleotide
ttccccctccaagaaggggcccct

SEQ ID NO: 52803 - DNA, 23 bp, Artificial Sequence
  Description of Artificial Sequence: Synthetic oligonucleotide
tccccctccaagaaggggcccct

SEQ ID NO: 52804 - DNA, 22 bp, Artificial Sequence
  Description of Artificial Sequence: Synthetic oligonucleotide
ccccctccaagaaggggcccct

SEQ ID NO: 52805 - DNA, 22 bp, Artificial Sequence
  Description of Artificial Sequence: Synthetic oligonucleotide
cccctccaagaaggggcccctg

SEQ ID NO: 52806 - DNA, 23 bp, Artificial Sequence
  Description of Artificial Sequence: Synthetic oligonucleotide
ccctccaagaaggggcccctgca

SEQ ID NO: 52807 - DNA, 23 bp, Artificial Sequence
  Description of Artificial Sequence: Synthetic oligonucleotide
cctccaagaaggggcccctgcag

SEQ ID NO: 52808 - DNA, 24 bp, Artificial Sequence
  Description of Artificial Sequence: Synthetic oligonucleotide
ctccaagaaggggcccctgcagca

SEQ ID NO: 52809 - DNA, 24 bp, Artificial Sequence
  Description of Artificial Sequence: Synthetic oligonucleotide
tccaagaaggggcccctgcagcac

SEQ ID NO: 52810 - DNA, 23 bp, Artificial Sequence
  Description of Artificial Sequence: Synthetic oligonucleotide
ccaagaaggggcccctgcagcac

SEQ ID NO: 52811 - DNA, 24 bp, Artificial Sequence
  Description of Artificial Sequence: Synthetic oligonucleotide
caagaaggggcccctgcagcacca

SEQ ID NO: 52812 - DNA, 26 bp, Artificial Sequence
  Description of Artificial Sequence: Synthetic oligonucleotide
aagaaggggcccctgcagcaccacaa

SEQ ID NO: 52813 - DNA, 25 bp, Artificial Sequence
  Description of Artificial Sequence: Synthetic oligonucleotide
agaaggggcccctgcagcaccacaa

SEQ ID NO: 52814 - DNA, 24 bp, Artificial Sequence
  Description of Artificial Sequence: Synthetic oligonucleotide
gaaggggcccctgcagcaccacaa

SEQ ID NO: 52815 - DNA, 24 bp, Artificial Sequence
  Description of Artificial Sequence: Synthetic oligonucleotide
aaggggcccctgcagcaccacaac

SEQ ID NO: 52816 - DNA, 23 bp, Artificial Sequence
  Description of Artificial Sequence: Synthetic oligonucleotide
aggggcccctgcagcaccacaac

SEQ ID NO: 52817 - DNA, 22 bp, Artificial Sequence
  Description of Artificial Sequence: Synthetic oligonucleotide
ggggcccctgcagcaccacaac

SEQ ID NO: 52818 - DNA, 23 bp, Artificial Sequence
  Description of Artificial Sequence: Synthetic oligonucleotide
gggcccctgcagcaccacaacct

SEQ ID NO: 52819 - DNA, 23 bp, Artificial Sequence
  Description of Artificial Sequence: Synthetic oligonucleotide
ggcccctgcagcaccacaacctg

SEQ ID NO: 52820 - DNA, 25 bp, Artificial Sequence
  Description of Artificial Sequence: Synthetic oligonucleotide
gcccctgcagcaccacaacctgctt

SEQ ID NO: 52821 - DNA, 26 bp, Artificial Sequence
  Description of Artificial Sequence: Synthetic oligonucleotide
cccctgcagcaccacaacctgcttgt

SEQ ID NO: 52822 - DNA, 27 bp, Artificial Sequence
  Description of Artificial Sequence: Synthetic oligonucleotide
ccctgcagcaccacaacctgcttgtct

SEQ ID NO: 52823 - DNA, 27 bp, Artificial Sequence
  Description of Artificial Sequence: Synthetic oligonucleotide
cctgcagcaccacaacctgcttgtctg

SEQ ID NO: 52824 - DNA, 27 bp, Artificial Sequence
  Description of Artificial Sequence: Synthetic oligonucleotide
ctgcagcaccacaacctgcttgtctgc

SEQ ID NO: 52825 - DNA, 27 bp, Artificial Sequence
  Description of Artificial Sequence: Synthetic oligonucleotide
tgcagcaccacaacctgcttgtctgcc

SEQ ID NO: 52826 - DNA, 27 bp, Artificial Sequence
  Description of Artificial Sequence: Synthetic oligonucleotide
gcagcaccacaacctgcttgtctgcca

SEQ ID NO: 52827 - DNA, 27 bp, Artificial Sequence
  Description of Artificial Sequence: Synthetic oligonucleotide
cagcaccacaacctgcttgtctgccac

SEQ ID NO: 52828 - DNA, 27 bp, Artificial Sequence
  Description of Artificial Sequence: Synthetic oligonucleotide
agcaccacaacctgcttgtctgccacg

SEQ ID NO: 52829 - DNA, 27 bp, Artificial Sequence
  Description of Artificial Sequence: Synthetic oligonucleotide
gcaccacaacctgcttgtctgccacgt

SEQ ID NO: 52830 - DNA, 27 bp, Artificial Sequence
  Description of Artificial Sequence: Synthetic oligonucleotide
caccacaacctgcttgtctgccacgtg

SEQ ID NO: 52831 - DNA, 28 bp, Artificial Sequence
  Description of Artificial Sequence: Synthetic oligonucleotide
accacaacctgcttgtctgccacgtgac

SEQ ID NO: 52832 - DNA, 27 bp, Artificial Sequence
  Description of Artificial Sequence: Synthetic oligonucleotide
ccacaacctgcttgtctgccacgtgac

SEQ ID NO: 52833 - DNA, 28 bp, Artificial Sequence
  Description of Artificial Sequence: Synthetic oligonucleotide
cacaacctgcttgtctgccacgtgacag

SEQ ID NO: 52834 - DNA, 32 bp, Artificial Sequence
  Description of Artificial Sequence: Synthetic oligonucleotide
acaacctgcttgtctgccacgtgacagatttc

SEQ ID NO: 52835 - DNA, 31 bp, Artificial Sequence
  Description of Artificial Sequence: Synthetic oligonucleotide
caacctgcttgtctgccacgtgacagatttc

SEQ ID NO: 52836 - DNA, 33 bp, Artificial Sequence
  Description of Artificial Sequence: Synthetic oligonucleotide
aacctgcttgtctgccacgtgacagatttctac

SEQ ID NO: 52837 - DNA, 32 bp, Artificial Sequence
  Description of Artificial Sequence: Synthetic oligonucleotide
acctgcttgtctgccacgtgacagatttctac

SEQ ID NO: 52838 - DNA, 31 bp, Artificial Sequence
  Description of Artificial Sequence: Synthetic oligonucleotide
cctgcttgtctgccacgtgacagatttctac

SEQ ID NO: 52839 - DNA, 31 bp, Artificial Sequence
  Description of Artificial Sequence: Synthetic oligonucleotide
ctgcttgtctgccacgtgacagatttctacc

SEQ ID NO: 52840 - DNA, 31 bp, Artificial Sequence
  Description of Artificial Sequence: Synthetic oligonucleotide
tgcttgtctgccacgtgacagatttctaccc

SEQ ID NO: 52841 - DNA, 30 bp, Artificial Sequence
  Description of Artificial Sequence: Synthetic oligonucleotide
gcttgtctgccacgtgacagatttctaccc

SEQ ID NO: 52842 - DNA, 31 bp, Artificial Sequence
  Description of Artificial Sequence: Synthetic oligonucleotide
cttgtctgccacgtgacagatttctacccag

SEQ ID NO: 52843 - DNA, 31 bp, Artificial Sequence
  Description of Artificial Sequence: Synthetic oligonucleotide
ttgtctgccacgtgacagatttctacccagg

SEQ ID NO: 52844 - DNA, 30 bp, Artificial Sequence
  Description of Artificial Sequence: Synthetic oligonucleotide
tgtctgccacgtgacagatttctacccagg

SEQ ID NO: 52845 - DNA, 29 bp, Artificial Sequence
  Description of Artificial Sequence: Synthetic oligonucleotide
gtctgccacgtgacagatttctacccagg

SEQ ID NO: 52846 - DNA, 29 bp, Artificial Sequence
  Description of Artificial Sequence: Synthetic oligonucleotide
tctgccacgtgacagatttctacccaggc

SEQ ID NO: 52847 - DNA, 28 bp, Artificial Sequence
  Description of Artificial Sequence: Synthetic oligonucleotide
ctgccacgtgacagatttctacccaggc

SEQ ID NO: 52848 - DNA, 29 bp, Artificial Sequence
  Description of Artificial Sequence: Synthetic oligonucleotide
tgccacgtgacagatttctacccaggcag

SEQ ID NO: 52849 - DNA, 28 bp, Artificial Sequence
  Description of Artificial Sequence: Synthetic oligonucleotide
gccacgtgacagatttctacccaggcag

SEQ ID NO: 52850 - DNA, 28 bp, Artificial Sequence
  Description of Artificial Sequence: Synthetic oligonucleotide
ccacgtgacagatttctacccaggcagc

SEQ ID NO: 52851 - DNA, 31 bp, Artificial Sequence
  Description of Artificial Sequence: Synthetic oligonucleotide
cacgtgacagatttctacccaggcagcattc

SEQ ID NO: 52852 - DNA, 33 bp, Artificial Sequence
  Description of Artificial Sequence: Synthetic oligonucleotide
acgtgacagatttctacccaggcagcattcaag

SEQ ID NO: 52853 - DNA, 32 bp, Artificial Sequence
  Description of Artificial Sequence: Synthetic oligonucleotide
cgtgacagatttctacccaggcagcattcaag

SEQ ID NO: 52854 - DNA, 33 bp, Artificial Sequence
  Description of Artificial Sequence: Synthetic oligonucleotide
gtgacagatttctacccaggcagcattcaagtc

SEQ ID NO: 52855 - DNA, 33 bp, Artificial Sequence
  Description of Artificial Sequence: Synthetic oligonucleotide
tgacagatttctacccaggcagcattcaagtcc

SEQ ID NO: 52856 - DNA, 32 bp, Artificial Sequence
  Description of Artificial Sequence: Synthetic oligonucleotide
gacagatttctacccaggcagcattcaagtcc

SEQ ID NO: 52857 - DNA, 32 bp, Artificial Sequence
  Description of Artificial Sequence: Synthetic oligonucleotide
acagatttctacccaggcagcattcaagtccg

SEQ ID NO: 52858 - DNA, 31 bp, Artificial Sequence
  Description of Artificial Sequence: Synthetic oligonucleotide
cagatttctacccaggcagcattcaagtccg

SEQ ID NO: 52859 - DNA, 33 bp, Artificial Sequence
  Description of Artificial Sequence: Synthetic oligonucleotide
agatttctacccaggcagcattcaagtccgatg

SEQ ID NO: 52860 - DNA, 32 bp, Artificial Sequence
  Description of Artificial Sequence: Synthetic oligonucleotide
gatttctacccaggcagcattcaagtccgatg

SEQ ID NO: 52861 - DNA, 32 bp, Artificial Sequence
  Description of Artificial Sequence: Synthetic oligonucleotide
atttctacccaggcagcattcaagtccgatgg

SEQ ID NO: 52862 - DNA, 31 bp, Artificial Sequence
  Description of Artificial Sequence: Synthetic oligonucleotide
tttctacccaggcagcattcaagtccgatgg

SEQ ID NO: 52863 - DNA, 30 bp, Artificial Sequence
  Description of Artificial Sequence: Synthetic oligonucleotide
ttctacccaggcagcattcaagtccgatgg

SEQ ID NO: 52864 - DNA, 29 bp, Artificial Sequence
  Description of Artificial Sequence: Synthetic oligonucleotide
tctacccaggcagcattcaagtccgatgg

SEQ ID NO: 52865 - DNA, 28 bp, Artificial Sequence
  Description of Artificial Sequence: Synthetic oligonucleotide
ctacccaggcagcattcaagtccgatgg

SEQ ID NO: 52866 - DNA, 30 bp, Artificial Sequence
  Description of Artificial Sequence: Synthetic oligonucleotide
tacccaggcagcattcaagtccgatggttc

SEQ ID NO: 52867 - DNA, 29 bp, Artificial Sequence
  Description of Artificial Sequence: Synthetic oligonucleotide
acccaggcagcattcaagtccgatggttc

SEQ ID NO: 52868 - DNA, 28 bp, Artificial Sequence
  Description of Artificial Sequence: Synthetic oligonucleotide
cccaggcagcattcaagtccgatggttc

SEQ ID NO: 52869 - DNA, 28 bp, Artificial Sequence
  Description of Artificial Sequence: Synthetic oligonucleotide
ccaggcagcattcaagtccgatggttcc

SEQ ID NO: 52870 - DNA, 29 bp, Artificial Sequence
  Description of Artificial Sequence: Synthetic oligonucleotide
caggcagcattcaagtccgatggttcctg

SEQ ID NO: 52871 - DNA, 32 bp, Artificial Sequence
  Description of Artificial Sequence: Synthetic oligonucleotide
aggcagcattcaagtccgatggttcctgaatg

SEQ ID NO: 52872 - DNA, 31 bp, Artificial Sequence
  Description of Artificial Sequence: Synthetic oligonucleotide
ggcagcattcaagtccgatggttcctgaatg

SEQ ID NO: 52873 - DNA, 31 bp, Artificial Sequence
  Description of Artificial Sequence: Synthetic oligonucleotide
gcagcattcaagtccgatggttcctgaatgg

SEQ ID NO: 52874 - DNA, 32 bp, Artificial Sequence
  Description of Artificial Sequence: Synthetic oligonucleotide
cagcattcaagtccgatggttcctgaatggac

SEQ ID NO: 52875 - DNA, 33 bp, Artificial Sequence
  Description of Artificial Sequence: Synthetic oligonucleotide
agcattcaagtccgatggttcctgaatggacag

SEQ ID NO: 52876 - DNA, 32 bp, Artificial Sequence
  Description of Artificial Sequence: Synthetic oligonucleotide
gcattcaagtccgatggttcctgaatggacag

SEQ ID NO: 52877 - DNA, 32 bp, Artificial Sequence
  Description of Artificial Sequence: Synthetic oligonucleotide
cattcaagtccgatggttcctgaatggacagg

SEQ ID NO: 52878 - DNA, 33 bp, Artificial Sequence
  Description of Artificial Sequence: Synthetic oligonucleotide
attcaagtccgatggttcctgaatggacaggag

SEQ ID NO: 52879 - DNA, 32 bp, Artificial Sequence
  Description of Artificial Sequence: Synthetic oligonucleotide
ttcaagtccgatggttcctgaatggacaggag

SEQ ID NO: 52880 - DNA, 31 bp, Artificial Sequence
  Description of Artificial Sequence: Synthetic oligonucleotide
tcaagtccgatggttcctgaatggacaggag

SEQ ID NO: 52881 - DNA, 30 bp, Artificial Sequence
  Description of Artificial Sequence: Synthetic oligonucleotide
caagtccgatggttcctgaatggacaggag

SEQ ID NO: 52882 - DNA, 30 bp, Artificial Sequence
  Description of Artificial Sequence: Synthetic oligonucleotide
aagtccgatggttcctgaatggacaggagg

SEQ ID NO: 52883 - DNA, 29 bp, Artificial Sequence
  Description of Artificial Sequence: Synthetic oligonucleotide
agtccgatggttcctgaatggacaggagg

SEQ ID NO: 52884 - DNA, 28 bp, Artificial Sequence
  Description of Artificial Sequence: Synthetic oligonucleotide
gtccgatggttcctgaatggacaggagg

SEQ ID NO: 52885 - DNA, 31 bp, Artificial Sequence
  Description of Artificial Sequence: Synthetic oligonucleotide
tccgatggttcctgaatggacaggaggaaac

SEQ ID NO: 52886 - DNA, 30 bp, Artificial Sequence
  Description of Artificial Sequence: Synthetic oligonucleotide
ccgatggttcctgaatggacaggaggaaac

SEQ ID NO: 52887 - DNA, 31 bp, Artificial Sequence
  Description of Artificial Sequence: Synthetic oligonucleotide
cgatggttcctgaatggacaggaggaaacag

SEQ ID NO: 52888 - DNA, 31 bp, Artificial Sequence
  Description of Artificial Sequence: Synthetic oligonucleotide
gatggttcctgaatggacaggaggaaacagc

SEQ ID NO: 52889 - DNA, 32 bp, Artificial Sequence
  Description of Artificial Sequence: Synthetic oligonucleotide
atggttcctgaatggacaggaggaaacagctg

SEQ ID NO: 52890 - DNA, 31 bp, Artificial Sequence
  Description of Artificial Sequence: Synthetic oligonucleotide
tggttcctgaatggacaggaggaaacagctg

SEQ ID NO: 52891 - DNA, 30 bp, Artificial Sequence
  Description of Artificial Sequence: Synthetic oligonucleotide
ggttcctgaatggacaggaggaaacagctg

SEQ ID NO: 52892 - DNA, 30 bp, Artificial Sequence
  Description of Artificial Sequence: Synthetic oligonucleotide
gttcctgaatggacaggaggaaacagctgg

SEQ ID NO: 52893 - DNA, 30 bp, Artificial Sequence
  Description of Artificial Sequence: Synthetic oligonucleotide
ttcctgaatggacaggaggaaacagctggg

SEQ ID NO: 52894 - DNA, 29 bp, Artificial Sequence
  Description of Artificial Sequence: Synthetic oligonucleotide
tcctgaatggacaggaggaaacagctggg

SEQ ID NO: 52895 - DNA, 28 bp, Artificial Sequence
  Description of Artificial Sequence: Synthetic oligonucleotide
cctgaatggacaggaggaaacagctggg

SEQ ID NO: 52896 - DNA, 28 bp, Artificial Sequence
  Description of Artificial Sequence: Synthetic oligonucleotide
ctgaatggacaggaggaaacagctgggg

SEQ ID NO: 52897 - DNA, 29 bp, Artificial Sequence
  Description of Artificial Sequence: Synthetic oligonucleotide
tgaatggacaggaggaaacagctggggtc

SEQ ID NO: 52898 - DNA, 28 bp, Artificial Sequence
  Description of Artificial Sequence: Synthetic oligonucleotide
gaatggacaggaggaaacagctggggtc

SEQ ID NO: 52899 - DNA, 28 bp, Artificial Sequence
  Description of Artificial Sequence: Synthetic oligonucleotide
aatggacaggaggaaacagctggggtcg

SEQ ID NO: 52900 - DNA, 27 bp, Artificial Sequence
  Description of Artificial Sequence: Synthetic oligonucleotide
atggacaggaggaaacagctggggtcg

SEQ ID NO: 52901 - DNA, 27 bp, Artificial Sequence
  Description of Artificial Sequence: Synthetic oligonucleotide
tggacaggaggaaacagctggggtcgt

SEQ ID NO: 52902 - DNA, 26 bp, Artificial Sequence
  Description of Artificial Sequence: Synthetic oligonucleotide
ggacaggaggaaacagctggggtcgt

SEQ ID NO: 52903 - DNA, 27 bp, Artificial Sequence
  Description of Artificial Sequence: Synthetic oligonucleotide
gacaggaggaaacagctggggtcgtgt

SEQ ID NO: 52904 - DNA, 27 bp, Artificial Sequence
  Description of Artificial Sequence: Synthetic oligonucleotide
acaggaggaaacagctggggtcgtgtc

SEQ ID NO: 52905 - DNA, 26 bp, Artificial Sequence
  Description of Artificial Sequence: Synthetic oligonucleotide
caggaggaaacagctggggtcgtgtc

SEQ ID NO: 52906 - DNA, 27 bp, Artificial Sequence
  Description of Artificial Sequence: Synthetic oligonucleotide
aggaggaaacagctggggtcgtgtcca

SEQ ID NO: 52907 - DNA, 26 bp, Artificial Sequence
  Description of Artificial Sequence: Synthetic oligonucleotide
ggaggaaacagctggggtcgtgtcca

SEQ ID NO: 52908 - DNA, 26 bp, Artificial Sequence
  Description of Artificial Sequence: Synthetic oligonucleotide
gaggaaacagctggggtcgtgtccac

SEQ ID NO: 52909 - DNA, 27 bp, Artificial Sequence
  Description of Artificial Sequence: Synthetic oligonucleotide
aggaaacagctggggtcgtgtccacca

SEQ ID NO: 52910 - DNA, 27 bp, Artificial Sequence
  Description of Artificial Sequence: Synthetic oligonucleotide
ggaaacagctggggtcgtgtccaccaa

SEQ ID NO: 52911 - DNA, 27 bp, Artificial Sequence
  Description of Artificial Sequence: Synthetic oligonucleotide
gaaacagctggggtcgtgtccaccaac

SEQ ID NO: 52912 - DNA, 27 bp, Artificial Sequence
  Description of Artificial Sequence: Synthetic oligonucleotide
aaacagctggggtcgtgtccaccaacc

SEQ ID NO: 52913 - DNA, 27 bp, Artificial Sequence
  Description of Artificial Sequence: Synthetic oligonucleotide
aacagctggggtcgtgtccaccaacct

SEQ ID NO: 52914 - DNA, 26 bp, Artificial Sequence
  Description of Artificial Sequence: Synthetic oligonucleotide
acagctggggtcgtgtccaccaacct

SEQ ID NO: 52915 - DNA, 25 bp, Artificial Sequence
  Description of Artificial Sequence: Synthetic oligonucleotide
cagctggggtcgtgtccaccaacct

SEQ ID NO: 52916 - DNA, 27 bp, Artificial Sequence
  Description of Artificial Sequence: Synthetic oligonucleotide
agctggggtcgtgtccaccaacctgat

SEQ ID NO: 52917 - DNA, 26 bp, Artificial Sequence
  Description of Artificial Sequence: Synthetic oligonucleotide
gctggggtcgtgtccaccaacctgat

SEQ ID NO: 52918 - DNA, 26 bp, Artificial Sequence
  Description of Artificial Sequence: Synthetic oligonucleotide
ctggggtcgtgtccaccaacctgatc

SEQ ID NO: 52919 - DNA, 26 bp, Artificial Sequence
  Description of Artificial Sequence: Synthetic oligonucleotide
tggggtcgtgtccaccaacctgatcc

SEQ ID NO: 52920 - DNA, 25 bp, Artificial Sequence
  Description of Artificial Sequence: Synthetic oligonucleotide
ggggtcgtgtccaccaacctgatcc

SEQ ID NO: 52921 - DNA, 27 bp, Artificial Sequence
  Description of Artificial Sequence: Synthetic oligonucleotide
gggtcgtgtccaccaacctgatccgta

SEQ ID NO: 52922 - DNA, 29 bp, Artificial Sequence
  Description of Artificial Sequence: Synthetic oligonucleotide
ggtcgtgtccaccaacctgatccgtaatg

SEQ ID NO: 52923 - DNA, 29 bp, Artificial Sequence
  Description of Artificial Sequence: Synthetic oligonucleotide
gtcgtgtccaccaacctgatccgtaatgg

SEQ ID NO: 52924 - DNA, 30 bp, Artificial Sequence
  Description of Artificial Sequence: Synthetic oligonucleotide
tcgtgtccaccaacctgatccgtaatggag

SEQ ID NO: 52925 - DNA, 29 bp, Artificial Sequence
  Description of Artificial Sequence: Synthetic oligonucleotide
cgtgtccaccaacctgatccgtaatggag

SEQ ID NO: 52926 - DNA, 30 bp, Artificial Sequence
  Description of Artificial Sequence: Synthetic oligonucleotide
gtgtccaccaacctgatccgtaatggagac

SEQ ID NO: 52927 - DNA, 31 bp, Artificial Sequence
  Description of Artificial Sequence: Synthetic oligonucleotide
tgtccaccaacctgatccgtaatggagactg

SEQ ID NO: 52928 - DNA, 30 bp, Artificial Sequence
  Description of Artificial Sequence: Synthetic oligonucleotide
gtccaccaacctgatccgtaatggagactg

SEQ ID NO: 52929 - DNA, 30 bp, Artificial Sequence
  Description of Artificial Sequence: Synthetic oligonucleotide
tccaccaacctgatccgtaatggagactgg

SEQ ID NO: 52930 - DNA, 29 bp, Artificial Sequence
  Description of Artificial Sequence: Synthetic oligonucleotide
ccaccaacctgatccgtaatggagactgg

SEQ ID NO: 52931 - DNA, 30 bp, Artificial Sequence
  Description of Artificial Sequence: Synthetic oligonucleotide
caccaacctgatccgtaatggagactggac

SEQ ID NO: 52932 - DNA, 30 bp, Artificial Sequence
  Description of Artificial Sequence: Synthetic oligonucleotide
accaacctgatccgtaatggagactggacc

SEQ ID NO: 52933 - DNA, 29 bp, Artificial Sequence
  Description of Artificial Sequence: Synthetic oligonucleotide
ccaacctgatccgtaatggagactggacc

SEQ ID NO: 52934 - DNA, 31 bp, Artificial Sequence
  Description of Artificial Sequence: Synthetic oligonucleotide
caacctgatccgtaatggagactggaccttc

SEQ ID NO: 52935 - DNA, 31 bp, Artificial Sequence
  Description of Artificial Sequence: Synthetic oligonucleotide
aacctgatccgtaatggagactggaccttcc

SEQ ID NO: 52936 - DNA, 30 bp, Artificial Sequence
  Description of Artificial Sequence: Synthetic oligonucleotide
acctgatccgtaatggagactggaccttcc

SEQ ID NO: 52937 - DNA, 29 bp, Artificial Sequence
  Description of Artificial Sequence: Synthetic oligonucleotide
cctgatccgtaatggagactggaccttcc

SEQ ID NO: 52938 - DNA, 30 bp, Artificial Sequence
  Description of Artificial Sequence: Synthetic oligonucleotide
ctgatccgtaatggagactggaccttccag

SEQ ID NO: 52939 - DNA, 32 bp, Artificial Sequence
  Description of Artificial Sequence: Synthetic oligonucleotide
tgatccgtaatggagactggaccttccagatc

SEQ ID NO: 52940 - DNA, 31 bp, Artificial Sequence
  Description of Artificial Sequence: Synthetic oligonucleotide
gatccgtaatggagactggaccttccagatc

SEQ ID NO: 52941 - DNA, 31 bp, Artificial Sequence
  Description of Artificial Sequence: Synthetic oligonucleotide
atccgtaatggagactggaccttccagatcc

SEQ ID NO: 52942 - DNA, 30 bp, Artificial Sequence
  Description of Artificial Sequence: Synthetic oligonucleotide
tccgtaatggagactggaccttccagatcc

SEQ ID NO: 52943 - DNA, 29 bp, Artificial Sequence
  Description of Artificial Sequence: Synthetic oligonucleotide
ccgtaatggagactggaccttccagatcc

SEQ ID NO: 52944 - DNA, 30 bp, Artificial Sequence
  Description of Artificial Sequence: Synthetic oligonucleotide
cgtaatggagactggaccttccagatcctg

SEQ ID NO: 52945 - DNA, 30 bp, Artificial Sequence
  Description of Artificial Sequence: Synthetic oligonucleotide
gtaatggagactggaccttccagatcctgg

SEQ ID NO: 52946 - DNA, 31 bp, Artificial Sequence
  Description of Artificial Sequence: Synthetic oligonucleotide
taatggagactggaccttccagatcctggtg

SEQ ID NO: 52947 - DNA, 30 bp, Artificial Sequence
  Description of Artificial Sequence: Synthetic oligonucleotide
aatggagactggaccttccagatcctggtg

SEQ ID NO: 52948 - DNA, 29 bp, Artificial Sequence
  Description of Artificial Sequence: Synthetic oligonucleotide
atggagactggaccttccagatcctggtg

SEQ ID NO: 52949 - DNA, 28 bp, Artificial Sequence
  Description of Artificial Sequence: Synthetic oligonucleotide
tggagactggaccttccagatcctggtg

SEQ ID NO: 52950 - DNA, 27 bp, Artificial Sequence
  Description of Artificial Sequence: Synthetic oligonucleotide
ggagactggaccttccagatcctggtg

SEQ ID NO: 52951 - DNA, 29 bp, Artificial Sequence
  Description of Artificial Sequence: Synthetic oligonucleotide
gagactggaccttccagatcctggtgatg

SEQ ID NO: 52952 - DNA, 29 bp, Artificial Sequence
  Description of Artificial Sequence: Synthetic oligonucleotide
agactggaccttccagatcctggtgatgc

SEQ ID NO: 52953 - DNA, 28 bp, Artificial Sequence
  Description of Artificial Sequence: Synthetic oligonucleotide
gactggaccttccagatcctggtgatgc

SEQ ID NO: 52954 - DNA, 29 bp, Artificial Sequence
  Description of Artificial Sequence: Synthetic oligonucleotide
actggaccttccagatcctggtgatgctg

SEQ ID NO: 52955 - DNA, 28 bp, Artificial Sequence
  Description of Artificial Sequence: Synthetic oligonucleotide
ctggaccttccagatcctggtgatgctg

SEQ ID NO: 52956 - DNA, 28 bp, Artificial Sequence
  Description of Artificial Sequence: Synthetic oligonucleotide
tggaccttccagatcctggtgatgctgg

SEQ ID NO: 52957 - DNA, 27 bp, Artificial Sequence
  Description of Artificial Sequence: Synthetic oligonucleotide
ggaccttccagatcctggtgatgctgg

SEQ ID NO: 52958 - DNA, 31 bp, Artificial Sequence
  Description of Artificial Sequence: Synthetic oligonucleotide
gaccttccagatcctggtgatgctggaaatg

SEQ ID NO: 52959 - DNA, 32 bp, Artificial Sequence
  Description of Artificial Sequence: Synthetic oligonucleotide
accttccagatcctggtgatgctggaaatgac

SEQ ID NO: 52960 - DNA, 31 bp, Artificial Sequence
  Description of Artificial Sequence: Synthetic oligonucleotide
ccttccagatcctggtgatgctggaaatgac

SEQ ID NO: 52961 - DNA, 31 bp, Artificial Sequence
  Description of Artificial Sequence: Synthetic oligonucleotide
cttccagatcctggtgatgctggaaatgacc

SEQ ID NO: 52962 - DNA, 31 bp, Artificial Sequence
  Description of Artificial Sequence: Synthetic oligonucleotide
ttccagatcctggtgatgctggaaatgaccc

SEQ ID NO: 52963 - DNA, 30 bp, Artificial Sequence
  Description of Artificial Sequence: Synthetic oligonucleotide
tccagatcctggtgatgctggaaatgaccc

SEQ ID NO: 52964 - DNA, 29 bp, Artificial Sequence
  Description of Artificial Sequence: Synthetic oligonucleotide
ccagatcctggtgatgctggaaatgaccc

SEQ ID NO: 52965 - DNA, 29 bp, Artificial Sequence
  Description of Artificial Sequence: Synthetic oligonucleotide
cagatcctggtgatgctggaaatgacccc

SEQ ID NO: 52966 - DNA, 29 bp, Artificial Sequence
  Description of Artificial Sequence: Synthetic oligonucleotide
agatcctggtgatgctggaaatgaccccc

SEQ ID NO: 52967 - DNA, 28 bp, Artificial Sequence
  Description of Artificial Sequence: Synthetic oligonucleotide
gatcctggtgatgctggaaatgaccccc

SEQ ID NO: 52968 - DNA, 28 bp, Artificial Sequence
  Description of Artificial Sequence: Synthetic oligonucleotide
atcctggtgatgctggaaatgacccccc

SEQ ID NO: 52969 - DNA, 27 bp, Artificial Sequence
  Description of Artificial Sequence: Synthetic oligonucleotide
tcctggtgatgctggaaatgacccccc

SEQ ID NO: 52970 - DNA, 27 bp, Artificial Sequence
  Description of Artificial Sequence: Synthetic oligonucleotide
cctggtgatgctggaaatgacccccca

SEQ ID NO: 52971 - DNA, 27 bp, Artificial Sequence
  Description of Artificial Sequence: Synthetic oligonucleotide
ctggtgatgctggaaatgaccccccag

SEQ ID NO: 52972 - DNA, 27 bp, Artificial Sequence
  Description of Artificial Sequence: Synthetic oligonucleotide
tggtgatgctggaaatgaccccccagc

SEQ ID NO: 52973 - DNA, 27 bp, Artificial Sequence
  Description of Artificial Sequence: Synthetic oligonucleotide
ggtgatgctggaaatgaccccccagca

SEQ ID NO: 52974 - DNA, 27 bp, Artificial Sequence
  Description of Artificial Sequence: Synthetic oligonucleotide
gtgatgctggaaatgaccccccagcag

SEQ ID NO: 52975 - DNA, 27 bp, Artificial Sequence
  Description of Artificial Sequence: Synthetic oligonucleotide
tgatgctggaaatgaccccccagcagg

SEQ ID NO: 52976 - DNA, 26 bp, Artificial Sequence
  Description of Artificial Sequence: Synthetic oligonucleotide
gatgctggaaatgaccccccagcagg

SEQ ID NO: 52977 - DNA, 27 bp, Artificial Sequence
  Description of Artificial Sequence: Synthetic oligonucleotide
atgctggaaatgaccccccagcaggga

SEQ ID NO: 52978 - DNA, 26 bp, Artificial Sequence
  Description of Artificial Sequence: Synthetic oligonucleotide
tgctggaaatgaccccccagcaggga

SEQ ID NO: 52979 - DNA, 25 bp, Artificial Sequence
  Description of Artificial Sequence: Synthetic oligonucleotide
gctggaaatgaccccccagcaggga

SEQ ID NO: 52980 - DNA, 26 bp, Artificial Sequence
  Description of Artificial Sequence: Synthetic oligonucleotide
ctggaaatgaccccccagcagggaga

SEQ ID NO: 52981 - DNA, 26 bp, Artificial Sequence
  Description of Artificial Sequence: Synthetic oligonucleotide
tggaaatgaccccccagcagggagac

SEQ ID NO: 52982 - DNA, 25 bp, Artificial Sequence
  Description of Artificial Sequence: Synthetic oligonucleotide
ggaaatgaccccccagcagggagac

SEQ ID NO: 52983 - DNA, 26 bp, Artificial Sequence
  Description of Artificial Sequence: Synthetic oligonucleotide
gaaatgaccccccagcagggagacgt

SEQ ID NO: 52984 - DNA, 27 bp, Artificial Sequence
  Description of Artificial Sequence: Synthetic oligonucleotide
aaatgaccccccagcagggagacgtct

SEQ ID NO: 52985 - DNA, 27 bp, Artificial Sequence
  Description of Artificial Sequence: Synthetic oligonucleotide
aatgaccccccagcagggagacgtcta

SEQ ID NO: 52986 - DNA, 26 bp, Artificial Sequence
  Description of Artificial Sequence: Synthetic oligonucleotide
atgaccccccagcagggagacgtcta

SEQ ID NO: 52987 - DNA, 25 bp, Artificial Sequence
  Description of Artificial Sequence: Synthetic oligonucleotide
tgaccccccagcagggagacgtcta

SEQ ID NO: 52988 - DNA, 24 bp, Artificial Sequence
  Description of Artificial Sequence: Synthetic oligonucleotide
gaccccccagcagggagacgtcta

SEQ ID NO: 52989 - DNA, 26 bp, Artificial Sequence
  Description of Artificial Sequence: Synthetic oligonucleotide
accccccagcagggagacgtctacat

SEQ ID NO: 52990 - DNA, 25 bp, Artificial Sequence
  Description of Artificial Sequence: Synthetic oligonucleotide
ccccccagcagggagacgtctacat

SEQ ID NO: 52991 - DNA, 26 bp, Artificial Sequence
  Description of Artificial Sequence: Synthetic oligonucleotide
cccccagcagggagacgtctacatct

SEQ ID NO: 52992 - DNA, 26 bp, Artificial Sequence
  Description of Artificial Sequence: Synthetic oligonucleotide
ccccagcagggagacgtctacatctg

SEQ ID NO: 52993 - DNA, 26 bp, Artificial Sequence
  Description of Artificial Sequence: Synthetic oligonucleotide
cccagcagggagacgtctacatctgc

SEQ ID NO: 52994 - DNA, 27 bp, Artificial Sequence
  Description of Artificial Sequence: Synthetic oligonucleotide
ccagcagggagacgtctacatctgcca

SEQ ID NO: 52995 - DNA, 28 bp, Artificial Sequence
  Description of Artificial Sequence: Synthetic oligonucleotide
cagcagggagacgtctacatctgccaag

SEQ ID NO: 52996 - DNA, 29 bp, Artificial Sequence
  Description of Artificial Sequence: Synthetic oligonucleotide
agcagggagacgtctacatctgccaagtg

SEQ ID NO: 52997 - DNA, 28 bp, Artificial Sequence
  Description of Artificial Sequence: Synthetic oligonucleotide
gcagggagacgtctacatctgccaagtg

SEQ ID NO: 52998 - DNA, 28 bp, Artificial Sequence
  Description of Artificial Sequence: Synthetic oligonucleotide
cagggagacgtctacatctgccaagtgg

SEQ ID NO: 52999 - DNA, 29 bp, Artificial Sequence
  Description of Artificial Sequence: Synthetic oligonucleotide
agggagacgtctacatctgccaagtggag

SEQ ID NO: 53000 - DNA, 28 bp, Artificial Sequence
  Description of Artificial Sequence: Synthetic oligonucleotide
gggagacgtctacatctgccaagtggag

SEQ ID NO: 53001 - DNA, 28 bp, Artificial Sequence
  Description of Artificial Sequence: Synthetic oligonucleotide
ggagacgtctacatctgccaagtggagc

SEQ ID NO: 53002 - DNA, 29 bp, Artificial Sequence
  Description of Artificial Sequence: Synthetic oligonucleotide
gagacgtctacatctgccaagtggagcac

SEQ ID NO: 53003 - DNA, 30 bp, Artificial Sequence
  Description of Artificial Sequence: Synthetic oligonucleotide
agacgtctacatctgccaagtggagcacac

SEQ ID NO: 53004 - DNA, 29 bp, Artificial Sequence
  Description of Artificial Sequence: Synthetic oligonucleotide
gacgtctacatctgccaagtggagcacac

SEQ ID NO: 53005 - DNA, 29 bp, Artificial Sequence
  Description of Artificial Sequence: Synthetic oligonucleotide
acgtctacatctgccaagtggagcacacc

SEQ ID NO: 53006 - DNA, 28 bp, Artificial Sequence
  Description of Artificial Sequence: Synthetic oligonucleotide
cgtctacatctgccaagtggagcacacc

SEQ ID NO: 53007 - DNA, 29 bp, Artificial Sequence
  Description of Artificial Sequence: Synthetic oligonucleotide
gtctacatctgccaagtggagcacaccag

SEQ ID NO: 53008 - DNA, 29 bp, Artificial Sequence
  Description of Artificial Sequence: Synthetic oligonucleotide
tctacatctgccaagtggagcacaccagc

SEQ ID NO: 53009 - DNA, 28 bp, Artificial Sequence
  Description of Artificial Sequence: Synthetic oligonucleotide
ctacatctgccaagtggagcacaccagc

SEQ ID NO: 53010 - DNA, 28 bp, Artificial Sequence
  Description of Artificial Sequence: Synthetic oligonucleotide
tacatctgccaagtggagcacaccagcc

SEQ ID NO: 53011 - DNA, 27 bp, Artificial Sequence
  Description of Artificial Sequence: Synthetic oligonucleotide
acatctgccaagtggagcacaccagcc

SEQ ID NO: 53012 - DNA, 27 bp, Artificial Sequence
  Description of Artificial Sequence: Synthetic oligonucleotide
catctgccaagtggagcacaccagcct

SEQ ID NO: 53013 - DNA, 27 bp, Artificial Sequence
  Description of Artificial Sequence: Synthetic oligonucleotide
atctgccaagtggagcacaccagcctg

SEQ ID NO: 53014 - DNA, 26 bp, Artificial Sequence
  Description of Artificial Sequence: Synthetic oligonucleotide
tctgccaagtggagcacaccagcctg

SEQ ID NO: 53015 - DNA, 25 bp, Artificial Sequence
  Description of Artificial Sequence: Synthetic oligonucleotide
ctgccaagtggagcacaccagcctg

SEQ ID NO: 53016 - DNA, 26 bp, Artificial Sequence
  Description of Artificial Sequence: Synthetic oligonucleotide
tgccaagtggagcacaccagcctgga

SEQ ID NO: 53017 - DNA, 25 bp, Artificial Sequence
  Description of Artificial Sequence: Synthetic oligonucleotide
gccaagtggagcacaccagcctgga

SEQ ID NO: 53018 - DNA, 26 bp, Artificial Sequence
  Description of Artificial Sequence: Synthetic oligonucleotide
ccaagtggagcacaccagcctggaca

SEQ ID NO: 53019 - DNA, 27 bp, Artificial Sequence
  Description of Artificial Sequence: Synthetic oligonucleotide
caagtggagcacaccagcctggacagt

SEQ ID NO: 53020 - DNA, 27 bp, Artificial Sequence
  Description of Artificial Sequence: Synthetic oligonucleotide
aagtggagcacaccagcctggacagtc

SEQ ID NO: 53021 - DNA, 26 bp, Artificial Sequence
  Description of Artificial Sequence: Synthetic oligonucleotide
agtggagcacaccagcctggacagtc

SEQ ID NO: 53022 - DNA, 25 bp, Artificial Sequence
  Description of Artificial Sequence: Synthetic oligonucleotide
gtggagcacaccagcctggacagtc

SEQ ID NO: 53023 - DNA, 26 bp, Artificial Sequence
  Description of Artificial Sequence: Synthetic oligonucleotide
tggagcacaccagcctggacagtcct

SEQ ID NO: 53024 - DNA, 25 bp, Artificial Sequence
  Description of Artificial Sequence: Synthetic oligonucleotide
ggagcacaccagcctggacagtcct

SEQ ID NO: 53025 - DNA, 26 bp, Artificial Sequence
  Description of Artificial Sequence: Synthetic oligonucleotide
gagcacaccagcctggacagtcctgt

SEQ ID NO: 53026 - DNA, 27 bp, Artificial Sequence
  Description of Artificial Sequence: Synthetic oligonucleotide
agcacaccagcctggacagtcctgtca

SEQ ID NO: 53027 - DNA, 26 bp, Artificial Sequence
  Description of Artificial Sequence: Synthetic oligonucleotide
gcacaccagcctggacagtcctgtca

SEQ ID NO: 53028 - DNA, 26 bp, Artificial Sequence
  Description of Artificial Sequence: Synthetic oligonucleotide
cacaccagcctggacagtcctgtcac

SEQ ID NO: 53029 - DNA, 26 bp, Artificial Sequence
  Description of Artificial Sequence: Synthetic oligonucleotide
acaccagcctggacagtcctgtcacc

SEQ ID NO: 53030 - DNA, 25 bp, Artificial Sequence
  Description of Artificial Sequence: Synthetic oligonucleotide
caccagcctggacagtcctgtcacc

SEQ ID NO: 53031 - DNA, 26 bp, Artificial Sequence
  Description of Artificial Sequence: Synthetic oligonucleotide
accagcctggacagtcctgtcaccgt

SEQ ID NO: 53032 - DNA, 25 bp, Artificial Sequence
  Description of Artificial Sequence: Synthetic oligonucleotide
ccagcctggacagtcctgtcaccgt

SEQ ID NO: 53033 - DNA, 25 bp, Artificial Sequence
  Description of Artificial Sequence: Synthetic oligonucleotide
cagcctggacagtcctgtcaccgtg

SEQ ID NO: 53034 - DNA, 26 bp, Artificial Sequence
  Description of Artificial Sequence: Synthetic oligonucleotide
agcctggacagtcctgtcaccgtgga

SEQ ID NO: 53035 - DNA, 25 bp, Artificial Sequence
  Description of Artificial Sequence: Synthetic oligonucleotide
gcctggacagtcctgtcaccgtgga

SEQ ID NO: 53036 - DNA, 26 bp, Artificial Sequence
  Description of Artificial Sequence: Synthetic oligonucleotide
cctggacagtcctgtcaccgtggagt

SEQ ID NO: 53037 - DNA, 26 bp, Artificial Sequence
  Description of Artificial Sequence: Synthetic oligonucleotide
ctggacagtcctgtcaccgtggagtg

SEQ ID NO: 53038 - DNA, 27 bp, Artificial Sequence
  Description of Artificial Sequence: Synthetic oligonucleotide
tggacagtcctgtcaccgtggagtgga

SEQ ID NO: 53039 - DNA, 27 bp, Artificial Sequence
  Description of Artificial Sequence: Synthetic oligonucleotide
ggacagtcctgtcaccgtggagtggaa

SEQ ID NO: 53040 - DNA, 27 bp, Artificial Sequence
  Description of Artificial Sequence: Synthetic oligonucleotide
gacagtcctgtcaccgtggagtggaag

SEQ ID NO: 53041 - DNA, 27 bp, Artificial Sequence
  Description of Artificial Sequence: Synthetic oligonucleotide
acagtcctgtcaccgtggagtggaagg

SEQ ID NO: 53042 - DNA, 26 bp, Artificial Sequence
  Description of Artificial Sequence: Synthetic oligonucleotide
cagtcctgtcaccgtggagtggaagg

SEQ ID NO: 53043 - DNA, 27 bp, Artificial Sequence
  Description of Artificial Sequence: Synthetic oligonucleotide
agtcctgtcaccgtggagtggaaggca

SEQ ID NO: 53044 - DNA, 26 bp, Artificial Sequence
  Description of Artificial Sequence: Synthetic oligonucleotide
gtcctgtcaccgtggagtggaaggca

SEQ ID NO: 53045 - DNA, 27 bp, Artificial Sequence
  Description of Artificial Sequence: Synthetic oligonucleotide
tcctgtcaccgtggagtggaaggcaca

SEQ ID NO: 53046 - DNA, 26 bp, Artificial Sequence
  Description of Artificial Sequence: Synthetic oligonucleotide
cctgtcaccgtggagtggaaggcaca

SEQ ID NO: 53047 - DNA, 27 bp, Artificial Sequence
  Description of Artificial Sequence: Synthetic oligonucleotide
ctgtcaccgtggagtggaaggcacagt

SEQ ID NO: 53048 - DNA, 27 bp, Artificial Sequence
  Description of Artificial Sequence: Synthetic oligonucleotide
tgtcaccgtggagtggaaggcacagtc

SEQ ID NO: 53049 - DNA, 27 bp, Artificial Sequence
  Description of Artificial Sequence: Synthetic oligonucleotide
gtcaccgtggagtggaaggcacagtct

SEQ ID NO: 53050 - DNA, 27 bp, Artificial Sequence
  Description of Artificial Sequence: Synthetic oligonucleotide
tcaccgtggagtggaaggcacagtctg

SEQ ID NO: 53051 - DNA, 27 bp, Artificial Sequence
  Description of Artificial Sequence: Synthetic oligonucleotide
caccgtggagtggaaggcacagtctga

SEQ ID NO: 53052 - DNA, 29 bp, Artificial Sequence
  Description of Artificial Sequence: Synthetic oligonucleotide
accgtggagtggaaggcacagtctgattc

SEQ ID NO: 53053 - DNA, 28 bp, Artificial Sequence
  Description of Artificial Sequence: Synthetic oligonucleotide
ccgtggagtggaaggcacagtctgattc

SEQ ID NO: 53054 - DNA, 29 bp, Artificial Sequence
  Description of Artificial Sequence: Synthetic oligonucleotide
cgtggagtggaaggcacagtctgattctg

SEQ ID NO: 53055 - DNA, 29 bp, Artificial Sequence
  Description of Artificial Sequence: Synthetic oligonucleotide
gtggagtggaaggcacagtctgattctgc

SEQ ID NO: 53056 - DNA, 29 bp, Artificial Sequence
  Description of Artificial Sequence: Synthetic oligonucleotide
tggagtggaaggcacagtctgattctgcc

SEQ ID NO: 53057 - DNA, 28 bp, Artificial Sequence
  Description of Artificial Sequence: Synthetic oligonucleotide
ggagtggaaggcacagtctgattctgcc

SEQ ID NO: 53058 - DNA, 28 bp, Artificial Sequence
  Description of Artificial Sequence: Synthetic oligonucleotide
gagtggaaggcacagtctgattctgccc

SEQ ID NO: 53059 - DNA, 29 bp, Artificial Sequence
  Description of Artificial Sequence: Synthetic oligonucleotide
agtggaaggcacagtctgattctgcccag

SEQ ID NO: 53060 - DNA, 28 bp, Artificial Sequence
  Description of Artificial Sequence: Synthetic oligonucleotide
gtggaaggcacagtctgattctgcccag

SEQ ID NO: 53061 - DNA, 29 bp, Artificial Sequence
  Description of Artificial Sequence: Synthetic oligonucleotide
tggaaggcacagtctgattctgcccagag

SEQ ID NO: 53062 - DNA, 28 bp, Artificial Sequence
  Description of Artificial Sequence: Synthetic oligonucleotide
ggaaggcacagtctgattctgcccagag

SEQ ID NO: 53063 - DNA, 31 bp, Artificial Sequence
  Description of Artificial Sequence: Synthetic oligonucleotide
gaaggcacagtctgattctgcccagagtaag

SEQ ID NO: 53064 - DNA, 32 bp, Artificial Sequence
  Description of Artificial Sequence: Synthetic oligonucleotide
aaggcacagtctgattctgcccagagtaagac

SEQ ID NO: 53065 - DNA, 31 bp, Artificial Sequence
  Description of Artificial Sequence: Synthetic oligonucleotide
aggcacagtctgattctgcccagagtaagac

SEQ ID NO: 53066 - DNA, 30 bp, Artificial Sequence
  Description of Artificial Sequence: Synthetic oligonucleotide
ggcacagtctgattctgcccagagtaagac

SEQ ID NO: 53067 - DNA, 33 bp, Artificial Sequence
  Description of Artificial Sequence: Synthetic oligonucleotide
gcacagtctgattctgcccagagtaagacattg

SEQ ID NO: 53068 - DNA, 34 bp, Artificial Sequence
  Description of Artificial Sequence: Synthetic oligonucleotide
cacagtctgattctgcccagagtaagacattgac

SEQ ID NO: 53069 - DNA, 34 bp, Artificial Sequence
  Description of Artificial Sequence: Synthetic oligonucleotide
acagtctgattctgcccagagtaagacattgacg

SEQ ID NO: 53070 - DNA, 33 bp, Artificial Sequence
  Description of Artificial Sequence: Synthetic oligonucleotide
cagtctgattctgcccagagtaagacattgacg

SEQ ID NO: 53071 - DNA, 33 bp, Artificial Sequence
  Description of Artificial Sequence: Synthetic oligonucleotide
agtctgattctgcccagagtaagacattgacgg

SEQ ID NO: 53072 - DNA, 32 bp, Artificial Sequence
  Description of Artificial Sequence: Synthetic oligonucleotide
gtctgattctgcccagagtaagacattgacgg

SEQ ID NO: 53073 - DNA, 32 bp, Artificial Sequence
  Description of Artificial Sequence: Synthetic oligonucleotide
tctgattctgcccagagtaagacattgacggg

SEQ ID NO: 53074 - DNA, 31 bp, Artificial Sequence
  Description of Artificial Sequence: Synthetic oligonucleotide
ctgattctgcccagagtaagacattgacggg

SEQ ID NO: 53075 - DNA, 32 bp, Artificial Sequence
  Description of Artificial Sequence: Synthetic oligonucleotide
tgattctgcccagagtaagacattgacgggag

SEQ ID NO: 53076 - DNA, 31 bp, Artificial Sequence
  Description of Artificial Sequence: Synthetic oligonucleotide
gattctgcccagagtaagacattgacgggag

SEQ ID NO: 53077 - DNA, 31 bp, Artificial Sequence
  Description of Artificial Sequence: Synthetic oligonucleotide
attctgcccagagtaagacattgacgggagc

SEQ ID NO: 53078 - DNA, 30 bp, Artificial Sequence
  Description of Artificial Sequence: Synthetic oligonucleotide
ttctgcccagagtaagacattgacgggagc

SEQ ID NO: 53079 - DNA, 29 bp, Artificial Sequence
  Description of Artificial Sequence: Synthetic oligonucleotide
tctgcccagagtaagacattgacgggagc

SEQ ID NO: 53080 - DNA, 28 bp, Artificial Sequence
  Description of Artificial Sequence: Synthetic oligonucleotide
ctgcccagagtaagacattgacgggagc

SEQ ID NO: 53081 - DNA, 29 bp, Artificial Sequence
  Description of Artificial Sequence: Synthetic oligonucleotide
tgcccagagtaagacattgacgggagctg

SEQ ID NO: 53082 - DNA, 28 bp, Artificial Sequence
  Description of Artificial Sequence: Synthetic oligonucleotide
gcccagagtaagacattgacgggagctg

SEQ ID NO: 53083 - DNA, 28 bp, Artificial Sequence
  Description of Artificial Sequence: Synthetic oligonucleotide
cccagagtaagacattgacgggagctgg

SEQ ID NO: 53084 - DNA, 28 bp, Artificial Sequence
  Description of Artificial Sequence: Synthetic oligonucleotide
ccagagtaagacattgacgggagctggg

SEQ ID NO: 53085 - DNA, 28 bp, Artificial Sequence
  Description of Artificial Sequence: Synthetic oligonucleotide
cagagtaagacattgacgggagctgggg

SEQ ID NO: 53086 - DNA, 28 bp, Artificial Sequence
  Description of Artificial Sequence: Synthetic oligonucleotide
agagtaagacattgacgggagctggggg

SEQ ID NO: 53087 - DNA, 27 bp, Artificial Sequence
  Description of Artificial Sequence: Synthetic oligonucleotide
gagtaagacattgacgggagctggggg

SEQ ID NO: 53088 - DNA, 27 bp, Artificial Sequence
  Description of Artificial Sequence: Synthetic oligonucleotide
agtaagacattgacgggagctgggggc

SEQ ID NO: 53089 - DNA, 27 bp, Artificial Sequence
  Description of Artificial Sequence: Synthetic oligonucleotide
gtaagacattgacgggagctgggggct

SEQ ID NO: 53090 - DNA, 28 bp, Artificial Sequence
  Description of Artificial Sequence: Synthetic oligonucleotide
taagacattgacgggagctgggggcttc

SEQ ID NO: 53091 - DNA, 27 bp, Artificial Sequence
  Description of Artificial Sequence: Synthetic oligonucleotide
aagacattgacgggagctgggggcttc

SEQ ID NO: 53092 - DNA, 26 bp, Artificial Sequence
  Description of Artificial Sequence: Synthetic oligonucleotide
agacattgacgggagctgggggcttc

SEQ ID NO: 53093 - DNA, 25 bp, Artificial Sequence
  Description of Artificial Sequence: Synthetic oligonucleotide
gacattgacgggagctgggggcttc

SEQ ID NO: 53094 - DNA, 26 bp, Artificial Sequence
  Description of Artificial Sequence: Synthetic oligonucleotide
acattgacgggagctgggggcttcgt

SEQ ID NO: 53095 - DNA, 25 bp, Artificial Sequence
  Description of Artificial Sequence: Synthetic oligonucleotide
cattgacgggagctgggggcttcgt

SEQ ID NO: 53096 - DNA, 25 bp, Artificial Sequence
  Description of Artificial Sequence: Synthetic oligonucleotide
attgacgggagctgggggcttcgtg

SEQ ID NO: 53097 - DNA, 24 bp, Artificial Sequence
  Description of Artificial Sequence: Synthetic oligonucleotide
ttgacgggagctgggggcttcgtg

SEQ ID NO: 53098 - DNA, 23 bp, Artificial Sequence
  Description of Artificial Sequence: Synthetic oligonucleotide
tgacgggagctgggggcttcgtg

SEQ ID NO: 53099 - DNA, 22 bp, Artificial Sequence
  Description of Artificial Sequence: Synthetic oligonucleotide
gacgggagctgggggcttcgtg

SEQ ID NO: 53100 - DNA, 23 bp, Artificial Sequence
  Description of Artificial Sequence: Synthetic oligonucleotide
acgggagctgggggcttcgtgct

SEQ ID NO: 53101 - DNA, 22 bp, Artificial Sequence
  Description of Artificial Sequence: Synthetic oligonucleotide
cgggagctgggggcttcgtgct

SEQ ID NO: 53102 - DNA, 22 bp, Artificial Sequence
  Description of Artificial Sequence: Synthetic oligonucleotide
gggagctgggggcttcgtgctg

SEQ ID NO: 53103 - DNA, 22 bp, Artificial Sequence
  Description of Artificial Sequence: Synthetic oligonucleotide
ggagctgggggcttcgtgctgg

SEQ ID NO: 53104 - DNA, 22 bp, Artificial Sequence
  Description of Artificial Sequence: Synthetic oligonucleotide
gagctgggggcttcgtgctggg

SEQ ID NO: 53105 - DNA, 22 bp, Artificial Sequence
  Description of Artificial Sequence: Synthetic oligonucleotide
agctgggggcttcgtgctgggg

SEQ ID NO: 53106 - DNA, 21 bp, Artificial Sequence
  Description of Artificial Sequence: Synthetic oligonucleotide
gctgggggcttcgtgctgggg

SEQ ID NO: 53107 - DNA, 22 bp, Artificial Sequence
  Description of Artificial Sequence: Synthetic oligonucleotide
ctgggggcttcgtgctggggct

SEQ ID NO: 53108 - DNA, 24 bp, Artificial Sequence
  Description of Artificial Sequence: Synthetic oligonucleotide
tgggggcttcgtgctggggctcat

SEQ ID NO: 53109 - DNA, 23 bp, Artificial Sequence
  Description of Artificial Sequence: Synthetic oligonucleotide
gggggcttcgtgctggggctcat

SEQ ID NO: 53110 - DNA, 25 bp, Artificial Sequence
  Description of Artificial Sequence: Synthetic oligonucleotide
ggggcttcgtgctggggctcatcat

SEQ ID NO: 53111 - DNA, 26 bp, Artificial Sequence
  Description of Artificial Sequence: Synthetic oligonucleotide
gggcttcgtgctggggctcatcatct

SEQ ID NO: 53112 - DNA, 27 bp, Artificial Sequence
  Description of Artificial Sequence: Synthetic oligonucleotide
ggcttcgtgctggggctcatcatctgt

SEQ ID NO: 53113 - DNA, 27 bp, Artificial Sequence
  Description of Artificial Sequence: Synthetic oligonucleotide
gcttcgtgctggggctcatcatctgtg

SEQ ID NO: 53114 - DNA, 27 bp, Artificial Sequence
  Description of Artificial Sequence: Synthetic oligonucleotide
cttcgtgctggggctcatcatctgtgg

SEQ ID NO: 53115 - DNA, 28 bp, Artificial Sequence
  Description of Artificial Sequence: Synthetic oligonucleotide
ttcgtgctggggctcatcatctgtggag

SEQ ID NO: 53116 - DNA, 27 bp, Artificial Sequence
  Description of Artificial Sequence: Synthetic oligonucleotide
tcgtgctggggctcatcatctgtggag

SEQ ID NO: 53117 - DNA, 27 bp, Artificial Sequence
  Description of Artificial Sequence: Synthetic oligonucleotide
cgtgctggggctcatcatctgtggagt

SEQ ID NO: 53118 - DNA, 27 bp, Artificial Sequence
  Description of Artificial Sequence: Synthetic oligonucleotide
gtgctggggctcatcatctgtggagtg

SEQ ID NO: 53119 - DNA, 27 bp, Artificial Sequence
  Description of Artificial Sequence: Synthetic oligonucleotide
tgctggggctcatcatctgtggagtgg

SEQ ID NO: 53120 - DNA, 26 bp, Artificial Sequence
  Description of Artificial Sequence: Synthetic oligonucleotide
gctggggctcatcatctgtggagtgg

SEQ ID NO: 53121 - DNA, 26 bp, Artificial Sequence
  Description of Artificial Sequence: Synthetic oligonucleotide
ctggggctcatcatctgtggagtggg

SEQ ID NO: 53122 - DNA, 27 bp, Artificial Sequence
  Description of Artificial Sequence: Synthetic oligonucleotide
tggggctcatcatctgtggagtgggca

SEQ ID NO: 53123 - DNA, 27 bp, Artificial Sequence
  Description of Artificial Sequence: Synthetic oligonucleotide
ggggctcatcatctgtggagtgggcat

SEQ ID NO: 53124 - DNA, 27 bp, Artificial Sequence
  Description of Artificial Sequence: Synthetic oligonucleotide
gggctcatcatctgtggagtgggcatc

SEQ ID NO: 53125 - DNA, 29 bp, Artificial Sequence
  Description of Artificial Sequence: Synthetic oligonucleotide
ggctcatcatctgtggagtgggcatcttc

SEQ ID NO: 53126 - DNA, 31 bp, Artificial Sequence
  Description of Artificial Sequence: Synthetic oligonucleotide
gctcatcatctgtggagtgggcatcttcatg

SEQ ID NO: 53127 - DNA, 31 bp, Artificial Sequence
  Description of Artificial Sequence: Synthetic oligonucleotide
ctcatcatctgtggagtgggcatcttcatgc

SEQ ID NO: 53128 - DNA, 32 bp, Artificial Sequence
  Description of Artificial Sequence: Synthetic oligonucleotide
tcatcatctgtggagtgggcatcttcatgcac

SEQ ID NO: 53129 - DNA, 31 bp, Artificial Sequence
  Description of Artificial Sequence: Synthetic oligonucleotide
catcatctgtggagtgggcatcttcatgcac

SEQ ID NO: 53130 - DNA, 32 bp, Artificial Sequence
  Description of Artificial Sequence: Synthetic oligonucleotide
atcatctgtggagtgggcatcttcatgcacag

SEQ ID NO: 53131 - DNA, 31 bp, Artificial Sequence
  Description of Artificial Sequence: Synthetic oligonucleotide
tcatctgtggagtgggcatcttcatgcacag

SEQ ID NO: 53132 - DNA, 30 bp, Artificial Sequence
  Description of Artificial Sequence: Synthetic oligonucleotide
catctgtggagtgggcatcttcatgcacag

SEQ ID NO: 53133 - DNA, 30 bp, Artificial Sequence
  Description of Artificial Sequence: Synthetic oligonucleotide
atctgtggagtgggcatcttcatgcacagg

SEQ ID NO: 53134 - DNA, 29 bp, Artificial Sequence
  Description of Artificial Sequence: Synthetic oligonucleotide
tctgtggagtgggcatcttcatgcacagg

SEQ ID NO: 53135 - DNA, 28 bp, Artificial Sequence
  Description of Artificial Sequence: Synthetic oligonucleotide
ctgtggagtgggcatcttcatgcacagg

SEQ ID NO: 53136 - DNA, 29 bp, Artificial Sequence
  Description of Artificial Sequence: Synthetic oligonucleotide
tgtggagtgggcatcttcatgcacaggag

SEQ ID NO: 53137 - DNA, 28 bp, Artificial Sequence
  Description of Artificial Sequence: Synthetic oligonucleotide
gtggagtgggcatcttcatgcacaggag

SEQ ID NO: 53138 - DNA, 28 bp, Artificial Sequence
  Description of Artificial Sequence: Synthetic oligonucleotide
tggagtgggcatcttcatgcacaggagg

SEQ ID NO: 53139 - DNA, 27 bp, Artificial Sequence
  Description of Artificial Sequence: Synthetic oligonucleotide
ggagtgggcatcttcatgcacaggagg

SEQ ID NO: 53140 - DNA, 28 bp, Artificial Sequence
  Description of Artificial Sequence: Synthetic oligonucleotide
gagtgggcatcttcatgcacaggaggag

SEQ ID NO: 53141 - DNA, 28 bp, Artificial Sequence
  Description of Artificial Sequence: Synthetic oligonucleotide
agtgggcatcttcatgcacaggaggagc

SEQ ID NO: 53142 - DNA, 27 bp, Artificial Sequence
  Description of Artificial Sequence: Synthetic oligonucleotide
gtgggcatcttcatgcacaggaggagc

SEQ ID NO: 53143 - DNA, 29 bp, Artificial Sequence
  Description of Artificial Sequence: Synthetic oligonucleotide
tgggcatcttcatgcacaggaggagcaag

SEQ ID NO: 53144 - DNA, 28 bp, Artificial Sequence
  Description of Artificial Sequence: Synthetic oligonucleotide
gggcatcttcatgcacaggaggagcaag

SEQ ID NO: 53145 - DNA, 31 bp, Artificial Sequence
  Description of Artificial Sequence: Synthetic oligonucleotide
ggcatcttcatgcacaggaggagcaagaaag

SEQ ID NO: 53146 - DNA, 33 bp, Artificial Sequence
  Description of Artificial Sequence: Synthetic oligonucleotide
gcatcttcatgcacaggaggagcaagaaagttc

SEQ ID NO: 53147 - DNA, 35 bp, Artificial Sequence
  Description of Artificial Sequence: Synthetic oligonucleotide
catcttcatgcacaggaggagcaagaaagttcaac

SEQ ID NO: 53148 - DNA, 35 bp, Artificial Sequence
  Description of Artificial Sequence: Synthetic oligonucleotide
atcttcatgcacaggaggagcaagaaagttcaacg

SEQ ID NO: 53149 - DNA, 34 bp, Artificial Sequence
  Description of Artificial Sequence: Synthetic oligonucleotide
tcttcatgcacaggaggagcaagaaagttcaacg

SEQ ID NO: 53150 - DNA, 33 bp, Artificial Sequence
  Description of Artificial Sequence: Synthetic oligonucleotide
cttcatgcacaggaggagcaagaaagttcaacg

SEQ ID NO: 53151 - DNA, 34 bp, Artificial Sequence
  Description of Artificial Sequence: Synthetic oligonucleotide
ttcatgcacaggaggagcaagaaagttcaacgag

SEQ ID NO: 53152 - DNA, 33 bp, Artificial Sequence
  Description of Artificial Sequence: Synthetic oligonucleotide
tcatgcacaggaggagcaagaaagttcaacgag

SEQ ID NO: 53153 - DNA, 32 bp, Artificial Sequence
  Description of Artificial Sequence: Synthetic oligonucleotide
catgcacaggaggagcaagaaagttcaacgag

SEQ ID NO: 53154 - DNA, 32 bp, Artificial Sequence
  Description of Artificial Sequence: Synthetic oligonucleotide
atgcacaggaggagcaagaaagttcaacgagg

SEQ ID NO: 53155 - DNA, 31 bp, Artificial Sequence
  Description of Artificial Sequence: Synthetic oligonucleotide
tgcacaggaggagcaagaaagttcaacgagg

SEQ ID NO: 53156 - DNA, 30 bp, Artificial Sequence
  Description of Artificial Sequence: Synthetic oligonucleotide
gcacaggaggagcaagaaagttcaacgagg

SEQ ID NO: 53157 - DNA, 32 bp, Artificial Sequence
  Description of Artificial Sequence: Synthetic oligonucleotide
cacaggaggagcaagaaagttcaacgaggatc

SEQ ID NO: 53158 - DNA, 33 bp, Artificial Sequence
  Description of Artificial Sequence: Synthetic oligonucleotide
acaggaggagcaagaaagttcaacgaggatctg

SEQ ID NO: 53159 - DNA, 32 bp, Artificial Sequence
  Description of Artificial Sequence: Synthetic oligonucleotide
caggaggagcaagaaagttcaacgaggatctg

SEQ ID NO: 53160 - DNA, 32 bp, Artificial Sequence
  Description of Artificial Sequence: Synthetic oligonucleotide
aggaggagcaagaaagttcaacgaggatctgc

SEQ ID NO: 53161 - DNA, 31 bp, Artificial Sequence
  Description of Artificial Sequence: Synthetic oligonucleotide
ggaggagcaagaaagttcaacgaggatctgc

SEQ ID NO: 53162 - DNA, 23 bp, Artificial Sequence
  Description of Artificial Sequence: Synthetic oligonucleotide
cgcgcttcgacagcgacgtggga

SEQ ID NO: 53163 - DNA, 24 bp, Artificial Sequence
  Description of Artificial Sequence: Synthetic oligonucleotide
gcgcttcgacagcgacgtgggaga

SEQ ID NO: 53164 - DNA, 26 bp, Artificial Sequence
  Description of Artificial Sequence: Synthetic oligonucleotide
cgcttcgacagcgacgtgggagagtt

SEQ ID NO: 53165 - DNA, 26 bp, Artificial Sequence
  Description of Artificial Sequence: Synthetic oligonucleotide
gcttcgacagcgacgtgggagagttc

SEQ ID NO: 53166 - DNA, 26 bp, Artificial Sequence
  Description of Artificial Sequence: Synthetic oligonucleotide
cttcgacagcgacgtgggagagttcc

SEQ ID NO: 53167 - DNA, 26 bp, Artificial Sequence
  Description of Artificial Sequence: Synthetic oligonucleotide
ttcgacagcgacgtgggagagttccg

SEQ ID NO: 53168 - DNA, 25 bp, Artificial Sequence
  Description of Artificial Sequence: Synthetic oligonucleotide
tcgacagcgacgtgggagagttccg

SEQ ID NO: 53169 - DNA, 24 bp, Artificial Sequence
  Description of Artificial Sequence: Synthetic oligonucleotide
cgacagcgacgtgggagagttccg

SEQ ID NO: 53170 - DNA, 24 bp, Artificial Sequence
  Description of Artificial Sequence: Synthetic oligonucleotide
gacagcgacgtgggagagttccgg

SEQ ID NO: 53171 - DNA, 24 bp, Artificial Sequence
  Description of Artificial Sequence: Synthetic oligonucleotide
acagcgacgtgggagagttccggg

SEQ ID NO: 53172 - DNA, 23 bp, Artificial Sequence
  Description of Artificial Sequence: Synthetic oligonucleotide
cagcgacgtgggagagttccggg

SEQ ID NO: 53173 - DNA, 23 bp, Artificial Sequence
  Description of Artificial Sequence: Synthetic oligonucleotide
agcgacgtgggagagttccgggc

SEQ ID NO: 53174 - DNA, 22 bp, Artificial Sequence
  Description of Artificial Sequence: Synthetic oligonucleotide
gcgacgtgggagagttccgggc

SEQ ID NO: 53175 - DNA, 22 bp, Artificial Sequence
  Description of Artificial Sequence: Synthetic oligonucleotide
cgacgtgggagagttccgggcg

SEQ ID NO: 53176 - DNA, 23 bp, Artificial Sequence
  Description of Artificial Sequence: Synthetic oligonucleotide
gacgtgggagagttccgggcggt

SEQ ID NO: 53177 - DNA, 24 bp, Artificial Sequence
  Description of Artificial Sequence: Synthetic oligonucleotide
acgtgggagagttccgggcggtga

SEQ ID NO: 53178 - DNA, 23 bp, Artificial Sequence
  Description of Artificial Sequence: Synthetic oligonucleotide
cgtgggagagttccgggcggtga

SEQ ID NO: 53179 - DNA, 23 bp, Artificial Sequence
  Description of Artificial Sequence: Synthetic oligonucleotide
gtgggagagttccgggcggtgac

SEQ ID NO: 53180 - DNA, 23 bp, Artificial Sequence
  Description of Artificial Sequence: Synthetic oligonucleotide
tgggagagttccgggcggtgacg

SEQ ID NO: 53181 - DNA, 22 bp, Artificial Sequence
  Description of Artificial Sequence: Synthetic oligonucleotide
gggagagttccgggcggtgacg

SEQ ID NO: 53182 - DNA, 23 bp, Artificial Sequence
  Description of Artificial Sequence: Synthetic oligonucleotide
ggagagttccgggcggtgacgga

SEQ ID NO: 53183 - DNA, 23 bp, Artificial Sequence
  Description of Artificial Sequence: Synthetic oligonucleotide
gagagttccgggcggtgacggag

SEQ ID NO: 53184 - DNA, 24 bp, Artificial Sequence
  Description of Artificial Sequence: Synthetic oligonucleotide
agagttccgggcggtgacggagct

SEQ ID NO: 53185 - DNA, 31 bp, Artificial Sequence
  Description of Artificial Sequence: Synthetic oligonucleotide
ggagtactggaacagccagaaggacatcttg

SEQ ID NO: 53186 - DNA, 31 bp, Artificial Sequence
  Description of Artificial Sequence: Synthetic oligonucleotide
gagtactggaacagccagaaggacatcttgg

SEQ ID NO: 53187 - DNA, 32 bp, Artificial Sequence
  Description of Artificial Sequence: Synthetic oligonucleotide
agtactggaacagccagaaggacatcttggag

SEQ ID NO: 53188 - DNA, 31 bp, Artificial Sequence
  Description of Artificial Sequence: Synthetic oligonucleotide
gtactggaacagccagaaggacatcttggag

SEQ ID NO: 53189 - DNA, 31 bp, Artificial Sequence
  Description of Artificial Sequence: Synthetic oligonucleotide
tactggaacagccagaaggacatcttggagg

SEQ ID NO: 53190 - DNA, 30 bp, Artificial Sequence
  Description of Artificial Sequence: Synthetic oligonucleotide
actggaacagccagaaggacatcttggagg

SEQ ID NO: 53191 - DNA, 29 bp, Artificial Sequence
  Description of Artificial Sequence: Synthetic oligonucleotide
ctggaacagccagaaggacatcttggagg

SEQ ID NO: 53192 - DNA, 30 bp, Artificial Sequence
  Description of Artificial Sequence: Synthetic oligonucleotide
tggaacagccagaaggacatcttggaggag

SEQ ID NO: 53193 - DNA, 29 bp, Artificial Sequence
  Description of Artificial Sequence: Synthetic oligonucleotide
ggaacagccagaaggacatcttggaggag

SEQ ID NO: 53194 - DNA, 31 bp, Artificial Sequence
  Description of Artificial Sequence: Synthetic oligonucleotide
gaacagccagaaggacatcttggaggagaag

SEQ ID NO: 53195 - DNA, 31 bp, Artificial Sequence
  Description of Artificial Sequence: Synthetic oligonucleotide
aacagccagaaggacatcttggaggagaagc

SEQ ID NO: 53196 - DNA, 30 bp, Artificial Sequence
  Description of Artificial Sequence: Synthetic oligonucleotide
acagccagaaggacatcttggaggagaagc

SEQ ID NO: 53197 - DNA, 29 bp, Artificial Sequence
  Description of Artificial Sequence: Synthetic oligonucleotide
cagccagaaggacatcttggaggagaagc

SEQ ID NO: 53198 - DNA, 29 bp, Artificial Sequence
  Description of Artificial Sequence: Synthetic oligonucleotide
agccagaaggacatcttggaggagaagcg

SEQ ID NO: 53199 - DNA, 28 bp, Artificial Sequence
  Description of Artificial Sequence: Synthetic oligonucleotide
gccagaaggacatcttggaggagaagcg

SEQ ID NO: 53200 - DNA, 28 bp, Artificial Sequence
  Description of Artificial Sequence: Synthetic oligonucleotide
ccagaaggacatcttggaggagaagcgg

SEQ ID NO: 53201 - DNA, 28 bp, Artificial Sequence
  Description of Artificial Sequence: Synthetic oligonucleotide
cagaaggacatcttggaggagaagcggg

SEQ ID NO: 53202 - DNA, 28 bp, Artificial Sequence
  Description of Artificial Sequence: Synthetic oligonucleotide
agaaggacatcttggaggagaagcgggc

SEQ ID NO: 53203 - DNA, 27 bp, Artificial Sequence
  Description of Artificial Sequence: Synthetic oligonucleotide
gaaggacatcttggaggagaagcgggc

SEQ ID NO: 53204 - DNA, 28 bp, Artificial Sequence
  Description of Artificial Sequence: Synthetic oligonucleotide
aaggacatcttggaggagaagcgggcag

SEQ ID NO: 53205 - DNA, 27 bp, Artificial Sequence
  Description of Artificial Sequence: Synthetic oligonucleotide
aggacatcttggaggagaagcgggcag

SEQ ID NO: 53206 - DNA, 27 bp, Artificial Sequence
  Description of Artificial Sequence: Synthetic oligonucleotide
ggacatcttggaggagaagcgggcagt

SEQ ID NO: 53207 - DNA, 27 bp, Artificial Sequence
  Description of Artificial Sequence: Synthetic oligonucleotide
gacatcttggaggagaagcgggcagtg

SEQ ID NO: 53208 - DNA, 27 bp, Artificial Sequence
  Description of Artificial Sequence: Synthetic oligonucleotide
acatcttggaggagaagcgggcagtgc

SEQ ID NO: 53209 - DNA, 26 bp, Artificial Sequence
  Description of Artificial Sequence: Synthetic oligonucleotide
catcttggaggagaagcgggcagtgc

SEQ ID NO: 53210 - DNA, 26 bp, Artificial Sequence
  Description of Artificial Sequence: Synthetic oligonucleotide
atcttggaggagaagcgggcagtgcc

SEQ ID NO: 53211 - DNA, 25 bp, Artificial Sequence
  Description of Artificial Sequence: Synthetic oligonucleotide
tcttggaggagaagcgggcagtgcc

SEQ ID NO: 53212 - DNA, 24 bp, Artificial Sequence
  Description of Artificial Sequence: Synthetic oligonucleotide
cttggaggagaagcgggcagtgcc

SEQ ID NO: 53213 - DNA, 24 bp, Artificial Sequence
  Description of Artificial Sequence: Synthetic oligonucleotide
ttggaggagaagcgggcagtgccg

SEQ ID NO: 53214 - DNA, 21 bp, Artificial Sequence
  Description of Artificial Sequence: Synthetic oligonucleotide
ccgtgaccctgcagcgccgag

SEQ ID NO: 53215 - DNA, 27 bp, Artificial Sequence
  Description of Artificial Sequence: Synthetic oligonucleotide
agggcagggccactccagagaattacc

SEQ ID NO: 53216 - DNA, 27 bp, Artificial Sequence
  Description of Artificial Sequence: Synthetic oligonucleotide
gggcagggccactccagagaattacct

SEQ ID NO: 53217 - DNA, 30 bp, Artificial Sequence
  Description of Artificial Sequence: Synthetic oligonucleotide
ggcagggccactccagagaattaccttttc

SEQ ID NO: 53218 - DNA, 30 bp, Artificial Sequence
  Description of Artificial Sequence: Synthetic oligonucleotide
gcagggccactccagagaattaccttttcc

SEQ ID NO: 53219 - DNA, 31 bp, Artificial Sequence
  Description of Artificial Sequence: Synthetic oligonucleotide
cagggccactccagagaattaccttttccag

SEQ ID NO: 53220 - DNA, 31 bp, Artificial Sequence
  Description of Artificial Sequence: Synthetic oligonucleotide
agggccactccagagaattaccttttccagg

SEQ ID NO: 53221 - DNA, 30 bp, Artificial Sequence
  Description of Artificial Sequence: Synthetic oligonucleotide
gggccactccagagaattaccttttccagg

SEQ ID NO: 53222 - DNA, 30 bp, Artificial Sequence
  Description of Artificial Sequence: Synthetic oligonucleotide
ggccactccagagaattaccttttccaggg

SEQ ID NO: 53223 - DNA, 31 bp, Artificial Sequence
  Description of Artificial Sequence: Synthetic oligonucleotide
gccactccagagaattaccttttccagggac

SEQ ID NO: 53224 - DNA, 31 bp, Artificial Sequence
  Description of Artificial Sequence: Synthetic oligonucleotide
ccactccagagaattaccttttccagggacg

SEQ ID NO: 53225 - DNA, 31 bp, Artificial Sequence
  Description of Artificial Sequence: Synthetic oligonucleotide
cactccagagaattaccttttccagggacgg

SEQ ID NO: 53226 - DNA, 31 bp, Artificial Sequence
  Description of Artificial Sequence: Synthetic oligonucleotide
actccagagaattaccttttccagggacggc

SEQ ID NO: 53227 - DNA, 30 bp, Artificial Sequence
  Description of Artificial Sequence: Synthetic oligonucleotide
ctccagagaattaccttttccagggacggc

SEQ ID NO: 53228 - DNA, 31 bp, Artificial Sequence
  Description of Artificial Sequence: Synthetic oligonucleotide
tccagagaattaccttttccagggacggcag

SEQ ID NO: 53229 - DNA, 30 bp, Artificial Sequence
  Description of Artificial Sequence: Synthetic oligonucleotide
ccagagaattaccttttccagggacggcag

SEQ ID NO: 53230 - DNA, 30 bp, Artificial Sequence
  Description of Artificial Sequence: Synthetic oligonucleotide
cagagaattaccttttccagggacggcagg

SEQ ID NO: 53231 - DNA, 33 bp, Artificial Sequence
  Description of Artificial Sequence: Synthetic oligonucleotide
agagaattaccttttccagggacggcaggaatg

SEQ ID NO: 53232 - DNA, 32 bp, Artificial Sequence
  Description of Artificial Sequence: Synthetic oligonucleotide
gagaattaccttttccagggacggcaggaatg

SEQ ID NO: 53233 - DNA, 32 bp, Artificial Sequence
  Description of Artificial Sequence: Synthetic oligonucleotide
agaattaccttttccagggacggcaggaatgc

SEQ ID NO: 53234 - DNA, 31 bp, Artificial Sequence
  Description of Artificial Sequence: Synthetic oligonucleotide
gaattaccttttccagggacggcaggaatgc

SEQ ID NO: 53235 - DNA, 33 bp, Artificial Sequence
  Description of Artificial Sequence: Synthetic oligonucleotide
aattaccttttccagggacggcaggaatgctac

SEQ ID NO: 53236 - DNA, 32 bp, Artificial Sequence
  Description of Artificial Sequence: Synthetic oligonucleotide
attaccttttccagggacggcaggaatgctac

SEQ ID NO: 53237 - DNA, 31 bp, Artificial Sequence
  Description of Artificial Sequence: Synthetic oligonucleotide
ttaccttttccagggacggcaggaatgctac

SEQ ID NO: 53238 - DNA, 30 bp, Artificial Sequence
  Description of Artificial Sequence: Synthetic oligonucleotide
taccttttccagggacggcaggaatgctac

SEQ ID NO: 53239 - DNA, 29 bp, Artificial Sequence
  Description of Artificial Sequence: Synthetic oligonucleotide
accttttccagggacggcaggaatgctac

SEQ ID NO: 53240 - DNA, 28 bp, Artificial Sequence
  Description of Artificial Sequence: Synthetic oligonucleotide
ccttttccagggacggcaggaatgctac

SEQ ID NO: 53241 - DNA, 28 bp, Artificial Sequence
  Description of Artificial Sequence: Synthetic oligonucleotide
cttttccagggacggcaggaatgctacg

SEQ ID NO: 53242 - DNA, 28 bp, Artificial Sequence
  Description of Artificial Sequence: Synthetic oligonucleotide
ttttccagggacggcaggaatgctacgc

SEQ ID NO: 53243 - DNA, 27 bp, Artificial Sequence
  Description of Artificial Sequence: Synthetic oligonucleotide
tttccagggacggcaggaatgctacgc

SEQ ID NO: 53244 - DNA, 26 bp, Artificial Sequence
  Description of Artificial Sequence: Synthetic oligonucleotide
ttccagggacggcaggaatgctacgc

SEQ ID NO: 53245 - DNA, 25 bp, Artificial Sequence
  Description of Artificial Sequence: Synthetic oligonucleotide
tccagggacggcaggaatgctacgc

SEQ ID NO: 53246 - DNA, 32 bp, Artificial Sequence
  Description of Artificial Sequence: Synthetic oligonucleotide
tggagagatacatctacaaccgggaggagttc

SEQ ID NO: 53247 - DNA, 31 bp, Artificial Sequence
  Description of Artificial Sequence: Synthetic oligonucleotide
ggagagatacatctacaaccgggaggagttc

SEQ ID NO: 53248 - DNA, 31 bp, Artificial Sequence
  Description of Artificial Sequence: Synthetic oligonucleotide
gagagatacatctacaaccgggaggagttcg

SEQ ID NO: 53249 - DNA, 32 bp, Artificial Sequence
  Description of Artificial Sequence: Synthetic oligonucleotide
agagatacatctacaaccgggaggagttcgtg

SEQ ID NO: 53250 - DNA, 31 bp, Artificial Sequence
  Description of Artificial Sequence: Synthetic oligonucleotide
gagatacatctacaaccgggaggagttcgtg

SEQ ID NO: 53251 - DNA, 31 bp, Artificial Sequence
  Description of Artificial Sequence: Synthetic oligonucleotide
agatacatctacaaccgggaggagttcgtgc

SEQ ID NO: 53252 - DNA, 30 bp, Artificial Sequence
  Description of Artificial Sequence: Synthetic oligonucleotide
gatacatctacaaccgggaggagttcgtgc

SEQ ID NO: 53253 - DNA, 30 bp, Artificial Sequence
  Description of Artificial Sequence: Synthetic oligonucleotide
atacatctacaaccgggaggagttcgtgcg

SEQ ID NO: 53254 - DNA, 29 bp, Artificial Sequence
  Description of Artificial Sequence: Synthetic oligonucleotide
tacatctacaaccgggaggagttcgtgcg

SEQ ID NO: 53255 - DNA, 28 bp, Artificial Sequence
  Description of Artificial Sequence: Synthetic oligonucleotide
acatctacaaccgggaggagttcgtgcg

SEQ ID NO: 53256 - DNA, 27 bp, Artificial Sequence
  Description of Artificial Sequence: Synthetic oligonucleotide
catctacaaccgggaggagttcgtgcg

SEQ ID NO: 53257 - DNA, 27 bp, Artificial Sequence
  Description of Artificial Sequence: Synthetic oligonucleotide
atctacaaccgggaggagttcgtgcgc

SEQ ID NO: 53258 - DNA, 27 bp, Artificial Sequence
  Description of Artificial Sequence: Synthetic oligonucleotide
tctacaaccgggaggagttcgtgcgct

SEQ ID NO: 53259 - DNA, 27 bp, Artificial Sequence
  Description of Artificial Sequence: Synthetic oligonucleotide
ctacaaccgggaggagttcgtgcgctt

SEQ ID NO: 53260 - DNA, 27 bp, Artificial Sequence
  Description of Artificial Sequence: Synthetic oligonucleotide
tacaaccgggaggagttcgtgcgcttc

SEQ ID NO: 53261 - DNA, 26 bp, Artificial Sequence
  Description of Artificial Sequence: Synthetic oligonucleotide
acaaccgggaggagttcgtgcgcttc

SEQ ID NO: 53262 - DNA, 25 bp, Artificial Sequence
  Description of Artificial Sequence: Synthetic oligonucleotide
caaccgggaggagttcgtgcgcttc

SEQ ID NO: 53263 - DNA, 26 bp, Artificial Sequence
  Description of Artificial Sequence: Synthetic oligonucleotide
aaccgggaggagttcgtgcgcttcga

SEQ ID NO: 53264 - DNA, 25 bp, Artificial Sequence
  Description of Artificial Sequence: Synthetic oligonucleotide
accgggaggagttcgtgcgcttcga

SEQ ID NO: 53265 - DNA, 24 bp, Artificial Sequence
  Description of Artificial Sequence: Synthetic oligonucleotide
ccgggaggagttcgtgcgcttcga

SEQ ID NO: 53266 - DNA, 25 bp, Artificial Sequence
  Description of Artificial Sequence: Synthetic oligonucleotide
cgggaggagttcgtgcgcttcgaca

SEQ ID NO: 53267 - DNA, 25 bp, Artificial Sequence
  Description of Artificial Sequence: Synthetic oligonucleotide
gggaggagttcgtgcgcttcgacag

SEQ ID NO: 53268 - DNA, 25 bp, Artificial Sequence
  Description of Artificial Sequence: Synthetic oligonucleotide
ggaggagttcgtgcgcttcgacagc

SEQ ID NO: 53269 - DNA, 26 bp, Artificial Sequence
  Description of Artificial Sequence: Synthetic oligonucleotide
gaggagttcgtgcgcttcgacagcga

SEQ ID NO: 53270 - DNA, 26 bp, Artificial Sequence
  Description of Artificial Sequence: Synthetic oligonucleotide
aggagttcgtgcgcttcgacagcgac

SEQ ID NO: 53271 - DNA, 25 bp, Artificial Sequence
  Description of Artificial Sequence: Synthetic oligonucleotide
ggagttcgtgcgcttcgacagcgac

SEQ ID NO: 53272 - DNA, 26 bp, Artificial Sequence
  Description of Artificial Sequence: Synthetic oligonucleotide
gagttcgtgcgcttcgacagcgacgt

SEQ ID NO: 53273 - DNA, 26 bp, Artificial Sequence
  Description of Artificial Sequence: Synthetic oligonucleotide
agttcgtgcgcttcgacagcgacgtg

SEQ ID NO: 53274 - DNA, 25 bp, Artificial Sequence
  Description of Artificial Sequence: Synthetic oligonucleotide
gttcgtgcgcttcgacagcgacgtg

SEQ ID NO: 53275 - DNA, 25 bp, Artificial Sequence
  Description of Artificial Sequence: Synthetic oligonucleotide
ttcgtgcgcttcgacagcgacgtgg

SEQ ID NO: 53276 - DNA, 24 bp, Artificial Sequence
  Description of Artificial Sequence: Synthetic oligonucleotide
tcgtgcgcttcgacagcgacgtgg

SEQ ID NO: 53277 - DNA, 23 bp, Artificial Sequence
  Description of Artificial Sequence: Synthetic oligonucleotide
cgtgcgcttcgacagcgacgtgg

SEQ ID NO: 53278 - DNA, 23 bp, Artificial Sequence
  Description of Artificial Sequence: Synthetic oligonucleotide
gtgcgcttcgacagcgacgtggg

SEQ ID NO: 53279 - DNA, 23 bp, Artificial Sequence
  Description of Artificial Sequence: Synthetic oligonucleotide
tgcgcttcgacagcgacgtgggg

SEQ ID NO: 53280 - DNA, 23 bp, Artificial Sequence
  Description of Artificial Sequence: Synthetic oligonucleotide
tgacggagctggggcggcctgat

SEQ ID NO: 53281 - DNA, 22 bp, Artificial Sequence
  Description of Artificial Sequence: Synthetic oligonucleotide
gacggagctggggcggcctgat

SEQ ID NO: 53282 - DNA, 23 bp, Artificial Sequence
  Description of Artificial Sequence: Synthetic oligonucleotide
acggagctggggcggcctgatga

SEQ ID NO: 53283 - DNA, 22 bp, Artificial Sequence
  Description of Artificial Sequence: Synthetic oligonucleotide
cggagctggggcggcctgatga

SEQ ID NO: 53284 - DNA, 22 bp, Artificial Sequence
  Description of Artificial Sequence: Synthetic oligonucleotide
ggagctggggcggcctgatgag

SEQ ID NO: 53285 - DNA, 23 bp, Artificial Sequence
  Description of Artificial Sequence: Synthetic oligonucleotide
gagctggggcggcctgatgagga

SEQ ID NO: 53286 - DNA, 25 bp, Artificial Sequence
  Description of Artificial Sequence: Synthetic oligonucleotide
agctggggcggcctgatgaggagta

SEQ ID NO: 53287 - DNA, 24 bp, Artificial Sequence
  Description of Artificial Sequence: Synthetic oligonucleotide
gctggggcggcctgatgaggagta

SEQ ID NO: 53288 - DNA, 25 bp, Artificial Sequence
  Description of Artificial Sequence: Synthetic oligonucleotide
ctggggcggcctgatgaggagtact

SEQ ID NO: 53289 - DNA, 25 bp, Artificial Sequence
  Description of Artificial Sequence: Synthetic oligonucleotide
tggggcggcctgatgaggagtactg

SEQ ID NO: 53290 - DNA, 24 bp, Artificial Sequence
  Description of Artificial Sequence: Synthetic oligonucleotide
ggggcggcctgatgaggagtactg

SEQ ID NO: 53291 - DNA, 26 bp, Artificial Sequence
  Description of Artificial Sequence: Synthetic oligonucleotide
gggcggcctgatgaggagtactggaa

SEQ ID NO: 53292 - DNA, 27 bp, Artificial Sequence
  Description of Artificial Sequence: Synthetic oligonucleotide
ggcggcctgatgaggagtactggaaca

SEQ ID NO: 53293 - DNA, 27 bp, Artificial Sequence
  Description of Artificial Sequence: Synthetic oligonucleotide
gcggcctgatgaggagtactggaacag

SEQ ID NO: 53294 - DNA, 27 bp, Artificial Sequence
  Description of Artificial Sequence: Synthetic oligonucleotide
cggcctgatgaggagtactggaacagc

SEQ ID NO: 53295 - DNA, 27 bp, Artificial Sequence
  Description of Artificial Sequence: Synthetic oligonucleotide
ggcctgatgaggagtactggaacagcc

SEQ ID NO: 53296 - DNA, 28 bp, Artificial Sequence
  Description of Artificial Sequence: Synthetic oligonucleotide
gcctgatgaggagtactggaacagccag

SEQ ID NO: 53297 - DNA, 30 bp, Artificial Sequence
  Description of Artificial Sequence: Synthetic oligonucleotide
cctgatgaggagtactggaacagccagaag

SEQ ID NO: 53298 - DNA, 30 bp, Artificial Sequence
  Description of Artificial Sequence: Synthetic oligonucleotide
ctgatgaggagtactggaacagccagaagg

SEQ ID NO: 53299 - DNA, 31 bp, Artificial Sequence
  Description of Artificial Sequence: Synthetic oligonucleotide
tgatgaggagtactggaacagccagaaggac

SEQ ID NO: 53300 - DNA, 30 bp, Artificial Sequence
  Description of Artificial Sequence: Synthetic oligonucleotide
gatgaggagtactggaacagccagaaggac

SEQ ID NO: 53301 - DNA, 32 bp, Artificial Sequence
  Description of Artificial Sequence: Synthetic oligonucleotide
atgaggagtactggaacagccagaaggacatc

SEQ ID NO: 53302 - DNA, 31 bp, Artificial Sequence
  Description of Artificial Sequence: Synthetic oligonucleotide
tgaggagtactggaacagccagaaggacatc

SEQ ID NO: 53303 - DNA, 30 bp, Artificial Sequence
  Description of Artificial Sequence: Synthetic oligonucleotide
gaggagtactggaacagccagaaggacatc

SEQ ID NO: 53304 - DNA, 30 bp, Artificial Sequence
  Description of Artificial Sequence: Synthetic oligonucleotide
aggagtactggaacagccagaaggacatcc

SEQ ID NO: 53305 - DNA, 28 bp, Artificial Sequence
  Description of Artificial Sequence: Synthetic oligonucleotide
aacagccagaaggacatcctggaggagg

SEQ ID NO: 53306 - DNA, 27 bp, Artificial Sequence
  Description of Artificial Sequence: Synthetic oligonucleotide
acagccagaaggacatcctggaggagg

SEQ ID NO: 53307 - DNA, 27 bp, Artificial Sequence
  Description of Artificial Sequence: Synthetic oligonucleotide
cagccagaaggacatcctggaggagga

SEQ ID NO: 53308 - DNA, 27 bp, Artificial Sequence
  Description of Artificial Sequence: Synthetic oligonucleotide
agccagaaggacatcctggaggaggag

SEQ ID NO: 53309 - DNA, 26 bp, Artificial Sequence
  Description of Artificial Sequence: Synthetic oligonucleotide
gccagaaggacatcctggaggaggag

SEQ ID NO: 53310 - DNA, 26 bp, Artificial Sequence
  Description of Artificial Sequence: Synthetic oligonucleotide
ccagaaggacatcctggaggaggagc

SEQ ID NO: 53311 - DNA, 26 bp, Artificial Sequence
  Description of Artificial Sequence: Synthetic oligonucleotide
cagaaggacatcctggaggaggagcg

SEQ ID NO: 53312 - DNA, 26 bp, Artificial Sequence
  Description of Artificial Sequence: Synthetic oligonucleotide
agaaggacatcctggaggaggagcgg

SEQ ID NO: 53313 - DNA, 25 bp, Artificial Sequence
  Description of Artificial Sequence: Synthetic oligonucleotide
gaaggacatcctggaggaggagcgg

SEQ ID NO: 53314 - DNA, 25 bp, Artificial Sequence
  Description of Artificial Sequence: Synthetic oligonucleotide
aaggacatcctggaggaggagcggg

SEQ ID NO: 53315 - DNA, 24 bp, Artificial Sequence
  Description of Artificial Sequence: Synthetic oligonucleotide
aggacatcctggaggaggagcggg

SEQ ID NO: 53316 - DNA, 23 bp, Artificial Sequence
  Description of Artificial Sequence: Synthetic oligonucleotide
ggacatcctggaggaggagcggg

SEQ ID NO: 53317 - DNA, 24 bp, Artificial Sequence
  Description of Artificial Sequence: Synthetic oligonucleotide
gacatcctggaggaggagcgggca

SEQ ID NO: 53318 - DNA, 25 bp, Artificial Sequence
  Description of Artificial Sequence: Synthetic oligonucleotide
acatcctggaggaggagcgggcagt

SEQ ID NO: 53319 - DNA, 24 bp, Artificial Sequence
  Description of Artificial Sequence: Synthetic oligonucleotide
catcctggaggaggagcgggcagt

SEQ ID NO: 53320 - DNA, 24 bp, Artificial Sequence
  Description of Artificial Sequence: Synthetic oligonucleotide
atcctggaggaggagcgggcagtg

SEQ ID NO: 53321 - DNA, 23 bp, Artificial Sequence
  Description of Artificial Sequence: Synthetic oligonucleotide
tcctggaggaggagcgggcagtg

SEQ ID NO: 53322 - DNA, 22 bp, Artificial Sequence
  Description of Artificial Sequence: Synthetic oligonucleotide
cctggaggaggagcgggcagtg

SEQ ID NO: 53323 - DNA, 22 bp, Artificial Sequence
  Description of Artificial Sequence: Synthetic oligonucleotide
ctggaggaggagcgggcagtgc

SEQ ID NO: 53324 - DNA, 22 bp, Artificial Sequence
  Description of Artificial Sequence: Synthetic oligonucleotide
tggaggaggagcgggcagtgcc

SEQ ID NO: 53325 - DNA, 21 bp, Artificial Sequence
  Description of Artificial Sequence: Synthetic oligonucleotide
ggaggaggagcgggcagtgcc

SEQ ID NO: 53326 - DNA, 21 bp, Artificial Sequence
  Description of Artificial Sequence: Synthetic oligonucleotide
gaggaggagcgggcagtgccg

SEQ ID NO: 53327 - DNA, 22 bp, Artificial Sequence
  Description of Artificial Sequence: Synthetic oligonucleotide
aggaggagcgggcagtgccgga

SEQ ID NO: 53328 - DNA, 21 bp, Artificial Sequence
  Description of Artificial Sequence: Synthetic oligonucleotide
ggaggagcgggcagtgccgga

SEQ ID NO: 53329 - DNA, 22 bp, Artificial Sequence
  Description of Artificial Sequence: Synthetic oligonucleotide
gaggagcgggcagtgccggaca

SEQ ID NO: 53330 - DNA, 22 bp, Artificial Sequence
  Description of Artificial Sequence: Synthetic oligonucleotide
aggagcgggcagtgccggacag

SEQ ID NO: 53331 - DNA, 21 bp, Artificial Sequence
  Description of Artificial Sequence: Synthetic oligonucleotide
ggagcgggcagtgccggacag

SEQ ID NO: 53332 - DNA, 23 bp, Artificial Sequence
  Description of Artificial Sequence: Synthetic oligonucleotide
gagcgggcagtgccggacaggat

SEQ ID NO: 53333 - DNA, 24 bp, Artificial Sequence
  Description of Artificial Sequence: Synthetic oligonucleotide
agcgggcagtgccggacaggatgt

SEQ ID NO: 53334 - DNA, 23 bp, Artificial Sequence
  Description of Artificial Sequence: Synthetic oligonucleotide
gcgggcagtgccggacaggatgt

SEQ ID NO: 53335 - DNA, 23 bp, Artificial Sequence
  Description of Artificial Sequence: Synthetic oligonucleotide
cgggcagtgccggacaggatgtg

SEQ ID NO: 53336 - DNA, 24 bp, Artificial Sequence
  Description of Artificial Sequence: Synthetic oligonucleotide
gggcagtgccggacaggatgtgca

SEQ ID NO: 53337 - DNA, 25 bp, Artificial Sequence
  Description of Artificial Sequence: Synthetic oligonucleotide
ggcagtgccggacaggatgtgcaga

SEQ ID NO: 53338 - DNA, 26 bp, Artificial Sequence
  Description of Artificial Sequence: Synthetic oligonucleotide
gcagtgccggacaggatgtgcagaca

SEQ ID NO: 53339 - DNA, 27 bp, Artificial Sequence
  Description of Artificial Sequence: Synthetic oligonucleotide
cagtgccggacaggatgtgcagacaca

SEQ ID NO: 53340 - DNA, 28 bp, Artificial Sequence
  Description of Artificial Sequence: Synthetic oligonucleotide
agtgccggacaggatgtgcagacacaac

SEQ ID NO: 53341 - DNA, 27 bp, Artificial Sequence
  Description of Artificial Sequence: Synthetic oligonucleotide
gtgccggacaggatgtgcagacacaac

SEQ ID NO: 53342 - DNA, 29 bp, Artificial Sequence
  Description of Artificial Sequence: Synthetic oligonucleotide
tgccggacaggatgtgcagacacaactac

SEQ ID NO: 53343 - DNA, 28 bp, Artificial Sequence
  Description of Artificial Sequence: Synthetic oligonucleotide
gccggacaggatgtgcagacacaactac

SEQ ID NO: 53344 - DNA, 28 bp, Artificial Sequence
  Description of Artificial Sequence: Synthetic oligonucleotide
ccggacaggatgtgcagacacaactacg

SEQ ID NO: 53345 - DNA, 29 bp, Artificial Sequence
  Description of Artificial Sequence: Synthetic oligonucleotide
cggacaggatgtgcagacacaactacgag

SEQ ID NO: 53346 - DNA, 29 bp, Artificial Sequence
  Description of Artificial Sequence: Synthetic oligonucleotide
ggacaggatgtgcagacacaactacgagc

SEQ ID NO: 53347 - DNA, 30 bp, Artificial Sequence
  Description of Artificial Sequence: Synthetic oligonucleotide
gacaggatgtgcagacacaactacgagctg

SEQ ID NO: 53348 - DNA, 30 bp, Artificial Sequence
  Description of Artificial Sequence: Synthetic oligonucleotide
acaggatgtgcagacacaactacgagctgg

SEQ ID NO: 53349 - DNA, 29 bp, Artificial Sequence
  Description of Artificial Sequence: Synthetic oligonucleotide
caggatgtgcagacacaactacgagctgg

SEQ ID NO: 53350 - DNA, 29 bp, Artificial Sequence
  Description of Artificial Sequence: Synthetic oligonucleotide
aggatgtgcagacacaactacgagctggg

SEQ ID NO: 53351 - DNA, 28 bp, Artificial Sequence
  Description of Artificial Sequence: Synthetic oligonucleotide
ggatgtgcagacacaactacgagctggg

SEQ ID NO: 53352 - DNA, 28 bp, Artificial Sequence
  Description of Artificial Sequence: Synthetic oligonucleotide
gatgtgcagacacaactacgagctgggc

SEQ ID NO: 53353 - DNA, 28 bp, Artificial Sequence
  Description of Artificial Sequence: Synthetic oligonucleotide
atgtgcagacacaactacgagctgggcg

SEQ ID NO: 53354 - DNA, 27 bp, Artificial Sequence
  Description of Artificial Sequence: Synthetic oligonucleotide
tgtgcagacacaactacgagctgggcg

SEQ ID NO: 53355 - DNA, 26 bp, Artificial Sequence
  Description of Artificial Sequence: Synthetic oligonucleotide
gtgcagacacaactacgagctgggcg

SEQ ID NO: 53356 - DNA, 26 bp, Artificial Sequence
  Description of Artificial Sequence: Synthetic oligonucleotide
tgcagacacaactacgagctgggcgg

SEQ ID NO: 53357 - DNA, 25 bp, Artificial Sequence
  Description of Artificial Sequence: Synthetic oligonucleotide
gcagacacaactacgagctgggcgg

SEQ ID NO: 53358 - DNA, 25 bp, Artificial Sequence
  Description of Artificial Sequence: Synthetic oligonucleotide
cagacacaactacgagctgggcggg

SEQ ID NO: 53359 - DNA, 25 bp, Artificial Sequence
  Description of Artificial Sequence: Synthetic oligonucleotide
agacacaactacgagctgggcgggc

SEQ ID NO: 53360 - DNA, 24 bp, Artificial Sequence
  Description of Artificial Sequence: Synthetic oligonucleotide
gacacaactacgagctgggcgggc

SEQ ID NO: 53361 - DNA, 24 bp, Artificial Sequence
  Description of Artificial Sequence: Synthetic oligonucleotide
acacaactacgagctgggcgggcc

SEQ ID NO: 53362 - DNA, 23 bp, Artificial Sequence
  Description of Artificial Sequence: Synthetic oligonucleotide
cacaactacgagctgggcgggcc

SEQ ID NO: 53363 - DNA, 25 bp, Artificial Sequence
  Description of Artificial Sequence: Synthetic oligonucleotide
acaactacgagctgggcgggcccat

SEQ ID NO: 53364 - DNA, 24 bp, Artificial Sequence
  Description of Artificial Sequence: Synthetic oligonucleotide
caactacgagctgggcgggcccat

SEQ ID NO: 53365 - DNA, 25 bp, Artificial Sequence
  Description of Artificial Sequence: Synthetic oligonucleotide
aactacgagctgggcgggcccatga

SEQ ID NO: 53366 - DNA, 24 bp, Artificial Sequence
  Description of Artificial Sequence: Synthetic oligonucleotide
actacgagctgggcgggcccatga

SEQ ID NO: 53367 - DNA, 23 bp, Artificial Sequence
  Description of Artificial Sequence: Synthetic oligonucleotide
ctacgagctgggcgggcccatga

SEQ ID NO: 53368 - DNA, 23 bp, Artificial Sequence
  Description of Artificial Sequence: Synthetic oligonucleotide
tacgagctgggcgggcccatgac

SEQ ID NO: 53369 - DNA, 22 bp, Artificial Sequence
  Description of Artificial Sequence: Synthetic oligonucleotide
acgagctgggcgggcccatgac

SEQ ID NO: 53370 - DNA, 21 bp, Artificial Sequence
  Description of Artificial Sequence: Synthetic oligonucleotide
cgagctgggcgggcccatgac

SEQ ID NO: 53371 - DNA, 21 bp, Artificial Sequence
  Description of Artificial Sequence: Synthetic oligonucleotide
gagctgggcgggcccatgacc

SEQ ID NO: 53372 - DNA, 22 bp, Artificial Sequence
  Description of Artificial Sequence: Synthetic oligonucleotide
agctgggcgggcccatgaccct

SEQ ID NO: 53373 - DNA, 21 bp, Artificial Sequence
  Description of Artificial Sequence: Synthetic oligonucleotide
gctgggcgggcccatgaccct

SEQ ID NO: 53374 - DNA, 21 bp, Artificial Sequence
  Description of Artificial Sequence: Synthetic oligonucleotide
ctgggcgggcccatgaccctg

SEQ ID NO: 53375 - DNA, 22 bp, Artificial Sequence
  Description of Artificial Sequence: Synthetic oligonucleotide
tgggcgggcccatgaccctgca

SEQ ID NO: 53376 - DNA, 21 bp, Artificial Sequence
  Description of Artificial Sequence: Synthetic oligonucleotide
gggcgggcccatgaccctgca

SEQ ID NO: 53377 - DNA, 21 bp, Artificial Sequence
  Description of Artificial Sequence: Synthetic oligonucleotide
ggcgggcccatgaccctgcag

SEQ ID NO: 53378 - DNA, 21 bp, Artificial Sequence
  Description of Artificial Sequence: Synthetic oligonucleotide
gcgggcccatgaccctgcagc

SEQ ID NO: 53379 - DNA, 21 bp, Artificial Sequence
  Description of Artificial Sequence: Synthetic oligonucleotide
cgggcccatgaccctgcagcg

SEQ ID NO: 53380 - DNA, 21 bp, Artificial Sequence
  Description of Artificial Sequence: Synthetic oligonucleotide
gggcccatgaccctgcagcgc

SEQ ID NO: 53381 - DNA, 21 bp, Artificial Sequence
  Description of Artificial Sequence: Synthetic oligonucleotide
ggcccatgaccctgcagcgcc

SEQ ID NO: 53382 - DNA, 22 bp, Artificial Sequence
  Description of Artificial Sequence: Synthetic oligonucleotide
gcccatgaccctgcagcgccga

SEQ ID NO: 53383 - DNA, 23 bp, Artificial Sequence
  Description of Artificial Sequence: Synthetic oligonucleotide
cccatgaccctgcagcgccgagt

SEQ ID NO: 53384 - DNA, 23 bp, Artificial Sequence
  Description of Artificial Sequence: Synthetic oligonucleotide
ccatgaccctgcagcgccgagtc

SEQ ID NO: 53385 - DNA, 24 bp, Artificial Sequence
  Description of Artificial Sequence: Synthetic oligonucleotide
catgaccctgcagcgccgagtcca

SEQ ID NO: 53386 - DNA, 24 bp, Artificial Sequence
  Description of Artificial Sequence: Synthetic oligonucleotide
atgaccctgcagcgccgagtccag

SEQ ID NO: 53387 - DNA, 23 bp, Artificial Sequence
  Description of Artificial Sequence: Synthetic oligonucleotide
cctgcagcgccgagtccagccta

SEQ ID NO: 53388 - DNA, 23 bp, Artificial Sequence
  Description of Artificial Sequence: Synthetic oligonucleotide
ctgcagcgccgagtccagcctag

SEQ ID NO: 53389 - DNA, 23 bp, Artificial Sequence
  Description of Artificial Sequence: Synthetic oligonucleotide
tgcagcgccgagtccagcctagg

SEQ ID NO: 53390 - DNA, 22 bp, Artificial Sequence
  Description of Artificial Sequence: Synthetic oligonucleotide
gcagcgccgagtccagcctagg

SEQ ID NO: 53391 - DNA, 23 bp, Artificial Sequence
  Description of Artificial Sequence: Synthetic oligonucleotide
cagcgccgagtccagcctagggt

SEQ ID NO: 53392 - DNA, 26 bp, Artificial Sequence
  Description of Artificial Sequence: Synthetic oligonucleotide
agcgccgagtccagcctagggtgaat

SEQ ID NO: 53393 - DNA, 25 bp, Artificial Sequence
  Description of Artificial Sequence: Synthetic oligonucleotide
gcgccgagtccagcctagggtgaat

SEQ ID NO: 53394 - DNA, 27 bp, Artificial Sequence
  Description of Artificial Sequence: Synthetic oligonucleotide
cgccgagtccagcctagggtgaatgtt

SEQ ID NO: 53395 - DNA, 28 bp, Artificial Sequence
  Description of Artificial Sequence: Synthetic oligonucleotide
gccgagtccagcctagggtgaatgtttc

SEQ ID NO: 53396 - DNA, 28 bp, Artificial Sequence
  Description of Artificial Sequence: Synthetic oligonucleotide
ccgagtccagcctagggtgaatgtttcc

SEQ ID NO: 53397 - DNA, 28 bp, Artificial Sequence
  Description of Artificial Sequence: Synthetic oligonucleotide
cgagtccagcctagggtgaatgtttccc

SEQ ID NO: 53398 - DNA, 28 bp, Artificial Sequence
  Description of Artificial Sequence: Synthetic oligonucleotide
gagtccagcctagggtgaatgtttcccc

SEQ ID NO: 53399 - DNA, 28 bp, Artificial Sequence
  Description of Artificial Sequence: Synthetic oligonucleotide
agtccagcctagggtgaatgtttccccc

SEQ ID NO: 53400 - DNA, 27 bp, Artificial Sequence
  Description of Artificial Sequence: Synthetic oligonucleotide
gtccagcctagggtgaatgtttccccc

SEQ ID NO: 53401 - DNA, 28 bp, Artificial Sequence
  Description of Artificial Sequence: Synthetic oligonucleotide
tccagcctagggtgaatgtttccccctc

SEQ ID NO: 53402 - DNA, 27 bp, Artificial Sequence
  Description of Artificial Sequence: Synthetic oligonucleotide
ccagcctagggtgaatgtttccccctc

SEQ ID NO: 53403 - DNA, 27 bp, Artificial Sequence
  Description of Artificial Sequence: Synthetic oligonucleotide
cagcctagggtgaatgtttccccctcc

SEQ ID NO: 53404 - DNA, 29 bp, Artificial Sequence
  Description of Artificial Sequence: Synthetic oligonucleotide
agcctagggtgaatgtttccccctccaag

SEQ ID NO: 53405 - DNA, 28 bp, Artificial Sequence
  Description of Artificial Sequence: Synthetic oligonucleotide
gcctagggtgaatgtttccccctccaag

SEQ ID NO: 53406 - DNA, 30 bp, Artificial Sequence
  Description of Artificial Sequence: Synthetic oligonucleotide
cctagggtgaatgtttccccctccaagaag

SEQ ID NO: 53407 - DNA, 30 bp, Artificial Sequence
  Description of Artificial Sequence: Synthetic oligonucleotide
ctagggtgaatgtttccccctccaagaagg

SEQ ID NO: 53408 - DNA, 30 bp, Artificial Sequence
  Description of Artificial Sequence: Synthetic oligonucleotide
tagggtgaatgtttccccctccaagaaggg

SEQ ID NO: 53409 - DNA, 29 bp, Artificial Sequence
  Description of Artificial Sequence: Synthetic oligonucleotide
agggtgaatgtttccccctccaagaaggg

SEQ ID NO: 53410 - DNA, 28 bp, Artificial Sequence
  Description of Artificial Sequence: Synthetic oligonucleotide
gggtgaatgtttccccctccaagaaggg

SEQ ID NO: 53411 - DNA, 28 bp, Artificial Sequence
  Description of Artificial Sequence: Synthetic oligonucleotide
ggtgaatgtttccccctccaagaagggg

SEQ ID NO: 53412 - DNA, 28 bp, Artificial Sequence
  Description of Artificial Sequence: Synthetic oligonucleotide
gtgaatgtttccccctccaagaaggggc

SEQ ID NO: 53413 - DNA, 28 bp, Artificial Sequence
  Description of Artificial Sequence: Synthetic oligonucleotide
tgaatgtttccccctccaagaaggggcc

SEQ ID NO: 53414 - DNA, 27 bp, Artificial Sequence
  Description of Artificial Sequence: Synthetic oligonucleotide
gaatgtttccccctccaagaaggggcc

SEQ ID NO: 53415 - DNA, 27 bp, Artificial Sequence
  Description of Artificial Sequence: Synthetic oligonucleotide
aatgtttccccctccaagaaggggccc

SEQ ID NO: 53416 - DNA, 27 bp, Artificial Sequence
  Description of Artificial Sequence: Synthetic oligonucleotide
atgtttccccctccaagaaggggccct

SEQ ID NO: 53417 - DNA, 27 bp, Artificial Sequence
  Description of Artificial Sequence: Synthetic oligonucleotide
tgtttccccctccaagaaggggccctt

SEQ ID NO: 53418 - DNA, 26 bp, Artificial Sequence
  Description of Artificial Sequence: Synthetic oligonucleotide
gtttccccctccaagaaggggccctt

SEQ ID NO: 53419 - DNA, 26 bp, Artificial Sequence
  Description of Artificial Sequence: Synthetic oligonucleotide
tttccccctccaagaaggggcccttg

SEQ ID NO: 53420 - DNA, 25 bp, Artificial Sequence
  Description of Artificial Sequence: Synthetic oligonucleotide
ttccccctccaagaaggggcccttg

SEQ ID NO: 53421 - DNA, 24 bp, Artificial Sequence
  Description of Artificial Sequence: Synthetic oligonucleotide
tccccctccaagaaggggcccttg

SEQ ID NO: 53422 - DNA, 23 bp, Artificial Sequence
  Description of Artificial Sequence: Synthetic oligonucleotide
ccccctccaagaaggggcccttg

SEQ ID NO: 53423 - DNA, 24 bp, Artificial Sequence
  Description of Artificial Sequence: Synthetic oligonucleotide
cccctccaagaaggggcccttgca

SEQ ID NO: 53424 - DNA, 24 bp, Artificial Sequence
  Description of Artificial Sequence: Synthetic oligonucleotide
ccctccaagaaggggcccttgcag

SEQ ID NO: 53425 - DNA, 25 bp, Artificial Sequence
  Description of Artificial Sequence: Synthetic oligonucleotide
cctccaagaaggggcccttgcagca

SEQ ID NO: 53426 - DNA, 25 bp, Artificial Sequence
  Description of Artificial Sequence: Synthetic oligonucleotide
ctccaagaaggggcccttgcagcac

SEQ ID NO: 53427 - DNA, 26 bp, Artificial Sequence
  Description of Artificial Sequence: Synthetic oligonucleotide
tccaagaaggggcccttgcagcacca

SEQ ID NO: 53428 - DNA, 25 bp, Artificial Sequence
  Description of Artificial Sequence: Synthetic oligonucleotide
ccaagaaggggcccttgcagcacca

SEQ ID NO: 53429 - DNA, 27 bp, Artificial Sequence
  Description of Artificial Sequence: Synthetic oligonucleotide
caagaaggggcccttgcagcaccacaa

SEQ ID NO: 53430 - DNA, 27 bp, Artificial Sequence
  Description of Artificial Sequence: Synthetic oligonucleotide
aagaaggggcccttgcagcaccacaac

SEQ ID NO: 53431 - DNA, 26 bp, Artificial Sequence
  Description of Artificial Sequence: Synthetic oligonucleotide
agaaggggcccttgcagcaccacaac

SEQ ID NO: 53432 - DNA, 25 bp, Artificial Sequence
  Description of Artificial Sequence: Synthetic oligonucleotide
gaaggggcccttgcagcaccacaac

SEQ ID NO: 53433 - DNA, 26 bp, Artificial Sequence
  Description of Artificial Sequence: Synthetic oligonucleotide
aaggggcccttgcagcaccacaacct

SEQ ID NO: 53434 - DNA, 25 bp, Artificial Sequence
  Description of Artificial Sequence: Synthetic oligonucleotide
aggggcccttgcagcaccacaacct

SEQ ID NO: 53435 - DNA, 24 bp, Artificial Sequence
  Description of Artificial Sequence: Synthetic oligonucleotide
ggggcccttgcagcaccacaacct

SEQ ID NO: 53436 - DNA, 24 bp, Artificial Sequence
  Description of Artificial Sequence: Synthetic oligonucleotide
gggcccttgcagcaccacaacctg

SEQ ID NO: 53437 - DNA, 26 bp, Artificial Sequence
  Description of Artificial Sequence: Synthetic oligonucleotide
ggcccttgcagcaccacaacctgctt

SEQ ID NO: 53438 - DNA, 27 bp, Artificial Sequence
  Description of Artificial Sequence: Synthetic oligonucleotide
gcccttgcagcaccacaacctgcttgt

SEQ ID NO: 53439 - DNA, 27 bp, Artificial Sequence
  Description of Artificial Sequence: Synthetic oligonucleotide
cccttgcagcaccacaacctgcttgtc

SEQ ID NO: 53440 - DNA, 28 bp, Artificial Sequence
  Description of Artificial Sequence: Synthetic oligonucleotide
ccttgcagcaccacaacctgcttgtctg

SEQ ID NO: 53441 - DNA, 28 bp, Artificial Sequence
  Description of Artificial Sequence: Synthetic oligonucleotide
cttgcagcaccacaacctgcttgtctgc

SEQ ID NO: 53442 - DNA, 28 bp, Artificial Sequence
  Description of Artificial Sequence: Synthetic oligonucleotide
ttgcagcaccacaacctgcttgtctgcc

SEQ ID NO: 53443 - DNA, 27 bp, Artificial Sequence
  Description of Artificial Sequence: Synthetic oligonucleotide
cacaacctgcttgtctgccacgtgacg

SEQ ID NO: 53444 - DNA, 27 bp, Artificial Sequence
  Description of Artificial Sequence: Synthetic oligonucleotide
acaacctgcttgtctgccacgtgacgg

SEQ ID NO: 53445 - DNA, 27 bp, Artificial Sequence
  Description of Artificial Sequence: Synthetic oligonucleotide
caacctgcttgtctgccacgtgacgga

SEQ ID NO: 53446 - DNA, 30 bp, Artificial Sequence
  Description of Artificial Sequence: Synthetic oligonucleotide
aacctgcttgtctgccacgtgacggatttc

SEQ ID NO: 53447 - DNA, 29 bp, Artificial Sequence
  Description of Artificial Sequence: Synthetic oligonucleotide
acctgcttgtctgccacgtgacggatttc

SEQ ID NO: 53448 - DNA, 28 bp, Artificial Sequence
  Description of Artificial Sequence: Synthetic oligonucleotide
cctgcttgtctgccacgtgacggatttc

SEQ ID NO: 53449 - DNA, 30 bp, Artificial Sequence
  Description of Artificial Sequence: Synthetic oligonucleotide
ctgcttgtctgccacgtgacggatttctac

SEQ ID NO: 53450 - DNA, 30 bp, Artificial Sequence
  Description of Artificial Sequence: Synthetic oligonucleotide
tgcttgtctgccacgtgacggatttctacc

SEQ ID NO: 53451 - DNA, 29 bp, Artificial Sequence
  Description of Artificial Sequence: Synthetic oligonucleotide
gcttgtctgccacgtgacggatttctacc

SEQ ID NO: 53452 - DNA, 29 bp, Artificial Sequence
  Description of Artificial Sequence: Synthetic oligonucleotide
cttgtctgccacgtgacggatttctaccc

SEQ ID NO: 53453 - DNA, 30 bp, Artificial Sequence
  Description of Artificial Sequence: Synthetic oligonucleotide
ttgtctgccacgtgacggatttctacccag

SEQ ID NO: 53454 - DNA, 29 bp, Artificial Sequence
  Description of Artificial Sequence: Synthetic oligonucleotide
tgtctgccacgtgacggatttctacccag

SEQ ID NO: 53455 - DNA, 28 bp, Artificial Sequence
  Description of Artificial Sequence: Synthetic oligonucleotide
gtctgccacgtgacggatttctacccag

SEQ ID NO: 53456 - DNA, 28 bp, Artificial Sequence
  Description of Artificial Sequence: Synthetic oligonucleotide
tctgccacgtgacggatttctacccagg

SEQ ID NO: 53457 - DNA, 27 bp, Artificial Sequence
  Description of Artificial Sequence: Synthetic oligonucleotide
ctgccacgtgacggatttctacccagg

SEQ ID NO: 53458 - DNA, 27 bp, Artificial Sequence
  Description of Artificial Sequence: Synthetic oligonucleotide
tgccacgtgacggatttctacccaggc

SEQ ID NO: 53459 - DNA, 27 bp, Artificial Sequence
  Description of Artificial Sequence: Synthetic oligonucleotide
gccacgtgacggatttctacccaggca

SEQ ID NO: 53460 - DNA, 27 bp, Artificial Sequence
  Description of Artificial Sequence: Synthetic oligonucleotide
ccacgtgacggatttctacccaggcag

SEQ ID NO: 53461 - DNA, 27 bp, Artificial Sequence
  Description of Artificial Sequence: Synthetic oligonucleotide
cacgtgacggatttctacccaggcagc

SEQ ID NO: 53462 - DNA, 30 bp, Artificial Sequence
  Description of Artificial Sequence: Synthetic oligonucleotide
acgtgacggatttctacccaggcagcattc

SEQ ID NO: 53463 - DNA, 29 bp, Artificial Sequence
  Description of Artificial Sequence: Synthetic oligonucleotide
cgtgacggatttctacccaggcagcattc

SEQ ID NO: 53464 - DNA, 31 bp, Artificial Sequence
  Description of Artificial Sequence: Synthetic oligonucleotide
gtgacggatttctacccaggcagcattcaag

SEQ ID NO: 53465 - DNA, 32 bp, Artificial Sequence
  Description of Artificial Sequence: Synthetic oligonucleotide
tgacggatttctacccaggcagcattcaagtc

SEQ ID NO: 53466 - DNA, 31 bp, Artificial Sequence
  Description of Artificial Sequence: Synthetic oligonucleotide
gacggatttctacccaggcagcattcaagtc

SEQ ID NO: 53467 - DNA, 31 bp, Artificial Sequence
  Description of Artificial Sequence: Synthetic oligonucleotide
acggatttctacccaggcagcattcaagtcc

SEQ ID NO: 53468 - DNA, 30 bp, Artificial Sequence
  Description of Artificial Sequence: Synthetic oligonucleotide
cggatttctacccaggcagcattcaagtcc

SEQ ID NO: 53469 - DNA, 30 bp, Artificial Sequence
  Description of Artificial Sequence: Synthetic oligonucleotide
ggatttctacccaggcagcattcaagtccg

SEQ ID NO: 53470 - DNA, 27 bp, Artificial Sequence
  Description of Artificial Sequence: Synthetic oligonucleotide
ctggaaatgaccccccagcagggagat

SEQ ID NO: 53471 - DNA, 27 bp, Artificial Sequence
  Description of Artificial Sequence: Synthetic oligonucleotide
tggaaatgaccccccagcagggagatg

SEQ ID NO: 53472 - DNA, 27 bp, Artificial Sequence
  Description of Artificial Sequence: Synthetic oligonucleotide
ggaaatgaccccccagcagggagatgt

SEQ ID NO: 53473 - DNA, 27 bp, Artificial Sequence
  Description of Artificial Sequence: Synthetic oligonucleotide
gaaatgaccccccagcagggagatgtc

SEQ ID NO: 53474 - DNA, 29 bp, Artificial Sequence
  Description of Artificial Sequence: Synthetic oligonucleotide
aaatgaccccccagcagggagatgtctac

SEQ ID NO: 53475 - DNA, 28 bp, Artificial Sequence
  Description of Artificial Sequence: Synthetic oligonucleotide
aatgaccccccagcagggagatgtctac

SEQ ID NO: 53476 - DNA, 27 bp, Artificial Sequence
  Description of Artificial Sequence: Synthetic oligonucleotide
atgaccccccagcagggagatgtctac

SEQ ID NO: 53477 - DNA, 27 bp, Artificial Sequence
  Description of Artificial Sequence: Synthetic oligonucleotide
tgaccccccagcagggagatgtctaca

SEQ ID NO: 53478 - DNA, 26 bp, Artificial Sequence
  Description of Artificial Sequence: Synthetic oligonucleotide
gaccccccagcagggagatgtctaca

SEQ ID NO: 53479 - DNA, 26 bp, Artificial Sequence
  Description of Artificial Sequence: Synthetic oligonucleotide
accccccagcagggagatgtctacac

SEQ ID NO: 53480 - DNA, 25 bp, Artificial Sequence
  Description of Artificial Sequence: Synthetic oligonucleotide
ccccccagcagggagatgtctacac

SEQ ID NO: 53481 - DNA, 26 bp, Artificial Sequence
  Description of Artificial Sequence: Synthetic oligonucleotide
cccccagcagggagatgtctacacct

SEQ ID NO: 53482 - DNA, 26 bp, Artificial Sequence
  Description of Artificial Sequence: Synthetic oligonucleotide
ccccagcagggagatgtctacacctg

SEQ ID NO: 53483 - DNA, 26 bp, Artificial Sequence
  Description of Artificial Sequence: Synthetic oligonucleotide
cccagcagggagatgtctacacctgc

SEQ ID NO: 53484 - DNA, 27 bp, Artificial Sequence
  Description of Artificial Sequence: Synthetic oligonucleotide
ccagcagggagatgtctacacctgcca

SEQ ID NO: 53485 - DNA, 28 bp, Artificial Sequence
  Description of Artificial Sequence: Synthetic oligonucleotide
cagcagggagatgtctacacctgccaag

SEQ ID NO: 53486 - DNA, 29 bp, Artificial Sequence
  Description of Artificial Sequence: Synthetic oligonucleotide
agcagggagatgtctacacctgccaagtg

SEQ ID NO: 53487 - DNA, 28 bp, Artificial Sequence
  Description of Artificial Sequence: Synthetic oligonucleotide
gcagggagatgtctacacctgccaagtg

SEQ ID NO: 53488 - DNA, 28 bp, Artificial Sequence
  Description of Artificial Sequence: Synthetic oligonucleotide
cagggagatgtctacacctgccaagtgg

SEQ ID NO: 53489 - DNA, 29 bp, Artificial Sequence
  Description of Artificial Sequence: Synthetic oligonucleotide
agggagatgtctacacctgccaagtggag

SEQ ID NO: 53490 - DNA, 28 bp, Artificial Sequence
  Description of Artificial Sequence: Synthetic oligonucleotide
gggagatgtctacacctgccaagtggag

SEQ ID NO: 53491 - DNA, 28 bp, Artificial Sequence
  Description of Artificial Sequence: Synthetic oligonucleotide
ggagatgtctacacctgccaagtggagc

SEQ ID NO: 53492 - DNA, 29 bp, Artificial Sequence
  Description of Artificial Sequence: Synthetic oligonucleotide
gagatgtctacacctgccaagtggagcac

SEQ ID NO: 53493 - DNA, 30 bp, Artificial Sequence
  Description of Artificial Sequence: Synthetic oligonucleotide
agatgtctacacctgccaagtggagcacac

SEQ ID NO: 53494 - DNA, 29 bp, Artificial Sequence
  Description of Artificial Sequence: Synthetic oligonucleotide
gatgtctacacctgccaagtggagcacac

SEQ ID NO: 53495 - DNA, 29 bp, Artificial Sequence
  Description of Artificial Sequence: Synthetic oligonucleotide
atgtctacacctgccaagtggagcacacc

SEQ ID NO: 53496 - DNA, 28 bp, Artificial Sequence
  Description of Artificial Sequence: Synthetic oligonucleotide
tgtctacacctgccaagtggagcacacc

SEQ ID NO: 53497 - DNA, 27 bp, Artificial Sequence
  Description of Artificial Sequence: Synthetic oligonucleotide
gtctacacctgccaagtggagcacacc

SEQ ID NO: 53498 - DNA, 28 bp, Artificial Sequence
  Description of Artificial Sequence: Synthetic oligonucleotide
tctacacctgccaagtggagcacaccag

SEQ ID NO: 53499 - DNA, 27 bp, Artificial Sequence
  Description of Artificial Sequence: Synthetic oligonucleotide
ctacacctgccaagtggagcacaccag

SEQ ID NO: 53500 - DNA, 27 bp, Artificial Sequence
  Description of Artificial Sequence: Synthetic oligonucleotide
tacacctgccaagtggagcacaccagc

SEQ ID NO: 53501 - DNA, 26 bp, Artificial Sequence
  Description of Artificial Sequence: Synthetic oligonucleotide
acacctgccaagtggagcacaccagc

SEQ ID NO: 53502 - DNA, 25 bp, Artificial Sequence
  Description of Artificial Sequence: Synthetic oligonucleotide
cacctgccaagtggagcacaccagc

SEQ ID NO: 53503 - DNA, 26 bp, Artificial Sequence
  Description of Artificial Sequence: Synthetic oligonucleotide
acctgccaagtggagcacaccagcct

SEQ ID NO: 53504 - DNA, 25 bp, Artificial Sequence
  Description of Artificial Sequence: Synthetic oligonucleotide
cctgccaagtggagcacaccagcct

SEQ ID NO: 53505 - DNA, 27 bp, Artificial Sequence
  Description of Artificial Sequence: Synthetic oligonucleotide
tgccaagtggagcacaccagcctggat

SEQ ID NO: 53506 - DNA, 27 bp, Artificial Sequence
  Description of Artificial Sequence: Synthetic oligonucleotide
gccaagtggagcacaccagcctggata

SEQ ID NO: 53507 - DNA, 27 bp, Artificial Sequence
  Description of Artificial Sequence: Synthetic oligonucleotide
ccaagtggagcacaccagcctggatag

SEQ ID NO: 53508 - DNA, 28 bp, Artificial Sequence
  Description of Artificial Sequence: Synthetic oligonucleotide
caagtggagcacaccagcctggatagtc

SEQ ID NO: 53509 - DNA, 28 bp, Artificial Sequence
  Description of Artificial Sequence: Synthetic oligonucleotide
aagtggagcacaccagcctggatagtcc

SEQ ID NO: 53510 - DNA, 27 bp, Artificial Sequence
  Description of Artificial Sequence: Synthetic oligonucleotide
agtggagcacaccagcctggatagtcc

SEQ ID NO: 53511 - DNA, 27 bp, Artificial Sequence
  Description of Artificial Sequence: Synthetic oligonucleotide
gtggagcacaccagcctggatagtcct

SEQ ID NO: 53512 - DNA, 27 bp, Artificial Sequence
  Description of Artificial Sequence: Synthetic oligonucleotide
tggagcacaccagcctggatagtcctg

SEQ ID NO: 53513 - DNA, 27 bp, Artificial Sequence
  Description of Artificial Sequence: Synthetic oligonucleotide
ggagcacaccagcctggatagtcctgt

SEQ ID NO: 53514 - DNA, 27 bp, Artificial Sequence
  Description of Artificial Sequence: Synthetic oligonucleotide
gagcacaccagcctggatagtcctgtc

SEQ ID NO: 53515 - DNA, 28 bp, Artificial Sequence
  Description of Artificial Sequence: Synthetic oligonucleotide
agcacaccagcctggatagtcctgtcac

SEQ ID NO: 53516 - DNA, 27 bp, Artificial Sequence
  Description of Artificial Sequence: Synthetic oligonucleotide
gcacaccagcctggatagtcctgtcac

SEQ ID NO: 53517 - DNA, 27 bp, Artificial Sequence
  Description of Artificial Sequence: Synthetic oligonucleotide
cacaccagcctggatagtcctgtcacc

SEQ ID NO: 53518 - DNA, 27 bp, Artificial Sequence
  Description of Artificial Sequence: Synthetic oligonucleotide
acaccagcctggatagtcctgtcaccg

SEQ ID NO: 53519 - DNA, 27 bp, Artificial Sequence
  Description of Artificial Sequence: Synthetic oligonucleotide
caccagcctggatagtcctgtcaccgt

SEQ ID NO: 53520 - DNA, 27 bp, Artificial Sequence
  Description of Artificial Sequence: Synthetic oligonucleotide
accagcctggatagtcctgtcaccgtg

SEQ ID NO: 53521 - DNA, 26 bp, Artificial Sequence
  Description of Artificial Sequence: Synthetic oligonucleotide
ccagcctggatagtcctgtcaccgtg

SEQ ID NO: 53522 - DNA, 27 bp, Artificial Sequence
  Description of Artificial Sequence: Synthetic oligonucleotide
cagcctggatagtcctgtcaccgtgga

SEQ ID NO: 53523 - DNA, 27 bp, Artificial Sequence
  Description of Artificial Sequence: Synthetic oligonucleotide
agcctggatagtcctgtcaccgtggag

SEQ ID NO: 53524 - DNA, 27 bp, Artificial Sequence
  Description of Artificial Sequence: Synthetic oligonucleotide
gcctggatagtcctgtcaccgtggagt

SEQ ID NO: 53525 - DNA, 27 bp, Artificial Sequence
  Description of Artificial Sequence: Synthetic oligonucleotide
cctggatagtcctgtcaccgtggagtg

SEQ ID NO: 53526 - DNA, 27 bp, Artificial Sequence
  Description of Artificial Sequence: Synthetic oligonucleotide
ctggatagtcctgtcaccgtggagtgg

SEQ ID NO: 53527 - DNA, 29 bp, Artificial Sequence
  Description of Artificial Sequence: Synthetic oligonucleotide
tggatagtcctgtcaccgtggagtggaag

SEQ ID NO: 53528 - DNA, 28 bp, Artificial Sequence
  Description of Artificial Sequence: Synthetic oligonucleotide
ggatagtcctgtcaccgtggagtggaag

SEQ ID NO: 53529 - DNA, 28 bp, Artificial Sequence
  Description of Artificial Sequence: Synthetic oligonucleotide
gatagtcctgtcaccgtggagtggaagg

SEQ ID NO: 53530 - DNA, 28 bp, Artificial Sequence
  Description of Artificial Sequence: Synthetic oligonucleotide
atagtcctgtcaccgtggagtggaaggc

SEQ ID NO: 53531 - DNA, 27 bp, Artificial Sequence
  Description of Artificial Sequence: Synthetic oligonucleotide
tagtcctgtcaccgtggagtggaaggc

SEQ ID NO: 53532 - DNA, 28 bp, Artificial Sequence
  Description of Artificial Sequence: Synthetic oligonucleotide
agtggaaggcacagtctgattctgcccg

SEQ ID NO: 53533 - DNA, 27 bp, Artificial Sequence
  Description of Artificial Sequence: Synthetic oligonucleotide
gtggaaggcacagtctgattctgcccg

SEQ ID NO: 53534 - DNA, 27 bp, Artificial Sequence
  Description of Artificial Sequence: Synthetic oligonucleotide
tggaaggcacagtctgattctgcccgg

SEQ ID NO: 53535 - DNA, 27 bp, Artificial Sequence
  Description of Artificial Sequence: Synthetic oligonucleotide
ggaaggcacagtctgattctgcccgga

SEQ ID NO: 53536 - DNA, 27 bp, Artificial Sequence
  Description of Artificial Sequence: Synthetic oligonucleotide
gaaggcacagtctgattctgcccggag

SEQ ID NO: 53537 - DNA, 30 bp, Artificial Sequence
  Description of Artificial Sequence: Synthetic oligonucleotide
aaggcacagtctgattctgcccggagtaag

SEQ ID NO: 53538 - DNA, 29 bp, Artificial Sequence
  Description of Artificial Sequence: Synthetic oligonucleotide
aggcacagtctgattctgcccggagtaag

SEQ ID NO: 53539 - DNA, 28 bp, Artificial Sequence
  Description of Artificial Sequence: Synthetic oligonucleotide
ggcacagtctgattctgcccggagtaag

SEQ ID NO: 53540 - DNA, 29 bp, Artificial Sequence
  Description of Artificial Sequence: Synthetic oligonucleotide
gcacagtctgattctgcccggagtaagac

SEQ ID NO: 53541 - DNA, 32 bp, Artificial Sequence
  Description of Artificial Sequence: Synthetic oligonucleotide
cacagtctgattctgcccggagtaagacattg

SEQ ID NO: 53542 - DNA, 33 bp, Artificial Sequence
  Description of Artificial Sequence: Synthetic oligonucleotide
acagtctgattctgcccggagtaagacattgac

SEQ ID NO: 53543 - DNA, 32 bp, Artificial Sequence
  Description of Artificial Sequence: Synthetic oligonucleotide
cagtctgattctgcccggagtaagacattgac

SEQ ID NO: 53544 - DNA, 32 bp, Artificial Sequence
  Description of Artificial Sequence: Synthetic oligonucleotide
agtctgattctgcccggagtaagacattgacg

SEQ ID NO: 53545 - DNA, 31 bp, Artificial Sequence
  Description of Artificial Sequence: Synthetic oligonucleotide
gtctgattctgcccggagtaagacattgacg

SEQ ID NO: 53546 - DNA, 31 bp, Artificial Sequence
  Description of Artificial Sequence: Synthetic oligonucleotide
tctgattctgcccggagtaagacattgacgg

SEQ ID NO: 53547 - DNA, 30 bp, Artificial Sequence
  Description of Artificial Sequence: Synthetic oligonucleotide
ctgattctgcccggagtaagacattgacgg

SEQ ID NO: 53548 - DNA, 30 bp, Artificial Sequence
  Description of Artificial Sequence: Synthetic oligonucleotide
tgattctgcccggagtaagacattgacggg

SEQ ID NO: 53549 - DNA, 29 bp, Artificial Sequence
  Description of Artificial Sequence: Synthetic oligonucleotide
gattctgcccggagtaagacattgacggg

SEQ ID NO: 53550 - DNA, 30 bp, Artificial Sequence
  Description of Artificial Sequence: Synthetic oligonucleotide
attctgcccggagtaagacattgacgggag

SEQ ID NO: 53551 - DNA, 29 bp, Artificial Sequence
  Description of Artificial Sequence: Synthetic oligonucleotide
ttctgcccggagtaagacattgacgggag

SEQ ID NO: 53552 - DNA, 28 bp, Artificial Sequence
  Description of Artificial Sequence: Synthetic oligonucleotide
tctgcccggagtaagacattgacgggag

SEQ ID NO: 53553 - DNA, 27 bp, Artificial Sequence
  Description of Artificial Sequence: Synthetic oligonucleotide
ctgcccggagtaagacattgacgggag

SEQ ID NO: 53554 - DNA, 27 bp, Artificial Sequence
  Description of Artificial Sequence: Synthetic oligonucleotide
tgcccggagtaagacattgacgggagc

SEQ ID NO: 53555 - DNA, 27 bp, Artificial Sequence
  Description of Artificial Sequence: Synthetic oligonucleotide
gcccggagtaagacattgacgggagct

SEQ ID NO: 53556 - DNA, 27 bp, Artificial Sequence
  Description of Artificial Sequence: Synthetic oligonucleotide
cccggagtaagacattgacgggagctg

SEQ ID NO: 53557 - DNA, 27 bp, Artificial Sequence
  Description of Artificial Sequence: Synthetic oligonucleotide
ccggagtaagacattgacgggagctgg

SEQ ID NO: 53558 - DNA, 27 bp, Artificial Sequence
  Description of Artificial Sequence: Synthetic oligonucleotide
cggagtaagacattgacgggagctggg

SEQ ID NO: 53559 - DNA, 27 bp, Artificial Sequence
  Description of Artificial Sequence: Synthetic oligonucleotide
ggagtaagacattgacgggagctgggg

SEQ ID NO: 53560 - DNA, 22 bp, Artificial Sequence
  Description of Artificial Sequence: Synthetic oligonucleotide
tgacggagctggggcggcctga

SEQ ID NO: 53561 - DNA, 21 bp, Artificial Sequence
  Description of Artificial Sequence: Synthetic oligonucleotide
gacggagctggggcggcctga

SEQ ID NO: 53562 - DNA, 21 bp, Artificial Sequence
  Description of Artificial Sequence: Synthetic oligonucleotide
acggagctggggcggcctgac

SEQ ID NO: 53563 - DNA, 20 bp, Artificial Sequence
  Description of Artificial Sequence: Synthetic oligonucleotide
cggagctggggcggcctgac

SEQ ID NO: 53564 - DNA, 21 bp, Artificial Sequence
  Description of Artificial Sequence: Synthetic oligonucleotide
ggagctggggcggcctgacga

SEQ ID NO: 53565 - DNA, 21 bp, Artificial Sequence
  Description of Artificial Sequence: Synthetic oligonucleotide
gagctggggcggcctgacgag

SEQ ID NO: 53566 - DNA, 22 bp, Artificial Sequence
  Description of Artificial Sequence: Synthetic oligonucleotide
agctggggcggcctgacgagga

SEQ ID NO: 53567 - DNA, 21 bp, Artificial Sequence
  Description of Artificial Sequence: Synthetic oligonucleotide
gctggggcggcctgacgagga

SEQ ID NO: 53568 - DNA, 23 bp, Artificial Sequence
  Description of Artificial Sequence: Synthetic oligonucleotide
ctggggcggcctgacgaggagta

SEQ ID NO: 53569 - DNA, 24 bp, Artificial Sequence
  Description of Artificial Sequence: Synthetic oligonucleotide
tggggcggcctgacgaggagtact

SEQ ID NO: 53570 - DNA, 23 bp, Artificial Sequence
  Description of Artificial Sequence: Synthetic oligonucleotide
ggggcggcctgacgaggagtact

SEQ ID NO: 53571 - DNA, 23 bp, Artificial Sequence
  Description of Artificial Sequence: Synthetic oligonucleotide
gggcggcctgacgaggagtactg

SEQ ID NO: 53572 - DNA, 25 bp, Artificial Sequence
  Description of Artificial Sequence: Synthetic oligonucleotide
ggcggcctgacgaggagtactggaa

SEQ ID NO: 53573 - DNA, 26 bp, Artificial Sequence
  Description of Artificial Sequence: Synthetic oligonucleotide
gcggcctgacgaggagtactggaaca

SEQ ID NO: 53574 - DNA, 26 bp, Artificial Sequence
  Description of Artificial Sequence: Synthetic oligonucleotide
cggcctgacgaggagtactggaacag

SEQ ID NO: 53575 - DNA, 26 bp, Artificial Sequence
  Description of Artificial Sequence: Synthetic oligonucleotide
ggcctgacgaggagtactggaacagc

SEQ ID NO: 53576 - DNA, 27 bp, Artificial Sequence
  Description of Artificial Sequence: Synthetic oligonucleotide
gcctgacgaggagtactggaacagcca

SEQ ID NO: 53577 - DNA, 27 bp, Artificial Sequence
  Description of Artificial Sequence: Synthetic oligonucleotide
cctgacgaggagtactggaacagccag

SEQ ID NO: 53578 - DNA, 29 bp, Artificial Sequence
  Description of Artificial Sequence: Synthetic oligonucleotide
ctgacgaggagtactggaacagccagaag

SEQ ID NO: 53579 - DNA, 29 bp, Artificial Sequence
  Description of Artificial Sequence: Synthetic oligonucleotide
tgacgaggagtactggaacagccagaagg

SEQ ID NO: 53580 - DNA, 28 bp, Artificial Sequence
  Description of Artificial Sequence: Synthetic oligonucleotide
gacgaggagtactggaacagccagaagg

SEQ ID NO: 53581 - DNA, 29 bp, Artificial Sequence
  Description of Artificial Sequence: Synthetic oligonucleotide
acgaggagtactggaacagccagaaggac

SEQ ID NO: 53582 - DNA, 28 bp, Artificial Sequence
  Description of Artificial Sequence: Synthetic oligonucleotide
cgaggagtactggaacagccagaaggac

SEQ ID NO: 53583 - DNA, 22 bp, Artificial Sequence
  Description of Artificial Sequence: Synthetic oligonucleotide
cccatgaccctgcagcgccgag

SEQ ID NO: 53584 - DNA, 26 bp, Artificial Sequence
  Description of Artificial Sequence: Synthetic oligonucleotide
acatcctggaggaggagcgggcagtt

SEQ ID NO: 53585 - DNA, 25 bp, Artificial Sequence
  Description of Artificial Sequence: Synthetic oligonucleotide
catcctggaggaggagcgggcagtt

SEQ ID NO: 53586 - DNA, 25 bp, Artificial Sequence
  Description of Artificial Sequence: Synthetic oligonucleotide
atcctggaggaggagcgggcagttc

SEQ ID NO: 53587 - DNA, 24 bp, Artificial Sequence
  Description of Artificial Sequence: Synthetic oligonucleotide
tcctggaggaggagcgggcagttc

SEQ ID NO: 53588 - DNA, 23 bp, Artificial Sequence
  Description of Artificial Sequence: Synthetic oligonucleotide
cctggaggaggagcgggcagttc

SEQ ID NO: 53589 - DNA, 23 bp, Artificial Sequence
  Description of Artificial Sequence: Synthetic oligonucleotide
ctggaggaggagcgggcagttcc

SEQ ID NO: 53590 - DNA, 23 bp, Artificial Sequence
  Description of Artificial Sequence: Synthetic oligonucleotide
tggaggaggagcgggcagttccg

SEQ ID NO: 53591 - DNA, 22 bp, Artificial Sequence
  Description of Artificial Sequence: Synthetic oligonucleotide
ggaggaggagcgggcagttccg

SEQ ID NO: 53592 - DNA, 23 bp, Artificial Sequence
  Description of Artificial Sequence: Synthetic oligonucleotide
gaggaggagcgggcagttccgga

SEQ ID NO: 53593 - DNA, 24 bp, Artificial Sequence
  Description of Artificial Sequence: Synthetic oligonucleotide
aggaggagcgggcagttccggaca

SEQ ID NO: 53594 - DNA, 23 bp, Artificial Sequence
  Description of Artificial Sequence: Synthetic oligonucleotide
ggaggagcgggcagttccggaca

SEQ ID NO: 53595 - DNA, 23 bp, Artificial Sequence
  Description of Artificial Sequence: Synthetic oligonucleotide
gaggagcgggcagttccggacag

SEQ ID NO: 53596 - DNA, 25 bp, Artificial Sequence
  Description of Artificial Sequence: Synthetic oligonucleotide
aggagcgggcagttccggacaggat

SEQ ID NO: 53597 - DNA, 24 bp, Artificial Sequence
  Description of Artificial Sequence: Synthetic oligonucleotide
ggagcgggcagttccggacaggat

SEQ ID NO: 53598 - DNA, 25 bp, Artificial Sequence
  Description of Artificial Sequence: Synthetic oligonucleotide
gagcgggcagttccggacaggatgt

SEQ ID NO: 53599 - DNA, 25 bp, Artificial Sequence
  Description of Artificial Sequence: Synthetic oligonucleotide
agcgggcagttccggacaggatgtg

SEQ ID NO: 53600 - DNA, 24 bp, Artificial Sequence
  Description of Artificial Sequence: Synthetic oligonucleotide
gcgggcagttccggacaggatgtg

SEQ ID NO: 53601 - DNA, 25 bp, Artificial Sequence
  Description of Artificial Sequence: Synthetic oligonucleotide
cgggcagttccggacaggatgtgca

SEQ ID NO: 53602 - DNA, 26 bp, Artificial Sequence
  Description of Artificial Sequence: Synthetic oligonucleotide
gggcagttccggacaggatgtgcaga

SEQ ID NO: 53603 - DNA, 27 bp, Artificial Sequence
  Description of Artificial Sequence: Synthetic oligonucleotide
ggcagttccggacaggatgtgcagaca

SEQ ID NO: 53604 - DNA, 27 bp, Artificial Sequence
  Description of Artificial Sequence: Synthetic oligonucleotide
gcagttccggacaggatgtgcagacac

SEQ ID NO: 53605 - DNA, 29 bp, Artificial Sequence
  Description of Artificial Sequence: Synthetic oligonucleotide
cagttccggacaggatgtgcagacacaac

SEQ ID NO: 53606 - DNA, 31 bp, Artificial Sequence
  Description of Artificial Sequence: Synthetic oligonucleotide
agttccggacaggatgtgcagacacaactac

SEQ ID NO: 53607 - DNA, 30 bp, Artificial Sequence
  Description of Artificial Sequence: Synthetic oligonucleotide
gttccggacaggatgtgcagacacaactac

SEQ ID NO: 53608 - DNA, 30 bp, Artificial Sequence
  Description of Artificial Sequence: Synthetic oligonucleotide
ttccggacaggatgtgcagacacaactacg

SEQ ID NO: 53609 - DNA, 29 bp, Artificial Sequence
  Description of Artificial Sequence: Synthetic oligonucleotide
tccggacaggatgtgcagacacaactacg

SEQ ID NO: 53610 - DNA, 32 bp, Artificial Sequence
  Description of Artificial Sequence: Synthetic oligonucleotide
cttcctggagagatacatctacaaccgggaag

SEQ ID NO: 53611 - DNA, 33 bp, Artificial Sequence
  Description of Artificial Sequence: Synthetic oligonucleotide
ttcctggagagatacatctacaaccgggaagag

SEQ ID NO: 53612 - DNA, 32 bp, Artificial Sequence
  Description of Artificial Sequence: Synthetic oligonucleotide
tcctggagagatacatctacaaccgggaagag

SEQ ID NO: 53613 - DNA, 31 bp, Artificial Sequence
  Description of Artificial Sequence: Synthetic oligonucleotide
cctggagagatacatctacaaccgggaagag

SEQ ID NO: 53614 - DNA, 33 bp, Artificial Sequence
  Description of Artificial Sequence: Synthetic oligonucleotide
ctggagagatacatctacaaccgggaagagttc

SEQ ID NO: 53615 - DNA, 33 bp, Artificial Sequence
  Description of Artificial Sequence: Synthetic oligonucleotide
tggagagatacatctacaaccgggaagagttcg

SEQ ID NO: 53616 - DNA, 32 bp, Artificial Sequence
  Description of Artificial Sequence: Synthetic oligonucleotide
ggagagatacatctacaaccgggaagagttcg

SEQ ID NO: 53617 - DNA, 33 bp, Artificial Sequence
  Description of Artificial Sequence: Synthetic oligonucleotide
gagagatacatctacaaccgggaagagttcgtg

SEQ ID NO: 53618 - DNA, 33 bp, Artificial Sequence
  Description of Artificial Sequence: Synthetic oligonucleotide
agagatacatctacaaccgggaagagttcgtgc

SEQ ID NO: 53619 - DNA, 32 bp, Artificial Sequence
  Description of Artificial Sequence: Synthetic oligonucleotide
gagatacatctacaaccgggaagagttcgtgc

SEQ ID NO: 53620 - DNA, 32 bp, Artificial Sequence
  Description of Artificial Sequence: Synthetic oligonucleotide
agatacatctacaaccgggaagagttcgtgcg

SEQ ID NO: 53621 - DNA, 31 bp, Artificial Sequence
  Description of Artificial Sequence: Synthetic oligonucleotide
gatacatctacaaccgggaagagttcgtgcg

SEQ ID NO: 53622 - DNA, 31 bp, Artificial Sequence
  Description of Artificial Sequence: Synthetic oligonucleotide
atacatctacaaccgggaagagttcgtgcgc

SEQ ID NO: 53623 - DNA, 30 bp, Artificial Sequence
  Description of Artificial Sequence: Synthetic oligonucleotide
tacatctacaaccgggaagagttcgtgcgc

SEQ ID NO: 53624 - DNA, 29 bp, Artificial Sequence
  Description of Artificial Sequence: Synthetic oligonucleotide
acatctacaaccgggaagagttcgtgcgc

SEQ ID NO: 53625 - DNA, 28 bp, Artificial Sequence
  Description of Artificial Sequence: Synthetic oligonucleotide
catctacaaccgggaagagttcgtgcgc

SEQ ID NO: 53626 - DNA, 30 bp, Artificial Sequence
  Description of Artificial Sequence: Synthetic oligonucleotide
atctacaaccgggaagagttcgtgcgcttc

SEQ ID NO: 53627 - DNA, 29 bp, Artificial Sequence
  Description of Artificial Sequence: Synthetic oligonucleotide
tctacaaccgggaagagttcgtgcgcttc

SEQ ID NO: 53628 - DNA, 28 bp, Artificial Sequence
  Description of Artificial Sequence: Synthetic oligonucleotide
ctacaaccgggaagagttcgtgcgcttc

SEQ ID NO: 53629 - DNA, 28 bp, Artificial Sequence
  Description of Artificial Sequence: Synthetic oligonucleotide
tacaaccgggaagagttcgtgcgcttcg

SEQ ID NO: 53630 - DNA, 27 bp, Artificial Sequence
  Description of Artificial Sequence: Synthetic oligonucleotide
acaaccgggaagagttcgtgcgcttcg

SEQ ID NO: 53631 - DNA, 27 bp, Artificial Sequence
  Description of Artificial Sequence: Synthetic oligonucleotide
caaccgggaagagttcgtgcgcttcga

SEQ ID NO: 53632 - DNA, 27 bp, Artificial Sequence
  Description of Artificial Sequence: Synthetic oligonucleotide
aaccgggaagagttcgtgcgcttcgac

SEQ ID NO: 53633 - DNA, 27 bp, Artificial Sequence
  Description of Artificial Sequence: Synthetic oligonucleotide
accgggaagagttcgtgcgcttcgaca

SEQ ID NO: 53634 - DNA, 26 bp, Artificial Sequence
  Description of Artificial Sequence: Synthetic oligonucleotide
ccgggaagagttcgtgcgcttcgaca

SEQ ID NO: 53635 - DNA, 26 bp, Artificial Sequence
  Description of Artificial Sequence: Synthetic oligonucleotide
cgggaagagttcgtgcgcttcgacag

SEQ ID NO: 53636 - DNA, 26 bp, Artificial Sequence
  Description of Artificial Sequence: Synthetic oligonucleotide
gggaagagttcgtgcgcttcgacagc

SEQ ID NO: 53637 - DNA, 27 bp, Artificial Sequence
  Description of Artificial Sequence: Synthetic oligonucleotide
ggaagagttcgtgcgcttcgacagcga

SEQ ID NO: 53638 - DNA, 27 bp, Artificial Sequence
  Description of Artificial Sequence: Synthetic oligonucleotide
gaagagttcgtgcgcttcgacagcgac

SEQ ID NO: 53639 - DNA, 27 bp, Artificial Sequence
  Description of Artificial Sequence: Synthetic oligonucleotide
aagagttcgtgcgcttcgacagcgacg

SEQ ID NO: 53640 - DNA, 27 bp, Artificial Sequence
  Description of Artificial Sequence: Synthetic oligonucleotide
agagttcgtgcgcttcgacagcgacgt

SEQ ID NO: 53641 - DNA, 33 bp, Artificial Sequence
  Description of Artificial Sequence: Synthetic oligonucleotide
tggagagatacatctacaaccgggaggagtttg

SEQ ID NO: 53642 - DNA, 32 bp, Artificial Sequence
  Description of Artificial Sequence: Synthetic oligonucleotide
ggagagatacatctacaaccgggaggagtttg

SEQ ID NO: 53643 - DNA, 33 bp, Artificial Sequence
  Description of Artificial Sequence: Synthetic oligonucleotide
gagagatacatctacaaccgggaggagtttgtg

SEQ ID NO: 53644 - DNA, 33 bp, Artificial Sequence
  Description of Artificial Sequence: Synthetic oligonucleotide
agagatacatctacaaccgggaggagtttgtgc

SEQ ID NO: 53645 - DNA, 32 bp, Artificial Sequence
  Description of Artificial Sequence: Synthetic oligonucleotide
gagatacatctacaaccgggaggagtttgtgc

SEQ ID NO: 53646 - DNA, 32 bp, Artificial Sequence
  Description of Artificial Sequence: Synthetic oligonucleotide
agatacatctacaaccgggaggagtttgtgcg

SEQ ID NO: 53647 - DNA, 31 bp, Artificial Sequence
  Description of Artificial Sequence: Synthetic oligonucleotide
gatacatctacaaccgggaggagtttgtgcg

SEQ ID NO: 53648 - DNA, 31 bp, Artificial Sequence
  Description of Artificial Sequence: Synthetic oligonucleotide
atacatctacaaccgggaggagtttgtgcgc

SEQ ID NO: 53649 - DNA, 30 bp, Artificial Sequence
  Description of Artificial Sequence: Synthetic oligonucleotide
tacatctacaaccgggaggagtttgtgcgc

SEQ ID NO: 53650 - DNA, 29 bp, Artificial Sequence
  Description of Artificial Sequence: Synthetic oligonucleotide
acatctacaaccgggaggagtttgtgcgc

SEQ ID NO: 53651 - DNA, 28 bp, Artificial Sequence
  Description of Artificial Sequence: Synthetic oligonucleotide
catctacaaccgggaggagtttgtgcgc

SEQ ID NO: 53652 - DNA, 30 bp, Artificial Sequence
  Description of Artificial Sequence: Synthetic oligonucleotide
atctacaaccgggaggagtttgtgcgcttc

SEQ ID NO: 53653 - DNA, 29 bp, Artificial Sequence
  Description of Artificial Sequence: Synthetic oligonucleotide
tctacaaccgggaggagtttgtgcgcttc

SEQ ID NO: 53654 - DNA, 28 bp, Artificial Sequence
  Description of Artificial Sequence: Synthetic oligonucleotide
ctacaaccgggaggagtttgtgcgcttc

SEQ ID NO: 53655 - DNA, 28 bp, Artificial Sequence
  Description of Artificial Sequence: Synthetic oligonucleotide
tacaaccgggaggagtttgtgcgcttcg

SEQ ID NO: 53656 - DNA, 27 bp, Artificial Sequence
  Description of Artificial Sequence: Synthetic oligonucleotide
acaaccgggaggagtttgtgcgcttcg

SEQ ID NO: 53657 - DNA, 27 bp, Artificial Sequence
  Description of Artificial Sequence: Synthetic oligonucleotide
caaccgggaggagtttgtgcgcttcga

SEQ ID NO: 53658 - DNA, 27 bp, Artificial Sequence
  Description of Artificial Sequence: Synthetic oligonucleotide
aaccgggaggagtttgtgcgcttcgac

SEQ ID NO: 53659 - DNA, 27 bp, Artificial Sequence
  Description of Artificial Sequence: Synthetic oligonucleotide
accgggaggagtttgtgcgcttcgaca

SEQ ID NO: 53660 - DNA, 26 bp, Artificial Sequence
  Description of Artificial Sequence: Synthetic oligonucleotide
ccgggaggagtttgtgcgcttcgaca

SEQ ID NO: 53661 - DNA, 26 bp, Artificial Sequence
  Description of Artificial Sequence: Synthetic oligonucleotide
cgggaggagtttgtgcgcttcgacag

SEQ ID NO: 53662 - DNA, 26 bp, Artificial Sequence
  Description of Artificial Sequence: Synthetic oligonucleotide
gggaggagtttgtgcgcttcgacagc

SEQ ID NO: 53663 - DNA, 27 bp, Artificial Sequence
  Description of Artificial Sequence: Synthetic oligonucleotide
ggaggagtttgtgcgcttcgacagcga

SEQ ID NO: 53664 - DNA, 27 bp, Artificial Sequence
  Description of Artificial Sequence: Synthetic oligonucleotide
gaggagtttgtgcgcttcgacagcgac

SEQ ID NO: 53665 - DNA, 27 bp, Artificial Sequence
  Description of Artificial Sequence: Synthetic oligonucleotide
aggagtttgtgcgcttcgacagcgacg

SEQ ID NO: 53666 - DNA, 27 bp, Artificial Sequence
  Description of Artificial Sequence: Synthetic oligonucleotide
ggagtttgtgcgcttcgacagcgacgt

SEQ ID NO: 53667 - DNA, 27 bp, Artificial Sequence
  Description of Artificial Sequence: Synthetic oligonucleotide
gagtttgtgcgcttcgacagcgacgtg

SEQ ID NO: 53668 - DNA, 27 bp, Artificial Sequence
  Description of Artificial Sequence: Synthetic oligonucleotide
agtttgtgcgcttcgacagcgacgtgg

SEQ ID NO: 53669 - DNA, 26 bp, Artificial Sequence
  Description of Artificial Sequence: Synthetic oligonucleotide
gtttgtgcgcttcgacagcgacgtgg

SEQ ID NO: 53670 - DNA, 26 bp, Artificial Sequence
  Description of Artificial Sequence: Synthetic oligonucleotide
tttgtgcgcttcgacagcgacgtggg

SEQ ID NO: 53671 - DNA, 25 bp, Artificial Sequence
  Description of Artificial Sequence: Synthetic oligonucleotide
ttgtgcgcttcgacagcgacgtggg

SEQ ID NO: 53672 - DNA, 24 bp, Artificial Sequence
  Description of Artificial Sequence: Synthetic oligonucleotide
tgtgcgcttcgacagcgacgtggg

SEQ ID NO: 53673 - DNA, 24 bp, Artificial Sequence
  Description of Artificial Sequence: Synthetic oligonucleotide
acggagctggggcggcctgatgaa

SEQ ID NO: 53674 - DNA, 23 bp, Artificial Sequence
  Description of Artificial Sequence: Synthetic oligonucleotide
cggagctggggcggcctgatgaa

SEQ ID NO: 53675 - DNA, 24 bp, Artificial Sequence
  Description of Artificial Sequence: Synthetic oligonucleotide
ggagctggggcggcctgatgaaga

SEQ ID NO: 53676 - DNA, 26 bp, Artificial Sequence
  Description of Artificial Sequence: Synthetic oligonucleotide
gagctggggcggcctgatgaagagta

SEQ ID NO: 53677 - DNA, 27 bp, Artificial Sequence
  Description of Artificial Sequence: Synthetic oligonucleotide
agctggggcggcctgatgaagagtact

SEQ ID NO: 53678 - DNA, 26 bp, Artificial Sequence
  Description of Artificial Sequence: Synthetic oligonucleotide
gctggggcggcctgatgaagagtact

SEQ ID NO: 53679 - DNA, 26 bp, Artificial Sequence
  Description of Artificial Sequence: Synthetic oligonucleotide
ctggggcggcctgatgaagagtactg

SEQ ID NO: 53680 - DNA, 27 bp, Artificial Sequence
  Description of Artificial Sequence: Synthetic oligonucleotide
tggggcggcctgatgaagagtactgga

SEQ ID NO: 53681 - DNA, 27 bp, Artificial Sequence
  Description of Artificial Sequence: Synthetic oligonucleotide
ggggcggcctgatgaagagtactggaa

SEQ ID NO: 53682 - DNA, 27 bp, Artificial Sequence
  Description of Artificial Sequence: Synthetic oligonucleotide
gggcggcctgatgaagagtactggaac

SEQ ID NO: 53683 - DNA, 28 bp, Artificial Sequence
  Description of Artificial Sequence: Synthetic oligonucleotide
ggcggcctgatgaagagtactggaacag

SEQ ID NO: 53684 - DNA, 28 bp, Artificial Sequence
  Description of Artificial Sequence: Synthetic oligonucleotide
gcggcctgatgaagagtactggaacagc

SEQ ID NO: 53685 - DNA, 28 bp, Artificial Sequence
  Description of Artificial Sequence: Synthetic oligonucleotide
cggcctgatgaagagtactggaacagcc

SEQ ID NO: 53686 - DNA, 29 bp, Artificial Sequence
  Description of Artificial Sequence: Synthetic oligonucleotide
ggcctgatgaagagtactggaacagccag

SEQ ID NO: 53687 - DNA, 31 bp, Artificial Sequence
  Description of Artificial Sequence: Synthetic oligonucleotide
gcctgatgaagagtactggaacagccagaag

SEQ ID NO: 53688 - DNA, 31 bp, Artificial Sequence
  Description of Artificial Sequence: Synthetic oligonucleotide
cctgatgaagagtactggaacagccagaagg

SEQ ID NO: 53689 - DNA, 32 bp, Artificial Sequence
  Description of Artificial Sequence: Synthetic oligonucleotide
ctgatgaagagtactggaacagccagaaggac

SEQ ID NO: 53690 - DNA, 34 bp, Artificial Sequence
  Description of Artificial Sequence: Synthetic oligonucleotide
tgatgaagagtactggaacagccagaaggacatc

SEQ ID NO: 53691 - DNA, 33 bp, Artificial Sequence
  Description of Artificial Sequence: Synthetic oligonucleotide
gatgaagagtactggaacagccagaaggacatc

SEQ ID NO: 53692 - DNA, 33 bp, Artificial Sequence
  Description of Artificial Sequence: Synthetic oligonucleotide
atgaagagtactggaacagccagaaggacatcc

SEQ ID NO: 53693 - DNA, 32 bp, Artificial Sequence
  Description of Artificial Sequence: Synthetic oligonucleotide
tgaagagtactggaacagccagaaggacatcc

SEQ ID NO: 53694 - DNA, 31 bp, Artificial Sequence
  Description of Artificial Sequence: Synthetic oligonucleotide
gaagagtactggaacagccagaaggacatcc

SEQ ID NO: 53695 - DNA, 32 bp, Artificial Sequence
  Description of Artificial Sequence: Synthetic oligonucleotide
aagagtactggaacagccagaaggacatcctg

SEQ ID NO: 53696 - DNA, 31 bp, Artificial Sequence
  Description of Artificial Sequence: Synthetic oligonucleotide
agagtactggaacagccagaaggacatcctg

SEQ ID NO: 53697 - DNA, 30 bp, Artificial Sequence
  Description of Artificial Sequence: Synthetic oligonucleotide
tggagagatacatctacaaccgggaggagc

SEQ ID NO: 53698 - DNA, 29 bp, Artificial Sequence
  Description of Artificial Sequence: Synthetic oligonucleotide
ggagagatacatctacaaccgggaggagc

SEQ ID NO: 53699 - DNA, 30 bp, Artificial Sequence
  Description of Artificial Sequence: Synthetic oligonucleotide
gagagatacatctacaaccgggaggagctc

SEQ ID NO: 53700 - DNA, 30 bp, Artificial Sequence
  Description of Artificial Sequence: Synthetic oligonucleotide
agagatacatctacaaccgggaggagctcg

SEQ ID NO: 53701 - DNA, 29 bp, Artificial Sequence
  Description of Artificial Sequence: Synthetic oligonucleotide
gagatacatctacaaccgggaggagctcg

SEQ ID NO: 53702 - DNA, 30 bp, Artificial Sequence
  Description of Artificial Sequence: Synthetic oligonucleotide
agatacatctacaaccgggaggagctcgtg

SEQ ID NO: 53703 - DNA, 29 bp, Artificial Sequence
  Description of Artificial Sequence: Synthetic oligonucleotide
gatacatctacaaccgggaggagctcgtg

SEQ ID NO: 53704 - DNA, 29 bp, Artificial Sequence
  Description of Artificial Sequence: Synthetic oligonucleotide
atacatctacaaccgggaggagctcgtgc

SEQ ID NO: 53705 - DNA, 28 bp, Artificial Sequence
  Description of Artificial Sequence: Synthetic oligonucleotide
tacatctacaaccgggaggagctcgtgc

SEQ ID NO: 53706 - DNA, 27 bp, Artificial Sequence
  Description of Artificial Sequence: Synthetic oligonucleotide
acatctacaaccgggaggagctcgtgc

SEQ ID NO: 53707 - DNA, 26 bp, Artificial Sequence
  Description of Artificial Sequence: Synthetic oligonucleotide
catctacaaccgggaggagctcgtgc

SEQ ID NO: 53708 - DNA, 26 bp, Artificial Sequence
  Description of Artificial Sequence: Synthetic oligonucleotide
atctacaaccgggaggagctcgtgcg

SEQ ID NO: 53709 - DNA, 25 bp, Artificial Sequence
  Description of Artificial Sequence: Synthetic oligonucleotide
tctacaaccgggaggagctcgtgcg

SEQ ID NO: 53710 - DNA, 24 bp, Artificial Sequence
  Description of Artificial Sequence: Synthetic oligonucleotide
ctacaaccgggaggagctcgtgcg

SEQ ID NO: 53711 - DNA, 26 bp, Artificial Sequence
  Description of Artificial Sequence: Synthetic oligonucleotide
tacaaccgggaggagctcgtgcgctt

SEQ ID NO: 53712 - DNA, 25 bp, Artificial Sequence
  Description of Artificial Sequence: Synthetic oligonucleotide
acaaccgggaggagctcgtgcgctt

SEQ ID NO: 53713 - DNA, 24 bp, Artificial Sequence
  Description of Artificial Sequence: Synthetic oligonucleotide
caaccgggaggagctcgtgcgctt

SEQ ID NO: 53714 - DNA, 24 bp, Artificial Sequence
  Description of Artificial Sequence: Synthetic oligonucleotide
aaccgggaggagctcgtgcgcttc

SEQ ID NO: 53715 - DNA, 23 bp, Artificial Sequence
  Description of Artificial Sequence: Synthetic oligonucleotide
accgggaggagctcgtgcgcttc

SEQ ID NO: 53716 - DNA, 22 bp, Artificial Sequence
  Description of Artificial Sequence: Synthetic oligonucleotide
ccgggaggagctcgtgcgcttc

SEQ ID NO: 53717 - DNA, 23 bp, Artificial Sequence
  Description of Artificial Sequence: Synthetic oligonucleotide
cgggaggagctcgtgcgcttcga

SEQ ID NO: 53718 - DNA, 24 bp, Artificial Sequence
  Description of Artificial Sequence: Synthetic oligonucleotide
gggaggagctcgtgcgcttcgaca

SEQ ID NO: 53719 - DNA, 24 bp, Artificial Sequence
  Description of Artificial Sequence: Synthetic oligonucleotide
ggaggagctcgtgcgcttcgacag

SEQ ID NO: 53720 - DNA, 24 bp, Artificial Sequence
  Description of Artificial Sequence: Synthetic oligonucleotide
gaggagctcgtgcgcttcgacagc

SEQ ID NO: 53721 - DNA, 25 bp, Artificial Sequence
  Description of Artificial Sequence: Synthetic oligonucleotide
aggagctcgtgcgcttcgacagcga

SEQ ID NO: 53722 - DNA, 24 bp, Artificial Sequence
  Description of Artificial Sequence: Synthetic oligonucleotide
ggagctcgtgcgcttcgacagcga

SEQ ID NO: 53723 - DNA, 24 bp, Artificial Sequence
  Description of Artificial Sequence: Synthetic oligonucleotide
gagctcgtgcgcttcgacagcgac

SEQ ID NO: 53724 - DNA, 25 bp, Artificial Sequence
  Description of Artificial Sequence: Synthetic oligonucleotide
agctcgtgcgcttcgacagcgacgt

SEQ ID NO: 53725 - DNA, 24 bp, Artificial Sequence
  Description of Artificial Sequence: Synthetic oligonucleotide
gctcgtgcgcttcgacagcgacgt

SEQ ID NO: 53726 - DNA, 24 bp, Artificial Sequence
  Description of Artificial Sequence: Synthetic oligonucleotide
ctcgtgcgcttcgacagcgacgtg

SEQ ID NO: 53727 - DNA, 21 bp, Artificial Sequence
  Description of Artificial Sequence: Synthetic oligonucleotide
acggagctggggcggcctgag

SEQ ID NO: 53728 - DNA, 20 bp, Artificial Sequence
  Description of Artificial Sequence: Synthetic oligonucleotide
cggagctggggcggcctgag

SEQ ID NO: 53729 - DNA, 20 bp, Artificial Sequence
  Description of Artificial Sequence: Synthetic oligonucleotide
ggagctggggcggcctgagg

SEQ ID NO: 53730 - DNA, 20 bp, Artificial Sequence
  Description of Artificial Sequence: Synthetic oligonucleotide
gagctggggcggcctgaggc

SEQ ID NO: 53731 - DNA, 20 bp, Artificial Sequence
  Description of Artificial Sequence: Synthetic oligonucleotide
agctggggcggcctgaggcg

SEQ ID NO: 53732 - DNA, 20 bp, Artificial Sequence
  Description of Artificial Sequence: Synthetic oligonucleotide
gctggggcggcctgaggcgt

SEQ ID NO: 53733 - DNA, 20 bp, Artificial Sequence
  Description of Artificial Sequence: Synthetic oligonucleotide
ctggggcggcctgaggcgga

SEQ ID NO: 53734 - DNA, 22 bp, Artificial Sequence
  Description of Artificial Sequence: Synthetic oligonucleotide
tggggcggcctgaggcggagta

SEQ ID NO: 53735 - DNA, 21 bp, Artificial Sequence
  Description of Artificial Sequence: Synthetic oligonucleotide
ggggcggcctgaggcggagta

SEQ ID NO: 53736 - DNA, 22 bp, Artificial Sequence
  Description of Artificial Sequence: Synthetic oligonucleotide
gggcggcctgaggcggagtact

SEQ ID NO: 53737 - DNA, 22 bp, Artificial Sequence
  Description of Artificial Sequence: Synthetic oligonucleotide
ggcggcctgaggcggagtactg

SEQ ID NO: 53738 - DNA, 24 bp, Artificial Sequence
  Description of Artificial Sequence: Synthetic oligonucleotide
gcggcctgaggcggagtactggaa

SEQ ID NO: 53739 - DNA, 25 bp, Artificial Sequence
  Description of Artificial Sequence: Synthetic oligonucleotide
cggcctgaggcggagtactggaaca

SEQ ID NO: 53740 - DNA, 25 bp, Artificial Sequence
  Description of Artificial Sequence: Synthetic oligonucleotide
ggcctgaggcggagtactggaacag

SEQ ID NO: 53741 - DNA, 25 bp, Artificial Sequence
  Description of Artificial Sequence: Synthetic oligonucleotide
gcctgaggcggagtactggaacagc

SEQ ID NO: 53742 - DNA, 26 bp, Artificial Sequence
  Description of Artificial Sequence: Synthetic oligonucleotide
cctgaggcggagtactggaacagcca

SEQ ID NO: 53743 - DNA, 27 bp, Artificial Sequence
  Description of Artificial Sequence: Synthetic oligonucleotide
ctgaggcggagtactggaacagccaga

SEQ ID NO: 53744 - DNA, 28 bp, Artificial Sequence
  Description of Artificial Sequence: Synthetic oligonucleotide
tgaggcggagtactggaacagccagaag

SEQ ID NO: 53745 - DNA, 27 bp, Artificial Sequence
  Description of Artificial Sequence: Synthetic oligonucleotide
gaggcggagtactggaacagccagaag

SEQ ID NO: 53746 - DNA, 27 bp, Artificial Sequence
  Description of Artificial Sequence: Synthetic oligonucleotide
aggcggagtactggaacagccagaagg

SEQ ID NO: 53747 - DNA, 27 bp, Artificial Sequence
  Description of Artificial Sequence: Synthetic oligonucleotide
ggcggagtactggaacagccagaagga

SEQ ID NO: 53748 - DNA, 32 bp, Artificial Sequence
  Description of Artificial Sequence: Synthetic oligonucleotide
ggccactccagagaattacgtgtaccagttac

SEQ ID NO: 53749 - DNA, 32 bp, Artificial Sequence
  Description of Artificial Sequence: Synthetic oligonucleotide
gccactccagagaattacgtgtaccagttacg

SEQ ID NO: 53750 - DNA, 32 bp, Artificial Sequence
  Description of Artificial Sequence: Synthetic oligonucleotide
ccactccagagaattacgtgtaccagttacgg

SEQ ID NO: 53751 - DNA, 32 bp, Artificial Sequence
  Description of Artificial Sequence: Synthetic oligonucleotide
cactccagagaattacgtgtaccagttacggc

SEQ ID NO: 53752 - DNA, 33 bp, Artificial Sequence
  Description of Artificial Sequence: Synthetic oligonucleotide
actccagagaattacgtgtaccagttacggcag

SEQ ID NO: 53753 - DNA, 32 bp, Artificial Sequence
  Description of Artificial Sequence: Synthetic oligonucleotide
ctccagagaattacgtgtaccagttacggcag

SEQ ID NO: 53754 - DNA, 32 bp, Artificial Sequence
  Description of Artificial Sequence: Synthetic oligonucleotide
tccagagaattacgtgtaccagttacggcagg

SEQ ID NO: 53755 - DNA, 31 bp, Artificial Sequence
  Description of Artificial Sequence: Synthetic oligonucleotide
ccagagaattacgtgtaccagttacggcagg

SEQ ID NO: 53756 - DNA, 34 bp, Artificial Sequence
  Description of Artificial Sequence: Synthetic oligonucleotide
cagagaattacgtgtaccagttacggcaggaatg

SEQ ID NO: 53757 - DNA, 34 bp, Artificial Sequence
  Description of Artificial Sequence: Synthetic oligonucleotide
agagaattacgtgtaccagttacggcaggaatgc

SEQ ID NO: 53758 - DNA, 33 bp, Artificial Sequence
  Description of Artificial Sequence: Synthetic oligonucleotide
gagaattacgtgtaccagttacggcaggaatgc

SEQ ID NO: 53759 - DNA, 35 bp, Artificial Sequence
  Description of Artificial Sequence: Synthetic oligonucleotide
agaattacgtgtaccagttacggcaggaatgctac

SEQ ID NO: 53760 - DNA, 34 bp, Artificial Sequence
  Description of Artificial Sequence: Synthetic oligonucleotide
gaattacgtgtaccagttacggcaggaatgctac

SEQ ID NO: 53761 - DNA, 34 bp, Artificial Sequence
  Description of Artificial Sequence: Synthetic oligonucleotide
aattacgtgtaccagttacggcaggaatgctacg

SEQ ID NO: 53762 - DNA, 33 bp, Artificial Sequence
  Description of Artificial Sequence: Synthetic oligonucleotide
attacgtgtaccagttacggcaggaatgctacg

SEQ ID NO: 53763 - DNA, 32 bp, Artificial Sequence
  Description of Artificial Sequence: Synthetic oligonucleotide
ttacgtgtaccagttacggcaggaatgctacg

SEQ ID NO: 53764 - DNA, 31 bp, Artificial Sequence
  Description of Artificial Sequence: Synthetic oligonucleotide
tacgtgtaccagttacggcaggaatgctacg

SEQ ID NO: 53765 - DNA, 30 bp, Artificial Sequence
  Description of Artificial Sequence: Synthetic oligonucleotide
acgtgtaccagttacggcaggaatgctacg

SEQ ID NO: 53766 - DNA, 29 bp, Artificial Sequence
  Description of Artificial Sequence: Synthetic oligonucleotide
cgtgtaccagttacggcaggaatgctacg

SEQ ID NO: 53767 - DNA, 29 bp, Artificial Sequence
  Description of Artificial Sequence: Synthetic oligonucleotide
gtgtaccagttacggcaggaatgctacgc

SEQ ID NO: 53768 - DNA, 29 bp, Artificial Sequence
  Description of Artificial Sequence: Synthetic oligonucleotide
tgtaccagttacggcaggaatgctacgcg

SEQ ID NO: 53769 - DNA, 28 bp, Artificial Sequence
  Description of Artificial Sequence: Synthetic oligonucleotide
gtaccagttacggcaggaatgctacgcg

SEQ ID NO: 53770 - DNA, 34 bp, Artificial Sequence
  Description of Artificial Sequence: Synthetic oligonucleotide
taccagttacggcaggaatgctacgcgtttaatg

SEQ ID NO: 53771 - DNA, 33 bp, Artificial Sequence
  Description of Artificial Sequence: Synthetic oligonucleotide
accagttacggcaggaatgctacgcgtttaatg

SEQ ID NO: 53772 - DNA, 32 bp, Artificial Sequence
  Description of Artificial Sequence: Synthetic oligonucleotide
ccagttacggcaggaatgctacgcgtttaatg

SEQ ID NO: 53773 - DNA, 32 bp, Artificial Sequence
  Description of Artificial Sequence: Synthetic oligonucleotide
cagttacggcaggaatgctacgcgtttaatgg

SEQ ID NO: 53774 - DNA, 32 bp, Artificial Sequence
  Description of Artificial Sequence: Synthetic oligonucleotide
agttacggcaggaatgctacgcgtttaatggg

SEQ ID NO: 53775 - DNA, 31 bp, Artificial Sequence
  Description of Artificial Sequence: Synthetic oligonucleotide
gttacggcaggaatgctacgcgtttaatggg

SEQ ID NO: 53776 - DNA, 32 bp, Artificial Sequence
  Description of Artificial Sequence: Synthetic oligonucleotide
ttacggcaggaatgctacgcgtttaatgggac

SEQ ID NO: 53777 - DNA, 31 bp, Artificial Sequence
  Description of Artificial Sequence: Synthetic oligonucleotide
tacggcaggaatgctacgcgtttaatgggac

SEQ ID NO: 53778 - DNA, 25 bp, Artificial Sequence
  Description of Artificial Sequence: Synthetic oligonucleotide
agctggggcggcctgatgaggacta

SEQ ID NO: 53779 - DNA, 24 bp, Artificial Sequence
  Description of Artificial Sequence: Synthetic oligonucleotide
gctggggcggcctgatgaggacta

SEQ ID NO: 53780 - DNA, 25 bp, Artificial Sequence
  Description of Artificial Sequence: Synthetic oligonucleotide
ctggggcggcctgatgaggactact

SEQ ID NO: 53781 - DNA, 25 bp, Artificial Sequence
  Description of Artificial Sequence: Synthetic oligonucleotide
tggggcggcctgatgaggactactg

SEQ ID NO: 53782 - DNA, 24 bp, Artificial Sequence
  Description of Artificial Sequence: Synthetic oligonucleotide
ggggcggcctgatgaggactactg

SEQ ID NO: 53783 - DNA, 26 bp, Artificial Sequence
  Description of Artificial Sequence: Synthetic oligonucleotide
gggcggcctgatgaggactactggaa

SEQ ID NO: 53784 - DNA, 27 bp, Artificial Sequence
  Description of Artificial Sequence: Synthetic oligonucleotide
ggcggcctgatgaggactactggaaca

SEQ ID NO: 53785 - DNA, 27 bp, Artificial Sequence
  Description of Artificial Sequence: Synthetic oligonucleotide
gcggcctgatgaggactactggaacag

SEQ ID NO: 53786 - DNA, 27 bp, Artificial Sequence
  Description of Artificial Sequence: Synthetic oligonucleotide
cggcctgatgaggactactggaacagc

SEQ ID NO: 53787 - DNA, 27 bp, Artificial Sequence
  Description of Artificial Sequence: Synthetic oligonucleotide
ggcctgatgaggactactggaacagcc

SEQ ID NO: 53788 - DNA, 28 bp, Artificial Sequence
  Description of Artificial Sequence: Synthetic oligonucleotide
gcctgatgaggactactggaacagccag

SEQ ID NO: 53789 - DNA, 30 bp, Artificial Sequence
  Description of Artificial Sequence: Synthetic oligonucleotide
cctgatgaggactactggaacagccagaag

SEQ ID NO: 53790 - DNA, 30 bp, Artificial Sequence
  Description of Artificial Sequence: Synthetic oligonucleotide
ctgatgaggactactggaacagccagaagg

SEQ ID NO: 53791 - DNA, 31 bp, Artificial Sequence
  Description of Artificial Sequence: Synthetic oligonucleotide
tgatgaggactactggaacagccagaaggac

SEQ ID NO: 53792 - DNA, 30 bp, Artificial Sequence
  Description of Artificial Sequence: Synthetic oligonucleotide
gatgaggactactggaacagccagaaggac

SEQ ID NO: 53793 - DNA, 30 bp, Artificial Sequence
  Description of Artificial Sequence: Synthetic oligonucleotide
atgaggactactggaacagccagaaggacc

SEQ ID NO: 53794 - DNA, 29 bp, Artificial Sequence
  Description of Artificial Sequence: Synthetic oligonucleotide
tgaggactactggaacagccagaaggacc

SEQ ID NO: 53795 - DNA, 28 bp, Artificial Sequence
  Description of Artificial Sequence: Synthetic oligonucleotide
gaggactactggaacagccagaaggacc

SEQ ID NO: 53796 - DNA, 29 bp, Artificial Sequence
  Description of Artificial Sequence: Synthetic oligonucleotide
aggactactggaacagccagaaggacctc

SEQ ID NO: 53797 - DNA, 28 bp, Artificial Sequence
  Description of Artificial Sequence: Synthetic oligonucleotide
ggactactggaacagccagaaggacctc

SEQ ID NO: 53798 - DNA, 28 bp, Artificial Sequence
  Description of Artificial Sequence: Synthetic oligonucleotide
gactactggaacagccagaaggacctcc

SEQ ID NO: 53799 - DNA, 29 bp, Artificial Sequence
  Description of Artificial Sequence: Synthetic oligonucleotide
actactggaacagccagaaggacctcctg

SEQ ID NO: 53800 - DNA, 28 bp, Artificial Sequence
  Description of Artificial Sequence: Synthetic oligonucleotide
ctactggaacagccagaaggacctcctg

SEQ ID NO: 53801 - DNA, 28 bp, Artificial Sequence
  Description of Artificial Sequence: Synthetic oligonucleotide
tactggaacagccagaaggacctcctgg

SEQ ID NO: 53802 - DNA, 27 bp, Artificial Sequence
  Description of Artificial Sequence: Synthetic oligonucleotide
actggaacagccagaaggacctcctgg

SEQ ID NO: 53803 - DNA, 27 bp, Artificial Sequence
  Description of Artificial Sequence: Synthetic oligonucleotide
ctggaacagccagaaggacctcctgga

SEQ ID NO: 53804 - DNA, 27 bp, Artificial Sequence
  Description of Artificial Sequence: Synthetic oligonucleotide
tggaacagccagaaggacctcctggag

SEQ ID NO: 53805 - DNA, 26 bp, Artificial Sequence
  Description of Artificial Sequence: Synthetic oligonucleotide
ggaacagccagaaggacctcctggag

SEQ ID NO: 53806 - DNA, 27 bp, Artificial Sequence
  Description of Artificial Sequence: Synthetic oligonucleotide
gaacagccagaaggacctcctggagga

SEQ ID NO: 53807 - DNA, 27 bp, Artificial Sequence
  Description of Artificial Sequence: Synthetic oligonucleotide
aacagccagaaggacctcctggaggag

SEQ ID NO: 53808 - DNA, 27 bp, Artificial Sequence
  Description of Artificial Sequence: Synthetic oligonucleotide
acagccagaaggacctcctggaggaga

SEQ ID NO: 53809 - DNA, 27 bp, Artificial Sequence
  Description of Artificial Sequence: Synthetic oligonucleotide
cagccagaaggacctcctggaggagaa

SEQ ID NO: 53810 - DNA, 27 bp, Artificial Sequence
  Description of Artificial Sequence: Synthetic oligonucleotide
agccagaaggacctcctggaggagaag

SEQ ID NO: 53811 - DNA, 26 bp, Artificial Sequence
  Description of Artificial Sequence: Synthetic oligonucleotide
gccagaaggacctcctggaggagaag

SEQ ID NO: 53812 - DNA, 26 bp, Artificial Sequence
  Description of Artificial Sequence: Synthetic oligonucleotide
ccagaaggacctcctggaggagaagc

SEQ ID NO: 53813 - DNA, 26 bp, Artificial Sequence
  Description of Artificial Sequence: Synthetic oligonucleotide
cagaaggacctcctggaggagaagcg

SEQ ID NO: 53814 - DNA, 26 bp, Artificial Sequence
  Description of Artificial Sequence: Synthetic oligonucleotide
agaaggacctcctggaggagaagcgg

SEQ ID NO: 53815 - DNA, 25 bp, Artificial Sequence
  Description of Artificial Sequence: Synthetic oligonucleotide
gaaggacctcctggaggagaagcgg

SEQ ID NO: 53816 - DNA, 25 bp, Artificial Sequence
  Description of Artificial Sequence: Synthetic oligonucleotide
aaggacctcctggaggagaagcggg

SEQ ID NO: 53817 - DNA, 24 bp, Artificial Sequence
  Description of Artificial Sequence: Synthetic oligonucleotide
aggacctcctggaggagaagcggg

SEQ ID NO: 53818 - DNA, 23 bp, Artificial Sequence
  Description of Artificial Sequence: Synthetic oligonucleotide
ggacctcctggaggagaagcggg

SEQ ID NO: 53819 - DNA, 24 bp, Artificial Sequence
  Description of Artificial Sequence: Synthetic oligonucleotide
gacctcctggaggagaagcgggca

SEQ ID NO: 53820 - DNA, 25 bp, Artificial Sequence
  Description of Artificial Sequence: Synthetic oligonucleotide
acctcctggaggagaagcgggcagt

SEQ ID NO: 53821 - DNA, 24 bp, Artificial Sequence
  Description of Artificial Sequence: Synthetic oligonucleotide
cctcctggaggagaagcgggcagt

SEQ ID NO: 53822 - DNA, 24 bp, Artificial Sequence
  Description of Artificial Sequence: Synthetic oligonucleotide
ctcctggaggagaagcgggcagtg

SEQ ID NO: 53823 - DNA, 24 bp, Artificial Sequence
  Description of Artificial Sequence: Synthetic oligonucleotide
gagctggacgaggccgtgacccta

SEQ ID NO: 53824 - DNA, 25 bp, Artificial Sequence
  Description of Artificial Sequence: Synthetic oligonucleotide
agctggacgaggccgtgaccctaca

SEQ ID NO: 53825 - DNA, 24 bp, Artificial Sequence
  Description of Artificial Sequence: Synthetic oligonucleotide
gctggacgaggccgtgaccctaca

SEQ ID NO: 53826 - DNA, 24 bp, Artificial Sequence
  Description of Artificial Sequence: Synthetic oligonucleotide
ctggacgaggccgtgaccctacag

SEQ ID NO: 53827 - DNA, 24 bp, Artificial Sequence
  Description of Artificial Sequence: Synthetic oligonucleotide
tggacgaggccgtgaccctacagc

SEQ ID NO: 53828 - DNA, 23 bp, Artificial Sequence
  Description of Artificial Sequence: Synthetic oligonucleotide
ggacgaggccgtgaccctacagc

SEQ ID NO: 53829 - DNA, 23 bp, Artificial Sequence
  Description of Artificial Sequence: Synthetic oligonucleotide
gacgaggccgtgaccctacagcg

SEQ ID NO: 53830 - DNA, 23 bp, Artificial Sequence
  Description of Artificial Sequence: Synthetic oligonucleotide
acgaggccgtgaccctacagcgc

SEQ ID NO: 53831 - DNA, 22 bp, Artificial Sequence
  Description of Artificial Sequence: Synthetic oligonucleotide
cgaggccgtgaccctacagcgc

SEQ ID NO: 53832 - DNA, 22 bp, Artificial Sequence
  Description of Artificial Sequence: Synthetic oligonucleotide
gaggccgtgaccctacagcgcc

SEQ ID NO: 53833 - DNA, 23 bp, Artificial Sequence
  Description of Artificial Sequence: Synthetic oligonucleotide
aggccgtgaccctacagcgccga

SEQ ID NO: 53834 - DNA, 22 bp, Artificial Sequence
  Description of Artificial Sequence: Synthetic oligonucleotide
ggccgtgaccctacagcgccga

SEQ ID NO: 53835 - DNA, 22 bp, Artificial Sequence
  Description of Artificial Sequence: Synthetic oligonucleotide
gccgtgaccctacagcgccgag

SEQ ID NO: 53836 - DNA, 31 bp, Artificial Sequence
  Description of Artificial Sequence: Synthetic oligonucleotide
agagatacatctacaaccgggaggagttcgc

SEQ ID NO: 53837 - DNA, 30 bp, Artificial Sequence
  Description of Artificial Sequence: Synthetic oligonucleotide
gagatacatctacaaccgggaggagttcgc

SEQ ID NO: 53838 - DNA, 30 bp, Artificial Sequence
  Description of Artificial Sequence: Synthetic oligonucleotide
agatacatctacaaccgggaggagttcgcg

SEQ ID NO: 53839 - DNA, 29 bp, Artificial Sequence
  Description of Artificial Sequence: Synthetic oligonucleotide
gatacatctacaaccgggaggagttcgcg

SEQ ID NO: 53840 - DNA, 29 bp, Artificial Sequence
  Description of Artificial Sequence: Synthetic oligonucleotide
atacatctacaaccgggaggagttcgcgc

SEQ ID NO: 53841 - DNA, 28 bp, Artificial Sequence
  Description of Artificial Sequence: Synthetic oligonucleotide
tacatctacaaccgggaggagttcgcgc

SEQ ID NO: 53842 - DNA, 27 bp, Artificial Sequence
  Description of Artificial Sequence: Synthetic oligonucleotide
acatctacaaccgggaggagttcgcgc

SEQ ID NO: 53843 - DNA, 26 bp, Artificial Sequence
  Description of Artificial Sequence: Synthetic oligonucleotide
catctacaaccgggaggagttcgcgc

SEQ ID NO: 53844 - DNA, 26 bp, Artificial Sequence
  Description of Artificial Sequence: Synthetic oligonucleotide
atctacaaccgggaggagttcgcgcg

SEQ ID NO: 53845 - DNA, 25 bp, Artificial Sequence
  Description of Artificial Sequence: Synthetic oligonucleotide
tctacaaccgggaggagttcgcgcg

SEQ ID NO: 53846 - DNA, 24 bp, Artificial Sequence
  Description of Artificial Sequence: Synthetic oligonucleotide
ctacaaccgggaggagttcgcgcg

SEQ ID NO: 53847 - DNA, 26 bp, Artificial Sequence
  Description of Artificial Sequence: Synthetic oligonucleotide
tacaaccgggaggagttcgcgcgctt

SEQ ID NO: 53848 - DNA, 25 bp, Artificial Sequence
  Description of Artificial Sequence: Synthetic oligonucleotide
acaaccgggaggagttcgcgcgctt

SEQ ID NO: 53849 - DNA, 24 bp, Artificial Sequence
  Description of Artificial Sequence: Synthetic oligonucleotide
caaccgggaggagttcgcgcgctt

SEQ ID NO: 53850 - DNA, 24 bp, Artificial Sequence
  Description of Artificial Sequence: Synthetic oligonucleotide
aaccgggaggagttcgcgcgcttc

SEQ ID NO: 53851 - DNA, 23 bp, Artificial Sequence
  Description of Artificial Sequence: Synthetic oligonucleotide
accgggaggagttcgcgcgcttc

SEQ ID NO: 53852 - DNA, 22 bp, Artificial Sequence
  Description of Artificial Sequence: Synthetic oligonucleotide
ccgggaggagttcgcgcgcttc

SEQ ID NO: 53853 - DNA, 23 bp, Artificial Sequence
  Description of Artificial Sequence: Synthetic oligonucleotide
cgggaggagttcgcgcgcttcga

SEQ ID NO: 53854 - DNA, 24 bp, Artificial Sequence
  Description of Artificial Sequence: Synthetic oligonucleotide
gggaggagttcgcgcgcttcgaca

SEQ ID NO: 53855 - DNA, 24 bp, Artificial Sequence
  Description of Artificial Sequence: Synthetic oligonucleotide
ggaggagttcgcgcgcttcgacag

SEQ ID NO: 53856 - DNA, 24 bp, Artificial Sequence
  Description of Artificial Sequence: Synthetic oligonucleotide
gaggagttcgcgcgcttcgacagc

SEQ ID NO: 53857 - DNA, 25 bp, Artificial Sequence
  Description of Artificial Sequence: Synthetic oligonucleotide
aggagttcgcgcgcttcgacagcga

SEQ ID NO: 53858 - DNA, 24 bp, Artificial Sequence
  Description of Artificial Sequence: Synthetic oligonucleotide
ggagttcgcgcgcttcgacagcga

SEQ ID NO: 53859 - DNA, 24 bp, Artificial Sequence
  Description of Artificial Sequence: Synthetic oligonucleotide
gagttcgcgcgcttcgacagcgac

SEQ ID NO: 53860 - DNA, 25 bp, Artificial Sequence
  Description of Artificial Sequence: Synthetic oligonucleotide
agttcgcgcgcttcgacagcgacgt

SEQ ID NO: 53861 - DNA, 24 bp, Artificial Sequence
  Description of Artificial Sequence: Synthetic oligonucleotide
gttcgcgcgcttcgacagcgacgt

SEQ ID NO: 53862 - DNA, 24 bp, Artificial Sequence
  Description of Artificial Sequence: Synthetic oligonucleotide
ttcgcgcgcttcgacagcgacgtg

SEQ ID NO: 53863 - DNA, 23 bp, Artificial Sequence
  Description of Artificial Sequence: Synthetic oligonucleotide
tcgcgcgcttcgacagcgacgtg

SEQ ID NO: 53864 - DNA, 25 bp, Artificial Sequence
  Description of Artificial Sequence: Synthetic oligonucleotide
agaagcgggcagtgccggacaggat

SEQ ID NO: 53865 - DNA, 24 bp, Artificial Sequence
  Description of Artificial Sequence: Synthetic oligonucleotide
gaagcgggcagtgccggacaggat

SEQ ID NO: 53866 - DNA, 25 bp, Artificial Sequence
  Description of Artificial Sequence: Synthetic oligonucleotide
aagcgggcagtgccggacaggatgt

SEQ ID NO: 53867 - DNA, 28 bp, Artificial Sequence
  Description of Artificial Sequence: Synthetic oligonucleotide
cagaaggacatcctggaggagaagcgtg

SEQ ID NO: 53868 - DNA, 28 bp, Artificial Sequence
  Description of Artificial Sequence: Synthetic oligonucleotide
agaaggacatcctggaggagaagcgtgc

SEQ ID NO: 53869 - DNA, 27 bp, Artificial Sequence
  Description of Artificial Sequence: Synthetic oligonucleotide
gaaggacatcctggaggagaagcgtgc

SEQ ID NO: 53870 - DNA, 28 bp, Artificial Sequence
  Description of Artificial Sequence: Synthetic oligonucleotide
aaggacatcctggaggagaagcgtgcag

SEQ ID NO: 53871 - DNA, 27 bp, Artificial Sequence
  Description of Artificial Sequence: Synthetic oligonucleotide
aggacatcctggaggagaagcgtgcag

SEQ ID NO: 53872 - DNA, 27 bp, Artificial Sequence
  Description of Artificial Sequence: Synthetic oligonucleotide
ggacatcctggaggagaagcgtgcagt

SEQ ID NO: 53873 - DNA, 27 bp, Artificial Sequence
  Description of Artificial Sequence: Synthetic oligonucleotide
gacatcctggaggagaagcgtgcagtg

SEQ ID NO: 53874 - DNA, 27 bp, Artificial Sequence
  Description of Artificial Sequence: Synthetic oligonucleotide
acatcctggaggagaagcgtgcagtgc

SEQ ID NO: 53875 - DNA, 26 bp, Artificial Sequence
  Description of Artificial Sequence: Synthetic oligonucleotide
catcctggaggagaagcgtgcagtgc

SEQ ID NO: 53876 - DNA, 26 bp, Artificial Sequence
  Description of Artificial Sequence: Synthetic oligonucleotide
atcctggaggagaagcgtgcagtgcc

SEQ ID NO: 53877 - DNA, 25 bp, Artificial Sequence
  Description of Artificial Sequence: Synthetic oligonucleotide
tcctggaggagaagcgtgcagtgcc

SEQ ID NO: 53878 - DNA, 24 bp, Artificial Sequence
  Description of Artificial Sequence: Synthetic oligonucleotide
cctggaggagaagcgtgcagtgcc

SEQ ID NO: 53879 - DNA, 24 bp, Artificial Sequence
  Description of Artificial Sequence: Synthetic oligonucleotide
ctggaggagaagcgtgcagtgccg

SEQ ID NO: 53880 - DNA, 25 bp, Artificial Sequence
  Description of Artificial Sequence: Synthetic oligonucleotide
tggaggagaagcgtgcagtgccgga

SEQ ID NO: 53881 - DNA, 24 bp, Artificial Sequence
  Description of Artificial Sequence: Synthetic oligonucleotide
ggaggagaagcgtgcagtgccgga

SEQ ID NO: 53882 - DNA, 25 bp, Artificial Sequence
  Description of Artificial Sequence: Synthetic oligonucleotide
gaggagaagcgtgcagtgccggaca

SEQ ID NO: 53883 - DNA, 25 bp, Artificial Sequence
  Description of Artificial Sequence: Synthetic oligonucleotide
aggagaagcgtgcagtgccggacag

SEQ ID NO: 53884 - DNA, 24 bp, Artificial Sequence
  Description of Artificial Sequence: Synthetic oligonucleotide
ggagaagcgtgcagtgccggacag

SEQ ID NO: 53885 - DNA, 26 bp, Artificial Sequence
  Description of Artificial Sequence: Synthetic oligonucleotide
gagaagcgtgcagtgccggacaggat

SEQ ID NO: 53886 - DNA, 27 bp, Artificial Sequence
  Description of Artificial Sequence: Synthetic oligonucleotide
agaagcgtgcagtgccggacaggatgt

SEQ ID NO: 53887 - DNA, 26 bp, Artificial Sequence
  Description of Artificial Sequence: Synthetic oligonucleotide
gaagcgtgcagtgccggacaggatgt

SEQ ID NO: 53888 - DNA, 26 bp, Artificial Sequence
  Description of Artificial Sequence: Synthetic oligonucleotide
aagcgtgcagtgccggacaggatgtg

SEQ ID NO: 53889 - DNA, 25 bp, Artificial Sequence
  Description of Artificial Sequence: Synthetic oligonucleotide
agcgtgcagtgccggacaggatgtg

SEQ ID NO: 53890 - DNA, 24 bp, Artificial Sequence
  Description of Artificial Sequence: Synthetic oligonucleotide
gcgtgcagtgccggacaggatgtg

SEQ ID NO: 53891 - DNA, 25 bp, Artificial Sequence
  Description of Artificial Sequence: Synthetic oligonucleotide
cgtgcagtgccggacaggatgtgca

SEQ ID NO: 53892 - DNA, 26 bp, Artificial Sequence
  Description of Artificial Sequence: Synthetic oligonucleotide
gtgcagtgccggacaggatgtgcaga

SEQ ID NO: 53893 - DNA, 27 bp, Artificial Sequence
  Description of Artificial Sequence: Synthetic oligonucleotide
tgcagtgccggacaggatgtgcagaca

SEQ ID NO: 53894 - DNA, 27 bp, Artificial Sequence
  Description of Artificial Sequence: Synthetic oligonucleotide
acacctgccaagtggagcacaccagca

SEQ ID NO: 53895 - DNA, 27 bp, Artificial Sequence
  Description of Artificial Sequence: Synthetic oligonucleotide
cacctgccaagtggagcacaccagcat

SEQ ID NO: 53896 - DNA, 27 bp, Artificial Sequence
  Description of Artificial Sequence: Synthetic oligonucleotide
acctgccaagtggagcacaccagcatg

SEQ ID NO: 53897 - DNA, 26 bp, Artificial Sequence
  Description of Artificial Sequence: Synthetic oligonucleotide
cctgccaagtggagcacaccagcatg

SEQ ID NO: 53898 - DNA, 27 bp, Artificial Sequence
  Description of Artificial Sequence: Synthetic oligonucleotide
ctgccaagtggagcacaccagcatgga

SEQ ID NO: 53899 - DNA, 29 bp, Artificial Sequence
  Description of Artificial Sequence: Synthetic oligonucleotide
tgccaagtggagcacaccagcatggatag

SEQ ID NO: 53900 - DNA, 28 bp, Artificial Sequence
  Description of Artificial Sequence: Synthetic oligonucleotide
gccaagtggagcacaccagcatggatag

SEQ ID NO: 53901 - DNA, 29 bp, Artificial Sequence
  Description of Artificial Sequence: Synthetic oligonucleotide
ccaagtggagcacaccagcatggatagtc

SEQ ID NO: 53902 - DNA, 29 bp, Artificial Sequence
  Description of Artificial Sequence: Synthetic oligonucleotide
caagtggagcacaccagcatggatagtcc

SEQ ID NO: 53903 - DNA, 30 bp, Artificial Sequence
  Description of Artificial Sequence: Synthetic oligonucleotide
aagtggagcacaccagcatggatagtcctg

SEQ ID NO: 53904 - DNA, 29 bp, Artificial Sequence
  Description of Artificial Sequence: Synthetic oligonucleotide
agtggagcacaccagcatggatagtcctg

SEQ ID NO: 53905 - DNA, 28 bp, Artificial Sequence
  Description of Artificial Sequence: Synthetic oligonucleotide
gtggagcacaccagcatggatagtcctg

SEQ ID NO: 53906 - DNA, 29 bp, Artificial Sequence
  Description of Artificial Sequence: Synthetic oligonucleotide
tggagcacaccagcatggatagtcctgtc

SEQ ID NO: 53907 - DNA, 28 bp, Artificial Sequence
  Description of Artificial Sequence: Synthetic oligonucleotide
ggagcacaccagcatggatagtcctgtc

SEQ ID NO: 53908 - DNA, 29 bp, Artificial Sequence
  Description of Artificial Sequence: Synthetic oligonucleotide
gagcacaccagcatggatagtcctgtcac

SEQ ID NO: 53909 - DNA, 29 bp, Artificial Sequence
  Description of Artificial Sequence: Synthetic oligonucleotide
agcacaccagcatggatagtcctgtcacc

SEQ ID NO: 53910 - DNA, 28 bp, Artificial Sequence
  Description of Artificial Sequence: Synthetic oligonucleotide
gcacaccagcatggatagtcctgtcacc

SEQ ID NO: 53911 - DNA, 28 bp, Artificial Sequence
  Description of Artificial Sequence: Synthetic oligonucleotide
cacaccagcatggatagtcctgtcaccg

SEQ ID NO: 53912 - DNA, 29 bp, Artificial Sequence
  Description of Artificial Sequence: Synthetic oligonucleotide
acaccagcatggatagtcctgtcaccgtg

SEQ ID NO: 53913 - DNA, 28 bp, Artificial Sequence
  Description of Artificial Sequence: Synthetic oligonucleotide
caccagcatggatagtcctgtcaccgtg

SEQ ID NO: 53914 - DNA, 28 bp, Artificial Sequence
  Description of Artificial Sequence: Synthetic oligonucleotide
accagcatggatagtcctgtcaccgtgg

SEQ ID NO: 53915 - DNA, 27 bp, Artificial Sequence
  Description of Artificial Sequence: Synthetic oligonucleotide
ccagcatggatagtcctgtcaccgtgg

SEQ ID NO: 53916 - DNA, 28 bp, Artificial Sequence
  Description of Artificial Sequence: Synthetic oligonucleotide
cagcatggatagtcctgtcaccgtggag

SEQ ID NO: 53917 - DNA, 29 bp, Artificial Sequence
  Description of Artificial Sequence: Synthetic oligonucleotide
agcatggatagtcctgtcaccgtggagtg

SEQ ID NO: 53918 - DNA, 28 bp, Artificial Sequence
  Description of Artificial Sequence: Synthetic oligonucleotide
gcatggatagtcctgtcaccgtggagtg

SEQ ID NO: 53919 - DNA, 28 bp, Artificial Sequence
  Description of Artificial Sequence: Synthetic oligonucleotide
catggatagtcctgtcaccgtggagtgg

SEQ ID NO: 53920 - DNA, 30 bp, Artificial Sequence
  Description of Artificial Sequence: Synthetic oligonucleotide
atggatagtcctgtcaccgtggagtggaag

SEQ ID NO: 53921 - DNA, 30 bp, Artificial Sequence
  Description of Artificial Sequence: Synthetic oligonucleotide
aggatgtgcagacacaactacgagctggac

SEQ ID NO: 53922 - DNA, 29 bp, Artificial Sequence
  Description of Artificial Sequence: Synthetic oligonucleotide
ggatgtgcagacacaactacgagctggac

SEQ ID NO: 53923 - DNA, 29 bp, Artificial Sequence
  Description of Artificial Sequence: Synthetic oligonucleotide
gatgtgcagacacaactacgagctggacg

SEQ ID NO: 53924 - DNA, 30 bp, Artificial Sequence
  Description of Artificial Sequence: Synthetic oligonucleotide
atgtgcagacacaactacgagctggacgag

SEQ ID NO: 53925 - DNA, 29 bp, Artificial Sequence
  Description of Artificial Sequence: Synthetic oligonucleotide
tgtgcagacacaactacgagctggacgag

SEQ ID NO: 53926 - DNA, 28 bp, Artificial Sequence
  Description of Artificial Sequence: Synthetic oligonucleotide
gtgcagacacaactacgagctggacgag

SEQ ID NO: 53927 - DNA, 27 bp, Artificial Sequence
  Description of Artificial Sequence: Synthetic oligonucleotide
agacattgacgggagctgggggcttca

SEQ ID NO: 53928 - DNA, 27 bp, Artificial Sequence
  Description of Artificial Sequence: Synthetic oligonucleotide
gacattgacgggagctgggggcttcat

SEQ ID NO: 53929 - DNA, 27 bp, Artificial Sequence
  Description of Artificial Sequence: Synthetic oligonucleotide
acattgacgggagctgggggcttcatg

SEQ ID NO: 53930 - DNA, 26 bp, Artificial Sequence
  Description of Artificial Sequence: Synthetic oligonucleotide
cattgacgggagctgggggcttcatg

SEQ ID NO: 53931 - DNA, 27 bp, Artificial Sequence
  Description of Artificial Sequence: Synthetic oligonucleotide
attgacgggagctgggggcttcatgct

SEQ ID NO: 53932 - DNA, 26 bp, Artificial Sequence
  Description of Artificial Sequence: Synthetic oligonucleotide
ttgacgggagctgggggcttcatgct

SEQ ID NO: 53933 - DNA, 25 bp, Artificial Sequence
  Description of Artificial Sequence: Synthetic oligonucleotide
tgacgggagctgggggcttcatgct

SEQ ID NO: 53934 - DNA, 24 bp, Artificial Sequence
  Description of Artificial Sequence: Synthetic oligonucleotide
gacgggagctgggggcttcatgct

SEQ ID NO: 53935 - DNA, 24 bp, Artificial Sequence
  Description of Artificial Sequence: Synthetic oligonucleotide
acgggagctgggggcttcatgctg

SEQ ID NO: 53936 - DNA, 23 bp, Artificial Sequence
  Description of Artificial Sequence: Synthetic oligonucleotide
cgggagctgggggcttcatgctg

SEQ ID NO: 53937 - DNA, 23 bp, Artificial Sequence
  Description of Artificial Sequence: Synthetic oligonucleotide
gggagctgggggcttcatgctgg

SEQ ID NO: 53938 - DNA, 23 bp, Artificial Sequence
  Description of Artificial Sequence: Synthetic oligonucleotide
ggagctgggggcttcatgctggg

SEQ ID NO: 53939 - DNA, 23 bp, Artificial Sequence
  Description of Artificial Sequence: Synthetic oligonucleotide
gagctgggggcttcatgctgggg

SEQ ID NO: 53940 - DNA, 24 bp, Artificial Sequence
  Description of Artificial Sequence: Synthetic oligonucleotide
agctgggggcttcatgctggggct

SEQ ID NO: 53941 - DNA, 23 bp, Artificial Sequence
  Description of Artificial Sequence: Synthetic oligonucleotide
gctgggggcttcatgctggggct

SEQ ID NO: 53942 - DNA, 25 bp, Artificial Sequence
  Description of Artificial Sequence: Synthetic oligonucleotide
ctgggggcttcatgctggggctcat

SEQ ID NO: 53943 - DNA, 27 bp, Artificial Sequence
  Description of Artificial Sequence: Synthetic oligonucleotide
tgggggcttcatgctggggctcatcat

SEQ ID NO: 53944 - DNA, 26 bp, Artificial Sequence
  Description of Artificial Sequence: Synthetic oligonucleotide
gggggcttcatgctggggctcatcat

SEQ ID NO: 53945 - DNA, 27 bp, Artificial Sequence
  Description of Artificial Sequence: Synthetic oligonucleotide
ggggcttcatgctggggctcatcatct

SEQ ID NO: 53946 - DNA, 27 bp, Artificial Sequence
  Description of Artificial Sequence: Synthetic oligonucleotide
gggcttcatgctggggctcatcatctg

SEQ ID NO: 53947 - DNA, 28 bp, Artificial Sequence
  Description of Artificial Sequence: Synthetic oligonucleotide
ggcttcatgctggggctcatcatctgtg

SEQ ID NO: 53948 - DNA, 28 bp, Artificial Sequence
  Description of Artificial Sequence: Synthetic oligonucleotide
gcttcatgctggggctcatcatctgtgg

SEQ ID NO: 53949 - DNA, 29 bp, Artificial Sequence
  Description of Artificial Sequence: Synthetic oligonucleotide
cttcatgctggggctcatcatctgtggag

SEQ ID NO: 53950 - DNA, 30 bp, Artificial Sequence
  Description of Artificial Sequence: Synthetic oligonucleotide
ttcatgctggggctcatcatctgtggagtg

SEQ ID NO: 53951 - DNA, 29 bp, Artificial Sequence
  Description of Artificial Sequence: Synthetic oligonucleotide
tcatgctggggctcatcatctgtggagtg

SEQ ID NO: 53952 - DNA, 28 bp, Artificial Sequence
  Description of Artificial Sequence: Synthetic oligonucleotide
catgctggggctcatcatctgtggagtg

SEQ ID NO: 53953 - DNA, 28 bp, Artificial Sequence
  Description of Artificial Sequence: Synthetic oligonucleotide
atgctggggctcatcatctgtggagtgg

SEQ ID NO: 53954 - DNA, 27 bp, Artificial Sequence
  Description of Artificial Sequence: Synthetic oligonucleotide
gaccccccagcagggagatgtctacat

SEQ ID NO: 53955 - DNA, 27 bp, Artificial Sequence
  Description of Artificial Sequence: Synthetic oligonucleotide
accccccagcagggagatgtctacatc

SEQ ID NO: 53956 - DNA, 27 bp, Artificial Sequence
  Description of Artificial Sequence: Synthetic oligonucleotide
ccccccagcagggagatgtctacatct

SEQ ID NO: 53957 - DNA, 27 bp, Artificial Sequence
  Description of Artificial Sequence: Synthetic oligonucleotide
cccccagcagggagatgtctacatctg

SEQ ID NO: 53958 - DNA, 27 bp, Artificial Sequence
  Description of Artificial Sequence: Synthetic oligonucleotide
ccccagcagggagatgtctacatctgc

SEQ ID NO: 53959 - DNA, 27 bp, Artificial Sequence
  Description of Artificial Sequence: Synthetic oligonucleotide
cccagcagggagatgtctacatctgcc

SEQ ID NO: 53960 - DNA, 29 bp, Artificial Sequence
  Description of Artificial Sequence: Synthetic oligonucleotide
ccagcagggagatgtctacatctgccaag

SEQ ID NO: 53961 - DNA, 30 bp, Artificial Sequence
  Description of Artificial Sequence: Synthetic oligonucleotide
cagcagggagatgtctacatctgccaagtg

SEQ ID NO: 53962 - DNA, 30 bp, Artificial Sequence
  Description of Artificial Sequence: Synthetic oligonucleotide
agcagggagatgtctacatctgccaagtgg

SEQ ID NO: 53963 - DNA, 29 bp, Artificial Sequence
  Description of Artificial Sequence: Synthetic oligonucleotide
gcagggagatgtctacatctgccaagtgg

SEQ ID NO: 53964 - DNA, 30 bp, Artificial Sequence
  Description of Artificial Sequence: Synthetic oligonucleotide
cagggagatgtctacatctgccaagtggag

SEQ ID NO: 53965 - DNA, 30 bp, Artificial Sequence
  Description of Artificial Sequence: Synthetic oligonucleotide
agggagatgtctacatctgccaagtggagc

SEQ ID NO: 53966 - DNA, 29 bp, Artificial Sequence
  Description of Artificial Sequence: Synthetic oligonucleotide
gggagatgtctacatctgccaagtggagc

SEQ ID NO: 53967 - DNA, 30 bp, Artificial Sequence
  Description of Artificial Sequence: Synthetic oligonucleotide
ggagatgtctacatctgccaagtggagcac

SEQ ID NO: 53968 - DNA, 31 bp, Artificial Sequence
  Description of Artificial Sequence: Synthetic oligonucleotide
gagatgtctacatctgccaagtggagcacac

SEQ ID NO: 53969 - DNA, 31 bp, Artificial Sequence
  Description of Artificial Sequence: Synthetic oligonucleotide
agatgtctacatctgccaagtggagcacacc

SEQ ID NO: 53970 - DNA, 30 bp, Artificial Sequence
  Description of Artificial Sequence: Synthetic oligonucleotide
gatgtctacatctgccaagtggagcacacc

SEQ ID NO: 53971 - DNA, 31 bp, Artificial Sequence
  Description of Artificial Sequence: Synthetic oligonucleotide
atgtctacatctgccaagtggagcacaccag

SEQ ID NO: 53972 - DNA, 30 bp, Artificial Sequence
  Description of Artificial Sequence: Synthetic oligonucleotide
tgtctacatctgccaagtggagcacaccag

SEQ ID NO: 53973 - DNA, 26 bp, Artificial Sequence
  Description of Artificial Sequence: Synthetic oligonucleotide
acagccagaaggacctcctggaggag

SEQ ID NO: 53974 - DNA, 25 bp, Artificial Sequence
  Description of Artificial Sequence: Synthetic oligonucleotide
cagccagaaggacctcctggaggag

SEQ ID NO: 53975 - DNA, 26 bp, Artificial Sequence
  Description of Artificial Sequence: Synthetic oligonucleotide
agccagaaggacctcctggaggagga

SEQ ID NO: 53976 - DNA, 25 bp, Artificial Sequence
  Description of Artificial Sequence: Synthetic oligonucleotide
gccagaaggacctcctggaggagga

SEQ ID NO: 53977 - DNA, 25 bp, Artificial Sequence
  Description of Artificial Sequence: Synthetic oligonucleotide
ccagaaggacctcctggaggaggag

SEQ ID NO: 53978 - DNA, 25 bp, Artificial Sequence
  Description of Artificial Sequence: Synthetic oligonucleotide
cagaaggacctcctggaggaggagc

SEQ ID NO: 53979 - DNA, 25 bp, Artificial Sequence
  Description of Artificial Sequence: Synthetic oligonucleotide
agaaggacctcctggaggaggagcg

SEQ ID NO: 53980 - DNA, 24 bp, Artificial Sequence
  Description of Artificial Sequence: Synthetic oligonucleotide
gaaggacctcctggaggaggagcg

SEQ ID NO: 53981 - DNA, 24 bp, Artificial Sequence
  Description of Artificial Sequence: Synthetic oligonucleotide
aaggacctcctggaggaggagcgg

SEQ ID NO: 53982 - DNA, 23 bp, Artificial Sequence
  Description of Artificial Sequence: Synthetic oligonucleotide
aggacctcctggaggaggagcgg

SEQ ID NO: 53983 - DNA, 22 bp, Artificial Sequence
  Description of Artificial Sequence: Synthetic oligonucleotide
ggacctcctggaggaggagcgg

SEQ ID NO: 53984 - DNA, 22 bp, Artificial Sequence
  Description of Artificial Sequence: Synthetic oligonucleotide
gacctcctggaggaggagcggg

SEQ ID NO: 53985 - DNA, 23 bp, Artificial Sequence
  Description of Artificial Sequence: Synthetic oligonucleotide
acctcctggaggaggagcgggca

SEQ ID NO: 53986 - DNA, 22 bp, Artificial Sequence
  Description of Artificial Sequence: Synthetic oligonucleotide
cctcctggaggaggagcgggca

SEQ ID NO: 53987 - DNA, 23 bp, Artificial Sequence
  Description of Artificial Sequence: Synthetic oligonucleotide
ctcctggaggaggagcgggcagt

SEQ ID NO: 53988 - DNA, 21 bp, Artificial Sequence
  Description of Artificial Sequence: Synthetic oligonucleotide
gagcgggcagtgccggacagg

SEQ ID NO: 53989 - DNA, 27 bp, Artificial Sequence
  Description of Artificial Sequence: Synthetic oligonucleotide
gcagggccactccagagaattacgtgc

SEQ ID NO: 53990 - DNA, 28 bp, Artificial Sequence
  Description of Artificial Sequence: Synthetic oligonucleotide
cagggccactccagagaattacgtgcac

SEQ ID NO: 53991 - DNA, 28 bp, Artificial Sequence
  Description of Artificial Sequence: Synthetic oligonucleotide
agggccactccagagaattacgtgcacc

SEQ ID NO: 53992 - DNA, 27 bp, Artificial Sequence
  Description of Artificial Sequence: Synthetic oligonucleotide
gggccactccagagaattacgtgcacc

SEQ ID NO: 53993 - DNA, 28 bp, Artificial Sequence
  Description of Artificial Sequence: Synthetic oligonucleotide
ggccactccagagaattacgtgcaccag

SEQ ID NO: 53994 - DNA, 31 bp, Artificial Sequence
  Description of Artificial Sequence: Synthetic oligonucleotide
gccactccagagaattacgtgcaccagttac

SEQ ID NO: 53995 - DNA, 31 bp, Artificial Sequence
  Description of Artificial Sequence: Synthetic oligonucleotide
ccactccagagaattacgtgcaccagttacg

SEQ ID NO: 53996 - DNA, 31 bp, Artificial Sequence
  Description of Artificial Sequence: Synthetic oligonucleotide
cactccagagaattacgtgcaccagttacgg

SEQ ID NO: 53997 - DNA, 31 bp, Artificial Sequence
  Description of Artificial Sequence: Synthetic oligonucleotide
actccagagaattacgtgcaccagttacggc

SEQ ID NO: 53998 - DNA, 30 bp, Artificial Sequence
  Description of Artificial Sequence: Synthetic oligonucleotide
ctccagagaattacgtgcaccagttacggc

SEQ ID NO: 53999 - DNA, 31 bp, Artificial Sequence
  Description of Artificial Sequence: Synthetic oligonucleotide
tccagagaattacgtgcaccagttacggcag

SEQ ID NO: 54000 - DNA, 30 bp, Artificial Sequence
  Description of Artificial Sequence: Synthetic oligonucleotide
ccagagaattacgtgcaccagttacggcag

SEQ ID NO: 54001 - DNA, 30 bp, Artificial Sequence
  Description of Artificial Sequence: Synthetic oligonucleotide
cagagaattacgtgcaccagttacggcagg

SEQ ID NO: 54002 - DNA, 33 bp, Artificial Sequence
  Description of Artificial Sequence: Synthetic oligonucleotide
agagaattacgtgcaccagttacggcaggaatg

SEQ ID NO: 54003 - DNA, 32 bp, Artificial Sequence
  Description of Artificial Sequence: Synthetic oligonucleotide
gagaattacgtgcaccagttacggcaggaatg

SEQ ID NO: 54004 - DNA, 32 bp, Artificial Sequence
  Description of Artificial Sequence: Synthetic oligonucleotide
agaattacgtgcaccagttacggcaggaatgc

SEQ ID NO: 54005 - DNA, 31 bp, Artificial Sequence
  Description of Artificial Sequence: Synthetic oligonucleotide
gaattacgtgcaccagttacggcaggaatgc

SEQ ID NO: 54006 - DNA, 33 bp, Artificial Sequence
  Description of Artificial Sequence: Synthetic oligonucleotide
aattacgtgcaccagttacggcaggaatgctac

SEQ ID NO: 54007 - DNA, 32 bp, Artificial Sequence
  Description of Artificial Sequence: Synthetic oligonucleotide
attacgtgcaccagttacggcaggaatgctac

SEQ ID NO: 54008 - DNA, 31 bp, Artificial Sequence
  Description of Artificial Sequence: Synthetic oligonucleotide
ttacgtgcaccagttacggcaggaatgctac

SEQ ID NO: 54009 - DNA, 30 bp, Artificial Sequence
  Description of Artificial Sequence: Synthetic oligonucleotide
tacgtgcaccagttacggcaggaatgctac

SEQ ID NO: 54010 - DNA, 29 bp, Artificial Sequence
  Description of Artificial Sequence: Synthetic oligonucleotide
acgtgcaccagttacggcaggaatgctac

SEQ ID NO: 54011 - DNA, 28 bp, Artificial Sequence
  Description of Artificial Sequence: Synthetic oligonucleotide
cgtgcaccagttacggcaggaatgctac

SEQ ID NO: 54012 - DNA, 28 bp, Artificial Sequence
  Description of Artificial Sequence: Synthetic oligonucleotide
gtgcaccagttacggcaggaatgctacg

SEQ ID NO: 54013 - DNA, 28 bp, Artificial Sequence
  Description of Artificial Sequence: Synthetic oligonucleotide
tgcaccagttacggcaggaatgctacgc

SEQ ID NO: 54014 - DNA, 27 bp, Artificial Sequence
  Description of Artificial Sequence: Synthetic oligonucleotide
gcaccagttacggcaggaatgctacgc

SEQ ID NO: 54015 - DNA, 27 bp, Artificial Sequence
  Description of Artificial Sequence: Synthetic oligonucleotide
caccagttacggcaggaatgctacgcg

SEQ ID NO: 54016 - DNA, 32 bp, Artificial Sequence
  Description of Artificial Sequence: Synthetic oligonucleotide
atgaggactactggaacagccagaaggacatc

SEQ ID NO: 54017 - DNA, 31 bp, Artificial Sequence
  Description of Artificial Sequence: Synthetic oligonucleotide
tgaggactactggaacagccagaaggacatc

SEQ ID NO: 54018 - DNA, 30 bp, Artificial Sequence
  Description of Artificial Sequence: Synthetic oligonucleotide
gaggactactggaacagccagaaggacatc

SEQ ID NO: 54019 - DNA, 30 bp, Artificial Sequence
  Description of Artificial Sequence: Synthetic oligonucleotide
aggactactggaacagccagaaggacatcc

SEQ ID NO: 54020 - DNA, 29 bp, Artificial Sequence
  Description of Artificial Sequence: Synthetic oligonucleotide
ggactactggaacagccagaaggacatcc

SEQ ID NO: 54021 - DNA, 30 bp, Artificial Sequence
  Description of Artificial Sequence: Synthetic oligonucleotide
gactactggaacagccagaaggacatcctg

SEQ ID NO: 54022 - DNA, 30 bp, Artificial Sequence
  Description of Artificial Sequence: Synthetic oligonucleotide
actactggaacagccagaaggacatcctgg

SEQ ID NO: 54023 - DNA, 29 bp, Artificial Sequence
  Description of Artificial Sequence: Synthetic oligonucleotide
ctactggaacagccagaaggacatcctgg

SEQ ID NO: 54024 - DNA, 22 bp, Artificial Sequence
  Description of Artificial Sequence: Synthetic oligonucleotide
gcggcctgaggcggagtactgg

SEQ ID NO: 54025 - DNA, 23 bp, Artificial Sequence
  Description of Artificial Sequence: Synthetic oligonucleotide
cggcctgaggcggagtactggca

SEQ ID NO: 54026 - DNA, 24 bp, Artificial Sequence
  Description of Artificial Sequence: Synthetic oligonucleotide
ggcctgaggcggagtactggcaca

SEQ ID NO: 54027 - DNA, 24 bp, Artificial Sequence
  Description of Artificial Sequence: Synthetic oligonucleotide
gcctgaggcggagtactggcacag

SEQ ID NO: 54028 - DNA, 24 bp, Artificial Sequence
  Description of Artificial Sequence: Synthetic oligonucleotide
cctgaggcggagtactggcacagc

SEQ ID NO: 54029 - DNA, 25 bp, Artificial Sequence
  Description of Artificial Sequence: Synthetic oligonucleotide
ctgaggcggagtactggcacagcca

SEQ ID NO: 54030 - DNA, 27 bp, Artificial Sequence
  Description of Artificial Sequence: Synthetic oligonucleotide
tgaggcggagtactggcacagccagaa

SEQ ID NO: 54031 - DNA, 26 bp, Artificial Sequence
  Description of Artificial Sequence: Synthetic oligonucleotide
gaggcggagtactggcacagccagaa

SEQ ID NO: 54032 - DNA, 26 bp, Artificial Sequence
  Description of Artificial Sequence: Synthetic oligonucleotide
aggcggagtactggcacagccagaag

SEQ ID NO: 54033 - DNA, 25 bp, Artificial Sequence
  Description of Artificial Sequence: Synthetic oligonucleotide
ggcggagtactggcacagccagaag

SEQ ID NO: 54034 - DNA, 26 bp, Artificial Sequence
  Description of Artificial Sequence: Synthetic oligonucleotide
gcggagtactggcacagccagaagga

SEQ ID NO: 54035 - DNA, 27 bp, Artificial Sequence
  Description of Artificial Sequence: Synthetic oligonucleotide
cggagtactggcacagccagaaggaca

SEQ ID NO: 54036 - DNA, 28 bp, Artificial Sequence
  Description of Artificial Sequence: Synthetic oligonucleotide
ggagtactggcacagccagaaggacatc

SEQ ID NO: 54037 - DNA, 28 bp, Artificial Sequence
  Description of Artificial Sequence: Synthetic oligonucleotide
gagtactggcacagccagaaggacatcc

SEQ ID NO: 54038 - DNA, 29 bp, Artificial Sequence
  Description of Artificial Sequence: Synthetic oligonucleotide
agtactggcacagccagaaggacatcctg

SEQ ID NO: 54039 - DNA, 28 bp, Artificial Sequence
  Description of Artificial Sequence: Synthetic oligonucleotide
gtactggcacagccagaaggacatcctg

SEQ ID NO: 54040 - DNA, 28 bp, Artificial Sequence
  Description of Artificial Sequence: Synthetic oligonucleotide
tactggcacagccagaaggacatcctgg

SEQ ID NO: 54041 - DNA, 27 bp, Artificial Sequence
  Description of Artificial Sequence: Synthetic oligonucleotide
actggcacagccagaaggacatcctgg

SEQ ID NO: 54042 - DNA, 27 bp, Artificial Sequence
  Description of Artificial Sequence: Synthetic oligonucleotide
ctggcacagccagaaggacatcctgga

SEQ ID NO: 54043 - DNA, 27 bp, Artificial Sequence
  Description of Artificial Sequence: Synthetic oligonucleotide
tggcacagccagaaggacatcctggag

SEQ ID NO: 54044 - DNA, 26 bp, Artificial Sequence
  Description of Artificial Sequence: Synthetic oligonucleotide
ggcacagccagaaggacatcctggag

SEQ ID NO: 54045 - DNA, 27 bp, Artificial Sequence
  Description of Artificial Sequence: Synthetic oligonucleotide
gcacagccagaaggacatcctggagga

SEQ ID NO: 54046 - DNA, 27 bp, Artificial Sequence
  Description of Artificial Sequence: Synthetic oligonucleotide
cacagccagaaggacatcctggaggag

SEQ ID NO: 54047 - DNA, 27 bp, Artificial Sequence
  Description of Artificial Sequence: Synthetic oligonucleotide
cggagtactggaacagccagaaggacc

SEQ ID NO: 54048 - DNA, 28 bp, Artificial Sequence
  Description of Artificial Sequence: Synthetic oligonucleotide
ggagtactggaacagccagaaggacctc

SEQ ID NO: 54049 - DNA, 28 bp, Artificial Sequence
  Description of Artificial Sequence: Synthetic oligonucleotide
gagtactggaacagccagaaggacctcc

SEQ ID NO: 54050 - DNA, 29 bp, Artificial Sequence
  Description of Artificial Sequence: Synthetic oligonucleotide
agtactggaacagccagaaggacctcctg

SEQ ID NO: 54051 - DNA, 28 bp, Artificial Sequence
  Description of Artificial Sequence: Synthetic oligonucleotide
gtactggaacagccagaaggacctcctg

SEQ ID NO: 54052 - DNA, 25 bp, Artificial Sequence
  Description of Artificial Sequence: Synthetic oligonucleotide
gagcgggcagtgccggacaggatat

SEQ ID NO: 54053 - DNA, 25 bp, Artificial Sequence
  Description of Artificial Sequence: Synthetic oligonucleotide
agcgggcagtgccggacaggatatg

SEQ ID NO: 54054 - DNA, 24 bp, Artificial Sequence
  Description of Artificial Sequence: Synthetic oligonucleotide
gcgggcagtgccggacaggatatg

SEQ ID NO: 54055 - DNA, 25 bp, Artificial Sequence
  Description of Artificial Sequence: Synthetic oligonucleotide
cgggcagtgccggacaggatatgca

SEQ ID NO: 54056 - DNA, 26 bp, Artificial Sequence
  Description of Artificial Sequence: Synthetic oligonucleotide
gggcagtgccggacaggatatgcaga

SEQ ID NO: 54057 - DNA, 27 bp, Artificial Sequence
  Description of Artificial Sequence: Synthetic oligonucleotide
ggcagtgccggacaggatatgcagaca

SEQ ID NO: 54058 - DNA, 27 bp, Artificial Sequence
  Description of Artificial Sequence: Synthetic oligonucleotide
gcagtgccggacaggatatgcagacac

SEQ ID NO: 54059 - DNA, 29 bp, Artificial Sequence
  Description of Artificial Sequence: Synthetic oligonucleotide
cagtgccggacaggatatgcagacacaac

SEQ ID NO: 54060 - DNA, 31 bp, Artificial Sequence
  Description of Artificial Sequence: Synthetic oligonucleotide
agtgccggacaggatatgcagacacaactac

SEQ ID NO: 54061 - DNA, 30 bp, Artificial Sequence
  Description of Artificial Sequence: Synthetic oligonucleotide
gtgccggacaggatatgcagacacaactac

SEQ ID NO: 54062 - DNA, 30 bp, Artificial Sequence
  Description of Artificial Sequence: Synthetic oligonucleotide
tgccggacaggatatgcagacacaactacg

SEQ ID NO: 54063 - DNA, 29 bp, Artificial Sequence
  Description of Artificial Sequence: Synthetic oligonucleotide
gccggacaggatatgcagacacaactacg

SEQ ID NO: 54064 - DNA, 30 bp, Artificial Sequence
  Description of Artificial Sequence: Synthetic oligonucleotide
ccggacaggatatgcagacacaactacgag

SEQ ID NO: 54065 - DNA, 30 bp, Artificial Sequence
  Description of Artificial Sequence: Synthetic oligonucleotide
cggacaggatatgcagacacaactacgagc

SEQ ID NO: 54066 - DNA, 31 bp, Artificial Sequence
  Description of Artificial Sequence: Synthetic oligonucleotide
ggacaggatatgcagacacaactacgagctg

SEQ ID NO: 54067 - DNA, 31 bp, Artificial Sequence
  Description of Artificial Sequence: Synthetic oligonucleotide
gacaggatatgcagacacaactacgagctgg

SEQ ID NO: 54068 - DNA, 32 bp, Artificial Sequence
  Description of Artificial Sequence: Synthetic oligonucleotide
acaggatatgcagacacaactacgagctggac

SEQ ID NO: 54069 - DNA, 31 bp, Artificial Sequence
  Description of Artificial Sequence: Synthetic oligonucleotide
caggatatgcagacacaactacgagctggac

SEQ ID NO: 54070 - DNA, 31 bp, Artificial Sequence
  Description of Artificial Sequence: Synthetic oligonucleotide
aggatatgcagacacaactacgagctggacg

SEQ ID NO: 54071 - DNA, 30 bp, Artificial Sequence
  Description of Artificial Sequence: Synthetic oligonucleotide
ggatatgcagacacaactacgagctggacg

SEQ ID NO: 54072 - DNA, 31 bp, Artificial Sequence
  Description of Artificial Sequence: Synthetic oligonucleotide
gatatgcagacacaactacgagctggacgag

SEQ ID NO: 54073 - DNA, 31 bp, Artificial Sequence
  Description of Artificial Sequence: Synthetic oligonucleotide
atatgcagacacaactacgagctggacgagg

SEQ ID NO: 54074 - DNA, 29 bp, Artificial Sequence
  Description of Artificial Sequence: Synthetic oligonucleotide
atgatggttctgcaggtttctgcagcccc

SEQ ID NO: 54075 - DNA, 28 bp, Artificial Sequence
  Description of Artificial Sequence: Synthetic oligonucleotide
tgatggttctgcaggtttctgcagcccc

SEQ ID NO: 54076 - DNA, 27 bp, Artificial Sequence
  Description of Artificial Sequence: Synthetic oligonucleotide
gatggttctgcaggtttctgcagcccc

SEQ ID NO: 54077 - DNA, 27 bp, Artificial Sequence
  Description of Artificial Sequence: Synthetic oligonucleotide
atggttctgcaggtttctgcagccccc

SEQ ID NO: 54078 - DNA, 26 bp, Artificial Sequence
  Description of Artificial Sequence: Synthetic oligonucleotide
tggttctgcaggtttctgcagccccc

SEQ ID NO: 54079 - DNA, 25 bp, Artificial Sequence
  Description of Artificial Sequence: Synthetic oligonucleotide
ggttctgcaggtttctgcagccccc

SEQ ID NO: 54080 - DNA, 25 bp, Artificial Sequence
  Description of Artificial Sequence: Synthetic oligonucleotide
gttctgcaggtttctgcagcccccc

SEQ ID NO: 54081 - DNA, 25 bp, Artificial Sequence
  Description of Artificial Sequence: Synthetic oligonucleotide
ttctgcaggtttctgcagccccccg

SEQ ID NO: 54082 - DNA, 24 bp, Artificial Sequence
  Description of Artificial Sequence: Synthetic oligonucleotide
tctgcaggtttctgcagccccccg

SEQ ID NO: 54083 - DNA, 23 bp, Artificial Sequence
  Description of Artificial Sequence: Synthetic oligonucleotide
ctgcaggtttctgcagccccccg

SEQ ID NO: 54084 - DNA, 24 bp, Artificial Sequence
  Description of Artificial Sequence: Synthetic oligonucleotide
tgcaggtttctgcagccccccgga

SEQ ID NO: 54085 - DNA, 23 bp, Artificial Sequence
  Description of Artificial Sequence: Synthetic oligonucleotide
gcaggtttctgcagccccccgga

SEQ ID NO: 54086 - DNA, 24 bp, Artificial Sequence
  Description of Artificial Sequence: Synthetic oligonucleotide
caggtttctgcagccccccggaca

SEQ ID NO: 54087 - DNA, 25 bp, Artificial Sequence
  Description of Artificial Sequence: Synthetic oligonucleotide
aggtttctgcagccccccggacagt

SEQ ID NO: 54088 - DNA, 24 bp, Artificial Sequence
  Description of Artificial Sequence: Synthetic oligonucleotide
ggtttctgcagccccccggacagt

SEQ ID NO: 54089 - DNA, 24 bp, Artificial Sequence
  Description of Artificial Sequence: Synthetic oligonucleotide
gtttctgcagccccccggacagtg

SEQ ID NO: 54090 - DNA, 24 bp, Artificial Sequence
  Description of Artificial Sequence: Synthetic oligonucleotide
tttctgcagccccccggacagtgg

SEQ ID NO: 54091 - DNA, 23 bp, Artificial Sequence
  Description of Artificial Sequence: Synthetic oligonucleotide
ttctgcagccccccggacagtgg

SEQ ID NO: 54092 - DNA, 22 bp, Artificial Sequence
  Description of Artificial Sequence: Synthetic oligonucleotide
tctgcagccccccggacagtgg

SEQ ID NO: 54093 - DNA, 21 bp, Artificial Sequence
  Description of Artificial Sequence: Synthetic oligonucleotide
ctgcagccccccggacagtgg

SEQ ID NO: 54094 - DNA, 22 bp, Artificial Sequence
  Description of Artificial Sequence: Synthetic oligonucleotide
tgcagccccccggacagtggct

SEQ ID NO: 54095 - DNA, 21 bp, Artificial Sequence
  Description of Artificial Sequence: Synthetic oligonucleotide
gcagccccccggacagtggct

SEQ ID NO: 54096 - DNA, 22 bp, Artificial Sequence
  Description of Artificial Sequence: Synthetic oligonucleotide
cagccccccggacagtggctct

SEQ ID NO: 54097 - DNA, 24 bp, Artificial Sequence
  Description of Artificial Sequence: Synthetic oligonucleotide
agccccccggacagtggctctgat

SEQ ID NO: 54098 - DNA, 23 bp, Artificial Sequence
  Description of Artificial Sequence: Synthetic oligonucleotide
gccccccggacagtggctctgat

SEQ ID NO: 54099 - DNA, 23 bp, Artificial Sequence
  Description of Artificial Sequence: Synthetic oligonucleotide
ccccccggacagtggctctgatg

SEQ ID NO: 54100 - DNA, 23 bp, Artificial Sequence
  Description of Artificial Sequence: Synthetic oligonucleotide
cccccggacagtggctctgatgg

SEQ ID NO: 54101 - DNA, 23 bp, Artificial Sequence
  Description of Artificial Sequence: Synthetic oligonucleotide
ccccggacagtggctctgatggc

SEQ ID NO: 54102 - DNA, 26 bp, Artificial Sequence
  Description of Artificial Sequence: Synthetic oligonucleotide
cccggacagtggctctgatggcgtta

SEQ ID NO: 54103 - DNA, 27 bp, Artificial Sequence
  Description of Artificial Sequence: Synthetic oligonucleotide
ccggacagtggctctgatggcgttact

SEQ ID NO: 54104 - DNA, 27 bp, Artificial Sequence
  Description of Artificial Sequence: Synthetic oligonucleotide
cggacagtggctctgatggcgttactg

SEQ ID NO: 54105 - DNA, 29 bp, Artificial Sequence
  Description of Artificial Sequence: Synthetic oligonucleotide
ggacagtggctctgatggcgttactgatg

SEQ ID NO: 54106 - DNA, 29 bp, Artificial Sequence
  Description of Artificial Sequence: Synthetic oligonucleotide
gacagtggctctgatggcgttactgatgg

SEQ ID NO: 54107 - DNA, 30 bp, Artificial Sequence
  Description of Artificial Sequence: Synthetic oligonucleotide
acagtggctctgatggcgttactgatggtg

SEQ ID NO: 54108 - DNA, 29 bp, Artificial Sequence
  Description of Artificial Sequence: Synthetic oligonucleotide
cagtggctctgatggcgttactgatggtg

SEQ ID NO: 54109 - DNA, 29 bp, Artificial Sequence
  Description of Artificial Sequence: Synthetic oligonucleotide
agtggctctgatggcgttactgatggtgc

SEQ ID NO: 54110 - DNA, 28 bp, Artificial Sequence
  Description of Artificial Sequence: Synthetic oligonucleotide
gtggctctgatggcgttactgatggtgc

SEQ ID NO: 54111 - DNA, 29 bp, Artificial Sequence
  Description of Artificial Sequence: Synthetic oligonucleotide
tggctctgatggcgttactgatggtgctg

SEQ ID NO: 54112 - DNA, 28 bp, Artificial Sequence
  Description of Artificial Sequence: Synthetic oligonucleotide
ggctctgatggcgttactgatggtgctg

SEQ ID NO: 54113 - DNA, 28 bp, Artificial Sequence
  Description of Artificial Sequence: Synthetic oligonucleotide
gctctgatggcgttactgatggtgctgc

SEQ ID NO: 54114 - DNA, 29 bp, Artificial Sequence
  Description of Artificial Sequence: Synthetic oligonucleotide
ctctgatggcgttactgatggtgctgctc

SEQ ID NO: 54115 - DNA, 30 bp, Artificial Sequence
  Description of Artificial Sequence: Synthetic oligonucleotide
tctgatggcgttactgatggtgctgctcac

SEQ ID NO: 54116 - DNA, 29 bp, Artificial Sequence
  Description of Artificial Sequence: Synthetic oligonucleotide
ctgatggcgttactgatggtgctgctcac

SEQ ID NO: 54117 - DNA, 31 bp, Artificial Sequence
  Description of Artificial Sequence: Synthetic oligonucleotide
tgatggcgttactgatggtgctgctcacatc

SEQ ID NO: 54118 - DNA, 30 bp, Artificial Sequence
  Description of Artificial Sequence: Synthetic oligonucleotide
gatggcgttactgatggtgctgctcacatc

SEQ ID NO: 54119 - DNA, 31 bp, Artificial Sequence
  Description of Artificial Sequence: Synthetic oligonucleotide
atggcgttactgatggtgctgctcacatctg

SEQ ID NO: 54120 - DNA, 30 bp, Artificial Sequence
  Description of Artificial Sequence: Synthetic oligonucleotide
tggcgttactgatggtgctgctcacatctg

SEQ ID NO: 54121 - DNA, 31 bp, Artificial Sequence
  Description of Artificial Sequence: Synthetic oligonucleotide
agcgcttcctggagagatacatctacaaccc

SEQ ID NO: 54122 - DNA, 30 bp, Artificial Sequence
  Description of Artificial Sequence: Synthetic oligonucleotide
gcgcttcctggagagatacatctacaaccc

SEQ ID NO: 54123 - DNA, 30 bp, Artificial Sequence
  Description of Artificial Sequence: Synthetic oligonucleotide
cgcttcctggagagatacatctacaacccg

SEQ ID NO: 54124 - DNA, 30 bp, Artificial Sequence
  Description of Artificial Sequence: Synthetic oligonucleotide
gcttcctggagagatacatctacaacccgg

SEQ ID NO: 54125 - DNA, 31 bp, Artificial Sequence
  Description of Artificial Sequence: Synthetic oligonucleotide
cttcctggagagatacatctacaacccggag

SEQ ID NO: 54126 - DNA, 31 bp, Artificial Sequence
  Description of Artificial Sequence: Synthetic oligonucleotide
ttcctggagagatacatctacaacccggagg

SEQ ID NO: 54127 - DNA, 30 bp, Artificial Sequence
  Description of Artificial Sequence: Synthetic oligonucleotide
tcctggagagatacatctacaacccggagg

SEQ ID NO: 54128 - DNA, 29 bp, Artificial Sequence
  Description of Artificial Sequence: Synthetic oligonucleotide
cctggagagatacatctacaacccggagg

SEQ ID NO: 54129 - DNA, 30 bp, Artificial Sequence
  Description of Artificial Sequence: Synthetic oligonucleotide
ctggagagatacatctacaacccggaggag

SEQ ID NO: 54130 - DNA, 32 bp, Artificial Sequence
  Description of Artificial Sequence: Synthetic oligonucleotide
tggagagatacatctacaacccggaggagttc

SEQ ID NO: 54131 - DNA, 31 bp, Artificial Sequence
  Description of Artificial Sequence: Synthetic oligonucleotide
ggagagatacatctacaacccggaggagttc

SEQ ID NO: 54132 - DNA, 31 bp, Artificial Sequence
  Description of Artificial Sequence: Synthetic oligonucleotide
gagagatacatctacaacccggaggagttcg

SEQ ID NO: 54133 - DNA, 32 bp, Artificial Sequence
  Description of Artificial Sequence: Synthetic oligonucleotide
agagatacatctacaacccggaggagttcgtg

SEQ ID NO: 54134 - DNA, 31 bp, Artificial Sequence
  Description of Artificial Sequence: Synthetic oligonucleotide
gagatacatctacaacccggaggagttcgtg

SEQ ID NO: 54135 - DNA, 31 bp, Artificial Sequence
  Description of Artificial Sequence: Synthetic oligonucleotide
agatacatctacaacccggaggagttcgtgc

SEQ ID NO: 54136 - DNA, 30 bp, Artificial Sequence
  Description of Artificial Sequence: Synthetic oligonucleotide
gatacatctacaacccggaggagttcgtgc

SEQ ID NO: 54137 - DNA, 30 bp, Artificial Sequence
  Description of Artificial Sequence: Synthetic oligonucleotide
atacatctacaacccggaggagttcgtgcg

SEQ ID NO: 54138 - DNA, 29 bp, Artificial Sequence
  Description of Artificial Sequence: Synthetic oligonucleotide
tacatctacaacccggaggagttcgtgcg

SEQ ID NO: 54139 - DNA, 28 bp, Artificial Sequence
  Description of Artificial Sequence: Synthetic oligonucleotide
acatctacaacccggaggagttcgtgcg

SEQ ID NO: 54140 - DNA, 27 bp, Artificial Sequence
  Description of Artificial Sequence: Synthetic oligonucleotide
catctacaacccggaggagttcgtgcg

SEQ ID NO: 54141 - DNA, 27 bp, Artificial Sequence
  Description of Artificial Sequence: Synthetic oligonucleotide
atctacaacccggaggagttcgtgcgc

SEQ ID NO: 54142 - DNA, 27 bp, Artificial Sequence
  Description of Artificial Sequence: Synthetic oligonucleotide
tctacaacccggaggagttcgtgcgct

SEQ ID NO: 54143 - DNA, 27 bp, Artificial Sequence
  Description of Artificial Sequence: Synthetic oligonucleotide
ctacaacccggaggagttcgtgcgctt

SEQ ID NO: 54144 - DNA, 27 bp, Artificial Sequence
  Description of Artificial Sequence: Synthetic oligonucleotide
tacaacccggaggagttcgtgcgcttc

SEQ ID NO: 54145 - DNA, 26 bp, Artificial Sequence
  Description of Artificial Sequence: Synthetic oligonucleotide
acaacccggaggagttcgtgcgcttc

SEQ ID NO: 54146 - DNA, 25 bp, Artificial Sequence
  Description of Artificial Sequence: Synthetic oligonucleotide
caacccggaggagttcgtgcgcttc

SEQ ID NO: 54147 - DNA, 26 bp, Artificial Sequence
  Description of Artificial Sequence: Synthetic oligonucleotide
aacccggaggagttcgtgcgcttcga

SEQ ID NO: 54148 - DNA, 25 bp, Artificial Sequence
  Description of Artificial Sequence: Synthetic oligonucleotide
acccggaggagttcgtgcgcttcga

SEQ ID NO: 54149 - DNA, 24 bp, Artificial Sequence
  Description of Artificial Sequence: Synthetic oligonucleotide
cccggaggagttcgtgcgcttcga

SEQ ID NO: 54150 - DNA, 25 bp, Artificial Sequence
  Description of Artificial Sequence: Synthetic oligonucleotide
ccggaggagttcgtgcgcttcgaca

SEQ ID NO: 54151 - DNA, 25 bp, Artificial Sequence
  Description of Artificial Sequence: Synthetic oligonucleotide
cggaggagttcgtgcgcttcgacag

SEQ ID NO: 54152 - DNA, 29 bp, Artificial Sequence
  Description of Artificial Sequence: Synthetic oligonucleotide
cttttccagggacggcaggaatgctacac

SEQ ID NO: 54153 - DNA, 29 bp, Artificial Sequence
  Description of Artificial Sequence: Synthetic oligonucleotide
ttttccagggacggcaggaatgctacacg

SEQ ID NO: 54154 - DNA, 28 bp, Artificial Sequence
  Description of Artificial Sequence: Synthetic oligonucleotide
tttccagggacggcaggaatgctacacg

SEQ ID NO: 54155 - DNA, 27 bp, Artificial Sequence
  Description of Artificial Sequence: Synthetic oligonucleotide
ttccagggacggcaggaatgctacacg

SEQ ID NO: 54156 - DNA, 27 bp, Artificial Sequence
  Description of Artificial Sequence: Synthetic oligonucleotide
tccagggacggcaggaatgctacacgt

SEQ ID NO: 54157 - DNA, 27 bp, Artificial Sequence
  Description of Artificial Sequence: Synthetic oligonucleotide
ccagggacggcaggaatgctacacgtt

SEQ ID NO: 54158 - DNA, 31 bp, Artificial Sequence
  Description of Artificial Sequence: Synthetic oligonucleotide
cagggacggcaggaatgctacacgtttaatg

SEQ ID NO: 54159 - DNA, 31 bp, Artificial Sequence
  Description of Artificial Sequence: Synthetic oligonucleotide
agggacggcaggaatgctacacgtttaatgg

SEQ ID NO: 54160 - DNA, 30 bp, Artificial Sequence
  Description of Artificial Sequence: Synthetic oligonucleotide
gggacggcaggaatgctacacgtttaatgg

SEQ ID NO: 54161 - DNA, 30 bp, Artificial Sequence
  Description of Artificial Sequence: Synthetic oligonucleotide
ggacggcaggaatgctacacgtttaatggg

SEQ ID NO: 54162 - DNA, 31 bp, Artificial Sequence
  Description of Artificial Sequence: Synthetic oligonucleotide
gacggcaggaatgctacacgtttaatgggac

SEQ ID NO: 54163 - DNA, 32 bp, Artificial Sequence
  Description of Artificial Sequence: Synthetic oligonucleotide
acggcaggaatgctacacgtttaatgggacac

SEQ ID NO: 54164 - DNA, 31 bp, Artificial Sequence
  Description of Artificial Sequence: Synthetic oligonucleotide
cggcaggaatgctacacgtttaatgggacac

SEQ ID NO: 54165 - DNA, 32 bp, Artificial Sequence
  Description of Artificial Sequence: Synthetic oligonucleotide
ggcaggaatgctacacgtttaatgggacacag

SEQ ID NO: 54166 - DNA, 32 bp, Artificial Sequence
  Description of Artificial Sequence: Synthetic oligonucleotide
gcaggaatgctacacgtttaatgggacacagc

SEQ ID NO: 54167 - DNA, 32 bp, Artificial Sequence
  Description of Artificial Sequence: Synthetic oligonucleotide
caggaatgctacacgtttaatgggacacagcg

SEQ ID NO: 54168 - DNA, 32 bp, Artificial Sequence
  Description of Artificial Sequence: Synthetic oligonucleotide
aggaatgctacacgtttaatgggacacagcgc

SEQ ID NO: 54169 - DNA, 31 bp, Artificial Sequence
  Description of Artificial Sequence: Synthetic oligonucleotide
ggaatgctacacgtttaatgggacacagcgc

SEQ ID NO: 54170 - DNA, 33 bp, Artificial Sequence
  Description of Artificial Sequence: Synthetic oligonucleotide
gaatgctacacgtttaatgggacacagcgcttc

SEQ ID NO: 54171 - DNA, 33 bp, Artificial Sequence
  Description of Artificial Sequence: Synthetic oligonucleotide
aatgctacacgtttaatgggacacagcgcttcc

SEQ ID NO: 54172 - DNA, 32 bp, Artificial Sequence
  Description of Artificial Sequence: Synthetic oligonucleotide
atgctacacgtttaatgggacacagcgcttcc

SEQ ID NO: 54173 - DNA, 31 bp, Artificial Sequence
  Description of Artificial Sequence: Synthetic oligonucleotide
tgctacacgtttaatgggacacagcgcttcc

SEQ ID NO: 54174 - DNA, 30 bp, Artificial Sequence
  Description of Artificial Sequence: Synthetic oligonucleotide
gctacacgtttaatgggacacagcgcttcc

SEQ ID NO: 54175 - DNA, 31 bp, Artificial Sequence
  Description of Artificial Sequence: Synthetic oligonucleotide
ctacacgtttaatgggacacagcgcttcctg

SEQ ID NO: 54176 - DNA, 31 bp, Artificial Sequence
  Description of Artificial Sequence: Synthetic oligonucleotide
tacacgtttaatgggacacagcgcttcctgg

SEQ ID NO: 54177 - DNA, 30 bp, Artificial Sequence
  Description of Artificial Sequence: Synthetic oligonucleotide
acacgtttaatgggacacagcgcttcctgg

SEQ ID NO: 54178 - DNA, 29 bp, Artificial Sequence
  Description of Artificial Sequence: Synthetic oligonucleotide
cacgtttaatgggacacagcgcttcctgg

SEQ ID NO: 54179 - DNA, 30 bp, Artificial Sequence
  Description of Artificial Sequence: Synthetic oligonucleotide
acgtttaatgggacacagcgcttcctggag

SEQ ID NO: 54180 - DNA, 32 bp, Artificial Sequence
  Description of Artificial Sequence: Synthetic oligonucleotide
tggagagatacatctacaacccggaggagtac

SEQ ID NO: 54181 - DNA, 31 bp, Artificial Sequence
  Description of Artificial Sequence: Synthetic oligonucleotide
ggagagatacatctacaacccggaggagtac

SEQ ID NO: 54182 - DNA, 31 bp, Artificial Sequence
  Description of Artificial Sequence: Synthetic oligonucleotide
gagagatacatctacaacccggaggagtacg

SEQ ID NO: 54183 - DNA, 31 bp, Artificial Sequence
  Description of Artificial Sequence: Synthetic oligonucleotide
agagatacatctacaacccggaggagtacgc

SEQ ID NO: 54184 - DNA, 30 bp, Artificial Sequence
  Description of Artificial Sequence: Synthetic oligonucleotide
gagatacatctacaacccggaggagtacgc

SEQ ID NO: 54185 - DNA, 30 bp, Artificial Sequence
  Description of Artificial Sequence: Synthetic oligonucleotide
agatacatctacaacccggaggagtacgcg

SEQ ID NO: 54186 - DNA, 29 bp, Artificial Sequence
  Description of Artificial Sequence: Synthetic oligonucleotide
gatacatctacaacccggaggagtacgcg

SEQ ID NO: 54187 - DNA, 29 bp, Artificial Sequence
  Description of Artificial Sequence: Synthetic oligonucleotide
atacatctacaacccggaggagtacgcgc

SEQ ID NO: 54188 - DNA, 28 bp, Artificial Sequence
  Description of Artificial Sequence: Synthetic oligonucleotide
tacatctacaacccggaggagtacgcgc

SEQ ID NO: 54189 - DNA, 27 bp, Artificial Sequence
  Description of Artificial Sequence: Synthetic oligonucleotide
acatctacaacccggaggagtacgcgc

SEQ ID NO: 54190 - DNA, 26 bp, Artificial Sequence
  Description of Artificial Sequence: Synthetic oligonucleotide
catctacaacccggaggagtacgcgc

SEQ ID NO: 54191 - DNA, 26 bp, Artificial Sequence
  Description of Artificial Sequence: Synthetic oligonucleotide
atctacaacccggaggagtacgcgcg

SEQ ID NO: 54192 - DNA, 25 bp, Artificial Sequence
  Description of Artificial Sequence: Synthetic oligonucleotide
tctacaacccggaggagtacgcgcg

SEQ ID NO: 54193 - DNA, 24 bp, Artificial Sequence
  Description of Artificial Sequence: Synthetic oligonucleotide
ctacaacccggaggagtacgcgcg

SEQ ID NO: 54194 - DNA, 26 bp, Artificial Sequence
  Description of Artificial Sequence: Synthetic oligonucleotide
tacaacccggaggagtacgcgcgctt

SEQ ID NO: 54195 - DNA, 25 bp, Artificial Sequence
  Description of Artificial Sequence: Synthetic oligonucleotide
acaacccggaggagtacgcgcgctt

SEQ ID NO: 54196 - DNA, 24 bp, Artificial Sequence
  Description of Artificial Sequence: Synthetic oligonucleotide
caacccggaggagtacgcgcgctt

SEQ ID NO: 54197 - DNA, 24 bp, Artificial Sequence
  Description of Artificial Sequence: Synthetic oligonucleotide
aacccggaggagtacgcgcgcttc

SEQ ID NO: 54198 - DNA, 23 bp, Artificial Sequence
  Description of Artificial Sequence: Synthetic oligonucleotide
acccggaggagtacgcgcgcttc

SEQ ID NO: 54199 - DNA, 22 bp, Artificial Sequence
  Description of Artificial Sequence: Synthetic oligonucleotide
cccggaggagtacgcgcgcttc

SEQ ID NO: 54200 - DNA, 23 bp, Artificial Sequence
  Description of Artificial Sequence: Synthetic oligonucleotide
ccggaggagtacgcgcgcttcga

SEQ ID NO: 54201 - DNA, 24 bp, Artificial Sequence
  Description of Artificial Sequence: Synthetic oligonucleotide
cggaggagtacgcgcgcttcgaca

SEQ ID NO: 54202 - DNA, 32 bp, Artificial Sequence
  Description of Artificial Sequence: Synthetic oligonucleotide
acagggtatgcagacacaactacgagctgaac

SEQ ID NO: 54203 - DNA, 31 bp, Artificial Sequence
  Description of Artificial Sequence: Synthetic oligonucleotide
cagggtatgcagacacaactacgagctgaac

SEQ ID NO: 54204 - DNA, 31 bp, Artificial Sequence
  Description of Artificial Sequence: Synthetic oligonucleotide
agggtatgcagacacaactacgagctgaacg

SEQ ID NO: 54205 - DNA, 30 bp, Artificial Sequence
  Description of Artificial Sequence: Synthetic oligonucleotide
gggtatgcagacacaactacgagctgaacg

SEQ ID NO: 54206 - DNA, 31 bp, Artificial Sequence
  Description of Artificial Sequence: Synthetic oligonucleotide
ggtatgcagacacaactacgagctgaacgag

SEQ ID NO: 54207 - DNA, 31 bp, Artificial Sequence
  Description of Artificial Sequence: Synthetic oligonucleotide
gtatgcagacacaactacgagctgaacgagg

SEQ ID NO: 54208 - DNA, 31 bp, Artificial Sequence
  Description of Artificial Sequence: Synthetic oligonucleotide
tatgcagacacaactacgagctgaacgaggc

SEQ ID NO: 54209 - DNA, 30 bp, Artificial Sequence
  Description of Artificial Sequence: Synthetic oligonucleotide
atgcagacacaactacgagctgaacgaggc

SEQ ID NO: 54210 - DNA, 29 bp, Artificial Sequence
  Description of Artificial Sequence: Synthetic oligonucleotide
tgcagacacaactacgagctgaacgaggc

SEQ ID NO: 54211 - DNA, 28 bp, Artificial Sequence
  Description of Artificial Sequence: Synthetic oligonucleotide
gcagacacaactacgagctgaacgaggc

SEQ ID NO: 54212 - DNA, 28 bp, Artificial Sequence
  Description of Artificial Sequence: Synthetic oligonucleotide
cagacacaactacgagctgaacgaggcc

SEQ ID NO: 54213 - DNA, 28 bp, Artificial Sequence
  Description of Artificial Sequence: Synthetic oligonucleotide
agacacaactacgagctgaacgaggccg

SEQ ID NO: 54214 - DNA, 27 bp, Artificial Sequence
  Description of Artificial Sequence: Synthetic oligonucleotide
gacacaactacgagctgaacgaggccg

SEQ ID NO: 54215 - DNA, 28 bp, Artificial Sequence
  Description of Artificial Sequence: Synthetic oligonucleotide
acacaactacgagctgaacgaggccgtg

SEQ ID NO: 54216 - DNA, 27 bp, Artificial Sequence
  Description of Artificial Sequence: Synthetic oligonucleotide
cacaactacgagctgaacgaggccgtg

SEQ ID NO: 54217 - DNA, 28 bp, Artificial Sequence
  Description of Artificial Sequence: Synthetic oligonucleotide
acaactacgagctgaacgaggccgtgac

SEQ ID NO: 54218 - DNA, 27 bp, Artificial Sequence
  Description of Artificial Sequence: Synthetic oligonucleotide
caactacgagctgaacgaggccgtgac

SEQ ID NO: 54219 - DNA, 27 bp, Artificial Sequence
  Description of Artificial Sequence: Synthetic oligonucleotide
aactacgagctgaacgaggccgtgacc

SEQ ID NO: 54220 - DNA, 26 bp, Artificial Sequence
  Description of Artificial Sequence: Synthetic oligonucleotide
actacgagctgaacgaggccgtgacc

SEQ ID NO: 54221 - DNA, 25 bp, Artificial Sequence
  Description of Artificial Sequence: Synthetic oligonucleotide
ctacgagctgaacgaggccgtgacc

SEQ ID NO: 54222 - DNA, 26 bp, Artificial Sequence
  Description of Artificial Sequence: Synthetic oligonucleotide
tacgagctgaacgaggccgtgaccct

SEQ ID NO: 54223 - DNA, 25 bp, Artificial Sequence
  Description of Artificial Sequence: Synthetic oligonucleotide
acgagctgaacgaggccgtgaccct

SEQ ID NO: 54224 - DNA, 24 bp, Artificial Sequence
  Description of Artificial Sequence: Synthetic oligonucleotide
cgagctgaacgaggccgtgaccct

SEQ ID NO: 54225 - DNA, 24 bp, Artificial Sequence
  Description of Artificial Sequence: Synthetic oligonucleotide
gagctgaacgaggccgtgaccctg

SEQ ID NO: 54226 - DNA, 25 bp, Artificial Sequence
  Description of Artificial Sequence: Synthetic oligonucleotide
agctgaacgaggccgtgaccctgca

SEQ ID NO: 54227 - DNA, 24 bp, Artificial Sequence
  Description of Artificial Sequence: Synthetic oligonucleotide
gctgaacgaggccgtgaccctgca

SEQ ID NO: 54228 - DNA, 24 bp, Artificial Sequence
  Description of Artificial Sequence: Synthetic oligonucleotide
ctgaacgaggccgtgaccctgcag

SEQ ID NO: 54229 - DNA, 24 bp, Artificial Sequence
  Description of Artificial Sequence: Synthetic oligonucleotide
tgaacgaggccgtgaccctgcagc

SEQ ID NO: 54230 - DNA, 23 bp, Artificial Sequence
  Description of Artificial Sequence: Synthetic oligonucleotide
gaacgaggccgtgaccctgcagc

SEQ ID NO: 54231 - DNA, 23 bp, Artificial Sequence
  Description of Artificial Sequence: Synthetic oligonucleotide
aacgaggccgtgaccctgcagcg

SEQ ID NO: 54232 - DNA, 30 bp, Artificial Sequence
  Description of Artificial Sequence: Synthetic oligonucleotide
gcttcctggagagatacatctacaaccggc

SEQ ID NO: 54233 - DNA, 31 bp, Artificial Sequence
  Description of Artificial Sequence: Synthetic oligonucleotide
cttcctggagagatacatctacaaccggcag

SEQ ID NO: 54234 - DNA, 31 bp, Artificial Sequence
  Description of Artificial Sequence: Synthetic oligonucleotide
ttcctggagagatacatctacaaccggcagg

SEQ ID NO: 54235 - DNA, 30 bp, Artificial Sequence
  Description of Artificial Sequence: Synthetic oligonucleotide
tcctggagagatacatctacaaccggcagg

SEQ ID NO: 54236 - DNA, 29 bp, Artificial Sequence
  Description of Artificial Sequence: Synthetic oligonucleotide
cctggagagatacatctacaaccggcagg

SEQ ID NO: 54237 - DNA, 30 bp, Artificial Sequence
  Description of Artificial Sequence: Synthetic oligonucleotide
ctggagagatacatctacaaccggcaggag

SEQ ID NO: 54238 - DNA, 32 bp, Artificial Sequence
  Description of Artificial Sequence: Synthetic oligonucleotide
tggagagatacatctacaaccggcaggagtac

SEQ ID NO: 54239 - DNA, 31 bp, Artificial Sequence
  Description of Artificial Sequence: Synthetic oligonucleotide
ggagagatacatctacaaccggcaggagtac

SEQ ID NO: 54240 - DNA, 31 bp, Artificial Sequence
  Description of Artificial Sequence: Synthetic oligonucleotide
gagagatacatctacaaccggcaggagtacg

SEQ ID NO: 54241 - DNA, 31 bp, Artificial Sequence
  Description of Artificial Sequence: Synthetic oligonucleotide
agagatacatctacaaccggcaggagtacgc

SEQ ID NO: 54242 - DNA, 30 bp, Artificial Sequence
  Description of Artificial Sequence: Synthetic oligonucleotide
gagatacatctacaaccggcaggagtacgc

SEQ ID NO: 54243 - DNA, 30 bp, Artificial Sequence
  Description of Artificial Sequence: Synthetic oligonucleotide
agatacatctacaaccggcaggagtacgcg

SEQ ID NO: 54244 - DNA, 29 bp, Artificial Sequence
  Description of Artificial Sequence: Synthetic oligonucleotide
gatacatctacaaccggcaggagtacgcg

SEQ ID NO: 54245 - DNA, 29 bp, Artificial Sequence
  Description of Artificial Sequence: Synthetic oligonucleotide
atacatctacaaccggcaggagtacgcgc

SEQ ID NO: 54246 - DNA, 28 bp, Artificial Sequence
  Description of Artificial Sequence: Synthetic oligonucleotide
tacatctacaaccggcaggagtacgcgc

SEQ ID NO: 54247 - DNA, 27 bp, Artificial Sequence
  Description of Artificial Sequence: Synthetic oligonucleotide
acatctacaaccggcaggagtacgcgc

SEQ ID NO: 54248 - DNA, 26 bp, Artificial Sequence
  Description of Artificial Sequence: Synthetic oligonucleotide
catctacaaccggcaggagtacgcgc

SEQ ID NO: 54249 - DNA, 26 bp, Artificial Sequence
  Description of Artificial Sequence: Synthetic oligonucleotide
atctacaaccggcaggagtacgcgcg

SEQ ID NO: 54250 - DNA, 25 bp, Artificial Sequence
  Description of Artificial Sequence: Synthetic oligonucleotide
tctacaaccggcaggagtacgcgcg

SEQ ID NO: 54251 - DNA, 24 bp, Artificial Sequence
  Description of Artificial Sequence: Synthetic oligonucleotide
ctacaaccggcaggagtacgcgcg

SEQ ID NO: 54252 - DNA, 26 bp, Artificial Sequence
  Description of Artificial Sequence: Synthetic oligonucleotide
tacaaccggcaggagtacgcgcgctt

SEQ ID NO: 54253 - DNA, 25 bp, Artificial Sequence
  Description of Artificial Sequence: Synthetic oligonucleotide
acaaccggcaggagtacgcgcgctt

SEQ ID NO: 54254 - DNA, 24 bp, Artificial Sequence
  Description of Artificial Sequence: Synthetic oligonucleotide
caaccggcaggagtacgcgcgctt

SEQ ID NO: 54255 - DNA, 24 bp, Artificial Sequence
  Description of Artificial Sequence: Synthetic oligonucleotide
aaccggcaggagtacgcgcgcttc

SEQ ID NO: 54256 - DNA, 23 bp, Artificial Sequence
  Description of Artificial Sequence: Synthetic oligonucleotide
accggcaggagtacgcgcgcttc

SEQ ID NO: 54257 - DNA, 22 bp, Artificial Sequence
  Description of Artificial Sequence: Synthetic oligonucleotide
ccggcaggagtacgcgcgcttc

SEQ ID NO: 54258 - DNA, 23 bp, Artificial Sequence
  Description of Artificial Sequence: Synthetic oligonucleotide
cggcaggagtacgcgcgcttcga

SEQ ID NO: 54259 - DNA, 24 bp, Artificial Sequence
  Description of Artificial Sequence: Synthetic oligonucleotide
ggcaggagtacgcgcgcttcgaca

SEQ ID NO: 54260 - DNA, 24 bp, Artificial Sequence
  Description of Artificial Sequence: Synthetic oligonucleotide
gcaggagtacgcgcgcttcgacag

SEQ ID NO: 54261 - DNA, 24 bp, Artificial Sequence
  Description of Artificial Sequence: Synthetic oligonucleotide
caggagtacgcgcgcttcgacagc

SEQ ID NO: 54262 - DNA, 26 bp, Artificial Sequence
  Description of Artificial Sequence: Synthetic oligonucleotide
cagccagaaggacctcctggaggaga

SEQ ID NO: 54263 - DNA, 26 bp, Artificial Sequence
  Description of Artificial Sequence: Synthetic oligonucleotide
agccagaaggacctcctggaggagag

SEQ ID NO: 54264 - DNA, 25 bp, Artificial Sequence
  Description of Artificial Sequence: Synthetic oligonucleotide
gccagaaggacctcctggaggagag

SEQ ID NO: 54265 - DNA, 25 bp, Artificial Sequence
  Description of Artificial Sequence: Synthetic oligonucleotide
ccagaaggacctcctggaggagagg

SEQ ID NO: 54266 - DNA, 25 bp, Artificial Sequence
  Description of Artificial Sequence: Synthetic oligonucleotide
cagaaggacctcctggaggagaggc

SEQ ID NO: 54267 - DNA, 25 bp, Artificial Sequence
  Description of Artificial Sequence: Synthetic oligonucleotide
agaaggacctcctggaggagaggcg

SEQ ID NO: 54268 - DNA, 24 bp, Artificial Sequence
  Description of Artificial Sequence: Synthetic oligonucleotide
gaaggacctcctggaggagaggcg

SEQ ID NO: 54269 - DNA, 24 bp, Artificial Sequence
  Description of Artificial Sequence: Synthetic oligonucleotide
aaggacctcctggaggagaggcgg

SEQ ID NO: 54270 - DNA, 23 bp, Artificial Sequence
  Description of Artificial Sequence: Synthetic oligonucleotide
aggacctcctggaggagaggcgg

SEQ ID NO: 54271 - DNA, 22 bp, Artificial Sequence
  Description of Artificial Sequence: Synthetic oligonucleotide
ggacctcctggaggagaggcgg

SEQ ID NO: 54272 - DNA, 22 bp, Artificial Sequence
  Description of Artificial Sequence: Synthetic oligonucleotide
gacctcctggaggagaggcggg

SEQ ID NO: 54273 - DNA, 23 bp, Artificial Sequence
  Description of Artificial Sequence: Synthetic oligonucleotide
acctcctggaggagaggcgggca

SEQ ID NO: 54274 - DNA, 22 bp, Artificial Sequence
  Description of Artificial Sequence: Synthetic oligonucleotide
cctcctggaggagaggcgggca

SEQ ID NO: 54275 - DNA, 23 bp, Artificial Sequence
  Description of Artificial Sequence: Synthetic oligonucleotide
ctcctggaggagaggcgggcagt

SEQ ID NO: 54276 - DNA, 23 bp, Artificial Sequence
  Description of Artificial Sequence: Synthetic oligonucleotide
tcctggaggagaggcgggcagtg

SEQ ID NO: 54277 - DNA, 22 bp, Artificial Sequence
  Description of Artificial Sequence: Synthetic oligonucleotide
cctggaggagaggcgggcagtg

SEQ ID NO: 54278 - DNA, 22 bp, Artificial Sequence
  Description of Artificial Sequence: Synthetic oligonucleotide
ctggaggagaggcgggcagtgc

SEQ ID NO: 54279 - DNA, 22 bp, Artificial Sequence
  Description of Artificial Sequence: Synthetic oligonucleotide
tggaggagaggcgggcagtgcc

SEQ ID NO: 54280 - DNA, 21 bp, Artificial Sequence
  Description of Artificial Sequence: Synthetic oligonucleotide
ggaggagaggcgggcagtgcc

SEQ ID NO: 54281 - DNA, 21 bp, Artificial Sequence
  Description of Artificial Sequence: Synthetic oligonucleotide
gaggagaggcgggcagtgccg

SEQ ID NO: 54282 - DNA, 22 bp, Artificial Sequence
  Description of Artificial Sequence: Synthetic oligonucleotide
aggagaggcgggcagtgccgga

SEQ ID NO: 54283 - DNA, 21 bp, Artificial Sequence
  Description of Artificial Sequence: Synthetic oligonucleotide
ggagaggcgggcagtgccgga

SEQ ID NO: 54284 - DNA, 22 bp, Artificial Sequence
  Description of Artificial Sequence: Synthetic oligonucleotide
gagaggcgggcagtgccggaca

SEQ ID NO: 54285 - DNA, 22 bp, Artificial Sequence
  Description of Artificial Sequence: Synthetic oligonucleotide
agaggcgggcagtgccggacag

SEQ ID NO: 54286 - DNA, 21 bp, Artificial Sequence
  Description of Artificial Sequence: Synthetic oligonucleotide
gaggcgggcagtgccggacag

SEQ ID NO: 54287 - DNA, 23 bp, Artificial Sequence
  Description of Artificial Sequence: Synthetic oligonucleotide
aggcgggcagtgccggacaggat

SEQ ID NO: 54288 - DNA, 22 bp, Artificial Sequence
  Description of Artificial Sequence: Synthetic oligonucleotide
ggcgggcagtgccggacaggat

SEQ ID NO: 54289 - DNA, 33 bp, Artificial Sequence
  Description of Artificial Sequence: Synthetic oligonucleotide
acagcgcttcctggagagatacatctacaacag

SEQ ID NO: 54290 - DNA, 32 bp, Artificial Sequence
  Description of Artificial Sequence: Synthetic oligonucleotide
cagcgcttcctggagagatacatctacaacag

SEQ ID NO: 54291 - DNA, 32 bp, Artificial Sequence
  Description of Artificial Sequence: Synthetic oligonucleotide
agcgcttcctggagagatacatctacaacagg

SEQ ID NO: 54292 - DNA, 31 bp, Artificial Sequence
  Description of Artificial Sequence: Synthetic oligonucleotide
gcgcttcctggagagatacatctacaacagg

SEQ ID NO: 54293 - DNA, 31 bp, Artificial Sequence
  Description of Artificial Sequence: Synthetic oligonucleotide
cgcttcctggagagatacatctacaacaggc

SEQ ID NO: 54294 - DNA, 32 bp, Artificial Sequence
  Description of Artificial Sequence: Synthetic oligonucleotide
gcttcctggagagatacatctacaacaggcag

SEQ ID NO: 54295 - DNA, 32 bp, Artificial Sequence
  Description of Artificial Sequence: Synthetic oligonucleotide
cttcctggagagatacatctacaacaggcagg

SEQ ID NO: 54296 - DNA, 33 bp, Artificial Sequence
  Description of Artificial Sequence: Synthetic oligonucleotide
ttcctggagagatacatctacaacaggcaggag

SEQ ID NO: 54297 - DNA, 32 bp, Artificial Sequence
  Description of Artificial Sequence: Synthetic oligonucleotide
tcctggagagatacatctacaacaggcaggag

SEQ ID NO: 54298 - DNA, 31 bp, Artificial Sequence
  Description of Artificial Sequence: Synthetic oligonucleotide
cctggagagatacatctacaacaggcaggag

SEQ ID NO: 54299 - DNA, 33 bp, Artificial Sequence
  Description of Artificial Sequence: Synthetic oligonucleotide
ctggagagatacatctacaacaggcaggagtac

SEQ ID NO: 54300 - DNA, 33 bp, Artificial Sequence
  Description of Artificial Sequence: Synthetic oligonucleotide
tggagagatacatctacaacaggcaggagtacg

SEQ ID NO: 54301 - DNA, 32 bp, Artificial Sequence
  Description of Artificial Sequence: Synthetic oligonucleotide
ggagagatacatctacaacaggcaggagtacg

SEQ ID NO: 54302 - DNA, 32 bp, Artificial Sequence
  Description of Artificial Sequence: Synthetic oligonucleotide
gagagatacatctacaacaggcaggagtacgc

SEQ ID NO: 54303 - DNA, 32 bp, Artificial Sequence
  Description of Artificial Sequence: Synthetic oligonucleotide
agagatacatctacaacaggcaggagtacgcg

SEQ ID NO: 54304 - DNA, 31 bp, Artificial Sequence
  Description of Artificial Sequence: Synthetic oligonucleotide
gagatacatctacaacaggcaggagtacgcg

SEQ ID NO: 54305 - DNA, 31 bp, Artificial Sequence
  Description of Artificial Sequence: Synthetic oligonucleotide
agatacatctacaacaggcaggagtacgcgc

SEQ ID NO: 54306 - DNA, 30 bp, Artificial Sequence
  Description of Artificial Sequence: Synthetic oligonucleotide
gatacatctacaacaggcaggagtacgcgc

SEQ ID NO: 54307 - DNA, 30 bp, Artificial Sequence
  Description of Artificial Sequence: Synthetic oligonucleotide
atacatctacaacaggcaggagtacgcgcg

SEQ ID NO: 54308 - DNA, 29 bp, Artificial Sequence
  Description of Artificial Sequence: Synthetic oligonucleotide
tacatctacaacaggcaggagtacgcgcg

SEQ ID NO: 54309 - DNA, 28 bp, Artificial Sequence
  Description of Artificial Sequence: Synthetic oligonucleotide
acatctacaacaggcaggagtacgcgcg

SEQ ID NO: 54310 - DNA, 27 bp, Artificial Sequence
  Description of Artificial Sequence: Synthetic oligonucleotide
catctacaacaggcaggagtacgcgcg

SEQ ID NO: 54311 - DNA, 27 bp, Artificial Sequence
  Description of Artificial Sequence: Synthetic oligonucleotide
atctacaacaggcaggagtacgcgcgc

SEQ ID NO: 54312 - DNA, 27 bp, Artificial Sequence
  Description of Artificial Sequence: Synthetic oligonucleotide
tctacaacaggcaggagtacgcgcgct

SEQ ID NO: 54313 - DNA, 27 bp, Artificial Sequence
  Description of Artificial Sequence: Synthetic oligonucleotide
ctacaacaggcaggagtacgcgcgctt

SEQ ID NO: 54314 - DNA, 27 bp, Artificial Sequence
  Description of Artificial Sequence: Synthetic oligonucleotide
tacaacaggcaggagtacgcgcgcttc

SEQ ID NO: 54315 - DNA, 26 bp, Artificial Sequence
  Description of Artificial Sequence: Synthetic oligonucleotide
acaacaggcaggagtacgcgcgcttc

SEQ ID NO: 54316 - DNA, 25 bp, Artificial Sequence
  Description of Artificial Sequence: Synthetic oligonucleotide
caacaggcaggagtacgcgcgcttc

SEQ ID NO: 54317 - DNA, 26 bp, Artificial Sequence
  Description of Artificial Sequence: Synthetic oligonucleotide
aacaggcaggagtacgcgcgcttcga

SEQ ID NO: 54318 - DNA, 25 bp, Artificial Sequence
  Description of Artificial Sequence: Synthetic oligonucleotide
acaggcaggagtacgcgcgcttcga

SEQ ID NO: 54319 - DNA, 24 bp, Artificial Sequence
  Description of Artificial Sequence: Synthetic oligonucleotide
caggcaggagtacgcgcgcttcga

SEQ ID NO: 54320 - DNA, 25 bp, Artificial Sequence
  Description of Artificial Sequence: Synthetic oligonucleotide
aggcaggagtacgcgcgcttcgaca

SEQ ID NO: 54321 - DNA, 35 bp, Artificial Sequence
  Description of Artificial Sequence: Synthetic oligonucleotide
agaattaccttttctagggacggcaggaatgctac

SEQ ID NO: 54322 - DNA, 34 bp, Artificial Sequence
  Description of Artificial Sequence: Synthetic oligonucleotide
gaattaccttttctagggacggcaggaatgctac

SEQ ID NO: 54323 - DNA, 34 bp, Artificial Sequence
  Description of Artificial Sequence: Synthetic oligonucleotide
aattaccttttctagggacggcaggaatgctacg

SEQ ID NO: 54324 - DNA, 33 bp, Artificial Sequence
  Description of Artificial Sequence: Synthetic oligonucleotide
attaccttttctagggacggcaggaatgctacg

SEQ ID NO: 54325 - DNA, 32 bp, Artificial Sequence
  Description of Artificial Sequence: Synthetic oligonucleotide
ttaccttttctagggacggcaggaatgctacg

SEQ ID NO: 54326 - DNA, 31 bp, Artificial Sequence
  Description of Artificial Sequence: Synthetic oligonucleotide
taccttttctagggacggcaggaatgctacg

SEQ ID NO: 54327 - DNA, 30 bp, Artificial Sequence
  Description of Artificial Sequence: Synthetic oligonucleotide
accttttctagggacggcaggaatgctacg

SEQ ID NO: 54328 - DNA, 29 bp, Artificial Sequence
  Description of Artificial Sequence: Synthetic oligonucleotide
ccttttctagggacggcaggaatgctacg

SEQ ID NO: 54329 - DNA, 29 bp, Artificial Sequence
  Description of Artificial Sequence: Synthetic oligonucleotide
cttttctagggacggcaggaatgctacgc

SEQ ID NO: 54330 - DNA, 29 bp, Artificial Sequence
  Description of Artificial Sequence: Synthetic oligonucleotide
ttttctagggacggcaggaatgctacgcg

SEQ ID NO: 54331 - DNA, 28 bp, Artificial Sequence
  Description of Artificial Sequence: Synthetic oligonucleotide
tttctagggacggcaggaatgctacgcg

SEQ ID NO: 54332 - DNA, 27 bp, Artificial Sequence
  Description of Artificial Sequence: Synthetic oligonucleotide
ttctagggacggcaggaatgctacgcg

SEQ ID NO: 54333 - DNA, 27 bp, Artificial Sequence
  Description of Artificial Sequence: Synthetic oligonucleotide
tctagggacggcaggaatgctacgcgt

SEQ ID NO: 54334 - DNA, 27 bp, Artificial Sequence
  Description of Artificial Sequence: Synthetic oligonucleotide
ctagggacggcaggaatgctacgcgtt

SEQ ID NO: 54335 - DNA, 31 bp, Artificial Sequence
  Description of Artificial Sequence: Synthetic oligonucleotide
tagggacggcaggaatgctacgcgtttaatg

SEQ ID NO: 54336 - DNA, 26 bp, Artificial Sequence
  Description of Artificial Sequence: Synthetic oligonucleotide
aaccgggaggagttcgcgcgcttcta

SEQ ID NO: 54337 - DNA, 25 bp, Artificial Sequence
  Description of Artificial Sequence: Synthetic oligonucleotide
accgggaggagttcgcgcgcttcta

SEQ ID NO: 54338 - DNA, 24 bp, Artificial Sequence
  Description of Artificial Sequence: Synthetic oligonucleotide
ccgggaggagttcgcgcgcttcta

SEQ ID NO: 54339 - DNA, 25 bp, Artificial Sequence
  Description of Artificial Sequence: Synthetic oligonucleotide
cgggaggagttcgcgcgcttctaca

SEQ ID NO: 54340 - DNA, 25 bp, Artificial Sequence
  Description of Artificial Sequence: Synthetic oligonucleotide
gggaggagttcgcgcgcttctacag

SEQ ID NO: 54341 - DNA, 25 bp, Artificial Sequence
  Description of Artificial Sequence: Synthetic oligonucleotide
ggaggagttcgcgcgcttctacagc

SEQ ID NO: 54342 - DNA, 26 bp, Artificial Sequence
  Description of Artificial Sequence: Synthetic oligonucleotide
gaggagttcgcgcgcttctacagcga

SEQ ID NO: 54343 - DNA, 26 bp, Artificial Sequence
  Description of Artificial Sequence: Synthetic oligonucleotide
aggagttcgcgcgcttctacagcgac

SEQ ID NO: 54344 - DNA, 25 bp, Artificial Sequence
  Description of Artificial Sequence: Synthetic oligonucleotide
ggagttcgcgcgcttctacagcgac

SEQ ID NO: 54345 - DNA, 26 bp, Artificial Sequence
  Description of Artificial Sequence: Synthetic oligonucleotide
gagttcgcgcgcttctacagcgacgt

SEQ ID NO: 54346 - DNA, 26 bp, Artificial Sequence
  Description of Artificial Sequence: Synthetic oligonucleotide
agttcgcgcgcttctacagcgacgtg

SEQ ID NO: 54347 - DNA, 25 bp, Artificial Sequence
  Description of Artificial Sequence: Synthetic oligonucleotide
gttcgcgcgcttctacagcgacgtg

SEQ ID NO: 54348 - DNA, 25 bp, Artificial Sequence
  Description of Artificial Sequence: Synthetic oligonucleotide
ttcgcgcgcttctacagcgacgtgg

SEQ ID NO: 54349 - DNA, 24 bp, Artificial Sequence
  Description of Artificial Sequence: Synthetic oligonucleotide
tcgcgcgcttctacagcgacgtgg

SEQ ID NO: 54350 - DNA, 23 bp, Artificial Sequence
  Description of Artificial Sequence: Synthetic oligonucleotide
cgcgcgcttctacagcgacgtgg

SEQ ID NO: 54351 - DNA, 23 bp, Artificial Sequence
  Description of Artificial Sequence: Synthetic oligonucleotide
gcgcgcttctacagcgacgtggg

SEQ ID NO: 54352 - DNA, 23 bp, Artificial Sequence
  Description of Artificial Sequence: Synthetic oligonucleotide
cgcgcttctacagcgacgtgggg

SEQ ID NO: 54353 - DNA, 24 bp, Artificial Sequence
  Description of Artificial Sequence: Synthetic oligonucleotide
gcgcttctacagcgacgtggggga

SEQ ID NO: 54354 - DNA, 26 bp, Artificial Sequence
  Description of Artificial Sequence: Synthetic oligonucleotide
cgcttctacagcgacgtgggggagtt

SEQ ID NO: 54355 - DNA, 26 bp, Artificial Sequence
  Description of Artificial Sequence: Synthetic oligonucleotide
gcttctacagcgacgtgggggagttc

SEQ ID NO: 54356 - DNA, 26 bp, Artificial Sequence
  Description of Artificial Sequence: Synthetic oligonucleotide
cttctacagcgacgtgggggagttcc

SEQ ID NO: 54357 - DNA, 26 bp, Artificial Sequence
  Description of Artificial Sequence: Synthetic oligonucleotide
ttctacagcgacgtgggggagttccg

SEQ ID NO: 54358 - DNA, 25 bp, Artificial Sequence
  Description of Artificial Sequence: Synthetic oligonucleotide
tctacagcgacgtgggggagttccg

SEQ ID NO: 54359 - DNA, 24 bp, Artificial Sequence
  Description of Artificial Sequence: Synthetic oligonucleotide
ctacagcgacgtgggggagttccg

SEQ ID NO: 54360 - DNA, 24 bp, Artificial Sequence
  Description of Artificial Sequence: Synthetic oligonucleotide
tacagcgacgtgggggagttccgg

SEQ ID NO: 54361 - DNA, 31 bp, Artificial Sequence
  Description of Artificial Sequence: Synthetic oligonucleotide
agaattaccttttccagggacggcaggaagg

SEQ ID NO: 54362 - DNA, 30 bp, Artificial Sequence
  Description of Artificial Sequence: Synthetic oligonucleotide
gaattaccttttccagggacggcaggaagg

SEQ ID NO: 54363 - DNA, 30 bp, Artificial Sequence
  Description of Artificial Sequence: Synthetic oligonucleotide
aattaccttttccagggacggcaggaaggc

SEQ ID NO: 54364 - DNA, 29 bp, Artificial Sequence
  Description of Artificial Sequence: Synthetic oligonucleotide
attaccttttccagggacggcaggaaggc

SEQ ID NO: 54365 - DNA, 28 bp, Artificial Sequence
  Description of Artificial Sequence: Synthetic oligonucleotide
ttaccttttccagggacggcaggaaggc

SEQ ID NO: 54366 - DNA, 27 bp, Artificial Sequence
  Description of Artificial Sequence: Synthetic oligonucleotide
taccttttccagggacggcaggaaggc

SEQ ID NO: 54367 - DNA, 27 bp, Artificial Sequence
  Description of Artificial Sequence: Synthetic oligonucleotide
accttttccagggacggcaggaaggct

SEQ ID NO: 54368 - DNA, 27 bp, Artificial Sequence
  Description of Artificial Sequence: Synthetic oligonucleotide
ccttttccagggacggcaggaaggcta

SEQ ID NO: 54369 - DNA, 27 bp, Artificial Sequence
  Description of Artificial Sequence: Synthetic oligonucleotide
cttttccagggacggcaggaaggctac

SEQ ID NO: 54370 - DNA, 27 bp, Artificial Sequence
  Description of Artificial Sequence: Synthetic oligonucleotide
ttttccagggacggcaggaaggctacg

SEQ ID NO: 54371 - DNA, 26 bp, Artificial Sequence
  Description of Artificial Sequence: Synthetic oligonucleotide
tttccagggacggcaggaaggctacg

SEQ ID NO: 54372 - DNA, 25 bp, Artificial Sequence
  Description of Artificial Sequence: Synthetic oligonucleotide
ttccagggacggcaggaaggctacg

SEQ ID NO: 54373 - DNA, 24 bp, Artificial Sequence
  Description of Artificial Sequence: Synthetic oligonucleotide
tccagggacggcaggaaggctacg

SEQ ID NO: 54374 - DNA, 23 bp, Artificial Sequence
  Description of Artificial Sequence: Synthetic oligonucleotide
ccagggacggcaggaaggctacg

SEQ ID NO: 54375 - DNA, 23 bp, Artificial Sequence
  Description of Artificial Sequence: Synthetic oligonucleotide
cagggacggcaggaaggctacgc

SEQ ID NO: 54376 - DNA, 27 bp, Artificial Sequence
  Description of Artificial Sequence: Synthetic oligonucleotide
agggacggcaggaaggctacgcgttta

SEQ ID NO: 54377 - DNA, 27 bp, Artificial Sequence
  Description of Artificial Sequence: Synthetic oligonucleotide
gggacggcaggaaggctacgcgtttaa

SEQ ID NO: 54378 - DNA, 28 bp, Artificial Sequence
  Description of Artificial Sequence: Synthetic oligonucleotide
ggacggcaggaaggctacgcgtttaatg

SEQ ID NO: 54379 - DNA, 28 bp, Artificial Sequence
  Description of Artificial Sequence: Synthetic oligonucleotide
gacggcaggaaggctacgcgtttaatgg

SEQ ID NO: 54380 - DNA, 28 bp, Artificial Sequence
  Description of Artificial Sequence: Synthetic oligonucleotide
acggcaggaaggctacgcgtttaatggg

SEQ ID NO: 54381 - DNA, 27 bp, Artificial Sequence
  Description of Artificial Sequence: Synthetic oligonucleotide
cggcaggaaggctacgcgtttaatggg

SEQ ID NO: 54382 - DNA, 28 bp, Artificial Sequence
  Description of Artificial Sequence: Synthetic oligonucleotide
ggcaggaaggctacgcgtttaatgggac

SEQ ID NO: 54383 - DNA, 29 bp, Artificial Sequence
  Description of Artificial Sequence: Synthetic oligonucleotide
gcaggaaggctacgcgtttaatgggacac

SEQ ID NO: 54384 - DNA, 30 bp, Artificial Sequence
  Description of Artificial Sequence: Synthetic oligonucleotide
caggaaggctacgcgtttaatgggacacag

SEQ ID NO: 54385 - DNA, 30 bp, Artificial Sequence
  Description of Artificial Sequence: Synthetic oligonucleotide
aggaaggctacgcgtttaatgggacacagc

SEQ ID NO: 54386 - DNA, 29 bp, Artificial Sequence
  Description of Artificial Sequence: Synthetic oligonucleotide
ggaaggctacgcgtttaatgggacacagc

SEQ ID NO: 54387 - DNA, 29 bp, Artificial Sequence
  Description of Artificial Sequence: Synthetic oligonucleotide
gaaggctacgcgtttaatgggacacagcg

SEQ ID NO: 54388 - DNA, 29 bp, Artificial Sequence
  Description of Artificial Sequence: Synthetic oligonucleotide
aaggctacgcgtttaatgggacacagcgc

SEQ ID NO: 54389 - DNA, 28 bp, Artificial Sequence
  Description of Artificial Sequence: Synthetic oligonucleotide
aggctacgcgtttaatgggacacagcgc

SEQ ID NO: 54390 - DNA, 27 bp, Artificial Sequence
  Description of Artificial Sequence: Synthetic oligonucleotide
ggctacgcgtttaatgggacacagcgc

SEQ ID NO: 54391 - DNA, 32 bp, Artificial Sequence
  Description of Artificial Sequence: Synthetic oligonucleotide
agaattacgtgtaccagggatggcaggaatgc

SEQ ID NO: 54392 - DNA, 31 bp, Artificial Sequence
  Description of Artificial Sequence: Synthetic oligonucleotide
gaattacgtgtaccagggatggcaggaatgc

SEQ ID NO: 54393 - DNA, 33 bp, Artificial Sequence
  Description of Artificial Sequence: Synthetic oligonucleotide
aattacgtgtaccagggatggcaggaatgctac

SEQ ID NO: 54394 - DNA, 32 bp, Artificial Sequence
  Description of Artificial Sequence: Synthetic oligonucleotide
attacgtgtaccagggatggcaggaatgctac

SEQ ID NO: 54395 - DNA, 31 bp, Artificial Sequence
  Description of Artificial Sequence: Synthetic oligonucleotide
ttacgtgtaccagggatggcaggaatgctac

SEQ ID NO: 54396 - DNA, 30 bp, Artificial Sequence
  Description of Artificial Sequence: Synthetic oligonucleotide
tacgtgtaccagggatggcaggaatgctac

SEQ ID NO: 54397 - DNA, 29 bp, Artificial Sequence
  Description of Artificial Sequence: Synthetic oligonucleotide
acgtgtaccagggatggcaggaatgctac

SEQ ID NO: 54398 - DNA, 28 bp, Artificial Sequence
  Description of Artificial Sequence: Synthetic oligonucleotide
cgtgtaccagggatggcaggaatgctac

SEQ ID NO: 54399 - DNA, 28 bp, Artificial Sequence
  Description of Artificial Sequence: Synthetic oligonucleotide
gtgtaccagggatggcaggaatgctacg

SEQ ID NO: 54400 - DNA, 28 bp, Artificial Sequence
  Description of Artificial Sequence: Synthetic oligonucleotide
tgtaccagggatggcaggaatgctacgc

SEQ ID NO: 54401 - DNA, 27 bp, Artificial Sequence
  Description of Artificial Sequence: Synthetic oligonucleotide
gtaccagggatggcaggaatgctacgc

SEQ ID NO: 54402 - DNA, 27 bp, Artificial Sequence
  Description of Artificial Sequence: Synthetic oligonucleotide
taccagggatggcaggaatgctacgcg

SEQ ID NO: 54403 - DNA, 27 bp, Artificial Sequence
  Description of Artificial Sequence: Synthetic oligonucleotide
accagggatggcaggaatgctacgcgt

SEQ ID NO: 54404 - DNA, 27 bp, Artificial Sequence
  Description of Artificial Sequence: Synthetic oligonucleotide
ccagggatggcaggaatgctacgcgtt

SEQ ID NO: 54405 - DNA, 31 bp, Artificial Sequence
  Description of Artificial Sequence: Synthetic oligonucleotide
cagggatggcaggaatgctacgcgtttaatg

SEQ ID NO: 54406 - DNA, 31 bp, Artificial Sequence
  Description of Artificial Sequence: Synthetic oligonucleotide
agggatggcaggaatgctacgcgtttaatgg

SEQ ID NO: 54407 - DNA, 30 bp, Artificial Sequence
  Description of Artificial Sequence: Synthetic oligonucleotide
gggatggcaggaatgctacgcgtttaatgg

SEQ ID NO: 54408 - DNA, 30 bp, Artificial Sequence
  Description of Artificial Sequence: Synthetic oligonucleotide
ggatggcaggaatgctacgcgtttaatggg

SEQ ID NO: 54409 - DNA, 31 bp, Artificial Sequence
  Description of Artificial Sequence: Synthetic oligonucleotide
gatggcaggaatgctacgcgtttaatgggac

SEQ ID NO: 54410 - DNA, 32 bp, Artificial Sequence
  Description of Artificial Sequence: Synthetic oligonucleotide
atggcaggaatgctacgcgtttaatgggacac

SEQ ID NO: 54411 - DNA, 31 bp, Artificial Sequence
  Description of Artificial Sequence: Synthetic oligonucleotide
tggcaggaatgctacgcgtttaatgggacac

SEQ ID NO: 54412 - DNA, 24 bp, Artificial Sequence
  Description of Artificial Sequence: Synthetic oligonucleotide
aagcgggcagtgccggacaggatg

SEQ ID NO: 54413 - DNA, 23 bp, Artificial Sequence
  Description of Artificial Sequence: Synthetic oligonucleotide
agcgggcagtgccggacaggatg

SEQ ID NO: 54414 - DNA, 22 bp, Artificial Sequence
  Description of Artificial Sequence: Synthetic oligonucleotide
gcgggcagtgccggacaggatg

SEQ ID NO: 54415 - DNA, 22 bp, Artificial Sequence
  Description of Artificial Sequence: Synthetic oligonucleotide
cgggcagtgccggacaggatgc

SEQ ID NO: 54416 - DNA, 22 bp, Artificial Sequence
  Description of Artificial Sequence: Synthetic oligonucleotide
gggcagtgccggacaggatgcg

SEQ ID NO: 54417 - DNA, 23 bp, Artificial Sequence
  Description of Artificial Sequence: Synthetic oligonucleotide
ggcagtgccggacaggatgcgca

SEQ ID NO: 54418 - DNA, 24 bp, Artificial Sequence
  Description of Artificial Sequence: Synthetic oligonucleotide
gcagtgccggacaggatgcgcaga

SEQ ID NO: 54419 - DNA, 25 bp, Artificial Sequence
  Description of Artificial Sequence: Synthetic oligonucleotide
cagtgccggacaggatgcgcagaca

SEQ ID NO: 54420 - DNA, 27 bp, Artificial Sequence
  Description of Artificial Sequence: Synthetic oligonucleotide
agtgccggacaggatgcgcagacacaa

SEQ ID NO: 54421 - DNA, 26 bp, Artificial Sequence
  Description of Artificial Sequence: Synthetic oligonucleotide
gtgccggacaggatgcgcagacacaa

SEQ ID NO: 54422 - DNA, 27 bp, Artificial Sequence
  Description of Artificial Sequence: Synthetic oligonucleotide
tgccggacaggatgcgcagacacaact

SEQ ID NO: 54423 - DNA, 27 bp, Artificial Sequence
  Description of Artificial Sequence: Synthetic oligonucleotide
gccggacaggatgcgcagacacaacta

SEQ ID NO: 54424 - DNA, 27 bp, Artificial Sequence
  Description of Artificial Sequence: Synthetic oligonucleotide
ccggacaggatgcgcagacacaactac

SEQ ID NO: 54425 - DNA, 27 bp, Artificial Sequence
  Description of Artificial Sequence: Synthetic oligonucleotide
cggacaggatgcgcagacacaactacg

SEQ ID NO: 54426 - DNA, 28 bp, Artificial Sequence
  Description of Artificial Sequence: Synthetic oligonucleotide
ggacaggatgcgcagacacaactacgag

SEQ ID NO: 54427 - DNA, 28 bp, Artificial Sequence
  Description of Artificial Sequence: Synthetic oligonucleotide
gacaggatgcgcagacacaactacgagc

SEQ ID NO: 54428 - DNA, 29 bp, Artificial Sequence
  Description of Artificial Sequence: Synthetic oligonucleotide
acaggatgcgcagacacaactacgagctg

SEQ ID NO: 54429 - DNA, 28 bp, Artificial Sequence
  Description of Artificial Sequence: Synthetic oligonucleotide
caggatgcgcagacacaactacgagctg

SEQ ID NO: 54430 - DNA, 28 bp, Artificial Sequence
  Description of Artificial Sequence: Synthetic oligonucleotide
aggatgcgcagacacaactacgagctgg

SEQ ID NO: 54431 - DNA, 27 bp, Artificial Sequence
  Description of Artificial Sequence: Synthetic oligonucleotide
ggatgcgcagacacaactacgagctgg

SEQ ID NO: 54432 - DNA, 27 bp, Artificial Sequence
  Description of Artificial Sequence: Synthetic oligonucleotide
gatgcgcagacacaactacgagctggg

SEQ ID NO: 54433 - DNA, 27 bp, Artificial Sequence
  Description of Artificial Sequence: Synthetic oligonucleotide
atgcgcagacacaactacgagctgggc

SEQ ID NO: 54434 - DNA, 26 bp, Artificial Sequence
  Description of Artificial Sequence: Synthetic oligonucleotide
tgcgcagacacaactacgagctgggc

SEQ ID NO: 54435 - DNA, 25 bp, Artificial Sequence
  Description of Artificial Sequence: Synthetic oligonucleotide
gcgcagacacaactacgagctgggc

SEQ ID NO: 54436 - DNA, 25 bp, Artificial Sequence
  Description of Artificial Sequence: Synthetic oligonucleotide
cgcagacacaactacgagctgggcg

SEQ ID NO: 54437 - DNA, 30 bp, Artificial Sequence
  Description of Artificial Sequence: Synthetic oligonucleotide
aggatgtgcagacacaactacgagctggtc

SEQ ID NO: 54438 - DNA, 29 bp, Artificial Sequence
  Description of Artificial Sequence: Synthetic oligonucleotide
ggatgtgcagacacaactacgagctggtc

SEQ ID NO: 54439 - DNA, 29 bp, Artificial Sequence
  Description of Artificial Sequence: Synthetic oligonucleotide
gatgtgcagacacaactacgagctggtcg

SEQ ID NO: 54440 - DNA, 29 bp, Artificial Sequence
  Description of Artificial Sequence: Synthetic oligonucleotide
atgtgcagacacaactacgagctggtcgg

SEQ ID NO: 54441 - DNA, 28 bp, Artificial Sequence
  Description of Artificial Sequence: Synthetic oligonucleotide
tgtgcagacacaactacgagctggtcgg

SEQ ID NO: 54442 - DNA, 27 bp, Artificial Sequence
  Description of Artificial Sequence: Synthetic oligonucleotide
gtgcagacacaactacgagctggtcgg

SEQ ID NO: 54443 - DNA, 27 bp, Artificial Sequence
  Description of Artificial Sequence: Synthetic oligonucleotide
tgcagacacaactacgagctggtcggg

SEQ ID NO: 54444 - DNA, 26 bp, Artificial Sequence
  Description of Artificial Sequence: Synthetic oligonucleotide
gcagacacaactacgagctggtcggg

SEQ ID NO: 54445 - DNA, 26 bp, Artificial Sequence
  Description of Artificial Sequence: Synthetic oligonucleotide
cagacacaactacgagctggtcgggc

SEQ ID NO: 54446 - DNA, 26 bp, Artificial Sequence
  Description of Artificial Sequence: Synthetic oligonucleotide
agacacaactacgagctggtcgggcc

SEQ ID NO: 54447 - DNA, 25 bp, Artificial Sequence
  Description of Artificial Sequence: Synthetic oligonucleotide
gacacaactacgagctggtcgggcc

SEQ ID NO: 54448 - DNA, 27 bp, Artificial Sequence
  Description of Artificial Sequence: Synthetic oligonucleotide
acacaactacgagctggtcgggcccat

SEQ ID NO: 54449 - DNA, 26 bp, Artificial Sequence
  Description of Artificial Sequence: Synthetic oligonucleotide
cacaactacgagctggtcgggcccat

SEQ ID NO: 54450 - DNA, 27 bp, Artificial Sequence
  Description of Artificial Sequence: Synthetic oligonucleotide
acaactacgagctggtcgggcccatga

SEQ ID NO: 54451 - DNA, 26 bp, Artificial Sequence
  Description of Artificial Sequence: Synthetic oligonucleotide
caactacgagctggtcgggcccatga

SEQ ID NO: 54452 - DNA, 26 bp, Artificial Sequence
  Description of Artificial Sequence: Synthetic oligonucleotide
aactacgagctggtcgggcccatgac

SEQ ID NO: 54453 - DNA, 25 bp, Artificial Sequence
  Description of Artificial Sequence: Synthetic oligonucleotide
actacgagctggtcgggcccatgac

SEQ ID NO: 54454 - DNA, 24 bp, Artificial Sequence
  Description of Artificial Sequence: Synthetic oligonucleotide
ctacgagctggtcgggcccatgac

SEQ ID NO: 54455 - DNA, 24 bp, Artificial Sequence
  Description of Artificial Sequence: Synthetic oligonucleotide
tacgagctggtcgggcccatgacc

SEQ ID NO: 54456 - DNA, 23 bp, Artificial Sequence
  Description of Artificial Sequence: Synthetic oligonucleotide
acgagctggtcgggcccatgacc

SEQ ID NO: 54457 - DNA, 22 bp, Artificial Sequence
  Description of Artificial Sequence: Synthetic oligonucleotide
cgagctggtcgggcccatgacc

SEQ ID NO: 54458 - DNA, 23 bp, Artificial Sequence
  Description of Artificial Sequence: Synthetic oligonucleotide
gagctggtcgggcccatgaccct

SEQ ID NO: 54459 - DNA, 23 bp, Artificial Sequence
  Description of Artificial Sequence: Synthetic oligonucleotide
agctggtcgggcccatgaccctg

SEQ ID NO: 54460 - DNA, 22 bp, Artificial Sequence
  Description of Artificial Sequence: Synthetic oligonucleotide
gctggtcgggcccatgaccctg

SEQ ID NO: 54461 - DNA, 23 bp, Artificial Sequence
  Description of Artificial Sequence: Synthetic oligonucleotide
ctggtcgggcccatgaccctgca

SEQ ID NO: 54462 - DNA, 23 bp, Artificial Sequence
  Description of Artificial Sequence: Synthetic oligonucleotide
tggtcgggcccatgaccctgcag

SEQ ID NO: 54463 - DNA, 22 bp, Artificial Sequence
  Description of Artificial Sequence: Synthetic oligonucleotide
ggtcgggcccatgaccctgcag

SEQ ID NO: 54464 - DNA, 22 bp, Artificial Sequence
  Description of Artificial Sequence: Synthetic oligonucleotide
gtcgggcccatgaccctgcagc

SEQ ID NO: 54465 - DNA, 22 bp, Artificial Sequence
  Description of Artificial Sequence: Synthetic oligonucleotide
tcgggcccatgaccctgcagcg

SEQ ID NO: 54466 - DNA, 27 bp, Artificial Sequence
  Description of Artificial Sequence: Synthetic oligonucleotide
cacaccagcctggacagtcctgtcact

SEQ ID NO: 54467 - DNA, 27 bp, Artificial Sequence
  Description of Artificial Sequence: Synthetic oligonucleotide
acaccagcctggacagtcctgtcactg

SEQ ID NO: 54468 - DNA, 27 bp, Artificial Sequence
  Description of Artificial Sequence: Synthetic oligonucleotide
caccagcctggacagtcctgtcactgt

SEQ ID NO: 54469 - DNA, 27 bp, Artificial Sequence
  Description of Artificial Sequence: Synthetic oligonucleotide
accagcctggacagtcctgtcactgtg

SEQ ID NO: 54470 - DNA, 26 bp, Artificial Sequence
  Description of Artificial Sequence: Synthetic oligonucleotide
ccagcctggacagtcctgtcactgtg

SEQ ID NO: 54471 - DNA, 27 bp, Artificial Sequence
  Description of Artificial Sequence: Synthetic oligonucleotide
cagcctggacagtcctgtcactgtgga

SEQ ID NO: 54472 - DNA, 27 bp, Artificial Sequence
  Description of Artificial Sequence: Synthetic oligonucleotide
agcctggacagtcctgtcactgtggag

SEQ ID NO: 54473 - DNA, 27 bp, Artificial Sequence
  Description of Artificial Sequence: Synthetic oligonucleotide
gcctggacagtcctgtcactgtggagt

SEQ ID NO: 54474 - DNA, 27 bp, Artificial Sequence
  Description of Artificial Sequence: Synthetic oligonucleotide
cctggacagtcctgtcactgtggagtg

SEQ ID NO: 54475 - DNA, 27 bp, Artificial Sequence
  Description of Artificial Sequence: Synthetic oligonucleotide
ctggacagtcctgtcactgtggagtgg

SEQ ID NO: 54476 - DNA, 29 bp, Artificial Sequence
  Description of Artificial Sequence: Synthetic oligonucleotide
tggacagtcctgtcactgtggagtggaag

SEQ ID NO: 54477 - DNA, 28 bp, Artificial Sequence
  Description of Artificial Sequence: Synthetic oligonucleotide
ggacagtcctgtcactgtggagtggaag

SEQ ID NO: 54478 - DNA, 28 bp, Artificial Sequence
  Description of Artificial Sequence: Synthetic oligonucleotide
gacagtcctgtcactgtggagtggaagg

SEQ ID NO: 54479 - DNA, 28 bp, Artificial Sequence
  Description of Artificial Sequence: Synthetic oligonucleotide
acagtcctgtcactgtggagtggaaggc

SEQ ID NO: 54480 - DNA, 27 bp, Artificial Sequence
  Description of Artificial Sequence: Synthetic oligonucleotide
cagtcctgtcactgtggagtggaaggc

SEQ ID NO: 54481 - DNA, 28 bp, Artificial Sequence
  Description of Artificial Sequence: Synthetic oligonucleotide
agtcctgtcactgtggagtggaaggcac

SEQ ID NO: 54482 - DNA, 27 bp, Artificial Sequence
  Description of Artificial Sequence: Synthetic oligonucleotide
gtcctgtcactgtggagtggaaggcac

SEQ ID NO: 54483 - DNA, 28 bp, Artificial Sequence
  Description of Artificial Sequence: Synthetic oligonucleotide
tcctgtcactgtggagtggaaggcacag

SEQ ID NO: 54484 - DNA, 27 bp, Artificial Sequence
  Description of Artificial Sequence: Synthetic oligonucleotide
cctgtcactgtggagtggaaggcacag

SEQ ID NO: 54485 - DNA, 28 bp, Artificial Sequence
  Description of Artificial Sequence: Synthetic oligonucleotide
ctgtcactgtggagtggaaggcacagtc

SEQ ID NO: 54486 - DNA, 29 bp, Artificial Sequence
  Description of Artificial Sequence: Synthetic oligonucleotide
tgtcactgtggagtggaaggcacagtctg

SEQ ID NO: 54487 - DNA, 28 bp, Artificial Sequence
  Description of Artificial Sequence: Synthetic oligonucleotide
gtcactgtggagtggaaggcacagtctg

SEQ ID NO: 54488 - DNA, 31 bp, Artificial Sequence
  Description of Artificial Sequence: Synthetic oligonucleotide
tcactgtggagtggaaggcacagtctgattc

SEQ ID NO: 54489 - DNA, 30 bp, Artificial Sequence
  Description of Artificial Sequence: Synthetic oligonucleotide
cactgtggagtggaaggcacagtctgattc

SEQ ID NO: 54490 - DNA, 31 bp, Artificial Sequence
  Description of Artificial Sequence: Synthetic oligonucleotide
actgtggagtggaaggcacagtctgattctg

SEQ ID NO: 54491 - DNA, 30 bp, Artificial Sequence
  Description of Artificial Sequence: Synthetic oligonucleotide
ctgtggagtggaaggcacagtctgattctg

SEQ ID NO: 54492 - DNA, 30 bp, Artificial Sequence
  Description of Artificial Sequence: Synthetic oligonucleotide
tgtggagtggaaggcacagtctgattctgc

SEQ ID NO: 54493 - DNA, 26 bp, Artificial Sequence
  Description of Artificial Sequence: Synthetic oligonucleotide
ggggctcatcatctgtggagtgggca

SEQ ID NO: 54494 - DNA, 26 bp, Artificial Sequence
  Description of Artificial Sequence: Synthetic oligonucleotide
gggctcatcatctgtggagtgggcac

SEQ ID NO: 54495 - DNA, 27 bp, Artificial Sequence
  Description of Artificial Sequence: Synthetic oligonucleotide
ggctcatcatctgtggagtgggcacct

SEQ ID NO: 54496 - DNA, 28 bp, Artificial Sequence
  Description of Artificial Sequence: Synthetic oligonucleotide
gctcatcatctgtggagtgggcaccttc

SEQ ID NO: 54497 - DNA, 30 bp, Artificial Sequence
  Description of Artificial Sequence: Synthetic oligonucleotide
ctcatcatctgtggagtgggcaccttcatg

SEQ ID NO: 54498 - DNA, 30 bp, Artificial Sequence
  Description of Artificial Sequence: Synthetic oligonucleotide
tcatcatctgtggagtgggcaccttcatgc

SEQ ID NO: 54499 - DNA, 29 bp, Artificial Sequence
  Description of Artificial Sequence: Synthetic oligonucleotide
catcatctgtggagtgggcaccttcatgc

SEQ ID NO: 54500 - DNA, 30 bp, Artificial Sequence
  Description of Artificial Sequence: Synthetic oligonucleotide
atcatctgtggagtgggcaccttcatgcac

SEQ ID NO: 54501 - DNA, 29 bp, Artificial Sequence
  Description of Artificial Sequence: Synthetic oligonucleotide
tcatctgtggagtgggcaccttcatgcac

SEQ ID NO: 54502 - DNA, 28 bp, Artificial Sequence
  Description of Artificial Sequence: Synthetic oligonucleotide
catctgtggagtgggcaccttcatgcac

SEQ ID NO: 54503 - DNA, 29 bp, Artificial Sequence
  Description of Artificial Sequence: Synthetic oligonucleotide
atctgtggagtgggcaccttcatgcacag

SEQ ID NO: 54504 - DNA, 28 bp, Artificial Sequence
  Description of Artificial Sequence: Synthetic oligonucleotide
tctgtggagtgggcaccttcatgcacag

SEQ ID NO: 54505 - DNA, 27 bp, Artificial Sequence
  Description of Artificial Sequence: Synthetic oligonucleotide
ctgtggagtgggcaccttcatgcacag

SEQ ID NO: 54506 - DNA, 27 bp, Artificial Sequence
  Description of Artificial Sequence: Synthetic oligonucleotide
tgtggagtgggcaccttcatgcacagg

SEQ ID NO: 54507 - DNA, 27 bp, Artificial Sequence
  Description of Artificial Sequence: Synthetic oligonucleotide
gtggagtgggcaccttcatgcacagga

SEQ ID NO: 54508 - DNA, 27 bp, Artificial Sequence
  Description of Artificial Sequence: Synthetic oligonucleotide
tggagtgggcaccttcatgcacaggag

SEQ ID NO: 54509 - DNA, 26 bp, Artificial Sequence
  Description of Artificial Sequence: Synthetic oligonucleotide
ggagtgggcaccttcatgcacaggag

SEQ ID NO: 54510 - DNA, 27 bp, Artificial Sequence
  Description of Artificial Sequence: Synthetic oligonucleotide
gagtgggcaccttcatgcacaggagga

SEQ ID NO: 54511 - DNA, 27 bp, Artificial Sequence
  Description of Artificial Sequence: Synthetic oligonucleotide
agtgggcaccttcatgcacaggaggag

SEQ ID NO: 54512 - DNA, 26 bp, Artificial Sequence
  Description of Artificial Sequence: Synthetic oligonucleotide
gtgggcaccttcatgcacaggaggag

SEQ ID NO: 54513 - DNA, 27 bp, Artificial Sequence
  Description of Artificial Sequence: Synthetic oligonucleotide
tgggcaccttcatgcacaggaggagca

SEQ ID NO: 54514 - DNA, 27 bp, Artificial Sequence
  Description of Artificial Sequence: Synthetic oligonucleotide
gggcaccttcatgcacaggaggagcaa

SEQ ID NO: 54515 - DNA, 27 bp, Artificial Sequence
  Description of Artificial Sequence: Synthetic oligonucleotide
ggcaccttcatgcacaggaggagcaag

SEQ ID NO: 54516 - DNA, 30 bp, Artificial Sequence
  Description of Artificial Sequence: Synthetic oligonucleotide
gcaccttcatgcacaggaggagcaagaaag

SEQ ID NO: 54517 - DNA, 32 bp, Artificial Sequence
  Description of Artificial Sequence: Synthetic oligonucleotide
caccttcatgcacaggaggagcaagaaagttc

SEQ ID NO: 54518 - DNA, 34 bp, Artificial Sequence
  Description of Artificial Sequence: Synthetic oligonucleotide
accttcatgcacaggaggagcaagaaagttcaac

SEQ ID NO: 54519 - DNA, 33 bp, Artificial Sequence
  Description of Artificial Sequence: Synthetic oligonucleotide
ccttcatgcacaggaggagcaagaaagttcaac

SEQ ID NO: 54520 - DNA, 23 bp, Artificial Sequence
  Description of Artificial Sequence: Synthetic oligonucleotide
acgaggccgtgaccctgcagcgt

SEQ ID NO: 54521 - DNA, 22 bp, Artificial Sequence
  Description of Artificial Sequence: Synthetic oligonucleotide
cgaggccgtgaccctgcagcgt

SEQ ID NO: 54522 - DNA, 22 bp, Artificial Sequence
  Description of Artificial Sequence: Synthetic oligonucleotide
gaggccgtgaccctgcagcgtc

SEQ ID NO: 54523 - DNA, 23 bp, Artificial Sequence
  Description of Artificial Sequence: Synthetic oligonucleotide
aggccgtgaccctgcagcgtcga

SEQ ID NO: 54524 - DNA, 30 bp, Artificial Sequence
  Description of Artificial Sequence: Synthetic oligonucleotide
atgaggagtactggaacagccagaaggacc

SEQ ID NO: 54525 - DNA, 29 bp, Artificial Sequence
  Description of Artificial Sequence: Synthetic oligonucleotide
tgaggagtactggaacagccagaaggacc

SEQ ID NO: 54526 - DNA, 28 bp, Artificial Sequence
  Description of Artificial Sequence: Synthetic oligonucleotide
gaggagtactggaacagccagaaggacc

SEQ ID NO: 54527 - DNA, 29 bp, Artificial Sequence
  Description of Artificial Sequence: Synthetic oligonucleotide
aggagtactggaacagccagaaggacctc

SEQ ID NO: 54528 - DNA, 24 bp, Artificial Sequence
  Description of Artificial Sequence: Synthetic oligonucleotide
gagaagcgggcagtgccggacaga

SEQ ID NO: 54529 - DNA, 27 bp, Artificial Sequence
  Description of Artificial Sequence: Synthetic oligonucleotide
agaagcgggcagtgccggacagagtat

SEQ ID NO: 54530 - DNA, 26 bp, Artificial Sequence
  Description of Artificial Sequence: Synthetic oligonucleotide
gaagcgggcagtgccggacagagtat

SEQ ID NO: 54531 - DNA, 26 bp, Artificial Sequence
  Description of Artificial Sequence: Synthetic oligonucleotide
aagcgggcagtgccggacagagtatg

SEQ ID NO: 54532 - DNA, 25 bp, Artificial Sequence
  Description of Artificial Sequence: Synthetic oligonucleotide
agcgggcagtgccggacagagtatg

SEQ ID NO: 54533 - DNA, 24 bp, Artificial Sequence
  Description of Artificial Sequence: Synthetic oligonucleotide
gcgggcagtgccggacagagtatg

SEQ ID NO: 54534 - DNA, 25 bp, Artificial Sequence
  Description of Artificial Sequence: Synthetic oligonucleotide
cgggcagtgccggacagagtatgca

SEQ ID NO: 54535 - DNA, 26 bp, Artificial Sequence
  Description of Artificial Sequence: Synthetic oligonucleotide
gggcagtgccggacagagtatgcaga

SEQ ID NO: 54536 - DNA, 27 bp, Artificial Sequence
  Description of Artificial Sequence: Synthetic oligonucleotide
ggcagtgccggacagagtatgcagaca

SEQ ID NO: 54537 - DNA, 27 bp, Artificial Sequence
  Description of Artificial Sequence: Synthetic oligonucleotide
gcagtgccggacagagtatgcagacac

SEQ ID NO: 54538 - DNA, 29 bp, Artificial Sequence
  Description of Artificial Sequence: Synthetic oligonucleotide
cagtgccggacagagtatgcagacacaac

SEQ ID NO: 54539 - DNA, 31 bp, Artificial Sequence
  Description of Artificial Sequence: Synthetic oligonucleotide
agtgccggacagagtatgcagacacaactac

SEQ ID NO: 54540 - DNA, 30 bp, Artificial Sequence
  Description of Artificial Sequence: Synthetic oligonucleotide
gtgccggacagagtatgcagacacaactac

SEQ ID NO: 54541 - DNA, 30 bp, Artificial Sequence
  Description of Artificial Sequence: Synthetic oligonucleotide
tgccggacagagtatgcagacacaactacg

SEQ ID NO: 54542 - DNA, 29 bp, Artificial Sequence
  Description of Artificial Sequence: Synthetic oligonucleotide
gccggacagagtatgcagacacaactacg

SEQ ID NO: 54543 - DNA, 30 bp, Artificial Sequence
  Description of Artificial Sequence: Synthetic oligonucleotide
ccggacagagtatgcagacacaactacgag

SEQ ID NO: 54544 - DNA, 30 bp, Artificial Sequence
  Description of Artificial Sequence: Synthetic oligonucleotide
cggacagagtatgcagacacaactacgagc

SEQ ID NO: 54545 - DNA, 31 bp, Artificial Sequence
  Description of Artificial Sequence: Synthetic oligonucleotide
ggacagagtatgcagacacaactacgagctg

SEQ ID NO: 54546 - DNA, 31 bp, Artificial Sequence
  Description of Artificial Sequence: Synthetic oligonucleotide
gacagagtatgcagacacaactacgagctgg

SEQ ID NO: 54547 - DNA, 32 bp, Artificial Sequence
  Description of Artificial Sequence: Synthetic oligonucleotide
acagagtatgcagacacaactacgagctggac

SEQ ID NO: 54548 - DNA, 31 bp, Artificial Sequence
  Description of Artificial Sequence: Synthetic oligonucleotide
cagagtatgcagacacaactacgagctggac

SEQ ID NO: 54549 - DNA, 31 bp, Artificial Sequence
  Description of Artificial Sequence: Synthetic oligonucleotide
agagtatgcagacacaactacgagctggacg

SEQ ID NO: 54550 - DNA, 30 bp, Artificial Sequence
  Description of Artificial Sequence: Synthetic oligonucleotide
gagtatgcagacacaactacgagctggacg

SEQ ID NO: 54551 - DNA, 31 bp, Artificial Sequence
  Description of Artificial Sequence: Synthetic oligonucleotide
agtatgcagacacaactacgagctggacgag

SEQ ID NO: 54552 - DNA, 26 bp, Artificial Sequence
  Description of Artificial Sequence: Synthetic oligonucleotide
gacctcctggaggagaagcgggcatt

SEQ ID NO: 54553 - DNA, 26 bp, Artificial Sequence
  Description of Artificial Sequence: Synthetic oligonucleotide
acctcctggaggagaagcgggcattg

SEQ ID NO: 54554 - DNA, 25 bp, Artificial Sequence
  Description of Artificial Sequence: Synthetic oligonucleotide
cctcctggaggagaagcgggcattg

SEQ ID NO: 54555 - DNA, 25 bp, Artificial Sequence
  Description of Artificial Sequence: Synthetic oligonucleotide
ctcctggaggagaagcgggcattgc

SEQ ID NO: 54556 - DNA, 25 bp, Artificial Sequence
  Description of Artificial Sequence: Synthetic oligonucleotide
tcctggaggagaagcgggcattgcc

SEQ ID NO: 54557 - DNA, 24 bp, Artificial Sequence
  Description of Artificial Sequence: Synthetic oligonucleotide
cctggaggagaagcgggcattgcc

SEQ ID NO: 54558 - DNA, 24 bp, Artificial Sequence
  Description of Artificial Sequence: Synthetic oligonucleotide
ctggaggagaagcgggcattgccg

SEQ ID NO: 54559 - DNA, 25 bp, Artificial Sequence
  Description of Artificial Sequence: Synthetic oligonucleotide
tggaggagaagcgggcattgccgga

SEQ ID NO: 54560 - DNA, 24 bp, Artificial Sequence
  Description of Artificial Sequence: Synthetic oligonucleotide
ggaggagaagcgggcattgccgga

SEQ ID NO: 54561 - DNA, 25 bp, Artificial Sequence
  Description of Artificial Sequence: Synthetic oligonucleotide
gaggagaagcgggcattgccggaca

SEQ ID NO: 54562 - DNA, 25 bp, Artificial Sequence
  Description of Artificial Sequence: Synthetic oligonucleotide
aggagaagcgggcattgccggacag

SEQ ID NO: 54563 - DNA, 24 bp, Artificial Sequence
  Description of Artificial Sequence: Synthetic oligonucleotide
ggagaagcgggcattgccggacag

SEQ ID NO: 54564 - DNA, 26 bp, Artificial Sequence
  Description of Artificial Sequence: Synthetic oligonucleotide
gagaagcgggcattgccggacaggat

SEQ ID NO: 54565 - DNA, 27 bp, Artificial Sequence
  Description of Artificial Sequence: Synthetic oligonucleotide
agaagcgggcattgccggacaggatgt

SEQ ID NO: 54566 - DNA, 26 bp, Artificial Sequence
  Description of Artificial Sequence: Synthetic oligonucleotide
gaagcgggcattgccggacaggatgt

SEQ ID NO: 54567 - DNA, 26 bp, Artificial Sequence
  Description of Artificial Sequence: Synthetic oligonucleotide
aagcgggcattgccggacaggatgtg

SEQ ID NO: 54568 - DNA, 25 bp, Artificial Sequence
  Description of Artificial Sequence: Synthetic oligonucleotide
agcgggcattgccggacaggatgtg

SEQ ID NO: 54569 - DNA, 24 bp, Artificial Sequence
  Description of Artificial Sequence: Synthetic oligonucleotide
gcgggcattgccggacaggatgtg

SEQ ID NO: 54570 - DNA, 25 bp, Artificial Sequence
  Description of Artificial Sequence: Synthetic oligonucleotide
cgggcattgccggacaggatgtgca

SEQ ID NO: 54571 - DNA, 26 bp, Artificial Sequence
  Description of Artificial Sequence: Synthetic oligonucleotide
gggcattgccggacaggatgtgcaga

SEQ ID NO: 54572 - DNA, 27 bp, Artificial Sequence
  Description of Artificial Sequence: Synthetic oligonucleotide
ggcattgccggacaggatgtgcagaca

SEQ ID NO: 54573 - DNA, 27 bp, Artificial Sequence
  Description of Artificial Sequence: Synthetic oligonucleotide
gcattgccggacaggatgtgcagacac

SEQ ID NO: 54574 - DNA, 29 bp, Artificial Sequence
  Description of Artificial Sequence: Synthetic oligonucleotide
cattgccggacaggatgtgcagacacaac

SEQ ID NO: 54575 - DNA, 31 bp, Artificial Sequence
  Description of Artificial Sequence: Synthetic oligonucleotide
attgccggacaggatgtgcagacacaactac

SEQ ID NO: 54576 - DNA, 30 bp, Artificial Sequence
  Description of Artificial Sequence: Synthetic oligonucleotide
ttgccggacaggatgtgcagacacaactac

SEQ ID NO: 54577 - DNA, 23 bp, Artificial Sequence
  Description of Artificial Sequence: Synthetic oligonucleotide
gagctggggcggcctgatgaggt

SEQ ID NO: 54578 - DNA, 25 bp, Artificial Sequence
  Description of Artificial Sequence: Synthetic oligonucleotide
agctggggcggcctgatgaggtgta

SEQ ID NO: 54579 - DNA, 24 bp, Artificial Sequence
  Description of Artificial Sequence: Synthetic oligonucleotide
gctggggcggcctgatgaggtgta

SEQ ID NO: 54580 - DNA, 25 bp, Artificial Sequence
  Description of Artificial Sequence: Synthetic oligonucleotide
ctggggcggcctgatgaggtgtact

SEQ ID NO: 54581 - DNA, 25 bp, Artificial Sequence
  Description of Artificial Sequence: Synthetic oligonucleotide
tggggcggcctgatgaggtgtactg

SEQ ID NO: 54582 - DNA, 24 bp, Artificial Sequence
  Description of Artificial Sequence: Synthetic oligonucleotide
ggggcggcctgatgaggtgtactg

SEQ ID NO: 54583 - DNA, 26 bp, Artificial Sequence
  Description of Artificial Sequence: Synthetic oligonucleotide
gggcggcctgatgaggtgtactggaa

SEQ ID NO: 54584 - DNA, 27 bp, Artificial Sequence
  Description of Artificial Sequence: Synthetic oligonucleotide
ggcggcctgatgaggtgtactggaaca

SEQ ID NO: 54585 - DNA, 27 bp, Artificial Sequence
  Description of Artificial Sequence: Synthetic oligonucleotide
gcggcctgatgaggtgtactggaacag

SEQ ID NO: 54586 - DNA, 27 bp, Artificial Sequence
  Description of Artificial Sequence: Synthetic oligonucleotide
cggcctgatgaggtgtactggaacagc

SEQ ID NO: 54587 - DNA, 27 bp, Artificial Sequence
  Description of Artificial Sequence: Synthetic oligonucleotide
ggcctgatgaggtgtactggaacagcc

SEQ ID NO: 54588 - DNA, 28 bp, Artificial Sequence
  Description of Artificial Sequence: Synthetic oligonucleotide
gcctgatgaggtgtactggaacagccag

SEQ ID NO: 54589 - DNA, 30 bp, Artificial Sequence
  Description of Artificial Sequence: Synthetic oligonucleotide
cctgatgaggtgtactggaacagccagaag

SEQ ID NO: 54590 - DNA, 30 bp, Artificial Sequence
  Description of Artificial Sequence: Synthetic oligonucleotide
ctgatgaggtgtactggaacagccagaagg

SEQ ID NO: 54591 - DNA, 31 bp, Artificial Sequence
  Description of Artificial Sequence: Synthetic oligonucleotide
tgatgaggtgtactggaacagccagaaggac

SEQ ID NO: 54592 - DNA, 30 bp, Artificial Sequence
  Description of Artificial Sequence: Synthetic oligonucleotide
gatgaggtgtactggaacagccagaaggac

SEQ ID NO: 54593 - DNA, 32 bp, Artificial Sequence
  Description of Artificial Sequence: Synthetic oligonucleotide
atgaggtgtactggaacagccagaaggacatc

SEQ ID NO: 54594 - DNA, 31 bp, Artificial Sequence
  Description of Artificial Sequence: Synthetic oligonucleotide
tgaggtgtactggaacagccagaaggacatc

SEQ ID NO: 54595 - DNA, 30 bp, Artificial Sequence
  Description of Artificial Sequence: Synthetic oligonucleotide
gaggtgtactggaacagccagaaggacatc

SEQ ID NO: 54596 - DNA, 30 bp, Artificial Sequence
  Description of Artificial Sequence: Synthetic oligonucleotide
aggtgtactggaacagccagaaggacatcc

SEQ ID NO: 54597 - DNA, 29 bp, Artificial Sequence
  Description of Artificial Sequence: Synthetic oligonucleotide
ggtgtactggaacagccagaaggacatcc

SEQ ID NO: 54598 - DNA, 30 bp, Artificial Sequence
  Description of Artificial Sequence: Synthetic oligonucleotide
gtgtactggaacagccagaaggacatcctg

SEQ ID NO: 54599 - DNA, 30 bp, Artificial Sequence
  Description of Artificial Sequence: Synthetic oligonucleotide
tgtactggaacagccagaaggacatcctgg

SEQ ID NO: 54600 - DNA, 35 bp, Artificial Sequence
  Description of Artificial Sequence: Synthetic oligonucleotide
agaattacgttcaccagttacggcaggaatgctac

SEQ ID NO: 54601 - DNA, 34 bp, Artificial Sequence
  Description of Artificial Sequence: Synthetic oligonucleotide
gaattacgttcaccagttacggcaggaatgctac

SEQ ID NO: 54602 - DNA, 34 bp, Artificial Sequence
  Description of Artificial Sequence: Synthetic oligonucleotide
aattacgttcaccagttacggcaggaatgctacg

SEQ ID NO: 54603 - DNA, 33 bp, Artificial Sequence
  Description of Artificial Sequence: Synthetic oligonucleotide
attacgttcaccagttacggcaggaatgctacg

SEQ ID NO: 54604 - DNA, 32 bp, Artificial Sequence
  Description of Artificial Sequence: Synthetic oligonucleotide
ttacgttcaccagttacggcaggaatgctacg

SEQ ID NO: 54605 - DNA, 31 bp, Artificial Sequence
  Description of Artificial Sequence: Synthetic oligonucleotide
tacgttcaccagttacggcaggaatgctacg

SEQ ID NO: 54606 - DNA, 30 bp, Artificial Sequence
  Description of Artificial Sequence: Synthetic oligonucleotide
acgttcaccagttacggcaggaatgctacg

SEQ ID NO: 54607 - DNA, 29 bp, Artificial Sequence
  Description of Artificial Sequence: Synthetic oligonucleotide
cgttcaccagttacggcaggaatgctacg

SEQ ID NO: 54608 - DNA, 29 bp, Artificial Sequence
  Description of Artificial Sequence: Synthetic oligonucleotide
gttcaccagttacggcaggaatgctacgc

SEQ ID NO: 54609 - DNA, 29 bp, Artificial Sequence
  Description of Artificial Sequence: Synthetic oligonucleotide
ttcaccagttacggcaggaatgctacgcg

SEQ ID NO: 54610 - DNA, 28 bp, Artificial Sequence
  Description of Artificial Sequence: Synthetic oligonucleotide
tcaccagttacggcaggaatgctacgcg

SEQ ID NO: 54611 - DNA, 24 bp, Artificial Sequence
  Description of Artificial Sequence: Synthetic oligonucleotide
tggacgaggccgtgaccctgcaga

SEQ ID NO: 54612 - DNA, 23 bp, Artificial Sequence
  Description of Artificial Sequence: Synthetic oligonucleotide
ggacgaggccgtgaccctgcaga

SEQ ID NO: 54613 - DNA, 23 bp, Artificial Sequence
  Description of Artificial Sequence: Synthetic oligonucleotide
gacgaggccgtgaccctgcagag

SEQ ID NO: 54614 - DNA, 23 bp, Artificial Sequence
  Description of Artificial Sequence: Synthetic oligonucleotide
acgaggccgtgaccctgcagagc

SEQ ID NO: 54615 - DNA, 22 bp, Artificial Sequence
  Description of Artificial Sequence: Synthetic oligonucleotide
cgaggccgtgaccctgcagagc

SEQ ID NO: 54616 - DNA, 22 bp, Artificial Sequence
  Description of Artificial Sequence: Synthetic oligonucleotide
gaggccgtgaccctgcagagcc

SEQ ID NO: 54617 - DNA, 23 bp, Artificial Sequence
  Description of Artificial Sequence: Synthetic oligonucleotide
aggccgtgaccctgcagagccga

SEQ ID NO: 54618 - DNA, 22 bp, Artificial Sequence
  Description of Artificial Sequence: Synthetic oligonucleotide
ggccgtgaccctgcagagccga

SEQ ID NO: 54619 - DNA, 23 bp, Artificial Sequence
  Description of Artificial Sequence: Synthetic oligonucleotide
gccgtgaccctgcagagccgagt

SEQ ID NO: 54620 - DNA, 23 bp, Artificial Sequence
  Description of Artificial Sequence: Synthetic oligonucleotide
ccgtgaccctgcagagccgagtc

SEQ ID NO: 54621 - DNA, 24 bp, Artificial Sequence
  Description of Artificial Sequence: Synthetic oligonucleotide
cgtgaccctgcagagccgagtcca

SEQ ID NO: 54622 - DNA, 24 bp, Artificial Sequence
  Description of Artificial Sequence: Synthetic oligonucleotide
gtgaccctgcagagccgagtccag

SEQ ID NO: 54623 - DNA, 24 bp, Artificial Sequence
  Description of Artificial Sequence: Synthetic oligonucleotide
tgaccctgcagagccgagtccagc

SEQ ID NO: 54624 - DNA, 23 bp, Artificial Sequence
  Description of Artificial Sequence: Synthetic oligonucleotide
gaccctgcagagccgagtccagc

SEQ ID NO: 54625 - DNA, 26 bp, Artificial Sequence
  Description of Artificial Sequence: Synthetic oligonucleotide
accctgcagagccgagtccagcctaa

SEQ ID NO: 54626 - DNA, 25 bp, Artificial Sequence
  Description of Artificial Sequence: Synthetic oligonucleotide
ccctgcagagccgagtccagcctaa

SEQ ID NO: 54627 - DNA, 25 bp, Artificial Sequence
  Description of Artificial Sequence: Synthetic oligonucleotide
cctgcagagccgagtccagcctaag

SEQ ID NO: 54628 - DNA, 26 bp, Artificial Sequence
  Description of Artificial Sequence: Synthetic oligonucleotide
ctgcagagccgagtccagcctaaggt

SEQ ID NO: 54629 - DNA, 27 bp, Artificial Sequence
  Description of Artificial Sequence: Synthetic oligonucleotide
tgcagagccgagtccagcctaaggtga

SEQ ID NO: 54630 - DNA, 27 bp, Artificial Sequence
  Description of Artificial Sequence: Synthetic oligonucleotide
gcagagccgagtccagcctaaggtgaa

SEQ ID NO: 54631 - DNA, 27 bp, Artificial Sequence
  Description of Artificial Sequence: Synthetic oligonucleotide
cagagccgagtccagcctaaggtgaac

SEQ ID NO: 54632 - DNA, 27 bp, Artificial Sequence
  Description of Artificial Sequence: Synthetic oligonucleotide
agagccgagtccagcctaaggtgaacg

SEQ ID NO: 54633 - DNA, 27 bp, Artificial Sequence
  Description of Artificial Sequence: Synthetic oligonucleotide
gagccgagtccagcctaaggtgaacgt

SEQ ID NO: 54634 - DNA, 29 bp, Artificial Sequence
  Description of Artificial Sequence: Synthetic oligonucleotide
agccgagtccagcctaaggtgaacgtttc

SEQ ID NO: 54635 - DNA, 28 bp, Artificial Sequence
  Description of Artificial Sequence: Synthetic oligonucleotide
cttttccagggacggcaggaatgctacc

SEQ ID NO: 54636 - DNA, 28 bp, Artificial Sequence
  Description of Artificial Sequence: Synthetic oligonucleotide
ttttccagggacggcaggaatgctaccc

SEQ ID NO: 54637 - DNA, 27 bp, Artificial Sequence
  Description of Artificial Sequence: Synthetic oligonucleotide
tttccagggacggcaggaatgctaccc

SEQ ID NO: 54638 - DNA, 26 bp, Artificial Sequence
  Description of Artificial Sequence: Synthetic oligonucleotide
ttccagggacggcaggaatgctaccc

SEQ ID NO: 54639 - DNA, 25 bp, Artificial Sequence
  Description of Artificial Sequence: Synthetic oligonucleotide
tccagggacggcaggaatgctaccc

SEQ ID NO: 54640 - DNA, 24 bp, Artificial Sequence
  Description of Artificial Sequence: Synthetic oligonucleotide
ccagggacggcaggaatgctaccc

SEQ ID NO: 54641 - DNA, 27 bp, Artificial Sequence
  Description of Artificial Sequence: Synthetic oligonucleotide
cagggacggcaggaatgctacccgttt

SEQ ID NO: 54642 - DNA, 30 bp, Artificial Sequence
  Description of Artificial Sequence: Synthetic oligonucleotide
agggacggcaggaatgctacccgtttaatg

SEQ ID NO: 54643 - DNA, 29 bp, Artificial Sequence
  Description of Artificial Sequence: Synthetic oligonucleotide
gggacggcaggaatgctacccgtttaatg

SEQ ID NO: 54644 - DNA, 29 bp, Artificial Sequence
  Description of Artificial Sequence: Synthetic oligonucleotide
ggacggcaggaatgctacccgtttaatgg

SEQ ID NO: 54645 - DNA, 29 bp, Artificial Sequence
  Description of Artificial Sequence: Synthetic oligonucleotide
gacggcaggaatgctacccgtttaatggg

SEQ ID NO: 54646 - DNA, 30 bp, Artificial Sequence
  Description of Artificial Sequence: Synthetic oligonucleotide
acggcaggaatgctacccgtttaatgggac

SEQ ID NO: 54647 - DNA, 29 bp, Artificial Sequence
  Description of Artificial Sequence: Synthetic oligonucleotide
cggcaggaatgctacccgtttaatgggac

SEQ ID NO: 54648 - DNA, 30 bp, Artificial Sequence
  Description of Artificial Sequence: Synthetic oligonucleotide
ggcaggaatgctacccgtttaatgggacac

SEQ ID NO: 54649 - DNA, 31 bp, Artificial Sequence
  Description of Artificial Sequence: Synthetic oligonucleotide
gcaggaatgctacccgtttaatgggacacag

SEQ ID NO: 54650 - DNA, 31 bp, Artificial Sequence
  Description of Artificial Sequence: Synthetic oligonucleotide
caggaatgctacccgtttaatgggacacagc

SEQ ID NO: 54651 - DNA, 31 bp, Artificial Sequence
  Description of Artificial Sequence: Synthetic oligonucleotide
aggaatgctacccgtttaatgggacacagcg

SEQ ID NO: 54652 - DNA, 30 bp, Artificial Sequence
  Description of Artificial Sequence: Synthetic oligonucleotide
ggaatgctacccgtttaatgggacacagcg

SEQ ID NO: 54653 - DNA, 30 bp, Artificial Sequence
  Description of Artificial Sequence: Synthetic oligonucleotide
gaatgctacccgtttaatgggacacagcgc

SEQ ID NO: 54654 - DNA, 32 bp, Artificial Sequence
  Description of Artificial Sequence: Synthetic oligonucleotide
aatgctacccgtttaatgggacacagcgcttc

SEQ ID NO: 54655 - DNA, 31 bp, Artificial Sequence
  Description of Artificial Sequence: Synthetic oligonucleotide
atgctacccgtttaatgggacacagcgcttc

SEQ ID NO: 54656 - DNA, 30 bp, Artificial Sequence
  Description of Artificial Sequence: Synthetic oligonucleotide
tgctacccgtttaatgggacacagcgcttc

SEQ ID NO: 54657 - DNA, 29 bp, Artificial Sequence
  Description of Artificial Sequence: Synthetic oligonucleotide
gctacccgtttaatgggacacagcgcttc

SEQ ID NO: 54658 - DNA, 29 bp, Artificial Sequence
  Description of Artificial Sequence: Synthetic oligonucleotide
ctacccgtttaatgggacacagcgcttcc

SEQ ID NO: 54659 - DNA, 30 bp, Artificial Sequence
  Description of Artificial Sequence: Synthetic oligonucleotide
tacccgtttaatgggacacagcgcttcctg

SEQ ID NO: 54660 - DNA, 29 bp, Artificial Sequence
  Description of Artificial Sequence: Synthetic oligonucleotide
acccgtttaatgggacacagcgcttcctg

SEQ ID NO: 54661 - DNA, 28 bp, Artificial Sequence
  Description of Artificial Sequence: Synthetic oligonucleotide
cccgtttaatgggacacagcgcttcctg

SEQ ID NO: 54662 - DNA, 28 bp, Artificial Sequence
  Description of Artificial Sequence: Synthetic oligonucleotide
ccgtttaatgggacacagcgcttcctgg

SEQ ID NO: 54663 - DNA, 32 bp, Artificial Sequence
  Description of Artificial Sequence: Synthetic oligonucleotide
atgaggagtactggaacagccagaaggacttc

SEQ ID NO: 54664 - DNA, 31 bp, Artificial Sequence
  Description of Artificial Sequence: Synthetic oligonucleotide
tgaggagtactggaacagccagaaggacttc

SEQ ID NO: 54665 - DNA, 30 bp, Artificial Sequence
  Description of Artificial Sequence: Synthetic oligonucleotide
gaggagtactggaacagccagaaggacttc

SEQ ID NO: 54666 - DNA, 30 bp, Artificial Sequence
  Description of Artificial Sequence: Synthetic oligonucleotide
aggagtactggaacagccagaaggacttcc

SEQ ID NO: 54667 - DNA, 29 bp, Artificial Sequence
  Description of Artificial Sequence: Synthetic oligonucleotide
ggagtactggaacagccagaaggacttcc

SEQ ID NO: 54668 - DNA, 30 bp, Artificial Sequence
  Description of Artificial Sequence: Synthetic oligonucleotide
gagtactggaacagccagaaggacttcctg

SEQ ID NO: 54669 - DNA, 30 bp, Artificial Sequence
  Description of Artificial Sequence: Synthetic oligonucleotide
agtactggaacagccagaaggacttcctgg

SEQ ID NO: 54670 - DNA, 29 bp, Artificial Sequence
  Description of Artificial Sequence: Synthetic oligonucleotide
gtactggaacagccagaaggacttcctgg

SEQ ID NO: 54671 - DNA, 30 bp, Artificial Sequence
  Description of Artificial Sequence: Synthetic oligonucleotide
tactggaacagccagaaggacttcctggag

SEQ ID NO: 54672 - DNA, 29 bp, Artificial Sequence
  Description of Artificial Sequence: Synthetic oligonucleotide
actggaacagccagaaggacttcctggag

SEQ ID NO: 54673 - DNA, 28 bp, Artificial Sequence
  Description of Artificial Sequence: Synthetic oligonucleotide
ctggaacagccagaaggacttcctggag

SEQ ID NO: 54674 - DNA, 28 bp, Artificial Sequence
  Description of Artificial Sequence: Synthetic oligonucleotide
tggaacagccagaaggacttcctggagg

SEQ ID NO: 54675 - DNA, 27 bp, Artificial Sequence
  Description of Artificial Sequence: Synthetic oligonucleotide
ggaacagccagaaggacttcctggagg

SEQ ID NO: 54676 - DNA, 28 bp, Artificial Sequence
  Description of Artificial Sequence: Synthetic oligonucleotide
gaacagccagaaggacttcctggaggag

SEQ ID NO: 54677 - DNA, 28 bp, Artificial Sequence
  Description of Artificial Sequence: Synthetic oligonucleotide
aacagccagaaggacttcctggaggagg

SEQ ID NO: 54678 - DNA, 27 bp, Artificial Sequence
  Description of Artificial Sequence: Synthetic oligonucleotide
acagccagaaggacttcctggaggagg

SEQ ID NO: 54679 - DNA, 27 bp, Artificial Sequence
  Description of Artificial Sequence: Synthetic oligonucleotide
cagccagaaggacttcctggaggagga

SEQ ID NO: 54680 - DNA, 27 bp, Artificial Sequence
  Description of Artificial Sequence: Synthetic oligonucleotide
agccagaaggacttcctggaggaggag

SEQ ID NO: 54681 - DNA, 26 bp, Artificial Sequence
  Description of Artificial Sequence: Synthetic oligonucleotide
gccagaaggacttcctggaggaggag

SEQ ID NO: 54682 - DNA, 26 bp, Artificial Sequence
  Description of Artificial Sequence: Synthetic oligonucleotide
ccagaaggacttcctggaggaggagc

SEQ ID NO: 54683 - DNA, 26 bp, Artificial Sequence
  Description of Artificial Sequence: Synthetic oligonucleotide
cagaaggacttcctggaggaggagcg

SEQ ID NO: 54684 - DNA, 26 bp, Artificial Sequence
  Description of Artificial Sequence: Synthetic oligonucleotide
agaaggacttcctggaggaggagcgg

SEQ ID NO: 54685 - DNA, 25 bp, Artificial Sequence
  Description of Artificial Sequence: Synthetic oligonucleotide
gaaggacttcctggaggaggagcgg

SEQ ID NO: 54686 - DNA, 25 bp, Artificial Sequence
  Description of Artificial Sequence: Synthetic oligonucleotide
aaggacttcctggaggaggagcggg

SEQ ID NO: 54687 - DNA, 24 bp, Artificial Sequence
  Description of Artificial Sequence: Synthetic oligonucleotide
aggacttcctggaggaggagcggg

SEQ ID NO: 54688 - DNA, 23 bp, Artificial Sequence
  Description of Artificial Sequence: Synthetic oligonucleotide
ggacttcctggaggaggagcggg

SEQ ID NO: 54689 - DNA, 24 bp, Artificial Sequence
  Description of Artificial Sequence: Synthetic oligonucleotide
gacttcctggaggaggagcgggca

SEQ ID NO: 54690 - DNA, 25 bp, Artificial Sequence
  Description of Artificial Sequence: Synthetic oligonucleotide
acttcctggaggaggagcgggcagt

SEQ ID NO: 54691 - DNA, 24 bp, Artificial Sequence
  Description of Artificial Sequence: Synthetic oligonucleotide
cttcctggaggaggagcgggcagt

SEQ ID NO: 54692 - DNA, 24 bp, Artificial Sequence
  Description of Artificial Sequence: Synthetic oligonucleotide
ttcctggaggaggagcgggcagtg

SEQ ID NO: 54693 - DNA, 24 bp, Artificial Sequence
  Description of Artificial Sequence: Synthetic oligonucleotide
aggaggagcgggcagtgccggata

SEQ ID NO: 54694 - DNA, 23 bp, Artificial Sequence
  Description of Artificial Sequence: Synthetic oligonucleotide
ggaggagcgggcagtgccggata

SEQ ID NO: 54695 - DNA, 23 bp, Artificial Sequence
  Description of Artificial Sequence: Synthetic oligonucleotide
gaggagcgggcagtgccggatag

SEQ ID NO: 54696 - DNA, 25 bp, Artificial Sequence
  Description of Artificial Sequence: Synthetic oligonucleotide
aggagcgggcagtgccggataggat

SEQ ID NO: 54697 - DNA, 24 bp, Artificial Sequence
  Description of Artificial Sequence: Synthetic oligonucleotide
ggagcgggcagtgccggataggat

SEQ ID NO: 54698 - DNA, 25 bp, Artificial Sequence
  Description of Artificial Sequence: Synthetic oligonucleotide
gagcgggcagtgccggataggatgt

SEQ ID NO: 54699 - DNA, 25 bp, Artificial Sequence
  Description of Artificial Sequence: Synthetic oligonucleotide
agcgggcagtgccggataggatgtg

SEQ ID NO: 54700 - DNA, 24 bp, Artificial Sequence
  Description of Artificial Sequence: Synthetic oligonucleotide
gcgggcagtgccggataggatgtg

SEQ ID NO: 54701 - DNA, 25 bp, Artificial Sequence
  Description of Artificial Sequence: Synthetic oligonucleotide
cgggcagtgccggataggatgtgca

SEQ ID NO: 54702 - DNA, 26 bp, Artificial Sequence
  Description of Artificial Sequence: Synthetic oligonucleotide
gggcagtgccggataggatgtgcaga

SEQ ID NO: 54703 - DNA, 27 bp, Artificial Sequence
  Description of Artificial Sequence: Synthetic oligonucleotide
ggcagtgccggataggatgtgcagaca

SEQ ID NO: 54704 - DNA, 27 bp, Artificial Sequence
  Description of Artificial Sequence: Synthetic oligonucleotide
gcagtgccggataggatgtgcagacac

SEQ ID NO: 54705 - DNA, 29 bp, Artificial Sequence
  Description of Artificial Sequence: Synthetic oligonucleotide
cagtgccggataggatgtgcagacacaac

SEQ ID NO: 54706 - DNA, 31 bp, Artificial Sequence
  Description of Artificial Sequence: Synthetic oligonucleotide
agtgccggataggatgtgcagacacaactac

SEQ ID NO: 54707 - DNA, 30 bp, Artificial Sequence
  Description of Artificial Sequence: Synthetic oligonucleotide
gtgccggataggatgtgcagacacaactac

SEQ ID NO: 54708 - DNA, 30 bp, Artificial Sequence
  Description of Artificial Sequence: Synthetic oligonucleotide
tgccggataggatgtgcagacacaactacg

SEQ ID NO: 54709 - DNA, 29 bp, Artificial Sequence
  Description of Artificial Sequence: Synthetic oligonucleotide
gccggataggatgtgcagacacaactacg

SEQ ID NO: 54710 - DNA, 30 bp, Artificial Sequence
  Description of Artificial Sequence: Synthetic oligonucleotide
ccggataggatgtgcagacacaactacgag

SEQ ID NO: 54711 - DNA, 30 bp, Artificial Sequence
  Description of Artificial Sequence: Synthetic oligonucleotide
cggataggatgtgcagacacaactacgagc

SEQ ID NO: 54712 - DNA, 31 bp, Artificial Sequence
  Description of Artificial Sequence: Synthetic oligonucleotide
ggataggatgtgcagacacaactacgagctg

SEQ ID NO: 54713 - DNA, 31 bp, Artificial Sequence
  Description of Artificial Sequence: Synthetic oligonucleotide
gataggatgtgcagacacaactacgagctgg

SEQ ID NO: 54714 - DNA, 31 bp, Artificial Sequence
  Description of Artificial Sequence: Synthetic oligonucleotide
ataggatgtgcagacacaactacgagctggg

SEQ ID NO: 54715 - DNA, 30 bp, Artificial Sequence
  Description of Artificial Sequence: Synthetic oligonucleotide
taggatgtgcagacacaactacgagctggg

SEQ ID NO: 54716 - DNA, 26 bp, Artificial Sequence
  Description of Artificial Sequence: Synthetic oligonucleotide
acacaactacgagctggacgaggccg

SEQ ID NO: 54717 - DNA, 32 bp, Artificial Sequence
  Description of Artificial Sequence: Synthetic oligonucleotide
atgaggagtactggaacagccagaaggacaac

SEQ ID NO: 54718 - DNA, 31 bp, Artificial Sequence
  Description of Artificial Sequence: Synthetic oligonucleotide
tgaggagtactggaacagccagaaggacaac

SEQ ID NO: 54719 - DNA, 30 bp, Artificial Sequence
  Description of Artificial Sequence: Synthetic oligonucleotide
gaggagtactggaacagccagaaggacaac

SEQ ID NO: 54720 - DNA, 30 bp, Artificial Sequence
  Description of Artificial Sequence: Synthetic oligonucleotide
aggagtactggaacagccagaaggacaacc

SEQ ID NO: 54721 - DNA, 29 bp, Artificial Sequence
  Description of Artificial Sequence: Synthetic oligonucleotide
ggagtactggaacagccagaaggacaacc

SEQ ID NO: 54722 - DNA, 30 bp, Artificial Sequence
  Description of Artificial Sequence: Synthetic oligonucleotide
gagtactggaacagccagaaggacaacctg

SEQ ID NO: 54723 - DNA, 30 bp, Artificial Sequence
  Description of Artificial Sequence: Synthetic oligonucleotide
agtactggaacagccagaaggacaacctgg

SEQ ID NO: 54724 - DNA, 29 bp, Artificial Sequence
  Description of Artificial Sequence: Synthetic oligonucleotide
gtactggaacagccagaaggacaacctgg

SEQ ID NO: 54725 - DNA, 30 bp, Artificial Sequence
  Description of Artificial Sequence: Synthetic oligonucleotide
tactggaacagccagaaggacaacctggag

SEQ ID NO: 54726 - DNA, 29 bp, Artificial Sequence
  Description of Artificial Sequence: Synthetic oligonucleotide
actggaacagccagaaggacaacctggag

SEQ ID NO: 54727 - DNA, 28 bp, Artificial Sequence
  Description of Artificial Sequence: Synthetic oligonucleotide
ctggaacagccagaaggacaacctggag

SEQ ID NO: 54728 - DNA, 28 bp, Artificial Sequence
  Description of Artificial Sequence: Synthetic oligonucleotide
tggaacagccagaaggacaacctggagg

SEQ ID NO: 54729 - DNA, 27 bp, Artificial Sequence
  Description of Artificial Sequence: Synthetic oligonucleotide
ggaacagccagaaggacaacctggagg

SEQ ID NO: 54730 - DNA, 28 bp, Artificial Sequence
  Description of Artificial Sequence: Synthetic oligonucleotide
gaacagccagaaggacaacctggaggag

SEQ ID NO: 54731 - DNA, 30 bp, Artificial Sequence
  Description of Artificial Sequence: Synthetic oligonucleotide
aacagccagaaggacaacctggaggagaag

SEQ ID NO: 54732 - DNA, 29 bp, Artificial Sequence
  Description of Artificial Sequence: Synthetic oligonucleotide
acagccagaaggacaacctggaggagaag

SEQ ID NO: 54733 - DNA, 28 bp, Artificial Sequence
  Description of Artificial Sequence: Synthetic oligonucleotide
cagccagaaggacaacctggaggagaag

SEQ ID NO: 54734 - DNA, 28 bp, Artificial Sequence
  Description of Artificial Sequence: Synthetic oligonucleotide
agccagaaggacaacctggaggagaagc

SEQ ID NO: 54735 - DNA, 27 bp, Artificial Sequence
  Description of Artificial Sequence: Synthetic oligonucleotide
gccagaaggacaacctggaggagaagc

SEQ ID NO: 54736 - DNA, 27 bp, Artificial Sequence
  Description of Artificial Sequence: Synthetic oligonucleotide
ccagaaggacaacctggaggagaagcg

SEQ ID NO: 54737 - DNA, 27 bp, Artificial Sequence
  Description of Artificial Sequence: Synthetic oligonucleotide
cagaaggacaacctggaggagaagcgg

SEQ ID NO: 54738 - DNA, 27 bp, Artificial Sequence
  Description of Artificial Sequence: Synthetic oligonucleotide
agaaggacaacctggaggagaagcggg

SEQ ID NO: 54739 - DNA, 26 bp, Artificial Sequence
  Description of Artificial Sequence: Synthetic oligonucleotide
gaaggacaacctggaggagaagcggg

SEQ ID NO: 54740 - DNA, 27 bp, Artificial Sequence
  Description of Artificial Sequence: Synthetic oligonucleotide
aaggacaacctggaggagaagcgggca

SEQ ID NO: 54741 - DNA, 26 bp, Artificial Sequence
  Description of Artificial Sequence: Synthetic oligonucleotide
aggacaacctggaggagaagcgggca

SEQ ID NO: 54742 - DNA, 25 bp, Artificial Sequence
  Description of Artificial Sequence: Synthetic oligonucleotide
ggacaacctggaggagaagcgggca

SEQ ID NO: 54743 - DNA, 26 bp, Artificial Sequence
  Description of Artificial Sequence: Synthetic oligonucleotide
gacaacctggaggagaagcgggcagt

SEQ ID NO: 54744 - DNA, 26 bp, Artificial Sequence
  Description of Artificial Sequence: Synthetic oligonucleotide
acaacctggaggagaagcgggcagtg

SEQ ID NO: 54745 - DNA, 25 bp, Artificial Sequence
  Description of Artificial Sequence: Synthetic oligonucleotide
caacctggaggagaagcgggcagtg

SEQ ID NO: 54746 - DNA, 25 bp, Artificial Sequence
  Description of Artificial Sequence: Synthetic oligonucleotide
aacctggaggagaagcgggcagtgc

SEQ ID NO: 54747 - DNA, 24 bp, Artificial Sequence
  Description of Artificial Sequence: Synthetic oligonucleotide
acctggaggagaagcgggcagtgc

SEQ ID NO: 54748 - DNA, 30 bp, Artificial Sequence
  Description of Artificial Sequence: Synthetic oligonucleotide
tactggaacagccagaaggacctcctgtag

SEQ ID NO: 54749 - DNA, 29 bp, Artificial Sequence
  Description of Artificial Sequence: Synthetic oligonucleotide
actggaacagccagaaggacctcctgtag

SEQ ID NO: 54750 - DNA, 28 bp, Artificial Sequence
  Description of Artificial Sequence: Synthetic oligonucleotide
ctggaacagccagaaggacctcctgtag

SEQ ID NO: 54751 - DNA, 28 bp, Artificial Sequence
  Description of Artificial Sequence: Synthetic oligonucleotide
tggaacagccagaaggacctcctgtagg

SEQ ID NO: 54752 - DNA, 27 bp, Artificial Sequence
  Description of Artificial Sequence: Synthetic oligonucleotide
ggaacagccagaaggacctcctgtagg

SEQ ID NO: 54753 - DNA, 28 bp, Artificial Sequence
  Description of Artificial Sequence: Synthetic oligonucleotide
gaacagccagaaggacctcctgtaggag

SEQ ID NO: 54754 - DNA, 30 bp, Artificial Sequence
  Description of Artificial Sequence: Synthetic oligonucleotide
aacagccagaaggacctcctgtaggagaag

SEQ ID NO: 54755 - DNA, 29 bp, Artificial Sequence
  Description of Artificial Sequence: Synthetic oligonucleotide
acagccagaaggacctcctgtaggagaag

SEQ ID NO: 54756 - DNA, 28 bp, Artificial Sequence
  Description of Artificial Sequence: Synthetic oligonucleotide
cagccagaaggacctcctgtaggagaag

SEQ ID NO: 54757 - DNA, 28 bp, Artificial Sequence
  Description of Artificial Sequence: Synthetic oligonucleotide
agccagaaggacctcctgtaggagaagc

SEQ ID NO: 54758 - DNA, 27 bp, Artificial Sequence
  Description of Artificial Sequence: Synthetic oligonucleotide
gccagaaggacctcctgtaggagaagc

SEQ ID NO: 54759 - DNA, 27 bp, Artificial Sequence
  Description of Artificial Sequence: Synthetic oligonucleotide
ccagaaggacctcctgtaggagaagcg

SEQ ID NO: 54760 - DNA, 27 bp, Artificial Sequence
  Description of Artificial Sequence: Synthetic oligonucleotide
cagaaggacctcctgtaggagaagcgg

SEQ ID NO: 54761 - DNA, 27 bp, Artificial Sequence
  Description of Artificial Sequence: Synthetic oligonucleotide
agaaggacctcctgtaggagaagcggg

SEQ ID NO: 54762 - DNA, 26 bp, Artificial Sequence
  Description of Artificial Sequence: Synthetic oligonucleotide
gaaggacctcctgtaggagaagcggg

SEQ ID NO: 54763 - DNA, 27 bp, Artificial Sequence
  Description of Artificial Sequence: Synthetic oligonucleotide
aaggacctcctgtaggagaagcgggca

SEQ ID NO: 54764 - DNA, 26 bp, Artificial Sequence
  Description of Artificial Sequence: Synthetic oligonucleotide
aggacctcctgtaggagaagcgggca

SEQ ID NO: 54765 - DNA, 25 bp, Artificial Sequence
  Description of Artificial Sequence: Synthetic oligonucleotide
ggacctcctgtaggagaagcgggca

SEQ ID NO: 54766 - DNA, 26 bp, Artificial Sequence
  Description of Artificial Sequence: Synthetic oligonucleotide
gacctcctgtaggagaagcgggcagt

SEQ ID NO: 54767 - DNA, 26 bp, Artificial Sequence
  Description of Artificial Sequence: Synthetic oligonucleotide
acctcctgtaggagaagcgggcagtg

SEQ ID NO: 54768 - DNA, 25 bp, Artificial Sequence
  Description of Artificial Sequence: Synthetic oligonucleotide
cctcctgtaggagaagcgggcagtg

SEQ ID NO: 54769 - DNA, 25 bp, Artificial Sequence
  Description of Artificial Sequence: Synthetic oligonucleotide
ctcctgtaggagaagcgggcagtgc

SEQ ID NO: 54770 - DNA, 25 bp, Artificial Sequence
  Description of Artificial Sequence: Synthetic oligonucleotide
tcctgtaggagaagcgggcagtgcc

SEQ ID NO: 54771 - DNA, 24 bp, Artificial Sequence
  Description of Artificial Sequence: Synthetic oligonucleotide
cctgtaggagaagcgggcagtgcc

SEQ ID NO: 54772 - DNA, 24 bp, Artificial Sequence
  Description of Artificial Sequence: Synthetic oligonucleotide
ctgtaggagaagcgggcagtgccg

SEQ ID NO: 54773 - DNA, 25 bp, Artificial Sequence
  Description of Artificial Sequence: Synthetic oligonucleotide
tgtaggagaagcgggcagtgccgga

SEQ ID NO: 54774 - DNA, 24 bp, Artificial Sequence
  Description of Artificial Sequence: Synthetic oligonucleotide
gtaggagaagcgggcagtgccgga

SEQ ID NO: 54775 - DNA, 25 bp, Artificial Sequence
  Description of Artificial Sequence: Synthetic oligonucleotide
taggagaagcgggcagtgccggaca

SEQ ID NO: 54776 - DNA, 35 bp, Artificial Sequence
  Description of Artificial Sequence: Synthetic oligonucleotide
aattaagtgtaccagttacggcaggaatgctacgc

SEQ ID NO: 54777 - DNA, 34 bp, Artificial Sequence
  Description of Artificial Sequence: Synthetic oligonucleotide
attaagtgtaccagttacggcaggaatgctacgc

SEQ ID NO: 54778 - DNA, 33 bp, Artificial Sequence
  Description of Artificial Sequence: Synthetic oligonucleotide
ttaagtgtaccagttacggcaggaatgctacgc

SEQ ID NO: 54779 - DNA, 32 bp, Artificial Sequence
  Description of Artificial Sequence: Synthetic oligonucleotide
taagtgtaccagttacggcaggaatgctacgc

SEQ ID NO: 54780 - DNA, 31 bp, Artificial Sequence
  Description of Artificial Sequence: Synthetic oligonucleotide
aagtgtaccagttacggcaggaatgctacgc

SEQ ID NO: 54781 - DNA, 30 bp, Artificial Sequence
  Description of Artificial Sequence: Synthetic oligonucleotide
agtgtaccagttacggcaggaatgctacgc

SEQ ID NO: 54782 - DNA, 33 bp, Artificial Sequence
  Description of Artificial Sequence: Synthetic oligonucleotide
aattacgtggaccagttacggcaggaatgctac

SEQ ID NO: 54783 - DNA, 32 bp, Artificial Sequence
  Description of Artificial Sequence: Synthetic oligonucleotide
attacgtggaccagttacggcaggaatgctac

SEQ ID NO: 54784 - DNA, 31 bp, Artificial Sequence
  Description of Artificial Sequence: Synthetic oligonucleotide
ttacgtggaccagttacggcaggaatgctac

SEQ ID NO: 54785 - DNA, 30 bp, Artificial Sequence
  Description of Artificial Sequence: Synthetic oligonucleotide
tacgtggaccagttacggcaggaatgctac

SEQ ID NO: 54786 - DNA, 29 bp, Artificial Sequence
  Description of Artificial Sequence: Synthetic oligonucleotide
acgtggaccagttacggcaggaatgctac

SEQ ID NO: 54787 - DNA, 28 bp, Artificial Sequence
  Description of Artificial Sequence: Synthetic oligonucleotide
cgtggaccagttacggcaggaatgctac

SEQ ID NO: 54788 - DNA, 28 bp, Artificial Sequence
  Description of Artificial Sequence: Synthetic oligonucleotide
gtggaccagttacggcaggaatgctacg

SEQ ID NO: 54789 - DNA, 28 bp, Artificial Sequence
  Description of Artificial Sequence: Synthetic oligonucleotide
tggaccagttacggcaggaatgctacgc

SEQ ID NO: 54790 - DNA, 27 bp, Artificial Sequence
  Description of Artificial Sequence: Synthetic oligonucleotide
ggaccagttacggcaggaatgctacgc

SEQ ID NO: 54791 - DNA, 27 bp, Artificial Sequence
  Description of Artificial Sequence: Synthetic oligonucleotide
gaccagttacggcaggaatgctacgcg

SEQ ID NO: 54792 - DNA, 29 bp, Artificial Sequence
  Description of Artificial Sequence: Synthetic oligonucleotide
agggtatgcagacacaactacgagctggg

SEQ ID NO: 54793 - DNA, 28 bp, Artificial Sequence
  Description of Artificial Sequence: Synthetic oligonucleotide
gggtatgcagacacaactacgagctggg

SEQ ID NO: 54794 - DNA, 28 bp, Artificial Sequence
  Description of Artificial Sequence: Synthetic oligonucleotide
ggtatgcagacacaactacgagctgggc

SEQ ID NO: 54795 - DNA, 28 bp, Artificial Sequence
  Description of Artificial Sequence: Synthetic oligonucleotide
gtatgcagacacaactacgagctgggcg

SEQ ID NO: 54796 - DNA, 28 bp, Artificial Sequence
  Description of Artificial Sequence: Synthetic oligonucleotide
tatgcagacacaactacgagctgggcgg

SEQ ID NO: 54797 - DNA, 27 bp, Artificial Sequence
  Description of Artificial Sequence: Synthetic oligonucleotide
atgcagacacaactacgagctgggcgg

SEQ ID NO: 54798 - DNA, 35 bp, Artificial Sequence
  Description of Artificial Sequence: Synthetic oligonucleotide
agaattaccttttccagggactgcaggaatgctac

SEQ ID NO: 54799 - DNA, 34 bp, Artificial Sequence
  Description of Artificial Sequence: Synthetic oligonucleotide
gaattaccttttccagggactgcaggaatgctac

SEQ ID NO: 54800 - DNA, 34 bp, Artificial Sequence
  Description of Artificial Sequence: Synthetic oligonucleotide
aattaccttttccagggactgcaggaatgctacg

SEQ ID NO: 54801 - DNA, 33 bp, Artificial Sequence
  Description of Artificial Sequence: Synthetic oligonucleotide
attaccttttccagggactgcaggaatgctacg

SEQ ID NO: 54802 - DNA, 32 bp, Artificial Sequence
  Description of Artificial Sequence: Synthetic oligonucleotide
ttaccttttccagggactgcaggaatgctacg

SEQ ID NO: 54803 - DNA, 31 bp, Artificial Sequence
  Description of Artificial Sequence: Synthetic oligonucleotide
taccttttccagggactgcaggaatgctacg

SEQ ID NO: 54804 - DNA, 30 bp, Artificial Sequence
  Description of Artificial Sequence: Synthetic oligonucleotide
accttttccagggactgcaggaatgctacg

SEQ ID NO: 54805 - DNA, 29 bp, Artificial Sequence
  Description of Artificial Sequence: Synthetic oligonucleotide
ccttttccagggactgcaggaatgctacg

SEQ ID NO: 54806 - DNA, 29 bp, Artificial Sequence
  Description of Artificial Sequence: Synthetic oligonucleotide
cttttccagggactgcaggaatgctacgc

SEQ ID NO: 54807 - DNA, 29 bp, Artificial Sequence
  Description of Artificial Sequence: Synthetic oligonucleotide
ttttccagggactgcaggaatgctacgcg

SEQ ID NO: 54808 - DNA, 28 bp, Artificial Sequence
  Description of Artificial Sequence: Synthetic oligonucleotide
tttccagggactgcaggaatgctacgcg

SEQ ID NO: 54809 - DNA, 27 bp, Artificial Sequence
  Description of Artificial Sequence: Synthetic oligonucleotide
ttccagggactgcaggaatgctacgcg

SEQ ID NO: 54810 - DNA, 27 bp, Artificial Sequence
  Description of Artificial Sequence: Synthetic oligonucleotide
tccagggactgcaggaatgctacgcgt

SEQ ID NO: 54811 - DNA, 27 bp, Artificial Sequence
  Description of Artificial Sequence: Synthetic oligonucleotide
ccagggactgcaggaatgctacgcgtt

SEQ ID NO: 54812 - DNA, 31 bp, Artificial Sequence
  Description of Artificial Sequence: Synthetic oligonucleotide
cagggactgcaggaatgctacgcgtttaatg

SEQ ID NO: 54813 - DNA, 31 bp, Artificial Sequence
  Description of Artificial Sequence: Synthetic oligonucleotide
agggactgcaggaatgctacgcgtttaatgg

SEQ ID NO: 54814 - DNA, 30 bp, Artificial Sequence
  Description of Artificial Sequence: Synthetic oligonucleotide
gggactgcaggaatgctacgcgtttaatgg

SEQ ID NO: 54815 - DNA, 30 bp, Artificial Sequence
  Description of Artificial Sequence: Synthetic oligonucleotide
ggactgcaggaatgctacgcgtttaatggg

SEQ ID NO: 54816 - DNA, 31 bp, Artificial Sequence
  Description of Artificial Sequence: Synthetic oligonucleotide
gactgcaggaatgctacgcgtttaatgggac

SEQ ID NO: 54817 - DNA, 32 bp, Artificial Sequence
  Description of Artificial Sequence: Synthetic oligonucleotide
actgcaggaatgctacgcgtttaatgggacac

SEQ ID NO: 54818 - DNA, 31 bp, Artificial Sequence
  Description of Artificial Sequence: Synthetic oligonucleotide
ctgcaggaatgctacgcgtttaatgggacac

SEQ ID NO: 54819 - DNA, 32 bp, Artificial Sequence
  Description of Artificial Sequence: Synthetic oligonucleotide
tgcaggaatgctacgcgtttaatgggacacag

SEQ ID NO: 54820 - DNA, 25 bp, Artificial Sequence
  Description of Artificial Sequence: Synthetic oligonucleotide
tcctggaggagaagcgggcagtgct

SEQ ID NO: 54821 - DNA, 24 bp, Artificial Sequence
  Description of Artificial Sequence: Synthetic oligonucleotide
cctggaggagaagcgggcagtgct

SEQ ID NO: 54822 - DNA, 24 bp, Artificial Sequence
  Description of Artificial Sequence: Synthetic oligonucleotide
ctggaggagaagcgggcagtgctg

SEQ ID NO: 54823 - DNA, 25 bp, Artificial Sequence
  Description of Artificial Sequence: Synthetic oligonucleotide
tggaggagaagcgggcagtgctgga

SEQ ID NO: 54824 - DNA, 24 bp, Artificial Sequence
  Description of Artificial Sequence: Synthetic oligonucleotide
ggaggagaagcgggcagtgctgga

SEQ ID NO: 54825 - DNA, 25 bp, Artificial Sequence
  Description of Artificial Sequence: Synthetic oligonucleotide
gaggagaagcgggcagtgctggaca

SEQ ID NO: 54826 - DNA, 25 bp, Artificial Sequence
  Description of Artificial Sequence: Synthetic oligonucleotide
aggagaagcgggcagtgctggacag

SEQ ID NO: 54827 - DNA, 24 bp, Artificial Sequence
  Description of Artificial Sequence: Synthetic oligonucleotide
ggagaagcgggcagtgctggacag

SEQ ID NO: 54828 - DNA, 24 bp, Artificial Sequence
  Description of Artificial Sequence: Synthetic oligonucleotide
gagaagcgggcagtgctggacagg

SEQ ID NO: 54829 - DNA, 27 bp, Artificial Sequence
  Description of Artificial Sequence: Synthetic oligonucleotide
agaagcgggcagtgctggacagggtat

SEQ ID NO: 54830 - DNA, 26 bp, Artificial Sequence
  Description of Artificial Sequence: Synthetic oligonucleotide
gaagcgggcagtgctggacagggtat

SEQ ID NO: 54831 - DNA, 26 bp, Artificial Sequence
  Description of Artificial Sequence: Synthetic oligonucleotide
aagcgggcagtgctggacagggtatg

SEQ ID NO: 54832 - DNA, 25 bp, Artificial Sequence
  Description of Artificial Sequence: Synthetic oligonucleotide
agcgggcagtgctggacagggtatg

SEQ ID NO: 54833 - DNA, 24 bp, Artificial Sequence
  Description of Artificial Sequence: Synthetic oligonucleotide
gcgggcagtgctggacagggtatg

SEQ ID NO: 54834 - DNA, 25 bp, Artificial Sequence
  Description of Artificial Sequence: Synthetic oligonucleotide
cgggcagtgctggacagggtatgca

SEQ ID NO: 54835 - DNA, 26 bp, Artificial Sequence
  Description of Artificial Sequence: Synthetic oligonucleotide
gggcagtgctggacagggtatgcaga

SEQ ID NO: 54836 - DNA, 27 bp, Artificial Sequence
  Description of Artificial Sequence: Synthetic oligonucleotide
ggcagtgctggacagggtatgcagaca

SEQ ID NO: 54837 - DNA, 27 bp, Artificial Sequence
  Description of Artificial Sequence: Synthetic oligonucleotide
gcagtgctggacagggtatgcagacac

SEQ ID NO: 54838 - DNA, 29 bp, Artificial Sequence
  Description of Artificial Sequence: Synthetic oligonucleotide
cagtgctggacagggtatgcagacacaac

SEQ ID NO: 54839 - DNA, 31 bp, Artificial Sequence
  Description of Artificial Sequence: Synthetic oligonucleotide
agtgctggacagggtatgcagacacaactac

SEQ ID NO: 54840 - DNA, 30 bp, Artificial Sequence
  Description of Artificial Sequence: Synthetic oligonucleotide
gtgctggacagggtatgcagacacaactac

SEQ ID NO: 54841 - DNA, 30 bp, Artificial Sequence
  Description of Artificial Sequence: Synthetic oligonucleotide
tgctggacagggtatgcagacacaactacg

SEQ ID NO: 54842 - DNA, 29 bp, Artificial Sequence
  Description of Artificial Sequence: Synthetic oligonucleotide
gctggacagggtatgcagacacaactacg

SEQ ID NO: 54843 - DNA, 30 bp, Artificial Sequence
  Description of Artificial Sequence: Synthetic oligonucleotide
ctggacagggtatgcagacacaactacgag

SEQ ID NO: 54844 - DNA, 30 bp, Artificial Sequence
  Description of Artificial Sequence: Synthetic oligonucleotide
tggacagggtatgcagacacaactacgagc

SEQ ID NO: 54845 - DNA, 22 bp, Artificial Sequence
  Description of Artificial Sequence: Synthetic oligonucleotide
gcgggcccatgaccctgcagca

SEQ ID NO: 54846 - DNA, 22 bp, Artificial Sequence
  Description of Artificial Sequence: Synthetic oligonucleotide
cgggcccatgaccctgcagcac

SEQ ID NO: 54847 - DNA, 22 bp, Artificial Sequence
  Description of Artificial Sequence: Synthetic oligonucleotide
gggcccatgaccctgcagcacc

SEQ ID NO: 54848 - DNA, 23 bp, Artificial Sequence
  Description of Artificial Sequence: Synthetic oligonucleotide
ggcccatgaccctgcagcaccga

SEQ ID NO: 54849 - DNA, 23 bp, Artificial Sequence
  Description of Artificial Sequence: Synthetic oligonucleotide
gcccatgaccctgcagcaccgag

SEQ ID NO: 54850 - DNA, 30 bp, Artificial Sequence
  Description of Artificial Sequence: Synthetic oligonucleotide
aacagccagaaggacttcctggaggagaag

SEQ ID NO: 54851 - DNA, 29 bp, Artificial Sequence
  Description of Artificial Sequence: Synthetic oligonucleotide
acagccagaaggacttcctggaggagaag

SEQ ID NO: 54852 - DNA, 28 bp, Artificial Sequence
  Description of Artificial Sequence: Synthetic oligonucleotide
cagccagaaggacttcctggaggagaag

SEQ ID NO: 54853 - DNA, 28 bp, Artificial Sequence
  Description of Artificial Sequence: Synthetic oligonucleotide
agccagaaggacttcctggaggagaagc

SEQ ID NO: 54854 - DNA, 27 bp, Artificial Sequence
  Description of Artificial Sequence: Synthetic oligonucleotide
gccagaaggacttcctggaggagaagc

SEQ ID NO: 54855 - DNA, 27 bp, Artificial Sequence
  Description of Artificial Sequence: Synthetic oligonucleotide
ccagaaggacttcctggaggagaagcg

SEQ ID NO: 54856 - DNA, 27 bp, Artificial Sequence
  Description of Artificial Sequence: Synthetic oligonucleotide
cagaaggacttcctggaggagaagcgg

SEQ ID NO: 54857 - DNA, 27 bp, Artificial Sequence
  Description of Artificial Sequence: Synthetic oligonucleotide
agaaggacttcctggaggagaagcggg

SEQ ID NO: 54858 - DNA, 26 bp, Artificial Sequence
  Description of Artificial Sequence: Synthetic oligonucleotide
gaaggacttcctggaggagaagcggg

SEQ ID NO: 54859 - DNA, 27 bp, Artificial Sequence
  Description of Artificial Sequence: Synthetic oligonucleotide
aaggacttcctggaggagaagcgggca

SEQ ID NO: 54860 - DNA, 26 bp, Artificial Sequence
  Description of Artificial Sequence: Synthetic oligonucleotide
aggacttcctggaggagaagcgggca

SEQ ID NO: 54861 - DNA, 25 bp, Artificial Sequence
  Description of Artificial Sequence: Synthetic oligonucleotide
ggacttcctggaggagaagcgggca

SEQ ID NO: 54862 - DNA, 26 bp, Artificial Sequence
  Description of Artificial Sequence: Synthetic oligonucleotide
gacttcctggaggagaagcgggcagt

SEQ ID NO: 54863 - DNA, 26 bp, Artificial Sequence
  Description of Artificial Sequence: Synthetic oligonucleotide
acttcctggaggagaagcgggcagtg

SEQ ID NO: 54864 - DNA, 25 bp, Artificial Sequence
  Description of Artificial Sequence: Synthetic oligonucleotide
cttcctggaggagaagcgggcagtg

SEQ ID NO: 54865 - DNA, 25 bp, Artificial Sequence
  Description of Artificial Sequence: Synthetic oligonucleotide
ttcctggaggagaagcgggcagtgc

SEQ ID NO: 54866 - DNA, 21 bp, Artificial Sequence
  Description of Artificial Sequence: Synthetic oligonucleotide
ggagctggggcggcctgagga

SEQ ID NO: 54867 - DNA, 21 bp, Artificial Sequence
  Description of Artificial Sequence: Synthetic oligonucleotide
gagctggggcggcctgaggag

SEQ ID NO: 54868 - DNA, 22 bp, Artificial Sequence
  Description of Artificial Sequence: Synthetic oligonucleotide
agctggggcggcctgaggagga

SEQ ID NO: 54869 - DNA, 21 bp, Artificial Sequence
  Description of Artificial Sequence: Synthetic oligonucleotide
gctggggcggcctgaggagga

SEQ ID NO: 54870 - DNA, 23 bp, Artificial Sequence
  Description of Artificial Sequence: Synthetic oligonucleotide
ctggggcggcctgaggaggagta

SEQ ID NO: 54871 - DNA, 24 bp, Artificial Sequence
  Description of Artificial Sequence: Synthetic oligonucleotide
tggggcggcctgaggaggagtact

SEQ ID NO: 54872 - DNA, 23 bp, Artificial Sequence
  Description of Artificial Sequence: Synthetic oligonucleotide
ggggcggcctgaggaggagtact

SEQ ID NO: 54873 - DNA, 23 bp, Artificial Sequence
  Description of Artificial Sequence: Synthetic oligonucleotide
gggcggcctgaggaggagtactg

SEQ ID NO: 54874 - DNA, 25 bp, Artificial Sequence
  Description of Artificial Sequence: Synthetic oligonucleotide
ggcggcctgaggaggagtactggaa

SEQ ID NO: 54875 - DNA, 26 bp, Artificial Sequence
  Description of Artificial Sequence: Synthetic oligonucleotide
gcggcctgaggaggagtactggaaca

SEQ ID NO: 54876 - DNA, 26 bp, Artificial Sequence
  Description of Artificial Sequence: Synthetic oligonucleotide
cggcctgaggaggagtactggaacag

SEQ ID NO: 54877 - DNA, 26 bp, Artificial Sequence
  Description of Artificial Sequence: Synthetic oligonucleotide
ggcctgaggaggagtactggaacagc

SEQ ID NO: 54878 - DNA, 27 bp, Artificial Sequence
  Description of Artificial Sequence: Synthetic oligonucleotide
gcctgaggaggagtactggaacagcca

SEQ ID NO: 54879 - DNA, 27 bp, Artificial Sequence
  Description of Artificial Sequence: Synthetic oligonucleotide
cctgaggaggagtactggaacagccag

SEQ ID NO: 54880 - DNA, 29 bp, Artificial Sequence
  Description of Artificial Sequence: Synthetic oligonucleotide
ctgaggaggagtactggaacagccagaag

SEQ ID NO: 54881 - DNA, 29 bp, Artificial Sequence
  Description of Artificial Sequence: Synthetic oligonucleotide
tgaggaggagtactggaacagccagaagg

SEQ ID NO: 54882 - DNA, 28 bp, Artificial Sequence
  Description of Artificial Sequence: Synthetic oligonucleotide
gaggaggagtactggaacagccagaagg

SEQ ID NO: 54883 - DNA, 29 bp, Artificial Sequence
  Description of Artificial Sequence: Synthetic oligonucleotide
aggaggagtactggaacagccagaaggac

SEQ ID NO: 54884 - DNA, 28 bp, Artificial Sequence
  Description of Artificial Sequence: Synthetic oligonucleotide
ggaggagtactggaacagccagaaggac

SEQ ID NO: 54885 - DNA, 23 bp, Artificial Sequence
  Description of Artificial Sequence: Synthetic oligonucleotide
gacgaggccgtgaccctgcagca

SEQ ID NO: 54886 - DNA, 23 bp, Artificial Sequence
  Description of Artificial Sequence: Synthetic oligonucleotide
acgaggccgtgaccctgcagcac

SEQ ID NO: 54887 - DNA, 22 bp, Artificial Sequence
  Description of Artificial Sequence: Synthetic oligonucleotide
cgaggccgtgaccctgcagcac

SEQ ID NO: 54888 - DNA, 22 bp, Artificial Sequence
  Description of Artificial Sequence: Synthetic oligonucleotide
gaggccgtgaccctgcagcacc

SEQ ID NO: 54889 - DNA, 23 bp, Artificial Sequence
  Description of Artificial Sequence: Synthetic oligonucleotide
aggccgtgaccctgcagcaccga

SEQ ID NO: 54890 - DNA, 22 bp, Artificial Sequence
  Description of Artificial Sequence: Synthetic oligonucleotide
ggccgtgaccctgcagcaccga

SEQ ID NO: 54891 - DNA, 23 bp, Artificial Sequence
  Description of Artificial Sequence: Synthetic oligonucleotide
gccgtgaccctgcagcaccgagt

SEQ ID NO: 54892 - DNA, 23 bp, Artificial Sequence
  Description of Artificial Sequence: Synthetic oligonucleotide
ccgtgaccctgcagcaccgagtc

SEQ ID NO: 54893 - DNA, 24 bp, Artificial Sequence
  Description of Artificial Sequence: Synthetic oligonucleotide
cgtgaccctgcagcaccgagtcca

SEQ ID NO: 54894 - DNA, 24 bp, Artificial Sequence
  Description of Artificial Sequence: Synthetic oligonucleotide
gtgaccctgcagcaccgagtccag

SEQ ID NO: 54895 - DNA, 24 bp, Artificial Sequence
  Description of Artificial Sequence: Synthetic oligonucleotide
tgaccctgcagcaccgagtccagc

SEQ ID NO: 54896 - DNA, 23 bp, Artificial Sequence
  Description of Artificial Sequence: Synthetic oligonucleotide
gaccctgcagcaccgagtccagc

SEQ ID NO: 54897 - DNA, 26 bp, Artificial Sequence
  Description of Artificial Sequence: Synthetic oligonucleotide
accctgcagcaccgagtccagcctaa

SEQ ID NO: 54898 - DNA, 25 bp, Artificial Sequence
  Description of Artificial Sequence: Synthetic oligonucleotide
ccctgcagcaccgagtccagcctaa

SEQ ID NO: 54899 - DNA, 25 bp, Artificial Sequence
  Description of Artificial Sequence: Synthetic oligonucleotide
cctgcagcaccgagtccagcctaag

SEQ ID NO: 54900 - DNA, 26 bp, Artificial Sequence
  Description of Artificial Sequence: Synthetic oligonucleotide
ctgcagcaccgagtccagcctaaggt

SEQ ID NO: 54901 - DNA, 27 bp, Artificial Sequence
  Description of Artificial Sequence: Synthetic oligonucleotide
tgcagcaccgagtccagcctaaggtga

SEQ ID NO: 54902 - DNA, 27 bp, Artificial Sequence
  Description of Artificial Sequence: Synthetic oligonucleotide
gcagcaccgagtccagcctaaggtgaa

SEQ ID NO: 54903 - DNA, 27 bp, Artificial Sequence
  Description of Artificial Sequence: Synthetic oligonucleotide
cagcaccgagtccagcctaaggtgaac

SEQ ID NO: 54904 - DNA, 27 bp, Artificial Sequence
  Description of Artificial Sequence: Synthetic oligonucleotide
agcaccgagtccagcctaaggtgaacg

SEQ ID NO: 54905 - DNA, 27 bp, Artificial Sequence
  Description of Artificial Sequence: Synthetic oligonucleotide
gcaccgagtccagcctaaggtgaacgt

SEQ ID NO: 54906 - DNA, 29 bp, Artificial Sequence
  Description of Artificial Sequence: Synthetic oligonucleotide
caccgagtccagcctaaggtgaacgtttc

SEQ ID NO: 54907 - DNA, 29 bp, Artificial Sequence
  Description of Artificial Sequence: Synthetic oligonucleotide
accgagtccagcctaaggtgaacgtttcc

SEQ ID NO: 54908 - DNA, 29 bp, Artificial Sequence
  Description of Artificial Sequence: Synthetic oligonucleotide
agccagaaggacatcctggaggagaagtg

SEQ ID NO: 54909 - DNA, 28 bp, Artificial Sequence
  Description of Artificial Sequence: Synthetic oligonucleotide
gccagaaggacatcctggaggagaagtg

SEQ ID NO: 54910 - DNA, 28 bp, Artificial Sequence
  Description of Artificial Sequence: Synthetic oligonucleotide
ccagaaggacatcctggaggagaagtgg

SEQ ID NO: 54911 - DNA, 28 bp, Artificial Sequence
  Description of Artificial Sequence: Synthetic oligonucleotide
cagaaggacatcctggaggagaagtggg

SEQ ID NO: 54912 - DNA, 28 bp, Artificial Sequence
  Description of Artificial Sequence: Synthetic oligonucleotide
agaaggacatcctggaggagaagtgggc

SEQ ID NO: 54913 - DNA, 27 bp, Artificial Sequence
  Description of Artificial Sequence: Synthetic oligonucleotide
gaaggacatcctggaggagaagtgggc

SEQ ID NO: 54914 - DNA, 28 bp, Artificial Sequence
  Description of Artificial Sequence: Synthetic oligonucleotide
aaggacatcctggaggagaagtgggcag

SEQ ID NO: 54915 - DNA, 27 bp, Artificial Sequence
  Description of Artificial Sequence: Synthetic oligonucleotide
aggacatcctggaggagaagtgggcag

SEQ ID NO: 54916 - DNA, 27 bp, Artificial Sequence
  Description of Artificial Sequence: Synthetic oligonucleotide
ggacatcctggaggagaagtgggcagt

SEQ ID NO: 54917 - DNA, 27 bp, Artificial Sequence
  Description of Artificial Sequence: Synthetic oligonucleotide
gacatcctggaggagaagtgggcagtg

SEQ ID NO: 54918 - DNA, 27 bp, Artificial Sequence
  Description of Artificial Sequence: Synthetic oligonucleotide
acatcctggaggagaagtgggcagtgc

SEQ ID NO: 54919 - DNA, 26 bp, Artificial Sequence
  Description of Artificial Sequence: Synthetic oligonucleotide
catcctggaggagaagtgggcagtgc

SEQ ID NO: 54920 - DNA, 26 bp, Artificial Sequence
  Description of Artificial Sequence: Synthetic oligonucleotide
atcctggaggagaagtgggcagtgcc

SEQ ID NO: 54921 - DNA, 25 bp, Artificial Sequence
  Description of Artificial Sequence: Synthetic oligonucleotide
tcctggaggagaagtgggcagtgcc

SEQ ID NO: 54922 - DNA, 24 bp, Artificial Sequence
  Description of Artificial Sequence: Synthetic oligonucleotide
cctggaggagaagtgggcagtgcc

SEQ ID NO: 54923 - DNA, 24 bp, Artificial Sequence
  Description of Artificial Sequence: Synthetic oligonucleotide
ctggaggagaagtgggcagtgccg

SEQ ID NO: 54924 - DNA, 25 bp, Artificial Sequence
  Description of Artificial Sequence: Synthetic oligonucleotide
tggaggagaagtgggcagtgccgga

SEQ ID NO: 54925 - DNA, 24 bp, Artificial Sequence
  Description of Artificial Sequence: Synthetic oligonucleotide
ggaggagaagtgggcagtgccgga

SEQ ID NO: 54926 - DNA, 25 bp, Artificial Sequence
  Description of Artificial Sequence: Synthetic oligonucleotide
gaggagaagtgggcagtgccggaca

SEQ ID NO: 54927 - DNA, 25 bp, Artificial Sequence
  Description of Artificial Sequence: Synthetic oligonucleotide
aggagaagtgggcagtgccggacag

SEQ ID NO: 54928 - DNA, 24 bp, Artificial Sequence
  Description of Artificial Sequence: Synthetic oligonucleotide
ggagaagtgggcagtgccggacag

SEQ ID NO: 54929 - DNA, 26 bp, Artificial Sequence
  Description of Artificial Sequence: Synthetic oligonucleotide
gagaagtgggcagtgccggacaggat

SEQ ID NO: 54930 - DNA, 27 bp, Artificial Sequence
  Description of Artificial Sequence: Synthetic oligonucleotide
agaagtgggcagtgccggacaggatgt

SEQ ID NO: 54931 - DNA, 26 bp, Artificial Sequence
  Description of Artificial Sequence: Synthetic oligonucleotide
gaagtgggcagtgccggacaggatgt

SEQ ID NO: 54932 - DNA, 26 bp, Artificial Sequence
  Description of Artificial Sequence: Synthetic oligonucleotide
aagtgggcagtgccggacaggatgtg

SEQ ID NO: 54933 - DNA, 25 bp, Artificial Sequence
  Description of Artificial Sequence: Synthetic oligonucleotide
agtgggcagtgccggacaggatgtg

SEQ ID NO: 54934 - DNA, 24 bp, Artificial Sequence
  Description of Artificial Sequence: Synthetic oligonucleotide
gtgggcagtgccggacaggatgtg

SEQ ID NO: 54935 - DNA, 25 bp, Artificial Sequence
  Description of Artificial Sequence: Synthetic oligonucleotide
tgggcagtgccggacaggatgtgca

SEQ ID NO: 54936 - DNA, 27 bp, Artificial Sequence
  Description of Artificial Sequence: Synthetic oligonucleotide
ctgcggagtactggaacagccagaagc

SEQ ID NO: 54937 - DNA, 28 bp, Artificial Sequence
  Description of Artificial Sequence: Synthetic oligonucleotide
tgcggagtactggaacagccagaagcac

SEQ ID NO: 54938 - DNA, 27 bp, Artificial Sequence
  Description of Artificial Sequence: Synthetic oligonucleotide
gcggagtactggaacagccagaagcac

SEQ ID NO: 54939 - DNA, 29 bp, Artificial Sequence
  Description of Artificial Sequence: Synthetic oligonucleotide
cggagtactggaacagccagaagcacatc

SEQ ID NO: 54940 - DNA, 29 bp, Artificial Sequence
  Description of Artificial Sequence: Synthetic oligonucleotide
ggagtactggaacagccagaagcacatcc

SEQ ID NO: 54941 - DNA, 30 bp, Artificial Sequence
  Description of Artificial Sequence: Synthetic oligonucleotide
gagtactggaacagccagaagcacatcctg

SEQ ID NO: 54942 - DNA, 30 bp, Artificial Sequence
  Description of Artificial Sequence: Synthetic oligonucleotide
agtactggaacagccagaagcacatcctgg

SEQ ID NO: 54943 - DNA, 29 bp, Artificial Sequence
  Description of Artificial Sequence: Synthetic oligonucleotide
gtactggaacagccagaagcacatcctgg

SEQ ID NO: 54944 - DNA, 30 bp, Artificial Sequence
  Description of Artificial Sequence: Synthetic oligonucleotide
tactggaacagccagaagcacatcctggag

SEQ ID NO: 54945 - DNA, 29 bp, Artificial Sequence
  Description of Artificial Sequence: Synthetic oligonucleotide
actggaacagccagaagcacatcctggag

SEQ ID NO: 54946 - DNA, 28 bp, Artificial Sequence
  Description of Artificial Sequence: Synthetic oligonucleotide
ctggaacagccagaagcacatcctggag

SEQ ID NO: 54947 - DNA, 28 bp, Artificial Sequence
  Description of Artificial Sequence: Synthetic oligonucleotide
tggaacagccagaagcacatcctggagg

SEQ ID NO: 54948 - DNA, 27 bp, Artificial Sequence
  Description of Artificial Sequence: Synthetic oligonucleotide
ggaacagccagaagcacatcctggagg

SEQ ID NO: 54949 - DNA, 28 bp, Artificial Sequence
  Description of Artificial Sequence: Synthetic oligonucleotide
gaacagccagaagcacatcctggaggag

SEQ ID NO: 54950 - DNA, 30 bp, Artificial Sequence
  Description of Artificial Sequence: Synthetic oligonucleotide
aacagccagaagcacatcctggaggagaag

SEQ ID NO: 54951 - DNA, 29 bp, Artificial Sequence
  Description of Artificial Sequence: Synthetic oligonucleotide
acagccagaagcacatcctggaggagaag

SEQ ID NO: 54952 - DNA, 28 bp, Artificial Sequence
  Description of Artificial Sequence: Synthetic oligonucleotide
cagccagaagcacatcctggaggagaag

SEQ ID NO: 54953 - DNA, 28 bp, Artificial Sequence
  Description of Artificial Sequence: Synthetic oligonucleotide
agccagaagcacatcctggaggagaagc

SEQ ID NO: 54954 - DNA, 27 bp, Artificial Sequence
  Description of Artificial Sequence: Synthetic oligonucleotide
gccagaagcacatcctggaggagaagc

SEQ ID NO: 54955 - DNA, 27 bp, Artificial Sequence
  Description of Artificial Sequence: Synthetic oligonucleotide
ccagaagcacatcctggaggagaagcg

SEQ ID NO: 54956 - DNA, 27 bp, Artificial Sequence
  Description of Artificial Sequence: Synthetic oligonucleotide
cagaagcacatcctggaggagaagcgg

SEQ ID NO: 54957 - DNA, 27 bp, Artificial Sequence
  Description of Artificial Sequence: Synthetic oligonucleotide
agaagcacatcctggaggagaagcggg

SEQ ID NO: 54958 - DNA, 26 bp, Artificial Sequence
  Description of Artificial Sequence: Synthetic oligonucleotide
gaagcacatcctggaggagaagcggg

SEQ ID NO: 54959 - DNA, 27 bp, Artificial Sequence
  Description of Artificial Sequence: Synthetic oligonucleotide
aagcacatcctggaggagaagcgggca

SEQ ID NO: 54960 - DNA, 26 bp, Artificial Sequence
  Description of Artificial Sequence: Synthetic oligonucleotide
agcacatcctggaggagaagcgggca

SEQ ID NO: 54961 - DNA, 25 bp, Artificial Sequence
  Description of Artificial Sequence: Synthetic oligonucleotide
gcacatcctggaggagaagcgggca

SEQ ID NO: 54962 - DNA, 26 bp, Artificial Sequence
  Description of Artificial Sequence: Synthetic oligonucleotide
cacatcctggaggagaagcgggcagt

SEQ ID NO: 54963 - DNA, 25 bp, Artificial Sequence
  Description of Artificial Sequence: Synthetic oligonucleotide
ctcgtgcgcttcgacagcgacgtgt

SEQ ID NO: 54964 - DNA, 25 bp, Artificial Sequence
  Description of Artificial Sequence: Synthetic oligonucleotide
tcgtgcgcttcgacagcgacgtgtg

SEQ ID NO: 54965 - DNA, 24 bp, Artificial Sequence
  Description of Artificial Sequence: Synthetic oligonucleotide
cgtgcgcttcgacagcgacgtgtg

SEQ ID NO: 54966 - DNA, 24 bp, Artificial Sequence
  Description of Artificial Sequence: Synthetic oligonucleotide
gtgcgcttcgacagcgacgtgtgg

SEQ ID NO: 54967 - DNA, 25 bp, Artificial Sequence
  Description of Artificial Sequence: Synthetic oligonucleotide
tgcgcttcgacagcgacgtgtggga

SEQ ID NO: 54968 - DNA, 24 bp, Artificial Sequence
  Description of Artificial Sequence: Synthetic oligonucleotide
gcgcttcgacagcgacgtgtggga

SEQ ID NO: 54969 - DNA, 26 bp, Artificial Sequence
  Description of Artificial Sequence: Synthetic oligonucleotide
cgcttcgacagcgacgtgtgggagtt

SEQ ID NO: 54970 - DNA, 26 bp, Artificial Sequence
  Description of Artificial Sequence: Synthetic oligonucleotide
gcttcgacagcgacgtgtgggagttc

SEQ ID NO: 54971 - DNA, 26 bp, Artificial Sequence
  Description of Artificial Sequence: Synthetic oligonucleotide
cttcgacagcgacgtgtgggagttcc

SEQ ID NO: 54972 - DNA, 26 bp, Artificial Sequence
  Description of Artificial Sequence: Synthetic oligonucleotide
ttcgacagcgacgtgtgggagttccg

SEQ ID NO: 54973 - DNA, 25 bp, Artificial Sequence
  Description of Artificial Sequence: Synthetic oligonucleotide
tcgacagcgacgtgtgggagttccg

SEQ ID NO: 54974 - DNA, 24 bp, Artificial Sequence
  Description of Artificial Sequence: Synthetic oligonucleotide
cgacagcgacgtgtgggagttccg

SEQ ID NO: 54975 - DNA, 24 bp, Artificial Sequence
  Description of Artificial Sequence: Synthetic oligonucleotide
gacagcgacgtgtgggagttccgg

SEQ ID NO: 54976 - DNA, 24 bp, Artificial Sequence
  Description of Artificial Sequence: Synthetic oligonucleotide
acagcgacgtgtgggagttccggg

SEQ ID NO: 54977 - DNA, 23 bp, Artificial Sequence
  Description of Artificial Sequence: Synthetic oligonucleotide
cagcgacgtgtgggagttccggg

SEQ ID NO: 54978 - DNA, 23 bp, Artificial Sequence
  Description of Artificial Sequence: Synthetic oligonucleotide
agcgacgtgtgggagttccgggc

SEQ ID NO: 54979 - DNA, 22 bp, Artificial Sequence
  Description of Artificial Sequence: Synthetic oligonucleotide
gcgacgtgtgggagttccgggc

SEQ ID NO: 54980 - DNA, 22 bp, Artificial Sequence
  Description of Artificial Sequence: Synthetic oligonucleotide
cgacgtgtgggagttccgggcg

SEQ ID NO: 54981 - DNA, 23 bp, Artificial Sequence
  Description of Artificial Sequence: Synthetic oligonucleotide
gacgtgtgggagttccgggcggt

SEQ ID NO: 54982 - DNA, 24 bp, Artificial Sequence
  Description of Artificial Sequence: Synthetic oligonucleotide
acgtgtgggagttccgggcggtga

SEQ ID NO: 54983 - DNA, 23 bp, Artificial Sequence
  Description of Artificial Sequence: Synthetic oligonucleotide
cgtgtgggagttccgggcggtga

SEQ ID NO: 54984 - DNA, 23 bp, Artificial Sequence
  Description of Artificial Sequence: Synthetic oligonucleotide
gtgtgggagttccgggcggtgac

SEQ ID NO: 54985 - DNA, 23 bp, Artificial Sequence
  Description of Artificial Sequence: Synthetic oligonucleotide
tgtgggagttccgggcggtgacg

SEQ ID NO: 54986 - DNA, 22 bp, Artificial Sequence
  Description of Artificial Sequence: Synthetic oligonucleotide
gtgggagttccgggcggtgacg

SEQ ID NO: 54987 - DNA, 23 bp, Artificial Sequence
  Description of Artificial Sequence: Synthetic oligonucleotide
tgggagttccgggcggtgacgga

SEQ ID NO: 54988 - DNA, 31 bp, Artificial Sequence
  Description of Artificial Sequence: Synthetic oligonucleotide
tttaatgggacacagcgcttcctggagagag

SEQ ID NO: 54989 - DNA, 30 bp, Artificial Sequence
  Description of Artificial Sequence: Synthetic oligonucleotide
ttaatgggacacagcgcttcctggagagag

SEQ ID NO: 54990 - DNA, 29 bp, Artificial Sequence
  Description of Artificial Sequence: Synthetic oligonucleotide
taatgggacacagcgcttcctggagagag

SEQ ID NO: 54991 - DNA, 28 bp, Artificial Sequence
  Description of Artificial Sequence: Synthetic oligonucleotide
aatgggacacagcgcttcctggagagag

SEQ ID NO: 54992 - DNA, 27 bp, Artificial Sequence
  Description of Artificial Sequence: Synthetic oligonucleotide
atgggacacagcgcttcctggagagag

SEQ ID NO: 54993 - DNA, 27 bp, Artificial Sequence
  Description of Artificial Sequence: Synthetic oligonucleotide
tgggacacagcgcttcctggagagaga

SEQ ID NO: 54994 - DNA, 26 bp, Artificial Sequence
  Description of Artificial Sequence: Synthetic oligonucleotide
gggacacagcgcttcctggagagaga

SEQ ID NO: 54995 - DNA, 27 bp, Artificial Sequence
  Description of Artificial Sequence: Synthetic oligonucleotide
ggacacagcgcttcctggagagagaca

SEQ ID NO: 54996 - DNA, 28 bp, Artificial Sequence
  Description of Artificial Sequence: Synthetic oligonucleotide
gacacagcgcttcctggagagagacatc

SEQ ID NO: 54997 - DNA, 30 bp, Artificial Sequence
  Description of Artificial Sequence: Synthetic oligonucleotide
acacagcgcttcctggagagagacatctac

SEQ ID NO: 54998 - DNA, 29 bp, Artificial Sequence
  Description of Artificial Sequence: Synthetic oligonucleotide
cacagcgcttcctggagagagacatctac

SEQ ID NO: 54999 - DNA, 31 bp, Artificial Sequence
  Description of Artificial Sequence: Synthetic oligonucleotide
acagcgcttcctggagagagacatctacaac

SEQ ID NO: 55000 - DNA, 30 bp, Artificial Sequence
  Description of Artificial Sequence: Synthetic oligonucleotide
cagcgcttcctggagagagacatctacaac

SEQ ID NO: 55001 - DNA, 30 bp, Artificial Sequence
  Description of Artificial Sequence: Synthetic oligonucleotide
agcgcttcctggagagagacatctacaacc

SEQ ID NO: 55002 - DNA, 29 bp, Artificial Sequence
  Description of Artificial Sequence: Synthetic oligonucleotide
gcgcttcctggagagagacatctacaacc

SEQ ID NO: 55003 - DNA, 29 bp, Artificial Sequence
  Description of Artificial Sequence: Synthetic oligonucleotide
cgcttcctggagagagacatctacaaccg

SEQ ID NO: 55004 - DNA, 29 bp, Artificial Sequence
  Description of Artificial Sequence: Synthetic oligonucleotide
gcttcctggagagagacatctacaaccgg

SEQ ID NO: 55005 - DNA, 29 bp, Artificial Sequence
  Description of Artificial Sequence: Synthetic oligonucleotide
cttcctggagagagacatctacaaccggg

SEQ ID NO: 55006 - DNA, 30 bp, Artificial Sequence
  Description of Artificial Sequence: Synthetic oligonucleotide
ttcctggagagagacatctacaaccgggag

SEQ ID NO: 55007 - DNA, 29 bp, Artificial Sequence
  Description of Artificial Sequence: Synthetic oligonucleotide
tcctggagagagacatctacaaccgggag

SEQ ID NO: 55008 - DNA, 28 bp, Artificial Sequence
  Description of Artificial Sequence: Synthetic oligonucleotide
cctggagagagacatctacaaccgggag

SEQ ID NO: 55009 - DNA, 28 bp, Artificial Sequence
  Description of Artificial Sequence: Synthetic oligonucleotide
ctggagagagacatctacaaccgggagg

SEQ ID NO: 55010 - DNA, 29 bp, Artificial Sequence
  Description of Artificial Sequence: Synthetic oligonucleotide
tggagagagacatctacaaccgggaggag

SEQ ID NO: 55011 - DNA, 28 bp, Artificial Sequence
  Description of Artificial Sequence: Synthetic oligonucleotide
ggagagagacatctacaaccgggaggag

SEQ ID NO: 55012 - DNA, 30 bp, Artificial Sequence
  Description of Artificial Sequence: Synthetic oligonucleotide
gagagagacatctacaaccgggaggagttc

SEQ ID NO: 55013 - DNA, 30 bp, Artificial Sequence
  Description of Artificial Sequence: Synthetic oligonucleotide
agagagacatctacaaccgggaggagttcg

SEQ ID NO: 55014 - DNA, 29 bp, Artificial Sequence
  Description of Artificial Sequence: Synthetic oligonucleotide
gagagacatctacaaccgggaggagttcg

SEQ ID NO: 55015 - DNA, 29 bp, Artificial Sequence
  Description of Artificial Sequence: Synthetic oligonucleotide
agagacatctacaaccgggaggagttcgc

SEQ ID NO: 55016 - DNA, 28 bp, Artificial Sequence
  Description of Artificial Sequence: Synthetic oligonucleotide
gagacatctacaaccgggaggagttcgc

SEQ ID NO: 55017 - DNA, 28 bp, Artificial Sequence
  Description of Artificial Sequence: Synthetic oligonucleotide
agacatctacaaccgggaggagttcgcg

SEQ ID NO: 55018 - DNA, 27 bp, Artificial Sequence
  Description of Artificial Sequence: Synthetic oligonucleotide
gacatctacaaccgggaggagttcgcg

SEQ ID NO: 55019 - DNA, 31 bp, Artificial Sequence
  Description of Artificial Sequence: Synthetic oligonucleotide
atgatcctaaacaaagctctgctgctggggg

SEQ ID NO: 55020 - DNA, 30 bp, Artificial Sequence
  Description of Artificial Sequence: Synthetic oligonucleotide
tgatcctaaacaaagctctgctgctggggg

SEQ ID NO: 55021 - DNA, 29 bp, Artificial Sequence
  Description of Artificial Sequence: Synthetic oligonucleotide
gatcctaaacaaagctctgctgctggggg

SEQ ID NO: 55022 - DNA, 29 bp, Artificial Sequence
  Description of Artificial Sequence: Synthetic oligonucleotide
atcctaaacaaagctctgctgctgggggc

SEQ ID NO: 55023 - DNA, 28 bp, Artificial Sequence
  Description of Artificial Sequence: Synthetic oligonucleotide
tcctaaacaaagctctgctgctgggggc

SEQ ID NO: 55024 - DNA, 27 bp, Artificial Sequence
  Description of Artificial Sequence: Synthetic oligonucleotide
cctaaacaaagctctgctgctgggggc

SEQ ID NO: 55025 - DNA, 27 bp, Artificial Sequence
  Description of Artificial Sequence: Synthetic oligonucleotide
ctaaacaaagctctgctgctgggggcc

SEQ ID NO: 55026 - DNA, 27 bp, Artificial Sequence
  Description of Artificial Sequence: Synthetic oligonucleotide
taaacaaagctctgctgctgggggccc

SEQ ID NO: 55027 - DNA, 27 bp, Artificial Sequence
  Description of Artificial Sequence: Synthetic oligonucleotide
aaacaaagctctgctgctgggggccct

SEQ ID NO: 55028 - DNA, 26 bp, Artificial Sequence
  Description of Artificial Sequence: Synthetic oligonucleotide
aacaaagctctgctgctgggggccct

SEQ ID NO: 55029 - DNA, 25 bp, Artificial Sequence
  Description of Artificial Sequence: Synthetic oligonucleotide
acaaagctctgctgctgggggccct

SEQ ID NO: 55030 - DNA, 24 bp, Artificial Sequence
  Description of Artificial Sequence: Synthetic oligonucleotide
caaagctctgctgctgggggccct

SEQ ID NO: 55031 - DNA, 24 bp, Artificial Sequence
  Description of Artificial Sequence: Synthetic oligonucleotide
aaagctctgctgctgggggccctc

SEQ ID NO: 55032 - DNA, 23 bp, Artificial Sequence
  Description of Artificial Sequence: Synthetic oligonucleotide
aagctctgctgctgggggccctc

SEQ ID NO: 55033 - DNA, 22 bp, Artificial Sequence
  Description of Artificial Sequence: Synthetic oligonucleotide
agctctgctgctgggggccctc

SEQ ID NO: 55034 - DNA, 21 bp, Artificial Sequence
  Description of Artificial Sequence: Synthetic oligonucleotide
gctctgctgctgggggccctc

SEQ ID NO: 55035 - DNA, 21 bp, Artificial Sequence
  Description of Artificial Sequence: Synthetic oligonucleotide
ctctgctgctgggggccctcg

SEQ ID NO: 55036 - DNA, 22 bp, Artificial Sequence
  Description of Artificial Sequence: Synthetic oligonucleotide
tctgctgctgggggccctcgct

SEQ ID NO: 55037 - DNA, 21 bp, Artificial Sequence
  Description of Artificial Sequence: Synthetic oligonucleotide
ctgctgctgggggccctcgct

SEQ ID NO: 55038 - DNA, 22 bp, Artificial Sequence
  Description of Artificial Sequence: Synthetic oligonucleotide
tgctgctgggggccctcgctct

SEQ ID NO: 55039 - DNA, 21 bp, Artificial Sequence
  Description of Artificial Sequence: Synthetic oligonucleotide
gctgctgggggccctcgctct

SEQ ID NO: 55040 - DNA, 22 bp, Artificial Sequence
  Description of Artificial Sequence: Synthetic oligonucleotide
ctgctgggggccctcgctctga

SEQ ID NO: 55041 - DNA, 22 bp, Artificial Sequence
  Description of Artificial Sequence: Synthetic oligonucleotide
tgctgggggccctcgctctgac

SEQ ID NO: 55042 - DNA, 21 bp, Artificial Sequence
  Description of Artificial Sequence: Synthetic oligonucleotide
gctgggggccctcgctctgac

SEQ ID NO: 55043 - DNA, 22 bp, Artificial Sequence
  Description of Artificial Sequence: Synthetic oligonucleotide
ctgggggccctcgctctgacca

SEQ ID NO: 55044 - DNA, 22 bp, Artificial Sequence
  Description of Artificial Sequence: Synthetic oligonucleotide
tgggggccctcgctctgaccac

SEQ ID NO: 55045 - DNA, 21 bp, Artificial Sequence
  Description of Artificial Sequence: Synthetic oligonucleotide
gggggccctcgctctgaccac

SEQ ID NO: 55046 - DNA, 21 bp, Artificial Sequence
  Description of Artificial Sequence: Synthetic oligonucleotide
ggggccctcgctctgaccacc

SEQ ID NO: 55047 - DNA, 22 bp, Artificial Sequence
  Description of Artificial Sequence: Synthetic oligonucleotide
gggccctcgctctgaccaccgt

SEQ ID NO: 55048 - DNA, 24 bp, Artificial Sequence
  Description of Artificial Sequence: Synthetic oligonucleotide
ggccctcgctctgaccaccgtgat

SEQ ID NO: 55049 - DNA, 25 bp, Artificial Sequence
  Description of Artificial Sequence: Synthetic oligonucleotide
gccctcgctctgaccaccgtgatga

SEQ ID NO: 55050 - DNA, 25 bp, Artificial Sequence
  Description of Artificial Sequence: Synthetic oligonucleotide
ccctcgctctgaccaccgtgatgag

SEQ ID NO: 55051 - DNA, 25 bp, Artificial Sequence
  Description of Artificial Sequence: Synthetic oligonucleotide
cctcgctctgaccaccgtgatgagc

SEQ ID NO: 55052 - DNA, 25 bp, Artificial Sequence
  Description of Artificial Sequence: Synthetic oligonucleotide
ctcgctctgaccaccgtgatgagcc

SEQ ID NO: 55053 - DNA, 25 bp, Artificial Sequence
  Description of Artificial Sequence: Synthetic oligonucleotide
tcgctctgaccaccgtgatgagccc

SEQ ID NO: 55054 - DNA, 24 bp, Artificial Sequence
  Description of Artificial Sequence: Synthetic oligonucleotide
cgctctgaccaccgtgatgagccc

SEQ ID NO: 55055 - DNA, 25 bp, Artificial Sequence
  Description of Artificial Sequence: Synthetic oligonucleotide
gctctgaccaccgtgatgagcccct

SEQ ID NO: 55056 - DNA, 26 bp, Artificial Sequence
  Description of Artificial Sequence: Synthetic oligonucleotide
ctctgaccaccgtgatgagcccctgt

SEQ ID NO: 55057 - DNA, 26 bp, Artificial Sequence
  Description of Artificial Sequence: Synthetic oligonucleotide
tctgaccaccgtgatgagcccctgtg

SEQ ID NO: 55058 - DNA, 25 bp, Artificial Sequence
  Description of Artificial Sequence: Synthetic oligonucleotide
ctgaccaccgtgatgagcccctgtg

SEQ ID NO: 55059 - DNA, 26 bp, Artificial Sequence
  Description of Artificial Sequence: Synthetic oligonucleotide
tgaccaccgtgatgagcccctgtgga

SEQ ID NO: 55060 - DNA, 25 bp, Artificial Sequence
  Description of Artificial Sequence: Synthetic oligonucleotide
gaccaccgtgatgagcccctgtgga

SEQ ID NO: 55061 - DNA, 25 bp, Artificial Sequence
  Description of Artificial Sequence: Synthetic oligonucleotide
accaccgtgatgagcccctgtggag

SEQ ID NO: 55062 - DNA, 24 bp, Artificial Sequence
  Description of Artificial Sequence: Synthetic oligonucleotide
ccaccgtgatgagcccctgtggag

SEQ ID NO: 55063 - DNA, 25 bp, Artificial Sequence
  Description of Artificial Sequence: Synthetic oligonucleotide
caccgtgatgagcccctgtggaggt

SEQ ID NO: 55064 - DNA, 27 bp, Artificial Sequence
  Description of Artificial Sequence: Synthetic oligonucleotide
accgtgatgagcccctgtggaggtgaa

SEQ ID NO: 55065 - DNA, 26 bp, Artificial Sequence
  Description of Artificial Sequence: Synthetic oligonucleotide
ccgtgatgagcccctgtggaggtgaa

SEQ ID NO: 55066 - DNA, 27 bp, Artificial Sequence
  Description of Artificial Sequence: Synthetic oligonucleotide
cgtgatgagcccctgtggaggtgaaga

SEQ ID NO: 55067 - DNA, 27 bp, Artificial Sequence
  Description of Artificial Sequence: Synthetic oligonucleotide
gtgatgagcccctgtggaggtgaagac

SEQ ID NO: 55068 - DNA, 30 bp, Artificial Sequence
  Description of Artificial Sequence: Synthetic oligonucleotide
tgatgagcccctgtggaggtgaagacattg

SEQ ID NO: 55069 - DNA, 29 bp, Artificial Sequence
  Description of Artificial Sequence: Synthetic oligonucleotide
gatgagcccctgtggaggtgaagacattg

SEQ ID NO: 55070 - DNA, 30 bp, Artificial Sequence
  Description of Artificial Sequence: Synthetic oligonucleotide
atgagcccctgtggaggtgaagacattgtg

SEQ ID NO: 55071 - DNA, 29 bp, Artificial Sequence
  Description of Artificial Sequence: Synthetic oligonucleotide
tgagcccctgtggaggtgaagacattgtg

SEQ ID NO: 55072 - DNA, 28 bp, Artificial Sequence
  Description of Artificial Sequence: Synthetic oligonucleotide
gagcccctgtggaggtgaagacattgtg

SEQ ID NO: 55073 - DNA, 28 bp, Artificial Sequence
  Description of Artificial Sequence: Synthetic oligonucleotide
agcccctgtggaggtgaagacattgtgg

SEQ ID NO: 55074 - DNA, 27 bp, Artificial Sequence
  Description of Artificial Sequence: Synthetic oligonucleotide
gcccctgtggaggtgaagacattgtgg

SEQ ID NO: 55075 - DNA, 27 bp, Artificial Sequence
  Description of Artificial Sequence: Synthetic oligonucleotide
cccctgtggaggtgaagacattgtggc

SEQ ID NO: 55076 - DNA, 28 bp, Artificial Sequence
  Description of Artificial Sequence: Synthetic oligonucleotide
ccctgtggaggtgaagacattgtggctg

SEQ ID NO: 55077 - DNA, 29 bp, Artificial Sequence
  Description of Artificial Sequence: Synthetic oligonucleotide
cctgtggaggtgaagacattgtggctgac

SEQ ID NO: 55078 - DNA, 29 bp, Artificial Sequence
  Description of Artificial Sequence: Synthetic oligonucleotide
ctgtggaggtgaagacattgtggctgacc

SEQ ID NO: 55079 - DNA, 30 bp, Artificial Sequence
  Description of Artificial Sequence: Synthetic oligonucleotide
tgtggaggtgaagacattgtggctgaccac

SEQ ID NO: 55080 - DNA, 29 bp, Artificial Sequence
  Description of Artificial Sequence: Synthetic oligonucleotide
gtggaggtgaagacattgtggctgaccac

SEQ ID NO: 55081 - DNA, 29 bp, Artificial Sequence
  Description of Artificial Sequence: Synthetic oligonucleotide
tggaggtgaagacattgtggctgaccacg

SEQ ID NO: 55082 - DNA, 28 bp, Artificial Sequence
  Description of Artificial Sequence: Synthetic oligonucleotide
ggaggtgaagacattgtggctgaccacg

SEQ ID NO: 55083 - DNA, 30 bp, Artificial Sequence
  Description of Artificial Sequence: Synthetic oligonucleotide
gaggtgaagacattgtggctgaccacgttg

SEQ ID NO: 55084 - DNA, 30 bp, Artificial Sequence
  Description of Artificial Sequence: Synthetic oligonucleotide
aggtgaagacattgtggctgaccacgttgc

SEQ ID NO: 55085 - DNA, 29 bp, Artificial Sequence
  Description of Artificial Sequence: Synthetic oligonucleotide
ggtgaagacattgtggctgaccacgttgc

SEQ ID NO: 55086 - DNA, 29 bp, Artificial Sequence
  Description of Artificial Sequence: Synthetic oligonucleotide
gtgaagacattgtggctgaccacgttgcc

SEQ ID NO: 55087 - DNA, 30 bp, Artificial Sequence
  Description of Artificial Sequence: Synthetic oligonucleotide
tgaagacattgtggctgaccacgttgcctc

SEQ ID NO: 55088 - DNA, 29 bp, Artificial Sequence
  Description of Artificial Sequence: Synthetic oligonucleotide
gaagacattgtggctgaccacgttgcctc

SEQ ID NO: 55089 - DNA, 31 bp, Artificial Sequence
  Description of Artificial Sequence: Synthetic oligonucleotide
aagacattgtggctgaccacgttgcctcttg

SEQ ID NO: 55090 - DNA, 30 bp, Artificial Sequence
  Description of Artificial Sequence: Synthetic oligonucleotide
agacattgtggctgaccacgttgcctcttg

SEQ ID NO: 55091 - DNA, 29 bp, Artificial Sequence
  Description of Artificial Sequence: Synthetic oligonucleotide
gacattgtggctgaccacgttgcctcttg

SEQ ID NO: 55092 - DNA, 30 bp, Artificial Sequence
  Description of Artificial Sequence: Synthetic oligonucleotide
acattgtggctgaccacgttgcctcttgtg

SEQ ID NO: 55093 - DNA, 29 bp, Artificial Sequence
  Description of Artificial Sequence: Synthetic oligonucleotide
cattgtggctgaccacgttgcctcttgtg

SEQ ID NO: 55094 - DNA, 29 bp, Artificial Sequence
  Description of Artificial Sequence: Synthetic oligonucleotide
attgtggctgaccacgttgcctcttgtgg

SEQ ID NO: 55095 - DNA, 28 bp, Artificial Sequence
  Description of Artificial Sequence: Synthetic oligonucleotide
ttgtggctgaccacgttgcctcttgtgg

SEQ ID NO: 55096 - DNA, 27 bp, Artificial Sequence
  Description of Artificial Sequence: Synthetic oligonucleotide
tgtggctgaccacgttgcctcttgtgg

SEQ ID NO: 55097 - DNA, 27 bp, Artificial Sequence
  Description of Artificial Sequence: Synthetic oligonucleotide
gtggctgaccacgttgcctcttgtggt

SEQ ID NO: 55098 - DNA, 27 bp, Artificial Sequence
  Description of Artificial Sequence: Synthetic oligonucleotide
tggctgaccacgttgcctcttgtggtg

SEQ ID NO: 55099 - DNA, 27 bp, Artificial Sequence
  Description of Artificial Sequence: Synthetic oligonucleotide
ggctgaccacgttgcctcttgtggtgt

SEQ ID NO: 55100 - DNA, 30 bp, Artificial Sequence
  Description of Artificial Sequence: Synthetic oligonucleotide
gctgaccacgttgcctcttgtggtgtaaac

SEQ ID NO: 55101 - DNA, 32 bp, Artificial Sequence
  Description of Artificial Sequence: Synthetic oligonucleotide
ctgaccacgttgcctcttgtggtgtaaacttg

SEQ ID NO: 55102 - DNA, 34 bp, Artificial Sequence
  Description of Artificial Sequence: Synthetic oligonucleotide
tgaccacgttgcctcttgtggtgtaaacttgtac

SEQ ID NO: 55103 - DNA, 33 bp, Artificial Sequence
  Description of Artificial Sequence: Synthetic oligonucleotide
gaccacgttgcctcttgtggtgtaaacttgtac

SEQ ID NO: 55104 - DNA, 33 bp, Artificial Sequence
  Description of Artificial Sequence: Synthetic oligonucleotide
accacgttgcctcttgtggtgtaaacttgtacc

SEQ ID NO: 55105 - DNA, 32 bp, Artificial Sequence
  Description of Artificial Sequence: Synthetic oligonucleotide
ccacgttgcctcttgtggtgtaaacttgtacc

SEQ ID NO: 55106 - DNA, 33 bp, Artificial Sequence
  Description of Artificial Sequence: Synthetic oligonucleotide
cacgttgcctcttgtggtgtaaacttgtaccag

SEQ ID NO: 55107 - DNA, 38 bp, Artificial Sequence
  Description of Artificial Sequence: Synthetic oligonucleotide
acgttgcctcttgtggtgtaaacttgtaccagttttac

SEQ ID NO: 55108 - DNA, 37 bp, Artificial Sequence
  Description of Artificial Sequence: Synthetic oligonucleotide
cgttgcctcttgtggtgtaaacttgtaccagttttac

SEQ ID NO: 55109 - DNA, 37 bp, Artificial Sequence
  Description of Artificial Sequence: Synthetic oligonucleotide
gttgcctcttgtggtgtaaacttgtaccagttttacg

SEQ ID NO: 55110 - DNA, 37 bp, Artificial Sequence
  Description of Artificial Sequence: Synthetic oligonucleotide
ttgcctcttgtggtgtaaacttgtaccagttttacgg

SEQ ID NO: 55111 - DNA, 36 bp, Artificial Sequence
  Description of Artificial Sequence: Synthetic oligonucleotide
tgcctcttgtggtgtaaacttgtaccagttttacgg

SEQ ID NO: 55112 - DNA, 35 bp, Artificial Sequence
  Description of Artificial Sequence: Synthetic oligonucleotide
gcctcttgtggtgtaaacttgtaccagttttacgg

SEQ ID NO: 55113 - DNA, 36 bp, Artificial Sequence
  Description of Artificial Sequence: Synthetic oligonucleotide
cctcttgtggtgtaaacttgtaccagttttacggtc

SEQ ID NO: 55114 - DNA, 36 bp, Artificial Sequence
  Description of Artificial Sequence: Synthetic oligonucleotide
ctcttgtggtgtaaacttgtaccagttttacggtcc

SEQ ID NO: 55115 - DNA, 36 bp, Artificial Sequence
  Description of Artificial Sequence: Synthetic oligonucleotide
tcttgtggtgtaaacttgtaccagttttacggtccc

SEQ ID NO: 55116 - DNA, 35 bp, Artificial Sequence
  Description of Artificial Sequence: Synthetic oligonucleotide
cttgtggtgtaaacttgtaccagttttacggtccc

SEQ ID NO: 55117 - DNA, 36 bp, Artificial Sequence
  Description of Artificial Sequence: Synthetic oligonucleotide
ttgtggtgtaaacttgtaccagttttacggtccctc

SEQ ID NO: 55118 - DNA, 35 bp, Artificial Sequence
  Description of Artificial Sequence: Synthetic oligonucleotide
tgtggtgtaaacttgtaccagttttacggtccctc

SEQ ID NO: 55119 - DNA, 34 bp, Artificial Sequence
  Description of Artificial Sequence: Synthetic oligonucleotide
gtggtgtaaacttgtaccagttttacggtccctc

SEQ ID NO: 55120 - DNA, 35 bp, Artificial Sequence
  Description of Artificial Sequence: Synthetic oligonucleotide
tggtgtaaacttgtaccagttttacggtccctctg

SEQ ID NO: 55121 - DNA, 34 bp, Artificial Sequence
  Description of Artificial Sequence: Synthetic oligonucleotide
ggtgtaaacttgtaccagttttacggtccctctg

SEQ ID NO: 55122 - DNA, 34 bp, Artificial Sequence
  Description of Artificial Sequence: Synthetic oligonucleotide
gtgtaaacttgtaccagttttacggtccctctgg

SEQ ID NO: 55123 - DNA, 34 bp, Artificial Sequence
  Description of Artificial Sequence: Synthetic oligonucleotide
tgtaaacttgtaccagttttacggtccctctggc

SEQ ID NO: 55124 - DNA, 33 bp, Artificial Sequence
  Description of Artificial Sequence: Synthetic oligonucleotide
gtaaacttgtaccagttttacggtccctctggc

SEQ ID NO: 55125 - DNA, 33 bp, Artificial Sequence
  Description of Artificial Sequence: Synthetic oligonucleotide
taaacttgtaccagttttacggtccctctggcc

SEQ ID NO: 55126 - DNA, 32 bp, Artificial Sequence
  Description of Artificial Sequence: Synthetic oligonucleotide
aaacttgtaccagttttacggtccctctggcc

SEQ ID NO: 55127 - DNA, 31 bp, Artificial Sequence
  Description of Artificial Sequence: Synthetic oligonucleotide
aacttgtaccagttttacggtccctctggcc

SEQ ID NO: 55128 - DNA, 30 bp, Artificial Sequence
  Description of Artificial Sequence: Synthetic oligonucleotide
acttgtaccagttttacggtccctctggcc

SEQ ID NO: 55129 - DNA, 29 bp, Artificial Sequence
  Description of Artificial Sequence: Synthetic oligonucleotide
cttgtaccagttttacggtccctctggcc

SEQ ID NO: 55130 - DNA, 30 bp, Artificial Sequence
  Description of Artificial Sequence: Synthetic oligonucleotide
ttgtaccagttttacggtccctctggccag

SEQ ID NO: 55131 - DNA, 29 bp, Artificial Sequence
  Description of Artificial Sequence: Synthetic oligonucleotide
tgtaccagttttacggtccctctggccag

SEQ ID NO: 55132 - DNA, 28 bp, Artificial Sequence
  Description of Artificial Sequence: Synthetic oligonucleotide
gtaccagttttacggtccctctggccag

SEQ ID NO: 55133 - DNA, 30 bp, Artificial Sequence
  Description of Artificial Sequence: Synthetic oligonucleotide
taccagttttacggtccctctggccagtac

SEQ ID NO: 55134 - DNA, 29 bp, Artificial Sequence
  Description of Artificial Sequence: Synthetic oligonucleotide
accagttttacggtccctctggccagtac

SEQ ID NO: 55135 - DNA, 28 bp, Artificial Sequence
  Description of Artificial Sequence: Synthetic oligonucleotide
ccagttttacggtccctctggccagtac

SEQ ID NO: 55136 - DNA, 29 bp, Artificial Sequence
  Description of Artificial Sequence: Synthetic oligonucleotide
cagttttacggtccctctggccagtacac

SEQ ID NO: 55137 - DNA, 29 bp, Artificial Sequence
  Description of Artificial Sequence: Synthetic oligonucleotide
agttttacggtccctctggccagtacacc

SEQ ID NO: 55138 - DNA, 28 bp, Artificial Sequence
  Description of Artificial Sequence: Synthetic oligonucleotide
gttttacggtccctctggccagtacacc

SEQ ID NO: 55139 - DNA, 28 bp, Artificial Sequence
  Description of Artificial Sequence: Synthetic oligonucleotide
ttttacggtccctctggccagtacaccc

SEQ ID NO: 55140 - DNA, 27 bp, Artificial Sequence
  Description of Artificial Sequence: Synthetic oligonucleotide
tttacggtccctctggccagtacaccc

SEQ ID NO: 55141 - DNA, 27 bp, Artificial Sequence
  Description of Artificial Sequence: Synthetic oligonucleotide
ttacggtccctctggccagtacaccca

SEQ ID NO: 55142 - DNA, 27 bp, Artificial Sequence
  Description of Artificial Sequence: Synthetic oligonucleotide
tacggtccctctggccagtacacccat

SEQ ID NO: 55143 - DNA, 26 bp, Artificial Sequence
  Description of Artificial Sequence: Synthetic oligonucleotide
acggtccctctggccagtacacccat

SEQ ID NO: 55144 - DNA, 25 bp, Artificial Sequence
  Description of Artificial Sequence: Synthetic oligonucleotide
cggtccctctggccagtacacccat

SEQ ID NO: 55145 - DNA, 27 bp, Artificial Sequence
  Description of Artificial Sequence: Synthetic oligonucleotide
ggtccctctggccagtacacccatgaa

SEQ ID NO: 55146 - DNA, 30 bp, Artificial Sequence
  Description of Artificial Sequence: Synthetic oligonucleotide
gtccctctggccagtacacccatgaatttg

SEQ ID NO: 55147 - DNA, 32 bp, Artificial Sequence
  Description of Artificial Sequence: Synthetic oligonucleotide
tccctctggccagtacacccatgaatttgatg

SEQ ID NO: 55148 - DNA, 31 bp, Artificial Sequence
  Description of Artificial Sequence: Synthetic oligonucleotide
ccctctggccagtacacccatgaatttgatg

SEQ ID NO: 55149 - DNA, 31 bp, Artificial Sequence
  Description of Artificial Sequence: Synthetic oligonucleotide
cctctggccagtacacccatgaatttgatgg

SEQ ID NO: 55150 - DNA, 32 bp, Artificial Sequence
  Description of Artificial Sequence: Synthetic oligonucleotide
ctctggccagtacacccatgaatttgatggag

SEQ ID NO: 55151 - DNA, 34 bp, Artificial Sequence
  Description of Artificial Sequence: Synthetic oligonucleotide
tctggccagtacacccatgaatttgatggagatg

SEQ ID NO: 55152 - DNA, 33 bp, Artificial Sequence
  Description of Artificial Sequence: Synthetic oligonucleotide
ctggccagtacacccatgaatttgatggagatg

SEQ ID NO: 55153 - DNA, 34 bp, Artificial Sequence
  Description of Artificial Sequence: Synthetic oligonucleotide
tggccagtacacccatgaatttgatggagatgag

SEQ ID NO: 55154 - DNA, 33 bp, Artificial Sequence
  Description of Artificial Sequence: Synthetic oligonucleotide
ggccagtacacccatgaatttgatggagatgag

SEQ ID NO: 55155 - DNA, 33 bp, Artificial Sequence
  Description of Artificial Sequence: Synthetic oligonucleotide
gccagtacacccatgaatttgatggagatgagg

SEQ ID NO: 55156 - DNA, 34 bp, Artificial Sequence
  Description of Artificial Sequence: Synthetic oligonucleotide
ccagtacacccatgaatttgatggagatgaggag

SEQ ID NO: 55157 - DNA, 36 bp, Artificial Sequence
  Description of Artificial Sequence: Synthetic oligonucleotide
cagtacacccatgaatttgatggagatgaggagttc

SEQ ID NO: 55158 - DNA, 38 bp, Artificial Sequence
  Description of Artificial Sequence: Synthetic oligonucleotide
agtacacccatgaatttgatggagatgaggagttctac

SEQ ID NO: 55159 - DNA, 37 bp, Artificial Sequence
  Description of Artificial Sequence: Synthetic oligonucleotide
gtacacccatgaatttgatggagatgaggagttctac

SEQ ID NO: 55160 - DNA, 37 bp, Artificial Sequence
  Description of Artificial Sequence: Synthetic oligonucleotide
tacacccatgaatttgatggagatgaggagttctacg

SEQ ID NO: 55161 - DNA, 36 bp, Artificial Sequence
  Description of Artificial Sequence: Synthetic oligonucleotide
acacccatgaatttgatggagatgaggagttctacg

SEQ ID NO: 55162 - DNA, 35 bp, Artificial Sequence
  Description of Artificial Sequence: Synthetic oligonucleotide
cacccatgaatttgatggagatgaggagttctacg

SEQ ID NO: 55163 - DNA, 36 bp, Artificial Sequence
  Description of Artificial Sequence: Synthetic oligonucleotide
acccatgaatttgatggagatgaggagttctacgtg

SEQ ID NO: 55164 - DNA, 35 bp, Artificial Sequence
  Description of Artificial Sequence: Synthetic oligonucleotide
cccatgaatttgatggagatgaggagttctacgtg

SEQ ID NO: 55165 - DNA, 35 bp, Artificial Sequence
  Description of Artificial Sequence: Synthetic oligonucleotide
ccatgaatttgatggagatgaggagttctacgtgg

SEQ ID NO: 55166 - DNA, 36 bp, Artificial Sequence
  Description of Artificial Sequence: Synthetic oligonucleotide
catgaatttgatggagatgaggagttctacgtggac

SEQ ID NO: 55167 - DNA, 36 bp, Artificial Sequence
  Description of Artificial Sequence: Synthetic oligonucleotide
atgaatttgatggagatgaggagttctacgtggacc

SEQ ID NO: 55168 - DNA, 35 bp, Artificial Sequence
  Description of Artificial Sequence: Synthetic oligonucleotide
tgaatttgatggagatgaggagttctacgtggacc

SEQ ID NO: 55169 - DNA, 34 bp, Artificial Sequence
  Description of Artificial Sequence: Synthetic oligonucleotide
gaatttgatggagatgaggagttctacgtggacc

SEQ ID NO: 55170 - DNA, 35 bp, Artificial Sequence
  Description of Artificial Sequence: Synthetic oligonucleotide
aatttgatggagatgaggagttctacgtggacctg

SEQ ID NO: 55171 - DNA, 34 bp, Artificial Sequence
  Description of Artificial Sequence: Synthetic oligonucleotide
atttgatggagatgaggagttctacgtggacctg

SEQ ID NO: 55172 - DNA, 33 bp, Artificial Sequence
  Description of Artificial Sequence: Synthetic oligonucleotide
tttgatggagatgaggagttctacgtggacctg

SEQ ID NO: 55173 - DNA, 32 bp, Artificial Sequence
  Description of Artificial Sequence: Synthetic oligonucleotide
ttgatggagatgaggagttctacgtggacctg

SEQ ID NO: 55174 - DNA, 31 bp, Artificial Sequence
  Description of Artificial Sequence: Synthetic oligonucleotide
tgatggagatgaggagttctacgtggacctg

SEQ ID NO: 55175 - DNA, 30 bp, Artificial Sequence
  Description of Artificial Sequence: Synthetic oligonucleotide
gatggagatgaggagttctacgtggacctg

SEQ ID NO: 55176 - DNA, 30 bp, Artificial Sequence
  Description of Artificial Sequence: Synthetic oligonucleotide
atggagatgaggagttctacgtggacctgg

SEQ ID NO: 55177 - DNA, 29 bp, Artificial Sequence
  Description of Artificial Sequence: Synthetic oligonucleotide
tggagatgaggagttctacgtggacctgg

SEQ ID NO: 55178 - DNA, 28 bp, Artificial Sequence
  Description of Artificial Sequence: Synthetic oligonucleotide
ggagatgaggagttctacgtggacctgg

SEQ ID NO: 55179 - DNA, 29 bp, Artificial Sequence
  Description of Artificial Sequence: Synthetic oligonucleotide
gagatgaggagttctacgtggacctggag

SEQ ID NO: 55180 - DNA, 30 bp, Artificial Sequence
  Description of Artificial Sequence: Synthetic oligonucleotide
agatgaggagttctacgtggacctggagag

SEQ ID NO: 55181 - DNA, 29 bp, Artificial Sequence
  Description of Artificial Sequence: Synthetic oligonucleotide
gatgaggagttctacgtggacctggagag

SEQ ID NO: 55182 - DNA, 29 bp, Artificial Sequence
  Description of Artificial Sequence: Synthetic oligonucleotide
atgaggagttctacgtggacctggagagg

SEQ ID NO: 55183 - DNA, 28 bp, Artificial Sequence
  Description of Artificial Sequence: Synthetic oligonucleotide
tgaggagttctacgtggacctggagagg

SEQ ID NO: 55184 - DNA, 27 bp, Artificial Sequence
  Description of Artificial Sequence: Synthetic oligonucleotide
gaggagttctacgtggacctggagagg

SEQ ID NO: 55185 - DNA, 29 bp, Artificial Sequence
  Description of Artificial Sequence: Synthetic oligonucleotide
aggagttctacgtggacctggagaggaag

SEQ ID NO: 55186 - DNA, 28 bp, Artificial Sequence
  Description of Artificial Sequence: Synthetic oligonucleotide
ggagttctacgtggacctggagaggaag

SEQ ID NO: 55187 - DNA, 28 bp, Artificial Sequence
  Description of Artificial Sequence: Synthetic oligonucleotide
gagttctacgtggacctggagaggaagg

SEQ ID NO: 55188 - DNA, 29 bp, Artificial Sequence
  Description of Artificial Sequence: Synthetic oligonucleotide
agttctacgtggacctggagaggaaggag

SEQ ID NO: 55189 - DNA, 28 bp, Artificial Sequence
  Description of Artificial Sequence: Synthetic oligonucleotide
gttctacgtggacctggagaggaaggag

SEQ ID NO: 55190 - DNA, 29 bp, Artificial Sequence
  Description of Artificial Sequence: Synthetic oligonucleotide
ttctacgtggacctggagaggaaggagac

SEQ ID NO: 55191 - DNA, 28 bp, Artificial Sequence
  Description of Artificial Sequence: Synthetic oligonucleotide
tctacgtggacctggagaggaaggagac

SEQ ID NO: 55192 - DNA, 27 bp, Artificial Sequence
  Description of Artificial Sequence: Synthetic oligonucleotide
ctacgtggacctggagaggaaggagac

SEQ ID NO: 55193 - DNA, 28 bp, Artificial Sequence
  Description of Artificial Sequence: Synthetic oligonucleotide
tacgtggacctggagaggaaggagactg

SEQ ID NO: 55194 - DNA, 27 bp, Artificial Sequence
  Description of Artificial Sequence: Synthetic oligonucleotide
acgtggacctggagaggaaggagactg

SEQ ID NO: 55195 - DNA, 26 bp, Artificial Sequence
  Description of Artificial Sequence: Synthetic oligonucleotide
cgtggacctggagaggaaggagactg

SEQ ID NO: 55196 - DNA, 26 bp, Artificial Sequence
  Description of Artificial Sequence: Synthetic oligonucleotide
gtggacctggagaggaaggagactgc

SEQ ID NO: 55197 - DNA, 27 bp, Artificial Sequence
  Description of Artificial Sequence: Synthetic oligonucleotide
tggacctggagaggaaggagactgcct

SEQ ID NO: 55198 - DNA, 26 bp, Artificial Sequence
  Description of Artificial Sequence: Synthetic oligonucleotide
ggacctggagaggaaggagactgcct

SEQ ID NO: 55199 - DNA, 26 bp, Artificial Sequence
  Description of Artificial Sequence: Synthetic oligonucleotide
gacctggagaggaaggagactgcctg

SEQ ID NO: 55200 - DNA, 26 bp, Artificial Sequence
  Description of Artificial Sequence: Synthetic oligonucleotide
acctggagaggaaggagactgcctgg

SEQ ID NO: 55201 - DNA, 25 bp, Artificial Sequence
  Description of Artificial Sequence: Synthetic oligonucleotide
cctggagaggaaggagactgcctgg

SEQ ID NO: 55202 - DNA, 25 bp, Artificial Sequence
  Description of Artificial Sequence: Synthetic oligonucleotide
ctggagaggaaggagactgcctggc

SEQ ID NO: 55203 - DNA, 25 bp, Artificial Sequence
  Description of Artificial Sequence: Synthetic oligonucleotide
tggagaggaaggagactgcctggcg

SEQ ID NO: 55204 - DNA, 24 bp, Artificial Sequence
  Description of Artificial Sequence: Synthetic oligonucleotide
ggagaggaaggagactgcctggcg

SEQ ID NO: 55205 - DNA, 25 bp, Artificial Sequence
  Description of Artificial Sequence: Synthetic oligonucleotide
gagaggaaggagactgcctggcggt

SEQ ID NO: 55206 - DNA, 25 bp, Artificial Sequence
  Description of Artificial Sequence: Synthetic oligonucleotide
agaggaaggagactgcctggcggtg

SEQ ID NO: 55207 - DNA, 24 bp, Artificial Sequence
  Description of Artificial Sequence: Synthetic oligonucleotide
gaggaaggagactgcctggcggtg

SEQ ID NO: 55208 - DNA, 24 bp, Artificial Sequence
  Description of Artificial Sequence: Synthetic oligonucleotide
aggaaggagactgcctggcggtgg

SEQ ID NO: 55209 - DNA, 23 bp, Artificial Sequence
  Description of Artificial Sequence: Synthetic oligonucleotide
ggaaggagactgcctggcggtgg

SEQ ID NO: 55210 - DNA, 23 bp, Artificial Sequence
  Description of Artificial Sequence: Synthetic oligonucleotide
gaaggagactgcctggcggtggc

SEQ ID NO: 55211 - DNA, 24 bp, Artificial Sequence
  Description of Artificial Sequence: Synthetic oligonucleotide
aaggagactgcctggcggtggcct

SEQ ID NO: 55212 - DNA, 23 bp, Artificial Sequence
  Description of Artificial Sequence: Synthetic oligonucleotide
aggagactgcctggcggtggcct

SEQ ID NO: 55213 - DNA, 22 bp, Artificial Sequence
  Description of Artificial Sequence: Synthetic oligonucleotide
ggagactgcctggcggtggcct

SEQ ID NO: 55214 - DNA, 23 bp, Artificial Sequence
  Description of Artificial Sequence: Synthetic oligonucleotide
gagactgcctggcggtggcctga

SEQ ID NO: 55215 - DNA, 25 bp, Artificial Sequence
  Description of Artificial Sequence: Synthetic oligonucleotide
agactgcctggcggtggcctgagtt

SEQ ID NO: 55216 - DNA, 24 bp, Artificial Sequence
  Description of Artificial Sequence: Synthetic oligonucleotide
gactgcctggcggtggcctgagtt

SEQ ID NO: 55217 - DNA, 25 bp, Artificial Sequence
  Description of Artificial Sequence: Synthetic oligonucleotide
actgcctggcggtggcctgagttca

SEQ ID NO: 55218 - DNA, 24 bp, Artificial Sequence
  Description of Artificial Sequence: Synthetic oligonucleotide
ctgcctggcggtggcctgagttca

SEQ ID NO: 55219 - DNA, 24 bp, Artificial Sequence
  Description of Artificial Sequence: Synthetic oligonucleotide
tgcctggcggtggcctgagttcag

SEQ ID NO: 55220 - DNA, 23 bp, Artificial Sequence
  Description of Artificial Sequence: Synthetic oligonucleotide
gcctggcggtggcctgagttcag

SEQ ID NO: 55221 - DNA, 27 bp, Artificial Sequence
  Description of Artificial Sequence: Synthetic oligonucleotide
cctggcggtggcctgagttcagcaaat

SEQ ID NO: 55222 - DNA, 29 bp, Artificial Sequence
  Description of Artificial Sequence: Synthetic oligonucleotide
ctggcggtggcctgagttcagcaaatttg

SEQ ID NO: 55223 - DNA, 29 bp, Artificial Sequence
  Description of Artificial Sequence: Synthetic oligonucleotide
tggcggtggcctgagttcagcaaatttgg

SEQ ID NO: 55224 - DNA, 28 bp, Artificial Sequence
  Description of Artificial Sequence: Synthetic oligonucleotide
ggcggtggcctgagttcagcaaatttgg

SEQ ID NO: 55225 - DNA, 29 bp, Artificial Sequence
  Description of Artificial Sequence: Synthetic oligonucleotide
gcggtggcctgagttcagcaaatttggag

SEQ ID NO: 55226 - DNA, 29 bp, Artificial Sequence
  Description of Artificial Sequence: Synthetic oligonucleotide
cggtggcctgagttcagcaaatttggagg

SEQ ID NO: 55227 - DNA, 33 bp, Artificial Sequence
  Description of Artificial Sequence: Synthetic oligonucleotide
ggtggcctgagttcagcaaatttggaggttttg

SEQ ID NO: 55228 - DNA, 34 bp, Artificial Sequence
  Description of Artificial Sequence: Synthetic oligonucleotide
gtggcctgagttcagcaaatttggaggttttgac

SEQ ID NO: 55229 - DNA, 34 bp, Artificial Sequence
  Description of Artificial Sequence: Synthetic oligonucleotide
tggcctgagttcagcaaatttggaggttttgacc

SEQ ID NO: 55230 - DNA, 33 bp, Artificial Sequence
  Description of Artificial Sequence: Synthetic oligonucleotide
ggcctgagttcagcaaatttggaggttttgacc

SEQ ID NO: 55231 - DNA, 33 bp, Artificial Sequence
  Description of Artificial Sequence: Synthetic oligonucleotide
gcctgagttcagcaaatttggaggttttgaccc

SEQ ID NO: 55232 - DNA, 33 bp, Artificial Sequence
  Description of Artificial Sequence: Synthetic oligonucleotide
cctgagttcagcaaatttggaggttttgacccg

SEQ ID NO: 55233 - DNA, 33 bp, Artificial Sequence
  Description of Artificial Sequence: Synthetic oligonucleotide
ctgagttcagcaaatttggaggttttgacccgc

SEQ ID NO: 55234 - DNA, 34 bp, Artificial Sequence
  Description of Artificial Sequence: Synthetic oligonucleotide
tgagttcagcaaatttggaggttttgacccgcag

SEQ ID NO: 55235 - DNA, 33 bp, Artificial Sequence
  Description of Artificial Sequence: Synthetic oligonucleotide
gagttcagcaaatttggaggttttgacccgcag

SEQ ID NO: 55236 - DNA, 33 bp, Artificial Sequence
  Description of Artificial Sequence: Synthetic oligonucleotide
agttcagcaaatttggaggttttgacccgcagg

SEQ ID NO: 55237 - DNA, 32 bp, Artificial Sequence
  Description of Artificial Sequence: Synthetic oligonucleotide
gttcagcaaatttggaggttttgacccgcagg

SEQ ID NO: 55238 - DNA, 32 bp, Artificial Sequence
  Description of Artificial Sequence: Synthetic oligonucleotide
ttcagcaaatttggaggttttgacccgcaggg

SEQ ID NO: 55239 - DNA, 31 bp, Artificial Sequence
  Description of Artificial Sequence: Synthetic oligonucleotide
tcagcaaatttggaggttttgacccgcaggg

SEQ ID NO: 55240 - DNA, 30 bp, Artificial Sequence
  Description of Artificial Sequence: Synthetic oligonucleotide
cagcaaatttggaggttttgacccgcaggg

SEQ ID NO: 55241 - DNA, 31 bp, Artificial Sequence
  Description of Artificial Sequence: Synthetic oligonucleotide
agcaaatttggaggttttgacccgcagggtg

SEQ ID NO: 55242 - DNA, 30 bp, Artificial Sequence
  Description of Artificial Sequence: Synthetic oligonucleotide
gcaaatttggaggttttgacccgcagggtg

SEQ ID NO: 55243 - DNA, 30 bp, Artificial Sequence
  Description of Artificial Sequence: Synthetic oligonucleotide
caaatttggaggttttgacccgcagggtgc

SEQ ID NO: 55244 - DNA, 31 bp, Artificial Sequence
  Description of Artificial Sequence: Synthetic oligonucleotide
aaatttggaggttttgacccgcagggtgcac

SEQ ID NO: 55245 - DNA, 30 bp, Artificial Sequence
  Description of Artificial Sequence: Synthetic oligonucleotide
aatttggaggttttgacccgcagggtgcac

SEQ ID NO: 55246 - DNA, 29 bp, Artificial Sequence
  Description of Artificial Sequence: Synthetic oligonucleotide
atttggaggttttgacccgcagggtgcac

SEQ ID NO: 55247 - DNA, 28 bp, Artificial Sequence
  Description of Artificial Sequence: Synthetic oligonucleotide
tttggaggttttgacccgcagggtgcac

SEQ ID NO: 55248 - DNA, 27 bp, Artificial Sequence
  Description of Artificial Sequence: Synthetic oligonucleotide
ttggaggttttgacccgcagggtgcac

SEQ ID NO: 55249 - DNA, 27 bp, Artificial Sequence
  Description of Artificial Sequence: Synthetic oligonucleotide
tggaggttttgacccgcagggtgcact

SEQ ID NO: 55250 - DNA, 26 bp, Artificial Sequence
  Description of Artificial Sequence: Synthetic oligonucleotide
ggaggttttgacccgcagggtgcact

SEQ ID NO: 55251 - DNA, 27 bp, Artificial Sequence
  Description of Artificial Sequence: Synthetic oligonucleotide
gaggttttgacccgcagggtgcactga

SEQ ID NO: 55252 - DNA, 27 bp, Artificial Sequence
  Description of Artificial Sequence: Synthetic oligonucleotide
aggttttgacccgcagggtgcactgag

SEQ ID NO: 55253 - DNA, 27 bp, Artificial Sequence
  Description of Artificial Sequence: Synthetic oligonucleotide
ggttttgacccgcagggtgcactgaga

SEQ ID NO: 55254 - DNA, 29 bp, Artificial Sequence
  Description of Artificial Sequence: Synthetic oligonucleotide
gttttgacccgcagggtgcactgagaaac

SEQ ID NO: 55255 - DNA, 31 bp, Artificial Sequence
  Description of Artificial Sequence: Synthetic oligonucleotide
ttttgacccgcagggtgcactgagaaacatg

SEQ ID NO: 55256 - DNA, 30 bp, Artificial Sequence
  Description of Artificial Sequence: Synthetic oligonucleotide
tttgacccgcagggtgcactgagaaacatg

SEQ ID NO: 55257 - DNA, 29 bp, Artificial Sequence
  Description of Artificial Sequence: Synthetic oligonucleotide
ttgacccgcagggtgcactgagaaacatg

SEQ ID NO: 55258 - DNA, 28 bp, Artificial Sequence
  Description of Artificial Sequence: Synthetic oligonucleotide
tgacccgcagggtgcactgagaaacatg

SEQ ID NO: 55259 - DNA, 27 bp, Artificial Sequence
  Description of Artificial Sequence: Synthetic oligonucleotide
gacccgcagggtgcactgagaaacatg

SEQ ID NO: 55260 - DNA, 27 bp, Artificial Sequence
  Description of Artificial Sequence: Synthetic oligonucleotide
acccgcagggtgcactgagaaacatgg

SEQ ID NO: 55261 - DNA, 26 bp, Artificial Sequence
  Description of Artificial Sequence: Synthetic oligonucleotide
cccgcagggtgcactgagaaacatgg

SEQ ID NO: 55262 - DNA, 27 bp, Artificial Sequence
  Description of Artificial Sequence: Synthetic oligonucleotide
ccgcagggtgcactgagaaacatggct

SEQ ID NO: 55263 - DNA, 27 bp, Artificial Sequence
  Description of Artificial Sequence: Synthetic oligonucleotide
cgcagggtgcactgagaaacatggctg

SEQ ID NO: 55264 - DNA, 28 bp, Artificial Sequence
  Description of Artificial Sequence: Synthetic oligonucleotide
gcagggtgcactgagaaacatggctgtg

SEQ ID NO: 55265 - DNA, 28 bp, Artificial Sequence
  Description of Artificial Sequence: Synthetic oligonucleotide
cagggtgcactgagaaacatggctgtgg

SEQ ID NO: 55266 - DNA, 28 bp, Artificial Sequence
  Description of Artificial Sequence: Synthetic oligonucleotide
agggtgcactgagaaacatggctgtggc

SEQ ID NO: 55267 - DNA, 27 bp, Artificial Sequence
  Description of Artificial Sequence: Synthetic oligonucleotide
gggtgcactgagaaacatggctgtggc

SEQ ID NO: 55268 - DNA, 31 bp, Artificial Sequence
  Description of Artificial Sequence: Synthetic oligonucleotide
ggtgcactgagaaacatggctgtggcaaaac

SEQ ID NO: 55269 - DNA, 32 bp, Artificial Sequence
  Description of Artificial Sequence: Synthetic oligonucleotide
gtgcactgagaaacatggctgtggcaaaacac

SEQ ID NO: 55270 - DNA, 34 bp, Artificial Sequence
  Description of Artificial Sequence: Synthetic oligonucleotide
tgcactgagaaacatggctgtggcaaaacacaac

SEQ ID NO: 55271 - DNA, 33 bp, Artificial Sequence
  Description of Artificial Sequence: Synthetic oligonucleotide
gcactgagaaacatggctgtggcaaaacacaac

SEQ ID NO: 55272 - DNA, 35 bp, Artificial Sequence
  Description of Artificial Sequence: Synthetic oligonucleotide
cactgagaaacatggctgtggcaaaacacaacttg

SEQ ID NO: 55273 - DNA, 37 bp, Artificial Sequence
  Description of Artificial Sequence: Synthetic oligonucleotide
actgagaaacatggctgtggcaaaacacaacttgaac

SEQ ID NO: 55274 - DNA, 36 bp, Artificial Sequence
  Description of Artificial Sequence: Synthetic oligonucleotide
ctgagaaacatggctgtggcaaaacacaacttgaac

SEQ ID NO: 55275 - DNA, 38 bp, Artificial Sequence
  Description of Artificial Sequence: Synthetic oligonucleotide
tgagaaacatggctgtggcaaaacacaacttgaacatc

SEQ ID NO: 55276 - DNA, 37 bp, Artificial Sequence
  Description of Artificial Sequence: Synthetic oligonucleotide
gagaaacatggctgtggcaaaacacaacttgaacatc

SEQ ID NO: 55277 - DNA, 39 bp, Artificial Sequence
  Description of Artificial Sequence: Synthetic oligonucleotide
agaaacatggctgtggcaaaacacaacttgaacatcatg

SEQ ID NO: 55278 - DNA, 38 bp, Artificial Sequence
  Description of Artificial Sequence: Synthetic oligonucleotide
gaaacatggctgtggcaaaacacaacttgaacatcatg

SEQ ID NO: 55279 - DNA, 44 bp, Artificial Sequence
  Description of Artificial Sequence: Synthetic oligonucleotide
aaacatggctgtggcaaaacacaacttgaacatcatgattaaac

SEQ ID NO: 55280 - DNA, 43 bp, Artificial Sequence
  Description of Artificial Sequence: Synthetic oligonucleotide
aacatggctgtggcaaaacacaacttgaacatcatgattaaac

SEQ ID NO: 55281 - DNA, 42 bp, Artificial Sequence
  Description of Artificial Sequence: Synthetic oligonucleotide
acatggctgtggcaaaacacaacttgaacatcatgattaaac

SEQ ID NO: 55282 - DNA, 41 bp, Artificial Sequence
  Description of Artificial Sequence: Synthetic oligonucleotide
catggctgtggcaaaacacaacttgaacatcatgattaaac

SEQ ID NO: 55283 - DNA, 41 bp, Artificial Sequence
  Description of Artificial Sequence: Synthetic oligonucleotide
atggctgtggcaaaacacaacttgaacatcatgattaaacg

SEQ ID NO: 55284 - DNA, 40 bp, Artificial Sequence
  Description of Artificial Sequence: Synthetic oligonucleotide
tggctgtggcaaaacacaacttgaacatcatgattaaacg

SEQ ID NO: 55285 - DNA, 39 bp, Artificial Sequence
  Description of Artificial Sequence: Synthetic oligonucleotide
ggctgtggcaaaacacaacttgaacatcatgattaaacg

SEQ ID NO: 55286 - DNA, 39 bp, Artificial Sequence
  Description of Artificial Sequence: Synthetic oligonucleotide
gctgtggcaaaacacaacttgaacatcatgattaaacgc

SEQ ID NO: 55287 - DNA, 41 bp, Artificial Sequence
  Description of Artificial Sequence: Synthetic oligonucleotide
ctgtggcaaaacacaacttgaacatcatgattaaacgctac

SEQ ID NO: 55288 - DNA, 43 bp, Artificial Sequence
  Description of Artificial Sequence: Synthetic oligonucleotide
tgtggcaaaacacaacttgaacatcatgattaaacgctacaac

SEQ ID NO: 55289 - DNA, 42 bp, Artificial Sequence
  Description of Artificial Sequence: Synthetic oligonucleotide
gtggcaaaacacaacttgaacatcatgattaaacgctacaac

SEQ ID NO: 55290 - DNA, 43 bp, Artificial Sequence
  Description of Artificial Sequence: Synthetic oligonucleotide
tggcaaaacacaacttgaacatcatgattaaacgctacaactc

SEQ ID NO: 55291 - DNA, 42 bp, Artificial Sequence
  Description of Artificial Sequence: Synthetic oligonucleotide
ggcaaaacacaacttgaacatcatgattaaacgctacaactc

SEQ ID NO: 55292 - DNA, 44 bp, Artificial Sequence
  Description of Artificial Sequence: Synthetic oligonucleotide
gcaaaacacaacttgaacatcatgattaaacgctacaactctac

SEQ ID NO: 55293 - DNA, 44 bp, Artificial Sequence
  Description of Artificial Sequence: Synthetic oligonucleotide
caaaacacaacttgaacatcatgattaaacgctacaactctacc

SEQ ID NO: 55294 - DNA, 44 bp, Artificial Sequence
  Description of Artificial Sequence: Synthetic oligonucleotide
aaaacacaacttgaacatcatgattaaacgctacaactctaccg

SEQ ID NO: 55295 - DNA, 43 bp, Artificial Sequence
  Description of Artificial Sequence: Synthetic oligonucleotide
aaacacaacttgaacatcatgattaaacgctacaactctaccg

SEQ ID NO: 55296 - DNA, 42 bp, Artificial Sequence
  Description of Artificial Sequence: Synthetic oligonucleotide
aacacaacttgaacatcatgattaaacgctacaactctaccg

SEQ ID NO: 55297 - DNA, 41 bp, Artificial Sequence
  Description of Artificial Sequence: Synthetic oligonucleotide
acacaacttgaacatcatgattaaacgctacaactctaccg

SEQ ID NO: 55298 - DNA, 40 bp, Artificial Sequence
  Description of Artificial Sequence: Synthetic oligonucleotide
cacaacttgaacatcatgattaaacgctacaactctaccg

SEQ ID NO: 55299 - DNA, 40 bp, Artificial Sequence
  Description of Artificial Sequence: Synthetic oligonucleotide
acaacttgaacatcatgattaaacgctacaactctaccgc

SEQ ID NO: 55300 - DNA, 39 bp, Artificial Sequence
  Description of Artificial Sequence: Synthetic oligonucleotide
caacttgaacatcatgattaaacgctacaactctaccgc

SEQ ID NO: 55301 - DNA, 40 bp, Artificial Sequence
  Description of Artificial Sequence: Synthetic oligonucleotide
aacttgaacatcatgattaaacgctacaactctaccgctg

SEQ ID NO: 55302 - DNA, 39 bp, Artificial Sequence
  Description of Artificial Sequence: Synthetic oligonucleotide
acttgaacatcatgattaaacgctacaactctaccgctg

SEQ ID NO: 55303 - DNA, 38 bp, Artificial Sequence
  Description of Artificial Sequence: Synthetic oligonucleotide
cttgaacatcatgattaaacgctacaactctaccgctg

SEQ ID NO: 55304 - DNA, 38 bp, Artificial Sequence
  Description of Artificial Sequence: Synthetic oligonucleotide
ttgaacatcatgattaaacgctacaactctaccgctgc

SEQ ID NO: 55305 - DNA, 37 bp, Artificial Sequence
  Description of Artificial Sequence: Synthetic oligonucleotide
tgaacatcatgattaaacgctacaactctaccgctgc

SEQ ID NO: 55306 - DNA, 36 bp, Artificial Sequence
  Description of Artificial Sequence: Synthetic oligonucleotide
gaacatcatgattaaacgctacaactctaccgctgc

SEQ ID NO: 55307 - DNA, 38 bp, Artificial Sequence
  Description of Artificial Sequence: Synthetic oligonucleotide
aacatcatgattaaacgctacaactctaccgctgctac

SEQ ID NO: 55308 - DNA, 37 bp, Artificial Sequence
  Description of Artificial Sequence: Synthetic oligonucleotide
acatcatgattaaacgctacaactctaccgctgctac

SEQ ID NO: 55309 - DNA, 36 bp, Artificial Sequence
  Description of Artificial Sequence: Synthetic oligonucleotide
catcatgattaaacgctacaactctaccgctgctac

SEQ ID NO: 55310 - DNA, 36 bp, Artificial Sequence
  Description of Artificial Sequence: Synthetic oligonucleotide
atcatgattaaacgctacaactctaccgctgctacc

SEQ ID NO: 55311 - DNA, 35 bp, Artificial Sequence
  Description of Artificial Sequence: Synthetic oligonucleotide
tcatgattaaacgctacaactctaccgctgctacc

SEQ ID NO: 55312 - DNA, 34 bp, Artificial Sequence
  Description of Artificial Sequence: Synthetic oligonucleotide
catgattaaacgctacaactctaccgctgctacc

SEQ ID NO: 55313 - DNA, 37 bp, Artificial Sequence
  Description of Artificial Sequence: Synthetic oligonucleotide
atgattaaacgctacaactctaccgctgctaccaatg

SEQ ID NO: 55314 - DNA, 36 bp, Artificial Sequence
  Description of Artificial Sequence: Synthetic oligonucleotide
tgattaaacgctacaactctaccgctgctaccaatg

SEQ ID NO: 55315 - DNA, 35 bp, Artificial Sequence
  Description of Artificial Sequence: Synthetic oligonucleotide
gattaaacgctacaactctaccgctgctaccaatg

SEQ ID NO: 55316 - DNA, 36 bp, Artificial Sequence
  Description of Artificial Sequence: Synthetic oligonucleotide
attaaacgctacaactctaccgctgctaccaatgag

SEQ ID NO: 55317 - DNA, 35 bp, Artificial Sequence
  Description of Artificial Sequence: Synthetic oligonucleotide
ttaaacgctacaactctaccgctgctaccaatgag

SEQ ID NO: 55318 - DNA, 34 bp, Artificial Sequence
  Description of Artificial Sequence: Synthetic oligonucleotide
taaacgctacaactctaccgctgctaccaatgag

SEQ ID NO: 55319 - DNA, 33 bp, Artificial Sequence
  Description of Artificial Sequence: Synthetic oligonucleotide
aaacgctacaactctaccgctgctaccaatgag

SEQ ID NO: 55320 - DNA, 32 bp, Artificial Sequence
  Description of Artificial Sequence: Synthetic oligonucleotide
aacgctacaactctaccgctgctaccaatgag

SEQ ID NO: 55321 - DNA, 31 bp, Artificial Sequence
  Description of Artificial Sequence: Synthetic oligonucleotide
acgctacaactctaccgctgctaccaatgag

SEQ ID NO: 55322 - DNA, 30 bp, Artificial Sequence
  Description of Artificial Sequence: Synthetic oligonucleotide
cgctacaactctaccgctgctaccaatgag

SEQ ID NO: 55323 - DNA, 30 bp, Artificial Sequence
  Description of Artificial Sequence: Synthetic oligonucleotide
gctacaactctaccgctgctaccaatgagg

SEQ ID NO: 55324 - DNA, 32 bp, Artificial Sequence
  Description of Artificial Sequence: Synthetic oligonucleotide
ctacaactctaccgctgctaccaatgaggttc

SEQ ID NO: 55325 - DNA, 32 bp, Artificial Sequence
  Description of Artificial Sequence: Synthetic oligonucleotide
tacaactctaccgctgctaccaatgaggttcc

SEQ ID NO: 55326 - DNA, 31 bp, Artificial Sequence
  Description of Artificial Sequence: Synthetic oligonucleotide
acaactctaccgctgctaccaatgaggttcc

SEQ ID NO: 55327 - DNA, 30 bp, Artificial Sequence
  Description of Artificial Sequence: Synthetic oligonucleotide
caactctaccgctgctaccaatgaggttcc

SEQ ID NO: 55328 - DNA, 31 bp, Artificial Sequence
  Description of Artificial Sequence: Synthetic oligonucleotide
aactctaccgctgctaccaatgaggttcctg

SEQ ID NO: 55329 - DNA, 30 bp, Artificial Sequence
  Description of Artificial Sequence: Synthetic oligonucleotide
actctaccgctgctaccaatgaggttcctg

SEQ ID NO: 55330 - DNA, 29 bp, Artificial Sequence
  Description of Artificial Sequence: Synthetic oligonucleotide
ctctaccgctgctaccaatgaggttcctg

SEQ ID NO: 55331 - DNA, 30 bp, Artificial Sequence
  Description of Artificial Sequence: Synthetic oligonucleotide
tctaccgctgctaccaatgaggttcctgag

SEQ ID NO: 55332 - DNA, 29 bp, Artificial Sequence
  Description of Artificial Sequence: Synthetic oligonucleotide
ctaccgctgctaccaatgaggttcctgag

SEQ ID NO: 55333 - DNA, 29 bp, Artificial Sequence
  Description of Artificial Sequence: Synthetic oligonucleotide
taccgctgctaccaatgaggttcctgagg

SEQ ID NO: 55334 - DNA, 28 bp, Artificial Sequence
  Description of Artificial Sequence: Synthetic oligonucleotide
accgctgctaccaatgaggttcctgagg

SEQ ID NO: 55335 - DNA, 27 bp, Artificial Sequence
  Description of Artificial Sequence: Synthetic oligonucleotide
ccgctgctaccaatgaggttcctgagg

SEQ ID NO: 55336 - DNA, 28 bp, Artificial Sequence
  Description of Artificial Sequence: Synthetic oligonucleotide
cgctgctaccaatgaggttcctgaggtc

SEQ ID NO: 55337 - DNA, 29 bp, Artificial Sequence
  Description of Artificial Sequence: Synthetic oligonucleotide
gctgctaccaatgaggttcctgaggtcac

SEQ ID NO: 55338 - DNA, 30 bp, Artificial Sequence
  Description of Artificial Sequence: Synthetic oligonucleotide
ctgctaccaatgaggttcctgaggtcacag

SEQ ID NO: 55339 - DNA, 31 bp, Artificial Sequence
  Description of Artificial Sequence: Synthetic oligonucleotide
tgctaccaatgaggttcctgaggtcacagtg

SEQ ID NO: 55340 - DNA, 30 bp, Artificial Sequence
  Description of Artificial Sequence: Synthetic oligonucleotide
gctaccaatgaggttcctgaggtcacagtg

SEQ ID NO: 55341 - DNA, 34 bp, Artificial Sequence
  Description of Artificial Sequence: Synthetic oligonucleotide
ctaccaatgaggttcctgaggtcacagtgttttc

SEQ ID NO: 55342 - DNA, 34 bp, Artificial Sequence
  Description of Artificial Sequence: Synthetic oligonucleotide
taccaatgaggttcctgaggtcacagtgttttcc

SEQ ID NO: 55343 - DNA, 33 bp, Artificial Sequence
  Description of Artificial Sequence: Synthetic oligonucleotide
accaatgaggttcctgaggtcacagtgttttcc

SEQ ID NO: 55344 - DNA, 32 bp, Artificial Sequence
  Description of Artificial Sequence: Synthetic oligonucleotide
ccaatgaggttcctgaggtcacagtgttttcc

SEQ ID NO: 55345 - DNA, 34 bp, Artificial Sequence
  Description of Artificial Sequence: Synthetic oligonucleotide
caatgaggttcctgaggtcacagtgttttccaag

SEQ ID NO: 55346 - DNA, 35 bp, Artificial Sequence
  Description of Artificial Sequence: Synthetic oligonucleotide
aatgaggttcctgaggtcacagtgttttccaagtc

SEQ ID NO: 55347 - DNA, 34 bp, Artificial Sequence
  Description of Artificial Sequence: Synthetic oligonucleotide
atgaggttcctgaggtcacagtgttttccaagtc

SEQ ID NO: 55348 - DNA, 33 bp, Artificial Sequence
  Description of Artificial Sequence: Synthetic oligonucleotide
tgaggttcctgaggtcacagtgttttccaagtc

SEQ ID NO: 55349 - DNA, 32 bp, Artificial Sequence
  Description of Artificial Sequence: Synthetic oligonucleotide
gaggttcctgaggtcacagtgttttccaagtc

SEQ ID NO: 55350 - DNA, 33 bp, Artificial Sequence
  Description of Artificial Sequence: Synthetic oligonucleotide
aggttcctgaggtcacagtgttttccaagtctc

SEQ ID NO: 55351 - DNA, 32 bp, Artificial Sequence
  Description of Artificial Sequence: Synthetic oligonucleotide
ggttcctgaggtcacagtgttttccaagtctc

SEQ ID NO: 55352 - DNA, 32 bp, Artificial Sequence
  Description of Artificial Sequence: Synthetic oligonucleotide
gttcctgaggtcacagtgttttccaagtctcc

SEQ ID NO: 55353 - DNA, 32 bp, Artificial Sequence
  Description of Artificial Sequence: Synthetic oligonucleotide
ttcctgaggtcacagtgttttccaagtctccc

SEQ ID NO: 55354 - DNA, 31 bp, Artificial Sequence
  Description of Artificial Sequence: Synthetic oligonucleotide
tcctgaggtcacagtgttttccaagtctccc

SEQ ID NO: 55355 - DNA, 30 bp, Artificial Sequence
  Description of Artificial Sequence: Synthetic oligonucleotide
cctgaggtcacagtgttttccaagtctccc

SEQ ID NO: 55356 - DNA, 30 bp, Artificial Sequence
  Description of Artificial Sequence: Synthetic oligonucleotide
ctgaggtcacagtgttttccaagtctcccg

SEQ ID NO: 55357 - DNA, 31 bp, Artificial Sequence
  Description of Artificial Sequence: Synthetic oligonucleotide
tgaggtcacagtgttttccaagtctcccgtg

SEQ ID NO: 55358 - DNA, 30 bp, Artificial Sequence
  Description of Artificial Sequence: Synthetic oligonucleotide
gaggtcacagtgttttccaagtctcccgtg

SEQ ID NO: 55359 - DNA, 31 bp, Artificial Sequence
  Description of Artificial Sequence: Synthetic oligonucleotide
aggtcacagtgttttccaagtctcccgtgac

SEQ ID NO: 55360 - DNA, 30 bp, Artificial Sequence
  Description of Artificial Sequence: Synthetic oligonucleotide
ggtcacagtgttttccaagtctcccgtgac

SEQ ID NO: 55361 - DNA, 31 bp, Artificial Sequence
  Description of Artificial Sequence: Synthetic oligonucleotide
gtcacagtgttttccaagtctcccgtgacac

SEQ ID NO: 55362 - DNA, 32 bp, Artificial Sequence
  Description of Artificial Sequence: Synthetic oligonucleotide
tcacagtgttttccaagtctcccgtgacactg

SEQ ID NO: 55363 - DNA, 31 bp, Artificial Sequence
  Description of Artificial Sequence: Synthetic oligonucleotide
cacagtgttttccaagtctcccgtgacactg

SEQ ID NO: 55364 - DNA, 31 bp, Artificial Sequence
  Description of Artificial Sequence: Synthetic oligonucleotide
acagtgttttccaagtctcccgtgacactgg

SEQ ID NO: 55365 - DNA, 30 bp, Artificial Sequence
  Description of Artificial Sequence: Synthetic oligonucleotide
cagtgttttccaagtctcccgtgacactgg

SEQ ID NO: 55366 - DNA, 30 bp, Artificial Sequence
  Description of Artificial Sequence: Synthetic oligonucleotide
agtgttttccaagtctcccgtgacactggg

SEQ ID NO: 55367 - DNA, 29 bp, Artificial Sequence
  Description of Artificial Sequence: Synthetic oligonucleotide
gtgttttccaagtctcccgtgacactggg

SEQ ID NO: 55368 - DNA, 30 bp, Artificial Sequence
  Description of Artificial Sequence: Synthetic oligonucleotide
tgttttccaagtctcccgtgacactgggtc

SEQ ID NO: 55369 - DNA, 29 bp, Artificial Sequence
  Description of Artificial Sequence: Synthetic oligonucleotide
gttttccaagtctcccgtgacactgggtc

SEQ ID NO: 55370 - DNA, 30 bp, Artificial Sequence
  Description of Artificial Sequence: Synthetic oligonucleotide
ttttccaagtctcccgtgacactgggtcag

SEQ ID NO: 55371 - DNA, 29 bp, Artificial Sequence
  Description of Artificial Sequence: Synthetic oligonucleotide
tttccaagtctcccgtgacactgggtcag

SEQ ID NO: 55372 - DNA, 28 bp, Artificial Sequence
  Description of Artificial Sequence: Synthetic oligonucleotide
ttccaagtctcccgtgacactgggtcag

SEQ ID NO: 55373 - DNA, 27 bp, Artificial Sequence
  Description of Artificial Sequence: Synthetic oligonucleotide
tccaagtctcccgtgacactgggtcag

SEQ ID NO: 55374 - DNA, 26 bp, Artificial Sequence
  Description of Artificial Sequence: Synthetic oligonucleotide
ccaagtctcccgtgacactgggtcag

SEQ ID NO: 55375 - DNA, 26 bp, Artificial Sequence
  Description of Artificial Sequence: Synthetic oligonucleotide
caagtctcccgtgacactgggtcagc

SEQ ID NO: 55376 - DNA, 26 bp, Artificial Sequence
  Description of Artificial Sequence: Synthetic oligonucleotide
aagtctcccgtgacactgggtcagcc

SEQ ID NO: 55377 - DNA, 25 bp, Artificial Sequence
  Description of Artificial Sequence: Synthetic oligonucleotide
agtctcccgtgacactgggtcagcc

SEQ ID NO: 55378 - DNA, 24 bp, Artificial Sequence
  Description of Artificial Sequence: Synthetic oligonucleotide
gtctcccgtgacactgggtcagcc

SEQ ID NO: 55379 - DNA, 26 bp, Artificial Sequence
  Description of Artificial Sequence: Synthetic oligonucleotide
tctcccgtgacactgggtcagcccaa

SEQ ID NO: 55380 - DNA, 25 bp, Artificial Sequence
  Description of Artificial Sequence: Synthetic oligonucleotide
ctcccgtgacactgggtcagcccaa

SEQ ID NO: 55381 - DNA, 26 bp, Artificial Sequence
  Description of Artificial Sequence: Synthetic oligonucleotide
tcccgtgacactgggtcagcccaaca

SEQ ID NO: 55382 - DNA, 25 bp, Artificial Sequence
  Description of Artificial Sequence: Synthetic oligonucleotide
cccgtgacactgggtcagcccaaca

SEQ ID NO: 55383 - DNA, 25 bp, Artificial Sequence
  Description of Artificial Sequence: Synthetic oligonucleotide
ccgtgacactgggtcagcccaacac

SEQ ID NO: 55384 - DNA, 25 bp, Artificial Sequence
  Description of Artificial Sequence: Synthetic oligonucleotide
cgtgacactgggtcagcccaacacc

SEQ ID NO: 55385 - DNA, 26 bp, Artificial Sequence
  Description of Artificial Sequence: Synthetic oligonucleotide
gtgacactgggtcagcccaacaccct

SEQ ID NO: 55386 - DNA, 27 bp, Artificial Sequence
  Description of Artificial Sequence: Synthetic oligonucleotide
tgacactgggtcagcccaacaccctca

SEQ ID NO: 55387 - DNA, 27 bp, Artificial Sequence
  Description of Artificial Sequence: Synthetic oligonucleotide
gacactgggtcagcccaacaccctcat

SEQ ID NO: 55388 - DNA, 29 bp, Artificial Sequence
  Description of Artificial Sequence: Synthetic oligonucleotide
acactgggtcagcccaacaccctcatttg

SEQ ID NO: 55389 - DNA, 28 bp, Artificial Sequence
  Description of Artificial Sequence: Synthetic oligonucleotide
cactgggtcagcccaacaccctcatttg

SEQ ID NO: 55390 - DNA, 29 bp, Artificial Sequence
  Description of Artificial Sequence: Synthetic oligonucleotide
actgggtcagcccaacaccctcatttgtc

SEQ ID NO: 55391 - DNA, 28 bp, Artificial Sequence
  Description of Artificial Sequence: Synthetic oligonucleotide
ctgggtcagcccaacaccctcatttgtc

SEQ ID NO: 55392 - DNA, 30 bp, Artificial Sequence
  Description of Artificial Sequence: Synthetic oligonucleotide
tgggtcagcccaacaccctcatttgtcttg

SEQ ID NO: 55393 - DNA, 29 bp, Artificial Sequence
  Description of Artificial Sequence: Synthetic oligonucleotide
gggtcagcccaacaccctcatttgtcttg

SEQ ID NO: 55394 - DNA, 30 bp, Artificial Sequence
  Description of Artificial Sequence: Synthetic oligonucleotide
ggtcagcccaacaccctcatttgtcttgtg

SEQ ID NO: 55395 - DNA, 30 bp, Artificial Sequence
  Description of Artificial Sequence: Synthetic oligonucleotide
gtcagcccaacaccctcatttgtcttgtgg

SEQ ID NO: 55396 - DNA, 31 bp, Artificial Sequence
  Description of Artificial Sequence: Synthetic oligonucleotide
tcagcccaacaccctcatttgtcttgtggac

SEQ ID NO: 55397 - DNA, 30 bp, Artificial Sequence
  Description of Artificial Sequence: Synthetic oligonucleotide
cagcccaacaccctcatttgtcttgtggac

SEQ ID NO: 55398 - DNA, 32 bp, Artificial Sequence
  Description of Artificial Sequence: Synthetic oligonucleotide
agcccaacaccctcatttgtcttgtggacaac

SEQ ID NO: 55399 - DNA, 31 bp, Artificial Sequence
  Description of Artificial Sequence: Synthetic oligonucleotide
gcccaacaccctcatttgtcttgtggacaac

SEQ ID NO: 55400 - DNA, 33 bp, Artificial Sequence
  Description of Artificial Sequence: Synthetic oligonucleotide
cccaacaccctcatttgtcttgtggacaacatc

SEQ ID NO: 55401 - DNA, 36 bp, Artificial Sequence
  Description of Artificial Sequence: Synthetic oligonucleotide
ccaacaccctcatttgtcttgtggacaacatctttc

SEQ ID NO: 55402 - DNA, 36 bp, Artificial Sequence
  Description of Artificial Sequence: Synthetic oligonucleotide
caacaccctcatttgtcttgtggacaacatctttcc

SEQ ID NO: 55403 - DNA, 37 bp, Artificial Sequence
  Description of Artificial Sequence: Synthetic oligonucleotide
aacaccctcatttgtcttgtggacaacatctttcctc

SEQ ID NO: 55404 - DNA, 36 bp, Artificial Sequence
  Description of Artificial Sequence: Synthetic oligonucleotide
acaccctcatttgtcttgtggacaacatctttcctc

SEQ ID NO: 55405 - DNA, 35 bp, Artificial Sequence
  Description of Artificial Sequence: Synthetic oligonucleotide
caccctcatttgtcttgtggacaacatctttcctc

SEQ ID NO: 55406 - DNA, 35 bp, Artificial Sequence
  Description of Artificial Sequence: Synthetic oligonucleotide
accctcatttgtcttgtggacaacatctttcctcc

SEQ ID NO: 55407 - DNA, 34 bp, Artificial Sequence
  Description of Artificial Sequence: Synthetic oligonucleotide
ccctcatttgtcttgtggacaacatctttcctcc

SEQ ID NO: 55408 - DNA, 35 bp, Artificial Sequence
  Description of Artificial Sequence: Synthetic oligonucleotide
cctcatttgtcttgtggacaacatctttcctcctg

SEQ ID NO: 55409 - DNA, 36 bp, Artificial Sequence
  Description of Artificial Sequence: Synthetic oligonucleotide
ctcatttgtcttgtggacaacatctttcctcctgtg

SEQ ID NO: 55410 - DNA, 36 bp, Artificial Sequence
  Description of Artificial Sequence: Synthetic oligonucleotide
tcatttgtcttgtggacaacatctttcctcctgtgg

SEQ ID NO: 55411 - DNA, 35 bp, Artificial Sequence
  Description of Artificial Sequence: Synthetic oligonucleotide
catttgtcttgtggacaacatctttcctcctgtgg

SEQ ID NO: 55412 - DNA, 36 bp, Artificial Sequence
  Description of Artificial Sequence: Synthetic oligonucleotide
atttgtcttgtggacaacatctttcctcctgtggtc

SEQ ID NO: 55413 - DNA, 35 bp, Artificial Sequence
  Description of Artificial Sequence: Synthetic oligonucleotide
tttgtcttgtggacaacatctttcctcctgtggtc

SEQ ID NO: 55414 - DNA, 34 bp, Artificial Sequence
  Description of Artificial Sequence: Synthetic oligonucleotide
ttgtcttgtggacaacatctttcctcctgtggtc

SEQ ID NO: 55415 - DNA, 33 bp, Artificial Sequence
  Description of Artificial Sequence: Synthetic oligonucleotide
tgtcttgtggacaacatctttcctcctgtggtc

SEQ ID NO: 55416 - DNA, 32 bp, Artificial Sequence
  Description of Artificial Sequence: Synthetic oligonucleotide
gtcttgtggacaacatctttcctcctgtggtc

SEQ ID NO: 55417 - DNA, 34 bp, Artificial Sequence
  Description of Artificial Sequence: Synthetic oligonucleotide
tcttgtggacaacatctttcctcctgtggtcaac

SEQ ID NO: 55418 - DNA, 33 bp, Artificial Sequence
  Description of Artificial Sequence: Synthetic oligonucleotide
cttgtggacaacatctttcctcctgtggtcaac

SEQ ID NO: 55419 - DNA, 35 bp, Artificial Sequence
  Description of Artificial Sequence: Synthetic oligonucleotide
ttgtggacaacatctttcctcctgtggtcaacatc

SEQ ID NO: 55420 - DNA, 34 bp, Artificial Sequence
  Description of Artificial Sequence: Synthetic oligonucleotide
tgtggacaacatctttcctcctgtggtcaacatc

SEQ ID NO: 55421 - DNA, 33 bp, Artificial Sequence
  Description of Artificial Sequence: Synthetic oligonucleotide
gtggacaacatctttcctcctgtggtcaacatc

SEQ ID NO: 55422 - DNA, 34 bp, Artificial Sequence
  Description of Artificial Sequence: Synthetic oligonucleotide
tggacaacatctttcctcctgtggtcaacatcac

SEQ ID NO: 55423 - DNA, 33 bp, Artificial Sequence
  Description of Artificial Sequence: Synthetic oligonucleotide
ggacaacatctttcctcctgtggtcaacatcac

SEQ ID NO: 55424 - DNA, 35 bp, Artificial Sequence
  Description of Artificial Sequence: Synthetic oligonucleotide
gacaacatctttcctcctgtggtcaacatcacatg

SEQ ID NO: 55425 - DNA, 35 bp, Artificial Sequence
  Description of Artificial Sequence: Synthetic oligonucleotide
acaacatctttcctcctgtggtcaacatcacatgg

SEQ ID NO: 55426 - DNA, 34 bp, Artificial Sequence
  Description of Artificial Sequence: Synthetic oligonucleotide
caacatctttcctcctgtggtcaacatcacatgg

SEQ ID NO: 55427 - DNA, 34 bp, Artificial Sequence
  Description of Artificial Sequence: Synthetic oligonucleotide
aacatctttcctcctgtggtcaacatcacatggc

SEQ ID NO: 55428 - DNA, 33 bp, Artificial Sequence
  Description of Artificial Sequence: Synthetic oligonucleotide
acatctttcctcctgtggtcaacatcacatggc

SEQ ID NO: 55429 - DNA, 32 bp, Artificial Sequence
  Description of Artificial Sequence: Synthetic oligonucleotide
catctttcctcctgtggtcaacatcacatggc

SEQ ID NO: 55430 - DNA, 33 bp, Artificial Sequence
  Description of Artificial Sequence: Synthetic oligonucleotide
atctttcctcctgtggtcaacatcacatggctg

SEQ ID NO: 55431 - DNA, 32 bp, Artificial Sequence
  Description of Artificial Sequence: Synthetic oligonucleotide
tctttcctcctgtggtcaacatcacatggctg

SEQ ID NO: 55432 - DNA, 31 bp, Artificial Sequence
  Description of Artificial Sequence: Synthetic oligonucleotide
ctttcctcctgtggtcaacatcacatggctg

SEQ ID NO: 55433 - DNA, 32 bp, Artificial Sequence
  Description of Artificial Sequence: Synthetic oligonucleotide
tttcctcctgtggtcaacatcacatggctgag

SEQ ID NO: 55434 - DNA, 31 bp, Artificial Sequence
  Description of Artificial Sequence: Synthetic oligonucleotide
ttcctcctgtggtcaacatcacatggctgag

SEQ ID NO: 55435 - DNA, 30 bp, Artificial Sequence
  Description of Artificial Sequence: Synthetic oligonucleotide
tcctcctgtggtcaacatcacatggctgag

SEQ ID NO: 55436 - DNA, 29 bp, Artificial Sequence
  Description of Artificial Sequence: Synthetic oligonucleotide
cctcctgtggtcaacatcacatggctgag

SEQ ID NO: 55437 - DNA, 29 bp, Artificial Sequence
  Description of Artificial Sequence: Synthetic oligonucleotide
ctcctgtggtcaacatcacatggctgagc

SEQ ID NO: 55438 - DNA, 32 bp, Artificial Sequence
  Description of Artificial Sequence: Synthetic oligonucleotide
tcctgtggtcaacatcacatggctgagcaatg

SEQ ID NO: 55439 - DNA, 31 bp, Artificial Sequence
  Description of Artificial Sequence: Synthetic oligonucleotide
cctgtggtcaacatcacatggctgagcaatg

SEQ ID NO: 55440 - DNA, 31 bp, Artificial Sequence
  Description of Artificial Sequence: Synthetic oligonucleotide
ctgtggtcaacatcacatggctgagcaatgg

SEQ ID NO: 55441 - DNA, 31 bp, Artificial Sequence
  Description of Artificial Sequence: Synthetic oligonucleotide
tgtggtcaacatcacatggctgagcaatggg

SEQ ID NO: 55442 - DNA, 30 bp, Artificial Sequence
  Description of Artificial Sequence: Synthetic oligonucleotide
gtggtcaacatcacatggctgagcaatggg

SEQ ID NO: 55443 - DNA, 30 bp, Artificial Sequence
  Description of Artificial Sequence: Synthetic oligonucleotide
tggtcaacatcacatggctgagcaatgggc

SEQ ID NO: 55444 - DNA, 29 bp, Artificial Sequence
  Description of Artificial Sequence: Synthetic oligonucleotide
ggtcaacatcacatggctgagcaatgggc

SEQ ID NO: 55445 - DNA, 30 bp, Artificial Sequence
  Description of Artificial Sequence: Synthetic oligonucleotide
gtcaacatcacatggctgagcaatgggcag

SEQ ID NO: 55446 - DNA, 31 bp, Artificial Sequence
  Description of Artificial Sequence: Synthetic oligonucleotide
tcaacatcacatggctgagcaatgggcagtc

SEQ ID NO: 55447 - DNA, 30 bp, Artificial Sequence
  Description of Artificial Sequence: Synthetic oligonucleotide
caacatcacatggctgagcaatgggcagtc

SEQ ID NO: 55448 - DNA, 31 bp, Artificial Sequence
  Description of Artificial Sequence: Synthetic oligonucleotide
aacatcacatggctgagcaatgggcagtcag

SEQ ID NO: 55449 - DNA, 30 bp, Artificial Sequence
  Description of Artificial Sequence: Synthetic oligonucleotide
acatcacatggctgagcaatgggcagtcag

SEQ ID NO: 55450 - DNA, 29 bp, Artificial Sequence
  Description of Artificial Sequence: Synthetic oligonucleotide
catcacatggctgagcaatgggcagtcag

SEQ ID NO: 55451 - DNA, 30 bp, Artificial Sequence
  Description of Artificial Sequence: Synthetic oligonucleotide
atcacatggctgagcaatgggcagtcagtc

SEQ ID NO: 55452 - DNA, 29 bp, Artificial Sequence
  Description of Artificial Sequence: Synthetic oligonucleotide
tcacatggctgagcaatgggcagtcagtc

SEQ ID NO: 55453 - DNA, 28 bp, Artificial Sequence
  Description of Artificial Sequence: Synthetic oligonucleotide
cacatggctgagcaatgggcagtcagtc

SEQ ID NO: 55454 - DNA, 29 bp, Artificial Sequence
  Description of Artificial Sequence: Synthetic oligonucleotide
acatggctgagcaatgggcagtcagtcac

SEQ ID NO: 55455 - DNA, 28 bp, Artificial Sequence
  Description of Artificial Sequence: Synthetic oligonucleotide
catggctgagcaatgggcagtcagtcac

SEQ ID NO: 55456 - DNA, 29 bp, Artificial Sequence
  Description of Artificial Sequence: Synthetic oligonucleotide
atggctgagcaatgggcagtcagtcacag

SEQ ID NO: 55457 - DNA, 28 bp, Artificial Sequence
  Description of Artificial Sequence: Synthetic oligonucleotide
tggctgagcaatgggcagtcagtcacag

SEQ ID NO: 55458 - DNA, 27 bp, Artificial Sequence
  Description of Artificial Sequence: Synthetic oligonucleotide
ggctgagcaatgggcagtcagtcacag

SEQ ID NO: 55459 - DNA, 29 bp, Artificial Sequence
  Description of Artificial Sequence: Synthetic oligonucleotide
gctgagcaatgggcagtcagtcacagaag

SEQ ID NO: 55460 - DNA, 29 bp, Artificial Sequence
  Description of Artificial Sequence: Synthetic oligonucleotide
ctgagcaatgggcagtcagtcacagaagg

SEQ ID NO: 55461 - DNA, 30 bp, Artificial Sequence
  Description of Artificial Sequence: Synthetic oligonucleotide
tgagcaatgggcagtcagtcacagaaggtg

SEQ ID NO: 55462 - DNA, 29 bp, Artificial Sequence
  Description of Artificial Sequence: Synthetic oligonucleotide
gagcaatgggcagtcagtcacagaaggtg

SEQ ID NO: 55463 - DNA, 32 bp, Artificial Sequence
  Description of Artificial Sequence: Synthetic oligonucleotide
agcaatgggcagtcagtcacagaaggtgtttc

SEQ ID NO: 55464 - DNA, 31 bp, Artificial Sequence
  Description of Artificial Sequence: Synthetic oligonucleotide
gcaatgggcagtcagtcacagaaggtgtttc

SEQ ID NO: 55465 - DNA, 32 bp, Artificial Sequence
  Description of Artificial Sequence: Synthetic oligonucleotide
caatgggcagtcagtcacagaaggtgtttctg

SEQ ID NO: 55466 - DNA, 33 bp, Artificial Sequence
  Description of Artificial Sequence: Synthetic oligonucleotide
aatgggcagtcagtcacagaaggtgtttctgag

SEQ ID NO: 55467 - DNA, 32 bp, Artificial Sequence
  Description of Artificial Sequence: Synthetic oligonucleotide
atgggcagtcagtcacagaaggtgtttctgag

SEQ ID NO: 55468 - DNA, 31 bp, Artificial Sequence
  Description of Artificial Sequence: Synthetic oligonucleotide
tgggcagtcagtcacagaaggtgtttctgag

SEQ ID NO: 55469 - DNA, 30 bp, Artificial Sequence
  Description of Artificial Sequence: Synthetic oligonucleotide
gggcagtcagtcacagaaggtgtttctgag

SEQ ID NO: 55470 - DNA, 31 bp, Artificial Sequence
  Description of Artificial Sequence: Synthetic oligonucleotide
ggcagtcagtcacagaaggtgtttctgagac

SEQ ID NO: 55471 - DNA, 31 bp, Artificial Sequence
  Description of Artificial Sequence: Synthetic oligonucleotide
gcagtcagtcacagaaggtgtttctgagacc

SEQ ID NO: 55472 - DNA, 32 bp, Artificial Sequence
  Description of Artificial Sequence: Synthetic oligonucleotide
cagtcagtcacagaaggtgtttctgagaccag

SEQ ID NO: 55473 - DNA, 32 bp, Artificial Sequence
  Description of Artificial Sequence: Synthetic oligonucleotide
agtcagtcacagaaggtgtttctgagaccagc

SEQ ID NO: 55474 - DNA, 31 bp, Artificial Sequence
  Description of Artificial Sequence: Synthetic oligonucleotide
gtcagtcacagaaggtgtttctgagaccagc

SEQ ID NO: 55475 - DNA, 33 bp, Artificial Sequence
  Description of Artificial Sequence: Synthetic oligonucleotide
tcagtcacagaaggtgtttctgagaccagcttc

SEQ ID NO: 55476 - DNA, 32 bp, Artificial Sequence
  Description of Artificial Sequence: Synthetic oligonucleotide
cagtcacagaaggtgtttctgagaccagcttc

SEQ ID NO: 55477 - DNA, 32 bp, Artificial Sequence
  Description of Artificial Sequence: Synthetic oligonucleotide
agtcacagaaggtgtttctgagaccagcttcc

SEQ ID NO: 55478 - DNA, 31 bp, Artificial Sequence
  Description of Artificial Sequence: Synthetic oligonucleotide
gtcacagaaggtgtttctgagaccagcttcc

SEQ ID NO: 55479 - DNA, 32 bp, Artificial Sequence
  Description of Artificial Sequence: Synthetic oligonucleotide
tcacagaaggtgtttctgagaccagcttcctc

SEQ ID NO: 55480 - DNA, 31 bp, Artificial Sequence
  Description of Artificial Sequence: Synthetic oligonucleotide
cacagaaggtgtttctgagaccagcttcctc

SEQ ID NO: 55481 - DNA, 32 bp, Artificial Sequence
  Description of Artificial Sequence: Synthetic oligonucleotide
acagaaggtgtttctgagaccagcttcctctc

SEQ ID NO: 55482 - DNA, 31 bp, Artificial Sequence
  Description of Artificial Sequence: Synthetic oligonucleotide
cagaaggtgtttctgagaccagcttcctctc

SEQ ID NO: 55483 - DNA, 31 bp, Artificial Sequence
  Description of Artificial Sequence: Synthetic oligonucleotide
agaaggtgtttctgagaccagcttcctctcc

SEQ ID NO: 55484 - DNA, 30 bp, Artificial Sequence
  Description of Artificial Sequence: Synthetic oligonucleotide
gaaggtgtttctgagaccagcttcctctcc

SEQ ID NO: 55485 - DNA, 32 bp, Artificial Sequence
  Description of Artificial Sequence: Synthetic oligonucleotide
aaggtgtttctgagaccagcttcctctccaag

SEQ ID NO: 55486 - DNA, 31 bp, Artificial Sequence
  Description of Artificial Sequence: Synthetic oligonucleotide
aggtgtttctgagaccagcttcctctccaag

SEQ ID NO: 55487 - DNA, 30 bp, Artificial Sequence
  Description of Artificial Sequence: Synthetic oligonucleotide
ggtgtttctgagaccagcttcctctccaag

SEQ ID NO: 55488 - DNA, 31 bp, Artificial Sequence
  Description of Artificial Sequence: Synthetic oligonucleotide
gtgtttctgagaccagcttcctctccaagag

SEQ ID NO: 55489 - DNA, 32 bp, Artificial Sequence
  Description of Artificial Sequence: Synthetic oligonucleotide
tgtttctgagaccagcttcctctccaagagtg

SEQ ID NO: 55490 - DNA, 31 bp, Artificial Sequence
  Description of Artificial Sequence: Synthetic oligonucleotide
gtttctgagaccagcttcctctccaagagtg

SEQ ID NO: 55491 - DNA, 33 bp, Artificial Sequence
  Description of Artificial Sequence: Synthetic oligonucleotide
tttctgagaccagcttcctctccaagagtgatc

SEQ ID NO: 55492 - DNA, 32 bp, Artificial Sequence
  Description of Artificial Sequence: Synthetic oligonucleotide
ttctgagaccagcttcctctccaagagtgatc

SEQ ID NO: 55493 - DNA, 31 bp, Artificial Sequence
  Description of Artificial Sequence: Synthetic oligonucleotide
tctgagaccagcttcctctccaagagtgatc

SEQ ID NO: 55494 - DNA, 30 bp, Artificial Sequence
  Description of Artificial Sequence: Synthetic oligonucleotide
ctgagaccagcttcctctccaagagtgatc

SEQ ID NO: 55495 - DNA, 33 bp, Artificial Sequence
  Description of Artificial Sequence: Synthetic oligonucleotide
tgagaccagcttcctctccaagagtgatcattc

SEQ ID NO: 55496 - DNA, 32 bp, Artificial Sequence
  Description of Artificial Sequence: Synthetic oligonucleotide
gagaccagcttcctctccaagagtgatcattc

SEQ ID NO: 55497 - DNA, 32 bp, Artificial Sequence
  Description of Artificial Sequence: Synthetic oligonucleotide
agaccagcttcctctccaagagtgatcattcc

SEQ ID NO: 55498 - DNA, 31 bp, Artificial Sequence
  Description of Artificial Sequence: Synthetic oligonucleotide
gaccagcttcctctccaagagtgatcattcc

SEQ ID NO: 55499 - DNA, 33 bp, Artificial Sequence
  Description of Artificial Sequence: Synthetic oligonucleotide
accagcttcctctccaagagtgatcattccttc

SEQ ID NO: 55500 - DNA, 32 bp, Artificial Sequence
  Description of Artificial Sequence: Synthetic oligonucleotide
ccagcttcctctccaagagtgatcattccttc

SEQ ID NO: 55501 - DNA, 34 bp, Artificial Sequence
  Description of Artificial Sequence: Synthetic oligonucleotide
cagcttcctctccaagagtgatcattccttcttc

SEQ ID NO: 55502 - DNA, 36 bp, Artificial Sequence
  Description of Artificial Sequence: Synthetic oligonucleotide
agcttcctctccaagagtgatcattccttcttcaag

SEQ ID NO: 55503 - DNA, 35 bp, Artificial Sequence
  Description of Artificial Sequence: Synthetic oligonucleotide
gcttcctctccaagagtgatcattccttcttcaag

SEQ ID NO: 55504 - DNA, 37 bp, Artificial Sequence
  Description of Artificial Sequence: Synthetic oligonucleotide
cttcctctccaagagtgatcattccttcttcaagatc

SEQ ID NO: 55505 - DNA, 38 bp, Artificial Sequence
  Description of Artificial Sequence: Synthetic oligonucleotide
ttcctctccaagagtgatcattccttcttcaagatcag

SEQ ID NO: 55506 - DNA, 37 bp, Artificial Sequence
  Description of Artificial Sequence: Synthetic oligonucleotide
tcctctccaagagtgatcattccttcttcaagatcag

SEQ ID NO: 55507 - DNA, 36 bp, Artificial Sequence
  Description of Artificial Sequence: Synthetic oligonucleotide
cctctccaagagtgatcattccttcttcaagatcag

SEQ ID NO: 55508 - DNA, 39 bp, Artificial Sequence
  Description of Artificial Sequence: Synthetic oligonucleotide
ctctccaagagtgatcattccttcttcaagatcagttac

SEQ ID NO: 55509 - DNA, 39 bp, Artificial Sequence
  Description of Artificial Sequence: Synthetic oligonucleotide
tctccaagagtgatcattccttcttcaagatcagttacc

SEQ ID NO: 55510 - DNA, 38 bp, Artificial Sequence
  Description of Artificial Sequence: Synthetic oligonucleotide
ctccaagagtgatcattccttcttcaagatcagttacc

SEQ ID NO: 55511 - DNA, 39 bp, Artificial Sequence
  Description of Artificial Sequence: Synthetic oligonucleotide
tccaagagtgatcattccttcttcaagatcagttacctc

SEQ ID NO: 55512 - DNA, 38 bp, Artificial Sequence
  Description of Artificial Sequence: Synthetic oligonucleotide
ccaagagtgatcattccttcttcaagatcagttacctc

SEQ ID NO: 55513 - DNA, 39 bp, Artificial Sequence
  Description of Artificial Sequence: Synthetic oligonucleotide
caagagtgatcattccttcttcaagatcagttacctcac

SEQ ID NO: 55514 - DNA, 39 bp, Artificial Sequence
  Description of Artificial Sequence: Synthetic oligonucleotide
aagagtgatcattccttcttcaagatcagttacctcacc

SEQ ID NO: 55515 - DNA, 38 bp, Artificial Sequence
  Description of Artificial Sequence: Synthetic oligonucleotide
agagtgatcattccttcttcaagatcagttacctcacc

SEQ ID NO: 55516 - DNA, 37 bp, Artificial Sequence
  Description of Artificial Sequence: Synthetic oligonucleotide
gagtgatcattccttcttcaagatcagttacctcacc

SEQ ID NO: 55517 - DNA, 39 bp, Artificial Sequence
  Description of Artificial Sequence: Synthetic oligonucleotide
agtgatcattccttcttcaagatcagttacctcaccttc

SEQ ID NO: 55518 - DNA, 38 bp, Artificial Sequence
  Description of Artificial Sequence: Synthetic oligonucleotide
gtgatcattccttcttcaagatcagttacctcaccttc

SEQ ID NO: 55519 - DNA, 38 bp, Artificial Sequence
  Description of Artificial Sequence: Synthetic oligonucleotide
tgatcattccttcttcaagatcagttacctcaccttcc

SEQ ID NO: 55520 - DNA, 37 bp, Artificial Sequence
  Description of Artificial Sequence: Synthetic oligonucleotide
gatcattccttcttcaagatcagttacctcaccttcc

SEQ ID NO: 55521 - DNA, 38 bp, Artificial Sequence
  Description of Artificial Sequence: Synthetic oligonucleotide
atcattccttcttcaagatcagttacctcaccttcctc

SEQ ID NO: 55522 - DNA, 37 bp, Artificial Sequence
  Description of Artificial Sequence: Synthetic oligonucleotide
tcattccttcttcaagatcagttacctcaccttcctc

SEQ ID NO: 55523 - DNA, 36 bp, Artificial Sequence
  Description of Artificial Sequence: Synthetic oligonucleotide
cattccttcttcaagatcagttacctcaccttcctc

SEQ ID NO: 55524 - DNA, 36 bp, Artificial Sequence
  Description of Artificial Sequence: Synthetic oligonucleotide
attccttcttcaagatcagttacctcaccttcctcc

SEQ ID NO: 55525 - DNA, 35 bp, Artificial Sequence
  Description of Artificial Sequence: Synthetic oligonucleotide
ttccttcttcaagatcagttacctcaccttcctcc

SEQ ID NO: 55526 - DNA, 34 bp, Artificial Sequence
  Description of Artificial Sequence: Synthetic oligonucleotide
tccttcttcaagatcagttacctcaccttcctcc

SEQ ID NO: 55527 - DNA, 33 bp, Artificial Sequence
  Description of Artificial Sequence: Synthetic oligonucleotide
ccttcttcaagatcagttacctcaccttcctcc

SEQ ID NO: 55528 - DNA, 33 bp, Artificial Sequence
  Description of Artificial Sequence: Synthetic oligonucleotide
cttcttcaagatcagttacctcaccttcctccc

SEQ ID NO: 55529 - DNA, 35 bp, Artificial Sequence
  Description of Artificial Sequence: Synthetic oligonucleotide
ttcttcaagatcagttacctcaccttcctcccttc

SEQ ID NO: 55530 - DNA, 34 bp, Artificial Sequence
  Description of Artificial Sequence: Synthetic oligonucleotide
tcttcaagatcagttacctcaccttcctcccttc

SEQ ID NO: 55531 - DNA, 33 bp, Artificial Sequence
  Description of Artificial Sequence: Synthetic oligonucleotide
cttcaagatcagttacctcaccttcctcccttc

SEQ ID NO: 55532 - DNA, 34 bp, Artificial Sequence
  Description of Artificial Sequence: Synthetic oligonucleotide
ttcaagatcagttacctcaccttcctcccttctg

SEQ ID NO: 55533 - DNA, 33 bp, Artificial Sequence
  Description of Artificial Sequence: Synthetic oligonucleotide
tcaagatcagttacctcaccttcctcccttctg

SEQ ID NO: 55534 - DNA, 32 bp, Artificial Sequence
  Description of Artificial Sequence: Synthetic oligonucleotide
caagatcagttacctcaccttcctcccttctg

SEQ ID NO: 55535 - DNA, 32 bp, Artificial Sequence
  Description of Artificial Sequence: Synthetic oligonucleotide
aagatcagttacctcaccttcctcccttctgc

SEQ ID NO: 55536 - DNA, 31 bp, Artificial Sequence
  Description of Artificial Sequence: Synthetic oligonucleotide
agatcagttacctcaccttcctcccttctgc

SEQ ID NO: 55537 - DNA, 30 bp, Artificial Sequence
  Description of Artificial Sequence: Synthetic oligonucleotide
gatcagttacctcaccttcctcccttctgc

SEQ ID NO: 55538 - DNA, 31 bp, Artificial Sequence
  Description of Artificial Sequence: Synthetic oligonucleotide
atcagttacctcaccttcctcccttctgctg

SEQ ID NO: 55539 - DNA, 30 bp, Artificial Sequence
  Description of Artificial Sequence: Synthetic oligonucleotide
tcagttacctcaccttcctcccttctgctg

SEQ ID NO: 55540 - DNA, 29 bp, Artificial Sequence
  Description of Artificial Sequence: Synthetic oligonucleotide
cagttacctcaccttcctcccttctgctg

SEQ ID NO: 55541 - DNA, 31 bp, Artificial Sequence
  Description of Artificial Sequence: Synthetic oligonucleotide
agttacctcaccttcctcccttctgctgatg

SEQ ID NO: 55542 - DNA, 30 bp, Artificial Sequence
  Description of Artificial Sequence: Synthetic oligonucleotide
gttacctcaccttcctcccttctgctgatg

SEQ ID NO: 55543 - DNA, 31 bp, Artificial Sequence
  Description of Artificial Sequence: Synthetic oligonucleotide
ttacctcaccttcctcccttctgctgatgag

SEQ ID NO: 55544 - DNA, 30 bp, Artificial Sequence
  Description of Artificial Sequence: Synthetic oligonucleotide
tacctcaccttcctcccttctgctgatgag

SEQ ID NO: 55545 - DNA, 29 bp, Artificial Sequence
  Description of Artificial Sequence: Synthetic oligonucleotide
acctcaccttcctcccttctgctgatgag

SEQ ID NO: 55546 - DNA, 28 bp, Artificial Sequence
  Description of Artificial Sequence: Synthetic oligonucleotide
cctcaccttcctcccttctgctgatgag

SEQ ID NO: 55547 - DNA, 34 bp, Artificial Sequence
  Description of Artificial Sequence: Synthetic oligonucleotide
ctcaccttcctcccttctgctgatgagatttatg

SEQ ID NO: 55548 - DNA, 35 bp, Artificial Sequence
  Description of Artificial Sequence: Synthetic oligonucleotide
tcaccttcctcccttctgctgatgagatttatgac

SEQ ID NO: 55549 - DNA, 34 bp, Artificial Sequence
  Description of Artificial Sequence: Synthetic oligonucleotide
caccttcctcccttctgctgatgagatttatgac

SEQ ID NO: 55550 - DNA, 35 bp, Artificial Sequence
  Description of Artificial Sequence: Synthetic oligonucleotide
accttcctcccttctgctgatgagatttatgactg

SEQ ID NO: 55551 - DNA, 34 bp, Artificial Sequence
  Description of Artificial Sequence: Synthetic oligonucleotide
ccttcctcccttctgctgatgagatttatgactg

SEQ ID NO: 55552 - DNA, 34 bp, Artificial Sequence
  Description of Artificial Sequence: Synthetic oligonucleotide
cttcctcccttctgctgatgagatttatgactgc

SEQ ID NO: 55553 - DNA, 36 bp, Artificial Sequence
  Description of Artificial Sequence: Synthetic oligonucleotide
ttcctcccttctgctgatgagatttatgactgcaag

SEQ ID NO: 55554 - DNA, 35 bp, Artificial Sequence
  Description of Artificial Sequence: Synthetic oligonucleotide
tcctcccttctgctgatgagatttatgactgcaag

SEQ ID NO: 55555 - DNA, 34 bp, Artificial Sequence
  Description of Artificial Sequence: Synthetic oligonucleotide
cctcccttctgctgatgagatttatgactgcaag

SEQ ID NO: 55556 - DNA, 34 bp, Artificial Sequence
  Description of Artificial Sequence: Synthetic oligonucleotide
ctcccttctgctgatgagatttatgactgcaagg

SEQ ID NO: 55557 - DNA, 35 bp, Artificial Sequence
  Description of Artificial Sequence: Synthetic oligonucleotide
tcccttctgctgatgagatttatgactgcaaggtg

SEQ ID NO: 55558 - DNA, 34 bp, Artificial Sequence
  Description of Artificial Sequence: Synthetic oligonucleotide
cccttctgctgatgagatttatgactgcaaggtg

SEQ ID NO: 55559 - DNA, 34 bp, Artificial Sequence
  Description of Artificial Sequence: Synthetic oligonucleotide
ccttctgctgatgagatttatgactgcaaggtgg

SEQ ID NO: 55560 - DNA, 35 bp, Artificial Sequence
  Description of Artificial Sequence: Synthetic oligonucleotide
cttctgctgatgagatttatgactgcaaggtggag

SEQ ID NO: 55561 - DNA, 35 bp, Artificial Sequence
  Description of Artificial Sequence: Synthetic oligonucleotide
ttctgctgatgagatttatgactgcaaggtggagc

SEQ ID NO: 55562 - DNA, 34 bp, Artificial Sequence
  Description of Artificial Sequence: Synthetic oligonucleotide
tctgctgatgagatttatgactgcaaggtggagc

SEQ ID NO: 55563 - DNA, 33 bp, Artificial Sequence
  Description of Artificial Sequence: Synthetic oligonucleotide
ctgctgatgagatttatgactgcaaggtggagc

SEQ ID NO: 55564 - DNA, 34 bp, Artificial Sequence
  Description of Artificial Sequence: Synthetic oligonucleotide
tgctgatgagatttatgactgcaaggtggagcac

SEQ ID NO: 55565 - DNA, 33 bp, Artificial Sequence
  Description of Artificial Sequence: Synthetic oligonucleotide
gctgatgagatttatgactgcaaggtggagcac

SEQ ID NO: 55566 - DNA, 34 bp, Artificial Sequence
  Description of Artificial Sequence: Synthetic oligonucleotide
ctgatgagatttatgactgcaaggtggagcactg

SEQ ID NO: 55567 - DNA, 34 bp, Artificial Sequence
  Description of Artificial Sequence: Synthetic oligonucleotide
tgatgagatttatgactgcaaggtggagcactgg

SEQ ID NO: 55568 - DNA, 33 bp, Artificial Sequence
  Description of Artificial Sequence: Synthetic oligonucleotide
gatgagatttatgactgcaaggtggagcactgg

SEQ ID NO: 55569 - DNA, 33 bp, Artificial Sequence
  Description of Artificial Sequence: Synthetic oligonucleotide
atgagatttatgactgcaaggtggagcactggg

SEQ ID NO: 55570 - DNA, 32 bp, Artificial Sequence
  Description of Artificial Sequence: Synthetic oligonucleotide
tgagatttatgactgcaaggtggagcactggg

SEQ ID NO: 55571 - DNA, 31 bp, Artificial Sequence
  Description of Artificial Sequence: Synthetic oligonucleotide
gagatttatgactgcaaggtggagcactggg

SEQ ID NO: 55572 - DNA, 31 bp, Artificial Sequence
  Description of Artificial Sequence: Synthetic oligonucleotide
agatttatgactgcaaggtggagcactgggg

SEQ ID NO: 55573 - DNA, 30 bp, Artificial Sequence
  Description of Artificial Sequence: Synthetic oligonucleotide
gatttatgactgcaaggtggagcactgggg

SEQ ID NO: 55574 - DNA, 30 bp, Artificial Sequence
  Description of Artificial Sequence: Synthetic oligonucleotide
atttatgactgcaaggtggagcactggggc

SEQ ID NO: 55575 - DNA, 29 bp, Artificial Sequence
  Description of Artificial Sequence: Synthetic oligonucleotide
tttatgactgcaaggtggagcactggggc

SEQ ID NO: 55576 - DNA, 28 bp, Artificial Sequence
  Description of Artificial Sequence: Synthetic oligonucleotide
ttatgactgcaaggtggagcactggggc

SEQ ID NO: 55577 - DNA, 27 bp, Artificial Sequence
  Description of Artificial Sequence: Synthetic oligonucleotide
tatgactgcaaggtggagcactggggc

SEQ ID NO: 55578 - DNA, 26 bp, Artificial Sequence
  Description of Artificial Sequence: Synthetic oligonucleotide
atgactgcaaggtggagcactggggc

SEQ ID NO: 55579 - DNA, 25 bp, Artificial Sequence
  Description of Artificial Sequence: Synthetic oligonucleotide
tgactgcaaggtggagcactggggc

SEQ ID NO: 55580 - DNA, 24 bp, Artificial Sequence
  Description of Artificial Sequence: Synthetic oligonucleotide
gactgcaaggtggagcactggggc

SEQ ID NO: 55581 - DNA, 25 bp, Artificial Sequence
  Description of Artificial Sequence: Synthetic oligonucleotide
actgcaaggtggagcactggggcct

SEQ ID NO: 55582 - DNA, 24 bp, Artificial Sequence
  Description of Artificial Sequence: Synthetic oligonucleotide
ctgcaaggtggagcactggggcct

SEQ ID NO: 55583 - DNA, 24 bp, Artificial Sequence
  Description of Artificial Sequence: Synthetic oligonucleotide
tgcaaggtggagcactggggcctg

SEQ ID NO: 55584 - DNA, 23 bp, Artificial Sequence
  Description of Artificial Sequence: Synthetic oligonucleotide
gcaaggtggagcactggggcctg

SEQ ID NO: 55585 - DNA, 24 bp, Artificial Sequence
  Description of Artificial Sequence: Synthetic oligonucleotide
caaggtggagcactggggcctgga

SEQ ID NO: 55586 - DNA, 24 bp, Artificial Sequence
  Description of Artificial Sequence: Synthetic oligonucleotide
aaggtggagcactggggcctggac

SEQ ID NO: 55587 - DNA, 23 bp, Artificial Sequence
  Description of Artificial Sequence: Synthetic oligonucleotide
aggtggagcactggggcctggac

SEQ ID NO: 55588 - DNA, 22 bp, Artificial Sequence
  Description of Artificial Sequence: Synthetic oligonucleotide
ggtggagcactggggcctggac

SEQ ID NO: 55589 - DNA, 23 bp, Artificial Sequence
  Description of Artificial Sequence: Synthetic oligonucleotide
gtggagcactggggcctggacca

SEQ ID NO: 55590 - DNA, 23 bp, Artificial Sequence
  Description of Artificial Sequence: Synthetic oligonucleotide
tggagcactggggcctggaccag

SEQ ID NO: 55591 - DNA, 22 bp, Artificial Sequence
  Description of Artificial Sequence: Synthetic oligonucleotide
ggagcactggggcctggaccag

SEQ ID NO: 55592 - DNA, 22 bp, Artificial Sequence
  Description of Artificial Sequence: Synthetic oligonucleotide
gagcactggggcctggaccagc

SEQ ID NO: 55593 - DNA, 23 bp, Artificial Sequence
  Description of Artificial Sequence: Synthetic oligonucleotide
agcactggggcctggaccagcct

SEQ ID NO: 55594 - DNA, 22 bp, Artificial Sequence
  Description of Artificial Sequence: Synthetic oligonucleotide
gcactggggcctggaccagcct

SEQ ID NO: 55595 - DNA, 24 bp, Artificial Sequence
  Description of Artificial Sequence: Synthetic oligonucleotide
cactggggcctggaccagcctctt

SEQ ID NO: 55596 - DNA, 25 bp, Artificial Sequence
  Description of Artificial Sequence: Synthetic oligonucleotide
actggggcctggaccagcctcttct

SEQ ID NO: 55597 - DNA, 24 bp, Artificial Sequence
  Description of Artificial Sequence: Synthetic oligonucleotide
ctggggcctggaccagcctcttct

SEQ ID NO: 55598 - DNA, 27 bp, Artificial Sequence
  Description of Artificial Sequence: Synthetic oligonucleotide
tggggcctggaccagcctcttctgaaa

SEQ ID NO: 55599 - DNA, 26 bp, Artificial Sequence
  Description of Artificial Sequence: Synthetic oligonucleotide
ggggcctggaccagcctcttctgaaa

SEQ ID NO: 55600 - DNA, 27 bp, Artificial Sequence
  Description of Artificial Sequence: Synthetic oligonucleotide
gggcctggaccagcctcttctgaaaca

SEQ ID NO: 55601 - DNA, 27 bp, Artificial Sequence
  Description of Artificial Sequence: Synthetic oligonucleotide
ggcctggaccagcctcttctgaaacac

SEQ ID NO: 55602 - DNA, 28 bp, Artificial Sequence
  Description of Artificial Sequence: Synthetic oligonucleotide
gcctggaccagcctcttctgaaacactg

SEQ ID NO: 55603 - DNA, 28 bp, Artificial Sequence
  Description of Artificial Sequence: Synthetic oligonucleotide
cctggaccagcctcttctgaaacactgg

SEQ ID NO: 55604 - DNA, 28 bp, Artificial Sequence
  Description of Artificial Sequence: Synthetic oligonucleotide
ctggaccagcctcttctgaaacactggg

SEQ ID NO: 55605 - DNA, 29 bp, Artificial Sequence
  Description of Artificial Sequence: Synthetic oligonucleotide
tggaccagcctcttctgaaacactgggag

SEQ ID NO: 55606 - DNA, 28 bp, Artificial Sequence
  Description of Artificial Sequence: Synthetic oligonucleotide
ggaccagcctcttctgaaacactgggag

SEQ ID NO: 55607 - DNA, 28 bp, Artificial Sequence
  Description of Artificial Sequence: Synthetic oligonucleotide
gaccagcctcttctgaaacactgggagc

SEQ ID NO: 55608 - DNA, 28 bp, Artificial Sequence
  Description of Artificial Sequence: Synthetic oligonucleotide
accagcctcttctgaaacactgggagcc

SEQ ID NO: 55609 - DNA, 27 bp, Artificial Sequence
  Description of Artificial Sequence: Synthetic oligonucleotide
ccagcctcttctgaaacactgggagcc

SEQ ID NO: 55610 - DNA, 28 bp, Artificial Sequence
  Description of Artificial Sequence: Synthetic oligonucleotide
cagcctcttctgaaacactgggagcctg

SEQ ID NO: 55611 - DNA, 29 bp, Artificial Sequence
  Description of Artificial Sequence: Synthetic oligonucleotide
agcctcttctgaaacactgggagcctgag

SEQ ID NO: 55612 - DNA, 28 bp, Artificial Sequence
  Description of Artificial Sequence: Synthetic oligonucleotide
gcctcttctgaaacactgggagcctgag

SEQ ID NO: 55613 - DNA, 31 bp, Artificial Sequence
  Description of Artificial Sequence: Synthetic oligonucleotide
cctcttctgaaacactgggagcctgagattc

SEQ ID NO: 55614 - DNA, 31 bp, Artificial Sequence
  Description of Artificial Sequence: Synthetic oligonucleotide
ctcttctgaaacactgggagcctgagattcc

SEQ ID NO: 55615 - DNA, 32 bp, Artificial Sequence
  Description of Artificial Sequence: Synthetic oligonucleotide
tcttctgaaacactgggagcctgagattccag

SEQ ID NO: 55616 - DNA, 31 bp, Artificial Sequence
  Description of Artificial Sequence: Synthetic oligonucleotide
cttctgaaacactgggagcctgagattccag

SEQ ID NO: 55617 - DNA, 31 bp, Artificial Sequence
  Description of Artificial Sequence: Synthetic oligonucleotide
ttctgaaacactgggagcctgagattccagc

SEQ ID NO: 55618 - DNA, 30 bp, Artificial Sequence
  Description of Artificial Sequence: Synthetic oligonucleotide
tctgaaacactgggagcctgagattccagc

SEQ ID NO: 55619 - DNA, 29 bp, Artificial Sequence
  Description of Artificial Sequence: Synthetic oligonucleotide
ctgaaacactgggagcctgagattccagc

SEQ ID NO: 55620 - DNA, 29 bp, Artificial Sequence
  Description of Artificial Sequence: Synthetic oligonucleotide
tgaaacactgggagcctgagattccagcc

SEQ ID NO: 55621 - DNA, 28 bp, Artificial Sequence
  Description of Artificial Sequence: Synthetic oligonucleotide
gaaacactgggagcctgagattccagcc

SEQ ID NO: 55622 - DNA, 28 bp, Artificial Sequence
  Description of Artificial Sequence: Synthetic oligonucleotide
aaacactgggagcctgagattccagccc

SEQ ID NO: 55623 - DNA, 27 bp, Artificial Sequence
  Description of Artificial Sequence: Synthetic oligonucleotide
aacactgggagcctgagattccagccc

SEQ ID NO: 55624 - DNA, 26 bp, Artificial Sequence
  Description of Artificial Sequence: Synthetic oligonucleotide
acactgggagcctgagattccagccc

SEQ ID NO: 55625 - DNA, 25 bp, Artificial Sequence
  Description of Artificial Sequence: Synthetic oligonucleotide
cactgggagcctgagattccagccc

SEQ ID NO: 55626 - DNA, 27 bp, Artificial Sequence
  Description of Artificial Sequence: Synthetic oligonucleotide
actgggagcctgagattccagccccta

SEQ ID NO: 55627 - DNA, 27 bp, Artificial Sequence
  Description of Artificial Sequence: Synthetic oligonucleotide
ctgggagcctgagattccagcccctat

SEQ ID NO: 55628 - DNA, 27 bp, Artificial Sequence
  Description of Artificial Sequence: Synthetic oligonucleotide
tgggagcctgagattccagcccctatg

SEQ ID NO: 55629 - DNA, 27 bp, Artificial Sequence
  Description of Artificial Sequence: Synthetic oligonucleotide
gggagcctgagattccagcccctatgt

SEQ ID NO: 55630 - DNA, 27 bp, Artificial Sequence
  Description of Artificial Sequence: Synthetic oligonucleotide
ggagcctgagattccagcccctatgtc

SEQ ID NO: 55631 - DNA, 28 bp, Artificial Sequence
  Description of Artificial Sequence: Synthetic oligonucleotide
gagcctgagattccagcccctatgtcag

SEQ ID NO: 55632 - DNA, 29 bp, Artificial Sequence
  Description of Artificial Sequence: Synthetic oligonucleotide
agcctgagattccagcccctatgtcagag

SEQ ID NO: 55633 - DNA, 28 bp, Artificial Sequence
  Description of Artificial Sequence: Synthetic oligonucleotide
gcctgagattccagcccctatgtcagag

SEQ ID NO: 55634 - DNA, 28 bp, Artificial Sequence
  Description of Artificial Sequence: Synthetic oligonucleotide
cctgagattccagcccctatgtcagagc

SEQ ID NO: 55635 - DNA, 29 bp, Artificial Sequence
  Description of Artificial Sequence: Synthetic oligonucleotide
ctgagattccagcccctatgtcagagctc

SEQ ID NO: 55636 - DNA, 30 bp, Artificial Sequence
  Description of Artificial Sequence: Synthetic oligonucleotide
tgagattccagcccctatgtcagagctcac

SEQ ID NO: 55637 - DNA, 29 bp, Artificial Sequence
  Description of Artificial Sequence: Synthetic oligonucleotide
gagattccagcccctatgtcagagctcac

SEQ ID NO: 55638 - DNA, 30 bp, Artificial Sequence
  Description of Artificial Sequence: Synthetic oligonucleotide
agattccagcccctatgtcagagctcacag

SEQ ID NO: 55639 - DNA, 29 bp, Artificial Sequence
  Description of Artificial Sequence: Synthetic oligonucleotide
gattccagcccctatgtcagagctcacag

SEQ ID NO: 55640 - DNA, 30 bp, Artificial Sequence
  Description of Artificial Sequence: Synthetic oligonucleotide
attccagcccctatgtcagagctcacagag

SEQ ID NO: 55641 - DNA, 29 bp, Artificial Sequence
  Description of Artificial Sequence: Synthetic oligonucleotide
ttccagcccctatgtcagagctcacagag

SEQ ID NO: 55642 - DNA, 28 bp, Artificial Sequence
  Description of Artificial Sequence: Synthetic oligonucleotide
tccagcccctatgtcagagctcacagag

SEQ ID NO: 55643 - DNA, 27 bp, Artificial Sequence
  Description of Artificial Sequence: Synthetic oligonucleotide
ccagcccctatgtcagagctcacagag

SEQ ID NO: 55644 - DNA, 28 bp, Artificial Sequence
  Description of Artificial Sequence: Synthetic oligonucleotide
cagcccctatgtcagagctcacagagac

SEQ ID NO: 55645 - DNA, 29 bp, Artificial Sequence
  Description of Artificial Sequence: Synthetic oligonucleotide
agcccctatgtcagagctcacagagactg

SEQ ID NO: 55646 - DNA, 28 bp, Artificial Sequence
  Description of Artificial Sequence: Synthetic oligonucleotide
gcccctatgtcagagctcacagagactg

SEQ ID NO: 55647 - DNA, 29 bp, Artificial Sequence
  Description of Artificial Sequence: Synthetic oligonucleotide
cccctatgtcagagctcacagagactgtg

SEQ ID NO: 55648 - DNA, 29 bp, Artificial Sequence
  Description of Artificial Sequence: Synthetic oligonucleotide
ccctatgtcagagctcacagagactgtgg

SEQ ID NO: 55649 - DNA, 30 bp, Artificial Sequence
  Description of Artificial Sequence: Synthetic oligonucleotide
cctatgtcagagctcacagagactgtggtc

SEQ ID NO: 55650 - DNA, 31 bp, Artificial Sequence
  Description of Artificial Sequence: Synthetic oligonucleotide
ctatgtcagagctcacagagactgtggtctg

SEQ ID NO: 55651 - DNA, 31 bp, Artificial Sequence
  Description of Artificial Sequence: Synthetic oligonucleotide
tatgtcagagctcacagagactgtggtctgc

SEQ ID NO: 55652 - DNA, 30 bp, Artificial Sequence
  Description of Artificial Sequence: Synthetic oligonucleotide
atgtcagagctcacagagactgtggtctgc

SEQ ID NO: 55653 - DNA, 29 bp, Artificial Sequence
  Description of Artificial Sequence: Synthetic oligonucleotide
tgtcagagctcacagagactgtggtctgc

SEQ ID NO: 55654 - DNA, 28 bp, Artificial Sequence
  Description of Artificial Sequence: Synthetic oligonucleotide
gtcagagctcacagagactgtggtctgc

SEQ ID NO: 55655 - DNA, 28 bp, Artificial Sequence
  Description of Artificial Sequence: Synthetic oligonucleotide
tcagagctcacagagactgtggtctgcg

SEQ ID NO: 55656 - DNA, 27 bp, Artificial Sequence
  Description of Artificial Sequence: Synthetic oligonucleotide
cagagctcacagagactgtggtctgcg

SEQ ID NO: 55657 - DNA, 27 bp, Artificial Sequence
  Description of Artificial Sequence: Synthetic oligonucleotide
agagctcacagagactgtggtctgcgc

SEQ ID NO: 55658 - DNA, 26 bp, Artificial Sequence
  Description of Artificial Sequence: Synthetic oligonucleotide
gagctcacagagactgtggtctgcgc

SEQ ID NO: 55659 - DNA, 26 bp, Artificial Sequence
  Description of Artificial Sequence: Synthetic oligonucleotide
agctcacagagactgtggtctgcgcc

SEQ ID NO: 55660 - DNA, 25 bp, Artificial Sequence
  Description of Artificial Sequence: Synthetic oligonucleotide
gctcacagagactgtggtctgcgcc

SEQ ID NO: 55661 - DNA, 26 bp, Artificial Sequence
  Description of Artificial Sequence: Synthetic oligonucleotide
ctcacagagactgtggtctgcgccct

SEQ ID NO: 55662 - DNA, 26 bp, Artificial Sequence
  Description of Artificial Sequence: Synthetic oligonucleotide
tcacagagactgtggtctgcgccctg

SEQ ID NO: 55663 - DNA, 25 bp, Artificial Sequence
  Description of Artificial Sequence: Synthetic oligonucleotide
cacagagactgtggtctgcgccctg

SEQ ID NO: 55664 - DNA, 25 bp, Artificial Sequence
  Description of Artificial Sequence: Synthetic oligonucleotide
acagagactgtggtctgcgccctgg

SEQ ID NO: 55665 - DNA, 24 bp, Artificial Sequence
  Description of Artificial Sequence: Synthetic oligonucleotide
cagagactgtggtctgcgccctgg

SEQ ID NO: 55666 - DNA, 24 bp, Artificial Sequence
  Description of Artificial Sequence: Synthetic oligonucleotide
agagactgtggtctgcgccctggg

SEQ ID NO: 55667 - DNA, 23 bp, Artificial Sequence
  Description of Artificial Sequence: Synthetic oligonucleotide
gagactgtggtctgcgccctggg

SEQ ID NO: 55668 - DNA, 25 bp, Artificial Sequence
  Description of Artificial Sequence: Synthetic oligonucleotide
agactgtggtctgcgccctggggtt

SEQ ID NO: 55669 - DNA, 24 bp, Artificial Sequence
  Description of Artificial Sequence: Synthetic oligonucleotide
gactgtggtctgcgccctggggtt

SEQ ID NO: 55670 - DNA, 25 bp, Artificial Sequence
  Description of Artificial Sequence: Synthetic oligonucleotide
actgtggtctgcgccctggggttgt

SEQ ID NO: 55671 - DNA, 24 bp, Artificial Sequence
  Description of Artificial Sequence: Synthetic oligonucleotide
ctgtggtctgcgccctggggttgt

SEQ ID NO: 55672 - DNA, 25 bp, Artificial Sequence
  Description of Artificial Sequence: Synthetic oligonucleotide
tgtggtctgcgccctggggttgtct

SEQ ID NO: 55673 - DNA, 24 bp, Artificial Sequence
  Description of Artificial Sequence: Synthetic oligonucleotide
gtggtctgcgccctggggttgtct

SEQ ID NO: 55674 - DNA, 25 bp, Artificial Sequence
  Description of Artificial Sequence: Synthetic oligonucleotide
tggtctgcgccctggggttgtctgt

SEQ ID NO: 55675 - DNA, 24 bp, Artificial Sequence
  Description of Artificial Sequence: Synthetic oligonucleotide
ggtctgcgccctggggttgtctgt

SEQ ID NO: 55676 - DNA, 24 bp, Artificial Sequence
  Description of Artificial Sequence: Synthetic oligonucleotide
gtctgcgccctggggttgtctgtg

SEQ ID NO: 55677 - DNA, 24 bp, Artificial Sequence
  Description of Artificial Sequence: Synthetic oligonucleotide
tctgcgccctggggttgtctgtgg

SEQ ID NO: 55678 - DNA, 23 bp, Artificial Sequence
  Description of Artificial Sequence: Synthetic oligonucleotide
ctgcgccctggggttgtctgtgg

SEQ ID NO: 55679 - DNA, 23 bp, Artificial Sequence
  Description of Artificial Sequence: Synthetic oligonucleotide
tgcgccctggggttgtctgtggg

SEQ ID NO: 55680 - DNA, 22 bp, Artificial Sequence
  Description of Artificial Sequence: Synthetic oligonucleotide
gcgccctggggttgtctgtggg

SEQ ID NO: 55681 - DNA, 22 bp, Artificial Sequence
  Description of Artificial Sequence: Synthetic oligonucleotide
cgccctggggttgtctgtgggc

SEQ ID NO: 55682 - DNA, 23 bp, Artificial Sequence
  Description of Artificial Sequence: Synthetic oligonucleotide
gccctggggttgtctgtgggcct

SEQ ID NO: 55683 - DNA, 23 bp, Artificial Sequence
  Description of Artificial Sequence: Synthetic oligonucleotide
ccctggggttgtctgtgggcctc

SEQ ID NO: 55684 - DNA, 24 bp, Artificial Sequence
  Description of Artificial Sequence: Synthetic oligonucleotide
cctggggttgtctgtgggcctcgt

SEQ ID NO: 55685 - DNA, 24 bp, Artificial Sequence
  Description of Artificial Sequence: Synthetic oligonucleotide
ctggggttgtctgtgggcctcgtg

SEQ ID NO: 55686 - DNA, 24 bp, Artificial Sequence
  Description of Artificial Sequence: Synthetic oligonucleotide
tggggttgtctgtgggcctcgtgg

SEQ ID NO: 55687 - DNA, 23 bp, Artificial Sequence
  Description of Artificial Sequence: Synthetic oligonucleotide
ggggttgtctgtgggcctcgtgg

SEQ ID NO: 55688 - DNA, 23 bp, Artificial Sequence
  Description of Artificial Sequence: Synthetic oligonucleotide
gggttgtctgtgggcctcgtggg

SEQ ID NO: 55689 - DNA, 26 bp, Artificial Sequence
  Description of Artificial Sequence: Synthetic oligonucleotide
ggttgtctgtgggcctcgtgggcatt

SEQ ID NO: 55690 - DNA, 27 bp, Artificial Sequence
  Description of Artificial Sequence: Synthetic oligonucleotide
gttgtctgtgggcctcgtgggcattgt

SEQ ID NO: 55691 - DNA, 27 bp, Artificial Sequence
  Description of Artificial Sequence: Synthetic oligonucleotide
ttgtctgtgggcctcgtgggcattgtg

SEQ ID NO: 55692 - DNA, 26 bp, Artificial Sequence
  Description of Artificial Sequence: Synthetic oligonucleotide
tgtctgtgggcctcgtgggcattgtg

SEQ ID NO: 55693 - DNA, 25 bp, Artificial Sequence
  Description of Artificial Sequence: Synthetic oligonucleotide
gtctgtgggcctcgtgggcattgtg

SEQ ID NO: 55694 - DNA, 26 bp, Artificial Sequence
  Description of Artificial Sequence: Synthetic oligonucleotide
tctgtgggcctcgtgggcattgtggt

SEQ ID NO: 55695 - DNA, 25 bp, Artificial Sequence
  Description of Artificial Sequence: Synthetic oligonucleotide
ctgtgggcctcgtgggcattgtggt

SEQ ID NO: 55696 - DNA, 25 bp, Artificial Sequence
  Description of Artificial Sequence: Synthetic oligonucleotide
tgtgggcctcgtgggcattgtggtg

SEQ ID NO: 55697 - DNA, 24 bp, Artificial Sequence
  Description of Artificial Sequence: Synthetic oligonucleotide
gtgggcctcgtgggcattgtggtg

SEQ ID NO: 55698 - DNA, 24 bp, Artificial Sequence
  Description of Artificial Sequence: Synthetic oligonucleotide
tgggcctcgtgggcattgtggtgg

SEQ ID NO: 55699 - DNA, 23 bp, Artificial Sequence
  Description of Artificial Sequence: Synthetic oligonucleotide
gggcctcgtgggcattgtggtgg

SEQ ID NO: 55700 - DNA, 23 bp, Artificial Sequence
  Description of Artificial Sequence: Synthetic oligonucleotide
ggcctcgtgggcattgtggtggg

SEQ ID NO: 55701 - DNA, 24 bp, Artificial Sequence
  Description of Artificial Sequence: Synthetic oligonucleotide
gcctcgtgggcattgtggtgggca

SEQ ID NO: 55702 - DNA, 25 bp, Artificial Sequence
  Description of Artificial Sequence: Synthetic oligonucleotide
cctcgtgggcattgtggtgggcact

SEQ ID NO: 55703 - DNA, 26 bp, Artificial Sequence
  Description of Artificial Sequence: Synthetic oligonucleotide
ctcgtgggcattgtggtgggcactgt

SEQ ID NO: 55704 - DNA, 27 bp, Artificial Sequence
  Description of Artificial Sequence: Synthetic oligonucleotide
tcgtgggcattgtggtgggcactgtct

SEQ ID NO: 55705 - DNA, 27 bp, Artificial Sequence
  Description of Artificial Sequence: Synthetic oligonucleotide
cgtgggcattgtggtgggcactgtctt

SEQ ID NO: 55706 - DNA, 27 bp, Artificial Sequence
  Description of Artificial Sequence: Synthetic oligonucleotide
gtgggcattgtggtgggcactgtcttc

SEQ ID NO: 55707 - DNA, 29 bp, Artificial Sequence
  Description of Artificial Sequence: Synthetic oligonucleotide
tgggcattgtggtgggcactgtcttcatc

SEQ ID NO: 55708 - DNA, 28 bp, Artificial Sequence
  Description of Artificial Sequence: Synthetic oligonucleotide
gggcattgtggtgggcactgtcttcatc

SEQ ID NO: 55709 - DNA, 30 bp, Artificial Sequence
  Description of Artificial Sequence: Synthetic oligonucleotide
ggcattgtggtgggcactgtcttcatcatc

SEQ ID NO: 55710 - DNA, 30 bp, Artificial Sequence
  Description of Artificial Sequence: Synthetic oligonucleotide
gcattgtggtgggcactgtcttcatcatcc

SEQ ID NO: 55711 - DNA, 32 bp, Artificial Sequence
  Description of Artificial Sequence: Synthetic oligonucleotide
cattgtggtgggcactgtcttcatcatccaag

SEQ ID NO: 55712 - DNA, 32 bp, Artificial Sequence
  Description of Artificial Sequence: Synthetic oligonucleotide
attgtggtgggcactgtcttcatcatccaagg

SEQ ID NO: 55713 - DNA, 31 bp, Artificial Sequence
  Description of Artificial Sequence: Synthetic oligonucleotide
ttgtggtgggcactgtcttcatcatccaagg

SEQ ID NO: 55714 - DNA, 30 bp, Artificial Sequence
  Description of Artificial Sequence: Synthetic oligonucleotide
tgtggtgggcactgtcttcatcatccaagg

SEQ ID NO: 55715 - DNA, 29 bp, Artificial Sequence
  Description of Artificial Sequence: Synthetic oligonucleotide
gtggtgggcactgtcttcatcatccaagg

SEQ ID NO: 55716 - DNA, 29 bp, Artificial Sequence
  Description of Artificial Sequence: Synthetic oligonucleotide
tggtgggcactgtcttcatcatccaaggc

SEQ ID NO: 55717 - DNA, 28 bp, Artificial Sequence
  Description of Artificial Sequence: Synthetic oligonucleotide
ggtgggcactgtcttcatcatccaaggc

SEQ ID NO: 55718 - DNA, 28 bp, Artificial Sequence
  Description of Artificial Sequence: Synthetic oligonucleotide
gtgggcactgtcttcatcatccaaggcc

SEQ ID NO: 55719 - DNA, 29 bp, Artificial Sequence
  Description of Artificial Sequence: Synthetic oligonucleotide
tgggcactgtcttcatcatccaaggcctg

SEQ ID NO: 55720 - DNA, 28 bp, Artificial Sequence
  Description of Artificial Sequence: Synthetic oligonucleotide
gggcactgtcttcatcatccaaggcctg

SEQ ID NO: 55721 - DNA, 28 bp, Artificial Sequence
  Description of Artificial Sequence: Synthetic oligonucleotide
ggcactgtcttcatcatccaaggcctgc

SEQ ID NO: 55722 - DNA, 28 bp, Artificial Sequence
  Description of Artificial Sequence: Synthetic oligonucleotide
gcactgtcttcatcatccaaggcctgcg

SEQ ID NO: 55723 - DNA, 30 bp, Artificial Sequence
  Description of Artificial Sequence: Synthetic oligonucleotide
cactgtcttcatcatccaaggcctgcgttc

SEQ ID NO: 55724 - DNA, 31 bp, Artificial Sequence
  Description of Artificial Sequence: Synthetic oligonucleotide
actgtcttcatcatccaaggcctgcgttcag

SEQ ID NO: 55725 - DNA, 30 bp, Artificial Sequence
  Description of Artificial Sequence: Synthetic oligonucleotide
ctgtcttcatcatccaaggcctgcgttcag

SEQ ID NO: 55726 - DNA, 32 bp, Artificial Sequence
  Description of Artificial Sequence: Synthetic oligonucleotide
tgtcttcatcatccaaggcctgcgttcagttg

SEQ ID NO: 55727 - DNA, 31 bp, Artificial Sequence
  Description of Artificial Sequence: Synthetic oligonucleotide
gtcttcatcatccaaggcctgcgttcagttg

SEQ ID NO: 55728 - DNA, 31 bp, Artificial Sequence
  Description of Artificial Sequence: Synthetic oligonucleotide
tcttcatcatccaaggcctgcgttcagttgg

SEQ ID NO: 55729 - DNA, 30 bp, Artificial Sequence
  Description of Artificial Sequence: Synthetic oligonucleotide
cttcatcatccaaggcctgcgttcagttgg

SEQ ID NO: 55730 - DNA, 31 bp, Artificial Sequence
  Description of Artificial Sequence: Synthetic oligonucleotide
ttcatcatccaaggcctgcgttcagttggtg

SEQ ID NO: 55731 - DNA, 30 bp, Artificial Sequence
  Description of Artificial Sequence: Synthetic oligonucleotide
tcatcatccaaggcctgcgttcagttggtg

SEQ ID NO: 55732 - DNA, 29 bp, Artificial Sequence
  Description of Artificial Sequence: Synthetic oligonucleotide
catcatccaaggcctgcgttcagttggtg

SEQ ID NO: 55733 - DNA, 29 bp, Artificial Sequence
  Description of Artificial Sequence: Synthetic oligonucleotide
atcatccaaggcctgcgttcagttggtgc

SEQ ID NO: 55734 - DNA, 28 bp, Artificial Sequence
  Description of Artificial Sequence: Synthetic oligonucleotide
tcatccaaggcctgcgttcagttggtgc

SEQ ID NO: 55735 - DNA, 27 bp, Artificial Sequence
  Description of Artificial Sequence: Synthetic oligonucleotide
catccaaggcctgcgttcagttggtgc

SEQ ID NO: 55736 - DNA, 29 bp, Artificial Sequence
  Description of Artificial Sequence: Synthetic oligonucleotide
atccaaggcctgcgttcagttggtgcttc

SEQ ID NO: 55737 - DNA, 28 bp, Artificial Sequence
  Description of Artificial Sequence: Synthetic oligonucleotide
tccaaggcctgcgttcagttggtgcttc

SEQ ID NO: 55738 - DNA, 27 bp, Artificial Sequence
  Description of Artificial Sequence: Synthetic oligonucleotide
ccaaggcctgcgttcagttggtgcttc

SEQ ID NO: 55739 - DNA, 27 bp, Artificial Sequence
  Description of Artificial Sequence: Synthetic oligonucleotide
caaggcctgcgttcagttggtgcttcc

SEQ ID NO: 55740 - DNA, 28 bp, Artificial Sequence
  Description of Artificial Sequence: Synthetic oligonucleotide
aaggcctgcgttcagttggtgcttccag

SEQ ID NO: 55741 - DNA, 27 bp, Artificial Sequence
  Description of Artificial Sequence: Synthetic oligonucleotide
aggcctgcgttcagttggtgcttccag

SEQ ID NO: 55742 - DNA, 27 bp, Artificial Sequence
  Description of Artificial Sequence: Synthetic oligonucleotide
ggcctgcgttcagttggtgcttccaga

SEQ ID NO: 55743 - DNA, 27 bp, Artificial Sequence
  Description of Artificial Sequence: Synthetic oligonucleotide
gcctgcgttcagttggtgcttccagac

SEQ ID NO: 55744 - DNA, 28 bp, Artificial Sequence
  Description of Artificial Sequence: Synthetic oligonucleotide
cctgcgttcagttggtgcttccagacac

SEQ ID NO: 55745 - DNA, 28 bp, Artificial Sequence
  Description of Artificial Sequence: Synthetic oligonucleotide
ctgcgttcagttggtgcttccagacacc

SEQ ID NO: 55746 - DNA, 30 bp, Artificial Sequence
  Description of Artificial Sequence: Synthetic oligonucleotide
tgcgttcagttggtgcttccagacaccaag

SEQ ID NO: 55747 - DNA, 29 bp, Artificial Sequence
  Description of Artificial Sequence: Synthetic oligonucleotide
gcgttcagttggtgcttccagacaccaag

SEQ ID NO: 55748 - DNA, 29 bp, Artificial Sequence
  Description of Artificial Sequence: Synthetic oligonucleotide
cgttcagttggtgcttccagacaccaagg

SEQ ID NO: 55749 - DNA, 29 bp, Artificial Sequence
  Description of Artificial Sequence: Synthetic oligonucleotide
gttcagttggtgcttccagacaccaaggg

SEQ ID NO: 55750 - DNA, 29 bp, Artificial Sequence
  Description of Artificial Sequence: Synthetic oligonucleotide
ttcagttggtgcttccagacaccaagggc

SEQ ID NO: 55751 - DNA, 28 bp, Artificial Sequence
  Description of Artificial Sequence: Synthetic oligonucleotide
tcagttggtgcttccagacaccaagggc

SEQ ID NO: 55752 - DNA, 27 bp, Artificial Sequence
  Description of Artificial Sequence: Synthetic oligonucleotide
cagttggtgcttccagacaccaagggc

SEQ ID NO: 55753 - DNA, 27 bp, Artificial Sequence
  Description of Artificial Sequence: Synthetic oligonucleotide
agttggtgcttccagacaccaagggcc

SEQ ID NO: 55754 - DNA, 27 bp, Artificial Sequence
  Description of Artificial Sequence: Synthetic oligonucleotide
gttggtgcttccagacaccaagggcca

SEQ ID NO: 55755 - DNA, 29 bp, Artificial Sequence
  Description of Artificial Sequence: Synthetic oligonucleotide
ttggtgcttccagacaccaagggccattg

SEQ ID NO: 55756 - DNA, 28 bp, Artificial Sequence
  Description of Artificial Sequence: Synthetic oligonucleotide
tggtgcttccagacaccaagggccattg

SEQ ID NO: 55757 - DNA, 27 bp, Artificial Sequence
  Description of Artificial Sequence: Synthetic oligonucleotide
ggtgcttccagacaccaagggccattg

SEQ ID NO: 55758 - DNA, 28 bp, Artificial Sequence
  Description of Artificial Sequence: Synthetic oligonucleotide
gtgcttccagacaccaagggccattgtg

SEQ ID NO: 55759 - DNA, 29 bp, Artificial Sequence
  Description of Artificial Sequence: Synthetic oligonucleotide
tgcgttcagttggtgcttccagacaccag

SEQ ID NO: 55760 - DNA, 28 bp, Artificial Sequence
  Description of Artificial Sequence: Synthetic oligonucleotide
gcgttcagttggtgcttccagacaccag

SEQ ID NO: 55761 - DNA, 28 bp, Artificial Sequence
  Description of Artificial Sequence: Synthetic oligonucleotide
cgttcagttggtgcttccagacaccagg

SEQ ID NO: 55762 - DNA, 28 bp, Artificial Sequence
  Description of Artificial Sequence: Synthetic oligonucleotide
gttcagttggtgcttccagacaccaggg

SEQ ID NO: 55763 - DNA, 28 bp, Artificial Sequence
  Description of Artificial Sequence: Synthetic oligonucleotide
ttcagttggtgcttccagacaccagggg

SEQ ID NO: 55764 - DNA, 27 bp, Artificial Sequence
  Description of Artificial Sequence: Synthetic oligonucleotide
tcagttggtgcttccagacaccagggg

SEQ ID NO: 55765 - DNA, 26 bp, Artificial Sequence
  Description of Artificial Sequence: Synthetic oligonucleotide
cagttggtgcttccagacaccagggg

SEQ ID NO: 55766 - DNA, 26 bp, Artificial Sequence
  Description of Artificial Sequence: Synthetic oligonucleotide
agttggtgcttccagacaccaggggc

SEQ ID NO: 55767 - DNA, 25 bp, Artificial Sequence
  Description of Artificial Sequence: Synthetic oligonucleotide
gttggtgcttccagacaccaggggc

SEQ ID NO: 55768 - DNA, 27 bp, Artificial Sequence
  Description of Artificial Sequence: Synthetic oligonucleotide
ttggtgcttccagacaccaggggccat

SEQ ID NO: 55769 - DNA, 27 bp, Artificial Sequence
  Description of Artificial Sequence: Synthetic oligonucleotide
tggtgcttccagacaccaggggccatt

SEQ ID NO: 55770 - DNA, 26 bp, Artificial Sequence
  Description of Artificial Sequence: Synthetic oligonucleotide
ggtgcttccagacaccaggggccatt

SEQ ID NO: 55771 - DNA, 27 bp, Artificial Sequence
  Description of Artificial Sequence: Synthetic oligonucleotide
gtgcttccagacaccaggggccattgt

SEQ ID NO: 55772 - DNA, 27 bp, Artificial Sequence
  Description of Artificial Sequence: Synthetic oligonucleotide
tgcttccagacaccaggggccattgtg

SEQ ID NO: 55773 - DNA, 27 bp, Artificial Sequence
  Description of Artificial Sequence: Synthetic oligonucleotide
gcttccagacaccaggggccattgtga

SEQ ID NO: 55774 - DNA, 33 bp, Artificial Sequence
  Description of Artificial Sequence: Synthetic oligonucleotide
gccagtacacccatgaatttgatggagatgagc

SEQ ID NO: 55775 - DNA, 34 bp, Artificial Sequence
  Description of Artificial Sequence: Synthetic oligonucleotide
ccagtacacccatgaatttgatggagatgagcag

SEQ ID NO: 55776 - DNA, 36 bp, Artificial Sequence
  Description of Artificial Sequence: Synthetic oligonucleotide
cagtacacccatgaatttgatggagatgagcagttc

SEQ ID NO: 55777 - DNA, 38 bp, Artificial Sequence
  Description of Artificial Sequence: Synthetic oligonucleotide
agtacacccatgaatttgatggagatgagcagttctac

SEQ ID NO: 55778 - DNA, 37 bp, Artificial Sequence
  Description of Artificial Sequence: Synthetic oligonucleotide
gtacacccatgaatttgatggagatgagcagttctac

SEQ ID NO: 55779 - DNA, 37 bp, Artificial Sequence
  Description of Artificial Sequence: Synthetic oligonucleotide
tacacccatgaatttgatggagatgagcagttctacg

SEQ ID NO: 55780 - DNA, 36 bp, Artificial Sequence
  Description of Artificial Sequence: Synthetic oligonucleotide
acacccatgaatttgatggagatgagcagttctacg

SEQ ID NO: 55781 - DNA, 35 bp, Artificial Sequence
  Description of Artificial Sequence: Synthetic oligonucleotide
cacccatgaatttgatggagatgagcagttctacg

SEQ ID NO: 55782 - DNA, 36 bp, Artificial Sequence
  Description of Artificial Sequence: Synthetic oligonucleotide
acccatgaatttgatggagatgagcagttctacgtg

SEQ ID NO: 55783 - DNA, 35 bp, Artificial Sequence
  Description of Artificial Sequence: Synthetic oligonucleotide
cccatgaatttgatggagatgagcagttctacgtg

SEQ ID NO: 55784 - DNA, 35 bp, Artificial Sequence
  Description of Artificial Sequence: Synthetic oligonucleotide
ccatgaatttgatggagatgagcagttctacgtgg

SEQ ID NO: 55785 - DNA, 36 bp, Artificial Sequence
  Description of Artificial Sequence: Synthetic oligonucleotide
catgaatttgatggagatgagcagttctacgtggac

SEQ ID NO: 55786 - DNA, 36 bp, Artificial Sequence
  Description of Artificial Sequence: Synthetic oligonucleotide
atgaatttgatggagatgagcagttctacgtggacc

SEQ ID NO: 55787 - DNA, 35 bp, Artificial Sequence
  Description of Artificial Sequence: Synthetic oligonucleotide
tgaatttgatggagatgagcagttctacgtggacc

SEQ ID NO: 55788 - DNA, 34 bp, Artificial Sequence
  Description of Artificial Sequence: Synthetic oligonucleotide
gaatttgatggagatgagcagttctacgtggacc

SEQ ID NO: 55789 - DNA, 35 bp, Artificial Sequence
  Description of Artificial Sequence: Synthetic oligonucleotide
aatttgatggagatgagcagttctacgtggacctg

SEQ ID NO: 55790 - DNA, 34 bp, Artificial Sequence
  Description of Artificial Sequence: Synthetic oligonucleotide
atttgatggagatgagcagttctacgtggacctg

SEQ ID NO: 55791 - DNA, 33 bp, Artificial Sequence
  Description of Artificial Sequence: Synthetic oligonucleotide
tttgatggagatgagcagttctacgtggacctg

SEQ ID NO: 55792 - DNA, 32 bp, Artificial Sequence
  Description of Artificial Sequence: Synthetic oligonucleotide
ttgatggagatgagcagttctacgtggacctg

SEQ ID NO: 55793 - DNA, 31 bp, Artificial Sequence
  Description of Artificial Sequence: Synthetic oligonucleotide
tgatggagatgagcagttctacgtggacctg

SEQ ID NO: 55794 - DNA, 30 bp, Artificial Sequence
  Description of Artificial Sequence: Synthetic oligonucleotide
gatggagatgagcagttctacgtggacctg

SEQ ID NO: 55795 - DNA, 30 bp, Artificial Sequence
  Description of Artificial Sequence: Synthetic oligonucleotide
atggagatgagcagttctacgtggacctgg

SEQ ID NO: 55796 - DNA, 29 bp, Artificial Sequence
  Description of Artificial Sequence: Synthetic oligonucleotide
tggagatgagcagttctacgtggacctgg

SEQ ID NO: 55797 - DNA, 28 bp, Artificial Sequence
  Description of Artificial Sequence: Synthetic oligonucleotide
ggagatgagcagttctacgtggacctgg

SEQ ID NO: 55798 - DNA, 29 bp, Artificial Sequence
  Description of Artificial Sequence: Synthetic oligonucleotide
gagatgagcagttctacgtggacctggag

SEQ ID NO: 55799 - DNA, 30 bp, Artificial Sequence
  Description of Artificial Sequence: Synthetic oligonucleotide
agatgagcagttctacgtggacctggagag

SEQ ID NO: 55800 - DNA, 29 bp, Artificial Sequence
  Description of Artificial Sequence: Synthetic oligonucleotide
gatgagcagttctacgtggacctggagag

SEQ ID NO: 55801 - DNA, 29 bp, Artificial Sequence
  Description of Artificial Sequence: Synthetic oligonucleotide
atgagcagttctacgtggacctggagagg

SEQ ID NO: 55802 - DNA, 28 bp, Artificial Sequence
  Description of Artificial Sequence: Synthetic oligonucleotide
tgagcagttctacgtggacctggagagg

SEQ ID NO: 55803 - DNA, 27 bp, Artificial Sequence
  Description of Artificial Sequence: Synthetic oligonucleotide
gagcagttctacgtggacctggagagg

SEQ ID NO: 55804 - DNA, 29 bp, Artificial Sequence
  Description of Artificial Sequence: Synthetic oligonucleotide
agcagttctacgtggacctggagaggaag

SEQ ID NO: 55805 - DNA, 28 bp, Artificial Sequence
  Description of Artificial Sequence: Synthetic oligonucleotide
gcagttctacgtggacctggagaggaag

SEQ ID NO: 55806 - DNA, 28 bp, Artificial Sequence
  Description of Artificial Sequence: Synthetic oligonucleotide
cagttctacgtggacctggagaggaagg

SEQ ID NO: 55807 - DNA, 32 bp, Artificial Sequence
  Description of Artificial Sequence: Synthetic oligonucleotide
tatgtcagagctcacagagactgtggtctgtg

SEQ ID NO: 55808 - DNA, 31 bp, Artificial Sequence
  Description of Artificial Sequence: Synthetic oligonucleotide
atgtcagagctcacagagactgtggtctgtg

SEQ ID NO: 55809 - DNA, 30 bp, Artificial Sequence
  Description of Artificial Sequence: Synthetic oligonucleotide
tgtcagagctcacagagactgtggtctgtg

SEQ ID NO: 55810 - DNA, 29 bp, Artificial Sequence
  Description of Artificial Sequence: Synthetic oligonucleotide
gtcagagctcacagagactgtggtctgtg

SEQ ID NO: 55811 - DNA, 29 bp, Artificial Sequence
  Description of Artificial Sequence: Synthetic oligonucleotide
tcagagctcacagagactgtggtctgtgc

SEQ ID NO: 55812 - DNA, 28 bp, Artificial Sequence
  Description of Artificial Sequence: Synthetic oligonucleotide
cagagctcacagagactgtggtctgtgc

SEQ ID NO: 55813 - DNA, 28 bp, Artificial Sequence
  Description of Artificial Sequence: Synthetic oligonucleotide
agagctcacagagactgtggtctgtgcc

SEQ ID NO: 55814 - DNA, 27 bp, Artificial Sequence
  Description of Artificial Sequence: Synthetic oligonucleotide
gagctcacagagactgtggtctgtgcc

SEQ ID NO: 55815 - DNA, 27 bp, Artificial Sequence
  Description of Artificial Sequence: Synthetic oligonucleotide
agctcacagagactgtggtctgtgccc

SEQ ID NO: 55816 - DNA, 27 bp, Artificial Sequence
  Description of Artificial Sequence: Synthetic oligonucleotide
gctcacagagactgtggtctgtgccct

SEQ ID NO: 55817 - DNA, 27 bp, Artificial Sequence
  Description of Artificial Sequence: Synthetic oligonucleotide
ctcacagagactgtggtctgtgccctg

SEQ ID NO: 55818 - DNA, 27 bp, Artificial Sequence
  Description of Artificial Sequence: Synthetic oligonucleotide
tcacagagactgtggtctgtgccctgg

SEQ ID NO: 55819 - DNA, 26 bp, Artificial Sequence
  Description of Artificial Sequence: Synthetic oligonucleotide
cacagagactgtggtctgtgccctgg

SEQ ID NO: 55820 - DNA, 26 bp, Artificial Sequence
  Description of Artificial Sequence: Synthetic oligonucleotide
acagagactgtggtctgtgccctggg

SEQ ID NO: 55821 - DNA, 25 bp, Artificial Sequence
  Description of Artificial Sequence: Synthetic oligonucleotide
cagagactgtggtctgtgccctggg

SEQ ID NO: 55822 - DNA, 27 bp, Artificial Sequence
  Description of Artificial Sequence: Synthetic oligonucleotide
agagactgtggtctgtgccctggggtt

SEQ ID NO: 55823 - DNA, 26 bp, Artificial Sequence
  Description of Artificial Sequence: Synthetic oligonucleotide
gagactgtggtctgtgccctggggtt

SEQ ID NO: 55824 - DNA, 27 bp, Artificial Sequence
  Description of Artificial Sequence: Synthetic oligonucleotide
agactgtggtctgtgccctggggttgt

SEQ ID NO: 55825 - DNA, 26 bp, Artificial Sequence
  Description of Artificial Sequence: Synthetic oligonucleotide
gactgtggtctgtgccctggggttgt

SEQ ID NO: 55826 - DNA, 27 bp, Artificial Sequence
  Description of Artificial Sequence: Synthetic oligonucleotide
actgtggtctgtgccctggggttgtct

SEQ ID NO: 55827 - DNA, 26 bp, Artificial Sequence
  Description of Artificial Sequence: Synthetic oligonucleotide
ctgtggtctgtgccctggggttgtct

SEQ ID NO: 55828 - DNA, 27 bp, Artificial Sequence
  Description of Artificial Sequence: Synthetic oligonucleotide
tgtggtctgtgccctggggttgtctgt

SEQ ID NO: 55829 - DNA, 26 bp, Artificial Sequence
  Description of Artificial Sequence: Synthetic oligonucleotide
gtggtctgtgccctggggttgtctgt

SEQ ID NO: 55830 - DNA, 26 bp, Artificial Sequence
  Description of Artificial Sequence: Synthetic oligonucleotide
tggtctgtgccctggggttgtctgtg

SEQ ID NO: 55831 - DNA, 25 bp, Artificial Sequence
  Description of Artificial Sequence: Synthetic oligonucleotide
ggtctgtgccctggggttgtctgtg

SEQ ID NO: 55832 - DNA, 25 bp, Artificial Sequence
  Description of Artificial Sequence: Synthetic oligonucleotide
gtctgtgccctggggttgtctgtgg

SEQ ID NO: 55833 - DNA, 25 bp, Artificial Sequence
  Description of Artificial Sequence: Synthetic oligonucleotide
tctgtgccctggggttgtctgtggg

SEQ ID NO: 55834 - DNA, 24 bp, Artificial Sequence
  Description of Artificial Sequence: Synthetic oligonucleotide
ctgtgccctggggttgtctgtggg

SEQ ID NO: 55835 - DNA, 24 bp, Artificial Sequence
  Description of Artificial Sequence: Synthetic oligonucleotide
tgtgccctggggttgtctgtgggc

SEQ ID NO: 55836 - DNA, 23 bp, Artificial Sequence
  Description of Artificial Sequence: Synthetic oligonucleotide
gtgccctggggttgtctgtgggc

SEQ ID NO: 55837 - DNA, 24 bp, Artificial Sequence
  Description of Artificial Sequence: Synthetic oligonucleotide
tgccctggggttgtctgtgggcct

SEQ ID NO: 55838 - DNA, 25 bp, Artificial Sequence
  Description of Artificial Sequence: Synthetic oligonucleotide
ccctggggttgtctgtgggcctcat

SEQ ID NO: 55839 - DNA, 25 bp, Artificial Sequence
  Description of Artificial Sequence: Synthetic oligonucleotide
cctggggttgtctgtgggcctcatg

SEQ ID NO: 55840 - DNA, 25 bp, Artificial Sequence
  Description of Artificial Sequence: Synthetic oligonucleotide
ctggggttgtctgtgggcctcatgg

SEQ ID NO: 55841 - DNA, 25 bp, Artificial Sequence
  Description of Artificial Sequence: Synthetic oligonucleotide
tggggttgtctgtgggcctcatggg

SEQ ID NO: 55842 - DNA, 24 bp, Artificial Sequence
  Description of Artificial Sequence: Synthetic oligonucleotide
ggggttgtctgtgggcctcatggg

SEQ ID NO: 55843 - DNA, 27 bp, Artificial Sequence
  Description of Artificial Sequence: Synthetic oligonucleotide
gggttgtctgtgggcctcatgggcatt

SEQ ID NO: 55844 - DNA, 27 bp, Artificial Sequence
  Description of Artificial Sequence: Synthetic oligonucleotide
ggttgtctgtgggcctcatgggcattg

SEQ ID NO: 55845 - DNA, 28 bp, Artificial Sequence
  Description of Artificial Sequence: Synthetic oligonucleotide
gttgtctgtgggcctcatgggcattgtg

SEQ ID NO: 55846 - DNA, 28 bp, Artificial Sequence
  Description of Artificial Sequence: Synthetic oligonucleotide
ttgtctgtgggcctcatgggcattgtgg

SEQ ID NO: 55847 - DNA, 27 bp, Artificial Sequence
  Description of Artificial Sequence: Synthetic oligonucleotide
tgtctgtgggcctcatgggcattgtgg

SEQ ID NO: 55848 - DNA, 27 bp, Artificial Sequence
  Description of Artificial Sequence: Synthetic oligonucleotide
gtctgtgggcctcatgggcattgtggt

SEQ ID NO: 55849 - DNA, 27 bp, Artificial Sequence
  Description of Artificial Sequence: Synthetic oligonucleotide
tctgtgggcctcatgggcattgtggtg

SEQ ID NO: 55850 - DNA, 26 bp, Artificial Sequence
  Description of Artificial Sequence: Synthetic oligonucleotide
ctgtgggcctcatgggcattgtggtg

SEQ ID NO: 55851 - DNA, 26 bp, Artificial Sequence
  Description of Artificial Sequence: Synthetic oligonucleotide
tgtgggcctcatgggcattgtggtgg

SEQ ID NO: 55852 - DNA, 25 bp, Artificial Sequence
  Description of Artificial Sequence: Synthetic oligonucleotide
gtgggcctcatgggcattgtggtgg

SEQ ID NO: 55853 - DNA, 25 bp, Artificial Sequence
  Description of Artificial Sequence: Synthetic oligonucleotide
tgggcctcatgggcattgtggtggg

SEQ ID NO: 55854 - DNA, 24 bp, Artificial Sequence
  Description of Artificial Sequence: Synthetic oligonucleotide
gggcctcatgggcattgtggtggg

SEQ ID NO: 55855 - DNA, 25 bp, Artificial Sequence
  Description of Artificial Sequence: Synthetic oligonucleotide
ggcctcatgggcattgtggtgggca

SEQ ID NO: 55856 - DNA, 26 bp, Artificial Sequence
  Description of Artificial Sequence: Synthetic oligonucleotide
gcctcatgggcattgtggtgggcact

SEQ ID NO: 55857 - DNA, 27 bp, Artificial Sequence
  Description of Artificial Sequence: Synthetic oligonucleotide
cctcatgggcattgtggtgggcactgt

SEQ ID NO: 55858 - DNA, 27 bp, Artificial Sequence
  Description of Artificial Sequence: Synthetic oligonucleotide
ctcatgggcattgtggtgggcactgtc

SEQ ID NO: 55859 - DNA, 29 bp, Artificial Sequence
  Description of Artificial Sequence: Synthetic oligonucleotide
tcatgggcattgtggtgggcactgtcttc

SEQ ID NO: 55860 - DNA, 28 bp, Artificial Sequence
  Description of Artificial Sequence: Synthetic oligonucleotide
catgggcattgtggtgggcactgtcttc

SEQ ID NO: 55861 - DNA, 30 bp, Artificial Sequence
  Description of Artificial Sequence: Synthetic oligonucleotide
atgggcattgtggtgggcactgtcttcatc

SEQ ID NO: 55862 - DNA, 27 bp, Artificial Sequence
  Description of Artificial Sequence: Synthetic oligonucleotide
acactgggtcagcccaacaccctcatc

SEQ ID NO: 55863 - DNA, 27 bp, Artificial Sequence
  Description of Artificial Sequence: Synthetic oligonucleotide
cactgggtcagcccaacaccctcatct

SEQ ID NO: 55864 - DNA, 27 bp, Artificial Sequence
  Description of Artificial Sequence: Synthetic oligonucleotide
actgggtcagcccaacaccctcatctg

SEQ ID NO: 55865 - DNA, 27 bp, Artificial Sequence
  Description of Artificial Sequence: Synthetic oligonucleotide
ctgggtcagcccaacaccctcatctgt

SEQ ID NO: 55866 - DNA, 27 bp, Artificial Sequence
  Description of Artificial Sequence: Synthetic oligonucleotide
tgggtcagcccaacaccctcatctgtc

SEQ ID NO: 55867 - DNA, 27 bp, Artificial Sequence
  Description of Artificial Sequence: Synthetic oligonucleotide
gggtcagcccaacaccctcatctgtct

SEQ ID NO: 55868 - DNA, 28 bp, Artificial Sequence
  Description of Artificial Sequence: Synthetic oligonucleotide
ggtcagcccaacaccctcatctgtcttg

SEQ ID NO: 55869 - DNA, 29 bp, Artificial Sequence
  Description of Artificial Sequence: Synthetic oligonucleotide
gtcagcccaacaccctcatctgtcttgtg

SEQ ID NO: 55870 - DNA, 29 bp, Artificial Sequence
  Description of Artificial Sequence: Synthetic oligonucleotide
tcagcccaacaccctcatctgtcttgtgg

SEQ ID NO: 55871 - DNA, 28 bp, Artificial Sequence
  Description of Artificial Sequence: Synthetic oligonucleotide
cagcccaacaccctcatctgtcttgtgg

SEQ ID NO: 55872 - DNA, 29 bp, Artificial Sequence
  Description of Artificial Sequence: Synthetic oligonucleotide
agcccaacaccctcatctgtcttgtggac

SEQ ID NO: 55873 - DNA, 28 bp, Artificial Sequence
  Description of Artificial Sequence: Synthetic oligonucleotide
gcccaacaccctcatctgtcttgtggac

SEQ ID NO: 55874 - DNA, 30 bp, Artificial Sequence
  Description of Artificial Sequence: Synthetic oligonucleotide
cccaacaccctcatctgtcttgtggacaac

SEQ ID NO: 55875 - DNA, 32 bp, Artificial Sequence
  Description of Artificial Sequence: Synthetic oligonucleotide
ccaacaccctcatctgtcttgtggacaacatc

SEQ ID NO: 55876 - DNA, 35 bp, Artificial Sequence
  Description of Artificial Sequence: Synthetic oligonucleotide
caacaccctcatctgtcttgtggacaacatctttc

SEQ ID NO: 55877 - DNA, 35 bp, Artificial Sequence
  Description of Artificial Sequence: Synthetic oligonucleotide
aacaccctcatctgtcttgtggacaacatctttcc

SEQ ID NO: 55878 - DNA, 34 bp, Artificial Sequence
  Description of Artificial Sequence: Synthetic oligonucleotide
acaccctcatctgtcttgtggacaacatctttcc

SEQ ID NO: 55879 - DNA, 33 bp, Artificial Sequence
  Description of Artificial Sequence: Synthetic oligonucleotide
caccctcatctgtcttgtggacaacatctttcc

SEQ ID NO: 55880 - DNA, 34 bp, Artificial Sequence
  Description of Artificial Sequence: Synthetic oligonucleotide
accctcatctgtcttgtggacaacatctttcctc

SEQ ID NO: 55881 - DNA, 33 bp, Artificial Sequence
  Description of Artificial Sequence: Synthetic oligonucleotide
ccctcatctgtcttgtggacaacatctttcctc

SEQ ID NO: 55882 - DNA, 33 bp, Artificial Sequence
  Description of Artificial Sequence: Synthetic oligonucleotide
cctcatctgtcttgtggacaacatctttcctcc

SEQ ID NO: 55883 - DNA, 34 bp, Artificial Sequence
  Description of Artificial Sequence: Synthetic oligonucleotide
ctcatctgtcttgtggacaacatctttcctcctg

SEQ ID NO: 55884 - DNA, 35 bp, Artificial Sequence
  Description of Artificial Sequence: Synthetic oligonucleotide
tcatctgtcttgtggacaacatctttcctcctgtg

SEQ ID NO: 55885 - DNA, 34 bp, Artificial Sequence
  Description of Artificial Sequence: Synthetic oligonucleotide
catctgtcttgtggacaacatctttcctcctgtg

SEQ ID NO: 55886 - DNA, 34 bp, Artificial Sequence
  Description of Artificial Sequence: Synthetic oligonucleotide
atctgtcttgtggacaacatctttcctcctgtgg

SEQ ID NO: 55887 - DNA, 33 bp, Artificial Sequence
  Description of Artificial Sequence: Synthetic oligonucleotide
tctgtcttgtggacaacatctttcctcctgtgg

SEQ ID NO: 55888 - DNA, 32 bp, Artificial Sequence
  Description of Artificial Sequence: Synthetic oligonucleotide
ctgtcttgtggacaacatctttcctcctgtgg

SEQ ID NO: 55889 - DNA, 33 bp, Artificial Sequence
  Description of Artificial Sequence: Synthetic oligonucleotide
gacaacatctttcctcctgtggtcaacatcacc

SEQ ID NO: 55890 - DNA, 34 bp, Artificial Sequence
  Description of Artificial Sequence: Synthetic oligonucleotide
acaacatctttcctcctgtggtcaacatcacctg

SEQ ID NO: 55891 - DNA, 33 bp, Artificial Sequence
  Description of Artificial Sequence: Synthetic oligonucleotide
caacatctttcctcctgtggtcaacatcacctg

SEQ ID NO: 55892 - DNA, 33 bp, Artificial Sequence
  Description of Artificial Sequence: Synthetic oligonucleotide
aacatctttcctcctgtggtcaacatcacctgg

SEQ ID NO: 55893 - DNA, 32 bp, Artificial Sequence
  Description of Artificial Sequence: Synthetic oligonucleotide
acatctttcctcctgtggtcaacatcacctgg

SEQ ID NO: 55894 - DNA, 31 bp, Artificial Sequence
  Description of Artificial Sequence: Synthetic oligonucleotide
catctttcctcctgtggtcaacatcacctgg

SEQ ID NO: 55895 - DNA, 31 bp, Artificial Sequence
  Description of Artificial Sequence: Synthetic oligonucleotide
atctttcctcctgtggtcaacatcacctggc

SEQ ID NO: 55896 - DNA, 30 bp, Artificial Sequence
  Description of Artificial Sequence: Synthetic oligonucleotide
tctttcctcctgtggtcaacatcacctggc

SEQ ID NO: 55897 - DNA, 29 bp, Artificial Sequence
  Description of Artificial Sequence: Synthetic oligonucleotide
ctttcctcctgtggtcaacatcacctggc

SEQ ID NO: 55898 - DNA, 30 bp, Artificial Sequence
  Description of Artificial Sequence: Synthetic oligonucleotide
tttcctcctgtggtcaacatcacctggctg

SEQ ID NO: 55899 - DNA, 29 bp, Artificial Sequence
  Description of Artificial Sequence: Synthetic oligonucleotide
ttcctcctgtggtcaacatcacctggctg

SEQ ID NO: 55900 - DNA, 28 bp, Artificial Sequence
  Description of Artificial Sequence: Synthetic oligonucleotide
tcctcctgtggtcaacatcacctggctg

SEQ ID NO: 55901 - DNA, 27 bp, Artificial Sequence
  Description of Artificial Sequence: Synthetic oligonucleotide
cctcctgtggtcaacatcacctggctg

SEQ ID NO: 55902 - DNA, 28 bp, Artificial Sequence
  Description of Artificial Sequence: Synthetic oligonucleotide
ctcctgtggtcaacatcacctggctgag

SEQ ID NO: 55903 - DNA, 28 bp, Artificial Sequence
  Description of Artificial Sequence: Synthetic oligonucleotide
tcctgtggtcaacatcacctggctgagc

SEQ ID NO: 55904 - DNA, 27 bp, Artificial Sequence
  Description of Artificial Sequence: Synthetic oligonucleotide
cctgtggtcaacatcacctggctgagc

SEQ ID NO: 55905 - DNA, 30 bp, Artificial Sequence
  Description of Artificial Sequence: Synthetic oligonucleotide
ctgtggtcaacatcacctggctgagcaatg

SEQ ID NO: 55906 - DNA, 30 bp, Artificial Sequence
  Description of Artificial Sequence: Synthetic oligonucleotide
tgtggtcaacatcacctggctgagcaatgg

SEQ ID NO: 55907 - DNA, 29 bp, Artificial Sequence
  Description of Artificial Sequence: Synthetic oligonucleotide
gtggtcaacatcacctggctgagcaatgg

SEQ ID NO: 55908 - DNA, 29 bp, Artificial Sequence
  Description of Artificial Sequence: Synthetic oligonucleotide
tggtcaacatcacctggctgagcaatggg

SEQ ID NO: 55909 - DNA, 28 bp, Artificial Sequence
  Description of Artificial Sequence: Synthetic oligonucleotide
ggtcaacatcacctggctgagcaatggg

SEQ ID NO: 55910 - DNA, 28 bp, Artificial Sequence
  Description of Artificial Sequence: Synthetic oligonucleotide
gtcaacatcacctggctgagcaatgggc

SEQ ID NO: 55911 - DNA, 29 bp, Artificial Sequence
  Description of Artificial Sequence: Synthetic oligonucleotide
tcaacatcacctggctgagcaatgggcag

SEQ ID NO: 55912 - DNA, 28 bp, Artificial Sequence
  Description of Artificial Sequence: Synthetic oligonucleotide
caacatcacctggctgagcaatgggcag

SEQ ID NO: 55913 - DNA, 29 bp, Artificial Sequence
  Description of Artificial Sequence: Synthetic oligonucleotide
aacatcacctggctgagcaatgggcagtc

SEQ ID NO: 55914 - DNA, 28 bp, Artificial Sequence
  Description of Artificial Sequence: Synthetic oligonucleotide
acatcacctggctgagcaatgggcagtc

SEQ ID NO: 55915 - DNA, 27 bp, Artificial Sequence
  Description of Artificial Sequence: Synthetic oligonucleotide
catcacctggctgagcaatgggcagtc

SEQ ID NO: 55916 - DNA, 28 bp, Artificial Sequence
  Description of Artificial Sequence: Synthetic oligonucleotide
atcacctggctgagcaatgggcagtcag

SEQ ID NO: 55917 - DNA, 27 bp, Artificial Sequence
  Description of Artificial Sequence: Synthetic oligonucleotide
tcacctggctgagcaatgggcagtcag

SEQ ID NO: 55918 - DNA, 27 bp, Artificial Sequence
  Description of Artificial Sequence: Synthetic oligonucleotide
cacctggctgagcaatgggcagtcagt

SEQ ID NO: 55919 - DNA, 27 bp, Artificial Sequence
  Description of Artificial Sequence: Synthetic oligonucleotide
acctggctgagcaatgggcagtcagtc

SEQ ID NO: 55920 - DNA, 27 bp, Artificial Sequence
  Description of Artificial Sequence: Synthetic oligonucleotide
cctggctgagcaatgggcagtcagtca

SEQ ID NO: 55921 - DNA, 27 bp, Artificial Sequence
  Description of Artificial Sequence: Synthetic oligonucleotide
ctggctgagcaatgggcagtcagtcac

SEQ ID NO: 55922 - DNA, 23 bp, Artificial Sequence
  Description of Artificial Sequence: Synthetic oligonucleotide
tgggggccctcgctctgaccact

SEQ ID NO: 55923 - DNA, 22 bp, Artificial Sequence
  Description of Artificial Sequence: Synthetic oligonucleotide
gggggccctcgctctgaccact

SEQ ID NO: 55924 - DNA, 23 bp, Artificial Sequence
  Description of Artificial Sequence: Synthetic oligonucleotide
ggggccctcgctctgaccactgt

SEQ ID NO: 55925 - DNA, 25 bp, Artificial Sequence
  Description of Artificial Sequence: Synthetic oligonucleotide
gggccctcgctctgaccactgtgat

SEQ ID NO: 55926 - DNA, 26 bp, Artificial Sequence
  Description of Artificial Sequence: Synthetic oligonucleotide
ggccctcgctctgaccactgtgatga

SEQ ID NO: 55927 - DNA, 26 bp, Artificial Sequence
  Description of Artificial Sequence: Synthetic oligonucleotide
gccctcgctctgaccactgtgatgag

SEQ ID NO: 55928 - DNA, 26 bp, Artificial Sequence
  Description of Artificial Sequence: Synthetic oligonucleotide
ccctcgctctgaccactgtgatgagc

SEQ ID NO: 55929 - DNA, 26 bp, Artificial Sequence
  Description of Artificial Sequence: Synthetic oligonucleotide
cctcgctctgaccactgtgatgagcc

SEQ ID NO: 55930 - DNA, 26 bp, Artificial Sequence
  Description of Artificial Sequence: Synthetic oligonucleotide
ctcgctctgaccactgtgatgagccc

SEQ ID NO: 55931 - DNA, 27 bp, Artificial Sequence
  Description of Artificial Sequence: Synthetic oligonucleotide
tcgctctgaccactgtgatgagcccct

SEQ ID NO: 55932 - DNA, 26 bp, Artificial Sequence
  Description of Artificial Sequence: Synthetic oligonucleotide
cgctctgaccactgtgatgagcccct

SEQ ID NO: 55933 - DNA, 27 bp, Artificial Sequence
  Description of Artificial Sequence: Synthetic oligonucleotide
gctctgaccactgtgatgagcccctgt

SEQ ID NO: 55934 - DNA, 27 bp, Artificial Sequence
  Description of Artificial Sequence: Synthetic oligonucleotide
ctctgaccactgtgatgagcccctgtg

SEQ ID NO: 55935 - DNA, 27 bp, Artificial Sequence
  Description of Artificial Sequence: Synthetic oligonucleotide
tctgaccactgtgatgagcccctgtgg

SEQ ID NO: 55936 - DNA, 27 bp, Artificial Sequence
  Description of Artificial Sequence: Synthetic oligonucleotide
ctgaccactgtgatgagcccctgtgga

SEQ ID NO: 55937 - DNA, 27 bp, Artificial Sequence
  Description of Artificial Sequence: Synthetic oligonucleotide
tgaccactgtgatgagcccctgtggag

SEQ ID NO: 55938 - DNA, 26 bp, Artificial Sequence
  Description of Artificial Sequence: Synthetic oligonucleotide
gaccactgtgatgagcccctgtggag

SEQ ID NO: 55939 - DNA, 27 bp, Artificial Sequence
  Description of Artificial Sequence: Synthetic oligonucleotide
accactgtgatgagcccctgtggaggt

SEQ ID NO: 55940 - DNA, 26 bp, Artificial Sequence
  Description of Artificial Sequence: Synthetic oligonucleotide
ccactgtgatgagcccctgtggaggt

SEQ ID NO: 55941 - DNA, 27 bp, Artificial Sequence
  Description of Artificial Sequence: Synthetic oligonucleotide
cactgtgatgagcccctgtggaggtga

SEQ ID NO: 55942 - DNA, 28 bp, Artificial Sequence
  Description of Artificial Sequence: Synthetic oligonucleotide
actgtgatgagcccctgtggaggtgaag

SEQ ID NO: 55943 - DNA, 27 bp, Artificial Sequence
  Description of Artificial Sequence: Synthetic oligonucleotide
ctgtgatgagcccctgtggaggtgaag

SEQ ID NO: 55944 - DNA, 28 bp, Artificial Sequence
  Description of Artificial Sequence: Synthetic oligonucleotide
tgtgatgagcccctgtggaggtgaagac

SEQ ID NO: 55945 - DNA, 31 bp, Artificial Sequence
  Description of Artificial Sequence: Synthetic oligonucleotide
tgtggaggtgaagacattgtggctgaccatg

SEQ ID NO: 55946 - DNA, 30 bp, Artificial Sequence
  Description of Artificial Sequence: Synthetic oligonucleotide
gtggaggtgaagacattgtggctgaccatg

SEQ ID NO: 55947 - DNA, 32 bp, Artificial Sequence
  Description of Artificial Sequence: Synthetic oligonucleotide
tggaggtgaagacattgtggctgaccatgttg

SEQ ID NO: 55948 - DNA, 31 bp, Artificial Sequence
  Description of Artificial Sequence: Synthetic oligonucleotide
ggaggtgaagacattgtggctgaccatgttg

SEQ ID NO: 55949 - DNA, 31 bp, Artificial Sequence
  Description of Artificial Sequence: Synthetic oligonucleotide
gaggtgaagacattgtggctgaccatgttgc

SEQ ID NO: 55950 - DNA, 31 bp, Artificial Sequence
  Description of Artificial Sequence: Synthetic oligonucleotide
aggtgaagacattgtggctgaccatgttgcc

SEQ ID NO: 55951 - DNA, 30 bp, Artificial Sequence
  Description of Artificial Sequence: Synthetic oligonucleotide
ggtgaagacattgtggctgaccatgttgcc

SEQ ID NO: 55952 - DNA, 31 bp, Artificial Sequence
  Description of Artificial Sequence: Synthetic oligonucleotide
gtgaagacattgtggctgaccatgttgcctc

SEQ ID NO: 55953 - DNA, 33 bp, Artificial Sequence
  Description of Artificial Sequence: Synthetic oligonucleotide
tgaagacattgtggctgaccatgttgcctcttg

SEQ ID NO: 55954 - DNA, 32 bp, Artificial Sequence
  Description of Artificial Sequence: Synthetic oligonucleotide
gaagacattgtggctgaccatgttgcctcttg

SEQ ID NO: 55955 - DNA, 33 bp, Artificial Sequence
  Description of Artificial Sequence: Synthetic oligonucleotide
aagacattgtggctgaccatgttgcctcttgtg

SEQ ID NO: 55956 - DNA, 32 bp, Artificial Sequence
  Description of Artificial Sequence: Synthetic oligonucleotide
agacattgtggctgaccatgttgcctcttgtg

SEQ ID NO: 55957 - DNA, 31 bp, Artificial Sequence
  Description of Artificial Sequence: Synthetic oligonucleotide
gacattgtggctgaccatgttgcctcttgtg

SEQ ID NO: 55958 - DNA, 31 bp, Artificial Sequence
  Description of Artificial Sequence: Synthetic oligonucleotide
acattgtggctgaccatgttgcctcttgtgg

SEQ ID NO: 55959 - DNA, 30 bp, Artificial Sequence
  Description of Artificial Sequence: Synthetic oligonucleotide
cattgtggctgaccatgttgcctcttgtgg

SEQ ID NO: 55960 - DNA, 31 bp, Artificial Sequence
  Description of Artificial Sequence: Synthetic oligonucleotide
attgtggctgaccatgttgcctcttgtggtg

SEQ ID NO: 55961 - DNA, 30 bp, Artificial Sequence
  Description of Artificial Sequence: Synthetic oligonucleotide
ttgtggctgaccatgttgcctcttgtggtg

SEQ ID NO: 55962 - DNA, 29 bp, Artificial Sequence
  Description of Artificial Sequence: Synthetic oligonucleotide
tgtggctgaccatgttgcctcttgtggtg

SEQ ID NO: 55963 - DNA, 28 bp, Artificial Sequence
  Description of Artificial Sequence: Synthetic oligonucleotide
gtggctgaccatgttgcctcttgtggtg

SEQ ID NO: 55964 - DNA, 32 bp, Artificial Sequence
  Description of Artificial Sequence: Synthetic oligonucleotide
tggctgaccatgttgcctcttgtggtgtaaac

SEQ ID NO: 55965 - DNA, 31 bp, Artificial Sequence
  Description of Artificial Sequence: Synthetic oligonucleotide
ggctgaccatgttgcctcttgtggtgtaaac

SEQ ID NO: 55966 - DNA, 33 bp, Artificial Sequence
  Description of Artificial Sequence: Synthetic oligonucleotide
gctgaccatgttgcctcttgtggtgtaaacttg

SEQ ID NO: 55967 - DNA, 35 bp, Artificial Sequence
  Description of Artificial Sequence: Synthetic oligonucleotide
ctgaccatgttgcctcttgtggtgtaaacttgtac

SEQ ID NO: 55968 - DNA, 35 bp, Artificial Sequence
  Description of Artificial Sequence: Synthetic oligonucleotide
tgaccatgttgcctcttgtggtgtaaacttgtacc

SEQ ID NO: 55969 - DNA, 34 bp, Artificial Sequence
  Description of Artificial Sequence: Synthetic oligonucleotide
gaccatgttgcctcttgtggtgtaaacttgtacc

SEQ ID NO: 55970 - DNA, 35 bp, Artificial Sequence
  Description of Artificial Sequence: Synthetic oligonucleotide
accatgttgcctcttgtggtgtaaacttgtaccag

SEQ ID NO: 55971 - DNA, 34 bp, Artificial Sequence
  Description of Artificial Sequence: Synthetic oligonucleotide
ccatgttgcctcttgtggtgtaaacttgtaccag

SEQ ID NO: 55972 - DNA, 39 bp, Artificial Sequence
  Description of Artificial Sequence: Synthetic oligonucleotide
catgttgcctcttgtggtgtaaacttgtaccagttttac

SEQ ID NO: 55973 - DNA, 39 bp, Artificial Sequence
  Description of Artificial Sequence: Synthetic oligonucleotide
atgttgcctcttgtggtgtaaacttgtaccagttttacg

SEQ ID NO: 55974 - DNA, 38 bp, Artificial Sequence
  Description of Artificial Sequence: Synthetic oligonucleotide
tgttgcctcttgtggtgtaaacttgtaccagttttacg

SEQ ID NO: 55975 - DNA, 30 bp, Artificial Sequence
  Description of Artificial Sequence: Synthetic oligonucleotide
taccagttttacggtccctctggccagttc

SEQ ID NO: 55976 - DNA, 29 bp, Artificial Sequence
  Description of Artificial Sequence: Synthetic oligonucleotide
accagttttacggtccctctggccagttc

SEQ ID NO: 55977 - DNA, 28 bp, Artificial Sequence
  Description of Artificial Sequence: Synthetic oligonucleotide
ccagttttacggtccctctggccagttc

SEQ ID NO: 55978 - DNA, 29 bp, Artificial Sequence
  Description of Artificial Sequence: Synthetic oligonucleotide
cagttttacggtccctctggccagttcac

SEQ ID NO: 55979 - DNA, 29 bp, Artificial Sequence
  Description of Artificial Sequence: Synthetic oligonucleotide
agttttacggtccctctggccagttcacc

SEQ ID NO: 55980 - DNA, 28 bp, Artificial Sequence
  Description of Artificial Sequence: Synthetic oligonucleotide
gttttacggtccctctggccagttcacc

SEQ ID NO: 55981 - DNA, 28 bp, Artificial Sequence
  Description of Artificial Sequence: Synthetic oligonucleotide
ttttacggtccctctggccagttcaccc

SEQ ID NO: 55982 - DNA, 27 bp, Artificial Sequence
  Description of Artificial Sequence: Synthetic oligonucleotide
tttacggtccctctggccagttcaccc

SEQ ID NO: 55983 - DNA, 27 bp, Artificial Sequence
  Description of Artificial Sequence: Synthetic oligonucleotide
ttacggtccctctggccagttcaccca

SEQ ID NO: 55984 - DNA, 27 bp, Artificial Sequence
  Description of Artificial Sequence: Synthetic oligonucleotide
tacggtccctctggccagttcacccat

SEQ ID NO: 55985 - DNA, 26 bp, Artificial Sequence
  Description of Artificial Sequence: Synthetic oligonucleotide
acggtccctctggccagttcacccat

SEQ ID NO: 55986 - DNA, 25 bp, Artificial Sequence
  Description of Artificial Sequence: Synthetic oligonucleotide
cggtccctctggccagttcacccat

SEQ ID NO: 55987 - DNA, 27 bp, Artificial Sequence
  Description of Artificial Sequence: Synthetic oligonucleotide
ggtccctctggccagttcacccatgaa

SEQ ID NO: 55988 - DNA, 30 bp, Artificial Sequence
  Description of Artificial Sequence: Synthetic oligonucleotide
gtccctctggccagttcacccatgaatttg

SEQ ID NO: 55989 - DNA, 32 bp, Artificial Sequence
  Description of Artificial Sequence: Synthetic oligonucleotide
tccctctggccagttcacccatgaatttgatg

SEQ ID NO: 55990 - DNA, 31 bp, Artificial Sequence
  Description of Artificial Sequence: Synthetic oligonucleotide
ccctctggccagttcacccatgaatttgatg

SEQ ID NO: 55991 - DNA, 31 bp, Artificial Sequence
  Description of Artificial Sequence: Synthetic oligonucleotide
cctctggccagttcacccatgaatttgatgg

SEQ ID NO: 55992 - DNA, 32 bp, Artificial Sequence
  Description of Artificial Sequence: Synthetic oligonucleotide
ctctggccagttcacccatgaatttgatggag

SEQ ID NO: 55993 - DNA, 34 bp, Artificial Sequence
  Description of Artificial Sequence: Synthetic oligonucleotide
tctggccagttcacccatgaatttgatggagatg

SEQ ID NO: 55994 - DNA, 33 bp, Artificial Sequence
  Description of Artificial Sequence: Synthetic oligonucleotide
ctggccagttcacccatgaatttgatggagatg

SEQ ID NO: 55995 - DNA, 34 bp, Artificial Sequence
  Description of Artificial Sequence: Synthetic oligonucleotide
tggccagttcacccatgaatttgatggagatgag

SEQ ID NO: 55996 - DNA, 33 bp, Artificial Sequence
  Description of Artificial Sequence: Synthetic oligonucleotide
ggccagttcacccatgaatttgatggagatgag

SEQ ID NO: 55997 - DNA, 33 bp, Artificial Sequence
  Description of Artificial Sequence: Synthetic oligonucleotide
gccagttcacccatgaatttgatggagatgagc

SEQ ID NO: 55998 - DNA, 34 bp, Artificial Sequence
  Description of Artificial Sequence: Synthetic oligonucleotide
ccagttcacccatgaatttgatggagatgagcag

SEQ ID NO: 55999 - DNA, 36 bp, Artificial Sequence
  Description of Artificial Sequence: Synthetic oligonucleotide
cagttcacccatgaatttgatggagatgagcagttc

SEQ ID NO: 56000 - DNA, 38 bp, Artificial Sequence
  Description of Artificial Sequence: Synthetic oligonucleotide
agttcacccatgaatttgatggagatgagcagttctac

SEQ ID NO: 56001 - DNA, 37 bp, Artificial Sequence
  Description of Artificial Sequence: Synthetic oligonucleotide
gttcacccatgaatttgatggagatgagcagttctac

SEQ ID NO: 56002 - DNA, 37 bp, Artificial Sequence
  Description of Artificial Sequence: Synthetic oligonucleotide
ttcacccatgaatttgatggagatgagcagttctacg

SEQ ID NO: 56003 - DNA, 36 bp, Artificial Sequence
  Description of Artificial Sequence: Synthetic oligonucleotide
tcacccatgaatttgatggagatgagcagttctacg

SEQ ID NO: 56004 - DNA, 31 bp, Artificial Sequence
  Description of Artificial Sequence: Synthetic oligonucleotide
agatgagcagttctacgtggacctggagaag

SEQ ID NO: 56005 - DNA, 30 bp, Artificial Sequence
  Description of Artificial Sequence: Synthetic oligonucleotide
gatgagcagttctacgtggacctggagaag

SEQ ID NO: 56006 - DNA, 32 bp, Artificial Sequence
  Description of Artificial Sequence: Synthetic oligonucleotide
atgagcagttctacgtggacctggagaagaag

SEQ ID NO: 56007 - DNA, 31 bp, Artificial Sequence
  Description of Artificial Sequence: Synthetic oligonucleotide
tgagcagttctacgtggacctggagaagaag

SEQ ID NO: 56008 - DNA, 30 bp, Artificial Sequence
  Description of Artificial Sequence: Synthetic oligonucleotide
gagcagttctacgtggacctggagaagaag

SEQ ID NO: 56009 - DNA, 30 bp, Artificial Sequence
  Description of Artificial Sequence: Synthetic oligonucleotide
agcagttctacgtggacctggagaagaagg

SEQ ID NO: 56010 - DNA, 29 bp, Artificial Sequence
  Description of Artificial Sequence: Synthetic oligonucleotide
gcagttctacgtggacctggagaagaagg

SEQ ID NO: 56011 - DNA, 30 bp, Artificial Sequence
  Description of Artificial Sequence: Synthetic oligonucleotide
cagttctacgtggacctggagaagaaggag

SEQ ID NO: 56012 - DNA, 31 bp, Artificial Sequence
  Description of Artificial Sequence: Synthetic oligonucleotide
agttctacgtggacctggagaagaaggagac

SEQ ID NO: 56013 - DNA, 30 bp, Artificial Sequence
  Description of Artificial Sequence: Synthetic oligonucleotide
gttctacgtggacctggagaagaaggagac

SEQ ID NO: 56014 - DNA, 31 bp, Artificial Sequence
  Description of Artificial Sequence: Synthetic oligonucleotide
ttctacgtggacctggagaagaaggagactg

SEQ ID NO: 56015 - DNA, 30 bp, Artificial Sequence
  Description of Artificial Sequence: Synthetic oligonucleotide
tctacgtggacctggagaagaaggagactg

SEQ ID NO: 56016 - DNA, 29 bp, Artificial Sequence
  Description of Artificial Sequence: Synthetic oligonucleotide
ctacgtggacctggagaagaaggagactg

SEQ ID NO: 56017 - DNA, 29 bp, Artificial Sequence
  Description of Artificial Sequence: Synthetic oligonucleotide
tacgtggacctggagaagaaggagactgc

SEQ ID NO: 56018 - DNA, 28 bp, Artificial Sequence
  Description of Artificial Sequence: Synthetic oligonucleotide
acgtggacctggagaagaaggagactgc

SEQ ID NO: 56019 - DNA, 27 bp, Artificial Sequence
  Description of Artificial Sequence: Synthetic oligonucleotide
cgtggacctggagaagaaggagactgc

SEQ ID NO: 56020 - DNA, 27 bp, Artificial Sequence
  Description of Artificial Sequence: Synthetic oligonucleotide
gtggacctggagaagaaggagactgcc

SEQ ID NO: 56021 - DNA, 28 bp, Artificial Sequence
  Description of Artificial Sequence: Synthetic oligonucleotide
tggacctggagaagaaggagactgcctg

SEQ ID NO: 56022 - DNA, 27 bp, Artificial Sequence
  Description of Artificial Sequence: Synthetic oligonucleotide
ggacctggagaagaaggagactgcctg

SEQ ID NO: 56023 - DNA, 27 bp, Artificial Sequence
  Description of Artificial Sequence: Synthetic oligonucleotide
gacctggagaagaaggagactgcctgg

SEQ ID NO: 56024 - DNA, 27 bp, Artificial Sequence
  Description of Artificial Sequence: Synthetic oligonucleotide
acctggagaagaaggagactgcctggc

SEQ ID NO: 56025 - DNA, 26 bp, Artificial Sequence
  Description of Artificial Sequence: Synthetic oligonucleotide
cctggagaagaaggagactgcctggc

SEQ ID NO: 56026 - DNA, 26 bp, Artificial Sequence
  Description of Artificial Sequence: Synthetic oligonucleotide
ctggagaagaaggagactgcctggcg

SEQ ID NO: 56027 - DNA, 27 bp, Artificial Sequence
  Description of Artificial Sequence: Synthetic oligonucleotide
tggagaagaaggagactgcctggcggt

SEQ ID NO: 56028 - DNA, 26 bp, Artificial Sequence
  Description of Artificial Sequence: Synthetic oligonucleotide
ggagaagaaggagactgcctggcggt

SEQ ID NO: 56029 - DNA, 26 bp, Artificial Sequence
  Description of Artificial Sequence: Synthetic oligonucleotide
gagaagaaggagactgcctggcggtg

SEQ ID NO: 56030 - DNA, 26 bp, Artificial Sequence
  Description of Artificial Sequence: Synthetic oligonucleotide
agaagaaggagactgcctggcggtgg

SEQ ID NO: 56031 - DNA, 25 bp, Artificial Sequence
  Description of Artificial Sequence: Synthetic oligonucleotide
gaagaaggagactgcctggcggtgg

SEQ ID NO: 56032 - DNA, 25 bp, Artificial Sequence
  Description of Artificial Sequence: Synthetic oligonucleotide
aagaaggagactgcctggcggtggc

SEQ ID NO: 56033 - DNA, 24 bp, Artificial Sequence
  Description of Artificial Sequence: Synthetic oligonucleotide
agaaggagactgcctggcggtggc

SEQ ID NO: 56034 - DNA, 30 bp, Artificial Sequence
  Description of Artificial Sequence: Synthetic oligonucleotide
gtcaacatcacatggctgagcaatgggcac

SEQ ID NO: 56035 - DNA, 30 bp, Artificial Sequence
  Description of Artificial Sequence: Synthetic oligonucleotide
tcaacatcacatggctgagcaatgggcacg

SEQ ID NO: 56036 - DNA, 29 bp, Artificial Sequence
  Description of Artificial Sequence: Synthetic oligonucleotide
caacatcacatggctgagcaatgggcacg

SEQ ID NO: 56037 - DNA, 29 bp, Artificial Sequence
  Description of Artificial Sequence: Synthetic oligonucleotide
aacatcacatggctgagcaatgggcacgc

SEQ ID NO: 56038 - DNA, 28 bp, Artificial Sequence
  Description of Artificial Sequence: Synthetic oligonucleotide
acatcacatggctgagcaatgggcacgc

SEQ ID NO: 56039 - DNA, 27 bp, Artificial Sequence
  Description of Artificial Sequence: Synthetic oligonucleotide
catcacatggctgagcaatgggcacgc

SEQ ID NO: 56040 - DNA, 28 bp, Artificial Sequence
  Description of Artificial Sequence: Synthetic oligonucleotide
atcacatggctgagcaatgggcacgcag

SEQ ID NO: 56041 - DNA, 27 bp, Artificial Sequence
  Description of Artificial Sequence: Synthetic oligonucleotide
tcacatggctgagcaatgggcacgcag

SEQ ID NO: 56042 - DNA, 27 bp, Artificial Sequence
  Description of Artificial Sequence: Synthetic oligonucleotide
cacatggctgagcaatgggcacgcagt

SEQ ID NO: 56043 - DNA, 27 bp, Artificial Sequence
  Description of Artificial Sequence: Synthetic oligonucleotide
acatggctgagcaatgggcacgcagtc

SEQ ID NO: 56044 - DNA, 27 bp, Artificial Sequence
  Description of Artificial Sequence: Synthetic oligonucleotide
catggctgagcaatgggcacgcagtca

SEQ ID NO: 56045 - DNA, 27 bp, Artificial Sequence
  Description of Artificial Sequence: Synthetic oligonucleotide
atggctgagcaatgggcacgcagtcac

SEQ ID NO: 56046 - DNA, 27 bp, Artificial Sequence
  Description of Artificial Sequence: Synthetic oligonucleotide
tggctgagcaatgggcacgcagtcaca

SEQ ID NO: 56047 - DNA, 26 bp, Artificial Sequence
  Description of Artificial Sequence: Synthetic oligonucleotide
ggctgagcaatgggcacgcagtcaca

SEQ ID NO: 56048 - DNA, 27 bp, Artificial Sequence
  Description of Artificial Sequence: Synthetic oligonucleotide
gctgagcaatgggcacgcagtcacaga

SEQ ID NO: 56049 - DNA, 28 bp, Artificial Sequence
  Description of Artificial Sequence: Synthetic oligonucleotide
ctgagcaatgggcacgcagtcacagaag

SEQ ID NO: 56050 - DNA, 28 bp, Artificial Sequence
  Description of Artificial Sequence: Synthetic oligonucleotide
tgagcaatgggcacgcagtcacagaagg

SEQ ID NO: 56051 - DNA, 27 bp, Artificial Sequence
  Description of Artificial Sequence: Synthetic oligonucleotide
gagcaatgggcacgcagtcacagaagg

SEQ ID NO: 56052 - DNA, 28 bp, Artificial Sequence
  Description of Artificial Sequence: Synthetic oligonucleotide
agcaatgggcacgcagtcacagaaggtg

SEQ ID NO: 56053 - DNA, 27 bp, Artificial Sequence
  Description of Artificial Sequence: Synthetic oligonucleotide
gcaatgggcacgcagtcacagaaggtg

SEQ ID NO: 56054 - DNA, 30 bp, Artificial Sequence
  Description of Artificial Sequence: Synthetic oligonucleotide
caatgggcacgcagtcacagaaggtgtttc

SEQ ID NO: 56055 - DNA, 31 bp, Artificial Sequence
  Description of Artificial Sequence: Synthetic oligonucleotide
aatgggcacgcagtcacagaaggtgtttctg

SEQ ID NO: 56056 - DNA, 30 bp, Artificial Sequence
  Description of Artificial Sequence: Synthetic oligonucleotide
atgggcacgcagtcacagaaggtgtttctg

SEQ ID NO: 56057 - DNA, 29 bp, Artificial Sequence
  Description of Artificial Sequence: Synthetic oligonucleotide
tgggcacgcagtcacagaaggtgtttctg

SEQ ID NO: 56058 - DNA, 28 bp, Artificial Sequence
  Description of Artificial Sequence: Synthetic oligonucleotide
gggcacgcagtcacagaaggtgtttctg

SEQ ID NO: 56059 - DNA, 29 bp, Artificial Sequence
  Description of Artificial Sequence: Synthetic oligonucleotide
ggcacgcagtcacagaaggtgtttctgag

SEQ ID NO: 56060 - DNA, 30 bp, Artificial Sequence
  Description of Artificial Sequence: Synthetic oligonucleotide
gcacgcagtcacagaaggtgtttctgagac

SEQ ID NO: 56061 - DNA, 30 bp, Artificial Sequence
  Description of Artificial Sequence: Synthetic oligonucleotide
cacgcagtcacagaaggtgtttctgagacc

SEQ ID NO: 56062 - DNA, 31 bp, Artificial Sequence
  Description of Artificial Sequence: Synthetic oligonucleotide
acgcagtcacagaaggtgtttctgagaccag

SEQ ID NO: 56063 - DNA, 30 bp, Artificial Sequence
  Description of Artificial Sequence: Synthetic oligonucleotide
cgcagtcacagaaggtgtttctgagaccag

SEQ ID NO: 56064 - DNA, 30 bp, Artificial Sequence
  Description of Artificial Sequence: Synthetic oligonucleotide
gcagtcacagaaggtgtttctgagaccagc

SEQ ID NO: 56065 - DNA, 26 bp, Artificial Sequence
  Description of Artificial Sequence: Synthetic oligonucleotide
gttggtgcttccagacaccaagggcc

SEQ ID NO: 56066 - DNA, 27 bp, Artificial Sequence
  Description of Artificial Sequence: Synthetic oligonucleotide
ttggtgcttccagacaccaagggccct

SEQ ID NO: 56067 - DNA, 27 bp, Artificial Sequence
  Description of Artificial Sequence: Synthetic oligonucleotide
tggtgcttccagacaccaagggccctt

SEQ ID NO: 56068 - DNA, 26 bp, Artificial Sequence
  Description of Artificial Sequence: Synthetic oligonucleotide
ggtgcttccagacaccaagggccctt

SEQ ID NO: 56069 - DNA, 27 bp, Artificial Sequence
  Description of Artificial Sequence: Synthetic oligonucleotide
gtgcttccagacaccaagggcccttgt

SEQ ID NO: 56070 - DNA, 27 bp, Artificial Sequence
  Description of Artificial Sequence: Synthetic oligonucleotide
tgcttccagacaccaagggcccttgtg

SEQ ID NO: 56071 - DNA, 27 bp, Artificial Sequence
  Description of Artificial Sequence: Synthetic oligonucleotide
gcttccagacaccaagggcccttgtga

SEQ ID NO: 56072 - DNA, 23 bp, Artificial Sequence
  Description of Artificial Sequence: Synthetic oligonucleotide
ggggccctcgctctgaccaccat

SEQ ID NO: 56073 - DNA, 25 bp, Artificial Sequence
  Description of Artificial Sequence: Synthetic oligonucleotide
gggccctcgctctgaccaccatgat

SEQ ID NO: 56074 - DNA, 26 bp, Artificial Sequence
  Description of Artificial Sequence: Synthetic oligonucleotide
ggccctcgctctgaccaccatgatga

SEQ ID NO: 56075 - DNA, 26 bp, Artificial Sequence
  Description of Artificial Sequence: Synthetic oligonucleotide
gccctcgctctgaccaccatgatgag

SEQ ID NO: 56076 - DNA, 26 bp, Artificial Sequence
  Description of Artificial Sequence: Synthetic oligonucleotide
ccctcgctctgaccaccatgatgagc

SEQ ID NO: 56077 - DNA, 26 bp, Artificial Sequence
  Description of Artificial Sequence: Synthetic oligonucleotide
cctcgctctgaccaccatgatgagcc

SEQ ID NO: 56078 - DNA, 27 bp, Artificial Sequence
  Description of Artificial Sequence: Synthetic oligonucleotide
ctcgctctgaccaccatgatgagccct

SEQ ID NO: 56079 - DNA, 28 bp, Artificial Sequence
  Description of Artificial Sequence: Synthetic oligonucleotide
tcgctctgaccaccatgatgagcccttg

SEQ ID NO: 56080 - DNA, 27 bp, Artificial Sequence
  Description of Artificial Sequence: Synthetic oligonucleotide
cgctctgaccaccatgatgagcccttg

SEQ ID NO: 56081 - DNA, 28 bp, Artificial Sequence
  Description of Artificial Sequence: Synthetic oligonucleotide
gctctgaccaccatgatgagcccttgtg

SEQ ID NO: 56082 - DNA, 28 bp, Artificial Sequence
  Description of Artificial Sequence: Synthetic oligonucleotide
ctctgaccaccatgatgagcccttgtgg

SEQ ID NO: 56083 - DNA, 29 bp, Artificial Sequence
  Description of Artificial Sequence: Synthetic oligonucleotide
tctgaccaccatgatgagcccttgtggag

SEQ ID NO: 56084 - DNA, 28 bp, Artificial Sequence
  Description of Artificial Sequence: Synthetic oligonucleotide
ctgaccaccatgatgagcccttgtggag

SEQ ID NO: 56085 - DNA, 28 bp, Artificial Sequence
  Description of Artificial Sequence: Synthetic oligonucleotide
tgaccaccatgatgagcccttgtggagg

SEQ ID NO: 56086 - DNA, 27 bp, Artificial Sequence
  Description of Artificial Sequence: Synthetic oligonucleotide
gaccaccatgatgagcccttgtggagg

SEQ ID NO: 56087 - DNA, 28 bp, Artificial Sequence
  Description of Artificial Sequence: Synthetic oligonucleotide
accaccatgatgagcccttgtggaggtg

SEQ ID NO: 56088 - DNA, 27 bp, Artificial Sequence
  Description of Artificial Sequence: Synthetic oligonucleotide
ccaccatgatgagcccttgtggaggtg

SEQ ID NO: 56089 - DNA, 29 bp, Artificial Sequence
  Description of Artificial Sequence: Synthetic oligonucleotide
caccatgatgagcccttgtggaggtgaag

SEQ ID NO: 56090 - DNA, 29 bp, Artificial Sequence
  Description of Artificial Sequence: Synthetic oligonucleotide
accatgatgagcccttgtggaggtgaagg

SEQ ID NO: 56091 - DNA, 28 bp, Artificial Sequence
  Description of Artificial Sequence: Synthetic oligonucleotide
ccatgatgagcccttgtggaggtgaagg

SEQ ID NO: 56092 - DNA, 28 bp, Artificial Sequence
  Description of Artificial Sequence: Synthetic oligonucleotide
catgatgagcccttgtggaggtgaaggc

SEQ ID NO: 56093 - DNA, 31 bp, Artificial Sequence
  Description of Artificial Sequence: Synthetic oligonucleotide
atgatgagcccttgtggaggtgaaggcattg

SEQ ID NO: 56094 - DNA, 30 bp, Artificial Sequence
  Description of Artificial Sequence: Synthetic oligonucleotide
tgatgagcccttgtggaggtgaaggcattg

SEQ ID NO: 56095 - DNA, 29 bp, Artificial Sequence
  Description of Artificial Sequence: Synthetic oligonucleotide
gatgagcccttgtggaggtgaaggcattg

SEQ ID NO: 56096 - DNA, 30 bp, Artificial Sequence
  Description of Artificial Sequence: Synthetic oligonucleotide
atgagcccttgtggaggtgaaggcattgtg

SEQ ID NO: 56097 - DNA, 29 bp, Artificial Sequence
  Description of Artificial Sequence: Synthetic oligonucleotide
tgagcccttgtggaggtgaaggcattgtg

SEQ ID NO: 56098 - DNA, 28 bp, Artificial Sequence
  Description of Artificial Sequence: Synthetic oligonucleotide
gagcccttgtggaggtgaaggcattgtg

SEQ ID NO: 56099 - DNA, 28 bp, Artificial Sequence
  Description of Artificial Sequence: Synthetic oligonucleotide
agcccttgtggaggtgaaggcattgtgg

SEQ ID NO: 56100 - DNA, 27 bp, Artificial Sequence
  Description of Artificial Sequence: Synthetic oligonucleotide
gcccttgtggaggtgaaggcattgtgg

SEQ ID NO: 56101 - DNA, 27 bp, Artificial Sequence
  Description of Artificial Sequence: Synthetic oligonucleotide
cccttgtggaggtgaaggcattgtggc

SEQ ID NO: 56102 - DNA, 28 bp, Artificial Sequence
  Description of Artificial Sequence: Synthetic oligonucleotide
ccttgtggaggtgaaggcattgtggctg

SEQ ID NO: 56103 - DNA, 29 bp, Artificial Sequence
  Description of Artificial Sequence: Synthetic oligonucleotide
cttgtggaggtgaaggcattgtggctgac

SEQ ID NO: 56104 - DNA, 29 bp, Artificial Sequence
  Description of Artificial Sequence: Synthetic oligonucleotide
ttgtggaggtgaaggcattgtggctgacc

SEQ ID NO: 56105 - DNA, 28 bp, Artificial Sequence
  Description of Artificial Sequence: Synthetic oligonucleotide
tgtggaggtgaaggcattgtggctgacc

SEQ ID NO: 56106 - DNA, 27 bp, Artificial Sequence
  Description of Artificial Sequence: Synthetic oligonucleotide
gtggaggtgaaggcattgtggctgacc

SEQ ID NO: 56107 - DNA, 28 bp, Artificial Sequence
  Description of Artificial Sequence: Synthetic oligonucleotide
tggaggtgaaggcattgtggctgaccac

SEQ ID NO: 56108 - DNA, 27 bp, Artificial Sequence
  Description of Artificial Sequence: Synthetic oligonucleotide
ggaggtgaaggcattgtggctgaccac

SEQ ID NO: 56109 - DNA, 27 bp, Artificial Sequence
  Description of Artificial Sequence: Synthetic oligonucleotide
gaggtgaaggcattgtggctgaccacg

SEQ ID NO: 56110 - DNA, 29 bp, Artificial Sequence
  Description of Artificial Sequence: Synthetic oligonucleotide
aggtgaaggcattgtggctgaccacgttg

SEQ ID NO: 56111 - DNA, 28 bp, Artificial Sequence
  Description of Artificial Sequence: Synthetic oligonucleotide
ggtgaaggcattgtggctgaccacgttg

SEQ ID NO: 56112 - DNA, 28 bp, Artificial Sequence
  Description of Artificial Sequence: Synthetic oligonucleotide
gtgaaggcattgtggctgaccacgttgc

SEQ ID NO: 56113 - DNA, 28 bp, Artificial Sequence
  Description of Artificial Sequence: Synthetic oligonucleotide
tgaaggcattgtggctgaccacgttgcc

SEQ ID NO: 56114 - DNA, 27 bp, Artificial Sequence
  Description of Artificial Sequence: Synthetic oligonucleotide
gaaggcattgtggctgaccacgttgcc

SEQ ID NO: 56115 - DNA, 28 bp, Artificial Sequence
  Description of Artificial Sequence: Synthetic oligonucleotide
aaggcattgtggctgaccacgttgcctc

SEQ ID NO: 56116 - DNA, 27 bp, Artificial Sequence
  Description of Artificial Sequence: Synthetic oligonucleotide
aggcattgtggctgaccacgttgcctc

SEQ ID NO: 56117 - DNA, 27 bp, Artificial Sequence
  Description of Artificial Sequence: Synthetic oligonucleotide
ggcattgtggctgaccacgttgcctct

SEQ ID NO: 56118 - DNA, 28 bp, Artificial Sequence
  Description of Artificial Sequence: Synthetic oligonucleotide
gcattgtggctgaccacgttgcctcttg

SEQ ID NO: 56119 - DNA, 29 bp, Artificial Sequence
  Description of Artificial Sequence: Synthetic oligonucleotide
tcagagctcacagagactgtggtctgcac

SEQ ID NO: 56120 - DNA, 28 bp, Artificial Sequence
  Description of Artificial Sequence: Synthetic oligonucleotide
cagagctcacagagactgtggtctgcac

SEQ ID NO: 56121 - DNA, 28 bp, Artificial Sequence
  Description of Artificial Sequence: Synthetic oligonucleotide
agagctcacagagactgtggtctgcacc

SEQ ID NO: 56122 - DNA, 27 bp, Artificial Sequence
  Description of Artificial Sequence: Synthetic oligonucleotide
gagctcacagagactgtggtctgcacc

SEQ ID NO: 56123 - DNA, 27 bp, Artificial Sequence
  Description of Artificial Sequence: Synthetic oligonucleotide
agctcacagagactgtggtctgcaccc

SEQ ID NO: 56124 - DNA, 27 bp, Artificial Sequence
  Description of Artificial Sequence: Synthetic oligonucleotide
gctcacagagactgtggtctgcaccct

SEQ ID NO: 56125 - DNA, 27 bp, Artificial Sequence
  Description of Artificial Sequence: Synthetic oligonucleotide
ctcacagagactgtggtctgcaccctg

SEQ ID NO: 56126 - DNA, 27 bp, Artificial Sequence
  Description of Artificial Sequence: Synthetic oligonucleotide
tcacagagactgtggtctgcaccctgg

SEQ ID NO: 56127 - DNA, 26 bp, Artificial Sequence
  Description of Artificial Sequence: Synthetic oligonucleotide
cacagagactgtggtctgcaccctgg

SEQ ID NO: 56128 - DNA, 26 bp, Artificial Sequence
  Description of Artificial Sequence: Synthetic oligonucleotide
acagagactgtggtctgcaccctggg

SEQ ID NO: 56129 - DNA, 25 bp, Artificial Sequence
  Description of Artificial Sequence: Synthetic oligonucleotide
cagagactgtggtctgcaccctggg

SEQ ID NO: 56130 - DNA, 27 bp, Artificial Sequence
  Description of Artificial Sequence: Synthetic oligonucleotide
agagactgtggtctgcaccctggggtt

SEQ ID NO: 56131 - DNA, 26 bp, Artificial Sequence
  Description of Artificial Sequence: Synthetic oligonucleotide
gagactgtggtctgcaccctggggtt

SEQ ID NO: 56132 - DNA, 27 bp, Artificial Sequence
  Description of Artificial Sequence: Synthetic oligonucleotide
agactgtggtctgcaccctggggttgt

SEQ ID NO: 56133 - DNA, 26 bp, Artificial Sequence
  Description of Artificial Sequence: Synthetic oligonucleotide
gactgtggtctgcaccctggggttgt

SEQ ID NO: 56134 - DNA, 27 bp, Artificial Sequence
  Description of Artificial Sequence: Synthetic oligonucleotide
actgtggtctgcaccctggggttgtct

SEQ ID NO: 56135 - DNA, 26 bp, Artificial Sequence
  Description of Artificial Sequence: Synthetic oligonucleotide
ctgtggtctgcaccctggggttgtct

SEQ ID NO: 56136 - DNA, 27 bp, Artificial Sequence
  Description of Artificial Sequence: Synthetic oligonucleotide
tgtggtctgcaccctggggttgtctgt

SEQ ID NO: 56137 - DNA, 26 bp, Artificial Sequence
  Description of Artificial Sequence: Synthetic oligonucleotide
gtggtctgcaccctggggttgtctgt

SEQ ID NO: 56138 - DNA, 26 bp, Artificial Sequence
  Description of Artificial Sequence: Synthetic oligonucleotide
tggtctgcaccctggggttgtctgtg

SEQ ID NO: 56139 - DNA, 25 bp, Artificial Sequence
  Description of Artificial Sequence: Synthetic oligonucleotide
ggtctgcaccctggggttgtctgtg

SEQ ID NO: 56140 - DNA, 25 bp, Artificial Sequence
  Description of Artificial Sequence: Synthetic oligonucleotide
gtctgcaccctggggttgtctgtgg

SEQ ID NO: 56141 - DNA, 25 bp, Artificial Sequence
  Description of Artificial Sequence: Synthetic oligonucleotide
tctgcaccctggggttgtctgtggg

SEQ ID NO: 56142 - DNA, 24 bp, Artificial Sequence
  Description of Artificial Sequence: Synthetic oligonucleotide
ctgcaccctggggttgtctgtggg

SEQ ID NO: 56143 - DNA, 24 bp, Artificial Sequence
  Description of Artificial Sequence: Synthetic oligonucleotide
tgcaccctggggttgtctgtgggc

SEQ ID NO: 56144 - DNA, 23 bp, Artificial Sequence
  Description of Artificial Sequence: Synthetic oligonucleotide
gcaccctggggttgtctgtgggc

SEQ ID NO: 56145 - DNA, 24 bp, Artificial Sequence
  Description of Artificial Sequence: Synthetic oligonucleotide
caccctggggttgtctgtgggcct

SEQ ID NO: 56146 - DNA, 24 bp, Artificial Sequence
  Description of Artificial Sequence: Synthetic oligonucleotide
accctggggttgtctgtgggcctc

SEQ ID NO: 56147 - DNA, 26 bp, Artificial Sequence
  Description of Artificial Sequence: Synthetic oligonucleotide
ctcgctctgaccaccatgatgagccc

SEQ ID NO: 56148 - DNA, 27 bp, Artificial Sequence
  Description of Artificial Sequence: Synthetic oligonucleotide
tcgctctgaccaccatgatgagcccct

SEQ ID NO: 56149 - DNA, 26 bp, Artificial Sequence
  Description of Artificial Sequence: Synthetic oligonucleotide
cgctctgaccaccatgatgagcccct

SEQ ID NO: 56150 - DNA, 27 bp, Artificial Sequence
  Description of Artificial Sequence: Synthetic oligonucleotide
gctctgaccaccatgatgagcccctgt

SEQ ID NO: 56151 - DNA, 27 bp, Artificial Sequence
  Description of Artificial Sequence: Synthetic oligonucleotide
ctctgaccaccatgatgagcccctgtg

SEQ ID NO: 56152 - DNA, 27 bp, Artificial Sequence
  Description of Artificial Sequence: Synthetic oligonucleotide
tctgaccaccatgatgagcccctgtgg

SEQ ID NO: 56153 - DNA, 27 bp, Artificial Sequence
  Description of Artificial Sequence: Synthetic oligonucleotide
ctgaccaccatgatgagcccctgtgga

SEQ ID NO: 56154 - DNA, 27 bp, Artificial Sequence
  Description of Artificial Sequence: Synthetic oligonucleotide
tgaccaccatgatgagcccctgtggag

SEQ ID NO: 56155 - DNA, 26 bp, Artificial Sequence
  Description of Artificial Sequence: Synthetic oligonucleotide
gaccaccatgatgagcccctgtggag

SEQ ID NO: 56156 - DNA, 27 bp, Artificial Sequence
  Description of Artificial Sequence: Synthetic oligonucleotide
accaccatgatgagcccctgtggaggt

SEQ ID NO: 56157 - DNA, 26 bp, Artificial Sequence
  Description of Artificial Sequence: Synthetic oligonucleotide
ccaccatgatgagcccctgtggaggt

SEQ ID NO: 56158 - DNA, 27 bp, Artificial Sequence
  Description of Artificial Sequence: Synthetic oligonucleotide
caccatgatgagcccctgtggaggtga

SEQ ID NO: 56159 - DNA, 28 bp, Artificial Sequence
  Description of Artificial Sequence: Synthetic oligonucleotide
accatgatgagcccctgtggaggtgaag

SEQ ID NO: 56160 - DNA, 27 bp, Artificial Sequence
  Description of Artificial Sequence: Synthetic oligonucleotide
ccatgatgagcccctgtggaggtgaag

SEQ ID NO: 56161 - DNA, 27 bp, Artificial Sequence
  Description of Artificial Sequence: Synthetic oligonucleotide
catgatgagcccctgtggaggtgaagg

SEQ ID NO: 56162 - DNA, 27 bp, Artificial Sequence
  Description of Artificial Sequence: Synthetic oligonucleotide
atgatgagcccctgtggaggtgaaggc

SEQ ID NO: 56163 - DNA, 27 bp, Artificial Sequence
  Description of Artificial Sequence: Synthetic oligonucleotide
tgatgagcccctgtggaggtgaaggca

SEQ ID NO: 56164 - DNA, 27 bp, Artificial Sequence
  Description of Artificial Sequence: Synthetic oligonucleotide
gatgagcccctgtggaggtgaaggcat

SEQ ID NO: 56165 - DNA, 28 bp, Artificial Sequence
  Description of Artificial Sequence: Synthetic oligonucleotide
atgagcccctgtggaggtgaaggcattg

SEQ ID NO: 56166 - DNA, 27 bp, Artificial Sequence
  Description of Artificial Sequence: Synthetic oligonucleotide
tgagcccctgtggaggtgaaggcattg

SEQ ID NO: 56167 - DNA, 27 bp, Artificial Sequence
  Description of Artificial Sequence: Synthetic oligonucleotide
gagcccctgtggaggtgaaggcattgt

SEQ ID NO: 56168 - DNA, 27 bp, Artificial Sequence
  Description of Artificial Sequence: Synthetic oligonucleotide
agcccctgtggaggtgaaggcattgtg

SEQ ID NO: 56169 - DNA, 26 bp, Artificial Sequence
  Description of Artificial Sequence: Synthetic oligonucleotide
gcccctgtggaggtgaaggcattgtg

SEQ ID NO: 56170 - DNA, 26 bp, Artificial Sequence
  Description of Artificial Sequence: Synthetic oligonucleotide
cccctgtggaggtgaaggcattgtgg

SEQ ID NO: 56171 - DNA, 27 bp, Artificial Sequence
  Description of Artificial Sequence: Synthetic oligonucleotide
ccctgtggaggtgaaggcattgtggct

SEQ ID NO: 56172 - DNA, 27 bp, Artificial Sequence
  Description of Artificial Sequence: Synthetic oligonucleotide
cctgtggaggtgaaggcattgtggctg

SEQ ID NO: 56173 - DNA, 28 bp, Artificial Sequence
  Description of Artificial Sequence: Synthetic oligonucleotide
ctgtggaggtgaaggcattgtggctgac

SEQ ID NO: 56174 - DNA, 28 bp, Artificial Sequence
  Description of Artificial Sequence: Synthetic oligonucleotide
ttctacgtggacctggagaggaaggagg

SEQ ID NO: 56175 - DNA, 27 bp, Artificial Sequence
  Description of Artificial Sequence: Synthetic oligonucleotide
tctacgtggacctggagaggaaggagg

SEQ ID NO: 56176 - DNA, 26 bp, Artificial Sequence
  Description of Artificial Sequence: Synthetic oligonucleotide
ctacgtggacctggagaggaaggagg

SEQ ID NO: 56177 - DNA, 27 bp, Artificial Sequence
  Description of Artificial Sequence: Synthetic oligonucleotide
tacgtggacctggagaggaaggaggct

SEQ ID NO: 56178 - DNA, 26 bp, Artificial Sequence
  Description of Artificial Sequence: Synthetic oligonucleotide
acgtggacctggagaggaaggaggct

SEQ ID NO: 56179 - DNA, 25 bp, Artificial Sequence
  Description of Artificial Sequence: Synthetic oligonucleotide
cgtggacctggagaggaaggaggct

SEQ ID NO: 56180 - DNA, 25 bp, Artificial Sequence
  Description of Artificial Sequence: Synthetic oligonucleotide
gtggacctggagaggaaggaggctg

SEQ ID NO: 56181 - DNA, 25 bp, Artificial Sequence
  Description of Artificial Sequence: Synthetic oligonucleotide
tggacctggagaggaaggaggctgc

SEQ ID NO: 56182 - DNA, 24 bp, Artificial Sequence
  Description of Artificial Sequence: Synthetic oligonucleotide
ggacctggagaggaaggaggctgc

SEQ ID NO: 56183 - DNA, 25 bp, Artificial Sequence
  Description of Artificial Sequence: Synthetic oligonucleotide
gacctggagaggaaggaggctgcct

SEQ ID NO: 56184 - DNA, 25 bp, Artificial Sequence
  Description of Artificial Sequence: Synthetic oligonucleotide
acctggagaggaaggaggctgcctg

SEQ ID NO: 56185 - DNA, 24 bp, Artificial Sequence
  Description of Artificial Sequence: Synthetic oligonucleotide
cctggagaggaaggaggctgcctg

SEQ ID NO: 56186 - DNA, 24 bp, Artificial Sequence
  Description of Artificial Sequence: Synthetic oligonucleotide
ctggagaggaaggaggctgcctgg

SEQ ID NO: 56187 - DNA, 24 bp, Artificial Sequence
  Description of Artificial Sequence: Synthetic oligonucleotide
tggagaggaaggaggctgcctggc

SEQ ID NO: 56188 - DNA, 23 bp, Artificial Sequence
  Description of Artificial Sequence: Synthetic oligonucleotide
ggagaggaaggaggctgcctggc

SEQ ID NO: 56189 - DNA, 23 bp, Artificial Sequence
  Description of Artificial Sequence: Synthetic oligonucleotide
gagaggaaggaggctgcctggcg

SEQ ID NO: 56190 - DNA, 24 bp, Artificial Sequence
  Description of Artificial Sequence: Synthetic oligonucleotide
agaggaaggaggctgcctggcggt

SEQ ID NO: 56191 - DNA, 23 bp, Artificial Sequence
  Description of Artificial Sequence: Synthetic oligonucleotide
gaggaaggaggctgcctggcggt

SEQ ID NO: 56192 - DNA, 23 bp, Artificial Sequence
  Description of Artificial Sequence: Synthetic oligonucleotide
aggaaggaggctgcctggcggtg

SEQ ID NO: 56193 - DNA, 22 bp, Artificial Sequence
  Description of Artificial Sequence: Synthetic oligonucleotide
ggaaggaggctgcctggcggtg

SEQ ID NO: 56194 - DNA, 22 bp, Artificial Sequence
  Description of Artificial Sequence: Synthetic oligonucleotide
gaaggaggctgcctggcggtgg

SEQ ID NO: 56195 - DNA, 22 bp, Artificial Sequence
  Description of Artificial Sequence: Synthetic oligonucleotide
aaggaggctgcctggcggtggc

SEQ ID NO: 56196 - DNA, 21 bp, Artificial Sequence
  Description of Artificial Sequence: Synthetic oligonucleotide
aggaggctgcctggcggtggc

SEQ ID NO: 56197 - DNA, 20 bp, Artificial Sequence
  Description of Artificial Sequence: Synthetic oligonucleotide
ggaggctgcctggcggtggc

SEQ ID NO: 56198 - DNA, 21 bp, Artificial Sequence
  Description of Artificial Sequence: Synthetic oligonucleotide
gaggctgcctggcggtggcct

SEQ ID NO: 56199 - DNA, 22 bp, Artificial Sequence
  Description of Artificial Sequence: Synthetic oligonucleotide
aggctgcctggcggtggcctga

SEQ ID NO: 56200 - DNA, 21 bp, Artificial Sequence
  Description of Artificial Sequence: Synthetic oligonucleotide
ggctgcctggcggtggcctga

SEQ ID NO: 56201 - DNA, 23 bp, Artificial Sequence
  Description of Artificial Sequence: Synthetic oligonucleotide
gctgcctggcggtggcctgagtt

SEQ ID NO: 56202 - DNA, 45 bp, Artificial Sequence
  Description of Artificial Sequence: Synthetic oligonucleotide
aaacatggctgtggcaaaacacaacttgaacatcatgattaaatg

SEQ ID NO: 56203 - DNA, 44 bp, Artificial Sequence
  Description of Artificial Sequence: Synthetic oligonucleotide
aacatggctgtggcaaaacacaacttgaacatcatgattaaatg

SEQ ID NO: 56204 - DNA, 43 bp, Artificial Sequence
  Description of Artificial Sequence: Synthetic oligonucleotide
acatggctgtggcaaaacacaacttgaacatcatgattaaatg

SEQ ID NO: 56205 - DNA, 42 bp, Artificial Sequence
  Description of Artificial Sequence: Synthetic oligonucleotide
catggctgtggcaaaacacaacttgaacatcatgattaaatg

SEQ ID NO: 56206 - DNA, 42 bp, Artificial Sequence
  Description of Artificial Sequence: Synthetic oligonucleotide
atggctgtggcaaaacacaacttgaacatcatgattaaatgc

SEQ ID NO: 56207 - DNA, 41 bp, Artificial Sequence
  Description of Artificial Sequence: Synthetic oligonucleotide
tggctgtggcaaaacacaacttgaacatcatgattaaatgc

SEQ ID NO: 56208 - DNA, 40 bp, Artificial Sequence
  Description of Artificial Sequence: Synthetic oligonucleotide
ggctgtggcaaaacacaacttgaacatcatgattaaatgc

SEQ ID NO: 56209 - DNA, 42 bp, Artificial Sequence
  Description of Artificial Sequence: Synthetic oligonucleotide
gctgtggcaaaacacaacttgaacatcatgattaaatgctac

SEQ ID NO: 56210 - DNA, 44 bp, Artificial Sequence
  Description of Artificial Sequence: Synthetic oligonucleotide
ctgtggcaaaacacaacttgaacatcatgattaaatgctacaac

SEQ ID NO: 56211 - DNA, 45 bp, Artificial Sequence
  Description of Artificial Sequence: Synthetic oligonucleotide
tgtggcaaaacacaacttgaacatcatgattaaatgctacaactc

SEQ ID NO: 56212 - DNA, 44 bp, Artificial Sequence
  Description of Artificial Sequence: Synthetic oligonucleotide
gtggcaaaacacaacttgaacatcatgattaaatgctacaactc

SEQ ID NO: 56213 - DNA, 46 bp, Artificial Sequence
  Description of Artificial Sequence: Synthetic oligonucleotide
tggcaaaacacaacttgaacatcatgattaaatgctacaactctac

SEQ ID NO: 56214 - DNA, 45 bp, Artificial Sequence
  Description of Artificial Sequence: Synthetic oligonucleotide
ggcaaaacacaacttgaacatcatgattaaatgctacaactctac

SEQ ID NO: 56215 - DNA, 45 bp, Artificial Sequence
  Description of Artificial Sequence: Synthetic oligonucleotide
gcaaaacacaacttgaacatcatgattaaatgctacaactctacc

SEQ ID NO: 56216 - DNA, 45 bp, Artificial Sequence
  Description of Artificial Sequence: Synthetic oligonucleotide
caaaacacaacttgaacatcatgattaaatgctacaactctaccg

SEQ ID NO: 56217 - DNA, 45 bp, Artificial Sequence
  Description of Artificial Sequence: Synthetic oligonucleotide
aaaacacaacttgaacatcatgattaaatgctacaactctaccgc

SEQ ID NO: 56218 - DNA, 44 bp, Artificial Sequence
  Description of Artificial Sequence: Synthetic oligonucleotide
aaacacaacttgaacatcatgattaaatgctacaactctaccgc

SEQ ID NO: 56219 - DNA, 43 bp, Artificial Sequence
  Description of Artificial Sequence: Synthetic oligonucleotide
aacacaacttgaacatcatgattaaatgctacaactctaccgc

SEQ ID NO: 56220 - DNA, 42 bp, Artificial Sequence
  Description of Artificial Sequence: Synthetic oligonucleotide
acacaacttgaacatcatgattaaatgctacaactctaccgc

SEQ ID NO: 56221 - DNA, 41 bp, Artificial Sequence
  Description of Artificial Sequence: Synthetic oligonucleotide
cacaacttgaacatcatgattaaatgctacaactctaccgc

SEQ ID NO: 56222 - DNA, 42 bp, Artificial Sequence
  Description of Artificial Sequence: Synthetic oligonucleotide
acaacttgaacatcatgattaaatgctacaactctaccgctg

SEQ ID NO: 56223 - DNA, 41 bp, Artificial Sequence
  Description of Artificial Sequence: Synthetic oligonucleotide
caacttgaacatcatgattaaatgctacaactctaccgctg

SEQ ID NO: 56224 - DNA, 41 bp, Artificial Sequence
  Description of Artificial Sequence: Synthetic oligonucleotide
aacttgaacatcatgattaaatgctacaactctaccgctgc

SEQ ID NO: 56225 - DNA, 40 bp, Artificial Sequence
  Description of Artificial Sequence: Synthetic oligonucleotide
acttgaacatcatgattaaatgctacaactctaccgctgc

SEQ ID NO: 56226 - DNA, 39 bp, Artificial Sequence
  Description of Artificial Sequence: Synthetic oligonucleotide
cttgaacatcatgattaaatgctacaactctaccgctgc

SEQ ID NO: 56227 - DNA, 41 bp, Artificial Sequence
  Description of Artificial Sequence: Synthetic oligonucleotide
ttgaacatcatgattaaatgctacaactctaccgctgctac

SEQ ID NO: 56228 - DNA, 40 bp, Artificial Sequence
  Description of Artificial Sequence: Synthetic oligonucleotide
tgaacatcatgattaaatgctacaactctaccgctgctac

SEQ ID NO: 56229 - DNA, 39 bp, Artificial Sequence
  Description of Artificial Sequence: Synthetic oligonucleotide
gaacatcatgattaaatgctacaactctaccgctgctac

SEQ ID NO: 56230 - DNA, 39 bp, Artificial Sequence
  Description of Artificial Sequence: Synthetic oligonucleotide
aacatcatgattaaatgctacaactctaccgctgctacc

SEQ ID NO: 56231 - DNA, 38 bp, Artificial Sequence
  Description of Artificial Sequence: Synthetic oligonucleotide
acatcatgattaaatgctacaactctaccgctgctacc

SEQ ID NO: 56232 - DNA, 37 bp, Artificial Sequence
  Description of Artificial Sequence: Synthetic oligonucleotide
catcatgattaaatgctacaactctaccgctgctacc

SEQ ID NO: 56233 - DNA, 40 bp, Artificial Sequence
  Description of Artificial Sequence: Synthetic oligonucleotide
atcatgattaaatgctacaactctaccgctgctaccaatg

SEQ ID NO: 56234 - DNA, 39 bp, Artificial Sequence
  Description of Artificial Sequence: Synthetic oligonucleotide
tcatgattaaatgctacaactctaccgctgctaccaatg

SEQ ID NO: 56235 - DNA, 38 bp, Artificial Sequence
  Description of Artificial Sequence: Synthetic oligonucleotide
catgattaaatgctacaactctaccgctgctaccaatg

SEQ ID NO: 56236 - DNA, 39 bp, Artificial Sequence
  Description of Artificial Sequence: Synthetic oligonucleotide
atgattaaatgctacaactctaccgctgctaccaatgag

SEQ ID NO: 56237 - DNA, 38 bp, Artificial Sequence
  Description of Artificial Sequence: Synthetic oligonucleotide
tgattaaatgctacaactctaccgctgctaccaatgag

SEQ ID NO: 56238 - DNA, 37 bp, Artificial Sequence
  Description of Artificial Sequence: Synthetic oligonucleotide
gattaaatgctacaactctaccgctgctaccaatgag

SEQ ID NO: 56239 - DNA, 37 bp, Artificial Sequence
  Description of Artificial Sequence: Synthetic oligonucleotide
attaaatgctacaactctaccgctgctaccaatgagg

SEQ ID NO: 56240 - DNA, 36 bp, Artificial Sequence
  Description of Artificial Sequence: Synthetic oligonucleotide
ttaaatgctacaactctaccgctgctaccaatgagg

SEQ ID NO: 56241 - DNA, 35 bp, Artificial Sequence
  Description of Artificial Sequence: Synthetic oligonucleotide
taaatgctacaactctaccgctgctaccaatgagg

SEQ ID NO: 56242 - DNA, 34 bp, Artificial Sequence
  Description of Artificial Sequence: Synthetic oligonucleotide
aaatgctacaactctaccgctgctaccaatgagg

SEQ ID NO: 56243 - DNA, 33 bp, Artificial Sequence
  Description of Artificial Sequence: Synthetic oligonucleotide
aatgctacaactctaccgctgctaccaatgagg

SEQ ID NO: 56244 - DNA, 32 bp, Artificial Sequence
  Description of Artificial Sequence: Synthetic oligonucleotide
atgctacaactctaccgctgctaccaatgagg

SEQ ID NO: 56245 - DNA, 31 bp, Artificial Sequence
  Description of Artificial Sequence: Synthetic oligonucleotide
tgctacaactctaccgctgctaccaatgagg

SEQ ID NO: 56246 - DNA, 32 bp, Artificial Sequence
  Description of Artificial Sequence: Synthetic oligonucleotide
atgatcctaaacaaagctctgatgctgggggc

SEQ ID NO: 56247 - DNA, 31 bp, Artificial Sequence
  Description of Artificial Sequence: Synthetic oligonucleotide
tgatcctaaacaaagctctgatgctgggggc

SEQ ID NO: 56248 - DNA, 30 bp, Artificial Sequence
  Description of Artificial Sequence: Synthetic oligonucleotide
gatcctaaacaaagctctgatgctgggggc

SEQ ID NO: 56249 - DNA, 30 bp, Artificial Sequence
  Description of Artificial Sequence: Synthetic oligonucleotide
atcctaaacaaagctctgatgctgggggcc

SEQ ID NO: 56250 - DNA, 29 bp, Artificial Sequence
  Description of Artificial Sequence: Synthetic oligonucleotide
tcctaaacaaagctctgatgctgggggcc

SEQ ID NO: 56251 - DNA, 28 bp, Artificial Sequence
  Description of Artificial Sequence: Synthetic oligonucleotide
cctaaacaaagctctgatgctgggggcc

SEQ ID NO: 56252 - DNA, 28 bp, Artificial Sequence
  Description of Artificial Sequence: Synthetic oligonucleotide
ctaaacaaagctctgatgctgggggccc

SEQ ID NO: 56253 - DNA, 29 bp, Artificial Sequence
  Description of Artificial Sequence: Synthetic oligonucleotide
taaacaaagctctgatgctgggggccctc

SEQ ID NO: 56254 - DNA, 28 bp, Artificial Sequence
  Description of Artificial Sequence: Synthetic oligonucleotide
aaacaaagctctgatgctgggggccctc

SEQ ID NO: 56255 - DNA, 27 bp, Artificial Sequence
  Description of Artificial Sequence: Synthetic oligonucleotide
aacaaagctctgatgctgggggccctc

SEQ ID NO: 56256 - DNA, 26 bp, Artificial Sequence
  Description of Artificial Sequence: Synthetic oligonucleotide
acaaagctctgatgctgggggccctc

SEQ ID NO: 56257 - DNA, 25 bp, Artificial Sequence
  Description of Artificial Sequence: Synthetic oligonucleotide
caaagctctgatgctgggggccctc

SEQ ID NO: 56258 - DNA, 25 bp, Artificial Sequence
  Description of Artificial Sequence: Synthetic oligonucleotide
aaagctctgatgctgggggccctcg

SEQ ID NO: 56259 - DNA, 24 bp, Artificial Sequence
  Description of Artificial Sequence: Synthetic oligonucleotide
aagctctgatgctgggggccctcg

SEQ ID NO: 56260 - DNA, 23 bp, Artificial Sequence
  Description of Artificial Sequence: Synthetic oligonucleotide
agctctgatgctgggggccctcg

SEQ ID NO: 56261 - DNA, 22 bp, Artificial Sequence
  Description of Artificial Sequence: Synthetic oligonucleotide
gctctgatgctgggggccctcg

SEQ ID NO: 56262 - DNA, 22 bp, Artificial Sequence
  Description of Artificial Sequence: Synthetic oligonucleotide
ctctgatgctgggggccctcgc

SEQ ID NO: 56263 - DNA, 22 bp, Artificial Sequence
  Description of Artificial Sequence: Synthetic oligonucleotide
tctgatgctgggggccctcgcc

SEQ ID NO: 56264 - DNA, 21 bp, Artificial Sequence
  Description of Artificial Sequence: Synthetic oligonucleotide
ctgatgctgggggccctcgcc

SEQ ID NO: 56265 - DNA, 22 bp, Artificial Sequence
  Description of Artificial Sequence: Synthetic oligonucleotide
tgatgctgggggccctcgccct

SEQ ID NO: 56266 - DNA, 21 bp, Artificial Sequence
  Description of Artificial Sequence: Synthetic oligonucleotide
gatgctgggggccctcgccct

SEQ ID NO: 56267 - DNA, 22 bp, Artificial Sequence
  Description of Artificial Sequence: Synthetic oligonucleotide
atgctgggggccctcgccctga

SEQ ID NO: 56268 - DNA, 21 bp, Artificial Sequence
  Description of Artificial Sequence: Synthetic oligonucleotide
tgctgggggccctcgccctga

SEQ ID NO: 56269 - DNA, 20 bp, Artificial Sequence
  Description of Artificial Sequence: Synthetic oligonucleotide
gctgggggccctcgccctga

SEQ ID NO: 56270 - DNA, 20 bp, Artificial Sequence
  Description of Artificial Sequence: Synthetic oligonucleotide
ctgggggccctcgccctgac

SEQ ID NO: 56271 - DNA, 21 bp, Artificial Sequence
  Description of Artificial Sequence: Synthetic oligonucleotide
tgggggccctcgccctgacca

SEQ ID NO: 56272 - DNA, 20 bp, Artificial Sequence
  Description of Artificial Sequence: Synthetic oligonucleotide
gggggccctcgccctgacca

SEQ ID NO: 56273 - DNA, 20 bp, Artificial Sequence
  Description of Artificial Sequence: Synthetic oligonucleotide
ggggccctcgccctgaccac

SEQ ID NO: 56274 - DNA, 20 bp, Artificial Sequence
  Description of Artificial Sequence: Synthetic oligonucleotide
gggccctcgccctgaccacc

SEQ ID NO: 56275 - DNA, 21 bp, Artificial Sequence
  Description of Artificial Sequence: Synthetic oligonucleotide
ggccctcgccctgaccaccgt

SEQ ID NO: 56276 - DNA, 23 bp, Artificial Sequence
  Description of Artificial Sequence: Synthetic oligonucleotide
gccctcgccctgaccaccgtgat

SEQ ID NO: 56277 - DNA, 24 bp, Artificial Sequence
  Description of Artificial Sequence: Synthetic oligonucleotide
ccctcgccctgaccaccgtgatga

SEQ ID NO: 56278 - DNA, 24 bp, Artificial Sequence
  Description of Artificial Sequence: Synthetic oligonucleotide
cctcgccctgaccaccgtgatgag

SEQ ID NO: 56279 - DNA, 24 bp, Artificial Sequence
  Description of Artificial Sequence: Synthetic oligonucleotide
ctcgccctgaccaccgtgatgagc

SEQ ID NO: 56280 - DNA, 24 bp, Artificial Sequence
  Description of Artificial Sequence: Synthetic oligonucleotide
tcgccctgaccaccgtgatgagcc

SEQ ID NO: 56281 - DNA, 23 bp, Artificial Sequence
  Description of Artificial Sequence: Synthetic oligonucleotide
cgccctgaccaccgtgatgagcc

SEQ ID NO: 56282 - DNA, 25 bp, Artificial Sequence
  Description of Artificial Sequence: Synthetic oligonucleotide
gccctgaccaccgtgatgagccctt

SEQ ID NO: 56283 - DNA, 26 bp, Artificial Sequence
  Description of Artificial Sequence: Synthetic oligonucleotide
ccctgaccaccgtgatgagcccttgt

SEQ ID NO: 56284 - DNA, 26 bp, Artificial Sequence
  Description of Artificial Sequence: Synthetic oligonucleotide
cctgaccaccgtgatgagcccttgtg

SEQ ID NO: 56285 - DNA, 27 bp, Artificial Sequence
  Description of Artificial Sequence: Synthetic oligonucleotide
ctgaccaccgtgatgagcccttgtgga

SEQ ID NO: 56286 - DNA, 27 bp, Artificial Sequence
  Description of Artificial Sequence: Synthetic oligonucleotide
tgaccaccgtgatgagcccttgtggag

SEQ ID NO: 56287 - DNA, 26 bp, Artificial Sequence
  Description of Artificial Sequence: Synthetic oligonucleotide
gaccaccgtgatgagcccttgtggag

SEQ ID NO: 56288 - DNA, 27 bp, Artificial Sequence
  Description of Artificial Sequence: Synthetic oligonucleotide
accaccgtgatgagcccttgtggaggt

SEQ ID NO: 56289 - DNA, 26 bp, Artificial Sequence
  Description of Artificial Sequence: Synthetic oligonucleotide
ccaccgtgatgagcccttgtggaggt

SEQ ID NO: 56290 - DNA, 27 bp, Artificial Sequence
  Description of Artificial Sequence: Synthetic oligonucleotide
caccgtgatgagcccttgtggaggtga

SEQ ID NO: 56291 - DNA, 28 bp, Artificial Sequence
  Description of Artificial Sequence: Synthetic oligonucleotide
accgtgatgagcccttgtggaggtgaag

SEQ ID NO: 56292 - DNA, 27 bp, Artificial Sequence
  Description of Artificial Sequence: Synthetic oligonucleotide
ccgtgatgagcccttgtggaggtgaag

SEQ ID NO: 56293 - DNA, 28 bp, Artificial Sequence
  Description of Artificial Sequence: Synthetic oligonucleotide
cgtgatgagcccttgtggaggtgaagac

SEQ ID NO: 56294 - DNA, 31 bp, Artificial Sequence
  Description of Artificial Sequence: Synthetic oligonucleotide
gtgatgagcccttgtggaggtgaagacattg

SEQ ID NO: 56295 - DNA, 32 bp, Artificial Sequence
  Description of Artificial Sequence: Synthetic oligonucleotide
tgatgagcccttgtggaggtgaagacattgtg

SEQ ID NO: 56296 - DNA, 31 bp, Artificial Sequence
  Description of Artificial Sequence: Synthetic oligonucleotide
gatgagcccttgtggaggtgaagacattgtg

SEQ ID NO: 56297 - DNA, 31 bp, Artificial Sequence
  Description of Artificial Sequence: Synthetic oligonucleotide
atgagcccttgtggaggtgaagacattgtgg

SEQ ID NO: 56298 - DNA, 30 bp, Artificial Sequence
  Description of Artificial Sequence: Synthetic oligonucleotide
tgagcccttgtggaggtgaagacattgtgg

SEQ ID NO: 56299 - DNA, 29 bp, Artificial Sequence
  Description of Artificial Sequence: Synthetic oligonucleotide
gagcccttgtggaggtgaagacattgtgg

SEQ ID NO: 56300 - DNA, 29 bp, Artificial Sequence
  Description of Artificial Sequence: Synthetic oligonucleotide
agcccttgtggaggtgaagacattgtggc

SEQ ID NO: 56301 - DNA, 28 bp, Artificial Sequence
  Description of Artificial Sequence: Synthetic oligonucleotide
gcccttgtggaggtgaagacattgtggc

SEQ ID NO: 56302 - DNA, 29 bp, Artificial Sequence
  Description of Artificial Sequence: Synthetic oligonucleotide
cccttgtggaggtgaagacattgtggctg

SEQ ID NO: 56303 - DNA, 30 bp, Artificial Sequence
  Description of Artificial Sequence: Synthetic oligonucleotide
ccttgtggaggtgaagacattgtggctgac

SEQ ID NO: 56304 - DNA, 30 bp, Artificial Sequence
  Description of Artificial Sequence: Synthetic oligonucleotide
cttgtggaggtgaagacattgtggctgacc

SEQ ID NO: 56305 - DNA, 31 bp, Artificial Sequence
  Description of Artificial Sequence: Synthetic oligonucleotide
ttgtggaggtgaagacattgtggctgaccac

SEQ ID NO: 56306 - DNA, 32 bp, Artificial Sequence
  Description of Artificial Sequence: Synthetic oligonucleotide
aagacattgtggctgaccacgttgcctcttac

SEQ ID NO: 56307 - DNA, 31 bp, Artificial Sequence
  Description of Artificial Sequence: Synthetic oligonucleotide
agacattgtggctgaccacgttgcctcttac

SEQ ID NO: 56308 - DNA, 30 bp, Artificial Sequence
  Description of Artificial Sequence: Synthetic oligonucleotide
gacattgtggctgaccacgttgcctcttac

SEQ ID NO: 56309 - DNA, 30 bp, Artificial Sequence
  Description of Artificial Sequence: Synthetic oligonucleotide
acattgtggctgaccacgttgcctcttacg

SEQ ID NO: 56310 - DNA, 29 bp, Artificial Sequence
  Description of Artificial Sequence: Synthetic oligonucleotide
cattgtggctgaccacgttgcctcttacg

SEQ ID NO: 56311 - DNA, 29 bp, Artificial Sequence
  Description of Artificial Sequence: Synthetic oligonucleotide
attgtggctgaccacgttgcctcttacgg

SEQ ID NO: 56312 - DNA, 28 bp, Artificial Sequence
  Description of Artificial Sequence: Synthetic oligonucleotide
ttgtggctgaccacgttgcctcttacgg

SEQ ID NO: 56313 - DNA, 27 bp, Artificial Sequence
  Description of Artificial Sequence: Synthetic oligonucleotide
tgtggctgaccacgttgcctcttacgg

SEQ ID NO: 56314 - DNA, 27 bp, Artificial Sequence
  Description of Artificial Sequence: Synthetic oligonucleotide
gtggctgaccacgttgcctcttacggt

SEQ ID NO: 56315 - DNA, 27 bp, Artificial Sequence
  Description of Artificial Sequence: Synthetic oligonucleotide
tggctgaccacgttgcctcttacggtg

SEQ ID NO: 56316 - DNA, 27 bp, Artificial Sequence
  Description of Artificial Sequence: Synthetic oligonucleotide
ggctgaccacgttgcctcttacggtgt

SEQ ID NO: 56317 - DNA, 30 bp, Artificial Sequence
  Description of Artificial Sequence: Synthetic oligonucleotide
gctgaccacgttgcctcttacggtgtaaac

SEQ ID NO: 56318 - DNA, 32 bp, Artificial Sequence
  Description of Artificial Sequence: Synthetic oligonucleotide
ctgaccacgttgcctcttacggtgtaaacttg

SEQ ID NO: 56319 - DNA, 34 bp, Artificial Sequence
  Description of Artificial Sequence: Synthetic oligonucleotide
tgaccacgttgcctcttacggtgtaaacttgtac

SEQ ID NO: 56320 - DNA, 33 bp, Artificial Sequence
  Description of Artificial Sequence: Synthetic oligonucleotide
gaccacgttgcctcttacggtgtaaacttgtac

SEQ ID NO: 56321 - DNA, 33 bp, Artificial Sequence
  Description of Artificial Sequence: Synthetic oligonucleotide
accacgttgcctcttacggtgtaaacttgtacc

SEQ ID NO: 56322 - DNA, 32 bp, Artificial Sequence
  Description of Artificial Sequence: Synthetic oligonucleotide
ccacgttgcctcttacggtgtaaacttgtacc

SEQ ID NO: 56323 - DNA, 33 bp, Artificial Sequence
  Description of Artificial Sequence: Synthetic oligonucleotide
cacgttgcctcttacggtgtaaacttgtaccag

SEQ ID NO: 56324 - DNA, 34 bp, Artificial Sequence
  Description of Artificial Sequence: Synthetic oligonucleotide
acgttgcctcttacggtgtaaacttgtaccagtc

SEQ ID NO: 56325 - DNA, 33 bp, Artificial Sequence
  Description of Artificial Sequence: Synthetic oligonucleotide
cgttgcctcttacggtgtaaacttgtaccagtc

SEQ ID NO: 56326 - DNA, 36 bp, Artificial Sequence
  Description of Artificial Sequence: Synthetic oligonucleotide
gttgcctcttacggtgtaaacttgtaccagtcttac

SEQ ID NO: 56327 - DNA, 36 bp, Artificial Sequence
  Description of Artificial Sequence: Synthetic oligonucleotide
ttgcctcttacggtgtaaacttgtaccagtcttacg

SEQ ID NO: 56328 - DNA, 35 bp, Artificial Sequence
  Description of Artificial Sequence: Synthetic oligonucleotide
tgcctcttacggtgtaaacttgtaccagtcttacg

SEQ ID NO: 56329 - DNA, 34 bp, Artificial Sequence
  Description of Artificial Sequence: Synthetic oligonucleotide
gcctcttacggtgtaaacttgtaccagtcttacg

SEQ ID NO: 56330 - DNA, 34 bp, Artificial Sequence
  Description of Artificial Sequence: Synthetic oligonucleotide
cctcttacggtgtaaacttgtaccagtcttacgg

SEQ ID NO: 56331 - DNA, 35 bp, Artificial Sequence
  Description of Artificial Sequence: Synthetic oligonucleotide
ctcttacggtgtaaacttgtaccagtcttacggtc

SEQ ID NO: 56332 - DNA, 35 bp, Artificial Sequence
  Description of Artificial Sequence: Synthetic oligonucleotide
tcttacggtgtaaacttgtaccagtcttacggtcc

SEQ ID NO: 56333 - DNA, 34 bp, Artificial Sequence
  Description of Artificial Sequence: Synthetic oligonucleotide
cttacggtgtaaacttgtaccagtcttacggtcc

SEQ ID NO: 56334 - DNA, 34 bp, Artificial Sequence
  Description of Artificial Sequence: Synthetic oligonucleotide
ttacggtgtaaacttgtaccagtcttacggtccc

SEQ ID NO: 56335 - DNA, 33 bp, Artificial Sequence
  Description of Artificial Sequence: Synthetic oligonucleotide
tacggtgtaaacttgtaccagtcttacggtccc

SEQ ID NO: 56336 - DNA, 32 bp, Artificial Sequence
  Description of Artificial Sequence: Synthetic oligonucleotide
acggtgtaaacttgtaccagtcttacggtccc

SEQ ID NO: 56337 - DNA, 31 bp, Artificial Sequence
  Description of Artificial Sequence: Synthetic oligonucleotide
cggtgtaaacttgtaccagtcttacggtccc

SEQ ID NO: 56338 - DNA, 32 bp, Artificial Sequence
  Description of Artificial Sequence: Synthetic oligonucleotide
ggtgtaaacttgtaccagtcttacggtccctc

SEQ ID NO: 56339 - DNA, 33 bp, Artificial Sequence
  Description of Artificial Sequence: Synthetic oligonucleotide
gtgtaaacttgtaccagtcttacggtccctctg

SEQ ID NO: 56340 - DNA, 33 bp, Artificial Sequence
  Description of Artificial Sequence: Synthetic oligonucleotide
tgtaaacttgtaccagtcttacggtccctctgg

SEQ ID NO: 56341 - DNA, 32 bp, Artificial Sequence
  Description of Artificial Sequence: Synthetic oligonucleotide
gtaaacttgtaccagtcttacggtccctctgg

SEQ ID NO: 56342 - DNA, 32 bp, Artificial Sequence
  Description of Artificial Sequence: Synthetic oligonucleotide
taaacttgtaccagtcttacggtccctctggc

SEQ ID NO: 56343 - DNA, 31 bp, Artificial Sequence
  Description of Artificial Sequence: Synthetic oligonucleotide
aaacttgtaccagtcttacggtccctctggc

SEQ ID NO: 56344 - DNA, 30 bp, Artificial Sequence
  Description of Artificial Sequence: Synthetic oligonucleotide
aacttgtaccagtcttacggtccctctggc

SEQ ID NO: 56345 - DNA, 29 bp, Artificial Sequence
  Description of Artificial Sequence: Synthetic oligonucleotide
acttgtaccagtcttacggtccctctggc

SEQ ID NO: 56346 - DNA, 28 bp, Artificial Sequence
  Description of Artificial Sequence: Synthetic oligonucleotide
cttgtaccagtcttacggtccctctggc

SEQ ID NO: 56347 - DNA, 28 bp, Artificial Sequence
  Description of Artificial Sequence: Synthetic oligonucleotide
ttgtaccagtcttacggtccctctggcc

SEQ ID NO: 56348 - DNA, 27 bp, Artificial Sequence
  Description of Artificial Sequence: Synthetic oligonucleotide
tgtaccagtcttacggtccctctggcc

SEQ ID NO: 56349 - DNA, 27 bp, Artificial Sequence
  Description of Artificial Sequence: Synthetic oligonucleotide
gtaccagtcttacggtccctctggcca

SEQ ID NO: 56350 - DNA, 27 bp, Artificial Sequence
  Description of Artificial Sequence: Synthetic oligonucleotide
taccagtcttacggtccctctggccag

SEQ ID NO: 56351 - DNA, 27 bp, Artificial Sequence
  Description of Artificial Sequence: Synthetic oligonucleotide
accagtcttacggtccctctggccagt

SEQ ID NO: 56352 - DNA, 27 bp, Artificial Sequence
  Description of Artificial Sequence: Synthetic oligonucleotide
ccagtcttacggtccctctggccagtt

SEQ ID NO: 56353 - DNA, 27 bp, Artificial Sequence
  Description of Artificial Sequence: Synthetic oligonucleotide
cagtcttacggtccctctggccagttc

SEQ ID NO: 56354 - DNA, 28 bp, Artificial Sequence
  Description of Artificial Sequence: Synthetic oligonucleotide
agtcttacggtccctctggccagttcac

SEQ ID NO: 56355 - DNA, 27 bp, Artificial Sequence
  Description of Artificial Sequence: Synthetic oligonucleotide
gtcttacggtccctctggccagttcac

SEQ ID NO: 56356 - DNA, 27 bp, Artificial Sequence
  Description of Artificial Sequence: Synthetic oligonucleotide
tcttacggtccctctggccagttcacc

SEQ ID NO: 56357 - DNA, 26 bp, Artificial Sequence
  Description of Artificial Sequence: Synthetic oligonucleotide
cttacggtccctctggccagttcacc

SEQ ID NO: 56358 - DNA, 33 bp, Artificial Sequence
  Description of Artificial Sequence: Synthetic oligonucleotide
tctggccagttcacccatgaatttgatggagac

SEQ ID NO: 56359 - DNA, 32 bp, Artificial Sequence
  Description of Artificial Sequence: Synthetic oligonucleotide
ctggccagttcacccatgaatttgatggagac

SEQ ID NO: 56360 - DNA, 32 bp, Artificial Sequence
  Description of Artificial Sequence: Synthetic oligonucleotide
tggccagttcacccatgaatttgatggagacg

SEQ ID NO: 56361 - DNA, 31 bp, Artificial Sequence
  Description of Artificial Sequence: Synthetic oligonucleotide
ggccagttcacccatgaatttgatggagacg

SEQ ID NO: 56362 - DNA, 32 bp, Artificial Sequence
  Description of Artificial Sequence: Synthetic oligonucleotide
gccagttcacccatgaatttgatggagacgag

SEQ ID NO: 56363 - DNA, 32 bp, Artificial Sequence
  Description of Artificial Sequence: Synthetic oligonucleotide
ccagttcacccatgaatttgatggagacgagg

SEQ ID NO: 56364 - DNA, 33 bp, Artificial Sequence
  Description of Artificial Sequence: Synthetic oligonucleotide
cagttcacccatgaatttgatggagacgaggag

SEQ ID NO: 56365 - DNA, 35 bp, Artificial Sequence
  Description of Artificial Sequence: Synthetic oligonucleotide
agttcacccatgaatttgatggagacgaggagttc

SEQ ID NO: 56366 - DNA, 34 bp, Artificial Sequence
  Description of Artificial Sequence: Synthetic oligonucleotide
gttcacccatgaatttgatggagacgaggagttc

SEQ ID NO: 56367 - DNA, 37 bp, Artificial Sequence
  Description of Artificial Sequence: Synthetic oligonucleotide
ttcacccatgaatttgatggagacgaggagttctatg

SEQ ID NO: 56368 - DNA, 36 bp, Artificial Sequence
  Description of Artificial Sequence: Synthetic oligonucleotide
tcacccatgaatttgatggagacgaggagttctatg

SEQ ID NO: 56369 - DNA, 35 bp, Artificial Sequence
  Description of Artificial Sequence: Synthetic oligonucleotide
cacccatgaatttgatggagacgaggagttctatg

SEQ ID NO: 56370 - DNA, 36 bp, Artificial Sequence
  Description of Artificial Sequence: Synthetic oligonucleotide
acccatgaatttgatggagacgaggagttctatgtg

SEQ ID NO: 56371 - DNA, 35 bp, Artificial Sequence
  Description of Artificial Sequence: Synthetic oligonucleotide
cccatgaatttgatggagacgaggagttctatgtg

SEQ ID NO: 56372 - DNA, 35 bp, Artificial Sequence
  Description of Artificial Sequence: Synthetic oligonucleotide
ccatgaatttgatggagacgaggagttctatgtgg

SEQ ID NO: 56373 - DNA, 36 bp, Artificial Sequence
  Description of Artificial Sequence: Synthetic oligonucleotide
catgaatttgatggagacgaggagttctatgtggac

SEQ ID NO: 56374 - DNA, 36 bp, Artificial Sequence
  Description of Artificial Sequence: Synthetic oligonucleotide
atgaatttgatggagacgaggagttctatgtggacc

SEQ ID NO: 56375 - DNA, 35 bp, Artificial Sequence
  Description of Artificial Sequence: Synthetic oligonucleotide
tgaatttgatggagacgaggagttctatgtggacc

SEQ ID NO: 56376 - DNA, 34 bp, Artificial Sequence
  Description of Artificial Sequence: Synthetic oligonucleotide
gaatttgatggagacgaggagttctatgtggacc

SEQ ID NO: 56377 - DNA, 35 bp, Artificial Sequence
  Description of Artificial Sequence: Synthetic oligonucleotide
aatttgatggagacgaggagttctatgtggacctg

SEQ ID NO: 56378 - DNA, 34 bp, Artificial Sequence
  Description of Artificial Sequence: Synthetic oligonucleotide
atttgatggagacgaggagttctatgtggacctg

SEQ ID NO: 56379 - DNA, 33 bp, Artificial Sequence
  Description of Artificial Sequence: Synthetic oligonucleotide
tttgatggagacgaggagttctatgtggacctg

SEQ ID NO: 56380 - DNA, 32 bp, Artificial Sequence
  Description of Artificial Sequence: Synthetic oligonucleotide
ttgatggagacgaggagttctatgtggacctg

SEQ ID NO: 56381 - DNA, 31 bp, Artificial Sequence
  Description of Artificial Sequence: Synthetic oligonucleotide
tgatggagacgaggagttctatgtggacctg

SEQ ID NO: 56382 - DNA, 30 bp, Artificial Sequence
  Description of Artificial Sequence: Synthetic oligonucleotide
gatggagacgaggagttctatgtggacctg

SEQ ID NO: 56383 - DNA, 30 bp, Artificial Sequence
  Description of Artificial Sequence: Synthetic oligonucleotide
atggagacgaggagttctatgtggacctgg

SEQ ID NO: 56384 - DNA, 29 bp, Artificial Sequence
  Description of Artificial Sequence: Synthetic oligonucleotide
tggagacgaggagttctatgtggacctgg

SEQ ID NO: 56385 - DNA, 28 bp, Artificial Sequence
  Description of Artificial Sequence: Synthetic oligonucleotide
ggagacgaggagttctatgtggacctgg

SEQ ID NO: 56386 - DNA, 29 bp, Artificial Sequence
  Description of Artificial Sequence: Synthetic oligonucleotide
gagacgaggagttctatgtggacctggag

SEQ ID NO: 56387 - DNA, 30 bp, Artificial Sequence
  Description of Artificial Sequence: Synthetic oligonucleotide
agacgaggagttctatgtggacctggagag

SEQ ID NO: 56388 - DNA, 29 bp, Artificial Sequence
  Description of Artificial Sequence: Synthetic oligonucleotide
gacgaggagttctatgtggacctggagag

SEQ ID NO: 56389 - DNA, 29 bp, Artificial Sequence
  Description of Artificial Sequence: Synthetic oligonucleotide
acgaggagttctatgtggacctggagagg

SEQ ID NO: 56390 - DNA, 28 bp, Artificial Sequence
  Description of Artificial Sequence: Synthetic oligonucleotide
cgaggagttctatgtggacctggagagg

SEQ ID NO: 56391 - DNA, 30 bp, Artificial Sequence
  Description of Artificial Sequence: Synthetic oligonucleotide
gaggagttctatgtggacctggagaggaag

SEQ ID NO: 56392 - DNA, 30 bp, Artificial Sequence
  Description of Artificial Sequence: Synthetic oligonucleotide
aggagttctatgtggacctggagaggaagg

SEQ ID NO: 56393 - DNA, 29 bp, Artificial Sequence
  Description of Artificial Sequence: Synthetic oligonucleotide
ggagttctatgtggacctggagaggaagg

SEQ ID NO: 56394 - DNA, 30 bp, Artificial Sequence
  Description of Artificial Sequence: Synthetic oligonucleotide
gagttctatgtggacctggagaggaaggag

SEQ ID NO: 56395 - DNA, 31 bp, Artificial Sequence
  Description of Artificial Sequence: Synthetic oligonucleotide
agttctatgtggacctggagaggaaggagac

SEQ ID NO: 56396 - DNA, 30 bp, Artificial Sequence
  Description of Artificial Sequence: Synthetic oligonucleotide
gttctatgtggacctggagaggaaggagac

SEQ ID NO: 56397 - DNA, 31 bp, Artificial Sequence
  Description of Artificial Sequence: Synthetic oligonucleotide
ttctatgtggacctggagaggaaggagactg

SEQ ID NO: 56398 - DNA, 30 bp, Artificial Sequence
  Description of Artificial Sequence: Synthetic oligonucleotide
tctatgtggacctggagaggaaggagactg

SEQ ID NO: 56399 - DNA, 29 bp, Artificial Sequence
  Description of Artificial Sequence: Synthetic oligonucleotide
ctatgtggacctggagaggaaggagactg

SEQ ID NO: 56400 - DNA, 30 bp, Artificial Sequence
  Description of Artificial Sequence: Synthetic oligonucleotide
tatgtggacctggagaggaaggagactgtc

SEQ ID NO: 56401 - DNA, 29 bp, Artificial Sequence
  Description of Artificial Sequence: Synthetic oligonucleotide
atgtggacctggagaggaaggagactgtc

SEQ ID NO: 56402 - DNA, 28 bp, Artificial Sequence
  Description of Artificial Sequence: Synthetic oligonucleotide
tgtggacctggagaggaaggagactgtc

SEQ ID NO: 56403 - DNA, 27 bp, Artificial Sequence
  Description of Artificial Sequence: Synthetic oligonucleotide
gtggacctggagaggaaggagactgtc

SEQ ID NO: 56404 - DNA, 28 bp, Artificial Sequence
  Description of Artificial Sequence: Synthetic oligonucleotide
tggacctggagaggaaggagactgtctg

SEQ ID NO: 56405 - DNA, 27 bp, Artificial Sequence
  Description of Artificial Sequence: Synthetic oligonucleotide
ggacctggagaggaaggagactgtctg

SEQ ID NO: 56406 - DNA, 27 bp, Artificial Sequence
  Description of Artificial Sequence: Synthetic oligonucleotide
gacctggagaggaaggagactgtctgg

SEQ ID NO: 56407 - DNA, 29 bp, Artificial Sequence
  Description of Artificial Sequence: Synthetic oligonucleotide
acctggagaggaaggagactgtctggaag

SEQ ID NO: 56408 - DNA, 28 bp, Artificial Sequence
  Description of Artificial Sequence: Synthetic oligonucleotide
cctggagaggaaggagactgtctggaag

SEQ ID NO: 56409 - DNA, 30 bp, Artificial Sequence
  Description of Artificial Sequence: Synthetic oligonucleotide
ctggagaggaaggagactgtctggaagttg

SEQ ID NO: 56410 - DNA, 30 bp, Artificial Sequence
  Description of Artificial Sequence: Synthetic oligonucleotide
tggagaggaaggagactgtctggaagttgc

SEQ ID NO: 56411 - DNA, 29 bp, Artificial Sequence
  Description of Artificial Sequence: Synthetic oligonucleotide
ggagaggaaggagactgtctggaagttgc

SEQ ID NO: 56412 - DNA, 29 bp, Artificial Sequence
  Description of Artificial Sequence: Synthetic oligonucleotide
gagaggaaggagactgtctggaagttgcc

SEQ ID NO: 56413 - DNA, 30 bp, Artificial Sequence
  Description of Artificial Sequence: Synthetic oligonucleotide
agaggaaggagactgtctggaagttgcctc

SEQ ID NO: 56414 - DNA, 29 bp, Artificial Sequence
  Description of Artificial Sequence: Synthetic oligonucleotide
gaggaaggagactgtctggaagttgcctc

SEQ ID NO: 56415 - DNA, 30 bp, Artificial Sequence
  Description of Artificial Sequence: Synthetic oligonucleotide
aggaaggagactgtctggaagttgcctctg

SEQ ID NO: 56416 - DNA, 29 bp, Artificial Sequence
  Description of Artificial Sequence: Synthetic oligonucleotide
ggaaggagactgtctggaagttgcctctg

SEQ ID NO: 56417 - DNA, 31 bp, Artificial Sequence
  Description of Artificial Sequence: Synthetic oligonucleotide
gaaggagactgtctggaagttgcctctgttc

SEQ ID NO: 56418 - DNA, 31 bp, Artificial Sequence
  Description of Artificial Sequence: Synthetic oligonucleotide
aaggagactgtctggaagttgcctctgttcc

SEQ ID NO: 56419 - DNA, 30 bp, Artificial Sequence
  Description of Artificial Sequence: Synthetic oligonucleotide
aggagactgtctggaagttgcctctgttcc

SEQ ID NO: 56420 - DNA, 29 bp, Artificial Sequence
  Description of Artificial Sequence: Synthetic oligonucleotide
ggagactgtctggaagttgcctctgttcc

SEQ ID NO: 56421 - DNA, 30 bp, Artificial Sequence
  Description of Artificial Sequence: Synthetic oligonucleotide
gagactgtctggaagttgcctctgttccac

SEQ ID NO: 56422 - DNA, 31 bp, Artificial Sequence
  Description of Artificial Sequence: Synthetic oligonucleotide
agactgtctggaagttgcctctgttccacag

SEQ ID NO: 56423 - DNA, 30 bp, Artificial Sequence
  Description of Artificial Sequence: Synthetic oligonucleotide
gactgtctggaagttgcctctgttccacag

SEQ ID NO: 56424 - DNA, 31 bp, Artificial Sequence
  Description of Artificial Sequence: Synthetic oligonucleotide
actgtctggaagttgcctctgttccacagac

SEQ ID NO: 56425 - DNA, 30 bp, Artificial Sequence
  Description of Artificial Sequence: Synthetic oligonucleotide
ctgtctggaagttgcctctgttccacagac

SEQ ID NO: 56426 - DNA, 33 bp, Artificial Sequence
  Description of Artificial Sequence: Synthetic oligonucleotide
tgtctggaagttgcctctgttccacagacttag

SEQ ID NO: 56427 - DNA, 32 bp, Artificial Sequence
  Description of Artificial Sequence: Synthetic oligonucleotide
gtctggaagttgcctctgttccacagacttag

SEQ ID NO: 56428 - DNA, 36 bp, Artificial Sequence
  Description of Artificial Sequence: Synthetic oligonucleotide
tctggaagttgcctctgttccacagacttagatttg

SEQ ID NO: 56429 - DNA, 35 bp, Artificial Sequence
  Description of Artificial Sequence: Synthetic oligonucleotide
ctggaagttgcctctgttccacagacttagatttg

SEQ ID NO: 56430 - DNA, 36 bp, Artificial Sequence
  Description of Artificial Sequence: Synthetic oligonucleotide
tggaagttgcctctgttccacagacttagatttgac

SEQ ID NO: 56431 - DNA, 35 bp, Artificial Sequence
  Description of Artificial Sequence: Synthetic oligonucleotide
ggaagttgcctctgttccacagacttagatttgac

SEQ ID NO: 56432 - DNA, 35 bp, Artificial Sequence
  Description of Artificial Sequence: Synthetic oligonucleotide
gaagttgcctctgttccacagacttagatttgacc

SEQ ID NO: 56433 - DNA, 35 bp, Artificial Sequence
  Description of Artificial Sequence: Synthetic oligonucleotide
aagttgcctctgttccacagacttagatttgaccc

SEQ ID NO: 56434 - DNA, 34 bp, Artificial Sequence
  Description of Artificial Sequence: Synthetic oligonucleotide
agttgcctctgttccacagacttagatttgaccc

SEQ ID NO: 56435 - DNA, 33 bp, Artificial Sequence
  Description of Artificial Sequence: Synthetic oligonucleotide
gttgcctctgttccacagacttagatttgaccc

SEQ ID NO: 56436 - DNA, 33 bp, Artificial Sequence
  Description of Artificial Sequence: Synthetic oligonucleotide
ttgcctctgttccacagacttagatttgacccg

SEQ ID NO: 56437 - DNA, 32 bp, Artificial Sequence
  Description of Artificial Sequence: Synthetic oligonucleotide
tgcctctgttccacagacttagatttgacccg

SEQ ID NO: 56438 - DNA, 31 bp, Artificial Sequence
  Description of Artificial Sequence: Synthetic oligonucleotide
gcctctgttccacagacttagatttgacccg

SEQ ID NO: 56439 - DNA, 31 bp, Artificial Sequence
  Description of Artificial Sequence: Synthetic oligonucleotide
cctctgttccacagacttagatttgacccgc

SEQ ID NO: 56440 - DNA, 36 bp, Artificial Sequence
  Description of Artificial Sequence: Synthetic oligonucleotide
ctctgttccacagacttagatttgacccgcaatttg

SEQ ID NO: 56441 - DNA, 36 bp, Artificial Sequence
  Description of Artificial Sequence: Synthetic oligonucleotide
tctgttccacagacttagatttgacccgcaatttgc

SEQ ID NO: 56442 - DNA, 35 bp, Artificial Sequence
  Description of Artificial Sequence: Synthetic oligonucleotide
ctgttccacagacttagatttgacccgcaatttgc

SEQ ID NO: 56443 - DNA, 36 bp, Artificial Sequence
  Description of Artificial Sequence: Synthetic oligonucleotide
tgttccacagacttagatttgacccgcaatttgcac

SEQ ID NO: 56444 - DNA, 35 bp, Artificial Sequence
  Description of Artificial Sequence: Synthetic oligonucleotide
gttccacagacttagatttgacccgcaatttgcac

SEQ ID NO: 56445 - DNA, 36 bp, Artificial Sequence
  Description of Artificial Sequence: Synthetic oligonucleotide
ttccacagacttagatttgacccgcaatttgcactg

SEQ ID NO: 56446 - DNA, 35 bp, Artificial Sequence
  Description of Artificial Sequence: Synthetic oligonucleotide
tccacagacttagatttgacccgcaatttgcactg

SEQ ID NO: 56447 - DNA, 34 bp, Artificial Sequence
  Description of Artificial Sequence: Synthetic oligonucleotide
ccacagacttagatttgacccgcaatttgcactg

SEQ ID NO: 56448 - DNA, 35 bp, Artificial Sequence
  Description of Artificial Sequence: Synthetic oligonucleotide
cacagacttagatttgacccgcaatttgcactgac

SEQ ID NO: 56449 - DNA, 38 bp, Artificial Sequence
  Description of Artificial Sequence: Synthetic oligonucleotide
acagacttagatttgacccgcaatttgcactgacaaac

SEQ ID NO: 56450 - DNA, 37 bp, Artificial Sequence
  Description of Artificial Sequence: Synthetic oligonucleotide
cagacttagatttgacccgcaatttgcactgacaaac

SEQ ID NO: 56451 - DNA, 39 bp, Artificial Sequence
  Description of Artificial Sequence: Synthetic oligonucleotide
agacttagatttgacccgcaatttgcactgacaaacatc

SEQ ID NO: 56452 - DNA, 38 bp, Artificial Sequence
  Description of Artificial Sequence: Synthetic oligonucleotide
gacttagatttgacccgcaatttgcactgacaaacatc

SEQ ID NO: 56453 - DNA, 38 bp, Artificial Sequence
  Description of Artificial Sequence: Synthetic oligonucleotide
acttagatttgacccgcaatttgcactgacaaacatcg

SEQ ID NO: 56454 - DNA, 37 bp, Artificial Sequence
  Description of Artificial Sequence: Synthetic oligonucleotide
cttagatttgacccgcaatttgcactgacaaacatcg

SEQ ID NO: 56455 - DNA, 37 bp, Artificial Sequence
  Description of Artificial Sequence: Synthetic oligonucleotide
ttagatttgacccgcaatttgcactgacaaacatcgc

SEQ ID NO: 56456 - DNA, 36 bp, Artificial Sequence
  Description of Artificial Sequence: Synthetic oligonucleotide
tagatttgacccgcaatttgcactgacaaacatcgc

SEQ ID NO: 56457 - DNA, 35 bp, Artificial Sequence
  Description of Artificial Sequence: Synthetic oligonucleotide
agatttgacccgcaatttgcactgacaaacatcgc

SEQ ID NO: 56458 - DNA, 34 bp, Artificial Sequence
  Description of Artificial Sequence: Synthetic oligonucleotide
gatttgacccgcaatttgcactgacaaacatcgc

SEQ ID NO: 56459 - DNA, 35 bp, Artificial Sequence
  Description of Artificial Sequence: Synthetic oligonucleotide
atttgacccgcaatttgcactgacaaacatcgctg

SEQ ID NO: 56460 - DNA, 34 bp, Artificial Sequence
  Description of Artificial Sequence: Synthetic oligonucleotide
tttgacccgcaatttgcactgacaaacatcgctg

SEQ ID NO: 56461 - DNA, 33 bp, Artificial Sequence
  Description of Artificial Sequence: Synthetic oligonucleotide
ttgacccgcaatttgcactgacaaacatcgctg

SEQ ID NO: 56462 - DNA, 32 bp, Artificial Sequence
  Description of Artificial Sequence: Synthetic oligonucleotide
tgacccgcaatttgcactgacaaacatcgctg

SEQ ID NO: 56463 - DNA, 31 bp, Artificial Sequence
  Description of Artificial Sequence: Synthetic oligonucleotide
gacccgcaatttgcactgacaaacatcgctg

SEQ ID NO: 56464 - DNA, 32 bp, Artificial Sequence
  Description of Artificial Sequence: Synthetic oligonucleotide
acccgcaatttgcactgacaaacatcgctgtg

SEQ ID NO: 56465 - DNA, 31 bp, Artificial Sequence
  Description of Artificial Sequence: Synthetic oligonucleotide
cccgcaatttgcactgacaaacatcgctgtg

SEQ ID NO: 56466 - DNA, 31 bp, Artificial Sequence
  Description of Artificial Sequence: Synthetic oligonucleotide
ccgcaatttgcactgacaaacatcgctgtgc

SEQ ID NO: 56467 - DNA, 36 bp, Artificial Sequence
  Description of Artificial Sequence: Synthetic oligonucleotide
cgcaatttgcactgacaaacatcgctgtgctaaaac

SEQ ID NO: 56468 - DNA, 40 bp, Artificial Sequence
  Description of Artificial Sequence: Synthetic oligonucleotide
gcaatttgcactgacaaacatcgctgtgctaaaacataac

SEQ ID NO: 56469 - DNA, 42 bp, Artificial Sequence
  Description of Artificial Sequence: Synthetic oligonucleotide
caatttgcactgacaaacatcgctgtgctaaaacataacttg

SEQ ID NO: 56470 - DNA, 44 bp, Artificial Sequence
  Description of Artificial Sequence: Synthetic oligonucleotide
aatttgcactgacaaacatcgctgtgctaaaacataacttgaac

SEQ ID NO: 56471 - DNA, 43 bp, Artificial Sequence
  Description of Artificial Sequence: Synthetic oligonucleotide
atttgcactgacaaacatcgctgtgctaaaacataacttgaac

SEQ ID NO: 56472 - DNA, 42 bp, Artificial Sequence
  Description of Artificial Sequence: Synthetic oligonucleotide
tttgcactgacaaacatcgctgtgctaaaacataacttgaac

SEQ ID NO: 56473 - DNA, 41 bp, Artificial Sequence
  Description of Artificial Sequence: Synthetic oligonucleotide
ttgcactgacaaacatcgctgtgctaaaacataacttgaac

SEQ ID NO: 56474 - DNA, 40 bp, Artificial Sequence
  Description of Artificial Sequence: Synthetic oligonucleotide
tgcactgacaaacatcgctgtgctaaaacataacttgaac

SEQ ID NO: 56475 - DNA, 39 bp, Artificial Sequence
  Description of Artificial Sequence: Synthetic oligonucleotide
gcactgacaaacatcgctgtgctaaaacataacttgaac

SEQ ID NO: 56476 - DNA, 41 bp, Artificial Sequence
  Description of Artificial Sequence: Synthetic oligonucleotide
cactgacaaacatcgctgtgctaaaacataacttgaacatc

SEQ ID NO: 56477 - DNA, 41 bp, Artificial Sequence
  Description of Artificial Sequence: Synthetic oligonucleotide
actgacaaacatcgctgtgctaaaacataacttgaacatcc

SEQ ID NO: 56478 - DNA, 40 bp, Artificial Sequence
  Description of Artificial Sequence: Synthetic oligonucleotide
ctgacaaacatcgctgtgctaaaacataacttgaacatcc

SEQ ID NO: 56479 - DNA, 41 bp, Artificial Sequence
  Description of Artificial Sequence: Synthetic oligonucleotide
tgacaaacatcgctgtgctaaaacataacttgaacatcctg

SEQ ID NO: 56480 - DNA, 40 bp, Artificial Sequence
  Description of Artificial Sequence: Synthetic oligonucleotide
gacaaacatcgctgtgctaaaacataacttgaacatcctg

SEQ ID NO: 56481 - DNA, 46 bp, Artificial Sequence
  Description of Artificial Sequence: Synthetic oligonucleotide
acaaacatcgctgtgctaaaacataacttgaacatcctgattaaac

SEQ ID NO: 56482 - DNA, 45 bp, Artificial Sequence
  Description of Artificial Sequence: Synthetic oligonucleotide
caaacatcgctgtgctaaaacataacttgaacatcctgattaaac

SEQ ID NO: 56483 - DNA, 45 bp, Artificial Sequence
  Description of Artificial Sequence: Synthetic oligonucleotide
aaacatcgctgtgctaaaacataacttgaacatcctgattaaacg

SEQ ID NO: 56484 - DNA, 44 bp, Artificial Sequence
  Description of Artificial Sequence: Synthetic oligonucleotide
aacatcgctgtgctaaaacataacttgaacatcctgattaaacg

SEQ ID NO: 56485 - DNA, 43 bp, Artificial Sequence
  Description of Artificial Sequence: Synthetic oligonucleotide
acatcgctgtgctaaaacataacttgaacatcctgattaaacg

SEQ ID NO: 56486 - DNA, 42 bp, Artificial Sequence
  Description of Artificial Sequence: Synthetic oligonucleotide
catcgctgtgctaaaacataacttgaacatcctgattaaacg

SEQ ID NO: 56487 - DNA, 42 bp, Artificial Sequence
  Description of Artificial Sequence: Synthetic oligonucleotide
atcgctgtgctaaaacataacttgaacatcctgattaaacgc

SEQ ID NO: 56488 - DNA, 41 bp, Artificial Sequence
  Description of Artificial Sequence: Synthetic oligonucleotide
tcgctgtgctaaaacataacttgaacatcctgattaaacgc

SEQ ID NO: 56489 - DNA, 40 bp, Artificial Sequence
  Description of Artificial Sequence: Synthetic oligonucleotide
cgctgtgctaaaacataacttgaacatcctgattaaacgc

SEQ ID NO: 56490 - DNA, 41 bp, Artificial Sequence
  Description of Artificial Sequence: Synthetic oligonucleotide
gctgtgctaaaacataacttgaacatcctgattaaacgctc

SEQ ID NO: 56491 - DNA, 41 bp, Artificial Sequence
  Description of Artificial Sequence: Synthetic oligonucleotide
ctgtgctaaaacataacttgaacatcctgattaaacgctcc

SEQ ID NO: 56492 - DNA, 43 bp, Artificial Sequence
  Description of Artificial Sequence: Synthetic oligonucleotide
tgtgctaaaacataacttgaacatcctgattaaacgctccaac

SEQ ID NO: 56493 - DNA, 42 bp, Artificial Sequence
  Description of Artificial Sequence: Synthetic oligonucleotide
gtgctaaaacataacttgaacatcctgattaaacgctccaac

SEQ ID NO: 56494 - DNA, 43 bp, Artificial Sequence
  Description of Artificial Sequence: Synthetic oligonucleotide
tgctaaaacataacttgaacatcctgattaaacgctccaactc

SEQ ID NO: 56495 - DNA, 42 bp, Artificial Sequence
  Description of Artificial Sequence: Synthetic oligonucleotide
gctaaaacataacttgaacatcctgattaaacgctccaactc

SEQ ID NO: 56496 - DNA, 44 bp, Artificial Sequence
  Description of Artificial Sequence: Synthetic oligonucleotide
ctaaaacataacttgaacatcctgattaaacgctccaactctac

SEQ ID NO: 56497 - DNA, 44 bp, Artificial Sequence
  Description of Artificial Sequence: Synthetic oligonucleotide
taaaacataacttgaacatcctgattaaacgctccaactctacc

SEQ ID NO: 56498 - DNA, 43 bp, Artificial Sequence
  Description of Artificial Sequence: Synthetic oligonucleotide
aaaacataacttgaacatcctgattaaacgctccaactctacc

SEQ ID NO: 56499 - DNA, 42 bp, Artificial Sequence
  Description of Artificial Sequence: Synthetic oligonucleotide
aaacataacttgaacatcctgattaaacgctccaactctacc

SEQ ID NO: 56500 - DNA, 41 bp, Artificial Sequence
  Description of Artificial Sequence: Synthetic oligonucleotide
aacataacttgaacatcctgattaaacgctccaactctacc

SEQ ID NO: 56501 - DNA, 40 bp, Artificial Sequence
  Description of Artificial Sequence: Synthetic oligonucleotide
acataacttgaacatcctgattaaacgctccaactctacc

SEQ ID NO: 56502 - DNA, 39 bp, Artificial Sequence
  Description of Artificial Sequence: Synthetic oligonucleotide
cataacttgaacatcctgattaaacgctccaactctacc

SEQ ID NO: 56503 - DNA, 39 bp, Artificial Sequence
  Description of Artificial Sequence: Synthetic oligonucleotide
ataacttgaacatcctgattaaacgctccaactctaccg

SEQ ID NO: 56504 - DNA, 38 bp, Artificial Sequence
  Description of Artificial Sequence: Synthetic oligonucleotide
taacttgaacatcctgattaaacgctccaactctaccg

SEQ ID NO: 56505 - DNA, 37 bp, Artificial Sequence
  Description of Artificial Sequence: Synthetic oligonucleotide
aacttgaacatcctgattaaacgctccaactctaccg

SEQ ID NO: 56506 - DNA, 36 bp, Artificial Sequence
  Description of Artificial Sequence: Synthetic oligonucleotide
acttgaacatcctgattaaacgctccaactctaccg

SEQ ID NO: 56507 - DNA, 35 bp, Artificial Sequence
  Description of Artificial Sequence: Synthetic oligonucleotide
cttgaacatcctgattaaacgctccaactctaccg

SEQ ID NO: 56508 - DNA, 35 bp, Artificial Sequence
  Description of Artificial Sequence: Synthetic oligonucleotide
ttgaacatcctgattaaacgctccaactctaccgc

SEQ ID NO: 56509 - DNA, 34 bp, Artificial Sequence
  Description of Artificial Sequence: Synthetic oligonucleotide
tgaacatcctgattaaacgctccaactctaccgc

SEQ ID NO: 56510 - DNA, 33 bp, Artificial Sequence
  Description of Artificial Sequence: Synthetic oligonucleotide
gaacatcctgattaaacgctccaactctaccgc

SEQ ID NO: 56511 - DNA, 34 bp, Artificial Sequence
  Description of Artificial Sequence: Synthetic oligonucleotide
aacatcctgattaaacgctccaactctaccgctg

SEQ ID NO: 56512 - DNA, 33 bp, Artificial Sequence
  Description of Artificial Sequence: Synthetic oligonucleotide
acatcctgattaaacgctccaactctaccgctg

SEQ ID NO: 56513 - DNA, 32 bp, Artificial Sequence
  Description of Artificial Sequence: Synthetic oligonucleotide
catcctgattaaacgctccaactctaccgctg

SEQ ID NO: 56514 - DNA, 32 bp, Artificial Sequence
  Description of Artificial Sequence: Synthetic oligonucleotide
atcctgattaaacgctccaactctaccgctgc

SEQ ID NO: 56515 - DNA, 31 bp, Artificial Sequence
  Description of Artificial Sequence: Synthetic oligonucleotide
tcctgattaaacgctccaactctaccgctgc

SEQ ID NO: 56516 - DNA, 30 bp, Artificial Sequence
  Description of Artificial Sequence: Synthetic oligonucleotide
cctgattaaacgctccaactctaccgctgc

SEQ ID NO: 56517 - DNA, 32 bp, Artificial Sequence
  Description of Artificial Sequence: Synthetic oligonucleotide
ctgattaaacgctccaactctaccgctgctac

SEQ ID NO: 56518 - DNA, 32 bp, Artificial Sequence
  Description of Artificial Sequence: Synthetic oligonucleotide
tgattaaacgctccaactctaccgctgctacc

SEQ ID NO: 56519 - DNA, 31 bp, Artificial Sequence
  Description of Artificial Sequence: Synthetic oligonucleotide
gattaaacgctccaactctaccgctgctacc

SEQ ID NO: 56520 - DNA, 34 bp, Artificial Sequence
  Description of Artificial Sequence: Synthetic oligonucleotide
attaaacgctccaactctaccgctgctaccaatg

SEQ ID NO: 56521 - DNA, 33 bp, Artificial Sequence
  Description of Artificial Sequence: Synthetic oligonucleotide
ttaaacgctccaactctaccgctgctaccaatg

SEQ ID NO: 56522 - DNA, 32 bp, Artificial Sequence
  Description of Artificial Sequence: Synthetic oligonucleotide
taaacgctccaactctaccgctgctaccaatg

SEQ ID NO: 56523 - DNA, 31 bp, Artificial Sequence
  Description of Artificial Sequence: Synthetic oligonucleotide
aaacgctccaactctaccgctgctaccaatg

SEQ ID NO: 56524 - DNA, 30 bp, Artificial Sequence
  Description of Artificial Sequence: Synthetic oligonucleotide
aacgctccaactctaccgctgctaccaatg

SEQ ID NO: 56525 - DNA, 29 bp, Artificial Sequence
  Description of Artificial Sequence: Synthetic oligonucleotide
acgctccaactctaccgctgctaccaatg

SEQ ID NO: 56526 - DNA, 28 bp, Artificial Sequence
  Description of Artificial Sequence: Synthetic oligonucleotide
cgctccaactctaccgctgctaccaatg

SEQ ID NO: 56527 - DNA, 29 bp, Artificial Sequence
  Description of Artificial Sequence: Synthetic oligonucleotide
gctccaactctaccgctgctaccaatgag

SEQ ID NO: 56528 - DNA, 29 bp, Artificial Sequence
  Description of Artificial Sequence: Synthetic oligonucleotide
ctccaactctaccgctgctaccaatgagg

SEQ ID NO: 56529 - DNA, 31 bp, Artificial Sequence
  Description of Artificial Sequence: Synthetic oligonucleotide
tccaactctaccgctgctaccaatgaggttc

SEQ ID NO: 56530 - DNA, 30 bp, Artificial Sequence
  Description of Artificial Sequence: Synthetic oligonucleotide
ccaactctaccgctgctaccaatgaggttc

SEQ ID NO: 56531 - DNA, 29 bp, Artificial Sequence
  Description of Artificial Sequence: Synthetic oligonucleotide
tcaacatcacctggctgagcaatgggcac

SEQ ID NO: 56532 - DNA, 28 bp, Artificial Sequence
  Description of Artificial Sequence: Synthetic oligonucleotide
caacatcacctggctgagcaatgggcac

SEQ ID NO: 56533 - DNA, 29 bp, Artificial Sequence
  Description of Artificial Sequence: Synthetic oligonucleotide
aacatcacctggctgagcaatgggcactc

SEQ ID NO: 56534 - DNA, 28 bp, Artificial Sequence
  Description of Artificial Sequence: Synthetic oligonucleotide
acatcacctggctgagcaatgggcactc

SEQ ID NO: 56535 - DNA, 27 bp, Artificial Sequence
  Description of Artificial Sequence: Synthetic oligonucleotide
catcacctggctgagcaatgggcactc

SEQ ID NO: 56536 - DNA, 28 bp, Artificial Sequence
  Description of Artificial Sequence: Synthetic oligonucleotide
atcacctggctgagcaatgggcactcag

SEQ ID NO: 56537 - DNA, 27 bp, Artificial Sequence
  Description of Artificial Sequence: Synthetic oligonucleotide
tcacctggctgagcaatgggcactcag

SEQ ID NO: 56538 - DNA, 27 bp, Artificial Sequence
  Description of Artificial Sequence: Synthetic oligonucleotide
cacctggctgagcaatgggcactcagt

SEQ ID NO: 56539 - DNA, 27 bp, Artificial Sequence
  Description of Artificial Sequence: Synthetic oligonucleotide
acctggctgagcaatgggcactcagtc

SEQ ID NO: 56540 - DNA, 27 bp, Artificial Sequence
  Description of Artificial Sequence: Synthetic oligonucleotide
cctggctgagcaatgggcactcagtca

SEQ ID NO: 56541 - DNA, 27 bp, Artificial Sequence
  Description of Artificial Sequence: Synthetic oligonucleotide
ctggctgagcaatgggcactcagtcac

SEQ ID NO: 56542 - DNA, 28 bp, Artificial Sequence
  Description of Artificial Sequence: Synthetic oligonucleotide
tggctgagcaatgggcactcagtcacag

SEQ ID NO: 56543 - DNA, 27 bp, Artificial Sequence
  Description of Artificial Sequence: Synthetic oligonucleotide
ggctgagcaatgggcactcagtcacag

SEQ ID NO: 56544 - DNA, 29 bp, Artificial Sequence
  Description of Artificial Sequence: Synthetic oligonucleotide
gctgagcaatgggcactcagtcacagaag

SEQ ID NO: 56545 - DNA, 29 bp, Artificial Sequence
  Description of Artificial Sequence: Synthetic oligonucleotide
ctgagcaatgggcactcagtcacagaagg

SEQ ID NO: 56546 - DNA, 30 bp, Artificial Sequence
  Description of Artificial Sequence: Synthetic oligonucleotide
tgagcaatgggcactcagtcacagaaggtg

SEQ ID NO: 56547 - DNA, 29 bp, Artificial Sequence
  Description of Artificial Sequence: Synthetic oligonucleotide
gagcaatgggcactcagtcacagaaggtg

SEQ ID NO: 56548 - DNA, 32 bp, Artificial Sequence
  Description of Artificial Sequence: Synthetic oligonucleotide
agcaatgggcactcagtcacagaaggtgtttc

SEQ ID NO: 56549 - DNA, 31 bp, Artificial Sequence
  Description of Artificial Sequence: Synthetic oligonucleotide
gcaatgggcactcagtcacagaaggtgtttc

SEQ ID NO: 56550 - DNA, 32 bp, Artificial Sequence
  Description of Artificial Sequence: Synthetic oligonucleotide
caatgggcactcagtcacagaaggtgtttctg

SEQ ID NO: 56551 - DNA, 33 bp, Artificial Sequence
  Description of Artificial Sequence: Synthetic oligonucleotide
aatgggcactcagtcacagaaggtgtttctgag

SEQ ID NO: 56552 - DNA, 32 bp, Artificial Sequence
  Description of Artificial Sequence: Synthetic oligonucleotide
atgggcactcagtcacagaaggtgtttctgag

SEQ ID NO: 56553 - DNA, 31 bp, Artificial Sequence
  Description of Artificial Sequence: Synthetic oligonucleotide
tgggcactcagtcacagaaggtgtttctgag

SEQ ID NO: 56554 - DNA, 30 bp, Artificial Sequence
  Description of Artificial Sequence: Synthetic oligonucleotide
gggcactcagtcacagaaggtgtttctgag

SEQ ID NO: 56555 - DNA, 31 bp, Artificial Sequence
  Description of Artificial Sequence: Synthetic oligonucleotide
ggcactcagtcacagaaggtgtttctgagac

SEQ ID NO: 56556 - DNA, 31 bp, Artificial Sequence
  Description of Artificial Sequence: Synthetic oligonucleotide
gcactcagtcacagaaggtgtttctgagacc

SEQ ID NO: 56557 - DNA, 32 bp, Artificial Sequence
  Description of Artificial Sequence: Synthetic oligonucleotide
cactcagtcacagaaggtgtttctgagaccag

SEQ ID NO: 56558 - DNA, 32 bp, Artificial Sequence
  Description of Artificial Sequence: Synthetic oligonucleotide
actcagtcacagaaggtgtttctgagaccagc

SEQ ID NO: 56559 - DNA, 31 bp, Artificial Sequence
  Description of Artificial Sequence: Synthetic oligonucleotide
ctcagtcacagaaggtgtttctgagaccagc

SEQ ID NO: 56560 - DNA, 25 bp, Artificial Sequence
  Description of Artificial Sequence: Synthetic oligonucleotide
caaggtggagcactggggcctggat

SEQ ID NO: 56561 - DNA, 26 bp, Artificial Sequence
  Description of Artificial Sequence: Synthetic oligonucleotide
aaggtggagcactggggcctggatga

SEQ ID NO: 56562 - DNA, 25 bp, Artificial Sequence
  Description of Artificial Sequence: Synthetic oligonucleotide
aggtggagcactggggcctggatga

SEQ ID NO: 56563 - DNA, 24 bp, Artificial Sequence
  Description of Artificial Sequence: Synthetic oligonucleotide
ggtggagcactggggcctggatga

SEQ ID NO: 56564 - DNA, 24 bp, Artificial Sequence
  Description of Artificial Sequence: Synthetic oligonucleotide
gtggagcactggggcctggatgag

SEQ ID NO: 56565 - DNA, 24 bp, Artificial Sequence
  Description of Artificial Sequence: Synthetic oligonucleotide
tggagcactggggcctggatgagc

SEQ ID NO: 56566 - DNA, 23 bp, Artificial Sequence
  Description of Artificial Sequence: Synthetic oligonucleotide
ggagcactggggcctggatgagc

SEQ ID NO: 56567 - DNA, 24 bp, Artificial Sequence
  Description of Artificial Sequence: Synthetic oligonucleotide
gagcactggggcctggatgagcct

SEQ ID NO: 56568 - DNA, 26 bp, Artificial Sequence
  Description of Artificial Sequence: Synthetic oligonucleotide
agcactggggcctggatgagcctctt

SEQ ID NO: 56569 - DNA, 25 bp, Artificial Sequence
  Description of Artificial Sequence: Synthetic oligonucleotide
gcactggggcctggatgagcctctt

SEQ ID NO: 56570 - DNA, 26 bp, Artificial Sequence
  Description of Artificial Sequence: Synthetic oligonucleotide
cactggggcctggatgagcctcttct

SEQ ID NO: 56571 - DNA, 27 bp, Artificial Sequence
  Description of Artificial Sequence: Synthetic oligonucleotide
actggggcctggatgagcctcttctga

SEQ ID NO: 56572 - DNA, 27 bp, Artificial Sequence
  Description of Artificial Sequence: Synthetic oligonucleotide
ctggggcctggatgagcctcttctgaa

SEQ ID NO: 56573 - DNA, 28 bp, Artificial Sequence
  Description of Artificial Sequence: Synthetic oligonucleotide
tggggcctggatgagcctcttctgaaac

SEQ ID NO: 56574 - DNA, 27 bp, Artificial Sequence
  Description of Artificial Sequence: Synthetic oligonucleotide
ggggcctggatgagcctcttctgaaac

SEQ ID NO: 56575 - DNA, 28 bp, Artificial Sequence
  Description of Artificial Sequence: Synthetic oligonucleotide
gggcctggatgagcctcttctgaaacac

SEQ ID NO: 56576 - DNA, 29 bp, Artificial Sequence
  Description of Artificial Sequence: Synthetic oligonucleotide
ggcctggatgagcctcttctgaaacactg

SEQ ID NO: 56577 - DNA, 29 bp, Artificial Sequence
  Description of Artificial Sequence: Synthetic oligonucleotide
gcctggatgagcctcttctgaaacactgg

SEQ ID NO: 56578 - DNA, 29 bp, Artificial Sequence
  Description of Artificial Sequence: Synthetic oligonucleotide
cctggatgagcctcttctgaaacactggg

SEQ ID NO: 56579 - DNA, 30 bp, Artificial Sequence
  Description of Artificial Sequence: Synthetic oligonucleotide
ctggatgagcctcttctgaaacactgggag

SEQ ID NO: 56580 - DNA, 30 bp, Artificial Sequence
  Description of Artificial Sequence: Synthetic oligonucleotide
tggatgagcctcttctgaaacactgggagc

SEQ ID NO: 56581 - DNA, 29 bp, Artificial Sequence
  Description of Artificial Sequence: Synthetic oligonucleotide
ggatgagcctcttctgaaacactgggagc

SEQ ID NO: 56582 - DNA, 29 bp, Artificial Sequence
  Description of Artificial Sequence: Synthetic oligonucleotide
gatgagcctcttctgaaacactgggagcc

SEQ ID NO: 56583 - DNA, 30 bp, Artificial Sequence
  Description of Artificial Sequence: Synthetic oligonucleotide
atgagcctcttctgaaacactgggagcctg

SEQ ID NO: 56584 - DNA, 29 bp, Artificial Sequence
  Description of Artificial Sequence: Synthetic oligonucleotide
tgagcctcttctgaaacactgggagcctg

SEQ ID NO: 56585 - DNA, 28 bp, Artificial Sequence
  Description of Artificial Sequence: Synthetic oligonucleotide
gagcctcttctgaaacactgggagcctg

SEQ ID NO: 56586 - DNA, 30 bp, Artificial Sequence
  Description of Artificial Sequence: Synthetic oligonucleotide
tgaaacactgggagcctgagattccagcac

SEQ ID NO: 56587 - DNA, 29 bp, Artificial Sequence
  Description of Artificial Sequence: Synthetic oligonucleotide
gaaacactgggagcctgagattccagcac

SEQ ID NO: 56588 - DNA, 29 bp, Artificial Sequence
  Description of Artificial Sequence: Synthetic oligonucleotide
aaacactgggagcctgagattccagcacc

SEQ ID NO: 56589 - DNA, 28 bp, Artificial Sequence
  Description of Artificial Sequence: Synthetic oligonucleotide
aacactgggagcctgagattccagcacc

SEQ ID NO: 56590 - DNA, 27 bp, Artificial Sequence
  Description of Artificial Sequence: Synthetic oligonucleotide
acactgggagcctgagattccagcacc

SEQ ID NO: 56591 - DNA, 27 bp, Artificial Sequence
  Description of Artificial Sequence: Synthetic oligonucleotide
cactgggagcctgagattccagcacct

SEQ ID NO: 56592 - DNA, 29 bp, Artificial Sequence
  Description of Artificial Sequence: Synthetic oligonucleotide
actgggagcctgagattccagcacctatg

SEQ ID NO: 56593 - DNA, 28 bp, Artificial Sequence
  Description of Artificial Sequence: Synthetic oligonucleotide
ctgggagcctgagattccagcacctatg

SEQ ID NO: 56594 - DNA, 29 bp, Artificial Sequence
  Description of Artificial Sequence: Synthetic oligonucleotide
tgggagcctgagattccagcacctatgtc

SEQ ID NO: 56595 - DNA, 28 bp, Artificial Sequence
  Description of Artificial Sequence: Synthetic oligonucleotide
gggagcctgagattccagcacctatgtc

SEQ ID NO: 56596 - DNA, 29 bp, Artificial Sequence
  Description of Artificial Sequence: Synthetic oligonucleotide
ggagcctgagattccagcacctatgtcag

SEQ ID NO: 56597 - DNA, 30 bp, Artificial Sequence
  Description of Artificial Sequence: Synthetic oligonucleotide
gagcctgagattccagcacctatgtcagag

SEQ ID NO: 56598 - DNA, 30 bp, Artificial Sequence
  Description of Artificial Sequence: Synthetic oligonucleotide
agcctgagattccagcacctatgtcagagc

SEQ ID NO: 56599 - DNA, 29 bp, Artificial Sequence
  Description of Artificial Sequence: Synthetic oligonucleotide
gcctgagattccagcacctatgtcagagc

SEQ ID NO: 56600 - DNA, 30 bp, Artificial Sequence
  Description of Artificial Sequence: Synthetic oligonucleotide
cctgagattccagcacctatgtcagagctc

SEQ ID NO: 56601 - DNA, 31 bp, Artificial Sequence
  Description of Artificial Sequence: Synthetic oligonucleotide
ctgagattccagcacctatgtcagagctcac

SEQ ID NO: 56602 - DNA, 32 bp, Artificial Sequence
  Description of Artificial Sequence: Synthetic oligonucleotide
tgagattccagcacctatgtcagagctcacag

SEQ ID NO: 56603 - DNA, 31 bp, Artificial Sequence
  Description of Artificial Sequence: Synthetic oligonucleotide
gagattccagcacctatgtcagagctcacag

SEQ ID NO: 56604 - DNA, 32 bp, Artificial Sequence
  Description of Artificial Sequence: Synthetic oligonucleotide
agattccagcacctatgtcagagctcacagag

SEQ ID NO: 56605 - DNA, 31 bp, Artificial Sequence
  Description of Artificial Sequence: Synthetic oligonucleotide
gattccagcacctatgtcagagctcacagag

SEQ ID NO: 56606 - DNA, 32 bp, Artificial Sequence
  Description of Artificial Sequence: Synthetic oligonucleotide
attccagcacctatgtcagagctcacagagac

SEQ ID NO: 56607 - DNA, 31 bp, Artificial Sequence
  Description of Artificial Sequence: Synthetic oligonucleotide
ttccagcacctatgtcagagctcacagagac

SEQ ID NO: 56608 - DNA, 30 bp, Artificial Sequence
  Description of Artificial Sequence: Synthetic oligonucleotide
tccagcacctatgtcagagctcacagagac

SEQ ID NO: 56609 - DNA, 29 bp, Artificial Sequence
  Description of Artificial Sequence: Synthetic oligonucleotide
ccagcacctatgtcagagctcacagagac

SEQ ID NO: 56610 - DNA, 30 bp, Artificial Sequence
  Description of Artificial Sequence: Synthetic oligonucleotide
cagcacctatgtcagagctcacagagactg

SEQ ID NO: 56611 - DNA, 31 bp, Artificial Sequence
  Description of Artificial Sequence: Synthetic oligonucleotide
agcacctatgtcagagctcacagagactgtg

SEQ ID NO: 56612 - DNA, 30 bp, Artificial Sequence
  Description of Artificial Sequence: Synthetic oligonucleotide
gcacctatgtcagagctcacagagactgtg

SEQ ID NO: 56613 - DNA, 30 bp, Artificial Sequence
  Description of Artificial Sequence: Synthetic oligonucleotide
cacctatgtcagagctcacagagactgtgg

SEQ ID NO: 56614 - DNA, 31 bp, Artificial Sequence
  Description of Artificial Sequence: Synthetic oligonucleotide
acctatgtcagagctcacagagactgtggtc

SEQ ID NO: 56615 - DNA, 24 bp, Artificial Sequence
  Description of Artificial Sequence: Synthetic oligonucleotide
gcctcgtgggcattgtggtgggga

SEQ ID NO: 56616 - DNA, 24 bp, Artificial Sequence
  Description of Artificial Sequence: Synthetic oligonucleotide
cctcgtgggcattgtggtggggac

SEQ ID NO: 56617 - DNA, 24 bp, Artificial Sequence
  Description of Artificial Sequence: Synthetic oligonucleotide
ctcgtgggcattgtggtggggacc

SEQ ID NO: 56618 - DNA, 25 bp, Artificial Sequence
  Description of Artificial Sequence: Synthetic oligonucleotide
tcgtgggcattgtggtggggaccgt

SEQ ID NO: 56619 - DNA, 24 bp, Artificial Sequence
  Description of Artificial Sequence: Synthetic oligonucleotide
cgtgggcattgtggtggggaccgt

SEQ ID NO: 56620 - DNA, 26 bp, Artificial Sequence
  Description of Artificial Sequence: Synthetic oligonucleotide
gtgggcattgtggtggggaccgtctt

SEQ ID NO: 56621 - DNA, 27 bp, Artificial Sequence
  Description of Artificial Sequence: Synthetic oligonucleotide
tgggcattgtggtggggaccgtcttga

SEQ ID NO: 56622 - DNA, 27 bp, Artificial Sequence
  Description of Artificial Sequence: Synthetic oligonucleotide
gggcattgtggtggggaccgtcttgat

SEQ ID NO: 56623 - DNA, 27 bp, Artificial Sequence
  Description of Artificial Sequence: Synthetic oligonucleotide
ggcattgtggtggggaccgtcttgatc

SEQ ID NO: 56624 - DNA, 29 bp, Artificial Sequence
  Description of Artificial Sequence: Synthetic oligonucleotide
gcattgtggtggggaccgtcttgatcatc

SEQ ID NO: 56625 - DNA, 29 bp, Artificial Sequence
  Description of Artificial Sequence: Synthetic oligonucleotide
cattgtggtggggaccgtcttgatcatcc

SEQ ID NO: 56626 - DNA, 29 bp, Artificial Sequence
  Description of Artificial Sequence: Synthetic oligonucleotide
attgtggtggggaccgtcttgatcatccg

SEQ ID NO: 56627 - DNA, 28 bp, Artificial Sequence
  Description of Artificial Sequence: Synthetic oligonucleotide
ttgtggtggggaccgtcttgatcatccg

SEQ ID NO: 56628 - DNA, 27 bp, Artificial Sequence
  Description of Artificial Sequence: Synthetic oligonucleotide
tgtggtggggaccgtcttgatcatccg

SEQ ID NO: 56629 - DNA, 27 bp, Artificial Sequence
  Description of Artificial Sequence: Synthetic oligonucleotide
gtggtggggaccgtcttgatcatccga

SEQ ID NO: 56630 - DNA, 27 bp, Artificial Sequence
  Description of Artificial Sequence: Synthetic oligonucleotide
tggtggggaccgtcttgatcatccgag

SEQ ID NO: 56631 - DNA, 26 bp, Artificial Sequence
  Description of Artificial Sequence: Synthetic oligonucleotide
ggtggggaccgtcttgatcatccgag

SEQ ID NO: 56632 - DNA, 26 bp, Artificial Sequence
  Description of Artificial Sequence: Synthetic oligonucleotide
gtggggaccgtcttgatcatccgagg

SEQ ID NO: 56633 - DNA, 26 bp, Artificial Sequence
  Description of Artificial Sequence: Synthetic oligonucleotide
tggggaccgtcttgatcatccgaggc

SEQ ID NO: 56634 - DNA, 25 bp, Artificial Sequence
  Description of Artificial Sequence: Synthetic oligonucleotide
ggggaccgtcttgatcatccgaggc

SEQ ID NO: 56635 - DNA, 26 bp, Artificial Sequence
  Description of Artificial Sequence: Synthetic oligonucleotide
gggaccgtcttgatcatccgaggcct

SEQ ID NO: 56636 - DNA, 26 bp, Artificial Sequence
  Description of Artificial Sequence: Synthetic oligonucleotide
ggaccgtcttgatcatccgaggcctg

SEQ ID NO: 56637 - DNA, 26 bp, Artificial Sequence
  Description of Artificial Sequence: Synthetic oligonucleotide
gaccgtcttgatcatccgaggcctgc

SEQ ID NO: 56638 - DNA, 27 bp, Artificial Sequence
  Description of Artificial Sequence: Synthetic oligonucleotide
accgtcttgatcatccgaggcctgcgt

SEQ ID NO: 56639 - DNA, 27 bp, Artificial Sequence
  Description of Artificial Sequence: Synthetic oligonucleotide
ccgtcttgatcatccgaggcctgcgtt

SEQ ID NO: 56640 - DNA, 27 bp, Artificial Sequence
  Description of Artificial Sequence: Synthetic oligonucleotide
cgtcttgatcatccgaggcctgcgttc

SEQ ID NO: 56641 - DNA, 28 bp, Artificial Sequence
  Description of Artificial Sequence: Synthetic oligonucleotide
gtcttgatcatccgaggcctgcgttcag

SEQ ID NO: 56642 - DNA, 30 bp, Artificial Sequence
  Description of Artificial Sequence: Synthetic oligonucleotide
tcttgatcatccgaggcctgcgttcagttg

SEQ ID NO: 56643 - DNA, 29 bp, Artificial Sequence
  Description of Artificial Sequence: Synthetic oligonucleotide
cttgatcatccgaggcctgcgttcagttg

SEQ ID NO: 56644 - DNA, 29 bp, Artificial Sequence
  Description of Artificial Sequence: Synthetic oligonucleotide
ttgatcatccgaggcctgcgttcagttgg

SEQ ID NO: 56645 - DNA, 28 bp, Artificial Sequence
  Description of Artificial Sequence: Synthetic oligonucleotide
tgatcatccgaggcctgcgttcagttgg

SEQ ID NO: 56646 - DNA, 27 bp, Artificial Sequence
  Description of Artificial Sequence: Synthetic oligonucleotide
gatcatccgaggcctgcgttcagttgg

SEQ ID NO: 56647 - DNA, 28 bp, Artificial Sequence
  Description of Artificial Sequence: Synthetic oligonucleotide
atcatccgaggcctgcgttcagttggtg

SEQ ID NO: 56648 - DNA, 27 bp, Artificial Sequence
  Description of Artificial Sequence: Synthetic oligonucleotide
tcatccgaggcctgcgttcagttggtg

SEQ ID NO: 56649 - DNA, 26 bp, Artificial Sequence
  Description of Artificial Sequence: Synthetic oligonucleotide
catccgaggcctgcgttcagttggtg

SEQ ID NO: 56650 - DNA, 27 bp, Artificial Sequence
  Description of Artificial Sequence: Synthetic oligonucleotide
atccgaggcctgcgttcagttggtgct

SEQ ID NO: 56651 - DNA, 27 bp, Artificial Sequence
  Description of Artificial Sequence: Synthetic oligonucleotide
tccgaggcctgcgttcagttggtgctt

SEQ ID NO: 56652 - DNA, 26 bp, Artificial Sequence
  Description of Artificial Sequence: Synthetic oligonucleotide
ccgaggcctgcgttcagttggtgctt

SEQ ID NO: 56653 - DNA, 26 bp, Artificial Sequence
  Description of Artificial Sequence: Synthetic oligonucleotide
cgaggcctgcgttcagttggtgcttc

SEQ ID NO: 56654 - DNA, 27 bp, Artificial Sequence
  Description of Artificial Sequence: Synthetic oligonucleotide
gaggcctgcgttcagttggtgcttcca

SEQ ID NO: 56655 - DNA, 32 bp, Artificial Sequence
  Description of Artificial Sequence: Synthetic oligonucleotide
ttgtggaggtgaagacattgtggctgaccatg

SEQ ID NO: 56656 - DNA, 34 bp, Artificial Sequence
  Description of Artificial Sequence: Synthetic oligonucleotide
tgaagacattgtggctgaccatgttgcctcttac

SEQ ID NO: 56657 - DNA, 33 bp, Artificial Sequence
  Description of Artificial Sequence: Synthetic oligonucleotide
gaagacattgtggctgaccatgttgcctcttac

SEQ ID NO: 56658 - DNA, 33 bp, Artificial Sequence
  Description of Artificial Sequence: Synthetic oligonucleotide
aagacattgtggctgaccatgttgcctcttacg

SEQ ID NO: 56659 - DNA, 32 bp, Artificial Sequence
  Description of Artificial Sequence: Synthetic oligonucleotide
agacattgtggctgaccatgttgcctcttacg

SEQ ID NO: 56660 - DNA, 31 bp, Artificial Sequence
  Description of Artificial Sequence: Synthetic oligonucleotide
gacattgtggctgaccatgttgcctcttacg

SEQ ID NO: 56661 - DNA, 31 bp, Artificial Sequence
  Description of Artificial Sequence: Synthetic oligonucleotide
acattgtggctgaccatgttgcctcttacgg

SEQ ID NO: 56662 - DNA, 30 bp, Artificial Sequence
  Description of Artificial Sequence: Synthetic oligonucleotide
cattgtggctgaccatgttgcctcttacgg

SEQ ID NO: 56663 - DNA, 31 bp, Artificial Sequence
  Description of Artificial Sequence: Synthetic oligonucleotide
attgtggctgaccatgttgcctcttacggtg

SEQ ID NO: 56664 - DNA, 30 bp, Artificial Sequence
  Description of Artificial Sequence: Synthetic oligonucleotide
ttgtggctgaccatgttgcctcttacggtg

SEQ ID NO: 56665 - DNA, 29 bp, Artificial Sequence
  Description of Artificial Sequence: Synthetic oligonucleotide
tgtggctgaccatgttgcctcttacggtg

SEQ ID NO: 56666 - DNA, 28 bp, Artificial Sequence
  Description of Artificial Sequence: Synthetic oligonucleotide
gtggctgaccatgttgcctcttacggtg

SEQ ID NO: 56667 - DNA, 32 bp, Artificial Sequence
  Description of Artificial Sequence: Synthetic oligonucleotide
tggctgaccatgttgcctcttacggtgtaaac

SEQ ID NO: 56668 - DNA, 31 bp, Artificial Sequence
  Description of Artificial Sequence: Synthetic oligonucleotide
ggctgaccatgttgcctcttacggtgtaaac

SEQ ID NO: 56669 - DNA, 33 bp, Artificial Sequence
  Description of Artificial Sequence: Synthetic oligonucleotide
gctgaccatgttgcctcttacggtgtaaacttg

SEQ ID NO: 56670 - DNA, 35 bp, Artificial Sequence
  Description of Artificial Sequence: Synthetic oligonucleotide
ctgaccatgttgcctcttacggtgtaaacttgtac

SEQ ID NO: 56671 - DNA, 35 bp, Artificial Sequence
  Description of Artificial Sequence: Synthetic oligonucleotide
tgaccatgttgcctcttacggtgtaaacttgtacc

SEQ ID NO: 56672 - DNA, 34 bp, Artificial Sequence
  Description of Artificial Sequence: Synthetic oligonucleotide
gaccatgttgcctcttacggtgtaaacttgtacc

SEQ ID NO: 56673 - DNA, 35 bp, Artificial Sequence
  Description of Artificial Sequence: Synthetic oligonucleotide
accatgttgcctcttacggtgtaaacttgtaccag

SEQ ID NO: 56674 - DNA, 34 bp, Artificial Sequence
  Description of Artificial Sequence: Synthetic oligonucleotide
ccatgttgcctcttacggtgtaaacttgtaccag

SEQ ID NO: 56675 - DNA, 35 bp, Artificial Sequence
  Description of Artificial Sequence: Synthetic oligonucleotide
catgttgcctcttacggtgtaaacttgtaccagtc

SEQ ID NO: 56676 - DNA, 39 bp, Artificial Sequence
  Description of Artificial Sequence: Synthetic oligonucleotide
atgttgcctcttacggtgtaaacttgtaccagtcttatg

SEQ ID NO: 56677 - DNA, 38 bp, Artificial Sequence
  Description of Artificial Sequence: Synthetic oligonucleotide
tgttgcctcttacggtgtaaacttgtaccagtcttatg

SEQ ID NO: 56678 - DNA, 37 bp, Artificial Sequence
  Description of Artificial Sequence: Synthetic oligonucleotide
gttgcctcttacggtgtaaacttgtaccagtcttatg

SEQ ID NO: 56679 - DNA, 37 bp, Artificial Sequence
  Description of Artificial Sequence: Synthetic oligonucleotide
ttgcctcttacggtgtaaacttgtaccagtcttatgg

SEQ ID NO: 56680 - DNA, 36 bp, Artificial Sequence
  Description of Artificial Sequence: Synthetic oligonucleotide
tgcctcttacggtgtaaacttgtaccagtcttatgg

SEQ ID NO: 56681 - DNA, 35 bp, Artificial Sequence
  Description of Artificial Sequence: Synthetic oligonucleotide
gcctcttacggtgtaaacttgtaccagtcttatgg

SEQ ID NO: 56682 - DNA, 36 bp, Artificial Sequence
  Description of Artificial Sequence: Synthetic oligonucleotide
cctcttacggtgtaaacttgtaccagtcttatggtc

SEQ ID NO: 56683 - DNA, 36 bp, Artificial Sequence
  Description of Artificial Sequence: Synthetic oligonucleotide
ctcttacggtgtaaacttgtaccagtcttatggtcc

SEQ ID NO: 56684 - DNA, 36 bp, Artificial Sequence
  Description of Artificial Sequence: Synthetic oligonucleotide
tcttacggtgtaaacttgtaccagtcttatggtccc

SEQ ID NO: 56685 - DNA, 35 bp, Artificial Sequence
  Description of Artificial Sequence: Synthetic oligonucleotide
cttacggtgtaaacttgtaccagtcttatggtccc

SEQ ID NO: 56686 - DNA, 36 bp, Artificial Sequence
  Description of Artificial Sequence: Synthetic oligonucleotide
ttacggtgtaaacttgtaccagtcttatggtccctc

SEQ ID NO: 56687 - DNA, 35 bp, Artificial Sequence
  Description of Artificial Sequence: Synthetic oligonucleotide
tacggtgtaaacttgtaccagtcttatggtccctc

SEQ ID NO: 56688 - DNA, 34 bp, Artificial Sequence
  Description of Artificial Sequence: Synthetic oligonucleotide
acggtgtaaacttgtaccagtcttatggtccctc

SEQ ID NO: 56689 - DNA, 33 bp, Artificial Sequence
  Description of Artificial Sequence: Synthetic oligonucleotide
cggtgtaaacttgtaccagtcttatggtccctc

SEQ ID NO: 56690 - DNA, 34 bp, Artificial Sequence
  Description of Artificial Sequence: Synthetic oligonucleotide
ggtgtaaacttgtaccagtcttatggtccctctg

SEQ ID NO: 56691 - DNA, 34 bp, Artificial Sequence
  Description of Artificial Sequence: Synthetic oligonucleotide
gtgtaaacttgtaccagtcttatggtccctctgg

SEQ ID NO: 56692 - DNA, 34 bp, Artificial Sequence
  Description of Artificial Sequence: Synthetic oligonucleotide
tgtaaacttgtaccagtcttatggtccctctggg

SEQ ID NO: 56693 - DNA, 33 bp, Artificial Sequence
  Description of Artificial Sequence: Synthetic oligonucleotide
gtaaacttgtaccagtcttatggtccctctggg

SEQ ID NO: 56694 - DNA, 33 bp, Artificial Sequence
  Description of Artificial Sequence: Synthetic oligonucleotide
taaacttgtaccagtcttatggtccctctgggc

SEQ ID NO: 56695 - DNA, 32 bp, Artificial Sequence
  Description of Artificial Sequence: Synthetic oligonucleotide
aaacttgtaccagtcttatggtccctctgggc

SEQ ID NO: 56696 - DNA, 31 bp, Artificial Sequence
  Description of Artificial Sequence: Synthetic oligonucleotide
aacttgtaccagtcttatggtccctctgggc

SEQ ID NO: 56697 - DNA, 30 bp, Artificial Sequence
  Description of Artificial Sequence: Synthetic oligonucleotide
acttgtaccagtcttatggtccctctgggc

SEQ ID NO: 56698 - DNA, 29 bp, Artificial Sequence
  Description of Artificial Sequence: Synthetic oligonucleotide
cttgtaccagtcttatggtccctctgggc

SEQ ID NO: 56699 - DNA, 30 bp, Artificial Sequence
  Description of Artificial Sequence: Synthetic oligonucleotide
ttgtaccagtcttatggtccctctgggcag

SEQ ID NO: 56700 - DNA, 29 bp, Artificial Sequence
  Description of Artificial Sequence: Synthetic oligonucleotide
tgtaccagtcttatggtccctctgggcag

SEQ ID NO: 56701 - DNA, 28 bp, Artificial Sequence
  Description of Artificial Sequence: Synthetic oligonucleotide
gtaccagtcttatggtccctctgggcag

SEQ ID NO: 56702 - DNA, 30 bp, Artificial Sequence
  Description of Artificial Sequence: Synthetic oligonucleotide
taccagtcttatggtccctctgggcagtac

SEQ ID NO: 56703 - DNA, 29 bp, Artificial Sequence
  Description of Artificial Sequence: Synthetic oligonucleotide
accagtcttatggtccctctgggcagtac

SEQ ID NO: 56704 - DNA, 28 bp, Artificial Sequence
  Description of Artificial Sequence: Synthetic oligonucleotide
ccagtcttatggtccctctgggcagtac

SEQ ID NO: 56705 - DNA, 29 bp, Artificial Sequence
  Description of Artificial Sequence: Synthetic oligonucleotide
cagtcttatggtccctctgggcagtacag

SEQ ID NO: 56706 - DNA, 29 bp, Artificial Sequence
  Description of Artificial Sequence: Synthetic oligonucleotide
agtcttatggtccctctgggcagtacagc

SEQ ID NO: 56707 - DNA, 28 bp, Artificial Sequence
  Description of Artificial Sequence: Synthetic oligonucleotide
gtcttatggtccctctgggcagtacagc

SEQ ID NO: 56708 - DNA, 28 bp, Artificial Sequence
  Description of Artificial Sequence: Synthetic oligonucleotide
tcttatggtccctctgggcagtacagcc

SEQ ID NO: 56709 - DNA, 27 bp, Artificial Sequence
  Description of Artificial Sequence: Synthetic oligonucleotide
cttatggtccctctgggcagtacagcc

SEQ ID NO: 56710 - DNA, 29 bp, Artificial Sequence
  Description of Artificial Sequence: Synthetic oligonucleotide
ttatggtccctctgggcagtacagccatg

SEQ ID NO: 56711 - DNA, 28 bp, Artificial Sequence
  Description of Artificial Sequence: Synthetic oligonucleotide
tatggtccctctgggcagtacagccatg

SEQ ID NO: 56712 - DNA, 27 bp, Artificial Sequence
  Description of Artificial Sequence: Synthetic oligonucleotide
atggtccctctgggcagtacagccatg

SEQ ID NO: 56713 - DNA, 27 bp, Artificial Sequence
  Description of Artificial Sequence: Synthetic oligonucleotide
tggtccctctgggcagtacagccatga

SEQ ID NO: 56714 - DNA, 27 bp, Artificial Sequence
  Description of Artificial Sequence: Synthetic oligonucleotide
ggtccctctgggcagtacagccatgaa

SEQ ID NO: 56715 - DNA, 30 bp, Artificial Sequence
  Description of Artificial Sequence: Synthetic oligonucleotide
gtccctctgggcagtacagccatgaatttg

SEQ ID NO: 56716 - DNA, 32 bp, Artificial Sequence
  Description of Artificial Sequence: Synthetic oligonucleotide
tccctctgggcagtacagccatgaatttgatg

SEQ ID NO: 56717 - DNA, 31 bp, Artificial Sequence
  Description of Artificial Sequence: Synthetic oligonucleotide
ccctctgggcagtacagccatgaatttgatg

SEQ ID NO: 56718 - DNA, 31 bp, Artificial Sequence
  Description of Artificial Sequence: Synthetic oligonucleotide
cctctgggcagtacagccatgaatttgatgg

SEQ ID NO: 56719 - DNA, 32 bp, Artificial Sequence
  Description of Artificial Sequence: Synthetic oligonucleotide
ctctgggcagtacagccatgaatttgatggag

SEQ ID NO: 56720 - DNA, 33 bp, Artificial Sequence
  Description of Artificial Sequence: Synthetic oligonucleotide
tctgggcagtacagccatgaatttgatggagac

SEQ ID NO: 56721 - DNA, 32 bp, Artificial Sequence
  Description of Artificial Sequence: Synthetic oligonucleotide
ctgggcagtacagccatgaatttgatggagac

SEQ ID NO: 56722 - DNA, 32 bp, Artificial Sequence
  Description of Artificial Sequence: Synthetic oligonucleotide
tgggcagtacagccatgaatttgatggagacg

SEQ ID NO: 56723 - DNA, 31 bp, Artificial Sequence
  Description of Artificial Sequence: Synthetic oligonucleotide
gggcagtacagccatgaatttgatggagacg

SEQ ID NO: 56724 - DNA, 32 bp, Artificial Sequence
  Description of Artificial Sequence: Synthetic oligonucleotide
ggcagtacagccatgaatttgatggagacgag

SEQ ID NO: 56725 - DNA, 32 bp, Artificial Sequence
  Description of Artificial Sequence: Synthetic oligonucleotide
gcagtacagccatgaatttgatggagacgagg

SEQ ID NO: 56726 - DNA, 33 bp, Artificial Sequence
  Description of Artificial Sequence: Synthetic oligonucleotide
cagtacagccatgaatttgatggagacgaggag

SEQ ID NO: 56727 - DNA, 35 bp, Artificial Sequence
  Description of Artificial Sequence: Synthetic oligonucleotide
agtacagccatgaatttgatggagacgaggagttc

SEQ ID NO: 56728 - DNA, 34 bp, Artificial Sequence
  Description of Artificial Sequence: Synthetic oligonucleotide
gtacagccatgaatttgatggagacgaggagttc

SEQ ID NO: 56729 - DNA, 37 bp, Artificial Sequence
  Description of Artificial Sequence: Synthetic oligonucleotide
tacagccatgaatttgatggagacgaggagttctatg

SEQ ID NO: 56730 - DNA, 36 bp, Artificial Sequence
  Description of Artificial Sequence: Synthetic oligonucleotide
acagccatgaatttgatggagacgaggagttctatg

SEQ ID NO: 56731 - DNA, 35 bp, Artificial Sequence
  Description of Artificial Sequence: Synthetic oligonucleotide
cagccatgaatttgatggagacgaggagttctatg

SEQ ID NO: 56732 - DNA, 36 bp, Artificial Sequence
  Description of Artificial Sequence: Synthetic oligonucleotide
agccatgaatttgatggagacgaggagttctatgtg

SEQ ID NO: 56733 - DNA, 35 bp, Artificial Sequence
  Description of Artificial Sequence: Synthetic oligonucleotide
gccatgaatttgatggagacgaggagttctatgtg

SEQ ID NO: 56734 - DNA, 27 bp, Artificial Sequence
  Description of Artificial Sequence: Synthetic oligonucleotide
acctggagaggaaggagactgtctggc

SEQ ID NO: 56735 - DNA, 27 bp, Artificial Sequence
  Description of Artificial Sequence: Synthetic oligonucleotide
cctggagaggaaggagactgtctggca

SEQ ID NO: 56736 - DNA, 27 bp, Artificial Sequence
  Description of Artificial Sequence: Synthetic oligonucleotide
ctggagaggaaggagactgtctggcag

SEQ ID NO: 56737 - DNA, 29 bp, Artificial Sequence
  Description of Artificial Sequence: Synthetic oligonucleotide
tggagaggaaggagactgtctggcagttg

SEQ ID NO: 56738 - DNA, 28 bp, Artificial Sequence
  Description of Artificial Sequence: Synthetic oligonucleotide
ggagaggaaggagactgtctggcagttg

SEQ ID NO: 56739 - DNA, 28 bp, Artificial Sequence
  Description of Artificial Sequence: Synthetic oligonucleotide
gagaggaaggagactgtctggcagttgc

SEQ ID NO: 56740 - DNA, 28 bp, Artificial Sequence
  Description of Artificial Sequence: Synthetic oligonucleotide
agaggaaggagactgtctggcagttgcc

SEQ ID NO: 56741 - DNA, 27 bp, Artificial Sequence
  Description of Artificial Sequence: Synthetic oligonucleotide
gaggaaggagactgtctggcagttgcc

SEQ ID NO: 56742 - DNA, 28 bp, Artificial Sequence
  Description of Artificial Sequence: Synthetic oligonucleotide
aggaaggagactgtctggcagttgcctc

SEQ ID NO: 56743 - DNA, 27 bp, Artificial Sequence
  Description of Artificial Sequence: Synthetic oligonucleotide
ggaaggagactgtctggcagttgcctc

SEQ ID NO: 56744 - DNA, 28 bp, Artificial Sequence
  Description of Artificial Sequence: Synthetic oligonucleotide
gaaggagactgtctggcagttgcctctg

SEQ ID NO: 56745 - DNA, 30 bp, Artificial Sequence
  Description of Artificial Sequence: Synthetic oligonucleotide
aaggagactgtctggcagttgcctctgttc

SEQ ID NO: 56746 - DNA, 29 bp, Artificial Sequence
  Description of Artificial Sequence: Synthetic oligonucleotide
aggagactgtctggcagttgcctctgttc

SEQ ID NO: 56747 - DNA, 28 bp, Artificial Sequence
  Description of Artificial Sequence: Synthetic oligonucleotide
ggagactgtctggcagttgcctctgttc

SEQ ID NO: 56748 - DNA, 28 bp, Artificial Sequence
  Description of Artificial Sequence: Synthetic oligonucleotide
gagactgtctggcagttgcctctgttcc

SEQ ID NO: 56749 - DNA, 28 bp, Artificial Sequence
  Description of Artificial Sequence: Synthetic oligonucleotide
agactgtctggcagttgcctctgttccg

SEQ ID NO: 56750 - DNA, 27 bp, Artificial Sequence
  Description of Artificial Sequence: Synthetic oligonucleotide
gactgtctggcagttgcctctgttccg

SEQ ID NO: 56751 - DNA, 27 bp, Artificial Sequence
  Description of Artificial Sequence: Synthetic oligonucleotide
actgtctggcagttgcctctgttccgc

SEQ ID NO: 56752 - DNA, 27 bp, Artificial Sequence
  Description of Artificial Sequence: Synthetic oligonucleotide
ctgtctggcagttgcctctgttccgca

SEQ ID NO: 56753 - DNA, 27 bp, Artificial Sequence
  Description of Artificial Sequence: Synthetic oligonucleotide
tgtctggcagttgcctctgttccgcag

SEQ ID NO: 56754 - DNA, 27 bp, Artificial Sequence
  Description of Artificial Sequence: Synthetic oligonucleotide
gtctggcagttgcctctgttccgcaga

SEQ ID NO: 56755 - DNA, 31 bp, Artificial Sequence
  Description of Artificial Sequence: Synthetic oligonucleotide
tctggcagttgcctctgttccgcagatttag

SEQ ID NO: 56756 - DNA, 30 bp, Artificial Sequence
  Description of Artificial Sequence: Synthetic oligonucleotide
ctggcagttgcctctgttccgcagatttag

SEQ ID NO: 56757 - DNA, 32 bp, Artificial Sequence
  Description of Artificial Sequence: Synthetic oligonucleotide
tggcagttgcctctgttccgcagatttagaag

SEQ ID NO: 56758 - DNA, 31 bp, Artificial Sequence
  Description of Artificial Sequence: Synthetic oligonucleotide
ggcagttgcctctgttccgcagatttagaag

SEQ ID NO: 56759 - DNA, 35 bp, Artificial Sequence
  Description of Artificial Sequence: Synthetic oligonucleotide
gcagttgcctctgttccgcagatttagaagatttg

SEQ ID NO: 56760 - DNA, 36 bp, Artificial Sequence
  Description of Artificial Sequence: Synthetic oligonucleotide
cagttgcctctgttccgcagatttagaagatttgac

SEQ ID NO: 56761 - DNA, 36 bp, Artificial Sequence
  Description of Artificial Sequence: Synthetic oligonucleotide
agttgcctctgttccgcagatttagaagatttgacc

SEQ ID NO: 56762 - DNA, 35 bp, Artificial Sequence
  Description of Artificial Sequence: Synthetic oligonucleotide
gttgcctctgttccgcagatttagaagatttgacc

SEQ ID NO: 56763 - DNA, 35 bp, Artificial Sequence
  Description of Artificial Sequence: Synthetic oligonucleotide
ttgcctctgttccgcagatttagaagatttgaccc

SEQ ID NO: 56764 - DNA, 34 bp, Artificial Sequence
  Description of Artificial Sequence: Synthetic oligonucleotide
tgcctctgttccgcagatttagaagatttgaccc

SEQ ID NO: 56765 - DNA, 33 bp, Artificial Sequence
  Description of Artificial Sequence: Synthetic oligonucleotide
gcctctgttccgcagatttagaagatttgaccc

SEQ ID NO: 56766 - DNA, 33 bp, Artificial Sequence
  Description of Artificial Sequence: Synthetic oligonucleotide
cctctgttccgcagatttagaagatttgacccg

SEQ ID NO: 56767 - DNA, 33 bp, Artificial Sequence
  Description of Artificial Sequence: Synthetic oligonucleotide
ctctgttccgcagatttagaagatttgacccgc

SEQ ID NO: 56768 - DNA, 38 bp, Artificial Sequence
  Description of Artificial Sequence: Synthetic oligonucleotide
tctgttccgcagatttagaagatttgacccgcaatttg

SEQ ID NO: 56769 - DNA, 37 bp, Artificial Sequence
  Description of Artificial Sequence: Synthetic oligonucleotide
ctgttccgcagatttagaagatttgacccgcaatttg

SEQ ID NO: 56770 - DNA, 37 bp, Artificial Sequence
  Description of Artificial Sequence: Synthetic oligonucleotide
tgttccgcagatttagaagatttgacccgcaatttgc

SEQ ID NO: 56771 - DNA, 36 bp, Artificial Sequence
  Description of Artificial Sequence: Synthetic oligonucleotide
gttccgcagatttagaagatttgacccgcaatttgc

SEQ ID NO: 56772 - DNA, 37 bp, Artificial Sequence
  Description of Artificial Sequence: Synthetic oligonucleotide
ttccgcagatttagaagatttgacccgcaatttgcac

SEQ ID NO: 56773 - DNA, 36 bp, Artificial Sequence
  Description of Artificial Sequence: Synthetic oligonucleotide
tccgcagatttagaagatttgacccgcaatttgcac

SEQ ID NO: 56774 - DNA, 35 bp, Artificial Sequence
  Description of Artificial Sequence: Synthetic oligonucleotide
ccgcagatttagaagatttgacccgcaatttgcac

SEQ ID NO: 56775 - DNA, 36 bp, Artificial Sequence
  Description of Artificial Sequence: Synthetic oligonucleotide
cgcagatttagaagatttgacccgcaatttgcactg

SEQ ID NO: 56776 - DNA, 37 bp, Artificial Sequence
  Description of Artificial Sequence: Synthetic oligonucleotide
gcagatttagaagatttgacccgcaatttgcactgac

SEQ ID NO: 56777 - DNA, 40 bp, Artificial Sequence
  Description of Artificial Sequence: Synthetic oligonucleotide
cagatttagaagatttgacccgcaatttgcactgacaaac

SEQ ID NO: 56778 - DNA, 42 bp, Artificial Sequence
  Description of Artificial Sequence: Synthetic oligonucleotide
agatttagaagatttgacccgcaatttgcactgacaaacatc

SEQ ID NO: 56779 - DNA, 41 bp, Artificial Sequence
  Description of Artificial Sequence: Synthetic oligonucleotide
gatttagaagatttgacccgcaatttgcactgacaaacatc

SEQ ID NO: 56780 - DNA, 41 bp, Artificial Sequence
  Description of Artificial Sequence: Synthetic oligonucleotide
atttagaagatttgacccgcaatttgcactgacaaacatcg

SEQ ID NO: 56781 - DNA, 40 bp, Artificial Sequence
  Description of Artificial Sequence: Synthetic oligonucleotide
tttagaagatttgacccgcaatttgcactgacaaacatcg

SEQ ID NO: 56782 - DNA, 39 bp, Artificial Sequence
  Description of Artificial Sequence: Synthetic oligonucleotide
ttagaagatttgacccgcaatttgcactgacaaacatcg

SEQ ID NO: 56783 - DNA, 38 bp, Artificial Sequence
  Description of Artificial Sequence: Synthetic oligonucleotide
tagaagatttgacccgcaatttgcactgacaaacatcg

SEQ ID NO: 56784 - DNA, 37 bp, Artificial Sequence
  Description of Artificial Sequence: Synthetic oligonucleotide
agaagatttgacccgcaatttgcactgacaaacatcg

SEQ ID NO: 56785 - DNA, 36 bp, Artificial Sequence
  Description of Artificial Sequence: Synthetic oligonucleotide
gaagatttgacccgcaatttgcactgacaaacatcg

SEQ ID NO: 56786 - DNA, 36 bp, Artificial Sequence
  Description of Artificial Sequence: Synthetic oligonucleotide
aagatttgacccgcaatttgcactgacaaacatcgc

SEQ ID NO: 56787 - DNA, 41 bp, Artificial Sequence
  Description of Artificial Sequence: Synthetic oligonucleotide
actgacaaacatcgctgtgctaaaacataacttgaacatcg

SEQ ID NO: 56788 - DNA, 40 bp, Artificial Sequence
  Description of Artificial Sequence: Synthetic oligonucleotide
ctgacaaacatcgctgtgctaaaacataacttgaacatcg

SEQ ID NO: 56789 - DNA, 41 bp, Artificial Sequence
  Description of Artificial Sequence: Synthetic oligonucleotide
tgacaaacatcgctgtgctaaaacataacttgaacatcgtg

SEQ ID NO: 56790 - DNA, 40 bp, Artificial Sequence
  Description of Artificial Sequence: Synthetic oligonucleotide
gacaaacatcgctgtgctaaaacataacttgaacatcgtg

SEQ ID NO: 56791 - DNA, 46 bp, Artificial Sequence
  Description of Artificial Sequence: Synthetic oligonucleotide
acaaacatcgctgtgctaaaacataacttgaacatcgtgattaaac

SEQ ID NO: 56792 - DNA, 45 bp, Artificial Sequence
  Description of Artificial Sequence: Synthetic oligonucleotide
caaacatcgctgtgctaaaacataacttgaacatcgtgattaaac

SEQ ID NO: 56793 - DNA, 45 bp, Artificial Sequence
  Description of Artificial Sequence: Synthetic oligonucleotide
aaacatcgctgtgctaaaacataacttgaacatcgtgattaaacg

SEQ ID NO: 56794 - DNA, 44 bp, Artificial Sequence
  Description of Artificial Sequence: Synthetic oligonucleotide
aacatcgctgtgctaaaacataacttgaacatcgtgattaaacg

SEQ ID NO: 56795 - DNA, 43 bp, Artificial Sequence
  Description of Artificial Sequence: Synthetic oligonucleotide
acatcgctgtgctaaaacataacttgaacatcgtgattaaacg

SEQ ID NO: 56796 - DNA, 42 bp, Artificial Sequence
  Description of Artificial Sequence: Synthetic oligonucleotide
catcgctgtgctaaaacataacttgaacatcgtgattaaacg

SEQ ID NO: 56797 - DNA, 42 bp, Artificial Sequence
  Description of Artificial Sequence: Synthetic oligonucleotide
atcgctgtgctaaaacataacttgaacatcgtgattaaacgc

SEQ ID NO: 56798 - DNA, 41 bp, Artificial Sequence
  Description of Artificial Sequence: Synthetic oligonucleotide
tcgctgtgctaaaacataacttgaacatcgtgattaaacgc

SEQ ID NO: 56799 - DNA, 40 bp, Artificial Sequence
  Description of Artificial Sequence: Synthetic oligonucleotide
cgctgtgctaaaacataacttgaacatcgtgattaaacgc

SEQ ID NO: 56800 - DNA, 41 bp, Artificial Sequence
  Description of Artificial Sequence: Synthetic oligonucleotide
gctgtgctaaaacataacttgaacatcgtgattaaacgctc

SEQ ID NO: 56801 - DNA, 41 bp, Artificial Sequence
  Description of Artificial Sequence: Synthetic oligonucleotide
ctgtgctaaaacataacttgaacatcgtgattaaacgctcc

SEQ ID NO: 56802 - DNA, 43 bp, Artificial Sequence
  Description of Artificial Sequence: Synthetic oligonucleotide
tgtgctaaaacataacttgaacatcgtgattaaacgctccaac

SEQ ID NO: 56803 - DNA, 42 bp, Artificial Sequence
  Description of Artificial Sequence: Synthetic oligonucleotide
gtgctaaaacataacttgaacatcgtgattaaacgctccaac

SEQ ID NO: 56804 - DNA, 43 bp, Artificial Sequence
  Description of Artificial Sequence: Synthetic oligonucleotide
tgctaaaacataacttgaacatcgtgattaaacgctccaactc

SEQ ID NO: 56805 - DNA, 42 bp, Artificial Sequence
  Description of Artificial Sequence: Synthetic oligonucleotide
gctaaaacataacttgaacatcgtgattaaacgctccaactc

SEQ ID NO: 56806 - DNA, 44 bp, Artificial Sequence
  Description of Artificial Sequence: Synthetic oligonucleotide
ctaaaacataacttgaacatcgtgattaaacgctccaactctac

SEQ ID NO: 56807 - DNA, 44 bp, Artificial Sequence
  Description of Artificial Sequence: Synthetic oligonucleotide
taaaacataacttgaacatcgtgattaaacgctccaactctacc

SEQ ID NO: 56808 - DNA, 43 bp, Artificial Sequence
  Description of Artificial Sequence: Synthetic oligonucleotide
aaaacataacttgaacatcgtgattaaacgctccaactctacc

SEQ ID NO: 56809 - DNA, 42 bp, Artificial Sequence
  Description of Artificial Sequence: Synthetic oligonucleotide
aaacataacttgaacatcgtgattaaacgctccaactctacc

SEQ ID NO: 56810 - DNA, 41 bp, Artificial Sequence
  Description of Artificial Sequence: Synthetic oligonucleotide
aacataacttgaacatcgtgattaaacgctccaactctacc

SEQ ID NO: 56811 - DNA, 40 bp, Artificial Sequence
  Description of Artificial Sequence: Synthetic oligonucleotide
acataacttgaacatcgtgattaaacgctccaactctacc

SEQ ID NO: 56812 - DNA, 39 bp, Artificial Sequence
  Description of Artificial Sequence: Synthetic oligonucleotide
cataacttgaacatcgtgattaaacgctccaactctacc

SEQ ID NO: 56813 - DNA, 39 bp, Artificial Sequence
  Description of Artificial Sequence: Synthetic oligonucleotide
ataacttgaacatcgtgattaaacgctccaactctaccg

SEQ ID NO: 56814 - DNA, 38 bp, Artificial Sequence
  Description of Artificial Sequence: Synthetic oligonucleotide
taacttgaacatcgtgattaaacgctccaactctaccg

SEQ ID NO: 56815 - DNA, 37 bp, Artificial Sequence
  Description of Artificial Sequence: Synthetic oligonucleotide
aacttgaacatcgtgattaaacgctccaactctaccg

SEQ ID NO: 56816 - DNA, 36 bp, Artificial Sequence
  Description of Artificial Sequence: Synthetic oligonucleotide
acttgaacatcgtgattaaacgctccaactctaccg

SEQ ID NO: 56817 - DNA, 35 bp, Artificial Sequence
  Description of Artificial Sequence: Synthetic oligonucleotide
cttgaacatcgtgattaaacgctccaactctaccg

SEQ ID NO: 56818 - DNA, 35 bp, Artificial Sequence
  Description of Artificial Sequence: Synthetic oligonucleotide
ttgaacatcgtgattaaacgctccaactctaccgc

SEQ ID NO: 56819 - DNA, 34 bp, Artificial Sequence
  Description of Artificial Sequence: Synthetic oligonucleotide
tgaacatcgtgattaaacgctccaactctaccgc

SEQ ID NO: 56820 - DNA, 33 bp, Artificial Sequence
  Description of Artificial Sequence: Synthetic oligonucleotide
gaacatcgtgattaaacgctccaactctaccgc

SEQ ID NO: 56821 - DNA, 34 bp, Artificial Sequence
  Description of Artificial Sequence: Synthetic oligonucleotide
aacatcgtgattaaacgctccaactctaccgctg

SEQ ID NO: 56822 - DNA, 33 bp, Artificial Sequence
  Description of Artificial Sequence: Synthetic oligonucleotide
acatcgtgattaaacgctccaactctaccgctg

SEQ ID NO: 56823 - DNA, 32 bp, Artificial Sequence
  Description of Artificial Sequence: Synthetic oligonucleotide
catcgtgattaaacgctccaactctaccgctg

SEQ ID NO: 56824 - DNA, 32 bp, Artificial Sequence
  Description of Artificial Sequence: Synthetic oligonucleotide
atcgtgattaaacgctccaactctaccgctgc

SEQ ID NO: 56825 - DNA, 31 bp, Artificial Sequence
  Description of Artificial Sequence: Synthetic oligonucleotide
tcgtgattaaacgctccaactctaccgctgc

SEQ ID NO: 56826 - DNA, 30 bp, Artificial Sequence
  Description of Artificial Sequence: Synthetic oligonucleotide
cgtgattaaacgctccaactctaccgctgc

SEQ ID NO: 56827 - DNA, 32 bp, Artificial Sequence
  Description of Artificial Sequence: Synthetic oligonucleotide
gtgattaaacgctccaactctaccgctgctac

SEQ ID NO: 56828 - DNA, 33 bp, Artificial Sequence
  Description of Artificial Sequence: Synthetic oligonucleotide
tcttctgaaacactgggagcctgagattccaac

SEQ ID NO: 56829 - DNA, 32 bp, Artificial Sequence
  Description of Artificial Sequence: Synthetic oligonucleotide
cttctgaaacactgggagcctgagattccaac

SEQ ID NO: 56830 - DNA, 33 bp, Artificial Sequence
  Description of Artificial Sequence: Synthetic oligonucleotide
ttctgaaacactgggagcctgagattccaacac

SEQ ID NO: 56831 - DNA, 32 bp, Artificial Sequence
  Description of Artificial Sequence: Synthetic oligonucleotide
tctgaaacactgggagcctgagattccaacac

SEQ ID NO: 56832 - DNA, 31 bp, Artificial Sequence
  Description of Artificial Sequence: Synthetic oligonucleotide
ctgaaacactgggagcctgagattccaacac

SEQ ID NO: 56833 - DNA, 31 bp, Artificial Sequence
  Description of Artificial Sequence: Synthetic oligonucleotide
tgaaacactgggagcctgagattccaacacc

SEQ ID NO: 56834 - DNA, 30 bp, Artificial Sequence
  Description of Artificial Sequence: Synthetic oligonucleotide
gaaacactgggagcctgagattccaacacc

SEQ ID NO: 56835 - DNA, 33 bp, Artificial Sequence
  Description of Artificial Sequence: Synthetic oligonucleotide
aaacactgggagcctgagattccaacacctatg

SEQ ID NO: 56836 - DNA, 32 bp, Artificial Sequence
  Description of Artificial Sequence: Synthetic oligonucleotide
aacactgggagcctgagattccaacacctatg

SEQ ID NO: 56837 - DNA, 31 bp, Artificial Sequence
  Description of Artificial Sequence: Synthetic oligonucleotide
acactgggagcctgagattccaacacctatg

SEQ ID NO: 56838 - DNA, 30 bp, Artificial Sequence
  Description of Artificial Sequence: Synthetic oligonucleotide
cactgggagcctgagattccaacacctatg

SEQ ID NO: 56839 - DNA, 31 bp, Artificial Sequence
  Description of Artificial Sequence: Synthetic oligonucleotide
actgggagcctgagattccaacacctatgtc

SEQ ID NO: 56840 - DNA, 30 bp, Artificial Sequence
  Description of Artificial Sequence: Synthetic oligonucleotide
ctgggagcctgagattccaacacctatgtc

SEQ ID NO: 56841 - DNA, 31 bp, Artificial Sequence
  Description of Artificial Sequence: Synthetic oligonucleotide
tgggagcctgagattccaacacctatgtcag

SEQ ID NO: 56842 - DNA, 30 bp, Artificial Sequence
  Description of Artificial Sequence: Synthetic oligonucleotide
gggagcctgagattccaacacctatgtcag

SEQ ID NO: 56843 - DNA, 31 bp, Artificial Sequence
  Description of Artificial Sequence: Synthetic oligonucleotide
ggagcctgagattccaacacctatgtcagag

SEQ ID NO: 56844 - DNA, 31 bp, Artificial Sequence
  Description of Artificial Sequence: Synthetic oligonucleotide
gagcctgagattccaacacctatgtcagagc

SEQ ID NO: 56845 - DNA, 32 bp, Artificial Sequence
  Description of Artificial Sequence: Synthetic oligonucleotide
agcctgagattccaacacctatgtcagagctc

SEQ ID NO: 56846 - DNA, 31 bp, Artificial Sequence
  Description of Artificial Sequence: Synthetic oligonucleotide
gcctgagattccaacacctatgtcagagctc

SEQ ID NO: 56847 - DNA, 32 bp, Artificial Sequence
  Description of Artificial Sequence: Synthetic oligonucleotide
cctgagattccaacacctatgtcagagctcac

SEQ ID NO: 56848 - DNA, 33 bp, Artificial Sequence
  Description of Artificial Sequence: Synthetic oligonucleotide
ctgagattccaacacctatgtcagagctcacag

SEQ ID NO: 56849 - DNA, 34 bp, Artificial Sequence
  Description of Artificial Sequence: Synthetic oligonucleotide
tgagattccaacacctatgtcagagctcacagag

SEQ ID NO: 56850 - DNA, 33 bp, Artificial Sequence
  Description of Artificial Sequence: Synthetic oligonucleotide
gagattccaacacctatgtcagagctcacagag

SEQ ID NO: 56851 - DNA, 34 bp, Artificial Sequence
  Description of Artificial Sequence: Synthetic oligonucleotide
agattccaacacctatgtcagagctcacagagac

SEQ ID NO: 56852 - DNA, 33 bp, Artificial Sequence
  Description of Artificial Sequence: Synthetic oligonucleotide
gattccaacacctatgtcagagctcacagagac

SEQ ID NO: 56853 - DNA, 34 bp, Artificial Sequence
  Description of Artificial Sequence: Synthetic oligonucleotide
attccaacacctatgtcagagctcacagagactg

SEQ ID NO: 56854 - DNA, 33 bp, Artificial Sequence
  Description of Artificial Sequence: Synthetic oligonucleotide
ttccaacacctatgtcagagctcacagagactg

SEQ ID NO: 56855 - DNA, 32 bp, Artificial Sequence
  Description of Artificial Sequence: Synthetic oligonucleotide
tccaacacctatgtcagagctcacagagactg

SEQ ID NO: 56856 - DNA, 31 bp, Artificial Sequence
  Description of Artificial Sequence: Synthetic oligonucleotide
ccaacacctatgtcagagctcacagagactg

SEQ ID NO: 56857 - DNA, 32 bp, Artificial Sequence
  Description of Artificial Sequence: Synthetic oligonucleotide
caacacctatgtcagagctcacagagactgtg

SEQ ID NO: 56858 - DNA, 32 bp, Artificial Sequence
  Description of Artificial Sequence: Synthetic oligonucleotide
aacacctatgtcagagctcacagagactgtgg

SEQ ID NO: 56859 - DNA, 31 bp, Artificial Sequence
  Description of Artificial Sequence: Synthetic oligonucleotide
acacctatgtcagagctcacagagactgtgg

SEQ ID NO: 56860 - DNA, 22 bp, Artificial Sequence
  Description of Artificial Sequence: Synthetic oligonucleotide
gccctcgccctgaccaccgtga

SEQ ID NO: 56861 - DNA, 22 bp, Artificial Sequence
  Description of Artificial Sequence: Synthetic oligonucleotide
ccctcgccctgaccaccgtgac

SEQ ID NO: 56862 - DNA, 23 bp, Artificial Sequence
  Description of Artificial Sequence: Synthetic oligonucleotide
cctcgccctgaccaccgtgacga

SEQ ID NO: 56863 - DNA, 23 bp, Artificial Sequence
  Description of Artificial Sequence: Synthetic oligonucleotide
ctcgccctgaccaccgtgacgag

SEQ ID NO: 56864 - DNA, 23 bp, Artificial Sequence
  Description of Artificial Sequence: Synthetic oligonucleotide
tcgccctgaccaccgtgacgagc

SEQ ID NO: 56865 - DNA, 22 bp, Artificial Sequence
  Description of Artificial Sequence: Synthetic oligonucleotide
cgccctgaccaccgtgacgagc

SEQ ID NO: 56866 - DNA, 22 bp, Artificial Sequence
  Description of Artificial Sequence: Synthetic oligonucleotide
gccctgaccaccgtgacgagcc

SEQ ID NO: 56867 - DNA, 24 bp, Artificial Sequence
  Description of Artificial Sequence: Synthetic oligonucleotide
ccctgaccaccgtgacgagccctt

SEQ ID NO: 56868 - DNA, 25 bp, Artificial Sequence
  Description of Artificial Sequence: Synthetic oligonucleotide
cctgaccaccgtgacgagcccttgt

SEQ ID NO: 56869 - DNA, 25 bp, Artificial Sequence
  Description of Artificial Sequence: Synthetic oligonucleotide
ctgaccaccgtgacgagcccttgtg

SEQ ID NO: 56870 - DNA, 26 bp, Artificial Sequence
  Description of Artificial Sequence: Synthetic oligonucleotide
tgaccaccgtgacgagcccttgtgga

SEQ ID NO: 56871 - DNA, 25 bp, Artificial Sequence
  Description of Artificial Sequence: Synthetic oligonucleotide
gaccaccgtgacgagcccttgtgga

SEQ ID NO: 56872 - DNA, 25 bp, Artificial Sequence
  Description of Artificial Sequence: Synthetic oligonucleotide
accaccgtgacgagcccttgtggag

SEQ ID NO: 56873 - DNA, 24 bp, Artificial Sequence
  Description of Artificial Sequence: Synthetic oligonucleotide
ccaccgtgacgagcccttgtggag

SEQ ID NO: 56874 - DNA, 25 bp, Artificial Sequence
  Description of Artificial Sequence: Synthetic oligonucleotide
caccgtgacgagcccttgtggaggt

SEQ ID NO: 56875 - DNA, 27 bp, Artificial Sequence
  Description of Artificial Sequence: Synthetic oligonucleotide
accgtgacgagcccttgtggaggtgaa

SEQ ID NO: 56876 - DNA, 26 bp, Artificial Sequence
  Description of Artificial Sequence: Synthetic oligonucleotide
ccgtgacgagcccttgtggaggtgaa

SEQ ID NO: 56877 - DNA, 27 bp, Artificial Sequence
  Description of Artificial Sequence: Synthetic oligonucleotide
cgtgacgagcccttgtggaggtgaaga

SEQ ID NO: 56878 - DNA, 27 bp, Artificial Sequence
  Description of Artificial Sequence: Synthetic oligonucleotide
gtgacgagcccttgtggaggtgaagac

SEQ ID NO: 56879 - DNA, 30 bp, Artificial Sequence
  Description of Artificial Sequence: Synthetic oligonucleotide
tgacgagcccttgtggaggtgaagacattg

SEQ ID NO: 56880 - DNA, 29 bp, Artificial Sequence
  Description of Artificial Sequence: Synthetic oligonucleotide
gacgagcccttgtggaggtgaagacattg

SEQ ID NO: 56881 - DNA, 30 bp, Artificial Sequence
  Description of Artificial Sequence: Synthetic oligonucleotide
acgagcccttgtggaggtgaagacattgtg

SEQ ID NO: 56882 - DNA, 29 bp, Artificial Sequence
  Description of Artificial Sequence: Synthetic oligonucleotide
cgagcccttgtggaggtgaagacattgtg

SEQ ID NO: 56883 - DNA, 34 bp, Artificial Sequence
  Description of Artificial Sequence: Synthetic oligonucleotide
aagatcagttacctcaccttcctcccttctgatg

SEQ ID NO: 56884 - DNA, 33 bp, Artificial Sequence
  Description of Artificial Sequence: Synthetic oligonucleotide
agatcagttacctcaccttcctcccttctgatg

SEQ ID NO: 56885 - DNA, 32 bp, Artificial Sequence
  Description of Artificial Sequence: Synthetic oligonucleotide
gatcagttacctcaccttcctcccttctgatg

SEQ ID NO: 56886 - DNA, 34 bp, Artificial Sequence
  Description of Artificial Sequence: Synthetic oligonucleotide
atcagttacctcaccttcctcccttctgatgatg

SEQ ID NO: 56887 - DNA, 33 bp, Artificial Sequence
  Description of Artificial Sequence: Synthetic oligonucleotide
tcagttacctcaccttcctcccttctgatgatg

SEQ ID NO: 56888 - DNA, 32 bp, Artificial Sequence
  Description of Artificial Sequence: Synthetic oligonucleotide
cagttacctcaccttcctcccttctgatgatg

SEQ ID NO: 56889 - DNA, 33 bp, Artificial Sequence
  Description of Artificial Sequence: Synthetic oligonucleotide
agttacctcaccttcctcccttctgatgatgag

SEQ ID NO: 56890 - DNA, 32 bp, Artificial Sequence
  Description of Artificial Sequence: Synthetic oligonucleotide
gttacctcaccttcctcccttctgatgatgag

SEQ ID NO: 56891 - DNA, 38 bp, Artificial Sequence
  Description of Artificial Sequence: Synthetic oligonucleotide
ttacctcaccttcctcccttctgatgatgagatttatg

SEQ ID NO: 56892 - DNA, 37 bp, Artificial Sequence
  Description of Artificial Sequence: Synthetic oligonucleotide
tacctcaccttcctcccttctgatgatgagatttatg

SEQ ID NO: 56893 - DNA, 36 bp, Artificial Sequence
  Description of Artificial Sequence: Synthetic oligonucleotide
acctcaccttcctcccttctgatgatgagatttatg

SEQ ID NO: 56894 - DNA, 35 bp, Artificial Sequence
  Description of Artificial Sequence: Synthetic oligonucleotide
cctcaccttcctcccttctgatgatgagatttatg

SEQ ID NO: 56895 - DNA, 36 bp, Artificial Sequence
  Description of Artificial Sequence: Synthetic oligonucleotide
ctcaccttcctcccttctgatgatgagatttatgac

SEQ ID NO: 56896 - DNA, 37 bp, Artificial Sequence
  Description of Artificial Sequence: Synthetic oligonucleotide
tcaccttcctcccttctgatgatgagatttatgactg

SEQ ID NO: 56897 - DNA, 36 bp, Artificial Sequence
  Description of Artificial Sequence: Synthetic oligonucleotide
caccttcctcccttctgatgatgagatttatgactg

SEQ ID NO: 56898 - DNA, 36 bp, Artificial Sequence
  Description of Artificial Sequence: Synthetic oligonucleotide
accttcctcccttctgatgatgagatttatgactgc

SEQ ID NO: 56899 - DNA, 35 bp, Artificial Sequence
  Description of Artificial Sequence: Synthetic oligonucleotide
ccttcctcccttctgatgatgagatttatgactgc

SEQ ID NO: 56900 - DNA, 37 bp, Artificial Sequence
  Description of Artificial Sequence: Synthetic oligonucleotide
cttcctcccttctgatgatgagatttatgactgcaag

SEQ ID NO: 56901 - DNA, 37 bp, Artificial Sequence
  Description of Artificial Sequence: Synthetic oligonucleotide
ttcctcccttctgatgatgagatttatgactgcaagg

SEQ ID NO: 56902 - DNA, 36 bp, Artificial Sequence
  Description of Artificial Sequence: Synthetic oligonucleotide
tcctcccttctgatgatgagatttatgactgcaagg

SEQ ID NO: 56903 - DNA, 35 bp, Artificial Sequence
  Description of Artificial Sequence: Synthetic oligonucleotide
cctcccttctgatgatgagatttatgactgcaagg

SEQ ID NO: 56904 - DNA, 36 bp, Artificial Sequence
  Description of Artificial Sequence: Synthetic oligonucleotide
ctcccttctgatgatgagatttatgactgcaaggtg

SEQ ID NO: 56905 - DNA, 36 bp, Artificial Sequence
  Description of Artificial Sequence: Synthetic oligonucleotide
tcccttctgatgatgagatttatgactgcaaggtgg

SEQ ID NO: 56906 - DNA, 35 bp, Artificial Sequence
  Description of Artificial Sequence: Synthetic oligonucleotide
cccttctgatgatgagatttatgactgcaaggtgg

SEQ ID NO: 56907 - DNA, 36 bp, Artificial Sequence
  Description of Artificial Sequence: Synthetic oligonucleotide
ccttctgatgatgagatttatgactgcaaggtggag

SEQ ID NO: 56908 - DNA, 36 bp, Artificial Sequence
  Description of Artificial Sequence: Synthetic oligonucleotide
cttctgatgatgagatttatgactgcaaggtggagc

SEQ ID NO: 56909 - DNA, 37 bp, Artificial Sequence
  Description of Artificial Sequence: Synthetic oligonucleotide
ttctgatgatgagatttatgactgcaaggtggagcac

SEQ ID NO: 56910 - DNA, 36 bp, Artificial Sequence
  Description of Artificial Sequence: Synthetic oligonucleotide
tctgatgatgagatttatgactgcaaggtggagcac

SEQ ID NO: 56911 - DNA, 35 bp, Artificial Sequence
  Description of Artificial Sequence: Synthetic oligonucleotide
ctgatgatgagatttatgactgcaaggtggagcac

SEQ ID NO: 56912 - DNA, 36 bp, Artificial Sequence
  Description of Artificial Sequence: Synthetic oligonucleotide
tgatgatgagatttatgactgcaaggtggagcactg

SEQ ID NO: 56913 - DNA, 35 bp, Artificial Sequence
  Description of Artificial Sequence: Synthetic oligonucleotide
gatgatgagatttatgactgcaaggtggagcactg

SEQ ID NO: 56914 - DNA, 35 bp, Artificial Sequence
  Description of Artificial Sequence: Synthetic oligonucleotide
atgatgagatttatgactgcaaggtggagcactgg

SEQ ID NO: 56915 - DNA, 27 bp, Artificial Sequence
  Description of Artificial Sequence: Synthetic oligonucleotide
aacaaagctctgctgctgggggccctt

SEQ ID NO: 56916 - DNA, 26 bp, Artificial Sequence
  Description of Artificial Sequence: Synthetic oligonucleotide
acaaagctctgctgctgggggccctt

SEQ ID NO: 56917 - DNA, 25 bp, Artificial Sequence
  Description of Artificial Sequence: Synthetic oligonucleotide
caaagctctgctgctgggggccctt

SEQ ID NO: 56918 - DNA, 25 bp, Artificial Sequence
  Description of Artificial Sequence: Synthetic oligonucleotide
aaagctctgctgctgggggcccttg

SEQ ID NO: 56919 - DNA, 24 bp, Artificial Sequence
  Description of Artificial Sequence: Synthetic oligonucleotide
aagctctgctgctgggggcccttg

SEQ ID NO: 56920 - DNA, 23 bp, Artificial Sequence
  Description of Artificial Sequence: Synthetic oligonucleotide
agctctgctgctgggggcccttg

SEQ ID NO: 56921 - DNA, 22 bp, Artificial Sequence
  Description of Artificial Sequence: Synthetic oligonucleotide
gctctgctgctgggggcccttg

SEQ ID NO: 56922 - DNA, 22 bp, Artificial Sequence
  Description of Artificial Sequence: Synthetic oligonucleotide
ctctgctgctgggggcccttgc

SEQ ID NO: 56923 - DNA, 22 bp, Artificial Sequence
  Description of Artificial Sequence: Synthetic oligonucleotide
tctgctgctgggggcccttgcc

SEQ ID NO: 56924 - DNA, 21 bp, Artificial Sequence
  Description of Artificial Sequence: Synthetic oligonucleotide
ctgctgctgggggcccttgcc

SEQ ID NO: 56925 - DNA, 22 bp, Artificial Sequence
  Description of Artificial Sequence: Synthetic oligonucleotide
tgctgctgggggcccttgccct

SEQ ID NO: 56926 - DNA, 21 bp, Artificial Sequence
  Description of Artificial Sequence: Synthetic oligonucleotide
gctgctgggggcccttgccct

SEQ ID NO: 56927 - DNA, 22 bp, Artificial Sequence
  Description of Artificial Sequence: Synthetic oligonucleotide
ctgctgggggcccttgccctga

SEQ ID NO: 56928 - DNA, 22 bp, Artificial Sequence
  Description of Artificial Sequence: Synthetic oligonucleotide
tgctgggggcccttgccctgac

SEQ ID NO: 56929 - DNA, 21 bp, Artificial Sequence
  Description of Artificial Sequence: Synthetic oligonucleotide
gctgggggcccttgccctgac

SEQ ID NO: 56930 - DNA, 22 bp, Artificial Sequence
  Description of Artificial Sequence: Synthetic oligonucleotide
ctgggggcccttgccctgacca

SEQ ID NO: 56931 - DNA, 22 bp, Artificial Sequence
  Description of Artificial Sequence: Synthetic oligonucleotide
tgggggcccttgccctgaccac

SEQ ID NO: 56932 - DNA, 21 bp, Artificial Sequence
  Description of Artificial Sequence: Synthetic oligonucleotide
gggggcccttgccctgaccac

SEQ ID NO: 56933 - DNA, 21 bp, Artificial Sequence
  Description of Artificial Sequence: Synthetic oligonucleotide
ggggcccttgccctgaccacc

SEQ ID NO: 56934 - DNA, 22 bp, Artificial Sequence
  Description of Artificial Sequence: Synthetic oligonucleotide
gggcccttgccctgaccaccgt

SEQ ID NO: 56935 - DNA, 24 bp, Artificial Sequence
  Description of Artificial Sequence: Synthetic oligonucleotide
ggcccttgccctgaccaccgtgat

SEQ ID NO: 56936 - DNA, 25 bp, Artificial Sequence
  Description of Artificial Sequence: Synthetic oligonucleotide
gcccttgccctgaccaccgtgatga

SEQ ID NO: 56937 - DNA, 25 bp, Artificial Sequence
  Description of Artificial Sequence: Synthetic oligonucleotide
cccttgccctgaccaccgtgatgag

SEQ ID NO: 56938 - DNA, 25 bp, Artificial Sequence
  Description of Artificial Sequence: Synthetic oligonucleotide
ccttgccctgaccaccgtgatgagc

SEQ ID NO: 56939 - DNA, 25 bp, Artificial Sequence
  Description of Artificial Sequence: Synthetic oligonucleotide
cttgccctgaccaccgtgatgagcc

SEQ ID NO: 56940 - DNA, 25 bp, Artificial Sequence
  Description of Artificial Sequence: Synthetic oligonucleotide
ttgccctgaccaccgtgatgagccc

SEQ ID NO: 56941 - DNA, 24 bp, Artificial Sequence
  Description of Artificial Sequence: Synthetic oligonucleotide
tgccctgaccaccgtgatgagccc

SEQ ID NO: 56942 - DNA, 23 bp, Artificial Sequence
  Description of Artificial Sequence: Synthetic oligonucleotide
gccctgaccaccgtgatgagccc

SEQ ID NO: 56943 - DNA, 24 bp, Artificial Sequence
  Description of Artificial Sequence: Synthetic oligonucleotide
ccctgaccaccgtgatgagcccct

SEQ ID NO: 56944 - DNA, 25 bp, Artificial Sequence
  Description of Artificial Sequence: Synthetic oligonucleotide
cctgaccaccgtgatgagcccctgt

SEQ ID NO: 56945 - DNA, 35 bp, Artificial Sequence
  Description of Artificial Sequence: Synthetic oligonucleotide
tgaagacattgtggctgaccatgttgcctcttatg

SEQ ID NO: 56946 - DNA, 34 bp, Artificial Sequence
  Description of Artificial Sequence: Synthetic oligonucleotide
gaagacattgtggctgaccatgttgcctcttatg

SEQ ID NO: 56947 - DNA, 34 bp, Artificial Sequence
  Description of Artificial Sequence: Synthetic oligonucleotide
aagacattgtggctgaccatgttgcctcttatgg

SEQ ID NO: 56948 - DNA, 33 bp, Artificial Sequence
  Description of Artificial Sequence: Synthetic oligonucleotide
agacattgtggctgaccatgttgcctcttatgg

SEQ ID NO: 56949 - DNA, 32 bp, Artificial Sequence
  Description of Artificial Sequence: Synthetic oligonucleotide
gacattgtggctgaccatgttgcctcttatgg

SEQ ID NO: 56950 - DNA, 33 bp, Artificial Sequence
  Description of Artificial Sequence: Synthetic oligonucleotide
acattgtggctgaccatgttgcctcttatggtg

SEQ ID NO: 56951 - DNA, 32 bp, Artificial Sequence
  Description of Artificial Sequence: Synthetic oligonucleotide
cattgtggctgaccatgttgcctcttatggtg

SEQ ID NO: 56952 - DNA, 36 bp, Artificial Sequence
  Description of Artificial Sequence: Synthetic oligonucleotide
attgtggctgaccatgttgcctcttatggtgtaaac

SEQ ID NO: 56953 - DNA, 35 bp, Artificial Sequence
  Description of Artificial Sequence: Synthetic oligonucleotide
ttgtggctgaccatgttgcctcttatggtgtaaac

SEQ ID NO: 56954 - DNA, 34 bp, Artificial Sequence
  Description of Artificial Sequence: Synthetic oligonucleotide
tgtggctgaccatgttgcctcttatggtgtaaac

SEQ ID NO: 56955 - DNA, 33 bp, Artificial Sequence
  Description of Artificial Sequence: Synthetic oligonucleotide
gtggctgaccatgttgcctcttatggtgtaaac

SEQ ID NO: 56956 - DNA, 35 bp, Artificial Sequence
  Description of Artificial Sequence: Synthetic oligonucleotide
tggctgaccatgttgcctcttatggtgtaaacttg

SEQ ID NO: 56957 - DNA, 34 bp, Artificial Sequence
  Description of Artificial Sequence: Synthetic oligonucleotide
ggctgaccatgttgcctcttatggtgtaaacttg

SEQ ID NO: 56958 - DNA, 36 bp, Artificial Sequence
  Description of Artificial Sequence: Synthetic oligonucleotide
gctgaccatgttgcctcttatggtgtaaacttgtac

SEQ ID NO: 56959 - DNA, 36 bp, Artificial Sequence
  Description of Artificial Sequence: Synthetic oligonucleotide
ctgaccatgttgcctcttatggtgtaaacttgtacc

SEQ ID NO: 56960 - DNA, 37 bp, Artificial Sequence
  Description of Artificial Sequence: Synthetic oligonucleotide
tgaccatgttgcctcttatggtgtaaacttgtaccag

SEQ ID NO: 56961 - DNA, 36 bp, Artificial Sequence
  Description of Artificial Sequence: Synthetic oligonucleotide
gaccatgttgcctcttatggtgtaaacttgtaccag

SEQ ID NO: 56962 - DNA, 37 bp, Artificial Sequence
  Description of Artificial Sequence: Synthetic oligonucleotide
accatgttgcctcttatggtgtaaacttgtaccagtc

SEQ ID NO: 56963 - DNA, 36 bp, Artificial Sequence
  Description of Artificial Sequence: Synthetic oligonucleotide
ccatgttgcctcttatggtgtaaacttgtaccagtc

SEQ ID NO: 56964 - DNA, 39 bp, Artificial Sequence
  Description of Artificial Sequence: Synthetic oligonucleotide
catgttgcctcttatggtgtaaacttgtaccagtcttac

SEQ ID NO: 56965 - DNA, 39 bp, Artificial Sequence
  Description of Artificial Sequence: Synthetic oligonucleotide
atgttgcctcttatggtgtaaacttgtaccagtcttacg

SEQ ID NO: 56966 - DNA, 38 bp, Artificial Sequence
  Description of Artificial Sequence: Synthetic oligonucleotide
tgttgcctcttatggtgtaaacttgtaccagtcttacg

SEQ ID NO: 56967 - DNA, 37 bp, Artificial Sequence
  Description of Artificial Sequence: Synthetic oligonucleotide
gttgcctcttatggtgtaaacttgtaccagtcttacg

SEQ ID NO: 56968 - DNA, 37 bp, Artificial Sequence
  Description of Artificial Sequence: Synthetic oligonucleotide
ttgcctcttatggtgtaaacttgtaccagtcttacgg

SEQ ID NO: 56969 - DNA, 36 bp, Artificial Sequence
  Description of Artificial Sequence: Synthetic oligonucleotide
tgcctcttatggtgtaaacttgtaccagtcttacgg

SEQ ID NO: 56970 - DNA, 35 bp, Artificial Sequence
  Description of Artificial Sequence: Synthetic oligonucleotide
gcctcttatggtgtaaacttgtaccagtcttacgg

SEQ ID NO: 56971 - DNA, 36 bp, Artificial Sequence
  Description of Artificial Sequence: Synthetic oligonucleotide
cctcttatggtgtaaacttgtaccagtcttacggtc

SEQ ID NO: 56972 - DNA, 36 bp, Artificial Sequence
  Description of Artificial Sequence: Synthetic oligonucleotide
ctcttatggtgtaaacttgtaccagtcttacggtcc

SEQ ID NO: 56973 - DNA, 36 bp, Artificial Sequence
  Description of Artificial Sequence: Synthetic oligonucleotide
tcttatggtgtaaacttgtaccagtcttacggtccc

SEQ ID NO: 56974 - DNA, 35 bp, Artificial Sequence
  Description of Artificial Sequence: Synthetic oligonucleotide
cttatggtgtaaacttgtaccagtcttacggtccc

SEQ ID NO: 56975 - DNA, 36 bp, Artificial Sequence
  Description of Artificial Sequence: Synthetic oligonucleotide
ttatggtgtaaacttgtaccagtcttacggtccctc

SEQ ID NO: 56976 - DNA, 35 bp, Artificial Sequence
  Description of Artificial Sequence: Synthetic oligonucleotide
tatggtgtaaacttgtaccagtcttacggtccctc

SEQ ID NO: 56977 - DNA, 34 bp, Artificial Sequence
  Description of Artificial Sequence: Synthetic oligonucleotide
atggtgtaaacttgtaccagtcttacggtccctc

SEQ ID NO: 56978 - DNA, 33 bp, Artificial Sequence
  Description of Artificial Sequence: Synthetic oligonucleotide
tggtgtaaacttgtaccagtcttacggtccctc

SEQ ID NO: 56979 - DNA, 27 bp, Artificial Sequence
  Description of Artificial Sequence: Synthetic oligonucleotide
ccagtcttacggtccctctggccagta

SEQ ID NO: 56980 - DNA, 27 bp, Artificial Sequence
  Description of Artificial Sequence: Synthetic oligonucleotide
cagtcttacggtccctctggccagtac

SEQ ID NO: 56981 - DNA, 28 bp, Artificial Sequence
  Description of Artificial Sequence: Synthetic oligonucleotide
agtcttacggtccctctggccagtacac

SEQ ID NO: 56982 - DNA, 27 bp, Artificial Sequence
  Description of Artificial Sequence: Synthetic oligonucleotide
gtcttacggtccctctggccagtacac

SEQ ID NO: 56983 - DNA, 27 bp, Artificial Sequence
  Description of Artificial Sequence: Synthetic oligonucleotide
tcttacggtccctctggccagtacacc

SEQ ID NO: 56984 - DNA, 26 bp, Artificial Sequence
  Description of Artificial Sequence: Synthetic oligonucleotide
cttacggtccctctggccagtacacc

SEQ ID NO: 56985 - DNA, 33 bp, Artificial Sequence
  Description of Artificial Sequence: Synthetic oligonucleotide
tctggccagtacacccatgaatttgatggagac

SEQ ID NO: 56986 - DNA, 32 bp, Artificial Sequence
  Description of Artificial Sequence: Synthetic oligonucleotide
ctggccagtacacccatgaatttgatggagac

SEQ ID NO: 56987 - DNA, 32 bp, Artificial Sequence
  Description of Artificial Sequence: Synthetic oligonucleotide
tggccagtacacccatgaatttgatggagacg

SEQ ID NO: 56988 - DNA, 31 bp, Artificial Sequence
  Description of Artificial Sequence: Synthetic oligonucleotide
ggccagtacacccatgaatttgatggagacg

SEQ ID NO: 56989 - DNA, 32 bp, Artificial Sequence
  Description of Artificial Sequence: Synthetic oligonucleotide
gccagtacacccatgaatttgatggagacgag

SEQ ID NO: 56990 - DNA, 32 bp, Artificial Sequence
  Description of Artificial Sequence: Synthetic oligonucleotide
ccagtacacccatgaatttgatggagacgagc

SEQ ID NO: 56991 - DNA, 33 bp, Artificial Sequence
  Description of Artificial Sequence: Synthetic oligonucleotide
cagtacacccatgaatttgatggagacgagcag

SEQ ID NO: 56992 - DNA, 35 bp, Artificial Sequence
  Description of Artificial Sequence: Synthetic oligonucleotide
agtacacccatgaatttgatggagacgagcagttc

SEQ ID NO: 56993 - DNA, 34 bp, Artificial Sequence
  Description of Artificial Sequence: Synthetic oligonucleotide
gtacacccatgaatttgatggagacgagcagttc

SEQ ID NO: 56994 - DNA, 36 bp, Artificial Sequence
  Description of Artificial Sequence: Synthetic oligonucleotide
tacacccatgaatttgatggagacgagcagttctac

SEQ ID NO: 56995 - DNA, 35 bp, Artificial Sequence
  Description of Artificial Sequence: Synthetic oligonucleotide
acacccatgaatttgatggagacgagcagttctac

SEQ ID NO: 56996 - DNA, 34 bp, Artificial Sequence
  Description of Artificial Sequence: Synthetic oligonucleotide
cacccatgaatttgatggagacgagcagttctac

SEQ ID NO: 56997 - DNA, 34 bp, Artificial Sequence
  Description of Artificial Sequence: Synthetic oligonucleotide
acccatgaatttgatggagacgagcagttctacg

SEQ ID NO: 56998 - DNA, 33 bp, Artificial Sequence
  Description of Artificial Sequence: Synthetic oligonucleotide
cccatgaatttgatggagacgagcagttctacg

SEQ ID NO: 56999 - DNA, 34 bp, Artificial Sequence
  Description of Artificial Sequence: Synthetic oligonucleotide
ccatgaatttgatggagacgagcagttctacgtg

SEQ ID NO: 57000 - DNA, 34 bp, Artificial Sequence
  Description of Artificial Sequence: Synthetic oligonucleotide
catgaatttgatggagacgagcagttctacgtgg

SEQ ID NO: 57001 - DNA, 35 bp, Artificial Sequence
  Description of Artificial Sequence: Synthetic oligonucleotide
atgaatttgatggagacgagcagttctacgtggac

SEQ ID NO: 57002 - DNA, 34 bp, Artificial Sequence
  Description of Artificial Sequence: Synthetic oligonucleotide
tgaatttgatggagacgagcagttctacgtggac

SEQ ID NO: 57003 - DNA, 33 bp, Artificial Sequence
  Description of Artificial Sequence: Synthetic oligonucleotide
gaatttgatggagacgagcagttctacgtggac

SEQ ID NO: 57004 - DNA, 33 bp, Artificial Sequence
  Description of Artificial Sequence: Synthetic oligonucleotide
aatttgatggagacgagcagttctacgtggacc

SEQ ID NO: 57005 - DNA, 32 bp, Artificial Sequence
  Description of Artificial Sequence: Synthetic oligonucleotide
atttgatggagacgagcagttctacgtggacc

SEQ ID NO: 57006 - DNA, 31 bp, Artificial Sequence
  Description of Artificial Sequence: Synthetic oligonucleotide
tttgatggagacgagcagttctacgtggacc

SEQ ID NO: 57007 - DNA, 30 bp, Artificial Sequence
  Description of Artificial Sequence: Synthetic oligonucleotide
ttgatggagacgagcagttctacgtggacc

SEQ ID NO: 57008 - DNA, 29 bp, Artificial Sequence
  Description of Artificial Sequence: Synthetic oligonucleotide
tgatggagacgagcagttctacgtggacc

SEQ ID NO: 57009 - DNA, 28 bp, Artificial Sequence
  Description of Artificial Sequence: Synthetic oligonucleotide
gatggagacgagcagttctacgtggacc

SEQ ID NO: 57010 - DNA, 29 bp, Artificial Sequence
  Description of Artificial Sequence: Synthetic oligonucleotide
atggagacgagcagttctacgtggacctg

SEQ ID NO: 57011 - DNA, 28 bp, Artificial Sequence
  Description of Artificial Sequence: Synthetic oligonucleotide
tggagacgagcagttctacgtggacctg

SEQ ID NO: 57012 - DNA, 27 bp, Artificial Sequence
  Description of Artificial Sequence: Synthetic oligonucleotide
ggagacgagcagttctacgtggacctg

SEQ ID NO: 57013 - DNA, 27 bp, Artificial Sequence
  Description of Artificial Sequence: Synthetic oligonucleotide
gagacgagcagttctacgtggacctgg

SEQ ID NO: 57014 - DNA, 27 bp, Artificial Sequence
  Description of Artificial Sequence: Synthetic oligonucleotide
agacgagcagttctacgtggacctggg

SEQ ID NO: 57015 - DNA, 26 bp, Artificial Sequence
  Description of Artificial Sequence: Synthetic oligonucleotide
gacgagcagttctacgtggacctggg

SEQ ID NO: 57016 - DNA, 27 bp, Artificial Sequence
  Description of Artificial Sequence: Synthetic oligonucleotide
acgagcagttctacgtggacctgggga

SEQ ID NO: 57017 - DNA, 26 bp, Artificial Sequence
  Description of Artificial Sequence: Synthetic oligonucleotide
cgagcagttctacgtggacctgggga

SEQ ID NO: 57018 - DNA, 26 bp, Artificial Sequence
  Description of Artificial Sequence: Synthetic oligonucleotide
gagcagttctacgtggacctggggag

SEQ ID NO: 57019 - DNA, 27 bp, Artificial Sequence
  Description of Artificial Sequence: Synthetic oligonucleotide
agcagttctacgtggacctggggagga

SEQ ID NO: 57020 - DNA, 27 bp, Artificial Sequence
  Description of Artificial Sequence: Synthetic oligonucleotide
gcagttctacgtggacctggggaggaa

SEQ ID NO: 57021 - DNA, 27 bp, Artificial Sequence
  Description of Artificial Sequence: Synthetic oligonucleotide
cagttctacgtggacctggggaggaag

SEQ ID NO: 57022 - DNA, 27 bp, Artificial Sequence
  Description of Artificial Sequence: Synthetic oligonucleotide
agttctacgtggacctggggaggaagg

SEQ ID NO: 57023 - DNA, 27 bp, Artificial Sequence
  Description of Artificial Sequence: Synthetic oligonucleotide
gttctacgtggacctggggaggaagga

SEQ ID NO: 57024 - DNA, 27 bp, Artificial Sequence
  Description of Artificial Sequence: Synthetic oligonucleotide
ttctacgtggacctggggaggaaggag

SEQ ID NO: 57025 - DNA, 27 bp, Artificial Sequence
  Description of Artificial Sequence: Synthetic oligonucleotide
tctacgtggacctggggaggaaggaga

SEQ ID NO: 57026 - DNA, 26 bp, Artificial Sequence
  Description of Artificial Sequence: Synthetic oligonucleotide
ctacgtggacctggggaggaaggaga

SEQ ID NO: 57027 - DNA, 27 bp, Artificial Sequence
  Description of Artificial Sequence: Synthetic oligonucleotide
tacgtggacctggggaggaaggagact

SEQ ID NO: 57028 - DNA, 26 bp, Artificial Sequence
  Description of Artificial Sequence: Synthetic oligonucleotide
acgtggacctggggaggaaggagact

SEQ ID NO: 57029 - DNA, 25 bp, Artificial Sequence
  Description of Artificial Sequence: Synthetic oligonucleotide
cgtggacctggggaggaaggagact

SEQ ID NO: 57030 - DNA, 26 bp, Artificial Sequence
  Description of Artificial Sequence: Synthetic oligonucleotide
gtggacctggggaggaaggagactgt

SEQ ID NO: 57031 - DNA, 27 bp, Artificial Sequence
  Description of Artificial Sequence: Synthetic oligonucleotide
tggacctggggaggaaggagactgtct

SEQ ID NO: 57032 - DNA, 26 bp, Artificial Sequence
  Description of Artificial Sequence: Synthetic oligonucleotide
ggacctggggaggaaggagactgtct

SEQ ID NO: 57033 - DNA, 26 bp, Artificial Sequence
  Description of Artificial Sequence: Synthetic oligonucleotide
gacctggggaggaaggagactgtctg

SEQ ID NO: 57034 - DNA, 27 bp, Artificial Sequence
  Description of Artificial Sequence: Synthetic oligonucleotide
acctggggaggaaggagactgtctggt

SEQ ID NO: 57035 - DNA, 26 bp, Artificial Sequence
  Description of Artificial Sequence: Synthetic oligonucleotide
cctggggaggaaggagactgtctggt

SEQ ID NO: 57036 - DNA, 27 bp, Artificial Sequence
  Description of Artificial Sequence: Synthetic oligonucleotide
ctggggaggaaggagactgtctggtgt

SEQ ID NO: 57037 - DNA, 29 bp, Artificial Sequence
  Description of Artificial Sequence: Synthetic oligonucleotide
tggggaggaaggagactgtctggtgtttg

SEQ ID NO: 57038 - DNA, 28 bp, Artificial Sequence
  Description of Artificial Sequence: Synthetic oligonucleotide
ggggaggaaggagactgtctggtgtttg

SEQ ID NO: 57039 - DNA, 28 bp, Artificial Sequence
  Description of Artificial Sequence: Synthetic oligonucleotide
gggaggaaggagactgtctggtgtttgc

SEQ ID NO: 57040 - DNA, 28 bp, Artificial Sequence
  Description of Artificial Sequence: Synthetic oligonucleotide
ggaggaaggagactgtctggtgtttgcc

SEQ ID NO: 57041 - DNA, 29 bp, Artificial Sequence
  Description of Artificial Sequence: Synthetic oligonucleotide
gaggaaggagactgtctggtgtttgcctg

SEQ ID NO: 57042 - DNA, 31 bp, Artificial Sequence
  Description of Artificial Sequence: Synthetic oligonucleotide
aggaaggagactgtctggtgtttgcctgttc

SEQ ID NO: 57043 - DNA, 30 bp, Artificial Sequence
  Description of Artificial Sequence: Synthetic oligonucleotide
ggaaggagactgtctggtgtttgcctgttc

SEQ ID NO: 57044 - DNA, 31 bp, Artificial Sequence
  Description of Artificial Sequence: Synthetic oligonucleotide
gaaggagactgtctggtgtttgcctgttctc

SEQ ID NO: 57045 - DNA, 32 bp, Artificial Sequence
  Description of Artificial Sequence: Synthetic oligonucleotide
aaggagactgtctggtgtttgcctgttctcag

SEQ ID NO: 57046 - DNA, 31 bp, Artificial Sequence
  Description of Artificial Sequence: Synthetic oligonucleotide
aggagactgtctggtgtttgcctgttctcag

SEQ ID NO: 57047 - DNA, 30 bp, Artificial Sequence
  Description of Artificial Sequence: Synthetic oligonucleotide
ggagactgtctggtgtttgcctgttctcag

SEQ ID NO: 57048 - DNA, 31 bp, Artificial Sequence
  Description of Artificial Sequence: Synthetic oligonucleotide
gagactgtctggtgtttgcctgttctcagac

SEQ ID NO: 57049 - DNA, 37 bp, Artificial Sequence
  Description of Artificial Sequence: Synthetic oligonucleotide
agactgtctggtgtttgcctgttctcagacaatttag

SEQ ID NO: 57050 - DNA, 36 bp, Artificial Sequence
  Description of Artificial Sequence: Synthetic oligonucleotide
gactgtctggtgtttgcctgttctcagacaatttag

SEQ ID NO: 57051 - DNA, 40 bp, Artificial Sequence
  Description of Artificial Sequence: Synthetic oligonucleotide
actgtctggtgtttgcctgttctcagacaatttagatttg

SEQ ID NO: 57052 - DNA, 39 bp, Artificial Sequence
  Description of Artificial Sequence: Synthetic oligonucleotide
ctgtctggtgtttgcctgttctcagacaatttagatttg

SEQ ID NO: 57053 - DNA, 40 bp, Artificial Sequence
  Description of Artificial Sequence: Synthetic oligonucleotide
tgtctggtgtttgcctgttctcagacaatttagatttgac

SEQ ID NO: 57054 - DNA, 39 bp, Artificial Sequence
  Description of Artificial Sequence: Synthetic oligonucleotide
gtctggtgtttgcctgttctcagacaatttagatttgac

SEQ ID NO: 57055 - DNA, 39 bp, Artificial Sequence
  Description of Artificial Sequence: Synthetic oligonucleotide
tctggtgtttgcctgttctcagacaatttagatttgacc

SEQ ID NO: 57056 - DNA, 38 bp, Artificial Sequence
  Description of Artificial Sequence: Synthetic oligonucleotide
ctggtgtttgcctgttctcagacaatttagatttgacc

SEQ ID NO: 57057 - DNA, 38 bp, Artificial Sequence
  Description of Artificial Sequence: Synthetic oligonucleotide
tggtgtttgcctgttctcagacaatttagatttgaccc

SEQ ID NO: 57058 - DNA, 37 bp, Artificial Sequence
  Description of Artificial Sequence: Synthetic oligonucleotide
ggtgtttgcctgttctcagacaatttagatttgaccc

SEQ ID NO: 57059 - DNA, 37 bp, Artificial Sequence
  Description of Artificial Sequence: Synthetic oligonucleotide
gtgtttgcctgttctcagacaatttagatttgacccg

SEQ ID NO: 57060 - DNA, 37 bp, Artificial Sequence
  Description of Artificial Sequence: Synthetic oligonucleotide
tgtttgcctgttctcagacaatttagatttgacccgc

SEQ ID NO: 57061 - DNA, 36 bp, Artificial Sequence
  Description of Artificial Sequence: Synthetic oligonucleotide
gtttgcctgttctcagacaatttagatttgacccgc

SEQ ID NO: 57062 - DNA, 41 bp, Artificial Sequence
  Description of Artificial Sequence: Synthetic oligonucleotide
tttgcctgttctcagacaatttagatttgacccgcaatttg

SEQ ID NO: 57063 - DNA, 40 bp, Artificial Sequence
  Description of Artificial Sequence: Synthetic oligonucleotide
ttgcctgttctcagacaatttagatttgacccgcaatttg

SEQ ID NO: 57064 - DNA, 39 bp, Artificial Sequence
  Description of Artificial Sequence: Synthetic oligonucleotide
tgcctgttctcagacaatttagatttgacccgcaatttg

SEQ ID NO: 57065 - DNA, 38 bp, Artificial Sequence
  Description of Artificial Sequence: Synthetic oligonucleotide
gcctgttctcagacaatttagatttgacccgcaatttg

SEQ ID NO: 57066 - DNA, 38 bp, Artificial Sequence
  Description of Artificial Sequence: Synthetic oligonucleotide
cctgttctcagacaatttagatttgacccgcaatttgc

SEQ ID NO: 57067 - DNA, 39 bp, Artificial Sequence
  Description of Artificial Sequence: Synthetic oligonucleotide
ctgttctcagacaatttagatttgacccgcaatttgcac

SEQ ID NO: 57068 - DNA, 40 bp, Artificial Sequence
  Description of Artificial Sequence: Synthetic oligonucleotide
tgttctcagacaatttagatttgacccgcaatttgcactg

SEQ ID NO: 57069 - DNA, 39 bp, Artificial Sequence
  Description of Artificial Sequence: Synthetic oligonucleotide
gttctcagacaatttagatttgacccgcaatttgcactg

SEQ ID NO: 57070 - DNA, 40 bp, Artificial Sequence
  Description of Artificial Sequence: Synthetic oligonucleotide
ttctcagacaatttagatttgacccgcaatttgcactgac

SEQ ID NO: 57071 - DNA, 39 bp, Artificial Sequence
  Description of Artificial Sequence: Synthetic oligonucleotide
tctcagacaatttagatttgacccgcaatttgcactgac

SEQ ID NO: 57072 - DNA, 38 bp, Artificial Sequence
  Description of Artificial Sequence: Synthetic oligonucleotide
ctcagacaatttagatttgacccgcaatttgcactgac

SEQ ID NO: 57073 - DNA, 41 bp, Artificial Sequence
  Description of Artificial Sequence: Synthetic oligonucleotide
tcagacaatttagatttgacccgcaatttgcactgacaaac

SEQ ID NO: 57074 - DNA, 40 bp, Artificial Sequence
  Description of Artificial Sequence: Synthetic oligonucleotide
cagacaatttagatttgacccgcaatttgcactgacaaac

SEQ ID NO: 57075 - DNA, 42 bp, Artificial Sequence
  Description of Artificial Sequence: Synthetic oligonucleotide
agacaatttagatttgacccgcaatttgcactgacaaacatc

SEQ ID NO: 57076 - DNA, 41 bp, Artificial Sequence
  Description of Artificial Sequence: Synthetic oligonucleotide
gacaatttagatttgacccgcaatttgcactgacaaacatc

SEQ ID NO: 57077 - DNA, 41 bp, Artificial Sequence
  Description of Artificial Sequence: Synthetic oligonucleotide
acaatttagatttgacccgcaatttgcactgacaaacatcg

SEQ ID NO: 57078 - DNA, 40 bp, Artificial Sequence
  Description of Artificial Sequence: Synthetic oligonucleotide
caatttagatttgacccgcaatttgcactgacaaacatcg

SEQ ID NO: 57079 - DNA, 40 bp, Artificial Sequence
  Description of Artificial Sequence: Synthetic oligonucleotide
aatttagatttgacccgcaatttgcactgacaaacatcgc

SEQ ID NO: 57080 - DNA, 39 bp, Artificial Sequence
  Description of Artificial Sequence: Synthetic oligonucleotide
atttagatttgacccgcaatttgcactgacaaacatcgc

SEQ ID NO: 57081 - DNA, 38 bp, Artificial Sequence
  Description of Artificial Sequence: Synthetic oligonucleotide
tttagatttgacccgcaatttgcactgacaaacatcgc

SEQ ID NO: 57082 - DNA, 32 bp, Artificial Sequence
  Description of Artificial Sequence: Synthetic oligonucleotide
ccgcaatttgcactgacaaacatcgctgtgac

SEQ ID NO: 57083 - DNA, 36 bp, Artificial Sequence
  Description of Artificial Sequence: Synthetic oligonucleotide
cgcaatttgcactgacaaacatcgctgtgacaaaac

SEQ ID NO: 57084 - DNA, 37 bp, Artificial Sequence
  Description of Artificial Sequence: Synthetic oligonucleotide
gcaatttgcactgacaaacatcgctgtgacaaaacac

SEQ ID NO: 57085 - DNA, 39 bp, Artificial Sequence
  Description of Artificial Sequence: Synthetic oligonucleotide
caatttgcactgacaaacatcgctgtgacaaaacacaac

SEQ ID NO: 57086 - DNA, 41 bp, Artificial Sequence
  Description of Artificial Sequence: Synthetic oligonucleotide
aatttgcactgacaaacatcgctgtgacaaaacacaacttg

SEQ ID NO: 57087 - DNA, 40 bp, Artificial Sequence
  Description of Artificial Sequence: Synthetic oligonucleotide
atttgcactgacaaacatcgctgtgacaaaacacaacttg

SEQ ID NO: 57088 - DNA, 39 bp, Artificial Sequence
  Description of Artificial Sequence: Synthetic oligonucleotide
tttgcactgacaaacatcgctgtgacaaaacacaacttg

SEQ ID NO: 57089 - DNA, 38 bp, Artificial Sequence
  Description of Artificial Sequence: Synthetic oligonucleotide
ttgcactgacaaacatcgctgtgacaaaacacaacttg

SEQ ID NO: 57090 - DNA, 37 bp, Artificial Sequence
  Description of Artificial Sequence: Synthetic oligonucleotide
tgcactgacaaacatcgctgtgacaaaacacaacttg

SEQ ID NO: 57091 - DNA, 36 bp, Artificial Sequence
  Description of Artificial Sequence: Synthetic oligonucleotide
gcactgacaaacatcgctgtgacaaaacacaacttg

SEQ ID NO: 57092 - DNA, 38 bp, Artificial Sequence
  Description of Artificial Sequence: Synthetic oligonucleotide
cactgacaaacatcgctgtgacaaaacacaacttgaac

SEQ ID NO: 57093 - DNA, 40 bp, Artificial Sequence
  Description of Artificial Sequence: Synthetic oligonucleotide
actgacaaacatcgctgtgacaaaacacaacttgaacatc

SEQ ID NO: 57094 - DNA, 39 bp, Artificial Sequence
  Description of Artificial Sequence: Synthetic oligonucleotide
ctgacaaacatcgctgtgacaaaacacaacttgaacatc

SEQ ID NO: 57095 - DNA, 39 bp, Artificial Sequence
  Description of Artificial Sequence: Synthetic oligonucleotide
tgacaaacatcgctgtgacaaaacacaacttgaacatcc

SEQ ID NO: 57096 - DNA, 38 bp, Artificial Sequence
  Description of Artificial Sequence: Synthetic oligonucleotide
gacaaacatcgctgtgacaaaacacaacttgaacatcc

SEQ ID NO: 57097 - DNA, 39 bp, Artificial Sequence
  Description of Artificial Sequence: Synthetic oligonucleotide
acaaacatcgctgtgacaaaacacaacttgaacatcctg

SEQ ID NO: 57098 - DNA, 38 bp, Artificial Sequence
  Description of Artificial Sequence: Synthetic oligonucleotide
caaacatcgctgtgacaaaacacaacttgaacatcctg

SEQ ID NO: 57099 - DNA, 44 bp, Artificial Sequence
  Description of Artificial Sequence: Synthetic oligonucleotide
aaacatcgctgtgacaaaacacaacttgaacatcctgattaaac

SEQ ID NO: 57100 - DNA, 43 bp, Artificial Sequence
  Description of Artificial Sequence: Synthetic oligonucleotide
aacatcgctgtgacaaaacacaacttgaacatcctgattaaac

SEQ ID NO: 57101 - DNA, 42 bp, Artificial Sequence
  Description of Artificial Sequence: Synthetic oligonucleotide
acatcgctgtgacaaaacacaacttgaacatcctgattaaac

SEQ ID NO: 57102 - DNA, 41 bp, Artificial Sequence
  Description of Artificial Sequence: Synthetic oligonucleotide
catcgctgtgacaaaacacaacttgaacatcctgattaaac

SEQ ID NO: 57103 - DNA, 41 bp, Artificial Sequence
  Description of Artificial Sequence: Synthetic oligonucleotide
atcgctgtgacaaaacacaacttgaacatcctgattaaacg

SEQ ID NO: 57104 - DNA, 40 bp, Artificial Sequence
  Description of Artificial Sequence: Synthetic oligonucleotide
tcgctgtgacaaaacacaacttgaacatcctgattaaacg

SEQ ID NO: 57105 - DNA, 39 bp, Artificial Sequence
  Description of Artificial Sequence: Synthetic oligonucleotide
cgctgtgacaaaacacaacttgaacatcctgattaaacg

SEQ ID NO: 57106 - DNA, 39 bp, Artificial Sequence
  Description of Artificial Sequence: Synthetic oligonucleotide
gctgtgacaaaacacaacttgaacatcctgattaaacgc

SEQ ID NO: 57107 - DNA, 40 bp, Artificial Sequence
  Description of Artificial Sequence: Synthetic oligonucleotide
ctgtgacaaaacacaacttgaacatcctgattaaacgctc

SEQ ID NO: 57108 - DNA, 40 bp, Artificial Sequence
  Description of Artificial Sequence: Synthetic oligonucleotide
tgtgacaaaacacaacttgaacatcctgattaaacgctcc

SEQ ID NO: 57109 - DNA, 39 bp, Artificial Sequence
  Description of Artificial Sequence: Synthetic oligonucleotide
gtgacaaaacacaacttgaacatcctgattaaacgctcc

SEQ ID NO: 57110 - DNA, 41 bp, Artificial Sequence
  Description of Artificial Sequence: Synthetic oligonucleotide
tgacaaaacacaacttgaacatcctgattaaacgctccaac

SEQ ID NO: 57111 - DNA, 40 bp, Artificial Sequence
  Description of Artificial Sequence: Synthetic oligonucleotide
gacaaaacacaacttgaacatcctgattaaacgctccaac

SEQ ID NO: 57112 - DNA, 41 bp, Artificial Sequence
  Description of Artificial Sequence: Synthetic oligonucleotide
acaaaacacaacttgaacatcctgattaaacgctccaactc

SEQ ID NO: 57113 - DNA, 40 bp, Artificial Sequence
  Description of Artificial Sequence: Synthetic oligonucleotide
caaaacacaacttgaacatcctgattaaacgctccaactc

SEQ ID NO: 57114 - DNA, 42 bp, Artificial Sequence
  Description of Artificial Sequence: Synthetic oligonucleotide
aaaacacaacttgaacatcctgattaaacgctccaactctac

SEQ ID NO: 57115 - DNA, 41 bp, Artificial Sequence
  Description of Artificial Sequence: Synthetic oligonucleotide
aaacacaacttgaacatcctgattaaacgctccaactctac

SEQ ID NO: 57116 - DNA, 40 bp, Artificial Sequence
  Description of Artificial Sequence: Synthetic oligonucleotide
aacacaacttgaacatcctgattaaacgctccaactctac

SEQ ID NO: 57117 - DNA, 39 bp, Artificial Sequence
  Description of Artificial Sequence: Synthetic oligonucleotide
acacaacttgaacatcctgattaaacgctccaactctac

SEQ ID NO: 57118 - DNA, 38 bp, Artificial Sequence
  Description of Artificial Sequence: Synthetic oligonucleotide
cacaacttgaacatcctgattaaacgctccaactctac

SEQ ID NO: 57119 - DNA, 39 bp, Artificial Sequence
  Description of Artificial Sequence: Synthetic oligonucleotide
acaacttgaacatcctgattaaacgctccaactctactg

SEQ ID NO: 57120 - DNA, 38 bp, Artificial Sequence
  Description of Artificial Sequence: Synthetic oligonucleotide
caacttgaacatcctgattaaacgctccaactctactg

SEQ ID NO: 57121 - DNA, 38 bp, Artificial Sequence
  Description of Artificial Sequence: Synthetic oligonucleotide
aacttgaacatcctgattaaacgctccaactctactgc

SEQ ID NO: 57122 - DNA, 37 bp, Artificial Sequence
  Description of Artificial Sequence: Synthetic oligonucleotide
acttgaacatcctgattaaacgctccaactctactgc

SEQ ID NO: 57123 - DNA, 36 bp, Artificial Sequence
  Description of Artificial Sequence: Synthetic oligonucleotide
cttgaacatcctgattaaacgctccaactctactgc

SEQ ID NO: 57124 - DNA, 37 bp, Artificial Sequence
  Description of Artificial Sequence: Synthetic oligonucleotide
ttgaacatcctgattaaacgctccaactctactgctg

SEQ ID NO: 57125 - DNA, 36 bp, Artificial Sequence
  Description of Artificial Sequence: Synthetic oligonucleotide
tgaacatcctgattaaacgctccaactctactgctg

SEQ ID NO: 57126 - DNA, 35 bp, Artificial Sequence
  Description of Artificial Sequence: Synthetic oligonucleotide
gaacatcctgattaaacgctccaactctactgctg

SEQ ID NO: 57127 - DNA, 35 bp, Artificial Sequence
  Description of Artificial Sequence: Synthetic oligonucleotide
aacatcctgattaaacgctccaactctactgctgc

SEQ ID NO: 57128 - DNA, 34 bp, Artificial Sequence
  Description of Artificial Sequence: Synthetic oligonucleotide
acatcctgattaaacgctccaactctactgctgc

SEQ ID NO: 57129 - DNA, 33 bp, Artificial Sequence
  Description of Artificial Sequence: Synthetic oligonucleotide
catcctgattaaacgctccaactctactgctgc

SEQ ID NO: 57130 - DNA, 35 bp, Artificial Sequence
  Description of Artificial Sequence: Synthetic oligonucleotide
atcctgattaaacgctccaactctactgctgctac

SEQ ID NO: 57131 - DNA, 34 bp, Artificial Sequence
  Description of Artificial Sequence: Synthetic oligonucleotide
tcctgattaaacgctccaactctactgctgctac

SEQ ID NO: 57132 - DNA, 33 bp, Artificial Sequence
  Description of Artificial Sequence: Synthetic oligonucleotide
cctgattaaacgctccaactctactgctgctac

SEQ ID NO: 57133 - DNA, 33 bp, Artificial Sequence
  Description of Artificial Sequence: Synthetic oligonucleotide
ctgattaaacgctccaactctactgctgctacc

SEQ ID NO: 57134 - DNA, 36 bp, Artificial Sequence
  Description of Artificial Sequence: Synthetic oligonucleotide
tgattaaacgctccaactctactgctgctaccaatg

SEQ ID NO: 57135 - DNA, 35 bp, Artificial Sequence
  Description of Artificial Sequence: Synthetic oligonucleotide
gattaaacgctccaactctactgctgctaccaatg

SEQ ID NO: 57136 - DNA, 36 bp, Artificial Sequence
  Description of Artificial Sequence: Synthetic oligonucleotide
attaaacgctccaactctactgctgctaccaatgag

SEQ ID NO: 57137 - DNA, 35 bp, Artificial Sequence
  Description of Artificial Sequence: Synthetic oligonucleotide
ttaaacgctccaactctactgctgctaccaatgag

SEQ ID NO: 57138 - DNA, 34 bp, Artificial Sequence
  Description of Artificial Sequence: Synthetic oligonucleotide
taaacgctccaactctactgctgctaccaatgag

SEQ ID NO: 57139 - DNA, 33 bp, Artificial Sequence
  Description of Artificial Sequence: Synthetic oligonucleotide
aaacgctccaactctactgctgctaccaatgag

SEQ ID NO: 57140 - DNA, 32 bp, Artificial Sequence
  Description of Artificial Sequence: Synthetic oligonucleotide
aacgctccaactctactgctgctaccaatgag

SEQ ID NO: 57141 - DNA, 31 bp, Artificial Sequence
  Description of Artificial Sequence: Synthetic oligonucleotide
acgctccaactctactgctgctaccaatgag

SEQ ID NO: 57142 - DNA, 30 bp, Artificial Sequence
  Description of Artificial Sequence: Synthetic oligonucleotide
cgctccaactctactgctgctaccaatgag

SEQ ID NO: 57143 - DNA, 30 bp, Artificial Sequence
  Description of Artificial Sequence: Synthetic oligonucleotide
gctccaactctactgctgctaccaatgagg

SEQ ID NO: 57144 - DNA, 32 bp, Artificial Sequence
  Description of Artificial Sequence: Synthetic oligonucleotide
ctccaactctactgctgctaccaatgaggttc

SEQ ID NO: 57145 - DNA, 32 bp, Artificial Sequence
  Description of Artificial Sequence: Synthetic oligonucleotide
tccaactctactgctgctaccaatgaggttcc

SEQ ID NO: 57146 - DNA, 31 bp, Artificial Sequence
  Description of Artificial Sequence: Synthetic oligonucleotide
ccaactctactgctgctaccaatgaggttcc

SEQ ID NO: 57147 - DNA, 32 bp, Artificial Sequence
  Description of Artificial Sequence: Synthetic oligonucleotide
caactctactgctgctaccaatgaggttcctg

SEQ ID NO: 57148 - DNA, 33 bp, Artificial Sequence
  Description of Artificial Sequence: Synthetic oligonucleotide
aactctactgctgctaccaatgaggttcctgag

SEQ ID NO: 57149 - DNA, 32 bp, Artificial Sequence
  Description of Artificial Sequence: Synthetic oligonucleotide
actctactgctgctaccaatgaggttcctgag

SEQ ID NO: 57150 - DNA, 31 bp, Artificial Sequence
  Description of Artificial Sequence: Synthetic oligonucleotide
ctctactgctgctaccaatgaggttcctgag

SEQ ID NO: 57151 - DNA, 31 bp, Artificial Sequence
  Description of Artificial Sequence: Synthetic oligonucleotide
tctactgctgctaccaatgaggttcctgagg

SEQ ID NO: 57152 - DNA, 30 bp, Artificial Sequence
  Description of Artificial Sequence: Synthetic oligonucleotide
ctactgctgctaccaatgaggttcctgagg

SEQ ID NO: 57153 - DNA, 31 bp, Artificial Sequence
  Description of Artificial Sequence: Synthetic oligonucleotide
tactgctgctaccaatgaggttcctgaggtc

SEQ ID NO: 57154 - DNA, 30 bp, Artificial Sequence
  Description of Artificial Sequence: Synthetic oligonucleotide
actgctgctaccaatgaggttcctgaggtc

SEQ ID NO: 57155 - DNA, 29 bp, Artificial Sequence
  Description of Artificial Sequence: Synthetic oligonucleotide
ctgctgctaccaatgaggttcctgaggtc

SEQ ID NO: 57156 - DNA, 30 bp, Artificial Sequence
  Description of Artificial Sequence: Synthetic oligonucleotide
tgctgctaccaatgaggttcctgaggtcac

SEQ ID NO: 57157 - DNA, 30 bp, Artificial Sequence
  Description of Artificial Sequence: Synthetic oligonucleotide
gtcacagtgttttccaagtctcccgtgacg

SEQ ID NO: 57158 - DNA, 30 bp, Artificial Sequence
  Description of Artificial Sequence: Synthetic oligonucleotide
tcacagtgttttccaagtctcccgtgacgc

SEQ ID NO: 57159 - DNA, 29 bp, Artificial Sequence
  Description of Artificial Sequence: Synthetic oligonucleotide
cacagtgttttccaagtctcccgtgacgc

SEQ ID NO: 57160 - DNA, 30 bp, Artificial Sequence
  Description of Artificial Sequence: Synthetic oligonucleotide
acagtgttttccaagtctcccgtgacgctg

SEQ ID NO: 57161 - DNA, 29 bp, Artificial Sequence
  Description of Artificial Sequence: Synthetic oligonucleotide
cagtgttttccaagtctcccgtgacgctg

SEQ ID NO: 57162 - DNA, 29 bp, Artificial Sequence
  Description of Artificial Sequence: Synthetic oligonucleotide
agtgttttccaagtctcccgtgacgctgg

SEQ ID NO: 57163 - DNA, 28 bp, Artificial Sequence
  Description of Artificial Sequence: Synthetic oligonucleotide
gtgttttccaagtctcccgtgacgctgg

SEQ ID NO: 57164 - DNA, 28 bp, Artificial Sequence
  Description of Artificial Sequence: Synthetic oligonucleotide
tgttttccaagtctcccgtgacgctggg

SEQ ID NO: 57165 - DNA, 27 bp, Artificial Sequence
  Description of Artificial Sequence: Synthetic oligonucleotide
gttttccaagtctcccgtgacgctggg

SEQ ID NO: 57166 - DNA, 28 bp, Artificial Sequence
  Description of Artificial Sequence: Synthetic oligonucleotide
ttttccaagtctcccgtgacgctgggtc

SEQ ID NO: 57167 - DNA, 27 bp, Artificial Sequence
  Description of Artificial Sequence: Synthetic oligonucleotide
tttccaagtctcccgtgacgctgggtc

SEQ ID NO: 57168 - DNA, 27 bp, Artificial Sequence
  Description of Artificial Sequence: Synthetic oligonucleotide
ttccaagtctcccgtgacgctgggtca

SEQ ID NO: 57169 - DNA, 26 bp, Artificial Sequence
  Description of Artificial Sequence: Synthetic oligonucleotide
tccaagtctcccgtgacgctgggtca

SEQ ID NO: 57170 - DNA, 25 bp, Artificial Sequence
  Description of Artificial Sequence: Synthetic oligonucleotide
ccaagtctcccgtgacgctgggtca

SEQ ID NO: 57171 - DNA, 25 bp, Artificial Sequence
  Description of Artificial Sequence: Synthetic oligonucleotide
caagtctcccgtgacgctgggtcag

SEQ ID NO: 57172 - DNA, 25 bp, Artificial Sequence
  Description of Artificial Sequence: Synthetic oligonucleotide
aagtctcccgtgacgctgggtcagc

SEQ ID NO: 57173 - DNA, 24 bp, Artificial Sequence
  Description of Artificial Sequence: Synthetic oligonucleotide
agtctcccgtgacgctgggtcagc

SEQ ID NO: 57174 - DNA, 23 bp, Artificial Sequence
  Description of Artificial Sequence: Synthetic oligonucleotide
gtctcccgtgacgctgggtcagc

SEQ ID NO: 57175 - DNA, 23 bp, Artificial Sequence
  Description of Artificial Sequence: Synthetic oligonucleotide
tctcccgtgacgctgggtcagcc

SEQ ID NO: 57176 - DNA, 22 bp, Artificial Sequence
  Description of Artificial Sequence: Synthetic oligonucleotide
ctcccgtgacgctgggtcagcc

SEQ ID NO: 57177 - DNA, 24 bp, Artificial Sequence
  Description of Artificial Sequence: Synthetic oligonucleotide
tcccgtgacgctgggtcagcccaa

SEQ ID NO: 57178 - DNA, 23 bp, Artificial Sequence
  Description of Artificial Sequence: Synthetic oligonucleotide
cccgtgacgctgggtcagcccaa

SEQ ID NO: 57179 - DNA, 24 bp, Artificial Sequence
  Description of Artificial Sequence: Synthetic oligonucleotide
ccgtgacgctgggtcagcccaaca

SEQ ID NO: 57180 - DNA, 24 bp, Artificial Sequence
  Description of Artificial Sequence: Synthetic oligonucleotide
cgtgacgctgggtcagcccaacac

SEQ ID NO: 57181 - DNA, 24 bp, Artificial Sequence
  Description of Artificial Sequence: Synthetic oligonucleotide
gtgacgctgggtcagcccaacacc

SEQ ID NO: 57182 - DNA, 25 bp, Artificial Sequence
  Description of Artificial Sequence: Synthetic oligonucleotide
tgacgctgggtcagcccaacaccct

SEQ ID NO: 57183 - DNA, 24 bp, Artificial Sequence
  Description of Artificial Sequence: Synthetic oligonucleotide
gacgctgggtcagcccaacaccct

SEQ ID NO: 57184 - DNA, 26 bp, Artificial Sequence
  Description of Artificial Sequence: Synthetic oligonucleotide
acgctgggtcagcccaacaccctcat

SEQ ID NO: 57185 - DNA, 25 bp, Artificial Sequence
  Description of Artificial Sequence: Synthetic oligonucleotide
cgctgggtcagcccaacaccctcat

SEQ ID NO: 57186 - DNA, 26 bp, Artificial Sequence
  Description of Artificial Sequence: Synthetic oligonucleotide
gctgggtcagcccaacaccctcatct

SEQ ID NO: 57187 - DNA, 31 bp, Artificial Sequence
  Description of Artificial Sequence: Synthetic oligonucleotide
tcaacatcacatggctgagcaatgggcactc

SEQ ID NO: 57188 - DNA, 30 bp, Artificial Sequence
  Description of Artificial Sequence: Synthetic oligonucleotide
caacatcacatggctgagcaatgggcactc

SEQ ID NO: 57189 - DNA, 31 bp, Artificial Sequence
  Description of Artificial Sequence: Synthetic oligonucleotide
aacatcacatggctgagcaatgggcactcag

SEQ ID NO: 57190 - DNA, 30 bp, Artificial Sequence
  Description of Artificial Sequence: Synthetic oligonucleotide
acatcacatggctgagcaatgggcactcag

SEQ ID NO: 57191 - DNA, 29 bp, Artificial Sequence
  Description of Artificial Sequence: Synthetic oligonucleotide
catcacatggctgagcaatgggcactcag

SEQ ID NO: 57192 - DNA, 30 bp, Artificial Sequence
  Description of Artificial Sequence: Synthetic oligonucleotide
atcacatggctgagcaatgggcactcagtc

SEQ ID NO: 57193 - DNA, 29 bp, Artificial Sequence
  Description of Artificial Sequence: Synthetic oligonucleotide
tcacatggctgagcaatgggcactcagtc

SEQ ID NO: 57194 - DNA, 28 bp, Artificial Sequence
  Description of Artificial Sequence: Synthetic oligonucleotide
cacatggctgagcaatgggcactcagtc

SEQ ID NO: 57195 - DNA, 29 bp, Artificial Sequence
  Description of Artificial Sequence: Synthetic oligonucleotide
acatggctgagcaatgggcactcagtcac

SEQ ID NO: 57196 - DNA, 28 bp, Artificial Sequence
  Description of Artificial Sequence: Synthetic oligonucleotide
catggctgagcaatgggcactcagtcac

SEQ ID NO: 57197 - DNA, 29 bp, Artificial Sequence
  Description of Artificial Sequence: Synthetic oligonucleotide
atggctgagcaatgggcactcagtcacag

SEQ ID NO: 57198 - DNA, 23 bp, Artificial Sequence
  Description of Artificial Sequence: Synthetic oligonucleotide
gtggagcactggggcctggacga

SEQ ID NO: 57199 - DNA, 23 bp, Artificial Sequence
  Description of Artificial Sequence: Synthetic oligonucleotide
tggagcactggggcctggacgag

SEQ ID NO: 57200 - DNA, 22 bp, Artificial Sequence
  Description of Artificial Sequence: Synthetic oligonucleotide
ggagcactggggcctggacgag

SEQ ID NO: 57201 - DNA, 22 bp, Artificial Sequence
  Description of Artificial Sequence: Synthetic oligonucleotide
gagcactggggcctggacgagc

SEQ ID NO: 57202 - DNA, 23 bp, Artificial Sequence
  Description of Artificial Sequence: Synthetic oligonucleotide
agcactggggcctggacgagcct

SEQ ID NO: 57203 - DNA, 22 bp, Artificial Sequence
  Description of Artificial Sequence: Synthetic oligonucleotide
gcactggggcctggacgagcct

SEQ ID NO: 57204 - DNA, 24 bp, Artificial Sequence
  Description of Artificial Sequence: Synthetic oligonucleotide
cactggggcctggacgagcctctt

SEQ ID NO: 57205 - DNA, 25 bp, Artificial Sequence
  Description of Artificial Sequence: Synthetic oligonucleotide
actggggcctggacgagcctcttct

SEQ ID NO: 57206 - DNA, 24 bp, Artificial Sequence
  Description of Artificial Sequence: Synthetic oligonucleotide
ctggggcctggacgagcctcttct

SEQ ID NO: 57207 - DNA, 27 bp, Artificial Sequence
  Description of Artificial Sequence: Synthetic oligonucleotide
tggggcctggacgagcctcttctgaaa

SEQ ID NO: 57208 - DNA, 26 bp, Artificial Sequence
  Description of Artificial Sequence: Synthetic oligonucleotide
ggggcctggacgagcctcttctgaaa

SEQ ID NO: 57209 - DNA, 27 bp, Artificial Sequence
  Description of Artificial Sequence: Synthetic oligonucleotide
gggcctggacgagcctcttctgaaaca

SEQ ID NO: 57210 - DNA, 27 bp, Artificial Sequence
  Description of Artificial Sequence: Synthetic oligonucleotide
ggcctggacgagcctcttctgaaacac

SEQ ID NO: 57211 - DNA, 28 bp, Artificial Sequence
  Description of Artificial Sequence: Synthetic oligonucleotide
gcctggacgagcctcttctgaaacactg

SEQ ID NO: 57212 - DNA, 28 bp, Artificial Sequence
  Description of Artificial Sequence: Synthetic oligonucleotide
cctggacgagcctcttctgaaacactgg

SEQ ID NO: 57213 - DNA, 28 bp, Artificial Sequence
  Description of Artificial Sequence: Synthetic oligonucleotide
ctggacgagcctcttctgaaacactggg

SEQ ID NO: 57214 - DNA, 29 bp, Artificial Sequence
  Description of Artificial Sequence: Synthetic oligonucleotide
tggacgagcctcttctgaaacactgggag

SEQ ID NO: 57215 - DNA, 28 bp, Artificial Sequence
  Description of Artificial Sequence: Synthetic oligonucleotide
ggacgagcctcttctgaaacactgggag

SEQ ID NO: 57216 - DNA, 28 bp, Artificial Sequence
  Description of Artificial Sequence: Synthetic oligonucleotide
gacgagcctcttctgaaacactgggagc

SEQ ID NO: 57217 - DNA, 28 bp, Artificial Sequence
  Description of Artificial Sequence: Synthetic oligonucleotide
acgagcctcttctgaaacactgggagcc

SEQ ID NO: 57218 - DNA, 27 bp, Artificial Sequence
  Description of Artificial Sequence: Synthetic oligonucleotide
cgagcctcttctgaaacactgggagcc

SEQ ID NO: 57219 - DNA, 27 bp, Artificial Sequence
  Description of Artificial Sequence: Synthetic oligonucleotide
agagactgtggtctgcgccctgggatt

SEQ ID NO: 57220 - DNA, 26 bp, Artificial Sequence
  Description of Artificial Sequence: Synthetic oligonucleotide
gagactgtggtctgcgccctgggatt

SEQ ID NO: 57221 - DNA, 27 bp, Artificial Sequence
  Description of Artificial Sequence: Synthetic oligonucleotide
agactgtggtctgcgccctgggattgt

SEQ ID NO: 57222 - DNA, 26 bp, Artificial Sequence
  Description of Artificial Sequence: Synthetic oligonucleotide
gactgtggtctgcgccctgggattgt

SEQ ID NO: 57223 - DNA, 27 bp, Artificial Sequence
  Description of Artificial Sequence: Synthetic oligonucleotide
actgtggtctgcgccctgggattgtct

SEQ ID NO: 57224 - DNA, 26 bp, Artificial Sequence
  Description of Artificial Sequence: Synthetic oligonucleotide
ctgtggtctgcgccctgggattgtct

SEQ ID NO: 57225 - DNA, 27 bp, Artificial Sequence
  Description of Artificial Sequence: Synthetic oligonucleotide
tgtggtctgcgccctgggattgtctgt

SEQ ID NO: 57226 - DNA, 26 bp, Artificial Sequence
  Description of Artificial Sequence: Synthetic oligonucleotide
gtggtctgcgccctgggattgtctgt

SEQ ID NO: 57227 - DNA, 26 bp, Artificial Sequence
  Description of Artificial Sequence: Synthetic oligonucleotide
tggtctgcgccctgggattgtctgtg

SEQ ID NO: 57228 - DNA, 25 bp, Artificial Sequence
  Description of Artificial Sequence: Synthetic oligonucleotide
ggtctgcgccctgggattgtctgtg

SEQ ID NO: 57229 - DNA, 25 bp, Artificial Sequence
  Description of Artificial Sequence: Synthetic oligonucleotide
gtctgcgccctgggattgtctgtgg

SEQ ID NO: 57230 - DNA, 25 bp, Artificial Sequence
  Description of Artificial Sequence: Synthetic oligonucleotide
tctgcgccctgggattgtctgtggg

SEQ ID NO: 57231 - DNA, 24 bp, Artificial Sequence
  Description of Artificial Sequence: Synthetic oligonucleotide
ctgcgccctgggattgtctgtggg

SEQ ID NO: 57232 - DNA, 24 bp, Artificial Sequence
  Description of Artificial Sequence: Synthetic oligonucleotide
tgcgccctgggattgtctgtgggc

SEQ ID NO: 57233 - DNA, 23 bp, Artificial Sequence
  Description of Artificial Sequence: Synthetic oligonucleotide
gcgccctgggattgtctgtgggc

SEQ ID NO: 57234 - DNA, 24 bp, Artificial Sequence
  Description of Artificial Sequence: Synthetic oligonucleotide
cgccctgggattgtctgtgggcct

SEQ ID NO: 57235 - DNA, 24 bp, Artificial Sequence
  Description of Artificial Sequence: Synthetic oligonucleotide
gccctgggattgtctgtgggcctc

SEQ ID NO: 57236 - DNA, 25 bp, Artificial Sequence
  Description of Artificial Sequence: Synthetic oligonucleotide
ccctgggattgtctgtgggcctcgt

SEQ ID NO: 57237 - DNA, 25 bp, Artificial Sequence
  Description of Artificial Sequence: Synthetic oligonucleotide
cctgggattgtctgtgggcctcgtg

SEQ ID NO: 57238 - DNA, 25 bp, Artificial Sequence
  Description of Artificial Sequence: Synthetic oligonucleotide
ctgggattgtctgtgggcctcgtgg

SEQ ID NO: 57239 - DNA, 25 bp, Artificial Sequence
  Description of Artificial Sequence: Synthetic oligonucleotide
tgggattgtctgtgggcctcgtggg

SEQ ID NO: 57240 - DNA, 24 bp, Artificial Sequence
  Description of Artificial Sequence: Synthetic oligonucleotide
gggattgtctgtgggcctcgtggg

SEQ ID NO: 57241 - DNA, 27 bp, Artificial Sequence
  Description of Artificial Sequence: Synthetic oligonucleotide
ggattgtctgtgggcctcgtgggcatt

SEQ ID NO: 57242 - DNA, 27 bp, Artificial Sequence
  Description of Artificial Sequence: Synthetic oligonucleotide
gattgtctgtgggcctcgtgggcattg

SEQ ID NO: 57243 - DNA, 28 bp, Artificial Sequence
  Description of Artificial Sequence: Synthetic oligonucleotide
attgtctgtgggcctcgtgggcattgtg

SEQ ID NO: 57244 - DNA, 30 bp, Artificial Sequence
  Description of Artificial Sequence: Synthetic oligonucleotide
cattgtggtgggcactgtcttcatcatccg

SEQ ID NO: 57245 - DNA, 31 bp, Artificial Sequence
  Description of Artificial Sequence: Synthetic oligonucleotide
attgtggtgggcactgtcttcatcatccgag

SEQ ID NO: 57246 - DNA, 30 bp, Artificial Sequence
  Description of Artificial Sequence: Synthetic oligonucleotide
ttgtggtgggcactgtcttcatcatccgag

SEQ ID NO: 57247 - DNA, 29 bp, Artificial Sequence
  Description of Artificial Sequence: Synthetic oligonucleotide
tgtggtgggcactgtcttcatcatccgag

SEQ ID NO: 57248 - DNA, 28 bp, Artificial Sequence
  Description of Artificial Sequence: Synthetic oligonucleotide
gtggtgggcactgtcttcatcatccgag

SEQ ID NO: 57249 - DNA, 28 bp, Artificial Sequence
  Description of Artificial Sequence: Synthetic oligonucleotide
tggtgggcactgtcttcatcatccgagg

SEQ ID NO: 57250 - DNA, 27 bp, Artificial Sequence
  Description of Artificial Sequence: Synthetic oligonucleotide
ggtgggcactgtcttcatcatccgagg

SEQ ID NO: 57251 - DNA, 27 bp, Artificial Sequence
  Description of Artificial Sequence: Synthetic oligonucleotide
gtgggcactgtcttcatcatccgaggc

SEQ ID NO: 57252 - DNA, 27 bp, Artificial Sequence
  Description of Artificial Sequence: Synthetic oligonucleotide
tgggcactgtcttcatcatccgaggcc

SEQ ID NO: 57253 - DNA, 27 bp, Artificial Sequence
  Description of Artificial Sequence: Synthetic oligonucleotide
gggcactgtcttcatcatccgaggcct

SEQ ID NO: 57254 - DNA, 27 bp, Artificial Sequence
  Description of Artificial Sequence: Synthetic oligonucleotide
ggcactgtcttcatcatccgaggcctg

SEQ ID NO: 57255 - DNA, 27 bp, Artificial Sequence
  Description of Artificial Sequence: Synthetic oligonucleotide
gcactgtcttcatcatccgaggcctgc

SEQ ID NO: 57256 - DNA, 27 bp, Artificial Sequence
  Description of Artificial Sequence: Synthetic oligonucleotide
cactgtcttcatcatccgaggcctgcg

SEQ ID NO: 57257 - DNA, 29 bp, Artificial Sequence
  Description of Artificial Sequence: Synthetic oligonucleotide
actgtcttcatcatccgaggcctgcgttc

SEQ ID NO: 57258 - DNA, 28 bp, Artificial Sequence
  Description of Artificial Sequence: Synthetic oligonucleotide
ctgtcttcatcatccgaggcctgcgttc

SEQ ID NO: 57259 - DNA, 29 bp, Artificial Sequence
  Description of Artificial Sequence: Synthetic oligonucleotide
tgtcttcatcatccgaggcctgcgttcag

SEQ ID NO: 57260 - DNA, 28 bp, Artificial Sequence
  Description of Artificial Sequence: Synthetic oligonucleotide
gtcttcatcatccgaggcctgcgttcag

SEQ ID NO: 57261 - DNA, 30 bp, Artificial Sequence
  Description of Artificial Sequence: Synthetic oligonucleotide
tcttcatcatccgaggcctgcgttcagttg

SEQ ID NO: 57262 - DNA, 29 bp, Artificial Sequence
  Description of Artificial Sequence: Synthetic oligonucleotide
cttcatcatccgaggcctgcgttcagttg

SEQ ID NO: 57263 - DNA, 29 bp, Artificial Sequence
  Description of Artificial Sequence: Synthetic oligonucleotide
ttcatcatccgaggcctgcgttcagttgg

SEQ ID NO: 57264 - DNA, 28 bp, Artificial Sequence
  Description of Artificial Sequence: Synthetic oligonucleotide
tcatcatccgaggcctgcgttcagttgg

SEQ ID NO: 57265 - DNA, 27 bp, Artificial Sequence
  Description of Artificial Sequence: Synthetic oligonucleotide
catcatccgaggcctgcgttcagttgg

SEQ ID NO: 57266 - DNA, 33 bp, Artificial Sequence
  Description of Artificial Sequence: Synthetic oligonucleotide
ttcctgaggtcacagtgttttccaagtctcctg

SEQ ID NO: 57267 - DNA, 32 bp, Artificial Sequence
  Description of Artificial Sequence: Synthetic oligonucleotide
tcctgaggtcacagtgttttccaagtctcctg

SEQ ID NO: 57268 - DNA, 31 bp, Artificial Sequence
  Description of Artificial Sequence: Synthetic oligonucleotide
cctgaggtcacagtgttttccaagtctcctg

SEQ ID NO: 57269 - DNA, 32 bp, Artificial Sequence
  Description of Artificial Sequence: Synthetic oligonucleotide
ctgaggtcacagtgttttccaagtctcctgtg

SEQ ID NO: 57270 - DNA, 33 bp, Artificial Sequence
  Description of Artificial Sequence: Synthetic oligonucleotide
tgaggtcacagtgttttccaagtctcctgtgac

SEQ ID NO: 57271 - DNA, 32 bp, Artificial Sequence
  Description of Artificial Sequence: Synthetic oligonucleotide
gaggtcacagtgttttccaagtctcctgtgac

SEQ ID NO: 57272 - DNA, 32 bp, Artificial Sequence
  Description of Artificial Sequence: Synthetic oligonucleotide
aggtcacagtgttttccaagtctcctgtgacg

SEQ ID NO: 57273 - DNA, 31 bp, Artificial Sequence
  Description of Artificial Sequence: Synthetic oligonucleotide
ggtcacagtgttttccaagtctcctgtgacg

SEQ ID NO: 57274 - DNA, 31 bp, Artificial Sequence
  Description of Artificial Sequence: Synthetic oligonucleotide
gtcacagtgttttccaagtctcctgtgacgc

SEQ ID NO: 57275 - DNA, 32 bp, Artificial Sequence
  Description of Artificial Sequence: Synthetic oligonucleotide
tcacagtgttttccaagtctcctgtgacgctg

SEQ ID NO: 57276 - DNA, 31 bp, Artificial Sequence
  Description of Artificial Sequence: Synthetic oligonucleotide
cacagtgttttccaagtctcctgtgacgctg

SEQ ID NO: 57277 - DNA, 31 bp, Artificial Sequence
  Description of Artificial Sequence: Synthetic oligonucleotide
acagtgttttccaagtctcctgtgacgctgg

SEQ ID NO: 57278 - DNA, 30 bp, Artificial Sequence
  Description of Artificial Sequence: Synthetic oligonucleotide
cagtgttttccaagtctcctgtgacgctgg

SEQ ID NO: 57279 - DNA, 30 bp, Artificial Sequence
  Description of Artificial Sequence: Synthetic oligonucleotide
agtgttttccaagtctcctgtgacgctggg

SEQ ID NO: 57280 - DNA, 29 bp, Artificial Sequence
  Description of Artificial Sequence: Synthetic oligonucleotide
gtgttttccaagtctcctgtgacgctggg

SEQ ID NO: 57281 - DNA, 30 bp, Artificial Sequence
  Description of Artificial Sequence: Synthetic oligonucleotide
tgttttccaagtctcctgtgacgctgggtc

SEQ ID NO: 57282 - DNA, 29 bp, Artificial Sequence
  Description of Artificial Sequence: Synthetic oligonucleotide
gttttccaagtctcctgtgacgctgggtc

SEQ ID NO: 57283 - DNA, 30 bp, Artificial Sequence
  Description of Artificial Sequence: Synthetic oligonucleotide
ttttccaagtctcctgtgacgctgggtcag

SEQ ID NO: 57284 - DNA, 29 bp, Artificial Sequence
  Description of Artificial Sequence: Synthetic oligonucleotide
tttccaagtctcctgtgacgctgggtcag

SEQ ID NO: 57285 - DNA, 28 bp, Artificial Sequence
  Description of Artificial Sequence: Synthetic oligonucleotide
ttccaagtctcctgtgacgctgggtcag

SEQ ID NO: 57286 - DNA, 27 bp, Artificial Sequence
  Description of Artificial Sequence: Synthetic oligonucleotide
tccaagtctcctgtgacgctgggtcag

SEQ ID NO: 57287 - DNA, 26 bp, Artificial Sequence
  Description of Artificial Sequence: Synthetic oligonucleotide
ccaagtctcctgtgacgctgggtcag

SEQ ID NO: 57288 - DNA, 26 bp, Artificial Sequence
  Description of Artificial Sequence: Synthetic oligonucleotide
caagtctcctgtgacgctgggtcagc

SEQ ID NO: 57289 - DNA, 26 bp, Artificial Sequence
  Description of Artificial Sequence: Synthetic oligonucleotide
aagtctcctgtgacgctgggtcagcc

SEQ ID NO: 57290 - DNA, 25 bp, Artificial Sequence
  Description of Artificial Sequence: Synthetic oligonucleotide
agtctcctgtgacgctgggtcagcc

SEQ ID NO: 57291 - DNA, 24 bp, Artificial Sequence
  Description of Artificial Sequence: Synthetic oligonucleotide
gtctcctgtgacgctgggtcagcc

SEQ ID NO: 57292 - DNA, 26 bp, Artificial Sequence
  Description of Artificial Sequence: Synthetic oligonucleotide
tctcctgtgacgctgggtcagcccaa

SEQ ID NO: 57293 - DNA, 25 bp, Artificial Sequence
  Description of Artificial Sequence: Synthetic oligonucleotide
ctcctgtgacgctgggtcagcccaa

SEQ ID NO: 57294 - DNA, 26 bp, Artificial Sequence
  Description of Artificial Sequence: Synthetic oligonucleotide
tcctgtgacgctgggtcagcccaaca

SEQ ID NO: 57295 - DNA, 25 bp, Artificial Sequence
  Description of Artificial Sequence: Synthetic oligonucleotide
cctgtgacgctgggtcagcccaaca

SEQ ID NO: 57296 - DNA, 25 bp, Artificial Sequence
  Description of Artificial Sequence: Synthetic oligonucleotide
ctgtgacgctgggtcagcccaacac

SEQ ID NO: 57297 - DNA, 25 bp, Artificial Sequence
  Description of Artificial Sequence: Synthetic oligonucleotide
tgtgacgctgggtcagcccaacacc

SEQ ID NO: 57298 - DNA, 32 bp, Artificial Sequence
  Description of Artificial Sequence: Synthetic oligonucleotide
ggcactcagtcacagaaggtgtttctgagatc

SEQ ID NO: 57299 - DNA, 33 bp, Artificial Sequence
  Description of Artificial Sequence: Synthetic oligonucleotide
gcactcagtcacagaaggtgtttctgagatcag

SEQ ID NO: 57300 - DNA, 33 bp, Artificial Sequence
  Description of Artificial Sequence: Synthetic oligonucleotide
cactcagtcacagaaggtgtttctgagatcagc

SEQ ID NO: 57301 - DNA, 35 bp, Artificial Sequence
  Description of Artificial Sequence: Synthetic oligonucleotide
actcagtcacagaaggtgtttctgagatcagcttc

SEQ ID NO: 57302 - DNA, 34 bp, Artificial Sequence
  Description of Artificial Sequence: Synthetic oligonucleotide
ctcagtcacagaaggtgtttctgagatcagcttc

SEQ ID NO: 57303 - DNA, 34 bp, Artificial Sequence
  Description of Artificial Sequence: Synthetic oligonucleotide
tcagtcacagaaggtgtttctgagatcagcttcc

SEQ ID NO: 57304 - DNA, 33 bp, Artificial Sequence
  Description of Artificial Sequence: Synthetic oligonucleotide
cagtcacagaaggtgtttctgagatcagcttcc

SEQ ID NO: 57305 - DNA, 34 bp, Artificial Sequence
  Description of Artificial Sequence: Synthetic oligonucleotide
agtcacagaaggtgtttctgagatcagcttcctc

SEQ ID NO: 57306 - DNA, 33 bp, Artificial Sequence
  Description of Artificial Sequence: Synthetic oligonucleotide
gtcacagaaggtgtttctgagatcagcttcctc

SEQ ID NO: 57307 - DNA, 34 bp, Artificial Sequence
  Description of Artificial Sequence: Synthetic oligonucleotide
tcacagaaggtgtttctgagatcagcttcctctc

SEQ ID NO: 57308 - DNA, 33 bp, Artificial Sequence
  Description of Artificial Sequence: Synthetic oligonucleotide
cacagaaggtgtttctgagatcagcttcctctc

SEQ ID NO: 57309 - DNA, 33 bp, Artificial Sequence
  Description of Artificial Sequence: Synthetic oligonucleotide
acagaaggtgtttctgagatcagcttcctctcc

SEQ ID NO: 57310 - DNA, 32 bp, Artificial Sequence
  Description of Artificial Sequence: Synthetic oligonucleotide
cagaaggtgtttctgagatcagcttcctctcc

SEQ ID NO: 57311 - DNA, 34 bp, Artificial Sequence
  Description of Artificial Sequence: Synthetic oligonucleotide
agaaggtgtttctgagatcagcttcctctccaag

SEQ ID NO: 57312 - DNA, 33 bp, Artificial Sequence
  Description of Artificial Sequence: Synthetic oligonucleotide
gaaggtgtttctgagatcagcttcctctccaag

SEQ ID NO: 57313 - DNA, 34 bp, Artificial Sequence
  Description of Artificial Sequence: Synthetic oligonucleotide
aaggtgtttctgagatcagcttcctctccaagag

SEQ ID NO: 57314 - DNA, 33 bp, Artificial Sequence
  Description of Artificial Sequence: Synthetic oligonucleotide
aggtgtttctgagatcagcttcctctccaagag

SEQ ID NO: 57315 - DNA, 32 bp, Artificial Sequence
  Description of Artificial Sequence: Synthetic oligonucleotide
ggtgtttctgagatcagcttcctctccaagag

SEQ ID NO: 57316 - DNA, 33 bp, Artificial Sequence
  Description of Artificial Sequence: Synthetic oligonucleotide
gtgtttctgagatcagcttcctctccaagagtg

SEQ ID NO: 57317 - DNA, 35 bp, Artificial Sequence
  Description of Artificial Sequence: Synthetic oligonucleotide
tgtttctgagatcagcttcctctccaagagtgatc

SEQ ID NO: 57318 - DNA, 34 bp, Artificial Sequence
  Description of Artificial Sequence: Synthetic oligonucleotide
gtttctgagatcagcttcctctccaagagtgatc

SEQ ID NO: 57319 - DNA, 37 bp, Artificial Sequence
  Description of Artificial Sequence: Synthetic oligonucleotide
tttctgagatcagcttcctctccaagagtgatcattc

SEQ ID NO: 57320 - DNA, 36 bp, Artificial Sequence
  Description of Artificial Sequence: Synthetic oligonucleotide
ttctgagatcagcttcctctccaagagtgatcattc

SEQ ID NO: 57321 - DNA, 35 bp, Artificial Sequence
  Description of Artificial Sequence: Synthetic oligonucleotide
tctgagatcagcttcctctccaagagtgatcattc

SEQ ID NO: 57322 - DNA, 34 bp, Artificial Sequence
  Description of Artificial Sequence: Synthetic oligonucleotide
ctgagatcagcttcctctccaagagtgatcattc

SEQ ID NO: 57323 - DNA, 34 bp, Artificial Sequence
  Description of Artificial Sequence: Synthetic oligonucleotide
tgagatcagcttcctctccaagagtgatcattcc

SEQ ID NO: 57324 - DNA, 33 bp, Artificial Sequence
  Description of Artificial Sequence: Synthetic oligonucleotide
gagatcagcttcctctccaagagtgatcattcc

SEQ ID NO: 57325 - DNA, 35 bp, Artificial Sequence
  Description of Artificial Sequence: Synthetic oligonucleotide
agatcagcttcctctccaagagtgatcattccttc

SEQ ID NO: 57326 - DNA, 34 bp, Artificial Sequence
  Description of Artificial Sequence: Synthetic oligonucleotide
gatcagcttcctctccaagagtgatcattccttc

SEQ ID NO: 57327 - DNA, 36 bp, Artificial Sequence
  Description of Artificial Sequence: Synthetic oligonucleotide
atcagcttcctctccaagagtgatcattccttcttc

SEQ ID NO: 57328 - DNA, 35 bp, Artificial Sequence
  Description of Artificial Sequence: Synthetic oligonucleotide
tcagcttcctctccaagagtgatcattccttcttc

SEQ ID NO: 57329 - DNA, 38 bp, Artificial Sequence
  Description of Artificial Sequence: Synthetic oligonucleotide
gagactgtctggtgtttgcctgttctcagataatttag

SEQ ID NO: 57330 - DNA, 42 bp, Artificial Sequence
  Description of Artificial Sequence: Synthetic oligonucleotide
agactgtctggtgtttgcctgttctcagataatttagatttg

SEQ ID NO: 57331 - DNA, 41 bp, Artificial Sequence
  Description of Artificial Sequence: Synthetic oligonucleotide
gactgtctggtgtttgcctgttctcagataatttagatttg

SEQ ID NO: 57332 - DNA, 42 bp, Artificial Sequence
  Description of Artificial Sequence: Synthetic oligonucleotide
actgtctggtgtttgcctgttctcagataatttagatttgac

SEQ ID NO: 57333 - DNA, 41 bp, Artificial Sequence
  Description of Artificial Sequence: Synthetic oligonucleotide
ctgtctggtgtttgcctgttctcagataatttagatttgac

SEQ ID NO: 57334 - DNA, 41 bp, Artificial Sequence
  Description of Artificial Sequence: Synthetic oligonucleotide
tgtctggtgtttgcctgttctcagataatttagatttgacc

SEQ ID NO: 57335 - DNA, 40 bp, Artificial Sequence
  Description of Artificial Sequence: Synthetic oligonucleotide
gtctggtgtttgcctgttctcagataatttagatttgacc

SEQ ID NO: 57336 - DNA, 40 bp, Artificial Sequence
  Description of Artificial Sequence: Synthetic oligonucleotide
tctggtgtttgcctgttctcagataatttagatttgaccc

SEQ ID NO: 57337 - DNA, 39 bp, Artificial Sequence
  Description of Artificial Sequence: Synthetic oligonucleotide
ctggtgtttgcctgttctcagataatttagatttgaccc

SEQ ID NO: 57338 - DNA, 39 bp, Artificial Sequence
  Description of Artificial Sequence: Synthetic oligonucleotide
tggtgtttgcctgttctcagataatttagatttgacccg

SEQ ID NO: 57339 - DNA, 38 bp, Artificial Sequence
  Description of Artificial Sequence: Synthetic oligonucleotide
ggtgtttgcctgttctcagataatttagatttgacccg

SEQ ID NO: 57340 - DNA, 38 bp, Artificial Sequence
  Description of Artificial Sequence: Synthetic oligonucleotide
gtgtttgcctgttctcagataatttagatttgacccgc

SEQ ID NO: 57341 - DNA, 43 bp, Artificial Sequence
  Description of Artificial Sequence: Synthetic oligonucleotide
tgtttgcctgttctcagataatttagatttgacccgcaatttg

SEQ ID NO: 57342 - DNA, 42 bp, Artificial Sequence
  Description of Artificial Sequence: Synthetic oligonucleotide
gtttgcctgttctcagataatttagatttgacccgcaatttg

SEQ ID NO: 57343 - DNA, 42 bp, Artificial Sequence
  Description of Artificial Sequence: Synthetic oligonucleotide
tttgcctgttctcagataatttagatttgacccgcaatttgc

SEQ ID NO: 57344 - DNA, 41 bp, Artificial Sequence
  Description of Artificial Sequence: Synthetic oligonucleotide
ttgcctgttctcagataatttagatttgacccgcaatttgc

SEQ ID NO: 57345 - DNA, 40 bp, Artificial Sequence
  Description of Artificial Sequence: Synthetic oligonucleotide
tgcctgttctcagataatttagatttgacccgcaatttgc

SEQ ID NO: 57346 - DNA, 39 bp, Artificial Sequence
  Description of Artificial Sequence: Synthetic oligonucleotide
gcctgttctcagataatttagatttgacccgcaatttgc

SEQ ID NO: 57347 - DNA, 40 bp, Artificial Sequence
  Description of Artificial Sequence: Synthetic oligonucleotide
cctgttctcagataatttagatttgacccgcaatttgcac

SEQ ID NO: 57348 - DNA, 41 bp, Artificial Sequence
  Description of Artificial Sequence: Synthetic oligonucleotide
ctgttctcagataatttagatttgacccgcaatttgcactg

SEQ ID NO: 57349 - DNA, 42 bp, Artificial Sequence
  Description of Artificial Sequence: Synthetic oligonucleotide
tgttctcagataatttagatttgacccgcaatttgcactgac

SEQ ID NO: 57350 - DNA, 41 bp, Artificial Sequence
  Description of Artificial Sequence: Synthetic oligonucleotide
gttctcagataatttagatttgacccgcaatttgcactgac

SEQ ID NO: 57351 - DNA, 44 bp, Artificial Sequence
  Description of Artificial Sequence: Synthetic oligonucleotide
ttctcagataatttagatttgacccgcaatttgcactgacaaac

SEQ ID NO: 57352 - DNA, 43 bp, Artificial Sequence
  Description of Artificial Sequence: Synthetic oligonucleotide
tctcagataatttagatttgacccgcaatttgcactgacaaac

SEQ ID NO: 57353 - DNA, 42 bp, Artificial Sequence
  Description of Artificial Sequence: Synthetic oligonucleotide
ctcagataatttagatttgacccgcaatttgcactgacaaac

SEQ ID NO: 57354 - DNA, 44 bp, Artificial Sequence
  Description of Artificial Sequence: Synthetic oligonucleotide
tcagataatttagatttgacccgcaatttgcactgacaaacatc

SEQ ID NO: 57355 - DNA, 43 bp, Artificial Sequence
  Description of Artificial Sequence: Synthetic oligonucleotide
cagataatttagatttgacccgcaatttgcactgacaaacatc

SEQ ID NO: 57356 - DNA, 43 bp, Artificial Sequence
  Description of Artificial Sequence: Synthetic oligonucleotide
agataatttagatttgacccgcaatttgcactgacaaacatcg

SEQ ID NO: 57357 - DNA, 42 bp, Artificial Sequence
  Description of Artificial Sequence: Synthetic oligonucleotide
gataatttagatttgacccgcaatttgcactgacaaacatcg

SEQ ID NO: 57358 - DNA, 42 bp, Artificial Sequence
  Description of Artificial Sequence: Synthetic oligonucleotide
ataatttagatttgacccgcaatttgcactgacaaacatcgc

SEQ ID NO: 57359 - DNA, 41 bp, Artificial Sequence
  Description of Artificial Sequence: Synthetic oligonucleotide
taatttagatttgacccgcaatttgcactgacaaacatcgc

SEQ ID NO: 57360 - DNA, 37 bp, Artificial Sequence
  Description of Artificial Sequence: Synthetic oligonucleotide
ctctccaagagtgatcattccttcttcaagatcagtc

SEQ ID NO: 57361 - DNA, 38 bp, Artificial Sequence
  Description of Artificial Sequence: Synthetic oligonucleotide
tctccaagagtgatcattccttcttcaagatcagtcac

SEQ ID NO: 57362 - DNA, 37 bp, Artificial Sequence
  Description of Artificial Sequence: Synthetic oligonucleotide
ctccaagagtgatcattccttcttcaagatcagtcac

SEQ ID NO: 57363 - DNA, 37 bp, Artificial Sequence
  Description of Artificial Sequence: Synthetic oligonucleotide
tccaagagtgatcattccttcttcaagatcagtcacc

SEQ ID NO: 57364 - DNA, 36 bp, Artificial Sequence
  Description of Artificial Sequence: Synthetic oligonucleotide
ccaagagtgatcattccttcttcaagatcagtcacc

SEQ ID NO: 57365 - DNA, 37 bp, Artificial Sequence
  Description of Artificial Sequence: Synthetic oligonucleotide
caagagtgatcattccttcttcaagatcagtcacctc

SEQ ID NO: 57366 - DNA, 38 bp, Artificial Sequence
  Description of Artificial Sequence: Synthetic oligonucleotide
aagagtgatcattccttcttcaagatcagtcacctcac

SEQ ID NO: 57367 - DNA, 37 bp, Artificial Sequence
  Description of Artificial Sequence: Synthetic oligonucleotide
agagtgatcattccttcttcaagatcagtcacctcac

SEQ ID NO: 57368 - DNA, 36 bp, Artificial Sequence
  Description of Artificial Sequence: Synthetic oligonucleotide
gagtgatcattccttcttcaagatcagtcacctcac

SEQ ID NO: 57369 - DNA, 36 bp, Artificial Sequence
  Description of Artificial Sequence: Synthetic oligonucleotide
agtgatcattccttcttcaagatcagtcacctcacc

SEQ ID NO: 57370 - DNA, 35 bp, Artificial Sequence
  Description of Artificial Sequence: Synthetic oligonucleotide
gtgatcattccttcttcaagatcagtcacctcacc

SEQ ID NO: 57371 - DNA, 37 bp, Artificial Sequence
  Description of Artificial Sequence: Synthetic oligonucleotide
tgatcattccttcttcaagatcagtcacctcaccttc

SEQ ID NO: 57372 - DNA, 36 bp, Artificial Sequence
  Description of Artificial Sequence: Synthetic oligonucleotide
gatcattccttcttcaagatcagtcacctcaccttc

SEQ ID NO: 57373 - DNA, 36 bp, Artificial Sequence
  Description of Artificial Sequence: Synthetic oligonucleotide
atcattccttcttcaagatcagtcacctcaccttcc

SEQ ID NO: 57374 - DNA, 35 bp, Artificial Sequence
  Description of Artificial Sequence: Synthetic oligonucleotide
tcattccttcttcaagatcagtcacctcaccttcc

SEQ ID NO: 57375 - DNA, 34 bp, Artificial Sequence
  Description of Artificial Sequence: Synthetic oligonucleotide
cattccttcttcaagatcagtcacctcaccttcc

SEQ ID NO: 57376 - DNA, 35 bp, Artificial Sequence
  Description of Artificial Sequence: Synthetic oligonucleotide
attccttcttcaagatcagtcacctcaccttcctc

SEQ ID NO: 57377 - DNA, 34 bp, Artificial Sequence
  Description of Artificial Sequence: Synthetic oligonucleotide
ttccttcttcaagatcagtcacctcaccttcctc

SEQ ID NO: 57378 - DNA, 33 bp, Artificial Sequence
  Description of Artificial Sequence: Synthetic oligonucleotide
tccttcttcaagatcagtcacctcaccttcctc

SEQ ID NO: 57379 - DNA, 32 bp, Artificial Sequence
  Description of Artificial Sequence: Synthetic oligonucleotide
ccttcttcaagatcagtcacctcaccttcctc

SEQ ID NO: 57380 - DNA, 32 bp, Artificial Sequence
  Description of Artificial Sequence: Synthetic oligonucleotide
cttcttcaagatcagtcacctcaccttcctcc

SEQ ID NO: 57381 - DNA, 32 bp, Artificial Sequence
  Description of Artificial Sequence: Synthetic oligonucleotide
ttcttcaagatcagtcacctcaccttcctccc

SEQ ID NO: 57382 - DNA, 31 bp, Artificial Sequence
  Description of Artificial Sequence: Synthetic oligonucleotide
tcttcaagatcagtcacctcaccttcctccc

SEQ ID NO: 57383 - DNA, 30 bp, Artificial Sequence
  Description of Artificial Sequence: Synthetic oligonucleotide
cttcaagatcagtcacctcaccttcctccc

SEQ ID NO: 57384 - DNA, 32 bp, Artificial Sequence
  Description of Artificial Sequence: Synthetic oligonucleotide
ttcaagatcagtcacctcaccttcctcccttc

SEQ ID NO: 57385 - DNA, 31 bp, Artificial Sequence
  Description of Artificial Sequence: Synthetic oligonucleotide
tcaagatcagtcacctcaccttcctcccttc

SEQ ID NO: 57386 - DNA, 30 bp, Artificial Sequence
  Description of Artificial Sequence: Synthetic oligonucleotide
caagatcagtcacctcaccttcctcccttc

SEQ ID NO: 57387 - DNA, 31 bp, Artificial Sequence
  Description of Artificial Sequence: Synthetic oligonucleotide
aagatcagtcacctcaccttcctcccttctg

SEQ ID NO: 57388 - DNA, 30 bp, Artificial Sequence
  Description of Artificial Sequence: Synthetic oligonucleotide
agatcagtcacctcaccttcctcccttctg

SEQ ID NO: 57389 - DNA, 29 bp, Artificial Sequence
  Description of Artificial Sequence: Synthetic oligonucleotide
gatcagtcacctcaccttcctcccttctg

SEQ ID NO: 57390 - DNA, 29 bp, Artificial Sequence
  Description of Artificial Sequence: Synthetic oligonucleotide
atcagtcacctcaccttcctcccttctgc

SEQ ID NO: 57391 - DNA, 28 bp, Artificial Sequence
  Description of Artificial Sequence: Synthetic oligonucleotide
tcagtcacctcaccttcctcccttctgc

SEQ ID NO: 57392 - DNA, 27 bp, Artificial Sequence
  Description of Artificial Sequence: Synthetic oligonucleotide
cagtcacctcaccttcctcccttctgc

SEQ ID NO: 57393 - DNA, 28 bp, Artificial Sequence
  Description of Artificial Sequence: Synthetic oligonucleotide
agtcacctcaccttcctcccttctgctg

SEQ ID NO: 57394 - DNA, 27 bp, Artificial Sequence
  Description of Artificial Sequence: Synthetic oligonucleotide
gtcacctcaccttcctcccttctgctg

SEQ ID NO: 57395 - DNA, 29 bp, Artificial Sequence
  Description of Artificial Sequence: Synthetic oligonucleotide
tcacctcaccttcctcccttctgctgatg

SEQ ID NO: 57396 - DNA, 28 bp, Artificial Sequence
  Description of Artificial Sequence: Synthetic oligonucleotide
cacctcaccttcctcccttctgctgatg

SEQ ID NO: 57397 - DNA, 30 bp, Artificial Sequence
  Description of Artificial Sequence: Synthetic oligonucleotide
taaacaaagctctgatgctgggggcccttg

SEQ ID NO: 57398 - DNA, 29 bp, Artificial Sequence
  Description of Artificial Sequence: Synthetic oligonucleotide
aaacaaagctctgatgctgggggcccttg

SEQ ID NO: 57399 - DNA, 28 bp, Artificial Sequence
  Description of Artificial Sequence: Synthetic oligonucleotide
aacaaagctctgatgctgggggcccttg

SEQ ID NO: 57400 - DNA, 27 bp, Artificial Sequence
  Description of Artificial Sequence: Synthetic oligonucleotide
acaaagctctgatgctgggggcccttg

SEQ ID NO: 57401 - DNA, 26 bp, Artificial Sequence
  Description of Artificial Sequence: Synthetic oligonucleotide
caaagctctgatgctgggggcccttg

SEQ ID NO: 57402 - DNA, 26 bp, Artificial Sequence
  Description of Artificial Sequence: Synthetic oligonucleotide
aaagctctgatgctgggggcccttgc

SEQ ID NO: 57403 - DNA, 25 bp, Artificial Sequence
  Description of Artificial Sequence: Synthetic oligonucleotide
aagctctgatgctgggggcccttgc

SEQ ID NO: 57404 - DNA, 24 bp, Artificial Sequence
  Description of Artificial Sequence: Synthetic oligonucleotide
agctctgatgctgggggcccttgc

SEQ ID NO: 57405 - DNA, 23 bp, Artificial Sequence
  Description of Artificial Sequence: Synthetic oligonucleotide
gctctgatgctgggggcccttgc

SEQ ID NO: 57406 - DNA, 23 bp, Artificial Sequence
  Description of Artificial Sequence: Synthetic oligonucleotide
ctctgatgctgggggcccttgcc

SEQ ID NO: 57407 - DNA, 24 bp, Artificial Sequence
  Description of Artificial Sequence: Synthetic oligonucleotide
tctgatgctgggggcccttgccct

SEQ ID NO: 57408 - DNA, 23 bp, Artificial Sequence
  Description of Artificial Sequence: Synthetic oligonucleotide
ctgatgctgggggcccttgccct

SEQ ID NO: 57409 - DNA, 24 bp, Artificial Sequence
  Description of Artificial Sequence: Synthetic oligonucleotide
tgatgctgggggcccttgccctga

SEQ ID NO: 57410 - DNA, 23 bp, Artificial Sequence
  Description of Artificial Sequence: Synthetic oligonucleotide
gatgctgggggcccttgccctga

SEQ ID NO: 57411 - DNA, 23 bp, Artificial Sequence
  Description of Artificial Sequence: Synthetic oligonucleotide
atgctgggggcccttgccctgac

SEQ ID NO: 57412 - DNA, 29 bp, Artificial Sequence
  Description of Artificial Sequence: Synthetic oligonucleotide
gaggtgaagacattgtggctgaccacgtc

SEQ ID NO: 57413 - DNA, 29 bp, Artificial Sequence
  Description of Artificial Sequence: Synthetic oligonucleotide
aggtgaagacattgtggctgaccacgtcg

SEQ ID NO: 57414 - DNA, 28 bp, Artificial Sequence
  Description of Artificial Sequence: Synthetic oligonucleotide
ggtgaagacattgtggctgaccacgtcg

SEQ ID NO: 57415 - DNA, 28 bp, Artificial Sequence
  Description of Artificial Sequence: Synthetic oligonucleotide
gtgaagacattgtggctgaccacgtcgc

SEQ ID NO: 57416 - DNA, 28 bp, Artificial Sequence
  Description of Artificial Sequence: Synthetic oligonucleotide
tgaagacattgtggctgaccacgtcgcc

SEQ ID NO: 57417 - DNA, 27 bp, Artificial Sequence
  Description of Artificial Sequence: Synthetic oligonucleotide
gaagacattgtggctgaccacgtcgcc

SEQ ID NO: 57418 - DNA, 28 bp, Artificial Sequence
  Description of Artificial Sequence: Synthetic oligonucleotide
aagacattgtggctgaccacgtcgcctc

SEQ ID NO: 57419 - DNA, 27 bp, Artificial Sequence
  Description of Artificial Sequence: Synthetic oligonucleotide
agacattgtggctgaccacgtcgcctc

SEQ ID NO: 57420 - DNA, 27 bp, Artificial Sequence
  Description of Artificial Sequence: Synthetic oligonucleotide
gacattgtggctgaccacgtcgcctct

SEQ ID NO: 57421 - DNA, 30 bp, Artificial Sequence
  Description of Artificial Sequence: Synthetic oligonucleotide
acattgtggctgaccacgtcgcctcttatg

SEQ ID NO: 57422 - DNA, 29 bp, Artificial Sequence
  Description of Artificial Sequence: Synthetic oligonucleotide
cattgtggctgaccacgtcgcctcttatg

SEQ ID NO: 57423 - DNA, 29 bp, Artificial Sequence
  Description of Artificial Sequence: Synthetic oligonucleotide
attgtggctgaccacgtcgcctcttatgg

SEQ ID NO: 57424 - DNA, 28 bp, Artificial Sequence
  Description of Artificial Sequence: Synthetic oligonucleotide
ttgtggctgaccacgtcgcctcttatgg

SEQ ID NO: 57425 - DNA, 27 bp, Artificial Sequence
  Description of Artificial Sequence: Synthetic oligonucleotide
tgtggctgaccacgtcgcctcttatgg

SEQ ID NO: 57426 - DNA, 27 bp, Artificial Sequence
  Description of Artificial Sequence: Synthetic oligonucleotide
gtggctgaccacgtcgcctcttatggt

SEQ ID NO: 57427 - DNA, 27 bp, Artificial Sequence
  Description of Artificial Sequence: Synthetic oligonucleotide
tggctgaccacgtcgcctcttatggtg

SEQ ID NO: 57428 - DNA, 27 bp, Artificial Sequence
  Description of Artificial Sequence: Synthetic oligonucleotide
ggctgaccacgtcgcctcttatggtgt

SEQ ID NO: 57429 - DNA, 30 bp, Artificial Sequence
  Description of Artificial Sequence: Synthetic oligonucleotide
gctgaccacgtcgcctcttatggtgtaaac

SEQ ID NO: 57430 - DNA, 32 bp, Artificial Sequence
  Description of Artificial Sequence: Synthetic oligonucleotide
ctgaccacgtcgcctcttatggtgtaaacttg

SEQ ID NO: 57431 - DNA, 34 bp, Artificial Sequence
  Description of Artificial Sequence: Synthetic oligonucleotide
tgaccacgtcgcctcttatggtgtaaacttgtac

SEQ ID NO: 57432 - DNA, 33 bp, Artificial Sequence
  Description of Artificial Sequence: Synthetic oligonucleotide
gaccacgtcgcctcttatggtgtaaacttgtac

SEQ ID NO: 57433 - DNA, 33 bp, Artificial Sequence
  Description of Artificial Sequence: Synthetic oligonucleotide
accacgtcgcctcttatggtgtaaacttgtacc

SEQ ID NO: 57434 - DNA, 32 bp, Artificial Sequence
  Description of Artificial Sequence: Synthetic oligonucleotide
ccacgtcgcctcttatggtgtaaacttgtacc

SEQ ID NO: 57435 - DNA, 33 bp, Artificial Sequence
  Description of Artificial Sequence: Synthetic oligonucleotide
cacgtcgcctcttatggtgtaaacttgtaccag

SEQ ID NO: 57436 - DNA, 34 bp, Artificial Sequence
  Description of Artificial Sequence: Synthetic oligonucleotide
acgtcgcctcttatggtgtaaacttgtaccagtc

SEQ ID NO: 57437 - DNA, 33 bp, Artificial Sequence
  Description of Artificial Sequence: Synthetic oligonucleotide
cgtcgcctcttatggtgtaaacttgtaccagtc

SEQ ID NO: 57438 - DNA, 36 bp, Artificial Sequence
  Description of Artificial Sequence: Synthetic oligonucleotide
gtcgcctcttatggtgtaaacttgtaccagtcttac

SEQ ID NO: 57439 - DNA, 36 bp, Artificial Sequence
  Description of Artificial Sequence: Synthetic oligonucleotide
tcgcctcttatggtgtaaacttgtaccagtcttacg

SEQ ID NO: 57440 - DNA, 35 bp, Artificial Sequence
  Description of Artificial Sequence: Synthetic oligonucleotide
cgcctcttatggtgtaaacttgtaccagtcttacg

SEQ ID NO: 57441 - DNA, 28 bp, Artificial Sequence
  Description of Artificial Sequence: Synthetic oligonucleotide
gagatgagcagttctacgtggacctggg

SEQ ID NO: 57442 - DNA, 28 bp, Artificial Sequence
  Description of Artificial Sequence: Synthetic oligonucleotide
agatgagcagttctacgtggacctgggg

SEQ ID NO: 57443 - DNA, 27 bp, Artificial Sequence
  Description of Artificial Sequence: Synthetic oligonucleotide
gatgagcagttctacgtggacctgggg

SEQ ID NO: 57444 - DNA, 28 bp, Artificial Sequence
  Description of Artificial Sequence: Synthetic oligonucleotide
atgagcagttctacgtggacctggggag

SEQ ID NO: 57445 - DNA, 27 bp, Artificial Sequence
  Description of Artificial Sequence: Synthetic oligonucleotide
tgagcagttctacgtggacctggggag

SEQ ID NO: 57446 - DNA, 32 bp, Artificial Sequence
  Description of Artificial Sequence: Synthetic oligonucleotide
acccgcaatttgcactgacaaacatcgctgtc

SEQ ID NO: 57447 - DNA, 31 bp, Artificial Sequence
  Description of Artificial Sequence: Synthetic oligonucleotide
cccgcaatttgcactgacaaacatcgctgtc

SEQ ID NO: 57448 - DNA, 31 bp, Artificial Sequence
  Description of Artificial Sequence: Synthetic oligonucleotide
ccgcaatttgcactgacaaacatcgctgtcc

SEQ ID NO: 57449 - DNA, 36 bp, Artificial Sequence
  Description of Artificial Sequence: Synthetic oligonucleotide
cgcaatttgcactgacaaacatcgctgtcctaaaac

SEQ ID NO: 57450 - DNA, 40 bp, Artificial Sequence
  Description of Artificial Sequence: Synthetic oligonucleotide
gcaatttgcactgacaaacatcgctgtcctaaaacataac

SEQ ID NO: 57451 - DNA, 42 bp, Artificial Sequence
  Description of Artificial Sequence: Synthetic oligonucleotide
caatttgcactgacaaacatcgctgtcctaaaacataacttg

SEQ ID NO: 57452 - DNA, 44 bp, Artificial Sequence
  Description of Artificial Sequence: Synthetic oligonucleotide
aatttgcactgacaaacatcgctgtcctaaaacataacttgaac

SEQ ID NO: 57453 - DNA, 43 bp, Artificial Sequence
  Description of Artificial Sequence: Synthetic oligonucleotide
atttgcactgacaaacatcgctgtcctaaaacataacttgaac

SEQ ID NO: 57454 - DNA, 42 bp, Artificial Sequence
  Description of Artificial Sequence: Synthetic oligonucleotide
tttgcactgacaaacatcgctgtcctaaaacataacttgaac

SEQ ID NO: 57455 - DNA, 41 bp, Artificial Sequence
  Description of Artificial Sequence: Synthetic oligonucleotide
ttgcactgacaaacatcgctgtcctaaaacataacttgaac

SEQ ID NO: 57456 - DNA, 40 bp, Artificial Sequence
  Description of Artificial Sequence: Synthetic oligonucleotide
tgcactgacaaacatcgctgtcctaaaacataacttgaac

SEQ ID NO: 57457 - DNA, 39 bp, Artificial Sequence
  Description of Artificial Sequence: Synthetic oligonucleotide
gcactgacaaacatcgctgtcctaaaacataacttgaac

SEQ ID NO: 57458 - DNA, 40 bp, Artificial Sequence
  Description of Artificial Sequence: Synthetic oligonucleotide
cactgacaaacatcgctgtcctaaaacataacttgaacag

SEQ ID NO: 57459 - DNA, 41 bp, Artificial Sequence
  Description of Artificial Sequence: Synthetic oligonucleotide
actgacaaacatcgctgtcctaaaacataacttgaacagtc

SEQ ID NO: 57460 - DNA, 40 bp, Artificial Sequence
  Description of Artificial Sequence: Synthetic oligonucleotide
ctgacaaacatcgctgtcctaaaacataacttgaacagtc

SEQ ID NO: 57461 - DNA, 41 bp, Artificial Sequence
  Description of Artificial Sequence: Synthetic oligonucleotide
tgacaaacatcgctgtcctaaaacataacttgaacagtctg

SEQ ID NO: 57462 - DNA, 40 bp, Artificial Sequence
  Description of Artificial Sequence: Synthetic oligonucleotide
gacaaacatcgctgtcctaaaacataacttgaacagtctg

SEQ ID NO: 57463 - DNA, 46 bp, Artificial Sequence
  Description of Artificial Sequence: Synthetic oligonucleotide
acaaacatcgctgtcctaaaacataacttgaacagtctgattaaac

SEQ ID NO: 57464 - DNA, 45 bp, Artificial Sequence
  Description of Artificial Sequence: Synthetic oligonucleotide
caaacatcgctgtcctaaaacataacttgaacagtctgattaaac

SEQ ID NO: 57465 - DNA, 45 bp, Artificial Sequence
  Description of Artificial Sequence: Synthetic oligonucleotide
aaacatcgctgtcctaaaacataacttgaacagtctgattaaacg

SEQ ID NO: 57466 - DNA, 44 bp, Artificial Sequence
  Description of Artificial Sequence: Synthetic oligonucleotide
aacatcgctgtcctaaaacataacttgaacagtctgattaaacg

SEQ ID NO: 57467 - DNA, 43 bp, Artificial Sequence
  Description of Artificial Sequence: Synthetic oligonucleotide
acatcgctgtcctaaaacataacttgaacagtctgattaaacg

SEQ ID NO: 57468 - DNA, 42 bp, Artificial Sequence
  Description of Artificial Sequence: Synthetic oligonucleotide
catcgctgtcctaaaacataacttgaacagtctgattaaacg

SEQ ID NO: 57469 - DNA, 42 bp, Artificial Sequence
  Description of Artificial Sequence: Synthetic oligonucleotide
atcgctgtcctaaaacataacttgaacagtctgattaaacgc

SEQ ID NO: 57470 - DNA, 41 bp, Artificial Sequence
  Description of Artificial Sequence: Synthetic oligonucleotide
tcgctgtcctaaaacataacttgaacagtctgattaaacgc

SEQ ID NO: 57471 - DNA, 40 bp, Artificial Sequence
  Description of Artificial Sequence: Synthetic oligonucleotide
cgctgtcctaaaacataacttgaacagtctgattaaacgc

SEQ ID NO: 57472 - DNA, 41 bp, Artificial Sequence
  Description of Artificial Sequence: Synthetic oligonucleotide
gctgtcctaaaacataacttgaacagtctgattaaacgctc

SEQ ID NO: 57473 - DNA, 41 bp, Artificial Sequence
  Description of Artificial Sequence: Synthetic oligonucleotide
ctgtcctaaaacataacttgaacagtctgattaaacgctcc

SEQ ID NO: 57474 - DNA, 43 bp, Artificial Sequence
  Description of Artificial Sequence: Synthetic oligonucleotide
tgtcctaaaacataacttgaacagtctgattaaacgctccaac

SEQ ID NO: 57475 - DNA, 42 bp, Artificial Sequence
  Description of Artificial Sequence: Synthetic oligonucleotide
gtcctaaaacataacttgaacagtctgattaaacgctccaac

SEQ ID NO: 57476 - DNA, 43 bp, Artificial Sequence
  Description of Artificial Sequence: Synthetic oligonucleotide
tcctaaaacataacttgaacagtctgattaaacgctccaactc

SEQ ID NO: 57477 - DNA, 42 bp, Artificial Sequence
  Description of Artificial Sequence: Synthetic oligonucleotide
cctaaaacataacttgaacagtctgattaaacgctccaactc

SEQ ID NO: 57478 - DNA, 44 bp, Artificial Sequence
  Description of Artificial Sequence: Synthetic oligonucleotide
ctaaaacataacttgaacagtctgattaaacgctccaactctac

SEQ ID NO: 57479 - DNA, 44 bp, Artificial Sequence
  Description of Artificial Sequence: Synthetic oligonucleotide
taaaacataacttgaacagtctgattaaacgctccaactctacc

SEQ ID NO: 57480 - DNA, 43 bp, Artificial Sequence
  Description of Artificial Sequence: Synthetic oligonucleotide
aaaacataacttgaacagtctgattaaacgctccaactctacc

SEQ ID NO: 57481 - DNA, 42 bp, Artificial Sequence
  Description of Artificial Sequence: Synthetic oligonucleotide
aaacataacttgaacagtctgattaaacgctccaactctacc

SEQ ID NO: 57482 - DNA, 41 bp, Artificial Sequence
  Description of Artificial Sequence: Synthetic oligonucleotide
aacataacttgaacagtctgattaaacgctccaactctacc

SEQ ID NO: 57483 - DNA, 40 bp, Artificial Sequence
  Description of Artificial Sequence: Synthetic oligonucleotide
acataacttgaacagtctgattaaacgctccaactctacc

SEQ ID NO: 57484 - DNA, 39 bp, Artificial Sequence
  Description of Artificial Sequence: Synthetic oligonucleotide
cataacttgaacagtctgattaaacgctccaactctacc

SEQ ID NO: 57485 - DNA, 39 bp, Artificial Sequence
  Description of Artificial Sequence: Synthetic oligonucleotide
ataacttgaacagtctgattaaacgctccaactctaccg

SEQ ID NO: 57486 - DNA, 38 bp, Artificial Sequence
  Description of Artificial Sequence: Synthetic oligonucleotide
taacttgaacagtctgattaaacgctccaactctaccg

SEQ ID NO: 57487 - DNA, 37 bp, Artificial Sequence
  Description of Artificial Sequence: Synthetic oligonucleotide
aacttgaacagtctgattaaacgctccaactctaccg

SEQ ID NO: 57488 - DNA, 36 bp, Artificial Sequence
  Description of Artificial Sequence: Synthetic oligonucleotide
acttgaacagtctgattaaacgctccaactctaccg

SEQ ID NO: 57489 - DNA, 35 bp, Artificial Sequence
  Description of Artificial Sequence: Synthetic oligonucleotide
cttgaacagtctgattaaacgctccaactctaccg

SEQ ID NO: 57490 - DNA, 35 bp, Artificial Sequence
  Description of Artificial Sequence: Synthetic oligonucleotide
ttgaacagtctgattaaacgctccaactctaccgc

SEQ ID NO: 57491 - DNA, 34 bp, Artificial Sequence
  Description of Artificial Sequence: Synthetic oligonucleotide
tgaacagtctgattaaacgctccaactctaccgc

SEQ ID NO: 57492 - DNA, 33 bp, Artificial Sequence
  Description of Artificial Sequence: Synthetic oligonucleotide
gaacagtctgattaaacgctccaactctaccgc

SEQ ID NO: 57493 - DNA, 34 bp, Artificial Sequence
  Description of Artificial Sequence: Synthetic oligonucleotide
aacagtctgattaaacgctccaactctaccgctg

SEQ ID NO: 57494 - DNA, 33 bp, Artificial Sequence
  Description of Artificial Sequence: Synthetic oligonucleotide
acagtctgattaaacgctccaactctaccgctg

SEQ ID NO: 57495 - DNA, 32 bp, Artificial Sequence
  Description of Artificial Sequence: Synthetic oligonucleotide
cagtctgattaaacgctccaactctaccgctg

SEQ ID NO: 57496 - DNA, 32 bp, Artificial Sequence
  Description of Artificial Sequence: Synthetic oligonucleotide
agtctgattaaacgctccaactctaccgctgc

SEQ ID NO: 57497 - DNA, 31 bp, Artificial Sequence
  Description of Artificial Sequence: Synthetic oligonucleotide
gtctgattaaacgctccaactctaccgctgc

SEQ ID NO: 57498 - DNA, 33 bp, Artificial Sequence
  Description of Artificial Sequence: Synthetic oligonucleotide
tctgattaaacgctccaactctaccgctgctac

SEQ ID NO: 57499 - DNA, 27 bp, Artificial Sequence
  Description of Artificial Sequence: Synthetic oligonucleotide
tcccgtgacactgggtcagcccaacat

SEQ ID NO: 57500 - DNA, 26 bp, Artificial Sequence
  Description of Artificial Sequence: Synthetic oligonucleotide
cccgtgacactgggtcagcccaacat

SEQ ID NO: 57501 - DNA, 26 bp, Artificial Sequence
  Description of Artificial Sequence: Synthetic oligonucleotide
ccgtgacactgggtcagcccaacatc

SEQ ID NO: 57502 - DNA, 27 bp, Artificial Sequence
  Description of Artificial Sequence: Synthetic oligonucleotide
cgtgacactgggtcagcccaacatcct

SEQ ID NO: 57503 - DNA, 27 bp, Artificial Sequence
  Description of Artificial Sequence: Synthetic oligonucleotide
gtgacactgggtcagcccaacatcctc

SEQ ID NO: 57504 - DNA, 29 bp, Artificial Sequence
  Description of Artificial Sequence: Synthetic oligonucleotide
tgacactgggtcagcccaacatcctcatc

SEQ ID NO: 57505 - DNA, 28 bp, Artificial Sequence
  Description of Artificial Sequence: Synthetic oligonucleotide
gacactgggtcagcccaacatcctcatc

SEQ ID NO: 57506 - DNA, 29 bp, Artificial Sequence
  Description of Artificial Sequence: Synthetic oligonucleotide
acactgggtcagcccaacatcctcatctg

SEQ ID NO: 57507 - DNA, 28 bp, Artificial Sequence
  Description of Artificial Sequence: Synthetic oligonucleotide
cactgggtcagcccaacatcctcatctg

SEQ ID NO: 57508 - DNA, 29 bp, Artificial Sequence
  Description of Artificial Sequence: Synthetic oligonucleotide
actgggtcagcccaacatcctcatctgtc

SEQ ID NO: 57509 - DNA, 28 bp, Artificial Sequence
  Description of Artificial Sequence: Synthetic oligonucleotide
ctgggtcagcccaacatcctcatctgtc

SEQ ID NO: 57510 - DNA, 30 bp, Artificial Sequence
  Description of Artificial Sequence: Synthetic oligonucleotide
tgggtcagcccaacatcctcatctgtcttg

SEQ ID NO: 57511 - DNA, 29 bp, Artificial Sequence
  Description of Artificial Sequence: Synthetic oligonucleotide
gggtcagcccaacatcctcatctgtcttg

SEQ ID NO: 57512 - DNA, 30 bp, Artificial Sequence
  Description of Artificial Sequence: Synthetic oligonucleotide
ggtcagcccaacatcctcatctgtcttgtg

SEQ ID NO: 57513 - DNA, 30 bp, Artificial Sequence
  Description of Artificial Sequence: Synthetic oligonucleotide
gtcagcccaacatcctcatctgtcttgtgg

SEQ ID NO: 57514 - DNA, 31 bp, Artificial Sequence
  Description of Artificial Sequence: Synthetic oligonucleotide
tcagcccaacatcctcatctgtcttgtggac

SEQ ID NO: 57515 - DNA, 30 bp, Artificial Sequence
  Description of Artificial Sequence: Synthetic oligonucleotide
cagcccaacatcctcatctgtcttgtggac

SEQ ID NO: 57516 - DNA, 32 bp, Artificial Sequence
  Description of Artificial Sequence: Synthetic oligonucleotide
agcccaacatcctcatctgtcttgtggacaac

SEQ ID NO: 57517 - DNA, 31 bp, Artificial Sequence
  Description of Artificial Sequence: Synthetic oligonucleotide
gcccaacatcctcatctgtcttgtggacaac

SEQ ID NO: 57518 - DNA, 33 bp, Artificial Sequence
  Description of Artificial Sequence: Synthetic oligonucleotide
cccaacatcctcatctgtcttgtggacaacatc

SEQ ID NO: 57519 - DNA, 36 bp, Artificial Sequence
  Description of Artificial Sequence: Synthetic oligonucleotide
ccaacatcctcatctgtcttgtggacaacatctttc

SEQ ID NO: 57520 - DNA, 36 bp, Artificial Sequence
  Description of Artificial Sequence: Synthetic oligonucleotide
caacatcctcatctgtcttgtggacaacatctttcc

SEQ ID NO: 57521 - DNA, 37 bp, Artificial Sequence
  Description of Artificial Sequence: Synthetic oligonucleotide
aacatcctcatctgtcttgtggacaacatctttcctc

SEQ ID NO: 57522 - DNA, 36 bp, Artificial Sequence
  Description of Artificial Sequence: Synthetic oligonucleotide
acatcctcatctgtcttgtggacaacatctttcctc

SEQ ID NO: 57523 - DNA, 35 bp, Artificial Sequence
  Description of Artificial Sequence: Synthetic oligonucleotide
catcctcatctgtcttgtggacaacatctttcctc

SEQ ID NO: 57524 - DNA, 35 bp, Artificial Sequence
  Description of Artificial Sequence: Synthetic oligonucleotide
atcctcatctgtcttgtggacaacatctttcctcc

SEQ ID NO: 57525 - DNA, 34 bp, Artificial Sequence
  Description of Artificial Sequence: Synthetic oligonucleotide
tcctcatctgtcttgtggacaacatctttcctcc

SEQ ID NO: 57526 - DNA, 37 bp, Artificial Sequence
  Description of Artificial Sequence: Synthetic oligonucleotide
agtgatcattccttcttcaagatcagttacctcaccc

SEQ ID NO: 57527 - DNA, 36 bp, Artificial Sequence
  Description of Artificial Sequence: Synthetic oligonucleotide
gtgatcattccttcttcaagatcagttacctcaccc

SEQ ID NO: 57528 - DNA, 37 bp, Artificial Sequence
  Description of Artificial Sequence: Synthetic oligonucleotide
tgatcattccttcttcaagatcagttacctcaccctc

SEQ ID NO: 57529 - DNA, 36 bp, Artificial Sequence
  Description of Artificial Sequence: Synthetic oligonucleotide
gatcattccttcttcaagatcagttacctcaccctc

SEQ ID NO: 57530 - DNA, 36 bp, Artificial Sequence
  Description of Artificial Sequence: Synthetic oligonucleotide
atcattccttcttcaagatcagttacctcaccctcc

SEQ ID NO: 57531 - DNA, 35 bp, Artificial Sequence
  Description of Artificial Sequence: Synthetic oligonucleotide
tcattccttcttcaagatcagttacctcaccctcc

SEQ ID NO: 57532 - DNA, 34 bp, Artificial Sequence
  Description of Artificial Sequence: Synthetic oligonucleotide
cattccttcttcaagatcagttacctcaccctcc

SEQ ID NO: 57533 - DNA, 35 bp, Artificial Sequence
  Description of Artificial Sequence: Synthetic oligonucleotide
attccttcttcaagatcagttacctcaccctcctc

SEQ ID NO: 57534 - DNA, 34 bp, Artificial Sequence
  Description of Artificial Sequence: Synthetic oligonucleotide
ttccttcttcaagatcagttacctcaccctcctc

SEQ ID NO: 57535 - DNA, 33 bp, Artificial Sequence
  Description of Artificial Sequence: Synthetic oligonucleotide
tccttcttcaagatcagttacctcaccctcctc

SEQ ID NO: 57536 - DNA, 32 bp, Artificial Sequence
  Description of Artificial Sequence: Synthetic oligonucleotide
ccttcttcaagatcagttacctcaccctcctc

SEQ ID NO: 57537 - DNA, 32 bp, Artificial Sequence
  Description of Artificial Sequence: Synthetic oligonucleotide
cttcttcaagatcagttacctcaccctcctcc

SEQ ID NO: 57538 - DNA, 32 bp, Artificial Sequence
  Description of Artificial Sequence: Synthetic oligonucleotide
ttcttcaagatcagttacctcaccctcctccc

SEQ ID NO: 57539 - DNA, 31 bp, Artificial Sequence
  Description of Artificial Sequence: Synthetic oligonucleotide
tcttcaagatcagttacctcaccctcctccc

SEQ ID NO: 57540 - DNA, 30 bp, Artificial Sequence
  Description of Artificial Sequence: Synthetic oligonucleotide
cttcaagatcagttacctcaccctcctccc

SEQ ID NO: 57541 - DNA, 32 bp, Artificial Sequence
  Description of Artificial Sequence: Synthetic oligonucleotide
ttcaagatcagttacctcaccctcctcccttc

SEQ ID NO: 57542 - DNA, 31 bp, Artificial Sequence
  Description of Artificial Sequence: Synthetic oligonucleotide
tcaagatcagttacctcaccctcctcccttc

SEQ ID NO: 57543 - DNA, 30 bp, Artificial Sequence
  Description of Artificial Sequence: Synthetic oligonucleotide
caagatcagttacctcaccctcctcccttc

SEQ ID NO: 57544 - DNA, 31 bp, Artificial Sequence
  Description of Artificial Sequence: Synthetic oligonucleotide
aagatcagttacctcaccctcctcccttctg

SEQ ID NO: 57545 - DNA, 30 bp, Artificial Sequence
  Description of Artificial Sequence: Synthetic oligonucleotide
agatcagttacctcaccctcctcccttctg

SEQ ID NO: 57546 - DNA, 29 bp, Artificial Sequence
  Description of Artificial Sequence: Synthetic oligonucleotide
gatcagttacctcaccctcctcccttctg

SEQ ID NO: 57547 - DNA, 29 bp, Artificial Sequence
  Description of Artificial Sequence: Synthetic oligonucleotide
atcagttacctcaccctcctcccttctgc

SEQ ID NO: 57548 - DNA, 28 bp, Artificial Sequence
  Description of Artificial Sequence: Synthetic oligonucleotide
tcagttacctcaccctcctcccttctgc

SEQ ID NO: 57549 - DNA, 27 bp, Artificial Sequence
  Description of Artificial Sequence: Synthetic oligonucleotide
cagttacctcaccctcctcccttctgc

SEQ ID NO: 57550 - DNA, 28 bp, Artificial Sequence
  Description of Artificial Sequence: Synthetic oligonucleotide
agttacctcaccctcctcccttctgctg

SEQ ID NO: 57551 - DNA, 27 bp, Artificial Sequence
  Description of Artificial Sequence: Synthetic oligonucleotide
gttacctcaccctcctcccttctgctg

SEQ ID NO: 57552 - DNA, 28 bp, Artificial Sequence
  Description of Artificial Sequence: Synthetic oligonucleotide
ttacctcaccctcctcccttctgctgag

SEQ ID NO: 57553 - DNA, 27 bp, Artificial Sequence
  Description of Artificial Sequence: Synthetic oligonucleotide
tacctcaccctcctcccttctgctgag

SEQ ID NO: 57554 - DNA, 26 bp, Artificial Sequence
  Description of Artificial Sequence: Synthetic oligonucleotide
acctcaccctcctcccttctgctgag

SEQ ID NO: 57555 - DNA, 25 bp, Artificial Sequence
  Description of Artificial Sequence: Synthetic oligonucleotide
cctcaccctcctcccttctgctgag

SEQ ID NO: 57556 - DNA, 26 bp, Artificial Sequence
  Description of Artificial Sequence: Synthetic oligonucleotide
ctcaccctcctcccttctgctgagga

SEQ ID NO: 57557 - DNA, 27 bp, Artificial Sequence
  Description of Artificial Sequence: Synthetic oligonucleotide
tcaccctcctcccttctgctgaggaga

SEQ ID NO: 57558 - DNA, 26 bp, Artificial Sequence
  Description of Artificial Sequence: Synthetic oligonucleotide
caccctcctcccttctgctgaggaga

SEQ ID NO: 57559 - DNA, 27 bp, Artificial Sequence
  Description of Artificial Sequence: Synthetic oligonucleotide
accctcctcccttctgctgaggagagt

SEQ ID NO: 57560 - DNA, 27 bp, Artificial Sequence
  Description of Artificial Sequence: Synthetic oligonucleotide
ccctcctcccttctgctgaggagagtt

SEQ ID NO: 57561 - DNA, 29 bp, Artificial Sequence
  Description of Artificial Sequence: Synthetic oligonucleotide
cctcctcccttctgctgaggagagttatg

SEQ ID NO: 57562 - DNA, 30 bp, Artificial Sequence
  Description of Artificial Sequence: Synthetic oligonucleotide
ctcctcccttctgctgaggagagttatgac

SEQ ID NO: 57563 - DNA, 31 bp, Artificial Sequence
  Description of Artificial Sequence: Synthetic oligonucleotide
tcctcccttctgctgaggagagttatgactg

SEQ ID NO: 57564 - DNA, 30 bp, Artificial Sequence
  Description of Artificial Sequence: Synthetic oligonucleotide
cctcccttctgctgaggagagttatgactg

SEQ ID NO: 57565 - DNA, 30 bp, Artificial Sequence
  Description of Artificial Sequence: Synthetic oligonucleotide
ctcccttctgctgaggagagttatgactgc

SEQ ID NO: 57566 - DNA, 32 bp, Artificial Sequence
  Description of Artificial Sequence: Synthetic oligonucleotide
tcccttctgctgaggagagttatgactgcaag

SEQ ID NO: 57567 - DNA, 31 bp, Artificial Sequence
  Description of Artificial Sequence: Synthetic oligonucleotide
cccttctgctgaggagagttatgactgcaag

SEQ ID NO: 57568 - DNA, 31 bp, Artificial Sequence
  Description of Artificial Sequence: Synthetic oligonucleotide
ccttctgctgaggagagttatgactgcaagg

SEQ ID NO: 57569 - DNA, 32 bp, Artificial Sequence
  Description of Artificial Sequence: Synthetic oligonucleotide
cttctgctgaggagagttatgactgcaaggtg

SEQ ID NO: 57570 - DNA, 32 bp, Artificial Sequence
  Description of Artificial Sequence: Synthetic oligonucleotide
ttctgctgaggagagttatgactgcaaggtgg

SEQ ID NO: 57571 - DNA, 31 bp, Artificial Sequence
  Description of Artificial Sequence: Synthetic oligonucleotide
tctgctgaggagagttatgactgcaaggtgg

SEQ ID NO: 57572 - DNA, 30 bp, Artificial Sequence
  Description of Artificial Sequence: Synthetic oligonucleotide
ctgctgaggagagttatgactgcaaggtgg

SEQ ID NO: 57573 - DNA, 31 bp, Artificial Sequence
  Description of Artificial Sequence: Synthetic oligonucleotide
tgctgaggagagttatgactgcaaggtggag

SEQ ID NO: 57574 - DNA, 30 bp, Artificial Sequence
  Description of Artificial Sequence: Synthetic oligonucleotide
gctgaggagagttatgactgcaaggtggag

SEQ ID NO: 57575 - DNA, 30 bp, Artificial Sequence
  Description of Artificial Sequence: Synthetic oligonucleotide
ctgaggagagttatgactgcaaggtggagc

SEQ ID NO: 57576 - DNA, 31 bp, Artificial Sequence
  Description of Artificial Sequence: Synthetic oligonucleotide
tgaggagagttatgactgcaaggtggagcac

SEQ ID NO: 57577 - DNA, 30 bp, Artificial Sequence
  Description of Artificial Sequence: Synthetic oligonucleotide
gaggagagttatgactgcaaggtggagcac

SEQ ID NO: 57578 - DNA, 31 bp, Artificial Sequence
  Description of Artificial Sequence: Synthetic oligonucleotide
aggagagttatgactgcaaggtggagcactg

SEQ ID NO: 57579 - DNA, 30 bp, Artificial Sequence
  Description of Artificial Sequence: Synthetic oligonucleotide
ggagagttatgactgcaaggtggagcactg

SEQ ID NO: 57580 - DNA, 30 bp, Artificial Sequence
  Description of Artificial Sequence: Synthetic oligonucleotide
gagagttatgactgcaaggtggagcactgg

SEQ ID NO: 57581 - DNA, 30 bp, Artificial Sequence
  Description of Artificial Sequence: Synthetic oligonucleotide
agagttatgactgcaaggtggagcactggg

SEQ ID NO: 57582 - DNA, 29 bp, Artificial Sequence
  Description of Artificial Sequence: Synthetic oligonucleotide
gagttatgactgcaaggtggagcactggg

SEQ ID NO: 57583 - DNA, 29 bp, Artificial Sequence
  Description of Artificial Sequence: Synthetic oligonucleotide
agttatgactgcaaggtggagcactgggg

SEQ ID NO: 57584 - DNA, 28 bp, Artificial Sequence
  Description of Artificial Sequence: Synthetic oligonucleotide
gttatgactgcaaggtggagcactgggg

SEQ ID NO: 57585 - DNA, 26 bp, Artificial Sequence
  Description of Artificial Sequence: Synthetic oligonucleotide
aaggtggagcactggggcctggacaa

SEQ ID NO: 57586 - DNA, 25 bp, Artificial Sequence
  Description of Artificial Sequence: Synthetic oligonucleotide
aggtggagcactggggcctggacaa

SEQ ID NO: 57587 - DNA, 24 bp, Artificial Sequence
  Description of Artificial Sequence: Synthetic oligonucleotide
ggtggagcactggggcctggacaa

SEQ ID NO: 57588 - DNA, 24 bp, Artificial Sequence
  Description of Artificial Sequence: Synthetic oligonucleotide
gtggagcactggggcctggacaag

SEQ ID NO: 57589 - DNA, 24 bp, Artificial Sequence
  Description of Artificial Sequence: Synthetic oligonucleotide
tggagcactggggcctggacaagc

SEQ ID NO: 57590 - DNA, 23 bp, Artificial Sequence
  Description of Artificial Sequence: Synthetic oligonucleotide
ggagcactggggcctggacaagc

SEQ ID NO: 57591 - DNA, 24 bp, Artificial Sequence
  Description of Artificial Sequence: Synthetic oligonucleotide
gagcactggggcctggacaagcct

SEQ ID NO: 57592 - DNA, 26 bp, Artificial Sequence
  Description of Artificial Sequence: Synthetic oligonucleotide
agcactggggcctggacaagcctctt

SEQ ID NO: 57593 - DNA, 25 bp, Artificial Sequence
  Description of Artificial Sequence: Synthetic oligonucleotide
gcactggggcctggacaagcctctt

SEQ ID NO: 57594 - DNA, 26 bp, Artificial Sequence
  Description of Artificial Sequence: Synthetic oligonucleotide
cactggggcctggacaagcctcttct

SEQ ID NO: 57595 - DNA, 27 bp, Artificial Sequence
  Description of Artificial Sequence: Synthetic oligonucleotide
actggggcctggacaagcctcttctga

SEQ ID NO: 57596 - DNA, 27 bp, Artificial Sequence
  Description of Artificial Sequence: Synthetic oligonucleotide
ctggggcctggacaagcctcttctgaa

SEQ ID NO: 57597 - DNA, 28 bp, Artificial Sequence
  Description of Artificial Sequence: Synthetic oligonucleotide
tggggcctggacaagcctcttctgaaac

SEQ ID NO: 57598 - DNA, 27 bp, Artificial Sequence
  Description of Artificial Sequence: Synthetic oligonucleotide
ggggcctggacaagcctcttctgaaac

SEQ ID NO: 57599 - DNA, 28 bp, Artificial Sequence
  Description of Artificial Sequence: Synthetic oligonucleotide
gggcctggacaagcctcttctgaaacac

SEQ ID NO: 57600 - DNA, 29 bp, Artificial Sequence
  Description of Artificial Sequence: Synthetic oligonucleotide
ggcctggacaagcctcttctgaaacactg

SEQ ID NO: 57601 - DNA, 29 bp, Artificial Sequence
  Description of Artificial Sequence: Synthetic oligonucleotide
gcctggacaagcctcttctgaaacactgg

SEQ ID NO: 57602 - DNA, 29 bp, Artificial Sequence
  Description of Artificial Sequence: Synthetic oligonucleotide
cctggacaagcctcttctgaaacactggg

SEQ ID NO: 57603 - DNA, 30 bp, Artificial Sequence
  Description of Artificial Sequence: Synthetic oligonucleotide
ctggacaagcctcttctgaaacactgggag

SEQ ID NO: 57604 - DNA, 30 bp, Artificial Sequence
  Description of Artificial Sequence: Synthetic oligonucleotide
tggacaagcctcttctgaaacactgggagc

SEQ ID NO: 57605 - DNA, 29 bp, Artificial Sequence
  Description of Artificial Sequence: Synthetic oligonucleotide
ggacaagcctcttctgaaacactgggagc

SEQ ID NO: 57606 - DNA, 29 bp, Artificial Sequence
  Description of Artificial Sequence: Synthetic oligonucleotide
gacaagcctcttctgaaacactgggagcc

SEQ ID NO: 57607 - DNA, 30 bp, Artificial Sequence
  Description of Artificial Sequence: Synthetic oligonucleotide
acaagcctcttctgaaacactgggagcctg

SEQ ID NO: 57608 - DNA, 29 bp, Artificial Sequence
  Description of Artificial Sequence: Synthetic oligonucleotide
caagcctcttctgaaacactgggagcctg

SEQ ID NO: 57609 - DNA, 30 bp, Artificial Sequence
  Description of Artificial Sequence: Synthetic oligonucleotide
aagcctcttctgaaacactgggagcctgag

SEQ ID NO: 57610 - DNA, 33 bp, Artificial Sequence
  Description of Artificial Sequence: Synthetic oligonucleotide
aagacattgtggctgaccacgttgcctcttatg

SEQ ID NO: 57611 - DNA, 32 bp, Artificial Sequence
  Description of Artificial Sequence: Synthetic oligonucleotide
agacattgtggctgaccacgttgcctcttatg

SEQ ID NO: 57612 - DNA, 31 bp, Artificial Sequence
  Description of Artificial Sequence: Synthetic oligonucleotide
gacattgtggctgaccacgttgcctcttatg

SEQ ID NO: 57613 - DNA, 31 bp, Artificial Sequence
  Description of Artificial Sequence: Synthetic oligonucleotide
acattgtggctgaccacgttgcctcttatgg

SEQ ID NO: 57614 - DNA, 30 bp, Artificial Sequence
  Description of Artificial Sequence: Synthetic oligonucleotide
cattgtggctgaccacgttgcctcttatgg

SEQ ID NO: 57615 - DNA, 31 bp, Artificial Sequence
  Description of Artificial Sequence: Synthetic oligonucleotide
attgtggctgaccacgttgcctcttatggtg

SEQ ID NO: 57616 - DNA, 30 bp, Artificial Sequence
  Description of Artificial Sequence: Synthetic oligonucleotide
ttgtggctgaccacgttgcctcttatggtg

SEQ ID NO: 57617 - DNA, 29 bp, Artificial Sequence
  Description of Artificial Sequence: Synthetic oligonucleotide
tgtggctgaccacgttgcctcttatggtg

SEQ ID NO: 57618 - DNA, 28 bp, Artificial Sequence
  Description of Artificial Sequence: Synthetic oligonucleotide
gtggctgaccacgttgcctcttatggtg

SEQ ID NO: 57619 - DNA, 32 bp, Artificial Sequence
  Description of Artificial Sequence: Synthetic oligonucleotide
tggctgaccacgttgcctcttatggtgtaaac

SEQ ID NO: 57620 - DNA, 31 bp, Artificial Sequence
  Description of Artificial Sequence: Synthetic oligonucleotide
ggctgaccacgttgcctcttatggtgtaaac

SEQ ID NO: 57621 - DNA, 33 bp, Artificial Sequence
  Description of Artificial Sequence: Synthetic oligonucleotide
gctgaccacgttgcctcttatggtgtaaacttg

SEQ ID NO: 57622 - DNA, 35 bp, Artificial Sequence
  Description of Artificial Sequence: Synthetic oligonucleotide
ctgaccacgttgcctcttatggtgtaaacttgtac

SEQ ID NO: 57623 - DNA, 35 bp, Artificial Sequence
  Description of Artificial Sequence: Synthetic oligonucleotide
tgaccacgttgcctcttatggtgtaaacttgtacc

SEQ ID NO: 57624 - DNA, 34 bp, Artificial Sequence
  Description of Artificial Sequence: Synthetic oligonucleotide
gaccacgttgcctcttatggtgtaaacttgtacc

SEQ ID NO: 57625 - DNA, 35 bp, Artificial Sequence
  Description of Artificial Sequence: Synthetic oligonucleotide
accacgttgcctcttatggtgtaaacttgtaccag

SEQ ID NO: 57626 - DNA, 34 bp, Artificial Sequence
  Description of Artificial Sequence: Synthetic oligonucleotide
ccacgttgcctcttatggtgtaaacttgtaccag

SEQ ID NO: 57627 - DNA, 35 bp, Artificial Sequence
  Description of Artificial Sequence: Synthetic oligonucleotide
cacgttgcctcttatggtgtaaacttgtaccagtc

SEQ ID NO: 57628 - DNA, 38 bp, Artificial Sequence
  Description of Artificial Sequence: Synthetic oligonucleotide
acgttgcctcttatggtgtaaacttgtaccagtcttac

SEQ ID NO: 57629 - DNA, 37 bp, Artificial Sequence
  Description of Artificial Sequence: Synthetic oligonucleotide
cgttgcctcttatggtgtaaacttgtaccagtcttac

SEQ ID NO: 57630 - DNA, 38 bp, Artificial Sequence
  Description of Artificial Sequence: Synthetic oligonucleotide
tggtgtttgcctgttctcagacaatttagatttgaccg

SEQ ID NO: 57631 - DNA, 37 bp, Artificial Sequence
  Description of Artificial Sequence: Synthetic oligonucleotide
ggtgtttgcctgttctcagacaatttagatttgaccg

SEQ ID NO: 57632 - DNA, 37 bp, Artificial Sequence
  Description of Artificial Sequence: Synthetic oligonucleotide
gtgtttgcctgttctcagacaatttagatttgaccgg

SEQ ID NO: 57633 - DNA, 37 bp, Artificial Sequence
  Description of Artificial Sequence: Synthetic oligonucleotide
tgtttgcctgttctcagacaatttagatttgaccggc

SEQ ID NO: 57634 - DNA, 36 bp, Artificial Sequence
  Description of Artificial Sequence: Synthetic oligonucleotide
gtttgcctgttctcagacaatttagatttgaccggc

SEQ ID NO: 57635 - DNA, 41 bp, Artificial Sequence
  Description of Artificial Sequence: Synthetic oligonucleotide
tttgcctgttctcagacaatttagatttgaccggcaatttg

SEQ ID NO: 57636 - DNA, 40 bp, Artificial Sequence
  Description of Artificial Sequence: Synthetic oligonucleotide
ttgcctgttctcagacaatttagatttgaccggcaatttg

SEQ ID NO: 57637 - DNA, 39 bp, Artificial Sequence
  Description of Artificial Sequence: Synthetic oligonucleotide
tgcctgttctcagacaatttagatttgaccggcaatttg

SEQ ID NO: 57638 - DNA, 38 bp, Artificial Sequence
  Description of Artificial Sequence: Synthetic oligonucleotide
gcctgttctcagacaatttagatttgaccggcaatttg

SEQ ID NO: 57639 - DNA, 38 bp, Artificial Sequence
  Description of Artificial Sequence: Synthetic oligonucleotide
cctgttctcagacaatttagatttgaccggcaatttgc

SEQ ID NO: 57640 - DNA, 39 bp, Artificial Sequence
  Description of Artificial Sequence: Synthetic oligonucleotide
ctgttctcagacaatttagatttgaccggcaatttgcac

SEQ ID NO: 57641 - DNA, 40 bp, Artificial Sequence
  Description of Artificial Sequence: Synthetic oligonucleotide
tgttctcagacaatttagatttgaccggcaatttgcactg

SEQ ID NO: 57642 - DNA, 39 bp, Artificial Sequence
  Description of Artificial Sequence: Synthetic oligonucleotide
gttctcagacaatttagatttgaccggcaatttgcactg

SEQ ID NO: 57643 - DNA, 40 bp, Artificial Sequence
  Description of Artificial Sequence: Synthetic oligonucleotide
ttctcagacaatttagatttgaccggcaatttgcactgac

SEQ ID NO: 57644 - DNA, 39 bp, Artificial Sequence
  Description of Artificial Sequence: Synthetic oligonucleotide
tctcagacaatttagatttgaccggcaatttgcactgac

SEQ ID NO: 57645 - DNA, 38 bp, Artificial Sequence
  Description of Artificial Sequence: Synthetic oligonucleotide
ctcagacaatttagatttgaccggcaatttgcactgac

SEQ ID NO: 57646 - DNA, 41 bp, Artificial Sequence
  Description of Artificial Sequence: Synthetic oligonucleotide
tcagacaatttagatttgaccggcaatttgcactgacaaac

SEQ ID NO: 57647 - DNA, 40 bp, Artificial Sequence
  Description of Artificial Sequence: Synthetic oligonucleotide
cagacaatttagatttgaccggcaatttgcactgacaaac

SEQ ID NO: 57648 - DNA, 42 bp, Artificial Sequence
  Description of Artificial Sequence: Synthetic oligonucleotide
agacaatttagatttgaccggcaatttgcactgacaaacatc

SEQ ID NO: 57649 - DNA, 41 bp, Artificial Sequence
  Description of Artificial Sequence: Synthetic oligonucleotide
gacaatttagatttgaccggcaatttgcactgacaaacatc

SEQ ID NO: 57650 - DNA, 41 bp, Artificial Sequence
  Description of Artificial Sequence: Synthetic oligonucleotide
acaatttagatttgaccggcaatttgcactgacaaacatcg

SEQ ID NO: 57651 - DNA, 40 bp, Artificial Sequence
  Description of Artificial Sequence: Synthetic oligonucleotide
caatttagatttgaccggcaatttgcactgacaaacatcg

SEQ ID NO: 57652 - DNA, 40 bp, Artificial Sequence
  Description of Artificial Sequence: Synthetic oligonucleotide
aatttagatttgaccggcaatttgcactgacaaacatcgc

SEQ ID NO: 57653 - DNA, 39 bp, Artificial Sequence
  Description of Artificial Sequence: Synthetic oligonucleotide
atttagatttgaccggcaatttgcactgacaaacatcgc

SEQ ID NO: 57654 - DNA, 38 bp, Artificial Sequence
  Description of Artificial Sequence: Synthetic oligonucleotide
tttagatttgaccggcaatttgcactgacaaacatcgc

SEQ ID NO: 57655 - DNA, 37 bp, Artificial Sequence
  Description of Artificial Sequence: Synthetic oligonucleotide
ttagatttgaccggcaatttgcactgacaaacatcgc

SEQ ID NO: 57656 - DNA, 36 bp, Artificial Sequence
  Description of Artificial Sequence: Synthetic oligonucleotide
tagatttgaccggcaatttgcactgacaaacatcgc

SEQ ID NO: 57657 - DNA, 35 bp, Artificial Sequence
  Description of Artificial Sequence: Synthetic oligonucleotide
agatttgaccggcaatttgcactgacaaacatcgc

SEQ ID NO: 57658 - DNA, 34 bp, Artificial Sequence
  Description of Artificial Sequence: Synthetic oligonucleotide
gatttgaccggcaatttgcactgacaaacatcgc

SEQ ID NO: 57659 - DNA, 35 bp, Artificial Sequence
  Description of Artificial Sequence: Synthetic oligonucleotide
atttgaccggcaatttgcactgacaaacatcgctg

SEQ ID NO: 57660 - DNA, 34 bp, Artificial Sequence
  Description of Artificial Sequence: Synthetic oligonucleotide
tttgaccggcaatttgcactgacaaacatcgctg

SEQ ID NO: 57661 - DNA, 33 bp, Artificial Sequence
  Description of Artificial Sequence: Synthetic oligonucleotide
ttgaccggcaatttgcactgacaaacatcgctg

SEQ ID NO: 57662 - DNA, 32 bp, Artificial Sequence
  Description of Artificial Sequence: Synthetic oligonucleotide
tgaccggcaatttgcactgacaaacatcgctg

SEQ ID NO: 57663 - DNA, 31 bp, Artificial Sequence
  Description of Artificial Sequence: Synthetic oligonucleotide
gaccggcaatttgcactgacaaacatcgctg

SEQ ID NO: 57664 - DNA, 32 bp, Artificial Sequence
  Description of Artificial Sequence: Synthetic oligonucleotide
accggcaatttgcactgacaaacatcgctgtc

SEQ ID NO: 57665 - DNA, 31 bp, Artificial Sequence
  Description of Artificial Sequence: Synthetic oligonucleotide
ccggcaatttgcactgacaaacatcgctgtc

SEQ ID NO: 57666 - DNA, 31 bp, Artificial Sequence
  Description of Artificial Sequence: Synthetic oligonucleotide
cggcaatttgcactgacaaacatcgctgtcc

SEQ ID NO: 57667 - DNA, 36 bp, Artificial Sequence
  Description of Artificial Sequence: Synthetic oligonucleotide
ggcaatttgcactgacaaacatcgctgtcctaaaac

SEQ ID NO: 57668 - DNA, 32 bp, Artificial Sequence
  Description of Artificial Sequence: Synthetic oligonucleotide
aagatcagttacctcaccctcctcccttcttc

SEQ ID NO: 57669 - DNA, 31 bp, Artificial Sequence
  Description of Artificial Sequence: Synthetic oligonucleotide
agatcagttacctcaccctcctcccttcttc

SEQ ID NO: 57670 - DNA, 30 bp, Artificial Sequence
  Description of Artificial Sequence: Synthetic oligonucleotide
gatcagttacctcaccctcctcccttcttc

SEQ ID NO: 57671 - DNA, 31 bp, Artificial Sequence
  Description of Artificial Sequence: Synthetic oligonucleotide
atcagttacctcaccctcctcccttcttctg

SEQ ID NO: 57672 - DNA, 30 bp, Artificial Sequence
  Description of Artificial Sequence: Synthetic oligonucleotide
tcagttacctcaccctcctcccttcttctg

SEQ ID NO: 57673 - DNA, 29 bp, Artificial Sequence
  Description of Artificial Sequence: Synthetic oligonucleotide
cagttacctcaccctcctcccttcttctg

SEQ ID NO: 57674 - DNA, 30 bp, Artificial Sequence
  Description of Artificial Sequence: Synthetic oligonucleotide
agttacctcaccctcctcccttcttctgag

SEQ ID NO: 57675 - DNA, 29 bp, Artificial Sequence
  Description of Artificial Sequence: Synthetic oligonucleotide
gttacctcaccctcctcccttcttctgag

SEQ ID NO: 57676 - DNA, 29 bp, Artificial Sequence
  Description of Artificial Sequence: Synthetic oligonucleotide
ttacctcaccctcctcccttcttctgagg

SEQ ID NO: 57677 - DNA, 28 bp, Artificial Sequence
  Description of Artificial Sequence: Synthetic oligonucleotide
tacctcaccctcctcccttcttctgagg

SEQ ID NO: 57678 - DNA, 27 bp, Artificial Sequence
  Description of Artificial Sequence: Synthetic oligonucleotide
acctcaccctcctcccttcttctgagg

SEQ ID NO: 57679 - DNA, 27 bp, Artificial Sequence
  Description of Artificial Sequence: Synthetic oligonucleotide
cctcaccctcctcccttcttctgagga

SEQ ID NO: 57680 - DNA, 27 bp, Artificial Sequence
  Description of Artificial Sequence: Synthetic oligonucleotide
ctcaccctcctcccttcttctgaggag

SEQ ID NO: 57681 - DNA, 28 bp, Artificial Sequence
  Description of Artificial Sequence: Synthetic oligonucleotide
tcaccctcctcccttcttctgaggagag

SEQ ID NO: 57682 - DNA, 27 bp, Artificial Sequence
  Description of Artificial Sequence: Synthetic oligonucleotide
caccctcctcccttcttctgaggagag

SEQ ID NO: 57683 - DNA, 31 bp, Artificial Sequence
  Description of Artificial Sequence: Synthetic oligonucleotide
accctcctcccttcttctgaggagagttatg

SEQ ID NO: 57684 - DNA, 30 bp, Artificial Sequence
  Description of Artificial Sequence: Synthetic oligonucleotide
ccctcctcccttcttctgaggagagttatg

SEQ ID NO: 57685 - DNA, 31 bp, Artificial Sequence
  Description of Artificial Sequence: Synthetic oligonucleotide
cctcctcccttcttctgaggagagttatgac

SEQ ID NO: 57686 - DNA, 32 bp, Artificial Sequence
  Description of Artificial Sequence: Synthetic oligonucleotide
ctcctcccttcttctgaggagagttatgactg

SEQ ID NO: 57687 - DNA, 32 bp, Artificial Sequence
  Description of Artificial Sequence: Synthetic oligonucleotide
tcctcccttcttctgaggagagttatgactgc

SEQ ID NO: 57688 - DNA, 31 bp, Artificial Sequence
  Description of Artificial Sequence: Synthetic oligonucleotide
cctcccttcttctgaggagagttatgactgc

SEQ ID NO: 57689 - DNA, 33 bp, Artificial Sequence
  Description of Artificial Sequence: Synthetic oligonucleotide
ctcccttcttctgaggagagttatgactgcaag

SEQ ID NO: 57690 - DNA, 33 bp, Artificial Sequence
  Description of Artificial Sequence: Synthetic oligonucleotide
tcccttcttctgaggagagttatgactgcaagg

SEQ ID NO: 57691 - DNA, 32 bp, Artificial Sequence
  Description of Artificial Sequence: Synthetic oligonucleotide
cccttcttctgaggagagttatgactgcaagg

SEQ ID NO: 57692 - DNA, 33 bp, Artificial Sequence
  Description of Artificial Sequence: Synthetic oligonucleotide
ccttcttctgaggagagttatgactgcaaggtg

SEQ ID NO: 57693 - DNA, 33 bp, Artificial Sequence
  Description of Artificial Sequence: Synthetic oligonucleotide
cttcttctgaggagagttatgactgcaaggtgg

SEQ ID NO: 57694 - DNA, 34 bp, Artificial Sequence
  Description of Artificial Sequence: Synthetic oligonucleotide
ttcttctgaggagagttatgactgcaaggtggag

SEQ ID NO: 57695 - DNA, 33 bp, Artificial Sequence
  Description of Artificial Sequence: Synthetic oligonucleotide
tcttctgaggagagttatgactgcaaggtggag

SEQ ID NO: 57696 - DNA, 32 bp, Artificial Sequence
  Description of Artificial Sequence: Synthetic oligonucleotide
cttctgaggagagttatgactgcaaggtggag

SEQ ID NO: 57697 - DNA, 32 bp, Artificial Sequence
  Description of Artificial Sequence: Synthetic oligonucleotide
ttctgaggagagttatgactgcaaggtggagc

SEQ ID NO: 57698 - DNA, 31 bp, Artificial Sequence
  Description of Artificial Sequence: Synthetic oligonucleotide
tctgaggagagttatgactgcaaggtggagc

SEQ ID NO: 57699 - DNA, 37 bp, Artificial Sequence
  Description of Artificial Sequence: Synthetic oligonucleotide
ctcttatggtgtaaacttgtaccagtcttacggtctc

SEQ ID NO: 57700 - DNA, 38 bp, Artificial Sequence
  Description of Artificial Sequence: Synthetic oligonucleotide
tcttatggtgtaaacttgtaccagtcttacggtctctc

SEQ ID NO: 57701 - DNA, 37 bp, Artificial Sequence
  Description of Artificial Sequence: Synthetic oligonucleotide
cttatggtgtaaacttgtaccagtcttacggtctctc

SEQ ID NO: 57702 - DNA, 38 bp, Artificial Sequence
  Description of Artificial Sequence: Synthetic oligonucleotide
ttatggtgtaaacttgtaccagtcttacggtctctctg

SEQ ID NO: 57703 - DNA, 37 bp, Artificial Sequence
  Description of Artificial Sequence: Synthetic oligonucleotide
tatggtgtaaacttgtaccagtcttacggtctctctg

SEQ ID NO: 57704 - DNA, 36 bp, Artificial Sequence
  Description of Artificial Sequence: Synthetic oligonucleotide
atggtgtaaacttgtaccagtcttacggtctctctg

SEQ ID NO: 57705 - DNA, 35 bp, Artificial Sequence
  Description of Artificial Sequence: Synthetic oligonucleotide
tggtgtaaacttgtaccagtcttacggtctctctg

SEQ ID NO: 57706 - DNA, 34 bp, Artificial Sequence
  Description of Artificial Sequence: Synthetic oligonucleotide
ggtgtaaacttgtaccagtcttacggtctctctg

SEQ ID NO: 57707 - DNA, 34 bp, Artificial Sequence
  Description of Artificial Sequence: Synthetic oligonucleotide
gtgtaaacttgtaccagtcttacggtctctctgg

SEQ ID NO: 57708 - DNA, 34 bp, Artificial Sequence
  Description of Artificial Sequence: Synthetic oligonucleotide
tgtaaacttgtaccagtcttacggtctctctggc

SEQ ID NO: 57709 - DNA, 33 bp, Artificial Sequence
  Description of Artificial Sequence: Synthetic oligonucleotide
gtaaacttgtaccagtcttacggtctctctggc

SEQ ID NO: 57710 - DNA, 33 bp, Artificial Sequence
  Description of Artificial Sequence: Synthetic oligonucleotide
taaacttgtaccagtcttacggtctctctggcc

SEQ ID NO: 57711 - DNA, 32 bp, Artificial Sequence
  Description of Artificial Sequence: Synthetic oligonucleotide
aaacttgtaccagtcttacggtctctctggcc

SEQ ID NO: 57712 - DNA, 31 bp, Artificial Sequence
  Description of Artificial Sequence: Synthetic oligonucleotide
aacttgtaccagtcttacggtctctctggcc

SEQ ID NO: 57713 - DNA, 30 bp, Artificial Sequence
  Description of Artificial Sequence: Synthetic oligonucleotide
acttgtaccagtcttacggtctctctggcc

SEQ ID NO: 57714 - DNA, 29 bp, Artificial Sequence
  Description of Artificial Sequence: Synthetic oligonucleotide
cttgtaccagtcttacggtctctctggcc

SEQ ID NO: 57715 - DNA, 30 bp, Artificial Sequence
  Description of Artificial Sequence: Synthetic oligonucleotide
ttgtaccagtcttacggtctctctggccag

SEQ ID NO: 57716 - DNA, 29 bp, Artificial Sequence
  Description of Artificial Sequence: Synthetic oligonucleotide
tgtaccagtcttacggtctctctggccag

SEQ ID NO: 57717 - DNA, 28 bp, Artificial Sequence
  Description of Artificial Sequence: Synthetic oligonucleotide
gtaccagtcttacggtctctctggccag

SEQ ID NO: 57718 - DNA, 30 bp, Artificial Sequence
  Description of Artificial Sequence: Synthetic oligonucleotide
taccagtcttacggtctctctggccagtac

SEQ ID NO: 57719 - DNA, 29 bp, Artificial Sequence
  Description of Artificial Sequence: Synthetic oligonucleotide
accagtcttacggtctctctggccagtac

SEQ ID NO: 57720 - DNA, 28 bp, Artificial Sequence
  Description of Artificial Sequence: Synthetic oligonucleotide
ccagtcttacggtctctctggccagtac

SEQ ID NO: 57721 - DNA, 29 bp, Artificial Sequence
  Description of Artificial Sequence: Synthetic oligonucleotide
cagtcttacggtctctctggccagtacac

SEQ ID NO: 57722 - DNA, 29 bp, Artificial Sequence
  Description of Artificial Sequence: Synthetic oligonucleotide
agtcttacggtctctctggccagtacacc

SEQ ID NO: 57723 - DNA, 28 bp, Artificial Sequence
  Description of Artificial Sequence: Synthetic oligonucleotide
gtcttacggtctctctggccagtacacc

SEQ ID NO: 57724 - DNA, 28 bp, Artificial Sequence
  Description of Artificial Sequence: Synthetic oligonucleotide
tcttacggtctctctggccagtacaccc

SEQ ID NO: 57725 - DNA, 27 bp, Artificial Sequence
  Description of Artificial Sequence: Synthetic oligonucleotide
cttacggtctctctggccagtacaccc

SEQ ID NO: 57726 - DNA, 29 bp, Artificial Sequence
  Description of Artificial Sequence: Synthetic oligonucleotide
ttacggtctctctggccagtacacccatg

SEQ ID NO: 57727 - DNA, 28 bp, Artificial Sequence
  Description of Artificial Sequence: Synthetic oligonucleotide
tacggtctctctggccagtacacccatg

SEQ ID NO: 57728 - DNA, 27 bp, Artificial Sequence
  Description of Artificial Sequence: Synthetic oligonucleotide
acggtctctctggccagtacacccatg

SEQ ID NO: 57729 - DNA, 27 bp, Artificial Sequence
  Description of Artificial Sequence: Synthetic oligonucleotide
cggtctctctggccagtacacccatga

SEQ ID NO: 57730 - DNA, 31 bp, Artificial Sequence
  Description of Artificial Sequence: Synthetic oligonucleotide
ggtctctctggccagtacacccatgaatttg

SEQ ID NO: 57731 - DNA, 33 bp, Artificial Sequence
  Description of Artificial Sequence: Synthetic oligonucleotide
gtctctctggccagtacacccatgaatttgatg

SEQ ID NO: 57732 - DNA, 33 bp, Artificial Sequence
  Description of Artificial Sequence: Synthetic oligonucleotide
tctctctggccagtacacccatgaatttgatgg

SEQ ID NO: 57733 - DNA, 32 bp, Artificial Sequence
  Description of Artificial Sequence: Synthetic oligonucleotide
ctctctggccagtacacccatgaatttgatgg

SEQ ID NO: 57734 - DNA, 33 bp, Artificial Sequence
  Description of Artificial Sequence: Synthetic oligonucleotide
tctctggccagtacacccatgaatttgatggag

SEQ ID NO: 57735 - DNA, 33 bp, Artificial Sequence
  Description of Artificial Sequence: Synthetic oligonucleotide
atgatcctaaacaaagctctgatgctggggacc

SEQ ID NO: 57736 - DNA, 32 bp, Artificial Sequence
  Description of Artificial Sequence: Synthetic oligonucleotide
tgatcctaaacaaagctctgatgctggggacc

SEQ ID NO: 57737 - DNA, 31 bp, Artificial Sequence
  Description of Artificial Sequence: Synthetic oligonucleotide
gatcctaaacaaagctctgatgctggggacc

SEQ ID NO: 57738 - DNA, 31 bp, Artificial Sequence
  Description of Artificial Sequence: Synthetic oligonucleotide
atcctaaacaaagctctgatgctggggaccc

SEQ ID NO: 57739 - DNA, 30 bp, Artificial Sequence
  Description of Artificial Sequence: Synthetic oligonucleotide
tcctaaacaaagctctgatgctggggaccc

SEQ ID NO: 57740 - DNA, 29 bp, Artificial Sequence
  Description of Artificial Sequence: Synthetic oligonucleotide
cctaaacaaagctctgatgctggggaccc

SEQ ID NO: 57741 - DNA, 31 bp, Artificial Sequence
  Description of Artificial Sequence: Synthetic oligonucleotide
ctaaacaaagctctgatgctggggacccttg

SEQ ID NO: 57742 - DNA, 31 bp, Artificial Sequence
  Description of Artificial Sequence: Synthetic oligonucleotide
taaacaaagctctgatgctggggacccttgc

SEQ ID NO: 57743 - DNA, 30 bp, Artificial Sequence
  Description of Artificial Sequence: Synthetic oligonucleotide
aaacaaagctctgatgctggggacccttgc

SEQ ID NO: 57744 - DNA, 29 bp, Artificial Sequence
  Description of Artificial Sequence: Synthetic oligonucleotide
aacaaagctctgatgctggggacccttgc

SEQ ID NO: 57745 - DNA, 28 bp, Artificial Sequence
  Description of Artificial Sequence: Synthetic oligonucleotide
acaaagctctgatgctggggacccttgc

SEQ ID NO: 57746 - DNA, 27 bp, Artificial Sequence
  Description of Artificial Sequence: Synthetic oligonucleotide
caaagctctgatgctggggacccttgc

SEQ ID NO: 57747 - DNA, 27 bp, Artificial Sequence
  Description of Artificial Sequence: Synthetic oligonucleotide
aaagctctgatgctggggacccttgcc

SEQ ID NO: 57748 - DNA, 26 bp, Artificial Sequence
  Description of Artificial Sequence: Synthetic oligonucleotide
aagctctgatgctggggacccttgcc

SEQ ID NO: 57749 - DNA, 25 bp, Artificial Sequence
  Description of Artificial Sequence: Synthetic oligonucleotide
agctctgatgctggggacccttgcc

SEQ ID NO: 57750 - DNA, 24 bp, Artificial Sequence
  Description of Artificial Sequence: Synthetic oligonucleotide
gctctgatgctggggacccttgcc

SEQ ID NO: 57751 - DNA, 25 bp, Artificial Sequence
  Description of Artificial Sequence: Synthetic oligonucleotide
ctctgatgctggggacccttgccct

SEQ ID NO: 57752 - DNA, 26 bp, Artificial Sequence
  Description of Artificial Sequence: Synthetic oligonucleotide
tctgatgctggggacccttgccctga

SEQ ID NO: 57753 - DNA, 25 bp, Artificial Sequence
  Description of Artificial Sequence: Synthetic oligonucleotide
ctgatgctggggacccttgccctga

SEQ ID NO: 57754 - DNA, 25 bp, Artificial Sequence
  Description of Artificial Sequence: Synthetic oligonucleotide
tgatgctggggacccttgccctgac

SEQ ID NO: 57755 - DNA, 24 bp, Artificial Sequence
  Description of Artificial Sequence: Synthetic oligonucleotide
gatgctggggacccttgccctgac

SEQ ID NO: 57756 - DNA, 25 bp, Artificial Sequence
  Description of Artificial Sequence: Synthetic oligonucleotide
atgctggggacccttgccctgacca

SEQ ID NO: 57757 - DNA, 24 bp, Artificial Sequence
  Description of Artificial Sequence: Synthetic oligonucleotide
tgctggggacccttgccctgacca

SEQ ID NO: 57758 - DNA, 23 bp, Artificial Sequence
  Description of Artificial Sequence: Synthetic oligonucleotide
gctggggacccttgccctgacca

SEQ ID NO: 57759 - DNA, 23 bp, Artificial Sequence
  Description of Artificial Sequence: Synthetic oligonucleotide
ctggggacccttgccctgaccac

SEQ ID NO: 57760 - DNA, 23 bp, Artificial Sequence
  Description of Artificial Sequence: Synthetic oligonucleotide
tggggacccttgccctgaccacc

SEQ ID NO: 57761 - DNA, 22 bp, Artificial Sequence
  Description of Artificial Sequence: Synthetic oligonucleotide
ggggacccttgccctgaccacc

SEQ ID NO: 57762 - DNA, 23 bp, Artificial Sequence
  Description of Artificial Sequence: Synthetic oligonucleotide
gggacccttgccctgaccaccgt

SEQ ID NO: 57763 - DNA, 25 bp, Artificial Sequence
  Description of Artificial Sequence: Synthetic oligonucleotide
ggacccttgccctgaccaccgtgat

SEQ ID NO: 57764 - DNA, 26 bp, Artificial Sequence
  Description of Artificial Sequence: Synthetic oligonucleotide
gacccttgccctgaccaccgtgatga

SEQ ID NO: 57765 - DNA, 26 bp, Artificial Sequence
  Description of Artificial Sequence: Synthetic oligonucleotide
acccttgccctgaccaccgtgatgag

SEQ ID NO: 57766 - DNA, 29 bp, Artificial Sequence
  Description of Artificial Sequence: Synthetic oligonucleotide
ttatgactgcaaggtggagcactggggac

SEQ ID NO: 57767 - DNA, 28 bp, Artificial Sequence
  Description of Artificial Sequence: Synthetic oligonucleotide
tatgactgcaaggtggagcactggggac

SEQ ID NO: 57768 - DNA, 27 bp, Artificial Sequence
  Description of Artificial Sequence: Synthetic oligonucleotide
atgactgcaaggtggagcactggggac

SEQ ID NO: 57769 - DNA, 27 bp, Artificial Sequence
  Description of Artificial Sequence: Synthetic oligonucleotide
tgactgcaaggtggagcactggggact

SEQ ID NO: 57770 - DNA, 26 bp, Artificial Sequence
  Description of Artificial Sequence: Synthetic oligonucleotide
gactgcaaggtggagcactggggact

SEQ ID NO: 57771 - DNA, 26 bp, Artificial Sequence
  Description of Artificial Sequence: Synthetic oligonucleotide
actgcaaggtggagcactggggactg

SEQ ID NO: 57772 - DNA, 25 bp, Artificial Sequence
  Description of Artificial Sequence: Synthetic oligonucleotide
ctgcaaggtggagcactggggactg

SEQ ID NO: 57773 - DNA, 26 bp, Artificial Sequence
  Description of Artificial Sequence: Synthetic oligonucleotide
tgcaaggtggagcactggggactgga

SEQ ID NO: 57774 - DNA, 25 bp, Artificial Sequence
  Description of Artificial Sequence: Synthetic oligonucleotide
gcaaggtggagcactggggactgga

SEQ ID NO: 57775 - DNA, 27 bp, Artificial Sequence
  Description of Artificial Sequence: Synthetic oligonucleotide
caaggtggagcactggggactggacaa

SEQ ID NO: 57776 - DNA, 27 bp, Artificial Sequence
  Description of Artificial Sequence: Synthetic oligonucleotide
aaggtggagcactggggactggacaag

SEQ ID NO: 57777 - DNA, 26 bp, Artificial Sequence
  Description of Artificial Sequence: Synthetic oligonucleotide
aggtggagcactggggactggacaag

SEQ ID NO: 57778 - DNA, 25 bp, Artificial Sequence
  Description of Artificial Sequence: Synthetic oligonucleotide
ggtggagcactggggactggacaag

SEQ ID NO: 57779 - DNA, 25 bp, Artificial Sequence
  Description of Artificial Sequence: Synthetic oligonucleotide
gtggagcactggggactggacaagc

SEQ ID NO: 57780 - DNA, 26 bp, Artificial Sequence
  Description of Artificial Sequence: Synthetic oligonucleotide
tggagcactggggactggacaagcct

SEQ ID NO: 57781 - DNA, 25 bp, Artificial Sequence
  Description of Artificial Sequence: Synthetic oligonucleotide
ggagcactggggactggacaagcct

SEQ ID NO: 57782 - DNA, 27 bp, Artificial Sequence
  Description of Artificial Sequence: Synthetic oligonucleotide
gagcactggggactggacaagcctctt

SEQ ID NO: 57783 - DNA, 27 bp, Artificial Sequence
  Description of Artificial Sequence: Synthetic oligonucleotide
agcactggggactggacaagcctcttc

SEQ ID NO: 57784 - DNA, 27 bp, Artificial Sequence
  Description of Artificial Sequence: Synthetic oligonucleotide
gcactggggactggacaagcctcttct

SEQ ID NO: 57785 - DNA, 27 bp, Artificial Sequence
  Description of Artificial Sequence: Synthetic oligonucleotide
cactggggactggacaagcctcttctg

SEQ ID NO: 57786 - DNA, 30 bp, Artificial Sequence
  Description of Artificial Sequence: Synthetic oligonucleotide
actggggactggacaagcctcttctgaaac

SEQ ID NO: 57787 - DNA, 29 bp, Artificial Sequence
  Description of Artificial Sequence: Synthetic oligonucleotide
ctggggactggacaagcctcttctgaaac

SEQ ID NO: 57788 - DNA, 30 bp, Artificial Sequence
  Description of Artificial Sequence: Synthetic oligonucleotide
tggggactggacaagcctcttctgaaacac

SEQ ID NO: 57789 - DNA, 29 bp, Artificial Sequence
  Description of Artificial Sequence: Synthetic oligonucleotide
ggggactggacaagcctcttctgaaacac

SEQ ID NO: 57790 - DNA, 30 bp, Artificial Sequence
  Description of Artificial Sequence: Synthetic oligonucleotide
gggactggacaagcctcttctgaaacactg

SEQ ID NO: 57791 - DNA, 30 bp, Artificial Sequence
  Description of Artificial Sequence: Synthetic oligonucleotide
ggactggacaagcctcttctgaaacactgg

SEQ ID NO: 57792 - DNA, 30 bp, Artificial Sequence
  Description of Artificial Sequence: Synthetic oligonucleotide
gactggacaagcctcttctgaaacactggg

SEQ ID NO: 57793 - DNA, 31 bp, Artificial Sequence
  Description of Artificial Sequence: Synthetic oligonucleotide
actggacaagcctcttctgaaacactgggag

SEQ ID NO: 57794 - DNA, 31 bp, Artificial Sequence
  Description of Artificial Sequence: Synthetic oligonucleotide
gtcacagtgttttccaagtctcccgtgacag

SEQ ID NO: 57795 - DNA, 32 bp, Artificial Sequence
  Description of Artificial Sequence: Synthetic oligonucleotide
tcacagtgttttccaagtctcccgtgacagtg

SEQ ID NO: 57796 - DNA, 31 bp, Artificial Sequence
  Description of Artificial Sequence: Synthetic oligonucleotide
cacagtgttttccaagtctcccgtgacagtg

SEQ ID NO: 57797 - DNA, 31 bp, Artificial Sequence
  Description of Artificial Sequence: Synthetic oligonucleotide
acagtgttttccaagtctcccgtgacagtgg

SEQ ID NO: 57798 - DNA, 30 bp, Artificial Sequence
  Description of Artificial Sequence: Synthetic oligonucleotide
cagtgttttccaagtctcccgtgacagtgg

SEQ ID NO: 57799 - DNA, 30 bp, Artificial Sequence
  Description of Artificial Sequence: Synthetic oligonucleotide
agtgttttccaagtctcccgtgacagtggg

SEQ ID NO: 57800 - DNA, 29 bp, Artificial Sequence
  Description of Artificial Sequence: Synthetic oligonucleotide
gtgttttccaagtctcccgtgacagtggg

SEQ ID NO: 57801 - DNA, 30 bp, Artificial Sequence
  Description of Artificial Sequence: Synthetic oligonucleotide
tgttttccaagtctcccgtgacagtgggtc

SEQ ID NO: 57802 - DNA, 29 bp, Artificial Sequence
  Description of Artificial Sequence: Synthetic oligonucleotide
gttttccaagtctcccgtgacagtgggtc

SEQ ID NO: 57803 - DNA, 30 bp, Artificial Sequence
  Description of Artificial Sequence: Synthetic oligonucleotide
ttttccaagtctcccgtgacagtgggtcag

SEQ ID NO: 57804 - DNA, 29 bp, Artificial Sequence
  Description of Artificial Sequence: Synthetic oligonucleotide
tttccaagtctcccgtgacagtgggtcag

SEQ ID NO: 57805 - DNA, 28 bp, Artificial Sequence
  Description of Artificial Sequence: Synthetic oligonucleotide
ttccaagtctcccgtgacagtgggtcag

SEQ ID NO: 57806 - DNA, 27 bp, Artificial Sequence
  Description of Artificial Sequence: Synthetic oligonucleotide
tccaagtctcccgtgacagtgggtcag

SEQ ID NO: 57807 - DNA, 26 bp, Artificial Sequence
  Description of Artificial Sequence: Synthetic oligonucleotide
ccaagtctcccgtgacagtgggtcag

SEQ ID NO: 57808 - DNA, 26 bp, Artificial Sequence
  Description of Artificial Sequence: Synthetic oligonucleotide
caagtctcccgtgacagtgggtcagc

SEQ ID NO: 57809 - DNA, 26 bp, Artificial Sequence
  Description of Artificial Sequence: Synthetic oligonucleotide
aagtctcccgtgacagtgggtcagcc

SEQ ID NO: 57810 - DNA, 25 bp, Artificial Sequence
  Description of Artificial Sequence: Synthetic oligonucleotide
agtctcccgtgacagtgggtcagcc

SEQ ID NO: 57811 - DNA, 24 bp, Artificial Sequence
  Description of Artificial Sequence: Synthetic oligonucleotide
gtctcccgtgacagtgggtcagcc

SEQ ID NO: 57812 - DNA, 26 bp, Artificial Sequence
  Description of Artificial Sequence: Synthetic oligonucleotide
tctcccgtgacagtgggtcagcccaa

SEQ ID NO: 57813 - DNA, 25 bp, Artificial Sequence
  Description of Artificial Sequence: Synthetic oligonucleotide
ctcccgtgacagtgggtcagcccaa

SEQ ID NO: 57814 - DNA, 27 bp, Artificial Sequence
  Description of Artificial Sequence: Synthetic oligonucleotide
tcccgtgacagtgggtcagcccaacat

SEQ ID NO: 57815 - DNA, 26 bp, Artificial Sequence
  Description of Artificial Sequence: Synthetic oligonucleotide
cccgtgacagtgggtcagcccaacat

SEQ ID NO: 57816 - DNA, 26 bp, Artificial Sequence
  Description of Artificial Sequence: Synthetic oligonucleotide
ccgtgacagtgggtcagcccaacatc

SEQ ID NO: 57817 - DNA, 27 bp, Artificial Sequence
  Description of Artificial Sequence: Synthetic oligonucleotide
cgtgacagtgggtcagcccaacatcct

SEQ ID NO: 57818 - DNA, 27 bp, Artificial Sequence
  Description of Artificial Sequence: Synthetic oligonucleotide
gtgacagtgggtcagcccaacatcctc

SEQ ID NO: 57819 - DNA, 29 bp, Artificial Sequence
  Description of Artificial Sequence: Synthetic oligonucleotide
tgacagtgggtcagcccaacatcctcatc

SEQ ID NO: 57820 - DNA, 28 bp, Artificial Sequence
  Description of Artificial Sequence: Synthetic oligonucleotide
gacagtgggtcagcccaacatcctcatc

SEQ ID NO: 57821 - DNA, 29 bp, Artificial Sequence
  Description of Artificial Sequence: Synthetic oligonucleotide
acagtgggtcagcccaacatcctcatctg

SEQ ID NO: 57822 - DNA, 28 bp, Artificial Sequence
  Description of Artificial Sequence: Synthetic oligonucleotide
cagtgggtcagcccaacatcctcatctg

SEQ ID NO: 57823 - DNA, 29 bp, Artificial Sequence
  Description of Artificial Sequence: Synthetic oligonucleotide
agtgggtcagcccaacatcctcatctgtc

SEQ ID NO: 57824 - DNA, 28 bp, Artificial Sequence
  Description of Artificial Sequence: Synthetic oligonucleotide
gtgggtcagcccaacatcctcatctgtc

SEQ ID NO: 57825 - DNA, 26 bp, Artificial Sequence
  Description of Artificial Sequence: Synthetic oligonucleotide
cctgggattgtctgtgggcctcgtgt

SEQ ID NO: 57826 - DNA, 26 bp, Artificial Sequence
  Description of Artificial Sequence: Synthetic oligonucleotide
ctgggattgtctgtgggcctcgtgtg

SEQ ID NO: 57827 - DNA, 27 bp, Artificial Sequence
  Description of Artificial Sequence: Synthetic oligonucleotide
tgggattgtctgtgggcctcgtgtgca

SEQ ID NO: 57828 - DNA, 27 bp, Artificial Sequence
  Description of Artificial Sequence: Synthetic oligonucleotide
gggattgtctgtgggcctcgtgtgcat

SEQ ID NO: 57829 - DNA, 28 bp, Artificial Sequence
  Description of Artificial Sequence: Synthetic oligonucleotide
ggattgtctgtgggcctcgtgtgcattg

SEQ ID NO: 57830 - DNA, 29 bp, Artificial Sequence
  Description of Artificial Sequence: Synthetic oligonucleotide
gattgtctgtgggcctcgtgtgcattgtg

SEQ ID NO: 57831 - DNA, 29 bp, Artificial Sequence
  Description of Artificial Sequence: Synthetic oligonucleotide
attgtctgtgggcctcgtgtgcattgtgg

SEQ ID NO: 57832 - DNA, 28 bp, Artificial Sequence
  Description of Artificial Sequence: Synthetic oligonucleotide
ttgtctgtgggcctcgtgtgcattgtgg

SEQ ID NO: 57833 - DNA, 27 bp, Artificial Sequence
  Description of Artificial Sequence: Synthetic oligonucleotide
tgtctgtgggcctcgtgtgcattgtgg

SEQ ID NO: 57834 - DNA, 27 bp, Artificial Sequence
  Description of Artificial Sequence: Synthetic oligonucleotide
gtctgtgggcctcgtgtgcattgtggt

SEQ ID NO: 57835 - DNA, 27 bp, Artificial Sequence
  Description of Artificial Sequence: Synthetic oligonucleotide
tctgtgggcctcgtgtgcattgtggtg

SEQ ID NO: 57836 - DNA, 26 bp, Artificial Sequence
  Description of Artificial Sequence: Synthetic oligonucleotide
ctgtgggcctcgtgtgcattgtggtg

SEQ ID NO: 57837 - DNA, 26 bp, Artificial Sequence
  Description of Artificial Sequence: Synthetic oligonucleotide
tgtgggcctcgtgtgcattgtggtgg

SEQ ID NO: 57838 - DNA, 25 bp, Artificial Sequence
  Description of Artificial Sequence: Synthetic oligonucleotide
gtgggcctcgtgtgcattgtggtgg

SEQ ID NO: 57839 - DNA, 25 bp, Artificial Sequence
  Description of Artificial Sequence: Synthetic oligonucleotide
tgggcctcgtgtgcattgtggtggg

SEQ ID NO: 57840 - DNA, 24 bp, Artificial Sequence
  Description of Artificial Sequence: Synthetic oligonucleotide
gggcctcgtgtgcattgtggtggg

SEQ ID NO: 57841 - DNA, 25 bp, Artificial Sequence
  Description of Artificial Sequence: Synthetic oligonucleotide
ggcctcgtgtgcattgtggtgggca

SEQ ID NO: 57842 - DNA, 26 bp, Artificial Sequence
  Description of Artificial Sequence: Synthetic oligonucleotide
gcctcgtgtgcattgtggtgggcact

SEQ ID NO: 57843 - DNA, 27 bp, Artificial Sequence
  Description of Artificial Sequence: Synthetic oligonucleotide
cctcgtgtgcattgtggtgggcactgt

SEQ ID NO: 57844 - DNA, 27 bp, Artificial Sequence
  Description of Artificial Sequence: Synthetic oligonucleotide
ctcgtgtgcattgtggtgggcactgtc

SEQ ID NO: 57845 - DNA, 29 bp, Artificial Sequence
  Description of Artificial Sequence: Synthetic oligonucleotide
tcgtgtgcattgtggtgggcactgtcttc

SEQ ID NO: 57846 - DNA, 28 bp, Artificial Sequence
  Description of Artificial Sequence: Synthetic oligonucleotide
cgtgtgcattgtggtgggcactgtcttc

SEQ ID NO: 57847 - DNA, 30 bp, Artificial Sequence
  Description of Artificial Sequence: Synthetic oligonucleotide
gtgtgcattgtggtgggcactgtcttcatc

SEQ ID NO: 57848 - DNA, 32 bp, Artificial Sequence
  Description of Artificial Sequence: Synthetic oligonucleotide
tgtgcattgtggtgggcactgtcttcatcatc

SEQ ID NO: 57849 - DNA, 31 bp, Artificial Sequence
  Description of Artificial Sequence: Synthetic oligonucleotide
gtgcattgtggtgggcactgtcttcatcatc

SEQ ID NO: 57850 - DNA, 31 bp, Artificial Sequence
  Description of Artificial Sequence: Synthetic oligonucleotide
tgcattgtggtgggcactgtcttcatcatcc

SEQ ID NO: 57851 - DNA, 33 bp, Artificial Sequence
  Description of Artificial Sequence: Synthetic oligonucleotide
cactcagtcacagaaggtgtttctgagaccatc

SEQ ID NO: 57852 - DNA, 35 bp, Artificial Sequence
  Description of Artificial Sequence: Synthetic oligonucleotide
actcagtcacagaaggtgtttctgagaccatcttc

SEQ ID NO: 57853 - DNA, 34 bp, Artificial Sequence
  Description of Artificial Sequence: Synthetic oligonucleotide
ctcagtcacagaaggtgtttctgagaccatcttc

SEQ ID NO: 57854 - DNA, 34 bp, Artificial Sequence
  Description of Artificial Sequence: Synthetic oligonucleotide
tcagtcacagaaggtgtttctgagaccatcttcc

SEQ ID NO: 57855 - DNA, 33 bp, Artificial Sequence
  Description of Artificial Sequence: Synthetic oligonucleotide
cagtcacagaaggtgtttctgagaccatcttcc

SEQ ID NO: 57856 - DNA, 34 bp, Artificial Sequence
  Description of Artificial Sequence: Synthetic oligonucleotide
agtcacagaaggtgtttctgagaccatcttcctc

SEQ ID NO: 57857 - DNA, 33 bp, Artificial Sequence
  Description of Artificial Sequence: Synthetic oligonucleotide
gtcacagaaggtgtttctgagaccatcttcctc

SEQ ID NO: 57858 - DNA, 34 bp, Artificial Sequence
  Description of Artificial Sequence: Synthetic oligonucleotide
tcacagaaggtgtttctgagaccatcttcctctc

SEQ ID NO: 57859 - DNA, 33 bp, Artificial Sequence
  Description of Artificial Sequence: Synthetic oligonucleotide
cacagaaggtgtttctgagaccatcttcctctc

SEQ ID NO: 57860 - DNA, 33 bp, Artificial Sequence
  Description of Artificial Sequence: Synthetic oligonucleotide
acagaaggtgtttctgagaccatcttcctctcc

SEQ ID NO: 57861 - DNA, 32 bp, Artificial Sequence
  Description of Artificial Sequence: Synthetic oligonucleotide
cagaaggtgtttctgagaccatcttcctctcc

SEQ ID NO: 57862 - DNA, 34 bp, Artificial Sequence
  Description of Artificial Sequence: Synthetic oligonucleotide
agaaggtgtttctgagaccatcttcctctccaag

SEQ ID NO: 57863 - DNA, 33 bp, Artificial Sequence
  Description of Artificial Sequence: Synthetic oligonucleotide
gaaggtgtttctgagaccatcttcctctccaag

SEQ ID NO: 57864 - DNA, 34 bp, Artificial Sequence
  Description of Artificial Sequence: Synthetic oligonucleotide
aaggtgtttctgagaccatcttcctctccaagag

SEQ ID NO: 57865 - DNA, 33 bp, Artificial Sequence
  Description of Artificial Sequence: Synthetic oligonucleotide
aggtgtttctgagaccatcttcctctccaagag

SEQ ID NO: 57866 - DNA, 32 bp, Artificial Sequence
  Description of Artificial Sequence: Synthetic oligonucleotide
ggtgtttctgagaccatcttcctctccaagag

SEQ ID NO: 57867 - DNA, 33 bp, Artificial Sequence
  Description of Artificial Sequence: Synthetic oligonucleotide
gtgtttctgagaccatcttcctctccaagagtg

SEQ ID NO: 57868 - DNA, 35 bp, Artificial Sequence
  Description of Artificial Sequence: Synthetic oligonucleotide
tgtttctgagaccatcttcctctccaagagtgatc

SEQ ID NO: 57869 - DNA, 34 bp, Artificial Sequence
  Description of Artificial Sequence: Synthetic oligonucleotide
gtttctgagaccatcttcctctccaagagtgatc

SEQ ID NO: 57870 - DNA, 37 bp, Artificial Sequence
  Description of Artificial Sequence: Synthetic oligonucleotide
tttctgagaccatcttcctctccaagagtgatcattc

SEQ ID NO: 57871 - DNA, 36 bp, Artificial Sequence
  Description of Artificial Sequence: Synthetic oligonucleotide
ttctgagaccatcttcctctccaagagtgatcattc

SEQ ID NO: 57872 - DNA, 35 bp, Artificial Sequence
  Description of Artificial Sequence: Synthetic oligonucleotide
tctgagaccatcttcctctccaagagtgatcattc

SEQ ID NO: 57873 - DNA, 34 bp, Artificial Sequence
  Description of Artificial Sequence: Synthetic oligonucleotide
ctgagaccatcttcctctccaagagtgatcattc

SEQ ID NO: 57874 - DNA, 34 bp, Artificial Sequence
  Description of Artificial Sequence: Synthetic oligonucleotide
tgagaccatcttcctctccaagagtgatcattcc

SEQ ID NO: 57875 - DNA, 33 bp, Artificial Sequence
  Description of Artificial Sequence: Synthetic oligonucleotide
gagaccatcttcctctccaagagtgatcattcc

SEQ ID NO: 57876 - DNA, 35 bp, Artificial Sequence
  Description of Artificial Sequence: Synthetic oligonucleotide
agaccatcttcctctccaagagtgatcattccttc

SEQ ID NO: 57877 - DNA, 34 bp, Artificial Sequence
  Description of Artificial Sequence: Synthetic oligonucleotide
gaccatcttcctctccaagagtgatcattccttc

SEQ ID NO: 57878 - DNA, 36 bp, Artificial Sequence
  Description of Artificial Sequence: Synthetic oligonucleotide
accatcttcctctccaagagtgatcattccttcttc

SEQ ID NO: 57879 - DNA, 35 bp, Artificial Sequence
  Description of Artificial Sequence: Synthetic oligonucleotide
ccatcttcctctccaagagtgatcattccttcttc

SEQ ID NO: 57880 - DNA, 37 bp, Artificial Sequence
  Description of Artificial Sequence: Synthetic oligonucleotide
catcttcctctccaagagtgatcattccttcttcaag

SEQ ID NO: 57881 - DNA, 39 bp, Artificial Sequence
  Description of Artificial Sequence: Synthetic oligonucleotide
atcttcctctccaagagtgatcattccttcttcaagatc

SEQ ID NO: 57882 - DNA, 38 bp, Artificial Sequence
  Description of Artificial Sequence: Synthetic oligonucleotide
tcttcctctccaagagtgatcattccttcttcaagatc

SEQ ID NO: 57883 - DNA, 27 bp, Artificial Sequence
  Description of Artificial Sequence: Synthetic oligonucleotide
caccgtgatgagcccctgtggaggtaa

SEQ ID NO: 57884 - DNA, 28 bp, Artificial Sequence
  Description of Artificial Sequence: Synthetic oligonucleotide
accgtgatgagcccctgtggaggtaaag

SEQ ID NO: 57885 - DNA, 27 bp, Artificial Sequence
  Description of Artificial Sequence: Synthetic oligonucleotide
ccgtgatgagcccctgtggaggtaaag

SEQ ID NO: 57886 - DNA, 28 bp, Artificial Sequence
  Description of Artificial Sequence: Synthetic oligonucleotide
cgtgatgagcccctgtggaggtaaagac

SEQ ID NO: 57887 - DNA, 31 bp, Artificial Sequence
  Description of Artificial Sequence: Synthetic oligonucleotide
gtgatgagcccctgtggaggtaaagacattg

SEQ ID NO: 57888 - DNA, 32 bp, Artificial Sequence
  Description of Artificial Sequence: Synthetic oligonucleotide
tgatgagcccctgtggaggtaaagacattgtg

SEQ ID NO: 57889 - DNA, 31 bp, Artificial Sequence
  Description of Artificial Sequence: Synthetic oligonucleotide
gatgagcccctgtggaggtaaagacattgtg

SEQ ID NO: 57890 - DNA, 31 bp, Artificial Sequence
  Description of Artificial Sequence: Synthetic oligonucleotide
atgagcccctgtggaggtaaagacattgtgg

SEQ ID NO: 57891 - DNA, 30 bp, Artificial Sequence
  Description of Artificial Sequence: Synthetic oligonucleotide
tgagcccctgtggaggtaaagacattgtgg

SEQ ID NO: 57892 - DNA, 29 bp, Artificial Sequence
  Description of Artificial Sequence: Synthetic oligonucleotide
gagcccctgtggaggtaaagacattgtgg

SEQ ID NO: 57893 - DNA, 29 bp, Artificial Sequence
  Description of Artificial Sequence: Synthetic oligonucleotide
agcccctgtggaggtaaagacattgtggc

SEQ ID NO: 57894 - DNA, 28 bp, Artificial Sequence
  Description of Artificial Sequence: Synthetic oligonucleotide
gcccctgtggaggtaaagacattgtggc

SEQ ID NO: 57895 - DNA, 29 bp, Artificial Sequence
  Description of Artificial Sequence: Synthetic oligonucleotide
cccctgtggaggtaaagacattgtggctg

SEQ ID NO: 57896 - DNA, 30 bp, Artificial Sequence
  Description of Artificial Sequence: Synthetic oligonucleotide
ccctgtggaggtaaagacattgtggctgac

SEQ ID NO: 57897 - DNA, 30 bp, Artificial Sequence
  Description of Artificial Sequence: Synthetic oligonucleotide
cctgtggaggtaaagacattgtggctgacc

SEQ ID NO: 57898 - DNA, 31 bp, Artificial Sequence
  Description of Artificial Sequence: Synthetic oligonucleotide
ctgtggaggtaaagacattgtggctgaccac

SEQ ID NO: 57899 - DNA, 31 bp, Artificial Sequence
  Description of Artificial Sequence: Synthetic oligonucleotide
tgtggaggtaaagacattgtggctgaccacg

SEQ ID NO: 57900 - DNA, 30 bp, Artificial Sequence
  Description of Artificial Sequence: Synthetic oligonucleotide
gtggaggtaaagacattgtggctgaccacg

SEQ ID NO: 57901 - DNA, 31 bp, Artificial Sequence
  Description of Artificial Sequence: Synthetic oligonucleotide
tggaggtaaagacattgtggctgaccacgtc

SEQ ID NO: 57902 - DNA, 30 bp, Artificial Sequence
  Description of Artificial Sequence: Synthetic oligonucleotide
ggaggtaaagacattgtggctgaccacgtc

SEQ ID NO: 57903 - DNA, 30 bp, Artificial Sequence
  Description of Artificial Sequence: Synthetic oligonucleotide
gaggtaaagacattgtggctgaccacgtcg

SEQ ID NO: 57904 - DNA, 30 bp, Artificial Sequence
  Description of Artificial Sequence: Synthetic oligonucleotide
aggtaaagacattgtggctgaccacgtcgc

SEQ ID NO: 57905 - DNA, 29 bp, Artificial Sequence
  Description of Artificial Sequence: Synthetic oligonucleotide
ggtaaagacattgtggctgaccacgtcgc

SEQ ID NO: 57906 - DNA, 29 bp, Artificial Sequence
  Description of Artificial Sequence: Synthetic oligonucleotide
gtaaagacattgtggctgaccacgtcgcc

SEQ ID NO: 57907 - DNA, 30 bp, Artificial Sequence
  Description of Artificial Sequence: Synthetic oligonucleotide
taaagacattgtggctgaccacgtcgcctc

SEQ ID NO: 57908 - DNA, 29 bp, Artificial Sequence
  Description of Artificial Sequence: Synthetic oligonucleotide
aaagacattgtggctgaccacgtcgcctc

SEQ ID NO: 57909 - DNA, 40 bp, Artificial Sequence
  Description of Artificial Sequence: Synthetic oligonucleotide
acaaacatcgctgtcctaaaacataacttgaacagtctgg

SEQ ID NO: 57910 - DNA, 39 bp, Artificial Sequence
  Description of Artificial Sequence: Synthetic oligonucleotide
caaacatcgctgtcctaaaacataacttgaacagtctgg

SEQ ID NO: 57911 - DNA, 44 bp, Artificial Sequence
  Description of Artificial Sequence: Synthetic oligonucleotide
aaacatcgctgtcctaaaacataacttgaacagtctggttaaac

SEQ ID NO: 57912 - DNA, 43 bp, Artificial Sequence
  Description of Artificial Sequence: Synthetic oligonucleotide
aacatcgctgtcctaaaacataacttgaacagtctggttaaac

SEQ ID NO: 57913 - DNA, 42 bp, Artificial Sequence
  Description of Artificial Sequence: Synthetic oligonucleotide
acatcgctgtcctaaaacataacttgaacagtctggttaaac

SEQ ID NO: 57914 - DNA, 41 bp, Artificial Sequence
  Description of Artificial Sequence: Synthetic oligonucleotide
catcgctgtcctaaaacataacttgaacagtctggttaaac

SEQ ID NO: 57915 - DNA, 41 bp, Artificial Sequence
  Description of Artificial Sequence: Synthetic oligonucleotide
atcgctgtcctaaaacataacttgaacagtctggttaaacg

SEQ ID NO: 57916 - DNA, 40 bp, Artificial Sequence
  Description of Artificial Sequence: Synthetic oligonucleotide
tcgctgtcctaaaacataacttgaacagtctggttaaacg

SEQ ID NO: 57917 - DNA, 39 bp, Artificial Sequence
  Description of Artificial Sequence: Synthetic oligonucleotide
cgctgtcctaaaacataacttgaacagtctggttaaacg

SEQ ID NO: 57918 - DNA, 39 bp, Artificial Sequence
  Description of Artificial Sequence: Synthetic oligonucleotide
gctgtcctaaaacataacttgaacagtctggttaaacgc

SEQ ID NO: 57919 - DNA, 40 bp, Artificial Sequence
  Description of Artificial Sequence: Synthetic oligonucleotide
ctgtcctaaaacataacttgaacagtctggttaaacgctc

SEQ ID NO: 57920 - DNA, 40 bp, Artificial Sequence
  Description of Artificial Sequence: Synthetic oligonucleotide
tgtcctaaaacataacttgaacagtctggttaaacgctcc

SEQ ID NO: 57921 - DNA, 39 bp, Artificial Sequence
  Description of Artificial Sequence: Synthetic oligonucleotide
gtcctaaaacataacttgaacagtctggttaaacgctcc

SEQ ID NO: 57922 - DNA, 41 bp, Artificial Sequence
  Description of Artificial Sequence: Synthetic oligonucleotide
tcctaaaacataacttgaacagtctggttaaacgctccaac

SEQ ID NO: 57923 - DNA, 40 bp, Artificial Sequence
  Description of Artificial Sequence: Synthetic oligonucleotide
cctaaaacataacttgaacagtctggttaaacgctccaac

SEQ ID NO: 57924 - DNA, 41 bp, Artificial Sequence
  Description of Artificial Sequence: Synthetic oligonucleotide
ctaaaacataacttgaacagtctggttaaacgctccaactc

SEQ ID NO: 57925 - DNA, 43 bp, Artificial Sequence
  Description of Artificial Sequence: Synthetic oligonucleotide
taaaacataacttgaacagtctggttaaacgctccaactctac

SEQ ID NO: 57926 - DNA, 42 bp, Artificial Sequence
  Description of Artificial Sequence: Synthetic oligonucleotide
aaaacataacttgaacagtctggttaaacgctccaactctac

SEQ ID NO: 57927 - DNA, 41 bp, Artificial Sequence
  Description of Artificial Sequence: Synthetic oligonucleotide
aaacataacttgaacagtctggttaaacgctccaactctac

SEQ ID NO: 57928 - DNA, 40 bp, Artificial Sequence
  Description of Artificial Sequence: Synthetic oligonucleotide
aacataacttgaacagtctggttaaacgctccaactctac

SEQ ID NO: 57929 - DNA, 39 bp, Artificial Sequence
  Description of Artificial Sequence: Synthetic oligonucleotide
acataacttgaacagtctggttaaacgctccaactctac

SEQ ID NO: 57930 - DNA, 38 bp, Artificial Sequence
  Description of Artificial Sequence: Synthetic oligonucleotide
cataacttgaacagtctggttaaacgctccaactctac

SEQ ID NO: 57931 - DNA, 38 bp, Artificial Sequence
  Description of Artificial Sequence: Synthetic oligonucleotide
ataacttgaacagtctggttaaacgctccaactctacc

SEQ ID NO: 57932 - DNA, 37 bp, Artificial Sequence
  Description of Artificial Sequence: Synthetic oligonucleotide
taacttgaacagtctggttaaacgctccaactctacc

SEQ ID NO: 57933 - DNA, 36 bp, Artificial Sequence
  Description of Artificial Sequence: Synthetic oligonucleotide
aacttgaacagtctggttaaacgctccaactctacc

SEQ ID NO: 57934 - DNA, 35 bp, Artificial Sequence
  Description of Artificial Sequence: Synthetic oligonucleotide
acttgaacagtctggttaaacgctccaactctacc

SEQ ID NO: 57935 - DNA, 34 bp, Artificial Sequence
  Description of Artificial Sequence: Synthetic oligonucleotide
cttgaacagtctggttaaacgctccaactctacc

SEQ ID NO: 57936 - DNA, 34 bp, Artificial Sequence
  Description of Artificial Sequence: Synthetic oligonucleotide
ttgaacagtctggttaaacgctccaactctaccg

SEQ ID NO: 57937 - DNA, 33 bp, Artificial Sequence
  Description of Artificial Sequence: Synthetic oligonucleotide
tgaacagtctggttaaacgctccaactctaccg

SEQ ID NO: 57938 - DNA, 32 bp, Artificial Sequence
  Description of Artificial Sequence: Synthetic oligonucleotide
gaacagtctggttaaacgctccaactctaccg

SEQ ID NO: 57939 - DNA, 32 bp, Artificial Sequence
  Description of Artificial Sequence: Synthetic oligonucleotide
aacagtctggttaaacgctccaactctaccgc

SEQ ID NO: 57940 - DNA, 31 bp, Artificial Sequence
  Description of Artificial Sequence: Synthetic oligonucleotide
acagtctggttaaacgctccaactctaccgc

SEQ ID NO: 57941 - DNA, 30 bp, Artificial Sequence
  Description of Artificial Sequence: Synthetic oligonucleotide
cagtctggttaaacgctccaactctaccgc

SEQ ID NO: 57942 - DNA, 31 bp, Artificial Sequence
  Description of Artificial Sequence: Synthetic oligonucleotide
agtctggttaaacgctccaactctaccgctg

SEQ ID NO: 57943 - DNA, 30 bp, Artificial Sequence
  Description of Artificial Sequence: Synthetic oligonucleotide
gtctggttaaacgctccaactctaccgctg

SEQ ID NO: 57944 - DNA, 30 bp, Artificial Sequence
  Description of Artificial Sequence: Synthetic oligonucleotide
tctggttaaacgctccaactctaccgctgc

SEQ ID NO: 57945 - DNA, 29 bp, Artificial Sequence
  Description of Artificial Sequence: Synthetic oligonucleotide
ctggttaaacgctccaactctaccgctgc

SEQ ID NO: 57946 - DNA, 31 bp, Artificial Sequence
  Description of Artificial Sequence: Synthetic oligonucleotide
tggttaaacgctccaactctaccgctgctac

SEQ ID NO: 57947 - DNA, 30 bp, Artificial Sequence
  Description of Artificial Sequence: Synthetic oligonucleotide
ggttaaacgctccaactctaccgctgctac

SEQ ID NO: 57948 - DNA, 30 bp, Artificial Sequence
  Description of Artificial Sequence: Synthetic oligonucleotide
gttaaacgctccaactctaccgctgctacc

SEQ ID NO: 57949 - DNA, 32 bp, Artificial Sequence
  Description of Artificial Sequence: Synthetic oligonucleotide
ccagttcacccatgaatttgatggagacgagc

SEQ ID NO: 57950 - DNA, 33 bp, Artificial Sequence
  Description of Artificial Sequence: Synthetic oligonucleotide
cagttcacccatgaatttgatggagacgagcag

SEQ ID NO: 57951 - DNA, 35 bp, Artificial Sequence
  Description of Artificial Sequence: Synthetic oligonucleotide
agttcacccatgaatttgatggagacgagcagttc

SEQ ID NO: 57952 - DNA, 34 bp, Artificial Sequence
  Description of Artificial Sequence: Synthetic oligonucleotide
gttcacccatgaatttgatggagacgagcagttc

SEQ ID NO: 57953 - DNA, 36 bp, Artificial Sequence
  Description of Artificial Sequence: Synthetic oligonucleotide
ttcacccatgaatttgatggagacgagcagttctac

SEQ ID NO: 57954 - DNA, 35 bp, Artificial Sequence
  Description of Artificial Sequence: Synthetic oligonucleotide
tcacccatgaatttgatggagacgagcagttctac

SEQ ID NO: 57955 - DNA, 38 bp, Artificial Sequence
  Description of Artificial Sequence: Synthetic oligonucleotide
acaacttgaacatcctgattaaacgctccaactctacc

SEQ ID NO: 57956 - DNA, 37 bp, Artificial Sequence
  Description of Artificial Sequence: Synthetic oligonucleotide
caacttgaacatcctgattaaacgctccaactctacc

SEQ ID NO: 57957 - DNA, 34 bp, Artificial Sequence
  Description of Artificial Sequence: Synthetic oligonucleotide
atttgacccgcaatttgcactgacaaacatcgcc

SEQ ID NO: 57958 - DNA, 33 bp, Artificial Sequence
  Description of Artificial Sequence: Synthetic oligonucleotide
tttgacccgcaatttgcactgacaaacatcgcc

SEQ ID NO: 57959 - DNA, 32 bp, Artificial Sequence
  Description of Artificial Sequence: Synthetic oligonucleotide
ttgacccgcaatttgcactgacaaacatcgcc

SEQ ID NO: 57960 - DNA, 31 bp, Artificial Sequence
  Description of Artificial Sequence: Synthetic oligonucleotide
tgacccgcaatttgcactgacaaacatcgcc

SEQ ID NO: 57961 - DNA, 30 bp, Artificial Sequence
  Description of Artificial Sequence: Synthetic oligonucleotide
gacccgcaatttgcactgacaaacatcgcc

SEQ ID NO: 57962 - DNA, 30 bp, Artificial Sequence
  Description of Artificial Sequence: Synthetic oligonucleotide
acccgcaatttgcactgacaaacatcgccg

SEQ ID NO: 57963 - DNA, 29 bp, Artificial Sequence
  Description of Artificial Sequence: Synthetic oligonucleotide
cccgcaatttgcactgacaaacatcgccg

SEQ ID NO: 57964 - DNA, 30 bp, Artificial Sequence
  Description of Artificial Sequence: Synthetic oligonucleotide
ccgcaatttgcactgacaaacatcgccgtg

SEQ ID NO: 57965 - DNA, 31 bp, Artificial Sequence
  Description of Artificial Sequence: Synthetic oligonucleotide
cgcaatttgcactgacaaacatcgccgtgac

SEQ ID NO: 57966 - DNA, 35 bp, Artificial Sequence
  Description of Artificial Sequence: Synthetic oligonucleotide
gcaatttgcactgacaaacatcgccgtgacaaaac

SEQ ID NO: 57967 - DNA, 36 bp, Artificial Sequence
  Description of Artificial Sequence: Synthetic oligonucleotide
caatttgcactgacaaacatcgccgtgacaaaacac

SEQ ID NO: 57968 - DNA, 38 bp, Artificial Sequence
  Description of Artificial Sequence: Synthetic oligonucleotide
aatttgcactgacaaacatcgccgtgacaaaacacaac

SEQ ID NO: 57969 - DNA, 37 bp, Artificial Sequence
  Description of Artificial Sequence: Synthetic oligonucleotide
atttgcactgacaaacatcgccgtgacaaaacacaac

SEQ ID NO: 57970 - DNA, 36 bp, Artificial Sequence
  Description of Artificial Sequence: Synthetic oligonucleotide
tttgcactgacaaacatcgccgtgacaaaacacaac

SEQ ID NO: 57971 - DNA, 35 bp, Artificial Sequence
  Description of Artificial Sequence: Synthetic oligonucleotide
ttgcactgacaaacatcgccgtgacaaaacacaac

SEQ ID NO: 57972 - DNA, 34 bp, Artificial Sequence
  Description of Artificial Sequence: Synthetic oligonucleotide
tgcactgacaaacatcgccgtgacaaaacacaac

SEQ ID NO: 57973 - DNA, 33 bp, Artificial Sequence
  Description of Artificial Sequence: Synthetic oligonucleotide
gcactgacaaacatcgccgtgacaaaacacaac

SEQ ID NO: 57974 - DNA, 35 bp, Artificial Sequence
  Description of Artificial Sequence: Synthetic oligonucleotide
cactgacaaacatcgccgtgacaaaacacaacttg

SEQ ID NO: 57975 - DNA, 37 bp, Artificial Sequence
  Description of Artificial Sequence: Synthetic oligonucleotide
actgacaaacatcgccgtgacaaaacacaacttgaac

SEQ ID NO: 57976 - DNA, 36 bp, Artificial Sequence
  Description of Artificial Sequence: Synthetic oligonucleotide
ctgacaaacatcgccgtgacaaaacacaacttgaac

SEQ ID NO: 57977 - DNA, 38 bp, Artificial Sequence
  Description of Artificial Sequence: Synthetic oligonucleotide
tgacaaacatcgccgtgacaaaacacaacttgaacatc

SEQ ID NO: 57978 - DNA, 37 bp, Artificial Sequence
  Description of Artificial Sequence: Synthetic oligonucleotide
gacaaacatcgccgtgacaaaacacaacttgaacatc

SEQ ID NO: 57979 - DNA, 37 bp, Artificial Sequence
  Description of Artificial Sequence: Synthetic oligonucleotide
acaaacatcgccgtgacaaaacacaacttgaacatcc

SEQ ID NO: 57980 - DNA, 36 bp, Artificial Sequence
  Description of Artificial Sequence: Synthetic oligonucleotide
caaacatcgccgtgacaaaacacaacttgaacatcc

SEQ ID NO: 57981 - DNA, 37 bp, Artificial Sequence
  Description of Artificial Sequence: Synthetic oligonucleotide
aaacatcgccgtgacaaaacacaacttgaacatcctg

SEQ ID NO: 57982 - DNA, 36 bp, Artificial Sequence
  Description of Artificial Sequence: Synthetic oligonucleotide
aacatcgccgtgacaaaacacaacttgaacatcctg

SEQ ID NO: 57983 - DNA, 35 bp, Artificial Sequence
  Description of Artificial Sequence: Synthetic oligonucleotide
acatcgccgtgacaaaacacaacttgaacatcctg

SEQ ID NO: 57984 - DNA, 34 bp, Artificial Sequence
  Description of Artificial Sequence: Synthetic oligonucleotide
catcgccgtgacaaaacacaacttgaacatcctg

SEQ ID NO: 57985 - DNA, 40 bp, Artificial Sequence
  Description of Artificial Sequence: Synthetic oligonucleotide
atcgccgtgacaaaacacaacttgaacatcctgattaaac

SEQ ID NO: 57986 - DNA, 39 bp, Artificial Sequence
  Description of Artificial Sequence: Synthetic oligonucleotide
tcgccgtgacaaaacacaacttgaacatcctgattaaac

SEQ ID NO: 57987 - DNA, 38 bp, Artificial Sequence
  Description of Artificial Sequence: Synthetic oligonucleotide
cgccgtgacaaaacacaacttgaacatcctgattaaac

SEQ ID NO: 57988 - DNA, 38 bp, Artificial Sequence
  Description of Artificial Sequence: Synthetic oligonucleotide
gccgtgacaaaacacaacttgaacatcctgattaaacg

SEQ ID NO: 57989 - DNA, 38 bp, Artificial Sequence
  Description of Artificial Sequence: Synthetic oligonucleotide
ccgtgacaaaacacaacttgaacatcctgattaaacgc

SEQ ID NO: 57990 - DNA, 39 bp, Artificial Sequence
  Description of Artificial Sequence: Synthetic oligonucleotide
cgtgacaaaacacaacttgaacatcctgattaaacgctc

SEQ ID NO: 57991 - DNA, 31 bp, Artificial Sequence
  Description of Artificial Sequence: Synthetic oligonucleotide
cactcagtcacagaaggtgtttctgagaccc

SEQ ID NO: 57992 - DNA, 31 bp, Artificial Sequence
  Description of Artificial Sequence: Synthetic oligonucleotide
actcagtcacagaaggtgtttctgagacccg

SEQ ID NO: 57993 - DNA, 30 bp, Artificial Sequence
  Description of Artificial Sequence: Synthetic oligonucleotide
ctcagtcacagaaggtgtttctgagacccg

SEQ ID NO: 57994 - DNA, 30 bp, Artificial Sequence
  Description of Artificial Sequence: Synthetic oligonucleotide
tcagtcacagaaggtgtttctgagacccgc

SEQ ID NO: 57995 - DNA, 29 bp, Artificial Sequence
  Description of Artificial Sequence: Synthetic oligonucleotide
cagtcacagaaggtgtttctgagacccgc

SEQ ID NO: 57996 - DNA, 31 bp, Artificial Sequence
  Description of Artificial Sequence: Synthetic oligonucleotide
agtcacagaaggtgtttctgagacccgcttc

SEQ ID NO: 57997 - DNA, 30 bp, Artificial Sequence
  Description of Artificial Sequence: Synthetic oligonucleotide
gtcacagaaggtgtttctgagacccgcttc

SEQ ID NO: 57998 - DNA, 30 bp, Artificial Sequence
  Description of Artificial Sequence: Synthetic oligonucleotide
tcacagaaggtgtttctgagacccgcttcc

SEQ ID NO: 57999 - DNA, 29 bp, Artificial Sequence
  Description of Artificial Sequence: Synthetic oligonucleotide
cacagaaggtgtttctgagacccgcttcc

SEQ ID NO: 58000 - DNA, 30 bp, Artificial Sequence
  Description of Artificial Sequence: Synthetic oligonucleotide
acagaaggtgtttctgagacccgcttcctc

SEQ ID NO: 58001 - DNA, 29 bp, Artificial Sequence
  Description of Artificial Sequence: Synthetic oligonucleotide
cagaaggtgtttctgagacccgcttcctc

SEQ ID NO: 58002 - DNA, 30 bp, Artificial Sequence
  Description of Artificial Sequence: Synthetic oligonucleotide
agaaggtgtttctgagacccgcttcctctc

SEQ ID NO: 58003 - DNA, 29 bp, Artificial Sequence
  Description of Artificial Sequence: Synthetic oligonucleotide
gaaggtgtttctgagacccgcttcctctc

SEQ ID NO: 58004 - DNA, 29 bp, Artificial Sequence
  Description of Artificial Sequence: Synthetic oligonucleotide
aaggtgtttctgagacccgcttcctctcc

SEQ ID NO: 58005 - DNA, 28 bp, Artificial Sequence
  Description of Artificial Sequence: Synthetic oligonucleotide
aggtgtttctgagacccgcttcctctcc

SEQ ID NO: 58006 - DNA, 27 bp, Artificial Sequence
  Description of Artificial Sequence: Synthetic oligonucleotide
ggtgtttctgagacccgcttcctctcc

SEQ ID NO: 58007 - DNA, 29 bp, Artificial Sequence
  Description of Artificial Sequence: Synthetic oligonucleotide
gtgtttctgagacccgcttcctctccaag

SEQ ID NO: 58008 - DNA, 30 bp, Artificial Sequence
  Description of Artificial Sequence: Synthetic oligonucleotide
tgtttctgagacccgcttcctctccaagag

SEQ ID NO: 58009 - DNA, 29 bp, Artificial Sequence
  Description of Artificial Sequence: Synthetic oligonucleotide
gtttctgagacccgcttcctctccaagag

SEQ ID NO: 58010 - DNA, 30 bp, Artificial Sequence
  Description of Artificial Sequence: Synthetic oligonucleotide
tttctgagacccgcttcctctccaagagtg

SEQ ID NO: 58011 - DNA, 29 bp, Artificial Sequence
  Description of Artificial Sequence: Synthetic oligonucleotide
ttctgagacccgcttcctctccaagagtg

SEQ ID NO: 58012 - DNA, 28 bp, Artificial Sequence
  Description of Artificial Sequence: Synthetic oligonucleotide
tctgagacccgcttcctctccaagagtg

SEQ ID NO: 58013 - DNA, 27 bp, Artificial Sequence
  Description of Artificial Sequence: Synthetic oligonucleotide
ctgagacccgcttcctctccaagagtg

SEQ ID NO: 58014 - DNA, 29 bp, Artificial Sequence
  Description of Artificial Sequence: Synthetic oligonucleotide
tgagacccgcttcctctccaagagtgatc

SEQ ID NO: 58015 - DNA, 28 bp, Artificial Sequence
  Description of Artificial Sequence: Synthetic oligonucleotide
gagacccgcttcctctccaagagtgatc

SEQ ID NO: 58016 - DNA, 31 bp, Artificial Sequence
  Description of Artificial Sequence: Synthetic oligonucleotide
agacccgcttcctctccaagagtgatcattc

SEQ ID NO: 58017 - DNA, 30 bp, Artificial Sequence
  Description of Artificial Sequence: Synthetic oligonucleotide
gacccgcttcctctccaagagtgatcattc

SEQ ID NO: 58018 - DNA, 30 bp, Artificial Sequence
  Description of Artificial Sequence: Synthetic oligonucleotide
acccgcttcctctccaagagtgatcattcc

SEQ ID NO: 58019 - DNA, 29 bp, Artificial Sequence
  Description of Artificial Sequence: Synthetic oligonucleotide
cccgcttcctctccaagagtgatcattcc

SEQ ID NO: 58020 - DNA, 31 bp, Artificial Sequence
  Description of Artificial Sequence: Synthetic oligonucleotide
ccgcttcctctccaagagtgatcattccttc

SEQ ID NO: 58021 - DNA, 33 bp, Artificial Sequence
  Description of Artificial Sequence: Synthetic oligonucleotide
cgcttcctctccaagagtgatcattccttcttc

SEQ ID NO: 58022 - DNA, 31 bp, Artificial Sequence
  Description of Artificial Sequence: Synthetic oligonucleotide
atgtcttggaaaaaggctttgcggatccccg

SEQ ID NO: 58023 - DNA, 30 bp, Artificial Sequence
  Description of Artificial Sequence: Synthetic oligonucleotide
tgtcttggaaaaaggctttgcggatccccg

SEQ ID NO: 58024 - DNA, 29 bp, Artificial Sequence
  Description of Artificial Sequence: Synthetic oligonucleotide
gtcttggaaaaaggctttgcggatccccg

SEQ ID NO: 58025 - DNA, 29 bp, Artificial Sequence
  Description of Artificial Sequence: Synthetic oligonucleotide
tcttggaaaaaggctttgcggatccccgg

SEQ ID NO: 58026 - DNA, 28 bp, Artificial Sequence
  Description of Artificial Sequence: Synthetic oligonucleotide
cttggaaaaaggctttgcggatccccgg

SEQ ID NO: 58027 - DNA, 29 bp, Artificial Sequence
  Description of Artificial Sequence: Synthetic oligonucleotide
ttggaaaaaggctttgcggatccccggag

SEQ ID NO: 58028 - DNA, 28 bp, Artificial Sequence
  Description of Artificial Sequence: Synthetic oligonucleotide
tggaaaaaggctttgcggatccccggag

SEQ ID NO: 58029 - DNA, 27 bp, Artificial Sequence
  Description of Artificial Sequence: Synthetic oligonucleotide
ggaaaaaggctttgcggatccccggag

SEQ ID NO: 58030 - DNA, 27 bp, Artificial Sequence
  Description of Artificial Sequence: Synthetic oligonucleotide
gaaaaaggctttgcggatccccggagg

SEQ ID NO: 58031 - DNA, 27 bp, Artificial Sequence
  Description of Artificial Sequence: Synthetic oligonucleotide
aaaaaggctttgcggatccccggaggc

SEQ ID NO: 58032 - DNA, 26 bp, Artificial Sequence
  Description of Artificial Sequence: Synthetic oligonucleotide
aaaaggctttgcggatccccggaggc

SEQ ID NO: 58033 - DNA, 25 bp, Artificial Sequence
  Description of Artificial Sequence: Synthetic oligonucleotide
aaaggctttgcggatccccggaggc

SEQ ID NO: 58034 - DNA, 24 bp, Artificial Sequence
  Description of Artificial Sequence: Synthetic oligonucleotide
aaggctttgcggatccccggaggc

SEQ ID NO: 58035 - DNA, 23 bp, Artificial Sequence
  Description of Artificial Sequence: Synthetic oligonucleotide
aggctttgcggatccccggaggc

SEQ ID NO: 58036 - DNA, 22 bp, Artificial Sequence
  Description of Artificial Sequence: Synthetic oligonucleotide
ggctttgcggatccccggaggc

SEQ ID NO: 58037 - DNA, 24 bp, Artificial Sequence
  Description of Artificial Sequence: Synthetic oligonucleotide
gctttgcggatccccggaggcctt

SEQ ID NO: 58038 - DNA, 24 bp, Artificial Sequence
  Description of Artificial Sequence: Synthetic oligonucleotide
ctttgcggatccccggaggccttc

SEQ ID NO: 58039 - DNA, 24 bp, Artificial Sequence
  Description of Artificial Sequence: Synthetic oligonucleotide
tttgcggatccccggaggccttcg

SEQ ID NO: 58040 - DNA, 23 bp, Artificial Sequence
  Description of Artificial Sequence: Synthetic oligonucleotide
ttgcggatccccggaggccttcg

SEQ ID NO: 58041 - DNA, 22 bp, Artificial Sequence
  Description of Artificial Sequence: Synthetic oligonucleotide
tgcggatccccggaggccttcg

SEQ ID NO: 58042 - DNA, 21 bp, Artificial Sequence
  Description of Artificial Sequence: Synthetic oligonucleotide
gcggatccccggaggccttcg

SEQ ID NO: 58043 - DNA, 21 bp, Artificial Sequence
  Description of Artificial Sequence: Synthetic oligonucleotide
cggatccccggaggccttcgg

SEQ ID NO: 58044 - DNA, 21 bp, Artificial Sequence
  Description of Artificial Sequence: Synthetic oligonucleotide
ggatccccggaggccttcggg

SEQ ID NO: 58045 - DNA, 22 bp, Artificial Sequence
  Description of Artificial Sequence: Synthetic oligonucleotide
gatccccggaggccttcgggca

SEQ ID NO: 58046 - DNA, 22 bp, Artificial Sequence
  Description of Artificial Sequence: Synthetic oligonucleotide
atccccggaggccttcgggcag

SEQ ID NO: 58047 - DNA, 21 bp, Artificial Sequence
  Description of Artificial Sequence: Synthetic oligonucleotide
tccccggaggccttcgggcag

SEQ ID NO: 58048 - DNA, 20 bp, Artificial Sequence
  Description of Artificial Sequence: Synthetic oligonucleotide
ccccggaggccttcgggcag

SEQ ID NO: 58049 - DNA, 22 bp, Artificial Sequence
  Description of Artificial Sequence: Synthetic oligonucleotide
cccggaggccttcgggcagcaa

SEQ ID NO: 58050 - DNA, 23 bp, Artificial Sequence
  Description of Artificial Sequence: Synthetic oligonucleotide
ccggaggccttcgggcagcaact

SEQ ID NO: 58051 - DNA, 24 bp, Artificial Sequence
  Description of Artificial Sequence: Synthetic oligonucleotide
cggaggccttcgggcagcaactgt

SEQ ID NO: 58052 - DNA, 25 bp, Artificial Sequence
  Description of Artificial Sequence: Synthetic oligonucleotide
ggaggccttcgggcagcaactgtga

SEQ ID NO: 58053 - DNA, 25 bp, Artificial Sequence
  Description of Artificial Sequence: Synthetic oligonucleotide
gaggccttcgggcagcaactgtgac

SEQ ID NO: 58054 - DNA, 27 bp, Artificial Sequence
  Description of Artificial Sequence: Synthetic oligonucleotide
aggccttcgggcagcaactgtgacctt

SEQ ID NO: 58055 - DNA, 26 bp, Artificial Sequence
  Description of Artificial Sequence: Synthetic oligonucleotide
ggccttcgggcagcaactgtgacctt

SEQ ID NO: 58056 - DNA, 27 bp, Artificial Sequence
  Description of Artificial Sequence: Synthetic oligonucleotide
gccttcgggcagcaactgtgaccttga

SEQ ID NO: 58057 - DNA, 28 bp, Artificial Sequence
  Description of Artificial Sequence: Synthetic oligonucleotide
ccttcgggcagcaactgtgaccttgatg

SEQ ID NO: 58058 - DNA, 28 bp, Artificial Sequence
  Description of Artificial Sequence: Synthetic oligonucleotide
cttcgggcagcaactgtgaccttgatgc

SEQ ID NO: 58059 - DNA, 29 bp, Artificial Sequence
  Description of Artificial Sequence: Synthetic oligonucleotide
ttcgggcagcaactgtgaccttgatgctg

SEQ ID NO: 58060 - DNA, 28 bp, Artificial Sequence
  Description of Artificial Sequence: Synthetic oligonucleotide
tcgggcagcaactgtgaccttgatgctg

SEQ ID NO: 58061 - DNA, 27 bp, Artificial Sequence
  Description of Artificial Sequence: Synthetic oligonucleotide
cgggcagcaactgtgaccttgatgctg

SEQ ID NO: 58062 - DNA, 28 bp, Artificial Sequence
  Description of Artificial Sequence: Synthetic oligonucleotide
gggcagcaactgtgaccttgatgctgtc

SEQ ID NO: 58063 - DNA, 28 bp, Artificial Sequence
  Description of Artificial Sequence: Synthetic oligonucleotide
ggcagcaactgtgaccttgatgctgtcg

SEQ ID NO: 58064 - DNA, 30 bp, Artificial Sequence
  Description of Artificial Sequence: Synthetic oligonucleotide
gcagcaactgtgaccttgatgctgtcgatg

SEQ ID NO: 58065 - DNA, 30 bp, Artificial Sequence
  Description of Artificial Sequence: Synthetic oligonucleotide
cagcaactgtgaccttgatgctgtcgatgc

SEQ ID NO: 58066 - DNA, 31 bp, Artificial Sequence
  Description of Artificial Sequence: Synthetic oligonucleotide
agcaactgtgaccttgatgctgtcgatgctg

SEQ ID NO: 58067 - DNA, 30 bp, Artificial Sequence
  Description of Artificial Sequence: Synthetic oligonucleotide
gcaactgtgaccttgatgctgtcgatgctg

SEQ ID NO: 58068 - DNA, 31 bp, Artificial Sequence
  Description of Artificial Sequence: Synthetic oligonucleotide
caactgtgaccttgatgctgtcgatgctgag

SEQ ID NO: 58069 - DNA, 31 bp, Artificial Sequence
  Description of Artificial Sequence: Synthetic oligonucleotide
aactgtgaccttgatgctgtcgatgctgagc

SEQ ID NO: 58070 - DNA, 30 bp, Artificial Sequence
  Description of Artificial Sequence: Synthetic oligonucleotide
actgtgaccttgatgctgtcgatgctgagc

SEQ ID NO: 58071 - DNA, 29 bp, Artificial Sequence
  Description of Artificial Sequence: Synthetic oligonucleotide
ctgtgaccttgatgctgtcgatgctgagc

SEQ ID NO: 58072 - DNA, 30 bp, Artificial Sequence
  Description of Artificial Sequence: Synthetic oligonucleotide
tgtgaccttgatgctgtcgatgctgagcac

SEQ ID NO: 58073 - DNA, 29 bp, Artificial Sequence
  Description of Artificial Sequence: Synthetic oligonucleotide
gtgaccttgatgctgtcgatgctgagcac

SEQ ID NO: 58074 - DNA, 29 bp, Artificial Sequence
  Description of Artificial Sequence: Synthetic oligonucleotide
tgaccttgatgctgtcgatgctgagcacc

SEQ ID NO: 58075 - DNA, 28 bp, Artificial Sequence
  Description of Artificial Sequence: Synthetic oligonucleotide
gaccttgatgctgtcgatgctgagcacc

SEQ ID NO: 58076 - DNA, 28 bp, Artificial Sequence
  Description of Artificial Sequence: Synthetic oligonucleotide
accttgatgctgtcgatgctgagcaccc

SEQ ID NO: 58077 - DNA, 27 bp, Artificial Sequence
  Description of Artificial Sequence: Synthetic oligonucleotide
ccttgatgctgtcgatgctgagcaccc

SEQ ID NO: 58078 - DNA, 27 bp, Artificial Sequence
  Description of Artificial Sequence: Synthetic oligonucleotide
cttgatgctgtcgatgctgagcacccc

SEQ ID NO: 58079 - DNA, 28 bp, Artificial Sequence
  Description of Artificial Sequence: Synthetic oligonucleotide
ttgatgctgtcgatgctgagcaccccag

SEQ ID NO: 58080 - DNA, 27 bp, Artificial Sequence
  Description of Artificial Sequence: Synthetic oligonucleotide
tgatgctgtcgatgctgagcaccccag

SEQ ID NO: 58081 - DNA, 27 bp, Artificial Sequence
  Description of Artificial Sequence: Synthetic oligonucleotide
gatgctgtcgatgctgagcaccccagt

SEQ ID NO: 58082 - DNA, 27 bp, Artificial Sequence
  Description of Artificial Sequence: Synthetic oligonucleotide
atgctgtcgatgctgagcaccccagtg

SEQ ID NO: 58083 - DNA, 26 bp, Artificial Sequence
  Description of Artificial Sequence: Synthetic oligonucleotide
tgctgtcgatgctgagcaccccagtg

SEQ ID NO: 58084 - DNA, 25 bp, Artificial Sequence
  Description of Artificial Sequence: Synthetic oligonucleotide
gctgtcgatgctgagcaccccagtg

SEQ ID NO: 58085 - DNA, 25 bp, Artificial Sequence
  Description of Artificial Sequence: Synthetic oligonucleotide
ctgtcgatgctgagcaccccagtgg

SEQ ID NO: 58086 - DNA, 26 bp, Artificial Sequence
  Description of Artificial Sequence: Synthetic oligonucleotide
tgtcgatgctgagcaccccagtggct

SEQ ID NO: 58087 - DNA, 25 bp, Artificial Sequence
  Description of Artificial Sequence: Synthetic oligonucleotide
gtcgatgctgagcaccccagtggct

SEQ ID NO: 58088 - DNA, 26 bp, Artificial Sequence
  Description of Artificial Sequence: Synthetic oligonucleotide
tcgatgctgagcaccccagtggctga

SEQ ID NO: 58089 - DNA, 25 bp, Artificial Sequence
  Description of Artificial Sequence: Synthetic oligonucleotide
cgatgctgagcaccccagtggctga

SEQ ID NO: 58090 - DNA, 25 bp, Artificial Sequence
  Description of Artificial Sequence: Synthetic oligonucleotide
gatgctgagcaccccagtggctgag

SEQ ID NO: 58091 - DNA, 25 bp, Artificial Sequence
  Description of Artificial Sequence: Synthetic oligonucleotide
atgctgagcaccccagtggctgagg

SEQ ID NO: 58092 - DNA, 24 bp, Artificial Sequence
  Description of Artificial Sequence: Synthetic oligonucleotide
tgctgagcaccccagtggctgagg

SEQ ID NO: 58093 - DNA, 23 bp, Artificial Sequence
  Description of Artificial Sequence: Synthetic oligonucleotide
gctgagcaccccagtggctgagg

SEQ ID NO: 58094 - DNA, 23 bp, Artificial Sequence
  Description of Artificial Sequence: Synthetic oligonucleotide
ctgagcaccccagtggctgaggg

SEQ ID NO: 58095 - DNA, 24 bp, Artificial Sequence
  Description of Artificial Sequence: Synthetic oligonucleotide
tgagcaccccagtggctgagggca

SEQ ID NO: 58096 - DNA, 23 bp, Artificial Sequence
  Description of Artificial Sequence: Synthetic oligonucleotide
gagcaccccagtggctgagggca

SEQ ID NO: 58097 - DNA, 24 bp, Artificial Sequence
  Description of Artificial Sequence: Synthetic oligonucleotide
agcaccccagtggctgagggcaga

SEQ ID NO: 58098 - DNA, 23 bp, Artificial Sequence
  Description of Artificial Sequence: Synthetic oligonucleotide
gcaccccagtggctgagggcaga

SEQ ID NO: 58099 - DNA, 24 bp, Artificial Sequence
  Description of Artificial Sequence: Synthetic oligonucleotide
caccccagtggctgagggcagaga

SEQ ID NO: 58100 - DNA, 25 bp, Artificial Sequence
  Description of Artificial Sequence: Synthetic oligonucleotide
accccagtggctgagggcagagact

SEQ ID NO: 58101 - DNA, 24 bp, Artificial Sequence
  Description of Artificial Sequence: Synthetic oligonucleotide
ccccagtggctgagggcagagact

SEQ ID NO: 58102 - DNA, 25 bp, Artificial Sequence
  Description of Artificial Sequence: Synthetic oligonucleotide
cccagtggctgagggcagagactct

SEQ ID NO: 58103 - DNA, 25 bp, Artificial Sequence
  Description of Artificial Sequence: Synthetic oligonucleotide
ccagtggctgagggcagagactctc

SEQ ID NO: 58104 - DNA, 25 bp, Artificial Sequence
  Description of Artificial Sequence: Synthetic oligonucleotide
cagtggctgagggcagagactctcc

SEQ ID NO: 58105 - DNA, 25 bp, Artificial Sequence
  Description of Artificial Sequence: Synthetic oligonucleotide
agtggctgagggcagagactctccc

SEQ ID NO: 58106 - DNA, 24 bp, Artificial Sequence
  Description of Artificial Sequence: Synthetic oligonucleotide
gtggctgagggcagagactctccc

SEQ ID NO: 58107 - DNA, 25 bp, Artificial Sequence
  Description of Artificial Sequence: Synthetic oligonucleotide
tggctgagggcagagactctcccga

SEQ ID NO: 58108 - DNA, 24 bp, Artificial Sequence
  Description of Artificial Sequence: Synthetic oligonucleotide
ggctgagggcagagactctcccga

SEQ ID NO: 58109 - DNA, 24 bp, Artificial Sequence
  Description of Artificial Sequence: Synthetic oligonucleotide
gctgagggcagagactctcccgag

SEQ ID NO: 58110 - DNA, 27 bp, Artificial Sequence
  Description of Artificial Sequence: Synthetic oligonucleotide
ctgagggcagagactctcccgaggatt

SEQ ID NO: 58111 - DNA, 28 bp, Artificial Sequence
  Description of Artificial Sequence: Synthetic oligonucleotide
tgagggcagagactctcccgaggatttc

SEQ ID NO: 58112 - DNA, 27 bp, Artificial Sequence
  Description of Artificial Sequence: Synthetic oligonucleotide
gagggcagagactctcccgaggatttc

SEQ ID NO: 58113 - DNA, 27 bp, Artificial Sequence
  Description of Artificial Sequence: Synthetic oligonucleotide
agggcagagactctcccgaggatttcg

SEQ ID NO: 58114 - DNA, 27 bp, Artificial Sequence
  Description of Artificial Sequence: Synthetic oligonucleotide
gggcagagactctcccgaggatttcgt

SEQ ID NO: 58115 - DNA, 27 bp, Artificial Sequence
  Description of Artificial Sequence: Synthetic oligonucleotide
ggcagagactctcccgaggatttcgtg

SEQ ID NO: 58116 - DNA, 29 bp, Artificial Sequence
  Description of Artificial Sequence: Synthetic oligonucleotide
gcagagactctcccgaggatttcgtgtac

SEQ ID NO: 58117 - DNA, 29 bp, Artificial Sequence
  Description of Artificial Sequence: Synthetic oligonucleotide
cagagactctcccgaggatttcgtgtacc

SEQ ID NO: 58118 - DNA, 30 bp, Artificial Sequence
  Description of Artificial Sequence: Synthetic oligonucleotide
agagactctcccgaggatttcgtgtaccag

SEQ ID NO: 58119 - DNA, 29 bp, Artificial Sequence
  Description of Artificial Sequence: Synthetic oligonucleotide
gagactctcccgaggatttcgtgtaccag

SEQ ID NO: 58120 - DNA, 34 bp, Artificial Sequence
  Description of Artificial Sequence: Synthetic oligonucleotide
agactctcccgaggatttcgtgtaccagtttaag

SEQ ID NO: 58121 - DNA, 33 bp, Artificial Sequence
  Description of Artificial Sequence: Synthetic oligonucleotide
gactctcccgaggatttcgtgtaccagtttaag

SEQ ID NO: 58122 - DNA, 33 bp, Artificial Sequence
  Description of Artificial Sequence: Synthetic oligonucleotide
actctcccgaggatttcgtgtaccagtttaagg

SEQ ID NO: 58123 - DNA, 32 bp, Artificial Sequence
  Description of Artificial Sequence: Synthetic oligonucleotide
ctctcccgaggatttcgtgtaccagtttaagg

SEQ ID NO: 58124 - DNA, 32 bp, Artificial Sequence
  Description of Artificial Sequence: Synthetic oligonucleotide
tctcccgaggatttcgtgtaccagtttaaggg

SEQ ID NO: 58125 - DNA, 31 bp, Artificial Sequence
  Description of Artificial Sequence: Synthetic oligonucleotide
ctcccgaggatttcgtgtaccagtttaaggg

SEQ ID NO: 58126 - DNA, 31 bp, Artificial Sequence
  Description of Artificial Sequence: Synthetic oligonucleotide
tcccgaggatttcgtgtaccagtttaagggc

SEQ ID NO: 58127 - DNA, 30 bp, Artificial Sequence
  Description of Artificial Sequence: Synthetic oligonucleotide
cccgaggatttcgtgtaccagtttaagggc

SEQ ID NO: 58128 - DNA, 32 bp, Artificial Sequence
  Description of Artificial Sequence: Synthetic oligonucleotide
ccgaggatttcgtgtaccagtttaagggcatg

SEQ ID NO: 58129 - DNA, 33 bp, Artificial Sequence
  Description of Artificial Sequence: Synthetic oligonucleotide
cgaggatttcgtgtaccagtttaagggcatgtg

SEQ ID NO: 58130 - DNA, 33 bp, Artificial Sequence
  Description of Artificial Sequence: Synthetic oligonucleotide
gaggatttcgtgtaccagtttaagggcatgtgc

SEQ ID NO: 58131 - DNA, 35 bp, Artificial Sequence
  Description of Artificial Sequence: Synthetic oligonucleotide
aggatttcgtgtaccagtttaagggcatgtgctac

SEQ ID NO: 58132 - DNA, 34 bp, Artificial Sequence
  Description of Artificial Sequence: Synthetic oligonucleotide
ggatttcgtgtaccagtttaagggcatgtgctac

SEQ ID NO: 58133 - DNA, 36 bp, Artificial Sequence
  Description of Artificial Sequence: Synthetic oligonucleotide
gatttcgtgtaccagtttaagggcatgtgctacttc

SEQ ID NO: 58134 - DNA, 37 bp, Artificial Sequence
  Description of Artificial Sequence: Synthetic oligonucleotide
atttcgtgtaccagtttaagggcatgtgctacttcac

SEQ ID NO: 58135 - DNA, 36 bp, Artificial Sequence
  Description of Artificial Sequence: Synthetic oligonucleotide
tttcgtgtaccagtttaagggcatgtgctacttcac

SEQ ID NO: 58136 - DNA, 35 bp, Artificial Sequence
  Description of Artificial Sequence: Synthetic oligonucleotide
ttcgtgtaccagtttaagggcatgtgctacttcac

SEQ ID NO: 58137 - DNA, 34 bp, Artificial Sequence
  Description of Artificial Sequence: Synthetic oligonucleotide
tcgtgtaccagtttaagggcatgtgctacttcac

SEQ ID NO: 58138 - DNA, 33 bp, Artificial Sequence
  Description of Artificial Sequence: Synthetic oligonucleotide
cgtgtaccagtttaagggcatgtgctacttcac

SEQ ID NO: 58139 - DNA, 33 bp, Artificial Sequence
  Description of Artificial Sequence: Synthetic oligonucleotide
gtgtaccagtttaagggcatgtgctacttcacc

SEQ ID NO: 58140 - DNA, 35 bp, Artificial Sequence
  Description of Artificial Sequence: Synthetic oligonucleotide
tgtaccagtttaagggcatgtgctacttcaccaac

SEQ ID NO: 58141 - DNA, 34 bp, Artificial Sequence
  Description of Artificial Sequence: Synthetic oligonucleotide
gtaccagtttaagggcatgtgctacttcaccaac

SEQ ID NO: 58142 - DNA, 34 bp, Artificial Sequence
  Description of Artificial Sequence: Synthetic oligonucleotide
taccagtttaagggcatgtgctacttcaccaacg

SEQ ID NO: 58143 - DNA, 33 bp, Artificial Sequence
  Description of Artificial Sequence: Synthetic oligonucleotide
accagtttaagggcatgtgctacttcaccaacg

SEQ ID NO: 58144 - DNA, 32 bp, Artificial Sequence
  Description of Artificial Sequence: Synthetic oligonucleotide
ccagtttaagggcatgtgctacttcaccaacg

SEQ ID NO: 58145 - DNA, 32 bp, Artificial Sequence
  Description of Artificial Sequence: Synthetic oligonucleotide
cagtttaagggcatgtgctacttcaccaacgg

SEQ ID NO: 58146 - DNA, 32 bp, Artificial Sequence
  Description of Artificial Sequence: Synthetic oligonucleotide
agtttaagggcatgtgctacttcaccaacggg

SEQ ID NO: 58147 - DNA, 31 bp, Artificial Sequence
  Description of Artificial Sequence: Synthetic oligonucleotide
gtttaagggcatgtgctacttcaccaacggg

SEQ ID NO: 58148 - DNA, 32 bp, Artificial Sequence
  Description of Artificial Sequence: Synthetic oligonucleotide
tttaagggcatgtgctacttcaccaacgggac

SEQ ID NO: 58149 - DNA, 31 bp, Artificial Sequence
  Description of Artificial Sequence: Synthetic oligonucleotide
ttaagggcatgtgctacttcaccaacgggac

SEQ ID NO: 58150 - DNA, 30 bp, Artificial Sequence
  Description of Artificial Sequence: Synthetic oligonucleotide
taagggcatgtgctacttcaccaacgggac

SEQ ID NO: 58151 - DNA, 29 bp, Artificial Sequence
  Description of Artificial Sequence: Synthetic oligonucleotide
aagggcatgtgctacttcaccaacgggac

SEQ ID NO: 58152 - DNA, 28 bp, Artificial Sequence
  Description of Artificial Sequence: Synthetic oligonucleotide
agggcatgtgctacttcaccaacgggac

SEQ ID NO: 58153 - DNA, 27 bp, Artificial Sequence
  Description of Artificial Sequence: Synthetic oligonucleotide
gggcatgtgctacttcaccaacgggac

SEQ ID NO: 58154 - DNA, 28 bp, Artificial Sequence
  Description of Artificial Sequence: Synthetic oligonucleotide
ggcatgtgctacttcaccaacgggacag

SEQ ID NO: 58155 - DNA, 29 bp, Artificial Sequence
  Description of Artificial Sequence: Synthetic oligonucleotide
gcatgtgctacttcaccaacgggacagag

SEQ ID NO: 58156 - DNA, 29 bp, Artificial Sequence
  Description of Artificial Sequence: Synthetic oligonucleotide
catgtgctacttcaccaacgggacagagc

SEQ ID NO: 58157 - DNA, 29 bp, Artificial Sequence
  Description of Artificial Sequence: Synthetic oligonucleotide
atgtgctacttcaccaacgggacagagcg

SEQ ID NO: 58158 - DNA, 28 bp, Artificial Sequence
  Description of Artificial Sequence: Synthetic oligonucleotide
tgtgctacttcaccaacgggacagagcg

SEQ ID NO: 58159 - DNA, 27 bp, Artificial Sequence
  Description of Artificial Sequence: Synthetic oligonucleotide
gtgctacttcaccaacgggacagagcg

SEQ ID NO: 58160 - DNA, 27 bp, Artificial Sequence
  Description of Artificial Sequence: Synthetic oligonucleotide
tgctacttcaccaacgggacagagcgc

SEQ ID NO: 58161 - DNA, 26 bp, Artificial Sequence
  Description of Artificial Sequence: Synthetic oligonucleotide
gctacttcaccaacgggacagagcgc

SEQ ID NO: 58162 - DNA, 27 bp, Artificial Sequence
  Description of Artificial Sequence: Synthetic oligonucleotide
ctacttcaccaacgggacagagcgcgt

SEQ ID NO: 58163 - DNA, 27 bp, Artificial Sequence
  Description of Artificial Sequence: Synthetic oligonucleotide
tacttcaccaacgggacagagcgcgtg

SEQ ID NO: 58164 - DNA, 26 bp, Artificial Sequence
  Description of Artificial Sequence: Synthetic oligonucleotide
acttcaccaacgggacagagcgcgtg

SEQ ID NO: 58165 - DNA, 25 bp, Artificial Sequence
  Description of Artificial Sequence: Synthetic oligonucleotide
cttcaccaacgggacagagcgcgtg

SEQ ID NO: 58166 - DNA, 25 bp, Artificial Sequence
  Description of Artificial Sequence: Synthetic oligonucleotide
ttcaccaacgggacagagcgcgtgc

SEQ ID NO: 58167 - DNA, 24 bp, Artificial Sequence
  Description of Artificial Sequence: Synthetic oligonucleotide
tcaccaacgggacagagcgcgtgc

SEQ ID NO: 58168 - DNA, 23 bp, Artificial Sequence
  Description of Artificial Sequence: Synthetic oligonucleotide
caccaacgggacagagcgcgtgc

SEQ ID NO: 58169 - DNA, 24 bp, Artificial Sequence
  Description of Artificial Sequence: Synthetic oligonucleotide
accaacgggacagagcgcgtgcgt

SEQ ID NO: 58170 - DNA, 23 bp, Artificial Sequence
  Description of Artificial Sequence: Synthetic oligonucleotide
ccaacgggacagagcgcgtgcgt

SEQ ID NO: 58171 - DNA, 25 bp, Artificial Sequence
  Description of Artificial Sequence: Synthetic oligonucleotide
caacgggacagagcgcgtgcgtctt

SEQ ID NO: 58172 - DNA, 26 bp, Artificial Sequence
  Description of Artificial Sequence: Synthetic oligonucleotide
aacgggacagagcgcgtgcgtcttgt

SEQ ID NO: 58173 - DNA, 25 bp, Artificial Sequence
  Description of Artificial Sequence: Synthetic oligonucleotide
acgggacagagcgcgtgcgtcttgt

SEQ ID NO: 58174 - DNA, 24 bp, Artificial Sequence
  Description of Artificial Sequence: Synthetic oligonucleotide
cgggacagagcgcgtgcgtcttgt

SEQ ID NO: 58175 - DNA, 25 bp, Artificial Sequence
  Description of Artificial Sequence: Synthetic oligonucleotide
gggacagagcgcgtgcgtcttgtga

SEQ ID NO: 58176 - DNA, 25 bp, Artificial Sequence
  Description of Artificial Sequence: Synthetic oligonucleotide
ggacagagcgcgtgcgtcttgtgag

SEQ ID NO: 58177 - DNA, 26 bp, Artificial Sequence
  Description of Artificial Sequence: Synthetic oligonucleotide
gacagagcgcgtgcgtcttgtgagca

SEQ ID NO: 58178 - DNA, 27 bp, Artificial Sequence
  Description of Artificial Sequence: Synthetic oligonucleotide
acagagcgcgtgcgtcttgtgagcaga

SEQ ID NO: 58179 - DNA, 27 bp, Artificial Sequence
  Description of Artificial Sequence: Synthetic oligonucleotide
cagagcgcgtgcgtcttgtgagcagaa

SEQ ID NO: 58180 - DNA, 27 bp, Artificial Sequence
  Description of Artificial Sequence: Synthetic oligonucleotide
agagcgcgtgcgtcttgtgagcagaag

SEQ ID NO: 58181 - DNA, 26 bp, Artificial Sequence
  Description of Artificial Sequence: Synthetic oligonucleotide
gagcgcgtgcgtcttgtgagcagaag

SEQ ID NO: 58182 - DNA, 27 bp, Artificial Sequence
  Description of Artificial Sequence: Synthetic oligonucleotide
agcgcgtgcgtcttgtgagcagaagca

SEQ ID NO: 58183 - DNA, 27 bp, Artificial Sequence
  Description of Artificial Sequence: Synthetic oligonucleotide
gcgcgtgcgtcttgtgagcagaagcat

SEQ ID NO: 58184 - DNA, 27 bp, Artificial Sequence
  Description of Artificial Sequence: Synthetic oligonucleotide
cgcgtgcgtcttgtgagcagaagcatc

SEQ ID NO: 58185 - DNA, 32 bp, Artificial Sequence
  Description of Artificial Sequence: Synthetic oligonucleotide
gcgtgcgtcttgtgagcagaagcatctataac

SEQ ID NO: 58186 - DNA, 32 bp, Artificial Sequence
  Description of Artificial Sequence: Synthetic oligonucleotide
cgtgcgtcttgtgagcagaagcatctataacc

SEQ ID NO: 58187 - DNA, 32 bp, Artificial Sequence
  Description of Artificial Sequence: Synthetic oligonucleotide
gtgcgtcttgtgagcagaagcatctataaccg

SEQ ID NO: 58188 - DNA, 33 bp, Artificial Sequence
  Description of Artificial Sequence: Synthetic oligonucleotide
tgcgtcttgtgagcagaagcatctataaccgag

SEQ ID NO: 58189 - DNA, 32 bp, Artificial Sequence
  Description of Artificial Sequence: Synthetic oligonucleotide
gcgtcttgtgagcagaagcatctataaccgag

SEQ ID NO: 58190 - DNA, 34 bp, Artificial Sequence
  Description of Artificial Sequence: Synthetic oligonucleotide
cgtcttgtgagcagaagcatctataaccgagaag

SEQ ID NO: 58191 - DNA, 35 bp, Artificial Sequence
  Description of Artificial Sequence: Synthetic oligonucleotide
gtcttgtgagcagaagcatctataaccgagaagag

SEQ ID NO: 58192 - DNA, 37 bp, Artificial Sequence
  Description of Artificial Sequence: Synthetic oligonucleotide
tcttgtgagcagaagcatctataaccgagaagagatc

SEQ ID NO: 58193 - DNA, 36 bp, Artificial Sequence
  Description of Artificial Sequence: Synthetic oligonucleotide
cttgtgagcagaagcatctataaccgagaagagatc

SEQ ID NO: 58194 - DNA, 36 bp, Artificial Sequence
  Description of Artificial Sequence: Synthetic oligonucleotide
ttgtgagcagaagcatctataaccgagaagagatcg

SEQ ID NO: 58195 - DNA, 35 bp, Artificial Sequence
  Description of Artificial Sequence: Synthetic oligonucleotide
tgtgagcagaagcatctataaccgagaagagatcg

SEQ ID NO: 58196 - DNA, 34 bp, Artificial Sequence
  Description of Artificial Sequence: Synthetic oligonucleotide
gtgagcagaagcatctataaccgagaagagatcg

SEQ ID NO: 58197 - DNA, 35 bp, Artificial Sequence
  Description of Artificial Sequence: Synthetic oligonucleotide
tgagcagaagcatctataaccgagaagagatcgtg

SEQ ID NO: 58198 - DNA, 34 bp, Artificial Sequence
  Description of Artificial Sequence: Synthetic oligonucleotide
gagcagaagcatctataaccgagaagagatcgtg

SEQ ID NO: 58199 - DNA, 34 bp, Artificial Sequence
  Description of Artificial Sequence: Synthetic oligonucleotide
agcagaagcatctataaccgagaagagatcgtgc

SEQ ID NO: 58200 - DNA, 33 bp, Artificial Sequence
  Description of Artificial Sequence: Synthetic oligonucleotide
gcagaagcatctataaccgagaagagatcgtgc

SEQ ID NO: 58201 - DNA, 33 bp, Artificial Sequence
  Description of Artificial Sequence: Synthetic oligonucleotide
cagaagcatctataaccgagaagagatcgtgcg

SEQ ID NO: 58202 - DNA, 33 bp, Artificial Sequence
  Description of Artificial Sequence: Synthetic oligonucleotide
agaagcatctataaccgagaagagatcgtgcgc

SEQ ID NO: 58203 - DNA, 32 bp, Artificial Sequence
  Description of Artificial Sequence: Synthetic oligonucleotide
gaagcatctataaccgagaagagatcgtgcgc

SEQ ID NO: 58204 - DNA, 34 bp, Artificial Sequence
  Description of Artificial Sequence: Synthetic oligonucleotide
aagcatctataaccgagaagagatcgtgcgcttc

SEQ ID NO: 58205 - DNA, 33 bp, Artificial Sequence
  Description of Artificial Sequence: Synthetic oligonucleotide
agcatctataaccgagaagagatcgtgcgcttc

SEQ ID NO: 58206 - DNA, 32 bp, Artificial Sequence
  Description of Artificial Sequence: Synthetic oligonucleotide
gcatctataaccgagaagagatcgtgcgcttc

SEQ ID NO: 58207 - DNA, 32 bp, Artificial Sequence
  Description of Artificial Sequence: Synthetic oligonucleotide
catctataaccgagaagagatcgtgcgcttcg

SEQ ID NO: 58208 - DNA, 33 bp, Artificial Sequence
  Description of Artificial Sequence: Synthetic oligonucleotide
atctataaccgagaagagatcgtgcgcttcgac

SEQ ID NO: 58209 - DNA, 32 bp, Artificial Sequence
  Description of Artificial Sequence: Synthetic oligonucleotide
tctataaccgagaagagatcgtgcgcttcgac

SEQ ID NO: 58210 - DNA, 31 bp, Artificial Sequence
  Description of Artificial Sequence: Synthetic oligonucleotide
ctataaccgagaagagatcgtgcgcttcgac

SEQ ID NO: 58211 - DNA, 32 bp, Artificial Sequence
  Description of Artificial Sequence: Synthetic oligonucleotide
tataaccgagaagagatcgtgcgcttcgacag

SEQ ID NO: 58212 - DNA, 31 bp, Artificial Sequence
  Description of Artificial Sequence: Synthetic oligonucleotide
ataaccgagaagagatcgtgcgcttcgacag

SEQ ID NO: 58213 - DNA, 30 bp, Artificial Sequence
  Description of Artificial Sequence: Synthetic oligonucleotide
taaccgagaagagatcgtgcgcttcgacag

SEQ ID NO: 58214 - DNA, 29 bp, Artificial Sequence
  Description of Artificial Sequence: Synthetic oligonucleotide
aaccgagaagagatcgtgcgcttcgacag

SEQ ID NO: 58215 - DNA, 28 bp, Artificial Sequence
  Description of Artificial Sequence: Synthetic oligonucleotide
accgagaagagatcgtgcgcttcgacag

SEQ ID NO: 58216 - DNA, 27 bp, Artificial Sequence
  Description of Artificial Sequence: Synthetic oligonucleotide
ccgagaagagatcgtgcgcttcgacag

SEQ ID NO: 58217 - DNA, 27 bp, Artificial Sequence
  Description of Artificial Sequence: Synthetic oligonucleotide
cgagaagagatcgtgcgcttcgacagc

SEQ ID NO: 58218 - DNA, 27 bp, Artificial Sequence
  Description of Artificial Sequence: Synthetic oligonucleotide
gagaagagatcgtgcgcttcgacagcg

SEQ ID NO: 58219 - DNA, 28 bp, Artificial Sequence
  Description of Artificial Sequence: Synthetic oligonucleotide
agaagagatcgtgcgcttcgacagcgac

SEQ ID NO: 58220 - DNA, 27 bp, Artificial Sequence
  Description of Artificial Sequence: Synthetic oligonucleotide
gaagagatcgtgcgcttcgacagcgac

SEQ ID NO: 58221 - DNA, 27 bp, Artificial Sequence
  Description of Artificial Sequence: Synthetic oligonucleotide
aagagatcgtgcgcttcgacagcgacg

SEQ ID NO: 58222 - DNA, 27 bp, Artificial Sequence
  Description of Artificial Sequence: Synthetic oligonucleotide
agagatcgtgcgcttcgacagcgacgt

SEQ ID NO: 58223 - DNA, 26 bp, Artificial Sequence
  Description of Artificial Sequence: Synthetic oligonucleotide
gagatcgtgcgcttcgacagcgacgt

SEQ ID NO: 58224 - DNA, 26 bp, Artificial Sequence
  Description of Artificial Sequence: Synthetic oligonucleotide
agatcgtgcgcttcgacagcgacgtg

SEQ ID NO: 58225 - DNA, 25 bp, Artificial Sequence
  Description of Artificial Sequence: Synthetic oligonucleotide
gatcgtgcgcttcgacagcgacgtg

SEQ ID NO: 58226 - DNA, 25 bp, Artificial Sequence
  Description of Artificial Sequence: Synthetic oligonucleotide
atcgtgcgcttcgacagcgacgtgg

SEQ ID NO: 58227 - DNA, 22 bp, Artificial Sequence
  Description of Artificial Sequence: Synthetic oligonucleotide
gggagttccgggcggtgacgct

SEQ ID NO: 58228 - DNA, 22 bp, Artificial Sequence
  Description of Artificial Sequence: Synthetic oligonucleotide
ggagttccgggcggtgacgctg

SEQ ID NO: 58229 - DNA, 23 bp, Artificial Sequence
  Description of Artificial Sequence: Synthetic oligonucleotide
gagttccgggcggtgacgctgct

SEQ ID NO: 58230 - DNA, 23 bp, Artificial Sequence
  Description of Artificial Sequence: Synthetic oligonucleotide
agttccgggcggtgacgctgctg

SEQ ID NO: 58231 - DNA, 22 bp, Artificial Sequence
  Description of Artificial Sequence: Synthetic oligonucleotide
gttccgggcggtgacgctgctg

SEQ ID NO: 58232 - DNA, 22 bp, Artificial Sequence
  Description of Artificial Sequence: Synthetic oligonucleotide
ttccgggcggtgacgctgctgg

SEQ ID NO: 58233 - DNA, 21 bp, Artificial Sequence
  Description of Artificial Sequence: Synthetic oligonucleotide
tccgggcggtgacgctgctgg

SEQ ID NO: 58234 - DNA, 20 bp, Artificial Sequence
  Description of Artificial Sequence: Synthetic oligonucleotide
ccgggcggtgacgctgctgg

SEQ ID NO: 58235 - DNA, 20 bp, Artificial Sequence
  Description of Artificial Sequence: Synthetic oligonucleotide
cgggcggtgacgctgctggg

SEQ ID NO: 58236 - DNA, 20 bp, Artificial Sequence
  Description of Artificial Sequence: Synthetic oligonucleotide
gggcggtgacgctgctgggg

SEQ ID NO: 58237 - DNA, 21 bp, Artificial Sequence
  Description of Artificial Sequence: Synthetic oligonucleotide
ggcggtgacgctgctggggct

SEQ ID NO: 58238 - DNA, 21 bp, Artificial Sequence
  Description of Artificial Sequence: Synthetic oligonucleotide
gcggtgacgctgctggggctg

SEQ ID NO: 58239 - DNA, 21 bp, Artificial Sequence
  Description of Artificial Sequence: Synthetic oligonucleotide
cggtgacgctgctggggctgc

SEQ ID NO: 58240 - DNA, 22 bp, Artificial Sequence
  Description of Artificial Sequence: Synthetic oligonucleotide
ggtgacgctgctggggctgcct

SEQ ID NO: 58241 - DNA, 22 bp, Artificial Sequence
  Description of Artificial Sequence: Synthetic oligonucleotide
gtgacgctgctggggctgcctg

SEQ ID NO: 58242 - DNA, 22 bp, Artificial Sequence
  Description of Artificial Sequence: Synthetic oligonucleotide
tgacgctgctggggctgcctgc

SEQ ID NO: 58243 - DNA, 21 bp, Artificial Sequence
  Description of Artificial Sequence: Synthetic oligonucleotide
gacgctgctggggctgcctgc

SEQ ID NO: 58244 - DNA, 21 bp, Artificial Sequence
  Description of Artificial Sequence: Synthetic oligonucleotide
acgctgctggggctgcctgcc

SEQ ID NO: 58245 - DNA, 20 bp, Artificial Sequence
  Description of Artificial Sequence: Synthetic oligonucleotide
cgctgctggggctgcctgcc

SEQ ID NO: 58246 - DNA, 20 bp, Artificial Sequence
  Description of Artificial Sequence: Synthetic oligonucleotide
gctgctggggctgcctgccg

SEQ ID NO: 58247 - DNA, 20 bp, Artificial Sequence
  Description of Artificial Sequence: Synthetic oligonucleotide
ctgctggggctgcctgccgc

SEQ ID NO: 58248 - DNA, 20 bp, Artificial Sequence
  Description of Artificial Sequence: Synthetic oligonucleotide
tgctggggctgcctgccgcc

SEQ ID NO: 58249 - DNA, 20 bp, Artificial Sequence
  Description of Artificial Sequence: Synthetic oligonucleotide
gctggggctgcctgccgcct

SEQ ID NO: 58250 - DNA, 20 bp, Artificial Sequence
  Description of Artificial Sequence: Synthetic oligonucleotide
ctggggctgcctgccgccga

SEQ ID NO: 58251 - DNA, 22 bp, Artificial Sequence
  Description of Artificial Sequence: Synthetic oligonucleotide
tggggctgcctgccgccgagta

SEQ ID NO: 58252 - DNA, 21 bp, Artificial Sequence
  Description of Artificial Sequence: Synthetic oligonucleotide
ggggctgcctgccgccgagta

SEQ ID NO: 58253 - DNA, 22 bp, Artificial Sequence
  Description of Artificial Sequence: Synthetic oligonucleotide
gggctgcctgccgccgagtact

SEQ ID NO: 58254 - DNA, 22 bp, Artificial Sequence
  Description of Artificial Sequence: Synthetic oligonucleotide
ggctgcctgccgccgagtactg

SEQ ID NO: 58255 - DNA, 24 bp, Artificial Sequence
  Description of Artificial Sequence: Synthetic oligonucleotide
gctgcctgccgccgagtactggaa

SEQ ID NO: 58256 - DNA, 25 bp, Artificial Sequence
  Description of Artificial Sequence: Synthetic oligonucleotide
ctgcctgccgccgagtactggaaca

SEQ ID NO: 58257 - DNA, 25 bp, Artificial Sequence
  Description of Artificial Sequence: Synthetic oligonucleotide
tgcctgccgccgagtactggaacag

SEQ ID NO: 58258 - DNA, 24 bp, Artificial Sequence
  Description of Artificial Sequence: Synthetic oligonucleotide
gcctgccgccgagtactggaacag

SEQ ID NO: 58259 - DNA, 24 bp, Artificial Sequence
  Description of Artificial Sequence: Synthetic oligonucleotide
cctgccgccgagtactggaacagc

SEQ ID NO: 58260 - DNA, 25 bp, Artificial Sequence
  Description of Artificial Sequence: Synthetic oligonucleotide
ctgccgccgagtactggaacagcca

SEQ ID NO: 58261 - DNA, 27 bp, Artificial Sequence
  Description of Artificial Sequence: Synthetic oligonucleotide
tgccgccgagtactggaacagccagaa

SEQ ID NO: 58262 - DNA, 26 bp, Artificial Sequence
  Description of Artificial Sequence: Synthetic oligonucleotide
gccgccgagtactggaacagccagaa

SEQ ID NO: 58263 - DNA, 26 bp, Artificial Sequence
  Description of Artificial Sequence: Synthetic oligonucleotide
ccgccgagtactggaacagccagaag

SEQ ID NO: 58264 - DNA, 27 bp, Artificial Sequence
  Description of Artificial Sequence: Synthetic oligonucleotide
cgccgagtactggaacagccagaagga

SEQ ID NO: 58265 - DNA, 27 bp, Artificial Sequence
  Description of Artificial Sequence: Synthetic oligonucleotide
gccgagtactggaacagccagaaggac

SEQ ID NO: 58266 - DNA, 29 bp, Artificial Sequence
  Description of Artificial Sequence: Synthetic oligonucleotide
ccgagtactggaacagccagaaggacatc

SEQ ID NO: 58267 - DNA, 29 bp, Artificial Sequence
  Description of Artificial Sequence: Synthetic oligonucleotide
cgagtactggaacagccagaaggacatcc

SEQ ID NO: 58268 - DNA, 29 bp, Artificial Sequence
  Description of Artificial Sequence: Synthetic oligonucleotide
tggaacagccagaaggacatcctggagag

SEQ ID NO: 58269 - DNA, 28 bp, Artificial Sequence
  Description of Artificial Sequence: Synthetic oligonucleotide
ggaacagccagaaggacatcctggagag

SEQ ID NO: 58270 - DNA, 28 bp, Artificial Sequence
  Description of Artificial Sequence: Synthetic oligonucleotide
gaacagccagaaggacatcctggagagg

SEQ ID NO: 58271 - DNA, 31 bp, Artificial Sequence
  Description of Artificial Sequence: Synthetic oligonucleotide
aacagccagaaggacatcctggagaggaaac

SEQ ID NO: 58272 - DNA, 30 bp, Artificial Sequence
  Description of Artificial Sequence: Synthetic oligonucleotide
acagccagaaggacatcctggagaggaaac

SEQ ID NO: 58273 - DNA, 29 bp, Artificial Sequence
  Description of Artificial Sequence: Synthetic oligonucleotide
cagccagaaggacatcctggagaggaaac

SEQ ID NO: 58274 - DNA, 29 bp, Artificial Sequence
  Description of Artificial Sequence: Synthetic oligonucleotide
agccagaaggacatcctggagaggaaacg

SEQ ID NO: 58275 - DNA, 28 bp, Artificial Sequence
  Description of Artificial Sequence: Synthetic oligonucleotide
gccagaaggacatcctggagaggaaacg

SEQ ID NO: 58276 - DNA, 28 bp, Artificial Sequence
  Description of Artificial Sequence: Synthetic oligonucleotide
ccagaaggacatcctggagaggaaacgg

SEQ ID NO: 58277 - DNA, 28 bp, Artificial Sequence
  Description of Artificial Sequence: Synthetic oligonucleotide
cagaaggacatcctggagaggaaacggg

SEQ ID NO: 58278 - DNA, 28 bp, Artificial Sequence
  Description of Artificial Sequence: Synthetic oligonucleotide
agaaggacatcctggagaggaaacgggc

SEQ ID NO: 58279 - DNA, 27 bp, Artificial Sequence
  Description of Artificial Sequence: Synthetic oligonucleotide
gaaggacatcctggagaggaaacgggc

SEQ ID NO: 58280 - DNA, 27 bp, Artificial Sequence
  Description of Artificial Sequence: Synthetic oligonucleotide
aaggacatcctggagaggaaacgggcg

SEQ ID NO: 58281 - DNA, 26 bp, Artificial Sequence
  Description of Artificial Sequence: Synthetic oligonucleotide
aggacatcctggagaggaaacgggcg

SEQ ID NO: 58282 - DNA, 25 bp, Artificial Sequence
  Description of Artificial Sequence: Synthetic oligonucleotide
ggacatcctggagaggaaacgggcg

SEQ ID NO: 58283 - DNA, 25 bp, Artificial Sequence
  Description of Artificial Sequence: Synthetic oligonucleotide
gacatcctggagaggaaacgggcgg

SEQ ID NO: 58284 - DNA, 25 bp, Artificial Sequence
  Description of Artificial Sequence: Synthetic oligonucleotide
acatcctggagaggaaacgggcggc

SEQ ID NO: 58285 - DNA, 24 bp, Artificial Sequence
  Description of Artificial Sequence: Synthetic oligonucleotide
catcctggagaggaaacgggcggc

SEQ ID NO: 58286 - DNA, 24 bp, Artificial Sequence
  Description of Artificial Sequence: Synthetic oligonucleotide
atcctggagaggaaacgggcggcg

SEQ ID NO: 58287 - DNA, 23 bp, Artificial Sequence
  Description of Artificial Sequence: Synthetic oligonucleotide
tcctggagaggaaacgggcggcg

SEQ ID NO: 58288 - DNA, 22 bp, Artificial Sequence
  Description of Artificial Sequence: Synthetic oligonucleotide
cctggagaggaaacgggcggcg

SEQ ID NO: 58289 - DNA, 23 bp, Artificial Sequence
  Description of Artificial Sequence: Synthetic oligonucleotide
ctggagaggaaacgggcggcggt

SEQ ID NO: 58290 - DNA, 23 bp, Artificial Sequence
  Description of Artificial Sequence: Synthetic oligonucleotide
tggagaggaaacgggcggcggtg

SEQ ID NO: 58291 - DNA, 22 bp, Artificial Sequence
  Description of Artificial Sequence: Synthetic oligonucleotide
ggagaggaaacgggcggcggtg

SEQ ID NO: 58292 - DNA, 23 bp, Artificial Sequence
  Description of Artificial Sequence: Synthetic oligonucleotide
gagaggaaacgggcggcggtgga

SEQ ID NO: 58293 - DNA, 24 bp, Artificial Sequence
  Description of Artificial Sequence: Synthetic oligonucleotide
agaggaaacgggcggcggtggaca

SEQ ID NO: 58294 - DNA, 23 bp, Artificial Sequence
  Description of Artificial Sequence: Synthetic oligonucleotide
gaggaaacgggcggcggtggaca

SEQ ID NO: 58295 - DNA, 23 bp, Artificial Sequence
  Description of Artificial Sequence: Synthetic oligonucleotide
aggaaacgggcggcggtggacag

SEQ ID NO: 58296 - DNA, 22 bp, Artificial Sequence
  Description of Artificial Sequence: Synthetic oligonucleotide
ggaaacgggcggcggtggacag

SEQ ID NO: 58297 - DNA, 22 bp, Artificial Sequence
  Description of Artificial Sequence: Synthetic oligonucleotide
gaaacgggcggcggtggacagg

SEQ ID NO: 58298 - DNA, 23 bp, Artificial Sequence
  Description of Artificial Sequence: Synthetic oligonucleotide
aaacgggcggcggtggacagggt

SEQ ID NO: 58299 - DNA, 22 bp, Artificial Sequence
  Description of Artificial Sequence: Synthetic oligonucleotide
aacgggcggcggtggacagggt

SEQ ID NO: 58300 - DNA, 21 bp, Artificial Sequence
  Description of Artificial Sequence: Synthetic oligonucleotide
acgggcggcggtggacagggt

SEQ ID NO: 58301 - DNA, 20 bp, Artificial Sequence
  Description of Artificial Sequence: Synthetic oligonucleotide
cgggcggcggtggacagggt

SEQ ID NO: 58302 - DNA, 21 bp, Artificial Sequence
  Description of Artificial Sequence: Synthetic oligonucleotide
gggcggcggtggacagggtgt

SEQ ID NO: 58303 - DNA, 21 bp, Artificial Sequence
  Description of Artificial Sequence: Synthetic oligonucleotide
ggcggcggtggacagggtgtg

SEQ ID NO: 58304 - DNA, 22 bp, Artificial Sequence
  Description of Artificial Sequence: Synthetic oligonucleotide
gcggcggtggacagggtgtgca

SEQ ID NO: 58305 - DNA, 23 bp, Artificial Sequence
  Description of Artificial Sequence: Synthetic oligonucleotide
cggcggtggacagggtgtgcaga

SEQ ID NO: 58306 - DNA, 24 bp, Artificial Sequence
  Description of Artificial Sequence: Synthetic oligonucleotide
ggcggtggacagggtgtgcagaca

SEQ ID NO: 58307 - DNA, 26 bp, Artificial Sequence
  Description of Artificial Sequence: Synthetic oligonucleotide
gcggtggacagggtgtgcagacacaa

SEQ ID NO: 58308 - DNA, 27 bp, Artificial Sequence
  Description of Artificial Sequence: Synthetic oligonucleotide
cggtggacagggtgtgcagacacaact

SEQ ID NO: 58309 - DNA, 28 bp, Artificial Sequence
  Description of Artificial Sequence: Synthetic oligonucleotide
ggtggacagggtgtgcagacacaactac

SEQ ID NO: 58310 - DNA, 28 bp, Artificial Sequence
  Description of Artificial Sequence: Synthetic oligonucleotide
gtggacagggtgtgcagacacaactacc

SEQ ID NO: 58311 - DNA, 29 bp, Artificial Sequence
  Description of Artificial Sequence: Synthetic oligonucleotide
tggacagggtgtgcagacacaactaccag

SEQ ID NO: 58312 - DNA, 28 bp, Artificial Sequence
  Description of Artificial Sequence: Synthetic oligonucleotide
ggacagggtgtgcagacacaactaccag

SEQ ID NO: 58313 - DNA, 30 bp, Artificial Sequence
  Description of Artificial Sequence: Synthetic oligonucleotide
gacagggtgtgcagacacaactaccagttg

SEQ ID NO: 58314 - DNA, 30 bp, Artificial Sequence
  Description of Artificial Sequence: Synthetic oligonucleotide
acagggtgtgcagacacaactaccagttgg

SEQ ID NO: 58315 - DNA, 29 bp, Artificial Sequence
  Description of Artificial Sequence: Synthetic oligonucleotide
cagggtgtgcagacacaactaccagttgg

SEQ ID NO: 58316 - DNA, 30 bp, Artificial Sequence
  Description of Artificial Sequence: Synthetic oligonucleotide
agggtgtgcagacacaactaccagttggag

SEQ ID NO: 58317 - DNA, 29 bp, Artificial Sequence
  Description of Artificial Sequence: Synthetic oligonucleotide
gggtgtgcagacacaactaccagttggag

SEQ ID NO: 58318 - DNA, 29 bp, Artificial Sequence
  Description of Artificial Sequence: Synthetic oligonucleotide
ggtgtgcagacacaactaccagttggagc

SEQ ID NO: 58319 - DNA, 30 bp, Artificial Sequence
  Description of Artificial Sequence: Synthetic oligonucleotide
gtgtgcagacacaactaccagttggagctc

SEQ ID NO: 58320 - DNA, 30 bp, Artificial Sequence
  Description of Artificial Sequence: Synthetic oligonucleotide
tgtgcagacacaactaccagttggagctcc

SEQ ID NO: 58321 - DNA, 29 bp, Artificial Sequence
  Description of Artificial Sequence: Synthetic oligonucleotide
gtgcagacacaactaccagttggagctcc

SEQ ID NO: 58322 - DNA, 29 bp, Artificial Sequence
  Description of Artificial Sequence: Synthetic oligonucleotide
tgcagacacaactaccagttggagctccg

SEQ ID NO: 58323 - DNA, 28 bp, Artificial Sequence
  Description of Artificial Sequence: Synthetic oligonucleotide
gcagacacaactaccagttggagctccg

SEQ ID NO: 58324 - DNA, 28 bp, Artificial Sequence
  Description of Artificial Sequence: Synthetic oligonucleotide
cagacacaactaccagttggagctccgc

SEQ ID NO: 58325 - DNA, 29 bp, Artificial Sequence
  Description of Artificial Sequence: Synthetic oligonucleotide
agacacaactaccagttggagctccgcac

SEQ ID NO: 58326 - DNA, 28 bp, Artificial Sequence
  Description of Artificial Sequence: Synthetic oligonucleotide
gacacaactaccagttggagctccgcac

SEQ ID NO: 58327 - DNA, 28 bp, Artificial Sequence
  Description of Artificial Sequence: Synthetic oligonucleotide
acacaactaccagttggagctccgcacg

SEQ ID NO: 58328 - DNA, 27 bp, Artificial Sequence
  Description of Artificial Sequence: Synthetic oligonucleotide
cacaactaccagttggagctccgcacg

SEQ ID NO: 58329 - DNA, 28 bp, Artificial Sequence
  Description of Artificial Sequence: Synthetic oligonucleotide
acaactaccagttggagctccgcacgac

SEQ ID NO: 58330 - DNA, 27 bp, Artificial Sequence
  Description of Artificial Sequence: Synthetic oligonucleotide
caactaccagttggagctccgcacgac

SEQ ID NO: 58331 - DNA, 27 bp, Artificial Sequence
  Description of Artificial Sequence: Synthetic oligonucleotide
aactaccagttggagctccgcacgacc

SEQ ID NO: 58332 - DNA, 27 bp, Artificial Sequence
  Description of Artificial Sequence: Synthetic oligonucleotide
actaccagttggagctccgcacgacct

SEQ ID NO: 58333 - DNA, 27 bp, Artificial Sequence
  Description of Artificial Sequence: Synthetic oligonucleotide
ctaccagttggagctccgcacgacctt

SEQ ID NO: 58334 - DNA, 27 bp, Artificial Sequence
  Description of Artificial Sequence: Synthetic oligonucleotide
taccagttggagctccgcacgaccttg

SEQ ID NO: 58335 - DNA, 26 bp, Artificial Sequence
  Description of Artificial Sequence: Synthetic oligonucleotide
accagttggagctccgcacgaccttg

SEQ ID NO: 58336 - DNA, 25 bp, Artificial Sequence
  Description of Artificial Sequence: Synthetic oligonucleotide
ccagttggagctccgcacgaccttg

SEQ ID NO: 58337 - DNA, 26 bp, Artificial Sequence
  Description of Artificial Sequence: Synthetic oligonucleotide
cagttggagctccgcacgaccttgca

SEQ ID NO: 58338 - DNA, 26 bp, Artificial Sequence
  Description of Artificial Sequence: Synthetic oligonucleotide
agttggagctccgcacgaccttgcag

SEQ ID NO: 58339 - DNA, 25 bp, Artificial Sequence
  Description of Artificial Sequence: Synthetic oligonucleotide
gttggagctccgcacgaccttgcag

SEQ ID NO: 58340 - DNA, 25 bp, Artificial Sequence
  Description of Artificial Sequence: Synthetic oligonucleotide
ttggagctccgcacgaccttgcagc

SEQ ID NO: 58341 - DNA, 24 bp, Artificial Sequence
  Description of Artificial Sequence: Synthetic oligonucleotide
tggagctccgcacgaccttgcagc

SEQ ID NO: 58342 - DNA, 23 bp, Artificial Sequence
  Description of Artificial Sequence: Synthetic oligonucleotide
ggagctccgcacgaccttgcagc

SEQ ID NO: 58343 - DNA, 23 bp, Artificial Sequence
  Description of Artificial Sequence: Synthetic oligonucleotide
gagctccgcacgaccttgcagcg

SEQ ID NO: 58344 - DNA, 23 bp, Artificial Sequence
  Description of Artificial Sequence: Synthetic oligonucleotide
agctccgcacgaccttgcagcgg

SEQ ID NO: 58345 - DNA, 22 bp, Artificial Sequence
  Description of Artificial Sequence: Synthetic oligonucleotide
gctccgcacgaccttgcagcgg

SEQ ID NO: 58346 - DNA, 22 bp, Artificial Sequence
  Description of Artificial Sequence: Synthetic oligonucleotide
ctccgcacgaccttgcagcggc

SEQ ID NO: 58347 - DNA, 23 bp, Artificial Sequence
  Description of Artificial Sequence: Synthetic oligonucleotide
tccgcacgaccttgcagcggcga

SEQ ID NO: 58348 - DNA, 22 bp, Artificial Sequence
  Description of Artificial Sequence: Synthetic oligonucleotide
ccgcacgaccttgcagcggcga

SEQ ID NO: 58349 - DNA, 23 bp, Artificial Sequence
  Description of Artificial Sequence: Synthetic oligonucleotide
cgcacgaccttgcagcggcgagt

SEQ ID NO: 58350 - DNA, 23 bp, Artificial Sequence
  Description of Artificial Sequence: Synthetic oligonucleotide
gcacgaccttgcagcggcgagtg

SEQ ID NO: 58351 - DNA, 24 bp, Artificial Sequence
  Description of Artificial Sequence: Synthetic oligonucleotide
cacgaccttgcagcggcgagtgga

SEQ ID NO: 58352 - DNA, 24 bp, Artificial Sequence
  Description of Artificial Sequence: Synthetic oligonucleotide
acgaccttgcagcggcgagtggag

SEQ ID NO: 58353 - DNA, 23 bp, Artificial Sequence
  Description of Artificial Sequence: Synthetic oligonucleotide
cgaccttgcagcggcgagtggag

SEQ ID NO: 58354 - DNA, 23 bp, Artificial Sequence
  Description of Artificial Sequence: Synthetic oligonucleotide
gaccttgcagcggcgagtggagc

SEQ ID NO: 58355 - DNA, 23 bp, Artificial Sequence
  Description of Artificial Sequence: Synthetic oligonucleotide
accttgcagcggcgagtggagcc

SEQ ID NO: 58356 - DNA, 22 bp, Artificial Sequence
  Description of Artificial Sequence: Synthetic oligonucleotide
ccttgcagcggcgagtggagcc

SEQ ID NO: 58357 - DNA, 23 bp, Artificial Sequence
  Description of Artificial Sequence: Synthetic oligonucleotide
cttgcagcggcgagtggagccca

SEQ ID NO: 58358 - DNA, 24 bp, Artificial Sequence
  Description of Artificial Sequence: Synthetic oligonucleotide
ttgcagcggcgagtggagcccaca

SEQ ID NO: 58359 - DNA, 23 bp, Artificial Sequence
  Description of Artificial Sequence: Synthetic oligonucleotide
tgcagcggcgagtggagcccaca

SEQ ID NO: 58360 - DNA, 22 bp, Artificial Sequence
  Description of Artificial Sequence: Synthetic oligonucleotide
gcagcggcgagtggagcccaca

SEQ ID NO: 58361 - DNA, 23 bp, Artificial Sequence
  Description of Artificial Sequence: Synthetic oligonucleotide
cagcggcgagtggagcccacagt

SEQ ID NO: 58362 - DNA, 24 bp, Artificial Sequence
  Description of Artificial Sequence: Synthetic oligonucleotide
agcggcgagtggagcccacagtga

SEQ ID NO: 58363 - DNA, 23 bp, Artificial Sequence
  Description of Artificial Sequence: Synthetic oligonucleotide
gcggcgagtggagcccacagtga

SEQ ID NO: 58364 - DNA, 23 bp, Artificial Sequence
  Description of Artificial Sequence: Synthetic oligonucleotide
cggcgagtggagcccacagtgac

SEQ ID NO: 58365 - DNA, 25 bp, Artificial Sequence
  Description of Artificial Sequence: Synthetic oligonucleotide
ggcgagtggagcccacagtgaccat

SEQ ID NO: 58366 - DNA, 26 bp, Artificial Sequence
  Description of Artificial Sequence: Synthetic oligonucleotide
gcgagtggagcccacagtgaccatct

SEQ ID NO: 58367 - DNA, 26 bp, Artificial Sequence
  Description of Artificial Sequence: Synthetic oligonucleotide
cgagtggagcccacagtgaccatctc

SEQ ID NO: 58368 - DNA, 26 bp, Artificial Sequence
  Description of Artificial Sequence: Synthetic oligonucleotide
gagtggagcccacagtgaccatctcc

SEQ ID NO: 58369 - DNA, 26 bp, Artificial Sequence
  Description of Artificial Sequence: Synthetic oligonucleotide
agtggagcccacagtgaccatctccc

SEQ ID NO: 58370 - DNA, 25 bp, Artificial Sequence
  Description of Artificial Sequence: Synthetic oligonucleotide
gtggagcccacagtgaccatctccc

SEQ ID NO: 58371 - DNA, 27 bp, Artificial Sequence
  Description of Artificial Sequence: Synthetic oligonucleotide
tggagcccacagtgaccatctccccat

SEQ ID NO: 58372 - DNA, 26 bp, Artificial Sequence
  Description of Artificial Sequence: Synthetic oligonucleotide
ggagcccacagtgaccatctccccat

SEQ ID NO: 58373 - DNA, 26 bp, Artificial Sequence
  Description of Artificial Sequence: Synthetic oligonucleotide
gagcccacagtgaccatctccccatc

SEQ ID NO: 58374 - DNA, 27 bp, Artificial Sequence
  Description of Artificial Sequence: Synthetic oligonucleotide
agcccacagtgaccatctccccatcca

SEQ ID NO: 58375 - DNA, 26 bp, Artificial Sequence
  Description of Artificial Sequence: Synthetic oligonucleotide
gcccacagtgaccatctccccatcca

SEQ ID NO: 58376 - DNA, 26 bp, Artificial Sequence
  Description of Artificial Sequence: Synthetic oligonucleotide
cccacagtgaccatctccccatccag

SEQ ID NO: 58377 - DNA, 27 bp, Artificial Sequence
  Description of Artificial Sequence: Synthetic oligonucleotide
ccacagtgaccatctccccatccagga

SEQ ID NO: 58378 - DNA, 27 bp, Artificial Sequence
  Description of Artificial Sequence: Synthetic oligonucleotide
cacagtgaccatctccccatccaggac

SEQ ID NO: 58379 - DNA, 28 bp, Artificial Sequence
  Description of Artificial Sequence: Synthetic oligonucleotide
acagtgaccatctccccatccaggacag

SEQ ID NO: 58380 - DNA, 27 bp, Artificial Sequence
  Description of Artificial Sequence: Synthetic oligonucleotide
cagtgaccatctccccatccaggacag

SEQ ID NO: 58381 - DNA, 28 bp, Artificial Sequence
  Description of Artificial Sequence: Synthetic oligonucleotide
agtgaccatctccccatccaggacagag

SEQ ID NO: 58382 - DNA, 27 bp, Artificial Sequence
  Description of Artificial Sequence: Synthetic oligonucleotide
gtgaccatctccccatccaggacagag

SEQ ID NO: 58383 - DNA, 27 bp, Artificial Sequence
  Description of Artificial Sequence: Synthetic oligonucleotide
tgaccatctccccatccaggacagagg

SEQ ID NO: 58384 - DNA, 26 bp, Artificial Sequence
  Description of Artificial Sequence: Synthetic oligonucleotide
gaccatctccccatccaggacagagg

SEQ ID NO: 58385 - DNA, 26 bp, Artificial Sequence
  Description of Artificial Sequence: Synthetic oligonucleotide
accatctccccatccaggacagaggc

SEQ ID NO: 58386 - DNA, 25 bp, Artificial Sequence
  Description of Artificial Sequence: Synthetic oligonucleotide
ccatctccccatccaggacagaggc

SEQ ID NO: 58387 - DNA, 25 bp, Artificial Sequence
  Description of Artificial Sequence: Synthetic oligonucleotide
catctccccatccaggacagaggcc

SEQ ID NO: 58388 - DNA, 26 bp, Artificial Sequence
  Description of Artificial Sequence: Synthetic oligonucleotide
atctccccatccaggacagaggccct

SEQ ID NO: 58389 - DNA, 25 bp, Artificial Sequence
  Description of Artificial Sequence: Synthetic oligonucleotide
tctccccatccaggacagaggccct

SEQ ID NO: 58390 - DNA, 24 bp, Artificial Sequence
  Description of Artificial Sequence: Synthetic oligonucleotide
ctccccatccaggacagaggccct

SEQ ID NO: 58391 - DNA, 26 bp, Artificial Sequence
  Description of Artificial Sequence: Synthetic oligonucleotide
tccccatccaggacagaggccctcaa

SEQ ID NO: 58392 - DNA, 25 bp, Artificial Sequence
  Description of Artificial Sequence: Synthetic oligonucleotide
ccccatccaggacagaggccctcaa

SEQ ID NO: 58393 - DNA, 25 bp, Artificial Sequence
  Description of Artificial Sequence: Synthetic oligonucleotide
cccatccaggacagaggccctcaac

SEQ ID NO: 58394 - DNA, 26 bp, Artificial Sequence
  Description of Artificial Sequence: Synthetic oligonucleotide
ccatccaggacagaggccctcaacca

SEQ ID NO: 58395 - DNA, 26 bp, Artificial Sequence
  Description of Artificial Sequence: Synthetic oligonucleotide
catccaggacagaggccctcaaccac

SEQ ID NO: 58396 - DNA, 27 bp, Artificial Sequence
  Description of Artificial Sequence: Synthetic oligonucleotide
atccaggacagaggccctcaaccacca

SEQ ID NO: 58397 - DNA, 26 bp, Artificial Sequence
  Description of Artificial Sequence: Synthetic oligonucleotide
tccaggacagaggccctcaaccacca

SEQ ID NO: 58398 - DNA, 25 bp, Artificial Sequence
  Description of Artificial Sequence: Synthetic oligonucleotide
ccaggacagaggccctcaaccacca

SEQ ID NO: 58399 - DNA, 27 bp, Artificial Sequence
  Description of Artificial Sequence: Synthetic oligonucleotide
caggacagaggccctcaaccaccacaa

SEQ ID NO: 58400 - DNA, 27 bp, Artificial Sequence
  Description of Artificial Sequence: Synthetic oligonucleotide
aggacagaggccctcaaccaccacaac

SEQ ID NO: 58401 - DNA, 26 bp, Artificial Sequence
  Description of Artificial Sequence: Synthetic oligonucleotide
ggacagaggccctcaaccaccacaac

SEQ ID NO: 58402 - DNA, 27 bp, Artificial Sequence
  Description of Artificial Sequence: Synthetic oligonucleotide
gacagaggccctcaaccaccacaacct

SEQ ID NO: 58403 - DNA, 27 bp, Artificial Sequence
  Description of Artificial Sequence: Synthetic oligonucleotide
acagaggccctcaaccaccacaacctg

SEQ ID NO: 58404 - DNA, 26 bp, Artificial Sequence
  Description of Artificial Sequence: Synthetic oligonucleotide
cagaggccctcaaccaccacaacctg

SEQ ID NO: 58405 - DNA, 27 bp, Artificial Sequence
  Description of Artificial Sequence: Synthetic oligonucleotide
agaggccctcaaccaccacaacctgct

SEQ ID NO: 58406 - DNA, 26 bp, Artificial Sequence
  Description of Artificial Sequence: Synthetic oligonucleotide
gaggccctcaaccaccacaacctgct

SEQ ID NO: 58407 - DNA, 26 bp, Artificial Sequence
  Description of Artificial Sequence: Synthetic oligonucleotide
aggccctcaaccaccacaacctgctg

SEQ ID NO: 58408 - DNA, 25 bp, Artificial Sequence
  Description of Artificial Sequence: Synthetic oligonucleotide
ggccctcaaccaccacaacctgctg

SEQ ID NO: 58409 - DNA, 26 bp, Artificial Sequence
  Description of Artificial Sequence: Synthetic oligonucleotide
gccctcaaccaccacaacctgctggt

SEQ ID NO: 58410 - DNA, 27 bp, Artificial Sequence
  Description of Artificial Sequence: Synthetic oligonucleotide
ccctcaaccaccacaacctgctggtct

SEQ ID NO: 58411 - DNA, 27 bp, Artificial Sequence
  Description of Artificial Sequence: Synthetic oligonucleotide
cctcaaccaccacaacctgctggtctg

SEQ ID NO: 58412 - DNA, 27 bp, Artificial Sequence
  Description of Artificial Sequence: Synthetic oligonucleotide
ctcaaccaccacaacctgctggtctgc

SEQ ID NO: 58413 - DNA, 28 bp, Artificial Sequence
  Description of Artificial Sequence: Synthetic oligonucleotide
tcaaccaccacaacctgctggtctgctc

SEQ ID NO: 58414 - DNA, 27 bp, Artificial Sequence
  Description of Artificial Sequence: Synthetic oligonucleotide
caaccaccacaacctgctggtctgctc

SEQ ID NO: 58415 - DNA, 27 bp, Artificial Sequence
  Description of Artificial Sequence: Synthetic oligonucleotide
aaccaccacaacctgctggtctgctcg

SEQ ID NO: 58416 - DNA, 26 bp, Artificial Sequence
  Description of Artificial Sequence: Synthetic oligonucleotide
accaccacaacctgctggtctgctcg

SEQ ID NO: 58417 - DNA, 25 bp, Artificial Sequence
  Description of Artificial Sequence: Synthetic oligonucleotide
ccaccacaacctgctggtctgctcg

SEQ ID NO: 58418 - DNA, 26 bp, Artificial Sequence
  Description of Artificial Sequence: Synthetic oligonucleotide
caccacaacctgctggtctgctcggt

SEQ ID NO: 58419 - DNA, 27 bp, Artificial Sequence
  Description of Artificial Sequence: Synthetic oligonucleotide
accacaacctgctggtctgctcggtga

SEQ ID NO: 58420 - DNA, 26 bp, Artificial Sequence
  Description of Artificial Sequence: Synthetic oligonucleotide
ccacaacctgctggtctgctcggtga

SEQ ID NO: 58421 - DNA, 27 bp, Artificial Sequence
  Description of Artificial Sequence: Synthetic oligonucleotide
cacaacctgctggtctgctcggtgaca

SEQ ID NO: 58422 - DNA, 27 bp, Artificial Sequence
  Description of Artificial Sequence: Synthetic oligonucleotide
acaacctgctggtctgctcggtgacag

SEQ ID NO: 58423 - DNA, 27 bp, Artificial Sequence
  Description of Artificial Sequence: Synthetic oligonucleotide
caacctgctggtctgctcggtgacaga

SEQ ID NO: 58424 - DNA, 30 bp, Artificial Sequence
  Description of Artificial Sequence: Synthetic oligonucleotide
aacctgctggtctgctcggtgacagatttc

SEQ ID NO: 58425 - DNA, 29 bp, Artificial Sequence
  Description of Artificial Sequence: Synthetic oligonucleotide
acctgctggtctgctcggtgacagatttc

SEQ ID NO: 58426 - DNA, 28 bp, Artificial Sequence
  Description of Artificial Sequence: Synthetic oligonucleotide
cctgctggtctgctcggtgacagatttc

SEQ ID NO: 58427 - DNA, 31 bp, Artificial Sequence
  Description of Artificial Sequence: Synthetic oligonucleotide
ctgctggtctgctcggtgacagatttctatc

SEQ ID NO: 58428 - DNA, 31 bp, Artificial Sequence
  Description of Artificial Sequence: Synthetic oligonucleotide
tgctggtctgctcggtgacagatttctatcc

SEQ ID NO: 58429 - DNA, 30 bp, Artificial Sequence
  Description of Artificial Sequence: Synthetic oligonucleotide
gctggtctgctcggtgacagatttctatcc

SEQ ID NO: 58430 - DNA, 31 bp, Artificial Sequence
  Description of Artificial Sequence: Synthetic oligonucleotide
ctggtctgctcggtgacagatttctatccag

SEQ ID NO: 58431 - DNA, 31 bp, Artificial Sequence
  Description of Artificial Sequence: Synthetic oligonucleotide
tggtctgctcggtgacagatttctatccagc

SEQ ID NO: 58432 - DNA, 30 bp, Artificial Sequence
  Description of Artificial Sequence: Synthetic oligonucleotide
ggtctgctcggtgacagatttctatccagc

SEQ ID NO: 58433 - DNA, 30 bp, Artificial Sequence
  Description of Artificial Sequence: Synthetic oligonucleotide
gtctgctcggtgacagatttctatccagcc

SEQ ID NO: 58434 - DNA, 30 bp, Artificial Sequence
  Description of Artificial Sequence: Synthetic oligonucleotide
tctgctcggtgacagatttctatccagccc

SEQ ID NO: 58435 - DNA, 29 bp, Artificial Sequence
  Description of Artificial Sequence: Synthetic oligonucleotide
ctgctcggtgacagatttctatccagccc

SEQ ID NO: 58436 - DNA, 30 bp, Artificial Sequence
  Description of Artificial Sequence: Synthetic oligonucleotide
tgctcggtgacagatttctatccagcccag

SEQ ID NO: 58437 - DNA, 29 bp, Artificial Sequence
  Description of Artificial Sequence: Synthetic oligonucleotide
gctcggtgacagatttctatccagcccag

SEQ ID NO: 58438 - DNA, 31 bp, Artificial Sequence
  Description of Artificial Sequence: Synthetic oligonucleotide
ctcggtgacagatttctatccagcccagatc

SEQ ID NO: 58439 - DNA, 34 bp, Artificial Sequence
  Description of Artificial Sequence: Synthetic oligonucleotide
tcggtgacagatttctatccagcccagatcaaag

SEQ ID NO: 58440 - DNA, 33 bp, Artificial Sequence
  Description of Artificial Sequence: Synthetic oligonucleotide
cggtgacagatttctatccagcccagatcaaag

SEQ ID NO: 58441 - DNA, 34 bp, Artificial Sequence
  Description of Artificial Sequence: Synthetic oligonucleotide
ggtgacagatttctatccagcccagatcaaagtc

SEQ ID NO: 58442 - DNA, 34 bp, Artificial Sequence
  Description of Artificial Sequence: Synthetic oligonucleotide
gtgacagatttctatccagcccagatcaaagtcc

SEQ ID NO: 58443 - DNA, 34 bp, Artificial Sequence
  Description of Artificial Sequence: Synthetic oligonucleotide
tgacagatttctatccagcccagatcaaagtccg

SEQ ID NO: 58444 - DNA, 33 bp, Artificial Sequence
  Description of Artificial Sequence: Synthetic oligonucleotide
gacagatttctatccagcccagatcaaagtccg

SEQ ID NO: 58445 - DNA, 33 bp, Artificial Sequence
  Description of Artificial Sequence: Synthetic oligonucleotide
acagatttctatccagcccagatcaaagtccgg

SEQ ID NO: 58446 - DNA, 32 bp, Artificial Sequence
  Description of Artificial Sequence: Synthetic oligonucleotide
cagatttctatccagcccagatcaaagtccgg

SEQ ID NO: 58447 - DNA, 33 bp, Artificial Sequence
  Description of Artificial Sequence: Synthetic oligonucleotide
agatttctatccagcccagatcaaagtccggtg

SEQ ID NO: 58448 - DNA, 32 bp, Artificial Sequence
  Description of Artificial Sequence: Synthetic oligonucleotide
gatttctatccagcccagatcaaagtccggtg

SEQ ID NO: 58449 - DNA, 32 bp, Artificial Sequence
  Description of Artificial Sequence: Synthetic oligonucleotide
atttctatccagcccagatcaaagtccggtgg

SEQ ID NO: 58450 - DNA, 31 bp, Artificial Sequence
  Description of Artificial Sequence: Synthetic oligonucleotide
tttctatccagcccagatcaaagtccggtgg

SEQ ID NO: 58451 - DNA, 30 bp, Artificial Sequence
  Description of Artificial Sequence: Synthetic oligonucleotide
ttctatccagcccagatcaaagtccggtgg

SEQ ID NO: 58452 - DNA, 29 bp, Artificial Sequence
  Description of Artificial Sequence: Synthetic oligonucleotide
tctatccagcccagatcaaagtccggtgg

SEQ ID NO: 58453 - DNA, 28 bp, Artificial Sequence
  Description of Artificial Sequence: Synthetic oligonucleotide
ctatccagcccagatcaaagtccggtgg

SEQ ID NO: 58454 - DNA, 31 bp, Artificial Sequence
  Description of Artificial Sequence: Synthetic oligonucleotide
tatccagcccagatcaaagtccggtggtttc

SEQ ID NO: 58455 - DNA, 30 bp, Artificial Sequence
  Description of Artificial Sequence: Synthetic oligonucleotide
atccagcccagatcaaagtccggtggtttc

SEQ ID NO: 58456 - DNA, 29 bp, Artificial Sequence
  Description of Artificial Sequence: Synthetic oligonucleotide
tccagcccagatcaaagtccggtggtttc

SEQ ID NO: 58457 - DNA, 28 bp, Artificial Sequence
  Description of Artificial Sequence: Synthetic oligonucleotide
ccagcccagatcaaagtccggtggtttc

SEQ ID NO: 58458 - DNA, 28 bp, Artificial Sequence
  Description of Artificial Sequence: Synthetic oligonucleotide
cagcccagatcaaagtccggtggtttcg

SEQ ID NO: 58459 - DNA, 28 bp, Artificial Sequence
  Description of Artificial Sequence: Synthetic oligonucleotide
agcccagatcaaagtccggtggtttcgg

SEQ ID NO: 58460 - DNA, 27 bp, Artificial Sequence
  Description of Artificial Sequence: Synthetic oligonucleotide
gcccagatcaaagtccggtggtttcgg

SEQ ID NO: 58461 - DNA, 30 bp, Artificial Sequence
  Description of Artificial Sequence: Synthetic oligonucleotide
cccagatcaaagtccggtggtttcggaatg

SEQ ID NO: 58462 - DNA, 31 bp, Artificial Sequence
  Description of Artificial Sequence: Synthetic oligonucleotide
ccagatcaaagtccggtggtttcggaatgac

SEQ ID NO: 58463 - DNA, 31 bp, Artificial Sequence
  Description of Artificial Sequence: Synthetic oligonucleotide
cagatcaaagtccggtggtttcggaatgacc

SEQ ID NO: 58464 - DNA, 32 bp, Artificial Sequence
  Description of Artificial Sequence: Synthetic oligonucleotide
agatcaaagtccggtggtttcggaatgaccag

SEQ ID NO: 58465 - DNA, 31 bp, Artificial Sequence
  Description of Artificial Sequence: Synthetic oligonucleotide
gatcaaagtccggtggtttcggaatgaccag

SEQ ID NO: 58466 - DNA, 31 bp, Artificial Sequence
  Description of Artificial Sequence: Synthetic oligonucleotide
atcaaagtccggtggtttcggaatgaccagg

SEQ ID NO: 58467 - DNA, 30 bp, Artificial Sequence
  Description of Artificial Sequence: Synthetic oligonucleotide
tcaaagtccggtggtttcggaatgaccagg

SEQ ID NO: 58468 - DNA, 29 bp, Artificial Sequence
  Description of Artificial Sequence: Synthetic oligonucleotide
caaagtccggtggtttcggaatgaccagg

SEQ ID NO: 58469 - DNA, 30 bp, Artificial Sequence
  Description of Artificial Sequence: Synthetic oligonucleotide
aaagtccggtggtttcggaatgaccaggag

SEQ ID NO: 58470 - DNA, 29 bp, Artificial Sequence
  Description of Artificial Sequence: Synthetic oligonucleotide
aagtccggtggtttcggaatgaccaggag

SEQ ID NO: 58471 - DNA, 28 bp, Artificial Sequence
  Description of Artificial Sequence: Synthetic oligonucleotide
agtccggtggtttcggaatgaccaggag

SEQ ID NO: 58472 - DNA, 27 bp, Artificial Sequence
  Description of Artificial Sequence: Synthetic oligonucleotide
gtccggtggtttcggaatgaccaggag

SEQ ID NO: 58473 - DNA, 27 bp, Artificial Sequence
  Description of Artificial Sequence: Synthetic oligonucleotide
tccggtggtttcggaatgaccaggagg

SEQ ID NO: 58474 - DNA, 27 bp, Artificial Sequence
  Description of Artificial Sequence: Synthetic oligonucleotide
ccggtggtttcggaatgaccaggagga

SEQ ID NO: 58475 - DNA, 27 bp, Artificial Sequence
  Description of Artificial Sequence: Synthetic oligonucleotide
cggtggtttcggaatgaccaggaggag

SEQ ID NO: 58476 - DNA, 28 bp, Artificial Sequence
  Description of Artificial Sequence: Synthetic oligonucleotide
ggtggtttcggaatgaccaggaggagac

SEQ ID NO: 58477 - DNA, 29 bp, Artificial Sequence
  Description of Artificial Sequence: Synthetic oligonucleotide
gtggtttcggaatgaccaggaggagacag

SEQ ID NO: 58478 - DNA, 29 bp, Artificial Sequence
  Description of Artificial Sequence: Synthetic oligonucleotide
tggtttcggaatgaccaggaggagacagc

SEQ ID NO: 58479 - DNA, 28 bp, Artificial Sequence
  Description of Artificial Sequence: Synthetic oligonucleotide
ggtttcggaatgaccaggaggagacagc

SEQ ID NO: 58480 - DNA, 29 bp, Artificial Sequence
  Description of Artificial Sequence: Synthetic oligonucleotide
gtttcggaatgaccaggaggagacagctg

SEQ ID NO: 58481 - DNA, 29 bp, Artificial Sequence
  Description of Artificial Sequence: Synthetic oligonucleotide
tttcggaatgaccaggaggagacagctgg

SEQ ID NO: 58482 - DNA, 28 bp, Artificial Sequence
  Description of Artificial Sequence: Synthetic oligonucleotide
ttcggaatgaccaggaggagacagctgg

SEQ ID NO: 58483 - DNA, 27 bp, Artificial Sequence
  Description of Artificial Sequence: Synthetic oligonucleotide
tcggaatgaccaggaggagacagctgg

SEQ ID NO: 58484 - DNA, 26 bp, Artificial Sequence
  Description of Artificial Sequence: Synthetic oligonucleotide
cggaatgaccaggaggagacagctgg

SEQ ID NO: 58485 - DNA, 26 bp, Artificial Sequence
  Description of Artificial Sequence: Synthetic oligonucleotide
ggaatgaccaggaggagacagctggc

SEQ ID NO: 58486 - DNA, 27 bp, Artificial Sequence
  Description of Artificial Sequence: Synthetic oligonucleotide
gaatgaccaggaggagacagctggcgt

SEQ ID NO: 58487 - DNA, 28 bp, Artificial Sequence
  Description of Artificial Sequence: Synthetic oligonucleotide
aatgaccaggaggagacagctggcgttg

SEQ ID NO: 58488 - DNA, 27 bp, Artificial Sequence
  Description of Artificial Sequence: Synthetic oligonucleotide
atgaccaggaggagacagctggcgttg

SEQ ID NO: 58489 - DNA, 27 bp, Artificial Sequence
  Description of Artificial Sequence: Synthetic oligonucleotide
tgaccaggaggagacagctggcgttgt

SEQ ID NO: 58490 - DNA, 26 bp, Artificial Sequence
  Description of Artificial Sequence: Synthetic oligonucleotide
gaccaggaggagacagctggcgttgt

SEQ ID NO: 58491 - DNA, 27 bp, Artificial Sequence
  Description of Artificial Sequence: Synthetic oligonucleotide
accaggaggagacagctggcgttgtgt

SEQ ID NO: 58492 - DNA, 26 bp, Artificial Sequence
  Description of Artificial Sequence: Synthetic oligonucleotide
ccaggaggagacagctggcgttgtgt

SEQ ID NO: 58493 - DNA, 26 bp, Artificial Sequence
  Description of Artificial Sequence: Synthetic oligonucleotide
caggaggagacagctggcgttgtgtc

SEQ ID NO: 58494 - DNA, 27 bp, Artificial Sequence
  Description of Artificial Sequence: Synthetic oligonucleotide
aggaggagacagctggcgttgtgtcca

SEQ ID NO: 58495 - DNA, 26 bp, Artificial Sequence
  Description of Artificial Sequence: Synthetic oligonucleotide
ggaggagacagctggcgttgtgtcca

SEQ ID NO: 58496 - DNA, 26 bp, Artificial Sequence
  Description of Artificial Sequence: Synthetic oligonucleotide
gaggagacagctggcgttgtgtccac

SEQ ID NO: 58497 - DNA, 26 bp, Artificial Sequence
  Description of Artificial Sequence: Synthetic oligonucleotide
aggagacagctggcgttgtgtccacc

SEQ ID NO: 58498 - DNA, 25 bp, Artificial Sequence
  Description of Artificial Sequence: Synthetic oligonucleotide
ggagacagctggcgttgtgtccacc

SEQ ID NO: 58499 - DNA, 25 bp, Artificial Sequence
  Description of Artificial Sequence: Synthetic oligonucleotide
gagacagctggcgttgtgtccaccc

SEQ ID NO: 58500 - DNA, 25 bp, Artificial Sequence
  Description of Artificial Sequence: Synthetic oligonucleotide
agacagctggcgttgtgtccacccc

SEQ ID NO: 58501 - DNA, 24 bp, Artificial Sequence
  Description of Artificial Sequence: Synthetic oligonucleotide
gacagctggcgttgtgtccacccc

SEQ ID NO: 58502 - DNA, 24 bp, Artificial Sequence
  Description of Artificial Sequence: Synthetic oligonucleotide
acagctggcgttgtgtccaccccc

SEQ ID NO: 58503 - DNA, 23 bp, Artificial Sequence
  Description of Artificial Sequence: Synthetic oligonucleotide
cagctggcgttgtgtccaccccc

SEQ ID NO: 58504 - DNA, 27 bp, Artificial Sequence
  Description of Artificial Sequence: Synthetic oligonucleotide
agctggcgttgtgtccaccccccttat

SEQ ID NO: 58505 - DNA, 27 bp, Artificial Sequence
  Description of Artificial Sequence: Synthetic oligonucleotide
gctggcgttgtgtccaccccccttatt

SEQ ID NO: 58506 - DNA, 28 bp, Artificial Sequence
  Description of Artificial Sequence: Synthetic oligonucleotide
ctggcgttgtgtccaccccccttattag

SEQ ID NO: 58507 - DNA, 28 bp, Artificial Sequence
  Description of Artificial Sequence: Synthetic oligonucleotide
tggcgttgtgtccaccccccttattagg

SEQ ID NO: 58508 - DNA, 27 bp, Artificial Sequence
  Description of Artificial Sequence: Synthetic oligonucleotide
ggcgttgtgtccaccccccttattagg

SEQ ID NO: 58509 - DNA, 30 bp, Artificial Sequence
  Description of Artificial Sequence: Synthetic oligonucleotide
gcgttgtgtccaccccccttattaggaatg

SEQ ID NO: 58510 - DNA, 30 bp, Artificial Sequence
  Description of Artificial Sequence: Synthetic oligonucleotide
cgttgtgtccaccccccttattaggaatgg

SEQ ID NO: 58511 - DNA, 31 bp, Artificial Sequence
  Description of Artificial Sequence: Synthetic oligonucleotide
gttgtgtccaccccccttattaggaatggtg

SEQ ID NO: 58512 - DNA, 32 bp, Artificial Sequence
  Description of Artificial Sequence: Synthetic oligonucleotide
ttgtgtccaccccccttattaggaatggtgac

SEQ ID NO: 58513 - DNA, 31 bp, Artificial Sequence
  Description of Artificial Sequence: Synthetic oligonucleotide
tgtgtccaccccccttattaggaatggtgac

SEQ ID NO: 58514 - DNA, 30 bp, Artificial Sequence
  Description of Artificial Sequence: Synthetic oligonucleotide
gtgtccaccccccttattaggaatggtgac

SEQ ID NO: 58515 - DNA, 31 bp, Artificial Sequence
  Description of Artificial Sequence: Synthetic oligonucleotide
tgtccaccccccttattaggaatggtgactg

SEQ ID NO: 58516 - DNA, 30 bp, Artificial Sequence
  Description of Artificial Sequence: Synthetic oligonucleotide
gtccaccccccttattaggaatggtgactg

SEQ ID NO: 58517 - DNA, 30 bp, Artificial Sequence
  Description of Artificial Sequence: Synthetic oligonucleotide
tccaccccccttattaggaatggtgactgg

SEQ ID NO: 58518 - DNA, 29 bp, Artificial Sequence
  Description of Artificial Sequence: Synthetic oligonucleotide
ccaccccccttattaggaatggtgactgg

SEQ ID NO: 58519 - DNA, 30 bp, Artificial Sequence
  Description of Artificial Sequence: Synthetic oligonucleotide
caccccccttattaggaatggtgactggac

SEQ ID NO: 58520 - DNA, 30 bp, Artificial Sequence
  Description of Artificial Sequence: Synthetic oligonucleotide
accccccttattaggaatggtgactggacc

SEQ ID NO: 58521 - DNA, 29 bp, Artificial Sequence
  Description of Artificial Sequence: Synthetic oligonucleotide
ccccccttattaggaatggtgactggacc

SEQ ID NO: 58522 - DNA, 31 bp, Artificial Sequence
  Description of Artificial Sequence: Synthetic oligonucleotide
cccccttattaggaatggtgactggaccttc

SEQ ID NO: 58523 - DNA, 31 bp, Artificial Sequence
  Description of Artificial Sequence: Synthetic oligonucleotide
ccccttattaggaatggtgactggaccttcc

SEQ ID NO: 58524 - DNA, 32 bp, Artificial Sequence
  Description of Artificial Sequence: Synthetic oligonucleotide
cccttattaggaatggtgactggaccttccag

SEQ ID NO: 58525 - DNA, 34 bp, Artificial Sequence
  Description of Artificial Sequence: Synthetic oligonucleotide
ccttattaggaatggtgactggaccttccagatc

SEQ ID NO: 58526 - DNA, 34 bp, Artificial Sequence
  Description of Artificial Sequence: Synthetic oligonucleotide
cttattaggaatggtgactggaccttccagatcc

SEQ ID NO: 58527 - DNA, 35 bp, Artificial Sequence
  Description of Artificial Sequence: Synthetic oligonucleotide
ttattaggaatggtgactggaccttccagatcctg

SEQ ID NO: 58528 - DNA, 34 bp, Artificial Sequence
  Description of Artificial Sequence: Synthetic oligonucleotide
tattaggaatggtgactggaccttccagatcctg

SEQ ID NO: 58529 - DNA, 33 bp, Artificial Sequence
  Description of Artificial Sequence: Synthetic oligonucleotide
attaggaatggtgactggaccttccagatcctg

SEQ ID NO: 58530 - DNA, 32 bp, Artificial Sequence
  Description of Artificial Sequence: Synthetic oligonucleotide
ttaggaatggtgactggaccttccagatcctg

SEQ ID NO: 58531 - DNA, 31 bp, Artificial Sequence
  Description of Artificial Sequence: Synthetic oligonucleotide
taggaatggtgactggaccttccagatcctg

SEQ ID NO: 58532 - DNA, 30 bp, Artificial Sequence
  Description of Artificial Sequence: Synthetic oligonucleotide
aggaatggtgactggaccttccagatcctg

SEQ ID NO: 58533 - DNA, 29 bp, Artificial Sequence
  Description of Artificial Sequence: Synthetic oligonucleotide
ggaatggtgactggaccttccagatcctg

SEQ ID NO: 58534 - DNA, 29 bp, Artificial Sequence
  Description of Artificial Sequence: Synthetic oligonucleotide
gaatggtgactggaccttccagatcctgg

SEQ ID NO: 58535 - DNA, 30 bp, Artificial Sequence
  Description of Artificial Sequence: Synthetic oligonucleotide
aatggtgactggaccttccagatcctggtg

SEQ ID NO: 58536 - DNA, 29 bp, Artificial Sequence
  Description of Artificial Sequence: Synthetic oligonucleotide
atggtgactggaccttccagatcctggtg

SEQ ID NO: 58537 - DNA, 28 bp, Artificial Sequence
  Description of Artificial Sequence: Synthetic oligonucleotide
tggtgactggaccttccagatcctggtg

SEQ ID NO: 58538 - DNA, 27 bp, Artificial Sequence
  Description of Artificial Sequence: Synthetic oligonucleotide
ggtgactggaccttccagatcctggtg

SEQ ID NO: 58539 - DNA, 29 bp, Artificial Sequence
  Description of Artificial Sequence: Synthetic oligonucleotide
gtgactggaccttccagatcctggtgatg

SEQ ID NO: 58540 - DNA, 29 bp, Artificial Sequence
  Description of Artificial Sequence: Synthetic oligonucleotide
tgactggaccttccagatcctggtgatgc

SEQ ID NO: 58541 - DNA, 32 bp, Artificial Sequence
  Description of Artificial Sequence: Synthetic oligonucleotide
cttccagatcctggtgatgctggaaatgactc

SEQ ID NO: 58542 - DNA, 32 bp, Artificial Sequence
  Description of Artificial Sequence: Synthetic oligonucleotide
ttccagatcctggtgatgctggaaatgactcc

SEQ ID NO: 58543 - DNA, 31 bp, Artificial Sequence
  Description of Artificial Sequence: Synthetic oligonucleotide
tccagatcctggtgatgctggaaatgactcc

SEQ ID NO: 58544 - DNA, 30 bp, Artificial Sequence
  Description of Artificial Sequence: Synthetic oligonucleotide
ccagatcctggtgatgctggaaatgactcc

SEQ ID NO: 58545 - DNA, 30 bp, Artificial Sequence
  Description of Artificial Sequence: Synthetic oligonucleotide
cagatcctggtgatgctggaaatgactccc

SEQ ID NO: 58546 - DNA, 30 bp, Artificial Sequence
  Description of Artificial Sequence: Synthetic oligonucleotide
agatcctggtgatgctggaaatgactcccc

SEQ ID NO: 58547 - DNA, 29 bp, Artificial Sequence
  Description of Artificial Sequence: Synthetic oligonucleotide
gatcctggtgatgctggaaatgactcccc

SEQ ID NO: 58548 - DNA, 30 bp, Artificial Sequence
  Description of Artificial Sequence: Synthetic oligonucleotide
atcctggtgatgctggaaatgactccccag

SEQ ID NO: 58549 - DNA, 29 bp, Artificial Sequence
  Description of Artificial Sequence: Synthetic oligonucleotide
tcctggtgatgctggaaatgactccccag

SEQ ID NO: 58550 - DNA, 28 bp, Artificial Sequence
  Description of Artificial Sequence: Synthetic oligonucleotide
cctggtgatgctggaaatgactccccag

SEQ ID NO: 58551 - DNA, 28 bp, Artificial Sequence
  Description of Artificial Sequence: Synthetic oligonucleotide
ctggtgatgctggaaatgactccccagc

SEQ ID NO: 58552 - DNA, 28 bp, Artificial Sequence
  Description of Artificial Sequence: Synthetic oligonucleotide
tggtgatgctggaaatgactccccagcg

SEQ ID NO: 58553 - DNA, 27 bp, Artificial Sequence
  Description of Artificial Sequence: Synthetic oligonucleotide
ggtgatgctggaaatgactccccagcg

SEQ ID NO: 58554 - DNA, 28 bp, Artificial Sequence
  Description of Artificial Sequence: Synthetic oligonucleotide
gtgatgctggaaatgactccccagcgtg

SEQ ID NO: 58555 - DNA, 28 bp, Artificial Sequence
  Description of Artificial Sequence: Synthetic oligonucleotide
tgatgctggaaatgactccccagcgtgg

SEQ ID NO: 58556 - DNA, 27 bp, Artificial Sequence
  Description of Artificial Sequence: Synthetic oligonucleotide
gatgctggaaatgactccccagcgtgg

SEQ ID NO: 58557 - DNA, 28 bp, Artificial Sequence
  Description of Artificial Sequence: Synthetic oligonucleotide
atgctggaaatgactccccagcgtggag

SEQ ID NO: 58558 - DNA, 27 bp, Artificial Sequence
  Description of Artificial Sequence: Synthetic oligonucleotide
tgctggaaatgactccccagcgtggag

SEQ ID NO: 58559 - DNA, 27 bp, Artificial Sequence
  Description of Artificial Sequence: Synthetic oligonucleotide
gctggaaatgactccccagcgtggaga

SEQ ID NO: 58560 - DNA, 27 bp, Artificial Sequence
  Description of Artificial Sequence: Synthetic oligonucleotide
ctggaaatgactccccagcgtggagac

SEQ ID NO: 58561 - DNA, 27 bp, Artificial Sequence
  Description of Artificial Sequence: Synthetic oligonucleotide
tggaaatgactccccagcgtggagacg

SEQ ID NO: 58562 - DNA, 27 bp, Artificial Sequence
  Description of Artificial Sequence: Synthetic oligonucleotide
ggaaatgactccccagcgtggagacgt

SEQ ID NO: 58563 - DNA, 27 bp, Artificial Sequence
  Description of Artificial Sequence: Synthetic oligonucleotide
gaaatgactccccagcgtggagacgtc

SEQ ID NO: 58564 - DNA, 29 bp, Artificial Sequence
  Description of Artificial Sequence: Synthetic oligonucleotide
aaatgactccccagcgtggagacgtctac

SEQ ID NO: 58565 - DNA, 28 bp, Artificial Sequence
  Description of Artificial Sequence: Synthetic oligonucleotide
aatgactccccagcgtggagacgtctac

SEQ ID NO: 58566 - DNA, 27 bp, Artificial Sequence
  Description of Artificial Sequence: Synthetic oligonucleotide
atgactccccagcgtggagacgtctac

SEQ ID NO: 58567 - DNA, 27 bp, Artificial Sequence
  Description of Artificial Sequence: Synthetic oligonucleotide
tgactccccagcgtggagacgtctaca

SEQ ID NO: 58568 - DNA, 26 bp, Artificial Sequence
  Description of Artificial Sequence: Synthetic oligonucleotide
gactccccagcgtggagacgtctaca

SEQ ID NO: 58569 - DNA, 26 bp, Artificial Sequence
  Description of Artificial Sequence: Synthetic oligonucleotide
actccccagcgtggagacgtctacac

SEQ ID NO: 58570 - DNA, 25 bp, Artificial Sequence
  Description of Artificial Sequence: Synthetic oligonucleotide
ctccccagcgtggagacgtctacac

SEQ ID NO: 58571 - DNA, 26 bp, Artificial Sequence
  Description of Artificial Sequence: Synthetic oligonucleotide
tccccagcgtggagacgtctacacct

SEQ ID NO: 58572 - DNA, 25 bp, Artificial Sequence
  Description of Artificial Sequence: Synthetic oligonucleotide
ccccagcgtggagacgtctacacct

SEQ ID NO: 58573 - DNA, 25 bp, Artificial Sequence
  Description of Artificial Sequence: Synthetic oligonucleotide
cccagcgtggagacgtctacacctg

SEQ ID NO: 58574 - DNA, 25 bp, Artificial Sequence
  Description of Artificial Sequence: Synthetic oligonucleotide
ccagcgtggagacgtctacacctgc

SEQ ID NO: 58575 - DNA, 26 bp, Artificial Sequence
  Description of Artificial Sequence: Synthetic oligonucleotide
cagcgtggagacgtctacacctgcca

SEQ ID NO: 58576 - DNA, 26 bp, Artificial Sequence
  Description of Artificial Sequence: Synthetic oligonucleotide
agcgtggagacgtctacacctgccac

SEQ ID NO: 58577 - DNA, 25 bp, Artificial Sequence
  Description of Artificial Sequence: Synthetic oligonucleotide
gcgtggagacgtctacacctgccac

SEQ ID NO: 58578 - DNA, 26 bp, Artificial Sequence
  Description of Artificial Sequence: Synthetic oligonucleotide
cgtggagacgtctacacctgccacgt

SEQ ID NO: 58579 - DNA, 26 bp, Artificial Sequence
  Description of Artificial Sequence: Synthetic oligonucleotide
gtggagacgtctacacctgccacgtg

SEQ ID NO: 58580 - DNA, 27 bp, Artificial Sequence
  Description of Artificial Sequence: Synthetic oligonucleotide
tggagacgtctacacctgccacgtgga

SEQ ID NO: 58581 - DNA, 26 bp, Artificial Sequence
  Description of Artificial Sequence: Synthetic oligonucleotide
ggagacgtctacacctgccacgtgga

SEQ ID NO: 58582 - DNA, 26 bp, Artificial Sequence
  Description of Artificial Sequence: Synthetic oligonucleotide
gagacgtctacacctgccacgtggag

SEQ ID NO: 58583 - DNA, 27 bp, Artificial Sequence
  Description of Artificial Sequence: Synthetic oligonucleotide
agacgtctacacctgccacgtggagca

SEQ ID NO: 58584 - DNA, 26 bp, Artificial Sequence
  Description of Artificial Sequence: Synthetic oligonucleotide
gacgtctacacctgccacgtggagca

SEQ ID NO: 58585 - DNA, 26 bp, Artificial Sequence
  Description of Artificial Sequence: Synthetic oligonucleotide
acgtctacacctgccacgtggagcac

SEQ ID NO: 58586 - DNA, 25 bp, Artificial Sequence
  Description of Artificial Sequence: Synthetic oligonucleotide
cgtctacacctgccacgtggagcac

SEQ ID NO: 58587 - DNA, 25 bp, Artificial Sequence
  Description of Artificial Sequence: Synthetic oligonucleotide
gtctacacctgccacgtggagcacc

SEQ ID NO: 58588 - DNA, 25 bp, Artificial Sequence
  Description of Artificial Sequence: Synthetic oligonucleotide
tctacacctgccacgtggagcaccc

SEQ ID NO: 58589 - DNA, 24 bp, Artificial Sequence
  Description of Artificial Sequence: Synthetic oligonucleotide
ctacacctgccacgtggagcaccc

SEQ ID NO: 58590 - DNA, 25 bp, Artificial Sequence
  Description of Artificial Sequence: Synthetic oligonucleotide
tacacctgccacgtggagcacccca

SEQ ID NO: 58591 - DNA, 24 bp, Artificial Sequence
  Description of Artificial Sequence: Synthetic oligonucleotide
acacctgccacgtggagcacccca

SEQ ID NO: 58592 - DNA, 23 bp, Artificial Sequence
  Description of Artificial Sequence: Synthetic oligonucleotide
cacctgccacgtggagcacccca

SEQ ID NO: 58593 - DNA, 23 bp, Artificial Sequence
  Description of Artificial Sequence: Synthetic oligonucleotide
acctgccacgtggagcaccccag

SEQ ID NO: 58594 - DNA, 22 bp, Artificial Sequence
  Description of Artificial Sequence: Synthetic oligonucleotide
cctgccacgtggagcaccccag

SEQ ID NO: 58595 - DNA, 22 bp, Artificial Sequence
  Description of Artificial Sequence: Synthetic oligonucleotide
ctgccacgtggagcaccccagc

SEQ ID NO: 58596 - DNA, 23 bp, Artificial Sequence
  Description of Artificial Sequence: Synthetic oligonucleotide
tgccacgtggagcaccccagcct

SEQ ID NO: 58597 - DNA, 22 bp, Artificial Sequence
  Description of Artificial Sequence: Synthetic oligonucleotide
gccacgtggagcaccccagcct

SEQ ID NO: 58598 - DNA, 22 bp, Artificial Sequence
  Description of Artificial Sequence: Synthetic oligonucleotide
ccacgtggagcaccccagcctc

SEQ ID NO: 58599 - DNA, 23 bp, Artificial Sequence
  Description of Artificial Sequence: Synthetic oligonucleotide
cacgtggagcaccccagcctcca

SEQ ID NO: 58600 - DNA, 24 bp, Artificial Sequence
  Description of Artificial Sequence: Synthetic oligonucleotide
acgtggagcaccccagcctccaga

SEQ ID NO: 58601 - DNA, 23 bp, Artificial Sequence
  Description of Artificial Sequence: Synthetic oligonucleotide
cgtggagcaccccagcctccaga

SEQ ID NO: 58602 - DNA, 23 bp, Artificial Sequence
  Description of Artificial Sequence: Synthetic oligonucleotide
gtggagcaccccagcctccagag

SEQ ID NO: 58603 - DNA, 23 bp, Artificial Sequence
  Description of Artificial Sequence: Synthetic oligonucleotide
tggagcaccccagcctccagagc

SEQ ID NO: 58604 - DNA, 22 bp, Artificial Sequence
  Description of Artificial Sequence: Synthetic oligonucleotide
ggagcaccccagcctccagagc

SEQ ID NO: 58605 - DNA, 22 bp, Artificial Sequence
  Description of Artificial Sequence: Synthetic oligonucleotide
gagcaccccagcctccagagcc

SEQ ID NO: 58606 - DNA, 22 bp, Artificial Sequence
  Description of Artificial Sequence: Synthetic oligonucleotide
agcaccccagcctccagagccc

SEQ ID NO: 58607 - DNA, 21 bp, Artificial Sequence
  Description of Artificial Sequence: Synthetic oligonucleotide
gcaccccagcctccagagccc

SEQ ID NO: 58608 - DNA, 23 bp, Artificial Sequence
  Description of Artificial Sequence: Synthetic oligonucleotide
caccccagcctccagagccccat

SEQ ID NO: 58609 - DNA, 24 bp, Artificial Sequence
  Description of Artificial Sequence: Synthetic oligonucleotide
accccagcctccagagccccatca

SEQ ID NO: 58610 - DNA, 23 bp, Artificial Sequence
  Description of Artificial Sequence: Synthetic oligonucleotide
ccccagcctccagagccccatca

SEQ ID NO: 58611 - DNA, 23 bp, Artificial Sequence
  Description of Artificial Sequence: Synthetic oligonucleotide
cccagcctccagagccccatcac

SEQ ID NO: 58612 - DNA, 23 bp, Artificial Sequence
  Description of Artificial Sequence: Synthetic oligonucleotide
ccagcctccagagccccatcacc

SEQ ID NO: 58613 - DNA, 24 bp, Artificial Sequence
  Description of Artificial Sequence: Synthetic oligonucleotide
cagcctccagagccccatcaccgt

SEQ ID NO: 58614 - DNA, 24 bp, Artificial Sequence
  Description of Artificial Sequence: Synthetic oligonucleotide
agcctccagagccccatcaccgtg

SEQ ID NO: 58615 - DNA, 23 bp, Artificial Sequence
  Description of Artificial Sequence: Synthetic oligonucleotide
gcctccagagccccatcaccgtg

SEQ ID NO: 58616 - DNA, 24 bp, Artificial Sequence
  Description of Artificial Sequence: Synthetic oligonucleotide
cctccagagccccatcaccgtgga

SEQ ID NO: 58617 - DNA, 25 bp, Artificial Sequence
  Description of Artificial Sequence: Synthetic oligonucleotide
ctccagagccccatcaccgtggagt

SEQ ID NO: 58618 - DNA, 25 bp, Artificial Sequence
  Description of Artificial Sequence: Synthetic oligonucleotide
tccagagccccatcaccgtggagtg

SEQ ID NO: 58619 - DNA, 24 bp, Artificial Sequence
  Description of Artificial Sequence: Synthetic oligonucleotide
ccagagccccatcaccgtggagtg

SEQ ID NO: 58620 - DNA, 24 bp, Artificial Sequence
  Description of Artificial Sequence: Synthetic oligonucleotide
cagagccccatcaccgtggagtgg

SEQ ID NO: 58621 - DNA, 24 bp, Artificial Sequence
  Description of Artificial Sequence: Synthetic oligonucleotide
agagccccatcaccgtggagtggc

SEQ ID NO: 58622 - DNA, 23 bp, Artificial Sequence
  Description of Artificial Sequence: Synthetic oligonucleotide
gagccccatcaccgtggagtggc

SEQ ID NO: 58623 - DNA, 23 bp, Artificial Sequence
  Description of Artificial Sequence: Synthetic oligonucleotide
agccccatcaccgtggagtggcg

SEQ ID NO: 58624 - DNA, 22 bp, Artificial Sequence
  Description of Artificial Sequence: Synthetic oligonucleotide
gccccatcaccgtggagtggcg

SEQ ID NO: 58625 - DNA, 22 bp, Artificial Sequence
  Description of Artificial Sequence: Synthetic oligonucleotide
ccccatcaccgtggagtggcgg

SEQ ID NO: 58626 - DNA, 22 bp, Artificial Sequence
  Description of Artificial Sequence: Synthetic oligonucleotide
cccatcaccgtggagtggcggg

SEQ ID NO: 58627 - DNA, 23 bp, Artificial Sequence
  Description of Artificial Sequence: Synthetic oligonucleotide
ccatcaccgtggagtggcgggct

SEQ ID NO: 58628 - DNA, 26 bp, Artificial Sequence
  Description of Artificial Sequence: Synthetic oligonucleotide
catcaccgtggagtggcgggctcaat

SEQ ID NO: 58629 - DNA, 27 bp, Artificial Sequence
  Description of Artificial Sequence: Synthetic oligonucleotide
atcaccgtggagtggcgggctcaatct

SEQ ID NO: 58630 - DNA, 26 bp, Artificial Sequence
  Description of Artificial Sequence: Synthetic oligonucleotide
tcaccgtggagtggcgggctcaatct

SEQ ID NO: 58631 - DNA, 25 bp, Artificial Sequence
  Description of Artificial Sequence: Synthetic oligonucleotide
caccgtggagtggcgggctcaatct

SEQ ID NO: 58632 - DNA, 27 bp, Artificial Sequence
  Description of Artificial Sequence: Synthetic oligonucleotide
accgtggagtggcgggctcaatctgaa

SEQ ID NO: 58633 - DNA, 27 bp, Artificial Sequence
  Description of Artificial Sequence: Synthetic oligonucleotide
ccgtggagtggcgggctcaatctgaat

SEQ ID NO: 58634 - DNA, 27 bp, Artificial Sequence
  Description of Artificial Sequence: Synthetic oligonucleotide
cgtggagtggcgggctcaatctgaatc

SEQ ID NO: 58635 - DNA, 28 bp, Artificial Sequence
  Description of Artificial Sequence: Synthetic oligonucleotide
gtggagtggcgggctcaatctgaatctg

SEQ ID NO: 58636 - DNA, 28 bp, Artificial Sequence
  Description of Artificial Sequence: Synthetic oligonucleotide
tggagtggcgggctcaatctgaatctgc

SEQ ID NO: 58637 - DNA, 27 bp, Artificial Sequence
  Description of Artificial Sequence: Synthetic oligonucleotide
ggagtggcgggctcaatctgaatctgc

SEQ ID NO: 58638 - DNA, 27 bp, Artificial Sequence
  Description of Artificial Sequence: Synthetic oligonucleotide
gagtggcgggctcaatctgaatctgcc

SEQ ID NO: 58639 - DNA, 27 bp, Artificial Sequence
  Description of Artificial Sequence: Synthetic oligonucleotide
agtggcgggctcaatctgaatctgccc

SEQ ID NO: 58640 - DNA, 27 bp, Artificial Sequence
  Description of Artificial Sequence: Synthetic oligonucleotide
gtggcgggctcaatctgaatctgccca

SEQ ID NO: 58641 - DNA, 27 bp, Artificial Sequence
  Description of Artificial Sequence: Synthetic oligonucleotide
tggcgggctcaatctgaatctgcccag

SEQ ID NO: 58642 - DNA, 27 bp, Artificial Sequence
  Description of Artificial Sequence: Synthetic oligonucleotide
ggcgggctcaatctgaatctgcccaga

SEQ ID NO: 58643 - DNA, 27 bp, Artificial Sequence
  Description of Artificial Sequence: Synthetic oligonucleotide
gcgggctcaatctgaatctgcccagag

SEQ ID NO: 58644 - DNA, 27 bp, Artificial Sequence
  Description of Artificial Sequence: Synthetic oligonucleotide
cgggctcaatctgaatctgcccagagc

SEQ ID NO: 58645 - DNA, 29 bp, Artificial Sequence
  Description of Artificial Sequence: Synthetic oligonucleotide
gggctcaatctgaatctgcccagagcaag

SEQ ID NO: 58646 - DNA, 31 bp, Artificial Sequence
  Description of Artificial Sequence: Synthetic oligonucleotide
ggctcaatctgaatctgcccagagcaagatg

SEQ ID NO: 58647 - DNA, 31 bp, Artificial Sequence
  Description of Artificial Sequence: Synthetic oligonucleotide
gctcaatctgaatctgcccagagcaagatgc

SEQ ID NO: 58648 - DNA, 32 bp, Artificial Sequence
  Description of Artificial Sequence: Synthetic oligonucleotide
ctcaatctgaatctgcccagagcaagatgctg

SEQ ID NO: 58649 - DNA, 33 bp, Artificial Sequence
  Description of Artificial Sequence: Synthetic oligonucleotide
tcaatctgaatctgcccagagcaagatgctgag

SEQ ID NO: 58650 - DNA, 32 bp, Artificial Sequence
  Description of Artificial Sequence: Synthetic oligonucleotide
caatctgaatctgcccagagcaagatgctgag

SEQ ID NO: 58651 - DNA, 33 bp, Artificial Sequence
  Description of Artificial Sequence: Synthetic oligonucleotide
aatctgaatctgcccagagcaagatgctgagtg

SEQ ID NO: 58652 - DNA, 32 bp, Artificial Sequence
  Description of Artificial Sequence: Synthetic oligonucleotide
atctgaatctgcccagagcaagatgctgagtg

SEQ ID NO: 58653 - DNA, 31 bp, Artificial Sequence
  Description of Artificial Sequence: Synthetic oligonucleotide
tctgaatctgcccagagcaagatgctgagtg

SEQ ID NO: 58654 - DNA, 30 bp, Artificial Sequence
  Description of Artificial Sequence: Synthetic oligonucleotide
ctgaatctgcccagagcaagatgctgagtg

SEQ ID NO: 58655 - DNA, 30 bp, Artificial Sequence
  Description of Artificial Sequence: Synthetic oligonucleotide
tgaatctgcccagagcaagatgctgagtgg

SEQ ID NO: 58656 - DNA, 29 bp, Artificial Sequence
  Description of Artificial Sequence: Synthetic oligonucleotide
gaatctgcccagagcaagatgctgagtgg

SEQ ID NO: 58657 - DNA, 29 bp, Artificial Sequence
  Description of Artificial Sequence: Synthetic oligonucleotide
aatctgcccagagcaagatgctgagtggc

SEQ ID NO: 58658 - DNA, 28 bp, Artificial Sequence
  Description of Artificial Sequence: Synthetic oligonucleotide
atctgcccagagcaagatgctgagtggc

SEQ ID NO: 58659 - DNA, 27 bp, Artificial Sequence
  Description of Artificial Sequence: Synthetic oligonucleotide
tctgcccagagcaagatgctgagtggc

SEQ ID NO: 58660 - DNA, 27 bp, Artificial Sequence
  Description of Artificial Sequence: Synthetic oligonucleotide
ctgcccagagcaagatgctgagtggca

SEQ ID NO: 58661 - DNA, 29 bp, Artificial Sequence
  Description of Artificial Sequence: Synthetic oligonucleotide
tgcccagagcaagatgctgagtggcattg

SEQ ID NO: 58662 - DNA, 28 bp, Artificial Sequence
  Description of Artificial Sequence: Synthetic oligonucleotide
gcccagagcaagatgctgagtggcattg

SEQ ID NO: 58663 - DNA, 28 bp, Artificial Sequence
  Description of Artificial Sequence: Synthetic oligonucleotide
cccagagcaagatgctgagtggcattgg

SEQ ID NO: 58664 - DNA, 29 bp, Artificial Sequence
  Description of Artificial Sequence: Synthetic oligonucleotide
ccagagcaagatgctgagtggcattggag

SEQ ID NO: 58665 - DNA, 29 bp, Artificial Sequence
  Description of Artificial Sequence: Synthetic oligonucleotide
cagagcaagatgctgagtggcattggagg

SEQ ID NO: 58666 - DNA, 29 bp, Artificial Sequence
  Description of Artificial Sequence: Synthetic oligonucleotide
agagcaagatgctgagtggcattggaggc

SEQ ID NO: 58667 - DNA, 28 bp, Artificial Sequence
  Description of Artificial Sequence: Synthetic oligonucleotide
gagcaagatgctgagtggcattggaggc

SEQ ID NO: 58668 - DNA, 30 bp, Artificial Sequence
  Description of Artificial Sequence: Synthetic oligonucleotide
agcaagatgctgagtggcattggaggcttc

SEQ ID NO: 58669 - DNA, 29 bp, Artificial Sequence
  Description of Artificial Sequence: Synthetic oligonucleotide
gcaagatgctgagtggcattggaggcttc

SEQ ID NO: 58670 - DNA, 29 bp, Artificial Sequence
  Description of Artificial Sequence: Synthetic oligonucleotide
caagatgctgagtggcattggaggcttcg

SEQ ID NO: 58671 - DNA, 30 bp, Artificial Sequence
  Description of Artificial Sequence: Synthetic oligonucleotide
aagatgctgagtggcattggaggcttcgtg

SEQ ID NO: 58672 - DNA, 29 bp, Artificial Sequence
  Description of Artificial Sequence: Synthetic oligonucleotide
agatgctgagtggcattggaggcttcgtg

SEQ ID NO: 58673 - DNA, 28 bp, Artificial Sequence
  Description of Artificial Sequence: Synthetic oligonucleotide
gatgctgagtggcattggaggcttcgtg

SEQ ID NO: 58674 - DNA, 28 bp, Artificial Sequence
  Description of Artificial Sequence: Synthetic oligonucleotide
atgctgagtggcattggaggcttcgtgc

SEQ ID NO: 58675 - DNA, 27 bp, Artificial Sequence
  Description of Artificial Sequence: Synthetic oligonucleotide
tgctgagtggcattggaggcttcgtgc

SEQ ID NO: 58676 - DNA, 27 bp, Artificial Sequence
  Description of Artificial Sequence: Synthetic oligonucleotide
gctgagtggcattggaggcttcgtgct

SEQ ID NO: 58677 - DNA, 27 bp, Artificial Sequence
  Description of Artificial Sequence: Synthetic oligonucleotide
ctgagtggcattggaggcttcgtgctg

SEQ ID NO: 58678 - DNA, 27 bp, Artificial Sequence
  Description of Artificial Sequence: Synthetic oligonucleotide
tgagtggcattggaggcttcgtgctgg

SEQ ID NO: 58679 - DNA, 26 bp, Artificial Sequence
  Description of Artificial Sequence: Synthetic oligonucleotide
gagtggcattggaggcttcgtgctgg

SEQ ID NO: 58680 - DNA, 26 bp, Artificial Sequence
  Description of Artificial Sequence: Synthetic oligonucleotide
agtggcattggaggcttcgtgctggg

SEQ ID NO: 58681 - DNA, 25 bp, Artificial Sequence
  Description of Artificial Sequence: Synthetic oligonucleotide
gtggcattggaggcttcgtgctggg

SEQ ID NO: 58682 - DNA, 25 bp, Artificial Sequence
  Description of Artificial Sequence: Synthetic oligonucleotide
tggcattggaggcttcgtgctgggg

SEQ ID NO: 58683 - DNA, 24 bp, Artificial Sequence
  Description of Artificial Sequence: Synthetic oligonucleotide
ggcattggaggcttcgtgctgggg

SEQ ID NO: 58684 - DNA, 25 bp, Artificial Sequence
  Description of Artificial Sequence: Synthetic oligonucleotide
gcattggaggcttcgtgctggggct

SEQ ID NO: 58685 - DNA, 27 bp, Artificial Sequence
  Description of Artificial Sequence: Synthetic oligonucleotide
cattggaggcttcgtgctggggctgat

SEQ ID NO: 58686 - DNA, 27 bp, Artificial Sequence
  Description of Artificial Sequence: Synthetic oligonucleotide
attggaggcttcgtgctggggctgatc

SEQ ID NO: 58687 - DNA, 27 bp, Artificial Sequence
  Description of Artificial Sequence: Synthetic oligonucleotide
ttggaggcttcgtgctggggctgatct

SEQ ID NO: 58688 - DNA, 27 bp, Artificial Sequence
  Description of Artificial Sequence: Synthetic oligonucleotide
tggaggcttcgtgctggggctgatctt

SEQ ID NO: 58689 - DNA, 26 bp, Artificial Sequence
  Description of Artificial Sequence: Synthetic oligonucleotide
ggaggcttcgtgctggggctgatctt

SEQ ID NO: 58690 - DNA, 26 bp, Artificial Sequence
  Description of Artificial Sequence: Synthetic oligonucleotide
gaggcttcgtgctggggctgatcttc

SEQ ID NO: 58691 - DNA, 27 bp, Artificial Sequence
  Description of Artificial Sequence: Synthetic oligonucleotide
aggcttcgtgctggggctgatcttcct

SEQ ID NO: 58692 - DNA, 26 bp, Artificial Sequence
  Description of Artificial Sequence: Synthetic oligonucleotide
ggcttcgtgctggggctgatcttcct

SEQ ID NO: 58693 - DNA, 26 bp, Artificial Sequence
  Description of Artificial Sequence: Synthetic oligonucleotide
gcttcgtgctggggctgatcttcctc

SEQ ID NO: 58694 - DNA, 26 bp, Artificial Sequence
  Description of Artificial Sequence: Synthetic oligonucleotide
cttcgtgctggggctgatcttcctcg

SEQ ID NO: 58695 - DNA, 26 bp, Artificial Sequence
  Description of Artificial Sequence: Synthetic oligonucleotide
ttcgtgctggggctgatcttcctcgg

SEQ ID NO: 58696 - DNA, 25 bp, Artificial Sequence
  Description of Artificial Sequence: Synthetic oligonucleotide
tcgtgctggggctgatcttcctcgg

SEQ ID NO: 58697 - DNA, 24 bp, Artificial Sequence
  Description of Artificial Sequence: Synthetic oligonucleotide
cgtgctggggctgatcttcctcgg

SEQ ID NO: 58698 - DNA, 24 bp, Artificial Sequence
  Description of Artificial Sequence: Synthetic oligonucleotide
gtgctggggctgatcttcctcggg

SEQ ID NO: 58699 - DNA, 25 bp, Artificial Sequence
  Description of Artificial Sequence: Synthetic oligonucleotide
tgctggggctgatcttcctcgggct

SEQ ID NO: 58700 - DNA, 24 bp, Artificial Sequence
  Description of Artificial Sequence: Synthetic oligonucleotide
gctggggctgatcttcctcgggct

SEQ ID NO: 58701 - DNA, 24 bp, Artificial Sequence
  Description of Artificial Sequence: Synthetic oligonucleotide
ctggggctgatcttcctcgggctg

SEQ ID NO: 58702 - DNA, 24 bp, Artificial Sequence
  Description of Artificial Sequence: Synthetic oligonucleotide
tggggctgatcttcctcgggctgg

SEQ ID NO: 58703 - DNA, 23 bp, Artificial Sequence
  Description of Artificial Sequence: Synthetic oligonucleotide
ggggctgatcttcctcgggctgg

SEQ ID NO: 58704 - DNA, 23 bp, Artificial Sequence
  Description of Artificial Sequence: Synthetic oligonucleotide
gggctgatcttcctcgggctggg

SEQ ID NO: 58705 - DNA, 23 bp, Artificial Sequence
  Description of Artificial Sequence: Synthetic oligonucleotide
ggctgatcttcctcgggctgggc

SEQ ID NO: 58706 - DNA, 27 bp, Artificial Sequence
  Description of Artificial Sequence: Synthetic oligonucleotide
gctgatcttcctcgggctgggccttat

SEQ ID NO: 58707 - DNA, 27 bp, Artificial Sequence
  Description of Artificial Sequence: Synthetic oligonucleotide
ctgatcttcctcgggctgggccttatc

SEQ ID NO: 58708 - DNA, 29 bp, Artificial Sequence
  Description of Artificial Sequence: Synthetic oligonucleotide
tgatcttcctcgggctgggccttatcatc

SEQ ID NO: 58709 - DNA, 28 bp, Artificial Sequence
  Description of Artificial Sequence: Synthetic oligonucleotide
gatcttcctcgggctgggccttatcatc

SEQ ID NO: 58710 - DNA, 28 bp, Artificial Sequence
  Description of Artificial Sequence: Synthetic oligonucleotide
atcttcctcgggctgggccttatcatcc

SEQ ID NO: 58711 - DNA, 27 bp, Artificial Sequence
  Description of Artificial Sequence: Synthetic oligonucleotide
tcttcctcgggctgggccttatcatcc

SEQ ID NO: 58712 - DNA, 27 bp, Artificial Sequence
  Description of Artificial Sequence: Synthetic oligonucleotide
cttcctcgggctgggccttatcatcca

SEQ ID NO: 58713 - DNA, 28 bp, Artificial Sequence
  Description of Artificial Sequence: Synthetic oligonucleotide
ttcctcgggctgggccttatcatccatc

SEQ ID NO: 58714 - DNA, 27 bp, Artificial Sequence
  Description of Artificial Sequence: Synthetic oligonucleotide
tcctcgggctgggccttatcatccatc

SEQ ID NO: 58715 - DNA, 27 bp, Artificial Sequence
  Description of Artificial Sequence: Synthetic oligonucleotide
cctcgggctgggccttatcatccatca

SEQ ID NO: 58716 - DNA, 27 bp, Artificial Sequence
  Description of Artificial Sequence: Synthetic oligonucleotide
ctcgggctgggccttatcatccatcac

SEQ ID NO: 58717 - DNA, 28 bp, Artificial Sequence
  Description of Artificial Sequence: Synthetic oligonucleotide
tcgggctgggccttatcatccatcacag

SEQ ID NO: 58718 - DNA, 27 bp, Artificial Sequence
  Description of Artificial Sequence: Synthetic oligonucleotide
cgggctgggccttatcatccatcacag

SEQ ID NO: 58719 - DNA, 27 bp, Artificial Sequence
  Description of Artificial Sequence: Synthetic oligonucleotide
gggctgggccttatcatccatcacagg

SEQ ID NO: 58720 - DNA, 28 bp, Artificial Sequence
  Description of Artificial Sequence: Synthetic oligonucleotide
ggctgggccttatcatccatcacaggag

SEQ ID NO: 58721 - DNA, 29 bp, Artificial Sequence
  Description of Artificial Sequence: Synthetic oligonucleotide
gctgggccttatcatccatcacaggagtc

SEQ ID NO: 58722 - DNA, 30 bp, Artificial Sequence
  Description of Artificial Sequence: Synthetic oligonucleotide
ctgggccttatcatccatcacaggagtcag

SEQ ID NO: 58723 - DNA, 33 bp, Artificial Sequence
  Description of Artificial Sequence: Synthetic oligonucleotide
tgggccttatcatccatcacaggagtcagaaag

SEQ ID NO: 58724 - DNA, 32 bp, Artificial Sequence
  Description of Artificial Sequence: Synthetic oligonucleotide
gggccttatcatccatcacaggagtcagaaag

SEQ ID NO: 58725 - DNA, 32 bp, Artificial Sequence
  Description of Artificial Sequence: Synthetic oligonucleotide
ggccttatcatccatcacaggagtcagaaagg

SEQ ID NO: 58726 - DNA, 32 bp, Artificial Sequence
  Description of Artificial Sequence: Synthetic oligonucleotide
gccttatcatccatcacaggagtcagaaaggg

SEQ ID NO: 58727 - DNA, 32 bp, Artificial Sequence
  Description of Artificial Sequence: Synthetic oligonucleotide
ccttatcatccatcacaggagtcagaaagggc

SEQ ID NO: 58728 - DNA, 33 bp, Artificial Sequence
  Description of Artificial Sequence: Synthetic oligonucleotide
cttatcatccatcacaggagtcagaaagggctc

SEQ ID NO: 58729 - DNA, 33 bp, Artificial Sequence
  Description of Artificial Sequence: Synthetic oligonucleotide
ttatcatccatcacaggagtcagaaagggctcc

SEQ ID NO: 58730 - DNA, 32 bp, Artificial Sequence
  Description of Artificial Sequence: Synthetic oligonucleotide
tatcatccatcacaggagtcagaaagggctcc

SEQ ID NO: 58731 - DNA, 31 bp, Artificial Sequence
  Description of Artificial Sequence: Synthetic oligonucleotide
atcatccatcacaggagtcagaaagggctcc

SEQ ID NO: 58732 - DNA, 30 bp, Artificial Sequence
  Description of Artificial Sequence: Synthetic oligonucleotide
tcatccatcacaggagtcagaaagggctcc

SEQ ID NO: 58733 - DNA, 29 bp, Artificial Sequence
  Description of Artificial Sequence: Synthetic oligonucleotide
catccatcacaggagtcagaaagggctcc

SEQ ID NO: 58734 - DNA, 30 bp, Artificial Sequence
  Description of Artificial Sequence: Synthetic oligonucleotide
atccatcacaggagtcagaaagggctcctg

SEQ ID NO: 58735 - DNA, 29 bp, Artificial Sequence
  Description of Artificial Sequence: Synthetic oligonucleotide
tccatcacaggagtcagaaagggctcctg

SEQ ID NO: 58736 - DNA, 28 bp, Artificial Sequence
  Description of Artificial Sequence: Synthetic oligonucleotide
ccatcacaggagtcagaaagggctcctg

SEQ ID NO: 58737 - DNA, 28 bp, Artificial Sequence
  Description of Artificial Sequence: Synthetic oligonucleotide
catcacaggagtcagaaagggctcctgc

SEQ ID NO: 58738 - DNA, 29 bp, Artificial Sequence
  Description of Artificial Sequence: Synthetic oligonucleotide
atcacaggagtcagaaagggctcctgcac

SEQ ID NO: 58739 - DNA, 28 bp, Artificial Sequence
  Description of Artificial Sequence: Synthetic oligonucleotide
tcacaggagtcagaaagggctcctgcac

SEQ ID NO: 58740 - DNA, 27 bp, Artificial Sequence
  Description of Artificial Sequence: Synthetic oligonucleotide
cacaggagtcagaaagggctcctgcac

SEQ ID NO: 58741 - DNA, 28 bp, Artificial Sequence
  Description of Artificial Sequence: Synthetic oligonucleotide
acaggagtcagaaagggctcctgcactg

SEQ ID NO: 58742 - DNA, 27 bp, Artificial Sequence
  Description of Artificial Sequence: Synthetic oligonucleotide
caggagtcagaaagggctcctgcactg

SEQ ID NO: 58743 - DNA, 24 bp, Artificial Sequence
  Description of Artificial Sequence: Synthetic oligonucleotide
tggggctgcctgccgccgagtatt

SEQ ID NO: 58744 - DNA, 23 bp, Artificial Sequence
  Description of Artificial Sequence: Synthetic oligonucleotide
ggggctgcctgccgccgagtatt

SEQ ID NO: 58745 - DNA, 23 bp, Artificial Sequence
  Description of Artificial Sequence: Synthetic oligonucleotide
gggctgcctgccgccgagtattg

SEQ ID NO: 58746 - DNA, 25 bp, Artificial Sequence
  Description of Artificial Sequence: Synthetic oligonucleotide
ggctgcctgccgccgagtattggaa

SEQ ID NO: 58747 - DNA, 26 bp, Artificial Sequence
  Description of Artificial Sequence: Synthetic oligonucleotide
gctgcctgccgccgagtattggaaca

SEQ ID NO: 58748 - DNA, 26 bp, Artificial Sequence
  Description of Artificial Sequence: Synthetic oligonucleotide
ctgcctgccgccgagtattggaacag

SEQ ID NO: 58749 - DNA, 26 bp, Artificial Sequence
  Description of Artificial Sequence: Synthetic oligonucleotide
tgcctgccgccgagtattggaacagc

SEQ ID NO: 58750 - DNA, 25 bp, Artificial Sequence
  Description of Artificial Sequence: Synthetic oligonucleotide
gcctgccgccgagtattggaacagc

SEQ ID NO: 58751 - DNA, 26 bp, Artificial Sequence
  Description of Artificial Sequence: Synthetic oligonucleotide
cctgccgccgagtattggaacagcca

SEQ ID NO: 58752 - DNA, 27 bp, Artificial Sequence
  Description of Artificial Sequence: Synthetic oligonucleotide
ctgccgccgagtattggaacagccaga

SEQ ID NO: 58753 - DNA, 28 bp, Artificial Sequence
  Description of Artificial Sequence: Synthetic oligonucleotide
tgccgccgagtattggaacagccagaag

SEQ ID NO: 58754 - DNA, 27 bp, Artificial Sequence
  Description of Artificial Sequence: Synthetic oligonucleotide
gccgccgagtattggaacagccagaag

SEQ ID NO: 58755 - DNA, 27 bp, Artificial Sequence
  Description of Artificial Sequence: Synthetic oligonucleotide
ccgccgagtattggaacagccagaagg

SEQ ID NO: 58756 - DNA, 28 bp, Artificial Sequence
  Description of Artificial Sequence: Synthetic oligonucleotide
cgccgagtattggaacagccagaaggac

SEQ ID NO: 58757 - DNA, 30 bp, Artificial Sequence
  Description of Artificial Sequence: Synthetic oligonucleotide
gccgagtattggaacagccagaaggacatc

SEQ ID NO: 58758 - DNA, 30 bp, Artificial Sequence
  Description of Artificial Sequence: Synthetic oligonucleotide
ccgagtattggaacagccagaaggacatcc

SEQ ID NO: 58759 - DNA, 31 bp, Artificial Sequence
  Description of Artificial Sequence: Synthetic oligonucleotide
cgagtattggaacagccagaaggacatcctg

SEQ ID NO: 58760 - DNA, 31 bp, Artificial Sequence
  Description of Artificial Sequence: Synthetic oligonucleotide
gagtattggaacagccagaaggacatcctgg

SEQ ID NO: 58761 - DNA, 32 bp, Artificial Sequence
  Description of Artificial Sequence: Synthetic oligonucleotide
agtattggaacagccagaaggacatcctggag

SEQ ID NO: 58762 - DNA, 31 bp, Artificial Sequence
  Description of Artificial Sequence: Synthetic oligonucleotide
gtattggaacagccagaaggacatcctggag

SEQ ID NO: 58763 - DNA, 32 bp, Artificial Sequence
  Description of Artificial Sequence: Synthetic oligonucleotide
tattggaacagccagaaggacatcctggagag

SEQ ID NO: 58764 - DNA, 31 bp, Artificial Sequence
  Description of Artificial Sequence: Synthetic oligonucleotide
attggaacagccagaaggacatcctggagag

SEQ ID NO: 58765 - DNA, 30 bp, Artificial Sequence
  Description of Artificial Sequence: Synthetic oligonucleotide
ttggaacagccagaaggacatcctggagag

SEQ ID NO: 58766 - DNA, 22 bp, Artificial Sequence
  Description of Artificial Sequence: Synthetic oligonucleotide
cgcacgaccttgcagcggcgag

SEQ ID NO: 58767 - DNA, 30 bp, Artificial Sequence
  Description of Artificial Sequence: Synthetic oligonucleotide
ccagatcaaagtccggtggtttcggaatgg

SEQ ID NO: 58768 - DNA, 30 bp, Artificial Sequence
  Description of Artificial Sequence: Synthetic oligonucleotide
cagatcaaagtccggtggtttcggaatggc

SEQ ID NO: 58769 - DNA, 30 bp, Artificial Sequence
  Description of Artificial Sequence: Synthetic oligonucleotide
agatcaaagtccggtggtttcggaatggcc

SEQ ID NO: 58770 - DNA, 29 bp, Artificial Sequence
  Description of Artificial Sequence: Synthetic oligonucleotide
gatcaaagtccggtggtttcggaatggcc

SEQ ID NO: 58771 - DNA, 30 bp, Artificial Sequence
  Description of Artificial Sequence: Synthetic oligonucleotide
atcaaagtccggtggtttcggaatggccag

SEQ ID NO: 58772 - DNA, 29 bp, Artificial Sequence
  Description of Artificial Sequence: Synthetic oligonucleotide
tcaaagtccggtggtttcggaatggccag

SEQ ID NO: 58773 - DNA, 28 bp, Artificial Sequence
  Description of Artificial Sequence: Synthetic oligonucleotide
caaagtccggtggtttcggaatggccag

SEQ ID NO: 58774 - DNA, 28 bp, Artificial Sequence
  Description of Artificial Sequence: Synthetic oligonucleotide
aaagtccggtggtttcggaatggccagg

SEQ ID NO: 58775 - DNA, 27 bp, Artificial Sequence
  Description of Artificial Sequence: Synthetic oligonucleotide
aagtccggtggtttcggaatggccagg

SEQ ID NO: 58776 - DNA, 27 bp, Artificial Sequence
  Description of Artificial Sequence: Synthetic oligonucleotide
agtccggtggtttcggaatggccagga

SEQ ID NO: 58777 - DNA, 26 bp, Artificial Sequence
  Description of Artificial Sequence: Synthetic oligonucleotide
gtccggtggtttcggaatggccagga

SEQ ID NO: 58778 - DNA, 26 bp, Artificial Sequence
  Description of Artificial Sequence: Synthetic oligonucleotide
tccggtggtttcggaatggccaggag

SEQ ID NO: 58779 - DNA, 25 bp, Artificial Sequence
  Description of Artificial Sequence: Synthetic oligonucleotide
ccggtggtttcggaatggccaggag

SEQ ID NO: 58780 - DNA, 26 bp, Artificial Sequence
  Description of Artificial Sequence: Synthetic oligonucleotide
cggtggtttcggaatggccaggagga

SEQ ID NO: 58781 - DNA, 27 bp, Artificial Sequence
  Description of Artificial Sequence: Synthetic oligonucleotide
ggtggtttcggaatggccaggaggaga

SEQ ID NO: 58782 - DNA, 27 bp, Artificial Sequence
  Description of Artificial Sequence: Synthetic oligonucleotide
gtggtttcggaatggccaggaggagac

SEQ ID NO: 58783 - DNA, 28 bp, Artificial Sequence
  Description of Artificial Sequence: Synthetic oligonucleotide
tggtttcggaatggccaggaggagacag

SEQ ID NO: 58784 - DNA, 27 bp, Artificial Sequence
  Description of Artificial Sequence: Synthetic oligonucleotide
ggtttcggaatggccaggaggagacag

SEQ ID NO: 58785 - DNA, 27 bp, Artificial Sequence
  Description of Artificial Sequence: Synthetic oligonucleotide
gtttcggaatggccaggaggagacagc

SEQ ID NO: 58786 - DNA, 28 bp, Artificial Sequence
  Description of Artificial Sequence: Synthetic oligonucleotide
tttcggaatggccaggaggagacagctg

SEQ ID NO: 58787 - DNA, 27 bp, Artificial Sequence
  Description of Artificial Sequence: Synthetic oligonucleotide
ttcggaatggccaggaggagacagctg

SEQ ID NO: 58788 - DNA, 26 bp, Artificial Sequence
  Description of Artificial Sequence: Synthetic oligonucleotide
tcggaatggccaggaggagacagctg

SEQ ID NO: 58789 - DNA, 25 bp, Artificial Sequence
  Description of Artificial Sequence: Synthetic oligonucleotide
cggaatggccaggaggagacagctg

SEQ ID NO: 58790 - DNA, 25 bp, Artificial Sequence
  Description of Artificial Sequence: Synthetic oligonucleotide
ggaatggccaggaggagacagctgg

SEQ ID NO: 58791 - DNA, 25 bp, Artificial Sequence
  Description of Artificial Sequence: Synthetic oligonucleotide
gaatggccaggaggagacagctggc

SEQ ID NO: 58792 - DNA, 27 bp, Artificial Sequence
  Description of Artificial Sequence: Synthetic oligonucleotide
aatggccaggaggagacagctggcgtt

SEQ ID NO: 58793 - DNA, 26 bp, Artificial Sequence
  Description of Artificial Sequence: Synthetic oligonucleotide
atggccaggaggagacagctggcgtt

SEQ ID NO: 58794 - DNA, 25 bp, Artificial Sequence
  Description of Artificial Sequence: Synthetic oligonucleotide
tggccaggaggagacagctggcgtt

SEQ ID NO: 58795 - DNA, 24 bp, Artificial Sequence
  Description of Artificial Sequence: Synthetic oligonucleotide
ggccaggaggagacagctggcgtt

SEQ ID NO: 58796 - DNA, 25 bp, Artificial Sequence
  Description of Artificial Sequence: Synthetic oligonucleotide
gccaggaggagacagctggcgttgt

SEQ ID NO: 58797 - DNA, 23 bp, Artificial Sequence
  Description of Artificial Sequence: Synthetic oligonucleotide
gtgacgctgctggggctgcctga

SEQ ID NO: 58798 - DNA, 23 bp, Artificial Sequence
  Description of Artificial Sequence: Synthetic oligonucleotide
tgacgctgctggggctgcctgac

SEQ ID NO: 58799 - DNA, 22 bp, Artificial Sequence
  Description of Artificial Sequence: Synthetic oligonucleotide
gacgctgctggggctgcctgac

SEQ ID NO: 58800 - DNA, 22 bp, Artificial Sequence
  Description of Artificial Sequence: Synthetic oligonucleotide
acgctgctggggctgcctgacg

SEQ ID NO: 58801 - DNA, 21 bp, Artificial Sequence
  Description of Artificial Sequence: Synthetic oligonucleotide
cgctgctggggctgcctgacg

SEQ ID NO: 58802 - DNA, 21 bp, Artificial Sequence
  Description of Artificial Sequence: Synthetic oligonucleotide
gctgctggggctgcctgacgc

SEQ ID NO: 58803 - DNA, 21 bp, Artificial Sequence
  Description of Artificial Sequence: Synthetic oligonucleotide
ctgctggggctgcctgacgcc

SEQ ID NO: 58804 - DNA, 22 bp, Artificial Sequence
  Description of Artificial Sequence: Synthetic oligonucleotide
tgctggggctgcctgacgccga

SEQ ID NO: 58805 - DNA, 21 bp, Artificial Sequence
  Description of Artificial Sequence: Synthetic oligonucleotide
gctggggctgcctgacgccga

SEQ ID NO: 58806 - DNA, 23 bp, Artificial Sequence
  Description of Artificial Sequence: Synthetic oligonucleotide
ctggggctgcctgacgccgagta

SEQ ID NO: 58807 - DNA, 24 bp, Artificial Sequence
  Description of Artificial Sequence: Synthetic oligonucleotide
tggggctgcctgacgccgagtact

SEQ ID NO: 58808 - DNA, 23 bp, Artificial Sequence
  Description of Artificial Sequence: Synthetic oligonucleotide
ggggctgcctgacgccgagtact

SEQ ID NO: 58809 - DNA, 23 bp, Artificial Sequence
  Description of Artificial Sequence: Synthetic oligonucleotide
gggctgcctgacgccgagtactg

SEQ ID NO: 58810 - DNA, 25 bp, Artificial Sequence
  Description of Artificial Sequence: Synthetic oligonucleotide
ggctgcctgacgccgagtactggaa

SEQ ID NO: 58811 - DNA, 26 bp, Artificial Sequence
  Description of Artificial Sequence: Synthetic oligonucleotide
gctgcctgacgccgagtactggaaca

SEQ ID NO: 58812 - DNA, 26 bp, Artificial Sequence
  Description of Artificial Sequence: Synthetic oligonucleotide
ctgcctgacgccgagtactggaacag

SEQ ID NO: 58813 - DNA, 26 bp, Artificial Sequence
  Description of Artificial Sequence: Synthetic oligonucleotide
tgcctgacgccgagtactggaacagc

SEQ ID NO: 58814 - DNA, 25 bp, Artificial Sequence
  Description of Artificial Sequence: Synthetic oligonucleotide
gcctgacgccgagtactggaacagc

SEQ ID NO: 58815 - DNA, 26 bp, Artificial Sequence
  Description of Artificial Sequence: Synthetic oligonucleotide
cctgacgccgagtactggaacagcca

SEQ ID NO: 58816 - DNA, 27 bp, Artificial Sequence
  Description of Artificial Sequence: Synthetic oligonucleotide
ctgacgccgagtactggaacagccaga

SEQ ID NO: 58817 - DNA, 28 bp, Artificial Sequence
  Description of Artificial Sequence: Synthetic oligonucleotide
tgacgccgagtactggaacagccagaag

SEQ ID NO: 58818 - DNA, 27 bp, Artificial Sequence
  Description of Artificial Sequence: Synthetic oligonucleotide
gacgccgagtactggaacagccagaag

SEQ ID NO: 58819 - DNA, 27 bp, Artificial Sequence
  Description of Artificial Sequence: Synthetic oligonucleotide
acgccgagtactggaacagccagaagg

SEQ ID NO: 58820 - DNA, 31 bp, Artificial Sequence
  Description of Artificial Sequence: Synthetic oligonucleotide
cagatcaaagtccggtggtttcggaatgacg

SEQ ID NO: 58821 - DNA, 32 bp, Artificial Sequence
  Description of Artificial Sequence: Synthetic oligonucleotide
agatcaaagtccggtggtttcggaatgacgag

SEQ ID NO: 58822 - DNA, 31 bp, Artificial Sequence
  Description of Artificial Sequence: Synthetic oligonucleotide
gatcaaagtccggtggtttcggaatgacgag

SEQ ID NO: 58823 - DNA, 31 bp, Artificial Sequence
  Description of Artificial Sequence: Synthetic oligonucleotide
atcaaagtccggtggtttcggaatgacgagg

SEQ ID NO: 58824 - DNA, 30 bp, Artificial Sequence
  Description of Artificial Sequence: Synthetic oligonucleotide
tcaaagtccggtggtttcggaatgacgagg

SEQ ID NO: 58825 - DNA, 29 bp, Artificial Sequence
  Description of Artificial Sequence: Synthetic oligonucleotide
caaagtccggtggtttcggaatgacgagg

SEQ ID NO: 58826 - DNA, 30 bp, Artificial Sequence
  Description of Artificial Sequence: Synthetic oligonucleotide
aaagtccggtggtttcggaatgacgaggag

SEQ ID NO: 58827 - DNA, 29 bp, Artificial Sequence
  Description of Artificial Sequence: Synthetic oligonucleotide
aagtccggtggtttcggaatgacgaggag

SEQ ID NO: 58828 - DNA, 28 bp, Artificial Sequence
  Description of Artificial Sequence: Synthetic oligonucleotide
agtccggtggtttcggaatgacgaggag

SEQ ID NO: 58829 - DNA, 27 bp, Artificial Sequence
  Description of Artificial Sequence: Synthetic oligonucleotide
gtccggtggtttcggaatgacgaggag

SEQ ID NO: 58830 - DNA, 27 bp, Artificial Sequence
  Description of Artificial Sequence: Synthetic oligonucleotide
tccggtggtttcggaatgacgaggagg

SEQ ID NO: 58831 - DNA, 27 bp, Artificial Sequence
  Description of Artificial Sequence: Synthetic oligonucleotide
ccggtggtttcggaatgacgaggagga

SEQ ID NO: 58832 - DNA, 27 bp, Artificial Sequence
  Description of Artificial Sequence: Synthetic oligonucleotide
cggtggtttcggaatgacgaggaggag

SEQ ID NO: 58833 - DNA, 28 bp, Artificial Sequence
  Description of Artificial Sequence: Synthetic oligonucleotide
ggtggtttcggaatgacgaggaggagac

SEQ ID NO: 58834 - DNA, 29 bp, Artificial Sequence
  Description of Artificial Sequence: Synthetic oligonucleotide
gtggtttcggaatgacgaggaggagacag

SEQ ID NO: 58835 - DNA, 29 bp, Artificial Sequence
  Description of Artificial Sequence: Synthetic oligonucleotide
tggtttcggaatgacgaggaggagacagc

SEQ ID NO: 58836 - DNA, 28 bp, Artificial Sequence
  Description of Artificial Sequence: Synthetic oligonucleotide
ggtttcggaatgacgaggaggagacagc

SEQ ID NO: 58837 - DNA, 29 bp, Artificial Sequence
  Description of Artificial Sequence: Synthetic oligonucleotide
gtttcggaatgacgaggaggagacagctg

SEQ ID NO: 58838 - DNA, 29 bp, Artificial Sequence
  Description of Artificial Sequence: Synthetic oligonucleotide
tttcggaatgacgaggaggagacagctgg

SEQ ID NO: 58839 - DNA, 28 bp, Artificial Sequence
  Description of Artificial Sequence: Synthetic oligonucleotide
ttcggaatgacgaggaggagacagctgg

SEQ ID NO: 58840 - DNA, 27 bp, Artificial Sequence
  Description of Artificial Sequence: Synthetic oligonucleotide
tcggaatgacgaggaggagacagctgg

SEQ ID NO: 58841 - DNA, 26 bp, Artificial Sequence
  Description of Artificial Sequence: Synthetic oligonucleotide
cggaatgacgaggaggagacagctgg

SEQ ID NO: 58842 - DNA, 26 bp, Artificial Sequence
  Description of Artificial Sequence: Synthetic oligonucleotide
ggaatgacgaggaggagacagctggc

SEQ ID NO: 58843 - DNA, 27 bp, Artificial Sequence
  Description of Artificial Sequence: Synthetic oligonucleotide
gaatgacgaggaggagacagctggcgt

SEQ ID NO: 58844 - DNA, 28 bp, Artificial Sequence
  Description of Artificial Sequence: Synthetic oligonucleotide
aatgacgaggaggagacagctggcgttg

SEQ ID NO: 58845 - DNA, 27 bp, Artificial Sequence
  Description of Artificial Sequence: Synthetic oligonucleotide
atgacgaggaggagacagctggcgttg

SEQ ID NO: 58846 - DNA, 27 bp, Artificial Sequence
  Description of Artificial Sequence: Synthetic oligonucleotide
tgacgaggaggagacagctggcgttgt

SEQ ID NO: 58847 - DNA, 26 bp, Artificial Sequence
  Description of Artificial Sequence: Synthetic oligonucleotide
gacgaggaggagacagctggcgttgt

SEQ ID NO: 58848 - DNA, 27 bp, Artificial Sequence
  Description of Artificial Sequence: Synthetic oligonucleotide
acgaggaggagacagctggcgttgtgt

SEQ ID NO: 58849 - DNA, 26 bp, Artificial Sequence
  Description of Artificial Sequence: Synthetic oligonucleotide
cgaggaggagacagctggcgttgtgt

SEQ ID NO: 58850 - DNA, 26 bp, Artificial Sequence
  Description of Artificial Sequence: Synthetic oligonucleotide
gaggaggagacagctggcgttgtgtc

SEQ ID NO: 58851 - DNA, 23 bp, Artificial Sequence
  Description of Artificial Sequence: Synthetic oligonucleotide
aggaaacgggcggcggtggacac

SEQ ID NO: 58852 - DNA, 22 bp, Artificial Sequence
  Description of Artificial Sequence: Synthetic oligonucleotide
ggaaacgggcggcggtggacac

SEQ ID NO: 58853 - DNA, 22 bp, Artificial Sequence
  Description of Artificial Sequence: Synthetic oligonucleotide
gaaacgggcggcggtggacacg

SEQ ID NO: 58854 - DNA, 23 bp, Artificial Sequence
  Description of Artificial Sequence: Synthetic oligonucleotide
aaacgggcggcggtggacacggt

SEQ ID NO: 58855 - DNA, 22 bp, Artificial Sequence
  Description of Artificial Sequence: Synthetic oligonucleotide
aacgggcggcggtggacacggt

SEQ ID NO: 58856 - DNA, 21 bp, Artificial Sequence
  Description of Artificial Sequence: Synthetic oligonucleotide
acgggcggcggtggacacggt

SEQ ID NO: 58857 - DNA, 20 bp, Artificial Sequence
  Description of Artificial Sequence: Synthetic oligonucleotide
cgggcggcggtggacacggt

SEQ ID NO: 58858 - DNA, 21 bp, Artificial Sequence
  Description of Artificial Sequence: Synthetic oligonucleotide
gggcggcggtggacacggtgt

SEQ ID NO: 58859 - DNA, 21 bp, Artificial Sequence
  Description of Artificial Sequence: Synthetic oligonucleotide
ggcggcggtggacacggtgtg

SEQ ID NO: 58860 - DNA, 22 bp, Artificial Sequence
  Description of Artificial Sequence: Synthetic oligonucleotide
gcggcggtggacacggtgtgca

SEQ ID NO: 58861 - DNA, 23 bp, Artificial Sequence
  Description of Artificial Sequence: Synthetic oligonucleotide
cggcggtggacacggtgtgcaga

SEQ ID NO: 58862 - DNA, 24 bp, Artificial Sequence
  Description of Artificial Sequence: Synthetic oligonucleotide
ggcggtggacacggtgtgcagaca

SEQ ID NO: 58863 - DNA, 26 bp, Artificial Sequence
  Description of Artificial Sequence: Synthetic oligonucleotide
gcggtggacacggtgtgcagacacaa

SEQ ID NO: 58864 - DNA, 27 bp, Artificial Sequence
  Description of Artificial Sequence: Synthetic oligonucleotide
cggtggacacggtgtgcagacacaact

SEQ ID NO: 58865 - DNA, 28 bp, Artificial Sequence
  Description of Artificial Sequence: Synthetic oligonucleotide
ggtggacacggtgtgcagacacaactac

SEQ ID NO: 58866 - DNA, 28 bp, Artificial Sequence
  Description of Artificial Sequence: Synthetic oligonucleotide
gtggacacggtgtgcagacacaactacc

SEQ ID NO: 58867 - DNA, 29 bp, Artificial Sequence
  Description of Artificial Sequence: Synthetic oligonucleotide
tggacacggtgtgcagacacaactaccag

SEQ ID NO: 58868 - DNA, 28 bp, Artificial Sequence
  Description of Artificial Sequence: Synthetic oligonucleotide
ggacacggtgtgcagacacaactaccag

SEQ ID NO: 58869 - DNA, 30 bp, Artificial Sequence
  Description of Artificial Sequence: Synthetic oligonucleotide
gacacggtgtgcagacacaactaccagttg

SEQ ID NO: 58870 - DNA, 30 bp, Artificial Sequence
  Description of Artificial Sequence: Synthetic oligonucleotide
acacggtgtgcagacacaactaccagttgg

SEQ ID NO: 58871 - DNA, 29 bp, Artificial Sequence
  Description of Artificial Sequence: Synthetic oligonucleotide
cacggtgtgcagacacaactaccagttgg

SEQ ID NO: 58872 - DNA, 30 bp, Artificial Sequence
  Description of Artificial Sequence: Synthetic oligonucleotide
acggtgtgcagacacaactaccagttggag

SEQ ID NO: 58873 - DNA, 29 bp, Artificial Sequence
  Description of Artificial Sequence: Synthetic oligonucleotide
cggtgtgcagacacaactaccagttggag

SEQ ID NO: 58874 - DNA, 26 bp, Artificial Sequence
  Description of Artificial Sequence: Synthetic oligonucleotide
cggaggccttcgggcagcaactgtta

SEQ ID NO: 58875 - DNA, 26 bp, Artificial Sequence
  Description of Artificial Sequence: Synthetic oligonucleotide
ggaggccttcgggcagcaactgttac

SEQ ID NO: 58876 - DNA, 27 bp, Artificial Sequence
  Description of Artificial Sequence: Synthetic oligonucleotide
gaggccttcgggcagcaactgttacct

SEQ ID NO: 58877 - DNA, 28 bp, Artificial Sequence
  Description of Artificial Sequence: Synthetic oligonucleotide
aggccttcgggcagcaactgttaccttg

SEQ ID NO: 58878 - DNA, 27 bp, Artificial Sequence
  Description of Artificial Sequence: Synthetic oligonucleotide
ggccttcgggcagcaactgttaccttg

SEQ ID NO: 58879 - DNA, 29 bp, Artificial Sequence
  Description of Artificial Sequence: Synthetic oligonucleotide
gccttcgggcagcaactgttaccttgatg

SEQ ID NO: 58880 - DNA, 29 bp, Artificial Sequence
  Description of Artificial Sequence: Synthetic oligonucleotide
ccttcgggcagcaactgttaccttgatgc

SEQ ID NO: 58881 - DNA, 30 bp, Artificial Sequence
  Description of Artificial Sequence: Synthetic oligonucleotide
cttcgggcagcaactgttaccttgatgctg

SEQ ID NO: 58882 - DNA, 30 bp, Artificial Sequence
  Description of Artificial Sequence: Synthetic oligonucleotide
ttcgggcagcaactgttaccttgatgctgg

SEQ ID NO: 58883 - DNA, 29 bp, Artificial Sequence
  Description of Artificial Sequence: Synthetic oligonucleotide
tcgggcagcaactgttaccttgatgctgg

SEQ ID NO: 58884 - DNA, 28 bp, Artificial Sequence
  Description of Artificial Sequence: Synthetic oligonucleotide
cgggcagcaactgttaccttgatgctgg

SEQ ID NO: 58885 - DNA, 28 bp, Artificial Sequence
  Description of Artificial Sequence: Synthetic oligonucleotide
gggcagcaactgttaccttgatgctggc

SEQ ID NO: 58886 - DNA, 28 bp, Artificial Sequence
  Description of Artificial Sequence: Synthetic oligonucleotide
ggcagcaactgttaccttgatgctggcg

SEQ ID NO: 58887 - DNA, 30 bp, Artificial Sequence
  Description of Artificial Sequence: Synthetic oligonucleotide
gcagcaactgttaccttgatgctggcgatg

SEQ ID NO: 58888 - DNA, 30 bp, Artificial Sequence
  Description of Artificial Sequence: Synthetic oligonucleotide
cagcaactgttaccttgatgctggcgatgc

SEQ ID NO: 58889 - DNA, 31 bp, Artificial Sequence
  Description of Artificial Sequence: Synthetic oligonucleotide
agcaactgttaccttgatgctggcgatgctg

SEQ ID NO: 58890 - DNA, 30 bp, Artificial Sequence
  Description of Artificial Sequence: Synthetic oligonucleotide
gcaactgttaccttgatgctggcgatgctg

SEQ ID NO: 58891 - DNA, 31 bp, Artificial Sequence
  Description of Artificial Sequence: Synthetic oligonucleotide
caactgttaccttgatgctggcgatgctgag

SEQ ID NO: 58892 - DNA, 31 bp, Artificial Sequence
  Description of Artificial Sequence: Synthetic oligonucleotide
aactgttaccttgatgctggcgatgctgagc

SEQ ID NO: 58893 - DNA, 30 bp, Artificial Sequence
  Description of Artificial Sequence: Synthetic oligonucleotide
actgttaccttgatgctggcgatgctgagc

SEQ ID NO: 58894 - DNA, 29 bp, Artificial Sequence
  Description of Artificial Sequence: Synthetic oligonucleotide
ctgttaccttgatgctggcgatgctgagc

SEQ ID NO: 58895 - DNA, 30 bp, Artificial Sequence
  Description of Artificial Sequence: Synthetic oligonucleotide
tgttaccttgatgctggcgatgctgagcac

SEQ ID NO: 58896 - DNA, 29 bp, Artificial Sequence
  Description of Artificial Sequence: Synthetic oligonucleotide
gttaccttgatgctggcgatgctgagcac

SEQ ID NO: 58897 - DNA, 29 bp, Artificial Sequence
  Description of Artificial Sequence: Synthetic oligonucleotide
ttaccttgatgctggcgatgctgagcacc

SEQ ID NO: 58898 - DNA, 28 bp, Artificial Sequence
  Description of Artificial Sequence: Synthetic oligonucleotide
taccttgatgctggcgatgctgagcacc

SEQ ID NO: 58899 - DNA, 27 bp, Artificial Sequence
  Description of Artificial Sequence: Synthetic oligonucleotide
accttgatgctggcgatgctgagcacc

SEQ ID NO: 58900 - DNA, 26 bp, Artificial Sequence
  Description of Artificial Sequence: Synthetic oligonucleotide
ccttgatgctggcgatgctgagcacc

SEQ ID NO: 58901 - DNA, 26 bp, Artificial Sequence
  Description of Artificial Sequence: Synthetic oligonucleotide
cttgatgctggcgatgctgagcaccc

SEQ ID NO: 58902 - DNA, 27 bp, Artificial Sequence
  Description of Artificial Sequence: Synthetic oligonucleotide
ttgatgctggcgatgctgagcacccca

SEQ ID NO: 58903 - DNA, 26 bp, Artificial Sequence
  Description of Artificial Sequence: Synthetic oligonucleotide
tgatgctggcgatgctgagcacccca

SEQ ID NO: 58904 - DNA, 25 bp, Artificial Sequence
  Description of Artificial Sequence: Synthetic oligonucleotide
gatgctggcgatgctgagcacccca

SEQ ID NO: 58905 - DNA, 26 bp, Artificial Sequence
  Description of Artificial Sequence: Synthetic oligonucleotide
atgctggcgatgctgagcaccccagt

SEQ ID NO: 58906 - DNA, 25 bp, Artificial Sequence
  Description of Artificial Sequence: Synthetic oligonucleotide
tgctggcgatgctgagcaccccagt

SEQ ID NO: 58907 - DNA, 24 bp, Artificial Sequence
  Description of Artificial Sequence: Synthetic oligonucleotide
gctggcgatgctgagcaccccagt

SEQ ID NO: 58908 - DNA, 24 bp, Artificial Sequence
  Description of Artificial Sequence: Synthetic oligonucleotide
ctggcgatgctgagcaccccagtg

SEQ ID NO: 58909 - DNA, 24 bp, Artificial Sequence
  Description of Artificial Sequence: Synthetic oligonucleotide
tggcgatgctgagcaccccagtgg

SEQ ID NO: 58910 - DNA, 23 bp, Artificial Sequence
  Description of Artificial Sequence: Synthetic oligonucleotide
ggcgatgctgagcaccccagtgg

SEQ ID NO: 58911 - DNA, 24 bp, Artificial Sequence
  Description of Artificial Sequence: Synthetic oligonucleotide
gcgatgctgagcaccccagtggct

SEQ ID NO: 58912 - DNA, 32 bp, Artificial Sequence
  Description of Artificial Sequence: Synthetic oligonucleotide
tctcccgaggatttcgtgtaccagtttaaggc

SEQ ID NO: 58913 - DNA, 31 bp, Artificial Sequence
  Description of Artificial Sequence: Synthetic oligonucleotide
ctcccgaggatttcgtgtaccagtttaaggc

SEQ ID NO: 58914 - DNA, 31 bp, Artificial Sequence
  Description of Artificial Sequence: Synthetic oligonucleotide
tcccgaggatttcgtgtaccagtttaaggcc

SEQ ID NO: 58915 - DNA, 30 bp, Artificial Sequence
  Description of Artificial Sequence: Synthetic oligonucleotide
cccgaggatttcgtgtaccagtttaaggcc

SEQ ID NO: 58916 - DNA, 32 bp, Artificial Sequence
  Description of Artificial Sequence: Synthetic oligonucleotide
ccgaggatttcgtgtaccagtttaaggccatg

SEQ ID NO: 58917 - DNA, 33 bp, Artificial Sequence
  Description of Artificial Sequence: Synthetic oligonucleotide
cgaggatttcgtgtaccagtttaaggccatgtg

SEQ ID NO: 58918 - DNA, 33 bp, Artificial Sequence
  Description of Artificial Sequence: Synthetic oligonucleotide
gaggatttcgtgtaccagtttaaggccatgtgc

SEQ ID NO: 58919 - DNA, 35 bp, Artificial Sequence
  Description of Artificial Sequence: Synthetic oligonucleotide
aggatttcgtgtaccagtttaaggccatgtgctac

SEQ ID NO: 58920 - DNA, 34 bp, Artificial Sequence
  Description of Artificial Sequence: Synthetic oligonucleotide
ggatttcgtgtaccagtttaaggccatgtgctac

SEQ ID NO: 58921 - DNA, 36 bp, Artificial Sequence
  Description of Artificial Sequence: Synthetic oligonucleotide
gatttcgtgtaccagtttaaggccatgtgctacttc

SEQ ID NO: 58922 - DNA, 37 bp, Artificial Sequence
  Description of Artificial Sequence: Synthetic oligonucleotide
atttcgtgtaccagtttaaggccatgtgctacttcac

SEQ ID NO: 58923 - DNA, 36 bp, Artificial Sequence
  Description of Artificial Sequence: Synthetic oligonucleotide
tttcgtgtaccagtttaaggccatgtgctacttcac

SEQ ID NO: 58924 - DNA, 35 bp, Artificial Sequence
  Description of Artificial Sequence: Synthetic oligonucleotide
ttcgtgtaccagtttaaggccatgtgctacttcac

SEQ ID NO: 58925 - DNA, 34 bp, Artificial Sequence
  Description of Artificial Sequence: Synthetic oligonucleotide
tcgtgtaccagtttaaggccatgtgctacttcac

SEQ ID NO: 58926 - DNA, 33 bp, Artificial Sequence
  Description of Artificial Sequence: Synthetic oligonucleotide
cgtgtaccagtttaaggccatgtgctacttcac

SEQ ID NO: 58927 - DNA, 33 bp, Artificial Sequence
  Description of Artificial Sequence: Synthetic oligonucleotide
gtgtaccagtttaaggccatgtgctacttcacc

SEQ ID NO: 58928 - DNA, 35 bp, Artificial Sequence
  Description of Artificial Sequence: Synthetic oligonucleotide
tgtaccagtttaaggccatgtgctacttcaccaac

SEQ ID NO: 58929 - DNA, 34 bp, Artificial Sequence
  Description of Artificial Sequence: Synthetic oligonucleotide
gtaccagtttaaggccatgtgctacttcaccaac

SEQ ID NO: 58930 - DNA, 34 bp, Artificial Sequence
  Description of Artificial Sequence: Synthetic oligonucleotide
taccagtttaaggccatgtgctacttcaccaacg

SEQ ID NO: 58931 - DNA, 33 bp, Artificial Sequence
  Description of Artificial Sequence: Synthetic oligonucleotide
accagtttaaggccatgtgctacttcaccaacg

SEQ ID NO: 58932 - DNA, 32 bp, Artificial Sequence
  Description of Artificial Sequence: Synthetic oligonucleotide
ccagtttaaggccatgtgctacttcaccaacg

SEQ ID NO: 58933 - DNA, 32 bp, Artificial Sequence
  Description of Artificial Sequence: Synthetic oligonucleotide
cagtttaaggccatgtgctacttcaccaacgg

SEQ ID NO: 58934 - DNA, 32 bp, Artificial Sequence
  Description of Artificial Sequence: Synthetic oligonucleotide
agtttaaggccatgtgctacttcaccaacggg

SEQ ID NO: 58935 - DNA, 31 bp, Artificial Sequence
  Description of Artificial Sequence: Synthetic oligonucleotide
gtttaaggccatgtgctacttcaccaacggg

SEQ ID NO: 58936 - DNA, 32 bp, Artificial Sequence
  Description of Artificial Sequence: Synthetic oligonucleotide
tttaaggccatgtgctacttcaccaacgggac

SEQ ID NO: 58937 - DNA, 31 bp, Artificial Sequence
  Description of Artificial Sequence: Synthetic oligonucleotide
ttaaggccatgtgctacttcaccaacgggac

SEQ ID NO: 58938 - DNA, 30 bp, Artificial Sequence
  Description of Artificial Sequence: Synthetic oligonucleotide
taaggccatgtgctacttcaccaacgggac

SEQ ID NO: 58939 - DNA, 29 bp, Artificial Sequence
  Description of Artificial Sequence: Synthetic oligonucleotide
aaggccatgtgctacttcaccaacgggac

SEQ ID NO: 58940 - DNA, 28 bp, Artificial Sequence
  Description of Artificial Sequence: Synthetic oligonucleotide
aggccatgtgctacttcaccaacgggac

SEQ ID NO: 58941 - DNA, 27 bp, Artificial Sequence
  Description of Artificial Sequence: Synthetic oligonucleotide
ggccatgtgctacttcaccaacgggac

SEQ ID NO: 58942 - DNA, 27 bp, Artificial Sequence
  Description of Artificial Sequence: Synthetic oligonucleotide
gccatgtgctacttcaccaacgggacg

SEQ ID NO: 58943 - DNA, 27 bp, Artificial Sequence
  Description of Artificial Sequence: Synthetic oligonucleotide
ccatgtgctacttcaccaacgggacgg

SEQ ID NO: 58944 - DNA, 28 bp, Artificial Sequence
  Description of Artificial Sequence: Synthetic oligonucleotide
catgtgctacttcaccaacgggacggag

SEQ ID NO: 58945 - DNA, 28 bp, Artificial Sequence
  Description of Artificial Sequence: Synthetic oligonucleotide
atgtgctacttcaccaacgggacggagc

SEQ ID NO: 58946 - DNA, 27 bp, Artificial Sequence
  Description of Artificial Sequence: Synthetic oligonucleotide
tgtgctacttcaccaacgggacggagc

SEQ ID NO: 58947 - DNA, 26 bp, Artificial Sequence
  Description of Artificial Sequence: Synthetic oligonucleotide
gtgctacttcaccaacgggacggagc

SEQ ID NO: 58948 - DNA, 26 bp, Artificial Sequence
  Description of Artificial Sequence: Synthetic oligonucleotide
tgctacttcaccaacgggacggagcg

SEQ ID NO: 58949 - DNA, 25 bp, Artificial Sequence
  Description of Artificial Sequence: Synthetic oligonucleotide
gctacttcaccaacgggacggagcg

SEQ ID NO: 58950 - DNA, 25 bp, Artificial Sequence
  Description of Artificial Sequence: Synthetic oligonucleotide
ctacttcaccaacgggacggagcgc

SEQ ID NO: 58951 - DNA, 26 bp, Artificial Sequence
  Description of Artificial Sequence: Synthetic oligonucleotide
tacttcaccaacgggacggagcgcgt

SEQ ID NO: 58952 - DNA, 25 bp, Artificial Sequence
  Description of Artificial Sequence: Synthetic oligonucleotide
acttcaccaacgggacggagcgcgt

SEQ ID NO: 58953 - DNA, 24 bp, Artificial Sequence
  Description of Artificial Sequence: Synthetic oligonucleotide
cttcaccaacgggacggagcgcgt

SEQ ID NO: 58954 - DNA, 24 bp, Artificial Sequence
  Description of Artificial Sequence: Synthetic oligonucleotide
ttcaccaacgggacggagcgcgtg

SEQ ID NO: 58955 - DNA, 23 bp, Artificial Sequence
  Description of Artificial Sequence: Synthetic oligonucleotide
tcaccaacgggacggagcgcgtg

SEQ ID NO: 58956 - DNA, 22 bp, Artificial Sequence
  Description of Artificial Sequence: Synthetic oligonucleotide
caccaacgggacggagcgcgtg

SEQ ID NO: 58957 - DNA, 22 bp, Artificial Sequence
  Description of Artificial Sequence: Synthetic oligonucleotide
accaacgggacggagcgcgtgc

SEQ ID NO: 58958 - DNA, 21 bp, Artificial Sequence
  Description of Artificial Sequence: Synthetic oligonucleotide
ccaacgggacggagcgcgtgc

SEQ ID NO: 58959 - DNA, 25 bp, Artificial Sequence
  Description of Artificial Sequence: Synthetic oligonucleotide
caacgggacggagcgcgtgcgttat

SEQ ID NO: 58960 - DNA, 26 bp, Artificial Sequence
  Description of Artificial Sequence: Synthetic oligonucleotide
aacgggacggagcgcgtgcgttatgt

SEQ ID NO: 58961 - DNA, 25 bp, Artificial Sequence
  Description of Artificial Sequence: Synthetic oligonucleotide
acgggacggagcgcgtgcgttatgt

SEQ ID NO: 58962 - DNA, 24 bp, Artificial Sequence
  Description of Artificial Sequence: Synthetic oligonucleotide
cgggacggagcgcgtgcgttatgt

SEQ ID NO: 58963 - DNA, 25 bp, Artificial Sequence
  Description of Artificial Sequence: Synthetic oligonucleotide
gggacggagcgcgtgcgttatgtga

SEQ ID NO: 58964 - DNA, 25 bp, Artificial Sequence
  Description of Artificial Sequence: Synthetic oligonucleotide
ggacggagcgcgtgcgttatgtgac

SEQ ID NO: 58965 - DNA, 26 bp, Artificial Sequence
  Description of Artificial Sequence: Synthetic oligonucleotide
gacggagcgcgtgcgttatgtgacca

SEQ ID NO: 58966 - DNA, 27 bp, Artificial Sequence
  Description of Artificial Sequence: Synthetic oligonucleotide
acggagcgcgtgcgttatgtgaccaga

SEQ ID NO: 58967 - DNA, 27 bp, Artificial Sequence
  Description of Artificial Sequence: Synthetic oligonucleotide
cggagcgcgtgcgttatgtgaccagat

SEQ ID NO: 58968 - DNA, 28 bp, Artificial Sequence
  Description of Artificial Sequence: Synthetic oligonucleotide
ggagcgcgtgcgttatgtgaccagatac

SEQ ID NO: 58969 - DNA, 30 bp, Artificial Sequence
  Description of Artificial Sequence: Synthetic oligonucleotide
gagcgcgtgcgttatgtgaccagatacatc

SEQ ID NO: 58970 - DNA, 35 bp, Artificial Sequence
  Description of Artificial Sequence: Synthetic oligonucleotide
agcgcgtgcgttatgtgaccagatacatctataac

SEQ ID NO: 58971 - DNA, 34 bp, Artificial Sequence
  Description of Artificial Sequence: Synthetic oligonucleotide
gcgcgtgcgttatgtgaccagatacatctataac

SEQ ID NO: 58972 - DNA, 34 bp, Artificial Sequence
  Description of Artificial Sequence: Synthetic oligonucleotide
cgcgtgcgttatgtgaccagatacatctataacc

SEQ ID NO: 58973 - DNA, 34 bp, Artificial Sequence
  Description of Artificial Sequence: Synthetic oligonucleotide
gcgtgcgttatgtgaccagatacatctataaccg

SEQ ID NO: 58974 - DNA, 35 bp, Artificial Sequence
  Description of Artificial Sequence: Synthetic oligonucleotide
cgtgcgttatgtgaccagatacatctataaccgag

SEQ ID NO: 58975 - DNA, 36 bp, Artificial Sequence
  Description of Artificial Sequence: Synthetic oligonucleotide
gtgcgttatgtgaccagatacatctataaccgagag

SEQ ID NO: 58976 - DNA, 36 bp, Artificial Sequence
  Description of Artificial Sequence: Synthetic oligonucleotide
tgcgttatgtgaccagatacatctataaccgagagg

SEQ ID NO: 58977 - DNA, 35 bp, Artificial Sequence
  Description of Artificial Sequence: Synthetic oligonucleotide
gcgttatgtgaccagatacatctataaccgagagg

SEQ ID NO: 58978 - DNA, 36 bp, Artificial Sequence
  Description of Artificial Sequence: Synthetic oligonucleotide
cgttatgtgaccagatacatctataaccgagaggag

SEQ ID NO: 58979 - DNA, 38 bp, Artificial Sequence
  Description of Artificial Sequence: Synthetic oligonucleotide
gttatgtgaccagatacatctataaccgagaggagtac

SEQ ID NO: 58980 - DNA, 38 bp, Artificial Sequence
  Description of Artificial Sequence: Synthetic oligonucleotide
ttatgtgaccagatacatctataaccgagaggagtacg

SEQ ID NO: 58981 - DNA, 37 bp, Artificial Sequence
  Description of Artificial Sequence: Synthetic oligonucleotide
tatgtgaccagatacatctataaccgagaggagtacg

SEQ ID NO: 58982 - DNA, 36 bp, Artificial Sequence
  Description of Artificial Sequence: Synthetic oligonucleotide
atgtgaccagatacatctataaccgagaggagtacg

SEQ ID NO: 58983 - DNA, 35 bp, Artificial Sequence
  Description of Artificial Sequence: Synthetic oligonucleotide
tgtgaccagatacatctataaccgagaggagtacg

SEQ ID NO: 58984 - DNA, 34 bp, Artificial Sequence
  Description of Artificial Sequence: Synthetic oligonucleotide
gtgaccagatacatctataaccgagaggagtacg

SEQ ID NO: 58985 - DNA, 34 bp, Artificial Sequence
  Description of Artificial Sequence: Synthetic oligonucleotide
tgaccagatacatctataaccgagaggagtacgc

SEQ ID NO: 58986 - DNA, 33 bp, Artificial Sequence
  Description of Artificial Sequence: Synthetic oligonucleotide
gaccagatacatctataaccgagaggagtacgc

SEQ ID NO: 58987 - DNA, 34 bp, Artificial Sequence
  Description of Artificial Sequence: Synthetic oligonucleotide
accagatacatctataaccgagaggagtacgcac

SEQ ID NO: 58988 - DNA, 33 bp, Artificial Sequence
  Description of Artificial Sequence: Synthetic oligonucleotide
ccagatacatctataaccgagaggagtacgcac

SEQ ID NO: 58989 - DNA, 33 bp, Artificial Sequence
  Description of Artificial Sequence: Synthetic oligonucleotide
cagatacatctataaccgagaggagtacgcacg

SEQ ID NO: 58990 - DNA, 33 bp, Artificial Sequence
  Description of Artificial Sequence: Synthetic oligonucleotide
agatacatctataaccgagaggagtacgcacgc

SEQ ID NO: 58991 - DNA, 32 bp, Artificial Sequence
  Description of Artificial Sequence: Synthetic oligonucleotide
gatacatctataaccgagaggagtacgcacgc

SEQ ID NO: 58992 - DNA, 34 bp, Artificial Sequence
  Description of Artificial Sequence: Synthetic oligonucleotide
atacatctataaccgagaggagtacgcacgcttc

SEQ ID NO: 58993 - DNA, 33 bp, Artificial Sequence
  Description of Artificial Sequence: Synthetic oligonucleotide
tacatctataaccgagaggagtacgcacgcttc

SEQ ID NO: 58994 - DNA, 32 bp, Artificial Sequence
  Description of Artificial Sequence: Synthetic oligonucleotide
acatctataaccgagaggagtacgcacgcttc

SEQ ID NO: 58995 - DNA, 31 bp, Artificial Sequence
  Description of Artificial Sequence: Synthetic oligonucleotide
catctataaccgagaggagtacgcacgcttc

SEQ ID NO: 58996 - DNA, 31 bp, Artificial Sequence
  Description of Artificial Sequence: Synthetic oligonucleotide
atctataaccgagaggagtacgcacgcttcg

SEQ ID NO: 58997 - DNA, 30 bp, Artificial Sequence
  Description of Artificial Sequence: Synthetic oligonucleotide
tctataaccgagaggagtacgcacgcttcg

SEQ ID NO: 58998 - DNA, 29 bp, Artificial Sequence
  Description of Artificial Sequence: Synthetic oligonucleotide
ctataaccgagaggagtacgcacgcttcg

SEQ ID NO: 58999 - DNA, 30 bp, Artificial Sequence
  Description of Artificial Sequence: Synthetic oligonucleotide
tataaccgagaggagtacgcacgcttcgac

SEQ ID NO: 59000 - DNA, 29 bp, Artificial Sequence
  Description of Artificial Sequence: Synthetic oligonucleotide
ataaccgagaggagtacgcacgcttcgac

SEQ ID NO: 59001 - DNA, 28 bp, Artificial Sequence
  Description of Artificial Sequence: Synthetic oligonucleotide
taaccgagaggagtacgcacgcttcgac

SEQ ID NO: 59002 - DNA, 27 bp, Artificial Sequence
  Description of Artificial Sequence: Synthetic oligonucleotide
aaccgagaggagtacgcacgcttcgac

SEQ ID NO: 59003 - DNA, 27 bp, Artificial Sequence
  Description of Artificial Sequence: Synthetic oligonucleotide
accgagaggagtacgcacgcttcgaca

SEQ ID NO: 59004 - DNA, 26 bp, Artificial Sequence
  Description of Artificial Sequence: Synthetic oligonucleotide
ccgagaggagtacgcacgcttcgaca

SEQ ID NO: 59005 - DNA, 26 bp, Artificial Sequence
  Description of Artificial Sequence: Synthetic oligonucleotide
cgagaggagtacgcacgcttcgacag

SEQ ID NO: 59006 - DNA, 26 bp, Artificial Sequence
  Description of Artificial Sequence: Synthetic oligonucleotide
gagaggagtacgcacgcttcgacagc

SEQ ID NO: 59007 - DNA, 27 bp, Artificial Sequence
  Description of Artificial Sequence: Synthetic oligonucleotide
agaggagtacgcacgcttcgacagcga

SEQ ID NO: 59008 - DNA, 26 bp, Artificial Sequence
  Description of Artificial Sequence: Synthetic oligonucleotide
gaggagtacgcacgcttcgacagcga

SEQ ID NO: 59009 - DNA, 26 bp, Artificial Sequence
  Description of Artificial Sequence: Synthetic oligonucleotide
aggagtacgcacgcttcgacagcgac

SEQ ID NO: 59010 - DNA, 25 bp, Artificial Sequence
  Description of Artificial Sequence: Synthetic oligonucleotide
ggagtacgcacgcttcgacagcgac

SEQ ID NO: 59011 - DNA, 26 bp, Artificial Sequence
  Description of Artificial Sequence: Synthetic oligonucleotide
gagtacgcacgcttcgacagcgacgt

SEQ ID NO: 59012 - DNA, 26 bp, Artificial Sequence
  Description of Artificial Sequence: Synthetic oligonucleotide
agtacgcacgcttcgacagcgacgtg

SEQ ID NO: 59013 - DNA, 25 bp, Artificial Sequence
  Description of Artificial Sequence: Synthetic oligonucleotide
gtacgcacgcttcgacagcgacgtg

SEQ ID NO: 59014 - DNA, 26 bp, Artificial Sequence
  Description of Artificial Sequence: Synthetic oligonucleotide
tacgcacgcttcgacagcgacgtgga

SEQ ID NO: 59015 - DNA, 25 bp, Artificial Sequence
  Description of Artificial Sequence: Synthetic oligonucleotide
acgcacgcttcgacagcgacgtgga

SEQ ID NO: 59016 - DNA, 24 bp, Artificial Sequence
  Description of Artificial Sequence: Synthetic oligonucleotide
cgcacgcttcgacagcgacgtgga

SEQ ID NO: 59017 - DNA, 24 bp, Artificial Sequence
  Description of Artificial Sequence: Synthetic oligonucleotide
gcacgcttcgacagcgacgtggag

SEQ ID NO: 59018 - DNA, 25 bp, Artificial Sequence
  Description of Artificial Sequence: Synthetic oligonucleotide
cacgcttcgacagcgacgtggaggt

SEQ ID NO: 59019 - DNA, 27 bp, Artificial Sequence
  Description of Artificial Sequence: Synthetic oligonucleotide
acgcttcgacagcgacgtggaggtgta

SEQ ID NO: 59020 - DNA, 26 bp, Artificial Sequence
  Description of Artificial Sequence: Synthetic oligonucleotide
cgcttcgacagcgacgtggaggtgta

SEQ ID NO: 59021 - DNA, 26 bp, Artificial Sequence
  Description of Artificial Sequence: Synthetic oligonucleotide
gcttcgacagcgacgtggaggtgtac

SEQ ID NO: 59022 - DNA, 26 bp, Artificial Sequence
  Description of Artificial Sequence: Synthetic oligonucleotide
cttcgacagcgacgtggaggtgtacc

SEQ ID NO: 59023 - DNA, 26 bp, Artificial Sequence
  Description of Artificial Sequence: Synthetic oligonucleotide
ttcgacagcgacgtggaggtgtaccg

SEQ ID NO: 59024 - DNA, 25 bp, Artificial Sequence
  Description of Artificial Sequence: Synthetic oligonucleotide
tcgacagcgacgtggaggtgtaccg

SEQ ID NO: 59025 - DNA, 24 bp, Artificial Sequence
  Description of Artificial Sequence: Synthetic oligonucleotide
cgacagcgacgtggaggtgtaccg

SEQ ID NO: 59026 - DNA, 24 bp, Artificial Sequence
  Description of Artificial Sequence: Synthetic oligonucleotide
gacagcgacgtggaggtgtaccgg

SEQ ID NO: 59027 - DNA, 24 bp, Artificial Sequence
  Description of Artificial Sequence: Synthetic oligonucleotide
acagcgacgtggaggtgtaccggg

SEQ ID NO: 59028 - DNA, 23 bp, Artificial Sequence
  Description of Artificial Sequence: Synthetic oligonucleotide
cagcgacgtggaggtgtaccggg

SEQ ID NO: 59029 - DNA, 23 bp, Artificial Sequence
  Description of Artificial Sequence: Synthetic oligonucleotide
agcgacgtggaggtgtaccgggc

SEQ ID NO: 59030 - DNA, 22 bp, Artificial Sequence
  Description of Artificial Sequence: Synthetic oligonucleotide
gcgacgtggaggtgtaccgggc

SEQ ID NO: 59031 - DNA, 22 bp, Artificial Sequence
  Description of Artificial Sequence: Synthetic oligonucleotide
cgacgtggaggtgtaccgggcg

SEQ ID NO: 59032 - DNA, 23 bp, Artificial Sequence
  Description of Artificial Sequence: Synthetic oligonucleotide
gacgtggaggtgtaccgggcggt

SEQ ID NO: 59033 - DNA, 24 bp, Artificial Sequence
  Description of Artificial Sequence: Synthetic oligonucleotide
acgtggaggtgtaccgggcggtga

SEQ ID NO: 59034 - DNA, 23 bp, Artificial Sequence
  Description of Artificial Sequence: Synthetic oligonucleotide
cgtggaggtgtaccgggcggtga

SEQ ID NO: 59035 - DNA, 23 bp, Artificial Sequence
  Description of Artificial Sequence: Synthetic oligonucleotide
gtggaggtgtaccgggcggtgac

SEQ ID NO: 59036 - DNA, 23 bp, Artificial Sequence
  Description of Artificial Sequence: Synthetic oligonucleotide
tggaggtgtaccgggcggtgacg

SEQ ID NO: 59037 - DNA, 22 bp, Artificial Sequence
  Description of Artificial Sequence: Synthetic oligonucleotide
ggaggtgtaccgggcggtgacg

SEQ ID NO: 59038 - DNA, 22 bp, Artificial Sequence
  Description of Artificial Sequence: Synthetic oligonucleotide
gaggtgtaccgggcggtgacgc

SEQ ID NO: 59039 - DNA, 22 bp, Artificial Sequence
  Description of Artificial Sequence: Synthetic oligonucleotide
aggtgtaccgggcggtgacgcc

SEQ ID NO: 59040 - DNA, 21 bp, Artificial Sequence
  Description of Artificial Sequence: Synthetic oligonucleotide
ggtgtaccgggcggtgacgcc

SEQ ID NO: 59041 - DNA, 21 bp, Artificial Sequence
  Description of Artificial Sequence: Synthetic oligonucleotide
gtgtaccgggcggtgacgccg

SEQ ID NO: 59042 - DNA, 22 bp, Artificial Sequence
  Description of Artificial Sequence: Synthetic oligonucleotide
tgtaccgggcggtgacgccgct

SEQ ID NO: 59043 - DNA, 21 bp, Artificial Sequence
  Description of Artificial Sequence: Synthetic oligonucleotide
gtaccgggcggtgacgccgct

SEQ ID NO: 59044 - DNA, 21 bp, Artificial Sequence
  Description of Artificial Sequence: Synthetic oligonucleotide
taccgggcggtgacgccgctg

SEQ ID NO: 59045 - DNA, 20 bp, Artificial Sequence
  Description of Artificial Sequence: Synthetic oligonucleotide
accgggcggtgacgccgctg

SEQ ID NO: 59046 - DNA, 20 bp, Artificial Sequence
  Description of Artificial Sequence: Synthetic oligonucleotide
ccgggcggtgacgccgctgt

SEQ ID NO: 59047 - DNA, 20 bp, Artificial Sequence
  Description of Artificial Sequence: Synthetic oligonucleotide
cgggcggtgacgccgctggt

SEQ ID NO: 59048 - DNA, 20 bp, Artificial Sequence
  Description of Artificial Sequence: Synthetic oligonucleotide
gggcggtgacgccgctgggt

SEQ ID NO: 59049 - DNA, 20 bp, Artificial Sequence
  Description of Artificial Sequence: Synthetic oligonucleotide
ggcggtgacgccgctggggt

SEQ ID NO: 59050 - DNA, 20 bp, Artificial Sequence
  Description of Artificial Sequence: Synthetic oligonucleotide
gcggtgacgccgctggggct

SEQ ID NO: 59051 - DNA, 20 bp, Artificial Sequence
  Description of Artificial Sequence: Synthetic oligonucleotide
cggtgacgccgctggggcct

SEQ ID NO: 59052 - DNA, 20 bp, Artificial Sequence
  Description of Artificial Sequence: Synthetic oligonucleotide
ggtgacgccgctggggccgt

SEQ ID NO: 59053 - DNA, 20 bp, Artificial Sequence
  Description of Artificial Sequence: Synthetic oligonucleotide
gtgacgccgctggggccgct

SEQ ID NO: 59054 - DNA, 20 bp, Artificial Sequence
  Description of Artificial Sequence: Synthetic oligonucleotide
tgacgccgctggggccgcct

SEQ ID NO: 59055 - DNA, 20 bp, Artificial Sequence
  Description of Artificial Sequence: Synthetic oligonucleotide
gacgccgctggggccgcctt

SEQ ID NO: 59056 - DNA, 20 bp, Artificial Sequence
  Description of Artificial Sequence: Synthetic oligonucleotide
acgccgctggggccgcctga

SEQ ID NO: 59057 - DNA, 20 bp, Artificial Sequence
  Description of Artificial Sequence: Synthetic oligonucleotide
cgccgctggggccgcctgat

SEQ ID NO: 59058 - DNA, 20 bp, Artificial Sequence
  Description of Artificial Sequence: Synthetic oligonucleotide
gccgctggggccgcctgact

SEQ ID NO: 59059 - DNA, 20 bp, Artificial Sequence
  Description of Artificial Sequence: Synthetic oligonucleotide
ccgctggggccgcctgacgt

SEQ ID NO: 59060 - DNA, 20 bp, Artificial Sequence
  Description of Artificial Sequence: Synthetic oligonucleotide
cgctggggccgcctgacgct

SEQ ID NO: 59061 - DNA, 20 bp, Artificial Sequence
  Description of Artificial Sequence: Synthetic oligonucleotide
gctggggccgcctgacgcct

SEQ ID NO: 59062 - DNA, 20 bp, Artificial Sequence
  Description of Artificial Sequence: Synthetic oligonucleotide
ctggggccgcctgacgccga

SEQ ID NO: 59063 - DNA, 22 bp, Artificial Sequence
  Description of Artificial Sequence: Synthetic oligonucleotide
tggggccgcctgacgccgagta

SEQ ID NO: 59064 - DNA, 21 bp, Artificial Sequence
  Description of Artificial Sequence: Synthetic oligonucleotide
ggggccgcctgacgccgagta

SEQ ID NO: 59065 - DNA, 22 bp, Artificial Sequence
  Description of Artificial Sequence: Synthetic oligonucleotide
gggccgcctgacgccgagtact

SEQ ID NO: 59066 - DNA, 22 bp, Artificial Sequence
  Description of Artificial Sequence: Synthetic oligonucleotide
ggccgcctgacgccgagtactg

SEQ ID NO: 59067 - DNA, 24 bp, Artificial Sequence
  Description of Artificial Sequence: Synthetic oligonucleotide
gccgcctgacgccgagtactggaa

SEQ ID NO: 59068 - DNA, 25 bp, Artificial Sequence
  Description of Artificial Sequence: Synthetic oligonucleotide
ccgcctgacgccgagtactggaaca

SEQ ID NO: 59069 - DNA, 25 bp, Artificial Sequence
  Description of Artificial Sequence: Synthetic oligonucleotide
cgcctgacgccgagtactggaacag

SEQ ID NO: 59070 - DNA, 28 bp, Artificial Sequence
  Description of Artificial Sequence: Synthetic oligonucleotide
gccgagtactggaacagccagaaggaag

SEQ ID NO: 59071 - DNA, 29 bp, Artificial Sequence
  Description of Artificial Sequence: Synthetic oligonucleotide
ccgagtactggaacagccagaaggaagtc

SEQ ID NO: 59072 - DNA, 29 bp, Artificial Sequence
  Description of Artificial Sequence: Synthetic oligonucleotide
cgagtactggaacagccagaaggaagtcc

SEQ ID NO: 59073 - DNA, 30 bp, Artificial Sequence
  Description of Artificial Sequence: Synthetic oligonucleotide
gagtactggaacagccagaaggaagtcctg

SEQ ID NO: 59074 - DNA, 30 bp, Artificial Sequence
  Description of Artificial Sequence: Synthetic oligonucleotide
agtactggaacagccagaaggaagtcctgg

SEQ ID NO: 59075 - DNA, 29 bp, Artificial Sequence
  Description of Artificial Sequence: Synthetic oligonucleotide
gtactggaacagccagaaggaagtcctgg

SEQ ID NO: 59076 - DNA, 30 bp, Artificial Sequence
  Description of Artificial Sequence: Synthetic oligonucleotide
tactggaacagccagaaggaagtcctggag

SEQ ID NO: 59077 - DNA, 29 bp, Artificial Sequence
  Description of Artificial Sequence: Synthetic oligonucleotide
actggaacagccagaaggaagtcctggag

SEQ ID NO: 59078 - DNA, 28 bp, Artificial Sequence
  Description of Artificial Sequence: Synthetic oligonucleotide
ctggaacagccagaaggaagtcctggag

SEQ ID NO: 59079 - DNA, 29 bp, Artificial Sequence
  Description of Artificial Sequence: Synthetic oligonucleotide
tggaacagccagaaggaagtcctggagag

SEQ ID NO: 59080 - DNA, 28 bp, Artificial Sequence
  Description of Artificial Sequence: Synthetic oligonucleotide
ggaacagccagaaggaagtcctggagag

SEQ ID NO: 59081 - DNA, 28 bp, Artificial Sequence
  Description of Artificial Sequence: Synthetic oligonucleotide
gaacagccagaaggaagtcctggagagg

SEQ ID NO: 59082 - DNA, 29 bp, Artificial Sequence
  Description of Artificial Sequence: Synthetic oligonucleotide
aacagccagaaggaagtcctggagaggac

SEQ ID NO: 59083 - DNA, 28 bp, Artificial Sequence
  Description of Artificial Sequence: Synthetic oligonucleotide
acagccagaaggaagtcctggagaggac

SEQ ID NO: 59084 - DNA, 27 bp, Artificial Sequence
  Description of Artificial Sequence: Synthetic oligonucleotide
cagccagaaggaagtcctggagaggac

SEQ ID NO: 59085 - DNA, 27 bp, Artificial Sequence
  Description of Artificial Sequence: Synthetic oligonucleotide
agccagaaggaagtcctggagaggacc

SEQ ID NO: 59086 - DNA, 26 bp, Artificial Sequence
  Description of Artificial Sequence: Synthetic oligonucleotide
gccagaaggaagtcctggagaggacc

SEQ ID NO: 59087 - DNA, 26 bp, Artificial Sequence
  Description of Artificial Sequence: Synthetic oligonucleotide
ccagaaggaagtcctggagaggaccc

SEQ ID NO: 59088 - DNA, 26 bp, Artificial Sequence
  Description of Artificial Sequence: Synthetic oligonucleotide
cagaaggaagtcctggagaggacccg

SEQ ID NO: 59089 - DNA, 26 bp, Artificial Sequence
  Description of Artificial Sequence: Synthetic oligonucleotide
agaaggaagtcctggagaggacccgg

SEQ ID NO: 59090 - DNA, 25 bp, Artificial Sequence
  Description of Artificial Sequence: Synthetic oligonucleotide
gaaggaagtcctggagaggacccgg

SEQ ID NO: 59091 - DNA, 25 bp, Artificial Sequence
  Description of Artificial Sequence: Synthetic oligonucleotide
aaggaagtcctggagaggacccggg

SEQ ID NO: 59092 - DNA, 24 bp, Artificial Sequence
  Description of Artificial Sequence: Synthetic oligonucleotide
aggaagtcctggagaggacccggg

SEQ ID NO: 59093 - DNA, 23 bp, Artificial Sequence
  Description of Artificial Sequence: Synthetic oligonucleotide
ggaagtcctggagaggacccggg

SEQ ID NO: 59094 - DNA, 23 bp, Artificial Sequence
  Description of Artificial Sequence: Synthetic oligonucleotide
gaagtcctggagaggacccgggc

SEQ ID NO: 59095 - DNA, 23 bp, Artificial Sequence
  Description of Artificial Sequence: Synthetic oligonucleotide
aagtcctggagaggacccgggcg

SEQ ID NO: 59096 - DNA, 22 bp, Artificial Sequence
  Description of Artificial Sequence: Synthetic oligonucleotide
agtcctggagaggacccgggcg

SEQ ID NO: 59097 - DNA, 21 bp, Artificial Sequence
  Description of Artificial Sequence: Synthetic oligonucleotide
gtcctggagaggacccgggcg

SEQ ID NO: 59098 - DNA, 22 bp, Artificial Sequence
  Description of Artificial Sequence: Synthetic oligonucleotide
tcctggagaggacccgggcgga

SEQ ID NO: 59099 - DNA, 21 bp, Artificial Sequence
  Description of Artificial Sequence: Synthetic oligonucleotide
cctggagaggacccgggcgga

SEQ ID NO: 59100 - DNA, 23 bp, Artificial Sequence
  Description of Artificial Sequence: Synthetic oligonucleotide
ctggagaggacccgggcggagtt

SEQ ID NO: 59101 - DNA, 23 bp, Artificial Sequence
  Description of Artificial Sequence: Synthetic oligonucleotide
tggagaggacccgggcggagttg

SEQ ID NO: 59102 - DNA, 22 bp, Artificial Sequence
  Description of Artificial Sequence: Synthetic oligonucleotide
ggagaggacccgggcggagttg

SEQ ID NO: 59103 - DNA, 23 bp, Artificial Sequence
  Description of Artificial Sequence: Synthetic oligonucleotide
gagaggacccgggcggagttgga

SEQ ID NO: 59104 - DNA, 24 bp, Artificial Sequence
  Description of Artificial Sequence: Synthetic oligonucleotide
agaggacccgggcggagttggaca

SEQ ID NO: 59105 - DNA, 23 bp, Artificial Sequence
  Description of Artificial Sequence: Synthetic oligonucleotide
gaggacccgggcggagttggaca

SEQ ID NO: 59106 - DNA, 23 bp, Artificial Sequence
  Description of Artificial Sequence: Synthetic oligonucleotide
aggacccgggcggagttggacac

SEQ ID NO: 59107 - DNA, 22 bp, Artificial Sequence
  Description of Artificial Sequence: Synthetic oligonucleotide
ggacccgggcggagttggacac

SEQ ID NO: 59108 - DNA, 22 bp, Artificial Sequence
  Description of Artificial Sequence: Synthetic oligonucleotide
gacccgggcggagttggacacg

SEQ ID NO: 59109 - DNA, 23 bp, Artificial Sequence
  Description of Artificial Sequence: Synthetic oligonucleotide
acccgggcggagttggacacggt

SEQ ID NO: 59110 - DNA, 22 bp, Artificial Sequence
  Description of Artificial Sequence: Synthetic oligonucleotide
cccgggcggagttggacacggt

SEQ ID NO: 59111 - DNA, 23 bp, Artificial Sequence
  Description of Artificial Sequence: Synthetic oligonucleotide
ccgggcggagttggacacggtgt

SEQ ID NO: 59112 - DNA, 23 bp, Artificial Sequence
  Description of Artificial Sequence: Synthetic oligonucleotide
cgggcggagttggacacggtgtg

SEQ ID NO: 59113 - DNA, 24 bp, Artificial Sequence
  Description of Artificial Sequence: Synthetic oligonucleotide
gggcggagttggacacggtgtgca

SEQ ID NO: 59114 - DNA, 25 bp, Artificial Sequence
  Description of Artificial Sequence: Synthetic oligonucleotide
ggcggagttggacacggtgtgcaga

SEQ ID NO: 59115 - DNA, 26 bp, Artificial Sequence
  Description of Artificial Sequence: Synthetic oligonucleotide
gcggagttggacacggtgtgcagaca

SEQ ID NO: 59116 - DNA, 27 bp, Artificial Sequence
  Description of Artificial Sequence: Synthetic oligonucleotide
cggagttggacacggtgtgcagacaca

SEQ ID NO: 59117 - DNA, 28 bp, Artificial Sequence
  Description of Artificial Sequence: Synthetic oligonucleotide
ggagttggacacggtgtgcagacacaac

SEQ ID NO: 59118 - DNA, 30 bp, Artificial Sequence
  Description of Artificial Sequence: Synthetic oligonucleotide
gagttggacacggtgtgcagacacaactac

SEQ ID NO: 59119 - DNA, 30 bp, Artificial Sequence
  Description of Artificial Sequence: Synthetic oligonucleotide
agttggacacggtgtgcagacacaactacc

SEQ ID NO: 59120 - DNA, 29 bp, Artificial Sequence
  Description of Artificial Sequence: Synthetic oligonucleotide
gttggacacggtgtgcagacacaactacc

SEQ ID NO: 59121 - DNA, 30 bp, Artificial Sequence
  Description of Artificial Sequence: Synthetic oligonucleotide
ttggacacggtgtgcagacacaactaccag

SEQ ID NO: 59122 - DNA, 28 bp, Artificial Sequence
  Description of Artificial Sequence: Synthetic oligonucleotide
aaccaccacaacctgctggtctgctcag

SEQ ID NO: 59123 - DNA, 27 bp, Artificial Sequence
  Description of Artificial Sequence: Synthetic oligonucleotide
accaccacaacctgctggtctgctcag

SEQ ID NO: 59124 - DNA, 27 bp, Artificial Sequence
  Description of Artificial Sequence: Synthetic oligonucleotide
ccaccacaacctgctggtctgctcagt

SEQ ID NO: 59125 - DNA, 27 bp, Artificial Sequence
  Description of Artificial Sequence: Synthetic oligonucleotide
caccacaacctgctggtctgctcagtg

SEQ ID NO: 59126 - DNA, 28 bp, Artificial Sequence
  Description of Artificial Sequence: Synthetic oligonucleotide
accacaacctgctggtctgctcagtgac

SEQ ID NO: 59127 - DNA, 27 bp, Artificial Sequence
  Description of Artificial Sequence: Synthetic oligonucleotide
ccacaacctgctggtctgctcagtgac

SEQ ID NO: 59128 - DNA, 28 bp, Artificial Sequence
  Description of Artificial Sequence: Synthetic oligonucleotide
cacaacctgctggtctgctcagtgacag

SEQ ID NO: 59129 - DNA, 32 bp, Artificial Sequence
  Description of Artificial Sequence: Synthetic oligonucleotide
acaacctgctggtctgctcagtgacagatttc

SEQ ID NO: 59130 - DNA, 31 bp, Artificial Sequence
  Description of Artificial Sequence: Synthetic oligonucleotide
caacctgctggtctgctcagtgacagatttc

SEQ ID NO: 59131 - DNA, 34 bp, Artificial Sequence
  Description of Artificial Sequence: Synthetic oligonucleotide
aacctgctggtctgctcagtgacagatttctatc

SEQ ID NO: 59132 - DNA, 33 bp, Artificial Sequence
  Description of Artificial Sequence: Synthetic oligonucleotide
acctgctggtctgctcagtgacagatttctatc

SEQ ID NO: 59133 - DNA, 32 bp, Artificial Sequence
  Description of Artificial Sequence: Synthetic oligonucleotide
cctgctggtctgctcagtgacagatttctatc

SEQ ID NO: 59134 - DNA, 32 bp, Artificial Sequence
  Description of Artificial Sequence: Synthetic oligonucleotide
ctgctggtctgctcagtgacagatttctatcc

SEQ ID NO: 59135 - DNA, 33 bp, Artificial Sequence
  Description of Artificial Sequence: Synthetic oligonucleotide
tgctggtctgctcagtgacagatttctatccag

SEQ ID NO: 59136 - DNA, 32 bp, Artificial Sequence
  Description of Artificial Sequence: Synthetic oligonucleotide
gctggtctgctcagtgacagatttctatccag

SEQ ID NO: 59137 - DNA, 32 bp, Artificial Sequence
  Description of Artificial Sequence: Synthetic oligonucleotide
ctggtctgctcagtgacagatttctatccagc

SEQ ID NO: 59138 - DNA, 32 bp, Artificial Sequence
  Description of Artificial Sequence: Synthetic oligonucleotide
tggtctgctcagtgacagatttctatccagcc

SEQ ID NO: 59139 - DNA, 31 bp, Artificial Sequence
  Description of Artificial Sequence: Synthetic oligonucleotide
ggtctgctcagtgacagatttctatccagcc

SEQ ID NO: 59140 - DNA, 31 bp, Artificial Sequence
  Description of Artificial Sequence: Synthetic oligonucleotide
gtctgctcagtgacagatttctatccagccc

SEQ ID NO: 59141 - DNA, 32 bp, Artificial Sequence
  Description of Artificial Sequence: Synthetic oligonucleotide
tctgctcagtgacagatttctatccagcccag

SEQ ID NO: 59142 - DNA, 31 bp, Artificial Sequence
  Description of Artificial Sequence: Synthetic oligonucleotide
ctgctcagtgacagatttctatccagcccag

SEQ ID NO: 59143 - DNA, 33 bp, Artificial Sequence
  Description of Artificial Sequence: Synthetic oligonucleotide
tgctcagtgacagatttctatccagcccagatc

SEQ ID NO: 59144 - DNA, 32 bp, Artificial Sequence
  Description of Artificial Sequence: Synthetic oligonucleotide
gctcagtgacagatttctatccagcccagatc

SEQ ID NO: 59145 - DNA, 35 bp, Artificial Sequence
  Description of Artificial Sequence: Synthetic oligonucleotide
ctcagtgacagatttctatccagcccagatcaaag

SEQ ID NO: 59146 - DNA, 36 bp, Artificial Sequence
  Description of Artificial Sequence: Synthetic oligonucleotide
tcagtgacagatttctatccagcccagatcaaagtc

SEQ ID NO: 59147 - DNA, 35 bp, Artificial Sequence
  Description of Artificial Sequence: Synthetic oligonucleotide
cagtgacagatttctatccagcccagatcaaagtc

SEQ ID NO: 59148 - DNA, 35 bp, Artificial Sequence
  Description of Artificial Sequence: Synthetic oligonucleotide
agtgacagatttctatccagcccagatcaaagtcc

SEQ ID NO: 59149 - DNA, 30 bp, Artificial Sequence
  Description of Artificial Sequence: Synthetic oligonucleotide
gtggtttcggaatgaccaggaggagacaac

SEQ ID NO: 59150 - DNA, 30 bp, Artificial Sequence
  Description of Artificial Sequence: Synthetic oligonucleotide
tggtttcggaatgaccaggaggagacaacc

SEQ ID NO: 59151 - DNA, 29 bp, Artificial Sequence
  Description of Artificial Sequence: Synthetic oligonucleotide
ggtttcggaatgaccaggaggagacaacc

SEQ ID NO: 59152 - DNA, 29 bp, Artificial Sequence
  Description of Artificial Sequence: Synthetic oligonucleotide
gtttcggaatgaccaggaggagacaaccg

SEQ ID NO: 59153 - DNA, 29 bp, Artificial Sequence
  Description of Artificial Sequence: Synthetic oligonucleotide
tttcggaatgaccaggaggagacaaccgg

SEQ ID NO: 59154 - DNA, 28 bp, Artificial Sequence
  Description of Artificial Sequence: Synthetic oligonucleotide
ttcggaatgaccaggaggagacaaccgg

SEQ ID NO: 59155 - DNA, 27 bp, Artificial Sequence
  Description of Artificial Sequence: Synthetic oligonucleotide
tcggaatgaccaggaggagacaaccgg

SEQ ID NO: 59156 - DNA, 26 bp, Artificial Sequence
  Description of Artificial Sequence: Synthetic oligonucleotide
cggaatgaccaggaggagacaaccgg

SEQ ID NO: 59157 - DNA, 26 bp, Artificial Sequence
  Description of Artificial Sequence: Synthetic oligonucleotide
ggaatgaccaggaggagacaaccggc

SEQ ID NO: 59158 - DNA, 27 bp, Artificial Sequence
  Description of Artificial Sequence: Synthetic oligonucleotide
gaatgaccaggaggagacaaccggcgt

SEQ ID NO: 59159 - DNA, 28 bp, Artificial Sequence
  Description of Artificial Sequence: Synthetic oligonucleotide
aatgaccaggaggagacaaccggcgttg

SEQ ID NO: 59160 - DNA, 27 bp, Artificial Sequence
  Description of Artificial Sequence: Synthetic oligonucleotide
atgaccaggaggagacaaccggcgttg

SEQ ID NO: 59161 - DNA, 27 bp, Artificial Sequence
  Description of Artificial Sequence: Synthetic oligonucleotide
tgaccaggaggagacaaccggcgttgt

SEQ ID NO: 59162 - DNA, 26 bp, Artificial Sequence
  Description of Artificial Sequence: Synthetic oligonucleotide
gaccaggaggagacaaccggcgttgt

SEQ ID NO: 59163 - DNA, 27 bp, Artificial Sequence
  Description of Artificial Sequence: Synthetic oligonucleotide
accaggaggagacaaccggcgttgtgt

SEQ ID NO: 59164 - DNA, 26 bp, Artificial Sequence
  Description of Artificial Sequence: Synthetic oligonucleotide
ccaggaggagacaaccggcgttgtgt

SEQ ID NO: 59165 - DNA, 26 bp, Artificial Sequence
  Description of Artificial Sequence: Synthetic oligonucleotide
caggaggagacaaccggcgttgtgtc

SEQ ID NO: 59166 - DNA, 27 bp, Artificial Sequence
  Description of Artificial Sequence: Synthetic oligonucleotide
aggaggagacaaccggcgttgtgtcca

SEQ ID NO: 59167 - DNA, 26 bp, Artificial Sequence
  Description of Artificial Sequence: Synthetic oligonucleotide
ggaggagacaaccggcgttgtgtcca

SEQ ID NO: 59168 - DNA, 26 bp, Artificial Sequence
  Description of Artificial Sequence: Synthetic oligonucleotide
gaggagacaaccggcgttgtgtccac

SEQ ID NO: 59169 - DNA, 26 bp, Artificial Sequence
  Description of Artificial Sequence: Synthetic oligonucleotide
aggagacaaccggcgttgtgtccacc

SEQ ID NO: 59170 - DNA, 25 bp, Artificial Sequence
  Description of Artificial Sequence: Synthetic oligonucleotide
ggagacaaccggcgttgtgtccacc

SEQ ID NO: 59171 - DNA, 25 bp, Artificial Sequence
  Description of Artificial Sequence: Synthetic oligonucleotide
gagacaaccggcgttgtgtccaccc

SEQ ID NO: 59172 - DNA, 25 bp, Artificial Sequence
  Description of Artificial Sequence: Synthetic oligonucleotide
agacaaccggcgttgtgtccacccc

SEQ ID NO: 59173 - DNA, 24 bp, Artificial Sequence
  Description of Artificial Sequence: Synthetic oligonucleotide
gacaaccggcgttgtgtccacccc

SEQ ID NO: 59174 - DNA, 24 bp, Artificial Sequence
  Description of Artificial Sequence: Synthetic oligonucleotide
acaaccggcgttgtgtccaccccc

SEQ ID NO: 59175 - DNA, 23 bp, Artificial Sequence
  Description of Artificial Sequence: Synthetic oligonucleotide
caaccggcgttgtgtccaccccc

SEQ ID NO: 59176 - DNA, 27 bp, Artificial Sequence
  Description of Artificial Sequence: Synthetic oligonucleotide
aaccggcgttgtgtccaccccccttat

SEQ ID NO: 59177 - DNA, 27 bp, Artificial Sequence
  Description of Artificial Sequence: Synthetic oligonucleotide
accggcgttgtgtccaccccccttatt

SEQ ID NO: 59178 - DNA, 27 bp, Artificial Sequence
  Description of Artificial Sequence: Synthetic oligonucleotide
ccggcgttgtgtccaccccccttatta

SEQ ID NO: 59179 - DNA, 27 bp, Artificial Sequence
  Description of Artificial Sequence: Synthetic oligonucleotide
cggcgttgtgtccaccccccttattag

SEQ ID NO: 59180 - DNA, 29 bp, Artificial Sequence
  Description of Artificial Sequence: Synthetic oligonucleotide
gcgttgtgtccaccccccttattaggaac

SEQ ID NO: 59181 - DNA, 29 bp, Artificial Sequence
  Description of Artificial Sequence: Synthetic oligonucleotide
cgttgtgtccaccccccttattaggaacg

SEQ ID NO: 59182 - DNA, 29 bp, Artificial Sequence
  Description of Artificial Sequence: Synthetic oligonucleotide
gttgtgtccaccccccttattaggaacgg

SEQ ID NO: 59183 - DNA, 30 bp, Artificial Sequence
  Description of Artificial Sequence: Synthetic oligonucleotide
ttgtgtccaccccccttattaggaacggtg

SEQ ID NO: 59184 - DNA, 29 bp, Artificial Sequence
  Description of Artificial Sequence: Synthetic oligonucleotide
tgtgtccaccccccttattaggaacggtg

SEQ ID NO: 59185 - DNA, 28 bp, Artificial Sequence
  Description of Artificial Sequence: Synthetic oligonucleotide
gtgtccaccccccttattaggaacggtg

SEQ ID NO: 59186 - DNA, 29 bp, Artificial Sequence
  Description of Artificial Sequence: Synthetic oligonucleotide
tgtccaccccccttattaggaacggtgac

SEQ ID NO: 59187 - DNA, 28 bp, Artificial Sequence
  Description of Artificial Sequence: Synthetic oligonucleotide
gtccaccccccttattaggaacggtgac

SEQ ID NO: 59188 - DNA, 29 bp, Artificial Sequence
  Description of Artificial Sequence: Synthetic oligonucleotide
tccaccccccttattaggaacggtgactg

SEQ ID NO: 59189 - DNA, 28 bp, Artificial Sequence
  Description of Artificial Sequence: Synthetic oligonucleotide
ccaccccccttattaggaacggtgactg

SEQ ID NO: 59190 - DNA, 28 bp, Artificial Sequence
  Description of Artificial Sequence: Synthetic oligonucleotide
caccccccttattaggaacggtgactgg

SEQ ID NO: 59191 - DNA, 29 bp, Artificial Sequence
  Description of Artificial Sequence: Synthetic oligonucleotide
accccccttattaggaacggtgactggac

SEQ ID NO: 59192 - DNA, 28 bp, Artificial Sequence
  Description of Artificial Sequence: Synthetic oligonucleotide
ccccccttattaggaacggtgactggac

SEQ ID NO: 59193 - DNA, 28 bp, Artificial Sequence
  Description of Artificial Sequence: Synthetic oligonucleotide
cccccttattaggaacggtgactggacc

SEQ ID NO: 59194 - DNA, 30 bp, Artificial Sequence
  Description of Artificial Sequence: Synthetic oligonucleotide
ccccttattaggaacggtgactggaccttc

SEQ ID NO: 59195 - DNA, 30 bp, Artificial Sequence
  Description of Artificial Sequence: Synthetic oligonucleotide
cccttattaggaacggtgactggaccttcc

SEQ ID NO: 59196 - DNA, 31 bp, Artificial Sequence
  Description of Artificial Sequence: Synthetic oligonucleotide
ccttattaggaacggtgactggaccttccag

SEQ ID NO: 59197 - DNA, 33 bp, Artificial Sequence
  Description of Artificial Sequence: Synthetic oligonucleotide
cttattaggaacggtgactggaccttccagatc

SEQ ID NO: 59198 - DNA, 33 bp, Artificial Sequence
  Description of Artificial Sequence: Synthetic oligonucleotide
ttattaggaacggtgactggaccttccagatcc

SEQ ID NO: 59199 - DNA, 32 bp, Artificial Sequence
  Description of Artificial Sequence: Synthetic oligonucleotide
tattaggaacggtgactggaccttccagatcc

SEQ ID NO: 59200 - DNA, 31 bp, Artificial Sequence
  Description of Artificial Sequence: Synthetic oligonucleotide
attaggaacggtgactggaccttccagatcc

SEQ ID NO: 59201 - DNA, 30 bp, Artificial Sequence
  Description of Artificial Sequence: Synthetic oligonucleotide
ttaggaacggtgactggaccttccagatcc

SEQ ID NO: 59202 - DNA, 29 bp, Artificial Sequence
  Description of Artificial Sequence: Synthetic oligonucleotide
taggaacggtgactggaccttccagatcc

SEQ ID NO: 59203 - DNA, 28 bp, Artificial Sequence
  Description of Artificial Sequence: Synthetic oligonucleotide
aggaacggtgactggaccttccagatcc

SEQ ID NO: 59204 - DNA, 27 bp, Artificial Sequence
  Description of Artificial Sequence: Synthetic oligonucleotide
ggaacggtgactggaccttccagatcc

SEQ ID NO: 59205 - DNA, 28 bp, Artificial Sequence
  Description of Artificial Sequence: Synthetic oligonucleotide
gaacggtgactggaccttccagatcctg

SEQ ID NO: 59206 - DNA, 28 bp, Artificial Sequence
  Description of Artificial Sequence: Synthetic oligonucleotide
aacggtgactggaccttccagatcctgg

SEQ ID NO: 59207 - DNA, 27 bp, Artificial Sequence
  Description of Artificial Sequence: Synthetic oligonucleotide
acggtgactggaccttccagatcctgg

SEQ ID NO: 59208 - DNA, 27 bp, Artificial Sequence
  Description of Artificial Sequence: Synthetic oligonucleotide
cggtgactggaccttccagatcctggt

SEQ ID NO: 59209 - DNA, 30 bp, Artificial Sequence
  Description of Artificial Sequence: Synthetic oligonucleotide
tggtgatgctggaaatgactccccagcatg

SEQ ID NO: 59210 - DNA, 29 bp, Artificial Sequence
  Description of Artificial Sequence: Synthetic oligonucleotide
ggtgatgctggaaatgactccccagcatg

SEQ ID NO: 59211 - DNA, 29 bp, Artificial Sequence
  Description of Artificial Sequence: Synthetic oligonucleotide
gtgatgctggaaatgactccccagcatgg

SEQ ID NO: 59212 - DNA, 30 bp, Artificial Sequence
  Description of Artificial Sequence: Synthetic oligonucleotide
tgatgctggaaatgactccccagcatggag

SEQ ID NO: 59213 - DNA, 29 bp, Artificial Sequence
  Description of Artificial Sequence: Synthetic oligonucleotide
gatgctggaaatgactccccagcatggag

SEQ ID NO: 59214 - DNA, 30 bp, Artificial Sequence
  Description of Artificial Sequence: Synthetic oligonucleotide
atgctggaaatgactccccagcatggagac

SEQ ID NO: 59215 - DNA, 29 bp, Artificial Sequence
  Description of Artificial Sequence: Synthetic oligonucleotide
tgctggaaatgactccccagcatggagac

SEQ ID NO: 59216 - DNA, 28 bp, Artificial Sequence
  Description of Artificial Sequence: Synthetic oligonucleotide
gctggaaatgactccccagcatggagac

SEQ ID NO: 59217 - DNA, 28 bp, Artificial Sequence
  Description of Artificial Sequence: Synthetic oligonucleotide
ctggaaatgactccccagcatggagacg

SEQ ID NO: 59218 - DNA, 29 bp, Artificial Sequence
  Description of Artificial Sequence: Synthetic oligonucleotide
tggaaatgactccccagcatggagacgtc

SEQ ID NO: 59219 - DNA, 28 bp, Artificial Sequence
  Description of Artificial Sequence: Synthetic oligonucleotide
ggaaatgactccccagcatggagacgtc

SEQ ID NO: 59220 - DNA, 30 bp, Artificial Sequence
  Description of Artificial Sequence: Synthetic oligonucleotide
gaaatgactccccagcatggagacgtctac

SEQ ID NO: 59221 - DNA, 31 bp, Artificial Sequence
  Description of Artificial Sequence: Synthetic oligonucleotide
aaatgactccccagcatggagacgtctacac

SEQ ID NO: 59222 - DNA, 30 bp, Artificial Sequence
  Description of Artificial Sequence: Synthetic oligonucleotide
aatgactccccagcatggagacgtctacac

SEQ ID NO: 59223 - DNA, 29 bp, Artificial Sequence
  Description of Artificial Sequence: Synthetic oligonucleotide
atgactccccagcatggagacgtctacac

SEQ ID NO: 59224 - DNA, 28 bp, Artificial Sequence
  Description of Artificial Sequence: Synthetic oligonucleotide
tgactccccagcatggagacgtctacac

SEQ ID NO: 59225 - DNA, 27 bp, Artificial Sequence
  Description of Artificial Sequence: Synthetic oligonucleotide
gactccccagcatggagacgtctacac

SEQ ID NO: 59226 - DNA, 27 bp, Artificial Sequence
  Description of Artificial Sequence: Synthetic oligonucleotide
actccccagcatggagacgtctacacc

SEQ ID NO: 59227 - DNA, 27 bp, Artificial Sequence
  Description of Artificial Sequence: Synthetic oligonucleotide
ctccccagcatggagacgtctacacct

SEQ ID NO: 59228 - DNA, 27 bp, Artificial Sequence
  Description of Artificial Sequence: Synthetic oligonucleotide
tccccagcatggagacgtctacacctg

SEQ ID NO: 59229 - DNA, 26 bp, Artificial Sequence
  Description of Artificial Sequence: Synthetic oligonucleotide
ccccagcatggagacgtctacacctg

SEQ ID NO: 59230 - DNA, 26 bp, Artificial Sequence
  Description of Artificial Sequence: Synthetic oligonucleotide
cccagcatggagacgtctacacctgc

SEQ ID NO: 59231 - DNA, 27 bp, Artificial Sequence
  Description of Artificial Sequence: Synthetic oligonucleotide
ccagcatggagacgtctacacctgcca

SEQ ID NO: 59232 - DNA, 27 bp, Artificial Sequence
  Description of Artificial Sequence: Synthetic oligonucleotide
cagcatggagacgtctacacctgccac

SEQ ID NO: 59233 - DNA, 27 bp, Artificial Sequence
  Description of Artificial Sequence: Synthetic oligonucleotide
agcatggagacgtctacacctgccacg

SEQ ID NO: 59234 - DNA, 27 bp, Artificial Sequence
  Description of Artificial Sequence: Synthetic oligonucleotide
gcatggagacgtctacacctgccacgt

SEQ ID NO: 59235 - DNA, 27 bp, Artificial Sequence
  Description of Artificial Sequence: Synthetic oligonucleotide
catggagacgtctacacctgccacgtg

SEQ ID NO: 59236 - DNA, 27 bp, Artificial Sequence
  Description of Artificial Sequence: Synthetic oligonucleotide
atggagacgtctacacctgccacgtgg

SEQ ID NO: 59237 - DNA, 25 bp, Artificial Sequence
  Description of Artificial Sequence: Synthetic oligonucleotide
acgtggagcaccccagcctccagaa

SEQ ID NO: 59238 - DNA, 24 bp, Artificial Sequence
  Description of Artificial Sequence: Synthetic oligonucleotide
cgtggagcaccccagcctccagaa

SEQ ID NO: 59239 - DNA, 24 bp, Artificial Sequence
  Description of Artificial Sequence: Synthetic oligonucleotide
gtggagcaccccagcctccagaac

SEQ ID NO: 59240 - DNA, 24 bp, Artificial Sequence
  Description of Artificial Sequence: Synthetic oligonucleotide
tggagcaccccagcctccagaacc

SEQ ID NO: 59241 - DNA, 23 bp, Artificial Sequence
  Description of Artificial Sequence: Synthetic oligonucleotide
ggagcaccccagcctccagaacc

SEQ ID NO: 59242 - DNA, 23 bp, Artificial Sequence
  Description of Artificial Sequence: Synthetic oligonucleotide
gagcaccccagcctccagaaccc

SEQ ID NO: 59243 - DNA, 25 bp, Artificial Sequence
  Description of Artificial Sequence: Synthetic oligonucleotide
agcaccccagcctccagaaccccat

SEQ ID NO: 59244 - DNA, 24 bp, Artificial Sequence
  Description of Artificial Sequence: Synthetic oligonucleotide
gcaccccagcctccagaaccccat

SEQ ID NO: 59245 - DNA, 25 bp, Artificial Sequence
  Description of Artificial Sequence: Synthetic oligonucleotide
caccccagcctccagaaccccatca

SEQ ID NO: 59246 - DNA, 25 bp, Artificial Sequence
  Description of Artificial Sequence: Synthetic oligonucleotide
accccagcctccagaaccccatcac

SEQ ID NO: 59247 - DNA, 24 bp, Artificial Sequence
  Description of Artificial Sequence: Synthetic oligonucleotide
ccccagcctccagaaccccatcac

SEQ ID NO: 59248 - DNA, 24 bp, Artificial Sequence
  Description of Artificial Sequence: Synthetic oligonucleotide
cccagcctccagaaccccatcacc

SEQ ID NO: 59249 - DNA, 25 bp, Artificial Sequence
  Description of Artificial Sequence: Synthetic oligonucleotide
ccagcctccagaaccccatcaccgt

SEQ ID NO: 59250 - DNA, 25 bp, Artificial Sequence
  Description of Artificial Sequence: Synthetic oligonucleotide
cagcctccagaaccccatcaccgtg

SEQ ID NO: 59251 - DNA, 26 bp, Artificial Sequence
  Description of Artificial Sequence: Synthetic oligonucleotide
agcctccagaaccccatcaccgtgga

SEQ ID NO: 59252 - DNA, 25 bp, Artificial Sequence
  Description of Artificial Sequence: Synthetic oligonucleotide
gcctccagaaccccatcaccgtgga

SEQ ID NO: 59253 - DNA, 26 bp, Artificial Sequence
  Description of Artificial Sequence: Synthetic oligonucleotide
cctccagaaccccatcaccgtggagt

SEQ ID NO: 59254 - DNA, 26 bp, Artificial Sequence
  Description of Artificial Sequence: Synthetic oligonucleotide
ctccagaaccccatcaccgtggagtg

SEQ ID NO: 59255 - DNA, 26 bp, Artificial Sequence
  Description of Artificial Sequence: Synthetic oligonucleotide
tccagaaccccatcaccgtggagtgg

SEQ ID NO: 59256 - DNA, 25 bp, Artificial Sequence
  Description of Artificial Sequence: Synthetic oligonucleotide
ccagaaccccatcaccgtggagtgg

SEQ ID NO: 59257 - DNA, 25 bp, Artificial Sequence
  Description of Artificial Sequence: Synthetic oligonucleotide
cagaaccccatcaccgtggagtggc

SEQ ID NO: 59258 - DNA, 25 bp, Artificial Sequence
  Description of Artificial Sequence: Synthetic oligonucleotide
agaaccccatcaccgtggagtggcg

SEQ ID NO: 59259 - DNA, 24 bp, Artificial Sequence
  Description of Artificial Sequence: Synthetic oligonucleotide
gaaccccatcaccgtggagtggcg

SEQ ID NO: 59260 - DNA, 24 bp, Artificial Sequence
  Description of Artificial Sequence: Synthetic oligonucleotide
aaccccatcaccgtggagtggcgg

SEQ ID NO: 59261 - DNA, 23 bp, Artificial Sequence
  Description of Artificial Sequence: Synthetic oligonucleotide
accccatcaccgtggagtggcgg

SEQ ID NO: 59262 - DNA, 24 bp, Artificial Sequence
  Description of Artificial Sequence: Synthetic oligonucleotide
catcaccgtggagtggcgggctca

SEQ ID NO: 59263 - DNA, 25 bp, Artificial Sequence
  Description of Artificial Sequence: Synthetic oligonucleotide
atcaccgtggagtggcgggctcagt

SEQ ID NO: 59264 - DNA, 24 bp, Artificial Sequence
  Description of Artificial Sequence: Synthetic oligonucleotide
tcaccgtggagtggcgggctcagt

SEQ ID NO: 59265 - DNA, 23 bp, Artificial Sequence
  Description of Artificial Sequence: Synthetic oligonucleotide
caccgtggagtggcgggctcagt

SEQ ID NO: 59266 - DNA, 24 bp, Artificial Sequence
  Description of Artificial Sequence: Synthetic oligonucleotide
accgtggagtggcgggctcagtct

SEQ ID NO: 59267 - DNA, 23 bp, Artificial Sequence
  Description of Artificial Sequence: Synthetic oligonucleotide
ccgtggagtggcgggctcagtct

SEQ ID NO: 59268 - DNA, 26 bp, Artificial Sequence
  Description of Artificial Sequence: Synthetic oligonucleotide
cgtggagtggcgggctcagtctgaat

SEQ ID NO: 59269 - DNA, 27 bp, Artificial Sequence
  Description of Artificial Sequence: Synthetic oligonucleotide
gtggagtggcgggctcagtctgaatct

SEQ ID NO: 59270 - DNA, 27 bp, Artificial Sequence
  Description of Artificial Sequence: Synthetic oligonucleotide
tggagtggcgggctcagtctgaatctg

SEQ ID NO: 59271 - DNA, 26 bp, Artificial Sequence
  Description of Artificial Sequence: Synthetic oligonucleotide
ggagtggcgggctcagtctgaatctg

SEQ ID NO: 59272 - DNA, 26 bp, Artificial Sequence
  Description of Artificial Sequence: Synthetic oligonucleotide
gagtggcgggctcagtctgaatctgc

SEQ ID NO: 59273 - DNA, 26 bp, Artificial Sequence
  Description of Artificial Sequence: Synthetic oligonucleotide
agtggcgggctcagtctgaatctgcc

SEQ ID NO: 59274 - DNA, 25 bp, Artificial Sequence
  Description of Artificial Sequence: Synthetic oligonucleotide
gtggcgggctcagtctgaatctgcc

SEQ ID NO: 59275 - DNA, 26 bp, Artificial Sequence
  Description of Artificial Sequence: Synthetic oligonucleotide
tggcgggctcagtctgaatctgccca

SEQ ID NO: 59276 - DNA, 25 bp, Artificial Sequence
  Description of Artificial Sequence: Synthetic oligonucleotide
ggcgggctcagtctgaatctgccca

SEQ ID NO: 59277 - DNA, 26 bp, Artificial Sequence
  Description of Artificial Sequence: Synthetic oligonucleotide
gcgggctcagtctgaatctgcccaga

SEQ ID NO: 59278 - DNA, 26 bp, Artificial Sequence
  Description of Artificial Sequence: Synthetic oligonucleotide
cgggctcagtctgaatctgcccagag

SEQ ID NO: 59279 - DNA, 27 bp, Artificial Sequence
  Description of Artificial Sequence: Synthetic oligonucleotide
gggctcagtctgaatctgcccagagca

SEQ ID NO: 59280 - DNA, 28 bp, Artificial Sequence
  Description of Artificial Sequence: Synthetic oligonucleotide
ggctcagtctgaatctgcccagagcaag

SEQ ID NO: 59281 - DNA, 30 bp, Artificial Sequence
  Description of Artificial Sequence: Synthetic oligonucleotide
gctcagtctgaatctgcccagagcaagatg

SEQ ID NO: 59282 - DNA, 30 bp, Artificial Sequence
  Description of Artificial Sequence: Synthetic oligonucleotide
ctcagtctgaatctgcccagagcaagatgc

SEQ ID NO: 59283 - DNA, 31 bp, Artificial Sequence
  Description of Artificial Sequence: Synthetic oligonucleotide
tcagtctgaatctgcccagagcaagatgctg

SEQ ID NO: 59284 - DNA, 30 bp, Artificial Sequence
  Description of Artificial Sequence: Synthetic oligonucleotide
cagtctgaatctgcccagagcaagatgctg

SEQ ID NO: 59285 - DNA, 31 bp, Artificial Sequence
  Description of Artificial Sequence: Synthetic oligonucleotide
agtctgaatctgcccagagcaagatgctgag

SEQ ID NO: 59286 - DNA, 30 bp, Artificial Sequence
  Description of Artificial Sequence: Synthetic oligonucleotide
gtctgaatctgcccagagcaagatgctgag

SEQ ID NO: 59287 - DNA, 27 bp, Artificial Sequence
  Description of Artificial Sequence: Synthetic oligonucleotide
cattggaggcttcgtgctggggctcat

SEQ ID NO: 59288 - DNA, 27 bp, Artificial Sequence
  Description of Artificial Sequence: Synthetic oligonucleotide
attggaggcttcgtgctggggctcatc

SEQ ID NO: 59289 - DNA, 27 bp, Artificial Sequence
  Description of Artificial Sequence: Synthetic oligonucleotide
ttggaggcttcgtgctggggctcatct

SEQ ID NO: 59290 - DNA, 27 bp, Artificial Sequence
  Description of Artificial Sequence: Synthetic oligonucleotide
tggaggcttcgtgctggggctcatctt

SEQ ID NO: 59291 - DNA, 26 bp, Artificial Sequence
  Description of Artificial Sequence: Synthetic oligonucleotide
ggaggcttcgtgctggggctcatctt

SEQ ID NO: 59292 - DNA, 26 bp, Artificial Sequence
  Description of Artificial Sequence: Synthetic oligonucleotide
gaggcttcgtgctggggctcatcttc

SEQ ID NO: 59293 - DNA, 27 bp, Artificial Sequence
  Description of Artificial Sequence: Synthetic oligonucleotide
aggcttcgtgctggggctcatcttcct

SEQ ID NO: 59294 - DNA, 26 bp, Artificial Sequence
  Description of Artificial Sequence: Synthetic oligonucleotide
ggcttcgtgctggggctcatcttcct

SEQ ID NO: 59295 - DNA, 26 bp, Artificial Sequence
  Description of Artificial Sequence: Synthetic oligonucleotide
gcttcgtgctggggctcatcttcctc

SEQ ID NO: 59296 - DNA, 26 bp, Artificial Sequence
  Description of Artificial Sequence: Synthetic oligonucleotide
cttcgtgctggggctcatcttcctcg

SEQ ID NO: 59297 - DNA, 26 bp, Artificial Sequence
  Description of Artificial Sequence: Synthetic oligonucleotide
ttcgtgctggggctcatcttcctcgg

SEQ ID NO: 59298 - DNA, 25 bp, Artificial Sequence
  Description of Artificial Sequence: Synthetic oligonucleotide
tcgtgctggggctcatcttcctcgg

SEQ ID NO: 59299 - DNA, 24 bp, Artificial Sequence
  Description of Artificial Sequence: Synthetic oligonucleotide
cgtgctggggctcatcttcctcgg

SEQ ID NO: 59300 - DNA, 24 bp, Artificial Sequence
  Description of Artificial Sequence: Synthetic oligonucleotide
gtgctggggctcatcttcctcggg

SEQ ID NO: 59301 - DNA, 25 bp, Artificial Sequence
  Description of Artificial Sequence: Synthetic oligonucleotide
tgctggggctcatcttcctcgggct

SEQ ID NO: 59302 - DNA, 24 bp, Artificial Sequence
  Description of Artificial Sequence: Synthetic oligonucleotide
gctggggctcatcttcctcgggct

SEQ ID NO: 59303 - DNA, 24 bp, Artificial Sequence
  Description of Artificial Sequence: Synthetic oligonucleotide
ctggggctcatcttcctcgggctg

SEQ ID NO: 59304 - DNA, 24 bp, Artificial Sequence
  Description of Artificial Sequence: Synthetic oligonucleotide
tggggctcatcttcctcgggctgg

SEQ ID NO: 59305 - DNA, 23 bp, Artificial Sequence
  Description of Artificial Sequence: Synthetic oligonucleotide
ggggctcatcttcctcgggctgg

SEQ ID NO: 59306 - DNA, 23 bp, Artificial Sequence
  Description of Artificial Sequence: Synthetic oligonucleotide
gggctcatcttcctcgggctggg

SEQ ID NO: 59307 - DNA, 23 bp, Artificial Sequence
  Description of Artificial Sequence: Synthetic oligonucleotide
ggctcatcttcctcgggctgggc

SEQ ID NO: 59308 - DNA, 27 bp, Artificial Sequence
  Description of Artificial Sequence: Synthetic oligonucleotide
gctcatcttcctcgggctgggccttat

SEQ ID NO: 59309 - DNA, 30 bp, Artificial Sequence
  Description of Artificial Sequence: Synthetic oligonucleotide
ctcatcttcctcgggctgggccttattatc

SEQ ID NO: 59310 - DNA, 30 bp, Artificial Sequence
  Description of Artificial Sequence: Synthetic oligonucleotide
tcatcttcctcgggctgggccttattatcc

SEQ ID NO: 59311 - DNA, 29 bp, Artificial Sequence
  Description of Artificial Sequence: Synthetic oligonucleotide
catcttcctcgggctgggccttattatcc

SEQ ID NO: 59312 - DNA, 31 bp, Artificial Sequence
  Description of Artificial Sequence: Synthetic oligonucleotide
atcttcctcgggctgggccttattatccatc

SEQ ID NO: 59313 - DNA, 30 bp, Artificial Sequence
  Description of Artificial Sequence: Synthetic oligonucleotide
tcttcctcgggctgggccttattatccatc

SEQ ID NO: 59314 - DNA, 29 bp, Artificial Sequence
  Description of Artificial Sequence: Synthetic oligonucleotide
cttcctcgggctgggccttattatccatc

SEQ ID NO: 59315 - DNA, 30 bp, Artificial Sequence
  Description of Artificial Sequence: Synthetic oligonucleotide
ttcctcgggctgggccttattatccatcac

SEQ ID NO: 59316 - DNA, 29 bp, Artificial Sequence
  Description of Artificial Sequence: Synthetic oligonucleotide
tcctcgggctgggccttattatccatcac

SEQ ID NO: 59317 - DNA, 28 bp, Artificial Sequence
  Description of Artificial Sequence: Synthetic oligonucleotide
cctcgggctgggccttattatccatcac

SEQ ID NO: 59318 - DNA, 29 bp, Artificial Sequence
  Description of Artificial Sequence: Synthetic oligonucleotide
ctcgggctgggccttattatccatcacag

SEQ ID NO: 59319 - DNA, 29 bp, Artificial Sequence
  Description of Artificial Sequence: Synthetic oligonucleotide
tcgggctgggccttattatccatcacagg

SEQ ID NO: 59320 - DNA, 28 bp, Artificial Sequence
  Description of Artificial Sequence: Synthetic oligonucleotide
cgggctgggccttattatccatcacagg

SEQ ID NO: 59321 - DNA, 29 bp, Artificial Sequence
  Description of Artificial Sequence: Synthetic oligonucleotide
gggctgggccttattatccatcacaggag

SEQ ID NO: 59322 - DNA, 30 bp, Artificial Sequence
  Description of Artificial Sequence: Synthetic oligonucleotide
ggctgggccttattatccatcacaggagtc

SEQ ID NO: 59323 - DNA, 31 bp, Artificial Sequence
  Description of Artificial Sequence: Synthetic oligonucleotide
gctgggccttattatccatcacaggagtcag

SEQ ID NO: 59324 - DNA, 34 bp, Artificial Sequence
  Description of Artificial Sequence: Synthetic oligonucleotide
ctgggccttattatccatcacaggagtcagaaag

SEQ ID NO: 59325 - DNA, 34 bp, Artificial Sequence
  Description of Artificial Sequence: Synthetic oligonucleotide
tgggccttattatccatcacaggagtcagaaagg

SEQ ID NO: 59326 - DNA, 33 bp, Artificial Sequence
  Description of Artificial Sequence: Synthetic oligonucleotide
gggccttattatccatcacaggagtcagaaagg

SEQ ID NO: 59327 - DNA, 33 bp, Artificial Sequence
  Description of Artificial Sequence: Synthetic oligonucleotide
ggccttattatccatcacaggagtcagaaaggg

SEQ ID NO: 59328 - DNA, 33 bp, Artificial Sequence
  Description of Artificial Sequence: Synthetic oligonucleotide
gccttattatccatcacaggagtcagaaagggc

SEQ ID NO: 59329 - DNA, 34 bp, Artificial Sequence
  Description of Artificial Sequence: Synthetic oligonucleotide
ccttattatccatcacaggagtcagaaagggctc

SEQ ID NO: 59330 - DNA, 34 bp, Artificial Sequence
  Description of Artificial Sequence: Synthetic oligonucleotide
cttattatccatcacaggagtcagaaagggctcc

SEQ ID NO: 59331 - DNA, 35 bp, Artificial Sequence
  Description of Artificial Sequence: Synthetic oligonucleotide
ttattatccatcacaggagtcagaaagggctcctg

SEQ ID NO: 59332 - DNA, 34 bp, Artificial Sequence
  Description of Artificial Sequence: Synthetic oligonucleotide
tattatccatcacaggagtcagaaagggctcctg

SEQ ID NO: 59333 - DNA, 33 bp, Artificial Sequence
  Description of Artificial Sequence: Synthetic oligonucleotide
attatccatcacaggagtcagaaagggctcctg

SEQ ID NO: 59334 - DNA, 32 bp, Artificial Sequence
  Description of Artificial Sequence: Synthetic oligonucleotide
ttatccatcacaggagtcagaaagggctcctg

SEQ ID NO: 59335 - DNA, 31 bp, Artificial Sequence
  Description of Artificial Sequence: Synthetic oligonucleotide
tatccatcacaggagtcagaaagggctcctg

SEQ ID NO: 59336 - DNA, 33 bp, Artificial Sequence
  Description of Artificial Sequence: Synthetic oligonucleotide
accagatacatctataaccgagaggagtacgcg

SEQ ID NO: 59337 - DNA, 32 bp, Artificial Sequence
  Description of Artificial Sequence: Synthetic oligonucleotide
ccagatacatctataaccgagaggagtacgcg

SEQ ID NO: 59338 - DNA, 32 bp, Artificial Sequence
  Description of Artificial Sequence: Synthetic oligonucleotide
cagatacatctataaccgagaggagtacgcgc

SEQ ID NO: 59339 - DNA, 32 bp, Artificial Sequence
  Description of Artificial Sequence: Synthetic oligonucleotide
agatacatctataaccgagaggagtacgcgcg

SEQ ID NO: 59340 - DNA, 31 bp, Artificial Sequence
  Description of Artificial Sequence: Synthetic oligonucleotide
gatacatctataaccgagaggagtacgcgcg

SEQ ID NO: 59341 - DNA, 31 bp, Artificial Sequence
  Description of Artificial Sequence: Synthetic oligonucleotide
atacatctataaccgagaggagtacgcgcgc

SEQ ID NO: 59342 - DNA, 30 bp, Artificial Sequence
  Description of Artificial Sequence: Synthetic oligonucleotide
tacatctataaccgagaggagtacgcgcgc

SEQ ID NO: 59343 - DNA, 29 bp, Artificial Sequence
  Description of Artificial Sequence: Synthetic oligonucleotide
acatctataaccgagaggagtacgcgcgc

SEQ ID NO: 59344 - DNA, 28 bp, Artificial Sequence
  Description of Artificial Sequence: Synthetic oligonucleotide
catctataaccgagaggagtacgcgcgc

SEQ ID NO: 59345 - DNA, 30 bp, Artificial Sequence
  Description of Artificial Sequence: Synthetic oligonucleotide
atctataaccgagaggagtacgcgcgcttc

SEQ ID NO: 59346 - DNA, 29 bp, Artificial Sequence
  Description of Artificial Sequence: Synthetic oligonucleotide
tctataaccgagaggagtacgcgcgcttc

SEQ ID NO: 59347 - DNA, 28 bp, Artificial Sequence
  Description of Artificial Sequence: Synthetic oligonucleotide
ctataaccgagaggagtacgcgcgcttc

SEQ ID NO: 59348 - DNA, 28 bp, Artificial Sequence
  Description of Artificial Sequence: Synthetic oligonucleotide
tataaccgagaggagtacgcgcgcttcg

SEQ ID NO: 59349 - DNA, 27 bp, Artificial Sequence
  Description of Artificial Sequence: Synthetic oligonucleotide
ataaccgagaggagtacgcgcgcttcg

SEQ ID NO: 59350 - DNA, 27 bp, Artificial Sequence
  Description of Artificial Sequence: Synthetic oligonucleotide
taaccgagaggagtacgcgcgcttcga

SEQ ID NO: 59351 - DNA, 26 bp, Artificial Sequence
  Description of Artificial Sequence: Synthetic oligonucleotide
aaccgagaggagtacgcgcgcttcga

SEQ ID NO: 59352 - DNA, 25 bp, Artificial Sequence
  Description of Artificial Sequence: Synthetic oligonucleotide
accgagaggagtacgcgcgcttcga

SEQ ID NO: 59353 - DNA, 24 bp, Artificial Sequence
  Description of Artificial Sequence: Synthetic oligonucleotide
ccgagaggagtacgcgcgcttcga

SEQ ID NO: 59354 - DNA, 25 bp, Artificial Sequence
  Description of Artificial Sequence: Synthetic oligonucleotide
cgagaggagtacgcgcgcttcgaca

SEQ ID NO: 59355 - DNA, 25 bp, Artificial Sequence
  Description of Artificial Sequence: Synthetic oligonucleotide
gagaggagtacgcgcgcttcgacag

SEQ ID NO: 59356 - DNA, 25 bp, Artificial Sequence
  Description of Artificial Sequence: Synthetic oligonucleotide
agaggagtacgcgcgcttcgacagc

SEQ ID NO: 59357 - DNA, 23 bp, Artificial Sequence
  Description of Artificial Sequence: Synthetic oligonucleotide
gcgcgcttcgacagcgacgtgga

SEQ ID NO: 59358 - DNA, 23 bp, Artificial Sequence
  Description of Artificial Sequence: Synthetic oligonucleotide
cgcgcttcgacagcgacgtggag

SEQ ID NO: 59359 - DNA, 24 bp, Artificial Sequence
  Description of Artificial Sequence: Synthetic oligonucleotide
gcgcttcgacagcgacgtggaggt

SEQ ID NO: 59360 - DNA, 20 bp, Artificial Sequence
  Description of Artificial Sequence: Synthetic oligonucleotide
ggtgacgccgctggggccct

SEQ ID NO: 59361 - DNA, 20 bp, Artificial Sequence
  Description of Artificial Sequence: Synthetic oligonucleotide
gtgacgccgctggggcccct

SEQ ID NO: 59362 - DNA, 20 bp, Artificial Sequence
  Description of Artificial Sequence: Synthetic oligonucleotide
tgacgccgctggggccccct

SEQ ID NO: 59363 - DNA, 20 bp, Artificial Sequence
  Description of Artificial Sequence: Synthetic oligonucleotide
gacgccgctggggccccctt

SEQ ID NO: 59364 - DNA, 20 bp, Artificial Sequence
  Description of Artificial Sequence: Synthetic oligonucleotide
acgccgctggggccccctga

SEQ ID NO: 59365 - DNA, 20 bp, Artificial Sequence
  Description of Artificial Sequence: Synthetic oligonucleotide
cgccgctggggccccctgat

SEQ ID NO: 59366 - DNA, 20 bp, Artificial Sequence
  Description of Artificial Sequence: Synthetic oligonucleotide
gccgctggggccccctgact

SEQ ID NO: 59367 - DNA, 20 bp, Artificial Sequence
  Description of Artificial Sequence: Synthetic oligonucleotide
ccgctggggccccctgacgt

SEQ ID NO: 59368 - DNA, 20 bp, Artificial Sequence
  Description of Artificial Sequence: Synthetic oligonucleotide
cgctggggccccctgacgct

SEQ ID NO: 59369 - DNA, 20 bp, Artificial Sequence
  Description of Artificial Sequence: Synthetic oligonucleotide
gctggggccccctgacgcct

SEQ ID NO: 59370 - DNA, 20 bp, Artificial Sequence
  Description of Artificial Sequence: Synthetic oligonucleotide
ctggggccccctgacgccga

SEQ ID NO: 59371 - DNA, 22 bp, Artificial Sequence
  Description of Artificial Sequence: Synthetic oligonucleotide
tggggccccctgacgccgagta

SEQ ID NO: 59372 - DNA, 21 bp, Artificial Sequence
  Description of Artificial Sequence: Synthetic oligonucleotide
ggggccccctgacgccgagta

SEQ ID NO: 59373 - DNA, 22 bp, Artificial Sequence
  Description of Artificial Sequence: Synthetic oligonucleotide
gggccccctgacgccgagtact

SEQ ID NO: 59374 - DNA, 22 bp, Artificial Sequence
  Description of Artificial Sequence: Synthetic oligonucleotide
ggccccctgacgccgagtactg

SEQ ID NO: 59375 - DNA, 24 bp, Artificial Sequence
  Description of Artificial Sequence: Synthetic oligonucleotide
gccccctgacgccgagtactggaa

SEQ ID NO: 59376 - DNA, 25 bp, Artificial Sequence
  Description of Artificial Sequence: Synthetic oligonucleotide
ccccctgacgccgagtactggaaca

SEQ ID NO: 59377 - DNA, 25 bp, Artificial Sequence
  Description of Artificial Sequence: Synthetic oligonucleotide
cccctgacgccgagtactggaacag

SEQ ID NO: 59378 - DNA, 25 bp, Artificial Sequence
  Description of Artificial Sequence: Synthetic oligonucleotide
ccctgacgccgagtactggaacagc

SEQ ID NO: 59379 - DNA, 31 bp, Artificial Sequence
  Description of Artificial Sequence: Synthetic oligonucleotide
atgctggaaatgactccccagcatggagatg

SEQ ID NO: 59380 - DNA, 30 bp, Artificial Sequence
  Description of Artificial Sequence: Synthetic oligonucleotide
tgctggaaatgactccccagcatggagatg

SEQ ID NO: 59381 - DNA, 29 bp, Artificial Sequence
  Description of Artificial Sequence: Synthetic oligonucleotide
gctggaaatgactccccagcatggagatg

SEQ ID NO: 59382 - DNA, 30 bp, Artificial Sequence
  Description of Artificial Sequence: Synthetic oligonucleotide
ctggaaatgactccccagcatggagatgtc

SEQ ID NO: 59383 - DNA, 32 bp, Artificial Sequence
  Description of Artificial Sequence: Synthetic oligonucleotide
tggaaatgactccccagcatggagatgtctac

SEQ ID NO: 59384 - DNA, 31 bp, Artificial Sequence
  Description of Artificial Sequence: Synthetic oligonucleotide
ggaaatgactccccagcatggagatgtctac

SEQ ID NO: 59385 - DNA, 32 bp, Artificial Sequence
  Description of Artificial Sequence: Synthetic oligonucleotide
gaaatgactccccagcatggagatgtctacac

SEQ ID NO: 59386 - DNA, 32 bp, Artificial Sequence
  Description of Artificial Sequence: Synthetic oligonucleotide
aaatgactccccagcatggagatgtctacacc

SEQ ID NO: 59387 - DNA, 31 bp, Artificial Sequence
  Description of Artificial Sequence: Synthetic oligonucleotide
aatgactccccagcatggagatgtctacacc

SEQ ID NO: 59388 - DNA, 30 bp, Artificial Sequence
  Description of Artificial Sequence: Synthetic oligonucleotide
atgactccccagcatggagatgtctacacc

SEQ ID NO: 59389 - DNA, 29 bp, Artificial Sequence
  Description of Artificial Sequence: Synthetic oligonucleotide
tgactccccagcatggagatgtctacacc

SEQ ID NO: 59390 - DNA, 28 bp, Artificial Sequence
  Description of Artificial Sequence: Synthetic oligonucleotide
gactccccagcatggagatgtctacacc

SEQ ID NO: 59391 - DNA, 29 bp, Artificial Sequence
  Description of Artificial Sequence: Synthetic oligonucleotide
actccccagcatggagatgtctacacctg

SEQ ID NO: 59392 - DNA, 28 bp, Artificial Sequence
  Description of Artificial Sequence: Synthetic oligonucleotide
ctccccagcatggagatgtctacacctg

SEQ ID NO: 59393 - DNA, 28 bp, Artificial Sequence
  Description of Artificial Sequence: Synthetic oligonucleotide
tccccagcatggagatgtctacacctgc

SEQ ID NO: 59394 - DNA, 27 bp, Artificial Sequence
  Description of Artificial Sequence: Synthetic oligonucleotide
ccccagcatggagatgtctacacctgc

SEQ ID NO: 59395 - DNA, 27 bp, Artificial Sequence
  Description of Artificial Sequence: Synthetic oligonucleotide
cccagcatggagatgtctacacctgcc

SEQ ID NO: 59396 - DNA, 28 bp, Artificial Sequence
  Description of Artificial Sequence: Synthetic oligonucleotide
ccagcatggagatgtctacacctgccac

SEQ ID NO: 59397 - DNA, 28 bp, Artificial Sequence
  Description of Artificial Sequence: Synthetic oligonucleotide
cagcatggagatgtctacacctgccacg

SEQ ID NO: 59398 - DNA, 29 bp, Artificial Sequence
  Description of Artificial Sequence: Synthetic oligonucleotide
agcatggagatgtctacacctgccacgtg

SEQ ID NO: 59399 - DNA, 28 bp, Artificial Sequence
  Description of Artificial Sequence: Synthetic oligonucleotide
gcatggagatgtctacacctgccacgtg

SEQ ID NO: 59400 - DNA, 28 bp, Artificial Sequence
  Description of Artificial Sequence: Synthetic oligonucleotide
catggagatgtctacacctgccacgtgg

SEQ ID NO: 59401 - DNA, 29 bp, Artificial Sequence
  Description of Artificial Sequence: Synthetic oligonucleotide
atggagatgtctacacctgccacgtggag

SEQ ID NO: 59402 - DNA, 28 bp, Artificial Sequence
  Description of Artificial Sequence: Synthetic oligonucleotide
tggagatgtctacacctgccacgtggag

SEQ ID NO: 59403 - DNA, 27 bp, Artificial Sequence
  Description of Artificial Sequence: Synthetic oligonucleotide
ggagatgtctacacctgccacgtggag

SEQ ID NO: 59404 - DNA, 27 bp, Artificial Sequence
  Description of Artificial Sequence: Synthetic oligonucleotide
gagatgtctacacctgccacgtggagc

SEQ ID NO: 59405 - DNA, 28 bp, Artificial Sequence
  Description of Artificial Sequence: Synthetic oligonucleotide
agatgtctacacctgccacgtggagcac

SEQ ID NO: 59406 - DNA, 27 bp, Artificial Sequence
  Description of Artificial Sequence: Synthetic oligonucleotide
gatgtctacacctgccacgtggagcac

SEQ ID NO: 59407 - DNA, 27 bp, Artificial Sequence
  Description of Artificial Sequence: Synthetic oligonucleotide
atgtctacacctgccacgtggagcacc

SEQ ID NO: 59408 - DNA, 26 bp, Artificial Sequence
  Description of Artificial Sequence: Synthetic oligonucleotide
tgtctacacctgccacgtggagcacc

SEQ ID NO: 59409 - DNA, 31 bp, Artificial Sequence
  Description of Artificial Sequence: Synthetic oligonucleotide
atgtcttggaagaaggctttgcggatccctg

SEQ ID NO: 59410 - DNA, 30 bp, Artificial Sequence
  Description of Artificial Sequence: Synthetic oligonucleotide
tgtcttggaagaaggctttgcggatccctg

SEQ ID NO: 59411 - DNA, 29 bp, Artificial Sequence
  Description of Artificial Sequence: Synthetic oligonucleotide
gtcttggaagaaggctttgcggatccctg

SEQ ID NO: 59412 - DNA, 29 bp, Artificial Sequence
  Description of Artificial Sequence: Synthetic oligonucleotide
tcttggaagaaggctttgcggatccctgg

SEQ ID NO: 59413 - DNA, 28 bp, Artificial Sequence
  Description of Artificial Sequence: Synthetic oligonucleotide
cttggaagaaggctttgcggatccctgg

SEQ ID NO: 59414 - DNA, 29 bp, Artificial Sequence
  Description of Artificial Sequence: Synthetic oligonucleotide
ttggaagaaggctttgcggatccctggag

SEQ ID NO: 59415 - DNA, 28 bp, Artificial Sequence
  Description of Artificial Sequence: Synthetic oligonucleotide
tggaagaaggctttgcggatccctggag

SEQ ID NO: 59416 - DNA, 27 bp, Artificial Sequence
  Description of Artificial Sequence: Synthetic oligonucleotide
ggaagaaggctttgcggatccctggag

SEQ ID NO: 59417 - DNA, 27 bp, Artificial Sequence
  Description of Artificial Sequence: Synthetic oligonucleotide
gaagaaggctttgcggatccctggagg

SEQ ID NO: 59418 - DNA, 27 bp, Artificial Sequence
  Description of Artificial Sequence: Synthetic oligonucleotide
aagaaggctttgcggatccctggaggc

SEQ ID NO: 59419 - DNA, 26 bp, Artificial Sequence
  Description of Artificial Sequence: Synthetic oligonucleotide
agaaggctttgcggatccctggaggc

SEQ ID NO: 59420 - DNA, 25 bp, Artificial Sequence
  Description of Artificial Sequence: Synthetic oligonucleotide
gaaggctttgcggatccctggaggc

SEQ ID NO: 59421 - DNA, 27 bp, Artificial Sequence
  Description of Artificial Sequence: Synthetic oligonucleotide
aaggctttgcggatccctggaggcctt

SEQ ID NO: 59422 - DNA, 26 bp, Artificial Sequence
  Description of Artificial Sequence: Synthetic oligonucleotide
aggctttgcggatccctggaggcctt

SEQ ID NO: 59423 - DNA, 25 bp, Artificial Sequence
  Description of Artificial Sequence: Synthetic oligonucleotide
ggctttgcggatccctggaggcctt

SEQ ID NO: 59424 - DNA, 25 bp, Artificial Sequence
  Description of Artificial Sequence: Synthetic oligonucleotide
gctttgcggatccctggaggccttc

SEQ ID NO: 59425 - DNA, 25 bp, Artificial Sequence
  Description of Artificial Sequence: Synthetic oligonucleotide
ctttgcggatccctggaggccttcg

SEQ ID NO: 59426 - DNA, 25 bp, Artificial Sequence
  Description of Artificial Sequence: Synthetic oligonucleotide
tttgcggatccctggaggccttcgg

SEQ ID NO: 59427 - DNA, 24 bp, Artificial Sequence
  Description of Artificial Sequence: Synthetic oligonucleotide
ttgcggatccctggaggccttcgg

SEQ ID NO: 59428 - DNA, 23 bp, Artificial Sequence
  Description of Artificial Sequence: Synthetic oligonucleotide
tgcggatccctggaggccttcgg

SEQ ID NO: 59429 - DNA, 22 bp, Artificial Sequence
  Description of Artificial Sequence: Synthetic oligonucleotide
gcggatccctggaggccttcgg

SEQ ID NO: 59430 - DNA, 24 bp, Artificial Sequence
  Description of Artificial Sequence: Synthetic oligonucleotide
cggatccctggaggccttcgggta

SEQ ID NO: 59431 - DNA, 24 bp, Artificial Sequence
  Description of Artificial Sequence: Synthetic oligonucleotide
ggatccctggaggccttcgggtag

SEQ ID NO: 59432 - DNA, 26 bp, Artificial Sequence
  Description of Artificial Sequence: Synthetic oligonucleotide
gatccctggaggccttcgggtagcaa

SEQ ID NO: 59433 - DNA, 27 bp, Artificial Sequence
  Description of Artificial Sequence: Synthetic oligonucleotide
atccctggaggccttcgggtagcaact

SEQ ID NO: 59434 - DNA, 26 bp, Artificial Sequence
  Description of Artificial Sequence: Synthetic oligonucleotide
tccctggaggccttcgggtagcaact

SEQ ID NO: 59435 - DNA, 25 bp, Artificial Sequence
  Description of Artificial Sequence: Synthetic oligonucleotide
ccctggaggccttcgggtagcaact

SEQ ID NO: 59436 - DNA, 26 bp, Artificial Sequence
  Description of Artificial Sequence: Synthetic oligonucleotide
cctggaggccttcgggtagcaactgt

SEQ ID NO: 59437 - DNA, 27 bp, Artificial Sequence
  Description of Artificial Sequence: Synthetic oligonucleotide
ctggaggccttcgggtagcaactgtga

SEQ ID NO: 59438 - DNA, 27 bp, Artificial Sequence
  Description of Artificial Sequence: Synthetic oligonucleotide
tggaggccttcgggtagcaactgtgac

SEQ ID NO: 59439 - DNA, 26 bp, Artificial Sequence
  Description of Artificial Sequence: Synthetic oligonucleotide
ggaggccttcgggtagcaactgtgac

SEQ ID NO: 59440 - DNA, 27 bp, Artificial Sequence
  Description of Artificial Sequence: Synthetic oligonucleotide
gaggccttcgggtagcaactgtgacct

SEQ ID NO: 59441 - DNA, 28 bp, Artificial Sequence
  Description of Artificial Sequence: Synthetic oligonucleotide
aggccttcgggtagcaactgtgaccttg

SEQ ID NO: 59442 - DNA, 27 bp, Artificial Sequence
  Description of Artificial Sequence: Synthetic oligonucleotide
ggccttcgggtagcaactgtgaccttg

SEQ ID NO: 59443 - DNA, 29 bp, Artificial Sequence
  Description of Artificial Sequence: Synthetic oligonucleotide
gccttcgggtagcaactgtgaccttgatg

SEQ ID NO: 59444 - DNA, 29 bp, Artificial Sequence
  Description of Artificial Sequence: Synthetic oligonucleotide
ccttcgggtagcaactgtgaccttgatgc

SEQ ID NO: 59445 - DNA, 30 bp, Artificial Sequence
  Description of Artificial Sequence: Synthetic oligonucleotide
cttcgggtagcaactgtgaccttgatgctg

SEQ ID NO: 59446 - DNA, 30 bp, Artificial Sequence
  Description of Artificial Sequence: Synthetic oligonucleotide
ttcgggtagcaactgtgaccttgatgctgg

SEQ ID NO: 59447 - DNA, 29 bp, Artificial Sequence
  Description of Artificial Sequence: Synthetic oligonucleotide
tcgggtagcaactgtgaccttgatgctgg

SEQ ID NO: 59448 - DNA, 28 bp, Artificial Sequence
  Description of Artificial Sequence: Synthetic oligonucleotide
cgggtagcaactgtgaccttgatgctgg

SEQ ID NO: 59449 - DNA, 28 bp, Artificial Sequence
  Description of Artificial Sequence: Synthetic oligonucleotide
gggtagcaactgtgaccttgatgctggc

SEQ ID NO: 59450 - DNA, 28 bp, Artificial Sequence
  Description of Artificial Sequence: Synthetic oligonucleotide
ggtagcaactgtgaccttgatgctggcg

SEQ ID NO: 59451 - DNA, 30 bp, Artificial Sequence
  Description of Artificial Sequence: Synthetic oligonucleotide
gtagcaactgtgaccttgatgctggcgatg

SEQ ID NO: 59452 - DNA, 30 bp, Artificial Sequence
  Description of Artificial Sequence: Synthetic oligonucleotide
tagcaactgtgaccttgatgctggcgatgc

SEQ ID NO: 59453 - DNA, 29 bp, Artificial Sequence
  Description of Artificial Sequence: Synthetic oligonucleotide
agcaactgtgaccttgatgctggcgatgc

SEQ ID NO: 59454 - DNA, 28 bp, Artificial Sequence
  Description of Artificial Sequence: Synthetic oligonucleotide
gcaactgtgaccttgatgctggcgatgc

SEQ ID NO: 59455 - DNA, 29 bp, Artificial Sequence
  Description of Artificial Sequence: Synthetic oligonucleotide
caactgtgaccttgatgctggcgatgctg

SEQ ID NO: 59456 - DNA, 30 bp, Artificial Sequence
  Description of Artificial Sequence: Synthetic oligonucleotide
aactgtgaccttgatgctggcgatgctgag

SEQ ID NO: 59457 - DNA, 29 bp, Artificial Sequence
  Description of Artificial Sequence: Synthetic oligonucleotide
actgtgaccttgatgctggcgatgctgag

SEQ ID NO: 59458 - DNA, 28 bp, Artificial Sequence
  Description of Artificial Sequence: Synthetic oligonucleotide
ctgtgaccttgatgctggcgatgctgag

SEQ ID NO: 59459 - DNA, 28 bp, Artificial Sequence
  Description of Artificial Sequence: Synthetic oligonucleotide
tgtgaccttgatgctggcgatgctgagc

SEQ ID NO: 59460 - DNA, 27 bp, Artificial Sequence
  Description of Artificial Sequence: Synthetic oligonucleotide
gtgaccttgatgctggcgatgctgagc

SEQ ID NO: 59461 - DNA, 28 bp, Artificial Sequence
  Description of Artificial Sequence: Synthetic oligonucleotide
tgaccttgatgctggcgatgctgagcac

SEQ ID NO: 59462 - DNA, 27 bp, Artificial Sequence
  Description of Artificial Sequence: Synthetic oligonucleotide
gaccttgatgctggcgatgctgagcac

SEQ ID NO: 59463 - DNA, 26 bp, Artificial Sequence
  Description of Artificial Sequence: Synthetic oligonucleotide
ttgatgctggcgatgctgagcacccc

SEQ ID NO: 59464 - DNA, 25 bp, Artificial Sequence
  Description of Artificial Sequence: Synthetic oligonucleotide
tgatgctggcgatgctgagcacccc

SEQ ID NO: 59465 - DNA, 24 bp, Artificial Sequence
  Description of Artificial Sequence: Synthetic oligonucleotide
gatgctggcgatgctgagcacccc

SEQ ID NO: 59466 - DNA, 24 bp, Artificial Sequence
  Description of Artificial Sequence: Synthetic oligonucleotide
atgctggcgatgctgagcaccccg

SEQ ID NO: 59467 - DNA, 23 bp, Artificial Sequence
  Description of Artificial Sequence: Synthetic oligonucleotide
tgctggcgatgctgagcaccccg

SEQ ID NO: 59468 - DNA, 22 bp, Artificial Sequence
  Description of Artificial Sequence: Synthetic oligonucleotide
gctggcgatgctgagcaccccg

SEQ ID NO: 59469 - DNA, 23 bp, Artificial Sequence
  Description of Artificial Sequence: Synthetic oligonucleotide
ctggcgatgctgagcaccccggt

SEQ ID NO: 59470 - DNA, 23 bp, Artificial Sequence
  Description of Artificial Sequence: Synthetic oligonucleotide
tggcgatgctgagcaccccggtg

SEQ ID NO: 59471 - DNA, 22 bp, Artificial Sequence
  Description of Artificial Sequence: Synthetic oligonucleotide
ggcgatgctgagcaccccggtg

SEQ ID NO: 59472 - DNA, 22 bp, Artificial Sequence
  Description of Artificial Sequence: Synthetic oligonucleotide
gcgatgctgagcaccccggtgg

SEQ ID NO: 59473 - DNA, 23 bp, Artificial Sequence
  Description of Artificial Sequence: Synthetic oligonucleotide
cgatgctgagcaccccggtggct

SEQ ID NO: 59474 - DNA, 24 bp, Artificial Sequence
  Description of Artificial Sequence: Synthetic oligonucleotide
gatgctgagcaccccggtggctga

SEQ ID NO: 59475 - DNA, 24 bp, Artificial Sequence
  Description of Artificial Sequence: Synthetic oligonucleotide
atgctgagcaccccggtggctgag

SEQ ID NO: 59476 - DNA, 23 bp, Artificial Sequence
  Description of Artificial Sequence: Synthetic oligonucleotide
tgctgagcaccccggtggctgag

SEQ ID NO: 59477 - DNA, 22 bp, Artificial Sequence
  Description of Artificial Sequence: Synthetic oligonucleotide
gctgagcaccccggtggctgag

SEQ ID NO: 59478 - DNA, 22 bp, Artificial Sequence
  Description of Artificial Sequence: Synthetic oligonucleotide
ctgagcaccccggtggctgagg

SEQ ID NO: 59479 - DNA, 22 bp, Artificial Sequence
  Description of Artificial Sequence: Synthetic oligonucleotide
tgagcaccccggtggctgaggg

SEQ ID NO: 59480 - DNA, 21 bp, Artificial Sequence
  Description of Artificial Sequence: Synthetic oligonucleotide
gagcaccccggtggctgaggg

SEQ ID NO: 59481 - DNA, 22 bp, Artificial Sequence
  Description of Artificial Sequence: Synthetic oligonucleotide
agcaccccggtggctgagggca

SEQ ID NO: 59482 - DNA, 21 bp, Artificial Sequence
  Description of Artificial Sequence: Synthetic oligonucleotide
gcaccccggtggctgagggca

SEQ ID NO: 59483 - DNA, 22 bp, Artificial Sequence
  Description of Artificial Sequence: Synthetic oligonucleotide
caccccggtggctgagggcaga

SEQ ID NO: 59484 - DNA, 23 bp, Artificial Sequence
  Description of Artificial Sequence: Synthetic oligonucleotide
accccggtggctgagggcagaga

SEQ ID NO: 59485 - DNA, 22 bp, Artificial Sequence
  Description of Artificial Sequence: Synthetic oligonucleotide
ccccggtggctgagggcagaga

SEQ ID NO: 59486 - DNA, 23 bp, Artificial Sequence
  Description of Artificial Sequence: Synthetic oligonucleotide
cccggtggctgagggcagagact

SEQ ID NO: 59487 - DNA, 24 bp, Artificial Sequence
  Description of Artificial Sequence: Synthetic oligonucleotide
ccggtggctgagggcagagactct

SEQ ID NO: 59488 - DNA, 24 bp, Artificial Sequence
  Description of Artificial Sequence: Synthetic oligonucleotide
cggtggctgagggcagagactctc

SEQ ID NO: 59489 - DNA, 24 bp, Artificial Sequence
  Description of Artificial Sequence: Synthetic oligonucleotide
ggtggctgagggcagagactctcc

SEQ ID NO: 59490 - DNA, 27 bp, Artificial Sequence
  Description of Artificial Sequence: Synthetic oligonucleotide
ggcatgtgctacttcaccaacgggacg

SEQ ID NO: 59491 - DNA, 27 bp, Artificial Sequence
  Description of Artificial Sequence: Synthetic oligonucleotide
gcatgtgctacttcaccaacgggacgg

SEQ ID NO: 59492 - DNA, 22 bp, Artificial Sequence
  Description of Artificial Sequence: Synthetic oligonucleotide
caacgggacggagcgcgtgcgt

SEQ ID NO: 59493 - DNA, 24 bp, Artificial Sequence
  Description of Artificial Sequence: Synthetic oligonucleotide
aacgggacggagcgcgtgcgtctt

SEQ ID NO: 59494 - DNA, 23 bp, Artificial Sequence
  Description of Artificial Sequence: Synthetic oligonucleotide
acgggacggagcgcgtgcgtctt

SEQ ID NO: 59495 - DNA, 22 bp, Artificial Sequence
  Description of Artificial Sequence: Synthetic oligonucleotide
cgggacggagcgcgtgcgtctt

SEQ ID NO: 59496 - DNA, 23 bp, Artificial Sequence
  Description of Artificial Sequence: Synthetic oligonucleotide
gggacggagcgcgtgcgtcttgt

SEQ ID NO: 59497 - DNA, 24 bp, Artificial Sequence
  Description of Artificial Sequence: Synthetic oligonucleotide
ggacggagcgcgtgcgtcttgtga

SEQ ID NO: 59498 - DNA, 24 bp, Artificial Sequence
  Description of Artificial Sequence: Synthetic oligonucleotide
gacggagcgcgtgcgtcttgtgac

SEQ ID NO: 59499 - DNA, 25 bp, Artificial Sequence
  Description of Artificial Sequence: Synthetic oligonucleotide
acggagcgcgtgcgtcttgtgacca

SEQ ID NO: 59500 - DNA, 24 bp, Artificial Sequence
  Description of Artificial Sequence: Synthetic oligonucleotide
cggagcgcgtgcgtcttgtgacca

SEQ ID NO: 59501 - DNA, 27 bp, Artificial Sequence
  Description of Artificial Sequence: Synthetic oligonucleotide
ggagcgcgtgcgtcttgtgaccagata

SEQ ID NO: 59502 - DNA, 27 bp, Artificial Sequence
  Description of Artificial Sequence: Synthetic oligonucleotide
gagcgcgtgcgtcttgtgaccagatac

SEQ ID NO: 59503 - DNA, 29 bp, Artificial Sequence
  Description of Artificial Sequence: Synthetic oligonucleotide
agcgcgtgcgtcttgtgaccagatacatc

SEQ ID NO: 59504 - DNA, 28 bp, Artificial Sequence
  Description of Artificial Sequence: Synthetic oligonucleotide
gcgcgtgcgtcttgtgaccagatacatc

SEQ ID NO: 59505 - DNA, 33 bp, Artificial Sequence
  Description of Artificial Sequence: Synthetic oligonucleotide
cgcgtgcgtcttgtgaccagatacatctataac

SEQ ID NO: 59506 - DNA, 33 bp, Artificial Sequence
  Description of Artificial Sequence: Synthetic oligonucleotide
gcgtgcgtcttgtgaccagatacatctataacc

SEQ ID NO: 59507 - DNA, 33 bp, Artificial Sequence
  Description of Artificial Sequence: Synthetic oligonucleotide
cgtgcgtcttgtgaccagatacatctataaccg

SEQ ID NO: 59508 - DNA, 34 bp, Artificial Sequence
  Description of Artificial Sequence: Synthetic oligonucleotide
gtgcgtcttgtgaccagatacatctataaccgag

SEQ ID NO: 59509 - DNA, 35 bp, Artificial Sequence
  Description of Artificial Sequence: Synthetic oligonucleotide
tgcgtcttgtgaccagatacatctataaccgagag

SEQ ID NO: 59510 - DNA, 34 bp, Artificial Sequence
  Description of Artificial Sequence: Synthetic oligonucleotide
gcgtcttgtgaccagatacatctataaccgagag

SEQ ID NO: 59511 - DNA, 34 bp, Artificial Sequence
  Description of Artificial Sequence: Synthetic oligonucleotide
cgtcttgtgaccagatacatctataaccgagagg

SEQ ID NO: 59512 - DNA, 35 bp, Artificial Sequence
  Description of Artificial Sequence: Synthetic oligonucleotide
gtcttgtgaccagatacatctataaccgagaggag

SEQ ID NO: 59513 - DNA, 37 bp, Artificial Sequence
  Description of Artificial Sequence: Synthetic oligonucleotide
tcttgtgaccagatacatctataaccgagaggagtac

SEQ ID NO: 59514 - DNA, 36 bp, Artificial Sequence
  Description of Artificial Sequence: Synthetic oligonucleotide
cttgtgaccagatacatctataaccgagaggagtac

SEQ ID NO: 59515 - DNA, 36 bp, Artificial Sequence
  Description of Artificial Sequence: Synthetic oligonucleotide
ttgtgaccagatacatctataaccgagaggagtacg

SEQ ID NO: 59516 - DNA, 25 bp, Artificial Sequence
  Description of Artificial Sequence: Synthetic oligonucleotide
tacgcacgcttcgacagcgacgtgg

SEQ ID NO: 59517 - DNA, 24 bp, Artificial Sequence
  Description of Artificial Sequence: Synthetic oligonucleotide
acgcacgcttcgacagcgacgtgg

SEQ ID NO: 59518 - DNA, 23 bp, Artificial Sequence
  Description of Artificial Sequence: Synthetic oligonucleotide
cgcacgcttcgacagcgacgtgg

SEQ ID NO: 59519 - DNA, 23 bp, Artificial Sequence
  Description of Artificial Sequence: Synthetic oligonucleotide
gcacgcttcgacagcgacgtggg

SEQ ID NO: 59520 - DNA, 23 bp, Artificial Sequence
  Description of Artificial Sequence: Synthetic oligonucleotide
cacgcttcgacagcgacgtgggg

SEQ ID NO: 59521 - DNA, 24 bp, Artificial Sequence
  Description of Artificial Sequence: Synthetic oligonucleotide
acgcttcgacagcgacgtgggggt

SEQ ID NO: 59522 - DNA, 23 bp, Artificial Sequence
  Description of Artificial Sequence: Synthetic oligonucleotide
cgcttcgacagcgacgtgggggt

SEQ ID NO: 59523 - DNA, 26 bp, Artificial Sequence
  Description of Artificial Sequence: Synthetic oligonucleotide
gcttcgacagcgacgtgggggtgtat

SEQ ID NO: 59524 - DNA, 26 bp, Artificial Sequence
  Description of Artificial Sequence: Synthetic oligonucleotide
cttcgacagcgacgtgggggtgtatc

SEQ ID NO: 59525 - DNA, 26 bp, Artificial Sequence
  Description of Artificial Sequence: Synthetic oligonucleotide
ttcgacagcgacgtgggggtgtatcg

SEQ ID NO: 59526 - DNA, 25 bp, Artificial Sequence
  Description of Artificial Sequence: Synthetic oligonucleotide
tcgacagcgacgtgggggtgtatcg

SEQ ID NO: 59527 - DNA, 24 bp, Artificial Sequence
  Description of Artificial Sequence: Synthetic oligonucleotide
cgacagcgacgtgggggtgtatcg

SEQ ID NO: 59528 - DNA, 24 bp, Artificial Sequence
  Description of Artificial Sequence: Synthetic oligonucleotide
gacagcgacgtgggggtgtatcgg

SEQ ID NO: 59529 - DNA, 24 bp, Artificial Sequence
  Description of Artificial Sequence: Synthetic oligonucleotide
acagcgacgtgggggtgtatcggg

SEQ ID NO: 59530 - DNA, 23 bp, Artificial Sequence
  Description of Artificial Sequence: Synthetic oligonucleotide
cagcgacgtgggggtgtatcggg

SEQ ID NO: 59531 - DNA, 23 bp, Artificial Sequence
  Description of Artificial Sequence: Synthetic oligonucleotide
agcgacgtgggggtgtatcgggc

SEQ ID NO: 59532 - DNA, 22 bp, Artificial Sequence
  Description of Artificial Sequence: Synthetic oligonucleotide
gcgacgtgggggtgtatcgggc

SEQ ID NO: 59533 - DNA, 22 bp, Artificial Sequence
  Description of Artificial Sequence: Synthetic oligonucleotide
cgacgtgggggtgtatcgggcg

SEQ ID NO: 59534 - DNA, 23 bp, Artificial Sequence
  Description of Artificial Sequence: Synthetic oligonucleotide
gacgtgggggtgtatcgggcggt

SEQ ID NO: 59535 - DNA, 24 bp, Artificial Sequence
  Description of Artificial Sequence: Synthetic oligonucleotide
acgtgggggtgtatcgggcggtga

SEQ ID NO: 59536 - DNA, 23 bp, Artificial Sequence
  Description of Artificial Sequence: Synthetic oligonucleotide
cgtgggggtgtatcgggcggtga

SEQ ID NO: 59537 - DNA, 23 bp, Artificial Sequence
  Description of Artificial Sequence: Synthetic oligonucleotide
gtgggggtgtatcgggcggtgac

SEQ ID NO: 59538 - DNA, 23 bp, Artificial Sequence
  Description of Artificial Sequence: Synthetic oligonucleotide
tgggggtgtatcgggcggtgacg

SEQ ID NO: 59539 - DNA, 22 bp, Artificial Sequence
  Description of Artificial Sequence: Synthetic oligonucleotide
gggggtgtatcgggcggtgacg

SEQ ID NO: 59540 - DNA, 22 bp, Artificial Sequence
  Description of Artificial Sequence: Synthetic oligonucleotide
ggggtgtatcgggcggtgacgc

SEQ ID NO: 59541 - DNA, 22 bp, Artificial Sequence
  Description of Artificial Sequence: Synthetic oligonucleotide
gggtgtatcgggcggtgacgcc

SEQ ID NO: 59542 - DNA, 22 bp, Artificial Sequence
  Description of Artificial Sequence: Synthetic oligonucleotide
ggtgtatcgggcggtgacgccg

SEQ ID NO: 59543 - DNA, 23 bp, Artificial Sequence
  Description of Artificial Sequence: Synthetic oligonucleotide
gtgtatcgggcggtgacgccgct

SEQ ID NO: 59544 - DNA, 23 bp, Artificial Sequence
  Description of Artificial Sequence: Synthetic oligonucleotide
tgtatcgggcggtgacgccgctg

SEQ ID NO: 59545 - DNA, 22 bp, Artificial Sequence
  Description of Artificial Sequence: Synthetic oligonucleotide
gtatcgggcggtgacgccgctg

SEQ ID NO: 59546 - DNA, 22 bp, Artificial Sequence
  Description of Artificial Sequence: Synthetic oligonucleotide
tatcgggcggtgacgccgctgg

SEQ ID NO: 59547 - DNA, 21 bp, Artificial Sequence
  Description of Artificial Sequence: Synthetic oligonucleotide
atcgggcggtgacgccgctgg

SEQ ID NO: 59548 - DNA, 20 bp, Artificial Sequence
  Description of Artificial Sequence: Synthetic oligonucleotide
tcgggcggtgacgccgctgg

SEQ ID NO: 59549 - DNA, 20 bp, Artificial Sequence
  Description of Artificial Sequence: Synthetic oligonucleotide
acgccgctggggccgcctgt

SEQ ID NO: 59550 - DNA, 20 bp, Artificial Sequence
  Description of Artificial Sequence: Synthetic oligonucleotide
cgccgctggggccgcctgtt

SEQ ID NO: 59551 - DNA, 20 bp, Artificial Sequence
  Description of Artificial Sequence: Synthetic oligonucleotide
gccgctggggccgcctgctt

SEQ ID NO: 59552 - DNA, 20 bp, Artificial Sequence
  Description of Artificial Sequence: Synthetic oligonucleotide
ccgctggggccgcctgcctt

SEQ ID NO: 59553 - DNA, 20 bp, Artificial Sequence
  Description of Artificial Sequence: Synthetic oligonucleotide
cgctggggccgcctgccgtt

SEQ ID NO: 59554 - DNA, 20 bp, Artificial Sequence
  Description of Artificial Sequence: Synthetic oligonucleotide
gctggggccgcctgccgctt

SEQ ID NO: 59555 - DNA, 20 bp, Artificial Sequence
  Description of Artificial Sequence: Synthetic oligonucleotide
ctggggccgcctgccgcctt

SEQ ID NO: 59556 - DNA, 20 bp, Artificial Sequence
  Description of Artificial Sequence: Synthetic oligonucleotide
tggggccgcctgccgccgat

SEQ ID NO: 59557 - DNA, 20 bp, Artificial Sequence
  Description of Artificial Sequence: Synthetic oligonucleotide
ggggccgcctgccgccgatt

SEQ ID NO: 59558 - DNA, 20 bp, Artificial Sequence
  Description of Artificial Sequence: Synthetic oligonucleotide
gggccgcctgccgccgagta

SEQ ID NO: 59559 - DNA, 21 bp, Artificial Sequence
  Description of Artificial Sequence: Synthetic oligonucleotide
ggccgcctgccgccgagtact

SEQ ID NO: 59560 - DNA, 21 bp, Artificial Sequence
  Description of Artificial Sequence: Synthetic oligonucleotide
gccgcctgccgccgagtactg

SEQ ID NO: 59561 - DNA, 23 bp, Artificial Sequence
  Description of Artificial Sequence: Synthetic oligonucleotide
ccgcctgccgccgagtactggaa

SEQ ID NO: 59562 - DNA, 24 bp, Artificial Sequence
  Description of Artificial Sequence: Synthetic oligonucleotide
cgcctgccgccgagtactggaaca

SEQ ID NO: 59563 - DNA, 31 bp, Artificial Sequence
  Description of Artificial Sequence: Synthetic oligonucleotide
tggtttcggaatgaccaggaggagacaactg

SEQ ID NO: 59564 - DNA, 30 bp, Artificial Sequence
  Description of Artificial Sequence: Synthetic oligonucleotide
ggtttcggaatgaccaggaggagacaactg

SEQ ID NO: 59565 - DNA, 30 bp, Artificial Sequence
  Description of Artificial Sequence: Synthetic oligonucleotide
gtttcggaatgaccaggaggagacaactgg

SEQ ID NO: 59566 - DNA, 30 bp, Artificial Sequence
  Description of Artificial Sequence: Synthetic oligonucleotide
tttcggaatgaccaggaggagacaactggc

SEQ ID NO: 59567 - DNA, 29 bp, Artificial Sequence
  Description of Artificial Sequence: Synthetic oligonucleotide
ttcggaatgaccaggaggagacaactggc

SEQ ID NO: 59568 - DNA, 28 bp, Artificial Sequence
  Description of Artificial Sequence: Synthetic oligonucleotide
tcggaatgaccaggaggagacaactggc

SEQ ID NO: 59569 - DNA, 27 bp, Artificial Sequence
  Description of Artificial Sequence: Synthetic oligonucleotide
cggaatgaccaggaggagacaactggc

SEQ ID NO: 59570 - DNA, 27 bp, Artificial Sequence
  Description of Artificial Sequence: Synthetic oligonucleotide
ggaatgaccaggaggagacaactggcg

SEQ ID NO: 59571 - DNA, 29 bp, Artificial Sequence
  Description of Artificial Sequence: Synthetic oligonucleotide
gaatgaccaggaggagacaactggcgttg

SEQ ID NO: 59572 - DNA, 30 bp, Artificial Sequence
  Description of Artificial Sequence: Synthetic oligonucleotide
aatgaccaggaggagacaactggcgttgtg

SEQ ID NO: 59573 - DNA, 29 bp, Artificial Sequence
  Description of Artificial Sequence: Synthetic oligonucleotide
atgaccaggaggagacaactggcgttgtg

SEQ ID NO: 59574 - DNA, 28 bp, Artificial Sequence
  Description of Artificial Sequence: Synthetic oligonucleotide
tgaccaggaggagacaactggcgttgtg

SEQ ID NO: 59575 - DNA, 27 bp, Artificial Sequence
  Description of Artificial Sequence: Synthetic oligonucleotide
gaccaggaggagacaactggcgttgtg

SEQ ID NO: 59576 - DNA, 28 bp, Artificial Sequence
  Description of Artificial Sequence: Synthetic oligonucleotide
accaggaggagacaactggcgttgtgtc

SEQ ID NO: 59577 - DNA, 27 bp, Artificial Sequence
  Description of Artificial Sequence: Synthetic oligonucleotide
ccaggaggagacaactggcgttgtgtc

SEQ ID NO: 59578 - DNA, 27 bp, Artificial Sequence
  Description of Artificial Sequence: Synthetic oligonucleotide
caggaggagacaactggcgttgtgtcc

SEQ ID NO: 59579 - DNA, 28 bp, Artificial Sequence
  Description of Artificial Sequence: Synthetic oligonucleotide
aggaggagacaactggcgttgtgtccac

SEQ ID NO: 59580 - DNA, 27 bp, Artificial Sequence
  Description of Artificial Sequence: Synthetic oligonucleotide
ggaggagacaactggcgttgtgtccac

SEQ ID NO: 59581 - DNA, 27 bp, Artificial Sequence
  Description of Artificial Sequence: Synthetic oligonucleotide
gaggagacaactggcgttgtgtccacc

SEQ ID NO: 59582 - DNA, 27 bp, Artificial Sequence
  Description of Artificial Sequence: Synthetic oligonucleotide
aggagacaactggcgttgtgtccaccc

SEQ ID NO: 59583 - DNA, 26 bp, Artificial Sequence
  Description of Artificial Sequence: Synthetic oligonucleotide
ggagacaactggcgttgtgtccaccc

SEQ ID NO: 59584 - DNA, 26 bp, Artificial Sequence
  Description of Artificial Sequence: Synthetic oligonucleotide
gagacaactggcgttgtgtccacccc

SEQ ID NO: 59585 - DNA, 26 bp, Artificial Sequence
  Description of Artificial Sequence: Synthetic oligonucleotide
agacaactggcgttgtgtccaccccc

SEQ ID NO: 59586 - DNA, 25 bp, Artificial Sequence
  Description of Artificial Sequence: Synthetic oligonucleotide
gacaactggcgttgtgtccaccccc

SEQ ID NO: 59587 - DNA, 27 bp, Artificial Sequence
  Description of Artificial Sequence: Synthetic oligonucleotide
acaactggcgttgtgtccacccccctt

SEQ ID NO: 59588 - DNA, 27 bp, Artificial Sequence
  Description of Artificial Sequence: Synthetic oligonucleotide
caactggcgttgtgtccacccccctta

SEQ ID NO: 59589 - DNA, 30 bp, Artificial Sequence
  Description of Artificial Sequence: Synthetic oligonucleotide
aactggcgttgtgtccaccccccttattag

SEQ ID NO: 59590 - DNA, 29 bp, Artificial Sequence
  Description of Artificial Sequence: Synthetic oligonucleotide
actggcgttgtgtccaccccccttattag

SEQ ID NO: 59591 - DNA, 26 bp, Artificial Sequence
  Description of Artificial Sequence: Synthetic oligonucleotide
caccccagcctccagaaccccatcat

SEQ ID NO: 59592 - DNA, 26 bp, Artificial Sequence
  Description of Artificial Sequence: Synthetic oligonucleotide
accccagcctccagaaccccatcatc

SEQ ID NO: 59593 - DNA, 25 bp, Artificial Sequence
  Description of Artificial Sequence: Synthetic oligonucleotide
ccccagcctccagaaccccatcatc

SEQ ID NO: 59594 - DNA, 26 bp, Artificial Sequence
  Description of Artificial Sequence: Synthetic oligonucleotide
cccagcctccagaaccccatcatcgt

SEQ ID NO: 59595 - DNA, 26 bp, Artificial Sequence
  Description of Artificial Sequence: Synthetic oligonucleotide
ccagcctccagaaccccatcatcgtg

SEQ ID NO: 59596 - DNA, 27 bp, Artificial Sequence
  Description of Artificial Sequence: Synthetic oligonucleotide
cagcctccagaaccccatcatcgtgga

SEQ ID NO: 59597 - DNA, 27 bp, Artificial Sequence
  Description of Artificial Sequence: Synthetic oligonucleotide
agcctccagaaccccatcatcgtggag

SEQ ID NO: 59598 - DNA, 27 bp, Artificial Sequence
  Description of Artificial Sequence: Synthetic oligonucleotide
gcctccagaaccccatcatcgtggagt

SEQ ID NO: 59599 - DNA, 27 bp, Artificial Sequence
  Description of Artificial Sequence: Synthetic oligonucleotide
cctccagaaccccatcatcgtggagtg

SEQ ID NO: 59600 - DNA, 27 bp, Artificial Sequence
  Description of Artificial Sequence: Synthetic oligonucleotide
ctccagaaccccatcatcgtggagtgg

SEQ ID NO: 59601 - DNA, 27 bp, Artificial Sequence
  Description of Artificial Sequence: Synthetic oligonucleotide
tccagaaccccatcatcgtggagtggc

SEQ ID NO: 59602 - DNA, 26 bp, Artificial Sequence
  Description of Artificial Sequence: Synthetic oligonucleotide
ccagaaccccatcatcgtggagtggc

SEQ ID NO: 59603 - DNA, 26 bp, Artificial Sequence
  Description of Artificial Sequence: Synthetic oligonucleotide
cagaaccccatcatcgtggagtggcg

SEQ ID NO: 59604 - DNA, 26 bp, Artificial Sequence
  Description of Artificial Sequence: Synthetic oligonucleotide
agaaccccatcatcgtggagtggcgg

SEQ ID NO: 59605 - DNA, 25 bp, Artificial Sequence
  Description of Artificial Sequence: Synthetic oligonucleotide
gaaccccatcatcgtggagtggcgg

SEQ ID NO: 59606 - DNA, 25 bp, Artificial Sequence
  Description of Artificial Sequence: Synthetic oligonucleotide
aaccccatcatcgtggagtggcggg

SEQ ID NO: 59607 - DNA, 24 bp, Artificial Sequence
  Description of Artificial Sequence: Synthetic oligonucleotide
accccatcatcgtggagtggcggg

SEQ ID NO: 59608 - DNA, 23 bp, Artificial Sequence
  Description of Artificial Sequence: Synthetic oligonucleotide
ccccatcatcgtggagtggcggg

SEQ ID NO: 59609 - DNA, 24 bp, Artificial Sequence
  Description of Artificial Sequence: Synthetic oligonucleotide
cccatcatcgtggagtggcgggct

SEQ ID NO: 59610 - DNA, 25 bp, Artificial Sequence
  Description of Artificial Sequence: Synthetic oligonucleotide
ccatcatcgtggagtggcgggctca

SEQ ID NO: 59611 - DNA, 26 bp, Artificial Sequence
  Description of Artificial Sequence: Synthetic oligonucleotide
catcatcgtggagtggcgggctcagt

SEQ ID NO: 59612 - DNA, 27 bp, Artificial Sequence
  Description of Artificial Sequence: Synthetic oligonucleotide
atcatcgtggagtggcgggctcagtct

SEQ ID NO: 59613 - DNA, 26 bp, Artificial Sequence
  Description of Artificial Sequence: Synthetic oligonucleotide
tcatcgtggagtggcgggctcagtct

SEQ ID NO: 59614 - DNA, 25 bp, Artificial Sequence
  Description of Artificial Sequence: Synthetic oligonucleotide
catcgtggagtggcgggctcagtct

SEQ ID NO: 59615 - DNA, 27 bp, Artificial Sequence
  Description of Artificial Sequence: Synthetic oligonucleotide
atcgtggagtggcgggctcagtctgaa

SEQ ID NO: 59616 - DNA, 27 bp, Artificial Sequence
  Description of Artificial Sequence: Synthetic oligonucleotide
tcgtggagtggcgggctcagtctgaat

SEQ ID NO: 59617 - DNA, 30 bp, Artificial Sequence
  Description of Artificial Sequence: Synthetic oligonucleotide
ctgatcttcctcgggctgggccttattatc

SEQ ID NO: 59618 - DNA, 30 bp, Artificial Sequence
  Description of Artificial Sequence: Synthetic oligonucleotide
tgatcttcctcgggctgggccttattatcc

SEQ ID NO: 59619 - DNA, 29 bp, Artificial Sequence
  Description of Artificial Sequence: Synthetic oligonucleotide
gatcttcctcgggctgggccttattatcc

SEQ ID NO: 59620 - DNA, 21 bp, Artificial Sequence
  Description of Artificial Sequence: Synthetic oligonucleotide
ctggagaggacccgggcggag

SEQ ID NO: 59621 - DNA, 22 bp, Artificial Sequence
  Description of Artificial Sequence: Synthetic oligonucleotide
tggagaggacccgggcggagct

SEQ ID NO: 59622 - DNA, 21 bp, Artificial Sequence
  Description of Artificial Sequence: Synthetic oligonucleotide
ggagaggacccgggcggagct

SEQ ID NO: 59623 - DNA, 21 bp, Artificial Sequence
  Description of Artificial Sequence: Synthetic oligonucleotide
gagaggacccgggcggagctg

SEQ ID NO: 59624 - DNA, 22 bp, Artificial Sequence
  Description of Artificial Sequence: Synthetic oligonucleotide
agaggacccgggcggagctgga

SEQ ID NO: 59625 - DNA, 21 bp, Artificial Sequence
  Description of Artificial Sequence: Synthetic oligonucleotide
gaggacccgggcggagctgga

SEQ ID NO: 59626 - DNA, 22 bp, Artificial Sequence
  Description of Artificial Sequence: Synthetic oligonucleotide
aggacccgggcggagctggaca

SEQ ID NO: 59627 - DNA, 21 bp, Artificial Sequence
  Description of Artificial Sequence: Synthetic oligonucleotide
ggacccgggcggagctggaca

SEQ ID NO: 59628 - DNA, 21 bp, Artificial Sequence
  Description of Artificial Sequence: Synthetic oligonucleotide
gacccgggcggagctggacac

SEQ ID NO: 59629 - DNA, 21 bp, Artificial Sequence
  Description of Artificial Sequence: Synthetic oligonucleotide
acccgggcggagctggacacg

SEQ ID NO: 59630 - DNA, 20 bp, Artificial Sequence
  Description of Artificial Sequence: Synthetic oligonucleotide
cccgggcggagctggacacg

SEQ ID NO: 59631 - DNA, 21 bp, Artificial Sequence
  Description of Artificial Sequence: Synthetic oligonucleotide
ccgggcggagctggacacggt

SEQ ID NO: 59632 - DNA, 22 bp, Artificial Sequence
  Description of Artificial Sequence: Synthetic oligonucleotide
cgggcggagctggacacggtgt

SEQ ID NO: 59633 - DNA, 22 bp, Artificial Sequence
  Description of Artificial Sequence: Synthetic oligonucleotide
gggcggagctggacacggtgtg

SEQ ID NO: 59634 - DNA, 23 bp, Artificial Sequence
  Description of Artificial Sequence: Synthetic oligonucleotide
ggcggagctggacacggtgtgca

SEQ ID NO: 59635 - DNA, 24 bp, Artificial Sequence
  Description of Artificial Sequence: Synthetic oligonucleotide
gcggagctggacacggtgtgcaga

SEQ ID NO: 59636 - DNA, 25 bp, Artificial Sequence
  Description of Artificial Sequence: Synthetic oligonucleotide
cggagctggacacggtgtgcagaca

SEQ ID NO: 59637 - DNA, 27 bp, Artificial Sequence
  Description of Artificial Sequence: Synthetic oligonucleotide
ggagctggacacggtgtgcagacacaa

SEQ ID NO: 59638 - DNA, 27 bp, Artificial Sequence
  Description of Artificial Sequence: Synthetic oligonucleotide
gagctggacacggtgtgcagacacaac

SEQ ID NO: 59639 - DNA, 29 bp, Artificial Sequence
  Description of Artificial Sequence: Synthetic oligonucleotide
agctggacacggtgtgcagacacaactac

SEQ ID NO: 59640 - DNA, 28 bp, Artificial Sequence
  Description of Artificial Sequence: Synthetic oligonucleotide
gctggacacggtgtgcagacacaactac

SEQ ID NO: 59641 - DNA, 28 bp, Artificial Sequence
  Description of Artificial Sequence: Synthetic oligonucleotide
ctggacacggtgtgcagacacaactacc

SEQ ID NO: 59642 - DNA, 34 bp, Artificial Sequence
  Description of Artificial Sequence: Synthetic oligonucleotide
cgcgtgcgtcttgtgaccagatacatctataatc

SEQ ID NO: 59643 - DNA, 34 bp, Artificial Sequence
  Description of Artificial Sequence: Synthetic oligonucleotide
gcgtgcgtcttgtgaccagatacatctataatcg

SEQ ID NO: 59644 - DNA, 35 bp, Artificial Sequence
  Description of Artificial Sequence: Synthetic oligonucleotide
cgtgcgtcttgtgaccagatacatctataatcgag

SEQ ID NO: 59645 - DNA, 36 bp, Artificial Sequence
  Description of Artificial Sequence: Synthetic oligonucleotide
gtgcgtcttgtgaccagatacatctataatcgagag

SEQ ID NO: 59646 - DNA, 36 bp, Artificial Sequence
  Description of Artificial Sequence: Synthetic oligonucleotide
tgcgtcttgtgaccagatacatctataatcgagagg

SEQ ID NO: 59647 - DNA, 35 bp, Artificial Sequence
  Description of Artificial Sequence: Synthetic oligonucleotide
gcgtcttgtgaccagatacatctataatcgagagg

SEQ ID NO: 59648 - DNA, 36 bp, Artificial Sequence
  Description of Artificial Sequence: Synthetic oligonucleotide
cgtcttgtgaccagatacatctataatcgagaggag

SEQ ID NO: 59649 - DNA, 38 bp, Artificial Sequence
  Description of Artificial Sequence: Synthetic oligonucleotide
gtcttgtgaccagatacatctataatcgagaggagtac

SEQ ID NO: 59650 - DNA, 38 bp, Artificial Sequence
  Description of Artificial Sequence: Synthetic oligonucleotide
tcttgtgaccagatacatctataatcgagaggagtacg

SEQ ID NO: 59651 - DNA, 37 bp, Artificial Sequence
  Description of Artificial Sequence: Synthetic oligonucleotide
cttgtgaccagatacatctataatcgagaggagtacg

SEQ ID NO: 59652 - DNA, 37 bp, Artificial Sequence
  Description of Artificial Sequence: Synthetic oligonucleotide
ttgtgaccagatacatctataatcgagaggagtacgc

SEQ ID NO: 59653 - DNA, 36 bp, Artificial Sequence
  Description of Artificial Sequence: Synthetic oligonucleotide
tgtgaccagatacatctataatcgagaggagtacgc

SEQ ID NO: 59654 - DNA, 35 bp, Artificial Sequence
  Description of Artificial Sequence: Synthetic oligonucleotide
gtgaccagatacatctataatcgagaggagtacgc

SEQ ID NO: 59655 - DNA, 36 bp, Artificial Sequence
  Description of Artificial Sequence: Synthetic oligonucleotide
tgaccagatacatctataatcgagaggagtacgcac

SEQ ID NO: 59656 - DNA, 35 bp, Artificial Sequence
  Description of Artificial Sequence: Synthetic oligonucleotide
gaccagatacatctataatcgagaggagtacgcac

SEQ ID NO: 59657 - DNA, 35 bp, Artificial Sequence
  Description of Artificial Sequence: Synthetic oligonucleotide
accagatacatctataatcgagaggagtacgcacg

SEQ ID NO: 59658 - DNA, 34 bp, Artificial Sequence
  Description of Artificial Sequence: Synthetic oligonucleotide
ccagatacatctataatcgagaggagtacgcacg

SEQ ID NO: 59659 - DNA, 34 bp, Artificial Sequence
  Description of Artificial Sequence: Synthetic oligonucleotide
cagatacatctataatcgagaggagtacgcacgc

SEQ ID NO: 59660 - DNA, 36 bp, Artificial Sequence
  Description of Artificial Sequence: Synthetic oligonucleotide
agatacatctataatcgagaggagtacgcacgcttc

SEQ ID NO: 59661 - DNA, 35 bp, Artificial Sequence
  Description of Artificial Sequence: Synthetic oligonucleotide
gatacatctataatcgagaggagtacgcacgcttc

SEQ ID NO: 59662 - DNA, 35 bp, Artificial Sequence
  Description of Artificial Sequence: Synthetic oligonucleotide
atacatctataatcgagaggagtacgcacgcttcg

SEQ ID NO: 59663 - DNA, 34 bp, Artificial Sequence
  Description of Artificial Sequence: Synthetic oligonucleotide
tacatctataatcgagaggagtacgcacgcttcg

SEQ ID NO: 59664 - DNA, 33 bp, Artificial Sequence
  Description of Artificial Sequence: Synthetic oligonucleotide
acatctataatcgagaggagtacgcacgcttcg

SEQ ID NO: 59665 - DNA, 32 bp, Artificial Sequence
  Description of Artificial Sequence: Synthetic oligonucleotide
catctataatcgagaggagtacgcacgcttcg

SEQ ID NO: 59666 - DNA, 33 bp, Artificial Sequence
  Description of Artificial Sequence: Synthetic oligonucleotide
atctataatcgagaggagtacgcacgcttcgac

SEQ ID NO: 59667 - DNA, 32 bp, Artificial Sequence
  Description of Artificial Sequence: Synthetic oligonucleotide
tctataatcgagaggagtacgcacgcttcgac

SEQ ID NO: 59668 - DNA, 31 bp, Artificial Sequence
  Description of Artificial Sequence: Synthetic oligonucleotide
ctataatcgagaggagtacgcacgcttcgac

SEQ ID NO: 59669 - DNA, 32 bp, Artificial Sequence
  Description of Artificial Sequence: Synthetic oligonucleotide
tataatcgagaggagtacgcacgcttcgacag

SEQ ID NO: 59670 - DNA, 31 bp, Artificial Sequence
  Description of Artificial Sequence: Synthetic oligonucleotide
ataatcgagaggagtacgcacgcttcgacag

SEQ ID NO: 59671 - DNA, 30 bp, Artificial Sequence
  Description of Artificial Sequence: Synthetic oligonucleotide
taatcgagaggagtacgcacgcttcgacag

SEQ ID NO: 59672 - DNA, 29 bp, Artificial Sequence
  Description of Artificial Sequence: Synthetic oligonucleotide
aatcgagaggagtacgcacgcttcgacag

SEQ ID NO: 59673 - DNA, 28 bp, Artificial Sequence
  Description of Artificial Sequence: Synthetic oligonucleotide
atcgagaggagtacgcacgcttcgacag

SEQ ID NO: 59674 - DNA, 27 bp, Artificial Sequence
  Description of Artificial Sequence: Synthetic oligonucleotide
tcgagaggagtacgcacgcttcgacag

SEQ ID NO: 59675 - DNA, 25 bp, Artificial Sequence
  Description of Artificial Sequence: Synthetic oligonucleotide
gcttcgacagcgacgtgggggtgta

SEQ ID NO: 59676 - DNA, 25 bp, Artificial Sequence
  Description of Artificial Sequence: Synthetic oligonucleotide
cttcgacagcgacgtgggggtgtac

SEQ ID NO: 59677 - DNA, 25 bp, Artificial Sequence
  Description of Artificial Sequence: Synthetic oligonucleotide
ttcgacagcgacgtgggggtgtacc

SEQ ID NO: 59678 - DNA, 24 bp, Artificial Sequence
  Description of Artificial Sequence: Synthetic oligonucleotide
tcgacagcgacgtgggggtgtacc

SEQ ID NO: 59679 - DNA, 23 bp, Artificial Sequence
  Description of Artificial Sequence: Synthetic oligonucleotide
cgacagcgacgtgggggtgtacc

SEQ ID NO: 59680 - DNA, 23 bp, Artificial Sequence
  Description of Artificial Sequence: Synthetic oligonucleotide
gacagcgacgtgggggtgtaccg

SEQ ID NO: 59681 - DNA, 23 bp, Artificial Sequence
  Description of Artificial Sequence: Synthetic oligonucleotide
acagcgacgtgggggtgtaccgc

SEQ ID NO: 59682 - DNA, 22 bp, Artificial Sequence
  Description of Artificial Sequence: Synthetic oligonucleotide
cagcgacgtgggggtgtaccgc

SEQ ID NO: 59683 - DNA, 22 bp, Artificial Sequence
  Description of Artificial Sequence: Synthetic oligonucleotide
agcgacgtgggggtgtaccgcg

SEQ ID NO: 59684 - DNA, 21 bp, Artificial Sequence
  Description of Artificial Sequence: Synthetic oligonucleotide
gcgacgtgggggtgtaccgcg

SEQ ID NO: 59685 - DNA, 21 bp, Artificial Sequence
  Description of Artificial Sequence: Synthetic oligonucleotide
cgacgtgggggtgtaccgcgc

SEQ ID NO: 59686 - DNA, 21 bp, Artificial Sequence
  Description of Artificial Sequence: Synthetic oligonucleotide
gacgtgggggtgtaccgcgcg

SEQ ID NO: 59687 - DNA, 22 bp, Artificial Sequence
  Description of Artificial Sequence: Synthetic oligonucleotide
acgtgggggtgtaccgcgcggt

SEQ ID NO: 59688 - DNA, 21 bp, Artificial Sequence
  Description of Artificial Sequence: Synthetic oligonucleotide
cgtgggggtgtaccgcgcggt

SEQ ID NO: 59689 - DNA, 22 bp, Artificial Sequence
  Description of Artificial Sequence: Synthetic oligonucleotide
gtgggggtgtaccgcgcggtga

SEQ ID NO: 59690 - DNA, 22 bp, Artificial Sequence
  Description of Artificial Sequence: Synthetic oligonucleotide
tgggggtgtaccgcgcggtgac

SEQ ID NO: 59691 - DNA, 21 bp, Artificial Sequence
  Description of Artificial Sequence: Synthetic oligonucleotide
gggggtgtaccgcgcggtgac

SEQ ID NO: 59692 - DNA, 21 bp, Artificial Sequence
  Description of Artificial Sequence: Synthetic oligonucleotide
ggggtgtaccgcgcggtgacg

SEQ ID NO: 59693 - DNA, 21 bp, Artificial Sequence
  Description of Artificial Sequence: Synthetic oligonucleotide
gggtgtaccgcgcggtgacgc

SEQ ID NO: 59694 - DNA, 21 bp, Artificial Sequence
  Description of Artificial Sequence: Synthetic oligonucleotide
ggtgtaccgcgcggtgacgcc

SEQ ID NO: 59695 - DNA, 21 bp, Artificial Sequence
  Description of Artificial Sequence: Synthetic oligonucleotide
gtgtaccgcgcggtgacgccg

SEQ ID NO: 59696 - DNA, 22 bp, Artificial Sequence
  Description of Artificial Sequence: Synthetic oligonucleotide
tgtaccgcgcggtgacgccgct

SEQ ID NO: 59697 - DNA, 21 bp, Artificial Sequence
  Description of Artificial Sequence: Synthetic oligonucleotide
gtaccgcgcggtgacgccgct

SEQ ID NO: 59698 - DNA, 21 bp, Artificial Sequence
  Description of Artificial Sequence: Synthetic oligonucleotide
taccgcgcggtgacgccgctg

SEQ ID NO: 59699 - DNA, 20 bp, Artificial Sequence
  Description of Artificial Sequence: Synthetic oligonucleotide
accgcgcggtgacgccgctg

SEQ ID NO: 59700 - DNA, 20 bp, Artificial Sequence
  Description of Artificial Sequence: Synthetic oligonucleotide
ccgcgcggtgacgccgctgt

SEQ ID NO: 59701 - DNA, 20 bp, Artificial Sequence
  Description of Artificial Sequence: Synthetic oligonucleotide
cgcgcggtgacgccgctggt

SEQ ID NO: 59702 - DNA, 20 bp, Artificial Sequence
  Description of Artificial Sequence: Synthetic oligonucleotide
gcgcggtgacgccgctgggt

SEQ ID NO: 59703 - DNA, 20 bp, Artificial Sequence
  Description of Artificial Sequence: Synthetic oligonucleotide
cgcggtgacgccgctggggt

SEQ ID NO: 59704 - DNA, 27 bp, Artificial Sequence
  Description of Artificial Sequence: Synthetic oligonucleotide
ggcatgtgctacttcaccaacgggacc

SEQ ID NO: 59705 - DNA, 27 bp, Artificial Sequence
  Description of Artificial Sequence: Synthetic oligonucleotide
gcatgtgctacttcaccaacgggaccg

SEQ ID NO: 59706 - DNA, 28 bp, Artificial Sequence
  Description of Artificial Sequence: Synthetic oligonucleotide
catgtgctacttcaccaacgggaccgag

SEQ ID NO: 59707 - DNA, 28 bp, Artificial Sequence
  Description of Artificial Sequence: Synthetic oligonucleotide
atgtgctacttcaccaacgggaccgagc

SEQ ID NO: 59708 - DNA, 27 bp, Artificial Sequence
  Description of Artificial Sequence: Synthetic oligonucleotide
tgtgctacttcaccaacgggaccgagc

SEQ ID NO: 59709 - DNA, 26 bp, Artificial Sequence
  Description of Artificial Sequence: Synthetic oligonucleotide
gtgctacttcaccaacgggaccgagc

SEQ ID NO: 59710 - DNA, 26 bp, Artificial Sequence
  Description of Artificial Sequence: Synthetic oligonucleotide
tgctacttcaccaacgggaccgagcg

SEQ ID NO: 59711 - DNA, 25 bp, Artificial Sequence
  Description of Artificial Sequence: Synthetic oligonucleotide
gctacttcaccaacgggaccgagcg

SEQ ID NO: 59712 - DNA, 25 bp, Artificial Sequence
  Description of Artificial Sequence: Synthetic oligonucleotide
ctacttcaccaacgggaccgagcgc

SEQ ID NO: 59713 - DNA, 26 bp, Artificial Sequence
  Description of Artificial Sequence: Synthetic oligonucleotide
tacttcaccaacgggaccgagcgcgt

SEQ ID NO: 59714 - DNA, 25 bp, Artificial Sequence
  Description of Artificial Sequence: Synthetic oligonucleotide
acttcaccaacgggaccgagcgcgt

SEQ ID NO: 59715 - DNA, 24 bp, Artificial Sequence
  Description of Artificial Sequence: Synthetic oligonucleotide
cttcaccaacgggaccgagcgcgt

SEQ ID NO: 59716 - DNA, 24 bp, Artificial Sequence
  Description of Artificial Sequence: Synthetic oligonucleotide
ttcaccaacgggaccgagcgcgtg

SEQ ID NO: 59717 - DNA, 23 bp, Artificial Sequence
  Description of Artificial Sequence: Synthetic oligonucleotide
tcaccaacgggaccgagcgcgtg

SEQ ID NO: 59718 - DNA, 22 bp, Artificial Sequence
  Description of Artificial Sequence: Synthetic oligonucleotide
caccaacgggaccgagcgcgtg

SEQ ID NO: 59719 - DNA, 22 bp, Artificial Sequence
  Description of Artificial Sequence: Synthetic oligonucleotide
accaacgggaccgagcgcgtgc

SEQ ID NO: 59720 - DNA, 21 bp, Artificial Sequence
  Description of Artificial Sequence: Synthetic oligonucleotide
ccaacgggaccgagcgcgtgc

SEQ ID NO: 59721 - DNA, 21 bp, Artificial Sequence
  Description of Artificial Sequence: Synthetic oligonucleotide
caacgggaccgagcgcgtgcg

SEQ ID NO: 59722 - DNA, 21 bp, Artificial Sequence
  Description of Artificial Sequence: Synthetic oligonucleotide
aacgggaccgagcgcgtgcgg

SEQ ID NO: 59723 - DNA, 20 bp, Artificial Sequence
  Description of Artificial Sequence: Synthetic oligonucleotide
acgggaccgagcgcgtgcgg

SEQ ID NO: 59724 - DNA, 20 bp, Artificial Sequence
  Description of Artificial Sequence: Synthetic oligonucleotide
cgggaccgagcgcgtgcggt

SEQ ID NO: 59725 - DNA, 20 bp, Artificial Sequence
  Description of Artificial Sequence: Synthetic oligonucleotide
gggaccgagcgcgtgcgggt

SEQ ID NO: 59726 - DNA, 20 bp, Artificial Sequence
  Description of Artificial Sequence: Synthetic oligonucleotide
ggaccgagcgcgtgcggggt

SEQ ID NO: 59727 - DNA, 21 bp, Artificial Sequence
  Description of Artificial Sequence: Synthetic oligonucleotide
gaccgagcgcgtgcggggtgt

SEQ ID NO: 59728 - DNA, 22 bp, Artificial Sequence
  Description of Artificial Sequence: Synthetic oligonucleotide
accgagcgcgtgcggggtgtga

SEQ ID NO: 59729 - DNA, 21 bp, Artificial Sequence
  Description of Artificial Sequence: Synthetic oligonucleotide
ccgagcgcgtgcggggtgtga

SEQ ID NO: 59730 - DNA, 21 bp, Artificial Sequence
  Description of Artificial Sequence: Synthetic oligonucleotide
cgagcgcgtgcggggtgtgac

SEQ ID NO: 59731 - DNA, 22 bp, Artificial Sequence
  Description of Artificial Sequence: Synthetic oligonucleotide
gagcgcgtgcggggtgtgacca

SEQ ID NO: 59732 - DNA, 25 bp, Artificial Sequence
  Description of Artificial Sequence: Synthetic oligonucleotide
agcgcgtgcggggtgtgaccagata

SEQ ID NO: 59733 - DNA, 24 bp, Artificial Sequence
  Description of Artificial Sequence: Synthetic oligonucleotide
gcgcgtgcggggtgtgaccagata

SEQ ID NO: 59734 - DNA, 26 bp, Artificial Sequence
  Description of Artificial Sequence: Synthetic oligonucleotide
cgcgtgcggggtgtgaccagatacat

SEQ ID NO: 59735 - DNA, 27 bp, Artificial Sequence
  Description of Artificial Sequence: Synthetic oligonucleotide
gcgtgcggggtgtgaccagatacatct

SEQ ID NO: 59736 - DNA, 31 bp, Artificial Sequence
  Description of Artificial Sequence: Synthetic oligonucleotide
cgtgcggggtgtgaccagatacatctataac

SEQ ID NO: 59737 - DNA, 31 bp, Artificial Sequence
  Description of Artificial Sequence: Synthetic oligonucleotide
gtgcggggtgtgaccagatacatctataacc

SEQ ID NO: 59738 - DNA, 31 bp, Artificial Sequence
  Description of Artificial Sequence: Synthetic oligonucleotide
tgcggggtgtgaccagatacatctataaccg

SEQ ID NO: 59739 - DNA, 30 bp, Artificial Sequence
  Description of Artificial Sequence: Synthetic oligonucleotide
gcggggtgtgaccagatacatctataaccg

SEQ ID NO: 59740 - DNA, 31 bp, Artificial Sequence
  Description of Artificial Sequence: Synthetic oligonucleotide
cggggtgtgaccagatacatctataaccgag

SEQ ID NO: 59741 - DNA, 32 bp, Artificial Sequence
  Description of Artificial Sequence: Synthetic oligonucleotide
ggggtgtgaccagatacatctataaccgagag

SEQ ID NO: 59742 - DNA, 32 bp, Artificial Sequence
  Description of Artificial Sequence: Synthetic oligonucleotide
gggtgtgaccagatacatctataaccgagagg

SEQ ID NO: 59743 - DNA, 33 bp, Artificial Sequence
  Description of Artificial Sequence: Synthetic oligonucleotide
ggtgtgaccagatacatctataaccgagaggag

SEQ ID NO: 59744 - DNA, 35 bp, Artificial Sequence
  Description of Artificial Sequence: Synthetic oligonucleotide
gtgtgaccagatacatctataaccgagaggagtac

SEQ ID NO: 59745 - DNA, 21 bp, Artificial Sequence
  Description of Artificial Sequence: Synthetic oligonucleotide
caacgggacggagcgcgtgcg

SEQ ID NO: 59746 - DNA, 21 bp, Artificial Sequence
  Description of Artificial Sequence: Synthetic oligonucleotide
aacgggacggagcgcgtgcgg

SEQ ID NO: 59747 - DNA, 20 bp, Artificial Sequence
  Description of Artificial Sequence: Synthetic oligonucleotide
acgggacggagcgcgtgcgg

SEQ ID NO: 59748 - DNA, 20 bp, Artificial Sequence
  Description of Artificial Sequence: Synthetic oligonucleotide
cgggacggagcgcgtgcggt

SEQ ID NO: 59749 - DNA, 20 bp, Artificial Sequence
  Description of Artificial Sequence: Synthetic oligonucleotide
gggacggagcgcgtgcgggt

SEQ ID NO: 59750 - DNA, 20 bp, Artificial Sequence
  Description of Artificial Sequence: Synthetic oligonucleotide
ggacggagcgcgtgcggggt

SEQ ID NO: 59751 - DNA, 21 bp, Artificial Sequence
  Description of Artificial Sequence: Synthetic oligonucleotide
gacggagcgcgtgcggggtgt

SEQ ID NO: 59752 - DNA, 22 bp, Artificial Sequence
  Description of Artificial Sequence: Synthetic oligonucleotide
acggagcgcgtgcggggtgtga

SEQ ID NO: 59753 - DNA, 21 bp, Artificial Sequence
  Description of Artificial Sequence: Synthetic oligonucleotide
cggagcgcgtgcggggtgtga

SEQ ID NO: 59754 - DNA, 21 bp, Artificial Sequence
  Description of Artificial Sequence: Synthetic oligonucleotide
ggagcgcgtgcggggtgtgac

SEQ ID NO: 59755 - DNA, 26 bp, Artificial Sequence
  Description of Artificial Sequence: Synthetic oligonucleotide
gccgcctgacgccgagtactggaata

SEQ ID NO: 59756 - DNA, 26 bp, Artificial Sequence
  Description of Artificial Sequence: Synthetic oligonucleotide
ccgcctgacgccgagtactggaatag

SEQ ID NO: 59757 - DNA, 26 bp, Artificial Sequence
  Description of Artificial Sequence: Synthetic oligonucleotide
cgcctgacgccgagtactggaatagc

SEQ ID NO: 59758 - DNA, 27 bp, Artificial Sequence
  Description of Artificial Sequence: Synthetic oligonucleotide
gcctgacgccgagtactggaatagcca

SEQ ID NO: 59759 - DNA, 27 bp, Artificial Sequence
  Description of Artificial Sequence: Synthetic oligonucleotide
cctgacgccgagtactggaatagccag

SEQ ID NO: 59760 - DNA, 29 bp, Artificial Sequence
  Description of Artificial Sequence: Synthetic oligonucleotide
ctgacgccgagtactggaatagccagaag

SEQ ID NO: 59761 - DNA, 29 bp, Artificial Sequence
  Description of Artificial Sequence: Synthetic oligonucleotide
tgacgccgagtactggaatagccagaagg

SEQ ID NO: 59762 - DNA, 28 bp, Artificial Sequence
  Description of Artificial Sequence: Synthetic oligonucleotide
gacgccgagtactggaatagccagaagg

SEQ ID NO: 59763 - DNA, 29 bp, Artificial Sequence
  Description of Artificial Sequence: Synthetic oligonucleotide
acgccgagtactggaatagccagaaggac

SEQ ID NO: 59764 - DNA, 28 bp, Artificial Sequence
  Description of Artificial Sequence: Synthetic oligonucleotide
cgccgagtactggaatagccagaaggac

SEQ ID NO: 59765 - DNA, 30 bp, Artificial Sequence
  Description of Artificial Sequence: Synthetic oligonucleotide
gccgagtactggaatagccagaaggacatc

SEQ ID NO: 59766 - DNA, 30 bp, Artificial Sequence
  Description of Artificial Sequence: Synthetic oligonucleotide
ccgagtactggaatagccagaaggacatcc

SEQ ID NO: 59767 - DNA, 31 bp, Artificial Sequence
  Description of Artificial Sequence: Synthetic oligonucleotide
cgagtactggaatagccagaaggacatcctg

SEQ ID NO: 59768 - DNA, 31 bp, Artificial Sequence
  Description of Artificial Sequence: Synthetic oligonucleotide
gagtactggaatagccagaaggacatcctgg

SEQ ID NO: 59769 - DNA, 32 bp, Artificial Sequence
  Description of Artificial Sequence: Synthetic oligonucleotide
agtactggaatagccagaaggacatcctggag

SEQ ID NO: 59770 - DNA, 31 bp, Artificial Sequence
  Description of Artificial Sequence: Synthetic oligonucleotide
gtactggaatagccagaaggacatcctggag

SEQ ID NO: 59771 - DNA, 31 bp, Artificial Sequence
  Description of Artificial Sequence: Synthetic oligonucleotide
tactggaatagccagaaggacatcctggagg

SEQ ID NO: 59772 - DNA, 30 bp, Artificial Sequence
  Description of Artificial Sequence: Synthetic oligonucleotide
actggaatagccagaaggacatcctggagg

SEQ ID NO: 59773 - DNA, 29 bp, Artificial Sequence
  Description of Artificial Sequence: Synthetic oligonucleotide
ctggaatagccagaaggacatcctggagg

SEQ ID NO: 59774 - DNA, 30 bp, Artificial Sequence
  Description of Artificial Sequence: Synthetic oligonucleotide
tggaatagccagaaggacatcctggaggag

SEQ ID NO: 59775 - DNA, 29 bp, Artificial Sequence
  Description of Artificial Sequence: Synthetic oligonucleotide
ggaatagccagaaggacatcctggaggag

SEQ ID NO: 59776 - DNA, 29 bp, Artificial Sequence
  Description of Artificial Sequence: Synthetic oligonucleotide
gaatagccagaaggacatcctggaggagg

SEQ ID NO: 59777 - DNA, 30 bp, Artificial Sequence
  Description of Artificial Sequence: Synthetic oligonucleotide
aatagccagaaggacatcctggaggaggac

SEQ ID NO: 59778 - DNA, 29 bp, Artificial Sequence
  Description of Artificial Sequence: Synthetic oligonucleotide
atagccagaaggacatcctggaggaggac

SEQ ID NO: 59779 - DNA, 28 bp, Artificial Sequence
  Description of Artificial Sequence: Synthetic oligonucleotide
tagccagaaggacatcctggaggaggac

SEQ ID NO: 59780 - DNA, 27 bp, Artificial Sequence
  Description of Artificial Sequence: Synthetic oligonucleotide
agccagaaggacatcctggaggaggac

SEQ ID NO: 59781 - DNA, 26 bp, Artificial Sequence
  Description of Artificial Sequence: Synthetic oligonucleotide
gccagaaggacatcctggaggaggac

SEQ ID NO: 59782 - DNA, 26 bp, Artificial Sequence
  Description of Artificial Sequence: Synthetic oligonucleotide
ccagaaggacatcctggaggaggacc

SEQ ID NO: 59783 - DNA, 26 bp, Artificial Sequence
  Description of Artificial Sequence: Synthetic oligonucleotide
cagaaggacatcctggaggaggaccg

SEQ ID NO: 59784 - DNA, 26 bp, Artificial Sequence
  Description of Artificial Sequence: Synthetic oligonucleotide
agaaggacatcctggaggaggaccgg

SEQ ID NO: 59785 - DNA, 25 bp, Artificial Sequence
  Description of Artificial Sequence: Synthetic oligonucleotide
gaaggacatcctggaggaggaccgg

SEQ ID NO: 59786 - DNA, 25 bp, Artificial Sequence
  Description of Artificial Sequence: Synthetic oligonucleotide
aaggacatcctggaggaggaccggg

SEQ ID NO: 59787 - DNA, 24 bp, Artificial Sequence
  Description of Artificial Sequence: Synthetic oligonucleotide
aggacatcctggaggaggaccggg

SEQ ID NO: 59788 - DNA, 23 bp, Artificial Sequence
  Description of Artificial Sequence: Synthetic oligonucleotide
ggacatcctggaggaggaccggg

SEQ ID NO: 59789 - DNA, 23 bp, Artificial Sequence
  Description of Artificial Sequence: Synthetic oligonucleotide
gacatcctggaggaggaccgggc

SEQ ID NO: 59790 - DNA, 24 bp, Artificial Sequence
  Description of Artificial Sequence: Synthetic oligonucleotide
acatcctggaggaggaccgggcgt

SEQ ID NO: 59791 - DNA, 23 bp, Artificial Sequence
  Description of Artificial Sequence: Synthetic oligonucleotide
catcctggaggaggaccgggcgt

SEQ ID NO: 59792 - DNA, 23 bp, Artificial Sequence
  Description of Artificial Sequence: Synthetic oligonucleotide
atcctggaggaggaccgggcgtc

SEQ ID NO: 59793 - DNA, 22 bp, Artificial Sequence
  Description of Artificial Sequence: Synthetic oligonucleotide
tcctggaggaggaccgggcgtc

SEQ ID NO: 59794 - DNA, 21 bp, Artificial Sequence
  Description of Artificial Sequence: Synthetic oligonucleotide
cctggaggaggaccgggcgtc

SEQ ID NO: 59795 - DNA, 21 bp, Artificial Sequence
  Description of Artificial Sequence: Synthetic oligonucleotide
ctggaggaggaccgggcgtcg

SEQ ID NO: 59796 - DNA, 22 bp, Artificial Sequence
  Description of Artificial Sequence: Synthetic oligonucleotide
tggaggaggaccgggcgtcggt

SEQ ID NO: 59797 - DNA, 21 bp, Artificial Sequence
  Description of Artificial Sequence: Synthetic oligonucleotide
ggaggaggaccgggcgtcggt

SEQ ID NO: 59798 - DNA, 21 bp, Artificial Sequence
  Description of Artificial Sequence: Synthetic oligonucleotide
gaggaggaccgggcgtcggtg

SEQ ID NO: 59799 - DNA, 22 bp, Artificial Sequence
  Description of Artificial Sequence: Synthetic oligonucleotide
aggaggaccgggcgtcggtgga

SEQ ID NO: 59800 - DNA, 21 bp, Artificial Sequence
  Description of Artificial Sequence: Synthetic oligonucleotide
ggaggaccgggcgtcggtgga

SEQ ID NO: 59801 - DNA, 22 bp, Artificial Sequence
  Description of Artificial Sequence: Synthetic oligonucleotide
gaggaccgggcgtcggtggaca

SEQ ID NO: 59802 - DNA, 22 bp, Artificial Sequence
  Description of Artificial Sequence: Synthetic oligonucleotide
aggaccgggcgtcggtggacac

SEQ ID NO: 59803 - DNA, 21 bp, Artificial Sequence
  Description of Artificial Sequence: Synthetic oligonucleotide
ggaccgggcgtcggtggacac

SEQ ID NO: 59804 - DNA, 21 bp, Artificial Sequence
  Description of Artificial Sequence: Synthetic oligonucleotide
gaccgggcgtcggtggacacc

SEQ ID NO: 59805 - DNA, 24 bp, Artificial Sequence
  Description of Artificial Sequence: Synthetic oligonucleotide
accgggcgtcggtggacaccgtat

SEQ ID NO: 59806 - DNA, 23 bp, Artificial Sequence
  Description of Artificial Sequence: Synthetic oligonucleotide
ccgggcgtcggtggacaccgtat

SEQ ID NO: 59807 - DNA, 23 bp, Artificial Sequence
  Description of Artificial Sequence: Synthetic oligonucleotide
cgggcgtcggtggacaccgtatg

SEQ ID NO: 59808 - DNA, 24 bp, Artificial Sequence
  Description of Artificial Sequence: Synthetic oligonucleotide
gggcgtcggtggacaccgtatgca

SEQ ID NO: 59809 - DNA, 25 bp, Artificial Sequence
  Description of Artificial Sequence: Synthetic oligonucleotide
ggcgtcggtggacaccgtatgcaga

SEQ ID NO: 59810 - DNA, 26 bp, Artificial Sequence
  Description of Artificial Sequence: Synthetic oligonucleotide
gcgtcggtggacaccgtatgcagaca

SEQ ID NO: 59811 - DNA, 27 bp, Artificial Sequence
  Description of Artificial Sequence: Synthetic oligonucleotide
cgtcggtggacaccgtatgcagacaca

SEQ ID NO: 59812 - DNA, 28 bp, Artificial Sequence
  Description of Artificial Sequence: Synthetic oligonucleotide
gtcggtggacaccgtatgcagacacaac

SEQ ID NO: 59813 - DNA, 30 bp, Artificial Sequence
  Description of Artificial Sequence: Synthetic oligonucleotide
tcggtggacaccgtatgcagacacaactac

SEQ ID NO: 59814 - DNA, 29 bp, Artificial Sequence
  Description of Artificial Sequence: Synthetic oligonucleotide
cggtggacaccgtatgcagacacaactac

SEQ ID NO: 59815 - DNA, 29 bp, Artificial Sequence
  Description of Artificial Sequence: Synthetic oligonucleotide
ggtggacaccgtatgcagacacaactacc

SEQ ID NO: 59816 - DNA, 30 bp, Artificial Sequence
  Description of Artificial Sequence: Synthetic oligonucleotide
gtggacaccgtatgcagacacaactaccag

SEQ ID NO: 59817 - DNA, 32 bp, Artificial Sequence
  Description of Artificial Sequence: Synthetic oligonucleotide
tggacaccgtatgcagacacaactaccagttg

SEQ ID NO: 59818 - DNA, 31 bp, Artificial Sequence
  Description of Artificial Sequence: Synthetic oligonucleotide
ggacaccgtatgcagacacaactaccagttg

SEQ ID NO: 59819 - DNA, 31 bp, Artificial Sequence
  Description of Artificial Sequence: Synthetic oligonucleotide
gacaccgtatgcagacacaactaccagttgg

SEQ ID NO: 59820 - DNA, 32 bp, Artificial Sequence
  Description of Artificial Sequence: Synthetic oligonucleotide
acaccgtatgcagacacaactaccagttggag

SEQ ID NO: 59821 - DNA, 31 bp, Artificial Sequence
  Description of Artificial Sequence: Synthetic oligonucleotide
caccgtatgcagacacaactaccagttggag

SEQ ID NO: 59822 - DNA, 31 bp, Artificial Sequence
  Description of Artificial Sequence: Synthetic oligonucleotide
accgtatgcagacacaactaccagttggagc

SEQ ID NO: 59823 - DNA, 30 bp, Artificial Sequence
  Description of Artificial Sequence: Synthetic oligonucleotide
ccgtatgcagacacaactaccagttggagc

SEQ ID NO: 59824 - DNA, 31 bp, Artificial Sequence
  Description of Artificial Sequence: Synthetic oligonucleotide
cgtatgcagacacaactaccagttggagctc

SEQ ID NO: 59825 - DNA, 31 bp, Artificial Sequence
  Description of Artificial Sequence: Synthetic oligonucleotide
gtatgcagacacaactaccagttggagctcc

SEQ ID NO: 59826 - DNA, 31 bp, Artificial Sequence
  Description of Artificial Sequence: Synthetic oligonucleotide
tatgcagacacaactaccagttggagctccg

SEQ ID NO: 59827 - DNA, 30 bp, Artificial Sequence
  Description of Artificial Sequence: Synthetic oligonucleotide
atgcagacacaactaccagttggagctccg

SEQ ID NO: 59828 - DNA, 25 bp, Artificial Sequence
  Description of Artificial Sequence: Synthetic oligonucleotide
acagcgacgtgggggtgtatcgggt

SEQ ID NO: 59829 - DNA, 24 bp, Artificial Sequence
  Description of Artificial Sequence: Synthetic oligonucleotide
cagcgacgtgggggtgtatcgggt

SEQ ID NO: 59830 - DNA, 24 bp, Artificial Sequence
  Description of Artificial Sequence: Synthetic oligonucleotide
agcgacgtgggggtgtatcgggtg

SEQ ID NO: 59831 - DNA, 23 bp, Artificial Sequence
  Description of Artificial Sequence: Synthetic oligonucleotide
gcgacgtgggggtgtatcgggtg

SEQ ID NO: 59832 - DNA, 24 bp, Artificial Sequence
  Description of Artificial Sequence: Synthetic oligonucleotide
cgacgtgggggtgtatcgggtggt

SEQ ID NO: 59833 - DNA, 25 bp, Artificial Sequence
  Description of Artificial Sequence: Synthetic oligonucleotide
gacgtgggggtgtatcgggtggtga

SEQ ID NO: 59834 - DNA, 25 bp, Artificial Sequence
  Description of Artificial Sequence: Synthetic oligonucleotide
acgtgggggtgtatcgggtggtgac

SEQ ID NO: 59835 - DNA, 24 bp, Artificial Sequence
  Description of Artificial Sequence: Synthetic oligonucleotide
cgtgggggtgtatcgggtggtgac

SEQ ID NO: 59836 - DNA, 24 bp, Artificial Sequence
  Description of Artificial Sequence: Synthetic oligonucleotide
gtgggggtgtatcgggtggtgacg

SEQ ID NO: 59837 - DNA, 24 bp, Artificial Sequence
  Description of Artificial Sequence: Synthetic oligonucleotide
tgggggtgtatcgggtggtgacgc

SEQ ID NO: 59838 - DNA, 23 bp, Artificial Sequence
  Description of Artificial Sequence: Synthetic oligonucleotide
gggggtgtatcgggtggtgacgc

SEQ ID NO: 59839 - DNA, 23 bp, Artificial Sequence
  Description of Artificial Sequence: Synthetic oligonucleotide
ggggtgtatcgggtggtgacgcc

SEQ ID NO: 59840 - DNA, 23 bp, Artificial Sequence
  Description of Artificial Sequence: Synthetic oligonucleotide
gggtgtatcgggtggtgacgccg

SEQ ID NO: 59841 - DNA, 24 bp, Artificial Sequence
  Description of Artificial Sequence: Synthetic oligonucleotide
ggtgtatcgggtggtgacgccgct

SEQ ID NO: 59842 - DNA, 24 bp, Artificial Sequence
  Description of Artificial Sequence: Synthetic oligonucleotide
gtgtatcgggtggtgacgccgctg

SEQ ID NO: 59843 - DNA, 24 bp, Artificial Sequence
  Description of Artificial Sequence: Synthetic oligonucleotide
tgtatcgggtggtgacgccgctgg

SEQ ID NO: 59844 - DNA, 23 bp, Artificial Sequence
  Description of Artificial Sequence: Synthetic oligonucleotide
gtatcgggtggtgacgccgctgg

SEQ ID NO: 59845 - DNA, 23 bp, Artificial Sequence
  Description of Artificial Sequence: Synthetic oligonucleotide
tatcgggtggtgacgccgctggg

SEQ ID NO: 59846 - DNA, 22 bp, Artificial Sequence
  Description of Artificial Sequence: Synthetic oligonucleotide
atcgggtggtgacgccgctggg

SEQ ID NO: 59847 - DNA, 21 bp, Artificial Sequence
  Description of Artificial Sequence: Synthetic oligonucleotide
tcgggtggtgacgccgctggg

SEQ ID NO: 59848 - DNA, 20 bp, Artificial Sequence
  Description of Artificial Sequence: Synthetic oligonucleotide
cgggtggtgacgccgctggg

SEQ ID NO: 59849 - DNA, 20 bp, Artificial Sequence
  Description of Artificial Sequence: Synthetic oligonucleotide
gggtggtgacgccgctgggg

SEQ ID NO: 59850 - DNA, 20 bp, Artificial Sequence
  Description of Artificial Sequence: Synthetic oligonucleotide
ggtggtgacgccgctggggc

SEQ ID NO: 59851 - DNA, 20 bp, Artificial Sequence
  Description of Artificial Sequence: Synthetic oligonucleotide
gtggtgacgccgctggggcc

SEQ ID NO: 59852 - DNA, 20 bp, Artificial Sequence
  Description of Artificial Sequence: Synthetic oligonucleotide
tggtgacgccgctggggccg

SEQ ID NO: 59853 - DNA, 28 bp, Artificial Sequence
  Description of Artificial Sequence: Synthetic oligonucleotide
tggaacagccagaaggaagtcctggagg

SEQ ID NO: 59854 - DNA, 27 bp, Artificial Sequence
  Description of Artificial Sequence: Synthetic oligonucleotide
ggaacagccagaaggaagtcctggagg

SEQ ID NO: 59855 - DNA, 27 bp, Artificial Sequence
  Description of Artificial Sequence: Synthetic oligonucleotide
gaacagccagaaggaagtcctggaggg

SEQ ID NO: 59856 - DNA, 27 bp, Artificial Sequence
  Description of Artificial Sequence: Synthetic oligonucleotide
aacagccagaaggaagtcctggagggg

SEQ ID NO: 59857 - DNA, 27 bp, Artificial Sequence
  Description of Artificial Sequence: Synthetic oligonucleotide
acagccagaaggaagtcctggagggga

SEQ ID NO: 59858 - DNA, 26 bp, Artificial Sequence
  Description of Artificial Sequence: Synthetic oligonucleotide
cagccagaaggaagtcctggagggga

SEQ ID NO: 59859 - DNA, 26 bp, Artificial Sequence
  Description of Artificial Sequence: Synthetic oligonucleotide
agccagaaggaagtcctggaggggac

SEQ ID NO: 59860 - DNA, 25 bp, Artificial Sequence
  Description of Artificial Sequence: Synthetic oligonucleotide
gccagaaggaagtcctggaggggac

SEQ ID NO: 59861 - DNA, 25 bp, Artificial Sequence
  Description of Artificial Sequence: Synthetic oligonucleotide
ccagaaggaagtcctggaggggacc

SEQ ID NO: 59862 - DNA, 25 bp, Artificial Sequence
  Description of Artificial Sequence: Synthetic oligonucleotide
cagaaggaagtcctggaggggaccc

SEQ ID NO: 59863 - DNA, 25 bp, Artificial Sequence
  Description of Artificial Sequence: Synthetic oligonucleotide
agaaggaagtcctggaggggacccg

SEQ ID NO: 59864 - DNA, 24 bp, Artificial Sequence
  Description of Artificial Sequence: Synthetic oligonucleotide
gaaggaagtcctggaggggacccg

SEQ ID NO: 59865 - DNA, 24 bp, Artificial Sequence
  Description of Artificial Sequence: Synthetic oligonucleotide
aaggaagtcctggaggggacccgg

SEQ ID NO: 59866 - DNA, 23 bp, Artificial Sequence
  Description of Artificial Sequence: Synthetic oligonucleotide
aggaagtcctggaggggacccgg

SEQ ID NO: 59867 - DNA, 22 bp, Artificial Sequence
  Description of Artificial Sequence: Synthetic oligonucleotide
ggaagtcctggaggggacccgg

SEQ ID NO: 59868 - DNA, 22 bp, Artificial Sequence
  Description of Artificial Sequence: Synthetic oligonucleotide
gaagtcctggaggggacccggg

SEQ ID NO: 59869 - DNA, 22 bp, Artificial Sequence
  Description of Artificial Sequence: Synthetic oligonucleotide
aagtcctggaggggacccgggc

SEQ ID NO: 59870 - DNA, 21 bp, Artificial Sequence
  Description of Artificial Sequence: Synthetic oligonucleotide
agtcctggaggggacccgggc

SEQ ID NO: 59871 - DNA, 20 bp, Artificial Sequence
  Description of Artificial Sequence: Synthetic oligonucleotide
gtcctggaggggacccgggc

SEQ ID NO: 59872 - DNA, 20 bp, Artificial Sequence
  Description of Artificial Sequence: Synthetic oligonucleotide
tcctggaggggacccgggcg

SEQ ID NO: 59873 - DNA, 20 bp, Artificial Sequence
  Description of Artificial Sequence: Synthetic oligonucleotide
cctggaggggacccgggcgt

SEQ ID NO: 59874 - DNA, 20 bp, Artificial Sequence
  Description of Artificial Sequence: Synthetic oligonucleotide
ctggaggggacccgggcgga

SEQ ID NO: 59875 - DNA, 22 bp, Artificial Sequence
  Description of Artificial Sequence: Synthetic oligonucleotide
tggaggggacccgggcggagtt

SEQ ID NO: 59876 - DNA, 21 bp, Artificial Sequence
  Description of Artificial Sequence: Synthetic oligonucleotide
ggaggggacccgggcggagtt

SEQ ID NO: 59877 - DNA, 21 bp, Artificial Sequence
  Description of Artificial Sequence: Synthetic oligonucleotide
gaggggacccgggcggagttg

SEQ ID NO: 59878 - DNA, 22 bp, Artificial Sequence
  Description of Artificial Sequence: Synthetic oligonucleotide
aggggacccgggcggagttgga

SEQ ID NO: 59879 - DNA, 21 bp, Artificial Sequence
  Description of Artificial Sequence: Synthetic oligonucleotide
ggggacccgggcggagttgga

SEQ ID NO: 59880 - DNA, 22 bp, Artificial Sequence
  Description of Artificial Sequence: Synthetic oligonucleotide
gggacccgggcggagttggaca

SEQ ID NO: 59881 - DNA, 29 bp, Artificial Sequence
  Description of Artificial Sequence: Synthetic oligonucleotide
gtgatgctggaaatgactccccagcatgc

SEQ ID NO: 59882 - DNA, 29 bp, Artificial Sequence
  Description of Artificial Sequence: Synthetic oligonucleotide
tgatgctggaaatgactccccagcatgcc

SEQ ID NO: 59883 - DNA, 28 bp, Artificial Sequence
  Description of Artificial Sequence: Synthetic oligonucleotide
gatgctggaaatgactccccagcatgcc

SEQ ID NO: 59884 - DNA, 28 bp, Artificial Sequence
  Description of Artificial Sequence: Synthetic oligonucleotide
atgctggaaatgactccccagcatgccg

SEQ ID NO: 59885 - DNA, 27 bp, Artificial Sequence
  Description of Artificial Sequence: Synthetic oligonucleotide
tgctggaaatgactccccagcatgccg

SEQ ID NO: 59886 - DNA, 27 bp, Artificial Sequence
  Description of Artificial Sequence: Synthetic oligonucleotide
gctggaaatgactccccagcatgccgt

SEQ ID NO: 59887 - DNA, 27 bp, Artificial Sequence
  Description of Artificial Sequence: Synthetic oligonucleotide
ctggaaatgactccccagcatgccgtc

SEQ ID NO: 59888 - DNA, 29 bp, Artificial Sequence
  Description of Artificial Sequence: Synthetic oligonucleotide
tggaaatgactccccagcatgccgtctac

SEQ ID NO: 59889 - DNA, 28 bp, Artificial Sequence
  Description of Artificial Sequence: Synthetic oligonucleotide
ggaaatgactccccagcatgccgtctac

SEQ ID NO: 59890 - DNA, 29 bp, Artificial Sequence
  Description of Artificial Sequence: Synthetic oligonucleotide
gaaatgactccccagcatgccgtctacac

SEQ ID NO: 59891 - DNA, 29 bp, Artificial Sequence
  Description of Artificial Sequence: Synthetic oligonucleotide
aaatgactccccagcatgccgtctacacc

SEQ ID NO: 59892 - DNA, 28 bp, Artificial Sequence
  Description of Artificial Sequence: Synthetic oligonucleotide
aatgactccccagcatgccgtctacacc

SEQ ID NO: 59893 - DNA, 27 bp, Artificial Sequence
  Description of Artificial Sequence: Synthetic oligonucleotide
atgactccccagcatgccgtctacacc

SEQ ID NO: 59894 - DNA, 27 bp, Artificial Sequence
  Description of Artificial Sequence: Synthetic oligonucleotide
tgactccccagcatgccgtctacacct

SEQ ID NO: 59895 - DNA, 26 bp, Artificial Sequence
  Description of Artificial Sequence: Synthetic oligonucleotide
gactccccagcatgccgtctacacct

SEQ ID NO: 59896 - DNA, 26 bp, Artificial Sequence
  Description of Artificial Sequence: Synthetic oligonucleotide
actccccagcatgccgtctacacctg

SEQ ID NO: 59897 - DNA, 25 bp, Artificial Sequence
  Description of Artificial Sequence: Synthetic oligonucleotide
ctccccagcatgccgtctacacctg

SEQ ID NO: 59898 - DNA, 25 bp, Artificial Sequence
  Description of Artificial Sequence: Synthetic oligonucleotide
tccccagcatgccgtctacacctgc

SEQ ID NO: 59899 - DNA, 24 bp, Artificial Sequence
  Description of Artificial Sequence: Synthetic oligonucleotide
ccccagcatgccgtctacacctgc

SEQ ID NO: 59900 - DNA, 25 bp, Artificial Sequence
  Description of Artificial Sequence: Synthetic oligonucleotide
cccagcatgccgtctacacctgcca

SEQ ID NO: 59901 - DNA, 25 bp, Artificial Sequence
  Description of Artificial Sequence: Synthetic oligonucleotide
ccagcatgccgtctacacctgccac

SEQ ID NO: 59902 - DNA, 26 bp, Artificial Sequence
  Description of Artificial Sequence: Synthetic oligonucleotide
cagcatgccgtctacacctgccacgt

SEQ ID NO: 59903 - DNA, 26 bp, Artificial Sequence
  Description of Artificial Sequence: Synthetic oligonucleotide
agcatgccgtctacacctgccacgtg

SEQ ID NO: 59904 - DNA, 25 bp, Artificial Sequence
  Description of Artificial Sequence: Synthetic oligonucleotide
gcatgccgtctacacctgccacgtg

SEQ ID NO: 59905 - DNA, 26 bp, Artificial Sequence
  Description of Artificial Sequence: Synthetic oligonucleotide
catgccgtctacacctgccacgtgga

SEQ ID NO: 59906 - DNA, 26 bp, Artificial Sequence
  Description of Artificial Sequence: Synthetic oligonucleotide
atgccgtctacacctgccacgtggag

SEQ ID NO: 59907 - DNA, 25 bp, Artificial Sequence
  Description of Artificial Sequence: Synthetic oligonucleotide
tgccgtctacacctgccacgtggag

SEQ ID NO: 59908 - DNA, 24 bp, Artificial Sequence
  Description of Artificial Sequence: Synthetic oligonucleotide
gccgtctacacctgccacgtggag

SEQ ID NO: 59909 - DNA, 25 bp, Artificial Sequence
  Description of Artificial Sequence: Synthetic oligonucleotide
ccgtctacacctgccacgtggagca

SEQ ID NO: 59910 - DNA, 32 bp, Artificial Sequence
  Description of Artificial Sequence: Synthetic oligonucleotide
aggatttcgtgtaccagtttaagggcctgtgc

SEQ ID NO: 59911 - DNA, 31 bp, Artificial Sequence
  Description of Artificial Sequence: Synthetic oligonucleotide
ggatttcgtgtaccagtttaagggcctgtgc

SEQ ID NO: 59912 - DNA, 33 bp, Artificial Sequence
  Description of Artificial Sequence: Synthetic oligonucleotide
gatttcgtgtaccagtttaagggcctgtgctac

SEQ ID NO: 59913 - DNA, 35 bp, Artificial Sequence
  Description of Artificial Sequence: Synthetic oligonucleotide
atttcgtgtaccagtttaagggcctgtgctacttc

SEQ ID NO: 59914 - DNA, 34 bp, Artificial Sequence
  Description of Artificial Sequence: Synthetic oligonucleotide
tttcgtgtaccagtttaagggcctgtgctacttc

SEQ ID NO: 59915 - DNA, 33 bp, Artificial Sequence
  Description of Artificial Sequence: Synthetic oligonucleotide
ttcgtgtaccagtttaagggcctgtgctacttc

SEQ ID NO: 59916 - DNA, 32 bp, Artificial Sequence
  Description of Artificial Sequence: Synthetic oligonucleotide
tcgtgtaccagtttaagggcctgtgctacttc

SEQ ID NO: 59917 - DNA, 31 bp, Artificial Sequence
  Description of Artificial Sequence: Synthetic oligonucleotide
cgtgtaccagtttaagggcctgtgctacttc

SEQ ID NO: 59918 - DNA, 32 bp, Artificial Sequence
  Description of Artificial Sequence: Synthetic oligonucleotide
gtgtaccagtttaagggcctgtgctacttcac

SEQ ID NO: 59919 - DNA, 32 bp, Artificial Sequence
  Description of Artificial Sequence: Synthetic oligonucleotide
tgtaccagtttaagggcctgtgctacttcacc

SEQ ID NO: 59920 - DNA, 31 bp, Artificial Sequence
  Description of Artificial Sequence: Synthetic oligonucleotide
gtaccagtttaagggcctgtgctacttcacc

SEQ ID NO: 59921 - DNA, 33 bp, Artificial Sequence
  Description of Artificial Sequence: Synthetic oligonucleotide
taccagtttaagggcctgtgctacttcaccaac

SEQ ID NO: 59922 - DNA, 32 bp, Artificial Sequence
  Description of Artificial Sequence: Synthetic oligonucleotide
accagtttaagggcctgtgctacttcaccaac

SEQ ID NO: 59923 - DNA, 31 bp, Artificial Sequence
  Description of Artificial Sequence: Synthetic oligonucleotide
ccagtttaagggcctgtgctacttcaccaac

SEQ ID NO: 59924 - DNA, 31 bp, Artificial Sequence
  Description of Artificial Sequence: Synthetic oligonucleotide
cagtttaagggcctgtgctacttcaccaacg

SEQ ID NO: 59925 - DNA, 31 bp, Artificial Sequence
  Description of Artificial Sequence: Synthetic oligonucleotide
agtttaagggcctgtgctacttcaccaacgg

SEQ ID NO: 59926 - DNA, 30 bp, Artificial Sequence
  Description of Artificial Sequence: Synthetic oligonucleotide
gtttaagggcctgtgctacttcaccaacgg

SEQ ID NO: 59927 - DNA, 30 bp, Artificial Sequence
  Description of Artificial Sequence: Synthetic oligonucleotide
tttaagggcctgtgctacttcaccaacggg

SEQ ID NO: 59928 - DNA, 29 bp, Artificial Sequence
  Description of Artificial Sequence: Synthetic oligonucleotide
ttaagggcctgtgctacttcaccaacggg

SEQ ID NO: 59929 - DNA, 28 bp, Artificial Sequence
  Description of Artificial Sequence: Synthetic oligonucleotide
taagggcctgtgctacttcaccaacggg

SEQ ID NO: 59930 - DNA, 27 bp, Artificial Sequence
  Description of Artificial Sequence: Synthetic oligonucleotide
aagggcctgtgctacttcaccaacggg

SEQ ID NO: 59931 - DNA, 27 bp, Artificial Sequence
  Description of Artificial Sequence: Synthetic oligonucleotide
agggcctgtgctacttcaccaacggga

SEQ ID NO: 59932 - DNA, 26 bp, Artificial Sequence
  Description of Artificial Sequence: Synthetic oligonucleotide
gggcctgtgctacttcaccaacggga

SEQ ID NO: 59933 - DNA, 26 bp, Artificial Sequence
  Description of Artificial Sequence: Synthetic oligonucleotide
ggcctgtgctacttcaccaacgggac

SEQ ID NO: 59934 - DNA, 26 bp, Artificial Sequence
  Description of Artificial Sequence: Synthetic oligonucleotide
gcctgtgctacttcaccaacgggacg

SEQ ID NO: 59935 - DNA, 27 bp, Artificial Sequence
  Description of Artificial Sequence: Synthetic oligonucleotide
cctgtgctacttcaccaacgggacgga

SEQ ID NO: 59936 - DNA, 27 bp, Artificial Sequence
  Description of Artificial Sequence: Synthetic oligonucleotide
ctgtgctacttcaccaacgggacggag

SEQ ID NO: 59937 - DNA, 29 bp, Artificial Sequence
  Description of Artificial Sequence: Synthetic oligonucleotide
ccgagtactggaacagccagaaggaagac

SEQ ID NO: 59938 - DNA, 29 bp, Artificial Sequence
  Description of Artificial Sequence: Synthetic oligonucleotide
cgagtactggaacagccagaaggaagacc

SEQ ID NO: 59939 - DNA, 30 bp, Artificial Sequence
  Description of Artificial Sequence: Synthetic oligonucleotide
gagtactggaacagccagaaggaagacctg

SEQ ID NO: 59940 - DNA, 30 bp, Artificial Sequence
  Description of Artificial Sequence: Synthetic oligonucleotide
agtactggaacagccagaaggaagacctgg

SEQ ID NO: 59941 - DNA, 29 bp, Artificial Sequence
  Description of Artificial Sequence: Synthetic oligonucleotide
gtactggaacagccagaaggaagacctgg

SEQ ID NO: 59942 - DNA, 30 bp, Artificial Sequence
  Description of Artificial Sequence: Synthetic oligonucleotide
tactggaacagccagaaggaagacctggag

SEQ ID NO: 59943 - DNA, 29 bp, Artificial Sequence
  Description of Artificial Sequence: Synthetic oligonucleotide
actggaacagccagaaggaagacctggag

SEQ ID NO: 59944 - DNA, 28 bp, Artificial Sequence
  Description of Artificial Sequence: Synthetic oligonucleotide
ctggaacagccagaaggaagacctggag

SEQ ID NO: 59945 - DNA, 29 bp, Artificial Sequence
  Description of Artificial Sequence: Synthetic oligonucleotide
tggaacagccagaaggaagacctggagag

SEQ ID NO: 59946 - DNA, 28 bp, Artificial Sequence
  Description of Artificial Sequence: Synthetic oligonucleotide
ggaacagccagaaggaagacctggagag

SEQ ID NO: 59947 - DNA, 28 bp, Artificial Sequence
  Description of Artificial Sequence: Synthetic oligonucleotide
gaacagccagaaggaagacctggagagg

SEQ ID NO: 59948 - DNA, 29 bp, Artificial Sequence
  Description of Artificial Sequence: Synthetic oligonucleotide
aacagccagaaggaagacctggagaggac

SEQ ID NO: 59949 - DNA, 28 bp, Artificial Sequence
  Description of Artificial Sequence: Synthetic oligonucleotide
acagccagaaggaagacctggagaggac

SEQ ID NO: 59950 - DNA, 27 bp, Artificial Sequence
  Description of Artificial Sequence: Synthetic oligonucleotide
cagccagaaggaagacctggagaggac

SEQ ID NO: 59951 - DNA, 27 bp, Artificial Sequence
  Description of Artificial Sequence: Synthetic oligonucleotide
agccagaaggaagacctggagaggacc

SEQ ID NO: 59952 - DNA, 26 bp, Artificial Sequence
  Description of Artificial Sequence: Synthetic oligonucleotide
gccagaaggaagacctggagaggacc

SEQ ID NO: 59953 - DNA, 26 bp, Artificial Sequence
  Description of Artificial Sequence: Synthetic oligonucleotide
ccagaaggaagacctggagaggaccc

SEQ ID NO: 59954 - DNA, 26 bp, Artificial Sequence
  Description of Artificial Sequence: Synthetic oligonucleotide
cagaaggaagacctggagaggacccg

SEQ ID NO: 59955 - DNA, 26 bp, Artificial Sequence
  Description of Artificial Sequence: Synthetic oligonucleotide
agaaggaagacctggagaggacccgg

SEQ ID NO: 59956 - DNA, 25 bp, Artificial Sequence
  Description of Artificial Sequence: Synthetic oligonucleotide
gaaggaagacctggagaggacccgg

SEQ ID NO: 59957 - DNA, 25 bp, Artificial Sequence
  Description of Artificial Sequence: Synthetic oligonucleotide
aaggaagacctggagaggacccggg

SEQ ID NO: 59958 - DNA, 24 bp, Artificial Sequence
  Description of Artificial Sequence: Synthetic oligonucleotide
aggaagacctggagaggacccggg

SEQ ID NO: 59959 - DNA, 23 bp, Artificial Sequence
  Description of Artificial Sequence: Synthetic oligonucleotide
ggaagacctggagaggacccggg

SEQ ID NO: 59960 - DNA, 23 bp, Artificial Sequence
  Description of Artificial Sequence: Synthetic oligonucleotide
gaagacctggagaggacccgggc

SEQ ID NO: 59961 - DNA, 23 bp, Artificial Sequence
  Description of Artificial Sequence: Synthetic oligonucleotide
aagacctggagaggacccgggcg

SEQ ID NO: 59962 - DNA, 22 bp, Artificial Sequence
  Description of Artificial Sequence: Synthetic oligonucleotide
agacctggagaggacccgggcg

SEQ ID NO: 59963 - DNA, 21 bp, Artificial Sequence
  Description of Artificial Sequence: Synthetic oligonucleotide
gacctggagaggacccgggcg

SEQ ID NO: 59964 - DNA, 22 bp, Artificial Sequence
  Description of Artificial Sequence: Synthetic oligonucleotide
acctggagaggacccgggcgga

SEQ ID NO: 59965 - DNA, 23 bp, Artificial Sequence
  Description of Artificial Sequence: Synthetic oligonucleotide
acagcgacgtgggggtgtaccgg

SEQ ID NO: 59966 - DNA, 22 bp, Artificial Sequence
  Description of Artificial Sequence: Synthetic oligonucleotide
cagcgacgtgggggtgtaccgg

SEQ ID NO: 59967 - DNA, 22 bp, Artificial Sequence
  Description of Artificial Sequence: Synthetic oligonucleotide
agcgacgtgggggtgtaccggg

SEQ ID NO: 59968 - DNA, 21 bp, Artificial Sequence
  Description of Artificial Sequence: Synthetic oligonucleotide
gcgacgtgggggtgtaccggg

SEQ ID NO: 59969 - DNA, 21 bp, Artificial Sequence
  Description of Artificial Sequence: Synthetic oligonucleotide
cgacgtgggggtgtaccgggc

SEQ ID NO: 59970 - DNA, 21 bp, Artificial Sequence
  Description of Artificial Sequence: Synthetic oligonucleotide
gacgtgggggtgtaccgggcg

SEQ ID NO: 59971 - DNA, 22 bp, Artificial Sequence
  Description of Artificial Sequence: Synthetic oligonucleotide
acgtgggggtgtaccgggcggt

SEQ ID NO: 59972 - DNA, 21 bp, Artificial Sequence
  Description of Artificial Sequence: Synthetic oligonucleotide
cgtgggggtgtaccgggcggt

SEQ ID NO: 59973 - DNA, 22 bp, Artificial Sequence
  Description of Artificial Sequence: Synthetic oligonucleotide
gtgggggtgtaccgggcggtga

SEQ ID NO: 59974 - DNA, 22 bp, Artificial Sequence
  Description of Artificial Sequence: Synthetic oligonucleotide
tgggggtgtaccgggcggtgac

SEQ ID NO: 59975 - DNA, 21 bp, Artificial Sequence
  Description of Artificial Sequence: Synthetic oligonucleotide
gggggtgtaccgggcggtgac

SEQ ID NO: 59976 - DNA, 21 bp, Artificial Sequence
  Description of Artificial Sequence: Synthetic oligonucleotide
ggggtgtaccgggcggtgacg

SEQ ID NO: 59977 - DNA, 21 bp, Artificial Sequence
  Description of Artificial Sequence: Synthetic oligonucleotide
gggtgtaccgggcggtgacgc

SEQ ID NO: 59978 - DNA, 25 bp, Artificial Sequence
  Description of Artificial Sequence: Synthetic oligonucleotide
gcctgacgccgagtactggaacagg

SEQ ID NO: 59979 - DNA, 26 bp, Artificial Sequence
  Description of Artificial Sequence: Synthetic oligonucleotide
cctgacgccgagtactggaacaggca

SEQ ID NO: 59980 - DNA, 27 bp, Artificial Sequence
  Description of Artificial Sequence: Synthetic oligonucleotide
ctgacgccgagtactggaacaggcaga

SEQ ID NO: 59981 - DNA, 28 bp, Artificial Sequence
  Description of Artificial Sequence: Synthetic oligonucleotide
tgacgccgagtactggaacaggcagaag

SEQ ID NO: 59982 - DNA, 27 bp, Artificial Sequence
  Description of Artificial Sequence: Synthetic oligonucleotide
gacgccgagtactggaacaggcagaag

SEQ ID NO: 59983 - DNA, 27 bp, Artificial Sequence
  Description of Artificial Sequence: Synthetic oligonucleotide
acgccgagtactggaacaggcagaagg

SEQ ID NO: 59984 - DNA, 27 bp, Artificial Sequence
  Description of Artificial Sequence: Synthetic oligonucleotide
cgccgagtactggaacaggcagaagga

SEQ ID NO: 59985 - DNA, 28 bp, Artificial Sequence
  Description of Artificial Sequence: Synthetic oligonucleotide
gccgagtactggaacaggcagaaggaag

SEQ ID NO: 59986 - DNA, 29 bp, Artificial Sequence
  Description of Artificial Sequence: Synthetic oligonucleotide
ccgagtactggaacaggcagaaggaagtc

SEQ ID NO: 59987 - DNA, 29 bp, Artificial Sequence
  Description of Artificial Sequence: Synthetic oligonucleotide
cgagtactggaacaggcagaaggaagtcc

SEQ ID NO: 59988 - DNA, 30 bp, Artificial Sequence
  Description of Artificial Sequence: Synthetic oligonucleotide
gagtactggaacaggcagaaggaagtcctg

SEQ ID NO: 59989 - DNA, 30 bp, Artificial Sequence
  Description of Artificial Sequence: Synthetic oligonucleotide
agtactggaacaggcagaaggaagtcctgg

SEQ ID NO: 59990 - DNA, 29 bp, Artificial Sequence
  Description of Artificial Sequence: Synthetic oligonucleotide
gtactggaacaggcagaaggaagtcctgg

SEQ ID NO: 59991 - DNA, 30 bp, Artificial Sequence
  Description of Artificial Sequence: Synthetic oligonucleotide
tactggaacaggcagaaggaagtcctggag

SEQ ID NO: 59992 - DNA, 29 bp, Artificial Sequence
  Description of Artificial Sequence: Synthetic oligonucleotide
actggaacaggcagaaggaagtcctggag

SEQ ID NO: 59993 - DNA, 28 bp, Artificial Sequence
  Description of Artificial Sequence: Synthetic oligonucleotide
ctggaacaggcagaaggaagtcctggag

SEQ ID NO: 59994 - DNA, 29 bp, Artificial Sequence
  Description of Artificial Sequence: Synthetic oligonucleotide
tggaacaggcagaaggaagtcctggagag

SEQ ID NO: 59995 - DNA, 28 bp, Artificial Sequence
  Description of Artificial Sequence: Synthetic oligonucleotide
ggaacaggcagaaggaagtcctggagag

SEQ ID NO: 59996 - DNA, 28 bp, Artificial Sequence
  Description of Artificial Sequence: Synthetic oligonucleotide
gaacaggcagaaggaagtcctggagagg

SEQ ID NO: 59997 - DNA, 29 bp, Artificial Sequence
  Description of Artificial Sequence: Synthetic oligonucleotide
aacaggcagaaggaagtcctggagaggac

SEQ ID NO: 59998 - DNA, 28 bp, Artificial Sequence
  Description of Artificial Sequence: Synthetic oligonucleotide
acaggcagaaggaagtcctggagaggac

SEQ ID NO: 59999 - DNA, 27 bp, Artificial Sequence
  Description of Artificial Sequence: Synthetic oligonucleotide
caggcagaaggaagtcctggagaggac

SEQ ID NO: 60000 - DNA, 27 bp, Artificial Sequence
  Description of Artificial Sequence: Synthetic oligonucleotide
aggcagaaggaagtcctggagaggacc

SEQ ID NO: 60001 - DNA, 26 bp, Artificial Sequence
  Description of Artificial Sequence: Synthetic oligonucleotide
ggcagaaggaagtcctggagaggacc

SEQ ID NO: 60002 - DNA, 26 bp, Artificial Sequence
  Description of Artificial Sequence: Synthetic oligonucleotide
gcagaaggaagtcctggagaggaccc

SEQ ID NO: 60003 - DNA, 20 bp, Artificial Sequence
  Description of Artificial Sequence: Synthetic oligonucleotide
gcggtgacgccgctggggca

SEQ ID NO: 60004 - DNA, 20 bp, Artificial Sequence
  Description of Artificial Sequence: Synthetic oligonucleotide
cggtgacgccgctggggcag

SEQ ID NO: 60005 - DNA, 20 bp, Artificial Sequence
  Description of Artificial Sequence: Synthetic oligonucleotide
ggtgacgccgctggggcagc

SEQ ID NO: 60006 - DNA, 21 bp, Artificial Sequence
  Description of Artificial Sequence: Synthetic oligonucleotide
gtgacgccgctggggcagcct

SEQ ID NO: 60007 - DNA, 22 bp, Artificial Sequence
  Description of Artificial Sequence: Synthetic oligonucleotide
tgacgccgctggggcagcctga

SEQ ID NO: 60008 - DNA, 21 bp, Artificial Sequence
  Description of Artificial Sequence: Synthetic oligonucleotide
gacgccgctggggcagcctga

SEQ ID NO: 60009 - DNA, 21 bp, Artificial Sequence
  Description of Artificial Sequence: Synthetic oligonucleotide
acgccgctggggcagcctgac

SEQ ID NO: 60010 - DNA, 20 bp, Artificial Sequence
  Description of Artificial Sequence: Synthetic oligonucleotide
cgccgctggggcagcctgac

SEQ ID NO: 60011 - DNA, 20 bp, Artificial Sequence
  Description of Artificial Sequence: Synthetic oligonucleotide
gccgctggggcagcctgacg

SEQ ID NO: 60012 - DNA, 20 bp, Artificial Sequence
  Description of Artificial Sequence: Synthetic oligonucleotide
ccgctggggcagcctgacgc

SEQ ID NO: 60013 - DNA, 20 bp, Artificial Sequence
  Description of Artificial Sequence: Synthetic oligonucleotide
cgctggggcagcctgacgcc

SEQ ID NO: 60014 - DNA, 21 bp, Artificial Sequence
  Description of Artificial Sequence: Synthetic oligonucleotide
gctggggcagcctgacgccga

SEQ ID NO: 60015 - DNA, 23 bp, Artificial Sequence
  Description of Artificial Sequence: Synthetic oligonucleotide
ctggggcagcctgacgccgagta

SEQ ID NO: 60016 - DNA, 24 bp, Artificial Sequence
  Description of Artificial Sequence: Synthetic oligonucleotide
tggggcagcctgacgccgagtact

SEQ ID NO: 60017 - DNA, 23 bp, Artificial Sequence
  Description of Artificial Sequence: Synthetic oligonucleotide
ggggcagcctgacgccgagtact

SEQ ID NO: 60018 - DNA, 23 bp, Artificial Sequence
  Description of Artificial Sequence: Synthetic oligonucleotide
gggcagcctgacgccgagtactg

SEQ ID NO: 60019 - DNA, 25 bp, Artificial Sequence
  Description of Artificial Sequence: Synthetic oligonucleotide
ggcagcctgacgccgagtactggaa

SEQ ID NO: 60020 - DNA, 26 bp, Artificial Sequence
  Description of Artificial Sequence: Synthetic oligonucleotide
gcagcctgacgccgagtactggaaca

SEQ ID NO: 60021 - DNA, 26 bp, Artificial Sequence
  Description of Artificial Sequence: Synthetic oligonucleotide
cagcctgacgccgagtactggaacag

SEQ ID NO: 60022 - DNA, 26 bp, Artificial Sequence
  Description of Artificial Sequence: Synthetic oligonucleotide
agcctgacgccgagtactggaacagc

SEQ ID NO: 60023 - DNA, 23 bp, Artificial Sequence
  Description of Artificial Sequence: Synthetic oligonucleotide
gggacggagcgcgtgcgtcttct

SEQ ID NO: 60024 - DNA, 24 bp, Artificial Sequence
  Description of Artificial Sequence: Synthetic oligonucleotide
ggacggagcgcgtgcgtcttctga

SEQ ID NO: 60025 - DNA, 24 bp, Artificial Sequence
  Description of Artificial Sequence: Synthetic oligonucleotide
gacggagcgcgtgcgtcttctgac

SEQ ID NO: 60026 - DNA, 25 bp, Artificial Sequence
  Description of Artificial Sequence: Synthetic oligonucleotide
acggagcgcgtgcgtcttctgacca

SEQ ID NO: 60027 - DNA, 24 bp, Artificial Sequence
  Description of Artificial Sequence: Synthetic oligonucleotide
cggagcgcgtgcgtcttctgacca

SEQ ID NO: 60028 - DNA, 27 bp, Artificial Sequence
  Description of Artificial Sequence: Synthetic oligonucleotide
ggagcgcgtgcgtcttctgaccagata

SEQ ID NO: 60029 - DNA, 27 bp, Artificial Sequence
  Description of Artificial Sequence: Synthetic oligonucleotide
gagcgcgtgcgtcttctgaccagatac

SEQ ID NO: 60030 - DNA, 29 bp, Artificial Sequence
  Description of Artificial Sequence: Synthetic oligonucleotide
agcgcgtgcgtcttctgaccagatacatc

SEQ ID NO: 60031 - DNA, 28 bp, Artificial Sequence
  Description of Artificial Sequence: Synthetic oligonucleotide
gcgcgtgcgtcttctgaccagatacatc

SEQ ID NO: 60032 - DNA, 33 bp, Artificial Sequence
  Description of Artificial Sequence: Synthetic oligonucleotide
cgcgtgcgtcttctgaccagatacatctataac

SEQ ID NO: 60033 - DNA, 33 bp, Artificial Sequence
  Description of Artificial Sequence: Synthetic oligonucleotide
gcgtgcgtcttctgaccagatacatctataacc

SEQ ID NO: 60034 - DNA, 33 bp, Artificial Sequence
  Description of Artificial Sequence: Synthetic oligonucleotide
cgtgcgtcttctgaccagatacatctataaccg

SEQ ID NO: 60035 - DNA, 34 bp, Artificial Sequence
  Description of Artificial Sequence: Synthetic oligonucleotide
gtgcgtcttctgaccagatacatctataaccgag

SEQ ID NO: 60036 - DNA, 35 bp, Artificial Sequence
  Description of Artificial Sequence: Synthetic oligonucleotide
tgcgtcttctgaccagatacatctataaccgagag

SEQ ID NO: 60037 - DNA, 34 bp, Artificial Sequence
  Description of Artificial Sequence: Synthetic oligonucleotide
gcgtcttctgaccagatacatctataaccgagag

SEQ ID NO: 60038 - DNA, 34 bp, Artificial Sequence
  Description of Artificial Sequence: Synthetic oligonucleotide
cgtcttctgaccagatacatctataaccgagagg

SEQ ID NO: 60039 - DNA, 35 bp, Artificial Sequence
  Description of Artificial Sequence: Synthetic oligonucleotide
gtcttctgaccagatacatctataaccgagaggag

SEQ ID NO: 60040 - DNA, 37 bp, Artificial Sequence
  Description of Artificial Sequence: Synthetic oligonucleotide
tcttctgaccagatacatctataaccgagaggagtac

SEQ ID NO: 60041 - DNA, 36 bp, Artificial Sequence
  Description of Artificial Sequence: Synthetic oligonucleotide
cttctgaccagatacatctataaccgagaggagtac

SEQ ID NO: 60042 - DNA, 36 bp, Artificial Sequence
  Description of Artificial Sequence: Synthetic oligonucleotide
ttctgaccagatacatctataaccgagaggagtacg

SEQ ID NO: 60043 - DNA, 35 bp, Artificial Sequence
  Description of Artificial Sequence: Synthetic oligonucleotide
tctgaccagatacatctataaccgagaggagtacg

SEQ ID NO: 60044 - DNA, 34 bp, Artificial Sequence
  Description of Artificial Sequence: Synthetic oligonucleotide
ctgaccagatacatctataaccgagaggagtacg

SEQ ID NO: 60045 - DNA, 37 bp, Artificial Sequence
  Description of Artificial Sequence: Synthetic oligonucleotide
ttgtgaccagatacatctataaccgagaggagtacac

SEQ ID NO: 60046 - DNA, 36 bp, Artificial Sequence
  Description of Artificial Sequence: Synthetic oligonucleotide
tgtgaccagatacatctataaccgagaggagtacac

SEQ ID NO: 60047 - DNA, 35 bp, Artificial Sequence
  Description of Artificial Sequence: Synthetic oligonucleotide
gtgaccagatacatctataaccgagaggagtacac

SEQ ID NO: 60048 - DNA, 36 bp, Artificial Sequence
  Description of Artificial Sequence: Synthetic oligonucleotide
tgaccagatacatctataaccgagaggagtacacac

SEQ ID NO: 60049 - DNA, 35 bp, Artificial Sequence
  Description of Artificial Sequence: Synthetic oligonucleotide
gaccagatacatctataaccgagaggagtacacac

SEQ ID NO: 60050 - DNA, 35 bp, Artificial Sequence
  Description of Artificial Sequence: Synthetic oligonucleotide
accagatacatctataaccgagaggagtacacacg

SEQ ID NO: 60051 - DNA, 34 bp, Artificial Sequence
  Description of Artificial Sequence: Synthetic oligonucleotide
ccagatacatctataaccgagaggagtacacacg

SEQ ID NO: 60052 - DNA, 34 bp, Artificial Sequence
  Description of Artificial Sequence: Synthetic oligonucleotide
cagatacatctataaccgagaggagtacacacgc

SEQ ID NO: 60053 - DNA, 36 bp, Artificial Sequence
  Description of Artificial Sequence: Synthetic oligonucleotide
agatacatctataaccgagaggagtacacacgcttc

SEQ ID NO: 60054 - DNA, 35 bp, Artificial Sequence
  Description of Artificial Sequence: Synthetic oligonucleotide
gatacatctataaccgagaggagtacacacgcttc

SEQ ID NO: 60055 - DNA, 35 bp, Artificial Sequence
  Description of Artificial Sequence: Synthetic oligonucleotide
atacatctataaccgagaggagtacacacgcttcg

SEQ ID NO: 60056 - DNA, 34 bp, Artificial Sequence
  Description of Artificial Sequence: Synthetic oligonucleotide
tacatctataaccgagaggagtacacacgcttcg

SEQ ID NO: 60057 - DNA, 33 bp, Artificial Sequence
  Description of Artificial Sequence: Synthetic oligonucleotide
acatctataaccgagaggagtacacacgcttcg

SEQ ID NO: 60058 - DNA, 32 bp, Artificial Sequence
  Description of Artificial Sequence: Synthetic oligonucleotide
catctataaccgagaggagtacacacgcttcg

SEQ ID NO: 60059 - DNA, 33 bp, Artificial Sequence
  Description of Artificial Sequence: Synthetic oligonucleotide
atctataaccgagaggagtacacacgcttcgac

SEQ ID NO: 60060 - DNA, 32 bp, Artificial Sequence
  Description of Artificial Sequence: Synthetic oligonucleotide
tctataaccgagaggagtacacacgcttcgac

SEQ ID NO: 60061 - DNA, 31 bp, Artificial Sequence
  Description of Artificial Sequence: Synthetic oligonucleotide
ctataaccgagaggagtacacacgcttcgac

SEQ ID NO: 60062 - DNA, 32 bp, Artificial Sequence
  Description of Artificial Sequence: Synthetic oligonucleotide
tataaccgagaggagtacacacgcttcgacag

SEQ ID NO: 60063 - DNA, 31 bp, Artificial Sequence
  Description of Artificial Sequence: Synthetic oligonucleotide
ataaccgagaggagtacacacgcttcgacag

SEQ ID NO: 60064 - DNA, 30 bp, Artificial Sequence
  Description of Artificial Sequence: Synthetic oligonucleotide
taaccgagaggagtacacacgcttcgacag

SEQ ID NO: 60065 - DNA, 29 bp, Artificial Sequence
  Description of Artificial Sequence: Synthetic oligonucleotide
aaccgagaggagtacacacgcttcgacag

SEQ ID NO: 60066 - DNA, 28 bp, Artificial Sequence
  Description of Artificial Sequence: Synthetic oligonucleotide
accgagaggagtacacacgcttcgacag

SEQ ID NO: 60067 - DNA, 27 bp, Artificial Sequence
  Description of Artificial Sequence: Synthetic oligonucleotide
ccgagaggagtacacacgcttcgacag

SEQ ID NO: 60068 - DNA, 27 bp, Artificial Sequence
  Description of Artificial Sequence: Synthetic oligonucleotide
cgagaggagtacacacgcttcgacagc

SEQ ID NO: 60069 - DNA, 27 bp, Artificial Sequence
  Description of Artificial Sequence: Synthetic oligonucleotide
gagaggagtacacacgcttcgacagcg

SEQ ID NO: 60070 - DNA, 28 bp, Artificial Sequence
  Description of Artificial Sequence: Synthetic oligonucleotide
agaggagtacacacgcttcgacagcgac

SEQ ID NO: 60071 - DNA, 27 bp, Artificial Sequence
  Description of Artificial Sequence: Synthetic oligonucleotide
gaggagtacacacgcttcgacagcgac

SEQ ID NO: 60072 - DNA, 27 bp, Artificial Sequence
  Description of Artificial Sequence: Synthetic oligonucleotide
aggagtacacacgcttcgacagcgacg

SEQ ID NO: 60073 - DNA, 27 bp, Artificial Sequence
  Description of Artificial Sequence: Synthetic oligonucleotide
ggagtacacacgcttcgacagcgacgt

SEQ ID NO: 60074 - DNA, 27 bp, Artificial Sequence
  Description of Artificial Sequence: Synthetic oligonucleotide
gagtacacacgcttcgacagcgacgtg

SEQ ID NO: 60075 - DNA, 27 bp, Artificial Sequence
  Description of Artificial Sequence: Synthetic oligonucleotide
agtacacacgcttcgacagcgacgtgg

SEQ ID NO: 60076 - DNA, 26 bp, Artificial Sequence
  Description of Artificial Sequence: Synthetic oligonucleotide
gtacacacgcttcgacagcgacgtgg

SEQ ID NO: 60077 - DNA, 26 bp, Artificial Sequence
  Description of Artificial Sequence: Synthetic oligonucleotide
tacacacgcttcgacagcgacgtggg

SEQ ID NO: 60078 - DNA, 25 bp, Artificial Sequence
  Description of Artificial Sequence: Synthetic oligonucleotide
acacacgcttcgacagcgacgtggg

SEQ ID NO: 60079 - DNA, 24 bp, Artificial Sequence
  Description of Artificial Sequence: Synthetic oligonucleotide
cacacgcttcgacagcgacgtggg

SEQ ID NO: 60080 - DNA, 24 bp, Artificial Sequence
  Description of Artificial Sequence: Synthetic oligonucleotide
acacgcttcgacagcgacgtgggg

SEQ ID NO: 60081 - DNA, 32 bp, Artificial Sequence
  Description of Artificial Sequence: Synthetic oligonucleotide
tatccagcccagatcaaagtccggtggttttg

SEQ ID NO: 60082 - DNA, 31 bp, Artificial Sequence
  Description of Artificial Sequence: Synthetic oligonucleotide
atccagcccagatcaaagtccggtggttttg

SEQ ID NO: 60083 - DNA, 30 bp, Artificial Sequence
  Description of Artificial Sequence: Synthetic oligonucleotide
tccagcccagatcaaagtccggtggttttg

SEQ ID NO: 60084 - DNA, 29 bp, Artificial Sequence
  Description of Artificial Sequence: Synthetic oligonucleotide
ccagcccagatcaaagtccggtggttttg

SEQ ID NO: 60085 - DNA, 29 bp, Artificial Sequence
  Description of Artificial Sequence: Synthetic oligonucleotide
cagcccagatcaaagtccggtggttttgg

SEQ ID NO: 60086 - DNA, 32 bp, Artificial Sequence
  Description of Artificial Sequence: Synthetic oligonucleotide
agcccagatcaaagtccggtggttttggaatg

SEQ ID NO: 60087 - DNA, 31 bp, Artificial Sequence
  Description of Artificial Sequence: Synthetic oligonucleotide
gcccagatcaaagtccggtggttttggaatg

SEQ ID NO: 60088 - DNA, 32 bp, Artificial Sequence
  Description of Artificial Sequence: Synthetic oligonucleotide
cccagatcaaagtccggtggttttggaatgac

SEQ ID NO: 60089 - DNA, 32 bp, Artificial Sequence
  Description of Artificial Sequence: Synthetic oligonucleotide
ccagatcaaagtccggtggttttggaatgacc

SEQ ID NO: 60090 - DNA, 33 bp, Artificial Sequence
  Description of Artificial Sequence: Synthetic oligonucleotide
cagatcaaagtccggtggttttggaatgaccag

SEQ ID NO: 60091 - DNA, 33 bp, Artificial Sequence
  Description of Artificial Sequence: Synthetic oligonucleotide
agatcaaagtccggtggttttggaatgaccagg

SEQ ID NO: 60092 - DNA, 32 bp, Artificial Sequence
  Description of Artificial Sequence: Synthetic oligonucleotide
gatcaaagtccggtggttttggaatgaccagg

SEQ ID NO: 60093 - DNA, 33 bp, Artificial Sequence
  Description of Artificial Sequence: Synthetic oligonucleotide
atcaaagtccggtggttttggaatgaccaggag

SEQ ID NO: 60094 - DNA, 32 bp, Artificial Sequence
  Description of Artificial Sequence: Synthetic oligonucleotide
tcaaagtccggtggttttggaatgaccaggag

SEQ ID NO: 60095 - DNA, 31 bp, Artificial Sequence
  Description of Artificial Sequence: Synthetic oligonucleotide
caaagtccggtggttttggaatgaccaggag

SEQ ID NO: 60096 - DNA, 31 bp, Artificial Sequence
  Description of Artificial Sequence: Synthetic oligonucleotide
aaagtccggtggttttggaatgaccaggagg

SEQ ID NO: 60097 - DNA, 30 bp, Artificial Sequence
  Description of Artificial Sequence: Synthetic oligonucleotide
aagtccggtggttttggaatgaccaggagg

SEQ ID NO: 60098 - DNA, 29 bp, Artificial Sequence
  Description of Artificial Sequence: Synthetic oligonucleotide
agtccggtggttttggaatgaccaggagg

SEQ ID NO: 60099 - DNA, 28 bp, Artificial Sequence
  Description of Artificial Sequence: Synthetic oligonucleotide
gtccggtggttttggaatgaccaggagg

SEQ ID NO: 60100 - DNA, 29 bp, Artificial Sequence
  Description of Artificial Sequence: Synthetic oligonucleotide
tccggtggttttggaatgaccaggaggag

SEQ ID NO: 60101 - DNA, 28 bp, Artificial Sequence
  Description of Artificial Sequence: Synthetic oligonucleotide
ccggtggttttggaatgaccaggaggag

SEQ ID NO: 60102 - DNA, 29 bp, Artificial Sequence
  Description of Artificial Sequence: Synthetic oligonucleotide
cggtggttttggaatgaccaggaggagac

SEQ ID NO: 60103 - DNA, 31 bp, Artificial Sequence
  Description of Artificial Sequence: Synthetic oligonucleotide
ggtggttttggaatgaccaggaggagacaac

SEQ ID NO: 60104 - DNA, 31 bp, Artificial Sequence
  Description of Artificial Sequence: Synthetic oligonucleotide
gtggttttggaatgaccaggaggagacaacc

SEQ ID NO: 60105 - DNA, 31 bp, Artificial Sequence
  Description of Artificial Sequence: Synthetic oligonucleotide
tggttttggaatgaccaggaggagacaaccg

SEQ ID NO: 60106 - DNA, 30 bp, Artificial Sequence
  Description of Artificial Sequence: Synthetic oligonucleotide
ggttttggaatgaccaggaggagacaaccg

SEQ ID NO: 60107 - DNA, 30 bp, Artificial Sequence
  Description of Artificial Sequence: Synthetic oligonucleotide
gttttggaatgaccaggaggagacaaccgg

SEQ ID NO: 60108 - DNA, 30 bp, Artificial Sequence
  Description of Artificial Sequence: Synthetic oligonucleotide
ttttggaatgaccaggaggagacaaccggc

SEQ ID NO: 60109 - DNA, 29 bp, Artificial Sequence
  Description of Artificial Sequence: Synthetic oligonucleotide
tttggaatgaccaggaggagacaaccggc

SEQ ID NO: 60110 - DNA, 28 bp, Artificial Sequence
  Description of Artificial Sequence: Synthetic oligonucleotide
ttggaatgaccaggaggagacaaccggc

SEQ ID NO: 60111 - DNA, 27 bp, Artificial Sequence
  Description of Artificial Sequence: Synthetic oligonucleotide
tggaatgaccaggaggagacaaccggc

SEQ ID NO: 60112 - DNA, 35 bp, Artificial Sequence
  Description of Artificial Sequence: Synthetic oligonucleotide
tgacagatttctatccagcccagatcaaagtccag

SEQ ID NO: 60113 - DNA, 34 bp, Artificial Sequence
  Description of Artificial Sequence: Synthetic oligonucleotide
gacagatttctatccagcccagatcaaagtccag

SEQ ID NO: 60114 - DNA, 35 bp, Artificial Sequence
  Description of Artificial Sequence: Synthetic oligonucleotide
acagatttctatccagcccagatcaaagtccagtg

SEQ ID NO: 60115 - DNA, 34 bp, Artificial Sequence
  Description of Artificial Sequence: Synthetic oligonucleotide
cagatttctatccagcccagatcaaagtccagtg

SEQ ID NO: 60116 - DNA, 34 bp, Artificial Sequence
  Description of Artificial Sequence: Synthetic oligonucleotide
agatttctatccagcccagatcaaagtccagtgg

SEQ ID NO: 60117 - DNA, 33 bp, Artificial Sequence
  Description of Artificial Sequence: Synthetic oligonucleotide
gatttctatccagcccagatcaaagtccagtgg

SEQ ID NO: 60118 - DNA, 36 bp, Artificial Sequence
  Description of Artificial Sequence: Synthetic oligonucleotide
atttctatccagcccagatcaaagtccagtggtttc

SEQ ID NO: 60119 - DNA, 35 bp, Artificial Sequence
  Description of Artificial Sequence: Synthetic oligonucleotide
tttctatccagcccagatcaaagtccagtggtttc

SEQ ID NO: 60120 - DNA, 34 bp, Artificial Sequence
  Description of Artificial Sequence: Synthetic oligonucleotide
ttctatccagcccagatcaaagtccagtggtttc

SEQ ID NO: 60121 - DNA, 33 bp, Artificial Sequence
  Description of Artificial Sequence: Synthetic oligonucleotide
tctatccagcccagatcaaagtccagtggtttc

SEQ ID NO: 60122 - DNA, 32 bp, Artificial Sequence
  Description of Artificial Sequence: Synthetic oligonucleotide
ctatccagcccagatcaaagtccagtggtttc

SEQ ID NO: 60123 - DNA, 32 bp, Artificial Sequence
  Description of Artificial Sequence: Synthetic oligonucleotide
tatccagcccagatcaaagtccagtggtttcg

SEQ ID NO: 60124 - DNA, 31 bp, Artificial Sequence
  Description of Artificial Sequence: Synthetic oligonucleotide
atccagcccagatcaaagtccagtggtttcg

SEQ ID NO: 60125 - DNA, 30 bp, Artificial Sequence
  Description of Artificial Sequence: Synthetic oligonucleotide
tccagcccagatcaaagtccagtggtttcg

SEQ ID NO: 60126 - DNA, 29 bp, Artificial Sequence
  Description of Artificial Sequence: Synthetic oligonucleotide
ccagcccagatcaaagtccagtggtttcg

SEQ ID NO: 60127 - DNA, 29 bp, Artificial Sequence
  Description of Artificial Sequence: Synthetic oligonucleotide
cagcccagatcaaagtccagtggtttcgg

SEQ ID NO: 60128 - DNA, 32 bp, Artificial Sequence
  Description of Artificial Sequence: Synthetic oligonucleotide
agcccagatcaaagtccagtggtttcggaatg

SEQ ID NO: 60129 - DNA, 31 bp, Artificial Sequence
  Description of Artificial Sequence: Synthetic oligonucleotide
gcccagatcaaagtccagtggtttcggaatg

SEQ ID NO: 60130 - DNA, 32 bp, Artificial Sequence
  Description of Artificial Sequence: Synthetic oligonucleotide
cccagatcaaagtccagtggtttcggaatgac

SEQ ID NO: 60131 - DNA, 32 bp, Artificial Sequence
  Description of Artificial Sequence: Synthetic oligonucleotide
ccagatcaaagtccagtggtttcggaatgacc

SEQ ID NO: 60132 - DNA, 33 bp, Artificial Sequence
  Description of Artificial Sequence: Synthetic oligonucleotide
cagatcaaagtccagtggtttcggaatgaccag

SEQ ID NO: 60133 - DNA, 33 bp, Artificial Sequence
  Description of Artificial Sequence: Synthetic oligonucleotide
agatcaaagtccagtggtttcggaatgaccagg

SEQ ID NO: 60134 - DNA, 32 bp, Artificial Sequence
  Description of Artificial Sequence: Synthetic oligonucleotide
gatcaaagtccagtggtttcggaatgaccagg

SEQ ID NO: 60135 - DNA, 33 bp, Artificial Sequence
  Description of Artificial Sequence: Synthetic oligonucleotide
atcaaagtccagtggtttcggaatgaccaggag

SEQ ID NO: 60136 - DNA, 32 bp, Artificial Sequence
  Description of Artificial Sequence: Synthetic oligonucleotide
tcaaagtccagtggtttcggaatgaccaggag

SEQ ID NO: 60137 - DNA, 31 bp, Artificial Sequence
  Description of Artificial Sequence: Synthetic oligonucleotide
caaagtccagtggtttcggaatgaccaggag

SEQ ID NO: 60138 - DNA, 31 bp, Artificial Sequence
  Description of Artificial Sequence: Synthetic oligonucleotide
aaagtccagtggtttcggaatgaccaggagg

SEQ ID NO: 60139 - DNA, 30 bp, Artificial Sequence
  Description of Artificial Sequence: Synthetic oligonucleotide
aagtccagtggtttcggaatgaccaggagg

SEQ ID NO: 60140 - DNA, 29 bp, Artificial Sequence
  Description of Artificial Sequence: Synthetic oligonucleotide
agtccagtggtttcggaatgaccaggagg

SEQ ID NO: 60141 - DNA, 28 bp, Artificial Sequence
  Description of Artificial Sequence: Synthetic oligonucleotide
gtccagtggtttcggaatgaccaggagg

SEQ ID NO: 60142 - DNA, 29 bp, Artificial Sequence
  Description of Artificial Sequence: Synthetic oligonucleotide
tccagtggtttcggaatgaccaggaggag

SEQ ID NO: 60143 - DNA, 28 bp, Artificial Sequence
  Description of Artificial Sequence: Synthetic oligonucleotide
ccagtggtttcggaatgaccaggaggag

SEQ ID NO: 60144 - DNA, 29 bp, Artificial Sequence
  Description of Artificial Sequence: Synthetic oligonucleotide
cagtggtttcggaatgaccaggaggagac

SEQ ID NO: 60145 - DNA, 31 bp, Artificial Sequence
  Description of Artificial Sequence: Synthetic oligonucleotide
agtggtttcggaatgaccaggaggagacaac

SEQ ID NO: 60146 - DNA, 22 bp, Artificial Sequence
  Description of Artificial Sequence: Synthetic oligonucleotide
tgtaccgcgcggtgacgccgca

SEQ ID NO: 60147 - DNA, 21 bp, Artificial Sequence
  Description of Artificial Sequence: Synthetic oligonucleotide
gtaccgcgcggtgacgccgca

SEQ ID NO: 60148 - DNA, 21 bp, Artificial Sequence
  Description of Artificial Sequence: Synthetic oligonucleotide
taccgcgcggtgacgccgcag

SEQ ID NO: 60149 - DNA, 20 bp, Artificial Sequence
  Description of Artificial Sequence: Synthetic oligonucleotide
accgcgcggtgacgccgcag

SEQ ID NO: 60150 - DNA, 20 bp, Artificial Sequence
  Description of Artificial Sequence: Synthetic oligonucleotide
ccgcgcggtgacgccgcagt

SEQ ID NO: 60151 - DNA, 20 bp, Artificial Sequence
  Description of Artificial Sequence: Synthetic oligonucleotide
cgcgcggtgacgccgcaggt

SEQ ID NO: 60152 - DNA, 20 bp, Artificial Sequence
  Description of Artificial Sequence: Synthetic oligonucleotide
gcgcggtgacgccgcagggt

SEQ ID NO: 60153 - DNA, 20 bp, Artificial Sequence
  Description of Artificial Sequence: Synthetic oligonucleotide
cgcggtgacgccgcaggggt

SEQ ID NO: 60154 - DNA, 20 bp, Artificial Sequence
  Description of Artificial Sequence: Synthetic oligonucleotide
gcggtgacgccgcaggggct

SEQ ID NO: 60155 - DNA, 20 bp, Artificial Sequence
  Description of Artificial Sequence: Synthetic oligonucleotide
cggtgacgccgcaggggcgt

SEQ ID NO: 60156 - DNA, 20 bp, Artificial Sequence
  Description of Artificial Sequence: Synthetic oligonucleotide
ggtgacgccgcaggggcggt

SEQ ID NO: 60157 - DNA, 20 bp, Artificial Sequence
  Description of Artificial Sequence: Synthetic oligonucleotide
gtgacgccgcaggggcggct

SEQ ID NO: 60158 - DNA, 20 bp, Artificial Sequence
  Description of Artificial Sequence: Synthetic oligonucleotide
tgacgccgcaggggcggcct

SEQ ID NO: 60159 - DNA, 20 bp, Artificial Sequence
  Description of Artificial Sequence: Synthetic oligonucleotide
gacgccgcaggggcggcctt

SEQ ID NO: 60160 - DNA, 21 bp, Artificial Sequence
  Description of Artificial Sequence: Synthetic oligonucleotide
acgccgcaggggcggcctgat

SEQ ID NO: 60161 - DNA, 20 bp, Artificial Sequence
  Description of Artificial Sequence: Synthetic oligonucleotide
cgccgcaggggcggcctgat

SEQ ID NO: 60162 - DNA, 20 bp, Artificial Sequence
  Description of Artificial Sequence: Synthetic oligonucleotide
gccgcaggggcggcctgatg

SEQ ID NO: 60163 - DNA, 20 bp, Artificial Sequence
  Description of Artificial Sequence: Synthetic oligonucleotide
ccgcaggggcggcctgatgc

SEQ ID NO: 60164 - DNA, 20 bp, Artificial Sequence
  Description of Artificial Sequence: Synthetic oligonucleotide
cgcaggggcggcctgatgcc

SEQ ID NO: 60165 - DNA, 21 bp, Artificial Sequence
  Description of Artificial Sequence: Synthetic oligonucleotide
gcaggggcggcctgatgccga

SEQ ID NO: 60166 - DNA, 23 bp, Artificial Sequence
  Description of Artificial Sequence: Synthetic oligonucleotide
caggggcggcctgatgccgagta

SEQ ID NO: 60167 - DNA, 24 bp, Artificial Sequence
  Description of Artificial Sequence: Synthetic oligonucleotide
aggggcggcctgatgccgagtact

SEQ ID NO: 60168 - DNA, 23 bp, Artificial Sequence
  Description of Artificial Sequence: Synthetic oligonucleotide
ggggcggcctgatgccgagtact

SEQ ID NO: 60169 - DNA, 23 bp, Artificial Sequence
  Description of Artificial Sequence: Synthetic oligonucleotide
gggcggcctgatgccgagtactg

SEQ ID NO: 60170 - DNA, 25 bp, Artificial Sequence
  Description of Artificial Sequence: Synthetic oligonucleotide
ggcggcctgatgccgagtactggaa

SEQ ID NO: 60171 - DNA, 26 bp, Artificial Sequence
  Description of Artificial Sequence: Synthetic oligonucleotide
gcggcctgatgccgagtactggaaca

SEQ ID NO: 60172 - DNA, 26 bp, Artificial Sequence
  Description of Artificial Sequence: Synthetic oligonucleotide
cggcctgatgccgagtactggaacag

SEQ ID NO: 60173 - DNA, 26 bp, Artificial Sequence
  Description of Artificial Sequence: Synthetic oligonucleotide
ggcctgatgccgagtactggaacagc

SEQ ID NO: 60174 - DNA, 27 bp, Artificial Sequence
  Description of Artificial Sequence: Synthetic oligonucleotide
gcctgatgccgagtactggaacagcca

SEQ ID NO: 60175 - DNA, 27 bp, Artificial Sequence
  Description of Artificial Sequence: Synthetic oligonucleotide
cctgatgccgagtactggaacagccag

SEQ ID NO: 60176 - DNA, 29 bp, Artificial Sequence
  Description of Artificial Sequence: Synthetic oligonucleotide
ctgatgccgagtactggaacagccagaag

SEQ ID NO: 60177 - DNA, 29 bp, Artificial Sequence
  Description of Artificial Sequence: Synthetic oligonucleotide
tgatgccgagtactggaacagccagaagg

SEQ ID NO: 60178 - DNA, 28 bp, Artificial Sequence
  Description of Artificial Sequence: Synthetic oligonucleotide
gatgccgagtactggaacagccagaagg

SEQ ID NO: 60179 - DNA, 30 bp, Artificial Sequence
  Description of Artificial Sequence: Synthetic oligonucleotide
atgccgagtactggaacagccagaaggaag

SEQ ID NO: 60180 - DNA, 29 bp, Artificial Sequence
  Description of Artificial Sequence: Synthetic oligonucleotide
tgccgagtactggaacagccagaaggaag

SEQ ID NO: 60181 - DNA, 30 bp, Artificial Sequence
  Description of Artificial Sequence: Synthetic oligonucleotide
ctggaaatgactccccagcatggagacatc

SEQ ID NO: 60182 - DNA, 32 bp, Artificial Sequence
  Description of Artificial Sequence: Synthetic oligonucleotide
tggaaatgactccccagcatggagacatctac

SEQ ID NO: 60183 - DNA, 31 bp, Artificial Sequence
  Description of Artificial Sequence: Synthetic oligonucleotide
ggaaatgactccccagcatggagacatctac

SEQ ID NO: 60184 - DNA, 32 bp, Artificial Sequence
  Description of Artificial Sequence: Synthetic oligonucleotide
gaaatgactccccagcatggagacatctacac

SEQ ID NO: 60185 - DNA, 32 bp, Artificial Sequence
  Description of Artificial Sequence: Synthetic oligonucleotide
aaatgactccccagcatggagacatctacacc

SEQ ID NO: 60186 - DNA, 31 bp, Artificial Sequence
  Description of Artificial Sequence: Synthetic oligonucleotide
aatgactccccagcatggagacatctacacc

SEQ ID NO: 60187 - DNA, 30 bp, Artificial Sequence
  Description of Artificial Sequence: Synthetic oligonucleotide
atgactccccagcatggagacatctacacc

SEQ ID NO: 60188 - DNA, 29 bp, Artificial Sequence
  Description of Artificial Sequence: Synthetic oligonucleotide
tgactccccagcatggagacatctacacc

SEQ ID NO: 60189 - DNA, 28 bp, Artificial Sequence
  Description of Artificial Sequence: Synthetic oligonucleotide
gactccccagcatggagacatctacacc

SEQ ID NO: 60190 - DNA, 29 bp, Artificial Sequence
  Description of Artificial Sequence: Synthetic oligonucleotide
actccccagcatggagacatctacacctg

SEQ ID NO: 60191 - DNA, 28 bp, Artificial Sequence
  Description of Artificial Sequence: Synthetic oligonucleotide
ctccccagcatggagacatctacacctg

SEQ ID NO: 60192 - DNA, 28 bp, Artificial Sequence
  Description of Artificial Sequence: Synthetic oligonucleotide
tccccagcatggagacatctacacctgc

SEQ ID NO: 60193 - DNA, 27 bp, Artificial Sequence
  Description of Artificial Sequence: Synthetic oligonucleotide
ccccagcatggagacatctacacctgc

SEQ ID NO: 60194 - DNA, 27 bp, Artificial Sequence
  Description of Artificial Sequence: Synthetic oligonucleotide
cccagcatggagacatctacacctgcc

SEQ ID NO: 60195 - DNA, 28 bp, Artificial Sequence
  Description of Artificial Sequence: Synthetic oligonucleotide
ccagcatggagacatctacacctgccac

SEQ ID NO: 60196 - DNA, 28 bp, Artificial Sequence
  Description of Artificial Sequence: Synthetic oligonucleotide
cagcatggagacatctacacctgccacg

SEQ ID NO: 60197 - DNA, 29 bp, Artificial Sequence
  Description of Artificial Sequence: Synthetic oligonucleotide
agcatggagacatctacacctgccacgtg

SEQ ID NO: 60198 - DNA, 28 bp, Artificial Sequence
  Description of Artificial Sequence: Synthetic oligonucleotide
gcatggagacatctacacctgccacgtg

SEQ ID NO: 60199 - DNA, 28 bp, Artificial Sequence
  Description of Artificial Sequence: Synthetic oligonucleotide
catggagacatctacacctgccacgtgg

SEQ ID NO: 60200 - DNA, 29 bp, Artificial Sequence
  Description of Artificial Sequence: Synthetic oligonucleotide
atggagacatctacacctgccacgtggag

SEQ ID NO: 60201 - DNA, 28 bp, Artificial Sequence
  Description of Artificial Sequence: Synthetic oligonucleotide
tggagacatctacacctgccacgtggag

SEQ ID NO: 60202 - DNA, 27 bp, Artificial Sequence
  Description of Artificial Sequence: Synthetic oligonucleotide
ggagacatctacacctgccacgtggag

SEQ ID NO: 60203 - DNA, 27 bp, Artificial Sequence
  Description of Artificial Sequence: Synthetic oligonucleotide
gagacatctacacctgccacgtggagc

SEQ ID NO: 60204 - DNA, 28 bp, Artificial Sequence
  Description of Artificial Sequence: Synthetic oligonucleotide
agacatctacacctgccacgtggagcac

SEQ ID NO: 60205 - DNA, 27 bp, Artificial Sequence
  Description of Artificial Sequence: Synthetic oligonucleotide
gacatctacacctgccacgtggagcac

SEQ ID NO: 60206 - DNA, 27 bp, Artificial Sequence
  Description of Artificial Sequence: Synthetic oligonucleotide
acatctacacctgccacgtggagcacc

SEQ ID NO: 60207 - DNA, 26 bp, Artificial Sequence
  Description of Artificial Sequence: Synthetic oligonucleotide
catctacacctgccacgtggagcacc

SEQ ID NO: 60208 - DNA, 26 bp, Artificial Sequence
  Description of Artificial Sequence: Synthetic oligonucleotide
atctacacctgccacgtggagcaccc

SEQ ID NO: 60209 - DNA, 20 bp, Artificial Sequence
  Description of Artificial Sequence: Synthetic oligonucleotide
cggtgacgccgctggggcgt

SEQ ID NO: 60210 - DNA, 20 bp, Artificial Sequence
  Description of Artificial Sequence: Synthetic oligonucleotide
ggtgacgccgctggggcggt

SEQ ID NO: 60211 - DNA, 21 bp, Artificial Sequence
  Description of Artificial Sequence: Synthetic oligonucleotide
gtgacgccgctggggcggctt

SEQ ID NO: 60212 - DNA, 22 bp, Artificial Sequence
  Description of Artificial Sequence: Synthetic oligonucleotide
tgacgccgctggggcggcttga

SEQ ID NO: 60213 - DNA, 21 bp, Artificial Sequence
  Description of Artificial Sequence: Synthetic oligonucleotide
gacgccgctggggcggcttga

SEQ ID NO: 60214 - DNA, 21 bp, Artificial Sequence
  Description of Artificial Sequence: Synthetic oligonucleotide
acgccgctggggcggcttgac

SEQ ID NO: 60215 - DNA, 20 bp, Artificial Sequence
  Description of Artificial Sequence: Synthetic oligonucleotide
cgccgctggggcggcttgac

SEQ ID NO: 60216 - DNA, 20 bp, Artificial Sequence
  Description of Artificial Sequence: Synthetic oligonucleotide
gccgctggggcggcttgacg

SEQ ID NO: 60217 - DNA, 20 bp, Artificial Sequence
  Description of Artificial Sequence: Synthetic oligonucleotide
ccgctggggcggcttgacgc

SEQ ID NO: 60218 - DNA, 20 bp, Artificial Sequence
  Description of Artificial Sequence: Synthetic oligonucleotide
cgctggggcggcttgacgcc

SEQ ID NO: 60219 - DNA, 21 bp, Artificial Sequence
  Description of Artificial Sequence: Synthetic oligonucleotide
gctggggcggcttgacgccga

SEQ ID NO: 60220 - DNA, 23 bp, Artificial Sequence
  Description of Artificial Sequence: Synthetic oligonucleotide
ctggggcggcttgacgccgagta

SEQ ID NO: 60221 - DNA, 24 bp, Artificial Sequence
  Description of Artificial Sequence: Synthetic oligonucleotide
tggggcggcttgacgccgagtact

SEQ ID NO: 60222 - DNA, 23 bp, Artificial Sequence
  Description of Artificial Sequence: Synthetic oligonucleotide
ggggcggcttgacgccgagtact

SEQ ID NO: 60223 - DNA, 23 bp, Artificial Sequence
  Description of Artificial Sequence: Synthetic oligonucleotide
gggcggcttgacgccgagtactg

SEQ ID NO: 60224 - DNA, 27 bp, Artificial Sequence
  Description of Artificial Sequence: Synthetic oligonucleotide
ggcggcttgacgccgagtactggaata

SEQ ID NO: 60225 - DNA, 27 bp, Artificial Sequence
  Description of Artificial Sequence: Synthetic oligonucleotide
gcggcttgacgccgagtactggaatag

SEQ ID NO: 60226 - DNA, 27 bp, Artificial Sequence
  Description of Artificial Sequence: Synthetic oligonucleotide
cggcttgacgccgagtactggaatagc

SEQ ID NO: 60227 - DNA, 27 bp, Artificial Sequence
  Description of Artificial Sequence: Synthetic oligonucleotide
ggcttgacgccgagtactggaatagcc

SEQ ID NO: 60228 - DNA, 28 bp, Artificial Sequence
  Description of Artificial Sequence: Synthetic oligonucleotide
gcttgacgccgagtactggaatagccag

SEQ ID NO: 60229 - DNA, 30 bp, Artificial Sequence
  Description of Artificial Sequence: Synthetic oligonucleotide
cttgacgccgagtactggaatagccagaag

SEQ ID NO: 60230 - DNA, 30 bp, Artificial Sequence
  Description of Artificial Sequence: Synthetic oligonucleotide
ttgacgccgagtactggaatagccagaagg

SEQ ID NO: 60231 - DNA, 28 bp, Artificial Sequence
  Description of Artificial Sequence: Synthetic oligonucleotide
gagttggacacggtgtgcagacacaacc

SEQ ID NO: 60232 - DNA, 29 bp, Artificial Sequence
  Description of Artificial Sequence: Synthetic oligonucleotide
agttggacacggtgtgcagacacaaccac

SEQ ID NO: 60233 - DNA, 28 bp, Artificial Sequence
  Description of Artificial Sequence: Synthetic oligonucleotide
gttggacacggtgtgcagacacaaccac

SEQ ID NO: 60234 - DNA, 28 bp, Artificial Sequence
  Description of Artificial Sequence: Synthetic oligonucleotide
ttggacacggtgtgcagacacaaccacc

SEQ ID NO: 60235 - DNA, 27 bp, Artificial Sequence
  Description of Artificial Sequence: Synthetic oligonucleotide
tggacacggtgtgcagacacaaccacc

SEQ ID NO: 60236 - DNA, 27 bp, Artificial Sequence
  Description of Artificial Sequence: Synthetic oligonucleotide
ggacacggtgtgcagacacaaccacca

SEQ ID NO: 60237 - DNA, 27 bp, Artificial Sequence
  Description of Artificial Sequence: Synthetic oligonucleotide
gacacggtgtgcagacacaaccaccag

SEQ ID NO: 60238 - DNA, 29 bp, Artificial Sequence
  Description of Artificial Sequence: Synthetic oligonucleotide
acacggtgtgcagacacaaccaccagttg

SEQ ID NO: 60239 - DNA, 28 bp, Artificial Sequence
  Description of Artificial Sequence: Synthetic oligonucleotide
cacggtgtgcagacacaaccaccagttg

SEQ ID NO: 60240 - DNA, 28 bp, Artificial Sequence
  Description of Artificial Sequence: Synthetic oligonucleotide
acggtgtgcagacacaaccaccagttgg

SEQ ID NO: 60241 - DNA, 27 bp, Artificial Sequence
  Description of Artificial Sequence: Synthetic oligonucleotide
cggtgtgcagacacaaccaccagttgg

SEQ ID NO: 60242 - DNA, 28 bp, Artificial Sequence
  Description of Artificial Sequence: Synthetic oligonucleotide
ggtgtgcagacacaaccaccagttggag

SEQ ID NO: 60243 - DNA, 28 bp, Artificial Sequence
  Description of Artificial Sequence: Synthetic oligonucleotide
gtgtgcagacacaaccaccagttggagc

SEQ ID NO: 60244 - DNA, 29 bp, Artificial Sequence
  Description of Artificial Sequence: Synthetic oligonucleotide
tgtgcagacacaaccaccagttggagctc

SEQ ID NO: 60245 - DNA, 28 bp, Artificial Sequence
  Description of Artificial Sequence: Synthetic oligonucleotide
gtgcagacacaaccaccagttggagctc

SEQ ID NO: 60246 - DNA, 28 bp, Artificial Sequence
  Description of Artificial Sequence: Synthetic oligonucleotide
tgcagacacaaccaccagttggagctcc

SEQ ID NO: 60247 - DNA, 27 bp, Artificial Sequence
  Description of Artificial Sequence: Synthetic oligonucleotide
gcagacacaaccaccagttggagctcc

SEQ ID NO: 60248 - DNA, 27 bp, Artificial Sequence
  Description of Artificial Sequence: Synthetic oligonucleotide
cagacacaaccaccagttggagctccg

SEQ ID NO: 60249 - DNA, 27 bp, Artificial Sequence
  Description of Artificial Sequence: Synthetic oligonucleotide
agacacaaccaccagttggagctccgc

SEQ ID NO: 60250 - DNA, 27 bp, Artificial Sequence
  Description of Artificial Sequence: Synthetic oligonucleotide
gacacaaccaccagttggagctccgca

SEQ ID NO: 60251 - DNA, 27 bp, Artificial Sequence
  Description of Artificial Sequence: Synthetic oligonucleotide
acacaaccaccagttggagctccgcac

SEQ ID NO: 60252 - DNA, 26 bp, Artificial Sequence
  Description of Artificial Sequence: Synthetic oligonucleotide
cacaaccaccagttggagctccgcac

SEQ ID NO: 60253 - DNA, 27 bp, Artificial Sequence
  Description of Artificial Sequence: Synthetic oligonucleotide
acaaccaccagttggagctccgcacga

SEQ ID NO: 60254 - DNA, 26 bp, Artificial Sequence
  Description of Artificial Sequence: Synthetic oligonucleotide
caaccaccagttggagctccgcacga

SEQ ID NO: 60255 - DNA, 26 bp, Artificial Sequence
  Description of Artificial Sequence: Synthetic oligonucleotide
aaccaccagttggagctccgcacgac

SEQ ID NO: 60256 - DNA, 25 bp, Artificial Sequence
  Description of Artificial Sequence: Synthetic oligonucleotide
accaccagttggagctccgcacgac

SEQ ID NO: 60257 - DNA, 24 bp, Artificial Sequence
  Description of Artificial Sequence: Synthetic oligonucleotide
ccaccagttggagctccgcacgac

SEQ ID NO: 60258 - DNA, 26 bp, Artificial Sequence
  Description of Artificial Sequence: Synthetic oligonucleotide
caccagttggagctccgcacgacctt

SEQ ID NO: 60259 - DNA, 27 bp, Artificial Sequence
  Description of Artificial Sequence: Synthetic oligonucleotide
tgaccttgatgctggcgatgctgagcg

SEQ ID NO: 60260 - DNA, 26 bp, Artificial Sequence
  Description of Artificial Sequence: Synthetic oligonucleotide
gaccttgatgctggcgatgctgagcg

SEQ ID NO: 60261 - DNA, 26 bp, Artificial Sequence
  Description of Artificial Sequence: Synthetic oligonucleotide
accttgatgctggcgatgctgagcgc

SEQ ID NO: 60262 - DNA, 25 bp, Artificial Sequence
  Description of Artificial Sequence: Synthetic oligonucleotide
ccttgatgctggcgatgctgagcgc

SEQ ID NO: 60263 - DNA, 25 bp, Artificial Sequence
  Description of Artificial Sequence: Synthetic oligonucleotide
cttgatgctggcgatgctgagcgcc

SEQ ID NO: 60264 - DNA, 25 bp, Artificial Sequence
  Description of Artificial Sequence: Synthetic oligonucleotide
ttgatgctggcgatgctgagcgccc

SEQ ID NO: 60265 - DNA, 24 bp, Artificial Sequence
  Description of Artificial Sequence: Synthetic oligonucleotide
tgatgctggcgatgctgagcgccc

SEQ ID NO: 60266 - DNA, 23 bp, Artificial Sequence
  Description of Artificial Sequence: Synthetic oligonucleotide
gatgctggcgatgctgagcgccc

SEQ ID NO: 60267 - DNA, 23 bp, Artificial Sequence
  Description of Artificial Sequence: Synthetic oligonucleotide
atgctggcgatgctgagcgcccc

SEQ ID NO: 60268 - DNA, 22 bp, Artificial Sequence
  Description of Artificial Sequence: Synthetic oligonucleotide
tgctggcgatgctgagcgcccc

SEQ ID NO: 60269 - DNA, 21 bp, Artificial Sequence
  Description of Artificial Sequence: Synthetic oligonucleotide
gctggcgatgctgagcgcccc

SEQ ID NO: 60270 - DNA, 21 bp, Artificial Sequence
  Description of Artificial Sequence: Synthetic oligonucleotide
ctggcgatgctgagcgccccg

SEQ ID NO: 60271 - DNA, 22 bp, Artificial Sequence
  Description of Artificial Sequence: Synthetic oligonucleotide
tggcgatgctgagcgccccggt

SEQ ID NO: 60272 - DNA, 21 bp, Artificial Sequence
  Description of Artificial Sequence: Synthetic oligonucleotide
ggcgatgctgagcgccccggt

SEQ ID NO: 60273 - DNA, 21 bp, Artificial Sequence
  Description of Artificial Sequence: Synthetic oligonucleotide
gcgatgctgagcgccccggtg

SEQ ID NO: 60274 - DNA, 21 bp, Artificial Sequence
  Description of Artificial Sequence: Synthetic oligonucleotide
cgatgctgagcgccccggtgg

SEQ ID NO: 60275 - DNA, 22 bp, Artificial Sequence
  Description of Artificial Sequence: Synthetic oligonucleotide
gatgctgagcgccccggtggct

SEQ ID NO: 60276 - DNA, 23 bp, Artificial Sequence
  Description of Artificial Sequence: Synthetic oligonucleotide
atgctgagcgccccggtggctga

SEQ ID NO: 60277 - DNA, 22 bp, Artificial Sequence
  Description of Artificial Sequence: Synthetic oligonucleotide
tgctgagcgccccggtggctga

SEQ ID NO: 60278 - DNA, 21 bp, Artificial Sequence
  Description of Artificial Sequence: Synthetic oligonucleotide
gctgagcgccccggtggctga

SEQ ID NO: 60279 - DNA, 21 bp, Artificial Sequence
  Description of Artificial Sequence: Synthetic oligonucleotide
ctgagcgccccggtggctgag

SEQ ID NO: 60280 - DNA, 21 bp, Artificial Sequence
  Description of Artificial Sequence: Synthetic oligonucleotide
tgagcgccccggtggctgagg

SEQ ID NO: 60281 - DNA, 20 bp, Artificial Sequence
  Description of Artificial Sequence: Synthetic oligonucleotide
gagcgccccggtggctgagg

SEQ ID NO: 60282 - DNA, 20 bp, Artificial Sequence
  Description of Artificial Sequence: Synthetic oligonucleotide
agcgccccggtggctgaggg

SEQ ID NO: 60283 - DNA, 20 bp, Artificial Sequence
  Description of Artificial Sequence: Synthetic oligonucleotide
gcgccccggtggctgagggt

SEQ ID NO: 60284 - DNA, 20 bp, Artificial Sequence
  Description of Artificial Sequence: Synthetic oligonucleotide
cgccccggtggctgagggca

SEQ ID NO: 60285 - DNA, 21 bp, Artificial Sequence
  Description of Artificial Sequence: Synthetic oligonucleotide
gccccggtggctgagggcaga

SEQ ID NO: 60286 - DNA, 29 bp, Artificial Sequence
  Description of Artificial Sequence: Synthetic oligonucleotide
gcagagactctcccgaggatttcgtgttc

SEQ ID NO: 60287 - DNA, 29 bp, Artificial Sequence
  Description of Artificial Sequence: Synthetic oligonucleotide
cagagactctcccgaggatttcgtgttcc

SEQ ID NO: 60288 - DNA, 30 bp, Artificial Sequence
  Description of Artificial Sequence: Synthetic oligonucleotide
agagactctcccgaggatttcgtgttccag

SEQ ID NO: 60289 - DNA, 29 bp, Artificial Sequence
  Description of Artificial Sequence: Synthetic oligonucleotide
gagactctcccgaggatttcgtgttccag

SEQ ID NO: 60290 - DNA, 34 bp, Artificial Sequence
  Description of Artificial Sequence: Synthetic oligonucleotide
agactctcccgaggatttcgtgttccagtttaag

SEQ ID NO: 60291 - DNA, 33 bp, Artificial Sequence
  Description of Artificial Sequence: Synthetic oligonucleotide
gactctcccgaggatttcgtgttccagtttaag

SEQ ID NO: 60292 - DNA, 33 bp, Artificial Sequence
  Description of Artificial Sequence: Synthetic oligonucleotide
actctcccgaggatttcgtgttccagtttaagg

SEQ ID NO: 60293 - DNA, 32 bp, Artificial Sequence
  Description of Artificial Sequence: Synthetic oligonucleotide
ctctcccgaggatttcgtgttccagtttaagg

SEQ ID NO: 60294 - DNA, 32 bp, Artificial Sequence
  Description of Artificial Sequence: Synthetic oligonucleotide
tctcccgaggatttcgtgttccagtttaaggg

SEQ ID NO: 60295 - DNA, 31 bp, Artificial Sequence
  Description of Artificial Sequence: Synthetic oligonucleotide
ctcccgaggatttcgtgttccagtttaaggg

SEQ ID NO: 60296 - DNA, 31 bp, Artificial Sequence
  Description of Artificial Sequence: Synthetic oligonucleotide
tcccgaggatttcgtgttccagtttaagggc

SEQ ID NO: 60297 - DNA, 30 bp, Artificial Sequence
  Description of Artificial Sequence: Synthetic oligonucleotide
cccgaggatttcgtgttccagtttaagggc

SEQ ID NO: 60298 - DNA, 32 bp, Artificial Sequence
  Description of Artificial Sequence: Synthetic oligonucleotide
ccgaggatttcgtgttccagtttaagggcatg

SEQ ID NO: 60299 - DNA, 33 bp, Artificial Sequence
  Description of Artificial Sequence: Synthetic oligonucleotide
cgaggatttcgtgttccagtttaagggcatgtg

SEQ ID NO: 60300 - DNA, 33 bp, Artificial Sequence
  Description of Artificial Sequence: Synthetic oligonucleotide
gaggatttcgtgttccagtttaagggcatgtgc

SEQ ID NO: 60301 - DNA, 35 bp, Artificial Sequence
  Description of Artificial Sequence: Synthetic oligonucleotide
aggatttcgtgttccagtttaagggcatgtgctac

SEQ ID NO: 60302 - DNA, 34 bp, Artificial Sequence
  Description of Artificial Sequence: Synthetic oligonucleotide
ggatttcgtgttccagtttaagggcatgtgctac

SEQ ID NO: 60303 - DNA, 36 bp, Artificial Sequence
  Description of Artificial Sequence: Synthetic oligonucleotide
gatttcgtgttccagtttaagggcatgtgctacttc

SEQ ID NO: 60304 - DNA, 37 bp, Artificial Sequence
  Description of Artificial Sequence: Synthetic oligonucleotide
atttcgtgttccagtttaagggcatgtgctacttcac

SEQ ID NO: 60305 - DNA, 36 bp, Artificial Sequence
  Description of Artificial Sequence: Synthetic oligonucleotide
tttcgtgttccagtttaagggcatgtgctacttcac

SEQ ID NO: 60306 - DNA, 35 bp, Artificial Sequence
  Description of Artificial Sequence: Synthetic oligonucleotide
ttcgtgttccagtttaagggcatgtgctacttcac

SEQ ID NO: 60307 - DNA, 34 bp, Artificial Sequence
  Description of Artificial Sequence: Synthetic oligonucleotide
tcgtgttccagtttaagggcatgtgctacttcac

SEQ ID NO: 60308 - DNA, 33 bp, Artificial Sequence
  Description of Artificial Sequence: Synthetic oligonucleotide
cgtgttccagtttaagggcatgtgctacttcac

SEQ ID NO: 60309 - DNA, 33 bp, Artificial Sequence
  Description of Artificial Sequence: Synthetic oligonucleotide
gtgttccagtttaagggcatgtgctacttcacc

SEQ ID NO: 60310 - DNA, 35 bp, Artificial Sequence
  Description of Artificial Sequence: Synthetic oligonucleotide
tgttccagtttaagggcatgtgctacttcaccaac

SEQ ID NO: 60311 - DNA, 34 bp, Artificial Sequence
  Description of Artificial Sequence: Synthetic oligonucleotide
gttccagtttaagggcatgtgctacttcaccaac

SEQ ID NO: 60312 - DNA, 34 bp, Artificial Sequence
  Description of Artificial Sequence: Synthetic oligonucleotide
ttccagtttaagggcatgtgctacttcaccaacg

SEQ ID NO: 60313 - DNA, 33 bp, Artificial Sequence
  Description of Artificial Sequence: Synthetic oligonucleotide
tccagtttaagggcatgtgctacttcaccaacg

SEQ ID NO: 60314 - DNA, 27 bp, Artificial Sequence
  Description of Artificial Sequence: Synthetic oligonucleotide
gtgctacttcaccaacgggaccgagct

SEQ ID NO: 60315 - DNA, 27 bp, Artificial Sequence
  Description of Artificial Sequence: Synthetic oligonucleotide
tgctacttcaccaacgggaccgagctc

SEQ ID NO: 60316 - DNA, 26 bp, Artificial Sequence
  Description of Artificial Sequence: Synthetic oligonucleotide
gctacttcaccaacgggaccgagctc

SEQ ID NO: 60317 - DNA, 27 bp, Artificial Sequence
  Description of Artificial Sequence: Synthetic oligonucleotide
ctacttcaccaacgggaccgagctcgt

SEQ ID NO: 60318 - DNA, 27 bp, Artificial Sequence
  Description of Artificial Sequence: Synthetic oligonucleotide
tacttcaccaacgggaccgagctcgtg

SEQ ID NO: 60319 - DNA, 26 bp, Artificial Sequence
  Description of Artificial Sequence: Synthetic oligonucleotide
acttcaccaacgggaccgagctcgtg

SEQ ID NO: 60320 - DNA, 25 bp, Artificial Sequence
  Description of Artificial Sequence: Synthetic oligonucleotide
cttcaccaacgggaccgagctcgtg

SEQ ID NO: 60321 - DNA, 25 bp, Artificial Sequence
  Description of Artificial Sequence: Synthetic oligonucleotide
ttcaccaacgggaccgagctcgtgc

SEQ ID NO: 60322 - DNA, 24 bp, Artificial Sequence
  Description of Artificial Sequence: Synthetic oligonucleotide
tcaccaacgggaccgagctcgtgc

SEQ ID NO: 60323 - DNA, 23 bp, Artificial Sequence
  Description of Artificial Sequence: Synthetic oligonucleotide
caccaacgggaccgagctcgtgc

SEQ ID NO: 60324 - DNA, 23 bp, Artificial Sequence
  Description of Artificial Sequence: Synthetic oligonucleotide
accaacgggaccgagctcgtgcg

SEQ ID NO: 60325 - DNA, 22 bp, Artificial Sequence
  Description of Artificial Sequence: Synthetic oligonucleotide
ccaacgggaccgagctcgtgcg

SEQ ID NO: 60326 - DNA, 22 bp, Artificial Sequence
  Description of Artificial Sequence: Synthetic oligonucleotide
caacgggaccgagctcgtgcgg

SEQ ID NO: 60327 - DNA, 22 bp, Artificial Sequence
  Description of Artificial Sequence: Synthetic oligonucleotide
aacgggaccgagctcgtgcggg

SEQ ID NO: 60328 - DNA, 21 bp, Artificial Sequence
  Description of Artificial Sequence: Synthetic oligonucleotide
acgggaccgagctcgtgcggg

SEQ ID NO: 60329 - DNA, 20 bp, Artificial Sequence
  Description of Artificial Sequence: Synthetic oligonucleotide
cgggaccgagctcgtgcggg

SEQ ID NO: 60330 - DNA, 21 bp, Artificial Sequence
  Description of Artificial Sequence: Synthetic oligonucleotide
gggaccgagctcgtgcggggt

SEQ ID NO: 60331 - DNA, 22 bp, Artificial Sequence
  Description of Artificial Sequence: Synthetic oligonucleotide
ggaccgagctcgtgcggggtgt

SEQ ID NO: 60332 - DNA, 23 bp, Artificial Sequence
  Description of Artificial Sequence: Synthetic oligonucleotide
gaccgagctcgtgcggggtgtga

SEQ ID NO: 60333 - DNA, 23 bp, Artificial Sequence
  Description of Artificial Sequence: Synthetic oligonucleotide
accgagctcgtgcggggtgtgac

SEQ ID NO: 60334 - DNA, 22 bp, Artificial Sequence
  Description of Artificial Sequence: Synthetic oligonucleotide
ccgagctcgtgcggggtgtgac

SEQ ID NO: 60335 - DNA, 23 bp, Artificial Sequence
  Description of Artificial Sequence: Synthetic oligonucleotide
cgagctcgtgcggggtgtgacca

SEQ ID NO: 60336 - DNA, 26 bp, Artificial Sequence
  Description of Artificial Sequence: Synthetic oligonucleotide
gagctcgtgcggggtgtgaccagata

SEQ ID NO: 60337 - DNA, 27 bp, Artificial Sequence
  Description of Artificial Sequence: Synthetic oligonucleotide
agctcgtgcggggtgtgaccagataca

SEQ ID NO: 60338 - DNA, 27 bp, Artificial Sequence
  Description of Artificial Sequence: Synthetic oligonucleotide
gctcgtgcggggtgtgaccagatacat

SEQ ID NO: 60339 - DNA, 27 bp, Artificial Sequence
  Description of Artificial Sequence: Synthetic oligonucleotide
ctcgtgcggggtgtgaccagatacatc

SEQ ID NO: 60340 - DNA, 32 bp, Artificial Sequence
  Description of Artificial Sequence: Synthetic oligonucleotide
tcgtgcggggtgtgaccagatacatctataac

SEQ ID NO: 60341 - DNA, 23 bp, Artificial Sequence
  Description of Artificial Sequence: Synthetic oligonucleotide
tggaggaggaccgggcgtcggtt

SEQ ID NO: 60342 - DNA, 22 bp, Artificial Sequence
  Description of Artificial Sequence: Synthetic oligonucleotide
ggaggaggaccgggcgtcggtt

SEQ ID NO: 60343 - DNA, 23 bp, Artificial Sequence
  Description of Artificial Sequence: Synthetic oligonucleotide
gaggaggaccgggcgtcggttga

SEQ ID NO: 60344 - DNA, 24 bp, Artificial Sequence
  Description of Artificial Sequence: Synthetic oligonucleotide
aggaggaccgggcgtcggttgaca

SEQ ID NO: 60345 - DNA, 23 bp, Artificial Sequence
  Description of Artificial Sequence: Synthetic oligonucleotide
ggaggaccgggcgtcggttgaca

SEQ ID NO: 60346 - DNA, 23 bp, Artificial Sequence
  Description of Artificial Sequence: Synthetic oligonucleotide
gaggaccgggcgtcggttgacac

SEQ ID NO: 60347 - DNA, 23 bp, Artificial Sequence
  Description of Artificial Sequence: Synthetic oligonucleotide
aggaccgggcgtcggttgacacc

SEQ ID NO: 60348 - DNA, 22 bp, Artificial Sequence
  Description of Artificial Sequence: Synthetic oligonucleotide
ggaccgggcgtcggttgacacc

SEQ ID NO: 60349 - DNA, 25 bp, Artificial Sequence
  Description of Artificial Sequence: Synthetic oligonucleotide
gaccgggcgtcggttgacaccgtat

SEQ ID NO: 60350 - DNA, 25 bp, Artificial Sequence
  Description of Artificial Sequence: Synthetic oligonucleotide
accgggcgtcggttgacaccgtatg

SEQ ID NO: 60351 - DNA, 24 bp, Artificial Sequence
  Description of Artificial Sequence: Synthetic oligonucleotide
ccgggcgtcggttgacaccgtatg

SEQ ID NO: 60352 - DNA, 25 bp, Artificial Sequence
  Description of Artificial Sequence: Synthetic oligonucleotide
cgggcgtcggttgacaccgtatgca

SEQ ID NO: 60353 - DNA, 26 bp, Artificial Sequence
  Description of Artificial Sequence: Synthetic oligonucleotide
gggcgtcggttgacaccgtatgcaga

SEQ ID NO: 60354 - DNA, 27 bp, Artificial Sequence
  Description of Artificial Sequence: Synthetic oligonucleotide
ggcgtcggttgacaccgtatgcagaca

SEQ ID NO: 60355 - DNA, 27 bp, Artificial Sequence
  Description of Artificial Sequence: Synthetic oligonucleotide
gcgtcggttgacaccgtatgcagacac

SEQ ID NO: 60356 - DNA, 29 bp, Artificial Sequence
  Description of Artificial Sequence: Synthetic oligonucleotide
cgtcggttgacaccgtatgcagacacaac

SEQ ID NO: 60357 - DNA, 31 bp, Artificial Sequence
  Description of Artificial Sequence: Synthetic oligonucleotide
gtcggttgacaccgtatgcagacacaactac

SEQ ID NO: 60358 - DNA, 31 bp, Artificial Sequence
  Description of Artificial Sequence: Synthetic oligonucleotide
tcggttgacaccgtatgcagacacaactacc

SEQ ID NO: 60359 - DNA, 30 bp, Artificial Sequence
  Description of Artificial Sequence: Synthetic oligonucleotide
cggttgacaccgtatgcagacacaactacc

SEQ ID NO: 60360 - DNA, 31 bp, Artificial Sequence
  Description of Artificial Sequence: Synthetic oligonucleotide
ggttgacaccgtatgcagacacaactaccag

SEQ ID NO: 60361 - DNA, 33 bp, Artificial Sequence
  Description of Artificial Sequence: Synthetic oligonucleotide
gttgacaccgtatgcagacacaactaccagttg

SEQ ID NO: 60362 - DNA, 33 bp, Artificial Sequence
  Description of Artificial Sequence: Synthetic oligonucleotide
ttgacaccgtatgcagacacaactaccagttgg

SEQ ID NO: 60363 - DNA, 32 bp, Artificial Sequence
  Description of Artificial Sequence: Synthetic oligonucleotide
tgacaccgtatgcagacacaactaccagttgg

SEQ ID NO: 60364 - DNA, 22 bp, Artificial Sequence
  Description of Artificial Sequence: Synthetic oligonucleotide
caacgggaccgagcgcgtgcgt

SEQ ID NO: 60365 - DNA, 24 bp, Artificial Sequence
  Description of Artificial Sequence: Synthetic oligonucleotide
aacgggaccgagcgcgtgcgtctt

SEQ ID NO: 60366 - DNA, 23 bp, Artificial Sequence
  Description of Artificial Sequence: Synthetic oligonucleotide
acgggaccgagcgcgtgcgtctt

SEQ ID NO: 60367 - DNA, 22 bp, Artificial Sequence
  Description of Artificial Sequence: Synthetic oligonucleotide
cgggaccgagcgcgtgcgtctt

SEQ ID NO: 60368 - DNA, 23 bp, Artificial Sequence
  Description of Artificial Sequence: Synthetic oligonucleotide
gggaccgagcgcgtgcgtcttgt

SEQ ID NO: 60369 - DNA, 24 bp, Artificial Sequence
  Description of Artificial Sequence: Synthetic oligonucleotide
ggaccgagcgcgtgcgtcttgtga

SEQ ID NO: 60370 - DNA, 24 bp, Artificial Sequence
  Description of Artificial Sequence: Synthetic oligonucleotide
gaccgagcgcgtgcgtcttgtgac

SEQ ID NO: 60371 - DNA, 25 bp, Artificial Sequence
  Description of Artificial Sequence: Synthetic oligonucleotide
accgagcgcgtgcgtcttgtgacca

SEQ ID NO: 60372 - DNA, 24 bp, Artificial Sequence
  Description of Artificial Sequence: Synthetic oligonucleotide
ccgagcgcgtgcgtcttgtgacca

SEQ ID NO: 60373 - DNA, 27 bp, Artificial Sequence
  Description of Artificial Sequence: Synthetic oligonucleotide
cgagcgcgtgcgtcttgtgaccagata

SEQ ID NO: 60374 - DNA, 31 bp, Artificial Sequence
  Description of Artificial Sequence: Synthetic oligonucleotide
atgtcttggaagaagtctttgcggatccccg

SEQ ID NO: 60375 - DNA, 30 bp, Artificial Sequence
  Description of Artificial Sequence: Synthetic oligonucleotide
tgtcttggaagaagtctttgcggatccccg

SEQ ID NO: 60376 - DNA, 29 bp, Artificial Sequence
  Description of Artificial Sequence: Synthetic oligonucleotide
gtcttggaagaagtctttgcggatccccg

SEQ ID NO: 60377 - DNA, 29 bp, Artificial Sequence
  Description of Artificial Sequence: Synthetic oligonucleotide
tcttggaagaagtctttgcggatccccgg

SEQ ID NO: 60378 - DNA, 28 bp, Artificial Sequence
  Description of Artificial Sequence: Synthetic oligonucleotide
cttggaagaagtctttgcggatccccgg

SEQ ID NO: 60379 - DNA, 29 bp, Artificial Sequence
  Description of Artificial Sequence: Synthetic oligonucleotide
ttggaagaagtctttgcggatccccggag

SEQ ID NO: 60380 - DNA, 28 bp, Artificial Sequence
  Description of Artificial Sequence: Synthetic oligonucleotide
tggaagaagtctttgcggatccccggag

SEQ ID NO: 60381 - DNA, 27 bp, Artificial Sequence
  Description of Artificial Sequence: Synthetic oligonucleotide
ggaagaagtctttgcggatccccggag

SEQ ID NO: 60382 - DNA, 28 bp, Artificial Sequence
  Description of Artificial Sequence: Synthetic oligonucleotide
gaagaagtctttgcggatccccggagac

SEQ ID NO: 60383 - DNA, 28 bp, Artificial Sequence
  Description of Artificial Sequence: Synthetic oligonucleotide
aagaagtctttgcggatccccggagacc

SEQ ID NO: 60384 - DNA, 27 bp, Artificial Sequence
  Description of Artificial Sequence: Synthetic oligonucleotide
agaagtctttgcggatccccggagacc

SEQ ID NO: 60385 - DNA, 27 bp, Artificial Sequence
  Description of Artificial Sequence: Synthetic oligonucleotide
gaagtctttgcggatccccggagacct

SEQ ID NO: 60386 - DNA, 28 bp, Artificial Sequence
  Description of Artificial Sequence: Synthetic oligonucleotide
aagtctttgcggatccccggagaccttc

SEQ ID NO: 60387 - DNA, 27 bp, Artificial Sequence
  Description of Artificial Sequence: Synthetic oligonucleotide
agtctttgcggatccccggagaccttc

SEQ ID NO: 60388 - DNA, 26 bp, Artificial Sequence
  Description of Artificial Sequence: Synthetic oligonucleotide
gtctttgcggatccccggagaccttc

SEQ ID NO: 60389 - DNA, 26 bp, Artificial Sequence
  Description of Artificial Sequence: Synthetic oligonucleotide
tctttgcggatccccggagaccttcg

SEQ ID NO: 60390 - DNA, 25 bp, Artificial Sequence
  Description of Artificial Sequence: Synthetic oligonucleotide
ctttgcggatccccggagaccttcg

SEQ ID NO: 60391 - DNA, 25 bp, Artificial Sequence
  Description of Artificial Sequence: Synthetic oligonucleotide
tttgcggatccccggagaccttcgg

SEQ ID NO: 60392 - DNA, 24 bp, Artificial Sequence
  Description of Artificial Sequence: Synthetic oligonucleotide
ttgcggatccccggagaccttcgg

SEQ ID NO: 60393 - DNA, 23 bp, Artificial Sequence
  Description of Artificial Sequence: Synthetic oligonucleotide
tgcggatccccggagaccttcgg

SEQ ID NO: 60394 - DNA, 22 bp, Artificial Sequence
  Description of Artificial Sequence: Synthetic oligonucleotide
gcggatccccggagaccttcgg

SEQ ID NO: 60395 - DNA, 24 bp, Artificial Sequence
  Description of Artificial Sequence: Synthetic oligonucleotide
cggatccccggagaccttcgggta

SEQ ID NO: 60396 - DNA, 24 bp, Artificial Sequence
  Description of Artificial Sequence: Synthetic oligonucleotide
ggatccccggagaccttcgggtag

SEQ ID NO: 60397 - DNA, 26 bp, Artificial Sequence
  Description of Artificial Sequence: Synthetic oligonucleotide
gatccccggagaccttcgggtagcaa

SEQ ID NO: 60398 - DNA, 27 bp, Artificial Sequence
  Description of Artificial Sequence: Synthetic oligonucleotide
atccccggagaccttcgggtagcaact

SEQ ID NO: 60399 - DNA, 26 bp, Artificial Sequence
  Description of Artificial Sequence: Synthetic oligonucleotide
tccccggagaccttcgggtagcaact

SEQ ID NO: 60400 - DNA, 25 bp, Artificial Sequence
  Description of Artificial Sequence: Synthetic oligonucleotide
ccccggagaccttcgggtagcaact

SEQ ID NO: 60401 - DNA, 26 bp, Artificial Sequence
  Description of Artificial Sequence: Synthetic oligonucleotide
cccggagaccttcgggtagcaactgt

SEQ ID NO: 60402 - DNA, 27 bp, Artificial Sequence
  Description of Artificial Sequence: Synthetic oligonucleotide
ccggagaccttcgggtagcaactgtca

SEQ ID NO: 60403 - DNA, 27 bp, Artificial Sequence
  Description of Artificial Sequence: Synthetic oligonucleotide
cggagaccttcgggtagcaactgtcac

SEQ ID NO: 60404 - DNA, 27 bp, Artificial Sequence
  Description of Artificial Sequence: Synthetic oligonucleotide
ggagaccttcgggtagcaactgtcacc

SEQ ID NO: 60405 - DNA, 29 bp, Artificial Sequence
  Description of Artificial Sequence: Synthetic oligonucleotide
gagaccttcgggtagcaactgtcaccttg

SEQ ID NO: 60406 - DNA, 31 bp, Artificial Sequence
  Description of Artificial Sequence: Synthetic oligonucleotide
agaccttcgggtagcaactgtcaccttgatg

SEQ ID NO: 60407 - DNA, 30 bp, Artificial Sequence
  Description of Artificial Sequence: Synthetic oligonucleotide
gaccttcgggtagcaactgtcaccttgatg

SEQ ID NO: 60408 - DNA, 30 bp, Artificial Sequence
  Description of Artificial Sequence: Synthetic oligonucleotide
accttcgggtagcaactgtcaccttgatgc

SEQ ID NO: 60409 - DNA, 29 bp, Artificial Sequence
  Description of Artificial Sequence: Synthetic oligonucleotide
ccttcgggtagcaactgtcaccttgatgc

SEQ ID NO: 60410 - DNA, 30 bp, Artificial Sequence
  Description of Artificial Sequence: Synthetic oligonucleotide
cttcgggtagcaactgtcaccttgatgctg

SEQ ID NO: 60411 - DNA, 30 bp, Artificial Sequence
  Description of Artificial Sequence: Synthetic oligonucleotide
ttcgggtagcaactgtcaccttgatgctgg

SEQ ID NO: 60412 - DNA, 29 bp, Artificial Sequence
  Description of Artificial Sequence: Synthetic oligonucleotide
tcgggtagcaactgtcaccttgatgctgg

SEQ ID NO: 60413 - DNA, 28 bp, Artificial Sequence
  Description of Artificial Sequence: Synthetic oligonucleotide
cgggtagcaactgtcaccttgatgctgg

SEQ ID NO: 60414 - DNA, 28 bp, Artificial Sequence
  Description of Artificial Sequence: Synthetic oligonucleotide
gggtagcaactgtcaccttgatgctggc

SEQ ID NO: 60415 - DNA, 28 bp, Artificial Sequence
  Description of Artificial Sequence: Synthetic oligonucleotide
ggtagcaactgtcaccttgatgctggcg

SEQ ID NO: 60416 - DNA, 30 bp, Artificial Sequence
  Description of Artificial Sequence: Synthetic oligonucleotide
gtagcaactgtcaccttgatgctggcgatc

SEQ ID NO: 60417 - DNA, 30 bp, Artificial Sequence
  Description of Artificial Sequence: Synthetic oligonucleotide
tagcaactgtcaccttgatgctggcgatcc

SEQ ID NO: 60418 - DNA, 29 bp, Artificial Sequence
  Description of Artificial Sequence: Synthetic oligonucleotide
agcaactgtcaccttgatgctggcgatcc

SEQ ID NO: 60419 - DNA, 28 bp, Artificial Sequence
  Description of Artificial Sequence: Synthetic oligonucleotide
gcaactgtcaccttgatgctggcgatcc

SEQ ID NO: 60420 - DNA, 29 bp, Artificial Sequence
  Description of Artificial Sequence: Synthetic oligonucleotide
caactgtcaccttgatgctggcgatcctg

SEQ ID NO: 60421 - DNA, 30 bp, Artificial Sequence
  Description of Artificial Sequence: Synthetic oligonucleotide
aactgtcaccttgatgctggcgatcctgag

SEQ ID NO: 60422 - DNA, 29 bp, Artificial Sequence
  Description of Artificial Sequence: Synthetic oligonucleotide
actgtcaccttgatgctggcgatcctgag

SEQ ID NO: 60423 - DNA, 28 bp, Artificial Sequence
  Description of Artificial Sequence: Synthetic oligonucleotide
ctgtcaccttgatgctggcgatcctgag

SEQ ID NO: 60424 - DNA, 28 bp, Artificial Sequence
  Description of Artificial Sequence: Synthetic oligonucleotide
tgtcaccttgatgctggcgatcctgagc

SEQ ID NO: 60425 - DNA, 27 bp, Artificial Sequence
  Description of Artificial Sequence: Synthetic oligonucleotide
gtcaccttgatgctggcgatcctgagc

SEQ ID NO: 60426 - DNA, 28 bp, Artificial Sequence
  Description of Artificial Sequence: Synthetic oligonucleotide
tcaccttgatgctggcgatcctgagctc

SEQ ID NO: 60427 - DNA, 27 bp, Artificial Sequence
  Description of Artificial Sequence: Synthetic oligonucleotide
caccttgatgctggcgatcctgagctc

SEQ ID NO: 60428 - DNA, 27 bp, Artificial Sequence
  Description of Artificial Sequence: Synthetic oligonucleotide
accttgatgctggcgatcctgagctcc

SEQ ID NO: 60429 - DNA, 27 bp, Artificial Sequence
  Description of Artificial Sequence: Synthetic oligonucleotide
ccttgatgctggcgatcctgagctcct

SEQ ID NO: 60430 - DNA, 27 bp, Artificial Sequence
  Description of Artificial Sequence: Synthetic oligonucleotide
cttgatgctggcgatcctgagctcctc

SEQ ID NO: 60431 - DNA, 28 bp, Artificial Sequence
  Description of Artificial Sequence: Synthetic oligonucleotide
ttgatgctggcgatcctgagctcctcac

SEQ ID NO: 60432 - DNA, 27 bp, Artificial Sequence
  Description of Artificial Sequence: Synthetic oligonucleotide
tgatgctggcgatcctgagctcctcac

SEQ ID NO: 60433 - DNA, 27 bp, Artificial Sequence
  Description of Artificial Sequence: Synthetic oligonucleotide
gatgctggcgatcctgagctcctcact

SEQ ID NO: 60434 - DNA, 27 bp, Artificial Sequence
  Description of Artificial Sequence: Synthetic oligonucleotide
atgctggcgatcctgagctcctcactg

SEQ ID NO: 60435 - DNA, 26 bp, Artificial Sequence
  Description of Artificial Sequence: Synthetic oligonucleotide
tgctggcgatcctgagctcctcactg

SEQ ID NO: 60436 - DNA, 25 bp, Artificial Sequence
  Description of Artificial Sequence: Synthetic oligonucleotide
gctggcgatcctgagctcctcactg

SEQ ID NO: 60437 - DNA, 25 bp, Artificial Sequence
  Description of Artificial Sequence: Synthetic oligonucleotide
ctggcgatcctgagctcctcactgg

SEQ ID NO: 60438 - DNA, 26 bp, Artificial Sequence
  Description of Artificial Sequence: Synthetic oligonucleotide
tggcgatcctgagctcctcactggct

SEQ ID NO: 60439 - DNA, 25 bp, Artificial Sequence
  Description of Artificial Sequence: Synthetic oligonucleotide
ggcgatcctgagctcctcactggct

SEQ ID NO: 60440 - DNA, 26 bp, Artificial Sequence
  Description of Artificial Sequence: Synthetic oligonucleotide
gcgatcctgagctcctcactggctga

SEQ ID NO: 60441 - DNA, 26 bp, Artificial Sequence
  Description of Artificial Sequence: Synthetic oligonucleotide
cgatcctgagctcctcactggctgag

SEQ ID NO: 60442 - DNA, 26 bp, Artificial Sequence
  Description of Artificial Sequence: Synthetic oligonucleotide
gatcctgagctcctcactggctgagg

SEQ ID NO: 60443 - DNA, 26 bp, Artificial Sequence
  Description of Artificial Sequence: Synthetic oligonucleotide
atcctgagctcctcactggctgaggg

SEQ ID NO: 60444 - DNA, 25 bp, Artificial Sequence
  Description of Artificial Sequence: Synthetic oligonucleotide
tcctgagctcctcactggctgaggg

SEQ ID NO: 60445 - DNA, 24 bp, Artificial Sequence
  Description of Artificial Sequence: Synthetic oligonucleotide
cctgagctcctcactggctgaggg

SEQ ID NO: 60446 - DNA, 25 bp, Artificial Sequence
  Description of Artificial Sequence: Synthetic oligonucleotide
ctgagctcctcactggctgagggca

SEQ ID NO: 60447 - DNA, 26 bp, Artificial Sequence
  Description of Artificial Sequence: Synthetic oligonucleotide
tgagctcctcactggctgagggcaga

SEQ ID NO: 60448 - DNA, 25 bp, Artificial Sequence
  Description of Artificial Sequence: Synthetic oligonucleotide
gagctcctcactggctgagggcaga

SEQ ID NO: 60449 - DNA, 26 bp, Artificial Sequence
  Description of Artificial Sequence: Synthetic oligonucleotide
agctcctcactggctgagggcagaga

SEQ ID NO: 60450 - DNA, 25 bp, Artificial Sequence
  Description of Artificial Sequence: Synthetic oligonucleotide
gctcctcactggctgagggcagaga

SEQ ID NO: 60451 - DNA, 26 bp, Artificial Sequence
  Description of Artificial Sequence: Synthetic oligonucleotide
ctcctcactggctgagggcagagact

SEQ ID NO: 60452 - DNA, 27 bp, Artificial Sequence
  Description of Artificial Sequence: Synthetic oligonucleotide
tcctcactggctgagggcagagactct

SEQ ID NO: 60453 - DNA, 26 bp, Artificial Sequence
  Description of Artificial Sequence: Synthetic oligonucleotide
cctcactggctgagggcagagactct

SEQ ID NO: 60454 - DNA, 26 bp, Artificial Sequence
  Description of Artificial Sequence: Synthetic oligonucleotide
ctcactggctgagggcagagactctc

SEQ ID NO: 60455 - DNA, 26 bp, Artificial Sequence
  Description of Artificial Sequence: Synthetic oligonucleotide
tcactggctgagggcagagactctcc

SEQ ID NO: 60456 - DNA, 25 bp, Artificial Sequence
  Description of Artificial Sequence: Synthetic oligonucleotide
cactggctgagggcagagactctcc

SEQ ID NO: 60457 - DNA, 25 bp, Artificial Sequence
  Description of Artificial Sequence: Synthetic oligonucleotide
actggctgagggcagagactctccc

SEQ ID NO: 60458 - DNA, 24 bp, Artificial Sequence
  Description of Artificial Sequence: Synthetic oligonucleotide
ctggctgagggcagagactctccc

SEQ ID NO: 60459 - DNA, 30 bp, Artificial Sequence
  Description of Artificial Sequence: Synthetic oligonucleotide
ccgaggatttcgtgtaccagtttaagggcc

SEQ ID NO: 60460 - DNA, 31 bp, Artificial Sequence
  Description of Artificial Sequence: Synthetic oligonucleotide
cgaggatttcgtgtaccagtttaagggcctg

SEQ ID NO: 60461 - DNA, 32 bp, Artificial Sequence
  Description of Artificial Sequence: Synthetic oligonucleotide
gaggatttcgtgtaccagtttaagggcctgtg

SEQ ID NO: 60462 - DNA, 23 bp, Artificial Sequence
  Description of Artificial Sequence: Synthetic oligonucleotide
agcgcgtgcggggtgtgaccaga

SEQ ID NO: 60463 - DNA, 22 bp, Artificial Sequence
  Description of Artificial Sequence: Synthetic oligonucleotide
gcgcgtgcggggtgtgaccaga

SEQ ID NO: 60464 - DNA, 23 bp, Artificial Sequence
  Description of Artificial Sequence: Synthetic oligonucleotide
cgcgtgcggggtgtgaccagaca

SEQ ID NO: 60465 - DNA, 25 bp, Artificial Sequence
  Description of Artificial Sequence: Synthetic oligonucleotide
gcgtgcggggtgtgaccagacacat

SEQ ID NO: 60466 - DNA, 27 bp, Artificial Sequence
  Description of Artificial Sequence: Synthetic oligonucleotide
cgtgcggggtgtgaccagacacatcta

SEQ ID NO: 60467 - DNA, 30 bp, Artificial Sequence
  Description of Artificial Sequence: Synthetic oligonucleotide
gtgcggggtgtgaccagacacatctataac

SEQ ID NO: 60468 - DNA, 30 bp, Artificial Sequence
  Description of Artificial Sequence: Synthetic oligonucleotide
tgcggggtgtgaccagacacatctataacc

SEQ ID NO: 60469 - DNA, 29 bp, Artificial Sequence
  Description of Artificial Sequence: Synthetic oligonucleotide
gcggggtgtgaccagacacatctataacc

SEQ ID NO: 60470 - DNA, 29 bp, Artificial Sequence
  Description of Artificial Sequence: Synthetic oligonucleotide
cggggtgtgaccagacacatctataaccg

SEQ ID NO: 60471 - DNA, 30 bp, Artificial Sequence
  Description of Artificial Sequence: Synthetic oligonucleotide
ggggtgtgaccagacacatctataaccgag

SEQ ID NO: 60472 - DNA, 31 bp, Artificial Sequence
  Description of Artificial Sequence: Synthetic oligonucleotide
gggtgtgaccagacacatctataaccgagag

SEQ ID NO: 60473 - DNA, 31 bp, Artificial Sequence
  Description of Artificial Sequence: Synthetic oligonucleotide
ggtgtgaccagacacatctataaccgagagg

SEQ ID NO: 60474 - DNA, 32 bp, Artificial Sequence
  Description of Artificial Sequence: Synthetic oligonucleotide
gtgtgaccagacacatctataaccgagaggag

SEQ ID NO: 60475 - DNA, 34 bp, Artificial Sequence
  Description of Artificial Sequence: Synthetic oligonucleotide
tgtgaccagacacatctataaccgagaggagtac

SEQ ID NO: 60476 - DNA, 33 bp, Artificial Sequence
  Description of Artificial Sequence: Synthetic oligonucleotide
gtgaccagacacatctataaccgagaggagtac

SEQ ID NO: 60477 - DNA, 33 bp, Artificial Sequence
  Description of Artificial Sequence: Synthetic oligonucleotide
tgaccagacacatctataaccgagaggagtacg

SEQ ID NO: 60478 - DNA, 32 bp, Artificial Sequence
  Description of Artificial Sequence: Synthetic oligonucleotide
gaccagacacatctataaccgagaggagtacg

SEQ ID NO: 60479 - DNA, 33 bp, Artificial Sequence
  Description of Artificial Sequence: Synthetic oligonucleotide
accagacacatctataaccgagaggagtacgtg

SEQ ID NO: 60480 - DNA, 32 bp, Artificial Sequence
  Description of Artificial Sequence: Synthetic oligonucleotide
ccagacacatctataaccgagaggagtacgtg

SEQ ID NO: 60481 - DNA, 32 bp, Artificial Sequence
  Description of Artificial Sequence: Synthetic oligonucleotide
cagacacatctataaccgagaggagtacgtgc

SEQ ID NO: 60482 - DNA, 32 bp, Artificial Sequence
  Description of Artificial Sequence: Synthetic oligonucleotide
agacacatctataaccgagaggagtacgtgcg

SEQ ID NO: 60483 - DNA, 31 bp, Artificial Sequence
  Description of Artificial Sequence: Synthetic oligonucleotide
gacacatctataaccgagaggagtacgtgcg

SEQ ID NO: 60484 - DNA, 31 bp, Artificial Sequence
  Description of Artificial Sequence: Synthetic oligonucleotide
acacatctataaccgagaggagtacgtgcgc

SEQ ID NO: 60485 - DNA, 30 bp, Artificial Sequence
  Description of Artificial Sequence: Synthetic oligonucleotide
cacatctataaccgagaggagtacgtgcgc

SEQ ID NO: 60486 - DNA, 32 bp, Artificial Sequence
  Description of Artificial Sequence: Synthetic oligonucleotide
acatctataaccgagaggagtacgtgcgcttc

SEQ ID NO: 60487 - DNA, 31 bp, Artificial Sequence
  Description of Artificial Sequence: Synthetic oligonucleotide
catctataaccgagaggagtacgtgcgcttc

SEQ ID NO: 60488 - DNA, 31 bp, Artificial Sequence
  Description of Artificial Sequence: Synthetic oligonucleotide
atctataaccgagaggagtacgtgcgcttcg

SEQ ID NO: 60489 - DNA, 30 bp, Artificial Sequence
  Description of Artificial Sequence: Synthetic oligonucleotide
tctataaccgagaggagtacgtgcgcttcg

SEQ ID NO: 60490 - DNA, 29 bp, Artificial Sequence
  Description of Artificial Sequence: Synthetic oligonucleotide
ctataaccgagaggagtacgtgcgcttcg

SEQ ID NO: 60491 - DNA, 30 bp, Artificial Sequence
  Description of Artificial Sequence: Synthetic oligonucleotide
tataaccgagaggagtacgtgcgcttcgac

SEQ ID NO: 60492 - DNA, 29 bp, Artificial Sequence
  Description of Artificial Sequence: Synthetic oligonucleotide
ataaccgagaggagtacgtgcgcttcgac

SEQ ID NO: 60493 - DNA, 28 bp, Artificial Sequence
  Description of Artificial Sequence: Synthetic oligonucleotide
taaccgagaggagtacgtgcgcttcgac

SEQ ID NO: 60494 - DNA, 27 bp, Artificial Sequence
  Description of Artificial Sequence: Synthetic oligonucleotide
aaccgagaggagtacgtgcgcttcgac

SEQ ID NO: 60495 - DNA, 27 bp, Artificial Sequence
  Description of Artificial Sequence: Synthetic oligonucleotide
accgagaggagtacgtgcgcttcgaca

SEQ ID NO: 60496 - DNA, 26 bp, Artificial Sequence
  Description of Artificial Sequence: Synthetic oligonucleotide
ccgagaggagtacgtgcgcttcgaca

SEQ ID NO: 60497 - DNA, 26 bp, Artificial Sequence
  Description of Artificial Sequence: Synthetic oligonucleotide
cgagaggagtacgtgcgcttcgacag

SEQ ID NO: 60498 - DNA, 26 bp, Artificial Sequence
  Description of Artificial Sequence: Synthetic oligonucleotide
gagaggagtacgtgcgcttcgacagc

SEQ ID NO: 60499 - DNA, 27 bp, Artificial Sequence
  Description of Artificial Sequence: Synthetic oligonucleotide
agaggagtacgtgcgcttcgacagcga

SEQ ID NO: 60500 - DNA, 26 bp, Artificial Sequence
  Description of Artificial Sequence: Synthetic oligonucleotide
gaggagtacgtgcgcttcgacagcga

SEQ ID NO: 60501 - DNA, 26 bp, Artificial Sequence
  Description of Artificial Sequence: Synthetic oligonucleotide
aggagtacgtgcgcttcgacagcgac

SEQ ID NO: 60502 - DNA, 25 bp, Artificial Sequence
  Description of Artificial Sequence: Synthetic oligonucleotide
ggagtacgtgcgcttcgacagcgac

SEQ ID NO: 60503 - DNA, 26 bp, Artificial Sequence
  Description of Artificial Sequence: Synthetic oligonucleotide
gagtacgtgcgcttcgacagcgacgt

SEQ ID NO: 60504 - DNA, 26 bp, Artificial Sequence
  Description of Artificial Sequence: Synthetic oligonucleotide
agtacgtgcgcttcgacagcgacgtg

SEQ ID NO: 60505 - DNA, 25 bp, Artificial Sequence
  Description of Artificial Sequence: Synthetic oligonucleotide
gtacgtgcgcttcgacagcgacgtg

SEQ ID NO: 60506 - DNA, 25 bp, Artificial Sequence
  Description of Artificial Sequence: Synthetic oligonucleotide
tacgtgcgcttcgacagcgacgtgg

SEQ ID NO: 60507 - DNA, 24 bp, Artificial Sequence
  Description of Artificial Sequence: Synthetic oligonucleotide
acgtgcgcttcgacagcgacgtgg

SEQ ID NO: 60508 - DNA, 22 bp, Artificial Sequence
  Description of Artificial Sequence: Synthetic oligonucleotide
cgacgtgggggtgtaccgggca

SEQ ID NO: 60509 - DNA, 23 bp, Artificial Sequence
  Description of Artificial Sequence: Synthetic oligonucleotide
gacgtgggggtgtaccgggcagt

SEQ ID NO: 60510 - DNA, 24 bp, Artificial Sequence
  Description of Artificial Sequence: Synthetic oligonucleotide
acgtgggggtgtaccgggcagtga

SEQ ID NO: 60511 - DNA, 23 bp, Artificial Sequence
  Description of Artificial Sequence: Synthetic oligonucleotide
cgtgggggtgtaccgggcagtga

SEQ ID NO: 60512 - DNA, 23 bp, Artificial Sequence
  Description of Artificial Sequence: Synthetic oligonucleotide
gtgggggtgtaccgggcagtgac

SEQ ID NO: 60513 - DNA, 23 bp, Artificial Sequence
  Description of Artificial Sequence: Synthetic oligonucleotide
tgggggtgtaccgggcagtgacg

SEQ ID NO: 60514 - DNA, 22 bp, Artificial Sequence
  Description of Artificial Sequence: Synthetic oligonucleotide
gggggtgtaccgggcagtgacg

SEQ ID NO: 60515 - DNA, 22 bp, Artificial Sequence
  Description of Artificial Sequence: Synthetic oligonucleotide
ggggtgtaccgggcagtgacgc

SEQ ID NO: 60516 - DNA, 22 bp, Artificial Sequence
  Description of Artificial Sequence: Synthetic oligonucleotide
gggtgtaccgggcagtgacgcc

SEQ ID NO: 60517 - DNA, 22 bp, Artificial Sequence
  Description of Artificial Sequence: Synthetic oligonucleotide
ggtgtaccgggcagtgacgccg

SEQ ID NO: 60518 - DNA, 23 bp, Artificial Sequence
  Description of Artificial Sequence: Synthetic oligonucleotide
gtgtaccgggcagtgacgccgca

SEQ ID NO: 60519 - DNA, 23 bp, Artificial Sequence
  Description of Artificial Sequence: Synthetic oligonucleotide
tgtaccgggcagtgacgccgcag

SEQ ID NO: 60520 - DNA, 22 bp, Artificial Sequence
  Description of Artificial Sequence: Synthetic oligonucleotide
gtaccgggcagtgacgccgcag

SEQ ID NO: 60521 - DNA, 22 bp, Artificial Sequence
  Description of Artificial Sequence: Synthetic oligonucleotide
taccgggcagtgacgccgcagg

SEQ ID NO: 60522 - DNA, 21 bp, Artificial Sequence
  Description of Artificial Sequence: Synthetic oligonucleotide
accgggcagtgacgccgcagg

SEQ ID NO: 60523 - DNA, 20 bp, Artificial Sequence
  Description of Artificial Sequence: Synthetic oligonucleotide
ccgggcagtgacgccgcagg

SEQ ID NO: 60524 - DNA, 20 bp, Artificial Sequence
  Description of Artificial Sequence: Synthetic oligonucleotide
cgggcagtgacgccgcaggg

SEQ ID NO: 60525 - DNA, 20 bp, Artificial Sequence
  Description of Artificial Sequence: Synthetic oligonucleotide
gggcagtgacgccgcagggg

SEQ ID NO: 60526 - DNA, 20 bp, Artificial Sequence
  Description of Artificial Sequence: Synthetic oligonucleotide
ggcagtgacgccgcaggggc

SEQ ID NO: 60527 - DNA, 20 bp, Artificial Sequence
  Description of Artificial Sequence: Synthetic oligonucleotide
gcagtgacgccgcaggggcg

SEQ ID NO: 60528 - DNA, 20 bp, Artificial Sequence
  Description of Artificial Sequence: Synthetic oligonucleotide
cagtgacgccgcaggggcgg

SEQ ID NO: 60529 - DNA, 20 bp, Artificial Sequence
  Description of Artificial Sequence: Synthetic oligonucleotide
agtgacgccgcaggggcggc

SEQ ID NO: 60530 - DNA, 21 bp, Artificial Sequence
  Description of Artificial Sequence: Synthetic oligonucleotide
acgccgcaggggcggcctgtt

SEQ ID NO: 60531 - DNA, 20 bp, Artificial Sequence
  Description of Artificial Sequence: Synthetic oligonucleotide
cgccgcaggggcggcctgtt

SEQ ID NO: 60532 - DNA, 20 bp, Artificial Sequence
  Description of Artificial Sequence: Synthetic oligonucleotide
gccgcaggggcggcctgttg

SEQ ID NO: 60533 - DNA, 20 bp, Artificial Sequence
  Description of Artificial Sequence: Synthetic oligonucleotide
ccgcaggggcggcctgttgc

SEQ ID NO: 60534 - DNA, 20 bp, Artificial Sequence
  Description of Artificial Sequence: Synthetic oligonucleotide
cgcaggggcggcctgttgcc

SEQ ID NO: 60535 - DNA, 21 bp, Artificial Sequence
  Description of Artificial Sequence: Synthetic oligonucleotide
gcaggggcggcctgttgccga

SEQ ID NO: 60536 - DNA, 23 bp, Artificial Sequence
  Description of Artificial Sequence: Synthetic oligonucleotide
caggggcggcctgttgccgagta

SEQ ID NO: 60537 - DNA, 24 bp, Artificial Sequence
  Description of Artificial Sequence: Synthetic oligonucleotide
aggggcggcctgttgccgagtact

SEQ ID NO: 60538 - DNA, 23 bp, Artificial Sequence
  Description of Artificial Sequence: Synthetic oligonucleotide
ggggcggcctgttgccgagtact

SEQ ID NO: 60539 - DNA, 23 bp, Artificial Sequence
  Description of Artificial Sequence: Synthetic oligonucleotide
gggcggcctgttgccgagtactg

SEQ ID NO: 60540 - DNA, 25 bp, Artificial Sequence
  Description of Artificial Sequence: Synthetic oligonucleotide
ggcggcctgttgccgagtactggaa

SEQ ID NO: 60541 - DNA, 26 bp, Artificial Sequence
  Description of Artificial Sequence: Synthetic oligonucleotide
gcggcctgttgccgagtactggaaca

SEQ ID NO: 60542 - DNA, 26 bp, Artificial Sequence
  Description of Artificial Sequence: Synthetic oligonucleotide
cggcctgttgccgagtactggaacag

SEQ ID NO: 60543 - DNA, 26 bp, Artificial Sequence
  Description of Artificial Sequence: Synthetic oligonucleotide
ggcctgttgccgagtactggaacagc

SEQ ID NO: 60544 - DNA, 27 bp, Artificial Sequence
  Description of Artificial Sequence: Synthetic oligonucleotide
gcctgttgccgagtactggaacagcca

SEQ ID NO: 60545 - DNA, 27 bp, Artificial Sequence
  Description of Artificial Sequence: Synthetic oligonucleotide
cctgttgccgagtactggaacagccag

SEQ ID NO: 60546 - DNA, 29 bp, Artificial Sequence
  Description of Artificial Sequence: Synthetic oligonucleotide
ctgttgccgagtactggaacagccagaag

SEQ ID NO: 60547 - DNA, 29 bp, Artificial Sequence
  Description of Artificial Sequence: Synthetic oligonucleotide
tgttgccgagtactggaacagccagaagg

SEQ ID NO: 60548 - DNA, 28 bp, Artificial Sequence
  Description of Artificial Sequence: Synthetic oligonucleotide
gttgccgagtactggaacagccagaagg

SEQ ID NO: 60549 - DNA, 30 bp, Artificial Sequence
  Description of Artificial Sequence: Synthetic oligonucleotide
ttgccgagtactggaacagccagaaggaag

SEQ ID NO: 60550 - DNA, 26 bp, Artificial Sequence
  Description of Artificial Sequence: Synthetic oligonucleotide
acagccagaaggaagtcctggagggg

SEQ ID NO: 60551 - DNA, 25 bp, Artificial Sequence
  Description of Artificial Sequence: Synthetic oligonucleotide
cagccagaaggaagtcctggagggg

SEQ ID NO: 60552 - DNA, 25 bp, Artificial Sequence
  Description of Artificial Sequence: Synthetic oligonucleotide
agccagaaggaagtcctggaggggg

SEQ ID NO: 60553 - DNA, 24 bp, Artificial Sequence
  Description of Artificial Sequence: Synthetic oligonucleotide
gccagaaggaagtcctggaggggg

SEQ ID NO: 60554 - DNA, 24 bp, Artificial Sequence
  Description of Artificial Sequence: Synthetic oligonucleotide
ccagaaggaagtcctggagggggc

SEQ ID NO: 60555 - DNA, 24 bp, Artificial Sequence
  Description of Artificial Sequence: Synthetic oligonucleotide
cagaaggaagtcctggagggggcc

SEQ ID NO: 60556 - DNA, 24 bp, Artificial Sequence
  Description of Artificial Sequence: Synthetic oligonucleotide
agaaggaagtcctggagggggccc

SEQ ID NO: 60557 - DNA, 23 bp, Artificial Sequence
  Description of Artificial Sequence: Synthetic oligonucleotide
gaaggaagtcctggagggggccc

SEQ ID NO: 60558 - DNA, 23 bp, Artificial Sequence
  Description of Artificial Sequence: Synthetic oligonucleotide
aaggaagtcctggagggggcccg

SEQ ID NO: 60559 - DNA, 22 bp, Artificial Sequence
  Description of Artificial Sequence: Synthetic oligonucleotide
aggaagtcctggagggggcccg

SEQ ID NO: 60560 - DNA, 21 bp, Artificial Sequence
  Description of Artificial Sequence: Synthetic oligonucleotide
ggaagtcctggagggggcccg

SEQ ID NO: 60561 - DNA, 21 bp, Artificial Sequence
  Description of Artificial Sequence: Synthetic oligonucleotide
gaagtcctggagggggcccgg

SEQ ID NO: 60562 - DNA, 21 bp, Artificial Sequence
  Description of Artificial Sequence: Synthetic oligonucleotide
aagtcctggagggggcccggg

SEQ ID NO: 60563 - DNA, 20 bp, Artificial Sequence
  Description of Artificial Sequence: Synthetic oligonucleotide
agtcctggagggggcccggg

SEQ ID NO: 60564 - DNA, 20 bp, Artificial Sequence
  Description of Artificial Sequence: Synthetic oligonucleotide
gtcctggagggggcccgggt

SEQ ID NO: 60565 - DNA, 20 bp, Artificial Sequence
  Description of Artificial Sequence: Synthetic oligonucleotide
tcctggagggggcccgggct

SEQ ID NO: 60566 - DNA, 20 bp, Artificial Sequence
  Description of Artificial Sequence: Synthetic oligonucleotide
cctggagggggcccgggctt

SEQ ID NO: 60567 - DNA, 20 bp, Artificial Sequence
  Description of Artificial Sequence: Synthetic oligonucleotide
ctggagggggcccgggcgtt

SEQ ID NO: 60568 - DNA, 20 bp, Artificial Sequence
  Description of Artificial Sequence: Synthetic oligonucleotide
tggagggggcccgggcgtct

SEQ ID NO: 60569 - DNA, 20 bp, Artificial Sequence
  Description of Artificial Sequence: Synthetic oligonucleotide
ggagggggcccgggcgtctt

SEQ ID NO: 60570 - DNA, 20 bp, Artificial Sequence
  Description of Artificial Sequence: Synthetic oligonucleotide
gagggggcccgggcgtcgtt

SEQ ID NO: 60571 - DNA, 20 bp, Artificial Sequence
  Description of Artificial Sequence: Synthetic oligonucleotide
agggggcccgggcgtcggtt

SEQ ID NO: 60572 - DNA, 20 bp, Artificial Sequence
  Description of Artificial Sequence: Synthetic oligonucleotide
gggggcccgggcgtcggttt

SEQ ID NO: 60573 - DNA, 20 bp, Artificial Sequence
  Description of Artificial Sequence: Synthetic oligonucleotide
ggggcccgggcgtcggtgtt

SEQ ID NO: 60574 - DNA, 20 bp, Artificial Sequence
  Description of Artificial Sequence: Synthetic oligonucleotide
gggcccgggcgtcggtggat

SEQ ID NO: 60575 - DNA, 20 bp, Artificial Sequence
  Description of Artificial Sequence: Synthetic oligonucleotide
ggcccgggcgtcggtggaca

SEQ ID NO: 60576 - DNA, 20 bp, Artificial Sequence
  Description of Artificial Sequence: Synthetic oligonucleotide
gcccgggcgtcggtggacag

SEQ ID NO: 60577 - DNA, 20 bp, Artificial Sequence
  Description of Artificial Sequence: Synthetic oligonucleotide
cccgggcgtcggtggacagg

SEQ ID NO: 60578 - DNA, 21 bp, Artificial Sequence
  Description of Artificial Sequence: Synthetic oligonucleotide
ccgggcgtcggtggacagggt

SEQ ID NO: 60579 - DNA, 22 bp, Artificial Sequence
  Description of Artificial Sequence: Synthetic oligonucleotide
cgggcgtcggtggacagggtgt

SEQ ID NO: 60580 - DNA, 22 bp, Artificial Sequence
  Description of Artificial Sequence: Synthetic oligonucleotide
gggcgtcggtggacagggtgtg

SEQ ID NO: 60581 - DNA, 23 bp, Artificial Sequence
  Description of Artificial Sequence: Synthetic oligonucleotide
ggcgtcggtggacagggtgtgca

SEQ ID NO: 60582 - DNA, 24 bp, Artificial Sequence
  Description of Artificial Sequence: Synthetic oligonucleotide
gcgtcggtggacagggtgtgcaga

SEQ ID NO: 60583 - DNA, 25 bp, Artificial Sequence
  Description of Artificial Sequence: Synthetic oligonucleotide
cgtcggtggacagggtgtgcagaca

SEQ ID NO: 60584 - DNA, 27 bp, Artificial Sequence
  Description of Artificial Sequence: Synthetic oligonucleotide
gtcggtggacagggtgtgcagacacaa

SEQ ID NO: 60585 - DNA, 27 bp, Artificial Sequence
  Description of Artificial Sequence: Synthetic oligonucleotide
tcggtggacagggtgtgcagacacaac

SEQ ID NO: 60586 - DNA, 28 bp, Artificial Sequence
  Description of Artificial Sequence: Synthetic oligonucleotide
gtggacagggtgtgcagacacaactacg

SEQ ID NO: 60587 - DNA, 29 bp, Artificial Sequence
  Description of Artificial Sequence: Synthetic oligonucleotide
tggacagggtgtgcagacacaactacgag

SEQ ID NO: 60588 - DNA, 28 bp, Artificial Sequence
  Description of Artificial Sequence: Synthetic oligonucleotide
ggacagggtgtgcagacacaactacgag

SEQ ID NO: 60589 - DNA, 28 bp, Artificial Sequence
  Description of Artificial Sequence: Synthetic oligonucleotide
gacagggtgtgcagacacaactacgagg

SEQ ID NO: 60590 - DNA, 29 bp, Artificial Sequence
  Description of Artificial Sequence: Synthetic oligonucleotide
acagggtgtgcagacacaactacgaggtg

SEQ ID NO: 60591 - DNA, 28 bp, Artificial Sequence
  Description of Artificial Sequence: Synthetic oligonucleotide
cagggtgtgcagacacaactacgaggtg

SEQ ID NO: 60592 - DNA, 28 bp, Artificial Sequence
  Description of Artificial Sequence: Synthetic oligonucleotide
agggtgtgcagacacaactacgaggtgg

SEQ ID NO: 60593 - DNA, 27 bp, Artificial Sequence
  Description of Artificial Sequence: Synthetic oligonucleotide
gggtgtgcagacacaactacgaggtgg

SEQ ID NO: 60594 - DNA, 27 bp, Artificial Sequence
  Description of Artificial Sequence: Synthetic oligonucleotide
ggtgtgcagacacaactacgaggtggc

SEQ ID NO: 60595 - DNA, 27 bp, Artificial Sequence
  Description of Artificial Sequence: Synthetic oligonucleotide
gtgtgcagacacaactacgaggtggcg

SEQ ID NO: 60596 - DNA, 29 bp, Artificial Sequence
  Description of Artificial Sequence: Synthetic oligonucleotide
tgtgcagacacaactacgaggtggcgtac

SEQ ID NO: 60597 - DNA, 28 bp, Artificial Sequence
  Description of Artificial Sequence: Synthetic oligonucleotide
gtgcagacacaactacgaggtggcgtac

SEQ ID NO: 60598 - DNA, 28 bp, Artificial Sequence
  Description of Artificial Sequence: Synthetic oligonucleotide
tgcagacacaactacgaggtggcgtacc

SEQ ID NO: 60599 - DNA, 27 bp, Artificial Sequence
  Description of Artificial Sequence: Synthetic oligonucleotide
gcagacacaactacgaggtggcgtacc

SEQ ID NO: 60600 - DNA, 27 bp, Artificial Sequence
  Description of Artificial Sequence: Synthetic oligonucleotide
cagacacaactacgaggtggcgtaccg

SEQ ID NO: 60601 - DNA, 27 bp, Artificial Sequence
  Description of Artificial Sequence: Synthetic oligonucleotide
agacacaactacgaggtggcgtaccgc

SEQ ID NO: 60602 - DNA, 26 bp, Artificial Sequence
  Description of Artificial Sequence: Synthetic oligonucleotide
gacacaactacgaggtggcgtaccgc

SEQ ID NO: 60603 - DNA, 26 bp, Artificial Sequence
  Description of Artificial Sequence: Synthetic oligonucleotide
acacaactacgaggtggcgtaccgcg

SEQ ID NO: 60604 - DNA, 25 bp, Artificial Sequence
  Description of Artificial Sequence: Synthetic oligonucleotide
cacaactacgaggtggcgtaccgcg

SEQ ID NO: 60605 - DNA, 25 bp, Artificial Sequence
  Description of Artificial Sequence: Synthetic oligonucleotide
acaactacgaggtggcgtaccgcgg

SEQ ID NO: 60606 - DNA, 24 bp, Artificial Sequence
  Description of Artificial Sequence: Synthetic oligonucleotide
caactacgaggtggcgtaccgcgg

SEQ ID NO: 60607 - DNA, 26 bp, Artificial Sequence
  Description of Artificial Sequence: Synthetic oligonucleotide
aactacgaggtggcgtaccgcgggat

SEQ ID NO: 60608 - DNA, 25 bp, Artificial Sequence
  Description of Artificial Sequence: Synthetic oligonucleotide
actacgaggtggcgtaccgcgggat

SEQ ID NO: 60609 - DNA, 24 bp, Artificial Sequence
  Description of Artificial Sequence: Synthetic oligonucleotide
ctacgaggtggcgtaccgcgggat

SEQ ID NO: 60610 - DNA, 24 bp, Artificial Sequence
  Description of Artificial Sequence: Synthetic oligonucleotide
tacgaggtggcgtaccgcgggatc

SEQ ID NO: 60611 - DNA, 23 bp, Artificial Sequence
  Description of Artificial Sequence: Synthetic oligonucleotide
acgaggtggcgtaccgcgggatc

SEQ ID NO: 60612 - DNA, 22 bp, Artificial Sequence
  Description of Artificial Sequence: Synthetic oligonucleotide
cgaggtggcgtaccgcgggatc

SEQ ID NO: 60613 - DNA, 23 bp, Artificial Sequence
  Description of Artificial Sequence: Synthetic oligonucleotide
gaggtggcgtaccgcgggatcct

SEQ ID NO: 60614 - DNA, 23 bp, Artificial Sequence
  Description of Artificial Sequence: Synthetic oligonucleotide
aggtggcgtaccgcgggatcctg

SEQ ID NO: 60615 - DNA, 22 bp, Artificial Sequence
  Description of Artificial Sequence: Synthetic oligonucleotide
ggtggcgtaccgcgggatcctg

SEQ ID NO: 60616 - DNA, 23 bp, Artificial Sequence
  Description of Artificial Sequence: Synthetic oligonucleotide
gtggcgtaccgcgggatcctgca

SEQ ID NO: 60617 - DNA, 24 bp, Artificial Sequence
  Description of Artificial Sequence: Synthetic oligonucleotide
tggcgtaccgcgggatcctgcaga

SEQ ID NO: 60618 - DNA, 23 bp, Artificial Sequence
  Description of Artificial Sequence: Synthetic oligonucleotide
ggcgtaccgcgggatcctgcaga

SEQ ID NO: 60619 - DNA, 23 bp, Artificial Sequence
  Description of Artificial Sequence: Synthetic oligonucleotide
gcgtaccgcgggatcctgcagag

SEQ ID NO: 60620 - DNA, 24 bp, Artificial Sequence
  Description of Artificial Sequence: Synthetic oligonucleotide
cgtaccgcgggatcctgcagagga

SEQ ID NO: 60621 - DNA, 25 bp, Artificial Sequence
  Description of Artificial Sequence: Synthetic oligonucleotide
gtaccgcgggatcctgcagaggaga

SEQ ID NO: 60622 - DNA, 26 bp, Artificial Sequence
  Description of Artificial Sequence: Synthetic oligonucleotide
taccgcgggatcctgcagaggagagt

SEQ ID NO: 60623 - DNA, 25 bp, Artificial Sequence
  Description of Artificial Sequence: Synthetic oligonucleotide
accgcgggatcctgcagaggagagt

SEQ ID NO: 60624 - DNA, 24 bp, Artificial Sequence
  Description of Artificial Sequence: Synthetic oligonucleotide
ccgcgggatcctgcagaggagagt

SEQ ID NO: 60625 - DNA, 24 bp, Artificial Sequence
  Description of Artificial Sequence: Synthetic oligonucleotide
cgcgggatcctgcagaggagagtg

SEQ ID NO: 60626 - DNA, 25 bp, Artificial Sequence
  Description of Artificial Sequence: Synthetic oligonucleotide
gcgggatcctgcagaggagagtgga

SEQ ID NO: 60627 - DNA, 25 bp, Artificial Sequence
  Description of Artificial Sequence: Synthetic oligonucleotide
cgggatcctgcagaggagagtggag

SEQ ID NO: 60628 - DNA, 25 bp, Artificial Sequence
  Description of Artificial Sequence: Synthetic oligonucleotide
gggatcctgcagaggagagtggagc

SEQ ID NO: 60629 - DNA, 25 bp, Artificial Sequence
  Description of Artificial Sequence: Synthetic oligonucleotide
ggatcctgcagaggagagtggagcc

SEQ ID NO: 60630 - DNA, 26 bp, Artificial Sequence
  Description of Artificial Sequence: Synthetic oligonucleotide
gatcctgcagaggagagtggagccca

SEQ ID NO: 60631 - DNA, 27 bp, Artificial Sequence
  Description of Artificial Sequence: Synthetic oligonucleotide
atcctgcagaggagagtggagcccaca

SEQ ID NO: 60632 - DNA, 26 bp, Artificial Sequence
  Description of Artificial Sequence: Synthetic oligonucleotide
tcctgcagaggagagtggagcccaca

SEQ ID NO: 60633 - DNA, 25 bp, Artificial Sequence
  Description of Artificial Sequence: Synthetic oligonucleotide
cctgcagaggagagtggagcccaca

SEQ ID NO: 60634 - DNA, 26 bp, Artificial Sequence
  Description of Artificial Sequence: Synthetic oligonucleotide
ctgcagaggagagtggagcccacagt

SEQ ID NO: 60635 - DNA, 27 bp, Artificial Sequence
  Description of Artificial Sequence: Synthetic oligonucleotide
tgcagaggagagtggagcccacagtga

SEQ ID NO: 60636 - DNA, 26 bp, Artificial Sequence
  Description of Artificial Sequence: Synthetic oligonucleotide
gcagaggagagtggagcccacagtga

SEQ ID NO: 60637 - DNA, 26 bp, Artificial Sequence
  Description of Artificial Sequence: Synthetic oligonucleotide
cagaggagagtggagcccacagtgac

SEQ ID NO: 60638 - DNA, 27 bp, Artificial Sequence
  Description of Artificial Sequence: Synthetic oligonucleotide
agaggagagtggagcccacagtgacca

SEQ ID NO: 60639 - DNA, 27 bp, Artificial Sequence
  Description of Artificial Sequence: Synthetic oligonucleotide
gaggagagtggagcccacagtgaccat

SEQ ID NO: 60640 - DNA, 27 bp, Artificial Sequence
  Description of Artificial Sequence: Synthetic oligonucleotide
aggagagtggagcccacagtgaccatc

SEQ ID NO: 60641 - DNA, 27 bp, Artificial Sequence
  Description of Artificial Sequence: Synthetic oligonucleotide
ggagagtggagcccacagtgaccatct

SEQ ID NO: 60642 - DNA, 27 bp, Artificial Sequence
  Description of Artificial Sequence: Synthetic oligonucleotide
gagagtggagcccacagtgaccatctc

SEQ ID NO: 60643 - DNA, 27 bp, Artificial Sequence
  Description of Artificial Sequence: Synthetic oligonucleotide
agagtggagcccacagtgaccatctcc

SEQ ID NO: 60644 - DNA, 27 bp, Artificial Sequence
  Description of Artificial Sequence: Synthetic oligonucleotide
aggccctcaaccaccacaacctgctga

SEQ ID NO: 60645 - DNA, 27 bp, Artificial Sequence
  Description of Artificial Sequence: Synthetic oligonucleotide
ggccctcaaccaccacaacctgctgat

SEQ ID NO: 60646 - DNA, 27 bp, Artificial Sequence
  Description of Artificial Sequence: Synthetic oligonucleotide
gccctcaaccaccacaacctgctgatc

SEQ ID NO: 60647 - DNA, 28 bp, Artificial Sequence
  Description of Artificial Sequence: Synthetic oligonucleotide
ccctcaaccaccacaacctgctgatctg

SEQ ID NO: 60648 - DNA, 28 bp, Artificial Sequence
  Description of Artificial Sequence: Synthetic oligonucleotide
cctcaaccaccacaacctgctgatctgc

SEQ ID NO: 60649 - DNA, 29 bp, Artificial Sequence
  Description of Artificial Sequence: Synthetic oligonucleotide
ctcaaccaccacaacctgctgatctgctc

SEQ ID NO: 60650 - DNA, 29 bp, Artificial Sequence
  Description of Artificial Sequence: Synthetic oligonucleotide
tcaaccaccacaacctgctgatctgctcg

SEQ ID NO: 60651 - DNA, 28 bp, Artificial Sequence
  Description of Artificial Sequence: Synthetic oligonucleotide
caaccaccacaacctgctgatctgctcg

SEQ ID NO: 60652 - DNA, 28 bp, Artificial Sequence
  Description of Artificial Sequence: Synthetic oligonucleotide
aaccaccacaacctgctgatctgctcgg

SEQ ID NO: 60653 - DNA, 27 bp, Artificial Sequence
  Description of Artificial Sequence: Synthetic oligonucleotide
accaccacaacctgctgatctgctcgg

SEQ ID NO: 60654 - DNA, 27 bp, Artificial Sequence
  Description of Artificial Sequence: Synthetic oligonucleotide
ccaccacaacctgctgatctgctcggt

SEQ ID NO: 60655 - DNA, 27 bp, Artificial Sequence
  Description of Artificial Sequence: Synthetic oligonucleotide
caccacaacctgctgatctgctcggtg

SEQ ID NO: 60656 - DNA, 28 bp, Artificial Sequence
  Description of Artificial Sequence: Synthetic oligonucleotide
accacaacctgctgatctgctcggtgac

SEQ ID NO: 60657 - DNA, 27 bp, Artificial Sequence
  Description of Artificial Sequence: Synthetic oligonucleotide
ccacaacctgctgatctgctcggtgac

SEQ ID NO: 60658 - DNA, 28 bp, Artificial Sequence
  Description of Artificial Sequence: Synthetic oligonucleotide
cacaacctgctgatctgctcggtgacag

SEQ ID NO: 60659 - DNA, 32 bp, Artificial Sequence
  Description of Artificial Sequence: Synthetic oligonucleotide
acaacctgctgatctgctcggtgacagatttc

SEQ ID NO: 60660 - DNA, 31 bp, Artificial Sequence
  Description of Artificial Sequence: Synthetic oligonucleotide
caacctgctgatctgctcggtgacagatttc

SEQ ID NO: 60661 - DNA, 34 bp, Artificial Sequence
  Description of Artificial Sequence: Synthetic oligonucleotide
aacctgctgatctgctcggtgacagatttctatc

SEQ ID NO: 60662 - DNA, 33 bp, Artificial Sequence
  Description of Artificial Sequence: Synthetic oligonucleotide
acctgctgatctgctcggtgacagatttctatc

SEQ ID NO: 60663 - DNA, 32 bp, Artificial Sequence
  Description of Artificial Sequence: Synthetic oligonucleotide
cctgctgatctgctcggtgacagatttctatc

SEQ ID NO: 60664 - DNA, 32 bp, Artificial Sequence
  Description of Artificial Sequence: Synthetic oligonucleotide
ctgctgatctgctcggtgacagatttctatcc

SEQ ID NO: 60665 - DNA, 34 bp, Artificial Sequence
  Description of Artificial Sequence: Synthetic oligonucleotide
tgctgatctgctcggtgacagatttctatccaag

SEQ ID NO: 60666 - DNA, 33 bp, Artificial Sequence
  Description of Artificial Sequence: Synthetic oligonucleotide
gctgatctgctcggtgacagatttctatccaag

SEQ ID NO: 60667 - DNA, 33 bp, Artificial Sequence
  Description of Artificial Sequence: Synthetic oligonucleotide
ctgatctgctcggtgacagatttctatccaagc

SEQ ID NO: 60668 - DNA, 33 bp, Artificial Sequence
  Description of Artificial Sequence: Synthetic oligonucleotide
tgatctgctcggtgacagatttctatccaagcc

SEQ ID NO: 60669 - DNA, 32 bp, Artificial Sequence
  Description of Artificial Sequence: Synthetic oligonucleotide
gatctgctcggtgacagatttctatccaagcc

SEQ ID NO: 60670 - DNA, 33 bp, Artificial Sequence
  Description of Artificial Sequence: Synthetic oligonucleotide
atctgctcggtgacagatttctatccaagccag

SEQ ID NO: 60671 - DNA, 32 bp, Artificial Sequence
  Description of Artificial Sequence: Synthetic oligonucleotide
tctgctcggtgacagatttctatccaagccag

SEQ ID NO: 60672 - DNA, 31 bp, Artificial Sequence
  Description of Artificial Sequence: Synthetic oligonucleotide
ctgctcggtgacagatttctatccaagccag

SEQ ID NO: 60673 - DNA, 33 bp, Artificial Sequence
  Description of Artificial Sequence: Synthetic oligonucleotide
tgctcggtgacagatttctatccaagccagatc

SEQ ID NO: 60674 - DNA, 32 bp, Artificial Sequence
  Description of Artificial Sequence: Synthetic oligonucleotide
gctcggtgacagatttctatccaagccagatc

SEQ ID NO: 60675 - DNA, 35 bp, Artificial Sequence
  Description of Artificial Sequence: Synthetic oligonucleotide
ctcggtgacagatttctatccaagccagatcaaag

SEQ ID NO: 60676 - DNA, 36 bp, Artificial Sequence
  Description of Artificial Sequence: Synthetic oligonucleotide
tcggtgacagatttctatccaagccagatcaaagtc

SEQ ID NO: 60677 - DNA, 35 bp, Artificial Sequence
  Description of Artificial Sequence: Synthetic oligonucleotide
cggtgacagatttctatccaagccagatcaaagtc

SEQ ID NO: 60678 - DNA, 35 bp, Artificial Sequence
  Description of Artificial Sequence: Synthetic oligonucleotide
ggtgacagatttctatccaagccagatcaaagtcc

SEQ ID NO: 60679 - DNA, 35 bp, Artificial Sequence
  Description of Artificial Sequence: Synthetic oligonucleotide
gtgacagatttctatccaagccagatcaaagtccg

SEQ ID NO: 60680 - DNA, 35 bp, Artificial Sequence
  Description of Artificial Sequence: Synthetic oligonucleotide
tgacagatttctatccaagccagatcaaagtccgg

SEQ ID NO: 60681 - DNA, 34 bp, Artificial Sequence
  Description of Artificial Sequence: Synthetic oligonucleotide
gacagatttctatccaagccagatcaaagtccgg

SEQ ID NO: 60682 - DNA, 35 bp, Artificial Sequence
  Description of Artificial Sequence: Synthetic oligonucleotide
acagatttctatccaagccagatcaaagtccggtg

SEQ ID NO: 60683 - DNA, 34 bp, Artificial Sequence
  Description of Artificial Sequence: Synthetic oligonucleotide
cagatttctatccaagccagatcaaagtccggtg

SEQ ID NO: 60684 - DNA, 34 bp, Artificial Sequence
  Description of Artificial Sequence: Synthetic oligonucleotide
agatttctatccaagccagatcaaagtccggtgg

SEQ ID NO: 60685 - DNA, 33 bp, Artificial Sequence
  Description of Artificial Sequence: Synthetic oligonucleotide
gatttctatccaagccagatcaaagtccggtgg

SEQ ID NO: 60686 - DNA, 36 bp, Artificial Sequence
  Description of Artificial Sequence: Synthetic oligonucleotide
atttctatccaagccagatcaaagtccggtggtttc

SEQ ID NO: 60687 - DNA, 35 bp, Artificial Sequence
  Description of Artificial Sequence: Synthetic oligonucleotide
tttctatccaagccagatcaaagtccggtggtttc

SEQ ID NO: 60688 - DNA, 34 bp, Artificial Sequence
  Description of Artificial Sequence: Synthetic oligonucleotide
ttctatccaagccagatcaaagtccggtggtttc

SEQ ID NO: 60689 - DNA, 33 bp, Artificial Sequence
  Description of Artificial Sequence: Synthetic oligonucleotide
tctatccaagccagatcaaagtccggtggtttc

SEQ ID NO: 60690 - DNA, 32 bp, Artificial Sequence
  Description of Artificial Sequence: Synthetic oligonucleotide
ctatccaagccagatcaaagtccggtggtttc

SEQ ID NO: 60691 - DNA, 32 bp, Artificial Sequence
  Description of Artificial Sequence: Synthetic oligonucleotide
tatccaagccagatcaaagtccggtggtttcg

SEQ ID NO: 60692 - DNA, 31 bp, Artificial Sequence
  Description of Artificial Sequence: Synthetic oligonucleotide
atccaagccagatcaaagtccggtggtttcg

SEQ ID NO: 60693 - DNA, 30 bp, Artificial Sequence
  Description of Artificial Sequence: Synthetic oligonucleotide
tccaagccagatcaaagtccggtggtttcg

SEQ ID NO: 60694 - DNA, 29 bp, Artificial Sequence
  Description of Artificial Sequence: Synthetic oligonucleotide
ccaagccagatcaaagtccggtggtttcg

SEQ ID NO: 60695 - DNA, 29 bp, Artificial Sequence
  Description of Artificial Sequence: Synthetic oligonucleotide
caagccagatcaaagtccggtggtttcgg

SEQ ID NO: 60696 - DNA, 32 bp, Artificial Sequence
  Description of Artificial Sequence: Synthetic oligonucleotide
aagccagatcaaagtccggtggtttcggaatg

SEQ ID NO: 60697 - DNA, 31 bp, Artificial Sequence
  Description of Artificial Sequence: Synthetic oligonucleotide
agccagatcaaagtccggtggtttcggaatg

SEQ ID NO: 60698 - DNA, 30 bp, Artificial Sequence
  Description of Artificial Sequence: Synthetic oligonucleotide
gccagatcaaagtccggtggtttcggaatg

SEQ ID NO: 60699 - DNA, 32 bp, Artificial Sequence
  Description of Artificial Sequence: Synthetic oligonucleotide
ccagatcaaagtccggtggtttcggaatgatc

SEQ ID NO: 60700 - DNA, 33 bp, Artificial Sequence
  Description of Artificial Sequence: Synthetic oligonucleotide
cagatcaaagtccggtggtttcggaatgatcag

SEQ ID NO: 60701 - DNA, 33 bp, Artificial Sequence
  Description of Artificial Sequence: Synthetic oligonucleotide
agatcaaagtccggtggtttcggaatgatcagg

SEQ ID NO: 60702 - DNA, 32 bp, Artificial Sequence
  Description of Artificial Sequence: Synthetic oligonucleotide
gatcaaagtccggtggtttcggaatgatcagg

SEQ ID NO: 60703 - DNA, 33 bp, Artificial Sequence
  Description of Artificial Sequence: Synthetic oligonucleotide
atcaaagtccggtggtttcggaatgatcaggag

SEQ ID NO: 60704 - DNA, 32 bp, Artificial Sequence
  Description of Artificial Sequence: Synthetic oligonucleotide
tcaaagtccggtggtttcggaatgatcaggag

SEQ ID NO: 60705 - DNA, 31 bp, Artificial Sequence
  Description of Artificial Sequence: Synthetic oligonucleotide
caaagtccggtggtttcggaatgatcaggag

SEQ ID NO: 60706 - DNA, 31 bp, Artificial Sequence
  Description of Artificial Sequence: Synthetic oligonucleotide
aaagtccggtggtttcggaatgatcaggagg

SEQ ID NO: 60707 - DNA, 30 bp, Artificial Sequence
  Description of Artificial Sequence: Synthetic oligonucleotide
aagtccggtggtttcggaatgatcaggagg

SEQ ID NO: 60708 - DNA, 29 bp, Artificial Sequence
  Description of Artificial Sequence: Synthetic oligonucleotide
agtccggtggtttcggaatgatcaggagg

SEQ ID NO: 60709 - DNA, 28 bp, Artificial Sequence
  Description of Artificial Sequence: Synthetic oligonucleotide
gtccggtggtttcggaatgatcaggagg

SEQ ID NO: 60710 - DNA, 29 bp, Artificial Sequence
  Description of Artificial Sequence: Synthetic oligonucleotide
tccggtggtttcggaatgatcaggaggag

SEQ ID NO: 60711 - DNA, 28 bp, Artificial Sequence
  Description of Artificial Sequence: Synthetic oligonucleotide
ccggtggtttcggaatgatcaggaggag

SEQ ID NO: 60712 - DNA, 29 bp, Artificial Sequence
  Description of Artificial Sequence: Synthetic oligonucleotide
cggtggtttcggaatgatcaggaggagac

SEQ ID NO: 60713 - DNA, 30 bp, Artificial Sequence
  Description of Artificial Sequence: Synthetic oligonucleotide
ggtggtttcggaatgatcaggaggagacag

SEQ ID NO: 60714 - DNA, 30 bp, Artificial Sequence
  Description of Artificial Sequence: Synthetic oligonucleotide
gtggtttcggaatgatcaggaggagacagc

SEQ ID NO: 60715 - DNA, 30 bp, Artificial Sequence
  Description of Artificial Sequence: Synthetic oligonucleotide
tggtttcggaatgatcaggaggagacagcc

SEQ ID NO: 60716 - DNA, 29 bp, Artificial Sequence
  Description of Artificial Sequence: Synthetic oligonucleotide
ggtttcggaatgatcaggaggagacagcc

SEQ ID NO: 60717 - DNA, 29 bp, Artificial Sequence
  Description of Artificial Sequence: Synthetic oligonucleotide
gtttcggaatgatcaggaggagacagccg

SEQ ID NO: 60718 - DNA, 29 bp, Artificial Sequence
  Description of Artificial Sequence: Synthetic oligonucleotide
tttcggaatgatcaggaggagacagccgg

SEQ ID NO: 60719 - DNA, 28 bp, Artificial Sequence
  Description of Artificial Sequence: Synthetic oligonucleotide
ttcggaatgatcaggaggagacagccgg

SEQ ID NO: 60720 - DNA, 27 bp, Artificial Sequence
  Description of Artificial Sequence: Synthetic oligonucleotide
tcggaatgatcaggaggagacagccgg

SEQ ID NO: 60721 - DNA, 26 bp, Artificial Sequence
  Description of Artificial Sequence: Synthetic oligonucleotide
cggaatgatcaggaggagacagccgg

SEQ ID NO: 60722 - DNA, 26 bp, Artificial Sequence
  Description of Artificial Sequence: Synthetic oligonucleotide
ggaatgatcaggaggagacagccggc

SEQ ID NO: 60723 - DNA, 27 bp, Artificial Sequence
  Description of Artificial Sequence: Synthetic oligonucleotide
gaatgatcaggaggagacagccggcgt

SEQ ID NO: 60724 - DNA, 28 bp, Artificial Sequence
  Description of Artificial Sequence: Synthetic oligonucleotide
aatgatcaggaggagacagccggcgttg

SEQ ID NO: 60725 - DNA, 27 bp, Artificial Sequence
  Description of Artificial Sequence: Synthetic oligonucleotide
atgatcaggaggagacagccggcgttg

SEQ ID NO: 60726 - DNA, 27 bp, Artificial Sequence
  Description of Artificial Sequence: Synthetic oligonucleotide
tgatcaggaggagacagccggcgttgt

SEQ ID NO: 60727 - DNA, 26 bp, Artificial Sequence
  Description of Artificial Sequence: Synthetic oligonucleotide
gatcaggaggagacagccggcgttgt

SEQ ID NO: 60728 - DNA, 27 bp, Artificial Sequence
  Description of Artificial Sequence: Synthetic oligonucleotide
atcaggaggagacagccggcgttgtgt

SEQ ID NO: 60729 - DNA, 26 bp, Artificial Sequence
  Description of Artificial Sequence: Synthetic oligonucleotide
tcaggaggagacagccggcgttgtgt

SEQ ID NO: 60730 - DNA, 25 bp, Artificial Sequence
  Description of Artificial Sequence: Synthetic oligonucleotide
caggaggagacagccggcgttgtgt

SEQ ID NO: 60731 - DNA, 25 bp, Artificial Sequence
  Description of Artificial Sequence: Synthetic oligonucleotide
aggaggagacagccggcgttgtgtc

SEQ ID NO: 60732 - DNA, 24 bp, Artificial Sequence
  Description of Artificial Sequence: Synthetic oligonucleotide
ggaggagacagccggcgttgtgtc

SEQ ID NO: 60733 - DNA, 25 bp, Artificial Sequence
  Description of Artificial Sequence: Synthetic oligonucleotide
gaggagacagccggcgttgtgtcca

SEQ ID NO: 60734 - DNA, 25 bp, Artificial Sequence
  Description of Artificial Sequence: Synthetic oligonucleotide
aggagacagccggcgttgtgtccac

SEQ ID NO: 60735 - DNA, 24 bp, Artificial Sequence
  Description of Artificial Sequence: Synthetic oligonucleotide
ggagacagccggcgttgtgtccac

SEQ ID NO: 60736 - DNA, 24 bp, Artificial Sequence
  Description of Artificial Sequence: Synthetic oligonucleotide
gagacagccggcgttgtgtccacc

SEQ ID NO: 60737 - DNA, 24 bp, Artificial Sequence
  Description of Artificial Sequence: Synthetic oligonucleotide
agacagccggcgttgtgtccaccc

SEQ ID NO: 60738 - DNA, 23 bp, Artificial Sequence
  Description of Artificial Sequence: Synthetic oligonucleotide
gacagccggcgttgtgtccaccc

SEQ ID NO: 60739 - DNA, 23 bp, Artificial Sequence
  Description of Artificial Sequence: Synthetic oligonucleotide
acagccggcgttgtgtccacccc

SEQ ID NO: 60740 - DNA, 22 bp, Artificial Sequence
  Description of Artificial Sequence: Synthetic oligonucleotide
cagccggcgttgtgtccacccc

SEQ ID NO: 60741 - DNA, 22 bp, Artificial Sequence
  Description of Artificial Sequence: Synthetic oligonucleotide
agccggcgttgtgtccaccccc

SEQ ID NO: 60742 - DNA, 21 bp, Artificial Sequence
  Description of Artificial Sequence: Synthetic oligonucleotide
gccggcgttgtgtccaccccc

SEQ ID NO: 60743 - DNA, 22 bp, Artificial Sequence
  Description of Artificial Sequence: Synthetic oligonucleotide
ccggcgttgtgtccacccccct

SEQ ID NO: 60744 - DNA, 26 bp, Artificial Sequence
  Description of Artificial Sequence: Synthetic oligonucleotide
cggcgttgtgtccacccccctcatta

SEQ ID NO: 60745 - DNA, 26 bp, Artificial Sequence
  Description of Artificial Sequence: Synthetic oligonucleotide
ggcgttgtgtccacccccctcattag

SEQ ID NO: 60746 - DNA, 27 bp, Artificial Sequence
  Description of Artificial Sequence: Synthetic oligonucleotide
gcgttgtgtccacccccctcattagga

SEQ ID NO: 60747 - DNA, 28 bp, Artificial Sequence
  Description of Artificial Sequence: Synthetic oligonucleotide
cgttgtgtccacccccctcattaggaac

SEQ ID NO: 60748 - DNA, 28 bp, Artificial Sequence
  Description of Artificial Sequence: Synthetic oligonucleotide
gttgtgtccacccccctcattaggaacg

SEQ ID NO: 60749 - DNA, 28 bp, Artificial Sequence
  Description of Artificial Sequence: Synthetic oligonucleotide
ttgtgtccacccccctcattaggaacgg

SEQ ID NO: 60750 - DNA, 27 bp, Artificial Sequence
  Description of Artificial Sequence: Synthetic oligonucleotide
tgtgtccacccccctcattaggaacgg

SEQ ID NO: 60751 - DNA, 27 bp, Artificial Sequence
  Description of Artificial Sequence: Synthetic oligonucleotide
gtgtccacccccctcattaggaacggt

SEQ ID NO: 60752 - DNA, 27 bp, Artificial Sequence
  Description of Artificial Sequence: Synthetic oligonucleotide
tgtccacccccctcattaggaacggtg

SEQ ID NO: 60753 - DNA, 27 bp, Artificial Sequence
  Description of Artificial Sequence: Synthetic oligonucleotide
gtccacccccctcattaggaacggtga

SEQ ID NO: 60754 - DNA, 27 bp, Artificial Sequence
  Description of Artificial Sequence: Synthetic oligonucleotide
tccacccccctcattaggaacggtgac

SEQ ID NO: 60755 - DNA, 27 bp, Artificial Sequence
  Description of Artificial Sequence: Synthetic oligonucleotide
ccacccccctcattaggaacggtgact

SEQ ID NO: 60756 - DNA, 27 bp, Artificial Sequence
  Description of Artificial Sequence: Synthetic oligonucleotide
cacccccctcattaggaacggtgactg

SEQ ID NO: 60757 - DNA, 27 bp, Artificial Sequence
  Description of Artificial Sequence: Synthetic oligonucleotide
acccccctcattaggaacggtgactgg

SEQ ID NO: 60758 - DNA, 27 bp, Artificial Sequence
  Description of Artificial Sequence: Synthetic oligonucleotide
cccccctcattaggaacggtgactgga

SEQ ID NO: 60759 - DNA, 27 bp, Artificial Sequence
  Description of Artificial Sequence: Synthetic oligonucleotide
ccccctcattaggaacggtgactggac

SEQ ID NO: 60760 - DNA, 27 bp, Artificial Sequence
  Description of Artificial Sequence: Synthetic oligonucleotide
cccctcattaggaacggtgactggacc

SEQ ID NO: 60761 - DNA, 29 bp, Artificial Sequence
  Description of Artificial Sequence: Synthetic oligonucleotide
ccctcattaggaacggtgactggaccttc

SEQ ID NO: 60762 - DNA, 29 bp, Artificial Sequence
  Description of Artificial Sequence: Synthetic oligonucleotide
cctcattaggaacggtgactggaccttcc

SEQ ID NO: 60763 - DNA, 30 bp, Artificial Sequence
  Description of Artificial Sequence: Synthetic oligonucleotide
ctcattaggaacggtgactggaccttccag

SEQ ID NO: 60764 - DNA, 32 bp, Artificial Sequence
  Description of Artificial Sequence: Synthetic oligonucleotide
tcattaggaacggtgactggaccttccagatc

SEQ ID NO: 60765 - DNA, 31 bp, Artificial Sequence
  Description of Artificial Sequence: Synthetic oligonucleotide
cattaggaacggtgactggaccttccagatc

SEQ ID NO: 60766 - DNA, 28 bp, Artificial Sequence
  Description of Artificial Sequence: Synthetic oligonucleotide
ctggaaatgactccccagcgtggagatg

SEQ ID NO: 60767 - DNA, 29 bp, Artificial Sequence
  Description of Artificial Sequence: Synthetic oligonucleotide
tggaaatgactccccagcgtggagatgtc

SEQ ID NO: 60768 - DNA, 28 bp, Artificial Sequence
  Description of Artificial Sequence: Synthetic oligonucleotide
ggaaatgactccccagcgtggagatgtc

SEQ ID NO: 60769 - DNA, 30 bp, Artificial Sequence
  Description of Artificial Sequence: Synthetic oligonucleotide
gaaatgactccccagcgtggagatgtctac

SEQ ID NO: 60770 - DNA, 31 bp, Artificial Sequence
  Description of Artificial Sequence: Synthetic oligonucleotide
aaatgactccccagcgtggagatgtctacac

SEQ ID NO: 60771 - DNA, 30 bp, Artificial Sequence
  Description of Artificial Sequence: Synthetic oligonucleotide
aatgactccccagcgtggagatgtctacac

SEQ ID NO: 60772 - DNA, 29 bp, Artificial Sequence
  Description of Artificial Sequence: Synthetic oligonucleotide
atgactccccagcgtggagatgtctacac

SEQ ID NO: 60773 - DNA, 28 bp, Artificial Sequence
  Description of Artificial Sequence: Synthetic oligonucleotide
tgactccccagcgtggagatgtctacac

SEQ ID NO: 60774 - DNA, 27 bp, Artificial Sequence
  Description of Artificial Sequence: Synthetic oligonucleotide
gactccccagcgtggagatgtctacac

SEQ ID NO: 60775 - DNA, 27 bp, Artificial Sequence
  Description of Artificial Sequence: Synthetic oligonucleotide
actccccagcgtggagatgtctacacc

SEQ ID NO: 60776 - DNA, 27 bp, Artificial Sequence
  Description of Artificial Sequence: Synthetic oligonucleotide
ctccccagcgtggagatgtctacacct

SEQ ID NO: 60777 - DNA, 27 bp, Artificial Sequence
  Description of Artificial Sequence: Synthetic oligonucleotide
tccccagcgtggagatgtctacacctg

SEQ ID NO: 60778 - DNA, 26 bp, Artificial Sequence
  Description of Artificial Sequence: Synthetic oligonucleotide
ccccagcgtggagatgtctacacctg

SEQ ID NO: 60779 - DNA, 26 bp, Artificial Sequence
  Description of Artificial Sequence: Synthetic oligonucleotide
cccagcgtggagatgtctacacctgc

SEQ ID NO: 60780 - DNA, 27 bp, Artificial Sequence
  Description of Artificial Sequence: Synthetic oligonucleotide
ccagcgtggagatgtctacacctgcca

SEQ ID NO: 60781 - DNA, 27 bp, Artificial Sequence
  Description of Artificial Sequence: Synthetic oligonucleotide
cagcgtggagatgtctacacctgccac

SEQ ID NO: 60782 - DNA, 27 bp, Artificial Sequence
  Description of Artificial Sequence: Synthetic oligonucleotide
agcgtggagatgtctacacctgccacg

SEQ ID NO: 60783 - DNA, 27 bp, Artificial Sequence
  Description of Artificial Sequence: Synthetic oligonucleotide
gcgtggagatgtctacacctgccacgt

SEQ ID NO: 60784 - DNA, 27 bp, Artificial Sequence
  Description of Artificial Sequence: Synthetic oligonucleotide
cgtggagatgtctacacctgccacgtg

SEQ ID NO: 60785 - DNA, 27 bp, Artificial Sequence
  Description of Artificial Sequence: Synthetic oligonucleotide
gtggagatgtctacacctgccacgtgg

SEQ ID NO: 60786 - DNA, 26 bp, Artificial Sequence
  Description of Artificial Sequence: Synthetic oligonucleotide
ctgcccagagcaagatgctgagtggc

SEQ ID NO: 60787 - DNA, 27 bp, Artificial Sequence
  Description of Artificial Sequence: Synthetic oligonucleotide
tgcccagagcaagatgctgagtggcgt

SEQ ID NO: 60788 - DNA, 27 bp, Artificial Sequence
  Description of Artificial Sequence: Synthetic oligonucleotide
gcccagagcaagatgctgagtggcgtt

SEQ ID NO: 60789 - DNA, 27 bp, Artificial Sequence
  Description of Artificial Sequence: Synthetic oligonucleotide
cccagagcaagatgctgagtggcgttg

SEQ ID NO: 60790 - DNA, 27 bp, Artificial Sequence
  Description of Artificial Sequence: Synthetic oligonucleotide
ccagagcaagatgctgagtggcgttgg

SEQ ID NO: 60791 - DNA, 28 bp, Artificial Sequence
  Description of Artificial Sequence: Synthetic oligonucleotide
cagagcaagatgctgagtggcgttggag

SEQ ID NO: 60792 - DNA, 28 bp, Artificial Sequence
  Description of Artificial Sequence: Synthetic oligonucleotide
agagcaagatgctgagtggcgttggagg

SEQ ID NO: 60793 - DNA, 27 bp, Artificial Sequence
  Description of Artificial Sequence: Synthetic oligonucleotide
gagcaagatgctgagtggcgttggagg

SEQ ID NO: 60794 - DNA, 27 bp, Artificial Sequence
  Description of Artificial Sequence: Synthetic oligonucleotide
agcaagatgctgagtggcgttggaggc

SEQ ID NO: 60795 - DNA, 27 bp, Artificial Sequence
  Description of Artificial Sequence: Synthetic oligonucleotide
gcaagatgctgagtggcgttggaggct

SEQ ID NO: 60796 - DNA, 28 bp, Artificial Sequence
  Description of Artificial Sequence: Synthetic oligonucleotide
caagatgctgagtggcgttggaggcttc

SEQ ID NO: 60797 - DNA, 28 bp, Artificial Sequence
  Description of Artificial Sequence: Synthetic oligonucleotide
aagatgctgagtggcgttggaggcttcg

SEQ ID NO: 60798 - DNA, 27 bp, Artificial Sequence
  Description of Artificial Sequence: Synthetic oligonucleotide
agatgctgagtggcgttggaggcttcg

SEQ ID NO: 60799 - DNA, 27 bp, Artificial Sequence
  Description of Artificial Sequence: Synthetic oligonucleotide
gatgctgagtggcgttggaggcttcgt

SEQ ID NO: 60800 - DNA, 27 bp, Artificial Sequence
  Description of Artificial Sequence: Synthetic oligonucleotide
atgctgagtggcgttggaggcttcgtg

SEQ ID NO: 60801 - DNA, 26 bp, Artificial Sequence
  Description of Artificial Sequence: Synthetic oligonucleotide
tgctgagtggcgttggaggcttcgtg

SEQ ID NO: 60802 - DNA, 25 bp, Artificial Sequence
  Description of Artificial Sequence: Synthetic oligonucleotide
gctgagtggcgttggaggcttcgtg

SEQ ID NO: 60803 - DNA, 26 bp, Artificial Sequence
  Description of Artificial Sequence: Synthetic oligonucleotide
ctgagtggcgttggaggcttcgtgct

SEQ ID NO: 60804 - DNA, 26 bp, Artificial Sequence
  Description of Artificial Sequence: Synthetic oligonucleotide
tgagtggcgttggaggcttcgtgctg

SEQ ID NO: 60805 - DNA, 25 bp, Artificial Sequence
  Description of Artificial Sequence: Synthetic oligonucleotide
gagtggcgttggaggcttcgtgctg

SEQ ID NO: 60806 - DNA, 25 bp, Artificial Sequence
  Description of Artificial Sequence: Synthetic oligonucleotide
agtggcgttggaggcttcgtgctgg

SEQ ID NO: 60807 - DNA, 24 bp, Artificial Sequence
  Description of Artificial Sequence: Synthetic oligonucleotide
gtggcgttggaggcttcgtgctgg

SEQ ID NO: 60808 - DNA, 24 bp, Artificial Sequence
  Description of Artificial Sequence: Synthetic oligonucleotide
tggcgttggaggcttcgtgctggg

SEQ ID NO: 60809 - DNA, 23 bp, Artificial Sequence
  Description of Artificial Sequence: Synthetic oligonucleotide
ggcgttggaggcttcgtgctggg

SEQ ID NO: 60810 - DNA, 23 bp, Artificial Sequence
  Description of Artificial Sequence: Synthetic oligonucleotide
gcgttggaggcttcgtgctgggg

SEQ ID NO: 60811 - DNA, 24 bp, Artificial Sequence
  Description of Artificial Sequence: Synthetic oligonucleotide
cgttggaggcttcgtgctggggct

SEQ ID NO: 60812 - DNA, 26 bp, Artificial Sequence
  Description of Artificial Sequence: Synthetic oligonucleotide
gttggaggcttcgtgctggggctgat

SEQ ID NO: 60813 - DNA, 27 bp, Artificial Sequence
  Description of Artificial Sequence: Synthetic oligonucleotide
ggcttcgtgctggggctgatcttcctt

SEQ ID NO: 60814 - DNA, 27 bp, Artificial Sequence
  Description of Artificial Sequence: Synthetic oligonucleotide
gcttcgtgctggggctgatcttccttg

SEQ ID NO: 60815 - DNA, 27 bp, Artificial Sequence
  Description of Artificial Sequence: Synthetic oligonucleotide
cttcgtgctggggctgatcttccttgg

SEQ ID NO: 60816 - DNA, 27 bp, Artificial Sequence
  Description of Artificial Sequence: Synthetic oligonucleotide
ttcgtgctggggctgatcttccttggg

SEQ ID NO: 60817 - DNA, 26 bp, Artificial Sequence
  Description of Artificial Sequence: Synthetic oligonucleotide
tcgtgctggggctgatcttccttggg

SEQ ID NO: 60818 - DNA, 25 bp, Artificial Sequence
  Description of Artificial Sequence: Synthetic oligonucleotide
cgtgctggggctgatcttccttggg

SEQ ID NO: 60819 - DNA, 27 bp, Artificial Sequence
  Description of Artificial Sequence: Synthetic oligonucleotide
gtgctggggctgatcttccttgggctt

SEQ ID NO: 60820 - DNA, 27 bp, Artificial Sequence
  Description of Artificial Sequence: Synthetic oligonucleotide
tgctggggctgatcttccttgggcttg

SEQ ID NO: 60821 - DNA, 26 bp, Artificial Sequence
  Description of Artificial Sequence: Synthetic oligonucleotide
gctggggctgatcttccttgggcttg

SEQ ID NO: 60822 - DNA, 26 bp, Artificial Sequence
  Description of Artificial Sequence: Synthetic oligonucleotide
ctggggctgatcttccttgggcttgg

SEQ ID NO: 60823 - DNA, 26 bp, Artificial Sequence
  Description of Artificial Sequence: Synthetic oligonucleotide
tggggctgatcttccttgggcttggc

SEQ ID NO: 60824 - DNA, 25 bp, Artificial Sequence
  Description of Artificial Sequence: Synthetic oligonucleotide
ggggctgatcttccttgggcttggc

SEQ ID NO: 60825 - DNA, 27 bp, Artificial Sequence
  Description of Artificial Sequence: Synthetic oligonucleotide
gggctgatcttccttgggcttggcctt

SEQ ID NO: 60826 - DNA, 29 bp, Artificial Sequence
  Description of Artificial Sequence: Synthetic oligonucleotide
ggctgatcttccttgggcttggccttatc

SEQ ID NO: 60827 - DNA, 31 bp, Artificial Sequence
  Description of Artificial Sequence: Synthetic oligonucleotide
gctgatcttccttgggcttggccttatcatc

SEQ ID NO: 60828 - DNA, 31 bp, Artificial Sequence
  Description of Artificial Sequence: Synthetic oligonucleotide
ctgatcttccttgggcttggccttatcatcc

SEQ ID NO: 60829 - DNA, 31 bp, Artificial Sequence
  Description of Artificial Sequence: Synthetic oligonucleotide
tgatcttccttgggcttggccttatcatccg

SEQ ID NO: 60830 - DNA, 30 bp, Artificial Sequence
  Description of Artificial Sequence: Synthetic oligonucleotide
gatcttccttgggcttggccttatcatccg

SEQ ID NO: 60831 - DNA, 31 bp, Artificial Sequence
  Description of Artificial Sequence: Synthetic oligonucleotide
atcttccttgggcttggccttatcatccgtc

SEQ ID NO: 60832 - DNA, 30 bp, Artificial Sequence
  Description of Artificial Sequence: Synthetic oligonucleotide
tcttccttgggcttggccttatcatccgtc

SEQ ID NO: 60833 - DNA, 29 bp, Artificial Sequence
  Description of Artificial Sequence: Synthetic oligonucleotide
cttccttgggcttggccttatcatccgtc

SEQ ID NO: 60834 - DNA, 32 bp, Artificial Sequence
  Description of Artificial Sequence: Synthetic oligonucleotide
ttccttgggcttggccttatcatccgtcaaag

SEQ ID NO: 60835 - DNA, 31 bp, Artificial Sequence
  Description of Artificial Sequence: Synthetic oligonucleotide
tccttgggcttggccttatcatccgtcaaag

SEQ ID NO: 60836 - DNA, 30 bp, Artificial Sequence
  Description of Artificial Sequence: Synthetic oligonucleotide
ccttgggcttggccttatcatccgtcaaag

SEQ ID NO: 60837 - DNA, 30 bp, Artificial Sequence
  Description of Artificial Sequence: Synthetic oligonucleotide
cttgggcttggccttatcatccgtcaaagg

SEQ ID NO: 60838 - DNA, 31 bp, Artificial Sequence
  Description of Artificial Sequence: Synthetic oligonucleotide
ttgggcttggccttatcatccgtcaaaggag

SEQ ID NO: 60839 - DNA, 30 bp, Artificial Sequence
  Description of Artificial Sequence: Synthetic oligonucleotide
tgggcttggccttatcatccgtcaaaggag

SEQ ID NO: 60840 - DNA, 29 bp, Artificial Sequence
  Description of Artificial Sequence: Synthetic oligonucleotide
gggcttggccttatcatccgtcaaaggag

SEQ ID NO: 60841 - DNA, 30 bp, Artificial Sequence
  Description of Artificial Sequence: Synthetic oligonucleotide
ggcttggccttatcatccgtcaaaggagtc

SEQ ID NO: 60842 - DNA, 30 bp, Artificial Sequence
  Description of Artificial Sequence: Synthetic oligonucleotide
gcttggccttatcatccgtcaaaggagtcg

SEQ ID NO: 60843 - DNA, 30 bp, Artificial Sequence
  Description of Artificial Sequence: Synthetic oligonucleotide
cttggccttatcatccgtcaaaggagtcgg

SEQ ID NO: 60844 - DNA, 33 bp, Artificial Sequence
  Description of Artificial Sequence: Synthetic oligonucleotide
ttggccttatcatccgtcaaaggagtcggaaag

SEQ ID NO: 60845 - DNA, 32 bp, Artificial Sequence
  Description of Artificial Sequence: Synthetic oligonucleotide
tggccttatcatccgtcaaaggagtcggaaag

SEQ ID NO: 60846 - DNA, 31 bp, Artificial Sequence
  Description of Artificial Sequence: Synthetic oligonucleotide
ggccttatcatccgtcaaaggagtcggaaag

SEQ ID NO: 60847 - DNA, 31 bp, Artificial Sequence
  Description of Artificial Sequence: Synthetic oligonucleotide
gccttatcatccgtcaaaggagtcggaaagg

SEQ ID NO: 60848 - DNA, 31 bp, Artificial Sequence
  Description of Artificial Sequence: Synthetic oligonucleotide
ccttatcatccgtcaaaggagtcggaaaggg

SEQ ID NO: 60849 - DNA, 31 bp, Artificial Sequence
  Description of Artificial Sequence: Synthetic oligonucleotide
cttatcatccgtcaaaggagtcggaaagggc

SEQ ID NO: 60850 - DNA, 33 bp, Artificial Sequence
  Description of Artificial Sequence: Synthetic oligonucleotide
ttatcatccgtcaaaggagtcggaaagggcttc

SEQ ID NO: 60851 - DNA, 32 bp, Artificial Sequence
  Description of Artificial Sequence: Synthetic oligonucleotide
tatcatccgtcaaaggagtcggaaagggcttc

SEQ ID NO: 60852 - DNA, 31 bp, Artificial Sequence
  Description of Artificial Sequence: Synthetic oligonucleotide
atcatccgtcaaaggagtcggaaagggcttc

SEQ ID NO: 60853 - DNA, 30 bp, Artificial Sequence
  Description of Artificial Sequence: Synthetic oligonucleotide
tcatccgtcaaaggagtcggaaagggcttc

SEQ ID NO: 60854 - DNA, 29 bp, Artificial Sequence
  Description of Artificial Sequence: Synthetic oligonucleotide
catccgtcaaaggagtcggaaagggcttc

SEQ ID NO: 60855 - DNA, 30 bp, Artificial Sequence
  Description of Artificial Sequence: Synthetic oligonucleotide
atccgtcaaaggagtcggaaagggcttctg

SEQ ID NO: 60856 - DNA, 29 bp, Artificial Sequence
  Description of Artificial Sequence: Synthetic oligonucleotide
tccgtcaaaggagtcggaaagggcttctg

SEQ ID NO: 60857 - DNA, 28 bp, Artificial Sequence
  Description of Artificial Sequence: Synthetic oligonucleotide
ccgtcaaaggagtcggaaagggcttctg

SEQ ID NO: 60858 - DNA, 28 bp, Artificial Sequence
  Description of Artificial Sequence: Synthetic oligonucleotide
cgtcaaaggagtcggaaagggcttctgc

SEQ ID NO: 60859 - DNA, 29 bp, Artificial Sequence
  Description of Artificial Sequence: Synthetic oligonucleotide
gtcaaaggagtcggaaagggcttctgcac

SEQ ID NO: 60860 - DNA, 30 bp, Artificial Sequence
  Description of Artificial Sequence: Synthetic oligonucleotide
tcaaaggagtcggaaagggcttctgcactg

SEQ ID NO: 60861 - DNA, 29 bp, Artificial Sequence
  Description of Artificial Sequence: Synthetic oligonucleotide
caaaggagtcggaaagggcttctgcactg

SEQ ID NO: 60862 - DNA, 22 bp, Artificial Sequence
  Description of Artificial Sequence: Synthetic oligonucleotide
tgtaccgggcggtgacgccgca

SEQ ID NO: 60863 - DNA, 21 bp, Artificial Sequence
  Description of Artificial Sequence: Synthetic oligonucleotide
gtaccgggcggtgacgccgca

SEQ ID NO: 60864 - DNA, 21 bp, Artificial Sequence
  Description of Artificial Sequence: Synthetic oligonucleotide
taccgggcggtgacgccgcag

SEQ ID NO: 60865 - DNA, 20 bp, Artificial Sequence
  Description of Artificial Sequence: Synthetic oligonucleotide
accgggcggtgacgccgcag

SEQ ID NO: 60866 - DNA, 20 bp, Artificial Sequence
  Description of Artificial Sequence: Synthetic oligonucleotide
ccgggcggtgacgccgcagt

SEQ ID NO: 60867 - DNA, 20 bp, Artificial Sequence
  Description of Artificial Sequence: Synthetic oligonucleotide
cgggcggtgacgccgcaggt

SEQ ID NO: 60868 - DNA, 20 bp, Artificial Sequence
  Description of Artificial Sequence: Synthetic oligonucleotide
gggcggtgacgccgcagggt

SEQ ID NO: 60869 - DNA, 20 bp, Artificial Sequence
  Description of Artificial Sequence: Synthetic oligonucleotide
ggcggtgacgccgcaggggt

SEQ ID NO: 60870 - DNA, 21 bp, Artificial Sequence
  Description of Artificial Sequence: Synthetic oligonucleotide
gcccgggcgtcggtggacaga

SEQ ID NO: 60871 - DNA, 22 bp, Artificial Sequence
  Description of Artificial Sequence: Synthetic oligonucleotide
cccgggcgtcggtggacagagt

SEQ ID NO: 60872 - DNA, 23 bp, Artificial Sequence
  Description of Artificial Sequence: Synthetic oligonucleotide
ccgggcgtcggtggacagagtgt

SEQ ID NO: 60873 - DNA, 23 bp, Artificial Sequence
  Description of Artificial Sequence: Synthetic oligonucleotide
cgggcgtcggtggacagagtgtg

SEQ ID NO: 60874 - DNA, 24 bp, Artificial Sequence
  Description of Artificial Sequence: Synthetic oligonucleotide
gggcgtcggtggacagagtgtgca

SEQ ID NO: 60875 - DNA, 25 bp, Artificial Sequence
  Description of Artificial Sequence: Synthetic oligonucleotide
ggcgtcggtggacagagtgtgcaga

SEQ ID NO: 60876 - DNA, 26 bp, Artificial Sequence
  Description of Artificial Sequence: Synthetic oligonucleotide
gcgtcggtggacagagtgtgcagaca

SEQ ID NO: 60877 - DNA, 27 bp, Artificial Sequence
  Description of Artificial Sequence: Synthetic oligonucleotide
cgtcggtggacagagtgtgcagacaca

SEQ ID NO: 60878 - DNA, 28 bp, Artificial Sequence
  Description of Artificial Sequence: Synthetic oligonucleotide
gtcggtggacagagtgtgcagacacaac

SEQ ID NO: 60879 - DNA, 30 bp, Artificial Sequence
  Description of Artificial Sequence: Synthetic oligonucleotide
tcggtggacagagtgtgcagacacaactac

SEQ ID NO: 60880 - DNA, 29 bp, Artificial Sequence
  Description of Artificial Sequence: Synthetic oligonucleotide
cggtggacagagtgtgcagacacaactac

SEQ ID NO: 60881 - DNA, 29 bp, Artificial Sequence
  Description of Artificial Sequence: Synthetic oligonucleotide
ggtggacagagtgtgcagacacaactacg

SEQ ID NO: 60882 - DNA, 30 bp, Artificial Sequence
  Description of Artificial Sequence: Synthetic oligonucleotide
gtggacagagtgtgcagacacaactacgag

SEQ ID NO: 60883 - DNA, 30 bp, Artificial Sequence
  Description of Artificial Sequence: Synthetic oligonucleotide
tggacagagtgtgcagacacaactacgagg

SEQ ID NO: 60884 - DNA, 29 bp, Artificial Sequence
  Description of Artificial Sequence: Synthetic oligonucleotide
ggacagagtgtgcagacacaactacgagg

SEQ ID NO: 60885 - DNA, 30 bp, Artificial Sequence
  Description of Artificial Sequence: Synthetic oligonucleotide
gacagagtgtgcagacacaactacgaggtg

SEQ ID NO: 60886 - DNA, 30 bp, Artificial Sequence
  Description of Artificial Sequence: Synthetic oligonucleotide
acagagtgtgcagacacaactacgaggtgg

SEQ ID NO: 60887 - DNA, 29 bp, Artificial Sequence
  Description of Artificial Sequence: Synthetic oligonucleotide
cagagtgtgcagacacaactacgaggtgg

SEQ ID NO: 60888 - DNA, 29 bp, Artificial Sequence
  Description of Artificial Sequence: Synthetic oligonucleotide
agagtgtgcagacacaactacgaggtggc

SEQ ID NO: 60889 - DNA, 28 bp, Artificial Sequence
  Description of Artificial Sequence: Synthetic oligonucleotide
gagtgtgcagacacaactacgaggtggc

SEQ ID NO: 60890 - DNA, 28 bp, Artificial Sequence
  Description of Artificial Sequence: Synthetic oligonucleotide
agtgtgcagacacaactacgaggtggcg

SEQ ID NO: 60891 - DNA, 23 bp, Artificial Sequence
  Description of Artificial Sequence: Synthetic oligonucleotide
cgtaccgcgggatcctgcagagg

SEQ ID NO: 60892 - DNA, 21 bp, Artificial Sequence
  Description of Artificial Sequence: Synthetic oligonucleotide
tgacgccgcaggggcggccta

SEQ ID NO: 60893 - DNA, 20 bp, Artificial Sequence
  Description of Artificial Sequence: Synthetic oligonucleotide
gacgccgcaggggcggccta

SEQ ID NO: 60894 - DNA, 20 bp, Artificial Sequence
  Description of Artificial Sequence: Synthetic oligonucleotide
acgccgcaggggcggcctag

SEQ ID NO: 60895 - DNA, 20 bp, Artificial Sequence
  Description of Artificial Sequence: Synthetic oligonucleotide
cgccgcaggggcggcctagt

SEQ ID NO: 60896 - DNA, 20 bp, Artificial Sequence
  Description of Artificial Sequence: Synthetic oligonucleotide
gccgcaggggcggcctagct

SEQ ID NO: 60897 - DNA, 20 bp, Artificial Sequence
  Description of Artificial Sequence: Synthetic oligonucleotide
ccgcaggggcggcctagcgt

SEQ ID NO: 60898 - DNA, 20 bp, Artificial Sequence
  Description of Artificial Sequence: Synthetic oligonucleotide
cgcaggggcggcctagcgct

SEQ ID NO: 60899 - DNA, 20 bp, Artificial Sequence
  Description of Artificial Sequence: Synthetic oligonucleotide
gcaggggcggcctagcgcct

SEQ ID NO: 60900 - DNA, 20 bp, Artificial Sequence
  Description of Artificial Sequence: Synthetic oligonucleotide
caggggcggcctagcgccga

SEQ ID NO: 60901 - DNA, 22 bp, Artificial Sequence
  Description of Artificial Sequence: Synthetic oligonucleotide
aggggcggcctagcgccgagta

SEQ ID NO: 60902 - DNA, 21 bp, Artificial Sequence
  Description of Artificial Sequence: Synthetic oligonucleotide
ggggcggcctagcgccgagta

SEQ ID NO: 60903 - DNA, 22 bp, Artificial Sequence
  Description of Artificial Sequence: Synthetic oligonucleotide
gggcggcctagcgccgagtact

SEQ ID NO: 60904 - DNA, 22 bp, Artificial Sequence
  Description of Artificial Sequence: Synthetic oligonucleotide
ggcggcctagcgccgagtactg

SEQ ID NO: 60905 - DNA, 24 bp, Artificial Sequence
  Description of Artificial Sequence: Synthetic oligonucleotide
gcggcctagcgccgagtactggaa

SEQ ID NO: 60906 - DNA, 25 bp, Artificial Sequence
  Description of Artificial Sequence: Synthetic oligonucleotide
cggcctagcgccgagtactggaaca

SEQ ID NO: 60907 - DNA, 25 bp, Artificial Sequence
  Description of Artificial Sequence: Synthetic oligonucleotide
ggcctagcgccgagtactggaacag

SEQ ID NO: 60908 - DNA, 25 bp, Artificial Sequence
  Description of Artificial Sequence: Synthetic oligonucleotide
gcctagcgccgagtactggaacagc

SEQ ID NO: 60909 - DNA, 26 bp, Artificial Sequence
  Description of Artificial Sequence: Synthetic oligonucleotide
cctagcgccgagtactggaacagcca

SEQ ID NO: 60910 - DNA, 27 bp, Artificial Sequence
  Description of Artificial Sequence: Synthetic oligonucleotide
ctagcgccgagtactggaacagccaga

SEQ ID NO: 60911 - DNA, 28 bp, Artificial Sequence
  Description of Artificial Sequence: Synthetic oligonucleotide
tagcgccgagtactggaacagccagaag

SEQ ID NO: 60912 - DNA, 27 bp, Artificial Sequence
  Description of Artificial Sequence: Synthetic oligonucleotide
agcgccgagtactggaacagccagaag

SEQ ID NO: 60913 - DNA, 26 bp, Artificial Sequence
  Description of Artificial Sequence: Synthetic oligonucleotide
gcgccgagtactggaacagccagaag

SEQ ID NO: 60914 - DNA, 33 bp, Artificial Sequence
  Description of Artificial Sequence: Synthetic oligonucleotide
atctgctcggtgacagatttctatccaagccac

SEQ ID NO: 60915 - DNA, 32 bp, Artificial Sequence
  Description of Artificial Sequence: Synthetic oligonucleotide
tctgctcggtgacagatttctatccaagccac

SEQ ID NO: 60916 - DNA, 31 bp, Artificial Sequence
  Description of Artificial Sequence: Synthetic oligonucleotide
ctgctcggtgacagatttctatccaagccac

SEQ ID NO: 60917 - DNA, 33 bp, Artificial Sequence
  Description of Artificial Sequence: Synthetic oligonucleotide
tgctcggtgacagatttctatccaagccacatc

SEQ ID NO: 60918 - DNA, 32 bp, Artificial Sequence
  Description of Artificial Sequence: Synthetic oligonucleotide
gctcggtgacagatttctatccaagccacatc

SEQ ID NO: 60919 - DNA, 35 bp, Artificial Sequence
  Description of Artificial Sequence: Synthetic oligonucleotide
ctcggtgacagatttctatccaagccacatcaaag

SEQ ID NO: 60920 - DNA, 36 bp, Artificial Sequence
  Description of Artificial Sequence: Synthetic oligonucleotide
tcggtgacagatttctatccaagccacatcaaagtc

SEQ ID NO: 60921 - DNA, 35 bp, Artificial Sequence
  Description of Artificial Sequence: Synthetic oligonucleotide
cggtgacagatttctatccaagccacatcaaagtc

SEQ ID NO: 60922 - DNA, 35 bp, Artificial Sequence
  Description of Artificial Sequence: Synthetic oligonucleotide
ggtgacagatttctatccaagccacatcaaagtcc

SEQ ID NO: 60923 - DNA, 35 bp, Artificial Sequence
  Description of Artificial Sequence: Synthetic oligonucleotide
gtgacagatttctatccaagccacatcaaagtccg

SEQ ID NO: 60924 - DNA, 35 bp, Artificial Sequence
  Description of Artificial Sequence: Synthetic oligonucleotide
tgacagatttctatccaagccacatcaaagtccgg

SEQ ID NO: 60925 - DNA, 34 bp, Artificial Sequence
  Description of Artificial Sequence: Synthetic oligonucleotide
gacagatttctatccaagccacatcaaagtccgg

SEQ ID NO: 60926 - DNA, 35 bp, Artificial Sequence
  Description of Artificial Sequence: Synthetic oligonucleotide
acagatttctatccaagccacatcaaagtccggtg

SEQ ID NO: 60927 - DNA, 34 bp, Artificial Sequence
  Description of Artificial Sequence: Synthetic oligonucleotide
cagatttctatccaagccacatcaaagtccggtg

SEQ ID NO: 60928 - DNA, 34 bp, Artificial Sequence
  Description of Artificial Sequence: Synthetic oligonucleotide
agatttctatccaagccacatcaaagtccggtgg

SEQ ID NO: 60929 - DNA, 33 bp, Artificial Sequence
  Description of Artificial Sequence: Synthetic oligonucleotide
gatttctatccaagccacatcaaagtccggtgg

SEQ ID NO: 60930 - DNA, 36 bp, Artificial Sequence
  Description of Artificial Sequence: Synthetic oligonucleotide
atttctatccaagccacatcaaagtccggtggtttc

SEQ ID NO: 60931 - DNA, 35 bp, Artificial Sequence
  Description of Artificial Sequence: Synthetic oligonucleotide
tttctatccaagccacatcaaagtccggtggtttc

SEQ ID NO: 60932 - DNA, 34 bp, Artificial Sequence
  Description of Artificial Sequence: Synthetic oligonucleotide
ttctatccaagccacatcaaagtccggtggtttc

SEQ ID NO: 60933 - DNA, 33 bp, Artificial Sequence
  Description of Artificial Sequence: Synthetic oligonucleotide
tctatccaagccacatcaaagtccggtggtttc

SEQ ID NO: 60934 - DNA, 32 bp, Artificial Sequence
  Description of Artificial Sequence: Synthetic oligonucleotide
ctatccaagccacatcaaagtccggtggtttc

SEQ ID NO: 60935 - DNA, 32 bp, Artificial Sequence
  Description of Artificial Sequence: Synthetic oligonucleotide
tatccaagccacatcaaagtccggtggtttcg

SEQ ID NO: 60936 - DNA, 31 bp, Artificial Sequence
  Description of Artificial Sequence: Synthetic oligonucleotide
atccaagccacatcaaagtccggtggtttcg

SEQ ID NO: 60937 - DNA, 30 bp, Artificial Sequence
  Description of Artificial Sequence: Synthetic oligonucleotide
tccaagccacatcaaagtccggtggtttcg

SEQ ID NO: 60938 - DNA, 29 bp, Artificial Sequence
  Description of Artificial Sequence: Synthetic oligonucleotide
ccaagccacatcaaagtccggtggtttcg

SEQ ID NO: 60939 - DNA, 29 bp, Artificial Sequence
  Description of Artificial Sequence: Synthetic oligonucleotide
caagccacatcaaagtccggtggtttcgg

SEQ ID NO: 60940 - DNA, 32 bp, Artificial Sequence
  Description of Artificial Sequence: Synthetic oligonucleotide
aagccacatcaaagtccggtggtttcggaatg

SEQ ID NO: 60941 - DNA, 31 bp, Artificial Sequence
  Description of Artificial Sequence: Synthetic oligonucleotide
agccacatcaaagtccggtggtttcggaatg

SEQ ID NO: 60942 - DNA, 30 bp, Artificial Sequence
  Description of Artificial Sequence: Synthetic oligonucleotide
gccacatcaaagtccggtggtttcggaatg

SEQ ID NO: 60943 - DNA, 32 bp, Artificial Sequence
  Description of Artificial Sequence: Synthetic oligonucleotide
ccacatcaaagtccggtggtttcggaatgatc

SEQ ID NO: 60944 - DNA, 33 bp, Artificial Sequence
  Description of Artificial Sequence: Synthetic oligonucleotide
cacatcaaagtccggtggtttcggaatgatcag

SEQ ID NO: 60945 - DNA, 33 bp, Artificial Sequence
  Description of Artificial Sequence: Synthetic oligonucleotide
acatcaaagtccggtggtttcggaatgatcagg

SEQ ID NO: 60946 - DNA, 32 bp, Artificial Sequence
  Description of Artificial Sequence: Synthetic oligonucleotide
catcaaagtccggtggtttcggaatgatcagg

SEQ ID NO: 60947 - DNA, 23 bp, Artificial Sequence
  Description of Artificial Sequence: Synthetic oligonucleotide
gtgtatcgggcggtgacgccgca

SEQ ID NO: 60948 - DNA, 23 bp, Artificial Sequence
  Description of Artificial Sequence: Synthetic oligonucleotide
tgtatcgggcggtgacgccgcag

SEQ ID NO: 60949 - DNA, 22 bp, Artificial Sequence
  Description of Artificial Sequence: Synthetic oligonucleotide
gtatcgggcggtgacgccgcag

SEQ ID NO: 60950 - DNA, 22 bp, Artificial Sequence
  Description of Artificial Sequence: Synthetic oligonucleotide
tatcgggcggtgacgccgcagg

SEQ ID NO: 60951 - DNA, 21 bp, Artificial Sequence
  Description of Artificial Sequence: Synthetic oligonucleotide
atcgggcggtgacgccgcagg

SEQ ID NO: 60952 - DNA, 20 bp, Artificial Sequence
  Description of Artificial Sequence: Synthetic oligonucleotide
tcgggcggtgacgccgcagg

SEQ ID NO: 60953 - DNA, 20 bp, Artificial Sequence
  Description of Artificial Sequence: Synthetic oligonucleotide
acgccgcaggggcggcctga

SEQ ID NO: 60954 - DNA, 20 bp, Artificial Sequence
  Description of Artificial Sequence: Synthetic oligonucleotide
gccgcaggggcggcctgact

SEQ ID NO: 60955 - DNA, 20 bp, Artificial Sequence
  Description of Artificial Sequence: Synthetic oligonucleotide
ccgcaggggcggcctgacgt

SEQ ID NO: 60956 - DNA, 20 bp, Artificial Sequence
  Description of Artificial Sequence: Synthetic oligonucleotide
cgcaggggcggcctgacgct

SEQ ID NO: 60957 - DNA, 20 bp, Artificial Sequence
  Description of Artificial Sequence: Synthetic oligonucleotide
gcaggggcggcctgacgcct

SEQ ID NO: 60958 - DNA, 20 bp, Artificial Sequence
  Description of Artificial Sequence: Synthetic oligonucleotide
caggggcggcctgacgccga

SEQ ID NO: 60959 - DNA, 22 bp, Artificial Sequence
  Description of Artificial Sequence: Synthetic oligonucleotide
aggggcggcctgacgccgagta

SEQ ID NO: 60960 - DNA, 21 bp, Artificial Sequence
  Description of Artificial Sequence: Synthetic oligonucleotide
ggggcggcctgacgccgagta

SEQ ID NO: 60961 - DNA, 22 bp, Artificial Sequence
  Description of Artificial Sequence: Synthetic oligonucleotide
gggcggcctgacgccgagtact

SEQ ID NO: 60962 - DNA, 22 bp, Artificial Sequence
  Description of Artificial Sequence: Synthetic oligonucleotide
ggcggcctgacgccgagtactg

SEQ ID NO: 60963 - DNA, 24 bp, Artificial Sequence
  Description of Artificial Sequence: Synthetic oligonucleotide
gcggcctgacgccgagtactggaa

SEQ ID NO: 60964 - DNA, 25 bp, Artificial Sequence
  Description of Artificial Sequence: Synthetic oligonucleotide
cggcctgacgccgagtactggaaca

SEQ ID NO: 60965 - DNA, 25 bp, Artificial Sequence
  Description of Artificial Sequence: Synthetic oligonucleotide
ggcctgacgccgagtactggaacag

SEQ ID NO: 60966 - DNA, 32 bp, Artificial Sequence
  Description of Artificial Sequence: Synthetic oligonucleotide
ccttatcatccgtcaaaggagtcggaaaggac

SEQ ID NO: 60967 - DNA, 32 bp, Artificial Sequence
  Description of Artificial Sequence: Synthetic oligonucleotide
cttatcatccgtcaaaggagtcggaaaggacc

SEQ ID NO: 60968 - DNA, 33 bp, Artificial Sequence
  Description of Artificial Sequence: Synthetic oligonucleotide
ttatcatccgtcaaaggagtcggaaaggacctc

SEQ ID NO: 60969 - DNA, 32 bp, Artificial Sequence
  Description of Artificial Sequence: Synthetic oligonucleotide
tatcatccgtcaaaggagtcggaaaggacctc

SEQ ID NO: 60970 - DNA, 31 bp, Artificial Sequence
  Description of Artificial Sequence: Synthetic oligonucleotide
atcatccgtcaaaggagtcggaaaggacctc

SEQ ID NO: 60971 - DNA, 30 bp, Artificial Sequence
  Description of Artificial Sequence: Synthetic oligonucleotide
tcatccgtcaaaggagtcggaaaggacctc

SEQ ID NO: 60972 - DNA, 29 bp, Artificial Sequence
  Description of Artificial Sequence: Synthetic oligonucleotide
catccgtcaaaggagtcggaaaggacctc

SEQ ID NO: 60973 - DNA, 31 bp, Artificial Sequence
  Description of Artificial Sequence: Synthetic oligonucleotide
atccgtcaaaggagtcggaaaggacctcaag

SEQ ID NO: 60974 - DNA, 30 bp, Artificial Sequence
  Description of Artificial Sequence: Synthetic oligonucleotide
tccgtcaaaggagtcggaaaggacctcaag

SEQ ID NO: 60975 - DNA, 29 bp, Artificial Sequence
  Description of Artificial Sequence: Synthetic oligonucleotide
ccgtcaaaggagtcggaaaggacctcaag

SEQ ID NO: 60976 - DNA, 29 bp, Artificial Sequence
  Description of Artificial Sequence: Synthetic oligonucleotide
cgtcaaaggagtcggaaaggacctcaagg

SEQ ID NO: 60977 - DNA, 29 bp, Artificial Sequence
  Description of Artificial Sequence: Synthetic oligonucleotide
gtcaaaggagtcggaaaggacctcaaggg

SEQ ID NO: 60978 - DNA, 29 bp, Artificial Sequence
  Description of Artificial Sequence: Synthetic oligonucleotide
tcaaaggagtcggaaaggacctcaagggc

SEQ ID NO: 60979 - DNA, 28 bp, Artificial Sequence
  Description of Artificial Sequence: Synthetic oligonucleotide
caaaggagtcggaaaggacctcaagggc

SEQ ID NO: 60980 - DNA, 28 bp, Artificial Sequence
  Description of Artificial Sequence: Synthetic oligonucleotide
aaaggagtcggaaaggacctcaagggcc

SEQ ID NO: 60981 - DNA, 27 bp, Artificial Sequence
  Description of Artificial Sequence: Synthetic oligonucleotide
aaggagtcggaaaggacctcaagggcc

SEQ ID NO: 60982 - DNA, 27 bp, Artificial Sequence
  Description of Artificial Sequence: Synthetic oligonucleotide
aggagtcggaaaggacctcaagggcct

SEQ ID NO: 60983 - DNA, 26 bp, Artificial Sequence
  Description of Artificial Sequence: Synthetic oligonucleotide
ggagtcggaaaggacctcaagggcct

SEQ ID NO: 60984 - DNA, 26 bp, Artificial Sequence
  Description of Artificial Sequence: Synthetic oligonucleotide
gagtcggaaaggacctcaagggcctc

SEQ ID NO: 60985 - DNA, 27 bp, Artificial Sequence
  Description of Artificial Sequence: Synthetic oligonucleotide
agtcggaaaggacctcaagggcctcca

SEQ ID NO: 60986 - DNA, 26 bp, Artificial Sequence
  Description of Artificial Sequence: Synthetic oligonucleotide
gtcggaaaggacctcaagggcctcca

SEQ ID NO: 60987 - DNA, 26 bp, Artificial Sequence
  Description of Artificial Sequence: Synthetic oligonucleotide
tcggaaaggacctcaagggcctccac

SEQ ID NO: 60988 - DNA, 25 bp, Artificial Sequence
  Description of Artificial Sequence: Synthetic oligonucleotide
cggaaaggacctcaagggcctccac

SEQ ID NO: 60989 - DNA, 26 bp, Artificial Sequence
  Description of Artificial Sequence: Synthetic oligonucleotide
ggaaaggacctcaagggcctccacca

SEQ ID NO: 60990 - DNA, 26 bp, Artificial Sequence
  Description of Artificial Sequence: Synthetic oligonucleotide
gaaaggacctcaagggcctccaccag

SEQ ID NO: 60991 - DNA, 27 bp, Artificial Sequence
  Description of Artificial Sequence: Synthetic oligonucleotide
aaaggacctcaagggcctccaccagca

SEQ ID NO: 60992 - DNA, 26 bp, Artificial Sequence
  Description of Artificial Sequence: Synthetic oligonucleotide
aaggacctcaagggcctccaccagca

SEQ ID NO: 60993 - DNA, 25 bp, Artificial Sequence
  Description of Artificial Sequence: Synthetic oligonucleotide
aggacctcaagggcctccaccagca

SEQ ID NO: 60994 - DNA, 24 bp, Artificial Sequence
  Description of Artificial Sequence: Synthetic oligonucleotide
ggacctcaagggcctccaccagca

SEQ ID NO: 60995 - DNA, 24 bp, Artificial Sequence
  Description of Artificial Sequence: Synthetic oligonucleotide
gacctcaagggcctccaccagcag

SEQ ID NO: 60996 - DNA, 24 bp, Artificial Sequence
  Description of Artificial Sequence: Synthetic oligonucleotide
acctcaagggcctccaccagcagg

SEQ ID NO: 60997 - DNA, 23 bp, Artificial Sequence
  Description of Artificial Sequence: Synthetic oligonucleotide
cctcaagggcctccaccagcagg

SEQ ID NO: 60998 - DNA, 23 bp, Artificial Sequence
  Description of Artificial Sequence: Synthetic oligonucleotide
ctcaagggcctccaccagcaggg

SEQ ID NO: 60999 - DNA, 25 bp, Artificial Sequence
  Description of Artificial Sequence: Synthetic oligonucleotide
tcaagggcctccaccagcagggctt

SEQ ID NO: 61000 - DNA, 24 bp, Artificial Sequence
  Description of Artificial Sequence: Synthetic oligonucleotide
caagggcctccaccagcagggctt

SEQ ID NO: 61001 - DNA, 25 bp, Artificial Sequence
  Description of Artificial Sequence: Synthetic oligonucleotide
aagggcctccaccagcagggcttct

SEQ ID NO: 61002 - DNA, 24 bp, Artificial Sequence
  Description of Artificial Sequence: Synthetic oligonucleotide
agggcctccaccagcagggcttct

SEQ ID NO: 61003 - DNA, 23 bp, Artificial Sequence
  Description of Artificial Sequence: Synthetic oligonucleotide
gggcctccaccagcagggcttct

SEQ ID NO: 61004 - DNA, 23 bp, Artificial Sequence
  Description of Artificial Sequence: Synthetic oligonucleotide
ggcctccaccagcagggcttctg

SEQ ID NO: 61005 - DNA, 24 bp, Artificial Sequence
  Description of Artificial Sequence: Synthetic oligonucleotide
gcctccaccagcagggcttctgca

SEQ ID NO: 61006 - DNA, 25 bp, Artificial Sequence
  Description of Artificial Sequence: Synthetic oligonucleotide
cctccaccagcagggcttctgcact

SEQ ID NO: 61007 - DNA, 26 bp, Artificial Sequence
  Description of Artificial Sequence: Synthetic oligonucleotide
ctccaccagcagggcttctgcactga

SEQ ID NO: 61008 - DNA, 33 bp, Artificial Sequence
  Description of Artificial Sequence: Synthetic oligonucleotide
ggggtgtgaccagatacatctataaccgagaag

SEQ ID NO: 61009 - DNA, 34 bp, Artificial Sequence
  Description of Artificial Sequence: Synthetic oligonucleotide
gggtgtgaccagatacatctataaccgagaagag

SEQ ID NO: 61010 - DNA, 36 bp, Artificial Sequence
  Description of Artificial Sequence: Synthetic oligonucleotide
ggtgtgaccagatacatctataaccgagaagagtac

SEQ ID NO: 61011 - DNA, 36 bp, Artificial Sequence
  Description of Artificial Sequence: Synthetic oligonucleotide
gtgtgaccagatacatctataaccgagaagagtacg

SEQ ID NO: 61012 - DNA, 37 bp, Artificial Sequence
  Description of Artificial Sequence: Synthetic oligonucleotide
tgtgaccagatacatctataaccgagaagagtacgtg

SEQ ID NO: 61013 - DNA, 36 bp, Artificial Sequence
  Description of Artificial Sequence: Synthetic oligonucleotide
gtgaccagatacatctataaccgagaagagtacgtg

SEQ ID NO: 61014 - DNA, 36 bp, Artificial Sequence
  Description of Artificial Sequence: Synthetic oligonucleotide
tgaccagatacatctataaccgagaagagtacgtgc

SEQ ID NO: 61015 - DNA, 35 bp, Artificial Sequence
  Description of Artificial Sequence: Synthetic oligonucleotide
gaccagatacatctataaccgagaagagtacgtgc

SEQ ID NO: 61016 - DNA, 35 bp, Artificial Sequence
  Description of Artificial Sequence: Synthetic oligonucleotide
accagatacatctataaccgagaagagtacgtgcg

SEQ ID NO: 61017 - DNA, 34 bp, Artificial Sequence
  Description of Artificial Sequence: Synthetic oligonucleotide
ccagatacatctataaccgagaagagtacgtgcg

SEQ ID NO: 61018 - DNA, 34 bp, Artificial Sequence
  Description of Artificial Sequence: Synthetic oligonucleotide
cagatacatctataaccgagaagagtacgtgcgc

SEQ ID NO: 61019 - DNA, 36 bp, Artificial Sequence
  Description of Artificial Sequence: Synthetic oligonucleotide
agatacatctataaccgagaagagtacgtgcgcttc

SEQ ID NO: 61020 - DNA, 35 bp, Artificial Sequence
  Description of Artificial Sequence: Synthetic oligonucleotide
gatacatctataaccgagaagagtacgtgcgcttc

SEQ ID NO: 61021 - DNA, 35 bp, Artificial Sequence
  Description of Artificial Sequence: Synthetic oligonucleotide
atacatctataaccgagaagagtacgtgcgcttcg

SEQ ID NO: 61022 - DNA, 34 bp, Artificial Sequence
  Description of Artificial Sequence: Synthetic oligonucleotide
tacatctataaccgagaagagtacgtgcgcttcg

SEQ ID NO: 61023 - DNA, 33 bp, Artificial Sequence
  Description of Artificial Sequence: Synthetic oligonucleotide
acatctataaccgagaagagtacgtgcgcttcg

SEQ ID NO: 61024 - DNA, 32 bp, Artificial Sequence
  Description of Artificial Sequence: Synthetic oligonucleotide
catctataaccgagaagagtacgtgcgcttcg

SEQ ID NO: 61025 - DNA, 33 bp, Artificial Sequence
  Description of Artificial Sequence: Synthetic oligonucleotide
atctataaccgagaagagtacgtgcgcttcgac

SEQ ID NO: 61026 - DNA, 32 bp, Artificial Sequence
  Description of Artificial Sequence: Synthetic oligonucleotide
tctataaccgagaagagtacgtgcgcttcgac

SEQ ID NO: 61027 - DNA, 31 bp, Artificial Sequence
  Description of Artificial Sequence: Synthetic oligonucleotide
ctataaccgagaagagtacgtgcgcttcgac

SEQ ID NO: 61028 - DNA, 32 bp, Artificial Sequence
  Description of Artificial Sequence: Synthetic oligonucleotide
tataaccgagaagagtacgtgcgcttcgacag

SEQ ID NO: 61029 - DNA, 31 bp, Artificial Sequence
  Description of Artificial Sequence: Synthetic oligonucleotide
ataaccgagaagagtacgtgcgcttcgacag

SEQ ID NO: 61030 - DNA, 30 bp, Artificial Sequence
  Description of Artificial Sequence: Synthetic oligonucleotide
taaccgagaagagtacgtgcgcttcgacag

SEQ ID NO: 61031 - DNA, 29 bp, Artificial Sequence
  Description of Artificial Sequence: Synthetic oligonucleotide
aaccgagaagagtacgtgcgcttcgacag

SEQ ID NO: 61032 - DNA, 28 bp, Artificial Sequence
  Description of Artificial Sequence: Synthetic oligonucleotide
accgagaagagtacgtgcgcttcgacag

SEQ ID NO: 61033 - DNA, 27 bp, Artificial Sequence
  Description of Artificial Sequence: Synthetic oligonucleotide
ccgagaagagtacgtgcgcttcgacag

SEQ ID NO: 61034 - DNA, 27 bp, Artificial Sequence
  Description of Artificial Sequence: Synthetic oligonucleotide
cgagaagagtacgtgcgcttcgacagc

SEQ ID NO: 61035 - DNA, 27 bp, Artificial Sequence
  Description of Artificial Sequence: Synthetic oligonucleotide
gagaagagtacgtgcgcttcgacagcg

SEQ ID NO: 61036 - DNA, 28 bp, Artificial Sequence
  Description of Artificial Sequence: Synthetic oligonucleotide
agaagagtacgtgcgcttcgacagcgac

SEQ ID NO: 61037 - DNA, 27 bp, Artificial Sequence
  Description of Artificial Sequence: Synthetic oligonucleotide
gaagagtacgtgcgcttcgacagcgac

SEQ ID NO: 61038 - DNA, 27 bp, Artificial Sequence
  Description of Artificial Sequence: Synthetic oligonucleotide
aagagtacgtgcgcttcgacagcgacg

SEQ ID NO: 61039 - DNA, 27 bp, Artificial Sequence
  Description of Artificial Sequence: Synthetic oligonucleotide
agagtacgtgcgcttcgacagcgacgt

SEQ ID NO: 61040 - DNA, 22 bp, Artificial Sequence
  Description of Artificial Sequence: Synthetic oligonucleotide
aggaccgggcgtcggtggacag

SEQ ID NO: 61041 - DNA, 21 bp, Artificial Sequence
  Description of Artificial Sequence: Synthetic oligonucleotide
ggaccgggcgtcggtggacag

SEQ ID NO: 61042 - DNA, 21 bp, Artificial Sequence
  Description of Artificial Sequence: Synthetic oligonucleotide
gaccgggcgtcggtggacagg

SEQ ID NO: 61043 - DNA, 22 bp, Artificial Sequence
  Description of Artificial Sequence: Synthetic oligonucleotide
accgggcgtcggtggacagggt

SEQ ID NO: 61044 - DNA, 32 bp, Artificial Sequence
  Description of Artificial Sequence: Synthetic oligonucleotide
accagacacatctataaccgagaggagtacgc

SEQ ID NO: 61045 - DNA, 31 bp, Artificial Sequence
  Description of Artificial Sequence: Synthetic oligonucleotide
ccagacacatctataaccgagaggagtacgc

SEQ ID NO: 61046 - DNA, 31 bp, Artificial Sequence
  Description of Artificial Sequence: Synthetic oligonucleotide
cagacacatctataaccgagaggagtacgcg

SEQ ID NO: 61047 - DNA, 31 bp, Artificial Sequence
  Description of Artificial Sequence: Synthetic oligonucleotide
agacacatctataaccgagaggagtacgcgc

SEQ ID NO: 61048 - DNA, 30 bp, Artificial Sequence
  Description of Artificial Sequence: Synthetic oligonucleotide
gacacatctataaccgagaggagtacgcgc

SEQ ID NO: 61049 - DNA, 30 bp, Artificial Sequence
  Description of Artificial Sequence: Synthetic oligonucleotide
acacatctataaccgagaggagtacgcgcg

SEQ ID NO: 61050 - DNA, 29 bp, Artificial Sequence
  Description of Artificial Sequence: Synthetic oligonucleotide
cacatctataaccgagaggagtacgcgcg

SEQ ID NO: 61051 - DNA, 25 bp, Artificial Sequence
  Description of Artificial Sequence: Synthetic oligonucleotide
taccgcgggatcctgcagaggagag

SEQ ID NO: 61052 - DNA, 32 bp, Artificial Sequence
  Description of Artificial Sequence: Synthetic oligonucleotide
acatctataaccgagaggagtacgtgcgcttg

SEQ ID NO: 61053 - DNA, 31 bp, Artificial Sequence
  Description of Artificial Sequence: Synthetic oligonucleotide
catctataaccgagaggagtacgtgcgcttg

SEQ ID NO: 61054 - DNA, 31 bp, Artificial Sequence
  Description of Artificial Sequence: Synthetic oligonucleotide
atctataaccgagaggagtacgtgcgcttgg

SEQ ID NO: 61055 - DNA, 30 bp, Artificial Sequence
  Description of Artificial Sequence: Synthetic oligonucleotide
tctataaccgagaggagtacgtgcgcttgg

SEQ ID NO: 61056 - DNA, 29 bp, Artificial Sequence
  Description of Artificial Sequence: Synthetic oligonucleotide
ctataaccgagaggagtacgtgcgcttgg

SEQ ID NO: 61057 - DNA, 30 bp, Artificial Sequence
  Description of Artificial Sequence: Synthetic oligonucleotide
tataaccgagaggagtacgtgcgcttggac

SEQ ID NO: 61058 - DNA, 29 bp, Artificial Sequence
  Description of Artificial Sequence: Synthetic oligonucleotide
ataaccgagaggagtacgtgcgcttggac

SEQ ID NO: 61059 - DNA, 28 bp, Artificial Sequence
  Description of Artificial Sequence: Synthetic oligonucleotide
taaccgagaggagtacgtgcgcttggac

SEQ ID NO: 61060 - DNA, 27 bp, Artificial Sequence
  Description of Artificial Sequence: Synthetic oligonucleotide
aaccgagaggagtacgtgcgcttggac

SEQ ID NO: 61061 - DNA, 27 bp, Artificial Sequence
  Description of Artificial Sequence: Synthetic oligonucleotide
accgagaggagtacgtgcgcttggaca

SEQ ID NO: 61062 - DNA, 26 bp, Artificial Sequence
  Description of Artificial Sequence: Synthetic oligonucleotide
ccgagaggagtacgtgcgcttggaca

SEQ ID NO: 61063 - DNA, 26 bp, Artificial Sequence
  Description of Artificial Sequence: Synthetic oligonucleotide
cgagaggagtacgtgcgcttggacag

SEQ ID NO: 61064 - DNA, 26 bp, Artificial Sequence
  Description of Artificial Sequence: Synthetic oligonucleotide
gagaggagtacgtgcgcttggacagc

SEQ ID NO: 61065 - DNA, 27 bp, Artificial Sequence
  Description of Artificial Sequence: Synthetic oligonucleotide
agaggagtacgtgcgcttggacagcga

SEQ ID NO: 61066 - DNA, 26 bp, Artificial Sequence
  Description of Artificial Sequence: Synthetic oligonucleotide
gaggagtacgtgcgcttggacagcga

SEQ ID NO: 61067 - DNA, 26 bp, Artificial Sequence
  Description of Artificial Sequence: Synthetic oligonucleotide
aggagtacgtgcgcttggacagcgac

SEQ ID NO: 61068 - DNA, 25 bp, Artificial Sequence
  Description of Artificial Sequence: Synthetic oligonucleotide
ggagtacgtgcgcttggacagcgac

SEQ ID NO: 61069 - DNA, 26 bp, Artificial Sequence
  Description of Artificial Sequence: Synthetic oligonucleotide
gagtacgtgcgcttggacagcgacgt

SEQ ID NO: 61070 - DNA, 26 bp, Artificial Sequence
  Description of Artificial Sequence: Synthetic oligonucleotide
agtacgtgcgcttggacagcgacgtg

SEQ ID NO: 61071 - DNA, 25 bp, Artificial Sequence
  Description of Artificial Sequence: Synthetic oligonucleotide
gtacgtgcgcttggacagcgacgtg

SEQ ID NO: 61072 - DNA, 25 bp, Artificial Sequence
  Description of Artificial Sequence: Synthetic oligonucleotide
tacgtgcgcttggacagcgacgtgg

SEQ ID NO: 61073 - DNA, 24 bp, Artificial Sequence
  Description of Artificial Sequence: Synthetic oligonucleotide
acgtgcgcttggacagcgacgtgg

SEQ ID NO: 61074 - DNA, 23 bp, Artificial Sequence
  Description of Artificial Sequence: Synthetic oligonucleotide
cgtgcgcttggacagcgacgtgg

SEQ ID NO: 61075 - DNA, 23 bp, Artificial Sequence
  Description of Artificial Sequence: Synthetic oligonucleotide
gtgcgcttggacagcgacgtggg

SEQ ID NO: 61076 - DNA, 23 bp, Artificial Sequence
  Description of Artificial Sequence: Synthetic oligonucleotide
tgcgcttggacagcgacgtgggg

SEQ ID NO: 61077 - DNA, 22 bp, Artificial Sequence
  Description of Artificial Sequence: Synthetic oligonucleotide
gcgcttggacagcgacgtgggg

SEQ ID NO: 61078 - DNA, 23 bp, Artificial Sequence
  Description of Artificial Sequence: Synthetic oligonucleotide
cgcttggacagcgacgtgggggt

SEQ ID NO: 61079 - DNA, 26 bp, Artificial Sequence
  Description of Artificial Sequence: Synthetic oligonucleotide
gcttggacagcgacgtgggggtgtat

SEQ ID NO: 61080 - DNA, 26 bp, Artificial Sequence
  Description of Artificial Sequence: Synthetic oligonucleotide
cttggacagcgacgtgggggtgtatc

SEQ ID NO: 61081 - DNA, 26 bp, Artificial Sequence
  Description of Artificial Sequence: Synthetic oligonucleotide
ttggacagcgacgtgggggtgtatcg

SEQ ID NO: 61082 - DNA, 25 bp, Artificial Sequence
  Description of Artificial Sequence: Synthetic oligonucleotide
tggacagcgacgtgggggtgtatcg

SEQ ID NO: 61083 - DNA, 24 bp, Artificial Sequence
  Description of Artificial Sequence: Synthetic oligonucleotide
ggacagcgacgtgggggtgtatcg

SEQ ID NO: 61084 - DNA, 27 bp, Artificial Sequence
  Description of Artificial Sequence: Synthetic oligonucleotide
agagaccctcccgaggatttcgtgctc

SEQ ID NO: 61085 - DNA, 26 bp, Artificial Sequence
  Description of Artificial Sequence: Synthetic oligonucleotide
gagaccctcccgaggatttcgtgctc

SEQ ID NO: 61086 - DNA, 27 bp, Artificial Sequence
  Description of Artificial Sequence: Synthetic oligonucleotide
agaccctcccgaggatttcgtgctcca

SEQ ID NO: 61087 - DNA, 26 bp, Artificial Sequence
  Description of Artificial Sequence: Synthetic oligonucleotide
gaccctcccgaggatttcgtgctcca

SEQ ID NO: 61088 - DNA, 27 bp, Artificial Sequence
  Description of Artificial Sequence: Synthetic oligonucleotide
accctcccgaggatttcgtgctccagt

SEQ ID NO: 61089 - DNA, 27 bp, Artificial Sequence
  Description of Artificial Sequence: Synthetic oligonucleotide
ccctcccgaggatttcgtgctccagtt

SEQ ID NO: 61090 - DNA, 30 bp, Artificial Sequence
  Description of Artificial Sequence: Synthetic oligonucleotide
cctcccgaggatttcgtgctccagtttaag

SEQ ID NO: 61091 - DNA, 30 bp, Artificial Sequence
  Description of Artificial Sequence: Synthetic oligonucleotide
ctcccgaggatttcgtgctccagtttaagg

SEQ ID NO: 61092 - DNA, 30 bp, Artificial Sequence
  Description of Artificial Sequence: Synthetic oligonucleotide
tcccgaggatttcgtgctccagtttaaggc

SEQ ID NO: 61093 - DNA, 29 bp, Artificial Sequence
  Description of Artificial Sequence: Synthetic oligonucleotide
cccgaggatttcgtgctccagtttaaggc

SEQ ID NO: 61094 - DNA, 29 bp, Artificial Sequence
  Description of Artificial Sequence: Synthetic oligonucleotide
ccgaggatttcgtgctccagtttaaggcc

SEQ ID NO: 61095 - DNA, 31 bp, Artificial Sequence
  Description of Artificial Sequence: Synthetic oligonucleotide
cgaggatttcgtgctccagtttaaggccatg

SEQ ID NO: 61096 - DNA, 32 bp, Artificial Sequence
  Description of Artificial Sequence: Synthetic oligonucleotide
gaggatttcgtgctccagtttaaggccatgtg

SEQ ID NO: 61097 - DNA, 32 bp, Artificial Sequence
  Description of Artificial Sequence: Synthetic oligonucleotide
aggatttcgtgctccagtttaaggccatgtgc

SEQ ID NO: 61098 - DNA, 31 bp, Artificial Sequence
  Description of Artificial Sequence: Synthetic oligonucleotide
ggatttcgtgctccagtttaaggccatgtgc

SEQ ID NO: 61099 - DNA, 33 bp, Artificial Sequence
  Description of Artificial Sequence: Synthetic oligonucleotide
gatttcgtgctccagtttaaggccatgtgctac

SEQ ID NO: 61100 - DNA, 35 bp, Artificial Sequence
  Description of Artificial Sequence: Synthetic oligonucleotide
atttcgtgctccagtttaaggccatgtgctacttc

SEQ ID NO: 61101 - DNA, 34 bp, Artificial Sequence
  Description of Artificial Sequence: Synthetic oligonucleotide
tttcgtgctccagtttaaggccatgtgctacttc

SEQ ID NO: 61102 - DNA, 33 bp, Artificial Sequence
  Description of Artificial Sequence: Synthetic oligonucleotide
ttcgtgctccagtttaaggccatgtgctacttc

SEQ ID NO: 61103 - DNA, 32 bp, Artificial Sequence
  Description of Artificial Sequence: Synthetic oligonucleotide
tcgtgctccagtttaaggccatgtgctacttc

SEQ ID NO: 61104 - DNA, 31 bp, Artificial Sequence
  Description of Artificial Sequence: Synthetic oligonucleotide
cgtgctccagtttaaggccatgtgctacttc

SEQ ID NO: 61105 - DNA, 32 bp, Artificial Sequence
  Description of Artificial Sequence: Synthetic oligonucleotide
gtgctccagtttaaggccatgtgctacttcac

SEQ ID NO: 61106 - DNA, 32 bp, Artificial Sequence
  Description of Artificial Sequence: Synthetic oligonucleotide
tgctccagtttaaggccatgtgctacttcacc

SEQ ID NO: 61107 - DNA, 31 bp, Artificial Sequence
  Description of Artificial Sequence: Synthetic oligonucleotide
gctccagtttaaggccatgtgctacttcacc

SEQ ID NO: 61108 - DNA, 34 bp, Artificial Sequence
  Description of Artificial Sequence: Synthetic oligonucleotide
ctccagtttaaggccatgtgctacttcaccaatg

SEQ ID NO: 61109 - DNA, 34 bp, Artificial Sequence
  Description of Artificial Sequence: Synthetic oligonucleotide
tccagtttaaggccatgtgctacttcaccaatgg

SEQ ID NO: 61110 - DNA, 33 bp, Artificial Sequence
  Description of Artificial Sequence: Synthetic oligonucleotide
ccagtttaaggccatgtgctacttcaccaatgg

SEQ ID NO: 61111 - DNA, 33 bp, Artificial Sequence
  Description of Artificial Sequence: Synthetic oligonucleotide
cagtttaaggccatgtgctacttcaccaatggg

SEQ ID NO: 61112 - DNA, 34 bp, Artificial Sequence
  Description of Artificial Sequence: Synthetic oligonucleotide
agtttaaggccatgtgctacttcaccaatgggac

SEQ ID NO: 61113 - DNA, 33 bp, Artificial Sequence
  Description of Artificial Sequence: Synthetic oligonucleotide
gtttaaggccatgtgctacttcaccaatgggac

SEQ ID NO: 61114 - DNA, 33 bp, Artificial Sequence
  Description of Artificial Sequence: Synthetic oligonucleotide
tttaaggccatgtgctacttcaccaatgggacg

SEQ ID NO: 61115 - DNA, 32 bp, Artificial Sequence
  Description of Artificial Sequence: Synthetic oligonucleotide
ttaaggccatgtgctacttcaccaatgggacg

SEQ ID NO: 61116 - DNA, 31 bp, Artificial Sequence
  Description of Artificial Sequence: Synthetic oligonucleotide
taaggccatgtgctacttcaccaatgggacg

SEQ ID NO: 61117 - DNA, 30 bp, Artificial Sequence
  Description of Artificial Sequence: Synthetic oligonucleotide
aaggccatgtgctacttcaccaatgggacg

SEQ ID NO: 61118 - DNA, 29 bp, Artificial Sequence
  Description of Artificial Sequence: Synthetic oligonucleotide
aggccatgtgctacttcaccaatgggacg

SEQ ID NO: 61119 - DNA, 28 bp, Artificial Sequence
  Description of Artificial Sequence: Synthetic oligonucleotide
ggccatgtgctacttcaccaatgggacg

SEQ ID NO: 61120 - DNA, 28 bp, Artificial Sequence
  Description of Artificial Sequence: Synthetic oligonucleotide
gccatgtgctacttcaccaatgggacgg

SEQ ID NO: 61121 - DNA, 29 bp, Artificial Sequence
  Description of Artificial Sequence: Synthetic oligonucleotide
ccatgtgctacttcaccaatgggacggag

SEQ ID NO: 61122 - DNA, 29 bp, Artificial Sequence
  Description of Artificial Sequence: Synthetic oligonucleotide
catgtgctacttcaccaatgggacggagc

SEQ ID NO: 61123 - DNA, 29 bp, Artificial Sequence
  Description of Artificial Sequence: Synthetic oligonucleotide
atgtgctacttcaccaatgggacggagcg

SEQ ID NO: 61124 - DNA, 28 bp, Artificial Sequence
  Description of Artificial Sequence: Synthetic oligonucleotide
tgtgctacttcaccaatgggacggagcg

SEQ ID NO: 61125 - DNA, 27 bp, Artificial Sequence
  Description of Artificial Sequence: Synthetic oligonucleotide
gtgctacttcaccaatgggacggagcg

SEQ ID NO: 61126 - DNA, 27 bp, Artificial Sequence
  Description of Artificial Sequence: Synthetic oligonucleotide
tgctacttcaccaatgggacggagcgc

SEQ ID NO: 61127 - DNA, 26 bp, Artificial Sequence
  Description of Artificial Sequence: Synthetic oligonucleotide
gctacttcaccaatgggacggagcgc

SEQ ID NO: 61128 - DNA, 27 bp, Artificial Sequence
  Description of Artificial Sequence: Synthetic oligonucleotide
ctacttcaccaatgggacggagcgcgt

SEQ ID NO: 61129 - DNA, 27 bp, Artificial Sequence
  Description of Artificial Sequence: Synthetic oligonucleotide
tacttcaccaatgggacggagcgcgtg

SEQ ID NO: 61130 - DNA, 26 bp, Artificial Sequence
  Description of Artificial Sequence: Synthetic oligonucleotide
acttcaccaatgggacggagcgcgtg

SEQ ID NO: 61131 - DNA, 25 bp, Artificial Sequence
  Description of Artificial Sequence: Synthetic oligonucleotide
cttcaccaatgggacggagcgcgtg

SEQ ID NO: 61132 - DNA, 25 bp, Artificial Sequence
  Description of Artificial Sequence: Synthetic oligonucleotide
ttcaccaatgggacggagcgcgtgc

SEQ ID NO: 61133 - DNA, 24 bp, Artificial Sequence
  Description of Artificial Sequence: Synthetic oligonucleotide
tcaccaatgggacggagcgcgtgc

SEQ ID NO: 61134 - DNA, 23 bp, Artificial Sequence
  Description of Artificial Sequence: Synthetic oligonucleotide
caccaatgggacggagcgcgtgc

SEQ ID NO: 61135 - DNA, 27 bp, Artificial Sequence
  Description of Artificial Sequence: Synthetic oligonucleotide
accaatgggacggagcgcgtgcgttat

SEQ ID NO: 61136 - DNA, 26 bp, Artificial Sequence
  Description of Artificial Sequence: Synthetic oligonucleotide
ccaatgggacggagcgcgtgcgttat

SEQ ID NO: 61137 - DNA, 27 bp, Artificial Sequence
  Description of Artificial Sequence: Synthetic oligonucleotide
caatgggacggagcgcgtgcgttatgt

SEQ ID NO: 61138 - DNA, 27 bp, Artificial Sequence
  Description of Artificial Sequence: Synthetic oligonucleotide
aatgggacggagcgcgtgcgttatgtg

SEQ ID NO: 61139 - DNA, 27 bp, Artificial Sequence
  Description of Artificial Sequence: Synthetic oligonucleotide
atgggacggagcgcgtgcgttatgtga

SEQ ID NO: 61140 - DNA, 26 bp, Artificial Sequence
  Description of Artificial Sequence: Synthetic oligonucleotide
tgggacggagcgcgtgcgttatgtga

SEQ ID NO: 61141 - DNA, 36 bp, Artificial Sequence
  Description of Artificial Sequence: Synthetic oligonucleotide
gttatgtgaccagatacatctataaccgagaggagg

SEQ ID NO: 61142 - DNA, 37 bp, Artificial Sequence
  Description of Artificial Sequence: Synthetic oligonucleotide
ttatgtgaccagatacatctataaccgagaggaggac

SEQ ID NO: 61143 - DNA, 36 bp, Artificial Sequence
  Description of Artificial Sequence: Synthetic oligonucleotide
tatgtgaccagatacatctataaccgagaggaggac

SEQ ID NO: 61144 - DNA, 35 bp, Artificial Sequence
  Description of Artificial Sequence: Synthetic oligonucleotide
atgtgaccagatacatctataaccgagaggaggac

SEQ ID NO: 61145 - DNA, 34 bp, Artificial Sequence
  Description of Artificial Sequence: Synthetic oligonucleotide
tgtgaccagatacatctataaccgagaggaggac

SEQ ID NO: 61146 - DNA, 33 bp, Artificial Sequence
  Description of Artificial Sequence: Synthetic oligonucleotide
gtgaccagatacatctataaccgagaggaggac

SEQ ID NO: 61147 - DNA, 33 bp, Artificial Sequence
  Description of Artificial Sequence: Synthetic oligonucleotide
tgaccagatacatctataaccgagaggaggacg

SEQ ID NO: 61148 - DNA, 32 bp, Artificial Sequence
  Description of Artificial Sequence: Synthetic oligonucleotide
gaccagatacatctataaccgagaggaggacg

SEQ ID NO: 61149 - DNA, 33 bp, Artificial Sequence
  Description of Artificial Sequence: Synthetic oligonucleotide
accagatacatctataaccgagaggaggacgtg

SEQ ID NO: 61150 - DNA, 32 bp, Artificial Sequence
  Description of Artificial Sequence: Synthetic oligonucleotide
ccagatacatctataaccgagaggaggacgtg

SEQ ID NO: 61151 - DNA, 32 bp, Artificial Sequence
  Description of Artificial Sequence: Synthetic oligonucleotide
cagatacatctataaccgagaggaggacgtgc

SEQ ID NO: 61152 - DNA, 32 bp, Artificial Sequence
  Description of Artificial Sequence: Synthetic oligonucleotide
agatacatctataaccgagaggaggacgtgcg

SEQ ID NO: 61153 - DNA, 31 bp, Artificial Sequence
  Description of Artificial Sequence: Synthetic oligonucleotide
gatacatctataaccgagaggaggacgtgcg

SEQ ID NO: 61154 - DNA, 31 bp, Artificial Sequence
  Description of Artificial Sequence: Synthetic oligonucleotide
atacatctataaccgagaggaggacgtgcgc

SEQ ID NO: 61155 - DNA, 30 bp, Artificial Sequence
  Description of Artificial Sequence: Synthetic oligonucleotide
tacatctataaccgagaggaggacgtgcgc

SEQ ID NO: 61156 - DNA, 29 bp, Artificial Sequence
  Description of Artificial Sequence: Synthetic oligonucleotide
acatctataaccgagaggaggacgtgcgc

SEQ ID NO: 61157 - DNA, 28 bp, Artificial Sequence
  Description of Artificial Sequence: Synthetic oligonucleotide
catctataaccgagaggaggacgtgcgc

SEQ ID NO: 61158 - DNA, 30 bp, Artificial Sequence
  Description of Artificial Sequence: Synthetic oligonucleotide
atctataaccgagaggaggacgtgcgcttc

SEQ ID NO: 61159 - DNA, 29 bp, Artificial Sequence
  Description of Artificial Sequence: Synthetic oligonucleotide
tctataaccgagaggaggacgtgcgcttc

SEQ ID NO: 61160 - DNA, 28 bp, Artificial Sequence
  Description of Artificial Sequence: Synthetic oligonucleotide
ctataaccgagaggaggacgtgcgcttc

SEQ ID NO: 61161 - DNA, 28 bp, Artificial Sequence
  Description of Artificial Sequence: Synthetic oligonucleotide
tataaccgagaggaggacgtgcgcttcg

SEQ ID NO: 61162 - DNA, 27 bp, Artificial Sequence
  Description of Artificial Sequence: Synthetic oligonucleotide
ataaccgagaggaggacgtgcgcttcg

SEQ ID NO: 61163 - DNA, 27 bp, Artificial Sequence
  Description of Artificial Sequence: Synthetic oligonucleotide
taaccgagaggaggacgtgcgcttcga

SEQ ID NO: 61164 - DNA, 26 bp, Artificial Sequence
  Description of Artificial Sequence: Synthetic oligonucleotide
aaccgagaggaggacgtgcgcttcga

SEQ ID NO: 61165 - DNA, 25 bp, Artificial Sequence
  Description of Artificial Sequence: Synthetic oligonucleotide
accgagaggaggacgtgcgcttcga

SEQ ID NO: 61166 - DNA, 24 bp, Artificial Sequence
  Description of Artificial Sequence: Synthetic oligonucleotide
ccgagaggaggacgtgcgcttcga

SEQ ID NO: 61167 - DNA, 25 bp, Artificial Sequence
  Description of Artificial Sequence: Synthetic oligonucleotide
cgagaggaggacgtgcgcttcgaca

SEQ ID NO: 61168 - DNA, 25 bp, Artificial Sequence
  Description of Artificial Sequence: Synthetic oligonucleotide
gagaggaggacgtgcgcttcgacag

SEQ ID NO: 61169 - DNA, 25 bp, Artificial Sequence
  Description of Artificial Sequence: Synthetic oligonucleotide
agaggaggacgtgcgcttcgacagc

SEQ ID NO: 61170 - DNA, 24 bp, Artificial Sequence
  Description of Artificial Sequence: Synthetic oligonucleotide
gaggaggacgtgcgcttcgacagc

SEQ ID NO: 61171 - DNA, 25 bp, Artificial Sequence
  Description of Artificial Sequence: Synthetic oligonucleotide
aggaggacgtgcgcttcgacagcga

SEQ ID NO: 61172 - DNA, 24 bp, Artificial Sequence
  Description of Artificial Sequence: Synthetic oligonucleotide
ggaggacgtgcgcttcgacagcga

SEQ ID NO: 61173 - DNA, 24 bp, Artificial Sequence
  Description of Artificial Sequence: Synthetic oligonucleotide
gaggacgtgcgcttcgacagcgac

SEQ ID NO: 61174 - DNA, 25 bp, Artificial Sequence
  Description of Artificial Sequence: Synthetic oligonucleotide
aggacgtgcgcttcgacagcgacgt

SEQ ID NO: 61175 - DNA, 24 bp, Artificial Sequence
  Description of Artificial Sequence: Synthetic oligonucleotide
ggacgtgcgcttcgacagcgacgt

SEQ ID NO: 61176 - DNA, 24 bp, Artificial Sequence
  Description of Artificial Sequence: Synthetic oligonucleotide
gacgtgcgcttcgacagcgacgtg

SEQ ID NO: 61177 - DNA, 29 bp, Artificial Sequence
  Description of Artificial Sequence: Synthetic oligonucleotide
aacagccagaaggacatcctggagaggac

SEQ ID NO: 61178 - DNA, 28 bp, Artificial Sequence
  Description of Artificial Sequence: Synthetic oligonucleotide
acagccagaaggacatcctggagaggac

SEQ ID NO: 61179 - DNA, 27 bp, Artificial Sequence
  Description of Artificial Sequence: Synthetic oligonucleotide
cagccagaaggacatcctggagaggac

SEQ ID NO: 61180 - DNA, 27 bp, Artificial Sequence
  Description of Artificial Sequence: Synthetic oligonucleotide
agccagaaggacatcctggagaggacc

SEQ ID NO: 61181 - DNA, 26 bp, Artificial Sequence
  Description of Artificial Sequence: Synthetic oligonucleotide
gccagaaggacatcctggagaggacc

SEQ ID NO: 61182 - DNA, 26 bp, Artificial Sequence
  Description of Artificial Sequence: Synthetic oligonucleotide
ccagaaggacatcctggagaggaccc

SEQ ID NO: 61183 - DNA, 27 bp, Artificial Sequence
  Description of Artificial Sequence: Synthetic oligonucleotide
cagaaggacatcctggagaggacccga

SEQ ID NO: 61184 - DNA, 27 bp, Artificial Sequence
  Description of Artificial Sequence: Synthetic oligonucleotide
agaaggacatcctggagaggacccgag

SEQ ID NO: 61185 - DNA, 26 bp, Artificial Sequence
  Description of Artificial Sequence: Synthetic oligonucleotide
gaaggacatcctggagaggacccgag

SEQ ID NO: 61186 - DNA, 26 bp, Artificial Sequence
  Description of Artificial Sequence: Synthetic oligonucleotide
aaggacatcctggagaggacccgagc

SEQ ID NO: 61187 - DNA, 25 bp, Artificial Sequence
  Description of Artificial Sequence: Synthetic oligonucleotide
aggacatcctggagaggacccgagc

SEQ ID NO: 61188 - DNA, 24 bp, Artificial Sequence
  Description of Artificial Sequence: Synthetic oligonucleotide
ggacatcctggagaggacccgagc

SEQ ID NO: 61189 - DNA, 24 bp, Artificial Sequence
  Description of Artificial Sequence: Synthetic oligonucleotide
gacatcctggagaggacccgagcg

SEQ ID NO: 61190 - DNA, 25 bp, Artificial Sequence
  Description of Artificial Sequence: Synthetic oligonucleotide
acatcctggagaggacccgagcgga

SEQ ID NO: 61191 - DNA, 24 bp, Artificial Sequence
  Description of Artificial Sequence: Synthetic oligonucleotide
catcctggagaggacccgagcgga

SEQ ID NO: 61192 - DNA, 26 bp, Artificial Sequence
  Description of Artificial Sequence: Synthetic oligonucleotide
atcctggagaggacccgagcggagtt

SEQ ID NO: 61193 - DNA, 25 bp, Artificial Sequence
  Description of Artificial Sequence: Synthetic oligonucleotide
tcctggagaggacccgagcggagtt

SEQ ID NO: 61194 - DNA, 24 bp, Artificial Sequence
  Description of Artificial Sequence: Synthetic oligonucleotide
cctggagaggacccgagcggagtt

SEQ ID NO: 61195 - DNA, 24 bp, Artificial Sequence
  Description of Artificial Sequence: Synthetic oligonucleotide
ctggagaggacccgagcggagttg

SEQ ID NO: 61196 - DNA, 25 bp, Artificial Sequence
  Description of Artificial Sequence: Synthetic oligonucleotide
tggagaggacccgagcggagttgga

SEQ ID NO: 61197 - DNA, 24 bp, Artificial Sequence
  Description of Artificial Sequence: Synthetic oligonucleotide
ggagaggacccgagcggagttgga

SEQ ID NO: 61198 - DNA, 25 bp, Artificial Sequence
  Description of Artificial Sequence: Synthetic oligonucleotide
gagaggacccgagcggagttggaca

SEQ ID NO: 61199 - DNA, 25 bp, Artificial Sequence
  Description of Artificial Sequence: Synthetic oligonucleotide
agaggacccgagcggagttggacac

SEQ ID NO: 61200 - DNA, 24 bp, Artificial Sequence
  Description of Artificial Sequence: Synthetic oligonucleotide
gaggacccgagcggagttggacac

SEQ ID NO: 61201 - DNA, 24 bp, Artificial Sequence
  Description of Artificial Sequence: Synthetic oligonucleotide
aggacccgagcggagttggacacg

SEQ ID NO: 61202 - DNA, 23 bp, Artificial Sequence
  Description of Artificial Sequence: Synthetic oligonucleotide
ggacccgagcggagttggacacg

SEQ ID NO: 61203 - DNA, 24 bp, Artificial Sequence
  Description of Artificial Sequence: Synthetic oligonucleotide
gacccgagcggagttggacacggt

SEQ ID NO: 61204 - DNA, 25 bp, Artificial Sequence
  Description of Artificial Sequence: Synthetic oligonucleotide
acccgagcggagttggacacggtgt

SEQ ID NO: 61205 - DNA, 24 bp, Artificial Sequence
  Description of Artificial Sequence: Synthetic oligonucleotide
cccgagcggagttggacacggtgt

SEQ ID NO: 61206 - DNA, 24 bp, Artificial Sequence
  Description of Artificial Sequence: Synthetic oligonucleotide
ccgagcggagttggacacggtgtg

SEQ ID NO: 61207 - DNA, 25 bp, Artificial Sequence
  Description of Artificial Sequence: Synthetic oligonucleotide
cgagcggagttggacacggtgtgca

SEQ ID NO: 61208 - DNA, 26 bp, Artificial Sequence
  Description of Artificial Sequence: Synthetic oligonucleotide
gagcggagttggacacggtgtgcaga

SEQ ID NO: 61209 - DNA, 27 bp, Artificial Sequence
  Description of Artificial Sequence: Synthetic oligonucleotide
agcggagttggacacggtgtgcagaca

SEQ ID NO: 61210 - DNA, 30 bp, Artificial Sequence
  Description of Artificial Sequence: Synthetic oligonucleotide
agttggacacggtgtgcagacacaactacg

SEQ ID NO: 61211 - DNA, 29 bp, Artificial Sequence
  Description of Artificial Sequence: Synthetic oligonucleotide
gttggacacggtgtgcagacacaactacg

SEQ ID NO: 61212 - DNA, 30 bp, Artificial Sequence
  Description of Artificial Sequence: Synthetic oligonucleotide
ttggacacggtgtgcagacacaactacgag

SEQ ID NO: 61213 - DNA, 29 bp, Artificial Sequence
  Description of Artificial Sequence: Synthetic oligonucleotide
tggacacggtgtgcagacacaactacgag

SEQ ID NO: 61214 - DNA, 28 bp, Artificial Sequence
  Description of Artificial Sequence: Synthetic oligonucleotide
ggacacggtgtgcagacacaactacgag

SEQ ID NO: 61215 - DNA, 28 bp, Artificial Sequence
  Description of Artificial Sequence: Synthetic oligonucleotide
gacacggtgtgcagacacaactacgagg

SEQ ID NO: 61216 - DNA, 29 bp, Artificial Sequence
  Description of Artificial Sequence: Synthetic oligonucleotide
acacggtgtgcagacacaactacgaggtg

SEQ ID NO: 61217 - DNA, 28 bp, Artificial Sequence
  Description of Artificial Sequence: Synthetic oligonucleotide
cacggtgtgcagacacaactacgaggtg

SEQ ID NO: 61218 - DNA, 28 bp, Artificial Sequence
  Description of Artificial Sequence: Synthetic oligonucleotide
acggtgtgcagacacaactacgaggtgg

SEQ ID NO: 61219 - DNA, 27 bp, Artificial Sequence
  Description of Artificial Sequence: Synthetic oligonucleotide
cggtgtgcagacacaactacgaggtgg

SEQ ID NO: 61220 - DNA, 29 bp, Artificial Sequence
  Description of Artificial Sequence: Synthetic oligonucleotide
tgtgcagacacaactacgaggtggcgttc

SEQ ID NO: 61221 - DNA, 28 bp, Artificial Sequence
  Description of Artificial Sequence: Synthetic oligonucleotide
gtgcagacacaactacgaggtggcgttc

SEQ ID NO: 61222 - DNA, 28 bp, Artificial Sequence
  Description of Artificial Sequence: Synthetic oligonucleotide
tgcagacacaactacgaggtggcgttcc

SEQ ID NO: 61223 - DNA, 27 bp, Artificial Sequence
  Description of Artificial Sequence: Synthetic oligonucleotide
gcagacacaactacgaggtggcgttcc

SEQ ID NO: 61224 - DNA, 27 bp, Artificial Sequence
  Description of Artificial Sequence: Synthetic oligonucleotide
cagacacaactacgaggtggcgttccg

SEQ ID NO: 61225 - DNA, 27 bp, Artificial Sequence
  Description of Artificial Sequence: Synthetic oligonucleotide
agacacaactacgaggtggcgttccgc

SEQ ID NO: 61226 - DNA, 26 bp, Artificial Sequence
  Description of Artificial Sequence: Synthetic oligonucleotide
gacacaactacgaggtggcgttccgc

SEQ ID NO: 61227 - DNA, 26 bp, Artificial Sequence
  Description of Artificial Sequence: Synthetic oligonucleotide
acacaactacgaggtggcgttccgcg

SEQ ID NO: 61228 - DNA, 25 bp, Artificial Sequence
  Description of Artificial Sequence: Synthetic oligonucleotide
cacaactacgaggtggcgttccgcg

SEQ ID NO: 61229 - DNA, 25 bp, Artificial Sequence
  Description of Artificial Sequence: Synthetic oligonucleotide
acaactacgaggtggcgttccgcgg

SEQ ID NO: 61230 - DNA, 24 bp, Artificial Sequence
  Description of Artificial Sequence: Synthetic oligonucleotide
caactacgaggtggcgttccgcgg

SEQ ID NO: 61231 - DNA, 26 bp, Artificial Sequence
  Description of Artificial Sequence: Synthetic oligonucleotide
aactacgaggtggcgttccgcgggat

SEQ ID NO: 61232 - DNA, 25 bp, Artificial Sequence
  Description of Artificial Sequence: Synthetic oligonucleotide
actacgaggtggcgttccgcgggat

SEQ ID NO: 61233 - DNA, 24 bp, Artificial Sequence
  Description of Artificial Sequence: Synthetic oligonucleotide
ctacgaggtggcgttccgcgggat

SEQ ID NO: 61234 - DNA, 26 bp, Artificial Sequence
  Description of Artificial Sequence: Synthetic oligonucleotide
tacgaggtggcgttccgcgggatctt

SEQ ID NO: 61235 - DNA, 25 bp, Artificial Sequence
  Description of Artificial Sequence: Synthetic oligonucleotide
acgaggtggcgttccgcgggatctt

SEQ ID NO: 61236 - DNA, 24 bp, Artificial Sequence
  Description of Artificial Sequence: Synthetic oligonucleotide
cgaggtggcgttccgcgggatctt

SEQ ID NO: 61237 - DNA, 24 bp, Artificial Sequence
  Description of Artificial Sequence: Synthetic oligonucleotide
gaggtggcgttccgcgggatcttg

SEQ ID NO: 61238 - DNA, 25 bp, Artificial Sequence
  Description of Artificial Sequence: Synthetic oligonucleotide
aggtggcgttccgcgggatcttgca

SEQ ID NO: 61239 - DNA, 24 bp, Artificial Sequence
  Description of Artificial Sequence: Synthetic oligonucleotide
ggtggcgttccgcgggatcttgca

SEQ ID NO: 61240 - DNA, 25 bp, Artificial Sequence
  Description of Artificial Sequence: Synthetic oligonucleotide
gtggcgttccgcgggatcttgcaga

SEQ ID NO: 61241 - DNA, 25 bp, Artificial Sequence
  Description of Artificial Sequence: Synthetic oligonucleotide
tggcgttccgcgggatcttgcagag

SEQ ID NO: 61242 - DNA, 24 bp, Artificial Sequence
  Description of Artificial Sequence: Synthetic oligonucleotide
ggcgttccgcgggatcttgcagag

SEQ ID NO: 61243 - DNA, 25 bp, Artificial Sequence
  Description of Artificial Sequence: Synthetic oligonucleotide
gcgttccgcgggatcttgcagagga

SEQ ID NO: 61244 - DNA, 26 bp, Artificial Sequence
  Description of Artificial Sequence: Synthetic oligonucleotide
cgttccgcgggatcttgcagaggaga

SEQ ID NO: 61245 - DNA, 27 bp, Artificial Sequence
  Description of Artificial Sequence: Synthetic oligonucleotide
gttccgcgggatcttgcagaggagagt

SEQ ID NO: 61246 - DNA, 27 bp, Artificial Sequence
  Description of Artificial Sequence: Synthetic oligonucleotide
ttccgcgggatcttgcagaggagagtg

SEQ ID NO: 61247 - DNA, 26 bp, Artificial Sequence
  Description of Artificial Sequence: Synthetic oligonucleotide
tccgcgggatcttgcagaggagagtg

SEQ ID NO: 61248 - DNA, 25 bp, Artificial Sequence
  Description of Artificial Sequence: Synthetic oligonucleotide
ccgcgggatcttgcagaggagagtg

SEQ ID NO: 61249 - DNA, 26 bp, Artificial Sequence
  Description of Artificial Sequence: Synthetic oligonucleotide
cgcgggatcttgcagaggagagtgga

SEQ ID NO: 61250 - DNA, 26 bp, Artificial Sequence
  Description of Artificial Sequence: Synthetic oligonucleotide
gcgggatcttgcagaggagagtggag

SEQ ID NO: 61251 - DNA, 26 bp, Artificial Sequence
  Description of Artificial Sequence: Synthetic oligonucleotide
cgggatcttgcagaggagagtggagc

SEQ ID NO: 61252 - DNA, 26 bp, Artificial Sequence
  Description of Artificial Sequence: Synthetic oligonucleotide
gggatcttgcagaggagagtggagcc

SEQ ID NO: 61253 - DNA, 27 bp, Artificial Sequence
  Description of Artificial Sequence: Synthetic oligonucleotide
ggatcttgcagaggagagtggagccca

SEQ ID NO: 61254 - DNA, 27 bp, Artificial Sequence
  Description of Artificial Sequence: Synthetic oligonucleotide
gatcttgcagaggagagtggagcccac

SEQ ID NO: 61255 - DNA, 28 bp, Artificial Sequence
  Description of Artificial Sequence: Synthetic oligonucleotide
atcttgcagaggagagtggagcccacag

SEQ ID NO: 61256 - DNA, 27 bp, Artificial Sequence
  Description of Artificial Sequence: Synthetic oligonucleotide
tcttgcagaggagagtggagcccacag

SEQ ID NO: 61257 - DNA, 27 bp, Artificial Sequence
  Description of Artificial Sequence: Synthetic oligonucleotide
cttgcagaggagagtggagcccacagt

SEQ ID NO: 61258 - DNA, 27 bp, Artificial Sequence
  Description of Artificial Sequence: Synthetic oligonucleotide
ttgcagaggagagtggagcccacagtg

SEQ ID NO: 61259 - DNA, 31 bp, Artificial Sequence
  Description of Artificial Sequence: Synthetic oligonucleotide
tggtctgctcggtgacagatttctatccagg

SEQ ID NO: 61260 - DNA, 30 bp, Artificial Sequence
  Description of Artificial Sequence: Synthetic oligonucleotide
ggtctgctcggtgacagatttctatccagg

SEQ ID NO: 61261 - DNA, 30 bp, Artificial Sequence
  Description of Artificial Sequence: Synthetic oligonucleotide
gtctgctcggtgacagatttctatccaggc

SEQ ID NO: 61262 - DNA, 30 bp, Artificial Sequence
  Description of Artificial Sequence: Synthetic oligonucleotide
tctgctcggtgacagatttctatccaggcc

SEQ ID NO: 61263 - DNA, 29 bp, Artificial Sequence
  Description of Artificial Sequence: Synthetic oligonucleotide
ctgctcggtgacagatttctatccaggcc

SEQ ID NO: 61264 - DNA, 30 bp, Artificial Sequence
  Description of Artificial Sequence: Synthetic oligonucleotide
tgctcggtgacagatttctatccaggccag

SEQ ID NO: 61265 - DNA, 29 bp, Artificial Sequence
  Description of Artificial Sequence: Synthetic oligonucleotide
gctcggtgacagatttctatccaggccag

SEQ ID NO: 61266 - DNA, 31 bp, Artificial Sequence
  Description of Artificial Sequence: Synthetic oligonucleotide
ctcggtgacagatttctatccaggccagatc

SEQ ID NO: 61267 - DNA, 34 bp, Artificial Sequence
  Description of Artificial Sequence: Synthetic oligonucleotide
tcggtgacagatttctatccaggccagatcaaag

SEQ ID NO: 61268 - DNA, 33 bp, Artificial Sequence
  Description of Artificial Sequence: Synthetic oligonucleotide
cggtgacagatttctatccaggccagatcaaag

SEQ ID NO: 61269 - DNA, 34 bp, Artificial Sequence
  Description of Artificial Sequence: Synthetic oligonucleotide
ggtgacagatttctatccaggccagatcaaagtc

SEQ ID NO: 61270 - DNA, 34 bp, Artificial Sequence
  Description of Artificial Sequence: Synthetic oligonucleotide
gtgacagatttctatccaggccagatcaaagtcc

SEQ ID NO: 61271 - DNA, 34 bp, Artificial Sequence
  Description of Artificial Sequence: Synthetic oligonucleotide
tgacagatttctatccaggccagatcaaagtccg

SEQ ID NO: 61272 - DNA, 33 bp, Artificial Sequence
  Description of Artificial Sequence: Synthetic oligonucleotide
gacagatttctatccaggccagatcaaagtccg

SEQ ID NO: 61273 - DNA, 33 bp, Artificial Sequence
  Description of Artificial Sequence: Synthetic oligonucleotide
acagatttctatccaggccagatcaaagtccgg

SEQ ID NO: 61274 - DNA, 32 bp, Artificial Sequence
  Description of Artificial Sequence: Synthetic oligonucleotide
cagatttctatccaggccagatcaaagtccgg

SEQ ID NO: 61275 - DNA, 33 bp, Artificial Sequence
  Description of Artificial Sequence: Synthetic oligonucleotide
agatttctatccaggccagatcaaagtccggtg

SEQ ID NO: 61276 - DNA, 32 bp, Artificial Sequence
  Description of Artificial Sequence: Synthetic oligonucleotide
gatttctatccaggccagatcaaagtccggtg

SEQ ID NO: 61277 - DNA, 32 bp, Artificial Sequence
  Description of Artificial Sequence: Synthetic oligonucleotide
atttctatccaggccagatcaaagtccggtgg

SEQ ID NO: 61278 - DNA, 31 bp, Artificial Sequence
  Description of Artificial Sequence: Synthetic oligonucleotide
tttctatccaggccagatcaaagtccggtgg

SEQ ID NO: 61279 - DNA, 30 bp, Artificial Sequence
  Description of Artificial Sequence: Synthetic oligonucleotide
ttctatccaggccagatcaaagtccggtgg

SEQ ID NO: 61280 - DNA, 29 bp, Artificial Sequence
  Description of Artificial Sequence: Synthetic oligonucleotide
tctatccaggccagatcaaagtccggtgg

SEQ ID NO: 61281 - DNA, 28 bp, Artificial Sequence
  Description of Artificial Sequence: Synthetic oligonucleotide
ctatccaggccagatcaaagtccggtgg

SEQ ID NO: 61282 - DNA, 31 bp, Artificial Sequence
  Description of Artificial Sequence: Synthetic oligonucleotide
tatccaggccagatcaaagtccggtggtttc

SEQ ID NO: 61283 - DNA, 30 bp, Artificial Sequence
  Description of Artificial Sequence: Synthetic oligonucleotide
atccaggccagatcaaagtccggtggtttc

SEQ ID NO: 61284 - DNA, 29 bp, Artificial Sequence
  Description of Artificial Sequence: Synthetic oligonucleotide
tccaggccagatcaaagtccggtggtttc

SEQ ID NO: 61285 - DNA, 28 bp, Artificial Sequence
  Description of Artificial Sequence: Synthetic oligonucleotide
ccaggccagatcaaagtccggtggtttc

SEQ ID NO: 61286 - DNA, 28 bp, Artificial Sequence
  Description of Artificial Sequence: Synthetic oligonucleotide
caggccagatcaaagtccggtggtttcg

SEQ ID NO: 61287 - DNA, 28 bp, Artificial Sequence
  Description of Artificial Sequence: Synthetic oligonucleotide
aggccagatcaaagtccggtggtttcgg

SEQ ID NO: 61288 - DNA, 27 bp, Artificial Sequence
  Description of Artificial Sequence: Synthetic oligonucleotide
ggccagatcaaagtccggtggtttcgg

SEQ ID NO: 61289 - DNA, 27 bp, Artificial Sequence
  Description of Artificial Sequence: Synthetic oligonucleotide
gcgggctcagtctgaatctgcccagaa

SEQ ID NO: 61290 - DNA, 27 bp, Artificial Sequence
  Description of Artificial Sequence: Synthetic oligonucleotide
cgggctcagtctgaatctgcccagaac

SEQ ID NO: 61291 - DNA, 29 bp, Artificial Sequence
  Description of Artificial Sequence: Synthetic oligonucleotide
gggctcagtctgaatctgcccagaacaag

SEQ ID NO: 61292 - DNA, 31 bp, Artificial Sequence
  Description of Artificial Sequence: Synthetic oligonucleotide
ggctcagtctgaatctgcccagaacaagatg

SEQ ID NO: 61293 - DNA, 31 bp, Artificial Sequence
  Description of Artificial Sequence: Synthetic oligonucleotide
gctcagtctgaatctgcccagaacaagatgc

SEQ ID NO: 61294 - DNA, 32 bp, Artificial Sequence
  Description of Artificial Sequence: Synthetic oligonucleotide
ctcagtctgaatctgcccagaacaagatgctg

SEQ ID NO: 61295 - DNA, 33 bp, Artificial Sequence
  Description of Artificial Sequence: Synthetic oligonucleotide
tcagtctgaatctgcccagaacaagatgctgag

SEQ ID NO: 61296 - DNA, 32 bp, Artificial Sequence
  Description of Artificial Sequence: Synthetic oligonucleotide
cagtctgaatctgcccagaacaagatgctgag

SEQ ID NO: 61297 - DNA, 33 bp, Artificial Sequence
  Description of Artificial Sequence: Synthetic oligonucleotide
agtctgaatctgcccagaacaagatgctgagtg

SEQ ID NO: 61298 - DNA, 32 bp, Artificial Sequence
  Description of Artificial Sequence: Synthetic oligonucleotide
gtctgaatctgcccagaacaagatgctgagtg

SEQ ID NO: 61299 - DNA, 32 bp, Artificial Sequence
  Description of Artificial Sequence: Synthetic oligonucleotide
tctgaatctgcccagaacaagatgctgagtgg

SEQ ID NO: 61300 - DNA, 31 bp, Artificial Sequence
  Description of Artificial Sequence: Synthetic oligonucleotide
ctgaatctgcccagaacaagatgctgagtgg

SEQ ID NO: 61301 - DNA, 31 bp, Artificial Sequence
  Description of Artificial Sequence: Synthetic oligonucleotide
tgaatctgcccagaacaagatgctgagtggc

SEQ ID NO: 61302 - DNA, 30 bp, Artificial Sequence
  Description of Artificial Sequence: Synthetic oligonucleotide
gaatctgcccagaacaagatgctgagtggc

SEQ ID NO: 61303 - DNA, 33 bp, Artificial Sequence
  Description of Artificial Sequence: Synthetic oligonucleotide
aatctgcccagaacaagatgctgagtggcattg

SEQ ID NO: 61304 - DNA, 32 bp, Artificial Sequence
  Description of Artificial Sequence: Synthetic oligonucleotide
atctgcccagaacaagatgctgagtggcattg

SEQ ID NO: 61305 - DNA, 31 bp, Artificial Sequence
  Description of Artificial Sequence: Synthetic oligonucleotide
tctgcccagaacaagatgctgagtggcattg

SEQ ID NO: 61306 - DNA, 30 bp, Artificial Sequence
  Description of Artificial Sequence: Synthetic oligonucleotide
ctgcccagaacaagatgctgagtggcattg

SEQ ID NO: 61307 - DNA, 30 bp, Artificial Sequence
  Description of Artificial Sequence: Synthetic oligonucleotide
tgcccagaacaagatgctgagtggcattgg

SEQ ID NO: 61308 - DNA, 29 bp, Artificial Sequence
  Description of Artificial Sequence: Synthetic oligonucleotide
gcccagaacaagatgctgagtggcattgg

SEQ ID NO: 61309 - DNA, 30 bp, Artificial Sequence
  Description of Artificial Sequence: Synthetic oligonucleotide
cccagaacaagatgctgagtggcattggag

SEQ ID NO: 61310 - DNA, 30 bp, Artificial Sequence
  Description of Artificial Sequence: Synthetic oligonucleotide
ccagaacaagatgctgagtggcattggagg

SEQ ID NO: 61311 - DNA, 30 bp, Artificial Sequence
  Description of Artificial Sequence: Synthetic oligonucleotide
cagaacaagatgctgagtggcattggaggc

SEQ ID NO: 61312 - DNA, 32 bp, Artificial Sequence
  Description of Artificial Sequence: Synthetic oligonucleotide
agaacaagatgctgagtggcattggaggcttc

SEQ ID NO: 61313 - DNA, 31 bp, Artificial Sequence
  Description of Artificial Sequence: Synthetic oligonucleotide
gaacaagatgctgagtggcattggaggcttc

SEQ ID NO: 61314 - DNA, 31 bp, Artificial Sequence
  Description of Artificial Sequence: Synthetic oligonucleotide
aacaagatgctgagtggcattggaggcttcg

SEQ ID NO: 61315 - DNA, 30 bp, Artificial Sequence
  Description of Artificial Sequence: Synthetic oligonucleotide
acaagatgctgagtggcattggaggcttcg

SEQ ID NO: 61316 - DNA, 26 bp, Artificial Sequence
  Description of Artificial Sequence: Synthetic oligonucleotide
cttcctcgggctgggccttatcatcc

SEQ ID NO: 61317 - DNA, 27 bp, Artificial Sequence
  Description of Artificial Sequence: Synthetic oligonucleotide
ttcctcgggctgggccttatcatccgt

SEQ ID NO: 61318 - DNA, 26 bp, Artificial Sequence
  Description of Artificial Sequence: Synthetic oligonucleotide
tcctcgggctgggccttatcatccgt

SEQ ID NO: 61319 - DNA, 25 bp, Artificial Sequence
  Description of Artificial Sequence: Synthetic oligonucleotide
cctcgggctgggccttatcatccgt

SEQ ID NO: 61320 - DNA, 27 bp, Artificial Sequence
  Description of Artificial Sequence: Synthetic oligonucleotide
ctcgggctgggccttatcatccgtcaa

SEQ ID NO: 61321 - DNA, 28 bp, Artificial Sequence
  Description of Artificial Sequence: Synthetic oligonucleotide
tcgggctgggccttatcatccgtcaaag

SEQ ID NO: 61322 - DNA, 27 bp, Artificial Sequence
  Description of Artificial Sequence: Synthetic oligonucleotide
cgggctgggccttatcatccgtcaaag

SEQ ID NO: 61323 - DNA, 27 bp, Artificial Sequence
  Description of Artificial Sequence: Synthetic oligonucleotide
gggctgggccttatcatccgtcaaagg

SEQ ID NO: 61324 - DNA, 28 bp, Artificial Sequence
  Description of Artificial Sequence: Synthetic oligonucleotide
ggctgggccttatcatccgtcaaaggag

SEQ ID NO: 61325 - DNA, 29 bp, Artificial Sequence
  Description of Artificial Sequence: Synthetic oligonucleotide
gctgggccttatcatccgtcaaaggagtc

SEQ ID NO: 61326 - DNA, 30 bp, Artificial Sequence
  Description of Artificial Sequence: Synthetic oligonucleotide
ctgggccttatcatccgtcaaaggagtcag

SEQ ID NO: 61327 - DNA, 33 bp, Artificial Sequence
  Description of Artificial Sequence: Synthetic oligonucleotide
tgggccttatcatccgtcaaaggagtcagaaag

SEQ ID NO: 61328 - DNA, 32 bp, Artificial Sequence
  Description of Artificial Sequence: Synthetic oligonucleotide
gggccttatcatccgtcaaaggagtcagaaag

SEQ ID NO: 61329 - DNA, 32 bp, Artificial Sequence
  Description of Artificial Sequence: Synthetic oligonucleotide
ggccttatcatccgtcaaaggagtcagaaagg

SEQ ID NO: 61330 - DNA, 33 bp, Artificial Sequence
  Description of Artificial Sequence: Synthetic oligonucleotide
gccttatcatccgtcaaaggagtcagaaaggac

SEQ ID NO: 61331 - DNA, 33 bp, Artificial Sequence
  Description of Artificial Sequence: Synthetic oligonucleotide
ccttatcatccgtcaaaggagtcagaaaggacc

SEQ ID NO: 61332 - DNA, 34 bp, Artificial Sequence
  Description of Artificial Sequence: Synthetic oligonucleotide
cttatcatccgtcaaaggagtcagaaaggacctc

SEQ ID NO: 61333 - DNA, 36 bp, Artificial Sequence
  Description of Artificial Sequence: Synthetic oligonucleotide
ttatcatccgtcaaaggagtcagaaaggacctcaag

SEQ ID NO: 61334 - DNA, 35 bp, Artificial Sequence
  Description of Artificial Sequence: Synthetic oligonucleotide
tatcatccgtcaaaggagtcagaaaggacctcaag

SEQ ID NO: 61335 - DNA, 34 bp, Artificial Sequence
  Description of Artificial Sequence: Synthetic oligonucleotide
atcatccgtcaaaggagtcagaaaggacctcaag

SEQ ID NO: 61336 - DNA, 33 bp, Artificial Sequence
  Description of Artificial Sequence: Synthetic oligonucleotide
tcatccgtcaaaggagtcagaaaggacctcaag

SEQ ID NO: 61337 - DNA, 32 bp, Artificial Sequence
  Description of Artificial Sequence: Synthetic oligonucleotide
catccgtcaaaggagtcagaaaggacctcaag

SEQ ID NO: 61338 - DNA, 32 bp, Artificial Sequence
  Description of Artificial Sequence: Synthetic oligonucleotide
atccgtcaaaggagtcagaaaggacctcaagg

SEQ ID NO: 61339 - DNA, 31 bp, Artificial Sequence
  Description of Artificial Sequence: Synthetic oligonucleotide
tccgtcaaaggagtcagaaaggacctcaagg

SEQ ID NO: 61340 - DNA, 30 bp, Artificial Sequence
  Description of Artificial Sequence: Synthetic oligonucleotide
ccgtcaaaggagtcagaaaggacctcaagg

SEQ ID NO: 61341 - DNA, 30 bp, Artificial Sequence
  Description of Artificial Sequence: Synthetic oligonucleotide
cgtcaaaggagtcagaaaggacctcaaggg

SEQ ID NO: 61342 - DNA, 30 bp, Artificial Sequence
  Description of Artificial Sequence: Synthetic oligonucleotide
gtcaaaggagtcagaaaggacctcaagggc

SEQ ID NO: 61343 - DNA, 30 bp, Artificial Sequence
  Description of Artificial Sequence: Synthetic oligonucleotide
tcaaaggagtcagaaaggacctcaagggcc

SEQ ID NO: 61344 - DNA, 29 bp, Artificial Sequence
  Description of Artificial Sequence: Synthetic oligonucleotide
caaaggagtcagaaaggacctcaagggcc

SEQ ID NO: 61345 - DNA, 30 bp, Artificial Sequence
  Description of Artificial Sequence: Synthetic oligonucleotide
aaaggagtcagaaaggacctcaagggcctc

SEQ ID NO: 61346 - DNA, 29 bp, Artificial Sequence
  Description of Artificial Sequence: Synthetic oligonucleotide
aaggagtcagaaaggacctcaagggcctc

SEQ ID NO: 61347 - DNA, 28 bp, Artificial Sequence
  Description of Artificial Sequence: Synthetic oligonucleotide
aggagtcagaaaggacctcaagggcctc

SEQ ID NO: 61348 - DNA, 27 bp, Artificial Sequence
  Description of Artificial Sequence: Synthetic oligonucleotide
ggagtcagaaaggacctcaagggcctc

SEQ ID NO: 61349 - DNA, 27 bp, Artificial Sequence
  Description of Artificial Sequence: Synthetic oligonucleotide
gagtcagaaaggacctcaagggcctcc

SEQ ID NO: 61350 - DNA, 28 bp, Artificial Sequence
  Description of Artificial Sequence: Synthetic oligonucleotide
agtcagaaaggacctcaagggcctccac

SEQ ID NO: 61351 - DNA, 27 bp, Artificial Sequence
  Description of Artificial Sequence: Synthetic oligonucleotide
gtcagaaaggacctcaagggcctccac

SEQ ID NO: 61352 - DNA, 27 bp, Artificial Sequence
  Description of Artificial Sequence: Synthetic oligonucleotide
tcagaaaggacctcaagggcctccacc

SEQ ID NO: 61353 - DNA, 27 bp, Artificial Sequence
  Description of Artificial Sequence: Synthetic oligonucleotide
cagaaaggacctcaagggcctccacca

SEQ ID NO: 61354 - DNA, 27 bp, Artificial Sequence
  Description of Artificial Sequence: Synthetic oligonucleotide
agaaaggacctcaagggcctccaccag

SEQ ID NO: 61355 - DNA, 23 bp, Artificial Sequence
  Description of Artificial Sequence: Synthetic oligonucleotide
tgggggtgtatcgggcggtgacc

SEQ ID NO: 61356 - DNA, 22 bp, Artificial Sequence
  Description of Artificial Sequence: Synthetic oligonucleotide
gggggtgtatcgggcggtgacc

SEQ ID NO: 61357 - DNA, 22 bp, Artificial Sequence
  Description of Artificial Sequence: Synthetic oligonucleotide
ggggtgtatcgggcggtgaccc

SEQ ID NO: 61358 - DNA, 22 bp, Artificial Sequence
  Description of Artificial Sequence: Synthetic oligonucleotide
gggtgtatcgggcggtgacccc

SEQ ID NO: 61359 - DNA, 22 bp, Artificial Sequence
  Description of Artificial Sequence: Synthetic oligonucleotide
ggtgtatcgggcggtgaccccg

SEQ ID NO: 61360 - DNA, 23 bp, Artificial Sequence
  Description of Artificial Sequence: Synthetic oligonucleotide
gtgtatcgggcggtgaccccgca

SEQ ID NO: 61361 - DNA, 23 bp, Artificial Sequence
  Description of Artificial Sequence: Synthetic oligonucleotide
tgtatcgggcggtgaccccgcag

SEQ ID NO: 61362 - DNA, 22 bp, Artificial Sequence
  Description of Artificial Sequence: Synthetic oligonucleotide
gtatcgggcggtgaccccgcag

SEQ ID NO: 61363 - DNA, 22 bp, Artificial Sequence
  Description of Artificial Sequence: Synthetic oligonucleotide
tatcgggcggtgaccccgcagg

SEQ ID NO: 61364 - DNA, 21 bp, Artificial Sequence
  Description of Artificial Sequence: Synthetic oligonucleotide
atcgggcggtgaccccgcagg

SEQ ID NO: 61365 - DNA, 20 bp, Artificial Sequence
  Description of Artificial Sequence: Synthetic oligonucleotide
tcgggcggtgaccccgcagg

SEQ ID NO: 61366 - DNA, 20 bp, Artificial Sequence
  Description of Artificial Sequence: Synthetic oligonucleotide
cgggcggtgaccccgcaggt

SEQ ID NO: 61367 - DNA, 20 bp, Artificial Sequence
  Description of Artificial Sequence: Synthetic oligonucleotide
gggcggtgaccccgcagggt

SEQ ID NO: 61368 - DNA, 20 bp, Artificial Sequence
  Description of Artificial Sequence: Synthetic oligonucleotide
ggcggtgaccccgcaggggt

SEQ ID NO: 61369 - DNA, 20 bp, Artificial Sequence
  Description of Artificial Sequence: Synthetic oligonucleotide
gcggtgaccccgcaggggct

SEQ ID NO: 61370 - DNA, 20 bp, Artificial Sequence
  Description of Artificial Sequence: Synthetic oligonucleotide
cggtgaccccgcaggggcgt

SEQ ID NO: 61371 - DNA, 20 bp, Artificial Sequence
  Description of Artificial Sequence: Synthetic oligonucleotide
ggtgaccccgcaggggcggt

SEQ ID NO: 61372 - DNA, 20 bp, Artificial Sequence
  Description of Artificial Sequence: Synthetic oligonucleotide
gtgaccccgcaggggcggct

SEQ ID NO: 61373 - DNA, 20 bp, Artificial Sequence
  Description of Artificial Sequence: Synthetic oligonucleotide
tgaccccgcaggggcggcct

SEQ ID NO: 61374 - DNA, 20 bp, Artificial Sequence
  Description of Artificial Sequence: Synthetic oligonucleotide
gaccccgcaggggcggcctt

SEQ ID NO: 61375 - DNA, 20 bp, Artificial Sequence
  Description of Artificial Sequence: Synthetic oligonucleotide
accccgcaggggcggcctga

SEQ ID NO: 61376 - DNA, 20 bp, Artificial Sequence
  Description of Artificial Sequence: Synthetic oligonucleotide
ccccgcaggggcggcctgat

SEQ ID NO: 61377 - DNA, 20 bp, Artificial Sequence
  Description of Artificial Sequence: Synthetic oligonucleotide
cccgcaggggcggcctgact

SEQ ID NO: 61378 - DNA, 31 bp, Artificial Sequence
  Description of Artificial Sequence: Synthetic oligonucleotide
aaagtccggtggtttcggaatgaccaggaag

SEQ ID NO: 61379 - DNA, 30 bp, Artificial Sequence
  Description of Artificial Sequence: Synthetic oligonucleotide
aagtccggtggtttcggaatgaccaggaag

SEQ ID NO: 61380 - DNA, 29 bp, Artificial Sequence
  Description of Artificial Sequence: Synthetic oligonucleotide
agtccggtggtttcggaatgaccaggaag

SEQ ID NO: 61381 - DNA, 28 bp, Artificial Sequence
  Description of Artificial Sequence: Synthetic oligonucleotide
gtccggtggtttcggaatgaccaggaag

SEQ ID NO: 61382 - DNA, 29 bp, Artificial Sequence
  Description of Artificial Sequence: Synthetic oligonucleotide
tccggtggtttcggaatgaccaggaagag

SEQ ID NO: 61383 - DNA, 28 bp, Artificial Sequence
  Description of Artificial Sequence: Synthetic oligonucleotide
ccggtggtttcggaatgaccaggaagag

SEQ ID NO: 61384 - DNA, 29 bp, Artificial Sequence
  Description of Artificial Sequence: Synthetic oligonucleotide
cggtggtttcggaatgaccaggaagagac

SEQ ID NO: 61385 - DNA, 30 bp, Artificial Sequence
  Description of Artificial Sequence: Synthetic oligonucleotide
ggtggtttcggaatgaccaggaagagacag

SEQ ID NO: 61386 - DNA, 30 bp, Artificial Sequence
  Description of Artificial Sequence: Synthetic oligonucleotide
gtggtttcggaatgaccaggaagagacagc

SEQ ID NO: 61387 - DNA, 31 bp, Artificial Sequence
  Description of Artificial Sequence: Synthetic oligonucleotide
tggtttcggaatgaccaggaagagacagctg

SEQ ID NO: 61388 - DNA, 30 bp, Artificial Sequence
  Description of Artificial Sequence: Synthetic oligonucleotide
ggtttcggaatgaccaggaagagacagctg

SEQ ID NO: 61389 - DNA, 30 bp, Artificial Sequence
  Description of Artificial Sequence: Synthetic oligonucleotide
gtttcggaatgaccaggaagagacagctgg

SEQ ID NO: 61390 - DNA, 30 bp, Artificial Sequence
  Description of Artificial Sequence: Synthetic oligonucleotide
tttcggaatgaccaggaagagacagctggc

SEQ ID NO: 61391 - DNA, 29 bp, Artificial Sequence
  Description of Artificial Sequence: Synthetic oligonucleotide
ttcggaatgaccaggaagagacagctggc

SEQ ID NO: 61392 - DNA, 28 bp, Artificial Sequence
  Description of Artificial Sequence: Synthetic oligonucleotide
tcggaatgaccaggaagagacagctggc

SEQ ID NO: 61393 - DNA, 27 bp, Artificial Sequence
  Description of Artificial Sequence: Synthetic oligonucleotide
cggaatgaccaggaagagacagctggc

SEQ ID NO: 61394 - DNA, 27 bp, Artificial Sequence
  Description of Artificial Sequence: Synthetic oligonucleotide
ggaatgaccaggaagagacagctggcg

SEQ ID NO: 61395 - DNA, 29 bp, Artificial Sequence
  Description of Artificial Sequence: Synthetic oligonucleotide
gaatgaccaggaagagacagctggcgttg

SEQ ID NO: 61396 - DNA, 30 bp, Artificial Sequence
  Description of Artificial Sequence: Synthetic oligonucleotide
aatgaccaggaagagacagctggcgttgtg

SEQ ID NO: 61397 - DNA, 29 bp, Artificial Sequence
  Description of Artificial Sequence: Synthetic oligonucleotide
atgaccaggaagagacagctggcgttgtg

SEQ ID NO: 61398 - DNA, 28 bp, Artificial Sequence
  Description of Artificial Sequence: Synthetic oligonucleotide
tgaccaggaagagacagctggcgttgtg

SEQ ID NO: 61399 - DNA, 27 bp, Artificial Sequence
  Description of Artificial Sequence: Synthetic oligonucleotide
gaccaggaagagacagctggcgttgtg

SEQ ID NO: 61400 - DNA, 28 bp, Artificial Sequence
  Description of Artificial Sequence: Synthetic oligonucleotide
accaggaagagacagctggcgttgtgtc

SEQ ID NO: 61401 - DNA, 27 bp, Artificial Sequence
  Description of Artificial Sequence: Synthetic oligonucleotide
ccaggaagagacagctggcgttgtgtc

SEQ ID NO: 61402 - DNA, 27 bp, Artificial Sequence
  Description of Artificial Sequence: Synthetic oligonucleotide
caggaagagacagctggcgttgtgtcc

SEQ ID NO: 61403 - DNA, 28 bp, Artificial Sequence
  Description of Artificial Sequence: Synthetic oligonucleotide
aggaagagacagctggcgttgtgtccac

SEQ ID NO: 61404 - DNA, 27 bp, Artificial Sequence
  Description of Artificial Sequence: Synthetic oligonucleotide
ggaagagacagctggcgttgtgtccac

SEQ ID NO: 61405 - DNA, 27 bp, Artificial Sequence
  Description of Artificial Sequence: Synthetic oligonucleotide
gaagagacagctggcgttgtgtccacc

SEQ ID NO: 61406 - DNA, 27 bp, Artificial Sequence
  Description of Artificial Sequence: Synthetic oligonucleotide
aagagacagctggcgttgtgtccaccc

SEQ ID NO: 61407 - DNA, 26 bp, Artificial Sequence
  Description of Artificial Sequence: Synthetic oligonucleotide
agagacagctggcgttgtgtccaccc

SEQ ID NO: 61408 - DNA, 33 bp, Artificial Sequence
  Description of Artificial Sequence: Synthetic oligonucleotide
cagtttaaggccatgtgctacttcaccaatggc

SEQ ID NO: 61409 - DNA, 34 bp, Artificial Sequence
  Description of Artificial Sequence: Synthetic oligonucleotide
agtttaaggccatgtgctacttcaccaatggcac

SEQ ID NO: 61410 - DNA, 33 bp, Artificial Sequence
  Description of Artificial Sequence: Synthetic oligonucleotide
gtttaaggccatgtgctacttcaccaatggcac

SEQ ID NO: 61411 - DNA, 33 bp, Artificial Sequence
  Description of Artificial Sequence: Synthetic oligonucleotide
tttaaggccatgtgctacttcaccaatggcacg

SEQ ID NO: 61412 - DNA, 32 bp, Artificial Sequence
  Description of Artificial Sequence: Synthetic oligonucleotide
ttaaggccatgtgctacttcaccaatggcacg

SEQ ID NO: 61413 - DNA, 31 bp, Artificial Sequence
  Description of Artificial Sequence: Synthetic oligonucleotide
taaggccatgtgctacttcaccaatggcacg

SEQ ID NO: 61414 - DNA, 30 bp, Artificial Sequence
  Description of Artificial Sequence: Synthetic oligonucleotide
aaggccatgtgctacttcaccaatggcacg

SEQ ID NO: 61415 - DNA, 29 bp, Artificial Sequence
  Description of Artificial Sequence: Synthetic oligonucleotide
aggccatgtgctacttcaccaatggcacg

SEQ ID NO: 61416 - DNA, 28 bp, Artificial Sequence
  Description of Artificial Sequence: Synthetic oligonucleotide
ggccatgtgctacttcaccaatggcacg

SEQ ID NO: 61417 - DNA, 28 bp, Artificial Sequence
  Description of Artificial Sequence: Synthetic oligonucleotide
gccatgtgctacttcaccaatggcacgg

SEQ ID NO: 61418 - DNA, 29 bp, Artificial Sequence
  Description of Artificial Sequence: Synthetic oligonucleotide
ccatgtgctacttcaccaatggcacggag

SEQ ID NO: 61419 - DNA, 29 bp, Artificial Sequence
  Description of Artificial Sequence: Synthetic oligonucleotide
catgtgctacttcaccaatggcacggagc

SEQ ID NO: 61420 - DNA, 29 bp, Artificial Sequence
  Description of Artificial Sequence: Synthetic oligonucleotide
atgtgctacttcaccaatggcacggagcg

SEQ ID NO: 61421 - DNA, 28 bp, Artificial Sequence
  Description of Artificial Sequence: Synthetic oligonucleotide
tgtgctacttcaccaatggcacggagcg

SEQ ID NO: 61422 - DNA, 27 bp, Artificial Sequence
  Description of Artificial Sequence: Synthetic oligonucleotide
gtgctacttcaccaatggcacggagcg

SEQ ID NO: 61423 - DNA, 27 bp, Artificial Sequence
  Description of Artificial Sequence: Synthetic oligonucleotide
tgctacttcaccaatggcacggagcgc

SEQ ID NO: 61424 - DNA, 26 bp, Artificial Sequence
  Description of Artificial Sequence: Synthetic oligonucleotide
gctacttcaccaatggcacggagcgc

SEQ ID NO: 61425 - DNA, 27 bp, Artificial Sequence
  Description of Artificial Sequence: Synthetic oligonucleotide
ctacttcaccaatggcacggagcgcgt

SEQ ID NO: 61426 - DNA, 27 bp, Artificial Sequence
  Description of Artificial Sequence: Synthetic oligonucleotide
tacttcaccaatggcacggagcgcgtg

SEQ ID NO: 61427 - DNA, 26 bp, Artificial Sequence
  Description of Artificial Sequence: Synthetic oligonucleotide
acttcaccaatggcacggagcgcgtg

SEQ ID NO: 61428 - DNA, 25 bp, Artificial Sequence
  Description of Artificial Sequence: Synthetic oligonucleotide
cttcaccaatggcacggagcgcgtg

SEQ ID NO: 61429 - DNA, 25 bp, Artificial Sequence
  Description of Artificial Sequence: Synthetic oligonucleotide
ttcaccaatggcacggagcgcgtgc

SEQ ID NO: 61430 - DNA, 24 bp, Artificial Sequence
  Description of Artificial Sequence: Synthetic oligonucleotide
tcaccaatggcacggagcgcgtgc

SEQ ID NO: 61431 - DNA, 23 bp, Artificial Sequence
  Description of Artificial Sequence: Synthetic oligonucleotide
caccaatggcacggagcgcgtgc

SEQ ID NO: 61432 - DNA, 27 bp, Artificial Sequence
  Description of Artificial Sequence: Synthetic oligonucleotide
accaatggcacggagcgcgtgcgttat

SEQ ID NO: 61433 - DNA, 26 bp, Artificial Sequence
  Description of Artificial Sequence: Synthetic oligonucleotide
ccaatggcacggagcgcgtgcgttat

SEQ ID NO: 61434 - DNA, 27 bp, Artificial Sequence
  Description of Artificial Sequence: Synthetic oligonucleotide
caatggcacggagcgcgtgcgttatgt

SEQ ID NO: 61435 - DNA, 27 bp, Artificial Sequence
  Description of Artificial Sequence: Synthetic oligonucleotide
aatggcacggagcgcgtgcgttatgtg

SEQ ID NO: 61436 - DNA, 27 bp, Artificial Sequence
  Description of Artificial Sequence: Synthetic oligonucleotide
atggcacggagcgcgtgcgttatgtga

SEQ ID NO: 61437 - DNA, 26 bp, Artificial Sequence
  Description of Artificial Sequence: Synthetic oligonucleotide
tggcacggagcgcgtgcgttatgtga

SEQ ID NO: 61438 - DNA, 25 bp, Artificial Sequence
  Description of Artificial Sequence: Synthetic oligonucleotide
ggcacggagcgcgtgcgttatgtga

SEQ ID NO: 61439 - DNA, 25 bp, Artificial Sequence
  Description of Artificial Sequence: Synthetic oligonucleotide
gcacggagcgcgtgcgttatgtgac

SEQ ID NO: 61440 - DNA, 26 bp, Artificial Sequence
  Description of Artificial Sequence: Synthetic oligonucleotide
cacggagcgcgtgcgttatgtgacca

SEQ ID NO: 61441 - DNA, 26 bp, Artificial Sequence
  Description of Artificial Sequence: Synthetic oligonucleotide
gttccgcgggatcttgcagaggagag

SEQ ID NO: 61442 - DNA, 30 bp, Artificial Sequence
  Description of Artificial Sequence: Synthetic oligonucleotide
atgtcttggaagaaggctttgcggatcccc

SEQ ID NO: 61443 - DNA, 29 bp, Artificial Sequence
  Description of Artificial Sequence: Synthetic oligonucleotide
tgtcttggaagaaggctttgcggatcccc

SEQ ID NO: 61444 - DNA, 28 bp, Artificial Sequence
  Description of Artificial Sequence: Synthetic oligonucleotide
gtcttggaagaaggctttgcggatcccc

SEQ ID NO: 61445 - DNA, 28 bp, Artificial Sequence
  Description of Artificial Sequence: Synthetic oligonucleotide
tcttggaagaaggctttgcggatccccg

SEQ ID NO: 61446 - DNA, 27 bp, Artificial Sequence
  Description of Artificial Sequence: Synthetic oligonucleotide
cttggaagaaggctttgcggatccccg

SEQ ID NO: 61447 - DNA, 27 bp, Artificial Sequence
  Description of Artificial Sequence: Synthetic oligonucleotide
ttggaagaaggctttgcggatccccgg

SEQ ID NO: 61448 - DNA, 27 bp, Artificial Sequence
  Description of Artificial Sequence: Synthetic oligonucleotide
tggaagaaggctttgcggatccccgga

SEQ ID NO: 61449 - DNA, 26 bp, Artificial Sequence
  Description of Artificial Sequence: Synthetic oligonucleotide
ggaagaaggctttgcggatccccgga

SEQ ID NO: 61450 - DNA, 27 bp, Artificial Sequence
  Description of Artificial Sequence: Synthetic oligonucleotide
gaagaaggctttgcggatccccggaga

SEQ ID NO: 61451 - DNA, 27 bp, Artificial Sequence
  Description of Artificial Sequence: Synthetic oligonucleotide
aagaaggctttgcggatccccggagac

SEQ ID NO: 61452 - DNA, 26 bp, Artificial Sequence
  Description of Artificial Sequence: Synthetic oligonucleotide
agaaggctttgcggatccccggagac

SEQ ID NO: 61453 - DNA, 25 bp, Artificial Sequence
  Description of Artificial Sequence: Synthetic oligonucleotide
gaaggctttgcggatccccggagac

SEQ ID NO: 61454 - DNA, 27 bp, Artificial Sequence
  Description of Artificial Sequence: Synthetic oligonucleotide
aaggctttgcggatccccggagacctt

SEQ ID NO: 61455 - DNA, 26 bp, Artificial Sequence
  Description of Artificial Sequence: Synthetic oligonucleotide
aggctttgcggatccccggagacctt

SEQ ID NO: 61456 - DNA, 25 bp, Artificial Sequence
  Description of Artificial Sequence: Synthetic oligonucleotide
ggctttgcggatccccggagacctt

SEQ ID NO: 61457 - DNA, 25 bp, Artificial Sequence
  Description of Artificial Sequence: Synthetic oligonucleotide
gctttgcggatccccggagaccttc

SEQ ID NO: 61458 - DNA, 30 bp, Artificial Sequence
  Description of Artificial Sequence: Synthetic oligonucleotide
gtagcaactgtcaccttgatgctggcgatg

SEQ ID NO: 61459 - DNA, 30 bp, Artificial Sequence
  Description of Artificial Sequence: Synthetic oligonucleotide
tagcaactgtcaccttgatgctggcgatgc

SEQ ID NO: 61460 - DNA, 29 bp, Artificial Sequence
  Description of Artificial Sequence: Synthetic oligonucleotide
agcaactgtcaccttgatgctggcgatgc

SEQ ID NO: 61461 - DNA, 28 bp, Artificial Sequence
  Description of Artificial Sequence: Synthetic oligonucleotide
gcaactgtcaccttgatgctggcgatgc

SEQ ID NO: 61462 - DNA, 29 bp, Artificial Sequence
  Description of Artificial Sequence: Synthetic oligonucleotide
caactgtcaccttgatgctggcgatgctg

SEQ ID NO: 61463 - DNA, 30 bp, Artificial Sequence
  Description of Artificial Sequence: Synthetic oligonucleotide
aactgtcaccttgatgctggcgatgctgag

SEQ ID NO: 61464 - DNA, 29 bp, Artificial Sequence
  Description of Artificial Sequence: Synthetic oligonucleotide
actgtcaccttgatgctggcgatgctgag

SEQ ID NO: 61465 - DNA, 28 bp, Artificial Sequence
  Description of Artificial Sequence: Synthetic oligonucleotide
ctgtcaccttgatgctggcgatgctgag

SEQ ID NO: 61466 - DNA, 28 bp, Artificial Sequence
  Description of Artificial Sequence: Synthetic oligonucleotide
tgtcaccttgatgctggcgatgctgagc

SEQ ID NO: 61467 - DNA, 27 bp, Artificial Sequence
  Description of Artificial Sequence: Synthetic oligonucleotide
gtcaccttgatgctggcgatgctgagc

SEQ ID NO: 61468 - DNA, 28 bp, Artificial Sequence
  Description of Artificial Sequence: Synthetic oligonucleotide
tcaccttgatgctggcgatgctgagctc

SEQ ID NO: 61469 - DNA, 27 bp, Artificial Sequence
  Description of Artificial Sequence: Synthetic oligonucleotide
caccttgatgctggcgatgctgagctc

SEQ ID NO: 61470 - DNA, 27 bp, Artificial Sequence
  Description of Artificial Sequence: Synthetic oligonucleotide
accttgatgctggcgatgctgagctcc

SEQ ID NO: 61471 - DNA, 26 bp, Artificial Sequence
  Description of Artificial Sequence: Synthetic oligonucleotide
ccttgatgctggcgatgctgagctcc

SEQ ID NO: 61472 - DNA, 27 bp, Artificial Sequence
  Description of Artificial Sequence: Synthetic oligonucleotide
cttgatgctggcgatgctgagctccct

SEQ ID NO: 61473 - DNA, 28 bp, Artificial Sequence
  Description of Artificial Sequence: Synthetic oligonucleotide
ttgatgctggcgatgctgagctccctac

SEQ ID NO: 61474 - DNA, 27 bp, Artificial Sequence
  Description of Artificial Sequence: Synthetic oligonucleotide
tgatgctggcgatgctgagctccctac

SEQ ID NO: 61475 - DNA, 27 bp, Artificial Sequence
  Description of Artificial Sequence: Synthetic oligonucleotide
gatgctggcgatgctgagctccctact

SEQ ID NO: 61476 - DNA, 27 bp, Artificial Sequence
  Description of Artificial Sequence: Synthetic oligonucleotide
atgctggcgatgctgagctccctactg

SEQ ID NO: 61477 - DNA, 26 bp, Artificial Sequence
  Description of Artificial Sequence: Synthetic oligonucleotide
tgctggcgatgctgagctccctactg

SEQ ID NO: 61478 - DNA, 25 bp, Artificial Sequence
  Description of Artificial Sequence: Synthetic oligonucleotide
gctggcgatgctgagctccctactg

SEQ ID NO: 61479 - DNA, 25 bp, Artificial Sequence
  Description of Artificial Sequence: Synthetic oligonucleotide
ctggcgatgctgagctccctactgg

SEQ ID NO: 61480 - DNA, 26 bp, Artificial Sequence
  Description of Artificial Sequence: Synthetic oligonucleotide
tggcgatgctgagctccctactggct

SEQ ID NO: 61481 - DNA, 25 bp, Artificial Sequence
  Description of Artificial Sequence: Synthetic oligonucleotide
ggcgatgctgagctccctactggct

SEQ ID NO: 61482 - DNA, 26 bp, Artificial Sequence
  Description of Artificial Sequence: Synthetic oligonucleotide
gcgatgctgagctccctactggctga

SEQ ID NO: 61483 - DNA, 26 bp, Artificial Sequence
  Description of Artificial Sequence: Synthetic oligonucleotide
cgatgctgagctccctactggctgag

SEQ ID NO: 61484 - DNA, 26 bp, Artificial Sequence
  Description of Artificial Sequence: Synthetic oligonucleotide
gatgctgagctccctactggctgagg

SEQ ID NO: 61485 - DNA, 26 bp, Artificial Sequence
  Description of Artificial Sequence: Synthetic oligonucleotide
atgctgagctccctactggctgaggg

SEQ ID NO: 61486 - DNA, 25 bp, Artificial Sequence
  Description of Artificial Sequence: Synthetic oligonucleotide
tgctgagctccctactggctgaggg

SEQ ID NO: 61487 - DNA, 24 bp, Artificial Sequence
  Description of Artificial Sequence: Synthetic oligonucleotide
gctgagctccctactggctgaggg

SEQ ID NO: 61488 - DNA, 25 bp, Artificial Sequence
  Description of Artificial Sequence: Synthetic oligonucleotide
ctgagctccctactggctgagggca

SEQ ID NO: 61489 - DNA, 26 bp, Artificial Sequence
  Description of Artificial Sequence: Synthetic oligonucleotide
tgagctccctactggctgagggcaga

SEQ ID NO: 61490 - DNA, 25 bp, Artificial Sequence
  Description of Artificial Sequence: Synthetic oligonucleotide
gagctccctactggctgagggcaga

SEQ ID NO: 61491 - DNA, 26 bp, Artificial Sequence
  Description of Artificial Sequence: Synthetic oligonucleotide
agctccctactggctgagggcagaga

SEQ ID NO: 61492 - DNA, 25 bp, Artificial Sequence
  Description of Artificial Sequence: Synthetic oligonucleotide
gctccctactggctgagggcagaga

SEQ ID NO: 61493 - DNA, 26 bp, Artificial Sequence
  Description of Artificial Sequence: Synthetic oligonucleotide
ctccctactggctgagggcagagact

SEQ ID NO: 61494 - DNA, 27 bp, Artificial Sequence
  Description of Artificial Sequence: Synthetic oligonucleotide
tccctactggctgagggcagagactct

SEQ ID NO: 61495 - DNA, 26 bp, Artificial Sequence
  Description of Artificial Sequence: Synthetic oligonucleotide
ccctactggctgagggcagagactct

SEQ ID NO: 61496 - DNA, 26 bp, Artificial Sequence
  Description of Artificial Sequence: Synthetic oligonucleotide
cctactggctgagggcagagactctc

SEQ ID NO: 61497 - DNA, 26 bp, Artificial Sequence
  Description of Artificial Sequence: Synthetic oligonucleotide
ctactggctgagggcagagactctcc

SEQ ID NO: 61498 - DNA, 26 bp, Artificial Sequence
  Description of Artificial Sequence: Synthetic oligonucleotide
tactggctgagggcagagactctccc

SEQ ID NO: 61499 - DNA, 33 bp, Artificial Sequence
  Description of Artificial Sequence: Synthetic oligonucleotide
accccccttattaggaatggtgactggactttc

SEQ ID NO: 61500 - DNA, 32 bp, Artificial Sequence
  Description of Artificial Sequence: Synthetic oligonucleotide
ccccccttattaggaatggtgactggactttc

SEQ ID NO: 61501 - DNA, 32 bp, Artificial Sequence
  Description of Artificial Sequence: Synthetic oligonucleotide
cccccttattaggaatggtgactggactttcc

SEQ ID NO: 61502 - DNA, 33 bp, Artificial Sequence
  Description of Artificial Sequence: Synthetic oligonucleotide
ccccttattaggaatggtgactggactttccag

SEQ ID NO: 61503 - DNA, 35 bp, Artificial Sequence
  Description of Artificial Sequence: Synthetic oligonucleotide
cccttattaggaatggtgactggactttccagatc

SEQ ID NO: 61504 - DNA, 35 bp, Artificial Sequence
  Description of Artificial Sequence: Synthetic oligonucleotide
ccttattaggaatggtgactggactttccagatcc

SEQ ID NO: 61505 - DNA, 36 bp, Artificial Sequence
  Description of Artificial Sequence: Synthetic oligonucleotide
cttattaggaatggtgactggactttccagatcctg

SEQ ID NO: 61506 - DNA, 36 bp, Artificial Sequence
  Description of Artificial Sequence: Synthetic oligonucleotide
ttattaggaatggtgactggactttccagatcctgg

SEQ ID NO: 61507 - DNA, 35 bp, Artificial Sequence
  Description of Artificial Sequence: Synthetic oligonucleotide
tattaggaatggtgactggactttccagatcctgg

SEQ ID NO: 61508 - DNA, 34 bp, Artificial Sequence
  Description of Artificial Sequence: Synthetic oligonucleotide
attaggaatggtgactggactttccagatcctgg

SEQ ID NO: 61509 - DNA, 33 bp, Artificial Sequence
  Description of Artificial Sequence: Synthetic oligonucleotide
ttaggaatggtgactggactttccagatcctgg

SEQ ID NO: 61510 - DNA, 32 bp, Artificial Sequence
  Description of Artificial Sequence: Synthetic oligonucleotide
taggaatggtgactggactttccagatcctgg

SEQ ID NO: 61511 - DNA, 31 bp, Artificial Sequence
  Description of Artificial Sequence: Synthetic oligonucleotide
aggaatggtgactggactttccagatcctgg

SEQ ID NO: 61512 - DNA, 30 bp, Artificial Sequence
  Description of Artificial Sequence: Synthetic oligonucleotide
ggaatggtgactggactttccagatcctgg

SEQ ID NO: 61513 - DNA, 31 bp, Artificial Sequence
  Description of Artificial Sequence: Synthetic oligonucleotide
gaatggtgactggactttccagatcctggtg

SEQ ID NO: 61514 - DNA, 33 bp, Artificial Sequence
  Description of Artificial Sequence: Synthetic oligonucleotide
aatggtgactggactttccagatcctggtgatg

SEQ ID NO: 61515 - DNA, 32 bp, Artificial Sequence
  Description of Artificial Sequence: Synthetic oligonucleotide
atggtgactggactttccagatcctggtgatg

SEQ ID NO: 61516 - DNA, 31 bp, Artificial Sequence
  Description of Artificial Sequence: Synthetic oligonucleotide
tggtgactggactttccagatcctggtgatg

SEQ ID NO: 61517 - DNA, 30 bp, Artificial Sequence
  Description of Artificial Sequence: Synthetic oligonucleotide
ggtgactggactttccagatcctggtgatg

SEQ ID NO: 61518 - DNA, 30 bp, Artificial Sequence
  Description of Artificial Sequence: Synthetic oligonucleotide
gtgactggactttccagatcctggtgatgc

SEQ ID NO: 61519 - DNA, 31 bp, Artificial Sequence
  Description of Artificial Sequence: Synthetic oligonucleotide
tgactggactttccagatcctggtgatgctg

SEQ ID NO: 61520 - DNA, 30 bp, Artificial Sequence
  Description of Artificial Sequence: Synthetic oligonucleotide
gactggactttccagatcctggtgatgctg

SEQ ID NO: 61521 - DNA, 30 bp, Artificial Sequence
  Description of Artificial Sequence: Synthetic oligonucleotide
actggactttccagatcctggtgatgctgg

SEQ ID NO: 61522 - DNA, 29 bp, Artificial Sequence
  Description of Artificial Sequence: Synthetic oligonucleotide
ctggactttccagatcctggtgatgctgg

SEQ ID NO: 61523 - DNA, 33 bp, Artificial Sequence
  Description of Artificial Sequence: Synthetic oligonucleotide
tggactttccagatcctggtgatgctggaaatg

SEQ ID NO: 61524 - DNA, 32 bp, Artificial Sequence
  Description of Artificial Sequence: Synthetic oligonucleotide
ggactttccagatcctggtgatgctggaaatg

SEQ ID NO: 61525 - DNA, 33 bp, Artificial Sequence
  Description of Artificial Sequence: Synthetic oligonucleotide
gactttccagatcctggtgatgctggaaatgac

SEQ ID NO: 61526 - DNA, 34 bp, Artificial Sequence
  Description of Artificial Sequence: Synthetic oligonucleotide
actttccagatcctggtgatgctggaaatgactc

SEQ ID NO: 61527 - DNA, 33 bp, Artificial Sequence
  Description of Artificial Sequence: Synthetic oligonucleotide
ctttccagatcctggtgatgctggaaatgactc

SEQ ID NO: 61528 - DNA, 33 bp, Artificial Sequence
  Description of Artificial Sequence: Synthetic oligonucleotide
tttccagatcctggtgatgctggaaatgactcc

SEQ ID NO: 61529 - DNA, 26 bp, Artificial Sequence
  Description of Artificial Sequence: Synthetic oligonucleotide
gtgctggggctgatcttccttgggct

SEQ ID NO: 61530 - DNA, 26 bp, Artificial Sequence
  Description of Artificial Sequence: Synthetic oligonucleotide
tgctggggctgatcttccttgggctg

SEQ ID NO: 61531 - DNA, 25 bp, Artificial Sequence
  Description of Artificial Sequence: Synthetic oligonucleotide
gctggggctgatcttccttgggctg

SEQ ID NO: 61532 - DNA, 25 bp, Artificial Sequence
  Description of Artificial Sequence: Synthetic oligonucleotide
ctggggctgatcttccttgggctgg

SEQ ID NO: 61533 - DNA, 25 bp, Artificial Sequence
  Description of Artificial Sequence: Synthetic oligonucleotide
tggggctgatcttccttgggctggg

SEQ ID NO: 61534 - DNA, 24 bp, Artificial Sequence
  Description of Artificial Sequence: Synthetic oligonucleotide
ggggctgatcttccttgggctggg

SEQ ID NO: 61535 - DNA, 24 bp, Artificial Sequence
  Description of Artificial Sequence: Synthetic oligonucleotide
gggctgatcttccttgggctgggc

SEQ ID NO: 61536 - DNA, 27 bp, Artificial Sequence
  Description of Artificial Sequence: Synthetic oligonucleotide
ggctgatcttccttgggctgggcctta

SEQ ID NO: 61537 - DNA, 28 bp, Artificial Sequence
  Description of Artificial Sequence: Synthetic oligonucleotide
gctgatcttccttgggctgggccttatc

SEQ ID NO: 61538 - DNA, 30 bp, Artificial Sequence
  Description of Artificial Sequence: Synthetic oligonucleotide
ctgatcttccttgggctgggccttatcatc

SEQ ID NO: 61539 - DNA, 30 bp, Artificial Sequence
  Description of Artificial Sequence: Synthetic oligonucleotide
tgatcttccttgggctgggccttatcatcc

SEQ ID NO: 61540 - DNA, 29 bp, Artificial Sequence
  Description of Artificial Sequence: Synthetic oligonucleotide
gatcttccttgggctgggccttatcatcc

SEQ ID NO: 61541 - DNA, 29 bp, Artificial Sequence
  Description of Artificial Sequence: Synthetic oligonucleotide
atcttccttgggctgggccttatcatccg

SEQ ID NO: 61542 - DNA, 28 bp, Artificial Sequence
  Description of Artificial Sequence: Synthetic oligonucleotide
tcttccttgggctgggccttatcatccg

SEQ ID NO: 61543 - DNA, 27 bp, Artificial Sequence
  Description of Artificial Sequence: Synthetic oligonucleotide
cttccttgggctgggccttatcatccg

SEQ ID NO: 61544 - DNA, 28 bp, Artificial Sequence
  Description of Artificial Sequence: Synthetic oligonucleotide
ttccttgggctgggccttatcatccgtc

SEQ ID NO: 61545 - DNA, 27 bp, Artificial Sequence
  Description of Artificial Sequence: Synthetic oligonucleotide
tccttgggctgggccttatcatccgtc

SEQ ID NO: 61546 - DNA, 27 bp, Artificial Sequence
  Description of Artificial Sequence: Synthetic oligonucleotide
ccttgggctgggccttatcatccgtca

SEQ ID NO: 61547 - DNA, 29 bp, Artificial Sequence
  Description of Artificial Sequence: Synthetic oligonucleotide
cttgggctgggccttatcatccgtcaaag

SEQ ID NO: 61548 - DNA, 29 bp, Artificial Sequence
  Description of Artificial Sequence: Synthetic oligonucleotide
ttgggctgggccttatcatccgtcaaagg

SEQ ID NO: 61549 - DNA, 28 bp, Artificial Sequence
  Description of Artificial Sequence: Synthetic oligonucleotide
tgggctgggccttatcatccgtcaaagg

SEQ ID NO: 61550 - DNA, 32 bp, Artificial Sequence
  Description of Artificial Sequence: Synthetic oligonucleotide
gccttatcatccgtcaaaggagtcagaaaggg

SEQ ID NO: 61551 - DNA, 32 bp, Artificial Sequence
  Description of Artificial Sequence: Synthetic oligonucleotide
ccttatcatccgtcaaaggagtcagaaagggc

SEQ ID NO: 61552 - DNA, 34 bp, Artificial Sequence
  Description of Artificial Sequence: Synthetic oligonucleotide
cttatcatccgtcaaaggagtcagaaagggcttc

SEQ ID NO: 61553 - DNA, 35 bp, Artificial Sequence
  Description of Artificial Sequence: Synthetic oligonucleotide
ttatcatccgtcaaaggagtcagaaagggcttctg

SEQ ID NO: 61554 - DNA, 34 bp, Artificial Sequence
  Description of Artificial Sequence: Synthetic oligonucleotide
tatcatccgtcaaaggagtcagaaagggcttctg

SEQ ID NO: 61555 - DNA, 33 bp, Artificial Sequence
  Description of Artificial Sequence: Synthetic oligonucleotide
atcatccgtcaaaggagtcagaaagggcttctg

SEQ ID NO: 61556 - DNA, 32 bp, Artificial Sequence
  Description of Artificial Sequence: Synthetic oligonucleotide
tcatccgtcaaaggagtcagaaagggcttctg

SEQ ID NO: 61557 - DNA, 31 bp, Artificial Sequence
  Description of Artificial Sequence: Synthetic oligonucleotide
catccgtcaaaggagtcagaaagggcttctg

SEQ ID NO: 61558 - DNA, 31 bp, Artificial Sequence
  Description of Artificial Sequence: Synthetic oligonucleotide
atccgtcaaaggagtcagaaagggcttctgc

SEQ ID NO: 61559 - DNA, 30 bp, Artificial Sequence
  Description of Artificial Sequence: Synthetic oligonucleotide
tccgtcaaaggagtcagaaagggcttctgc

SEQ ID NO: 61560 - DNA, 29 bp, Artificial Sequence
  Description of Artificial Sequence: Synthetic oligonucleotide
ccgtcaaaggagtcagaaagggcttctgc

SEQ ID NO: 61561 - DNA, 30 bp, Artificial Sequence
  Description of Artificial Sequence: Synthetic oligonucleotide
cgtcaaaggagtcagaaagggcttctgcac

SEQ ID NO: 61562 - DNA, 31 bp, Artificial Sequence
  Description of Artificial Sequence: Synthetic oligonucleotide
gtcaaaggagtcagaaagggcttctgcactg

SEQ ID NO: 61563 - DNA, 25 bp, Artificial Sequence
  Description of Artificial Sequence: Synthetic oligonucleotide
gggacggagcgcgtgcgtcttgtaa

SEQ ID NO: 61564 - DNA, 25 bp, Artificial Sequence
  Description of Artificial Sequence: Synthetic oligonucleotide
ggacggagcgcgtgcgtcttgtaac

SEQ ID NO: 61565 - DNA, 26 bp, Artificial Sequence
  Description of Artificial Sequence: Synthetic oligonucleotide
gacggagcgcgtgcgtcttgtaacca

SEQ ID NO: 61566 - DNA, 27 bp, Artificial Sequence
  Description of Artificial Sequence: Synthetic oligonucleotide
acggagcgcgtgcgtcttgtaaccaga

SEQ ID NO: 61567 - DNA, 26 bp, Artificial Sequence
  Description of Artificial Sequence: Synthetic oligonucleotide
cggagcgcgtgcgtcttgtaaccaga

SEQ ID NO: 61568 - DNA, 27 bp, Artificial Sequence
  Description of Artificial Sequence: Synthetic oligonucleotide
ggagcgcgtgcgtcttgtaaccagaca

SEQ ID NO: 61569 - DNA, 27 bp, Artificial Sequence
  Description of Artificial Sequence: Synthetic oligonucleotide
gagcgcgtgcgtcttgtaaccagacac

SEQ ID NO: 61570 - DNA, 29 bp, Artificial Sequence
  Description of Artificial Sequence: Synthetic oligonucleotide
agcgcgtgcgtcttgtaaccagacacatc

SEQ ID NO: 61571 - DNA, 28 bp, Artificial Sequence
  Description of Artificial Sequence: Synthetic oligonucleotide
gcgcgtgcgtcttgtaaccagacacatc

SEQ ID NO: 61572 - DNA, 33 bp, Artificial Sequence
  Description of Artificial Sequence: Synthetic oligonucleotide
cgcgtgcgtcttgtaaccagacacatctataac

SEQ ID NO: 61573 - DNA, 33 bp, Artificial Sequence
  Description of Artificial Sequence: Synthetic oligonucleotide
gcgtgcgtcttgtaaccagacacatctataacc

SEQ ID NO: 61574 - DNA, 33 bp, Artificial Sequence
  Description of Artificial Sequence: Synthetic oligonucleotide
cgtgcgtcttgtaaccagacacatctataaccg

SEQ ID NO: 61575 - DNA, 34 bp, Artificial Sequence
  Description of Artificial Sequence: Synthetic oligonucleotide
gtgcgtcttgtaaccagacacatctataaccgag

SEQ ID NO: 61576 - DNA, 35 bp, Artificial Sequence
  Description of Artificial Sequence: Synthetic oligonucleotide
tgcgtcttgtaaccagacacatctataaccgagag

SEQ ID NO: 61577 - DNA, 34 bp, Artificial Sequence
  Description of Artificial Sequence: Synthetic oligonucleotide
gcgtcttgtaaccagacacatctataaccgagag

SEQ ID NO: 61578 - DNA, 34 bp, Artificial Sequence
  Description of Artificial Sequence: Synthetic oligonucleotide
cgtcttgtaaccagacacatctataaccgagagg

SEQ ID NO: 61579 - DNA, 35 bp, Artificial Sequence
  Description of Artificial Sequence: Synthetic oligonucleotide
gtcttgtaaccagacacatctataaccgagaggag

SEQ ID NO: 61580 - DNA, 37 bp, Artificial Sequence
  Description of Artificial Sequence: Synthetic oligonucleotide
tcttgtaaccagacacatctataaccgagaggagtac

SEQ ID NO: 61581 - DNA, 36 bp, Artificial Sequence
  Description of Artificial Sequence: Synthetic oligonucleotide
cttgtaaccagacacatctataaccgagaggagtac

SEQ ID NO: 61582 - DNA, 36 bp, Artificial Sequence
  Description of Artificial Sequence: Synthetic oligonucleotide
ttgtaaccagacacatctataaccgagaggagtacg

SEQ ID NO: 61583 - DNA, 35 bp, Artificial Sequence
  Description of Artificial Sequence: Synthetic oligonucleotide
tgtaaccagacacatctataaccgagaggagtacg

SEQ ID NO: 61584 - DNA, 34 bp, Artificial Sequence
  Description of Artificial Sequence: Synthetic oligonucleotide
gtaaccagacacatctataaccgagaggagtacg

SEQ ID NO: 61585 - DNA, 34 bp, Artificial Sequence
  Description of Artificial Sequence: Synthetic oligonucleotide
taaccagacacatctataaccgagaggagtacgc

SEQ ID NO: 61586 - DNA, 33 bp, Artificial Sequence
  Description of Artificial Sequence: Synthetic oligonucleotide
aaccagacacatctataaccgagaggagtacgc

SEQ ID NO: 61587 - DNA, 32 bp, Artificial Sequence
  Description of Artificial Sequence: Synthetic oligonucleotide
cagacacatctataaccgagaggagtacgcac

SEQ ID NO: 61588 - DNA, 32 bp, Artificial Sequence
  Description of Artificial Sequence: Synthetic oligonucleotide
agacacatctataaccgagaggagtacgcacg

SEQ ID NO: 61589 - DNA, 31 bp, Artificial Sequence
  Description of Artificial Sequence: Synthetic oligonucleotide
gacacatctataaccgagaggagtacgcacg

SEQ ID NO: 61590 - DNA, 31 bp, Artificial Sequence
  Description of Artificial Sequence: Synthetic oligonucleotide
acacatctataaccgagaggagtacgcacgc

SEQ ID NO: 61591 - DNA, 30 bp, Artificial Sequence
  Description of Artificial Sequence: Synthetic oligonucleotide
cacatctataaccgagaggagtacgcacgc

SEQ ID NO: 61592 - DNA, 27 bp, Artificial Sequence
  Description of Artificial Sequence: Synthetic oligonucleotide
ggtgtgcagacacaactacgaggtggg

SEQ ID NO: 61593 - DNA, 27 bp, Artificial Sequence
  Description of Artificial Sequence: Synthetic oligonucleotide
gtgtgcagacacaactacgaggtgggg

SEQ ID NO: 61594 - DNA, 29 bp, Artificial Sequence
  Description of Artificial Sequence: Synthetic oligonucleotide
tgtgcagacacaactacgaggtggggtac

SEQ ID NO: 61595 - DNA, 28 bp, Artificial Sequence
  Description of Artificial Sequence: Synthetic oligonucleotide
gtgcagacacaactacgaggtggggtac

SEQ ID NO: 61596 - DNA, 28 bp, Artificial Sequence
  Description of Artificial Sequence: Synthetic oligonucleotide
tgcagacacaactacgaggtggggtacc

SEQ ID NO: 61597 - DNA, 27 bp, Artificial Sequence
  Description of Artificial Sequence: Synthetic oligonucleotide
gcagacacaactacgaggtggggtacc

SEQ ID NO: 61598 - DNA, 27 bp, Artificial Sequence
  Description of Artificial Sequence: Synthetic oligonucleotide
cagacacaactacgaggtggggtaccg

SEQ ID NO: 61599 - DNA, 27 bp, Artificial Sequence
  Description of Artificial Sequence: Synthetic oligonucleotide
agacacaactacgaggtggggtaccgc

SEQ ID NO: 61600 - DNA, 26 bp, Artificial Sequence
  Description of Artificial Sequence: Synthetic oligonucleotide
gacacaactacgaggtggggtaccgc

SEQ ID NO: 61601 - DNA, 26 bp, Artificial Sequence
  Description of Artificial Sequence: Synthetic oligonucleotide
acacaactacgaggtggggtaccgcg

SEQ ID NO: 61602 - DNA, 25 bp, Artificial Sequence
  Description of Artificial Sequence: Synthetic oligonucleotide
cacaactacgaggtggggtaccgcg

SEQ ID NO: 61603 - DNA, 25 bp, Artificial Sequence
  Description of Artificial Sequence: Synthetic oligonucleotide
acaactacgaggtggggtaccgcgg

SEQ ID NO: 61604 - DNA, 24 bp, Artificial Sequence
  Description of Artificial Sequence: Synthetic oligonucleotide
caactacgaggtggggtaccgcgg

SEQ ID NO: 61605 - DNA, 26 bp, Artificial Sequence
  Description of Artificial Sequence: Synthetic oligonucleotide
aactacgaggtggggtaccgcgggat

SEQ ID NO: 61606 - DNA, 25 bp, Artificial Sequence
  Description of Artificial Sequence: Synthetic oligonucleotide
actacgaggtggggtaccgcgggat

SEQ ID NO: 61607 - DNA, 24 bp, Artificial Sequence
  Description of Artificial Sequence: Synthetic oligonucleotide
ctacgaggtggggtaccgcgggat

SEQ ID NO: 61608 - DNA, 24 bp, Artificial Sequence
  Description of Artificial Sequence: Synthetic oligonucleotide
tacgaggtggggtaccgcgggatc

SEQ ID NO: 61609 - DNA, 23 bp, Artificial Sequence
  Description of Artificial Sequence: Synthetic oligonucleotide
acgaggtggggtaccgcgggatc

SEQ ID NO: 61610 - DNA, 22 bp, Artificial Sequence
  Description of Artificial Sequence: Synthetic oligonucleotide
cgaggtggggtaccgcgggatc

SEQ ID NO: 61611 - DNA, 23 bp, Artificial Sequence
  Description of Artificial Sequence: Synthetic oligonucleotide
gaggtggggtaccgcgggatcct

SEQ ID NO: 61612 - DNA, 23 bp, Artificial Sequence
  Description of Artificial Sequence: Synthetic oligonucleotide
aggtggggtaccgcgggatcctg

SEQ ID NO: 61613 - DNA, 22 bp, Artificial Sequence
  Description of Artificial Sequence: Synthetic oligonucleotide
ggtggggtaccgcgggatcctg

SEQ ID NO: 61614 - DNA, 23 bp, Artificial Sequence
  Description of Artificial Sequence: Synthetic oligonucleotide
gtggggtaccgcgggatcctgca

SEQ ID NO: 61615 - DNA, 24 bp, Artificial Sequence
  Description of Artificial Sequence: Synthetic oligonucleotide
tggggtaccgcgggatcctgcaga

SEQ ID NO: 61616 - DNA, 23 bp, Artificial Sequence
  Description of Artificial Sequence: Synthetic oligonucleotide
ggggtaccgcgggatcctgcaga

SEQ ID NO: 61617 - DNA, 23 bp, Artificial Sequence
  Description of Artificial Sequence: Synthetic oligonucleotide
gggtaccgcgggatcctgcagag

SEQ ID NO: 61618 - DNA, 24 bp, Artificial Sequence
  Description of Artificial Sequence: Synthetic oligonucleotide
ggtaccgcgggatcctgcagagga

SEQ ID NO: 61619 - DNA, 35 bp, Artificial Sequence
  Description of Artificial Sequence: Synthetic oligonucleotide
tgacagatttctatccaggccagatcaaagtccag

SEQ ID NO: 61620 - DNA, 34 bp, Artificial Sequence
  Description of Artificial Sequence: Synthetic oligonucleotide
gacagatttctatccaggccagatcaaagtccag

SEQ ID NO: 61621 - DNA, 35 bp, Artificial Sequence
  Description of Artificial Sequence: Synthetic oligonucleotide
acagatttctatccaggccagatcaaagtccagtg

SEQ ID NO: 61622 - DNA, 34 bp, Artificial Sequence
  Description of Artificial Sequence: Synthetic oligonucleotide
cagatttctatccaggccagatcaaagtccagtg

SEQ ID NO: 61623 - DNA, 34 bp, Artificial Sequence
  Description of Artificial Sequence: Synthetic oligonucleotide
agatttctatccaggccagatcaaagtccagtgg

SEQ ID NO: 61624 - DNA, 33 bp, Artificial Sequence
  Description of Artificial Sequence: Synthetic oligonucleotide
gatttctatccaggccagatcaaagtccagtgg

SEQ ID NO: 61625 - DNA, 36 bp, Artificial Sequence
  Description of Artificial Sequence: Synthetic oligonucleotide
atttctatccaggccagatcaaagtccagtggtttc

SEQ ID NO: 61626 - DNA, 35 bp, Artificial Sequence
  Description of Artificial Sequence: Synthetic oligonucleotide
tttctatccaggccagatcaaagtccagtggtttc

SEQ ID NO: 61627 - DNA, 34 bp, Artificial Sequence
  Description of Artificial Sequence: Synthetic oligonucleotide
ttctatccaggccagatcaaagtccagtggtttc

SEQ ID NO: 61628 - DNA, 33 bp, Artificial Sequence
  Description of Artificial Sequence: Synthetic oligonucleotide
tctatccaggccagatcaaagtccagtggtttc

SEQ ID NO: 61629 - DNA, 32 bp, Artificial Sequence
  Description of Artificial Sequence: Synthetic oligonucleotide
ctatccaggccagatcaaagtccagtggtttc

SEQ ID NO: 61630 - DNA, 32 bp, Artificial Sequence
  Description of Artificial Sequence: Synthetic oligonucleotide
tatccaggccagatcaaagtccagtggtttcg

SEQ ID NO: 61631 - DNA, 31 bp, Artificial Sequence
  Description of Artificial Sequence: Synthetic oligonucleotide
atccaggccagatcaaagtccagtggtttcg

SEQ ID NO: 61632 - DNA, 30 bp, Artificial Sequence
  Description of Artificial Sequence: Synthetic oligonucleotide
tccaggccagatcaaagtccagtggtttcg

SEQ ID NO: 61633 - DNA, 29 bp, Artificial Sequence
  Description of Artificial Sequence: Synthetic oligonucleotide
ccaggccagatcaaagtccagtggtttcg

SEQ ID NO: 61634 - DNA, 29 bp, Artificial Sequence
  Description of Artificial Sequence: Synthetic oligonucleotide
caggccagatcaaagtccagtggtttcgg

SEQ ID NO: 61635 - DNA, 32 bp, Artificial Sequence
  Description of Artificial Sequence: Synthetic oligonucleotide
aggccagatcaaagtccagtggtttcggaatg

SEQ ID NO: 61636 - DNA, 31 bp, Artificial Sequence
  Description of Artificial Sequence: Synthetic oligonucleotide
ggccagatcaaagtccagtggtttcggaatg

SEQ ID NO: 61637 - DNA, 33 bp, Artificial Sequence
  Description of Artificial Sequence: Synthetic oligonucleotide
gccagatcaaagtccagtggtttcggaatgatc

SEQ ID NO: 61638 - DNA, 34 bp, Artificial Sequence
  Description of Artificial Sequence: Synthetic oligonucleotide
ccagatcaaagtccagtggtttcggaatgatcag

SEQ ID NO: 61639 - DNA, 34 bp, Artificial Sequence
  Description of Artificial Sequence: Synthetic oligonucleotide
cagatcaaagtccagtggtttcggaatgatcagg

SEQ ID NO: 61640 - DNA, 35 bp, Artificial Sequence
  Description of Artificial Sequence: Synthetic oligonucleotide
agatcaaagtccagtggtttcggaatgatcaggag

SEQ ID NO: 61641 - DNA, 34 bp, Artificial Sequence
  Description of Artificial Sequence: Synthetic oligonucleotide
gatcaaagtccagtggtttcggaatgatcaggag

SEQ ID NO: 61642 - DNA, 34 bp, Artificial Sequence
  Description of Artificial Sequence: Synthetic oligonucleotide
atcaaagtccagtggtttcggaatgatcaggagg

SEQ ID NO: 61643 - DNA, 33 bp, Artificial Sequence
  Description of Artificial Sequence: Synthetic oligonucleotide
tcaaagtccagtggtttcggaatgatcaggagg

SEQ ID NO: 61644 - DNA, 32 bp, Artificial Sequence
  Description of Artificial Sequence: Synthetic oligonucleotide
caaagtccagtggtttcggaatgatcaggagg

SEQ ID NO: 61645 - DNA, 33 bp, Artificial Sequence
  Description of Artificial Sequence: Synthetic oligonucleotide
aaagtccagtggtttcggaatgatcaggaggag

SEQ ID NO: 61646 - DNA, 32 bp, Artificial Sequence
  Description of Artificial Sequence: Synthetic oligonucleotide
aagtccagtggtttcggaatgatcaggaggag

SEQ ID NO: 61647 - DNA, 31 bp, Artificial Sequence
  Description of Artificial Sequence: Synthetic oligonucleotide
agtccagtggtttcggaatgatcaggaggag

SEQ ID NO: 61648 - DNA, 30 bp, Artificial Sequence
  Description of Artificial Sequence: Synthetic oligonucleotide
gtccagtggtttcggaatgatcaggaggag

SEQ ID NO: 61649 - DNA, 31 bp, Artificial Sequence
  Description of Artificial Sequence: Synthetic oligonucleotide
tccagtggtttcggaatgatcaggaggagac

SEQ ID NO: 61650 - DNA, 30 bp, Artificial Sequence
  Description of Artificial Sequence: Synthetic oligonucleotide
ccagtggtttcggaatgatcaggaggagac

SEQ ID NO: 61651 - DNA, 31 bp, Artificial Sequence
  Description of Artificial Sequence: Synthetic oligonucleotide
cagtggtttcggaatgatcaggaggagacag

SEQ ID NO: 61652 - DNA, 31 bp, Artificial Sequence
  Description of Artificial Sequence: Synthetic oligonucleotide
agtggtttcggaatgatcaggaggagacagc

SEQ ID NO: 61653 - DNA, 22 bp, Artificial Sequence
  Description of Artificial Sequence: Synthetic oligonucleotide
gacccgggcggagttggacacc

SEQ ID NO: 61654 - DNA, 23 bp, Artificial Sequence
  Description of Artificial Sequence: Synthetic oligonucleotide
acccgggcggagttggacaccgt

SEQ ID NO: 61655 - DNA, 22 bp, Artificial Sequence
  Description of Artificial Sequence: Synthetic oligonucleotide
cccgggcggagttggacaccgt

SEQ ID NO: 61656 - DNA, 23 bp, Artificial Sequence
  Description of Artificial Sequence: Synthetic oligonucleotide
ccgggcggagttggacaccgtgt

SEQ ID NO: 61657 - DNA, 23 bp, Artificial Sequence
  Description of Artificial Sequence: Synthetic oligonucleotide
cgggcggagttggacaccgtgtg

SEQ ID NO: 61658 - DNA, 24 bp, Artificial Sequence
  Description of Artificial Sequence: Synthetic oligonucleotide
gggcggagttggacaccgtgtgca

SEQ ID NO: 61659 - DNA, 25 bp, Artificial Sequence
  Description of Artificial Sequence: Synthetic oligonucleotide
ggcggagttggacaccgtgtgcaga

SEQ ID NO: 61660 - DNA, 26 bp, Artificial Sequence
  Description of Artificial Sequence: Synthetic oligonucleotide
gcggagttggacaccgtgtgcagaca

SEQ ID NO: 61661 - DNA, 27 bp, Artificial Sequence
  Description of Artificial Sequence: Synthetic oligonucleotide
cggagttggacaccgtgtgcagacaca

SEQ ID NO: 61662 - DNA, 28 bp, Artificial Sequence
  Description of Artificial Sequence: Synthetic oligonucleotide
ggagttggacaccgtgtgcagacacaac

SEQ ID NO: 61663 - DNA, 30 bp, Artificial Sequence
  Description of Artificial Sequence: Synthetic oligonucleotide
gagttggacaccgtgtgcagacacaactac

SEQ ID NO: 61664 - DNA, 30 bp, Artificial Sequence
  Description of Artificial Sequence: Synthetic oligonucleotide
agttggacaccgtgtgcagacacaactacg

SEQ ID NO: 61665 - DNA, 29 bp, Artificial Sequence
  Description of Artificial Sequence: Synthetic oligonucleotide
gttggacaccgtgtgcagacacaactacg

SEQ ID NO: 61666 - DNA, 30 bp, Artificial Sequence
  Description of Artificial Sequence: Synthetic oligonucleotide
ttggacaccgtgtgcagacacaactacgag

SEQ ID NO: 61667 - DNA, 29 bp, Artificial Sequence
  Description of Artificial Sequence: Synthetic oligonucleotide
tggacaccgtgtgcagacacaactacgag

SEQ ID NO: 61668 - DNA, 28 bp, Artificial Sequence
  Description of Artificial Sequence: Synthetic oligonucleotide
ggacaccgtgtgcagacacaactacgag

SEQ ID NO: 61669 - DNA, 28 bp, Artificial Sequence
  Description of Artificial Sequence: Synthetic oligonucleotide
gacaccgtgtgcagacacaactacgagg

SEQ ID NO: 61670 - DNA, 29 bp, Artificial Sequence
  Description of Artificial Sequence: Synthetic oligonucleotide
acaccgtgtgcagacacaactacgaggtg

SEQ ID NO: 61671 - DNA, 28 bp, Artificial Sequence
  Description of Artificial Sequence: Synthetic oligonucleotide
caccgtgtgcagacacaactacgaggtg

SEQ ID NO: 61672 - DNA, 28 bp, Artificial Sequence
  Description of Artificial Sequence: Synthetic oligonucleotide
accgtgtgcagacacaactacgaggtgg

SEQ ID NO: 61673 - DNA, 27 bp, Artificial Sequence
  Description of Artificial Sequence: Synthetic oligonucleotide
ccgtgtgcagacacaactacgaggtgg

SEQ ID NO: 61674 - DNA, 27 bp, Artificial Sequence
  Description of Artificial Sequence: Synthetic oligonucleotide
cgtgtgcagacacaactacgaggtggg

SEQ ID NO: 61675 - DNA, 27 bp, Artificial Sequence
  Description of Artificial Sequence: Synthetic oligonucleotide
cggagcgcgtgcgtcttgtaaccagat

SEQ ID NO: 61676 - DNA, 28 bp, Artificial Sequence
  Description of Artificial Sequence: Synthetic oligonucleotide
ggagcgcgtgcgtcttgtaaccagatac

SEQ ID NO: 61677 - DNA, 30 bp, Artificial Sequence
  Description of Artificial Sequence: Synthetic oligonucleotide
gagcgcgtgcgtcttgtaaccagatacatc

SEQ ID NO: 61678 - DNA, 35 bp, Artificial Sequence
  Description of Artificial Sequence: Synthetic oligonucleotide
agcgcgtgcgtcttgtaaccagatacatctataac

SEQ ID NO: 61679 - DNA, 34 bp, Artificial Sequence
  Description of Artificial Sequence: Synthetic oligonucleotide
gcgcgtgcgtcttgtaaccagatacatctataac

SEQ ID NO: 61680 - DNA, 34 bp, Artificial Sequence
  Description of Artificial Sequence: Synthetic oligonucleotide
cgcgtgcgtcttgtaaccagatacatctataacc

SEQ ID NO: 61681 - DNA, 34 bp, Artificial Sequence
  Description of Artificial Sequence: Synthetic oligonucleotide
gcgtgcgtcttgtaaccagatacatctataaccg

SEQ ID NO: 61682 - DNA, 35 bp, Artificial Sequence
  Description of Artificial Sequence: Synthetic oligonucleotide
cgtgcgtcttgtaaccagatacatctataaccgag

SEQ ID NO: 61683 - DNA, 36 bp, Artificial Sequence
  Description of Artificial Sequence: Synthetic oligonucleotide
gtgcgtcttgtaaccagatacatctataaccgagag

SEQ ID NO: 61684 - DNA, 36 bp, Artificial Sequence
  Description of Artificial Sequence: Synthetic oligonucleotide
tgcgtcttgtaaccagatacatctataaccgagagg

SEQ ID NO: 61685 - DNA, 35 bp, Artificial Sequence
  Description of Artificial Sequence: Synthetic oligonucleotide
gcgtcttgtaaccagatacatctataaccgagagg

SEQ ID NO: 61686 - DNA, 36 bp, Artificial Sequence
  Description of Artificial Sequence: Synthetic oligonucleotide
cgtcttgtaaccagatacatctataaccgagaggag

SEQ ID NO: 61687 - DNA, 38 bp, Artificial Sequence
  Description of Artificial Sequence: Synthetic oligonucleotide
gtcttgtaaccagatacatctataaccgagaggagtac

SEQ ID NO: 61688 - DNA, 38 bp, Artificial Sequence
  Description of Artificial Sequence: Synthetic oligonucleotide
tcttgtaaccagatacatctataaccgagaggagtacg

SEQ ID NO: 61689 - DNA, 37 bp, Artificial Sequence
  Description of Artificial Sequence: Synthetic oligonucleotide
cttgtaaccagatacatctataaccgagaggagtacg

SEQ ID NO: 61690 - DNA, 37 bp, Artificial Sequence
  Description of Artificial Sequence: Synthetic oligonucleotide
ttgtaaccagatacatctataaccgagaggagtacgc

SEQ ID NO: 61691 - DNA, 36 bp, Artificial Sequence
  Description of Artificial Sequence: Synthetic oligonucleotide
tgtaaccagatacatctataaccgagaggagtacgc

SEQ ID NO: 61692 - DNA, 35 bp, Artificial Sequence
  Description of Artificial Sequence: Synthetic oligonucleotide
gtaaccagatacatctataaccgagaggagtacgc

SEQ ID NO: 61693 - DNA, 35 bp, Artificial Sequence
  Description of Artificial Sequence: Synthetic oligonucleotide
taaccagatacatctataaccgagaggagtacgcg

SEQ ID NO: 61694 - DNA, 34 bp, Artificial Sequence
  Description of Artificial Sequence: Synthetic oligonucleotide
aaccagatacatctataaccgagaggagtacgcg

SEQ ID NO: 61695 - DNA, 20 bp, Artificial Sequence
  Description of Artificial Sequence: Synthetic oligonucleotide
acgccgcaggggcggcctgt

SEQ ID NO: 61696 - DNA, 20 bp, Artificial Sequence
  Description of Artificial Sequence: Synthetic oligonucleotide
gccgcaggggcggcctgtct

SEQ ID NO: 61697 - DNA, 20 bp, Artificial Sequence
  Description of Artificial Sequence: Synthetic oligonucleotide
ccgcaggggcggcctgtcgt

SEQ ID NO: 61698 - DNA, 20 bp, Artificial Sequence
  Description of Artificial Sequence: Synthetic oligonucleotide
cgcaggggcggcctgtcgct

SEQ ID NO: 61699 - DNA, 20 bp, Artificial Sequence
  Description of Artificial Sequence: Synthetic oligonucleotide
gcaggggcggcctgtcgcct

SEQ ID NO: 61700 - DNA, 20 bp, Artificial Sequence
  Description of Artificial Sequence: Synthetic oligonucleotide
caggggcggcctgtcgccga

SEQ ID NO: 61701 - DNA, 22 bp, Artificial Sequence
  Description of Artificial Sequence: Synthetic oligonucleotide
aggggcggcctgtcgccgagta

SEQ ID NO: 61702 - DNA, 21 bp, Artificial Sequence
  Description of Artificial Sequence: Synthetic oligonucleotide
ggggcggcctgtcgccgagta

SEQ ID NO: 61703 - DNA, 22 bp, Artificial Sequence
  Description of Artificial Sequence: Synthetic oligonucleotide
gggcggcctgtcgccgagtact

SEQ ID NO: 61704 - DNA, 22 bp, Artificial Sequence
  Description of Artificial Sequence: Synthetic oligonucleotide
ggcggcctgtcgccgagtactg

SEQ ID NO: 61705 - DNA, 24 bp, Artificial Sequence
  Description of Artificial Sequence: Synthetic oligonucleotide
gcggcctgtcgccgagtactggaa

SEQ ID NO: 61706 - DNA, 25 bp, Artificial Sequence
  Description of Artificial Sequence: Synthetic oligonucleotide
cggcctgtcgccgagtactggaaca

SEQ ID NO: 61707 - DNA, 25 bp, Artificial Sequence
  Description of Artificial Sequence: Synthetic oligonucleotide
ggcctgtcgccgagtactggaacag

SEQ ID NO: 61708 - DNA, 25 bp, Artificial Sequence
  Description of Artificial Sequence: Synthetic oligonucleotide
gcctgtcgccgagtactggaacagc

SEQ ID NO: 61709 - DNA, 26 bp, Artificial Sequence
  Description of Artificial Sequence: Synthetic oligonucleotide
cctgtcgccgagtactggaacagcca

SEQ ID NO: 61710 - DNA, 27 bp, Artificial Sequence
  Description of Artificial Sequence: Synthetic oligonucleotide
ctgtcgccgagtactggaacagccaga

SEQ ID NO: 61711 - DNA, 28 bp, Artificial Sequence
  Description of Artificial Sequence: Synthetic oligonucleotide
tgtcgccgagtactggaacagccagaag

SEQ ID NO: 61712 - DNA, 27 bp, Artificial Sequence
  Description of Artificial Sequence: Synthetic oligonucleotide
gtcgccgagtactggaacagccagaag

SEQ ID NO: 61713 - DNA, 27 bp, Artificial Sequence
  Description of Artificial Sequence: Synthetic oligonucleotide
tcgccgagtactggaacagccagaagg

SEQ ID NO: 61714 - DNA, 21 bp, Artificial Sequence
  Description of Artificial Sequence: Synthetic oligonucleotide
tcctggagaggacccgggcgg

SEQ ID NO: 61715 - DNA, 20 bp, Artificial Sequence
  Description of Artificial Sequence: Synthetic oligonucleotide
cctggagaggacccgggcgg

SEQ ID NO: 61716 - DNA, 20 bp, Artificial Sequence
  Description of Artificial Sequence: Synthetic oligonucleotide
ctggagaggacccgggcggc

SEQ ID NO: 61717 - DNA, 20 bp, Artificial Sequence
  Description of Artificial Sequence: Synthetic oligonucleotide
tggagaggacccgggcggcg

SEQ ID NO: 61718 - DNA, 20 bp, Artificial Sequence
  Description of Artificial Sequence: Synthetic oligonucleotide
ggagaggacccgggcggcgt

SEQ ID NO: 61719 - DNA, 20 bp, Artificial Sequence
  Description of Artificial Sequence: Synthetic oligonucleotide
gagaggacccgggcggcggt

SEQ ID NO: 61720 - DNA, 20 bp, Artificial Sequence
  Description of Artificial Sequence: Synthetic oligonucleotide
agaggacccgggcggcggtg

SEQ ID NO: 61721 - DNA, 20 bp, Artificial Sequence
  Description of Artificial Sequence: Synthetic oligonucleotide
gaggacccgggcggcggtgt

SEQ ID NO: 61722 - DNA, 20 bp, Artificial Sequence
  Description of Artificial Sequence: Synthetic oligonucleotide
aggacccgggcggcggtgga

SEQ ID NO: 61723 - DNA, 20 bp, Artificial Sequence
  Description of Artificial Sequence: Synthetic oligonucleotide
ggacccgggcggcggtggat

SEQ ID NO: 61724 - DNA, 20 bp, Artificial Sequence
  Description of Artificial Sequence: Synthetic oligonucleotide
gacccgggcggcggtggaca

SEQ ID NO: 61725 - DNA, 20 bp, Artificial Sequence
  Description of Artificial Sequence: Synthetic oligonucleotide
acccgggcggcggtggacag

SEQ ID NO: 61726 - DNA, 20 bp, Artificial Sequence
  Description of Artificial Sequence: Synthetic oligonucleotide
cccgggcggcggtggacagt

SEQ ID NO: 61727 - DNA, 20 bp, Artificial Sequence
  Description of Artificial Sequence: Synthetic oligonucleotide
ccgggcggcggtggacaggt

SEQ ID NO: 61728 - DNA, 20 bp, Artificial Sequence
  Description of Artificial Sequence: Synthetic oligonucleotide
gggcggcggtggacagggtg

SEQ ID NO: 61729 - DNA, 22 bp, Artificial Sequence
  Description of Artificial Sequence: Synthetic oligonucleotide
gaggtggggtaccgcgggatcc

SEQ ID NO: 61730 - DNA, 25 bp, Artificial Sequence
  Description of Artificial Sequence: Synthetic oligonucleotide
tacgaggtggcgttccgcgggatct

SEQ ID NO: 61731 - DNA, 24 bp, Artificial Sequence
  Description of Artificial Sequence: Synthetic oligonucleotide
gcgttccgcgggatcttgcagagg

SEQ ID NO: 61732 - DNA, 25 bp, Artificial Sequence
  Description of Artificial Sequence: Synthetic oligonucleotide
ggagcgcgtgcgtcttgtgaccaga

SEQ ID NO: 61733 - DNA, 26 bp, Artificial Sequence
  Description of Artificial Sequence: Synthetic oligonucleotide
gagcgcgtgcgtcttgtgaccagaca

SEQ ID NO: 61734 - DNA, 27 bp, Artificial Sequence
  Description of Artificial Sequence: Synthetic oligonucleotide
agcgcgtgcgtcttgtgaccagacaca

SEQ ID NO: 61735 - DNA, 27 bp, Artificial Sequence
  Description of Artificial Sequence: Synthetic oligonucleotide
gcgcgtgcgtcttgtgaccagacacat

SEQ ID NO: 61736 - DNA, 27 bp, Artificial Sequence
  Description of Artificial Sequence: Synthetic oligonucleotide
cgcgtgcgtcttgtgaccagacacatc

SEQ ID NO: 61737 - DNA, 32 bp, Artificial Sequence
  Description of Artificial Sequence: Synthetic oligonucleotide
gcgtgcgtcttgtgaccagacacatctataac

SEQ ID NO: 61738 - DNA, 32 bp, Artificial Sequence
  Description of Artificial Sequence: Synthetic oligonucleotide
cgtgcgtcttgtgaccagacacatctataacc

SEQ ID NO: 61739 - DNA, 32 bp, Artificial Sequence
  Description of Artificial Sequence: Synthetic oligonucleotide
gtgcgtcttgtgaccagacacatctataaccg

SEQ ID NO: 61740 - DNA, 33 bp, Artificial Sequence
  Description of Artificial Sequence: Synthetic oligonucleotide
tgcgtcttgtgaccagacacatctataaccgag

SEQ ID NO: 61741 - DNA, 32 bp, Artificial Sequence
  Description of Artificial Sequence: Synthetic oligonucleotide
gcgtcttgtgaccagacacatctataaccgag

SEQ ID NO: 61742 - DNA, 33 bp, Artificial Sequence
  Description of Artificial Sequence: Synthetic oligonucleotide
cgtcttgtgaccagacacatctataaccgagag

SEQ ID NO: 61743 - DNA, 33 bp, Artificial Sequence
  Description of Artificial Sequence: Synthetic oligonucleotide
gtcttgtgaccagacacatctataaccgagagg

SEQ ID NO: 61744 - DNA, 34 bp, Artificial Sequence
  Description of Artificial Sequence: Synthetic oligonucleotide
tcttgtgaccagacacatctataaccgagaggag

SEQ ID NO: 61745 - DNA, 33 bp, Artificial Sequence
  Description of Artificial Sequence: Synthetic oligonucleotide
cttgtgaccagacacatctataaccgagaggag

SEQ ID NO: 61746 - DNA, 35 bp, Artificial Sequence
  Description of Artificial Sequence: Synthetic oligonucleotide
ttgtgaccagacacatctataaccgagaggagtac

SEQ ID NO: 61747 - DNA, 23 bp, Artificial Sequence
  Description of Artificial Sequence: Synthetic oligonucleotide
caggggcggcctgatgccgagaa

SEQ ID NO: 61748 - DNA, 24 bp, Artificial Sequence
  Description of Artificial Sequence: Synthetic oligonucleotide
aggggcggcctgatgccgagaact

SEQ ID NO: 61749 - DNA, 23 bp, Artificial Sequence
  Description of Artificial Sequence: Synthetic oligonucleotide
ggggcggcctgatgccgagaact

SEQ ID NO: 61750 - DNA, 23 bp, Artificial Sequence
  Description of Artificial Sequence: Synthetic oligonucleotide
gggcggcctgatgccgagaactg

SEQ ID NO: 61751 - DNA, 25 bp, Artificial Sequence
  Description of Artificial Sequence: Synthetic oligonucleotide
ggcggcctgatgccgagaactggaa

SEQ ID NO: 61752 - DNA, 26 bp, Artificial Sequence
  Description of Artificial Sequence: Synthetic oligonucleotide
gcggcctgatgccgagaactggaaca

SEQ ID NO: 61753 - DNA, 26 bp, Artificial Sequence
  Description of Artificial Sequence: Synthetic oligonucleotide
cggcctgatgccgagaactggaacag

SEQ ID NO: 61754 - DNA, 26 bp, Artificial Sequence
  Description of Artificial Sequence: Synthetic oligonucleotide
ggcctgatgccgagaactggaacagc

SEQ ID NO: 61755 - DNA, 27 bp, Artificial Sequence
  Description of Artificial Sequence: Synthetic oligonucleotide
gcctgatgccgagaactggaacagcca

SEQ ID NO: 61756 - DNA, 27 bp, Artificial Sequence
  Description of Artificial Sequence: Synthetic oligonucleotide
cctgatgccgagaactggaacagccag

SEQ ID NO: 61757 - DNA, 29 bp, Artificial Sequence
  Description of Artificial Sequence: Synthetic oligonucleotide
ctgatgccgagaactggaacagccagaag

SEQ ID NO: 61758 - DNA, 29 bp, Artificial Sequence
  Description of Artificial Sequence: Synthetic oligonucleotide
tgatgccgagaactggaacagccagaagg

SEQ ID NO: 61759 - DNA, 28 bp, Artificial Sequence
  Description of Artificial Sequence: Synthetic oligonucleotide
gatgccgagaactggaacagccagaagg

SEQ ID NO: 61760 - DNA, 30 bp, Artificial Sequence
  Description of Artificial Sequence: Synthetic oligonucleotide
atgccgagaactggaacagccagaaggaag

SEQ ID NO: 61761 - DNA, 29 bp, Artificial Sequence
  Description of Artificial Sequence: Synthetic oligonucleotide
tgccgagaactggaacagccagaaggaag

SEQ ID NO: 61762 - DNA, 28 bp, Artificial Sequence
  Description of Artificial Sequence: Synthetic oligonucleotide
gccgagaactggaacagccagaaggaag

SEQ ID NO: 61763 - DNA, 29 bp, Artificial Sequence
  Description of Artificial Sequence: Synthetic oligonucleotide
ccgagaactggaacagccagaaggaagtc

SEQ ID NO: 61764 - DNA, 29 bp, Artificial Sequence
  Description of Artificial Sequence: Synthetic oligonucleotide
cgagaactggaacagccagaaggaagtcc

SEQ ID NO: 61765 - DNA, 30 bp, Artificial Sequence
  Description of Artificial Sequence: Synthetic oligonucleotide
gagaactggaacagccagaaggaagtcctg

SEQ ID NO: 61766 - DNA, 30 bp, Artificial Sequence
  Description of Artificial Sequence: Synthetic oligonucleotide
agaactggaacagccagaaggaagtcctgg

SEQ ID NO: 61767 - DNA, 29 bp, Artificial Sequence
  Description of Artificial Sequence: Synthetic oligonucleotide
gaactggaacagccagaaggaagtcctgg

SEQ ID NO: 61768 - DNA, 30 bp, Artificial Sequence
  Description of Artificial Sequence: Synthetic oligonucleotide
aactggaacagccagaaggaagtcctggag

SEQ ID NO: 61769 - DNA, 20 bp, Artificial Sequence
  Description of Artificial Sequence: Synthetic oligonucleotide
tggagggggcccgggcggat

SEQ ID NO: 61770 - DNA, 20 bp, Artificial Sequence
  Description of Artificial Sequence: Synthetic oligonucleotide
ggagggggcccgggcggatt

SEQ ID NO: 61771 - DNA, 20 bp, Artificial Sequence
  Description of Artificial Sequence: Synthetic oligonucleotide
gagggggcccgggcggagtt

SEQ ID NO: 61772 - DNA, 20 bp, Artificial Sequence
  Description of Artificial Sequence: Synthetic oligonucleotide
agggggcccgggcggagttg

SEQ ID NO: 61773 - DNA, 20 bp, Artificial Sequence
  Description of Artificial Sequence: Synthetic oligonucleotide
gggggcccgggcggagttgt

SEQ ID NO: 61774 - DNA, 20 bp, Artificial Sequence
  Description of Artificial Sequence: Synthetic oligonucleotide
ggggcccgggcggagttgga

SEQ ID NO: 61775 - DNA, 21 bp, Artificial Sequence
  Description of Artificial Sequence: Synthetic oligonucleotide
gggcccgggcggagttggaca

SEQ ID NO: 61776 - DNA, 21 bp, Artificial Sequence
  Description of Artificial Sequence: Synthetic oligonucleotide
ggcccgggcggagttggacac

SEQ ID NO: 61777 - DNA, 21 bp, Artificial Sequence
  Description of Artificial Sequence: Synthetic oligonucleotide
gcccgggcggagttggacacg

SEQ ID NO: 61778 - DNA, 25 bp, Artificial Sequence
  Description of Artificial Sequence: Synthetic oligonucleotide
cgttccgcgggatcttgcagaggag

SEQ ID NO: 61779 - DNA, 20 bp, Artificial Sequence
  Description of Artificial Sequence: Synthetic oligonucleotide
gtgacgccgctggggcggct

SEQ ID NO: 61780 - DNA, 20 bp, Artificial Sequence
  Description of Artificial Sequence: Synthetic oligonucleotide
tgacgccgctggggcggcct

SEQ ID NO: 61781 - DNA, 20 bp, Artificial Sequence
  Description of Artificial Sequence: Synthetic oligonucleotide
gacgccgctggggcggcctt

SEQ ID NO: 61782 - DNA, 21 bp, Artificial Sequence
  Description of Artificial Sequence: Synthetic oligonucleotide
acgccgctggggcggcctgat

SEQ ID NO: 61783 - DNA, 20 bp, Artificial Sequence
  Description of Artificial Sequence: Synthetic oligonucleotide
cgccgctggggcggcctgat

SEQ ID NO: 61784 - DNA, 20 bp, Artificial Sequence
  Description of Artificial Sequence: Synthetic oligonucleotide
gccgctggggcggcctgatg

SEQ ID NO: 61785 - DNA, 20 bp, Artificial Sequence
  Description of Artificial Sequence: Synthetic oligonucleotide
ccgctggggcggcctgatgc

SEQ ID NO: 61786 - DNA, 20 bp, Artificial Sequence
  Description of Artificial Sequence: Synthetic oligonucleotide
cgctggggcggcctgatgcc

SEQ ID NO: 61787 - DNA, 21 bp, Artificial Sequence
  Description of Artificial Sequence: Synthetic oligonucleotide
gctggggcggcctgatgccga

SEQ ID NO: 61788 - DNA, 23 bp, Artificial Sequence
  Description of Artificial Sequence: Synthetic oligonucleotide
ctggggcggcctgatgccgagta

SEQ ID NO: 61789 - DNA, 24 bp, Artificial Sequence
  Description of Artificial Sequence: Synthetic oligonucleotide
tggggcggcctgatgccgagtact

SEQ ID NO: 61790 - DNA, 33 bp, Artificial Sequence
  Description of Artificial Sequence: Synthetic oligonucleotide
ttccagtttaagggcctgtgctacttcaccaac

SEQ ID NO: 61791 - DNA, 32 bp, Artificial Sequence
  Description of Artificial Sequence: Synthetic oligonucleotide
tccagtttaagggcctgtgctacttcaccaac

SEQ ID NO: 61792 - DNA, 26 bp, Artificial Sequence
  Description of Artificial Sequence: Synthetic oligonucleotide
gacggagcgcgtgcgtcttgtaacct

SEQ ID NO: 61793 - DNA, 27 bp, Artificial Sequence
  Description of Artificial Sequence: Synthetic oligonucleotide
acggagcgcgtgcgtcttgtaacctga

SEQ ID NO: 61794 - DNA, 26 bp, Artificial Sequence
  Description of Artificial Sequence: Synthetic oligonucleotide
cggagcgcgtgcgtcttgtaacctga

SEQ ID NO: 61795 - DNA, 27 bp, Artificial Sequence
  Description of Artificial Sequence: Synthetic oligonucleotide
ggagcgcgtgcgtcttgtaacctgaca

SEQ ID NO: 61796 - DNA, 27 bp, Artificial Sequence
  Description of Artificial Sequence: Synthetic oligonucleotide
gagcgcgtgcgtcttgtaacctgacac

SEQ ID NO: 61797 - DNA, 29 bp, Artificial Sequence
  Description of Artificial Sequence: Synthetic oligonucleotide
agcgcgtgcgtcttgtaacctgacacatc

SEQ ID NO: 61798 - DNA, 28 bp, Artificial Sequence
  Description of Artificial Sequence: Synthetic oligonucleotide
gcgcgtgcgtcttgtaacctgacacatc

SEQ ID NO: 61799 - DNA, 33 bp, Artificial Sequence
  Description of Artificial Sequence: Synthetic oligonucleotide
cgcgtgcgtcttgtaacctgacacatctataac

SEQ ID NO: 61800 - DNA, 33 bp, Artificial Sequence
  Description of Artificial Sequence: Synthetic oligonucleotide
gcgtgcgtcttgtaacctgacacatctataacc

SEQ ID NO: 61801 - DNA, 33 bp, Artificial Sequence
  Description of Artificial Sequence: Synthetic oligonucleotide
cgtgcgtcttgtaacctgacacatctataaccg

SEQ ID NO: 61802 - DNA, 34 bp, Artificial Sequence
  Description of Artificial Sequence: Synthetic oligonucleotide
gtgcgtcttgtaacctgacacatctataaccgag

SEQ ID NO: 61803 - DNA, 35 bp, Artificial Sequence
  Description of Artificial Sequence: Synthetic oligonucleotide
tgcgtcttgtaacctgacacatctataaccgagag

SEQ ID NO: 61804 - DNA, 34 bp, Artificial Sequence
  Description of Artificial Sequence: Synthetic oligonucleotide
gcgtcttgtaacctgacacatctataaccgagag

SEQ ID NO: 61805 - DNA, 34 bp, Artificial Sequence
  Description of Artificial Sequence: Synthetic oligonucleotide
cgtcttgtaacctgacacatctataaccgagagg

SEQ ID NO: 61806 - DNA, 35 bp, Artificial Sequence
  Description of Artificial Sequence: Synthetic oligonucleotide
gtcttgtaacctgacacatctataaccgagaggag

SEQ ID NO: 61807 - DNA, 37 bp, Artificial Sequence
  Description of Artificial Sequence: Synthetic oligonucleotide
tcttgtaacctgacacatctataaccgagaggagtac

SEQ ID NO: 61808 - DNA, 36 bp, Artificial Sequence
  Description of Artificial Sequence: Synthetic oligonucleotide
cttgtaacctgacacatctataaccgagaggagtac

SEQ ID NO: 61809 - DNA, 36 bp, Artificial Sequence
  Description of Artificial Sequence: Synthetic oligonucleotide
ttgtaacctgacacatctataaccgagaggagtacg

SEQ ID NO: 61810 - DNA, 35 bp, Artificial Sequence
  Description of Artificial Sequence: Synthetic oligonucleotide
tgtaacctgacacatctataaccgagaggagtacg

SEQ ID NO: 61811 - DNA, 34 bp, Artificial Sequence
  Description of Artificial Sequence: Synthetic oligonucleotide
gtaacctgacacatctataaccgagaggagtacg

SEQ ID NO: 61812 - DNA, 34 bp, Artificial Sequence
  Description of Artificial Sequence: Synthetic oligonucleotide
taacctgacacatctataaccgagaggagtacgc

SEQ ID NO: 61813 - DNA, 33 bp, Artificial Sequence
  Description of Artificial Sequence: Synthetic oligonucleotide
aacctgacacatctataaccgagaggagtacgc

SEQ ID NO: 61814 - DNA, 32 bp, Artificial Sequence
  Description of Artificial Sequence: Synthetic oligonucleotide
acctgacacatctataaccgagaggagtacgc

SEQ ID NO: 61815 - DNA, 31 bp, Artificial Sequence
  Description of Artificial Sequence: Synthetic oligonucleotide
cctgacacatctataaccgagaggagtacgc

SEQ ID NO: 61816 - DNA, 31 bp, Artificial Sequence
  Description of Artificial Sequence: Synthetic oligonucleotide
ctgacacatctataaccgagaggagtacgcg

SEQ ID NO: 61817 - DNA, 31 bp, Artificial Sequence
  Description of Artificial Sequence: Synthetic oligonucleotide
tgacacatctataaccgagaggagtacgcgc

SEQ ID NO: 61818 - DNA, 35 bp, Artificial Sequence
  Description of Artificial Sequence: Synthetic oligonucleotide
taaccagacacatctataaccgagaggagtacgtg

SEQ ID NO: 61819 - DNA, 34 bp, Artificial Sequence
  Description of Artificial Sequence: Synthetic oligonucleotide
aaccagacacatctataaccgagaggagtacgtg

SEQ ID NO: 61820 - DNA, 20 bp, Artificial Sequence
  Description of Artificial Sequence: Synthetic oligonucleotide
cggtgacgccgcaggggcct

SEQ ID NO: 61821 - DNA, 20 bp, Artificial Sequence
  Description of Artificial Sequence: Synthetic oligonucleotide
ggtgacgccgcaggggccgt

SEQ ID NO: 61822 - DNA, 20 bp, Artificial Sequence
  Description of Artificial Sequence: Synthetic oligonucleotide
gtgacgccgcaggggccgct

SEQ ID NO: 61823 - DNA, 20 bp, Artificial Sequence
  Description of Artificial Sequence: Synthetic oligonucleotide
tgacgccgcaggggccgcct

SEQ ID NO: 61824 - DNA, 20 bp, Artificial Sequence
  Description of Artificial Sequence: Synthetic oligonucleotide
gacgccgcaggggccgcctt

SEQ ID NO: 61825 - DNA, 20 bp, Artificial Sequence
  Description of Artificial Sequence: Synthetic oligonucleotide
acgccgcaggggccgcctgt

SEQ ID NO: 61826 - DNA, 20 bp, Artificial Sequence
  Description of Artificial Sequence: Synthetic oligonucleotide
cgccgcaggggccgcctgtt

SEQ ID NO: 61827 - DNA, 20 bp, Artificial Sequence
  Description of Artificial Sequence: Synthetic oligonucleotide
gccgcaggggccgcctgctt

SEQ ID NO: 61828 - DNA, 20 bp, Artificial Sequence
  Description of Artificial Sequence: Synthetic oligonucleotide
ccgcaggggccgcctgcctt

SEQ ID NO: 61829 - DNA, 20 bp, Artificial Sequence
  Description of Artificial Sequence: Synthetic oligonucleotide
cgcaggggccgcctgccgtt

SEQ ID NO: 61830 - DNA, 20 bp, Artificial Sequence
  Description of Artificial Sequence: Synthetic oligonucleotide
gcaggggccgcctgccgctt

SEQ ID NO: 61831 - DNA, 20 bp, Artificial Sequence
  Description of Artificial Sequence: Synthetic oligonucleotide
caggggccgcctgccgcctt

SEQ ID NO: 61832 - DNA, 20 bp, Artificial Sequence
  Description of Artificial Sequence: Synthetic oligonucleotide
aggggccgcctgccgccgat

SEQ ID NO: 61833 - DNA, 35 bp, Artificial Sequence
  Description of Artificial Sequence: Synthetic oligonucleotide
aggatttcgtgttccagttaaagggcatgtgctac

SEQ ID NO: 61834 - DNA, 34 bp, Artificial Sequence
  Description of Artificial Sequence: Synthetic oligonucleotide
ggatttcgtgttccagttaaagggcatgtgctac

SEQ ID NO: 61835 - DNA, 36 bp, Artificial Sequence
  Description of Artificial Sequence: Synthetic oligonucleotide
gatttcgtgttccagttaaagggcatgtgctacttc

SEQ ID NO: 61836 - DNA, 37 bp, Artificial Sequence
  Description of Artificial Sequence: Synthetic oligonucleotide
atttcgtgttccagttaaagggcatgtgctacttcac

SEQ ID NO: 61837 - DNA, 36 bp, Artificial Sequence
  Description of Artificial Sequence: Synthetic oligonucleotide
tttcgtgttccagttaaagggcatgtgctacttcac

SEQ ID NO: 61838 - DNA, 35 bp, Artificial Sequence
  Description of Artificial Sequence: Synthetic oligonucleotide
ttcgtgttccagttaaagggcatgtgctacttcac

SEQ ID NO: 61839 - DNA, 34 bp, Artificial Sequence
  Description of Artificial Sequence: Synthetic oligonucleotide
tcgtgttccagttaaagggcatgtgctacttcac

SEQ ID NO: 61840 - DNA, 33 bp, Artificial Sequence
  Description of Artificial Sequence: Synthetic oligonucleotide
cgtgttccagttaaagggcatgtgctacttcac

SEQ ID NO: 61841 - DNA, 33 bp, Artificial Sequence
  Description of Artificial Sequence: Synthetic oligonucleotide
gtgttccagttaaagggcatgtgctacttcacc

SEQ ID NO: 61842 - DNA, 35 bp, Artificial Sequence
  Description of Artificial Sequence: Synthetic oligonucleotide
tgttccagttaaagggcatgtgctacttcaccaac

SEQ ID NO: 61843 - DNA, 34 bp, Artificial Sequence
  Description of Artificial Sequence: Synthetic oligonucleotide
gttccagttaaagggcatgtgctacttcaccaac

SEQ ID NO: 61844 - DNA, 34 bp, Artificial Sequence
  Description of Artificial Sequence: Synthetic oligonucleotide
ttccagttaaagggcatgtgctacttcaccaacg

SEQ ID NO: 61845 - DNA, 33 bp, Artificial Sequence
  Description of Artificial Sequence: Synthetic oligonucleotide
tccagttaaagggcatgtgctacttcaccaacg

SEQ ID NO: 61846 - DNA, 32 bp, Artificial Sequence
  Description of Artificial Sequence: Synthetic oligonucleotide
ccagttaaagggcatgtgctacttcaccaacg

SEQ ID NO: 61847 - DNA, 32 bp, Artificial Sequence
  Description of Artificial Sequence: Synthetic oligonucleotide
cagttaaagggcatgtgctacttcaccaacgg

SEQ ID NO: 61848 - DNA, 32 bp, Artificial Sequence
  Description of Artificial Sequence: Synthetic oligonucleotide
agttaaagggcatgtgctacttcaccaacggg

SEQ ID NO: 61849 - DNA, 31 bp, Artificial Sequence
  Description of Artificial Sequence: Synthetic oligonucleotide
gttaaagggcatgtgctacttcaccaacggg

SEQ ID NO: 61850 - DNA, 32 bp, Artificial Sequence
  Description of Artificial Sequence: Synthetic oligonucleotide
ttaaagggcatgtgctacttcaccaacgggac

SEQ ID NO: 61851 - DNA, 31 bp, Artificial Sequence
  Description of Artificial Sequence: Synthetic oligonucleotide
taaagggcatgtgctacttcaccaacgggac

SEQ ID NO: 61852 - DNA, 30 bp, Artificial Sequence
  Description of Artificial Sequence: Synthetic oligonucleotide
aaagggcatgtgctacttcaccaacgggac

SEQ ID NO: 61853 - DNA, 25 bp, Artificial Sequence
  Description of Artificial Sequence: Synthetic oligonucleotide
cagagccccatcaccgtggagtggt

SEQ ID NO: 61854 - DNA, 25 bp, Artificial Sequence
  Description of Artificial Sequence: Synthetic oligonucleotide
agagccccatcaccgtggagtggtg

SEQ ID NO: 61855 - DNA, 24 bp, Artificial Sequence
  Description of Artificial Sequence: Synthetic oligonucleotide
gagccccatcaccgtggagtggtg

SEQ ID NO: 61856 - DNA, 24 bp, Artificial Sequence
  Description of Artificial Sequence: Synthetic oligonucleotide
agccccatcaccgtggagtggtgg

SEQ ID NO: 61857 - DNA, 23 bp, Artificial Sequence
  Description of Artificial Sequence: Synthetic oligonucleotide
gccccatcaccgtggagtggtgg

SEQ ID NO: 61858 - DNA, 23 bp, Artificial Sequence
  Description of Artificial Sequence: Synthetic oligonucleotide
ccccatcaccgtggagtggtggg

SEQ ID NO: 61859 - DNA, 24 bp, Artificial Sequence
  Description of Artificial Sequence: Synthetic oligonucleotide
cccatcaccgtggagtggtgggct

SEQ ID NO: 61860 - DNA, 25 bp, Artificial Sequence
  Description of Artificial Sequence: Synthetic oligonucleotide
ccatcaccgtggagtggtgggctca

SEQ ID NO: 61861 - DNA, 25 bp, Artificial Sequence
  Description of Artificial Sequence: Synthetic oligonucleotide
acgtgcgcttcgacagcgacgtgga

SEQ ID NO: 61862 - DNA, 24 bp, Artificial Sequence
  Description of Artificial Sequence: Synthetic oligonucleotide
cgtgcgcttcgacagcgacgtgga

SEQ ID NO: 61863 - DNA, 24 bp, Artificial Sequence
  Description of Artificial Sequence: Synthetic oligonucleotide
gtgcgcttcgacagcgacgtggag

SEQ ID NO: 61864 - DNA, 25 bp, Artificial Sequence
  Description of Artificial Sequence: Synthetic oligonucleotide
tgcgcttcgacagcgacgtggaggt

SEQ ID NO: 61865 - DNA, 20 bp, Artificial Sequence
  Description of Artificial Sequence: Synthetic oligonucleotide
acgccgctggggcggcctga

SEQ ID NO: 61866 - DNA, 20 bp, Artificial Sequence
  Description of Artificial Sequence: Synthetic oligonucleotide
gccgctggggcggcctgact

SEQ ID NO: 61867 - DNA, 20 bp, Artificial Sequence
  Description of Artificial Sequence: Synthetic oligonucleotide
ccgctggggcggcctgacgt

SEQ ID NO: 61868 - DNA, 20 bp, Artificial Sequence
  Description of Artificial Sequence: Synthetic oligonucleotide
cgctggggcggcctgacgct

SEQ ID NO: 61869 - DNA, 20 bp, Artificial Sequence
  Description of Artificial Sequence: Synthetic oligonucleotide
gctggggcggcctgacgcct

SEQ ID NO: 61870 - DNA, 20 bp, Artificial Sequence
  Description of Artificial Sequence: Synthetic oligonucleotide
ctggggcggcctgacgccga

SEQ ID NO: 61871 - DNA, 22 bp, Artificial Sequence
  Description of Artificial Sequence: Synthetic oligonucleotide
tggggcggcctgacgccgagta

SEQ ID NO: 61872 - DNA, 23 bp, Artificial Sequence
  Description of Artificial Sequence: Synthetic oligonucleotide
cagcctccagagccccatcaccg

SEQ ID NO: 61873 - DNA, 23 bp, Artificial Sequence
  Description of Artificial Sequence: Synthetic oligonucleotide
agcctccagagccccatcaccgc

SEQ ID NO: 61874 - DNA, 22 bp, Artificial Sequence
  Description of Artificial Sequence: Synthetic oligonucleotide
gcctccagagccccatcaccgc

SEQ ID NO: 61875 - DNA, 22 bp, Artificial Sequence
  Description of Artificial Sequence: Synthetic oligonucleotide
cctccagagccccatcaccgcg

SEQ ID NO: 61876 - DNA, 23 bp, Artificial Sequence
  Description of Artificial Sequence: Synthetic oligonucleotide
ctccagagccccatcaccgcgga

SEQ ID NO: 61877 - DNA, 24 bp, Artificial Sequence
  Description of Artificial Sequence: Synthetic oligonucleotide
tccagagccccatcaccgcggagt

SEQ ID NO: 61878 - DNA, 23 bp, Artificial Sequence
  Description of Artificial Sequence: Synthetic oligonucleotide
ccagagccccatcaccgcggagt

SEQ ID NO: 61879 - DNA, 23 bp, Artificial Sequence
  Description of Artificial Sequence: Synthetic oligonucleotide
cagagccccatcaccgcggagtg

SEQ ID NO: 61880 - DNA, 23 bp, Artificial Sequence
  Description of Artificial Sequence: Synthetic oligonucleotide
agagccccatcaccgcggagtgg

SEQ ID NO: 61881 - DNA, 22 bp, Artificial Sequence
  Description of Artificial Sequence: Synthetic oligonucleotide
gagccccatcaccgcggagtgg

SEQ ID NO: 61882 - DNA, 22 bp, Artificial Sequence
  Description of Artificial Sequence: Synthetic oligonucleotide
agccccatcaccgcggagtggc

SEQ ID NO: 61883 - DNA, 21 bp, Artificial Sequence
  Description of Artificial Sequence: Synthetic oligonucleotide
gccccatcaccgcggagtggc

SEQ ID NO: 61884 - DNA, 21 bp, Artificial Sequence
  Description of Artificial Sequence: Synthetic oligonucleotide
ccccatcaccgcggagtggcg

SEQ ID NO: 61885 - DNA, 21 bp, Artificial Sequence
  Description of Artificial Sequence: Synthetic oligonucleotide
cccatcaccgcggagtggcgg

SEQ ID NO: 61886 - DNA, 21 bp, Artificial Sequence
  Description of Artificial Sequence: Synthetic oligonucleotide
ccatcaccgcggagtggcggg

SEQ ID NO: 61887 - DNA, 22 bp, Artificial Sequence
  Description of Artificial Sequence: Synthetic oligonucleotide
catcaccgcggagtggcgggct

SEQ ID NO: 61888 - DNA, 23 bp, Artificial Sequence
  Description of Artificial Sequence: Synthetic oligonucleotide
atcaccgcggagtggcgggctca

SEQ ID NO: 61889 - DNA, 22 bp, Artificial Sequence
  Description of Artificial Sequence: Synthetic oligonucleotide
tcaccgcggagtggcgggctca

SEQ ID NO: 61890 - DNA, 21 bp, Artificial Sequence
  Description of Artificial Sequence: Synthetic oligonucleotide
caccgcggagtggcgggctca

SEQ ID NO: 61891 - DNA, 22 bp, Artificial Sequence
  Description of Artificial Sequence: Synthetic oligonucleotide
accgcggagtggcgggctcagt

SEQ ID NO: 61892 - DNA, 21 bp, Artificial Sequence
  Description of Artificial Sequence: Synthetic oligonucleotide
ccgcggagtggcgggctcagt

SEQ ID NO: 61893 - DNA, 22 bp, Artificial Sequence
  Description of Artificial Sequence: Synthetic oligonucleotide
cgcggagtggcgggctcagtct

SEQ ID NO: 61894 - DNA, 25 bp, Artificial Sequence
  Description of Artificial Sequence: Synthetic oligonucleotide
gcggagtggcgggctcagtctgaat

SEQ ID NO: 61895 - DNA, 26 bp, Artificial Sequence
  Description of Artificial Sequence: Synthetic oligonucleotide
cggagtggcgggctcagtctgaatct

SEQ ID NO: 61896 - DNA, 26 bp, Artificial Sequence
  Description of Artificial Sequence: Synthetic oligonucleotide
gcggcctgatgccgagtactggaaga

SEQ ID NO: 61897 - DNA, 26 bp, Artificial Sequence
  Description of Artificial Sequence: Synthetic oligonucleotide
cggcctgatgccgagtactggaagag

SEQ ID NO: 61898 - DNA, 26 bp, Artificial Sequence
  Description of Artificial Sequence: Synthetic oligonucleotide
ggcctgatgccgagtactggaagagc

SEQ ID NO: 61899 - DNA, 27 bp, Artificial Sequence
  Description of Artificial Sequence: Synthetic oligonucleotide
gcctgatgccgagtactggaagagcca

SEQ ID NO: 61900 - DNA, 27 bp, Artificial Sequence
  Description of Artificial Sequence: Synthetic oligonucleotide
cctgatgccgagtactggaagagccag

SEQ ID NO: 61901 - DNA, 29 bp, Artificial Sequence
  Description of Artificial Sequence: Synthetic oligonucleotide
ctgatgccgagtactggaagagccagaag

SEQ ID NO: 61902 - DNA, 29 bp, Artificial Sequence
  Description of Artificial Sequence: Synthetic oligonucleotide
tgatgccgagtactggaagagccagaagg

SEQ ID NO: 61903 - DNA, 28 bp, Artificial Sequence
  Description of Artificial Sequence: Synthetic oligonucleotide
gatgccgagtactggaagagccagaagg

SEQ ID NO: 61904 - DNA, 30 bp, Artificial Sequence
  Description of Artificial Sequence: Synthetic oligonucleotide
atgccgagtactggaagagccagaaggaag

SEQ ID NO: 61905 - DNA, 29 bp, Artificial Sequence
  Description of Artificial Sequence: Synthetic oligonucleotide
tgccgagtactggaagagccagaaggaag

SEQ ID NO: 61906 - DNA, 28 bp, Artificial Sequence
  Description of Artificial Sequence: Synthetic oligonucleotide
gccgagtactggaagagccagaaggaag

SEQ ID NO: 61907 - DNA, 29 bp, Artificial Sequence
  Description of Artificial Sequence: Synthetic oligonucleotide
ccgagtactggaagagccagaaggaagtc

SEQ ID NO: 61908 - DNA, 29 bp, Artificial Sequence
  Description of Artificial Sequence: Synthetic oligonucleotide
cgagtactggaagagccagaaggaagtcc

SEQ ID NO: 61909 - DNA, 30 bp, Artificial Sequence
  Description of Artificial Sequence: Synthetic oligonucleotide
gagtactggaagagccagaaggaagtcctg

SEQ ID NO: 61910 - DNA, 30 bp, Artificial Sequence
  Description of Artificial Sequence: Synthetic oligonucleotide
agtactggaagagccagaaggaagtcctgg

SEQ ID NO: 61911 - DNA, 29 bp, Artificial Sequence
  Description of Artificial Sequence: Synthetic oligonucleotide
gtactggaagagccagaaggaagtcctgg

SEQ ID NO: 61912 - DNA, 30 bp, Artificial Sequence
  Description of Artificial Sequence: Synthetic oligonucleotide
tactggaagagccagaaggaagtcctggag

SEQ ID NO: 61913 - DNA, 29 bp, Artificial Sequence
  Description of Artificial Sequence: Synthetic oligonucleotide
actggaagagccagaaggaagtcctggag

SEQ ID NO: 61914 - DNA, 28 bp, Artificial Sequence
  Description of Artificial Sequence: Synthetic oligonucleotide
ctggaagagccagaaggaagtcctggag

SEQ ID NO: 61915 - DNA, 29 bp, Artificial Sequence
  Description of Artificial Sequence: Synthetic oligonucleotide
tggaagagccagaaggaagtcctggagag

SEQ ID NO: 61916 - DNA, 28 bp, Artificial Sequence
  Description of Artificial Sequence: Synthetic oligonucleotide
ggaagagccagaaggaagtcctggagag

SEQ ID NO: 61917 - DNA, 28 bp, Artificial Sequence
  Description of Artificial Sequence: Synthetic oligonucleotide
gaagagccagaaggaagtcctggagagg

SEQ ID NO: 61918 - DNA, 29 bp, Artificial Sequence
  Description of Artificial Sequence: Synthetic oligonucleotide
aagagccagaaggaagtcctggagaggac

SEQ ID NO: 61919 - DNA, 28 bp, Artificial Sequence
  Description of Artificial Sequence: Synthetic oligonucleotide
agagccagaaggaagtcctggagaggac

SEQ ID NO: 61920 - DNA, 27 bp, Artificial Sequence
  Description of Artificial Sequence: Synthetic oligonucleotide
gagccagaaggaagtcctggagaggac

SEQ ID NO: 61921 - DNA, 33 bp, Artificial Sequence
  Description of Artificial Sequence: Synthetic oligonucleotide
tatccaggccagatcaaagtccagtggtttcag

SEQ ID NO: 61922 - DNA, 32 bp, Artificial Sequence
  Description of Artificial Sequence: Synthetic oligonucleotide
atccaggccagatcaaagtccagtggtttcag

SEQ ID NO: 61923 - DNA, 31 bp, Artificial Sequence
  Description of Artificial Sequence: Synthetic oligonucleotide
tccaggccagatcaaagtccagtggtttcag

SEQ ID NO: 61924 - DNA, 30 bp, Artificial Sequence
  Description of Artificial Sequence: Synthetic oligonucleotide
ccaggccagatcaaagtccagtggtttcag

SEQ ID NO: 61925 - DNA, 33 bp, Artificial Sequence
  Description of Artificial Sequence: Synthetic oligonucleotide
caggccagatcaaagtccagtggtttcagaatg

SEQ ID NO: 61926 - DNA, 35 bp, Artificial Sequence
  Description of Artificial Sequence: Synthetic oligonucleotide
aggccagatcaaagtccagtggtttcagaatgatc

SEQ ID NO: 61927 - DNA, 34 bp, Artificial Sequence
  Description of Artificial Sequence: Synthetic oligonucleotide
ggccagatcaaagtccagtggtttcagaatgatc

SEQ ID NO: 61928 - DNA, 35 bp, Artificial Sequence
  Description of Artificial Sequence: Synthetic oligonucleotide
gccagatcaaagtccagtggtttcagaatgatcag

SEQ ID NO: 61929 - DNA, 35 bp, Artificial Sequence
  Description of Artificial Sequence: Synthetic oligonucleotide
ccagatcaaagtccagtggtttcagaatgatcagg

SEQ ID NO: 61930 - DNA, 36 bp, Artificial Sequence
  Description of Artificial Sequence: Synthetic oligonucleotide
cagatcaaagtccagtggtttcagaatgatcaggag

SEQ ID NO: 61931 - DNA, 36 bp, Artificial Sequence
  Description of Artificial Sequence: Synthetic oligonucleotide
agatcaaagtccagtggtttcagaatgatcaggagg

SEQ ID NO: 61932 - DNA, 35 bp, Artificial Sequence
  Description of Artificial Sequence: Synthetic oligonucleotide
gatcaaagtccagtggtttcagaatgatcaggagg

SEQ ID NO: 61933 - DNA, 36 bp, Artificial Sequence
  Description of Artificial Sequence: Synthetic oligonucleotide
atcaaagtccagtggtttcagaatgatcaggaggag

SEQ ID NO: 61934 - DNA, 35 bp, Artificial Sequence
  Description of Artificial Sequence: Synthetic oligonucleotide
tcaaagtccagtggtttcagaatgatcaggaggag

SEQ ID NO: 61935 - DNA, 34 bp, Artificial Sequence
  Description of Artificial Sequence: Synthetic oligonucleotide
caaagtccagtggtttcagaatgatcaggaggag

SEQ ID NO: 61936 - DNA, 35 bp, Artificial Sequence
  Description of Artificial Sequence: Synthetic oligonucleotide
aaagtccagtggtttcagaatgatcaggaggagac

SEQ ID NO: 61937 - DNA, 34 bp, Artificial Sequence
  Description of Artificial Sequence: Synthetic oligonucleotide
aagtccagtggtttcagaatgatcaggaggagac

SEQ ID NO: 61938 - DNA, 33 bp, Artificial Sequence
  Description of Artificial Sequence: Synthetic oligonucleotide
agtccagtggtttcagaatgatcaggaggagac

SEQ ID NO: 61939 - DNA, 32 bp, Artificial Sequence
  Description of Artificial Sequence: Synthetic oligonucleotide
gtccagtggtttcagaatgatcaggaggagac

SEQ ID NO: 61940 - DNA, 33 bp, Artificial Sequence
  Description of Artificial Sequence: Synthetic oligonucleotide
tccagtggtttcagaatgatcaggaggagacag

SEQ ID NO: 61941 - DNA, 32 bp, Artificial Sequence
  Description of Artificial Sequence: Synthetic oligonucleotide
ccagtggtttcagaatgatcaggaggagacag

SEQ ID NO: 61942 - DNA, 32 bp, Artificial Sequence
  Description of Artificial Sequence: Synthetic oligonucleotide
cagtggtttcagaatgatcaggaggagacagc

SEQ ID NO: 61943 - DNA, 32 bp, Artificial Sequence
  Description of Artificial Sequence: Synthetic oligonucleotide
agtggtttcagaatgatcaggaggagacagcc

SEQ ID NO: 61944 - DNA, 31 bp, Artificial Sequence
  Description of Artificial Sequence: Synthetic oligonucleotide
gtggtttcagaatgatcaggaggagacagcc

SEQ ID NO: 61945 - DNA, 31 bp, Artificial Sequence
  Description of Artificial Sequence: Synthetic oligonucleotide
tggtttcagaatgatcaggaggagacagccg

SEQ ID NO: 61946 - DNA, 30 bp, Artificial Sequence
  Description of Artificial Sequence: Synthetic oligonucleotide
ggtttcagaatgatcaggaggagacagccg

SEQ ID NO: 61947 - DNA, 30 bp, Artificial Sequence
  Description of Artificial Sequence: Synthetic oligonucleotide
gtttcagaatgatcaggaggagacagccgg

SEQ ID NO: 61948 - DNA, 30 bp, Artificial Sequence
  Description of Artificial Sequence: Synthetic oligonucleotide
tttcagaatgatcaggaggagacagccggc

SEQ ID NO: 61949 - DNA, 29 bp, Artificial Sequence
  Description of Artificial Sequence: Synthetic oligonucleotide
ttcagaatgatcaggaggagacagccggc

SEQ ID NO: 61950 - DNA, 28 bp, Artificial Sequence
  Description of Artificial Sequence: Synthetic oligonucleotide
tcagaatgatcaggaggagacagccggc

SEQ ID NO: 61951 - DNA, 27 bp, Artificial Sequence
  Description of Artificial Sequence: Synthetic oligonucleotide
cagaatgatcaggaggagacagccggc

SEQ ID NO: 61952 - DNA, 27 bp, Artificial Sequence
  Description of Artificial Sequence: Synthetic oligonucleotide
agaatgatcaggaggagacagccggcg

SEQ ID NO: 61953 - DNA, 27 bp, Artificial Sequence
  Description of Artificial Sequence: Synthetic oligonucleotide
agcgcgtgcgtcttgtaaccagacacg

SEQ ID NO: 61954 - DNA, 27 bp, Artificial Sequence
  Description of Artificial Sequence: Synthetic oligonucleotide
gcgcgtgcgtcttgtaaccagacacgt

SEQ ID NO: 61955 - DNA, 27 bp, Artificial Sequence
  Description of Artificial Sequence: Synthetic oligonucleotide
cgcgtgcgtcttgtaaccagacacgtc

SEQ ID NO: 61956 - DNA, 32 bp, Artificial Sequence
  Description of Artificial Sequence: Synthetic oligonucleotide
gcgtgcgtcttgtaaccagacacgtctataac

SEQ ID NO: 61957 - DNA, 32 bp, Artificial Sequence
  Description of Artificial Sequence: Synthetic oligonucleotide
cgtgcgtcttgtaaccagacacgtctataacc

SEQ ID NO: 61958 - DNA, 32 bp, Artificial Sequence
  Description of Artificial Sequence: Synthetic oligonucleotide
gtgcgtcttgtaaccagacacgtctataaccg

SEQ ID NO: 61959 - DNA, 33 bp, Artificial Sequence
  Description of Artificial Sequence: Synthetic oligonucleotide
tgcgtcttgtaaccagacacgtctataaccgag

SEQ ID NO: 61960 - DNA, 32 bp, Artificial Sequence
  Description of Artificial Sequence: Synthetic oligonucleotide
gcgtcttgtaaccagacacgtctataaccgag

SEQ ID NO: 61961 - DNA, 33 bp, Artificial Sequence
  Description of Artificial Sequence: Synthetic oligonucleotide
cgtcttgtaaccagacacgtctataaccgagag

SEQ ID NO: 61962 - DNA, 33 bp, Artificial Sequence
  Description of Artificial Sequence: Synthetic oligonucleotide
gtcttgtaaccagacacgtctataaccgagagg

SEQ ID NO: 61963 - DNA, 34 bp, Artificial Sequence
  Description of Artificial Sequence: Synthetic oligonucleotide
tcttgtaaccagacacgtctataaccgagaggag

SEQ ID NO: 61964 - DNA, 33 bp, Artificial Sequence
  Description of Artificial Sequence: Synthetic oligonucleotide
cttgtaaccagacacgtctataaccgagaggag

SEQ ID NO: 61965 - DNA, 35 bp, Artificial Sequence
  Description of Artificial Sequence: Synthetic oligonucleotide
ttgtaaccagacacgtctataaccgagaggagtac

SEQ ID NO: 61966 - DNA, 34 bp, Artificial Sequence
  Description of Artificial Sequence: Synthetic oligonucleotide
tgtaaccagacacgtctataaccgagaggagtac

SEQ ID NO: 61967 - DNA, 33 bp, Artificial Sequence
  Description of Artificial Sequence: Synthetic oligonucleotide
gtaaccagacacgtctataaccgagaggagtac

SEQ ID NO: 61968 - DNA, 33 bp, Artificial Sequence
  Description of Artificial Sequence: Synthetic oligonucleotide
taaccagacacgtctataaccgagaggagtacg

SEQ ID NO: 61969 - DNA, 32 bp, Artificial Sequence
  Description of Artificial Sequence: Synthetic oligonucleotide
aaccagacacgtctataaccgagaggagtacg

SEQ ID NO: 61970 - DNA, 31 bp, Artificial Sequence
  Description of Artificial Sequence: Synthetic oligonucleotide
accagacacgtctataaccgagaggagtacg

SEQ ID NO: 61971 - DNA, 30 bp, Artificial Sequence
  Description of Artificial Sequence: Synthetic oligonucleotide
ccagacacgtctataaccgagaggagtacg

SEQ ID NO: 61972 - DNA, 30 bp, Artificial Sequence
  Description of Artificial Sequence: Synthetic oligonucleotide
cagacacgtctataaccgagaggagtacgc

SEQ ID NO: 61973 - DNA, 30 bp, Artificial Sequence
  Description of Artificial Sequence: Synthetic oligonucleotide
agacacgtctataaccgagaggagtacgcg

SEQ ID NO: 61974 - DNA, 29 bp, Artificial Sequence
  Description of Artificial Sequence: Synthetic oligonucleotide
gacacgtctataaccgagaggagtacgcg

SEQ ID NO: 61975 - DNA, 29 bp, Artificial Sequence
  Description of Artificial Sequence: Synthetic oligonucleotide
acacgtctataaccgagaggagtacgcgc

SEQ ID NO: 61976 - DNA, 28 bp, Artificial Sequence
  Description of Artificial Sequence: Synthetic oligonucleotide
cacgtctataaccgagaggagtacgcgc

SEQ ID NO: 61977 - DNA, 28 bp, Artificial Sequence
  Description of Artificial Sequence: Synthetic oligonucleotide
acgtctataaccgagaggagtacgcgcg

SEQ ID NO: 61978 - DNA, 27 bp, Artificial Sequence
  Description of Artificial Sequence: Synthetic oligonucleotide
cgtctataaccgagaggagtacgcgcg

SEQ ID NO: 61979 - DNA, 27 bp, Artificial Sequence
  Description of Artificial Sequence: Synthetic oligonucleotide
gtctataaccgagaggagtacgcgcgc

SEQ ID NO: 61980 - DNA, 29 bp, Artificial Sequence
  Description of Artificial Sequence: Synthetic oligonucleotide
atggccataagtggagtccctgtgctagg

SEQ ID NO: 61981 - DNA, 28 bp, Artificial Sequence
  Description of Artificial Sequence: Synthetic oligonucleotide
tggccataagtggagtccctgtgctagg

SEQ ID NO: 61982 - DNA, 27 bp, Artificial Sequence
  Description of Artificial Sequence: Synthetic oligonucleotide
ggccataagtggagtccctgtgctagg

SEQ ID NO: 61983 - DNA, 33 bp, Artificial Sequence
  Description of Artificial Sequence: Synthetic oligonucleotide
gccataagtggagtccctgtgctaggatttttc

SEQ ID NO: 61984 - DNA, 35 bp, Artificial Sequence
  Description of Artificial Sequence: Synthetic oligonucleotide
ccataagtggagtccctgtgctaggatttttcatc

SEQ ID NO: 61985 - DNA, 38 bp, Artificial Sequence
  Description of Artificial Sequence: Synthetic oligonucleotide
cataagtggagtccctgtgctaggatttttcatcatag

SEQ ID NO: 61986 - DNA, 38 bp, Artificial Sequence
  Description of Artificial Sequence: Synthetic oligonucleotide
ataagtggagtccctgtgctaggatttttcatcatagc

SEQ ID NO: 61987 - DNA, 37 bp, Artificial Sequence
  Description of Artificial Sequence: Synthetic oligonucleotide
taagtggagtccctgtgctaggatttttcatcatagc

SEQ ID NO: 61988 - DNA, 36 bp, Artificial Sequence
  Description of Artificial Sequence: Synthetic oligonucleotide
aagtggagtccctgtgctaggatttttcatcatagc

SEQ ID NO: 61989 - DNA, 35 bp, Artificial Sequence
  Description of Artificial Sequence: Synthetic oligonucleotide
agtggagtccctgtgctaggatttttcatcatagc

SEQ ID NO: 61990 - DNA, 34 bp, Artificial Sequence
  Description of Artificial Sequence: Synthetic oligonucleotide
gtggagtccctgtgctaggatttttcatcatagc

SEQ ID NO: 61991 - DNA, 35 bp, Artificial Sequence
  Description of Artificial Sequence: Synthetic oligonucleotide
tggagtccctgtgctaggatttttcatcatagctg

SEQ ID NO: 61992 - DNA, 34 bp, Artificial Sequence
  Description of Artificial Sequence: Synthetic oligonucleotide
ggagtccctgtgctaggatttttcatcatagctg

SEQ ID NO: 61993 - DNA, 35 bp, Artificial Sequence
  Description of Artificial Sequence: Synthetic oligonucleotide
gagtccctgtgctaggatttttcatcatagctgtg

SEQ ID NO: 61994 - DNA, 35 bp, Artificial Sequence
  Description of Artificial Sequence: Synthetic oligonucleotide
agtccctgtgctaggatttttcatcatagctgtgc

SEQ ID NO: 61995 - DNA, 34 bp, Artificial Sequence
  Description of Artificial Sequence: Synthetic oligonucleotide
gtccctgtgctaggatttttcatcatagctgtgc

SEQ ID NO: 61996 - DNA, 35 bp, Artificial Sequence
  Description of Artificial Sequence: Synthetic oligonucleotide
tccctgtgctaggatttttcatcatagctgtgctg

SEQ ID NO: 61997 - DNA, 34 bp, Artificial Sequence
  Description of Artificial Sequence: Synthetic oligonucleotide
ccctgtgctaggatttttcatcatagctgtgctg

SEQ ID NO: 61998 - DNA, 36 bp, Artificial Sequence
  Description of Artificial Sequence: Synthetic oligonucleotide
cctgtgctaggatttttcatcatagctgtgctgatg

SEQ ID NO: 61999 - DNA, 37 bp, Artificial Sequence
  Description of Artificial Sequence: Synthetic oligonucleotide
ctgtgctaggatttttcatcatagctgtgctgatgag

SEQ ID NO: 62000 - DNA, 37 bp, Artificial Sequence
  Description of Artificial Sequence: Synthetic oligonucleotide
tgtgctaggatttttcatcatagctgtgctgatgagc

SEQ ID NO: 62001 - DNA, 36 bp, Artificial Sequence
  Description of Artificial Sequence: Synthetic oligonucleotide
gtgctaggatttttcatcatagctgtgctgatgagc

SEQ ID NO: 62002 - DNA, 36 bp, Artificial Sequence
  Description of Artificial Sequence: Synthetic oligonucleotide
tgctaggatttttcatcatagctgtgctgatgagcg

SEQ ID NO: 62003 - DNA, 35 bp, Artificial Sequence
  Description of Artificial Sequence: Synthetic oligonucleotide
gctaggatttttcatcatagctgtgctgatgagcg

SEQ ID NO: 62004 - DNA, 35 bp, Artificial Sequence
  Description of Artificial Sequence: Synthetic oligonucleotide
ctaggatttttcatcatagctgtgctgatgagcgc

SEQ ID NO: 62005 - DNA, 36 bp, Artificial Sequence
  Description of Artificial Sequence: Synthetic oligonucleotide
taggatttttcatcatagctgtgctgatgagcgctc

SEQ ID NO: 62006 - DNA, 35 bp, Artificial Sequence
  Description of Artificial Sequence: Synthetic oligonucleotide
aggatttttcatcatagctgtgctgatgagcgctc

SEQ ID NO: 62007 - DNA, 34 bp, Artificial Sequence
  Description of Artificial Sequence: Synthetic oligonucleotide
ggatttttcatcatagctgtgctgatgagcgctc

SEQ ID NO: 62008 - DNA, 35 bp, Artificial Sequence
  Description of Artificial Sequence: Synthetic oligonucleotide
gatttttcatcatagctgtgctgatgagcgctcag

SEQ ID NO: 62009 - DNA, 35 bp, Artificial Sequence
  Description of Artificial Sequence: Synthetic oligonucleotide
atttttcatcatagctgtgctgatgagcgctcagg

SEQ ID NO: 62010 - DNA, 34 bp, Artificial Sequence
  Description of Artificial Sequence: Synthetic oligonucleotide
tttttcatcatagctgtgctgatgagcgctcagg

SEQ ID NO: 62011 - DNA, 33 bp, Artificial Sequence
  Description of Artificial Sequence: Synthetic oligonucleotide
ttttcatcatagctgtgctgatgagcgctcagg

SEQ ID NO: 62012 - DNA, 32 bp, Artificial Sequence
  Description of Artificial Sequence: Synthetic oligonucleotide
tttcatcatagctgtgctgatgagcgctcagg

SEQ ID NO: 62013 - DNA, 31 bp, Artificial Sequence
  Description of Artificial Sequence: Synthetic oligonucleotide
ttcatcatagctgtgctgatgagcgctcagg

SEQ ID NO: 62014 - DNA, 30 bp, Artificial Sequence
  Description of Artificial Sequence: Synthetic oligonucleotide
tcatcatagctgtgctgatgagcgctcagg

SEQ ID NO: 62015 - DNA, 29 bp, Artificial Sequence
  Description of Artificial Sequence: Synthetic oligonucleotide
catcatagctgtgctgatgagcgctcagg

SEQ ID NO: 62016 - DNA, 32 bp, Artificial Sequence
  Description of Artificial Sequence: Synthetic oligonucleotide
atcatagctgtgctgatgagcgctcaggaatc

SEQ ID NO: 62017 - DNA, 31 bp, Artificial Sequence
  Description of Artificial Sequence: Synthetic oligonucleotide
tcatagctgtgctgatgagcgctcaggaatc

SEQ ID NO: 62018 - DNA, 30 bp, Artificial Sequence
  Description of Artificial Sequence: Synthetic oligonucleotide
catagctgtgctgatgagcgctcaggaatc

SEQ ID NO: 62019 - DNA, 32 bp, Artificial Sequence
  Description of Artificial Sequence: Synthetic oligonucleotide
atagctgtgctgatgagcgctcaggaatcatg

SEQ ID NO: 62020 - DNA, 31 bp, Artificial Sequence
  Description of Artificial Sequence: Synthetic oligonucleotide
tagctgtgctgatgagcgctcaggaatcatg

SEQ ID NO: 62021 - DNA, 30 bp, Artificial Sequence
  Description of Artificial Sequence: Synthetic oligonucleotide
agctgtgctgatgagcgctcaggaatcatg

SEQ ID NO: 62022 - DNA, 29 bp, Artificial Sequence
  Description of Artificial Sequence: Synthetic oligonucleotide
gctgtgctgatgagcgctcaggaatcatg

SEQ ID NO: 62023 - DNA, 29 bp, Artificial Sequence
  Description of Artificial Sequence: Synthetic oligonucleotide
ctgtgctgatgagcgctcaggaatcatgg

SEQ ID NO: 62024 - DNA, 29 bp, Artificial Sequence
  Description of Artificial Sequence: Synthetic oligonucleotide
tgtgctgatgagcgctcaggaatcatggg

SEQ ID NO: 62025 - DNA, 28 bp, Artificial Sequence
  Description of Artificial Sequence: Synthetic oligonucleotide
gtgctgatgagcgctcaggaatcatggg

SEQ ID NO: 62026 - DNA, 28 bp, Artificial Sequence
  Description of Artificial Sequence: Synthetic oligonucleotide
tgctgatgagcgctcaggaatcatgggc

SEQ ID NO: 62027 - DNA, 27 bp, Artificial Sequence
  Description of Artificial Sequence: Synthetic oligonucleotide
gctgatgagcgctcaggaatcatgggc

SEQ ID NO: 62028 - DNA, 30 bp, Artificial Sequence
  Description of Artificial Sequence: Synthetic oligonucleotide
ctgatgagcgctcaggaatcatgggctatc

SEQ ID NO: 62029 - DNA, 33 bp, Artificial Sequence
  Description of Artificial Sequence: Synthetic oligonucleotide
tgatgagcgctcaggaatcatgggctatcaaag

SEQ ID NO: 62030 - DNA, 32 bp, Artificial Sequence
  Description of Artificial Sequence: Synthetic oligonucleotide
gatgagcgctcaggaatcatgggctatcaaag

SEQ ID NO: 62031 - DNA, 34 bp, Artificial Sequence
  Description of Artificial Sequence: Synthetic oligonucleotide
atgagcgctcaggaatcatgggctatcaaagaag

SEQ ID NO: 62032 - DNA, 33 bp, Artificial Sequence
  Description of Artificial Sequence: Synthetic oligonucleotide
tgagcgctcaggaatcatgggctatcaaagaag

SEQ ID NO: 62033 - DNA, 32 bp, Artificial Sequence
  Description of Artificial Sequence: Synthetic oligonucleotide
gagcgctcaggaatcatgggctatcaaagaag

SEQ ID NO: 62034 - DNA, 34 bp, Artificial Sequence
  Description of Artificial Sequence: Synthetic oligonucleotide
agcgctcaggaatcatgggctatcaaagaagaac

SEQ ID NO: 62035 - DNA, 33 bp, Artificial Sequence
  Description of Artificial Sequence: Synthetic oligonucleotide
gcgctcaggaatcatgggctatcaaagaagaac

SEQ ID NO: 62036 - DNA, 35 bp, Artificial Sequence
  Description of Artificial Sequence: Synthetic oligonucleotide
cgctcaggaatcatgggctatcaaagaagaacatg

SEQ ID NO: 62037 - DNA, 36 bp, Artificial Sequence
  Description of Artificial Sequence: Synthetic oligonucleotide
gctcaggaatcatgggctatcaaagaagaacatgtg

SEQ ID NO: 62038 - DNA, 38 bp, Artificial Sequence
  Description of Artificial Sequence: Synthetic oligonucleotide
ctcaggaatcatgggctatcaaagaagaacatgtgatc

SEQ ID NO: 62039 - DNA, 40 bp, Artificial Sequence
  Description of Artificial Sequence: Synthetic oligonucleotide
tcaggaatcatgggctatcaaagaagaacatgtgatcatc

SEQ ID NO: 62040 - DNA, 39 bp, Artificial Sequence
  Description of Artificial Sequence: Synthetic oligonucleotide
caggaatcatgggctatcaaagaagaacatgtgatcatc

SEQ ID NO: 62041 - DNA, 39 bp, Artificial Sequence
  Description of Artificial Sequence: Synthetic oligonucleotide
aggaatcatgggctatcaaagaagaacatgtgatcatcc

SEQ ID NO: 62042 - DNA, 38 bp, Artificial Sequence
  Description of Artificial Sequence: Synthetic oligonucleotide
ggaatcatgggctatcaaagaagaacatgtgatcatcc

SEQ ID NO: 62043 - DNA, 39 bp, Artificial Sequence
  Description of Artificial Sequence: Synthetic oligonucleotide
gaatcatgggctatcaaagaagaacatgtgatcatccag

SEQ ID NO: 62044 - DNA, 39 bp, Artificial Sequence
  Description of Artificial Sequence: Synthetic oligonucleotide
aatcatgggctatcaaagaagaacatgtgatcatccagg

SEQ ID NO: 62045 - DNA, 38 bp, Artificial Sequence
  Description of Artificial Sequence: Synthetic oligonucleotide
atcatgggctatcaaagaagaacatgtgatcatccagg

SEQ ID NO: 62046 - DNA, 37 bp, Artificial Sequence
  Description of Artificial Sequence: Synthetic oligonucleotide
tcatgggctatcaaagaagaacatgtgatcatccagg

SEQ ID NO: 62047 - DNA, 36 bp, Artificial Sequence
  Description of Artificial Sequence: Synthetic oligonucleotide
catgggctatcaaagaagaacatgtgatcatccagg

SEQ ID NO: 62048 - DNA, 36 bp, Artificial Sequence
  Description of Artificial Sequence: Synthetic oligonucleotide
atgggctatcaaagaagaacatgtgatcatccaggc

SEQ ID NO: 62049 - DNA, 35 bp, Artificial Sequence
  Description of Artificial Sequence: Synthetic oligonucleotide
tgggctatcaaagaagaacatgtgatcatccaggc

SEQ ID NO: 62050 - DNA, 34 bp, Artificial Sequence
  Description of Artificial Sequence: Synthetic oligonucleotide
gggctatcaaagaagaacatgtgatcatccaggc

SEQ ID NO: 62051 - DNA, 34 bp, Artificial Sequence
  Description of Artificial Sequence: Synthetic oligonucleotide
ggctatcaaagaagaacatgtgatcatccaggcc

SEQ ID NO: 62052 - DNA, 34 bp, Artificial Sequence
  Description of Artificial Sequence: Synthetic oligonucleotide
gctatcaaagaagaacatgtgatcatccaggccg

SEQ ID NO: 62053 - DNA, 35 bp, Artificial Sequence
  Description of Artificial Sequence: Synthetic oligonucleotide
ctatcaaagaagaacatgtgatcatccaggccgag

SEQ ID NO: 62054 - DNA, 37 bp, Artificial Sequence
  Description of Artificial Sequence: Synthetic oligonucleotide
tatcaaagaagaacatgtgatcatccaggccgagttc

SEQ ID NO: 62055 - DNA, 36 bp, Artificial Sequence
  Description of Artificial Sequence: Synthetic oligonucleotide
atcaaagaagaacatgtgatcatccaggccgagttc

SEQ ID NO: 62056 - DNA, 35 bp, Artificial Sequence
  Description of Artificial Sequence: Synthetic oligonucleotide
tcaaagaagaacatgtgatcatccaggccgagttc

SEQ ID NO: 62057 - DNA, 34 bp, Artificial Sequence
  Description of Artificial Sequence: Synthetic oligonucleotide
caaagaagaacatgtgatcatccaggccgagttc

SEQ ID NO: 62058 - DNA, 37 bp, Artificial Sequence
  Description of Artificial Sequence: Synthetic oligonucleotide
aaagaagaacatgtgatcatccaggccgagttctatc

SEQ ID NO: 62059 - DNA, 36 bp, Artificial Sequence
  Description of Artificial Sequence: Synthetic oligonucleotide
aagaagaacatgtgatcatccaggccgagttctatc

SEQ ID NO: 62060 - DNA, 35 bp, Artificial Sequence
  Description of Artificial Sequence: Synthetic oligonucleotide
agaagaacatgtgatcatccaggccgagttctatc

SEQ ID NO: 62061 - DNA, 34 bp, Artificial Sequence
  Description of Artificial Sequence: Synthetic oligonucleotide
gaagaacatgtgatcatccaggccgagttctatc

SEQ ID NO: 62062 - DNA, 35 bp, Artificial Sequence
  Description of Artificial Sequence: Synthetic oligonucleotide
aagaacatgtgatcatccaggccgagttctatctg

SEQ ID NO: 62063 - DNA, 34 bp, Artificial Sequence
  Description of Artificial Sequence: Synthetic oligonucleotide
agaacatgtgatcatccaggccgagttctatctg

SEQ ID NO: 62064 - DNA, 33 bp, Artificial Sequence
  Description of Artificial Sequence: Synthetic oligonucleotide
gaacatgtgatcatccaggccgagttctatctg

SEQ ID NO: 62065 - DNA, 36 bp, Artificial Sequence
  Description of Artificial Sequence: Synthetic oligonucleotide
aacatgtgatcatccaggccgagttctatctgaatc

SEQ ID NO: 62066 - DNA, 35 bp, Artificial Sequence
  Description of Artificial Sequence: Synthetic oligonucleotide
acatgtgatcatccaggccgagttctatctgaatc

SEQ ID NO: 62067 - DNA, 34 bp, Artificial Sequence
  Description of Artificial Sequence: Synthetic oligonucleotide
catgtgatcatccaggccgagttctatctgaatc

SEQ ID NO: 62068 - DNA, 34 bp, Artificial Sequence
  Description of Artificial Sequence: Synthetic oligonucleotide
atgtgatcatccaggccgagttctatctgaatcc

SEQ ID NO: 62069 - DNA, 33 bp, Artificial Sequence
  Description of Artificial Sequence: Synthetic oligonucleotide
tgtgatcatccaggccgagttctatctgaatcc

SEQ ID NO: 62070 - DNA, 32 bp, Artificial Sequence
  Description of Artificial Sequence: Synthetic oligonucleotide
gtgatcatccaggccgagttctatctgaatcc

SEQ ID NO: 62071 - DNA, 33 bp, Artificial Sequence
  Description of Artificial Sequence: Synthetic oligonucleotide
tgatcatccaggccgagttctatctgaatcctg

SEQ ID NO: 62072 - DNA, 32 bp, Artificial Sequence
  Description of Artificial Sequence: Synthetic oligonucleotide
gatcatccaggccgagttctatctgaatcctg

SEQ ID NO: 62073 - DNA, 33 bp, Artificial Sequence
  Description of Artificial Sequence: Synthetic oligonucleotide
atcatccaggccgagttctatctgaatcctgac

SEQ ID NO: 62074 - DNA, 32 bp, Artificial Sequence
  Description of Artificial Sequence: Synthetic oligonucleotide
tcatccaggccgagttctatctgaatcctgac

SEQ ID NO: 62075 - DNA, 31 bp, Artificial Sequence
  Description of Artificial Sequence: Synthetic oligonucleotide
catccaggccgagttctatctgaatcctgac

SEQ ID NO: 62076 - DNA, 31 bp, Artificial Sequence
  Description of Artificial Sequence: Synthetic oligonucleotide
atccaggccgagttctatctgaatcctgacc

SEQ ID NO: 62077 - DNA, 30 bp, Artificial Sequence
  Description of Artificial Sequence: Synthetic oligonucleotide
tccaggccgagttctatctgaatcctgacc

SEQ ID NO: 62078 - DNA, 29 bp, Artificial Sequence
  Description of Artificial Sequence: Synthetic oligonucleotide
ccaggccgagttctatctgaatcctgacc

SEQ ID NO: 62079 - DNA, 32 bp, Artificial Sequence
  Description of Artificial Sequence: Synthetic oligonucleotide
caggccgagttctatctgaatcctgaccaatc

SEQ ID NO: 62080 - DNA, 33 bp, Artificial Sequence
  Description of Artificial Sequence: Synthetic oligonucleotide
aggccgagttctatctgaatcctgaccaatcag

SEQ ID NO: 62081 - DNA, 32 bp, Artificial Sequence
  Description of Artificial Sequence: Synthetic oligonucleotide
ggccgagttctatctgaatcctgaccaatcag

SEQ ID NO: 62082 - DNA, 32 bp, Artificial Sequence
  Description of Artificial Sequence: Synthetic oligonucleotide
gccgagttctatctgaatcctgaccaatcagg

SEQ ID NO: 62083 - DNA, 32 bp, Artificial Sequence
  Description of Artificial Sequence: Synthetic oligonucleotide
ccgagttctatctgaatcctgaccaatcaggc

SEQ ID NO: 62084 - DNA, 32 bp, Artificial Sequence
  Description of Artificial Sequence: Synthetic oligonucleotide
cgagttctatctgaatcctgaccaatcaggcg

SEQ ID NO: 62085 - DNA, 33 bp, Artificial Sequence
  Description of Artificial Sequence: Synthetic oligonucleotide
gagttctatctgaatcctgaccaatcaggcgag

SEQ ID NO: 62086 - DNA, 38 bp, Artificial Sequence
  Description of Artificial Sequence: Synthetic oligonucleotide
agttctatctgaatcctgaccaatcaggcgagtttatg

SEQ ID NO: 62087 - DNA, 37 bp, Artificial Sequence
  Description of Artificial Sequence: Synthetic oligonucleotide
gttctatctgaatcctgaccaatcaggcgagtttatg

SEQ ID NO: 62088 - DNA, 40 bp, Artificial Sequence
  Description of Artificial Sequence: Synthetic oligonucleotide
ttctatctgaatcctgaccaatcaggcgagtttatgtttg

SEQ ID NO: 62089 - DNA, 39 bp, Artificial Sequence
  Description of Artificial Sequence: Synthetic oligonucleotide
tctatctgaatcctgaccaatcaggcgagtttatgtttg

SEQ ID NO: 62090 - DNA, 38 bp, Artificial Sequence
  Description of Artificial Sequence: Synthetic oligonucleotide
ctatctgaatcctgaccaatcaggcgagtttatgtttg

SEQ ID NO: 62091 - DNA, 39 bp, Artificial Sequence
  Description of Artificial Sequence: Synthetic oligonucleotide
tatctgaatcctgaccaatcaggcgagtttatgtttgac

SEQ ID NO: 62092 - DNA, 38 bp, Artificial Sequence
  Description of Artificial Sequence: Synthetic oligonucleotide
atctgaatcctgaccaatcaggcgagtttatgtttgac

SEQ ID NO: 62093 - DNA, 37 bp, Artificial Sequence
  Description of Artificial Sequence: Synthetic oligonucleotide
tctgaatcctgaccaatcaggcgagtttatgtttgac

SEQ ID NO: 62094 - DNA, 36 bp, Artificial Sequence
  Description of Artificial Sequence: Synthetic oligonucleotide
ctgaatcctgaccaatcaggcgagtttatgtttgac

SEQ ID NO: 62095 - DNA, 39 bp, Artificial Sequence
  Description of Artificial Sequence: Synthetic oligonucleotide
tgaatcctgaccaatcaggcgagtttatgtttgactttg

SEQ ID NO: 62096 - DNA, 38 bp, Artificial Sequence
  Description of Artificial Sequence: Synthetic oligonucleotide
gaatcctgaccaatcaggcgagtttatgtttgactttg

SEQ ID NO: 62097 - DNA, 40 bp, Artificial Sequence
  Description of Artificial Sequence: Synthetic oligonucleotide
aatcctgaccaatcaggcgagtttatgtttgactttgatg

SEQ ID NO: 62098 - DNA, 39 bp, Artificial Sequence
  Description of Artificial Sequence: Synthetic oligonucleotide
atcctgaccaatcaggcgagtttatgtttgactttgatg

SEQ ID NO: 62099 - DNA, 38 bp, Artificial Sequence
  Description of Artificial Sequence: Synthetic oligonucleotide
tcctgaccaatcaggcgagtttatgtttgactttgatg

SEQ ID NO: 62100 - DNA, 37 bp, Artificial Sequence
  Description of Artificial Sequence: Synthetic oligonucleotide
cctgaccaatcaggcgagtttatgtttgactttgatg

SEQ ID NO: 62101 - DNA, 37 bp, Artificial Sequence
  Description of Artificial Sequence: Synthetic oligonucleotide
ctgaccaatcaggcgagtttatgtttgactttgatgg

SEQ ID NO: 62102 - DNA, 38 bp, Artificial Sequence
  Description of Artificial Sequence: Synthetic oligonucleotide
tgaccaatcaggcgagtttatgtttgactttgatggtg

SEQ ID NO: 62103 - DNA, 37 bp, Artificial Sequence
  Description of Artificial Sequence: Synthetic oligonucleotide
gaccaatcaggcgagtttatgtttgactttgatggtg

SEQ ID NO: 62104 - DNA, 39 bp, Artificial Sequence
  Description of Artificial Sequence: Synthetic oligonucleotide
accaatcaggcgagtttatgtttgactttgatggtgatg

SEQ ID NO: 62105 - DNA, 38 bp, Artificial Sequence
  Description of Artificial Sequence: Synthetic oligonucleotide
ccaatcaggcgagtttatgtttgactttgatggtgatg

SEQ ID NO: 62106 - DNA, 39 bp, Artificial Sequence
  Description of Artificial Sequence: Synthetic oligonucleotide
caatcaggcgagtttatgtttgactttgatggtgatgag

SEQ ID NO: 62107 - DNA, 44 bp, Artificial Sequence
  Description of Artificial Sequence: Synthetic oligonucleotide
aatcaggcgagtttatgtttgactttgatggtgatgagattttc

SEQ ID NO: 62108 - DNA, 43 bp, Artificial Sequence
  Description of Artificial Sequence: Synthetic oligonucleotide
atcaggcgagtttatgtttgactttgatggtgatgagattttc

SEQ ID NO: 62109 - DNA, 42 bp, Artificial Sequence
  Description of Artificial Sequence: Synthetic oligonucleotide
tcaggcgagtttatgtttgactttgatggtgatgagattttc

SEQ ID NO: 62110 - DNA, 41 bp, Artificial Sequence
  Description of Artificial Sequence: Synthetic oligonucleotide
caggcgagtttatgtttgactttgatggtgatgagattttc

SEQ ID NO: 62111 - DNA, 41 bp, Artificial Sequence
  Description of Artificial Sequence: Synthetic oligonucleotide
aggcgagtttatgtttgactttgatggtgatgagattttcc

SEQ ID NO: 62112 - DNA, 40 bp, Artificial Sequence
  Description of Artificial Sequence: Synthetic oligonucleotide
ggcgagtttatgtttgactttgatggtgatgagattttcc

SEQ ID NO: 62113 - DNA, 42 bp, Artificial Sequence
  Description of Artificial Sequence: Synthetic oligonucleotide
gcgagtttatgtttgactttgatggtgatgagattttccatg

SEQ ID NO: 62114 - DNA, 43 bp, Artificial Sequence
  Description of Artificial Sequence: Synthetic oligonucleotide
cgagtttatgtttgactttgatggtgatgagattttccatgtg

SEQ ID NO: 62115 - DNA, 43 bp, Artificial Sequence
  Description of Artificial Sequence: Synthetic oligonucleotide
gagtttatgtttgactttgatggtgatgagattttccatgtgg

SEQ ID NO: 62116 - DNA, 47 bp, Artificial Sequence
  Description of Artificial Sequence: Synthetic oligonucleotide
agtttatgtttgactttgatggtgatgagattttccatgtggatatg

SEQ ID NO: 62117 - DNA, 46 bp, Artificial Sequence
  Description of Artificial Sequence: Synthetic oligonucleotide
gtttatgtttgactttgatggtgatgagattttccatgtggatatg

SEQ ID NO: 62118 - DNA, 46 bp, Artificial Sequence
  Description of Artificial Sequence: Synthetic oligonucleotide
tttatgtttgactttgatggtgatgagattttccatgtggatatgg

SEQ ID NO: 62119 - DNA, 45 bp, Artificial Sequence
  Description of Artificial Sequence: Synthetic oligonucleotide
ttatgtttgactttgatggtgatgagattttccatgtggatatgg

SEQ ID NO: 62120 - DNA, 44 bp, Artificial Sequence
  Description of Artificial Sequence: Synthetic oligonucleotide
tatgtttgactttgatggtgatgagattttccatgtggatatgg

SEQ ID NO: 62121 - DNA, 43 bp, Artificial Sequence
  Description of Artificial Sequence: Synthetic oligonucleotide
atgtttgactttgatggtgatgagattttccatgtggatatgg

SEQ ID NO: 62122 - DNA, 42 bp, Artificial Sequence
  Description of Artificial Sequence: Synthetic oligonucleotide
tgtttgactttgatggtgatgagattttccatgtggatatgg

SEQ ID NO: 62123 - DNA, 41 bp, Artificial Sequence
  Description of Artificial Sequence: Synthetic oligonucleotide
gtttgactttgatggtgatgagattttccatgtggatatgg

SEQ ID NO: 62124 - DNA, 41 bp, Artificial Sequence
  Description of Artificial Sequence: Synthetic oligonucleotide
tttgactttgatggtgatgagattttccatgtggatatggc

SEQ ID NO: 62125 - DNA, 40 bp, Artificial Sequence
  Description of Artificial Sequence: Synthetic oligonucleotide
ttgactttgatggtgatgagattttccatgtggatatggc

SEQ ID NO: 62126 - DNA, 39 bp, Artificial Sequence
  Description of Artificial Sequence: Synthetic oligonucleotide
tgactttgatggtgatgagattttccatgtggatatggc

SEQ ID NO: 62127 - DNA, 38 bp, Artificial Sequence
  Description of Artificial Sequence: Synthetic oligonucleotide
gactttgatggtgatgagattttccatgtggatatggc

SEQ ID NO: 62128 - DNA, 41 bp, Artificial Sequence
  Description of Artificial Sequence: Synthetic oligonucleotide
actttgatggtgatgagattttccatgtggatatggcaaag

SEQ ID NO: 62129 - DNA, 40 bp, Artificial Sequence
  Description of Artificial Sequence: Synthetic oligonucleotide
ctttgatggtgatgagattttccatgtggatatggcaaag

SEQ ID NO: 62130 - DNA, 42 bp, Artificial Sequence
  Description of Artificial Sequence: Synthetic oligonucleotide
tttgatggtgatgagattttccatgtggatatggcaaagaag

SEQ ID NO: 62131 - DNA, 41 bp, Artificial Sequence
  Description of Artificial Sequence: Synthetic oligonucleotide
ttgatggtgatgagattttccatgtggatatggcaaagaag

SEQ ID NO: 62132 - DNA, 40 bp, Artificial Sequence
  Description of Artificial Sequence: Synthetic oligonucleotide
tgatggtgatgagattttccatgtggatatggcaaagaag

SEQ ID NO: 62133 - DNA, 39 bp, Artificial Sequence
  Description of Artificial Sequence: Synthetic oligonucleotide
gatggtgatgagattttccatgtggatatggcaaagaag

SEQ ID NO: 62134 - DNA, 39 bp, Artificial Sequence
  Description of Artificial Sequence: Synthetic oligonucleotide
atggtgatgagattttccatgtggatatggcaaagaagg

SEQ ID NO: 62135 - DNA, 38 bp, Artificial Sequence
  Description of Artificial Sequence: Synthetic oligonucleotide
tggtgatgagattttccatgtggatatggcaaagaagg

SEQ ID NO: 62136 - DNA, 37 bp, Artificial Sequence
  Description of Artificial Sequence: Synthetic oligonucleotide
ggtgatgagattttccatgtggatatggcaaagaagg

SEQ ID NO: 62137 - DNA, 38 bp, Artificial Sequence
  Description of Artificial Sequence: Synthetic oligonucleotide
gtgatgagattttccatgtggatatggcaaagaaggag

SEQ ID NO: 62138 - DNA, 39 bp, Artificial Sequence
  Description of Artificial Sequence: Synthetic oligonucleotide
tgatgagattttccatgtggatatggcaaagaaggagac

SEQ ID NO: 62139 - DNA, 38 bp, Artificial Sequence
  Description of Artificial Sequence: Synthetic oligonucleotide
gatgagattttccatgtggatatggcaaagaaggagac

SEQ ID NO: 62140 - DNA, 38 bp, Artificial Sequence
  Description of Artificial Sequence: Synthetic oligonucleotide
atgagattttccatgtggatatggcaaagaaggagacg

SEQ ID NO: 62141 - DNA, 37 bp, Artificial Sequence
  Description of Artificial Sequence: Synthetic oligonucleotide
tgagattttccatgtggatatggcaaagaaggagacg

SEQ ID NO: 62142 - DNA, 36 bp, Artificial Sequence
  Description of Artificial Sequence: Synthetic oligonucleotide
gagattttccatgtggatatggcaaagaaggagacg

SEQ ID NO: 62143 - DNA, 36 bp, Artificial Sequence
  Description of Artificial Sequence: Synthetic oligonucleotide
agattttccatgtggatatggcaaagaaggagacgg

SEQ ID NO: 62144 - DNA, 35 bp, Artificial Sequence
  Description of Artificial Sequence: Synthetic oligonucleotide
gattttccatgtggatatggcaaagaaggagacgg

SEQ ID NO: 62145 - DNA, 36 bp, Artificial Sequence
  Description of Artificial Sequence: Synthetic oligonucleotide
attttccatgtggatatggcaaagaaggagacggtc

SEQ ID NO: 62146 - DNA, 35 bp, Artificial Sequence
  Description of Artificial Sequence: Synthetic oligonucleotide
ttttccatgtggatatggcaaagaaggagacggtc

SEQ ID NO: 62147 - DNA, 34 bp, Artificial Sequence
  Description of Artificial Sequence: Synthetic oligonucleotide
tttccatgtggatatggcaaagaaggagacggtc

SEQ ID NO: 62148 - DNA, 33 bp, Artificial Sequence
  Description of Artificial Sequence: Synthetic oligonucleotide
ttccatgtggatatggcaaagaaggagacggtc

SEQ ID NO: 62149 - DNA, 32 bp, Artificial Sequence
  Description of Artificial Sequence: Synthetic oligonucleotide
tccatgtggatatggcaaagaaggagacggtc

SEQ ID NO: 62150 - DNA, 31 bp, Artificial Sequence
  Description of Artificial Sequence: Synthetic oligonucleotide
ccatgtggatatggcaaagaaggagacggtc

SEQ ID NO: 62151 - DNA, 32 bp, Artificial Sequence
  Description of Artificial Sequence: Synthetic oligonucleotide
catgtggatatggcaaagaaggagacggtctg

SEQ ID NO: 62152 - DNA, 32 bp, Artificial Sequence
  Description of Artificial Sequence: Synthetic oligonucleotide
atgtggatatggcaaagaaggagacggtctgg

SEQ ID NO: 62153 - DNA, 31 bp, Artificial Sequence
  Description of Artificial Sequence: Synthetic oligonucleotide
tgtggatatggcaaagaaggagacggtctgg

SEQ ID NO: 62154 - DNA, 30 bp, Artificial Sequence
  Description of Artificial Sequence: Synthetic oligonucleotide
gtggatatggcaaagaaggagacggtctgg

SEQ ID NO: 62155 - DNA, 30 bp, Artificial Sequence
  Description of Artificial Sequence: Synthetic oligonucleotide
tggatatggcaaagaaggagacggtctggc

SEQ ID NO: 62156 - DNA, 29 bp, Artificial Sequence
  Description of Artificial Sequence: Synthetic oligonucleotide
ggatatggcaaagaaggagacggtctggc

SEQ ID NO: 62157 - DNA, 29 bp, Artificial Sequence
  Description of Artificial Sequence: Synthetic oligonucleotide
gatatggcaaagaaggagacggtctggcg

SEQ ID NO: 62158 - DNA, 29 bp, Artificial Sequence
  Description of Artificial Sequence: Synthetic oligonucleotide
atatggcaaagaaggagacggtctggcgg

SEQ ID NO: 62159 - DNA, 28 bp, Artificial Sequence
  Description of Artificial Sequence: Synthetic oligonucleotide
tatggcaaagaaggagacggtctggcgg

SEQ ID NO: 62160 - DNA, 27 bp, Artificial Sequence
  Description of Artificial Sequence: Synthetic oligonucleotide
atggcaaagaaggagacggtctggcgg

SEQ ID NO: 62161 - DNA, 26 bp, Artificial Sequence
  Description of Artificial Sequence: Synthetic oligonucleotide
tggcaaagaaggagacggtctggcgg

SEQ ID NO: 62162 - DNA, 25 bp, Artificial Sequence
  Description of Artificial Sequence: Synthetic oligonucleotide
ggcaaagaaggagacggtctggcgg

SEQ ID NO: 62163 - DNA, 27 bp, Artificial Sequence
  Description of Artificial Sequence: Synthetic oligonucleotide
gcaaagaaggagacggtctggcggctt

SEQ ID NO: 62164 - DNA, 27 bp, Artificial Sequence
  Description of Artificial Sequence: Synthetic oligonucleotide
caaagaaggagacggtctggcggcttg

SEQ ID NO: 62165 - DNA, 29 bp, Artificial Sequence
  Description of Artificial Sequence: Synthetic oligonucleotide
aaagaaggagacggtctggcggcttgaag

SEQ ID NO: 62166 - DNA, 28 bp, Artificial Sequence
  Description of Artificial Sequence: Synthetic oligonucleotide
aagaaggagacggtctggcggcttgaag

SEQ ID NO: 62167 - DNA, 27 bp, Artificial Sequence
  Description of Artificial Sequence: Synthetic oligonucleotide
agaaggagacggtctggcggcttgaag

SEQ ID NO: 62168 - DNA, 27 bp, Artificial Sequence
  Description of Artificial Sequence: Synthetic oligonucleotide
gaaggagacggtctggcggcttgaaga

SEQ ID NO: 62169 - DNA, 31 bp, Artificial Sequence
  Description of Artificial Sequence: Synthetic oligonucleotide
aaggagacggtctggcggcttgaagaatttg

SEQ ID NO: 62170 - DNA, 30 bp, Artificial Sequence
  Description of Artificial Sequence: Synthetic oligonucleotide
aggagacggtctggcggcttgaagaatttg

SEQ ID NO: 62171 - DNA, 29 bp, Artificial Sequence
  Description of Artificial Sequence: Synthetic oligonucleotide
ggagacggtctggcggcttgaagaatttg

SEQ ID NO: 62172 - DNA, 29 bp, Artificial Sequence
  Description of Artificial Sequence: Synthetic oligonucleotide
gagacggtctggcggcttgaagaatttgg

SEQ ID NO: 62173 - DNA, 30 bp, Artificial Sequence
  Description of Artificial Sequence: Synthetic oligonucleotide
agacggtctggcggcttgaagaatttggac

SEQ ID NO: 62174 - DNA, 29 bp, Artificial Sequence
  Description of Artificial Sequence: Synthetic oligonucleotide
gacggtctggcggcttgaagaatttggac

SEQ ID NO: 62175 - DNA, 29 bp, Artificial Sequence
  Description of Artificial Sequence: Synthetic oligonucleotide
acggtctggcggcttgaagaatttggacg

SEQ ID NO: 62176 - DNA, 28 bp, Artificial Sequence
  Description of Artificial Sequence: Synthetic oligonucleotide
cggtctggcggcttgaagaatttggacg

SEQ ID NO: 62177 - DNA, 32 bp, Artificial Sequence
  Description of Artificial Sequence: Synthetic oligonucleotide
ggtctggcggcttgaagaatttggacgatttg

SEQ ID NO: 62178 - DNA, 32 bp, Artificial Sequence
  Description of Artificial Sequence: Synthetic oligonucleotide
gtctggcggcttgaagaatttggacgatttgc

SEQ ID NO: 62179 - DNA, 32 bp, Artificial Sequence
  Description of Artificial Sequence: Synthetic oligonucleotide
tctggcggcttgaagaatttggacgatttgcc

SEQ ID NO: 62180 - DNA, 31 bp, Artificial Sequence
  Description of Artificial Sequence: Synthetic oligonucleotide
ctggcggcttgaagaatttggacgatttgcc

SEQ ID NO: 62181 - DNA, 32 bp, Artificial Sequence
  Description of Artificial Sequence: Synthetic oligonucleotide
tggcggcttgaagaatttggacgatttgccag

SEQ ID NO: 62182 - DNA, 31 bp, Artificial Sequence
  Description of Artificial Sequence: Synthetic oligonucleotide
ggcggcttgaagaatttggacgatttgccag

SEQ ID NO: 62183 - DNA, 31 bp, Artificial Sequence
  Description of Artificial Sequence: Synthetic oligonucleotide
gcggcttgaagaatttggacgatttgccagc

SEQ ID NO: 62184 - DNA, 34 bp, Artificial Sequence
  Description of Artificial Sequence: Synthetic oligonucleotide
cggcttgaagaatttggacgatttgccagctttg

SEQ ID NO: 62185 - DNA, 35 bp, Artificial Sequence
  Description of Artificial Sequence: Synthetic oligonucleotide
ggcttgaagaatttggacgatttgccagctttgag

SEQ ID NO: 62186 - DNA, 35 bp, Artificial Sequence
  Description of Artificial Sequence: Synthetic oligonucleotide
gcttgaagaatttggacgatttgccagctttgagg

SEQ ID NO: 62187 - DNA, 35 bp, Artificial Sequence
  Description of Artificial Sequence: Synthetic oligonucleotide
cttgaagaatttggacgatttgccagctttgaggc

SEQ ID NO: 62188 - DNA, 36 bp, Artificial Sequence
  Description of Artificial Sequence: Synthetic oligonucleotide
ttgaagaatttggacgatttgccagctttgaggctc

SEQ ID NO: 62189 - DNA, 35 bp, Artificial Sequence
  Description of Artificial Sequence: Synthetic oligonucleotide
tgaagaatttggacgatttgccagctttgaggctc

SEQ ID NO: 62190 - DNA, 34 bp, Artificial Sequence
  Description of Artificial Sequence: Synthetic oligonucleotide
gaagaatttggacgatttgccagctttgaggctc

SEQ ID NO: 62191 - DNA, 36 bp, Artificial Sequence
  Description of Artificial Sequence: Synthetic oligonucleotide
aagaatttggacgatttgccagctttgaggctcaag

SEQ ID NO: 62192 - DNA, 35 bp, Artificial Sequence
  Description of Artificial Sequence: Synthetic oligonucleotide
agaatttggacgatttgccagctttgaggctcaag

SEQ ID NO: 62193 - DNA, 34 bp, Artificial Sequence
  Description of Artificial Sequence: Synthetic oligonucleotide
gaatttggacgatttgccagctttgaggctcaag

SEQ ID NO: 62194 - DNA, 34 bp, Artificial Sequence
  Description of Artificial Sequence: Synthetic oligonucleotide
aatttggacgatttgccagctttgaggctcaagg

SEQ ID NO: 62195 - DNA, 33 bp, Artificial Sequence
  Description of Artificial Sequence: Synthetic oligonucleotide
atttggacgatttgccagctttgaggctcaagg

SEQ ID NO: 62196 - DNA, 32 bp, Artificial Sequence
  Description of Artificial Sequence: Synthetic oligonucleotide
tttggacgatttgccagctttgaggctcaagg

SEQ ID NO: 62197 - DNA, 31 bp, Artificial Sequence
  Description of Artificial Sequence: Synthetic oligonucleotide
ttggacgatttgccagctttgaggctcaagg

SEQ ID NO: 62198 - DNA, 30 bp, Artificial Sequence
  Description of Artificial Sequence: Synthetic oligonucleotide
tggacgatttgccagctttgaggctcaagg

SEQ ID NO: 62199 - DNA, 29 bp, Artificial Sequence
  Description of Artificial Sequence: Synthetic oligonucleotide
ggacgatttgccagctttgaggctcaagg

SEQ ID NO: 62200 - DNA, 30 bp, Artificial Sequence
  Description of Artificial Sequence: Synthetic oligonucleotide
gacgatttgccagctttgaggctcaaggtg

SEQ ID NO: 62201 - DNA, 30 bp, Artificial Sequence
  Description of Artificial Sequence: Synthetic oligonucleotide
acgatttgccagctttgaggctcaaggtgc

SEQ ID NO: 62202 - DNA, 29 bp, Artificial Sequence
  Description of Artificial Sequence: Synthetic oligonucleotide
cgatttgccagctttgaggctcaaggtgc

SEQ ID NO: 62203 - DNA, 32 bp, Artificial Sequence
  Description of Artificial Sequence: Synthetic oligonucleotide
gatttgccagctttgaggctcaaggtgcattg

SEQ ID NO: 62204 - DNA, 32 bp, Artificial Sequence
  Description of Artificial Sequence: Synthetic oligonucleotide
atttgccagctttgaggctcaaggtgcattgg

SEQ ID NO: 62205 - DNA, 31 bp, Artificial Sequence
  Description of Artificial Sequence: Synthetic oligonucleotide
tttgccagctttgaggctcaaggtgcattgg

SEQ ID NO: 62206 - DNA, 30 bp, Artificial Sequence
  Description of Artificial Sequence: Synthetic oligonucleotide
ttgccagctttgaggctcaaggtgcattgg

SEQ ID NO: 62207 - DNA, 29 bp, Artificial Sequence
  Description of Artificial Sequence: Synthetic oligonucleotide
tgccagctttgaggctcaaggtgcattgg

SEQ ID NO: 62208 - DNA, 28 bp, Artificial Sequence
  Description of Artificial Sequence: Synthetic oligonucleotide
gccagctttgaggctcaaggtgcattgg

SEQ ID NO: 62209 - DNA, 28 bp, Artificial Sequence
  Description of Artificial Sequence: Synthetic oligonucleotide
ccagctttgaggctcaaggtgcattggc

SEQ ID NO: 62210 - DNA, 28 bp, Artificial Sequence
  Description of Artificial Sequence: Synthetic oligonucleotide
cagctttgaggctcaaggtgcattggcc

SEQ ID NO: 62211 - DNA, 30 bp, Artificial Sequence
  Description of Artificial Sequence: Synthetic oligonucleotide
agctttgaggctcaaggtgcattggccaac

SEQ ID NO: 62212 - DNA, 29 bp, Artificial Sequence
  Description of Artificial Sequence: Synthetic oligonucleotide
gctttgaggctcaaggtgcattggccaac

SEQ ID NO: 62213 - DNA, 32 bp, Artificial Sequence
  Description of Artificial Sequence: Synthetic oligonucleotide
ctttgaggctcaaggtgcattggccaacatag

SEQ ID NO: 62214 - DNA, 32 bp, Artificial Sequence
  Description of Artificial Sequence: Synthetic oligonucleotide
tttgaggctcaaggtgcattggccaacatagc

SEQ ID NO: 62215 - DNA, 31 bp, Artificial Sequence
  Description of Artificial Sequence: Synthetic oligonucleotide
ttgaggctcaaggtgcattggccaacatagc

SEQ ID NO: 62216 - DNA, 30 bp, Artificial Sequence
  Description of Artificial Sequence: Synthetic oligonucleotide
tgaggctcaaggtgcattggccaacatagc

SEQ ID NO: 62217 - DNA, 29 bp, Artificial Sequence
  Description of Artificial Sequence: Synthetic oligonucleotide
gaggctcaaggtgcattggccaacatagc

SEQ ID NO: 62218 - DNA, 30 bp, Artificial Sequence
  Description of Artificial Sequence: Synthetic oligonucleotide
aggctcaaggtgcattggccaacatagctg

SEQ ID NO: 62219 - DNA, 29 bp, Artificial Sequence
  Description of Artificial Sequence: Synthetic oligonucleotide
ggctcaaggtgcattggccaacatagctg

SEQ ID NO: 62220 - DNA, 30 bp, Artificial Sequence
  Description of Artificial Sequence: Synthetic oligonucleotide
gctcaaggtgcattggccaacatagctgtg

SEQ ID NO: 62221 - DNA, 30 bp, Artificial Sequence
  Description of Artificial Sequence: Synthetic oligonucleotide
ctcaaggtgcattggccaacatagctgtgg

SEQ ID NO: 62222 - DNA, 31 bp, Artificial Sequence
  Description of Artificial Sequence: Synthetic oligonucleotide
tcaaggtgcattggccaacatagctgtggac

SEQ ID NO: 62223 - DNA, 30 bp, Artificial Sequence
  Description of Artificial Sequence: Synthetic oligonucleotide
caaggtgcattggccaacatagctgtggac

SEQ ID NO: 62224 - DNA, 33 bp, Artificial Sequence
  Description of Artificial Sequence: Synthetic oligonucleotide
aaggtgcattggccaacatagctgtggacaaag

SEQ ID NO: 62225 - DNA, 32 bp, Artificial Sequence
  Description of Artificial Sequence: Synthetic oligonucleotide
aggtgcattggccaacatagctgtggacaaag

SEQ ID NO: 62226 - DNA, 31 bp, Artificial Sequence
  Description of Artificial Sequence: Synthetic oligonucleotide
ggtgcattggccaacatagctgtggacaaag

SEQ ID NO: 62227 - DNA, 31 bp, Artificial Sequence
  Description of Artificial Sequence: Synthetic oligonucleotide
gtgcattggccaacatagctgtggacaaagc

SEQ ID NO: 62228 - DNA, 31 bp, Artificial Sequence
  Description of Artificial Sequence: Synthetic oligonucleotide
tgcattggccaacatagctgtggacaaagcc

SEQ ID NO: 62229 - DNA, 30 bp, Artificial Sequence
  Description of Artificial Sequence: Synthetic oligonucleotide
gcattggccaacatagctgtggacaaagcc

SEQ ID NO: 62230 - DNA, 32 bp, Artificial Sequence
  Description of Artificial Sequence: Synthetic oligonucleotide
cattggccaacatagctgtggacaaagccaac

SEQ ID NO: 62231 - DNA, 32 bp, Artificial Sequence
  Description of Artificial Sequence: Synthetic oligonucleotide
attggccaacatagctgtggacaaagccaacc

SEQ ID NO: 62232 - DNA, 31 bp, Artificial Sequence
  Description of Artificial Sequence: Synthetic oligonucleotide
ttggccaacatagctgtggacaaagccaacc

SEQ ID NO: 62233 - DNA, 30 bp, Artificial Sequence
  Description of Artificial Sequence: Synthetic oligonucleotide
tggccaacatagctgtggacaaagccaacc

SEQ ID NO: 62234 - DNA, 29 bp, Artificial Sequence
  Description of Artificial Sequence: Synthetic oligonucleotide
ggccaacatagctgtggacaaagccaacc

SEQ ID NO: 62235 - DNA, 30 bp, Artificial Sequence
  Description of Artificial Sequence: Synthetic oligonucleotide
gccaacatagctgtggacaaagccaacctg

SEQ ID NO: 62236 - DNA, 30 bp, Artificial Sequence
  Description of Artificial Sequence: Synthetic oligonucleotide
ccaacatagctgtggacaaagccaacctgg

SEQ ID NO: 62237 - DNA, 34 bp, Artificial Sequence
  Description of Artificial Sequence: Synthetic oligonucleotide
caacatagctgtggacaaagccaacctggaaatc

SEQ ID NO: 62238 - DNA, 36 bp, Artificial Sequence
  Description of Artificial Sequence: Synthetic oligonucleotide
aacatagctgtggacaaagccaacctggaaatcatg

SEQ ID NO: 62239 - DNA, 35 bp, Artificial Sequence
  Description of Artificial Sequence: Synthetic oligonucleotide
acatagctgtggacaaagccaacctggaaatcatg

SEQ ID NO: 62240 - DNA, 34 bp, Artificial Sequence
  Description of Artificial Sequence: Synthetic oligonucleotide
catagctgtggacaaagccaacctggaaatcatg

SEQ ID NO: 62241 - DNA, 35 bp, Artificial Sequence
  Description of Artificial Sequence: Synthetic oligonucleotide
atagctgtggacaaagccaacctggaaatcatgac

SEQ ID NO: 62242 - DNA, 34 bp, Artificial Sequence
  Description of Artificial Sequence: Synthetic oligonucleotide
tagctgtggacaaagccaacctggaaatcatgac

SEQ ID NO: 62243 - DNA, 33 bp, Artificial Sequence
  Description of Artificial Sequence: Synthetic oligonucleotide
agctgtggacaaagccaacctggaaatcatgac

SEQ ID NO: 62244 - DNA, 32 bp, Artificial Sequence
  Description of Artificial Sequence: Synthetic oligonucleotide
gctgtggacaaagccaacctggaaatcatgac

SEQ ID NO: 62245 - DNA, 35 bp, Artificial Sequence
  Description of Artificial Sequence: Synthetic oligonucleotide
ctgtggacaaagccaacctggaaatcatgacaaag

SEQ ID NO: 62246 - DNA, 35 bp, Artificial Sequence
  Description of Artificial Sequence: Synthetic oligonucleotide
tgtggacaaagccaacctggaaatcatgacaaagc

SEQ ID NO: 62247 - DNA, 34 bp, Artificial Sequence
  Description of Artificial Sequence: Synthetic oligonucleotide
gtggacaaagccaacctggaaatcatgacaaagc

SEQ ID NO: 62248 - DNA, 34 bp, Artificial Sequence
  Description of Artificial Sequence: Synthetic oligonucleotide
tggacaaagccaacctggaaatcatgacaaagcg

SEQ ID NO: 62249 - DNA, 33 bp, Artificial Sequence
  Description of Artificial Sequence: Synthetic oligonucleotide
ggacaaagccaacctggaaatcatgacaaagcg

SEQ ID NO: 62250 - DNA, 33 bp, Artificial Sequence
  Description of Artificial Sequence: Synthetic oligonucleotide
gacaaagccaacctggaaatcatgacaaagcgc

SEQ ID NO: 62251 - DNA, 34 bp, Artificial Sequence
  Description of Artificial Sequence: Synthetic oligonucleotide
acaaagccaacctggaaatcatgacaaagcgctc

SEQ ID NO: 62252 - DNA, 33 bp, Artificial Sequence
  Description of Artificial Sequence: Synthetic oligonucleotide
caaagccaacctggaaatcatgacaaagcgctc

SEQ ID NO: 62253 - DNA, 33 bp, Artificial Sequence
  Description of Artificial Sequence: Synthetic oligonucleotide
aaagccaacctggaaatcatgacaaagcgctcc

SEQ ID NO: 62254 - DNA, 32 bp, Artificial Sequence
  Description of Artificial Sequence: Synthetic oligonucleotide
aagccaacctggaaatcatgacaaagcgctcc

SEQ ID NO: 62255 - DNA, 31 bp, Artificial Sequence
  Description of Artificial Sequence: Synthetic oligonucleotide
agccaacctggaaatcatgacaaagcgctcc

SEQ ID NO: 62256 - DNA, 30 bp, Artificial Sequence
  Description of Artificial Sequence: Synthetic oligonucleotide
gccaacctggaaatcatgacaaagcgctcc

SEQ ID NO: 62257 - DNA, 32 bp, Artificial Sequence
  Description of Artificial Sequence: Synthetic oligonucleotide
ccaacctggaaatcatgacaaagcgctccaac

SEQ ID NO: 62258 - DNA, 36 bp, Artificial Sequence
  Description of Artificial Sequence: Synthetic oligonucleotide
caacctggaaatcatgacaaagcgctccaactatac

SEQ ID NO: 62259 - DNA, 37 bp, Artificial Sequence
  Description of Artificial Sequence: Synthetic oligonucleotide
aacctggaaatcatgacaaagcgctccaactatactc

SEQ ID NO: 62260 - DNA, 36 bp, Artificial Sequence
  Description of Artificial Sequence: Synthetic oligonucleotide
acctggaaatcatgacaaagcgctccaactatactc

SEQ ID NO: 62261 - DNA, 35 bp, Artificial Sequence
  Description of Artificial Sequence: Synthetic oligonucleotide
cctggaaatcatgacaaagcgctccaactatactc

SEQ ID NO: 62262 - DNA, 35 bp, Artificial Sequence
  Description of Artificial Sequence: Synthetic oligonucleotide
ctggaaatcatgacaaagcgctccaactatactcc

SEQ ID NO: 62263 - DNA, 35 bp, Artificial Sequence
  Description of Artificial Sequence: Synthetic oligonucleotide
tggaaatcatgacaaagcgctccaactatactccg

SEQ ID NO: 62264 - DNA, 34 bp, Artificial Sequence
  Description of Artificial Sequence: Synthetic oligonucleotide
ggaaatcatgacaaagcgctccaactatactccg

SEQ ID NO: 62265 - DNA, 36 bp, Artificial Sequence
  Description of Artificial Sequence: Synthetic oligonucleotide
gaaatcatgacaaagcgctccaactatactccgatc

SEQ ID NO: 62266 - DNA, 37 bp, Artificial Sequence
  Description of Artificial Sequence: Synthetic oligonucleotide
aaatcatgacaaagcgctccaactatactccgatcac

SEQ ID NO: 62267 - DNA, 36 bp, Artificial Sequence
  Description of Artificial Sequence: Synthetic oligonucleotide
aatcatgacaaagcgctccaactatactccgatcac

SEQ ID NO: 62268 - DNA, 35 bp, Artificial Sequence
  Description of Artificial Sequence: Synthetic oligonucleotide
atcatgacaaagcgctccaactatactccgatcac

SEQ ID NO: 62269 - DNA, 34 bp, Artificial Sequence
  Description of Artificial Sequence: Synthetic oligonucleotide
tcatgacaaagcgctccaactatactccgatcac

SEQ ID NO: 62270 - DNA, 33 bp, Artificial Sequence
  Description of Artificial Sequence: Synthetic oligonucleotide
catgacaaagcgctccaactatactccgatcac

SEQ ID NO: 62271 - DNA, 33 bp, Artificial Sequence
  Description of Artificial Sequence: Synthetic oligonucleotide
atgacaaagcgctccaactatactccgatcacc

SEQ ID NO: 62272 - DNA, 32 bp, Artificial Sequence
  Description of Artificial Sequence: Synthetic oligonucleotide
tgacaaagcgctccaactatactccgatcacc

SEQ ID NO: 62273 - DNA, 31 bp, Artificial Sequence
  Description of Artificial Sequence: Synthetic oligonucleotide
gacaaagcgctccaactatactccgatcacc

SEQ ID NO: 62274 - DNA, 34 bp, Artificial Sequence
  Description of Artificial Sequence: Synthetic oligonucleotide
acaaagcgctccaactatactccgatcaccaatg

SEQ ID NO: 62275 - DNA, 33 bp, Artificial Sequence
  Description of Artificial Sequence: Synthetic oligonucleotide
caaagcgctccaactatactccgatcaccaatg

SEQ ID NO: 62276 - DNA, 35 bp, Artificial Sequence
  Description of Artificial Sequence: Synthetic oligonucleotide
aaagcgctccaactatactccgatcaccaatgtac

SEQ ID NO: 62277 - DNA, 34 bp, Artificial Sequence
  Description of Artificial Sequence: Synthetic oligonucleotide
aagcgctccaactatactccgatcaccaatgtac

SEQ ID NO: 62278 - DNA, 33 bp, Artificial Sequence
  Description of Artificial Sequence: Synthetic oligonucleotide
agcgctccaactatactccgatcaccaatgtac

SEQ ID NO: 62279 - DNA, 32 bp, Artificial Sequence
  Description of Artificial Sequence: Synthetic oligonucleotide
gcgctccaactatactccgatcaccaatgtac

SEQ ID NO: 62280 - DNA, 32 bp, Artificial Sequence
  Description of Artificial Sequence: Synthetic oligonucleotide
cgctccaactatactccgatcaccaatgtacc

SEQ ID NO: 62281 - DNA, 33 bp, Artificial Sequence
  Description of Artificial Sequence: Synthetic oligonucleotide
gctccaactatactccgatcaccaatgtacctc

SEQ ID NO: 62282 - DNA, 33 bp, Artificial Sequence
  Description of Artificial Sequence: Synthetic oligonucleotide
ctccaactatactccgatcaccaatgtacctcc

SEQ ID NO: 62283 - DNA, 34 bp, Artificial Sequence
  Description of Artificial Sequence: Synthetic oligonucleotide
tccaactatactccgatcaccaatgtacctccag

SEQ ID NO: 62284 - DNA, 33 bp, Artificial Sequence
  Description of Artificial Sequence: Synthetic oligonucleotide
ccaactatactccgatcaccaatgtacctccag

SEQ ID NO: 62285 - DNA, 34 bp, Artificial Sequence
  Description of Artificial Sequence: Synthetic oligonucleotide
caactatactccgatcaccaatgtacctccagag

SEQ ID NO: 62286 - DNA, 34 bp, Artificial Sequence
  Description of Artificial Sequence: Synthetic oligonucleotide
aactatactccgatcaccaatgtacctccagagg

SEQ ID NO: 62287 - DNA, 33 bp, Artificial Sequence
  Description of Artificial Sequence: Synthetic oligonucleotide
actatactccgatcaccaatgtacctccagagg

SEQ ID NO: 62288 - DNA, 32 bp, Artificial Sequence
  Description of Artificial Sequence: Synthetic oligonucleotide
ctatactccgatcaccaatgtacctccagagg

SEQ ID NO: 62289 - DNA, 35 bp, Artificial Sequence
  Description of Artificial Sequence: Synthetic oligonucleotide
tatactccgatcaccaatgtacctccagaggtaac

SEQ ID NO: 62290 - DNA, 34 bp, Artificial Sequence
  Description of Artificial Sequence: Synthetic oligonucleotide
atactccgatcaccaatgtacctccagaggtaac

SEQ ID NO: 62291 - DNA, 33 bp, Artificial Sequence
  Description of Artificial Sequence: Synthetic oligonucleotide
tactccgatcaccaatgtacctccagaggtaac

SEQ ID NO: 62292 - DNA, 32 bp, Artificial Sequence
  Description of Artificial Sequence: Synthetic oligonucleotide
actccgatcaccaatgtacctccagaggtaac

SEQ ID NO: 62293 - DNA, 31 bp, Artificial Sequence
  Description of Artificial Sequence: Synthetic oligonucleotide
ctccgatcaccaatgtacctccagaggtaac

SEQ ID NO: 62294 - DNA, 32 bp, Artificial Sequence
  Description of Artificial Sequence: Synthetic oligonucleotide
tccgatcaccaatgtacctccagaggtaactg

SEQ ID NO: 62295 - DNA, 31 bp, Artificial Sequence
  Description of Artificial Sequence: Synthetic oligonucleotide
ccgatcaccaatgtacctccagaggtaactg

SEQ ID NO: 62296 - DNA, 32 bp, Artificial Sequence
  Description of Artificial Sequence: Synthetic oligonucleotide
cgatcaccaatgtacctccagaggtaactgtg

SEQ ID NO: 62297 - DNA, 32 bp, Artificial Sequence
  Description of Artificial Sequence: Synthetic oligonucleotide
gatcaccaatgtacctccagaggtaactgtgc

SEQ ID NO: 62298 - DNA, 33 bp, Artificial Sequence
  Description of Artificial Sequence: Synthetic oligonucleotide
atcaccaatgtacctccagaggtaactgtgctc

SEQ ID NO: 62299 - DNA, 32 bp, Artificial Sequence
  Description of Artificial Sequence: Synthetic oligonucleotide
tcaccaatgtacctccagaggtaactgtgctc

SEQ ID NO: 62300 - DNA, 31 bp, Artificial Sequence
  Description of Artificial Sequence: Synthetic oligonucleotide
caccaatgtacctccagaggtaactgtgctc

SEQ ID NO: 62301 - DNA, 32 bp, Artificial Sequence
  Description of Artificial Sequence: Synthetic oligonucleotide
accaatgtacctccagaggtaactgtgctcac

SEQ ID NO: 62302 - DNA, 31 bp, Artificial Sequence
  Description of Artificial Sequence: Synthetic oligonucleotide
ccaatgtacctccagaggtaactgtgctcac

SEQ ID NO: 62303 - DNA, 31 bp, Artificial Sequence
  Description of Artificial Sequence: Synthetic oligonucleotide
caatgtacctccagaggtaactgtgctcacg

SEQ ID NO: 62304 - DNA, 33 bp, Artificial Sequence
  Description of Artificial Sequence: Synthetic oligonucleotide
aatgtacctccagaggtaactgtgctcacgaac

SEQ ID NO: 62305 - DNA, 32 bp, Artificial Sequence
  Description of Artificial Sequence: Synthetic oligonucleotide
atgtacctccagaggtaactgtgctcacgaac

SEQ ID NO: 62306 - DNA, 31 bp, Artificial Sequence
  Description of Artificial Sequence: Synthetic oligonucleotide
tgtacctccagaggtaactgtgctcacgaac

SEQ ID NO: 62307 - DNA, 30 bp, Artificial Sequence
  Description of Artificial Sequence: Synthetic oligonucleotide
gtacctccagaggtaactgtgctcacgaac

SEQ ID NO: 62308 - DNA, 31 bp, Artificial Sequence
  Description of Artificial Sequence: Synthetic oligonucleotide
tacctccagaggtaactgtgctcacgaacag

SEQ ID NO: 62309 - DNA, 30 bp, Artificial Sequence
  Description of Artificial Sequence: Synthetic oligonucleotide
acctccagaggtaactgtgctcacgaacag

SEQ ID NO: 62310 - DNA, 29 bp, Artificial Sequence
  Description of Artificial Sequence: Synthetic oligonucleotide
cctccagaggtaactgtgctcacgaacag

SEQ ID NO: 62311 - DNA, 29 bp, Artificial Sequence
  Description of Artificial Sequence: Synthetic oligonucleotide
ctccagaggtaactgtgctcacgaacagc

SEQ ID NO: 62312 - DNA, 29 bp, Artificial Sequence
  Description of Artificial Sequence: Synthetic oligonucleotide
tccagaggtaactgtgctcacgaacagcc

SEQ ID NO: 62313 - DNA, 28 bp, Artificial Sequence
  Description of Artificial Sequence: Synthetic oligonucleotide
ccagaggtaactgtgctcacgaacagcc

SEQ ID NO: 62314 - DNA, 28 bp, Artificial Sequence
  Description of Artificial Sequence: Synthetic oligonucleotide
cagaggtaactgtgctcacgaacagccc

SEQ ID NO: 62315 - DNA, 29 bp, Artificial Sequence
  Description of Artificial Sequence: Synthetic oligonucleotide
agaggtaactgtgctcacgaacagccctg

SEQ ID NO: 62316 - DNA, 28 bp, Artificial Sequence
  Description of Artificial Sequence: Synthetic oligonucleotide
gaggtaactgtgctcacgaacagccctg

SEQ ID NO: 62317 - DNA, 29 bp, Artificial Sequence
  Description of Artificial Sequence: Synthetic oligonucleotide
aggtaactgtgctcacgaacagccctgtg

SEQ ID NO: 62318 - DNA, 28 bp, Artificial Sequence
  Description of Artificial Sequence: Synthetic oligonucleotide
ggtaactgtgctcacgaacagccctgtg

SEQ ID NO: 62319 - DNA, 28 bp, Artificial Sequence
  Description of Artificial Sequence: Synthetic oligonucleotide
gtaactgtgctcacgaacagccctgtgg

SEQ ID NO: 62320 - DNA, 30 bp, Artificial Sequence
  Description of Artificial Sequence: Synthetic oligonucleotide
taactgtgctcacgaacagccctgtggaac

SEQ ID NO: 62321 - DNA, 29 bp, Artificial Sequence
  Description of Artificial Sequence: Synthetic oligonucleotide
aactgtgctcacgaacagccctgtggaac

SEQ ID NO: 62322 - DNA, 28 bp, Artificial Sequence
  Description of Artificial Sequence: Synthetic oligonucleotide
actgtgctcacgaacagccctgtggaac

SEQ ID NO: 62323 - DNA, 27 bp, Artificial Sequence
  Description of Artificial Sequence: Synthetic oligonucleotide
ctgtgctcacgaacagccctgtggaac

SEQ ID NO: 62324 - DNA, 28 bp, Artificial Sequence
  Description of Artificial Sequence: Synthetic oligonucleotide
tgtgctcacgaacagccctgtggaactg

SEQ ID NO: 62325 - DNA, 27 bp, Artificial Sequence
  Description of Artificial Sequence: Synthetic oligonucleotide
gtgctcacgaacagccctgtggaactg

SEQ ID NO: 62326 - DNA, 28 bp, Artificial Sequence
  Description of Artificial Sequence: Synthetic oligonucleotide
tgctcacgaacagccctgtggaactgag

SEQ ID NO: 62327 - DNA, 27 bp, Artificial Sequence
  Description of Artificial Sequence: Synthetic oligonucleotide
gctcacgaacagccctgtggaactgag

SEQ ID NO: 62328 - DNA, 28 bp, Artificial Sequence
  Description of Artificial Sequence: Synthetic oligonucleotide
ctcacgaacagccctgtggaactgagag

SEQ ID NO: 62329 - DNA, 29 bp, Artificial Sequence
  Description of Artificial Sequence: Synthetic oligonucleotide
tcacgaacagccctgtggaactgagagag

SEQ ID NO: 62330 - DNA, 28 bp, Artificial Sequence
  Description of Artificial Sequence: Synthetic oligonucleotide
cacgaacagccctgtggaactgagagag

SEQ ID NO: 62331 - DNA, 28 bp, Artificial Sequence
  Description of Artificial Sequence: Synthetic oligonucleotide
acgaacagccctgtggaactgagagagc

SEQ ID NO: 62332 - DNA, 27 bp, Artificial Sequence
  Description of Artificial Sequence: Synthetic oligonucleotide
cgaacagccctgtggaactgagagagc

SEQ ID NO: 62333 - DNA, 27 bp, Artificial Sequence
  Description of Artificial Sequence: Synthetic oligonucleotide
gaacagccctgtggaactgagagagcc

SEQ ID NO: 62334 - DNA, 27 bp, Artificial Sequence
  Description of Artificial Sequence: Synthetic oligonucleotide
aacagccctgtggaactgagagagccc

SEQ ID NO: 62335 - DNA, 27 bp, Artificial Sequence
  Description of Artificial Sequence: Synthetic oligonucleotide
acagccctgtggaactgagagagccca

SEQ ID NO: 62336 - DNA, 27 bp, Artificial Sequence
  Description of Artificial Sequence: Synthetic oligonucleotide
cagccctgtggaactgagagagcccaa

SEQ ID NO: 62337 - DNA, 27 bp, Artificial Sequence
  Description of Artificial Sequence: Synthetic oligonucleotide
agccctgtggaactgagagagcccaac

SEQ ID NO: 62338 - DNA, 26 bp, Artificial Sequence
  Description of Artificial Sequence: Synthetic oligonucleotide
gccctgtggaactgagagagcccaac

SEQ ID NO: 62339 - DNA, 27 bp, Artificial Sequence
  Description of Artificial Sequence: Synthetic oligonucleotide
ccctgtggaactgagagagcccaacgt

SEQ ID NO: 62340 - DNA, 27 bp, Artificial Sequence
  Description of Artificial Sequence: Synthetic oligonucleotide
cctgtggaactgagagagcccaacgtc

SEQ ID NO: 62341 - DNA, 27 bp, Artificial Sequence
  Description of Artificial Sequence: Synthetic oligonucleotide
ctgtggaactgagagagcccaacgtcc

SEQ ID NO: 62342 - DNA, 28 bp, Artificial Sequence
  Description of Artificial Sequence: Synthetic oligonucleotide
tgtggaactgagagagcccaacgtcctc

SEQ ID NO: 62343 - DNA, 27 bp, Artificial Sequence
  Description of Artificial Sequence: Synthetic oligonucleotide
gtggaactgagagagcccaacgtcctc

SEQ ID NO: 62344 - DNA, 29 bp, Artificial Sequence
  Description of Artificial Sequence: Synthetic oligonucleotide
tggaactgagagagcccaacgtcctcatc

SEQ ID NO: 62345 - DNA, 28 bp, Artificial Sequence
  Description of Artificial Sequence: Synthetic oligonucleotide
ggaactgagagagcccaacgtcctcatc

SEQ ID NO: 62346 - DNA, 29 bp, Artificial Sequence
  Description of Artificial Sequence: Synthetic oligonucleotide
gaactgagagagcccaacgtcctcatctg

SEQ ID NO: 62347 - DNA, 32 bp, Artificial Sequence
  Description of Artificial Sequence: Synthetic oligonucleotide
aactgagagagcccaacgtcctcatctgtttc

SEQ ID NO: 62348 - DNA, 31 bp, Artificial Sequence
  Description of Artificial Sequence: Synthetic oligonucleotide
actgagagagcccaacgtcctcatctgtttc

SEQ ID NO: 62349 - DNA, 30 bp, Artificial Sequence
  Description of Artificial Sequence: Synthetic oligonucleotide
ctgagagagcccaacgtcctcatctgtttc

SEQ ID NO: 62350 - DNA, 32 bp, Artificial Sequence
  Description of Artificial Sequence: Synthetic oligonucleotide
tgagagagcccaacgtcctcatctgtttcatc

SEQ ID NO: 62351 - DNA, 31 bp, Artificial Sequence
  Description of Artificial Sequence: Synthetic oligonucleotide
gagagagcccaacgtcctcatctgtttcatc

SEQ ID NO: 62352 - DNA, 31 bp, Artificial Sequence
  Description of Artificial Sequence: Synthetic oligonucleotide
agagagcccaacgtcctcatctgtttcatcg

SEQ ID NO: 62353 - DNA, 30 bp, Artificial Sequence
  Description of Artificial Sequence: Synthetic oligonucleotide
gagagcccaacgtcctcatctgtttcatcg

SEQ ID NO: 62354 - DNA, 31 bp, Artificial Sequence
  Description of Artificial Sequence: Synthetic oligonucleotide
agagcccaacgtcctcatctgtttcatcgac

SEQ ID NO: 62355 - DNA, 30 bp, Artificial Sequence
  Description of Artificial Sequence: Synthetic oligonucleotide
gagcccaacgtcctcatctgtttcatcgac

SEQ ID NO: 62356 - DNA, 32 bp, Artificial Sequence
  Description of Artificial Sequence: Synthetic oligonucleotide
agcccaacgtcctcatctgtttcatcgacaag

SEQ ID NO: 62357 - DNA, 31 bp, Artificial Sequence
  Description of Artificial Sequence: Synthetic oligonucleotide
gcccaacgtcctcatctgtttcatcgacaag

SEQ ID NO: 62358 - DNA, 33 bp, Artificial Sequence
  Description of Artificial Sequence: Synthetic oligonucleotide
cccaacgtcctcatctgtttcatcgacaagttc

SEQ ID NO: 62359 - DNA, 34 bp, Artificial Sequence
  Description of Artificial Sequence: Synthetic oligonucleotide
ccaacgtcctcatctgtttcatcgacaagttcac

SEQ ID NO: 62360 - DNA, 34 bp, Artificial Sequence
  Description of Artificial Sequence: Synthetic oligonucleotide
caacgtcctcatctgtttcatcgacaagttcacc

SEQ ID NO: 62361 - DNA, 34 bp, Artificial Sequence
  Description of Artificial Sequence: Synthetic oligonucleotide
aacgtcctcatctgtttcatcgacaagttcaccc

SEQ ID NO: 62362 - DNA, 33 bp, Artificial Sequence
  Description of Artificial Sequence: Synthetic oligonucleotide
acgtcctcatctgtttcatcgacaagttcaccc

SEQ ID NO: 62363 - DNA, 32 bp, Artificial Sequence
  Description of Artificial Sequence: Synthetic oligonucleotide
cgtcctcatctgtttcatcgacaagttcaccc

SEQ ID NO: 62364 - DNA, 32 bp, Artificial Sequence
  Description of Artificial Sequence: Synthetic oligonucleotide
gtcctcatctgtttcatcgacaagttcacccc

SEQ ID NO: 62365 - DNA, 33 bp, Artificial Sequence
  Description of Artificial Sequence: Synthetic oligonucleotide
tcctcatctgtttcatcgacaagttcaccccac

SEQ ID NO: 62366 - DNA, 32 bp, Artificial Sequence
  Description of Artificial Sequence: Synthetic oligonucleotide
cctcatctgtttcatcgacaagttcaccccac

SEQ ID NO: 62367 - DNA, 32 bp, Artificial Sequence
  Description of Artificial Sequence: Synthetic oligonucleotide
ctcatctgtttcatcgacaagttcaccccacc

SEQ ID NO: 62368 - DNA, 33 bp, Artificial Sequence
  Description of Artificial Sequence: Synthetic oligonucleotide
tcatctgtttcatcgacaagttcaccccaccag

SEQ ID NO: 62369 - DNA, 32 bp, Artificial Sequence
  Description of Artificial Sequence: Synthetic oligonucleotide
catctgtttcatcgacaagttcaccccaccag

SEQ ID NO: 62370 - DNA, 33 bp, Artificial Sequence
  Description of Artificial Sequence: Synthetic oligonucleotide
atctgtttcatcgacaagttcaccccaccagtg

SEQ ID NO: 62371 - DNA, 32 bp, Artificial Sequence
  Description of Artificial Sequence: Synthetic oligonucleotide
tctgtttcatcgacaagttcaccccaccagtg

SEQ ID NO: 62372 - DNA, 31 bp, Artificial Sequence
  Description of Artificial Sequence: Synthetic oligonucleotide
ctgtttcatcgacaagttcaccccaccagtg

SEQ ID NO: 62373 - DNA, 31 bp, Artificial Sequence
  Description of Artificial Sequence: Synthetic oligonucleotide
tgtttcatcgacaagttcaccccaccagtgg

SEQ ID NO: 62374 - DNA, 30 bp, Artificial Sequence
  Description of Artificial Sequence: Synthetic oligonucleotide
gtttcatcgacaagttcaccccaccagtgg

SEQ ID NO: 62375 - DNA, 31 bp, Artificial Sequence
  Description of Artificial Sequence: Synthetic oligonucleotide
tttcatcgacaagttcaccccaccagtggtc

SEQ ID NO: 62376 - DNA, 30 bp, Artificial Sequence
  Description of Artificial Sequence: Synthetic oligonucleotide
ttcatcgacaagttcaccccaccagtggtc

SEQ ID NO: 62377 - DNA, 29 bp, Artificial Sequence
  Description of Artificial Sequence: Synthetic oligonucleotide
tcatcgacaagttcaccccaccagtggtc

SEQ ID NO: 62378 - DNA, 28 bp, Artificial Sequence
  Description of Artificial Sequence: Synthetic oligonucleotide
catcgacaagttcaccccaccagtggtc

SEQ ID NO: 62379 - DNA, 31 bp, Artificial Sequence
  Description of Artificial Sequence: Synthetic oligonucleotide
atcgacaagttcaccccaccagtggtcaatg

SEQ ID NO: 62380 - DNA, 30 bp, Artificial Sequence
  Description of Artificial Sequence: Synthetic oligonucleotide
tcgacaagttcaccccaccagtggtcaatg

SEQ ID NO: 62381 - DNA, 29 bp, Artificial Sequence
  Description of Artificial Sequence: Synthetic oligonucleotide
cgacaagttcaccccaccagtggtcaatg

SEQ ID NO: 62382 - DNA, 30 bp, Artificial Sequence
  Description of Artificial Sequence: Synthetic oligonucleotide
gacaagttcaccccaccagtggtcaatgtc

SEQ ID NO: 62383 - DNA, 31 bp, Artificial Sequence
  Description of Artificial Sequence: Synthetic oligonucleotide
acaagttcaccccaccagtggtcaatgtcac

SEQ ID NO: 62384 - DNA, 30 bp, Artificial Sequence
  Description of Artificial Sequence: Synthetic oligonucleotide
caagttcaccccaccagtggtcaatgtcac

SEQ ID NO: 62385 - DNA, 30 bp, Artificial Sequence
  Description of Artificial Sequence: Synthetic oligonucleotide
aagttcaccccaccagtggtcaatgtcacg

SEQ ID NO: 62386 - DNA, 29 bp, Artificial Sequence
  Description of Artificial Sequence: Synthetic oligonucleotide
agttcaccccaccagtggtcaatgtcacg

SEQ ID NO: 62387 - DNA, 28 bp, Artificial Sequence
  Description of Artificial Sequence: Synthetic oligonucleotide
gttcaccccaccagtggtcaatgtcacg

SEQ ID NO: 62388 - DNA, 29 bp, Artificial Sequence
  Description of Artificial Sequence: Synthetic oligonucleotide
ttcaccccaccagtggtcaatgtcacgtg

SEQ ID NO: 62389 - DNA, 28 bp, Artificial Sequence
  Description of Artificial Sequence: Synthetic oligonucleotide
tcaccccaccagtggtcaatgtcacgtg

SEQ ID NO: 62390 - DNA, 27 bp, Artificial Sequence
  Description of Artificial Sequence: Synthetic oligonucleotide
caccccaccagtggtcaatgtcacgtg

SEQ ID NO: 62391 - DNA, 27 bp, Artificial Sequence
  Description of Artificial Sequence: Synthetic oligonucleotide
accccaccagtggtcaatgtcacgtgg

SEQ ID NO: 62392 - DNA, 26 bp, Artificial Sequence
  Description of Artificial Sequence: Synthetic oligonucleotide
ccccaccagtggtcaatgtcacgtgg

SEQ ID NO: 62393 - DNA, 27 bp, Artificial Sequence
  Description of Artificial Sequence: Synthetic oligonucleotide
cccaccagtggtcaatgtcacgtggct

SEQ ID NO: 62394 - DNA, 28 bp, Artificial Sequence
  Description of Artificial Sequence: Synthetic oligonucleotide
ccaccagtggtcaatgtcacgtggcttc

SEQ ID NO: 62395 - DNA, 28 bp, Artificial Sequence
  Description of Artificial Sequence: Synthetic oligonucleotide
caccagtggtcaatgtcacgtggcttcg

SEQ ID NO: 62396 - DNA, 32 bp, Artificial Sequence
  Description of Artificial Sequence: Synthetic oligonucleotide
accagtggtcaatgtcacgtggcttcgaaatg

SEQ ID NO: 62397 - DNA, 31 bp, Artificial Sequence
  Description of Artificial Sequence: Synthetic oligonucleotide
ccagtggtcaatgtcacgtggcttcgaaatg

SEQ ID NO: 62398 - DNA, 31 bp, Artificial Sequence
  Description of Artificial Sequence: Synthetic oligonucleotide
cagtggtcaatgtcacgtggcttcgaaatgg

SEQ ID NO: 62399 - DNA, 35 bp, Artificial Sequence
  Description of Artificial Sequence: Synthetic oligonucleotide
agtggtcaatgtcacgtggcttcgaaatggaaaac

SEQ ID NO: 62400 - DNA, 34 bp, Artificial Sequence
  Description of Artificial Sequence: Synthetic oligonucleotide
gtggtcaatgtcacgtggcttcgaaatggaaaac

SEQ ID NO: 62401 - DNA, 34 bp, Artificial Sequence
  Description of Artificial Sequence: Synthetic oligonucleotide
tggtcaatgtcacgtggcttcgaaatggaaaacc

SEQ ID NO: 62402 - DNA, 33 bp, Artificial Sequence
  Description of Artificial Sequence: Synthetic oligonucleotide
ggtcaatgtcacgtggcttcgaaatggaaaacc

SEQ ID NO: 62403 - DNA, 34 bp, Artificial Sequence
  Description of Artificial Sequence: Synthetic oligonucleotide
gtcaatgtcacgtggcttcgaaatggaaaacctg

SEQ ID NO: 62404 - DNA, 35 bp, Artificial Sequence
  Description of Artificial Sequence: Synthetic oligonucleotide
tcaatgtcacgtggcttcgaaatggaaaacctgtc

SEQ ID NO: 62405 - DNA, 34 bp, Artificial Sequence
  Description of Artificial Sequence: Synthetic oligonucleotide
caatgtcacgtggcttcgaaatggaaaacctgtc

SEQ ID NO: 62406 - DNA, 35 bp, Artificial Sequence
  Description of Artificial Sequence: Synthetic oligonucleotide
aatgtcacgtggcttcgaaatggaaaacctgtcac

SEQ ID NO: 62407 - DNA, 34 bp, Artificial Sequence
  Description of Artificial Sequence: Synthetic oligonucleotide
atgtcacgtggcttcgaaatggaaaacctgtcac

SEQ ID NO: 62408 - DNA, 33 bp, Artificial Sequence
  Description of Artificial Sequence: Synthetic oligonucleotide
tgtcacgtggcttcgaaatggaaaacctgtcac

SEQ ID NO: 62409 - DNA, 32 bp, Artificial Sequence
  Description of Artificial Sequence: Synthetic oligonucleotide
gtcacgtggcttcgaaatggaaaacctgtcac

SEQ ID NO: 62410 - DNA, 32 bp, Artificial Sequence
  Description of Artificial Sequence: Synthetic oligonucleotide
tcacgtggcttcgaaatggaaaacctgtcacc

SEQ ID NO: 62411 - DNA, 31 bp, Artificial Sequence
  Description of Artificial Sequence: Synthetic oligonucleotide
cacgtggcttcgaaatggaaaacctgtcacc

SEQ ID NO: 62412 - DNA, 32 bp, Artificial Sequence
  Description of Artificial Sequence: Synthetic oligonucleotide
acgtggcttcgaaatggaaaacctgtcaccac

SEQ ID NO: 62413 - DNA, 31 bp, Artificial Sequence
  Description of Artificial Sequence: Synthetic oligonucleotide
cgtggcttcgaaatggaaaacctgtcaccac

SEQ ID NO: 62414 - DNA, 32 bp, Artificial Sequence
  Description of Artificial Sequence: Synthetic oligonucleotide
gtggcttcgaaatggaaaacctgtcaccacag

SEQ ID NO: 62415 - DNA, 32 bp, Artificial Sequence
  Description of Artificial Sequence: Synthetic oligonucleotide
tggcttcgaaatggaaaacctgtcaccacagg

SEQ ID NO: 62416 - DNA, 31 bp, Artificial Sequence
  Description of Artificial Sequence: Synthetic oligonucleotide
ggcttcgaaatggaaaacctgtcaccacagg

SEQ ID NO: 62417 - DNA, 32 bp, Artificial Sequence
  Description of Artificial Sequence: Synthetic oligonucleotide
gcttcgaaatggaaaacctgtcaccacaggag

SEQ ID NO: 62418 - DNA, 33 bp, Artificial Sequence
  Description of Artificial Sequence: Synthetic oligonucleotide
cttcgaaatggaaaacctgtcaccacaggagtg

SEQ ID NO: 62419 - DNA, 34 bp, Artificial Sequence
  Description of Artificial Sequence: Synthetic oligonucleotide
ttcgaaatggaaaacctgtcaccacaggagtgtc

SEQ ID NO: 62420 - DNA, 33 bp, Artificial Sequence
  Description of Artificial Sequence: Synthetic oligonucleotide
tcgaaatggaaaacctgtcaccacaggagtgtc

SEQ ID NO: 62421 - DNA, 32 bp, Artificial Sequence
  Description of Artificial Sequence: Synthetic oligonucleotide
cgaaatggaaaacctgtcaccacaggagtgtc

SEQ ID NO: 62422 - DNA, 33 bp, Artificial Sequence
  Description of Artificial Sequence: Synthetic oligonucleotide
gaaatggaaaacctgtcaccacaggagtgtcag

SEQ ID NO: 62423 - DNA, 34 bp, Artificial Sequence
  Description of Artificial Sequence: Synthetic oligonucleotide
aaatggaaaacctgtcaccacaggagtgtcagag

SEQ ID NO: 62424 - DNA, 33 bp, Artificial Sequence
  Description of Artificial Sequence: Synthetic oligonucleotide
aatggaaaacctgtcaccacaggagtgtcagag

SEQ ID NO: 62425 - DNA, 32 bp, Artificial Sequence
  Description of Artificial Sequence: Synthetic oligonucleotide
atggaaaacctgtcaccacaggagtgtcagag

SEQ ID NO: 62426 - DNA, 31 bp, Artificial Sequence
  Description of Artificial Sequence: Synthetic oligonucleotide
tggaaaacctgtcaccacaggagtgtcagag

SEQ ID NO: 62427 - DNA, 30 bp, Artificial Sequence
  Description of Artificial Sequence: Synthetic oligonucleotide
ggaaaacctgtcaccacaggagtgtcagag

SEQ ID NO: 62428 - DNA, 31 bp, Artificial Sequence
  Description of Artificial Sequence: Synthetic oligonucleotide
gaaaacctgtcaccacaggagtgtcagagac

SEQ ID NO: 62429 - DNA, 32 bp, Artificial Sequence
  Description of Artificial Sequence: Synthetic oligonucleotide
aaaacctgtcaccacaggagtgtcagagacag

SEQ ID NO: 62430 - DNA, 31 bp, Artificial Sequence
  Description of Artificial Sequence: Synthetic oligonucleotide
aaacctgtcaccacaggagtgtcagagacag

SEQ ID NO: 62431 - DNA, 30 bp, Artificial Sequence
  Description of Artificial Sequence: Synthetic oligonucleotide
aacctgtcaccacaggagtgtcagagacag

SEQ ID NO: 62432 - DNA, 29 bp, Artificial Sequence
  Description of Artificial Sequence: Synthetic oligonucleotide
acctgtcaccacaggagtgtcagagacag

SEQ ID NO: 62433 - DNA, 28 bp, Artificial Sequence
  Description of Artificial Sequence: Synthetic oligonucleotide
cctgtcaccacaggagtgtcagagacag

SEQ ID NO: 62434 - DNA, 29 bp, Artificial Sequence
  Description of Artificial Sequence: Synthetic oligonucleotide
ctgtcaccacaggagtgtcagagacagtc

SEQ ID NO: 62435 - DNA, 31 bp, Artificial Sequence
  Description of Artificial Sequence: Synthetic oligonucleotide
tgtcaccacaggagtgtcagagacagtcttc

SEQ ID NO: 62436 - DNA, 30 bp, Artificial Sequence
  Description of Artificial Sequence: Synthetic oligonucleotide
gtcaccacaggagtgtcagagacagtcttc

SEQ ID NO: 62437 - DNA, 30 bp, Artificial Sequence
  Description of Artificial Sequence: Synthetic oligonucleotide
tcaccacaggagtgtcagagacagtcttcc

SEQ ID NO: 62438 - DNA, 29 bp, Artificial Sequence
  Description of Artificial Sequence: Synthetic oligonucleotide
caccacaggagtgtcagagacagtcttcc

SEQ ID NO: 62439 - DNA, 30 bp, Artificial Sequence
  Description of Artificial Sequence: Synthetic oligonucleotide
accacaggagtgtcagagacagtcttcctg

SEQ ID NO: 62440 - DNA, 29 bp, Artificial Sequence
  Description of Artificial Sequence: Synthetic oligonucleotide
ccacaggagtgtcagagacagtcttcctg

SEQ ID NO: 62441 - DNA, 29 bp, Artificial Sequence
  Description of Artificial Sequence: Synthetic oligonucleotide
cacaggagtgtcagagacagtcttcctgc

SEQ ID NO: 62442 - DNA, 29 bp, Artificial Sequence
  Description of Artificial Sequence: Synthetic oligonucleotide
acaggagtgtcagagacagtcttcctgcc

SEQ ID NO: 62443 - DNA, 28 bp, Artificial Sequence
  Description of Artificial Sequence: Synthetic oligonucleotide
caggagtgtcagagacagtcttcctgcc

SEQ ID NO: 62444 - DNA, 28 bp, Artificial Sequence
  Description of Artificial Sequence: Synthetic oligonucleotide
aggagtgtcagagacagtcttcctgccc

SEQ ID NO: 62445 - DNA, 27 bp, Artificial Sequence
  Description of Artificial Sequence: Synthetic oligonucleotide
ggagtgtcagagacagtcttcctgccc

SEQ ID NO: 62446 - DNA, 28 bp, Artificial Sequence
  Description of Artificial Sequence: Synthetic oligonucleotide
gagtgtcagagacagtcttcctgcccag

SEQ ID NO: 62447 - DNA, 28 bp, Artificial Sequence
  Description of Artificial Sequence: Synthetic oligonucleotide
agtgtcagagacagtcttcctgcccagg

SEQ ID NO: 62448 - DNA, 27 bp, Artificial Sequence
  Description of Artificial Sequence: Synthetic oligonucleotide
gtgtcagagacagtcttcctgcccagg

SEQ ID NO: 62449 - DNA, 27 bp, Artificial Sequence
  Description of Artificial Sequence: Synthetic oligonucleotide
tgtcagagacagtcttcctgcccaggg

SEQ ID NO: 62450 - DNA, 27 bp, Artificial Sequence
  Description of Artificial Sequence: Synthetic oligonucleotide
gtcagagacagtcttcctgcccaggga

SEQ ID NO: 62451 - DNA, 28 bp, Artificial Sequence
  Description of Artificial Sequence: Synthetic oligonucleotide
tcagagacagtcttcctgcccagggaag

SEQ ID NO: 62452 - DNA, 27 bp, Artificial Sequence
  Description of Artificial Sequence: Synthetic oligonucleotide
cagagacagtcttcctgcccagggaag

SEQ ID NO: 62453 - DNA, 28 bp, Artificial Sequence
  Description of Artificial Sequence: Synthetic oligonucleotide
agagacagtcttcctgcccagggaagac

SEQ ID NO: 62454 - DNA, 27 bp, Artificial Sequence
  Description of Artificial Sequence: Synthetic oligonucleotide
gagacagtcttcctgcccagggaagac

SEQ ID NO: 62455 - DNA, 27 bp, Artificial Sequence
  Description of Artificial Sequence: Synthetic oligonucleotide
agacagtcttcctgcccagggaagacc

SEQ ID NO: 62456 - DNA, 27 bp, Artificial Sequence
  Description of Artificial Sequence: Synthetic oligonucleotide
gacagtcttcctgcccagggaagacca

SEQ ID NO: 62457 - DNA, 27 bp, Artificial Sequence
  Description of Artificial Sequence: Synthetic oligonucleotide
acagtcttcctgcccagggaagaccac

SEQ ID NO: 62458 - DNA, 26 bp, Artificial Sequence
  Description of Artificial Sequence: Synthetic oligonucleotide
cagtcttcctgcccagggaagaccac

SEQ ID NO: 62459 - DNA, 27 bp, Artificial Sequence
  Description of Artificial Sequence: Synthetic oligonucleotide
agtcttcctgcccagggaagaccacct

SEQ ID NO: 62460 - DNA, 27 bp, Artificial Sequence
  Description of Artificial Sequence: Synthetic oligonucleotide
gtcttcctgcccagggaagaccacctt

SEQ ID NO: 62461 - DNA, 29 bp, Artificial Sequence
  Description of Artificial Sequence: Synthetic oligonucleotide
tcttcctgcccagggaagaccaccttttc

SEQ ID NO: 62462 - DNA, 28 bp, Artificial Sequence
  Description of Artificial Sequence: Synthetic oligonucleotide
cttcctgcccagggaagaccaccttttc

SEQ ID NO: 62463 - DNA, 28 bp, Artificial Sequence
  Description of Artificial Sequence: Synthetic oligonucleotide
ttcctgcccagggaagaccaccttttcc

SEQ ID NO: 62464 - DNA, 27 bp, Artificial Sequence
  Description of Artificial Sequence: Synthetic oligonucleotide
tcctgcccagggaagaccaccttttcc

SEQ ID NO: 62465 - DNA, 26 bp, Artificial Sequence
  Description of Artificial Sequence: Synthetic oligonucleotide
cctgcccagggaagaccaccttttcc

SEQ ID NO: 62466 - DNA, 26 bp, Artificial Sequence
  Description of Artificial Sequence: Synthetic oligonucleotide
ctgcccagggaagaccaccttttccg

SEQ ID NO: 62467 - DNA, 27 bp, Artificial Sequence
  Description of Artificial Sequence: Synthetic oligonucleotide
tgcccagggaagaccaccttttccgca

SEQ ID NO: 62468 - DNA, 27 bp, Artificial Sequence
  Description of Artificial Sequence: Synthetic oligonucleotide
gcccagggaagaccaccttttccgcaa

SEQ ID NO: 62469 - DNA, 27 bp, Artificial Sequence
  Description of Artificial Sequence: Synthetic oligonucleotide
cccagggaagaccaccttttccgcaag

SEQ ID NO: 62470 - DNA, 29 bp, Artificial Sequence
  Description of Artificial Sequence: Synthetic oligonucleotide
ccagggaagaccaccttttccgcaagttc

SEQ ID NO: 62471 - DNA, 29 bp, Artificial Sequence
  Description of Artificial Sequence: Synthetic oligonucleotide
cagggaagaccaccttttccgcaagttcc

SEQ ID NO: 62472 - DNA, 30 bp, Artificial Sequence
  Description of Artificial Sequence: Synthetic oligonucleotide
agggaagaccaccttttccgcaagttccac

SEQ ID NO: 62473 - DNA, 29 bp, Artificial Sequence
  Description of Artificial Sequence: Synthetic oligonucleotide
gggaagaccaccttttccgcaagttccac

SEQ ID NO: 62474 - DNA, 32 bp, Artificial Sequence
  Description of Artificial Sequence: Synthetic oligonucleotide
ggaagaccaccttttccgcaagttccactatc

SEQ ID NO: 62475 - DNA, 33 bp, Artificial Sequence
  Description of Artificial Sequence: Synthetic oligonucleotide
gaagaccaccttttccgcaagttccactatctc

SEQ ID NO: 62476 - DNA, 33 bp, Artificial Sequence
  Description of Artificial Sequence: Synthetic oligonucleotide
aagaccaccttttccgcaagttccactatctcc

SEQ ID NO: 62477 - DNA, 32 bp, Artificial Sequence
  Description of Artificial Sequence: Synthetic oligonucleotide
agaccaccttttccgcaagttccactatctcc

SEQ ID NO: 62478 - DNA, 31 bp, Artificial Sequence
  Description of Artificial Sequence: Synthetic oligonucleotide
gaccaccttttccgcaagttccactatctcc

SEQ ID NO: 62479 - DNA, 31 bp, Artificial Sequence
  Description of Artificial Sequence: Synthetic oligonucleotide
accaccttttccgcaagttccactatctccc

SEQ ID NO: 62480 - DNA, 30 bp, Artificial Sequence
  Description of Artificial Sequence: Synthetic oligonucleotide
ccaccttttccgcaagttccactatctccc

SEQ ID NO: 62481 - DNA, 30 bp, Artificial Sequence
  Description of Artificial Sequence: Synthetic oligonucleotide
caccttttccgcaagttccactatctcccc

SEQ ID NO: 62482 - DNA, 32 bp, Artificial Sequence
  Description of Artificial Sequence: Synthetic oligonucleotide
accttttccgcaagttccactatctccccttc

SEQ ID NO: 62483 - DNA, 31 bp, Artificial Sequence
  Description of Artificial Sequence: Synthetic oligonucleotide
ccttttccgcaagttccactatctccccttc

SEQ ID NO: 62484 - DNA, 31 bp, Artificial Sequence
  Description of Artificial Sequence: Synthetic oligonucleotide
cttttccgcaagttccactatctccccttcc

SEQ ID NO: 62485 - DNA, 32 bp, Artificial Sequence
  Description of Artificial Sequence: Synthetic oligonucleotide
ttttccgcaagttccactatctccccttcctg

SEQ ID NO: 62486 - DNA, 31 bp, Artificial Sequence
  Description of Artificial Sequence: Synthetic oligonucleotide
tttccgcaagttccactatctccccttcctg

SEQ ID NO: 62487 - DNA, 30 bp, Artificial Sequence
  Description of Artificial Sequence: Synthetic oligonucleotide
ttccgcaagttccactatctccccttcctg

SEQ ID NO: 62488 - DNA, 29 bp, Artificial Sequence
  Description of Artificial Sequence: Synthetic oligonucleotide
tccgcaagttccactatctccccttcctg

SEQ ID NO: 62489 - DNA, 28 bp, Artificial Sequence
  Description of Artificial Sequence: Synthetic oligonucleotide
ccgcaagttccactatctccccttcctg

SEQ ID NO: 62490 - DNA, 28 bp, Artificial Sequence
  Description of Artificial Sequence: Synthetic oligonucleotide
cgcaagttccactatctccccttcctgc

SEQ ID NO: 62491 - DNA, 28 bp, Artificial Sequence
  Description of Artificial Sequence: Synthetic oligonucleotide
gcaagttccactatctccccttcctgcc

SEQ ID NO: 62492 - DNA, 28 bp, Artificial Sequence
  Description of Artificial Sequence: Synthetic oligonucleotide
caagttccactatctccccttcctgccc

SEQ ID NO: 62493 - DNA, 29 bp, Artificial Sequence
  Description of Artificial Sequence: Synthetic oligonucleotide
aagttccactatctccccttcctgccctc

SEQ ID NO: 62494 - DNA, 28 bp, Artificial Sequence
  Description of Artificial Sequence: Synthetic oligonucleotide
agttccactatctccccttcctgccctc

SEQ ID NO: 62495 - DNA, 27 bp, Artificial Sequence
  Description of Artificial Sequence: Synthetic oligonucleotide
gttccactatctccccttcctgccctc

SEQ ID NO: 62496 - DNA, 29 bp, Artificial Sequence
  Description of Artificial Sequence: Synthetic oligonucleotide
ttccactatctccccttcctgccctcaac

SEQ ID NO: 62497 - DNA, 28 bp, Artificial Sequence
  Description of Artificial Sequence: Synthetic oligonucleotide
tccactatctccccttcctgccctcaac

SEQ ID NO: 62498 - DNA, 27 bp, Artificial Sequence
  Description of Artificial Sequence: Synthetic oligonucleotide
ccactatctccccttcctgccctcaac

SEQ ID NO: 62499 - DNA, 28 bp, Artificial Sequence
  Description of Artificial Sequence: Synthetic oligonucleotide
cactatctccccttcctgccctcaactg

SEQ ID NO: 62500 - DNA, 29 bp, Artificial Sequence
  Description of Artificial Sequence: Synthetic oligonucleotide
actatctccccttcctgccctcaactgag

SEQ ID NO: 62501 - DNA, 28 bp, Artificial Sequence
  Description of Artificial Sequence: Synthetic oligonucleotide
ctatctccccttcctgccctcaactgag

SEQ ID NO: 62502 - DNA, 28 bp, Artificial Sequence
  Description of Artificial Sequence: Synthetic oligonucleotide
tatctccccttcctgccctcaactgagg

SEQ ID NO: 62503 - DNA, 27 bp, Artificial Sequence
  Description of Artificial Sequence: Synthetic oligonucleotide
atctccccttcctgccctcaactgagg

SEQ ID NO: 62504 - DNA, 27 bp, Artificial Sequence
  Description of Artificial Sequence: Synthetic oligonucleotide
tctccccttcctgccctcaactgagga

SEQ ID NO: 62505 - DNA, 26 bp, Artificial Sequence
  Description of Artificial Sequence: Synthetic oligonucleotide
ctccccttcctgccctcaactgagga

SEQ ID NO: 62506 - DNA, 26 bp, Artificial Sequence
  Description of Artificial Sequence: Synthetic oligonucleotide
tccccttcctgccctcaactgaggac

SEQ ID NO: 62507 - DNA, 25 bp, Artificial Sequence
  Description of Artificial Sequence: Synthetic oligonucleotide
ccccttcctgccctcaactgaggac

SEQ ID NO: 62508 - DNA, 27 bp, Artificial Sequence
  Description of Artificial Sequence: Synthetic oligonucleotide
cccttcctgccctcaactgaggacgtt

SEQ ID NO: 62509 - DNA, 29 bp, Artificial Sequence
  Description of Artificial Sequence: Synthetic oligonucleotide
ccttcctgccctcaactgaggacgtttac

SEQ ID NO: 62510 - DNA, 29 bp, Artificial Sequence
  Description of Artificial Sequence: Synthetic oligonucleotide
cttcctgccctcaactgaggacgtttacg

SEQ ID NO: 62511 - DNA, 30 bp, Artificial Sequence
  Description of Artificial Sequence: Synthetic oligonucleotide
ttcctgccctcaactgaggacgtttacgac

SEQ ID NO: 62512 - DNA, 29 bp, Artificial Sequence
  Description of Artificial Sequence: Synthetic oligonucleotide
tcctgccctcaactgaggacgtttacgac

SEQ ID NO: 62513 - DNA, 28 bp, Artificial Sequence
  Description of Artificial Sequence: Synthetic oligonucleotide
cctgccctcaactgaggacgtttacgac

SEQ ID NO: 62514 - DNA, 29 bp, Artificial Sequence
  Description of Artificial Sequence: Synthetic oligonucleotide
ctgccctcaactgaggacgtttacgactg

SEQ ID NO: 62515 - DNA, 29 bp, Artificial Sequence
  Description of Artificial Sequence: Synthetic oligonucleotide
tgccctcaactgaggacgtttacgactgc

SEQ ID NO: 62516 - DNA, 28 bp, Artificial Sequence
  Description of Artificial Sequence: Synthetic oligonucleotide
gccctcaactgaggacgtttacgactgc

SEQ ID NO: 62517 - DNA, 29 bp, Artificial Sequence
  Description of Artificial Sequence: Synthetic oligonucleotide
ccctcaactgaggacgtttacgactgcag

SEQ ID NO: 62518 - DNA, 29 bp, Artificial Sequence
  Description of Artificial Sequence: Synthetic oligonucleotide
cctcaactgaggacgtttacgactgcagg

SEQ ID NO: 62519 - DNA, 29 bp, Artificial Sequence
  Description of Artificial Sequence: Synthetic oligonucleotide
ctcaactgaggacgtttacgactgcaggg

SEQ ID NO: 62520 - DNA, 30 bp, Artificial Sequence
  Description of Artificial Sequence: Synthetic oligonucleotide
tcaactgaggacgtttacgactgcagggtg

SEQ ID NO: 62521 - DNA, 29 bp, Artificial Sequence
  Description of Artificial Sequence: Synthetic oligonucleotide
caactgaggacgtttacgactgcagggtg

SEQ ID NO: 62522 - DNA, 29 bp, Artificial Sequence
  Description of Artificial Sequence: Synthetic oligonucleotide
aactgaggacgtttacgactgcagggtgg

SEQ ID NO: 62523 - DNA, 28 bp, Artificial Sequence
  Description of Artificial Sequence: Synthetic oligonucleotide
actgaggacgtttacgactgcagggtgg

SEQ ID NO: 62524 - DNA, 27 bp, Artificial Sequence
  Description of Artificial Sequence: Synthetic oligonucleotide
ctgaggacgtttacgactgcagggtgg

SEQ ID NO: 62525 - DNA, 28 bp, Artificial Sequence
  Description of Artificial Sequence: Synthetic oligonucleotide
tgaggacgtttacgactgcagggtggag

SEQ ID NO: 62526 - DNA, 27 bp, Artificial Sequence
  Description of Artificial Sequence: Synthetic oligonucleotide
gaggacgtttacgactgcagggtggag

SEQ ID NO: 62527 - DNA, 27 bp, Artificial Sequence
  Description of Artificial Sequence: Synthetic oligonucleotide
aggacgtttacgactgcagggtggagc

SEQ ID NO: 62528 - DNA, 27 bp, Artificial Sequence
  Description of Artificial Sequence: Synthetic oligonucleotide
ggacgtttacgactgcagggtggagca

SEQ ID NO: 62529 - DNA, 27 bp, Artificial Sequence
  Description of Artificial Sequence: Synthetic oligonucleotide
gacgtttacgactgcagggtggagcac

SEQ ID NO: 62530 - DNA, 28 bp, Artificial Sequence
  Description of Artificial Sequence: Synthetic oligonucleotide
acgtttacgactgcagggtggagcactg

SEQ ID NO: 62531 - DNA, 27 bp, Artificial Sequence
  Description of Artificial Sequence: Synthetic oligonucleotide
cgtttacgactgcagggtggagcactg

SEQ ID NO: 62532 - DNA, 27 bp, Artificial Sequence
  Description of Artificial Sequence: Synthetic oligonucleotide
gtttacgactgcagggtggagcactgg

SEQ ID NO: 62533 - DNA, 27 bp, Artificial Sequence
  Description of Artificial Sequence: Synthetic oligonucleotide
tttacgactgcagggtggagcactggg

SEQ ID NO: 62534 - DNA, 26 bp, Artificial Sequence
  Description of Artificial Sequence: Synthetic oligonucleotide
ttacgactgcagggtggagcactggg

SEQ ID NO: 62535 - DNA, 25 bp, Artificial Sequence
  Description of Artificial Sequence: Synthetic oligonucleotide
tacgactgcagggtggagcactggg

SEQ ID NO: 62536 - DNA, 24 bp, Artificial Sequence
  Description of Artificial Sequence: Synthetic oligonucleotide
acgactgcagggtggagcactggg

SEQ ID NO: 62537 - DNA, 23 bp, Artificial Sequence
  Description of Artificial Sequence: Synthetic oligonucleotide
cgactgcagggtggagcactggg

SEQ ID NO: 62538 - DNA, 25 bp, Artificial Sequence
  Description of Artificial Sequence: Synthetic oligonucleotide
cagggtggagcactggggcttggat

SEQ ID NO: 62539 - DNA, 26 bp, Artificial Sequence
  Description of Artificial Sequence: Synthetic oligonucleotide
agggtggagcactggggcttggatga

SEQ ID NO: 62540 - DNA, 25 bp, Artificial Sequence
  Description of Artificial Sequence: Synthetic oligonucleotide
gggtggagcactggggcttggatga

SEQ ID NO: 62541 - DNA, 25 bp, Artificial Sequence
  Description of Artificial Sequence: Synthetic oligonucleotide
ggtggagcactggggcttggatgag

SEQ ID NO: 62542 - DNA, 25 bp, Artificial Sequence
  Description of Artificial Sequence: Synthetic oligonucleotide
gtggagcactggggcttggatgagc

SEQ ID NO: 62543 - DNA, 26 bp, Artificial Sequence
  Description of Artificial Sequence: Synthetic oligonucleotide
tggagcactggggcttggatgagcct

SEQ ID NO: 62544 - DNA, 25 bp, Artificial Sequence
  Description of Artificial Sequence: Synthetic oligonucleotide
ggagcactggggcttggatgagcct

SEQ ID NO: 62545 - DNA, 27 bp, Artificial Sequence
  Description of Artificial Sequence: Synthetic oligonucleotide
gagcactggggcttggatgagcctctt

SEQ ID NO: 62546 - DNA, 27 bp, Artificial Sequence
  Description of Artificial Sequence: Synthetic oligonucleotide
agcactggggcttggatgagcctcttc

SEQ ID NO: 62547 - DNA, 27 bp, Artificial Sequence
  Description of Artificial Sequence: Synthetic oligonucleotide
gcactggggcttggatgagcctcttct

SEQ ID NO: 62548 - DNA, 27 bp, Artificial Sequence
  Description of Artificial Sequence: Synthetic oligonucleotide
cactggggcttggatgagcctcttctc

SEQ ID NO: 62549 - DNA, 29 bp, Artificial Sequence
  Description of Artificial Sequence: Synthetic oligonucleotide
actggggcttggatgagcctcttctcaag

SEQ ID NO: 62550 - DNA, 28 bp, Artificial Sequence
  Description of Artificial Sequence: Synthetic oligonucleotide
ctggggcttggatgagcctcttctcaag

SEQ ID NO: 62551 - DNA, 28 bp, Artificial Sequence
  Description of Artificial Sequence: Synthetic oligonucleotide
tggggcttggatgagcctcttctcaagc

SEQ ID NO: 62552 - DNA, 27 bp, Artificial Sequence
  Description of Artificial Sequence: Synthetic oligonucleotide
ggggcttggatgagcctcttctcaagc

SEQ ID NO: 62553 - DNA, 28 bp, Artificial Sequence
  Description of Artificial Sequence: Synthetic oligonucleotide
gggcttggatgagcctcttctcaagcac

SEQ ID NO: 62554 - DNA, 29 bp, Artificial Sequence
  Description of Artificial Sequence: Synthetic oligonucleotide
ggcttggatgagcctcttctcaagcactg

SEQ ID NO: 62555 - DNA, 29 bp, Artificial Sequence
  Description of Artificial Sequence: Synthetic oligonucleotide
gcttggatgagcctcttctcaagcactgg

SEQ ID NO: 62556 - DNA, 29 bp, Artificial Sequence
  Description of Artificial Sequence: Synthetic oligonucleotide
cttggatgagcctcttctcaagcactggg

SEQ ID NO: 62557 - DNA, 30 bp, Artificial Sequence
  Description of Artificial Sequence: Synthetic oligonucleotide
ttggatgagcctcttctcaagcactgggag

SEQ ID NO: 62558 - DNA, 29 bp, Artificial Sequence
  Description of Artificial Sequence: Synthetic oligonucleotide
tggatgagcctcttctcaagcactgggag

SEQ ID NO: 62559 - DNA, 28 bp, Artificial Sequence
  Description of Artificial Sequence: Synthetic oligonucleotide
ggatgagcctcttctcaagcactgggag

SEQ ID NO: 62560 - DNA, 31 bp, Artificial Sequence
  Description of Artificial Sequence: Synthetic oligonucleotide
gatgagcctcttctcaagcactgggagtttg

SEQ ID NO: 62561 - DNA, 33 bp, Artificial Sequence
  Description of Artificial Sequence: Synthetic oligonucleotide
atgagcctcttctcaagcactgggagtttgatg

SEQ ID NO: 62562 - DNA, 32 bp, Artificial Sequence
  Description of Artificial Sequence: Synthetic oligonucleotide
tgagcctcttctcaagcactgggagtttgatg

SEQ ID NO: 62563 - DNA, 31 bp, Artificial Sequence
  Description of Artificial Sequence: Synthetic oligonucleotide
gagcctcttctcaagcactgggagtttgatg

SEQ ID NO: 62564 - DNA, 31 bp, Artificial Sequence
  Description of Artificial Sequence: Synthetic oligonucleotide
agcctcttctcaagcactgggagtttgatgc

SEQ ID NO: 62565 - DNA, 30 bp, Artificial Sequence
  Description of Artificial Sequence: Synthetic oligonucleotide
gcctcttctcaagcactgggagtttgatgc

SEQ ID NO: 62566 - DNA, 31 bp, Artificial Sequence
  Description of Artificial Sequence: Synthetic oligonucleotide
cctcttctcaagcactgggagtttgatgctc

SEQ ID NO: 62567 - DNA, 31 bp, Artificial Sequence
  Description of Artificial Sequence: Synthetic oligonucleotide
ctcttctcaagcactgggagtttgatgctcc

SEQ ID NO: 62568 - DNA, 33 bp, Artificial Sequence
  Description of Artificial Sequence: Synthetic oligonucleotide
tcttctcaagcactgggagtttgatgctccaag

SEQ ID NO: 62569 - DNA, 32 bp, Artificial Sequence
  Description of Artificial Sequence: Synthetic oligonucleotide
cttctcaagcactgggagtttgatgctccaag

SEQ ID NO: 62570 - DNA, 32 bp, Artificial Sequence
  Description of Artificial Sequence: Synthetic oligonucleotide
ttctcaagcactgggagtttgatgctccaagc

SEQ ID NO: 62571 - DNA, 31 bp, Artificial Sequence
  Description of Artificial Sequence: Synthetic oligonucleotide
tctcaagcactgggagtttgatgctccaagc

SEQ ID NO: 62572 - DNA, 30 bp, Artificial Sequence
  Description of Artificial Sequence: Synthetic oligonucleotide
ctcaagcactgggagtttgatgctccaagc

SEQ ID NO: 62573 - DNA, 30 bp, Artificial Sequence
  Description of Artificial Sequence: Synthetic oligonucleotide
tcaagcactgggagtttgatgctccaagcc

SEQ ID NO: 62574 - DNA, 29 bp, Artificial Sequence
  Description of Artificial Sequence: Synthetic oligonucleotide
caagcactgggagtttgatgctccaagcc

SEQ ID NO: 62575 - DNA, 29 bp, Artificial Sequence
  Description of Artificial Sequence: Synthetic oligonucleotide
aagcactgggagtttgatgctccaagccc

SEQ ID NO: 62576 - DNA, 28 bp, Artificial Sequence
  Description of Artificial Sequence: Synthetic oligonucleotide
agcactgggagtttgatgctccaagccc

SEQ ID NO: 62577 - DNA, 27 bp, Artificial Sequence
  Description of Artificial Sequence: Synthetic oligonucleotide
gcactgggagtttgatgctccaagccc

SEQ ID NO: 62578 - DNA, 28 bp, Artificial Sequence
  Description of Artificial Sequence: Synthetic oligonucleotide
cactgggagtttgatgctccaagccctc

SEQ ID NO: 62579 - DNA, 29 bp, Artificial Sequence
  Description of Artificial Sequence: Synthetic oligonucleotide
actgggagtttgatgctccaagccctctc

SEQ ID NO: 62580 - DNA, 28 bp, Artificial Sequence
  Description of Artificial Sequence: Synthetic oligonucleotide
ctgggagtttgatgctccaagccctctc

SEQ ID NO: 62581 - DNA, 28 bp, Artificial Sequence
  Description of Artificial Sequence: Synthetic oligonucleotide
tgggagtttgatgctccaagccctctcc

SEQ ID NO: 62582 - DNA, 27 bp, Artificial Sequence
  Description of Artificial Sequence: Synthetic oligonucleotide
gggagtttgatgctccaagccctctcc

SEQ ID NO: 62583 - DNA, 27 bp, Artificial Sequence
  Description of Artificial Sequence: Synthetic oligonucleotide
ggagtttgatgctccaagccctctccc

SEQ ID NO: 62584 - DNA, 28 bp, Artificial Sequence
  Description of Artificial Sequence: Synthetic oligonucleotide
gagtttgatgctccaagccctctcccag

SEQ ID NO: 62585 - DNA, 29 bp, Artificial Sequence
  Description of Artificial Sequence: Synthetic oligonucleotide
agtttgatgctccaagccctctcccagag

SEQ ID NO: 62586 - DNA, 28 bp, Artificial Sequence
  Description of Artificial Sequence: Synthetic oligonucleotide
gtttgatgctccaagccctctcccagag

SEQ ID NO: 62587 - DNA, 29 bp, Artificial Sequence
  Description of Artificial Sequence: Synthetic oligonucleotide
tttgatgctccaagccctctcccagagac

SEQ ID NO: 62588 - DNA, 28 bp, Artificial Sequence
  Description of Artificial Sequence: Synthetic oligonucleotide
ttgatgctccaagccctctcccagagac

SEQ ID NO: 62589 - DNA, 27 bp, Artificial Sequence
  Description of Artificial Sequence: Synthetic oligonucleotide
tgatgctccaagccctctcccagagac

SEQ ID NO: 62590 - DNA, 27 bp, Artificial Sequence
  Description of Artificial Sequence: Synthetic oligonucleotide
gatgctccaagccctctcccagagact

SEQ ID NO: 62591 - DNA, 28 bp, Artificial Sequence
  Description of Artificial Sequence: Synthetic oligonucleotide
atgctccaagccctctcccagagactac

SEQ ID NO: 62592 - DNA, 27 bp, Artificial Sequence
  Description of Artificial Sequence: Synthetic oligonucleotide
tgctccaagccctctcccagagactac

SEQ ID NO: 62593 - DNA, 27 bp, Artificial Sequence
  Description of Artificial Sequence: Synthetic oligonucleotide
gctccaagccctctcccagagactaca

SEQ ID NO: 62594 - DNA, 27 bp, Artificial Sequence
  Description of Artificial Sequence: Synthetic oligonucleotide
ctccaagccctctcccagagactacag

SEQ ID NO: 62595 - DNA, 28 bp, Artificial Sequence
  Description of Artificial Sequence: Synthetic oligonucleotide
tccaagccctctcccagagactacagag

SEQ ID NO: 62596 - DNA, 27 bp, Artificial Sequence
  Description of Artificial Sequence: Synthetic oligonucleotide
ccaagccctctcccagagactacagag

SEQ ID NO: 62597 - DNA, 29 bp, Artificial Sequence
  Description of Artificial Sequence: Synthetic oligonucleotide
caagccctctcccagagactacagagaac

SEQ ID NO: 62598 - DNA, 29 bp, Artificial Sequence
  Description of Artificial Sequence: Synthetic oligonucleotide
aagccctctcccagagactacagagaacg

SEQ ID NO: 62599 - DNA, 28 bp, Artificial Sequence
  Description of Artificial Sequence: Synthetic oligonucleotide
agccctctcccagagactacagagaacg

SEQ ID NO: 62600 - DNA, 27 bp, Artificial Sequence
  Description of Artificial Sequence: Synthetic oligonucleotide
gccctctcccagagactacagagaacg

SEQ ID NO: 62601 - DNA, 28 bp, Artificial Sequence
  Description of Artificial Sequence: Synthetic oligonucleotide
ccctctcccagagactacagagaacgtg

SEQ ID NO: 62602 - DNA, 28 bp, Artificial Sequence
  Description of Artificial Sequence: Synthetic oligonucleotide
cctctcccagagactacagagaacgtgg

SEQ ID NO: 62603 - DNA, 29 bp, Artificial Sequence
  Description of Artificial Sequence: Synthetic oligonucleotide
ctctcccagagactacagagaacgtggtg

SEQ ID NO: 62604 - DNA, 30 bp, Artificial Sequence
  Description of Artificial Sequence: Synthetic oligonucleotide
tctcccagagactacagagaacgtggtgtg

SEQ ID NO: 62605 - DNA, 29 bp, Artificial Sequence
  Description of Artificial Sequence: Synthetic oligonucleotide
ctcccagagactacagagaacgtggtgtg

SEQ ID NO: 62606 - DNA, 30 bp, Artificial Sequence
  Description of Artificial Sequence: Synthetic oligonucleotide
tcccagagactacagagaacgtggtgtgtg

SEQ ID NO: 62607 - DNA, 29 bp, Artificial Sequence
  Description of Artificial Sequence: Synthetic oligonucleotide
cccagagactacagagaacgtggtgtgtg

SEQ ID NO: 62608 - DNA, 29 bp, Artificial Sequence
  Description of Artificial Sequence: Synthetic oligonucleotide
ccagagactacagagaacgtggtgtgtgc

SEQ ID NO: 62609 - DNA, 29 bp, Artificial Sequence
  Description of Artificial Sequence: Synthetic oligonucleotide
cagagactacagagaacgtggtgtgtgcc

SEQ ID NO: 62610 - DNA, 29 bp, Artificial Sequence
  Description of Artificial Sequence: Synthetic oligonucleotide
agagactacagagaacgtggtgtgtgccc

SEQ ID NO: 62611 - DNA, 28 bp, Artificial Sequence
  Description of Artificial Sequence: Synthetic oligonucleotide
gagactacagagaacgtggtgtgtgccc

SEQ ID NO: 62612 - DNA, 29 bp, Artificial Sequence
  Description of Artificial Sequence: Synthetic oligonucleotide
agactacagagaacgtggtgtgtgccctg

SEQ ID NO: 62613 - DNA, 28 bp, Artificial Sequence
  Description of Artificial Sequence: Synthetic oligonucleotide
gactacagagaacgtggtgtgtgccctg

SEQ ID NO: 62614 - DNA, 28 bp, Artificial Sequence
  Description of Artificial Sequence: Synthetic oligonucleotide
actacagagaacgtggtgtgtgccctgg

SEQ ID NO: 62615 - DNA, 27 bp, Artificial Sequence
  Description of Artificial Sequence: Synthetic oligonucleotide
ctacagagaacgtggtgtgtgccctgg

SEQ ID NO: 62616 - DNA, 27 bp, Artificial Sequence
  Description of Artificial Sequence: Synthetic oligonucleotide
tacagagaacgtggtgtgtgccctggg

SEQ ID NO: 62617 - DNA, 26 bp, Artificial Sequence
  Description of Artificial Sequence: Synthetic oligonucleotide
acagagaacgtggtgtgtgccctggg

SEQ ID NO: 62618 - DNA, 25 bp, Artificial Sequence
  Description of Artificial Sequence: Synthetic oligonucleotide
cagagaacgtggtgtgtgccctggg

SEQ ID NO: 62619 - DNA, 25 bp, Artificial Sequence
  Description of Artificial Sequence: Synthetic oligonucleotide
agagaacgtggtgtgtgccctgggc

SEQ ID NO: 62620 - DNA, 24 bp, Artificial Sequence
  Description of Artificial Sequence: Synthetic oligonucleotide
gagaacgtggtgtgtgccctgggc

SEQ ID NO: 62621 - DNA, 25 bp, Artificial Sequence
  Description of Artificial Sequence: Synthetic oligonucleotide
agaacgtggtgtgtgccctgggcct

SEQ ID NO: 62622 - DNA, 24 bp, Artificial Sequence
  Description of Artificial Sequence: Synthetic oligonucleotide
gaacgtggtgtgtgccctgggcct

SEQ ID NO: 62623 - DNA, 25 bp, Artificial Sequence
  Description of Artificial Sequence: Synthetic oligonucleotide
aacgtggtgtgtgccctgggcctga

SEQ ID NO: 62624 - DNA, 24 bp, Artificial Sequence
  Description of Artificial Sequence: Synthetic oligonucleotide
acgtggtgtgtgccctgggcctga

SEQ ID NO: 62625 - DNA, 23 bp, Artificial Sequence
  Description of Artificial Sequence: Synthetic oligonucleotide
cgtggtgtgtgccctgggcctga

SEQ ID NO: 62626 - DNA, 24 bp, Artificial Sequence
  Description of Artificial Sequence: Synthetic oligonucleotide
gtggtgtgtgccctgggcctgact

SEQ ID NO: 62627 - DNA, 25 bp, Artificial Sequence
  Description of Artificial Sequence: Synthetic oligonucleotide
tggtgtgtgccctgggcctgactgt

SEQ ID NO: 62628 - DNA, 24 bp, Artificial Sequence
  Description of Artificial Sequence: Synthetic oligonucleotide
ggtgtgtgccctgggcctgactgt

SEQ ID NO: 62629 - DNA, 24 bp, Artificial Sequence
  Description of Artificial Sequence: Synthetic oligonucleotide
gtgtgtgccctgggcctgactgtg

SEQ ID NO: 62630 - DNA, 24 bp, Artificial Sequence
  Description of Artificial Sequence: Synthetic oligonucleotide
tgtgtgccctgggcctgactgtgg

SEQ ID NO: 62631 - DNA, 23 bp, Artificial Sequence
  Description of Artificial Sequence: Synthetic oligonucleotide
gtgtgccctgggcctgactgtgg

SEQ ID NO: 62632 - DNA, 24 bp, Artificial Sequence
  Description of Artificial Sequence: Synthetic oligonucleotide
tgtgccctgggcctgactgtgggt

SEQ ID NO: 62633 - DNA, 23 bp, Artificial Sequence
  Description of Artificial Sequence: Synthetic oligonucleotide
gtgccctgggcctgactgtgggt

SEQ ID NO: 62634 - DNA, 24 bp, Artificial Sequence
  Description of Artificial Sequence: Synthetic oligonucleotide
tgccctgggcctgactgtgggtct

SEQ ID NO: 62635 - DNA, 23 bp, Artificial Sequence
  Description of Artificial Sequence: Synthetic oligonucleotide
gccctgggcctgactgtgggtct

SEQ ID NO: 62636 - DNA, 23 bp, Artificial Sequence
  Description of Artificial Sequence: Synthetic oligonucleotide
ccctgggcctgactgtgggtctg

SEQ ID NO: 62637 - DNA, 24 bp, Artificial Sequence
  Description of Artificial Sequence: Synthetic oligonucleotide
cctgggcctgactgtgggtctggt

SEQ ID NO: 62638 - DNA, 24 bp, Artificial Sequence
  Description of Artificial Sequence: Synthetic oligonucleotide
ctgggcctgactgtgggtctggtg

SEQ ID NO: 62639 - DNA, 24 bp, Artificial Sequence
  Description of Artificial Sequence: Synthetic oligonucleotide
tgggcctgactgtgggtctggtgg

SEQ ID NO: 62640 - DNA, 23 bp, Artificial Sequence
  Description of Artificial Sequence: Synthetic oligonucleotide
gggcctgactgtgggtctggtgg

SEQ ID NO: 62641 - DNA, 23 bp, Artificial Sequence
  Description of Artificial Sequence: Synthetic oligonucleotide
ggcctgactgtgggtctggtggg

SEQ ID NO: 62642 - DNA, 25 bp, Artificial Sequence
  Description of Artificial Sequence: Synthetic oligonucleotide
gcctgactgtgggtctggtgggcat

SEQ ID NO: 62643 - DNA, 27 bp, Artificial Sequence
  Description of Artificial Sequence: Synthetic oligonucleotide
cctgactgtgggtctggtgggcatcat

SEQ ID NO: 62644 - DNA, 31 bp, Artificial Sequence
  Description of Artificial Sequence: Synthetic oligonucleotide
ctgactgtgggtctggtgggcatcattattg

SEQ ID NO: 62645 - DNA, 31 bp, Artificial Sequence
  Description of Artificial Sequence: Synthetic oligonucleotide
tgactgtgggtctggtgggcatcattattgg

SEQ ID NO: 62646 - DNA, 30 bp, Artificial Sequence
  Description of Artificial Sequence: Synthetic oligonucleotide
gactgtgggtctggtgggcatcattattgg

SEQ ID NO: 62647 - DNA, 30 bp, Artificial Sequence
  Description of Artificial Sequence: Synthetic oligonucleotide
actgtgggtctggtgggcatcattattggg

SEQ ID NO: 62648 - DNA, 29 bp, Artificial Sequence
  Description of Artificial Sequence: Synthetic oligonucleotide
ctgtgggtctggtgggcatcattattggg

SEQ ID NO: 62649 - DNA, 30 bp, Artificial Sequence
  Description of Artificial Sequence: Synthetic oligonucleotide
tgtgggtctggtgggcatcattattgggac

SEQ ID NO: 62650 - DNA, 29 bp, Artificial Sequence
  Description of Artificial Sequence: Synthetic oligonucleotide
gtgggtctggtgggcatcattattgggac

SEQ ID NO: 62651 - DNA, 29 bp, Artificial Sequence
  Description of Artificial Sequence: Synthetic oligonucleotide
tgggtctggtgggcatcattattgggacc

SEQ ID NO: 62652 - DNA, 28 bp, Artificial Sequence
  Description of Artificial Sequence: Synthetic oligonucleotide
gggtctggtgggcatcattattgggacc

SEQ ID NO: 62653 - DNA, 30 bp, Artificial Sequence
  Description of Artificial Sequence: Synthetic oligonucleotide
ggtctggtgggcatcattattgggaccatc

SEQ ID NO: 62654 - DNA, 32 bp, Artificial Sequence
  Description of Artificial Sequence: Synthetic oligonucleotide
gtctggtgggcatcattattgggaccatcttc

SEQ ID NO: 62655 - DNA, 34 bp, Artificial Sequence
  Description of Artificial Sequence: Synthetic oligonucleotide
tctggtgggcatcattattgggaccatcttcatc

SEQ ID NO: 62656 - DNA, 33 bp, Artificial Sequence
  Description of Artificial Sequence: Synthetic oligonucleotide
ctggtgggcatcattattgggaccatcttcatc

SEQ ID NO: 62657 - DNA, 35 bp, Artificial Sequence
  Description of Artificial Sequence: Synthetic oligonucleotide
tggtgggcatcattattgggaccatcttcatcatc

SEQ ID NO: 62658 - DNA, 34 bp, Artificial Sequence
  Description of Artificial Sequence: Synthetic oligonucleotide
ggtgggcatcattattgggaccatcttcatcatc

SEQ ID NO: 62659 - DNA, 36 bp, Artificial Sequence
  Description of Artificial Sequence: Synthetic oligonucleotide
gtgggcatcattattgggaccatcttcatcatcaag

SEQ ID NO: 62660 - DNA, 36 bp, Artificial Sequence
  Description of Artificial Sequence: Synthetic oligonucleotide
tgggcatcattattgggaccatcttcatcatcaagg

SEQ ID NO: 62661 - DNA, 35 bp, Artificial Sequence
  Description of Artificial Sequence: Synthetic oligonucleotide
gggcatcattattgggaccatcttcatcatcaagg

SEQ ID NO: 62662 - DNA, 35 bp, Artificial Sequence
  Description of Artificial Sequence: Synthetic oligonucleotide
ggcatcattattgggaccatcttcatcatcaaggg

SEQ ID NO: 62663 - DNA, 36 bp, Artificial Sequence
  Description of Artificial Sequence: Synthetic oligonucleotide
gcatcattattgggaccatcttcatcatcaagggag

SEQ ID NO: 62664 - DNA, 37 bp, Artificial Sequence
  Description of Artificial Sequence: Synthetic oligonucleotide
catcattattgggaccatcttcatcatcaagggagtg

SEQ ID NO: 62665 - DNA, 37 bp, Artificial Sequence
  Description of Artificial Sequence: Synthetic oligonucleotide
atcattattgggaccatcttcatcatcaagggagtgc

SEQ ID NO: 62666 - DNA, 36 bp, Artificial Sequence
  Description of Artificial Sequence: Synthetic oligonucleotide
tcattattgggaccatcttcatcatcaagggagtgc

SEQ ID NO: 62667 - DNA, 35 bp, Artificial Sequence
  Description of Artificial Sequence: Synthetic oligonucleotide
cattattgggaccatcttcatcatcaagggagtgc

SEQ ID NO: 62668 - DNA, 35 bp, Artificial Sequence
  Description of Artificial Sequence: Synthetic oligonucleotide
attattgggaccatcttcatcatcaagggagtgcg

SEQ ID NO: 62669 - DNA, 34 bp, Artificial Sequence
  Description of Artificial Sequence: Synthetic oligonucleotide
ttattgggaccatcttcatcatcaagggagtgcg

SEQ ID NO: 62670 - DNA, 33 bp, Artificial Sequence
  Description of Artificial Sequence: Synthetic oligonucleotide
tattgggaccatcttcatcatcaagggagtgcg

SEQ ID NO: 62671 - DNA, 32 bp, Artificial Sequence
  Description of Artificial Sequence: Synthetic oligonucleotide
attgggaccatcttcatcatcaagggagtgcg

SEQ ID NO: 62672 - DNA, 31 bp, Artificial Sequence
  Description of Artificial Sequence: Synthetic oligonucleotide
ttgggaccatcttcatcatcaagggagtgcg

SEQ ID NO: 62673 - DNA, 30 bp, Artificial Sequence
  Description of Artificial Sequence: Synthetic oligonucleotide
tgggaccatcttcatcatcaagggagtgcg

SEQ ID NO: 62674 - DNA, 29 bp, Artificial Sequence
  Description of Artificial Sequence: Synthetic oligonucleotide
gggaccatcttcatcatcaagggagtgcg

SEQ ID NO: 62675 - DNA, 29 bp, Artificial Sequence
  Description of Artificial Sequence: Synthetic oligonucleotide
ggaccatcttcatcatcaagggagtgcgc

SEQ ID NO: 62676 - DNA, 33 bp, Artificial Sequence
  Description of Artificial Sequence: Synthetic oligonucleotide
gaccatcttcatcatcaagggagtgcgcaaaag

SEQ ID NO: 62677 - DNA, 33 bp, Artificial Sequence
  Description of Artificial Sequence: Synthetic oligonucleotide
accatcttcatcatcaagggagtgcgcaaaagc

SEQ ID NO: 62678 - DNA, 32 bp, Artificial Sequence
  Description of Artificial Sequence: Synthetic oligonucleotide
ccatcttcatcatcaagggagtgcgcaaaagc

SEQ ID NO: 62679 - DNA, 35 bp, Artificial Sequence
  Description of Artificial Sequence: Synthetic oligonucleotide
catcttcatcatcaagggagtgcgcaaaagcaatg

SEQ ID NO: 62680 - DNA, 35 bp, Artificial Sequence
  Description of Artificial Sequence: Synthetic oligonucleotide
atcttcatcatcaagggagtgcgcaaaagcaatgc

SEQ ID NO: 62681 - DNA, 34 bp, Artificial Sequence
  Description of Artificial Sequence: Synthetic oligonucleotide
tcttcatcatcaagggagtgcgcaaaagcaatgc

SEQ ID NO: 62682 - DNA, 33 bp, Artificial Sequence
  Description of Artificial Sequence: Synthetic oligonucleotide
cttcatcatcaagggagtgcgcaaaagcaatgc

SEQ ID NO: 62683 - DNA, 34 bp, Artificial Sequence
  Description of Artificial Sequence: Synthetic oligonucleotide
ttcatcatcaagggagtgcgcaaaagcaatgcag

SEQ ID NO: 62684 - DNA, 33 bp, Artificial Sequence
  Description of Artificial Sequence: Synthetic oligonucleotide
tcatcatcaagggagtgcgcaaaagcaatgcag

SEQ ID NO: 62685 - DNA, 32 bp, Artificial Sequence
  Description of Artificial Sequence: Synthetic oligonucleotide
catcatcaagggagtgcgcaaaagcaatgcag

SEQ ID NO: 62686 - DNA, 32 bp, Artificial Sequence
  Description of Artificial Sequence: Synthetic oligonucleotide
atcatcaagggagtgcgcaaaagcaatgcagc

SEQ ID NO: 62687 - DNA, 31 bp, Artificial Sequence
  Description of Artificial Sequence: Synthetic oligonucleotide
tcatcaagggagtgcgcaaaagcaatgcagc

SEQ ID NO: 62688 - DNA, 30 bp, Artificial Sequence
  Description of Artificial Sequence: Synthetic oligonucleotide
catcaagggagtgcgcaaaagcaatgcagc

SEQ ID NO: 62689 - DNA, 31 bp, Artificial Sequence
  Description of Artificial Sequence: Synthetic oligonucleotide
atcaagggagtgcgcaaaagcaatgcagcag

SEQ ID NO: 62690 - DNA, 30 bp, Artificial Sequence
  Description of Artificial Sequence: Synthetic oligonucleotide
tcaagggagtgcgcaaaagcaatgcagcag

SEQ ID NO: 62691 - DNA, 29 bp, Artificial Sequence
  Description of Artificial Sequence: Synthetic oligonucleotide
caagggagtgcgcaaaagcaatgcagcag

SEQ ID NO: 62692 - DNA, 31 bp, Artificial Sequence
  Description of Artificial Sequence: Synthetic oligonucleotide
aagggagtgcgcaaaagcaatgcagcagaac

SEQ ID NO: 62693 - DNA, 30 bp, Artificial Sequence
  Description of Artificial Sequence: Synthetic oligonucleotide
agggagtgcgcaaaagcaatgcagcagaac

SEQ ID NO: 62694 - DNA, 29 bp, Artificial Sequence
  Description of Artificial Sequence: Synthetic oligonucleotide
gggagtgcgcaaaagcaatgcagcagaac

SEQ ID NO: 62695 - DNA, 29 bp, Artificial Sequence
  Description of Artificial Sequence: Synthetic oligonucleotide
ggagtgcgcaaaagcaatgcagcagaacg

SEQ ID NO: 62696 - DNA, 29 bp, Artificial Sequence
  Description of Artificial Sequence: Synthetic oligonucleotide
gagtgcgcaaaagcaatgcagcagaacgc

SEQ ID NO: 62697 - DNA, 30 bp, Artificial Sequence
  Description of Artificial Sequence: Synthetic oligonucleotide
agtgcgcaaaagcaatgcagcagaacgcag

SEQ ID NO: 62698 - DNA, 29 bp, Artificial Sequence
  Description of Artificial Sequence: Synthetic oligonucleotide
gtgcgcaaaagcaatgcagcagaacgcag

SEQ ID NO: 62699 - DNA, 29 bp, Artificial Sequence
  Description of Artificial Sequence: Synthetic oligonucleotide
tgcgcaaaagcaatgcagcagaacgcagg

SEQ ID NO: 62700 - DNA, 28 bp, Artificial Sequence
  Description of Artificial Sequence: Synthetic oligonucleotide
gcgcaaaagcaatgcagcagaacgcagg

SEQ ID NO: 62701 - DNA, 28 bp, Artificial Sequence
  Description of Artificial Sequence: Synthetic oligonucleotide
cgcaaaagcaatgcagcagaacgcaggg

SEQ ID NO: 62702 - DNA, 28 bp, Artificial Sequence
  Description of Artificial Sequence: Synthetic oligonucleotide
gcaaaagcaatgcagcagaacgcagggg

SEQ ID NO: 62703 - DNA, 28 bp, Artificial Sequence
  Description of Artificial Sequence: Synthetic oligonucleotide
caaaagcaatgcagcagaacgcaggggg

SEQ ID NO: 62704 - DNA, 28 bp, Artificial Sequence
  Description of Artificial Sequence: Synthetic oligonucleotide
aaaagcaatgcagcagaacgcagggggc

SEQ ID NO: 62705 - DNA, 27 bp, Artificial Sequence
  Description of Artificial Sequence: Synthetic oligonucleotide
aaagcaatgcagcagaacgcagggggc

SEQ ID NO: 62706 - DNA, 26 bp, Artificial Sequence
  Description of Artificial Sequence: Synthetic oligonucleotide
aagcaatgcagcagaacgcagggggc

SEQ ID NO: 62707 - DNA, 25 bp, Artificial Sequence
  Description of Artificial Sequence: Synthetic oligonucleotide
agcaatgcagcagaacgcagggggc

SEQ ID NO: 62708 - DNA, 24 bp, Artificial Sequence
  Description of Artificial Sequence: Synthetic oligonucleotide
gcaatgcagcagaacgcagggggc

SEQ ID NO: 62709 - DNA, 25 bp, Artificial Sequence
  Description of Artificial Sequence: Synthetic oligonucleotide
caatgcagcagaacgcagggggcct

SEQ ID NO: 62710 - DNA, 26 bp, Artificial Sequence
  Description of Artificial Sequence: Synthetic oligonucleotide
aatgcagcagaacgcagggggcctct

SEQ ID NO: 62711 - DNA, 25 bp, Artificial Sequence
  Description of Artificial Sequence: Synthetic oligonucleotide
atgcagcagaacgcagggggcctct

SEQ ID NO: 62712 - DNA, 24 bp, Artificial Sequence
  Description of Artificial Sequence: Synthetic oligonucleotide
tgcagcagaacgcagggggcctct

SEQ ID NO: 62713 - DNA, 23 bp, Artificial Sequence
  Description of Artificial Sequence: Synthetic oligonucleotide
gcagcagaacgcagggggcctct

SEQ ID NO: 62714 - DNA, 26 bp, Artificial Sequence
  Description of Artificial Sequence: Synthetic oligonucleotide
cagcagaacgcagggggcctctgtaa

SEQ ID NO: 62715 - DNA, 38 bp, Artificial Sequence
  Description of Artificial Sequence: Synthetic oligonucleotide
gcatcattattgggaccatcttcatcatcaagggattg

SEQ ID NO: 62716 - DNA, 38 bp, Artificial Sequence
  Description of Artificial Sequence: Synthetic oligonucleotide
catcattattgggaccatcttcatcatcaagggattgc

SEQ ID NO: 62717 - DNA, 38 bp, Artificial Sequence
  Description of Artificial Sequence: Synthetic oligonucleotide
atcattattgggaccatcttcatcatcaagggattgcg

SEQ ID NO: 62718 - DNA, 37 bp, Artificial Sequence
  Description of Artificial Sequence: Synthetic oligonucleotide
tcattattgggaccatcttcatcatcaagggattgcg

SEQ ID NO: 62719 - DNA, 36 bp, Artificial Sequence
  Description of Artificial Sequence: Synthetic oligonucleotide
cattattgggaccatcttcatcatcaagggattgcg

SEQ ID NO: 62720 - DNA, 36 bp, Artificial Sequence
  Description of Artificial Sequence: Synthetic oligonucleotide
attattgggaccatcttcatcatcaagggattgcgc

SEQ ID NO: 62721 - DNA, 35 bp, Artificial Sequence
  Description of Artificial Sequence: Synthetic oligonucleotide
ttattgggaccatcttcatcatcaagggattgcgc

SEQ ID NO: 62722 - DNA, 34 bp, Artificial Sequence
  Description of Artificial Sequence: Synthetic oligonucleotide
tattgggaccatcttcatcatcaagggattgcgc

SEQ ID NO: 62723 - DNA, 33 bp, Artificial Sequence
  Description of Artificial Sequence: Synthetic oligonucleotide
attgggaccatcttcatcatcaagggattgcgc

SEQ ID NO: 62724 - DNA, 32 bp, Artificial Sequence
  Description of Artificial Sequence: Synthetic oligonucleotide
ttgggaccatcttcatcatcaagggattgcgc

SEQ ID NO: 62725 - DNA, 31 bp, Artificial Sequence
  Description of Artificial Sequence: Synthetic oligonucleotide
tgggaccatcttcatcatcaagggattgcgc

SEQ ID NO: 62726 - DNA, 30 bp, Artificial Sequence
  Description of Artificial Sequence: Synthetic oligonucleotide
gggaccatcttcatcatcaagggattgcgc

SEQ ID NO: 62727 - DNA, 34 bp, Artificial Sequence
  Description of Artificial Sequence: Synthetic oligonucleotide
ggaccatcttcatcatcaagggattgcgcaaaag

SEQ ID NO: 62728 - DNA, 34 bp, Artificial Sequence
  Description of Artificial Sequence: Synthetic oligonucleotide
gaccatcttcatcatcaagggattgcgcaaaagc

SEQ ID NO: 62729 - DNA, 37 bp, Artificial Sequence
  Description of Artificial Sequence: Synthetic oligonucleotide
accatcttcatcatcaagggattgcgcaaaagcaatg

SEQ ID NO: 62730 - DNA, 36 bp, Artificial Sequence
  Description of Artificial Sequence: Synthetic oligonucleotide
ccatcttcatcatcaagggattgcgcaaaagcaatg

SEQ ID NO: 62731 - DNA, 36 bp, Artificial Sequence
  Description of Artificial Sequence: Synthetic oligonucleotide
catcttcatcatcaagggattgcgcaaaagcaatgc

SEQ ID NO: 62732 - DNA, 37 bp, Artificial Sequence
  Description of Artificial Sequence: Synthetic oligonucleotide
atcttcatcatcaagggattgcgcaaaagcaatgcag

SEQ ID NO: 62733 - DNA, 36 bp, Artificial Sequence
  Description of Artificial Sequence: Synthetic oligonucleotide
tcttcatcatcaagggattgcgcaaaagcaatgcag

SEQ ID NO: 62734 - DNA, 35 bp, Artificial Sequence
  Description of Artificial Sequence: Synthetic oligonucleotide
cttcatcatcaagggattgcgcaaaagcaatgcag

SEQ ID NO: 62735 - DNA, 35 bp, Artificial Sequence
  Description of Artificial Sequence: Synthetic oligonucleotide
ttcatcatcaagggattgcgcaaaagcaatgcagc

SEQ ID NO: 62736 - DNA, 34 bp, Artificial Sequence
  Description of Artificial Sequence: Synthetic oligonucleotide
tcatcatcaagggattgcgcaaaagcaatgcagc

SEQ ID NO: 62737 - DNA, 33 bp, Artificial Sequence
  Description of Artificial Sequence: Synthetic oligonucleotide
catcatcaagggattgcgcaaaagcaatgcagc

SEQ ID NO: 62738 - DNA, 34 bp, Artificial Sequence
  Description of Artificial Sequence: Synthetic oligonucleotide
atcatcaagggattgcgcaaaagcaatgcagcag

SEQ ID NO: 62739 - DNA, 33 bp, Artificial Sequence
  Description of Artificial Sequence: Synthetic oligonucleotide
tcatcaagggattgcgcaaaagcaatgcagcag

SEQ ID NO: 62740 - DNA, 32 bp, Artificial Sequence
  Description of Artificial Sequence: Synthetic oligonucleotide
catcaagggattgcgcaaaagcaatgcagcag

SEQ ID NO: 62741 - DNA, 34 bp, Artificial Sequence
  Description of Artificial Sequence: Synthetic oligonucleotide
atcaagggattgcgcaaaagcaatgcagcagaac

SEQ ID NO: 62742 - DNA, 33 bp, Artificial Sequence
  Description of Artificial Sequence: Synthetic oligonucleotide
tcaagggattgcgcaaaagcaatgcagcagaac

SEQ ID NO: 62743 - DNA, 32 bp, Artificial Sequence
  Description of Artificial Sequence: Synthetic oligonucleotide
caagggattgcgcaaaagcaatgcagcagaac

SEQ ID NO: 62744 - DNA, 32 bp, Artificial Sequence
  Description of Artificial Sequence: Synthetic oligonucleotide
aagggattgcgcaaaagcaatgcagcagaacg

SEQ ID NO: 62745 - DNA, 31 bp, Artificial Sequence
  Description of Artificial Sequence: Synthetic oligonucleotide
agggattgcgcaaaagcaatgcagcagaacg

SEQ ID NO: 62746 - DNA, 30 bp, Artificial Sequence
  Description of Artificial Sequence: Synthetic oligonucleotide
gggattgcgcaaaagcaatgcagcagaacg

SEQ ID NO: 62747 - DNA, 30 bp, Artificial Sequence
  Description of Artificial Sequence: Synthetic oligonucleotide
ggattgcgcaaaagcaatgcagcagaacgc

SEQ ID NO: 62748 - DNA, 31 bp, Artificial Sequence
  Description of Artificial Sequence: Synthetic oligonucleotide
gattgcgcaaaagcaatgcagcagaacgcag

SEQ ID NO: 62749 - DNA, 31 bp, Artificial Sequence
  Description of Artificial Sequence: Synthetic oligonucleotide
attgcgcaaaagcaatgcagcagaacgcagg

SEQ ID NO: 62750 - DNA, 30 bp, Artificial Sequence
  Description of Artificial Sequence: Synthetic oligonucleotide
ttgcgcaaaagcaatgcagcagaacgcagg

SEQ ID NO: 62751 - DNA, 33 bp, Artificial Sequence
  Description of Artificial Sequence: Synthetic oligonucleotide
tgagagagcccaacgtcctcatctgtttcatag

SEQ ID NO: 62752 - DNA, 32 bp, Artificial Sequence
  Description of Artificial Sequence: Synthetic oligonucleotide
gagagagcccaacgtcctcatctgtttcatag

SEQ ID NO: 62753 - DNA, 33 bp, Artificial Sequence
  Description of Artificial Sequence: Synthetic oligonucleotide
agagagcccaacgtcctcatctgtttcatagac

SEQ ID NO: 62754 - DNA, 32 bp, Artificial Sequence
  Description of Artificial Sequence: Synthetic oligonucleotide
gagagcccaacgtcctcatctgtttcatagac

SEQ ID NO: 62755 - DNA, 34 bp, Artificial Sequence
  Description of Artificial Sequence: Synthetic oligonucleotide
agagcccaacgtcctcatctgtttcatagacaag

SEQ ID NO: 62756 - DNA, 33 bp, Artificial Sequence
  Description of Artificial Sequence: Synthetic oligonucleotide
gagcccaacgtcctcatctgtttcatagacaag

SEQ ID NO: 62757 - DNA, 35 bp, Artificial Sequence
  Description of Artificial Sequence: Synthetic oligonucleotide
agcccaacgtcctcatctgtttcatagacaagttc

SEQ ID NO: 62758 - DNA, 34 bp, Artificial Sequence
  Description of Artificial Sequence: Synthetic oligonucleotide
gcccaacgtcctcatctgtttcatagacaagttc

SEQ ID NO: 62759 - DNA, 35 bp, Artificial Sequence
  Description of Artificial Sequence: Synthetic oligonucleotide
cccaacgtcctcatctgtttcatagacaagttcac

SEQ ID NO: 62760 - DNA, 35 bp, Artificial Sequence
  Description of Artificial Sequence: Synthetic oligonucleotide
ccaacgtcctcatctgtttcatagacaagttcacc

SEQ ID NO: 62761 - DNA, 35 bp, Artificial Sequence
  Description of Artificial Sequence: Synthetic oligonucleotide
caacgtcctcatctgtttcatagacaagttcaccc

SEQ ID NO: 62762 - DNA, 35 bp, Artificial Sequence
  Description of Artificial Sequence: Synthetic oligonucleotide
aacgtcctcatctgtttcatagacaagttcacccc

SEQ ID NO: 62763 - DNA, 34 bp, Artificial Sequence
  Description of Artificial Sequence: Synthetic oligonucleotide
acgtcctcatctgtttcatagacaagttcacccc

SEQ ID NO: 62764 - DNA, 33 bp, Artificial Sequence
  Description of Artificial Sequence: Synthetic oligonucleotide
cgtcctcatctgtttcatagacaagttcacccc

SEQ ID NO: 62765 - DNA, 34 bp, Artificial Sequence
  Description of Artificial Sequence: Synthetic oligonucleotide
gtcctcatctgtttcatagacaagttcaccccac

SEQ ID NO: 62766 - DNA, 34 bp, Artificial Sequence
  Description of Artificial Sequence: Synthetic oligonucleotide
tcctcatctgtttcatagacaagttcaccccacc

SEQ ID NO: 62767 - DNA, 33 bp, Artificial Sequence
  Description of Artificial Sequence: Synthetic oligonucleotide
cctcatctgtttcatagacaagttcaccccacc

SEQ ID NO: 62768 - DNA, 34 bp, Artificial Sequence
  Description of Artificial Sequence: Synthetic oligonucleotide
ctcatctgtttcatagacaagttcaccccaccag

SEQ ID NO: 62769 - DNA, 35 bp, Artificial Sequence
  Description of Artificial Sequence: Synthetic oligonucleotide
tcatctgtttcatagacaagttcaccccaccagtg

SEQ ID NO: 62770 - DNA, 34 bp, Artificial Sequence
  Description of Artificial Sequence: Synthetic oligonucleotide
catctgtttcatagacaagttcaccccaccagtg

SEQ ID NO: 62771 - DNA, 34 bp, Artificial Sequence
  Description of Artificial Sequence: Synthetic oligonucleotide
atctgtttcatagacaagttcaccccaccagtgg

SEQ ID NO: 62772 - DNA, 33 bp, Artificial Sequence
  Description of Artificial Sequence: Synthetic oligonucleotide
tctgtttcatagacaagttcaccccaccagtgg

SEQ ID NO: 62773 - DNA, 32 bp, Artificial Sequence
  Description of Artificial Sequence: Synthetic oligonucleotide
ctgtttcatagacaagttcaccccaccagtgg

SEQ ID NO: 62774 - DNA, 33 bp, Artificial Sequence
  Description of Artificial Sequence: Synthetic oligonucleotide
tgtttcatagacaagttcaccccaccagtggtc

SEQ ID NO: 62775 - DNA, 32 bp, Artificial Sequence
  Description of Artificial Sequence: Synthetic oligonucleotide
gtttcatagacaagttcaccccaccagtggtc

SEQ ID NO: 62776 - DNA, 35 bp, Artificial Sequence
  Description of Artificial Sequence: Synthetic oligonucleotide
tttcatagacaagttcaccccaccagtggtcaatg

SEQ ID NO: 62777 - DNA, 34 bp, Artificial Sequence
  Description of Artificial Sequence: Synthetic oligonucleotide
ttcatagacaagttcaccccaccagtggtcaatg

SEQ ID NO: 62778 - DNA, 33 bp, Artificial Sequence
  Description of Artificial Sequence: Synthetic oligonucleotide
tcatagacaagttcaccccaccagtggtcaatg

SEQ ID NO: 62779 - DNA, 32 bp, Artificial Sequence
  Description of Artificial Sequence: Synthetic oligonucleotide
catagacaagttcaccccaccagtggtcaatg

SEQ ID NO: 62780 - DNA, 33 bp, Artificial Sequence
  Description of Artificial Sequence: Synthetic oligonucleotide
atagacaagttcaccccaccagtggtcaatgtc

SEQ ID NO: 62781 - DNA, 32 bp, Artificial Sequence
  Description of Artificial Sequence: Synthetic oligonucleotide
tagacaagttcaccccaccagtggtcaatgtc

SEQ ID NO: 62782 - DNA, 31 bp, Artificial Sequence
  Description of Artificial Sequence: Synthetic oligonucleotide
agacaagttcaccccaccagtggtcaatgtc

SEQ ID NO: 62783 - DNA, 27 bp, Artificial Sequence
  Description of Artificial Sequence: Synthetic oligonucleotide
atggtgtgtctgaagctccctggaggc

SEQ ID NO: 62784 - DNA, 27 bp, Artificial Sequence
  Description of Artificial Sequence: Synthetic oligonucleotide
tggtgtgtctgaagctccctggaggct

SEQ ID NO: 62785 - DNA, 26 bp, Artificial Sequence
  Description of Artificial Sequence: Synthetic oligonucleotide
ggtgtgtctgaagctccctggaggct

SEQ ID NO: 62786 - DNA, 26 bp, Artificial Sequence
  Description of Artificial Sequence: Synthetic oligonucleotide
gtgtgtctgaagctccctggaggctc

SEQ ID NO: 62787 - DNA, 27 bp, Artificial Sequence
  Description of Artificial Sequence: Synthetic oligonucleotide
tgtgtctgaagctccctggaggctcct

SEQ ID NO: 62788 - DNA, 26 bp, Artificial Sequence
  Description of Artificial Sequence: Synthetic oligonucleotide
gtgtctgaagctccctggaggctcct

SEQ ID NO: 62789 - DNA, 26 bp, Artificial Sequence
  Description of Artificial Sequence: Synthetic oligonucleotide
tgtctgaagctccctggaggctcctg

SEQ ID NO: 62790 - DNA, 25 bp, Artificial Sequence
  Description of Artificial Sequence: Synthetic oligonucleotide
gtctgaagctccctggaggctcctg

SEQ ID NO: 62791 - DNA, 27 bp, Artificial Sequence
  Description of Artificial Sequence: Synthetic oligonucleotide
tctgaagctccctggaggctcctgcat

SEQ ID NO: 62792 - DNA, 26 bp, Artificial Sequence
  Description of Artificial Sequence: Synthetic oligonucleotide
ctgaagctccctggaggctcctgcat

SEQ ID NO: 62793 - DNA, 27 bp, Artificial Sequence
  Description of Artificial Sequence: Synthetic oligonucleotide
tgaagctccctggaggctcctgcatga

SEQ ID NO: 62794 - DNA, 26 bp, Artificial Sequence
  Description of Artificial Sequence: Synthetic oligonucleotide
gaagctccctggaggctcctgcatga

SEQ ID NO: 62795 - DNA, 27 bp, Artificial Sequence
  Description of Artificial Sequence: Synthetic oligonucleotide
aagctccctggaggctcctgcatgaca

SEQ ID NO: 62796 - DNA, 26 bp, Artificial Sequence
  Description of Artificial Sequence: Synthetic oligonucleotide
agctccctggaggctcctgcatgaca

SEQ ID NO: 62797 - DNA, 25 bp, Artificial Sequence
  Description of Artificial Sequence: Synthetic oligonucleotide
gctccctggaggctcctgcatgaca

SEQ ID NO: 62798 - DNA, 25 bp, Artificial Sequence
  Description of Artificial Sequence: Synthetic oligonucleotide
ctccctggaggctcctgcatgacag

SEQ ID NO: 62799 - DNA, 25 bp, Artificial Sequence
  Description of Artificial Sequence: Synthetic oligonucleotide
tccctggaggctcctgcatgacagc

SEQ ID NO: 62800 - DNA, 24 bp, Artificial Sequence
  Description of Artificial Sequence: Synthetic oligonucleotide
ccctggaggctcctgcatgacagc

SEQ ID NO: 62801 - DNA, 24 bp, Artificial Sequence
  Description of Artificial Sequence: Synthetic oligonucleotide
cctggaggctcctgcatgacagcg

SEQ ID NO: 62802 - DNA, 25 bp, Artificial Sequence
  Description of Artificial Sequence: Synthetic oligonucleotide
ctggaggctcctgcatgacagcgct

SEQ ID NO: 62803 - DNA, 26 bp, Artificial Sequence
  Description of Artificial Sequence: Synthetic oligonucleotide
tggaggctcctgcatgacagcgctga

SEQ ID NO: 62804 - DNA, 25 bp, Artificial Sequence
  Description of Artificial Sequence: Synthetic oligonucleotide
ggaggctcctgcatgacagcgctga

SEQ ID NO: 62805 - DNA, 26 bp, Artificial Sequence
  Description of Artificial Sequence: Synthetic oligonucleotide
gaggctcctgcatgacagcgctgaca

SEQ ID NO: 62806 - DNA, 27 bp, Artificial Sequence
  Description of Artificial Sequence: Synthetic oligonucleotide
aggctcctgcatgacagcgctgacagt

SEQ ID NO: 62807 - DNA, 26 bp, Artificial Sequence
  Description of Artificial Sequence: Synthetic oligonucleotide
ggctcctgcatgacagcgctgacagt

SEQ ID NO: 62808 - DNA, 27 bp, Artificial Sequence
  Description of Artificial Sequence: Synthetic oligonucleotide
gctcctgcatgacagcgctgacagtga

SEQ ID NO: 62809 - DNA, 27 bp, Artificial Sequence
  Description of Artificial Sequence: Synthetic oligonucleotide
ctcctgcatgacagcgctgacagtgac

SEQ ID NO: 62810 - DNA, 28 bp, Artificial Sequence
  Description of Artificial Sequence: Synthetic oligonucleotide
tcctgcatgacagcgctgacagtgacac

SEQ ID NO: 62811 - DNA, 27 bp, Artificial Sequence
  Description of Artificial Sequence: Synthetic oligonucleotide
cctgcatgacagcgctgacagtgacac

SEQ ID NO: 62812 - DNA, 28 bp, Artificial Sequence
  Description of Artificial Sequence: Synthetic oligonucleotide
ctgcatgacagcgctgacagtgacactg

SEQ ID NO: 62813 - DNA, 30 bp, Artificial Sequence
  Description of Artificial Sequence: Synthetic oligonucleotide
tgcatgacagcgctgacagtgacactgatg

SEQ ID NO: 62814 - DNA, 29 bp, Artificial Sequence
  Description of Artificial Sequence: Synthetic oligonucleotide
gcatgacagcgctgacagtgacactgatg

SEQ ID NO: 62815 - DNA, 29 bp, Artificial Sequence
  Description of Artificial Sequence: Synthetic oligonucleotide
catgacagcgctgacagtgacactgatgg

SEQ ID NO: 62816 - DNA, 30 bp, Artificial Sequence
  Description of Artificial Sequence: Synthetic oligonucleotide
atgacagcgctgacagtgacactgatggtg

SEQ ID NO: 62817 - DNA, 29 bp, Artificial Sequence
  Description of Artificial Sequence: Synthetic oligonucleotide
tgacagcgctgacagtgacactgatggtg

SEQ ID NO: 62818 - DNA, 28 bp, Artificial Sequence
  Description of Artificial Sequence: Synthetic oligonucleotide
gacagcgctgacagtgacactgatggtg

SEQ ID NO: 62819 - DNA, 28 bp, Artificial Sequence
  Description of Artificial Sequence: Synthetic oligonucleotide
acagcgctgacagtgacactgatggtgc

SEQ ID NO: 62820 - DNA, 27 bp, Artificial Sequence
  Description of Artificial Sequence: Synthetic oligonucleotide
cagcgctgacagtgacactgatggtgc

SEQ ID NO: 62821 - DNA, 28 bp, Artificial Sequence
  Description of Artificial Sequence: Synthetic oligonucleotide
agcgctgacagtgacactgatggtgctg

SEQ ID NO: 62822 - DNA, 27 bp, Artificial Sequence
  Description of Artificial Sequence: Synthetic oligonucleotide
gcgctgacagtgacactgatggtgctg

SEQ ID NO: 62823 - DNA, 28 bp, Artificial Sequence
  Description of Artificial Sequence: Synthetic oligonucleotide
cgctgacagtgacactgatggtgctgag

SEQ ID NO: 62824 - DNA, 28 bp, Artificial Sequence
  Description of Artificial Sequence: Synthetic oligonucleotide
gctgacagtgacactgatggtgctgagc

SEQ ID NO: 62825 - DNA, 29 bp, Artificial Sequence
  Description of Artificial Sequence: Synthetic oligonucleotide
ctgacagtgacactgatggtgctgagctc

SEQ ID NO: 62826 - DNA, 29 bp, Artificial Sequence
  Description of Artificial Sequence: Synthetic oligonucleotide
tgacagtgacactgatggtgctgagctcc

SEQ ID NO: 62827 - DNA, 28 bp, Artificial Sequence
  Description of Artificial Sequence: Synthetic oligonucleotide
gacagtgacactgatggtgctgagctcc

SEQ ID NO: 62828 - DNA, 28 bp, Artificial Sequence
  Description of Artificial Sequence: Synthetic oligonucleotide
acagtgacactgatggtgctgagctccc

SEQ ID NO: 62829 - DNA, 27 bp, Artificial Sequence
  Description of Artificial Sequence: Synthetic oligonucleotide
cagtgacactgatggtgctgagctccc

SEQ ID NO: 62830 - DNA, 27 bp, Artificial Sequence
  Description of Artificial Sequence: Synthetic oligonucleotide
agtgacactgatggtgctgagctcccc

SEQ ID NO: 62831 - DNA, 27 bp, Artificial Sequence
  Description of Artificial Sequence: Synthetic oligonucleotide
gtgacactgatggtgctgagctcccca

SEQ ID NO: 62832 - DNA, 27 bp, Artificial Sequence
  Description of Artificial Sequence: Synthetic oligonucleotide
tgacactgatggtgctgagctccccac

SEQ ID NO: 62833 - DNA, 27 bp, Artificial Sequence
  Description of Artificial Sequence: Synthetic oligonucleotide
gacactgatggtgctgagctccccact

SEQ ID NO: 62834 - DNA, 27 bp, Artificial Sequence
  Description of Artificial Sequence: Synthetic oligonucleotide
acactgatggtgctgagctccccactg

SEQ ID NO: 62835 - DNA, 26 bp, Artificial Sequence
  Description of Artificial Sequence: Synthetic oligonucleotide
cactgatggtgctgagctccccactg

SEQ ID NO: 62836 - DNA, 26 bp, Artificial Sequence
  Description of Artificial Sequence: Synthetic oligonucleotide
actgatggtgctgagctccccactgg

SEQ ID NO: 62837 - DNA, 25 bp, Artificial Sequence
  Description of Artificial Sequence: Synthetic oligonucleotide
ctgatggtgctgagctccccactgg

SEQ ID NO: 62838 - DNA, 27 bp, Artificial Sequence
  Description of Artificial Sequence: Synthetic oligonucleotide
tgatggtgctgagctccccactggctt

SEQ ID NO: 62839 - DNA, 27 bp, Artificial Sequence
  Description of Artificial Sequence: Synthetic oligonucleotide
gatggtgctgagctccccactggcttt

SEQ ID NO: 62840 - DNA, 27 bp, Artificial Sequence
  Description of Artificial Sequence: Synthetic oligonucleotide
atggtgctgagctccccactggctttg

SEQ ID NO: 62841 - DNA, 26 bp, Artificial Sequence
  Description of Artificial Sequence: Synthetic oligonucleotide
tggtgctgagctccccactggctttg

SEQ ID NO: 62842 - DNA, 25 bp, Artificial Sequence
  Description of Artificial Sequence: Synthetic oligonucleotide
ggtgctgagctccccactggctttg

SEQ ID NO: 62843 - DNA, 25 bp, Artificial Sequence
  Description of Artificial Sequence: Synthetic oligonucleotide
gtgctgagctccccactggctttgg

SEQ ID NO: 62844 - DNA, 26 bp, Artificial Sequence
  Description of Artificial Sequence: Synthetic oligonucleotide
tgctgagctccccactggctttggct

SEQ ID NO: 62845 - DNA, 25 bp, Artificial Sequence
  Description of Artificial Sequence: Synthetic oligonucleotide
gctgagctccccactggctttggct

SEQ ID NO: 62846 - DNA, 25 bp, Artificial Sequence
  Description of Artificial Sequence: Synthetic oligonucleotide
ctgagctccccactggctttggctg

SEQ ID NO: 62847 - DNA, 25 bp, Artificial Sequence
  Description of Artificial Sequence: Synthetic oligonucleotide
tgagctccccactggctttggctgg

SEQ ID NO: 62848 - DNA, 24 bp, Artificial Sequence
  Description of Artificial Sequence: Synthetic oligonucleotide
gagctccccactggctttggctgg

SEQ ID NO: 62849 - DNA, 24 bp, Artificial Sequence
  Description of Artificial Sequence: Synthetic oligonucleotide
agctccccactggctttggctggg

SEQ ID NO: 62850 - DNA, 23 bp, Artificial Sequence
  Description of Artificial Sequence: Synthetic oligonucleotide
gctccccactggctttggctggg

SEQ ID NO: 62851 - DNA, 24 bp, Artificial Sequence
  Description of Artificial Sequence: Synthetic oligonucleotide
ctccccactggctttggctgggga

SEQ ID NO: 62852 - DNA, 25 bp, Artificial Sequence
  Description of Artificial Sequence: Synthetic oligonucleotide
tccccactggctttggctggggaca

SEQ ID NO: 62853 - DNA, 24 bp, Artificial Sequence
  Description of Artificial Sequence: Synthetic oligonucleotide
ccccactggctttggctggggaca

SEQ ID NO: 62854 - DNA, 24 bp, Artificial Sequence
  Description of Artificial Sequence: Synthetic oligonucleotide
cccactggctttggctggggacac

SEQ ID NO: 62855 - DNA, 24 bp, Artificial Sequence
  Description of Artificial Sequence: Synthetic oligonucleotide
ccactggctttggctggggacacc

SEQ ID NO: 62856 - DNA, 24 bp, Artificial Sequence
  Description of Artificial Sequence: Synthetic oligonucleotide
cactggctttggctggggacaccc

SEQ ID NO: 62857 - DNA, 25 bp, Artificial Sequence
  Description of Artificial Sequence: Synthetic oligonucleotide
actggctttggctggggacacccga

SEQ ID NO: 62858 - DNA, 24 bp, Artificial Sequence
  Description of Artificial Sequence: Synthetic oligonucleotide
ctggctttggctggggacacccga

SEQ ID NO: 62859 - DNA, 24 bp, Artificial Sequence
  Description of Artificial Sequence: Synthetic oligonucleotide
tggctttggctggggacacccgac

SEQ ID NO: 62860 - DNA, 23 bp, Artificial Sequence
  Description of Artificial Sequence: Synthetic oligonucleotide
ggctttggctggggacacccgac

SEQ ID NO: 62861 - DNA, 24 bp, Artificial Sequence
  Description of Artificial Sequence: Synthetic oligonucleotide
gctttggctggggacacccgacca

SEQ ID NO: 62862 - DNA, 24 bp, Artificial Sequence
  Description of Artificial Sequence: Synthetic oligonucleotide
ctttggctggggacacccgaccac

SEQ ID NO: 62863 - DNA, 27 bp, Artificial Sequence
  Description of Artificial Sequence: Synthetic oligonucleotide
tttggctggggacacccgaccacgttt

SEQ ID NO: 62864 - DNA, 26 bp, Artificial Sequence
  Description of Artificial Sequence: Synthetic oligonucleotide
ttggctggggacacccgaccacgttt

SEQ ID NO: 62865 - DNA, 25 bp, Artificial Sequence
  Description of Artificial Sequence: Synthetic oligonucleotide
tggctggggacacccgaccacgttt

SEQ ID NO: 62866 - DNA, 24 bp, Artificial Sequence
  Description of Artificial Sequence: Synthetic oligonucleotide
ggctggggacacccgaccacgttt

SEQ ID NO: 62867 - DNA, 26 bp, Artificial Sequence
  Description of Artificial Sequence: Synthetic oligonucleotide
gctggggacacccgaccacgtttctt

SEQ ID NO: 62868 - DNA, 27 bp, Artificial Sequence
  Description of Artificial Sequence: Synthetic oligonucleotide
ctggggacacccgaccacgtttcttgt

SEQ ID NO: 62869 - DNA, 27 bp, Artificial Sequence
  Description of Artificial Sequence: Synthetic oligonucleotide
tggggacacccgaccacgtttcttgtg

SEQ ID NO: 62870 - DNA, 26 bp, Artificial Sequence
  Description of Artificial Sequence: Synthetic oligonucleotide
ggggacacccgaccacgtttcttgtg

SEQ ID NO: 62871 - DNA, 26 bp, Artificial Sequence
  Description of Artificial Sequence: Synthetic oligonucleotide
gggacacccgaccacgtttcttgtgg

SEQ ID NO: 62872 - DNA, 27 bp, Artificial Sequence
  Description of Artificial Sequence: Synthetic oligonucleotide
ggacacccgaccacgtttcttgtggca

SEQ ID NO: 62873 - DNA, 27 bp, Artificial Sequence
  Description of Artificial Sequence: Synthetic oligonucleotide
gacacccgaccacgtttcttgtggcag

SEQ ID NO: 62874 - DNA, 27 bp, Artificial Sequence
  Description of Artificial Sequence: Synthetic oligonucleotide
acacccgaccacgtttcttgtggcagc

SEQ ID NO: 62875 - DNA, 27 bp, Artificial Sequence
  Description of Artificial Sequence: Synthetic oligonucleotide
cacccgaccacgtttcttgtggcagct

SEQ ID NO: 62876 - DNA, 30 bp, Artificial Sequence
  Description of Artificial Sequence: Synthetic oligonucleotide
acccgaccacgtttcttgtggcagcttaag

SEQ ID NO: 62877 - DNA, 29 bp, Artificial Sequence
  Description of Artificial Sequence: Synthetic oligonucleotide
cccgaccacgtttcttgtggcagcttaag

SEQ ID NO: 62878 - DNA, 32 bp, Artificial Sequence
  Description of Artificial Sequence: Synthetic oligonucleotide
ccgaccacgtttcttgtggcagcttaagtttg

SEQ ID NO: 62879 - DNA, 35 bp, Artificial Sequence
  Description of Artificial Sequence: Synthetic oligonucleotide
cgaccacgtttcttgtggcagcttaagtttgaatg

SEQ ID NO: 62880 - DNA, 36 bp, Artificial Sequence
  Description of Artificial Sequence: Synthetic oligonucleotide
gaccacgtttcttgtggcagcttaagtttgaatgtc

SEQ ID NO: 62881 - DNA, 40 bp, Artificial Sequence
  Description of Artificial Sequence: Synthetic oligonucleotide
accacgtttcttgtggcagcttaagtttgaatgtcatttc

SEQ ID NO: 62882 - DNA, 39 bp, Artificial Sequence
  Description of Artificial Sequence: Synthetic oligonucleotide
ccacgtttcttgtggcagcttaagtttgaatgtcatttc

SEQ ID NO: 62883 - DNA, 41 bp, Artificial Sequence
  Description of Artificial Sequence: Synthetic oligonucleotide
cacgtttcttgtggcagcttaagtttgaatgtcatttcttc

SEQ ID NO: 62884 - DNA, 44 bp, Artificial Sequence
  Description of Artificial Sequence: Synthetic oligonucleotide
acgtttcttgtggcagcttaagtttgaatgtcatttcttcaatg

SEQ ID NO: 62885 - DNA, 43 bp, Artificial Sequence
  Description of Artificial Sequence: Synthetic oligonucleotide
cgtttcttgtggcagcttaagtttgaatgtcatttcttcaatg

SEQ ID NO: 62886 - DNA, 43 bp, Artificial Sequence
  Description of Artificial Sequence: Synthetic oligonucleotide
gtttcttgtggcagcttaagtttgaatgtcatttcttcaatgg

SEQ ID NO: 62887 - DNA, 43 bp, Artificial Sequence
  Description of Artificial Sequence: Synthetic oligonucleotide
tttcttgtggcagcttaagtttgaatgtcatttcttcaatggg

SEQ ID NO: 62888 - DNA, 42 bp, Artificial Sequence
  Description of Artificial Sequence: Synthetic oligonucleotide
ttcttgtggcagcttaagtttgaatgtcatttcttcaatggg

SEQ ID NO: 62889 - DNA, 41 bp, Artificial Sequence
  Description of Artificial Sequence: Synthetic oligonucleotide
tcttgtggcagcttaagtttgaatgtcatttcttcaatggg

SEQ ID NO: 62890 - DNA, 40 bp, Artificial Sequence
  Description of Artificial Sequence: Synthetic oligonucleotide
cttgtggcagcttaagtttgaatgtcatttcttcaatggg

SEQ ID NO: 62891 - DNA, 41 bp, Artificial Sequence
  Description of Artificial Sequence: Synthetic oligonucleotide
ttgtggcagcttaagtttgaatgtcatttcttcaatgggac

SEQ ID NO: 62892 - DNA, 40 bp, Artificial Sequence
  Description of Artificial Sequence: Synthetic oligonucleotide
tgtggcagcttaagtttgaatgtcatttcttcaatgggac

SEQ ID NO: 62893 - DNA, 39 bp, Artificial Sequence
  Description of Artificial Sequence: Synthetic oligonucleotide
gtggcagcttaagtttgaatgtcatttcttcaatgggac

SEQ ID NO: 62894 - DNA, 39 bp, Artificial Sequence
  Description of Artificial Sequence: Synthetic oligonucleotide
tggcagcttaagtttgaatgtcatttcttcaatgggacg

SEQ ID NO: 62895 - DNA, 38 bp, Artificial Sequence
  Description of Artificial Sequence: Synthetic oligonucleotide
ggcagcttaagtttgaatgtcatttcttcaatgggacg

SEQ ID NO: 62896 - DNA, 38 bp, Artificial Sequence
  Description of Artificial Sequence: Synthetic oligonucleotide
gcagcttaagtttgaatgtcatttcttcaatgggacgg

SEQ ID NO: 62897 - DNA, 39 bp, Artificial Sequence
  Description of Artificial Sequence: Synthetic oligonucleotide
cagcttaagtttgaatgtcatttcttcaatgggacggag

SEQ ID NO: 62898 - DNA, 39 bp, Artificial Sequence
  Description of Artificial Sequence: Synthetic oligonucleotide
agcttaagtttgaatgtcatttcttcaatgggacggagc

SEQ ID NO: 62899 - DNA, 38 bp, Artificial Sequence
  Description of Artificial Sequence: Synthetic oligonucleotide
gcttaagtttgaatgtcatttcttcaatgggacggagc

SEQ ID NO: 62900 - DNA, 38 bp, Artificial Sequence
  Description of Artificial Sequence: Synthetic oligonucleotide
cttaagtttgaatgtcatttcttcaatgggacggagcg

SEQ ID NO: 62901 - DNA, 38 bp, Artificial Sequence
  Description of Artificial Sequence: Synthetic oligonucleotide
ttaagtttgaatgtcatttcttcaatgggacggagcgg

SEQ ID NO: 62902 - DNA, 37 bp, Artificial Sequence
  Description of Artificial Sequence: Synthetic oligonucleotide
taagtttgaatgtcatttcttcaatgggacggagcgg

SEQ ID NO: 62903 - DNA, 36 bp, Artificial Sequence
  Description of Artificial Sequence: Synthetic oligonucleotide
aagtttgaatgtcatttcttcaatgggacggagcgg

SEQ ID NO: 62904 - DNA, 35 bp, Artificial Sequence
  Description of Artificial Sequence: Synthetic oligonucleotide
agtttgaatgtcatttcttcaatgggacggagcgg

SEQ ID NO: 62905 - DNA, 34 bp, Artificial Sequence
  Description of Artificial Sequence: Synthetic oligonucleotide
gtttgaatgtcatttcttcaatgggacggagcgg

SEQ ID NO: 62906 - DNA, 34 bp, Artificial Sequence
  Description of Artificial Sequence: Synthetic oligonucleotide
tttgaatgtcatttcttcaatgggacggagcggg

SEQ ID NO: 62907 - DNA, 33 bp, Artificial Sequence
  Description of Artificial Sequence: Synthetic oligonucleotide
ttgaatgtcatttcttcaatgggacggagcggg

SEQ ID NO: 62908 - DNA, 32 bp, Artificial Sequence
  Description of Artificial Sequence: Synthetic oligonucleotide
tgaatgtcatttcttcaatgggacggagcggg

SEQ ID NO: 62909 - DNA, 31 bp, Artificial Sequence
  Description of Artificial Sequence: Synthetic oligonucleotide
gaatgtcatttcttcaatgggacggagcggg

SEQ ID NO: 62910 - DNA, 32 bp, Artificial Sequence
  Description of Artificial Sequence: Synthetic oligonucleotide
aatgtcatttcttcaatgggacggagcgggtg

SEQ ID NO: 62911 - DNA, 31 bp, Artificial Sequence
  Description of Artificial Sequence: Synthetic oligonucleotide
atgtcatttcttcaatgggacggagcgggtg

SEQ ID NO: 62912 - DNA, 30 bp, Artificial Sequence
  Description of Artificial Sequence: Synthetic oligonucleotide
tgtcatttcttcaatgggacggagcgggtg

SEQ ID NO: 62913 - DNA, 29 bp, Artificial Sequence
  Description of Artificial Sequence: Synthetic oligonucleotide
gtcatttcttcaatgggacggagcgggtg

SEQ ID NO: 62914 - DNA, 29 bp, Artificial Sequence
  Description of Artificial Sequence: Synthetic oligonucleotide
tcatttcttcaatgggacggagcgggtgc

SEQ ID NO: 62915 - DNA, 28 bp, Artificial Sequence
  Description of Artificial Sequence: Synthetic oligonucleotide
catttcttcaatgggacggagcgggtgc

SEQ ID NO: 62916 - DNA, 28 bp, Artificial Sequence
  Description of Artificial Sequence: Synthetic oligonucleotide
atttcttcaatgggacggagcgggtgcg

SEQ ID NO: 62917 - DNA, 27 bp, Artificial Sequence
  Description of Artificial Sequence: Synthetic oligonucleotide
tttcttcaatgggacggagcgggtgcg

SEQ ID NO: 62918 - DNA, 26 bp, Artificial Sequence
  Description of Artificial Sequence: Synthetic oligonucleotide
ttcttcaatgggacggagcgggtgcg

SEQ ID NO: 62919 - DNA, 25 bp, Artificial Sequence
  Description of Artificial Sequence: Synthetic oligonucleotide
tcttcaatgggacggagcgggtgcg

SEQ ID NO: 62920 - DNA, 24 bp, Artificial Sequence
  Description of Artificial Sequence: Synthetic oligonucleotide
cttcaatgggacggagcgggtgcg

SEQ ID NO: 62921 - DNA, 26 bp, Artificial Sequence
  Description of Artificial Sequence: Synthetic oligonucleotide
ttcaatgggacggagcgggtgcggtt

SEQ ID NO: 62922 - DNA, 25 bp, Artificial Sequence
  Description of Artificial Sequence: Synthetic oligonucleotide
tcaatgggacggagcgggtgcggtt

SEQ ID NO: 62923 - DNA, 24 bp, Artificial Sequence
  Description of Artificial Sequence: Synthetic oligonucleotide
caatgggacggagcgggtgcggtt

SEQ ID NO: 62924 - DNA, 24 bp, Artificial Sequence
  Description of Artificial Sequence: Synthetic oligonucleotide
aatgggacggagcgggtgcggttg

SEQ ID NO: 62925 - DNA, 23 bp, Artificial Sequence
  Description of Artificial Sequence: Synthetic oligonucleotide
atgggacggagcgggtgcggttg

SEQ ID NO: 62926 - DNA, 22 bp, Artificial Sequence
  Description of Artificial Sequence: Synthetic oligonucleotide
tgggacggagcgggtgcggttg

SEQ ID NO: 62927 - DNA, 21 bp, Artificial Sequence
  Description of Artificial Sequence: Synthetic oligonucleotide
gggacggagcgggtgcggttg

SEQ ID NO: 62928 - DNA, 22 bp, Artificial Sequence
  Description of Artificial Sequence: Synthetic oligonucleotide
ggacggagcgggtgcggttgct

SEQ ID NO: 62929 - DNA, 22 bp, Artificial Sequence
  Description of Artificial Sequence: Synthetic oligonucleotide
gacggagcgggtgcggttgctg

SEQ ID NO: 62930 - DNA, 25 bp, Artificial Sequence
  Description of Artificial Sequence: Synthetic oligonucleotide
acggagcgggtgcggttgctggaaa

SEQ ID NO: 62931 - DNA, 24 bp, Artificial Sequence
  Description of Artificial Sequence: Synthetic oligonucleotide
cggagcgggtgcggttgctggaaa

SEQ ID NO: 62932 - DNA, 26 bp, Artificial Sequence
  Description of Artificial Sequence: Synthetic oligonucleotide
ggagcgggtgcggttgctggaaagat

SEQ ID NO: 62933 - DNA, 26 bp, Artificial Sequence
  Description of Artificial Sequence: Synthetic oligonucleotide
gagcgggtgcggttgctggaaagatg

SEQ ID NO: 62934 - DNA, 27 bp, Artificial Sequence
  Description of Artificial Sequence: Synthetic oligonucleotide
agcgggtgcggttgctggaaagatgca

SEQ ID NO: 62935 - DNA, 27 bp, Artificial Sequence
  Description of Artificial Sequence: Synthetic oligonucleotide
gcgggtgcggttgctggaaagatgcat

SEQ ID NO: 62936 - DNA, 27 bp, Artificial Sequence
  Description of Artificial Sequence: Synthetic oligonucleotide
cgggtgcggttgctggaaagatgcatc

SEQ ID NO: 62937 - DNA, 32 bp, Artificial Sequence
  Description of Artificial Sequence: Synthetic oligonucleotide
gggtgcggttgctggaaagatgcatctataac

SEQ ID NO: 62938 - DNA, 32 bp, Artificial Sequence
  Description of Artificial Sequence: Synthetic oligonucleotide
ggtgcggttgctggaaagatgcatctataacc

SEQ ID NO: 62939 - DNA, 34 bp, Artificial Sequence
  Description of Artificial Sequence: Synthetic oligonucleotide
gtgcggttgctggaaagatgcatctataaccaag

SEQ ID NO: 62940 - DNA, 35 bp, Artificial Sequence
  Description of Artificial Sequence: Synthetic oligonucleotide
tgcggttgctggaaagatgcatctataaccaagag

SEQ ID NO: 62941 - DNA, 34 bp, Artificial Sequence
  Description of Artificial Sequence: Synthetic oligonucleotide
gcggttgctggaaagatgcatctataaccaagag

SEQ ID NO: 62942 - DNA, 34 bp, Artificial Sequence
  Description of Artificial Sequence: Synthetic oligonucleotide
cggttgctggaaagatgcatctataaccaagagg

SEQ ID NO: 62943 - DNA, 35 bp, Artificial Sequence
  Description of Artificial Sequence: Synthetic oligonucleotide
ggttgctggaaagatgcatctataaccaagaggag

SEQ ID NO: 62944 - DNA, 36 bp, Artificial Sequence
  Description of Artificial Sequence: Synthetic oligonucleotide
gttgctggaaagatgcatctataaccaagaggagtc

SEQ ID NO: 62945 - DNA, 36 bp, Artificial Sequence
  Description of Artificial Sequence: Synthetic oligonucleotide
ttgctggaaagatgcatctataaccaagaggagtcc

SEQ ID NO: 62946 - DNA, 35 bp, Artificial Sequence
  Description of Artificial Sequence: Synthetic oligonucleotide
tgctggaaagatgcatctataaccaagaggagtcc

SEQ ID NO: 62947 - DNA, 34 bp, Artificial Sequence
  Description of Artificial Sequence: Synthetic oligonucleotide
gctggaaagatgcatctataaccaagaggagtcc

SEQ ID NO: 62948 - DNA, 34 bp, Artificial Sequence
  Description of Artificial Sequence: Synthetic oligonucleotide
ctggaaagatgcatctataaccaagaggagtccg

SEQ ID NO: 62949 - DNA, 35 bp, Artificial Sequence
  Description of Artificial Sequence: Synthetic oligonucleotide
tggaaagatgcatctataaccaagaggagtccgtg

SEQ ID NO: 62950 - DNA, 34 bp, Artificial Sequence
  Description of Artificial Sequence: Synthetic oligonucleotide
ggaaagatgcatctataaccaagaggagtccgtg

SEQ ID NO: 62951 - DNA, 34 bp, Artificial Sequence
  Description of Artificial Sequence: Synthetic oligonucleotide
gaaagatgcatctataaccaagaggagtccgtgc

SEQ ID NO: 62952 - DNA, 34 bp, Artificial Sequence
  Description of Artificial Sequence: Synthetic oligonucleotide
aaagatgcatctataaccaagaggagtccgtgcg

SEQ ID NO: 62953 - DNA, 33 bp, Artificial Sequence
  Description of Artificial Sequence: Synthetic oligonucleotide
aagatgcatctataaccaagaggagtccgtgcg

SEQ ID NO: 62954 - DNA, 32 bp, Artificial Sequence
  Description of Artificial Sequence: Synthetic oligonucleotide
agatgcatctataaccaagaggagtccgtgcg

SEQ ID NO: 62955 - DNA, 31 bp, Artificial Sequence
  Description of Artificial Sequence: Synthetic oligonucleotide
gatgcatctataaccaagaggagtccgtgcg

SEQ ID NO: 62956 - DNA, 31 bp, Artificial Sequence
  Description of Artificial Sequence: Synthetic oligonucleotide
atgcatctataaccaagaggagtccgtgcgc

SEQ ID NO: 62957 - DNA, 30 bp, Artificial Sequence
  Description of Artificial Sequence: Synthetic oligonucleotide
tgcatctataaccaagaggagtccgtgcgc

SEQ ID NO: 62958 - DNA, 29 bp, Artificial Sequence
  Description of Artificial Sequence: Synthetic oligonucleotide
gcatctataaccaagaggagtccgtgcgc

SEQ ID NO: 62959 - DNA, 31 bp, Artificial Sequence
  Description of Artificial Sequence: Synthetic oligonucleotide
catctataaccaagaggagtccgtgcgcttc

SEQ ID NO: 62960 - DNA, 31 bp, Artificial Sequence
  Description of Artificial Sequence: Synthetic oligonucleotide
atctataaccaagaggagtccgtgcgcttcg

SEQ ID NO: 62961 - DNA, 30 bp, Artificial Sequence
  Description of Artificial Sequence: Synthetic oligonucleotide
tctataaccaagaggagtccgtgcgcttcg

SEQ ID NO: 62962 - DNA, 29 bp, Artificial Sequence
  Description of Artificial Sequence: Synthetic oligonucleotide
ctataaccaagaggagtccgtgcgcttcg

SEQ ID NO: 62963 - DNA, 30 bp, Artificial Sequence
  Description of Artificial Sequence: Synthetic oligonucleotide
tataaccaagaggagtccgtgcgcttcgac

SEQ ID NO: 62964 - DNA, 29 bp, Artificial Sequence
  Description of Artificial Sequence: Synthetic oligonucleotide
ataaccaagaggagtccgtgcgcttcgac

SEQ ID NO: 62965 - DNA, 28 bp, Artificial Sequence
  Description of Artificial Sequence: Synthetic oligonucleotide
taaccaagaggagtccgtgcgcttcgac

SEQ ID NO: 62966 - DNA, 27 bp, Artificial Sequence
  Description of Artificial Sequence: Synthetic oligonucleotide
aaccaagaggagtccgtgcgcttcgac

SEQ ID NO: 62967 - DNA, 27 bp, Artificial Sequence
  Description of Artificial Sequence: Synthetic oligonucleotide
accaagaggagtccgtgcgcttcgaca

SEQ ID NO: 62968 - DNA, 26 bp, Artificial Sequence
  Description of Artificial Sequence: Synthetic oligonucleotide
ccaagaggagtccgtgcgcttcgaca

SEQ ID NO: 62969 - DNA, 26 bp, Artificial Sequence
  Description of Artificial Sequence: Synthetic oligonucleotide
caagaggagtccgtgcgcttcgacag

SEQ ID NO: 62970 - DNA, 26 bp, Artificial Sequence
  Description of Artificial Sequence: Synthetic oligonucleotide
aagaggagtccgtgcgcttcgacagc

SEQ ID NO: 62971 - DNA, 25 bp, Artificial Sequence
  Description of Artificial Sequence: Synthetic oligonucleotide
agaggagtccgtgcgcttcgacagc

SEQ ID NO: 62972 - DNA, 24 bp, Artificial Sequence
  Description of Artificial Sequence: Synthetic oligonucleotide
gaggagtccgtgcgcttcgacagc

SEQ ID NO: 62973 - DNA, 25 bp, Artificial Sequence
  Description of Artificial Sequence: Synthetic oligonucleotide
aggagtccgtgcgcttcgacagcga

SEQ ID NO: 62974 - DNA, 24 bp, Artificial Sequence
  Description of Artificial Sequence: Synthetic oligonucleotide
ggagtccgtgcgcttcgacagcga

SEQ ID NO: 62975 - DNA, 24 bp, Artificial Sequence
  Description of Artificial Sequence: Synthetic oligonucleotide
gagtccgtgcgcttcgacagcgac

SEQ ID NO: 62976 - DNA, 25 bp, Artificial Sequence
  Description of Artificial Sequence: Synthetic oligonucleotide
agtccgtgcgcttcgacagcgacgt

SEQ ID NO: 62977 - DNA, 24 bp, Artificial Sequence
  Description of Artificial Sequence: Synthetic oligonucleotide
gtccgtgcgcttcgacagcgacgt

SEQ ID NO: 62978 - DNA, 24 bp, Artificial Sequence
  Description of Artificial Sequence: Synthetic oligonucleotide
tccgtgcgcttcgacagcgacgtg

SEQ ID NO: 62979 - DNA, 23 bp, Artificial Sequence
  Description of Artificial Sequence: Synthetic oligonucleotide
ccgtgcgcttcgacagcgacgtg

SEQ ID NO: 62980 - DNA, 25 bp, Artificial Sequence
  Description of Artificial Sequence: Synthetic oligonucleotide
gcttcgacagcgacgtgggggagta

SEQ ID NO: 62981 - DNA, 25 bp, Artificial Sequence
  Description of Artificial Sequence: Synthetic oligonucleotide
cttcgacagcgacgtgggggagtac

SEQ ID NO: 62982 - DNA, 25 bp, Artificial Sequence
  Description of Artificial Sequence: Synthetic oligonucleotide
ttcgacagcgacgtgggggagtacc

SEQ ID NO: 62983 - DNA, 24 bp, Artificial Sequence
  Description of Artificial Sequence: Synthetic oligonucleotide
tcgacagcgacgtgggggagtacc

SEQ ID NO: 62984 - DNA, 23 bp, Artificial Sequence
  Description of Artificial Sequence: Synthetic oligonucleotide
cgacagcgacgtgggggagtacc

SEQ ID NO: 62985 - DNA, 23 bp, Artificial Sequence
  Description of Artificial Sequence: Synthetic oligonucleotide
gacagcgacgtgggggagtaccg

SEQ ID NO: 62986 - DNA, 23 bp, Artificial Sequence
  Description of Artificial Sequence: Synthetic oligonucleotide
acagcgacgtgggggagtaccgg

SEQ ID NO: 62987 - DNA, 22 bp, Artificial Sequence
  Description of Artificial Sequence: Synthetic oligonucleotide
cagcgacgtgggggagtaccgg

SEQ ID NO: 62988 - DNA, 22 bp, Artificial Sequence
  Description of Artificial Sequence: Synthetic oligonucleotide
agcgacgtgggggagtaccggg

SEQ ID NO: 62989 - DNA, 21 bp, Artificial Sequence
  Description of Artificial Sequence: Synthetic oligonucleotide
gcgacgtgggggagtaccggg

SEQ ID NO: 62990 - DNA, 21 bp, Artificial Sequence
  Description of Artificial Sequence: Synthetic oligonucleotide
cgacgtgggggagtaccgggc

SEQ ID NO: 62991 - DNA, 21 bp, Artificial Sequence
  Description of Artificial Sequence: Synthetic oligonucleotide
gacgtgggggagtaccgggcg

SEQ ID NO: 62992 - DNA, 22 bp, Artificial Sequence
  Description of Artificial Sequence: Synthetic oligonucleotide
acgtgggggagtaccgggcggt

SEQ ID NO: 62993 - DNA, 21 bp, Artificial Sequence
  Description of Artificial Sequence: Synthetic oligonucleotide
cgtgggggagtaccgggcggt

SEQ ID NO: 62994 - DNA, 22 bp, Artificial Sequence
  Description of Artificial Sequence: Synthetic oligonucleotide
gtgggggagtaccgggcggtga

SEQ ID NO: 62995 - DNA, 22 bp, Artificial Sequence
  Description of Artificial Sequence: Synthetic oligonucleotide
tgggggagtaccgggcggtgac

SEQ ID NO: 62996 - DNA, 21 bp, Artificial Sequence
  Description of Artificial Sequence: Synthetic oligonucleotide
gggggagtaccgggcggtgac

SEQ ID NO: 62997 - DNA, 21 bp, Artificial Sequence
  Description of Artificial Sequence: Synthetic oligonucleotide
ggggagtaccgggcggtgacg

SEQ ID NO: 62998 - DNA, 22 bp, Artificial Sequence
  Description of Artificial Sequence: Synthetic oligonucleotide
gggagtaccgggcggtgacgga

SEQ ID NO: 62999 - DNA, 22 bp, Artificial Sequence
  Description of Artificial Sequence: Synthetic oligonucleotide
ggagtaccgggcggtgacggag

SEQ ID NO: 63000 - DNA, 23 bp, Artificial Sequence
  Description of Artificial Sequence: Synthetic oligonucleotide
gagtaccgggcggtgacggagct

SEQ ID NO: 63001 - DNA, 23 bp, Artificial Sequence
  Description of Artificial Sequence: Synthetic oligonucleotide
agtaccgggcggtgacggagctg

SEQ ID NO: 63002 - DNA, 22 bp, Artificial Sequence
  Description of Artificial Sequence: Synthetic oligonucleotide
gtaccgggcggtgacggagctg

SEQ ID NO: 63003 - DNA, 22 bp, Artificial Sequence
  Description of Artificial Sequence: Synthetic oligonucleotide
taccgggcggtgacggagctgg

SEQ ID NO: 63004 - DNA, 21 bp, Artificial Sequence
  Description of Artificial Sequence: Synthetic oligonucleotide
accgggcggtgacggagctgg

SEQ ID NO: 63005 - DNA, 22 bp, Artificial Sequence
  Description of Artificial Sequence: Synthetic oligonucleotide
acggagctggggcggcctgatg

SEQ ID NO: 63006 - DNA, 21 bp, Artificial Sequence
  Description of Artificial Sequence: Synthetic oligonucleotide
cggagctggggcggcctgatg

SEQ ID NO: 63007 - DNA, 21 bp, Artificial Sequence
  Description of Artificial Sequence: Synthetic oligonucleotide
ggagctggggcggcctgatgc

SEQ ID NO: 63008 - DNA, 21 bp, Artificial Sequence
  Description of Artificial Sequence: Synthetic oligonucleotide
gagctggggcggcctgatgcc

SEQ ID NO: 63009 - DNA, 22 bp, Artificial Sequence
  Description of Artificial Sequence: Synthetic oligonucleotide
agctggggcggcctgatgccga

SEQ ID NO: 63010 - DNA, 29 bp, Artificial Sequence
  Description of Artificial Sequence: Synthetic oligonucleotide
atgccgagtactggaacagccagaaggac

SEQ ID NO: 63011 - DNA, 28 bp, Artificial Sequence
  Description of Artificial Sequence: Synthetic oligonucleotide
tgccgagtactggaacagccagaaggac

SEQ ID NO: 63012 - DNA, 27 bp, Artificial Sequence
  Description of Artificial Sequence: Synthetic oligonucleotide
ccgagtactggaacagccagaaggacc

SEQ ID NO: 63013 - DNA, 28 bp, Artificial Sequence
  Description of Artificial Sequence: Synthetic oligonucleotide
cgagtactggaacagccagaaggacctc

SEQ ID NO: 63014 - DNA, 27 bp, Artificial Sequence
  Description of Artificial Sequence: Synthetic oligonucleotide
gaacagccagaaggacctcctggagca

SEQ ID NO: 63015 - DNA, 27 bp, Artificial Sequence
  Description of Artificial Sequence: Synthetic oligonucleotide
aacagccagaaggacctcctggagcag

SEQ ID NO: 63016 - DNA, 27 bp, Artificial Sequence
  Description of Artificial Sequence: Synthetic oligonucleotide
acagccagaaggacctcctggagcaga

SEQ ID NO: 63017 - DNA, 26 bp, Artificial Sequence
  Description of Artificial Sequence: Synthetic oligonucleotide
cagccagaaggacctcctggagcaga

SEQ ID NO: 63018 - DNA, 26 bp, Artificial Sequence
  Description of Artificial Sequence: Synthetic oligonucleotide
agccagaaggacctcctggagcagag

SEQ ID NO: 63019 - DNA, 25 bp, Artificial Sequence
  Description of Artificial Sequence: Synthetic oligonucleotide
gccagaaggacctcctggagcagag

SEQ ID NO: 63020 - DNA, 25 bp, Artificial Sequence
  Description of Artificial Sequence: Synthetic oligonucleotide
ccagaaggacctcctggagcagagg

SEQ ID NO: 63021 - DNA, 25 bp, Artificial Sequence
  Description of Artificial Sequence: Synthetic oligonucleotide
cagaaggacctcctggagcagaggc

SEQ ID NO: 63022 - DNA, 25 bp, Artificial Sequence
  Description of Artificial Sequence: Synthetic oligonucleotide
agaaggacctcctggagcagaggcg

SEQ ID NO: 63023 - DNA, 24 bp, Artificial Sequence
  Description of Artificial Sequence: Synthetic oligonucleotide
gaaggacctcctggagcagaggcg

SEQ ID NO: 63024 - DNA, 24 bp, Artificial Sequence
  Description of Artificial Sequence: Synthetic oligonucleotide
aaggacctcctggagcagaggcgg

SEQ ID NO: 63025 - DNA, 23 bp, Artificial Sequence
  Description of Artificial Sequence: Synthetic oligonucleotide
aggacctcctggagcagaggcgg

SEQ ID NO: 63026 - DNA, 22 bp, Artificial Sequence
  Description of Artificial Sequence: Synthetic oligonucleotide
ggacctcctggagcagaggcgg

SEQ ID NO: 63027 - DNA, 22 bp, Artificial Sequence
  Description of Artificial Sequence: Synthetic oligonucleotide
gacctcctggagcagaggcggg

SEQ ID NO: 63028 - DNA, 22 bp, Artificial Sequence
  Description of Artificial Sequence: Synthetic oligonucleotide
acctcctggagcagaggcgggc

SEQ ID NO: 63029 - DNA, 21 bp, Artificial Sequence
  Description of Artificial Sequence: Synthetic oligonucleotide
cctcctggagcagaggcgggc

SEQ ID NO: 63030 - DNA, 21 bp, Artificial Sequence
  Description of Artificial Sequence: Synthetic oligonucleotide
ctcctggagcagaggcgggcc

SEQ ID NO: 63031 - DNA, 21 bp, Artificial Sequence
  Description of Artificial Sequence: Synthetic oligonucleotide
tcctggagcagaggcgggccg

SEQ ID NO: 63032 - DNA, 20 bp, Artificial Sequence
  Description of Artificial Sequence: Synthetic oligonucleotide
cctggagcagaggcgggccg

SEQ ID NO: 63033 - DNA, 20 bp, Artificial Sequence
  Description of Artificial Sequence: Synthetic oligonucleotide
ctggagcagaggcgggccgc

SEQ ID NO: 63034 - DNA, 20 bp, Artificial Sequence
  Description of Artificial Sequence: Synthetic oligonucleotide
tggagcagaggcgggccgcg

SEQ ID NO: 63035 - DNA, 20 bp, Artificial Sequence
  Description of Artificial Sequence: Synthetic oligonucleotide
ggagcagaggcgggccgcgt

SEQ ID NO: 63036 - DNA, 20 bp, Artificial Sequence
  Description of Artificial Sequence: Synthetic oligonucleotide
gagcagaggcgggccgcggt

SEQ ID NO: 63037 - DNA, 20 bp, Artificial Sequence
  Description of Artificial Sequence: Synthetic oligonucleotide
agcagaggcgggccgcggtg

SEQ ID NO: 63038 - DNA, 20 bp, Artificial Sequence
  Description of Artificial Sequence: Synthetic oligonucleotide
gcagaggcgggccgcggtgt

SEQ ID NO: 63039 - DNA, 20 bp, Artificial Sequence
  Description of Artificial Sequence: Synthetic oligonucleotide
cagaggcgggccgcggtgga

SEQ ID NO: 63040 - DNA, 21 bp, Artificial Sequence
  Description of Artificial Sequence: Synthetic oligonucleotide
agaggcgggccgcggtggaca

SEQ ID NO: 63041 - DNA, 20 bp, Artificial Sequence
  Description of Artificial Sequence: Synthetic oligonucleotide
gaggcgggccgcggtggaca

SEQ ID NO: 63042 - DNA, 20 bp, Artificial Sequence
  Description of Artificial Sequence: Synthetic oligonucleotide
aggcgggccgcggtggacac

SEQ ID NO: 63043 - DNA, 20 bp, Artificial Sequence
  Description of Artificial Sequence: Synthetic oligonucleotide
ggcgggccgcggtggacact

SEQ ID NO: 63044 - DNA, 21 bp, Artificial Sequence
  Description of Artificial Sequence: Synthetic oligonucleotide
gcgggccgcggtggacaccta

SEQ ID NO: 63045 - DNA, 22 bp, Artificial Sequence
  Description of Artificial Sequence: Synthetic oligonucleotide
cgggccgcggtggacacctact

SEQ ID NO: 63046 - DNA, 22 bp, Artificial Sequence
  Description of Artificial Sequence: Synthetic oligonucleotide
gggccgcggtggacacctactg

SEQ ID NO: 63047 - DNA, 23 bp, Artificial Sequence
  Description of Artificial Sequence: Synthetic oligonucleotide
ggccgcggtggacacctactgca

SEQ ID NO: 63048 - DNA, 24 bp, Artificial Sequence
  Description of Artificial Sequence: Synthetic oligonucleotide
gccgcggtggacacctactgcaga

SEQ ID NO: 63049 - DNA, 25 bp, Artificial Sequence
  Description of Artificial Sequence: Synthetic oligonucleotide
ccgcggtggacacctactgcagaca

SEQ ID NO: 63050 - DNA, 27 bp, Artificial Sequence
  Description of Artificial Sequence: Synthetic oligonucleotide
cgcggtggacacctactgcagacacaa

SEQ ID NO: 63051 - DNA, 27 bp, Artificial Sequence
  Description of Artificial Sequence: Synthetic oligonucleotide
gcggtggacacctactgcagacacaac

SEQ ID NO: 63052 - DNA, 29 bp, Artificial Sequence
  Description of Artificial Sequence: Synthetic oligonucleotide
cggtggacacctactgcagacacaactac

SEQ ID NO: 63053 - DNA, 29 bp, Artificial Sequence
  Description of Artificial Sequence: Synthetic oligonucleotide
ggtggacacctactgcagacacaactacg

SEQ ID NO: 63054 - DNA, 29 bp, Artificial Sequence
  Description of Artificial Sequence: Synthetic oligonucleotide
gtggacacctactgcagacacaactacgg

SEQ ID NO: 63055 - DNA, 29 bp, Artificial Sequence
  Description of Artificial Sequence: Synthetic oligonucleotide
tggacacctactgcagacacaactacggg

SEQ ID NO: 63056 - DNA, 28 bp, Artificial Sequence
  Description of Artificial Sequence: Synthetic oligonucleotide
ggacacctactgcagacacaactacggg

SEQ ID NO: 63057 - DNA, 28 bp, Artificial Sequence
  Description of Artificial Sequence: Synthetic oligonucleotide
gacacctactgcagacacaactacgggg

SEQ ID NO: 63058 - DNA, 30 bp, Artificial Sequence
  Description of Artificial Sequence: Synthetic oligonucleotide
acacctactgcagacacaactacggggttg

SEQ ID NO: 63059 - DNA, 29 bp, Artificial Sequence
  Description of Artificial Sequence: Synthetic oligonucleotide
cacctactgcagacacaactacggggttg

SEQ ID NO: 63060 - DNA, 29 bp, Artificial Sequence
  Description of Artificial Sequence: Synthetic oligonucleotide
acctactgcagacacaactacggggttgg

SEQ ID NO: 63061 - DNA, 28 bp, Artificial Sequence
  Description of Artificial Sequence: Synthetic oligonucleotide
cctactgcagacacaactacggggttgg

SEQ ID NO: 63062 - DNA, 29 bp, Artificial Sequence
  Description of Artificial Sequence: Synthetic oligonucleotide
ctactgcagacacaactacggggttggtg

SEQ ID NO: 63063 - DNA, 30 bp, Artificial Sequence
  Description of Artificial Sequence: Synthetic oligonucleotide
tactgcagacacaactacggggttggtgag

SEQ ID NO: 63064 - DNA, 29 bp, Artificial Sequence
  Description of Artificial Sequence: Synthetic oligonucleotide
actgcagacacaactacggggttggtgag

SEQ ID NO: 63065 - DNA, 28 bp, Artificial Sequence
  Description of Artificial Sequence: Synthetic oligonucleotide
ctgcagacacaactacggggttggtgag

SEQ ID NO: 63066 - DNA, 29 bp, Artificial Sequence
  Description of Artificial Sequence: Synthetic oligonucleotide
tgcagacacaactacggggttggtgagag

SEQ ID NO: 63067 - DNA, 28 bp, Artificial Sequence
  Description of Artificial Sequence: Synthetic oligonucleotide
gcagacacaactacggggttggtgagag

SEQ ID NO: 63068 - DNA, 28 bp, Artificial Sequence
  Description of Artificial Sequence: Synthetic oligonucleotide
cagacacaactacggggttggtgagagc

SEQ ID NO: 63069 - DNA, 30 bp, Artificial Sequence
  Description of Artificial Sequence: Synthetic oligonucleotide
agacacaactacggggttggtgagagcttc

SEQ ID NO: 63070 - DNA, 29 bp, Artificial Sequence
  Description of Artificial Sequence: Synthetic oligonucleotide
gacacaactacggggttggtgagagcttc

SEQ ID NO: 63071 - DNA, 30 bp, Artificial Sequence
  Description of Artificial Sequence: Synthetic oligonucleotide
acacaactacggggttggtgagagcttcac

SEQ ID NO: 63072 - DNA, 29 bp, Artificial Sequence
  Description of Artificial Sequence: Synthetic oligonucleotide
cacaactacggggttggtgagagcttcac

SEQ ID NO: 63073 - DNA, 30 bp, Artificial Sequence
  Description of Artificial Sequence: Synthetic oligonucleotide
acaactacggggttggtgagagcttcacag

SEQ ID NO: 63074 - DNA, 29 bp, Artificial Sequence
  Description of Artificial Sequence: Synthetic oligonucleotide
caactacggggttggtgagagcttcacag

SEQ ID NO: 63075 - DNA, 30 bp, Artificial Sequence
  Description of Artificial Sequence: Synthetic oligonucleotide
aactacggggttggtgagagcttcacagtg

SEQ ID NO: 63076 - DNA, 29 bp, Artificial Sequence
  Description of Artificial Sequence: Synthetic oligonucleotide
actacggggttggtgagagcttcacagtg

SEQ ID NO: 63077 - DNA, 28 bp, Artificial Sequence
  Description of Artificial Sequence: Synthetic oligonucleotide
ctacggggttggtgagagcttcacagtg

SEQ ID NO: 63078 - DNA, 28 bp, Artificial Sequence
  Description of Artificial Sequence: Synthetic oligonucleotide
tacggggttggtgagagcttcacagtgc

SEQ ID NO: 63079 - DNA, 27 bp, Artificial Sequence
  Description of Artificial Sequence: Synthetic oligonucleotide
acggggttggtgagagcttcacagtgc

SEQ ID NO: 63080 - DNA, 27 bp, Artificial Sequence
  Description of Artificial Sequence: Synthetic oligonucleotide
cggggttggtgagagcttcacagtgca

SEQ ID NO: 63081 - DNA, 27 bp, Artificial Sequence
  Description of Artificial Sequence: Synthetic oligonucleotide
ggggttggtgagagcttcacagtgcag

SEQ ID NO: 63082 - DNA, 27 bp, Artificial Sequence
  Description of Artificial Sequence: Synthetic oligonucleotide
gggttggtgagagcttcacagtgcagc

SEQ ID NO: 63083 - DNA, 27 bp, Artificial Sequence
  Description of Artificial Sequence: Synthetic oligonucleotide
ggttggtgagagcttcacagtgcagcg

SEQ ID NO: 63084 - DNA, 27 bp, Artificial Sequence
  Description of Artificial Sequence: Synthetic oligonucleotide
gttggtgagagcttcacagtgcagcgg

SEQ ID NO: 63085 - DNA, 27 bp, Artificial Sequence
  Description of Artificial Sequence: Synthetic oligonucleotide
ttggtgagagcttcacagtgcagcggc

SEQ ID NO: 63086 - DNA, 26 bp, Artificial Sequence
  Description of Artificial Sequence: Synthetic oligonucleotide
tggtgagagcttcacagtgcagcggc

SEQ ID NO: 63087 - DNA, 25 bp, Artificial Sequence
  Description of Artificial Sequence: Synthetic oligonucleotide
ggtgagagcttcacagtgcagcggc

SEQ ID NO: 63088 - DNA, 26 bp, Artificial Sequence
  Description of Artificial Sequence: Synthetic oligonucleotide
gtgagagcttcacagtgcagcggcga

SEQ ID NO: 63089 - DNA, 27 bp, Artificial Sequence
  Description of Artificial Sequence: Synthetic oligonucleotide
tgagagcttcacagtgcagcggcgagt

SEQ ID NO: 63090 - DNA, 27 bp, Artificial Sequence
  Description of Artificial Sequence: Synthetic oligonucleotide
gagagcttcacagtgcagcggcgagtt

SEQ ID NO: 63091 - DNA, 27 bp, Artificial Sequence
  Description of Artificial Sequence: Synthetic oligonucleotide
agagcttcacagtgcagcggcgagttg

SEQ ID NO: 63092 - DNA, 27 bp, Artificial Sequence
  Description of Artificial Sequence: Synthetic oligonucleotide
gagcttcacagtgcagcggcgagttga

SEQ ID NO: 63093 - DNA, 27 bp, Artificial Sequence
  Description of Artificial Sequence: Synthetic oligonucleotide
agcttcacagtgcagcggcgagttgag

SEQ ID NO: 63094 - DNA, 26 bp, Artificial Sequence
  Description of Artificial Sequence: Synthetic oligonucleotide
gcttcacagtgcagcggcgagttgag

SEQ ID NO: 63095 - DNA, 26 bp, Artificial Sequence
  Description of Artificial Sequence: Synthetic oligonucleotide
cttcacagtgcagcggcgagttgagc

SEQ ID NO: 63096 - DNA, 27 bp, Artificial Sequence
  Description of Artificial Sequence: Synthetic oligonucleotide
ttcacagtgcagcggcgagttgagcct

SEQ ID NO: 63097 - DNA, 27 bp, Artificial Sequence
  Description of Artificial Sequence: Synthetic oligonucleotide
tcacagtgcagcggcgagttgagccta

SEQ ID NO: 63098 - DNA, 27 bp, Artificial Sequence
  Description of Artificial Sequence: Synthetic oligonucleotide
cacagtgcagcggcgagttgagcctaa

SEQ ID NO: 63099 - DNA, 27 bp, Artificial Sequence
  Description of Artificial Sequence: Synthetic oligonucleotide
acagtgcagcggcgagttgagcctaag

SEQ ID NO: 63100 - DNA, 26 bp, Artificial Sequence
  Description of Artificial Sequence: Synthetic oligonucleotide
cagtgcagcggcgagttgagcctaag

SEQ ID NO: 63101 - DNA, 27 bp, Artificial Sequence
  Description of Artificial Sequence: Synthetic oligonucleotide
agtgcagcggcgagttgagcctaaggt

SEQ ID NO: 63102 - DNA, 26 bp, Artificial Sequence
  Description of Artificial Sequence: Synthetic oligonucleotide
gtgcagcggcgagttgagcctaaggt

SEQ ID NO: 63103 - DNA, 27 bp, Artificial Sequence
  Description of Artificial Sequence: Synthetic oligonucleotide
tgcagcggcgagttgagcctaaggtga

SEQ ID NO: 63104 - DNA, 26 bp, Artificial Sequence
  Description of Artificial Sequence: Synthetic oligonucleotide
gcagcggcgagttgagcctaaggtga

SEQ ID NO: 63105 - DNA, 27 bp, Artificial Sequence
  Description of Artificial Sequence: Synthetic oligonucleotide
cagcggcgagttgagcctaaggtgact

SEQ ID NO: 63106 - DNA, 27 bp, Artificial Sequence
  Description of Artificial Sequence: Synthetic oligonucleotide
agcggcgagttgagcctaaggtgactg

SEQ ID NO: 63107 - DNA, 27 bp, Artificial Sequence
  Description of Artificial Sequence: Synthetic oligonucleotide
gcggcgagttgagcctaaggtgactgt

SEQ ID NO: 63108 - DNA, 27 bp, Artificial Sequence
  Description of Artificial Sequence: Synthetic oligonucleotide
cggcgagttgagcctaaggtgactgtg

SEQ ID NO: 63109 - DNA, 30 bp, Artificial Sequence
  Description of Artificial Sequence: Synthetic oligonucleotide
ggcgagttgagcctaaggtgactgtgtatc

SEQ ID NO: 63110 - DNA, 30 bp, Artificial Sequence
  Description of Artificial Sequence: Synthetic oligonucleotide
gcgagttgagcctaaggtgactgtgtatcc

SEQ ID NO: 63111 - DNA, 32 bp, Artificial Sequence
  Description of Artificial Sequence: Synthetic oligonucleotide
cgagttgagcctaaggtgactgtgtatccttc

SEQ ID NO: 63112 - DNA, 35 bp, Artificial Sequence
  Description of Artificial Sequence: Synthetic oligonucleotide
gagttgagcctaaggtgactgtgtatccttcaaag

SEQ ID NO: 63113 - DNA, 36 bp, Artificial Sequence
  Description of Artificial Sequence: Synthetic oligonucleotide
agttgagcctaaggtgactgtgtatccttcaaagac

SEQ ID NO: 63114 - DNA, 35 bp, Artificial Sequence
  Description of Artificial Sequence: Synthetic oligonucleotide
gttgagcctaaggtgactgtgtatccttcaaagac

SEQ ID NO: 63115 - DNA, 35 bp, Artificial Sequence
  Description of Artificial Sequence: Synthetic oligonucleotide
ttgagcctaaggtgactgtgtatccttcaaagacc

SEQ ID NO: 63116 - DNA, 34 bp, Artificial Sequence
  Description of Artificial Sequence: Synthetic oligonucleotide
tgagcctaaggtgactgtgtatccttcaaagacc

SEQ ID NO: 63117 - DNA, 33 bp, Artificial Sequence
  Description of Artificial Sequence: Synthetic oligonucleotide
gagcctaaggtgactgtgtatccttcaaagacc

SEQ ID NO: 63118 - DNA, 33 bp, Artificial Sequence
  Description of Artificial Sequence: Synthetic oligonucleotide
agcctaaggtgactgtgtatccttcaaagaccc

SEQ ID NO: 63119 - DNA, 32 bp, Artificial Sequence
  Description of Artificial Sequence: Synthetic oligonucleotide
gcctaaggtgactgtgtatccttcaaagaccc

SEQ ID NO: 63120 - DNA, 33 bp, Artificial Sequence
  Description of Artificial Sequence: Synthetic oligonucleotide
cctaaggtgactgtgtatccttcaaagacccag

SEQ ID NO: 63121 - DNA, 33 bp, Artificial Sequence
  Description of Artificial Sequence: Synthetic oligonucleotide
ctaaggtgactgtgtatccttcaaagacccagc

SEQ ID NO: 63122 - DNA, 33 bp, Artificial Sequence
  Description of Artificial Sequence: Synthetic oligonucleotide
taaggtgactgtgtatccttcaaagacccagcc

SEQ ID NO: 63123 - DNA, 32 bp, Artificial Sequence
  Description of Artificial Sequence: Synthetic oligonucleotide
aaggtgactgtgtatccttcaaagacccagcc

SEQ ID NO: 63124 - DNA, 31 bp, Artificial Sequence
  Description of Artificial Sequence: Synthetic oligonucleotide
aggtgactgtgtatccttcaaagacccagcc

SEQ ID NO: 63125 - DNA, 30 bp, Artificial Sequence
  Description of Artificial Sequence: Synthetic oligonucleotide
ggtgactgtgtatccttcaaagacccagcc

SEQ ID NO: 63126 - DNA, 30 bp, Artificial Sequence
  Description of Artificial Sequence: Synthetic oligonucleotide
gtgactgtgtatccttcaaagacccagccc

SEQ ID NO: 63127 - DNA, 30 bp, Artificial Sequence
  Description of Artificial Sequence: Synthetic oligonucleotide
tgactgtgtatccttcaaagacccagcccc

SEQ ID NO: 63128 - DNA, 29 bp, Artificial Sequence
  Description of Artificial Sequence: Synthetic oligonucleotide
gactgtgtatccttcaaagacccagcccc

SEQ ID NO: 63129 - DNA, 30 bp, Artificial Sequence
  Description of Artificial Sequence: Synthetic oligonucleotide
actgtgtatccttcaaagacccagcccctg

SEQ ID NO: 63130 - DNA, 29 bp, Artificial Sequence
  Description of Artificial Sequence: Synthetic oligonucleotide
ctgtgtatccttcaaagacccagcccctg

SEQ ID NO: 63131 - DNA, 29 bp, Artificial Sequence
  Description of Artificial Sequence: Synthetic oligonucleotide
tgtgtatccttcaaagacccagcccctgc

SEQ ID NO: 63132 - DNA, 28 bp, Artificial Sequence
  Description of Artificial Sequence: Synthetic oligonucleotide
gtgtatccttcaaagacccagcccctgc

SEQ ID NO: 63133 - DNA, 29 bp, Artificial Sequence
  Description of Artificial Sequence: Synthetic oligonucleotide
tgtatccttcaaagacccagcccctgcag

SEQ ID NO: 63134 - DNA, 28 bp, Artificial Sequence
  Description of Artificial Sequence: Synthetic oligonucleotide
gtatccttcaaagacccagcccctgcag

SEQ ID NO: 63135 - DNA, 28 bp, Artificial Sequence
  Description of Artificial Sequence: Synthetic oligonucleotide
tatccttcaaagacccagcccctgcagc

SEQ ID NO: 63136 - DNA, 27 bp, Artificial Sequence
  Description of Artificial Sequence: Synthetic oligonucleotide
atccttcaaagacccagcccctgcagc

SEQ ID NO: 63137 - DNA, 27 bp, Artificial Sequence
  Description of Artificial Sequence: Synthetic oligonucleotide
tccttcaaagacccagcccctgcagca

SEQ ID NO: 63138 - DNA, 26 bp, Artificial Sequence
  Description of Artificial Sequence: Synthetic oligonucleotide
ccttcaaagacccagcccctgcagca

SEQ ID NO: 63139 - DNA, 26 bp, Artificial Sequence
  Description of Artificial Sequence: Synthetic oligonucleotide
cttcaaagacccagcccctgcagcac

SEQ ID NO: 63140 - DNA, 27 bp, Artificial Sequence
  Description of Artificial Sequence: Synthetic oligonucleotide
ttcaaagacccagcccctgcagcacca

SEQ ID NO: 63141 - DNA, 26 bp, Artificial Sequence
  Description of Artificial Sequence: Synthetic oligonucleotide
tcaaagacccagcccctgcagcacca

SEQ ID NO: 63142 - DNA, 25 bp, Artificial Sequence
  Description of Artificial Sequence: Synthetic oligonucleotide
caaagacccagcccctgcagcacca

SEQ ID NO: 63143 - DNA, 27 bp, Artificial Sequence
  Description of Artificial Sequence: Synthetic oligonucleotide
aaagacccagcccctgcagcaccacaa

SEQ ID NO: 63144 - DNA, 26 bp, Artificial Sequence
  Description of Artificial Sequence: Synthetic oligonucleotide
aagacccagcccctgcagcaccacaa

SEQ ID NO: 63145 - DNA, 25 bp, Artificial Sequence
  Description of Artificial Sequence: Synthetic oligonucleotide
agacccagcccctgcagcaccacaa

SEQ ID NO: 63146 - DNA, 24 bp, Artificial Sequence
  Description of Artificial Sequence: Synthetic oligonucleotide
gacccagcccctgcagcaccacaa

SEQ ID NO: 63147 - DNA, 24 bp, Artificial Sequence
  Description of Artificial Sequence: Synthetic oligonucleotide
acccagcccctgcagcaccacaac

SEQ ID NO: 63148 - DNA, 23 bp, Artificial Sequence
  Description of Artificial Sequence: Synthetic oligonucleotide
cccagcccctgcagcaccacaac

SEQ ID NO: 63149 - DNA, 24 bp, Artificial Sequence
  Description of Artificial Sequence: Synthetic oligonucleotide
ccagcccctgcagcaccacaacct

SEQ ID NO: 63150 - DNA, 24 bp, Artificial Sequence
  Description of Artificial Sequence: Synthetic oligonucleotide
cagcccctgcagcaccacaacctc

SEQ ID NO: 63151 - DNA, 25 bp, Artificial Sequence
  Description of Artificial Sequence: Synthetic oligonucleotide
agcccctgcagcaccacaacctcct

SEQ ID NO: 63152 - DNA, 24 bp, Artificial Sequence
  Description of Artificial Sequence: Synthetic oligonucleotide
gcccctgcagcaccacaacctcct

SEQ ID NO: 63153 - DNA, 24 bp, Artificial Sequence
  Description of Artificial Sequence: Synthetic oligonucleotide
cccctgcagcaccacaacctcctg

SEQ ID NO: 63154 - DNA, 25 bp, Artificial Sequence
  Description of Artificial Sequence: Synthetic oligonucleotide
ccctgcagcaccacaacctcctggt

SEQ ID NO: 63155 - DNA, 26 bp, Artificial Sequence
  Description of Artificial Sequence: Synthetic oligonucleotide
cctgcagcaccacaacctcctggtct

SEQ ID NO: 63156 - DNA, 26 bp, Artificial Sequence
  Description of Artificial Sequence: Synthetic oligonucleotide
ctgcagcaccacaacctcctggtctg

SEQ ID NO: 63157 - DNA, 27 bp, Artificial Sequence
  Description of Artificial Sequence: Synthetic oligonucleotide
tgcagcaccacaacctcctggtctgct

SEQ ID NO: 63158 - DNA, 26 bp, Artificial Sequence
  Description of Artificial Sequence: Synthetic oligonucleotide
gcagcaccacaacctcctggtctgct

SEQ ID NO: 63159 - DNA, 27 bp, Artificial Sequence
  Description of Artificial Sequence: Synthetic oligonucleotide
cagcaccacaacctcctggtctgctct

SEQ ID NO: 63160 - DNA, 27 bp, Artificial Sequence
  Description of Artificial Sequence: Synthetic oligonucleotide
agcaccacaacctcctggtctgctctg

SEQ ID NO: 63161 - DNA, 27 bp, Artificial Sequence
  Description of Artificial Sequence: Synthetic oligonucleotide
gcaccacaacctcctggtctgctctgt

SEQ ID NO: 63162 - DNA, 27 bp, Artificial Sequence
  Description of Artificial Sequence: Synthetic oligonucleotide
caccacaacctcctggtctgctctgtg

SEQ ID NO: 63163 - DNA, 28 bp, Artificial Sequence
  Description of Artificial Sequence: Synthetic oligonucleotide
accacaacctcctggtctgctctgtgag

SEQ ID NO: 63164 - DNA, 27 bp, Artificial Sequence
  Description of Artificial Sequence: Synthetic oligonucleotide
ccacaacctcctggtctgctctgtgag

SEQ ID NO: 63165 - DNA, 28 bp, Artificial Sequence
  Description of Artificial Sequence: Synthetic oligonucleotide
cacaacctcctggtctgctctgtgagtg

SEQ ID NO: 63166 - DNA, 28 bp, Artificial Sequence
  Description of Artificial Sequence: Synthetic oligonucleotide
acaacctcctggtctgctctgtgagtgg

SEQ ID NO: 63167 - DNA, 27 bp, Artificial Sequence
  Description of Artificial Sequence: Synthetic oligonucleotide
caacctcctggtctgctctgtgagtgg

SEQ ID NO: 63168 - DNA, 30 bp, Artificial Sequence
  Description of Artificial Sequence: Synthetic oligonucleotide
aacctcctggtctgctctgtgagtggtttc

SEQ ID NO: 63169 - DNA, 29 bp, Artificial Sequence
  Description of Artificial Sequence: Synthetic oligonucleotide
acctcctggtctgctctgtgagtggtttc

SEQ ID NO: 63170 - DNA, 28 bp, Artificial Sequence
  Description of Artificial Sequence: Synthetic oligonucleotide
cctcctggtctgctctgtgagtggtttc

SEQ ID NO: 63171 - DNA, 31 bp, Artificial Sequence
  Description of Artificial Sequence: Synthetic oligonucleotide
ctcctggtctgctctgtgagtggtttctatc

SEQ ID NO: 63172 - DNA, 31 bp, Artificial Sequence
  Description of Artificial Sequence: Synthetic oligonucleotide
tcctggtctgctctgtgagtggtttctatcc

SEQ ID NO: 63173 - DNA, 30 bp, Artificial Sequence
  Description of Artificial Sequence: Synthetic oligonucleotide
cctggtctgctctgtgagtggtttctatcc

SEQ ID NO: 63174 - DNA, 31 bp, Artificial Sequence
  Description of Artificial Sequence: Synthetic oligonucleotide
ctggtctgctctgtgagtggtttctatccag

SEQ ID NO: 63175 - DNA, 31 bp, Artificial Sequence
  Description of Artificial Sequence: Synthetic oligonucleotide
tggtctgctctgtgagtggtttctatccagg

SEQ ID NO: 63176 - DNA, 30 bp, Artificial Sequence
  Description of Artificial Sequence: Synthetic oligonucleotide
ggtctgctctgtgagtggtttctatccagg

SEQ ID NO: 63177 - DNA, 30 bp, Artificial Sequence
  Description of Artificial Sequence: Synthetic oligonucleotide
gtctgctctgtgagtggtttctatccaggc

SEQ ID NO: 63178 - DNA, 31 bp, Artificial Sequence
  Description of Artificial Sequence: Synthetic oligonucleotide
tctgctctgtgagtggtttctatccaggcag

SEQ ID NO: 63179 - DNA, 30 bp, Artificial Sequence
  Description of Artificial Sequence: Synthetic oligonucleotide
ctgctctgtgagtggtttctatccaggcag

SEQ ID NO: 63180 - DNA, 30 bp, Artificial Sequence
  Description of Artificial Sequence: Synthetic oligonucleotide
tgctctgtgagtggtttctatccaggcagc

SEQ ID NO: 63181 - DNA, 29 bp, Artificial Sequence
  Description of Artificial Sequence: Synthetic oligonucleotide
gctctgtgagtggtttctatccaggcagc

SEQ ID NO: 63182 - DNA, 32 bp, Artificial Sequence
  Description of Artificial Sequence: Synthetic oligonucleotide
ctctgtgagtggtttctatccaggcagcattg

SEQ ID NO: 63183 - DNA, 34 bp, Artificial Sequence
  Description of Artificial Sequence: Synthetic oligonucleotide
tctgtgagtggtttctatccaggcagcattgaag

SEQ ID NO: 63184 - DNA, 33 bp, Artificial Sequence
  Description of Artificial Sequence: Synthetic oligonucleotide
ctgtgagtggtttctatccaggcagcattgaag

SEQ ID NO: 63185 - DNA, 34 bp, Artificial Sequence
  Description of Artificial Sequence: Synthetic oligonucleotide
tgtgagtggtttctatccaggcagcattgaagtc

SEQ ID NO: 63186 - DNA, 33 bp, Artificial Sequence
  Description of Artificial Sequence: Synthetic oligonucleotide
gtgagtggtttctatccaggcagcattgaagtc

SEQ ID NO: 63187 - DNA, 34 bp, Artificial Sequence
  Description of Artificial Sequence: Synthetic oligonucleotide
tgagtggtttctatccaggcagcattgaagtcag

SEQ ID NO: 63188 - DNA, 33 bp, Artificial Sequence
  Description of Artificial Sequence: Synthetic oligonucleotide
gagtggtttctatccaggcagcattgaagtcag

SEQ ID NO: 63189 - DNA, 33 bp, Artificial Sequence
  Description of Artificial Sequence: Synthetic oligonucleotide
agtggtttctatccaggcagcattgaagtcagg

SEQ ID NO: 63190 - DNA, 32 bp, Artificial Sequence
  Description of Artificial Sequence: Synthetic oligonucleotide
gtggtttctatccaggcagcattgaagtcagg

SEQ ID NO: 63191 - DNA, 33 bp, Artificial Sequence
  Description of Artificial Sequence: Synthetic oligonucleotide
tggtttctatccaggcagcattgaagtcaggtg

SEQ ID NO: 63192 - DNA, 32 bp, Artificial Sequence
  Description of Artificial Sequence: Synthetic oligonucleotide
ggtttctatccaggcagcattgaagtcaggtg

SEQ ID NO: 63193 - DNA, 32 bp, Artificial Sequence
  Description of Artificial Sequence: Synthetic oligonucleotide
gtttctatccaggcagcattgaagtcaggtgg

SEQ ID NO: 63194 - DNA, 34 bp, Artificial Sequence
  Description of Artificial Sequence: Synthetic oligonucleotide
tttctatccaggcagcattgaagtcaggtggttc

SEQ ID NO: 63195 - DNA, 33 bp, Artificial Sequence
  Description of Artificial Sequence: Synthetic oligonucleotide
ttctatccaggcagcattgaagtcaggtggttc

SEQ ID NO: 63196 - DNA, 32 bp, Artificial Sequence
  Description of Artificial Sequence: Synthetic oligonucleotide
tctatccaggcagcattgaagtcaggtggttc

SEQ ID NO: 63197 - DNA, 31 bp, Artificial Sequence
  Description of Artificial Sequence: Synthetic oligonucleotide
ctatccaggcagcattgaagtcaggtggttc

SEQ ID NO: 63198 - DNA, 31 bp, Artificial Sequence
  Description of Artificial Sequence: Synthetic oligonucleotide
tatccaggcagcattgaagtcaggtggttcc

SEQ ID NO: 63199 - DNA, 30 bp, Artificial Sequence
  Description of Artificial Sequence: Synthetic oligonucleotide
atccaggcagcattgaagtcaggtggttcc

SEQ ID NO: 63200 - DNA, 29 bp, Artificial Sequence
  Description of Artificial Sequence: Synthetic oligonucleotide
tccaggcagcattgaagtcaggtggttcc

SEQ ID NO: 63201 - DNA, 28 bp, Artificial Sequence
  Description of Artificial Sequence: Synthetic oligonucleotide
ccaggcagcattgaagtcaggtggttcc

SEQ ID NO: 63202 - DNA, 28 bp, Artificial Sequence
  Description of Artificial Sequence: Synthetic oligonucleotide
caggcagcattgaagtcaggtggttccg

SEQ ID NO: 63203 - DNA, 28 bp, Artificial Sequence
  Description of Artificial Sequence: Synthetic oligonucleotide
aggcagcattgaagtcaggtggttccgg

SEQ ID NO: 63204 - DNA, 27 bp, Artificial Sequence
  Description of Artificial Sequence: Synthetic oligonucleotide
ggcagcattgaagtcaggtggttccgg

SEQ ID NO: 63205 - DNA, 29 bp, Artificial Sequence
  Description of Artificial Sequence: Synthetic oligonucleotide
gcagcattgaagtcaggtggttccggaac

SEQ ID NO: 63206 - DNA, 29 bp, Artificial Sequence
  Description of Artificial Sequence: Synthetic oligonucleotide
cagcattgaagtcaggtggttccggaacg

SEQ ID NO: 63207 - DNA, 29 bp, Artificial Sequence
  Description of Artificial Sequence: Synthetic oligonucleotide
agcattgaagtcaggtggttccggaacgg

SEQ ID NO: 63208 - DNA, 28 bp, Artificial Sequence
  Description of Artificial Sequence: Synthetic oligonucleotide
gcattgaagtcaggtggttccggaacgg

SEQ ID NO: 63209 - DNA, 28 bp, Artificial Sequence
  Description of Artificial Sequence: Synthetic oligonucleotide
cattgaagtcaggtggttccggaacggc

SEQ ID NO: 63210 - DNA, 28 bp, Artificial Sequence
  Description of Artificial Sequence: Synthetic oligonucleotide
attgaagtcaggtggttccggaacggcc

SEQ ID NO: 63211 - DNA, 27 bp, Artificial Sequence
  Description of Artificial Sequence: Synthetic oligonucleotide
ttgaagtcaggtggttccggaacggcc

SEQ ID NO: 63212 - DNA, 27 bp, Artificial Sequence
  Description of Artificial Sequence: Synthetic oligonucleotide
tgaagtcaggtggttccggaacggcca

SEQ ID NO: 63213 - DNA, 26 bp, Artificial Sequence
  Description of Artificial Sequence: Synthetic oligonucleotide
gaagtcaggtggttccggaacggcca

SEQ ID NO: 63214 - DNA, 26 bp, Artificial Sequence
  Description of Artificial Sequence: Synthetic oligonucleotide
aagtcaggtggttccggaacggccag

SEQ ID NO: 63215 - DNA, 25 bp, Artificial Sequence
  Description of Artificial Sequence: Synthetic oligonucleotide
agtcaggtggttccggaacggccag

SEQ ID NO: 63216 - DNA, 24 bp, Artificial Sequence
  Description of Artificial Sequence: Synthetic oligonucleotide
gtcaggtggttccggaacggccag

SEQ ID NO: 63217 - DNA, 26 bp, Artificial Sequence
  Description of Artificial Sequence: Synthetic oligonucleotide
tcaggtggttccggaacggccaggaa

SEQ ID NO: 63218 - DNA, 25 bp, Artificial Sequence
  Description of Artificial Sequence: Synthetic oligonucleotide
caggtggttccggaacggccaggaa

SEQ ID NO: 63219 - DNA, 26 bp, Artificial Sequence
  Description of Artificial Sequence: Synthetic oligonucleotide
aggtggttccggaacggccaggaaga

SEQ ID NO: 63220 - DNA, 25 bp, Artificial Sequence
  Description of Artificial Sequence: Synthetic oligonucleotide
ggtggttccggaacggccaggaaga

SEQ ID NO: 63221 - DNA, 27 bp, Artificial Sequence
  Description of Artificial Sequence: Synthetic oligonucleotide
gtggttccggaacggccaggaagagaa

SEQ ID NO: 63222 - DNA, 27 bp, Artificial Sequence
  Description of Artificial Sequence: Synthetic oligonucleotide
tggttccggaacggccaggaagagaag

SEQ ID NO: 63223 - DNA, 26 bp, Artificial Sequence
  Description of Artificial Sequence: Synthetic oligonucleotide
ggttccggaacggccaggaagagaag

SEQ ID NO: 63224 - DNA, 26 bp, Artificial Sequence
  Description of Artificial Sequence: Synthetic oligonucleotide
gttccggaacggccaggaagagaagg

SEQ ID NO: 63225 - DNA, 27 bp, Artificial Sequence
  Description of Artificial Sequence: Synthetic oligonucleotide
ttccggaacggccaggaagagaaggct

SEQ ID NO: 63226 - DNA, 26 bp, Artificial Sequence
  Description of Artificial Sequence: Synthetic oligonucleotide
tccggaacggccaggaagagaaggct

SEQ ID NO: 63227 - DNA, 25 bp, Artificial Sequence
  Description of Artificial Sequence: Synthetic oligonucleotide
ccggaacggccaggaagagaaggct

SEQ ID NO: 63228 - DNA, 25 bp, Artificial Sequence
  Description of Artificial Sequence: Synthetic oligonucleotide
cggaacggccaggaagagaaggctg

SEQ ID NO: 63229 - DNA, 25 bp, Artificial Sequence
  Description of Artificial Sequence: Synthetic oligonucleotide
ggaacggccaggaagagaaggctgg

SEQ ID NO: 63230 - DNA, 25 bp, Artificial Sequence
  Description of Artificial Sequence: Synthetic oligonucleotide
gaacggccaggaagagaaggctggg

SEQ ID NO: 63231 - DNA, 26 bp, Artificial Sequence
  Description of Artificial Sequence: Synthetic oligonucleotide
aacggccaggaagagaaggctggggt

SEQ ID NO: 63232 - DNA, 25 bp, Artificial Sequence
  Description of Artificial Sequence: Synthetic oligonucleotide
acggccaggaagagaaggctggggt

SEQ ID NO: 63233 - DNA, 24 bp, Artificial Sequence
  Description of Artificial Sequence: Synthetic oligonucleotide
cggccaggaagagaaggctggggt

SEQ ID NO: 63234 - DNA, 24 bp, Artificial Sequence
  Description of Artificial Sequence: Synthetic oligonucleotide
ggccaggaagagaaggctggggtg

SEQ ID NO: 63235 - DNA, 25 bp, Artificial Sequence
  Description of Artificial Sequence: Synthetic oligonucleotide
gccaggaagagaaggctggggtggt

SEQ ID NO: 63236 - DNA, 26 bp, Artificial Sequence
  Description of Artificial Sequence: Synthetic oligonucleotide
ccaggaagagaaggctggggtggtgt

SEQ ID NO: 63237 - DNA, 26 bp, Artificial Sequence
  Description of Artificial Sequence: Synthetic oligonucleotide
caggaagagaaggctggggtggtgtc

SEQ ID NO: 63238 - DNA, 27 bp, Artificial Sequence
  Description of Artificial Sequence: Synthetic oligonucleotide
aggaagagaaggctggggtggtgtcca

SEQ ID NO: 63239 - DNA, 26 bp, Artificial Sequence
  Description of Artificial Sequence: Synthetic oligonucleotide
ggaagagaaggctggggtggtgtcca

SEQ ID NO: 63240 - DNA, 27 bp, Artificial Sequence
  Description of Artificial Sequence: Synthetic oligonucleotide
gaagagaaggctggggtggtgtccaca

SEQ ID NO: 63241 - DNA, 27 bp, Artificial Sequence
  Description of Artificial Sequence: Synthetic oligonucleotide
aagagaaggctggggtggtgtccacag

SEQ ID NO: 63242 - DNA, 26 bp, Artificial Sequence
  Description of Artificial Sequence: Synthetic oligonucleotide
agagaaggctggggtggtgtccacag

SEQ ID NO: 63243 - DNA, 25 bp, Artificial Sequence
  Description of Artificial Sequence: Synthetic oligonucleotide
gagaaggctggggtggtgtccacag

SEQ ID NO: 63244 - DNA, 25 bp, Artificial Sequence
  Description of Artificial Sequence: Synthetic oligonucleotide
agaaggctggggtggtgtccacagg

SEQ ID NO: 63245 - DNA, 24 bp, Artificial Sequence
  Description of Artificial Sequence: Synthetic oligonucleotide
gaaggctggggtggtgtccacagg

SEQ ID NO: 63246 - DNA, 24 bp, Artificial Sequence
  Description of Artificial Sequence: Synthetic oligonucleotide
aaggctggggtggtgtccacaggc

SEQ ID NO: 63247 - DNA, 23 bp, Artificial Sequence
  Description of Artificial Sequence: Synthetic oligonucleotide
aggctggggtggtgtccacaggc

SEQ ID NO: 63248 - DNA, 22 bp, Artificial Sequence
  Description of Artificial Sequence: Synthetic oligonucleotide
ggctggggtggtgtccacaggc

SEQ ID NO: 63249 - DNA, 23 bp, Artificial Sequence
  Description of Artificial Sequence: Synthetic oligonucleotide
gctggggtggtgtccacaggcct

SEQ ID NO: 63250 - DNA, 25 bp, Artificial Sequence
  Description of Artificial Sequence: Synthetic oligonucleotide
ctggggtggtgtccacaggcctgat

SEQ ID NO: 63251 - DNA, 25 bp, Artificial Sequence
  Description of Artificial Sequence: Synthetic oligonucleotide
tggggtggtgtccacaggcctgatc

SEQ ID NO: 63252 - DNA, 24 bp, Artificial Sequence
  Description of Artificial Sequence: Synthetic oligonucleotide
ggggtggtgtccacaggcctgatc

SEQ ID NO: 63253 - DNA, 25 bp, Artificial Sequence
  Description of Artificial Sequence: Synthetic oligonucleotide
gggtggtgtccacaggcctgatcca

SEQ ID NO: 63254 - DNA, 27 bp, Artificial Sequence
  Description of Artificial Sequence: Synthetic oligonucleotide
ggtggtgtccacaggcctgatccagaa

SEQ ID NO: 63255 - DNA, 28 bp, Artificial Sequence
  Description of Artificial Sequence: Synthetic oligonucleotide
gtggtgtccacaggcctgatccagaatg

SEQ ID NO: 63256 - DNA, 28 bp, Artificial Sequence
  Description of Artificial Sequence: Synthetic oligonucleotide
tggtgtccacaggcctgatccagaatgg

SEQ ID NO: 63257 - DNA, 27 bp, Artificial Sequence
  Description of Artificial Sequence: Synthetic oligonucleotide
ggtgtccacaggcctgatccagaatgg

SEQ ID NO: 63258 - DNA, 28 bp, Artificial Sequence
  Description of Artificial Sequence: Synthetic oligonucleotide
gtgtccacaggcctgatccagaatggag

SEQ ID NO: 63259 - DNA, 31 bp, Artificial Sequence
  Description of Artificial Sequence: Synthetic oligonucleotide
tgtccacaggcctgatccagaatggagattg

SEQ ID NO: 63260 - DNA, 30 bp, Artificial Sequence
  Description of Artificial Sequence: Synthetic oligonucleotide
gtccacaggcctgatccagaatggagattg

SEQ ID NO: 63261 - DNA, 30 bp, Artificial Sequence
  Description of Artificial Sequence: Synthetic oligonucleotide
tccacaggcctgatccagaatggagattgg

SEQ ID NO: 63262 - DNA, 29 bp, Artificial Sequence
  Description of Artificial Sequence: Synthetic oligonucleotide
ccacaggcctgatccagaatggagattgg

SEQ ID NO: 63263 - DNA, 30 bp, Artificial Sequence
  Description of Artificial Sequence: Synthetic oligonucleotide
cacaggcctgatccagaatggagattggac

SEQ ID NO: 63264 - DNA, 30 bp, Artificial Sequence
  Description of Artificial Sequence: Synthetic oligonucleotide
acaggcctgatccagaatggagattggacc

SEQ ID NO: 63265 - DNA, 29 bp, Artificial Sequence
  Description of Artificial Sequence: Synthetic oligonucleotide
caggcctgatccagaatggagattggacc

SEQ ID NO: 63266 - DNA, 31 bp, Artificial Sequence
  Description of Artificial Sequence: Synthetic oligonucleotide
aggcctgatccagaatggagattggaccttc

SEQ ID NO: 63267 - DNA, 30 bp, Artificial Sequence
  Description of Artificial Sequence: Synthetic oligonucleotide
ggcctgatccagaatggagattggaccttc

SEQ ID NO: 63268 - DNA, 30 bp, Artificial Sequence
  Description of Artificial Sequence: Synthetic oligonucleotide
gcctgatccagaatggagattggaccttcc

SEQ ID NO: 63269 - DNA, 31 bp, Artificial Sequence
  Description of Artificial Sequence: Synthetic oligonucleotide
cctgatccagaatggagattggaccttccag

SEQ ID NO: 63270 - DNA, 32 bp, Artificial Sequence
  Description of Artificial Sequence: Synthetic oligonucleotide
ctgatccagaatggagattggaccttccagac

SEQ ID NO: 63271 - DNA, 32 bp, Artificial Sequence
  Description of Artificial Sequence: Synthetic oligonucleotide
tgatccagaatggagattggaccttccagacc

SEQ ID NO: 63272 - DNA, 31 bp, Artificial Sequence
  Description of Artificial Sequence: Synthetic oligonucleotide
gatccagaatggagattggaccttccagacc

SEQ ID NO: 63273 - DNA, 31 bp, Artificial Sequence
  Description of Artificial Sequence: Synthetic oligonucleotide
atccagaatggagattggaccttccagaccc

SEQ ID NO: 63274 - DNA, 30 bp, Artificial Sequence
  Description of Artificial Sequence: Synthetic oligonucleotide
tccagaatggagattggaccttccagaccc

SEQ ID NO: 63275 - DNA, 29 bp, Artificial Sequence
  Description of Artificial Sequence: Synthetic oligonucleotide
ccagaatggagattggaccttccagaccc

SEQ ID NO: 63276 - DNA, 30 bp, Artificial Sequence
  Description of Artificial Sequence: Synthetic oligonucleotide
cagaatggagattggaccttccagaccctg

SEQ ID NO: 63277 - DNA, 30 bp, Artificial Sequence
  Description of Artificial Sequence: Synthetic oligonucleotide
agaatggagattggaccttccagaccctgg

SEQ ID NO: 63278 - DNA, 29 bp, Artificial Sequence
  Description of Artificial Sequence: Synthetic oligonucleotide
gaatggagattggaccttccagaccctgg

SEQ ID NO: 63279 - DNA, 30 bp, Artificial Sequence
  Description of Artificial Sequence: Synthetic oligonucleotide
aatggagattggaccttccagaccctggtg

SEQ ID NO: 63280 - DNA, 29 bp, Artificial Sequence
  Description of Artificial Sequence: Synthetic oligonucleotide
atggagattggaccttccagaccctggtg

SEQ ID NO: 63281 - DNA, 28 bp, Artificial Sequence
  Description of Artificial Sequence: Synthetic oligonucleotide
tggagattggaccttccagaccctggtg

SEQ ID NO: 63282 - DNA, 27 bp, Artificial Sequence
  Description of Artificial Sequence: Synthetic oligonucleotide
ggagattggaccttccagaccctggtg

SEQ ID NO: 63283 - DNA, 29 bp, Artificial Sequence
  Description of Artificial Sequence: Synthetic oligonucleotide
gagattggaccttccagaccctggtgatg

SEQ ID NO: 63284 - DNA, 29 bp, Artificial Sequence
  Description of Artificial Sequence: Synthetic oligonucleotide
agattggaccttccagaccctggtgatgc

SEQ ID NO: 63285 - DNA, 28 bp, Artificial Sequence
  Description of Artificial Sequence: Synthetic oligonucleotide
gattggaccttccagaccctggtgatgc

SEQ ID NO: 63286 - DNA, 29 bp, Artificial Sequence
  Description of Artificial Sequence: Synthetic oligonucleotide
attggaccttccagaccctggtgatgctg

SEQ ID NO: 63287 - DNA, 28 bp, Artificial Sequence
  Description of Artificial Sequence: Synthetic oligonucleotide
ttggaccttccagaccctggtgatgctg

SEQ ID NO: 63288 - DNA, 27 bp, Artificial Sequence
  Description of Artificial Sequence: Synthetic oligonucleotide
tggaccttccagaccctggtgatgctg

SEQ ID NO: 63289 - DNA, 26 bp, Artificial Sequence
  Description of Artificial Sequence: Synthetic oligonucleotide
ggaccttccagaccctggtgatgctg

SEQ ID NO: 63290 - DNA, 27 bp, Artificial Sequence
  Description of Artificial Sequence: Synthetic oligonucleotide
gaccttccagaccctggtgatgctgga

SEQ ID NO: 63291 - DNA, 29 bp, Artificial Sequence
  Description of Artificial Sequence: Synthetic oligonucleotide
accttccagaccctggtgatgctggaaac

SEQ ID NO: 63292 - DNA, 28 bp, Artificial Sequence
  Description of Artificial Sequence: Synthetic oligonucleotide
ccttccagaccctggtgatgctggaaac

SEQ ID NO: 63293 - DNA, 29 bp, Artificial Sequence
  Description of Artificial Sequence: Synthetic oligonucleotide
cttccagaccctggtgatgctggaaacag

SEQ ID NO: 63294 - DNA, 31 bp, Artificial Sequence
  Description of Artificial Sequence: Synthetic oligonucleotide
ttccagaccctggtgatgctggaaacagttc

SEQ ID NO: 63295 - DNA, 30 bp, Artificial Sequence
  Description of Artificial Sequence: Synthetic oligonucleotide
tccagaccctggtgatgctggaaacagttc

SEQ ID NO: 63296 - DNA, 29 bp, Artificial Sequence
  Description of Artificial Sequence: Synthetic oligonucleotide
ccagaccctggtgatgctggaaacagttc

SEQ ID NO: 63297 - DNA, 29 bp, Artificial Sequence
  Description of Artificial Sequence: Synthetic oligonucleotide
cagaccctggtgatgctggaaacagttcc

SEQ ID NO: 63298 - DNA, 30 bp, Artificial Sequence
  Description of Artificial Sequence: Synthetic oligonucleotide
agaccctggtgatgctggaaacagttcctc

SEQ ID NO: 63299 - DNA, 29 bp, Artificial Sequence
  Description of Artificial Sequence: Synthetic oligonucleotide
gaccctggtgatgctggaaacagttcctc

SEQ ID NO: 63300 - DNA, 29 bp, Artificial Sequence
  Description of Artificial Sequence: Synthetic oligonucleotide
accctggtgatgctggaaacagttcctcg

SEQ ID NO: 63301 - DNA, 28 bp, Artificial Sequence
  Description of Artificial Sequence: Synthetic oligonucleotide
ccctggtgatgctggaaacagttcctcg

SEQ ID NO: 63302 - DNA, 28 bp, Artificial Sequence
  Description of Artificial Sequence: Synthetic oligonucleotide
cctggtgatgctggaaacagttcctcgg

SEQ ID NO: 63303 - DNA, 29 bp, Artificial Sequence
  Description of Artificial Sequence: Synthetic oligonucleotide
ctggtgatgctggaaacagttcctcggag

SEQ ID NO: 63304 - DNA, 30 bp, Artificial Sequence
  Description of Artificial Sequence: Synthetic oligonucleotide
tggtgatgctggaaacagttcctcggagtg

SEQ ID NO: 63305 - DNA, 29 bp, Artificial Sequence
  Description of Artificial Sequence: Synthetic oligonucleotide
ggtgatgctggaaacagttcctcggagtg

SEQ ID NO: 63306 - DNA, 29 bp, Artificial Sequence
  Description of Artificial Sequence: Synthetic oligonucleotide
gtgatgctggaaacagttcctcggagtgg

SEQ ID NO: 63307 - DNA, 30 bp, Artificial Sequence
  Description of Artificial Sequence: Synthetic oligonucleotide
tgatgctggaaacagttcctcggagtggag

SEQ ID NO: 63308 - DNA, 29 bp, Artificial Sequence
  Description of Artificial Sequence: Synthetic oligonucleotide
gatgctggaaacagttcctcggagtggag

SEQ ID NO: 63309 - DNA, 30 bp, Artificial Sequence
  Description of Artificial Sequence: Synthetic oligonucleotide
atgctggaaacagttcctcggagtggagag

SEQ ID NO: 63310 - DNA, 29 bp, Artificial Sequence
  Description of Artificial Sequence: Synthetic oligonucleotide
tgctggaaacagttcctcggagtggagag

SEQ ID NO: 63311 - DNA, 28 bp, Artificial Sequence
  Description of Artificial Sequence: Synthetic oligonucleotide
gctggaaacagttcctcggagtggagag

SEQ ID NO: 63312 - DNA, 28 bp, Artificial Sequence
  Description of Artificial Sequence: Synthetic oligonucleotide
ctggaaacagttcctcggagtggagagg

SEQ ID NO: 63313 - DNA, 32 bp, Artificial Sequence
  Description of Artificial Sequence: Synthetic oligonucleotide
tggaaacagttcctcggagtggagaggtttac

SEQ ID NO: 63314 - DNA, 31 bp, Artificial Sequence
  Description of Artificial Sequence: Synthetic oligonucleotide
ggaaacagttcctcggagtggagaggtttac

SEQ ID NO: 63315 - DNA, 32 bp, Artificial Sequence
  Description of Artificial Sequence: Synthetic oligonucleotide
gaaacagttcctcggagtggagaggtttacac

SEQ ID NO: 63316 - DNA, 32 bp, Artificial Sequence
  Description of Artificial Sequence: Synthetic oligonucleotide
aaacagttcctcggagtggagaggtttacacc

SEQ ID NO: 63317 - DNA, 31 bp, Artificial Sequence
  Description of Artificial Sequence: Synthetic oligonucleotide
aacagttcctcggagtggagaggtttacacc

SEQ ID NO: 63318 - DNA, 30 bp, Artificial Sequence
  Description of Artificial Sequence: Synthetic oligonucleotide
acagttcctcggagtggagaggtttacacc

SEQ ID NO: 63319 - DNA, 29 bp, Artificial Sequence
  Description of Artificial Sequence: Synthetic oligonucleotide
cagttcctcggagtggagaggtttacacc

SEQ ID NO: 63320 - DNA, 30 bp, Artificial Sequence
  Description of Artificial Sequence: Synthetic oligonucleotide
agttcctcggagtggagaggtttacacctg

SEQ ID NO: 63321 - DNA, 29 bp, Artificial Sequence
  Description of Artificial Sequence: Synthetic oligonucleotide
gttcctcggagtggagaggtttacacctg

SEQ ID NO: 63322 - DNA, 29 bp, Artificial Sequence
  Description of Artificial Sequence: Synthetic oligonucleotide
ttcctcggagtggagaggtttacacctgc

SEQ ID NO: 63323 - DNA, 28 bp, Artificial Sequence
  Description of Artificial Sequence: Synthetic oligonucleotide
tcctcggagtggagaggtttacacctgc

SEQ ID NO: 63324 - DNA, 27 bp, Artificial Sequence
  Description of Artificial Sequence: Synthetic oligonucleotide
cctcggagtggagaggtttacacctgc

SEQ ID NO: 63325 - DNA, 27 bp, Artificial Sequence
  Description of Artificial Sequence: Synthetic oligonucleotide
ctcggagtggagaggtttacacctgcc

SEQ ID NO: 63326 - DNA, 29 bp, Artificial Sequence
  Description of Artificial Sequence: Synthetic oligonucleotide
tcggagtggagaggtttacacctgccaag

SEQ ID NO: 63327 - DNA, 28 bp, Artificial Sequence
  Description of Artificial Sequence: Synthetic oligonucleotide
cggagtggagaggtttacacctgccaag

SEQ ID NO: 63328 - DNA, 29 bp, Artificial Sequence
  Description of Artificial Sequence: Synthetic oligonucleotide
ggagtggagaggtttacacctgccaagtg

SEQ ID NO: 63329 - DNA, 29 bp, Artificial Sequence
  Description of Artificial Sequence: Synthetic oligonucleotide
gagtggagaggtttacacctgccaagtgg

SEQ ID NO: 63330 - DNA, 30 bp, Artificial Sequence
  Description of Artificial Sequence: Synthetic oligonucleotide
agtggagaggtttacacctgccaagtggag

SEQ ID NO: 63331 - DNA, 29 bp, Artificial Sequence
  Description of Artificial Sequence: Synthetic oligonucleotide
gtggagaggtttacacctgccaagtggag

SEQ ID NO: 63332 - DNA, 29 bp, Artificial Sequence
  Description of Artificial Sequence: Synthetic oligonucleotide
tggagaggtttacacctgccaagtggagc

SEQ ID NO: 63333 - DNA, 28 bp, Artificial Sequence
  Description of Artificial Sequence: Synthetic oligonucleotide
ggagaggtttacacctgccaagtggagc

SEQ ID NO: 63334 - DNA, 29 bp, Artificial Sequence
  Description of Artificial Sequence: Synthetic oligonucleotide
gagaggtttacacctgccaagtggagcac

SEQ ID NO: 63335 - DNA, 29 bp, Artificial Sequence
  Description of Artificial Sequence: Synthetic oligonucleotide
agaggtttacacctgccaagtggagcacc

SEQ ID NO: 63336 - DNA, 28 bp, Artificial Sequence
  Description of Artificial Sequence: Synthetic oligonucleotide
gaggtttacacctgccaagtggagcacc

SEQ ID NO: 63337 - DNA, 28 bp, Artificial Sequence
  Description of Artificial Sequence: Synthetic oligonucleotide
aggtttacacctgccaagtggagcaccc

SEQ ID NO: 63338 - DNA, 27 bp, Artificial Sequence
  Description of Artificial Sequence: Synthetic oligonucleotide
ggtttacacctgccaagtggagcaccc

SEQ ID NO: 63339 - DNA, 29 bp, Artificial Sequence
  Description of Artificial Sequence: Synthetic oligonucleotide
gtttacacctgccaagtggagcacccaag

SEQ ID NO: 63340 - DNA, 30 bp, Artificial Sequence
  Description of Artificial Sequence: Synthetic oligonucleotide
tttacacctgccaagtggagcacccaagtg

SEQ ID NO: 63341 - DNA, 29 bp, Artificial Sequence
  Description of Artificial Sequence: Synthetic oligonucleotide
ttacacctgccaagtggagcacccaagtg

SEQ ID NO: 63342 - DNA, 28 bp, Artificial Sequence
  Description of Artificial Sequence: Synthetic oligonucleotide
tacacctgccaagtggagcacccaagtg

SEQ ID NO: 63343 - DNA, 27 bp, Artificial Sequence
  Description of Artificial Sequence: Synthetic oligonucleotide
acacctgccaagtggagcacccaagtg

SEQ ID NO: 63344 - DNA, 27 bp, Artificial Sequence
  Description of Artificial Sequence: Synthetic oligonucleotide
cacctgccaagtggagcacccaagtgt

SEQ ID NO: 63345 - DNA, 27 bp, Artificial Sequence
  Description of Artificial Sequence: Synthetic oligonucleotide
acctgccaagtggagcacccaagtgtg

SEQ ID NO: 63346 - DNA, 27 bp, Artificial Sequence
  Description of Artificial Sequence: Synthetic oligonucleotide
cctgccaagtggagcacccaagtgtga

SEQ ID NO: 63347 - DNA, 27 bp, Artificial Sequence
  Description of Artificial Sequence: Synthetic oligonucleotide
ctgccaagtggagcacccaagtgtgac

SEQ ID NO: 63348 - DNA, 27 bp, Artificial Sequence
  Description of Artificial Sequence: Synthetic oligonucleotide
tgccaagtggagcacccaagtgtgacg

SEQ ID NO: 63349 - DNA, 27 bp, Artificial Sequence
  Description of Artificial Sequence: Synthetic oligonucleotide
gccaagtggagcacccaagtgtgacga

SEQ ID NO: 63350 - DNA, 27 bp, Artificial Sequence
  Description of Artificial Sequence: Synthetic oligonucleotide
ccaagtggagcacccaagtgtgacgag

SEQ ID NO: 63351 - DNA, 27 bp, Artificial Sequence
  Description of Artificial Sequence: Synthetic oligonucleotide
caagtggagcacccaagtgtgacgagc

SEQ ID NO: 63352 - DNA, 27 bp, Artificial Sequence
  Description of Artificial Sequence: Synthetic oligonucleotide
aagtggagcacccaagtgtgacgagcc

SEQ ID NO: 63353 - DNA, 26 bp, Artificial Sequence
  Description of Artificial Sequence: Synthetic oligonucleotide
agtggagcacccaagtgtgacgagcc

SEQ ID NO: 63354 - DNA, 25 bp, Artificial Sequence
  Description of Artificial Sequence: Synthetic oligonucleotide
gtggagcacccaagtgtgacgagcc

SEQ ID NO: 63355 - DNA, 26 bp, Artificial Sequence
  Description of Artificial Sequence: Synthetic oligonucleotide
tggagcacccaagtgtgacgagccct

SEQ ID NO: 63356 - DNA, 25 bp, Artificial Sequence
  Description of Artificial Sequence: Synthetic oligonucleotide
ggagcacccaagtgtgacgagccct

SEQ ID NO: 63357 - DNA, 26 bp, Artificial Sequence
  Description of Artificial Sequence: Synthetic oligonucleotide
gagcacccaagtgtgacgagccctct

SEQ ID NO: 63358 - DNA, 27 bp, Artificial Sequence
  Description of Artificial Sequence: Synthetic oligonucleotide
agcacccaagtgtgacgagccctctca

SEQ ID NO: 63359 - DNA, 26 bp, Artificial Sequence
  Description of Artificial Sequence: Synthetic oligonucleotide
gcacccaagtgtgacgagccctctca

SEQ ID NO: 63360 - DNA, 27 bp, Artificial Sequence
  Description of Artificial Sequence: Synthetic oligonucleotide
cacccaagtgtgacgagccctctcaca

SEQ ID NO: 63361 - DNA, 27 bp, Artificial Sequence
  Description of Artificial Sequence: Synthetic oligonucleotide
acccaagtgtgacgagccctctcacag

SEQ ID NO: 63362 - DNA, 27 bp, Artificial Sequence
  Description of Artificial Sequence: Synthetic oligonucleotide
cccaagtgtgacgagccctctcacagt

SEQ ID NO: 63363 - DNA, 27 bp, Artificial Sequence
  Description of Artificial Sequence: Synthetic oligonucleotide
ccaagtgtgacgagccctctcacagtg

SEQ ID NO: 63364 - DNA, 27 bp, Artificial Sequence
  Description of Artificial Sequence: Synthetic oligonucleotide
caagtgtgacgagccctctcacagtgg

SEQ ID NO: 63365 - DNA, 30 bp, Artificial Sequence
  Description of Artificial Sequence: Synthetic oligonucleotide
aagtgtgacgagccctctcacagtggaatg

SEQ ID NO: 63366 - DNA, 29 bp, Artificial Sequence
  Description of Artificial Sequence: Synthetic oligonucleotide
agtgtgacgagccctctcacagtggaatg

SEQ ID NO: 63367 - DNA, 28 bp, Artificial Sequence
  Description of Artificial Sequence: Synthetic oligonucleotide
gtgtgacgagccctctcacagtggaatg

SEQ ID NO: 63368 - DNA, 28 bp, Artificial Sequence
  Description of Artificial Sequence: Synthetic oligonucleotide
tgtgacgagccctctcacagtggaatgg

SEQ ID NO: 63369 - DNA, 27 bp, Artificial Sequence
  Description of Artificial Sequence: Synthetic oligonucleotide
gtgacgagccctctcacagtggaatgg

SEQ ID NO: 63370 - DNA, 28 bp, Artificial Sequence
  Description of Artificial Sequence: Synthetic oligonucleotide
tgacgagccctctcacagtggaatggag

SEQ ID NO: 63371 - DNA, 27 bp, Artificial Sequence
  Description of Artificial Sequence: Synthetic oligonucleotide
gacgagccctctcacagtggaatggag

SEQ ID NO: 63372 - DNA, 28 bp, Artificial Sequence
  Description of Artificial Sequence: Synthetic oligonucleotide
acgagccctctcacagtggaatggagag

SEQ ID NO: 63373 - DNA, 27 bp, Artificial Sequence
  Description of Artificial Sequence: Synthetic oligonucleotide
cgagccctctcacagtggaatggagag

SEQ ID NO: 63374 - DNA, 27 bp, Artificial Sequence
  Description of Artificial Sequence: Synthetic oligonucleotide
gagccctctcacagtggaatggagagc

SEQ ID NO: 63375 - DNA, 28 bp, Artificial Sequence
  Description of Artificial Sequence: Synthetic oligonucleotide
agccctctcacagtggaatggagagcac

SEQ ID NO: 63376 - DNA, 27 bp, Artificial Sequence
  Description of Artificial Sequence: Synthetic oligonucleotide
gccctctcacagtggaatggagagcac

SEQ ID NO: 63377 - DNA, 27 bp, Artificial Sequence
  Description of Artificial Sequence: Synthetic oligonucleotide
ccctctcacagtggaatggagagcacg

SEQ ID NO: 63378 - DNA, 27 bp, Artificial Sequence
  Description of Artificial Sequence: Synthetic oligonucleotide
cctctcacagtggaatggagagcacgg

SEQ ID NO: 63379 - DNA, 28 bp, Artificial Sequence
  Description of Artificial Sequence: Synthetic oligonucleotide
ctctcacagtggaatggagagcacggtc

SEQ ID NO: 63380 - DNA, 29 bp, Artificial Sequence
  Description of Artificial Sequence: Synthetic oligonucleotide
tctcacagtggaatggagagcacggtctg

SEQ ID NO: 63381 - DNA, 28 bp, Artificial Sequence
  Description of Artificial Sequence: Synthetic oligonucleotide
ctcacagtggaatggagagcacggtctg

SEQ ID NO: 63382 - DNA, 31 bp, Artificial Sequence
  Description of Artificial Sequence: Synthetic oligonucleotide
tcacagtggaatggagagcacggtctgaatc

SEQ ID NO: 63383 - DNA, 30 bp, Artificial Sequence
  Description of Artificial Sequence: Synthetic oligonucleotide
cacagtggaatggagagcacggtctgaatc

SEQ ID NO: 63384 - DNA, 31 bp, Artificial Sequence
  Description of Artificial Sequence: Synthetic oligonucleotide
acagtggaatggagagcacggtctgaatctg

SEQ ID NO: 63385 - DNA, 30 bp, Artificial Sequence
  Description of Artificial Sequence: Synthetic oligonucleotide
cagtggaatggagagcacggtctgaatctg

SEQ ID NO: 63386 - DNA, 30 bp, Artificial Sequence
  Description of Artificial Sequence: Synthetic oligonucleotide
agtggaatggagagcacggtctgaatctgc

SEQ ID NO: 63387 - DNA, 29 bp, Artificial Sequence
  Description of Artificial Sequence: Synthetic oligonucleotide
gtggaatggagagcacggtctgaatctgc

SEQ ID NO: 63388 - DNA, 30 bp, Artificial Sequence
  Description of Artificial Sequence: Synthetic oligonucleotide
tggaatggagagcacggtctgaatctgcac

SEQ ID NO: 63389 - DNA, 29 bp, Artificial Sequence
  Description of Artificial Sequence: Synthetic oligonucleotide
ggaatggagagcacggtctgaatctgcac

SEQ ID NO: 63390 - DNA, 30 bp, Artificial Sequence
  Description of Artificial Sequence: Synthetic oligonucleotide
gaatggagagcacggtctgaatctgcacag

SEQ ID NO: 63391 - DNA, 31 bp, Artificial Sequence
  Description of Artificial Sequence: Synthetic oligonucleotide
aatggagagcacggtctgaatctgcacagag

SEQ ID NO: 63392 - DNA, 30 bp, Artificial Sequence
  Description of Artificial Sequence: Synthetic oligonucleotide
atggagagcacggtctgaatctgcacagag

SEQ ID NO: 63393 - DNA, 29 bp, Artificial Sequence
  Description of Artificial Sequence: Synthetic oligonucleotide
tggagagcacggtctgaatctgcacagag

SEQ ID NO: 63394 - DNA, 28 bp, Artificial Sequence
  Description of Artificial Sequence: Synthetic oligonucleotide
ggagagcacggtctgaatctgcacagag

SEQ ID NO: 63395 - DNA, 28 bp, Artificial Sequence
  Description of Artificial Sequence: Synthetic oligonucleotide
gagagcacggtctgaatctgcacagagc

SEQ ID NO: 63396 - DNA, 30 bp, Artificial Sequence
  Description of Artificial Sequence: Synthetic oligonucleotide
agagcacggtctgaatctgcacagagcaag

SEQ ID NO: 63397 - DNA, 29 bp, Artificial Sequence
  Description of Artificial Sequence: Synthetic oligonucleotide
gagcacggtctgaatctgcacagagcaag

SEQ ID NO: 63398 - DNA, 31 bp, Artificial Sequence
  Description of Artificial Sequence: Synthetic oligonucleotide
agcacggtctgaatctgcacagagcaagatg

SEQ ID NO: 63399 - DNA, 30 bp, Artificial Sequence
  Description of Artificial Sequence: Synthetic oligonucleotide
gcacggtctgaatctgcacagagcaagatg

SEQ ID NO: 63400 - DNA, 30 bp, Artificial Sequence
  Description of Artificial Sequence: Synthetic oligonucleotide
cacggtctgaatctgcacagagcaagatgc

SEQ ID NO: 63401 - DNA, 31 bp, Artificial Sequence
  Description of Artificial Sequence: Synthetic oligonucleotide
acggtctgaatctgcacagagcaagatgctg

SEQ ID NO: 63402 - DNA, 30 bp, Artificial Sequence
  Description of Artificial Sequence: Synthetic oligonucleotide
cggtctgaatctgcacagagcaagatgctg

SEQ ID NO: 63403 - DNA, 31 bp, Artificial Sequence
  Description of Artificial Sequence: Synthetic oligonucleotide
ggtctgaatctgcacagagcaagatgctgag

SEQ ID NO: 63404 - DNA, 32 bp, Artificial Sequence
  Description of Artificial Sequence: Synthetic oligonucleotide
gtctgaatctgcacagagcaagatgctgagtg

SEQ ID NO: 63405 - DNA, 32 bp, Artificial Sequence
  Description of Artificial Sequence: Synthetic oligonucleotide
tctgaatctgcacagagcaagatgctgagtgg

SEQ ID NO: 63406 - DNA, 31 bp, Artificial Sequence
  Description of Artificial Sequence: Synthetic oligonucleotide
ctgaatctgcacagagcaagatgctgagtgg

SEQ ID NO: 63407 - DNA, 32 bp, Artificial Sequence
  Description of Artificial Sequence: Synthetic oligonucleotide
tgaatctgcacagagcaagatgctgagtggag

SEQ ID NO: 63408 - DNA, 31 bp, Artificial Sequence
  Description of Artificial Sequence: Synthetic oligonucleotide
gaatctgcacagagcaagatgctgagtggag

SEQ ID NO: 63409 - DNA, 32 bp, Artificial Sequence
  Description of Artificial Sequence: Synthetic oligonucleotide
aatctgcacagagcaagatgctgagtggagtc

SEQ ID NO: 63410 - DNA, 31 bp, Artificial Sequence
  Description of Artificial Sequence: Synthetic oligonucleotide
atctgcacagagcaagatgctgagtggagtc

SEQ ID NO: 63411 - DNA, 30 bp, Artificial Sequence
  Description of Artificial Sequence: Synthetic oligonucleotide
tctgcacagagcaagatgctgagtggagtc

SEQ ID NO: 63412 - DNA, 29 bp, Artificial Sequence
  Description of Artificial Sequence: Synthetic oligonucleotide
ctgcacagagcaagatgctgagtggagtc

SEQ ID NO: 63413 - DNA, 29 bp, Artificial Sequence
  Description of Artificial Sequence: Synthetic oligonucleotide
tgcacagagcaagatgctgagtggagtcg

SEQ ID NO: 63414 - DNA, 28 bp, Artificial Sequence
  Description of Artificial Sequence: Synthetic oligonucleotide
gcacagagcaagatgctgagtggagtcg

SEQ ID NO: 63415 - DNA, 28 bp, Artificial Sequence
  Description of Artificial Sequence: Synthetic oligonucleotide
cacagagcaagatgctgagtggagtcgg

SEQ ID NO: 63416 - DNA, 28 bp, Artificial Sequence
  Description of Artificial Sequence: Synthetic oligonucleotide
acagagcaagatgctgagtggagtcggg

SEQ ID NO: 63417 - DNA, 27 bp, Artificial Sequence
  Description of Artificial Sequence: Synthetic oligonucleotide
cagagcaagatgctgagtggagtcggg

SEQ ID NO: 63418 - DNA, 27 bp, Artificial Sequence
  Description of Artificial Sequence: Synthetic oligonucleotide
agagcaagatgctgagtggagtcgggg

SEQ ID NO: 63419 - DNA, 26 bp, Artificial Sequence
  Description of Artificial Sequence: Synthetic oligonucleotide
gagcaagatgctgagtggagtcgggg

SEQ ID NO: 63420 - DNA, 26 bp, Artificial Sequence
  Description of Artificial Sequence: Synthetic oligonucleotide
agcaagatgctgagtggagtcggggg

SEQ ID NO: 63421 - DNA, 25 bp, Artificial Sequence
  Description of Artificial Sequence: Synthetic oligonucleotide
gcaagatgctgagtggagtcggggg

SEQ ID NO: 63422 - DNA, 27 bp, Artificial Sequence
  Description of Artificial Sequence: Synthetic oligonucleotide
caagatgctgagtggagtcgggggctt

SEQ ID NO: 63423 - DNA, 27 bp, Artificial Sequence
  Description of Artificial Sequence: Synthetic oligonucleotide
aagatgctgagtggagtcgggggcttc

SEQ ID NO: 63424 - DNA, 26 bp, Artificial Sequence
  Description of Artificial Sequence: Synthetic oligonucleotide
agatgctgagtggagtcgggggcttc

SEQ ID NO: 63425 - DNA, 25 bp, Artificial Sequence
  Description of Artificial Sequence: Synthetic oligonucleotide
gatgctgagtggagtcgggggcttc

SEQ ID NO: 63426 - DNA, 26 bp, Artificial Sequence
  Description of Artificial Sequence: Synthetic oligonucleotide
atgctgagtggagtcgggggcttcgt

SEQ ID NO: 63427 - DNA, 25 bp, Artificial Sequence
  Description of Artificial Sequence: Synthetic oligonucleotide
tgctgagtggagtcgggggcttcgt

SEQ ID NO: 63428 - DNA, 24 bp, Artificial Sequence
  Description of Artificial Sequence: Synthetic oligonucleotide
gctgagtggagtcgggggcttcgt

SEQ ID NO: 63429 - DNA, 24 bp, Artificial Sequence
  Description of Artificial Sequence: Synthetic oligonucleotide
ctgagtggagtcgggggcttcgtg

SEQ ID NO: 63430 - DNA, 25 bp, Artificial Sequence
  Description of Artificial Sequence: Synthetic oligonucleotide
tgagtggagtcgggggcttcgtgct

SEQ ID NO: 63431 - DNA, 24 bp, Artificial Sequence
  Description of Artificial Sequence: Synthetic oligonucleotide
gagtggagtcgggggcttcgtgct

SEQ ID NO: 63432 - DNA, 24 bp, Artificial Sequence
  Description of Artificial Sequence: Synthetic oligonucleotide
agtggagtcgggggcttcgtgctg

SEQ ID NO: 63433 - DNA, 23 bp, Artificial Sequence
  Description of Artificial Sequence: Synthetic oligonucleotide
gtggagtcgggggcttcgtgctg

SEQ ID NO: 63434 - DNA, 23 bp, Artificial Sequence
  Description of Artificial Sequence: Synthetic oligonucleotide
tggagtcgggggcttcgtgctgg

SEQ ID NO: 63435 - DNA, 22 bp, Artificial Sequence
  Description of Artificial Sequence: Synthetic oligonucleotide
ggagtcgggggcttcgtgctgg

SEQ ID NO: 63436 - DNA, 22 bp, Artificial Sequence
  Description of Artificial Sequence: Synthetic oligonucleotide
gagtcgggggcttcgtgctggg

SEQ ID NO: 63437 - DNA, 22 bp, Artificial Sequence
  Description of Artificial Sequence: Synthetic oligonucleotide
agtcgggggcttcgtgctgggc

SEQ ID NO: 63438 - DNA, 21 bp, Artificial Sequence
  Description of Artificial Sequence: Synthetic oligonucleotide
gtcgggggcttcgtgctgggc

SEQ ID NO: 63439 - DNA, 22 bp, Artificial Sequence
  Description of Artificial Sequence: Synthetic oligonucleotide
tcgggggcttcgtgctgggcct

SEQ ID NO: 63440 - DNA, 21 bp, Artificial Sequence
  Description of Artificial Sequence: Synthetic oligonucleotide
cgggggcttcgtgctgggcct

SEQ ID NO: 63441 - DNA, 21 bp, Artificial Sequence
  Description of Artificial Sequence: Synthetic oligonucleotide
gggggcttcgtgctgggcctg

SEQ ID NO: 63442 - DNA, 22 bp, Artificial Sequence
  Description of Artificial Sequence: Synthetic oligonucleotide
ggggcttcgtgctgggcctgct

SEQ ID NO: 63443 - DNA, 24 bp, Artificial Sequence
  Description of Artificial Sequence: Synthetic oligonucleotide
gggcttcgtgctgggcctgctctt

SEQ ID NO: 63444 - DNA, 24 bp, Artificial Sequence
  Description of Artificial Sequence: Synthetic oligonucleotide
ggcttcgtgctgggcctgctcttc

SEQ ID NO: 63445 - DNA, 26 bp, Artificial Sequence
  Description of Artificial Sequence: Synthetic oligonucleotide
gcttcgtgctgggcctgctcttcctt

SEQ ID NO: 63446 - DNA, 26 bp, Artificial Sequence
  Description of Artificial Sequence: Synthetic oligonucleotide
cttcgtgctgggcctgctcttccttg

SEQ ID NO: 63447 - DNA, 26 bp, Artificial Sequence
  Description of Artificial Sequence: Synthetic oligonucleotide
ttcgtgctgggcctgctcttccttgg

SEQ ID NO: 63448 - DNA, 25 bp, Artificial Sequence
  Description of Artificial Sequence: Synthetic oligonucleotide
tcgtgctgggcctgctcttccttgg

SEQ ID NO: 63449 - DNA, 24 bp, Artificial Sequence
  Description of Artificial Sequence: Synthetic oligonucleotide
cgtgctgggcctgctcttccttgg

SEQ ID NO: 63450 - DNA, 24 bp, Artificial Sequence
  Description of Artificial Sequence: Synthetic oligonucleotide
gtgctgggcctgctcttccttggg

SEQ ID NO: 63451 - DNA, 24 bp, Artificial Sequence
  Description of Artificial Sequence: Synthetic oligonucleotide
tgctgggcctgctcttccttgggg

SEQ ID NO: 63452 - DNA, 23 bp, Artificial Sequence
  Description of Artificial Sequence: Synthetic oligonucleotide
gctgggcctgctcttccttgggg

SEQ ID NO: 63453 - DNA, 23 bp, Artificial Sequence
  Description of Artificial Sequence: Synthetic oligonucleotide
ctgggcctgctcttccttggggc

SEQ ID NO: 63454 - DNA, 23 bp, Artificial Sequence
  Description of Artificial Sequence: Synthetic oligonucleotide
tgggcctgctcttccttggggcc

SEQ ID NO: 63455 - DNA, 22 bp, Artificial Sequence
  Description of Artificial Sequence: Synthetic oligonucleotide
gggcctgctcttccttggggcc

SEQ ID NO: 63456 - DNA, 22 bp, Artificial Sequence
  Description of Artificial Sequence: Synthetic oligonucleotide
ggcctgctcttccttggggccg

SEQ ID NO: 63457 - DNA, 22 bp, Artificial Sequence
  Description of Artificial Sequence: Synthetic oligonucleotide
gcctgctcttccttggggccgg

SEQ ID NO: 63458 - DNA, 22 bp, Artificial Sequence
  Description of Artificial Sequence: Synthetic oligonucleotide
cctgctcttccttggggccggg

SEQ ID NO: 63459 - DNA, 23 bp, Artificial Sequence
  Description of Artificial Sequence: Synthetic oligonucleotide
ctgctcttccttggggccgggct

SEQ ID NO: 63460 - DNA, 25 bp, Artificial Sequence
  Description of Artificial Sequence: Synthetic oligonucleotide
tgctcttccttggggccgggctgtt

SEQ ID NO: 63461 - DNA, 24 bp, Artificial Sequence
  Description of Artificial Sequence: Synthetic oligonucleotide
gctcttccttggggccgggctgtt

SEQ ID NO: 63462 - DNA, 26 bp, Artificial Sequence
  Description of Artificial Sequence: Synthetic oligonucleotide
ctcttccttggggccgggctgttcat

SEQ ID NO: 63463 - DNA, 27 bp, Artificial Sequence
  Description of Artificial Sequence: Synthetic oligonucleotide
tcttccttggggccgggctgttcatct

SEQ ID NO: 63464 - DNA, 27 bp, Artificial Sequence
  Description of Artificial Sequence: Synthetic oligonucleotide
cttccttggggccgggctgttcatcta

SEQ ID NO: 63465 - DNA, 27 bp, Artificial Sequence
  Description of Artificial Sequence: Synthetic oligonucleotide
ttccttggggccgggctgttcatctac

SEQ ID NO: 63466 - DNA, 27 bp, Artificial Sequence
  Description of Artificial Sequence: Synthetic oligonucleotide
tccttggggccgggctgttcatctact

SEQ ID NO: 63467 - DNA, 27 bp, Artificial Sequence
  Description of Artificial Sequence: Synthetic oligonucleotide
ccttggggccgggctgttcatctactt

SEQ ID NO: 63468 - DNA, 27 bp, Artificial Sequence
  Description of Artificial Sequence: Synthetic oligonucleotide
cttggggccgggctgttcatctacttc

SEQ ID NO: 63469 - DNA, 28 bp, Artificial Sequence
  Description of Artificial Sequence: Synthetic oligonucleotide
ttggggccgggctgttcatctacttcag

SEQ ID NO: 63470 - DNA, 27 bp, Artificial Sequence
  Description of Artificial Sequence: Synthetic oligonucleotide
tggggccgggctgttcatctacttcag

SEQ ID NO: 63471 - DNA, 26 bp, Artificial Sequence
  Description of Artificial Sequence: Synthetic oligonucleotide
ggggccgggctgttcatctacttcag

SEQ ID NO: 63472 - DNA, 27 bp, Artificial Sequence
  Description of Artificial Sequence: Synthetic oligonucleotide
gggccgggctgttcatctacttcagga

SEQ ID NO: 63473 - DNA, 29 bp, Artificial Sequence
  Description of Artificial Sequence: Synthetic oligonucleotide
ggccgggctgttcatctacttcaggaatc

SEQ ID NO: 63474 - DNA, 30 bp, Artificial Sequence
  Description of Artificial Sequence: Synthetic oligonucleotide
gccgggctgttcatctacttcaggaatcag

SEQ ID NO: 63475 - DNA, 33 bp, Artificial Sequence
  Description of Artificial Sequence: Synthetic oligonucleotide
ccgggctgttcatctacttcaggaatcagaaag

SEQ ID NO: 63476 - DNA, 33 bp, Artificial Sequence
  Description of Artificial Sequence: Synthetic oligonucleotide
cgggctgttcatctacttcaggaatcagaaagg

SEQ ID NO: 63477 - DNA, 34 bp, Artificial Sequence
  Description of Artificial Sequence: Synthetic oligonucleotide
gggctgttcatctacttcaggaatcagaaaggac

SEQ ID NO: 63478 - DNA, 35 bp, Artificial Sequence
  Description of Artificial Sequence: Synthetic oligonucleotide
ggctgttcatctacttcaggaatcagaaaggacac

SEQ ID NO: 63479 - DNA, 36 bp, Artificial Sequence
  Description of Artificial Sequence: Synthetic oligonucleotide
gctgttcatctacttcaggaatcagaaaggacactc

SEQ ID NO: 63480 - DNA, 37 bp, Artificial Sequence
  Description of Artificial Sequence: Synthetic oligonucleotide
ctgttcatctacttcaggaatcagaaaggacactctg

SEQ ID NO: 63481 - DNA, 37 bp, Artificial Sequence
  Description of Artificial Sequence: Synthetic oligonucleotide
tgttcatctacttcaggaatcagaaaggacactctgg

SEQ ID NO: 63482 - DNA, 36 bp, Artificial Sequence
  Description of Artificial Sequence: Synthetic oligonucleotide
gttcatctacttcaggaatcagaaaggacactctgg

SEQ ID NO: 63483 - DNA, 37 bp, Artificial Sequence
  Description of Artificial Sequence: Synthetic oligonucleotide
ttcatctacttcaggaatcagaaaggacactctggac

SEQ ID NO: 63484 - DNA, 36 bp, Artificial Sequence
  Description of Artificial Sequence: Synthetic oligonucleotide
tcatctacttcaggaatcagaaaggacactctggac

SEQ ID NO: 63485 - DNA, 35 bp, Artificial Sequence
  Description of Artificial Sequence: Synthetic oligonucleotide
catctacttcaggaatcagaaaggacactctggac

SEQ ID NO: 63486 - DNA, 37 bp, Artificial Sequence
  Description of Artificial Sequence: Synthetic oligonucleotide
atctacttcaggaatcagaaaggacactctggacttc

SEQ ID NO: 63487 - DNA, 36 bp, Artificial Sequence
  Description of Artificial Sequence: Synthetic oligonucleotide
tctacttcaggaatcagaaaggacactctggacttc

SEQ ID NO: 63488 - DNA, 35 bp, Artificial Sequence
  Description of Artificial Sequence: Synthetic oligonucleotide
ctacttcaggaatcagaaaggacactctggacttc

SEQ ID NO: 63489 - DNA, 36 bp, Artificial Sequence
  Description of Artificial Sequence: Synthetic oligonucleotide
tacttcaggaatcagaaaggacactctggacttcag

SEQ ID NO: 63490 - DNA, 35 bp, Artificial Sequence
  Description of Artificial Sequence: Synthetic oligonucleotide
acttcaggaatcagaaaggacactctggacttcag

SEQ ID NO: 63491 - DNA, 34 bp, Artificial Sequence
  Description of Artificial Sequence: Synthetic oligonucleotide
cttcaggaatcagaaaggacactctggacttcag

SEQ ID NO: 63492 - DNA, 34 bp, Artificial Sequence
  Description of Artificial Sequence: Synthetic oligonucleotide
ttcaggaatcagaaaggacactctggacttcagc

SEQ ID NO: 63493 - DNA, 33 bp, Artificial Sequence
  Description of Artificial Sequence: Synthetic oligonucleotide
tcaggaatcagaaaggacactctggacttcagc

SEQ ID NO: 63494 - DNA, 32 bp, Artificial Sequence
  Description of Artificial Sequence: Synthetic oligonucleotide
caggaatcagaaaggacactctggacttcagc

SEQ ID NO: 63495 - DNA, 32 bp, Artificial Sequence
  Description of Artificial Sequence: Synthetic oligonucleotide
aggaatcagaaaggacactctggacttcagcc

SEQ ID NO: 63496 - DNA, 31 bp, Artificial Sequence
  Description of Artificial Sequence: Synthetic oligonucleotide
ggaatcagaaaggacactctggacttcagcc

SEQ ID NO: 63497 - DNA, 33 bp, Artificial Sequence
  Description of Artificial Sequence: Synthetic oligonucleotide
gaatcagaaaggacactctggacttcagccaac

SEQ ID NO: 63498 - DNA, 34 bp, Artificial Sequence
  Description of Artificial Sequence: Synthetic oligonucleotide
aatcagaaaggacactctggacttcagccaacag

SEQ ID NO: 63499 - DNA, 33 bp, Artificial Sequence
  Description of Artificial Sequence: Synthetic oligonucleotide
atcagaaaggacactctggacttcagccaacag

SEQ ID NO: 63500 - DNA, 32 bp, Artificial Sequence
  Description of Artificial Sequence: Synthetic oligonucleotide
tcagaaaggacactctggacttcagccaacag

SEQ ID NO: 63501 - DNA, 31 bp, Artificial Sequence
  Description of Artificial Sequence: Synthetic oligonucleotide
cagaaaggacactctggacttcagccaacag

SEQ ID NO: 63502 - DNA, 31 bp, Artificial Sequence
  Description of Artificial Sequence: Synthetic oligonucleotide
agaaaggacactctggacttcagccaacagg

SEQ ID NO: 63503 - DNA, 30 bp, Artificial Sequence
  Description of Artificial Sequence: Synthetic oligonucleotide
gaaaggacactctggacttcagccaacagg

SEQ ID NO: 63504 - DNA, 33 bp, Artificial Sequence
  Description of Artificial Sequence: Synthetic oligonucleotide
aaaggacactctggacttcagccaacaggattc

SEQ ID NO: 63505 - DNA, 32 bp, Artificial Sequence
  Description of Artificial Sequence: Synthetic oligonucleotide
aaggacactctggacttcagccaacaggattc

SEQ ID NO: 63506 - DNA, 31 bp, Artificial Sequence
  Description of Artificial Sequence: Synthetic oligonucleotide
aggacactctggacttcagccaacaggattc

SEQ ID NO: 63507 - DNA, 30 bp, Artificial Sequence
  Description of Artificial Sequence: Synthetic oligonucleotide
ggacactctggacttcagccaacaggattc

SEQ ID NO: 63508 - DNA, 30 bp, Artificial Sequence
  Description of Artificial Sequence: Synthetic oligonucleotide
gacactctggacttcagccaacaggattcc

SEQ ID NO: 63509 - DNA, 31 bp, Artificial Sequence
  Description of Artificial Sequence: Synthetic oligonucleotide
acactctggacttcagccaacaggattcctg

SEQ ID NO: 63510 - DNA, 30 bp, Artificial Sequence
  Description of Artificial Sequence: Synthetic oligonucleotide
cactctggacttcagccaacaggattcctg

SEQ ID NO: 63511 - DNA, 31 bp, Artificial Sequence
  Description of Artificial Sequence: Synthetic oligonucleotide
actctggacttcagccaacaggattcctgag

SEQ ID NO: 63512 - DNA, 30 bp, Artificial Sequence
  Description of Artificial Sequence: Synthetic oligonucleotide
ctctggacttcagccaacaggattcctgag

SEQ ID NO: 63513 - DNA, 30 bp, Artificial Sequence
  Description of Artificial Sequence: Synthetic oligonucleotide
tctggacttcagccaacaggattcctgagc

SEQ ID NO: 63514 - DNA, 29 bp, Artificial Sequence
  Description of Artificial Sequence: Synthetic oligonucleotide
ctggacttcagccaacaggattcctgagc

SEQ ID NO: 63515 - DNA, 30 bp, Artificial Sequence
  Description of Artificial Sequence: Synthetic oligonucleotide
tggacttcagccaacaggattcctgagctg

SEQ ID NO: 63516 - DNA, 29 bp, Artificial Sequence
  Description of Artificial Sequence: Synthetic oligonucleotide
ggacttcagccaacaggattcctgagctg

SEQ ID NO: 63517 - DNA, 37 bp, Artificial Sequence
  Description of Artificial Sequence: Synthetic oligonucleotide
ggttgctggaaagatgcatctataaccaagaggaatc

SEQ ID NO: 63518 - DNA, 37 bp, Artificial Sequence
  Description of Artificial Sequence: Synthetic oligonucleotide
gttgctggaaagatgcatctataaccaagaggaatcc

SEQ ID NO: 63519 - DNA, 37 bp, Artificial Sequence
  Description of Artificial Sequence: Synthetic oligonucleotide
ttgctggaaagatgcatctataaccaagaggaatccg

SEQ ID NO: 63520 - DNA, 36 bp, Artificial Sequence
  Description of Artificial Sequence: Synthetic oligonucleotide
tgctggaaagatgcatctataaccaagaggaatccg

SEQ ID NO: 63521 - DNA, 35 bp, Artificial Sequence
  Description of Artificial Sequence: Synthetic oligonucleotide
gctggaaagatgcatctataaccaagaggaatccg

SEQ ID NO: 63522 - DNA, 36 bp, Artificial Sequence
  Description of Artificial Sequence: Synthetic oligonucleotide
ctggaaagatgcatctataaccaagaggaatccgtg

SEQ ID NO: 63523 - DNA, 36 bp, Artificial Sequence
  Description of Artificial Sequence: Synthetic oligonucleotide
tggaaagatgcatctataaccaagaggaatccgtgc

SEQ ID NO: 63524 - DNA, 35 bp, Artificial Sequence
  Description of Artificial Sequence: Synthetic oligonucleotide
ggaaagatgcatctataaccaagaggaatccgtgc

SEQ ID NO: 63525 - DNA, 35 bp, Artificial Sequence
  Description of Artificial Sequence: Synthetic oligonucleotide
gaaagatgcatctataaccaagaggaatccgtgcg

SEQ ID NO: 63526 - DNA, 35 bp, Artificial Sequence
  Description of Artificial Sequence: Synthetic oligonucleotide
aaagatgcatctataaccaagaggaatccgtgcgc

SEQ ID NO: 63527 - DNA, 34 bp, Artificial Sequence
  Description of Artificial Sequence: Synthetic oligonucleotide
aagatgcatctataaccaagaggaatccgtgcgc

SEQ ID NO: 63528 - DNA, 33 bp, Artificial Sequence
  Description of Artificial Sequence: Synthetic oligonucleotide
agatgcatctataaccaagaggaatccgtgcgc

SEQ ID NO: 63529 - DNA, 32 bp, Artificial Sequence
  Description of Artificial Sequence: Synthetic oligonucleotide
gatgcatctataaccaagaggaatccgtgcgc

SEQ ID NO: 63530 - DNA, 34 bp, Artificial Sequence
  Description of Artificial Sequence: Synthetic oligonucleotide
atgcatctataaccaagaggaatccgtgcgcttc

SEQ ID NO: 63531 - DNA, 33 bp, Artificial Sequence
  Description of Artificial Sequence: Synthetic oligonucleotide
tgcatctataaccaagaggaatccgtgcgcttc

SEQ ID NO: 63532 - DNA, 32 bp, Artificial Sequence
  Description of Artificial Sequence: Synthetic oligonucleotide
gcatctataaccaagaggaatccgtgcgcttc

SEQ ID NO: 63533 - DNA, 32 bp, Artificial Sequence
  Description of Artificial Sequence: Synthetic oligonucleotide
catctataaccaagaggaatccgtgcgcttcg

SEQ ID NO: 63534 - DNA, 33 bp, Artificial Sequence
  Description of Artificial Sequence: Synthetic oligonucleotide
atctataaccaagaggaatccgtgcgcttcgac

SEQ ID NO: 63535 - DNA, 32 bp, Artificial Sequence
  Description of Artificial Sequence: Synthetic oligonucleotide
tctataaccaagaggaatccgtgcgcttcgac

SEQ ID NO: 63536 - DNA, 31 bp, Artificial Sequence
  Description of Artificial Sequence: Synthetic oligonucleotide
ctataaccaagaggaatccgtgcgcttcgac

SEQ ID NO: 63537 - DNA, 32 bp, Artificial Sequence
  Description of Artificial Sequence: Synthetic oligonucleotide
tataaccaagaggaatccgtgcgcttcgacag

SEQ ID NO: 63538 - DNA, 31 bp, Artificial Sequence
  Description of Artificial Sequence: Synthetic oligonucleotide
ataaccaagaggaatccgtgcgcttcgacag

SEQ ID NO: 63539 - DNA, 30 bp, Artificial Sequence
  Description of Artificial Sequence: Synthetic oligonucleotide
taaccaagaggaatccgtgcgcttcgacag

SEQ ID NO: 63540 - DNA, 29 bp, Artificial Sequence
  Description of Artificial Sequence: Synthetic oligonucleotide
aaccaagaggaatccgtgcgcttcgacag

SEQ ID NO: 63541 - DNA, 28 bp, Artificial Sequence
  Description of Artificial Sequence: Synthetic oligonucleotide
accaagaggaatccgtgcgcttcgacag

SEQ ID NO: 63542 - DNA, 27 bp, Artificial Sequence
  Description of Artificial Sequence: Synthetic oligonucleotide
ccaagaggaatccgtgcgcttcgacag

SEQ ID NO: 63543 - DNA, 27 bp, Artificial Sequence
  Description of Artificial Sequence: Synthetic oligonucleotide
caagaggaatccgtgcgcttcgacagc

SEQ ID NO: 63544 - DNA, 27 bp, Artificial Sequence
  Description of Artificial Sequence: Synthetic oligonucleotide
aagaggaatccgtgcgcttcgacagcg

SEQ ID NO: 63545 - DNA, 27 bp, Artificial Sequence
  Description of Artificial Sequence: Synthetic oligonucleotide
agaggaatccgtgcgcttcgacagcga

SEQ ID NO: 63546 - DNA, 26 bp, Artificial Sequence
  Description of Artificial Sequence: Synthetic oligonucleotide
gaggaatccgtgcgcttcgacagcga

SEQ ID NO: 63547 - DNA, 26 bp, Artificial Sequence
  Description of Artificial Sequence: Synthetic oligonucleotide
aggaatccgtgcgcttcgacagcgac

SEQ ID NO: 63548 - DNA, 25 bp, Artificial Sequence
  Description of Artificial Sequence: Synthetic oligonucleotide
ggaatccgtgcgcttcgacagcgac

SEQ ID NO: 63549 - DNA, 26 bp, Artificial Sequence
  Description of Artificial Sequence: Synthetic oligonucleotide
gaatccgtgcgcttcgacagcgacgt

SEQ ID NO: 63550 - DNA, 26 bp, Artificial Sequence
  Description of Artificial Sequence: Synthetic oligonucleotide
aatccgtgcgcttcgacagcgacgtg

SEQ ID NO: 63551 - DNA, 25 bp, Artificial Sequence
  Description of Artificial Sequence: Synthetic oligonucleotide
atccgtgcgcttcgacagcgacgtg

SEQ ID NO: 63552 - DNA, 26 bp, Artificial Sequence
  Description of Artificial Sequence: Synthetic oligonucleotide
tgagagcttcacagtgcagcggcgag

SEQ ID NO: 63553 - DNA, 30 bp, Artificial Sequence
  Description of Artificial Sequence: Synthetic oligonucleotide
gagtactggaacagccagaaggacctcttg

SEQ ID NO: 63554 - DNA, 30 bp, Artificial Sequence
  Description of Artificial Sequence: Synthetic oligonucleotide
agtactggaacagccagaaggacctcttgg

SEQ ID NO: 63555 - DNA, 29 bp, Artificial Sequence
  Description of Artificial Sequence: Synthetic oligonucleotide
gtactggaacagccagaaggacctcttgg

SEQ ID NO: 63556 - DNA, 30 bp, Artificial Sequence
  Description of Artificial Sequence: Synthetic oligonucleotide
tactggaacagccagaaggacctcttggag

SEQ ID NO: 63557 - DNA, 29 bp, Artificial Sequence
  Description of Artificial Sequence: Synthetic oligonucleotide
actggaacagccagaaggacctcttggag

SEQ ID NO: 63558 - DNA, 28 bp, Artificial Sequence
  Description of Artificial Sequence: Synthetic oligonucleotide
ctggaacagccagaaggacctcttggag

SEQ ID NO: 63559 - DNA, 28 bp, Artificial Sequence
  Description of Artificial Sequence: Synthetic oligonucleotide
tggaacagccagaaggacctcttggagc

SEQ ID NO: 63560 - DNA, 27 bp, Artificial Sequence
  Description of Artificial Sequence: Synthetic oligonucleotide
ggaacagccagaaggacctcttggagc

SEQ ID NO: 63561 - DNA, 28 bp, Artificial Sequence
  Description of Artificial Sequence: Synthetic oligonucleotide
gaacagccagaaggacctcttggagcag

SEQ ID NO: 63562 - DNA, 29 bp, Artificial Sequence
  Description of Artificial Sequence: Synthetic oligonucleotide
aacagccagaaggacctcttggagcagag

SEQ ID NO: 63563 - DNA, 28 bp, Artificial Sequence
  Description of Artificial Sequence: Synthetic oligonucleotide
acagccagaaggacctcttggagcagag

SEQ ID NO: 63564 - DNA, 27 bp, Artificial Sequence
  Description of Artificial Sequence: Synthetic oligonucleotide
cagccagaaggacctcttggagcagag

SEQ ID NO: 63565 - DNA, 27 bp, Artificial Sequence
  Description of Artificial Sequence: Synthetic oligonucleotide
agccagaaggacctcttggagcagagg

SEQ ID NO: 63566 - DNA, 26 bp, Artificial Sequence
  Description of Artificial Sequence: Synthetic oligonucleotide
gccagaaggacctcttggagcagagg

SEQ ID NO: 63567 - DNA, 26 bp, Artificial Sequence
  Description of Artificial Sequence: Synthetic oligonucleotide
ccagaaggacctcttggagcagaggc

SEQ ID NO: 63568 - DNA, 26 bp, Artificial Sequence
  Description of Artificial Sequence: Synthetic oligonucleotide
cagaaggacctcttggagcagaggcg

SEQ ID NO: 63569 - DNA, 26 bp, Artificial Sequence
  Description of Artificial Sequence: Synthetic oligonucleotide
agaaggacctcttggagcagaggcgg

SEQ ID NO: 63570 - DNA, 25 bp, Artificial Sequence
  Description of Artificial Sequence: Synthetic oligonucleotide
gaaggacctcttggagcagaggcgg

SEQ ID NO: 63571 - DNA, 25 bp, Artificial Sequence
  Description of Artificial Sequence: Synthetic oligonucleotide
aaggacctcttggagcagaggcggg

SEQ ID NO: 63572 - DNA, 24 bp, Artificial Sequence
  Description of Artificial Sequence: Synthetic oligonucleotide
aggacctcttggagcagaggcggg

SEQ ID NO: 63573 - DNA, 23 bp, Artificial Sequence
  Description of Artificial Sequence: Synthetic oligonucleotide
ggacctcttggagcagaggcggg

SEQ ID NO: 63574 - DNA, 23 bp, Artificial Sequence
  Description of Artificial Sequence: Synthetic oligonucleotide
gacctcttggagcagaggcgggc

SEQ ID NO: 63575 - DNA, 23 bp, Artificial Sequence
  Description of Artificial Sequence: Synthetic oligonucleotide
acctcttggagcagaggcgggcc

SEQ ID NO: 63576 - DNA, 22 bp, Artificial Sequence
  Description of Artificial Sequence: Synthetic oligonucleotide
cctcttggagcagaggcgggcc

SEQ ID NO: 63577 - DNA, 22 bp, Artificial Sequence
  Description of Artificial Sequence: Synthetic oligonucleotide
ctcttggagcagaggcgggccg

SEQ ID NO: 63578 - DNA, 22 bp, Artificial Sequence
  Description of Artificial Sequence: Synthetic oligonucleotide
tcttggagcagaggcgggccgc

SEQ ID NO: 63579 - DNA, 21 bp, Artificial Sequence
  Description of Artificial Sequence: Synthetic oligonucleotide
cttggagcagaggcgggccgc

SEQ ID NO: 63580 - DNA, 21 bp, Artificial Sequence
  Description of Artificial Sequence: Synthetic oligonucleotide
ttggagcagaggcgggccgcg

SEQ ID NO: 63581 - DNA, 33 bp, Artificial Sequence
  Description of Artificial Sequence: Synthetic oligonucleotide
gggtgcggttgctggaaagatgcatctataatc

SEQ ID NO: 63582 - DNA, 35 bp, Artificial Sequence
  Description of Artificial Sequence: Synthetic oligonucleotide
ggtgcggttgctggaaagatgcatctataatcaag

SEQ ID NO: 63583 - DNA, 36 bp, Artificial Sequence
  Description of Artificial Sequence: Synthetic oligonucleotide
gtgcggttgctggaaagatgcatctataatcaagag

SEQ ID NO: 63584 - DNA, 36 bp, Artificial Sequence
  Description of Artificial Sequence: Synthetic oligonucleotide
tgcggttgctggaaagatgcatctataatcaagagg

SEQ ID NO: 63585 - DNA, 35 bp, Artificial Sequence
  Description of Artificial Sequence: Synthetic oligonucleotide
gcggttgctggaaagatgcatctataatcaagagg

SEQ ID NO: 63586 - DNA, 36 bp, Artificial Sequence
  Description of Artificial Sequence: Synthetic oligonucleotide
cggttgctggaaagatgcatctataatcaagaggag

SEQ ID NO: 63587 - DNA, 37 bp, Artificial Sequence
  Description of Artificial Sequence: Synthetic oligonucleotide
ggttgctggaaagatgcatctataatcaagaggagtc

SEQ ID NO: 63588 - DNA, 37 bp, Artificial Sequence
  Description of Artificial Sequence: Synthetic oligonucleotide
gttgctggaaagatgcatctataatcaagaggagtcc

SEQ ID NO: 63589 - DNA, 37 bp, Artificial Sequence
  Description of Artificial Sequence: Synthetic oligonucleotide
ttgctggaaagatgcatctataatcaagaggagtccg

SEQ ID NO: 63590 - DNA, 36 bp, Artificial Sequence
  Description of Artificial Sequence: Synthetic oligonucleotide
tgctggaaagatgcatctataatcaagaggagtccg

SEQ ID NO: 63591 - DNA, 35 bp, Artificial Sequence
  Description of Artificial Sequence: Synthetic oligonucleotide
gctggaaagatgcatctataatcaagaggagtccg

SEQ ID NO: 63592 - DNA, 36 bp, Artificial Sequence
  Description of Artificial Sequence: Synthetic oligonucleotide
ctggaaagatgcatctataatcaagaggagtccgtg

SEQ ID NO: 63593 - DNA, 36 bp, Artificial Sequence
  Description of Artificial Sequence: Synthetic oligonucleotide
tggaaagatgcatctataatcaagaggagtccgtgc

SEQ ID NO: 63594 - DNA, 35 bp, Artificial Sequence
  Description of Artificial Sequence: Synthetic oligonucleotide
ggaaagatgcatctataatcaagaggagtccgtgc

SEQ ID NO: 63595 - DNA, 35 bp, Artificial Sequence
  Description of Artificial Sequence: Synthetic oligonucleotide
gaaagatgcatctataatcaagaggagtccgtgcg

SEQ ID NO: 63596 - DNA, 35 bp, Artificial Sequence
  Description of Artificial Sequence: Synthetic oligonucleotide
aaagatgcatctataatcaagaggagtccgtgcgc

SEQ ID NO: 63597 - DNA, 34 bp, Artificial Sequence
  Description of Artificial Sequence: Synthetic oligonucleotide
aagatgcatctataatcaagaggagtccgtgcgc

SEQ ID NO: 63598 - DNA, 33 bp, Artificial Sequence
  Description of Artificial Sequence: Synthetic oligonucleotide
agatgcatctataatcaagaggagtccgtgcgc

SEQ ID NO: 63599 - DNA, 32 bp, Artificial Sequence
  Description of Artificial Sequence: Synthetic oligonucleotide
gatgcatctataatcaagaggagtccgtgcgc

SEQ ID NO: 63600 - DNA, 34 bp, Artificial Sequence
  Description of Artificial Sequence: Synthetic oligonucleotide
atgcatctataatcaagaggagtccgtgcgcttc

SEQ ID NO: 63601 - DNA, 33 bp, Artificial Sequence
  Description of Artificial Sequence: Synthetic oligonucleotide
tgcatctataatcaagaggagtccgtgcgcttc

SEQ ID NO: 63602 - DNA, 32 bp, Artificial Sequence
  Description of Artificial Sequence: Synthetic oligonucleotide
gcatctataatcaagaggagtccgtgcgcttc

SEQ ID NO: 63603 - DNA, 32 bp, Artificial Sequence
  Description of Artificial Sequence: Synthetic oligonucleotide
catctataatcaagaggagtccgtgcgcttcg

SEQ ID NO: 63604 - DNA, 33 bp, Artificial Sequence
  Description of Artificial Sequence: Synthetic oligonucleotide
atctataatcaagaggagtccgtgcgcttcgac

SEQ ID NO: 63605 - DNA, 32 bp, Artificial Sequence
  Description of Artificial Sequence: Synthetic oligonucleotide
tctataatcaagaggagtccgtgcgcttcgac

SEQ ID NO: 63606 - DNA, 31 bp, Artificial Sequence
  Description of Artificial Sequence: Synthetic oligonucleotide
ctataatcaagaggagtccgtgcgcttcgac

SEQ ID NO: 63607 - DNA, 32 bp, Artificial Sequence
  Description of Artificial Sequence: Synthetic oligonucleotide
tataatcaagaggagtccgtgcgcttcgacag

SEQ ID NO: 63608 - DNA, 31 bp, Artificial Sequence
  Description of Artificial Sequence: Synthetic oligonucleotide
ataatcaagaggagtccgtgcgcttcgacag

SEQ ID NO: 63609 - DNA, 30 bp, Artificial Sequence
  Description of Artificial Sequence: Synthetic oligonucleotide
taatcaagaggagtccgtgcgcttcgacag

SEQ ID NO: 63610 - DNA, 29 bp, Artificial Sequence
  Description of Artificial Sequence: Synthetic oligonucleotide
aatcaagaggagtccgtgcgcttcgacag

SEQ ID NO: 63611 - DNA, 28 bp, Artificial Sequence
  Description of Artificial Sequence: Synthetic oligonucleotide
atcaagaggagtccgtgcgcttcgacag

SEQ ID NO: 63612 - DNA, 27 bp, Artificial Sequence
  Description of Artificial Sequence: Synthetic oligonucleotide
tcaagaggagtccgtgcgcttcgacag

SEQ ID NO: 63613 - DNA, 29 bp, Artificial Sequence
  Description of Artificial Sequence: Synthetic oligonucleotide
acaactacggggttggtgagagcttcacg

SEQ ID NO: 63614 - DNA, 28 bp, Artificial Sequence
  Description of Artificial Sequence: Synthetic oligonucleotide
caactacggggttggtgagagcttcacg

SEQ ID NO: 63615 - DNA, 28 bp, Artificial Sequence
  Description of Artificial Sequence: Synthetic oligonucleotide
aactacggggttggtgagagcttcacgg

SEQ ID NO: 63616 - DNA, 27 bp, Artificial Sequence
  Description of Artificial Sequence: Synthetic oligonucleotide
actacggggttggtgagagcttcacgg

SEQ ID NO: 63617 - DNA, 27 bp, Artificial Sequence
  Description of Artificial Sequence: Synthetic oligonucleotide
ctacggggttggtgagagcttcacggt

SEQ ID NO: 63618 - DNA, 27 bp, Artificial Sequence
  Description of Artificial Sequence: Synthetic oligonucleotide
tacggggttggtgagagcttcacggtg

SEQ ID NO: 63619 - DNA, 26 bp, Artificial Sequence
  Description of Artificial Sequence: Synthetic oligonucleotide
acggggttggtgagagcttcacggtg

SEQ ID NO: 63620 - DNA, 25 bp, Artificial Sequence
  Description of Artificial Sequence: Synthetic oligonucleotide
cggggttggtgagagcttcacggtg

SEQ ID NO: 63621 - DNA, 26 bp, Artificial Sequence
  Description of Artificial Sequence: Synthetic oligonucleotide
ggggttggtgagagcttcacggtgca

SEQ ID NO: 63622 - DNA, 26 bp, Artificial Sequence
  Description of Artificial Sequence: Synthetic oligonucleotide
gggttggtgagagcttcacggtgcag

SEQ ID NO: 63623 - DNA, 26 bp, Artificial Sequence
  Description of Artificial Sequence: Synthetic oligonucleotide
ggttggtgagagcttcacggtgcagc

SEQ ID NO: 63624 - DNA, 26 bp, Artificial Sequence
  Description of Artificial Sequence: Synthetic oligonucleotide
gttggtgagagcttcacggtgcagcg

SEQ ID NO: 63625 - DNA, 26 bp, Artificial Sequence
  Description of Artificial Sequence: Synthetic oligonucleotide
ttggtgagagcttcacggtgcagcgg

SEQ ID NO: 63626 - DNA, 25 bp, Artificial Sequence
  Description of Artificial Sequence: Synthetic oligonucleotide
tggtgagagcttcacggtgcagcgg

SEQ ID NO: 63627 - DNA, 24 bp, Artificial Sequence
  Description of Artificial Sequence: Synthetic oligonucleotide
ggtgagagcttcacggtgcagcgg

SEQ ID NO: 63628 - DNA, 24 bp, Artificial Sequence
  Description of Artificial Sequence: Synthetic oligonucleotide
gtgagagcttcacggtgcagcggc

SEQ ID NO: 63629 - DNA, 25 bp, Artificial Sequence
  Description of Artificial Sequence: Synthetic oligonucleotide
tgagagcttcacggtgcagcggcga

SEQ ID NO: 63630 - DNA, 24 bp, Artificial Sequence
  Description of Artificial Sequence: Synthetic oligonucleotide
gagagcttcacggtgcagcggcga

SEQ ID NO: 63631 - DNA, 24 bp, Artificial Sequence
  Description of Artificial Sequence: Synthetic oligonucleotide
agagcttcacggtgcagcggcgag

SEQ ID NO: 63632 - DNA, 37 bp, Artificial Sequence
  Description of Artificial Sequence: Synthetic oligonucleotide
ttgctggaaagatgcatctataaccaagaggagtctg

SEQ ID NO: 63633 - DNA, 36 bp, Artificial Sequence
  Description of Artificial Sequence: Synthetic oligonucleotide
tgctggaaagatgcatctataaccaagaggagtctg

SEQ ID NO: 63634 - DNA, 35 bp, Artificial Sequence
  Description of Artificial Sequence: Synthetic oligonucleotide
gctggaaagatgcatctataaccaagaggagtctg

SEQ ID NO: 63635 - DNA, 36 bp, Artificial Sequence
  Description of Artificial Sequence: Synthetic oligonucleotide
ctggaaagatgcatctataaccaagaggagtctgtg

SEQ ID NO: 63636 - DNA, 36 bp, Artificial Sequence
  Description of Artificial Sequence: Synthetic oligonucleotide
tggaaagatgcatctataaccaagaggagtctgtgc

SEQ ID NO: 63637 - DNA, 35 bp, Artificial Sequence
  Description of Artificial Sequence: Synthetic oligonucleotide
ggaaagatgcatctataaccaagaggagtctgtgc

SEQ ID NO: 63638 - DNA, 35 bp, Artificial Sequence
  Description of Artificial Sequence: Synthetic oligonucleotide
gaaagatgcatctataaccaagaggagtctgtgcg

SEQ ID NO: 63639 - DNA, 35 bp, Artificial Sequence
  Description of Artificial Sequence: Synthetic oligonucleotide
aaagatgcatctataaccaagaggagtctgtgcgc

SEQ ID NO: 63640 - DNA, 34 bp, Artificial Sequence
  Description of Artificial Sequence: Synthetic oligonucleotide
aagatgcatctataaccaagaggagtctgtgcgc

SEQ ID NO: 63641 - DNA, 33 bp, Artificial Sequence
  Description of Artificial Sequence: Synthetic oligonucleotide
agatgcatctataaccaagaggagtctgtgcgc

SEQ ID NO: 63642 - DNA, 32 bp, Artificial Sequence
  Description of Artificial Sequence: Synthetic oligonucleotide
gatgcatctataaccaagaggagtctgtgcgc

SEQ ID NO: 63643 - DNA, 34 bp, Artificial Sequence
  Description of Artificial Sequence: Synthetic oligonucleotide
atgcatctataaccaagaggagtctgtgcgcttc

SEQ ID NO: 63644 - DNA, 33 bp, Artificial Sequence
  Description of Artificial Sequence: Synthetic oligonucleotide
tgcatctataaccaagaggagtctgtgcgcttc

SEQ ID NO: 63645 - DNA, 32 bp, Artificial Sequence
  Description of Artificial Sequence: Synthetic oligonucleotide
gcatctataaccaagaggagtctgtgcgcttc

SEQ ID NO: 63646 - DNA, 32 bp, Artificial Sequence
  Description of Artificial Sequence: Synthetic oligonucleotide
catctataaccaagaggagtctgtgcgcttcg

SEQ ID NO: 63647 - DNA, 33 bp, Artificial Sequence
  Description of Artificial Sequence: Synthetic oligonucleotide
atctataaccaagaggagtctgtgcgcttcgac

SEQ ID NO: 63648 - DNA, 32 bp, Artificial Sequence
  Description of Artificial Sequence: Synthetic oligonucleotide
tctataaccaagaggagtctgtgcgcttcgac

SEQ ID NO: 63649 - DNA, 31 bp, Artificial Sequence
  Description of Artificial Sequence: Synthetic oligonucleotide
ctataaccaagaggagtctgtgcgcttcgac

SEQ ID NO: 63650 - DNA, 32 bp, Artificial Sequence
  Description of Artificial Sequence: Synthetic oligonucleotide
tataaccaagaggagtctgtgcgcttcgacag

SEQ ID NO: 63651 - DNA, 31 bp, Artificial Sequence
  Description of Artificial Sequence: Synthetic oligonucleotide
ataaccaagaggagtctgtgcgcttcgacag

SEQ ID NO: 63652 - DNA, 30 bp, Artificial Sequence
  Description of Artificial Sequence: Synthetic oligonucleotide
taaccaagaggagtctgtgcgcttcgacag

SEQ ID NO: 63653 - DNA, 29 bp, Artificial Sequence
  Description of Artificial Sequence: Synthetic oligonucleotide
aaccaagaggagtctgtgcgcttcgacag

SEQ ID NO: 63654 - DNA, 28 bp, Artificial Sequence
  Description of Artificial Sequence: Synthetic oligonucleotide
accaagaggagtctgtgcgcttcgacag

SEQ ID NO: 63655 - DNA, 27 bp, Artificial Sequence
  Description of Artificial Sequence: Synthetic oligonucleotide
ccaagaggagtctgtgcgcttcgacag

SEQ ID NO: 63656 - DNA, 27 bp, Artificial Sequence
  Description of Artificial Sequence: Synthetic oligonucleotide
caagaggagtctgtgcgcttcgacagc

SEQ ID NO: 63657 - DNA, 27 bp, Artificial Sequence
  Description of Artificial Sequence: Synthetic oligonucleotide
aagaggagtctgtgcgcttcgacagcg

SEQ ID NO: 63658 - DNA, 27 bp, Artificial Sequence
  Description of Artificial Sequence: Synthetic oligonucleotide
agaggagtctgtgcgcttcgacagcga

SEQ ID NO: 63659 - DNA, 26 bp, Artificial Sequence
  Description of Artificial Sequence: Synthetic oligonucleotide
gaggagtctgtgcgcttcgacagcga

SEQ ID NO: 63660 - DNA, 26 bp, Artificial Sequence
  Description of Artificial Sequence: Synthetic oligonucleotide
aggagtctgtgcgcttcgacagcgac

SEQ ID NO: 63661 - DNA, 25 bp, Artificial Sequence
  Description of Artificial Sequence: Synthetic oligonucleotide
ggagtctgtgcgcttcgacagcgac

SEQ ID NO: 63662 - DNA, 26 bp, Artificial Sequence
  Description of Artificial Sequence: Synthetic oligonucleotide
gagtctgtgcgcttcgacagcgacgt

SEQ ID NO: 63663 - DNA, 26 bp, Artificial Sequence
  Description of Artificial Sequence: Synthetic oligonucleotide
agtctgtgcgcttcgacagcgacgtg

SEQ ID NO: 63664 - DNA, 25 bp, Artificial Sequence
  Description of Artificial Sequence: Synthetic oligonucleotide
gtctgtgcgcttcgacagcgacgtg

SEQ ID NO: 63665 - DNA, 25 bp, Artificial Sequence
  Description of Artificial Sequence: Synthetic oligonucleotide
tctgtgcgcttcgacagcgacgtgg

SEQ ID NO: 63666 - DNA, 24 bp, Artificial Sequence
  Description of Artificial Sequence: Synthetic oligonucleotide
ctgtgcgcttcgacagcgacgtgg

SEQ ID NO: 63667 - DNA, 26 bp, Artificial Sequence
  Description of Artificial Sequence: Synthetic oligonucleotide
agtccgtgcgcttcgacagcgacgta

SEQ ID NO: 63668 - DNA, 25 bp, Artificial Sequence
  Description of Artificial Sequence: Synthetic oligonucleotide
gtccgtgcgcttcgacagcgacgta

SEQ ID NO: 63669 - DNA, 25 bp, Artificial Sequence
  Description of Artificial Sequence: Synthetic oligonucleotide
tccgtgcgcttcgacagcgacgtag

SEQ ID NO: 63670 - DNA, 24 bp, Artificial Sequence
  Description of Artificial Sequence: Synthetic oligonucleotide
ccgtgcgcttcgacagcgacgtag

SEQ ID NO: 63671 - DNA, 24 bp, Artificial Sequence
  Description of Artificial Sequence: Synthetic oligonucleotide
cgtgcgcttcgacagcgacgtagg

SEQ ID NO: 63672 - DNA, 24 bp, Artificial Sequence
  Description of Artificial Sequence: Synthetic oligonucleotide
gtgcgcttcgacagcgacgtaggg

SEQ ID NO: 63673 - DNA, 25 bp, Artificial Sequence
  Description of Artificial Sequence: Synthetic oligonucleotide
tgcgcttcgacagcgacgtagggga

SEQ ID NO: 63674 - DNA, 24 bp, Artificial Sequence
  Description of Artificial Sequence: Synthetic oligonucleotide
gcgcttcgacagcgacgtagggga

SEQ ID NO: 63675 - DNA, 26 bp, Artificial Sequence
  Description of Artificial Sequence: Synthetic oligonucleotide
cgcttcgacagcgacgtaggggagta

SEQ ID NO: 63676 - DNA, 26 bp, Artificial Sequence
  Description of Artificial Sequence: Synthetic oligonucleotide
gcttcgacagcgacgtaggggagtac

SEQ ID NO: 63677 - DNA, 26 bp, Artificial Sequence
  Description of Artificial Sequence: Synthetic oligonucleotide
cttcgacagcgacgtaggggagtacc

SEQ ID NO: 63678 - DNA, 26 bp, Artificial Sequence
  Description of Artificial Sequence: Synthetic oligonucleotide
ttcgacagcgacgtaggggagtaccg

SEQ ID NO: 63679 - DNA, 25 bp, Artificial Sequence
  Description of Artificial Sequence: Synthetic oligonucleotide
tcgacagcgacgtaggggagtaccg

SEQ ID NO: 63680 - DNA, 24 bp, Artificial Sequence
  Description of Artificial Sequence: Synthetic oligonucleotide
cgacagcgacgtaggggagtaccg

SEQ ID NO: 63681 - DNA, 24 bp, Artificial Sequence
  Description of Artificial Sequence: Synthetic oligonucleotide
gacagcgacgtaggggagtaccgg

SEQ ID NO: 63682 - DNA, 24 bp, Artificial Sequence
  Description of Artificial Sequence: Synthetic oligonucleotide
acagcgacgtaggggagtaccggg

SEQ ID NO: 63683 - DNA, 23 bp, Artificial Sequence
  Description of Artificial Sequence: Synthetic oligonucleotide
cagcgacgtaggggagtaccggg

SEQ ID NO: 63684 - DNA, 23 bp, Artificial Sequence
  Description of Artificial Sequence: Synthetic oligonucleotide
agcgacgtaggggagtaccgggc

SEQ ID NO: 63685 - DNA, 22 bp, Artificial Sequence
  Description of Artificial Sequence: Synthetic oligonucleotide
gcgacgtaggggagtaccgggc

SEQ ID NO: 63686 - DNA, 22 bp, Artificial Sequence
  Description of Artificial Sequence: Synthetic oligonucleotide
cgacgtaggggagtaccgggcg

SEQ ID NO: 63687 - DNA, 23 bp, Artificial Sequence
  Description of Artificial Sequence: Synthetic oligonucleotide
gacgtaggggagtaccgggcggt

SEQ ID NO: 63688 - DNA, 24 bp, Artificial Sequence
  Description of Artificial Sequence: Synthetic oligonucleotide
acgtaggggagtaccgggcggtga

SEQ ID NO: 63689 - DNA, 23 bp, Artificial Sequence
  Description of Artificial Sequence: Synthetic oligonucleotide
cgtaggggagtaccgggcggtga

SEQ ID NO: 63690 - DNA, 23 bp, Artificial Sequence
  Description of Artificial Sequence: Synthetic oligonucleotide
gtaggggagtaccgggcggtgac

SEQ ID NO: 63691 - DNA, 23 bp, Artificial Sequence
  Description of Artificial Sequence: Synthetic oligonucleotide
taggggagtaccgggcggtgacg

SEQ ID NO: 63692 - DNA, 22 bp, Artificial Sequence
  Description of Artificial Sequence: Synthetic oligonucleotide
aggggagtaccgggcggtgacg

SEQ ID NO: 63693 - DNA, 27 bp, Artificial Sequence
  Description of Artificial Sequence: Synthetic oligonucleotide
ttcttcaatgggacggagcgggtgcgt

SEQ ID NO: 63694 - DNA, 27 bp, Artificial Sequence
  Description of Artificial Sequence: Synthetic oligonucleotide
tcttcaatgggacggagcgggtgcgtt

SEQ ID NO: 63695 - DNA, 27 bp, Artificial Sequence
  Description of Artificial Sequence: Synthetic oligonucleotide
cttcaatgggacggagcgggtgcgttt

SEQ ID NO: 63696 - DNA, 27 bp, Artificial Sequence
  Description of Artificial Sequence: Synthetic oligonucleotide
ttcaatgggacggagcgggtgcgtttg

SEQ ID NO: 63697 - DNA, 26 bp, Artificial Sequence
  Description of Artificial Sequence: Synthetic oligonucleotide
tcaatgggacggagcgggtgcgtttg

SEQ ID NO: 63698 - DNA, 25 bp, Artificial Sequence
  Description of Artificial Sequence: Synthetic oligonucleotide
caatgggacggagcgggtgcgtttg

SEQ ID NO: 63699 - DNA, 26 bp, Artificial Sequence
  Description of Artificial Sequence: Synthetic oligonucleotide
aatgggacggagcgggtgcgtttgct

SEQ ID NO: 63700 - DNA, 25 bp, Artificial Sequence
  Description of Artificial Sequence: Synthetic oligonucleotide
atgggacggagcgggtgcgtttgct

SEQ ID NO: 63701 - DNA, 24 bp, Artificial Sequence
  Description of Artificial Sequence: Synthetic oligonucleotide
tgggacggagcgggtgcgtttgct

SEQ ID NO: 63702 - DNA, 23 bp, Artificial Sequence
  Description of Artificial Sequence: Synthetic oligonucleotide
gggacggagcgggtgcgtttgct

SEQ ID NO: 63703 - DNA, 23 bp, Artificial Sequence
  Description of Artificial Sequence: Synthetic oligonucleotide
ggacggagcgggtgcgtttgctg

SEQ ID NO: 63704 - DNA, 26 bp, Artificial Sequence
  Description of Artificial Sequence: Synthetic oligonucleotide
gacggagcgggtgcgtttgctggaaa

SEQ ID NO: 63705 - DNA, 27 bp, Artificial Sequence
  Description of Artificial Sequence: Synthetic oligonucleotide
acggagcgggtgcgtttgctggaaaga

SEQ ID NO: 63706 - DNA, 27 bp, Artificial Sequence
  Description of Artificial Sequence: Synthetic oligonucleotide
cggagcgggtgcgtttgctggaaagat

SEQ ID NO: 63707 - DNA, 27 bp, Artificial Sequence
  Description of Artificial Sequence: Synthetic oligonucleotide
ggagcgggtgcgtttgctggaaagatg

SEQ ID NO: 63708 - DNA, 27 bp, Artificial Sequence
  Description of Artificial Sequence: Synthetic oligonucleotide
gagcgggtgcgtttgctggaaagatgc

SEQ ID NO: 63709 - DNA, 29 bp, Artificial Sequence
  Description of Artificial Sequence: Synthetic oligonucleotide
agcgggtgcgtttgctggaaagatgcatc

SEQ ID NO: 63710 - DNA, 28 bp, Artificial Sequence
  Description of Artificial Sequence: Synthetic oligonucleotide
gcgggtgcgtttgctggaaagatgcatc

SEQ ID NO: 63711 - DNA, 33 bp, Artificial Sequence
  Description of Artificial Sequence: Synthetic oligonucleotide
cgggtgcgtttgctggaaagatgcatctataac

SEQ ID NO: 63712 - DNA, 33 bp, Artificial Sequence
  Description of Artificial Sequence: Synthetic oligonucleotide
gggtgcgtttgctggaaagatgcatctataacc

SEQ ID NO: 63713 - DNA, 35 bp, Artificial Sequence
  Description of Artificial Sequence: Synthetic oligonucleotide
ggtgcgtttgctggaaagatgcatctataaccaag

SEQ ID NO: 63714 - DNA, 36 bp, Artificial Sequence
  Description of Artificial Sequence: Synthetic oligonucleotide
gtgcgtttgctggaaagatgcatctataaccaagag

SEQ ID NO: 63715 - DNA, 36 bp, Artificial Sequence
  Description of Artificial Sequence: Synthetic oligonucleotide
tgcgtttgctggaaagatgcatctataaccaagagg

SEQ ID NO: 63716 - DNA, 35 bp, Artificial Sequence
  Description of Artificial Sequence: Synthetic oligonucleotide
gcgtttgctggaaagatgcatctataaccaagagg

SEQ ID NO: 63717 - DNA, 36 bp, Artificial Sequence
  Description of Artificial Sequence: Synthetic oligonucleotide
cgtttgctggaaagatgcatctataaccaagaggag

SEQ ID NO: 63718 - DNA, 37 bp, Artificial Sequence
  Description of Artificial Sequence: Synthetic oligonucleotide
gtttgctggaaagatgcatctataaccaagaggagtc

SEQ ID NO: 63719 - DNA, 37 bp, Artificial Sequence
  Description of Artificial Sequence: Synthetic oligonucleotide
tttgctggaaagatgcatctataaccaagaggagtcc

SEQ ID NO: 63720 - DNA, 26 bp, Artificial Sequence
  Description of Artificial Sequence: Synthetic oligonucleotide
aggagtccgtgcgcttcgacagcgat

SEQ ID NO: 63721 - DNA, 25 bp, Artificial Sequence
  Description of Artificial Sequence: Synthetic oligonucleotide
ggagtccgtgcgcttcgacagcgat

SEQ ID NO: 63722 - DNA, 26 bp, Artificial Sequence
  Description of Artificial Sequence: Synthetic oligonucleotide
gagtccgtgcgcttcgacagcgatgt

SEQ ID NO: 63723 - DNA, 26 bp, Artificial Sequence
  Description of Artificial Sequence: Synthetic oligonucleotide
agtccgtgcgcttcgacagcgatgtg

SEQ ID NO: 63724 - DNA, 25 bp, Artificial Sequence
  Description of Artificial Sequence: Synthetic oligonucleotide
gtccgtgcgcttcgacagcgatgtg

SEQ ID NO: 63725 - DNA, 25 bp, Artificial Sequence
  Description of Artificial Sequence: Synthetic oligonucleotide
tccgtgcgcttcgacagcgatgtgg

SEQ ID NO: 63726 - DNA, 24 bp, Artificial Sequence
  Description of Artificial Sequence: Synthetic oligonucleotide
ccgtgcgcttcgacagcgatgtgg

SEQ ID NO: 63727 - DNA, 24 bp, Artificial Sequence
  Description of Artificial Sequence: Synthetic oligonucleotide
cgtgcgcttcgacagcgatgtggg

SEQ ID NO: 63728 - DNA, 24 bp, Artificial Sequence
  Description of Artificial Sequence: Synthetic oligonucleotide
gtgcgcttcgacagcgatgtgggg

SEQ ID NO: 63729 - DNA, 25 bp, Artificial Sequence
  Description of Artificial Sequence: Synthetic oligonucleotide
tgcgcttcgacagcgatgtggggga

SEQ ID NO: 63730 - DNA, 24 bp, Artificial Sequence
  Description of Artificial Sequence: Synthetic oligonucleotide
gcgcttcgacagcgatgtggggga

SEQ ID NO: 63731 - DNA, 26 bp, Artificial Sequence
  Description of Artificial Sequence: Synthetic oligonucleotide
cgcttcgacagcgatgtgggggagta

SEQ ID NO: 63732 - DNA, 26 bp, Artificial Sequence
  Description of Artificial Sequence: Synthetic oligonucleotide
gcttcgacagcgatgtgggggagtac

SEQ ID NO: 63733 - DNA, 26 bp, Artificial Sequence
  Description of Artificial Sequence: Synthetic oligonucleotide
cttcgacagcgatgtgggggagtacc

SEQ ID NO: 63734 - DNA, 26 bp, Artificial Sequence
  Description of Artificial Sequence: Synthetic oligonucleotide
ttcgacagcgatgtgggggagtaccg

SEQ ID NO: 63735 - DNA, 25 bp, Artificial Sequence
  Description of Artificial Sequence: Synthetic oligonucleotide
tcgacagcgatgtgggggagtaccg

SEQ ID NO: 63736 - DNA, 24 bp, Artificial Sequence
  Description of Artificial Sequence: Synthetic oligonucleotide
cgacagcgatgtgggggagtaccg

SEQ ID NO: 63737 - DNA, 24 bp, Artificial Sequence
  Description of Artificial Sequence: Synthetic oligonucleotide
gacagcgatgtgggggagtaccgg

SEQ ID NO: 63738 - DNA, 24 bp, Artificial Sequence
  Description of Artificial Sequence: Synthetic oligonucleotide
acagcgatgtgggggagtaccggg

SEQ ID NO: 63739 - DNA, 23 bp, Artificial Sequence
  Description of Artificial Sequence: Synthetic oligonucleotide
cagcgatgtgggggagtaccggg

SEQ ID NO: 63740 - DNA, 23 bp, Artificial Sequence
  Description of Artificial Sequence: Synthetic oligonucleotide
agcgatgtgggggagtaccgggc

SEQ ID NO: 63741 - DNA, 22 bp, Artificial Sequence
  Description of Artificial Sequence: Synthetic oligonucleotide
gcgatgtgggggagtaccgggc

SEQ ID NO: 63742 - DNA, 22 bp, Artificial Sequence
  Description of Artificial Sequence: Synthetic oligonucleotide
cgatgtgggggagtaccgggcg

SEQ ID NO: 63743 - DNA, 23 bp, Artificial Sequence
  Description of Artificial Sequence: Synthetic oligonucleotide
gatgtgggggagtaccgggcggt

SEQ ID NO: 63744 - DNA, 24 bp, Artificial Sequence
  Description of Artificial Sequence: Synthetic oligonucleotide
atgtgggggagtaccgggcggtga

SEQ ID NO: 63745 - DNA, 23 bp, Artificial Sequence
  Description of Artificial Sequence: Synthetic oligonucleotide
tgtgggggagtaccgggcggtga

SEQ ID NO: 63746 - DNA, 33 bp, Artificial Sequence
  Description of Artificial Sequence: Synthetic oligonucleotide
aatgtcatttcttcaatgggacggagcgggtac

SEQ ID NO: 63747 - DNA, 32 bp, Artificial Sequence
  Description of Artificial Sequence: Synthetic oligonucleotide
atgtcatttcttcaatgggacggagcgggtac

SEQ ID NO: 63748 - DNA, 31 bp, Artificial Sequence
  Description of Artificial Sequence: Synthetic oligonucleotide
tgtcatttcttcaatgggacggagcgggtac

SEQ ID NO: 63749 - DNA, 30 bp, Artificial Sequence
  Description of Artificial Sequence: Synthetic oligonucleotide
gtcatttcttcaatgggacggagcgggtac

SEQ ID NO: 63750 - DNA, 30 bp, Artificial Sequence
  Description of Artificial Sequence: Synthetic oligonucleotide
tcatttcttcaatgggacggagcgggtacg

SEQ ID NO: 63751 - DNA, 29 bp, Artificial Sequence
  Description of Artificial Sequence: Synthetic oligonucleotide
catttcttcaatgggacggagcgggtacg

SEQ ID NO: 63752 - DNA, 29 bp, Artificial Sequence
  Description of Artificial Sequence: Synthetic oligonucleotide
atttcttcaatgggacggagcgggtacgg

SEQ ID NO: 63753 - DNA, 28 bp, Artificial Sequence
  Description of Artificial Sequence: Synthetic oligonucleotide
tttcttcaatgggacggagcgggtacgg

SEQ ID NO: 63754 - DNA, 27 bp, Artificial Sequence
  Description of Artificial Sequence: Synthetic oligonucleotide
ttcttcaatgggacggagcgggtacgg

SEQ ID NO: 63755 - DNA, 27 bp, Artificial Sequence
  Description of Artificial Sequence: Synthetic oligonucleotide
tcttcaatgggacggagcgggtacggt

SEQ ID NO: 63756 - DNA, 27 bp, Artificial Sequence
  Description of Artificial Sequence: Synthetic oligonucleotide
cttcaatgggacggagcgggtacggtt

SEQ ID NO: 63757 - DNA, 27 bp, Artificial Sequence
  Description of Artificial Sequence: Synthetic oligonucleotide
ttcaatgggacggagcgggtacggttg

SEQ ID NO: 63758 - DNA, 26 bp, Artificial Sequence
  Description of Artificial Sequence: Synthetic oligonucleotide
tcaatgggacggagcgggtacggttg

SEQ ID NO: 63759 - DNA, 25 bp, Artificial Sequence
  Description of Artificial Sequence: Synthetic oligonucleotide
caatgggacggagcgggtacggttg

SEQ ID NO: 63760 - DNA, 26 bp, Artificial Sequence
  Description of Artificial Sequence: Synthetic oligonucleotide
aatgggacggagcgggtacggttgct

SEQ ID NO: 63761 - DNA, 25 bp, Artificial Sequence
  Description of Artificial Sequence: Synthetic oligonucleotide
atgggacggagcgggtacggttgct

SEQ ID NO: 63762 - DNA, 24 bp, Artificial Sequence
  Description of Artificial Sequence: Synthetic oligonucleotide
tgggacggagcgggtacggttgct

SEQ ID NO: 63763 - DNA, 23 bp, Artificial Sequence
  Description of Artificial Sequence: Synthetic oligonucleotide
gggacggagcgggtacggttgct

SEQ ID NO: 63764 - DNA, 23 bp, Artificial Sequence
  Description of Artificial Sequence: Synthetic oligonucleotide
ggacggagcgggtacggttgctg

SEQ ID NO: 63765 - DNA, 26 bp, Artificial Sequence
  Description of Artificial Sequence: Synthetic oligonucleotide
gacggagcgggtacggttgctggaaa

SEQ ID NO: 63766 - DNA, 27 bp, Artificial Sequence
  Description of Artificial Sequence: Synthetic oligonucleotide
acggagcgggtacggttgctggaaaga

SEQ ID NO: 63767 - DNA, 27 bp, Artificial Sequence
  Description of Artificial Sequence: Synthetic oligonucleotide
cggagcgggtacggttgctggaaagat

SEQ ID NO: 63768 - DNA, 27 bp, Artificial Sequence
  Description of Artificial Sequence: Synthetic oligonucleotide
ggagcgggtacggttgctggaaagatg

SEQ ID NO: 63769 - DNA, 27 bp, Artificial Sequence
  Description of Artificial Sequence: Synthetic oligonucleotide
gagcgggtacggttgctggaaagatgc

SEQ ID NO: 63770 - DNA, 29 bp, Artificial Sequence
  Description of Artificial Sequence: Synthetic oligonucleotide
agcgggtacggttgctggaaagatgcatc

SEQ ID NO: 63771 - DNA, 28 bp, Artificial Sequence
  Description of Artificial Sequence: Synthetic oligonucleotide
gcgggtacggttgctggaaagatgcatc

SEQ ID NO: 63772 - DNA, 33 bp, Artificial Sequence
  Description of Artificial Sequence: Synthetic oligonucleotide
cgggtacggttgctggaaagatgcatctataac

SEQ ID NO: 63773 - DNA, 33 bp, Artificial Sequence
  Description of Artificial Sequence: Synthetic oligonucleotide
gggtacggttgctggaaagatgcatctataacc

SEQ ID NO: 63774 - DNA, 35 bp, Artificial Sequence
  Description of Artificial Sequence: Synthetic oligonucleotide
ggtacggttgctggaaagatgcatctataaccaag

SEQ ID NO: 63775 - DNA, 36 bp, Artificial Sequence
  Description of Artificial Sequence: Synthetic oligonucleotide
gtacggttgctggaaagatgcatctataaccaagag

SEQ ID NO: 63776 - DNA, 36 bp, Artificial Sequence
  Description of Artificial Sequence: Synthetic oligonucleotide
tacggttgctggaaagatgcatctataaccaagagg

SEQ ID NO: 63777 - DNA, 35 bp, Artificial Sequence
  Description of Artificial Sequence: Synthetic oligonucleotide
acggttgctggaaagatgcatctataaccaagagg

SEQ ID NO: 63778 - DNA, 36 bp, Artificial Sequence
  Description of Artificial Sequence: Synthetic oligonucleotide
ttgctggaaagatgcatctataaccaagaggagtcg

SEQ ID NO: 63779 - DNA, 35 bp, Artificial Sequence
  Description of Artificial Sequence: Synthetic oligonucleotide
tgctggaaagatgcatctataaccaagaggagtcg

SEQ ID NO: 63780 - DNA, 34 bp, Artificial Sequence
  Description of Artificial Sequence: Synthetic oligonucleotide
gctggaaagatgcatctataaccaagaggagtcg

SEQ ID NO: 63781 - DNA, 34 bp, Artificial Sequence
  Description of Artificial Sequence: Synthetic oligonucleotide
ctggaaagatgcatctataaccaagaggagtcgg

SEQ ID NO: 63782 - DNA, 35 bp, Artificial Sequence
  Description of Artificial Sequence: Synthetic oligonucleotide
tggaaagatgcatctataaccaagaggagtcggtg

SEQ ID NO: 63783 - DNA, 34 bp, Artificial Sequence
  Description of Artificial Sequence: Synthetic oligonucleotide
ggaaagatgcatctataaccaagaggagtcggtg

SEQ ID NO: 63784 - DNA, 34 bp, Artificial Sequence
  Description of Artificial Sequence: Synthetic oligonucleotide
gaaagatgcatctataaccaagaggagtcggtgc

SEQ ID NO: 63785 - DNA, 34 bp, Artificial Sequence
  Description of Artificial Sequence: Synthetic oligonucleotide
aaagatgcatctataaccaagaggagtcggtgcg

SEQ ID NO: 63786 - DNA, 33 bp, Artificial Sequence
  Description of Artificial Sequence: Synthetic oligonucleotide
aagatgcatctataaccaagaggagtcggtgcg

SEQ ID NO: 63787 - DNA, 32 bp, Artificial Sequence
  Description of Artificial Sequence: Synthetic oligonucleotide
agatgcatctataaccaagaggagtcggtgcg

SEQ ID NO: 63788 - DNA, 31 bp, Artificial Sequence
  Description of Artificial Sequence: Synthetic oligonucleotide
gatgcatctataaccaagaggagtcggtgcg

SEQ ID NO: 63789 - DNA, 31 bp, Artificial Sequence
  Description of Artificial Sequence: Synthetic oligonucleotide
atgcatctataaccaagaggagtcggtgcgc

SEQ ID NO: 63790 - DNA, 30 bp, Artificial Sequence
  Description of Artificial Sequence: Synthetic oligonucleotide
tgcatctataaccaagaggagtcggtgcgc

SEQ ID NO: 63791 - DNA, 29 bp, Artificial Sequence
  Description of Artificial Sequence: Synthetic oligonucleotide
gcatctataaccaagaggagtcggtgcgc

SEQ ID NO: 63792 - DNA, 31 bp, Artificial Sequence
  Description of Artificial Sequence: Synthetic oligonucleotide
catctataaccaagaggagtcggtgcgcttc

SEQ ID NO: 63793 - DNA, 31 bp, Artificial Sequence
  Description of Artificial Sequence: Synthetic oligonucleotide
atctataaccaagaggagtcggtgcgcttcg

SEQ ID NO: 63794 - DNA, 30 bp, Artificial Sequence
  Description of Artificial Sequence: Synthetic oligonucleotide
tctataaccaagaggagtcggtgcgcttcg

SEQ ID NO: 63795 - DNA, 29 bp, Artificial Sequence
  Description of Artificial Sequence: Synthetic oligonucleotide
ctataaccaagaggagtcggtgcgcttcg

SEQ ID NO: 63796 - DNA, 30 bp, Artificial Sequence
  Description of Artificial Sequence: Synthetic oligonucleotide
tataaccaagaggagtcggtgcgcttcgac

SEQ ID NO: 63797 - DNA, 29 bp, Artificial Sequence
  Description of Artificial Sequence: Synthetic oligonucleotide
ataaccaagaggagtcggtgcgcttcgac

SEQ ID NO: 63798 - DNA, 28 bp, Artificial Sequence
  Description of Artificial Sequence: Synthetic oligonucleotide
taaccaagaggagtcggtgcgcttcgac

SEQ ID NO: 63799 - DNA, 27 bp, Artificial Sequence
  Description of Artificial Sequence: Synthetic oligonucleotide
aaccaagaggagtcggtgcgcttcgac

SEQ ID NO: 63800 - DNA, 27 bp, Artificial Sequence
  Description of Artificial Sequence: Synthetic oligonucleotide
accaagaggagtcggtgcgcttcgaca

SEQ ID NO: 63801 - DNA, 26 bp, Artificial Sequence
  Description of Artificial Sequence: Synthetic oligonucleotide
ccaagaggagtcggtgcgcttcgaca

SEQ ID NO: 63802 - DNA, 26 bp, Artificial Sequence
  Description of Artificial Sequence: Synthetic oligonucleotide
caagaggagtcggtgcgcttcgacag

SEQ ID NO: 63803 - DNA, 26 bp, Artificial Sequence
  Description of Artificial Sequence: Synthetic oligonucleotide
aagaggagtcggtgcgcttcgacagc

SEQ ID NO: 63804 - DNA, 25 bp, Artificial Sequence
  Description of Artificial Sequence: Synthetic oligonucleotide
agaggagtcggtgcgcttcgacagc

SEQ ID NO: 63805 - DNA, 24 bp, Artificial Sequence
  Description of Artificial Sequence: Synthetic oligonucleotide
gaggagtcggtgcgcttcgacagc

SEQ ID NO: 63806 - DNA, 25 bp, Artificial Sequence
  Description of Artificial Sequence: Synthetic oligonucleotide
aggagtcggtgcgcttcgacagcga

SEQ ID NO: 63807 - DNA, 24 bp, Artificial Sequence
  Description of Artificial Sequence: Synthetic oligonucleotide
ggagtcggtgcgcttcgacagcga

SEQ ID NO: 63808 - DNA, 24 bp, Artificial Sequence
  Description of Artificial Sequence: Synthetic oligonucleotide
gagtcggtgcgcttcgacagcgac

SEQ ID NO: 63809 - DNA, 25 bp, Artificial Sequence
  Description of Artificial Sequence: Synthetic oligonucleotide
agtcggtgcgcttcgacagcgacgt

SEQ ID NO: 63810 - DNA, 24 bp, Artificial Sequence
  Description of Artificial Sequence: Synthetic oligonucleotide
gtcggtgcgcttcgacagcgacgt

SEQ ID NO: 63811 - DNA, 24 bp, Artificial Sequence
  Description of Artificial Sequence: Synthetic oligonucleotide
tcggtgcgcttcgacagcgacgtg

SEQ ID NO: 63812 - DNA, 23 bp, Artificial Sequence
  Description of Artificial Sequence: Synthetic oligonucleotide
cggtgcgcttcgacagcgacgtg

SEQ ID NO: 63813 - DNA, 23 bp, Artificial Sequence
  Description of Artificial Sequence: Synthetic oligonucleotide
ggtgcgcttcgacagcgacgtgg

SEQ ID NO: 63814 - DNA, 24 bp, Artificial Sequence
  Description of Artificial Sequence: Synthetic oligonucleotide
tccgtgcgcttcgacagcgacgtc

SEQ ID NO: 63815 - DNA, 23 bp, Artificial Sequence
  Description of Artificial Sequence: Synthetic oligonucleotide
ccgtgcgcttcgacagcgacgtc

SEQ ID NO: 63816 - DNA, 23 bp, Artificial Sequence
  Description of Artificial Sequence: Synthetic oligonucleotide
cgtgcgcttcgacagcgacgtcg

SEQ ID NO: 63817 - DNA, 23 bp, Artificial Sequence
  Description of Artificial Sequence: Synthetic oligonucleotide
gtgcgcttcgacagcgacgtcgg

SEQ ID NO: 63818 - DNA, 23 bp, Artificial Sequence
  Description of Artificial Sequence: Synthetic oligonucleotide
tgcgcttcgacagcgacgtcggg

SEQ ID NO: 63819 - DNA, 22 bp, Artificial Sequence
  Description of Artificial Sequence: Synthetic oligonucleotide
gcgcttcgacagcgacgtcggg

SEQ ID NO: 63820 - DNA, 23 bp, Artificial Sequence
  Description of Artificial Sequence: Synthetic oligonucleotide
cgcttcgacagcgacgtcgggga

SEQ ID NO: 63821 - DNA, 25 bp, Artificial Sequence
  Description of Artificial Sequence: Synthetic oligonucleotide
gcttcgacagcgacgtcggggagta

SEQ ID NO: 63822 - DNA, 25 bp, Artificial Sequence
  Description of Artificial Sequence: Synthetic oligonucleotide
cttcgacagcgacgtcggggagtac

SEQ ID NO: 63823 - DNA, 25 bp, Artificial Sequence
  Description of Artificial Sequence: Synthetic oligonucleotide
ttcgacagcgacgtcggggagtacc

SEQ ID NO: 63824 - DNA, 24 bp, Artificial Sequence
  Description of Artificial Sequence: Synthetic oligonucleotide
tcgacagcgacgtcggggagtacc

SEQ ID NO: 63825 - DNA, 23 bp, Artificial Sequence
  Description of Artificial Sequence: Synthetic oligonucleotide
cgacagcgacgtcggggagtacc

SEQ ID NO: 63826 - DNA, 23 bp, Artificial Sequence
  Description of Artificial Sequence: Synthetic oligonucleotide
gacagcgacgtcggggagtaccg

SEQ ID NO: 63827 - DNA, 23 bp, Artificial Sequence
  Description of Artificial Sequence: Synthetic oligonucleotide
acagcgacgtcggggagtaccgg

SEQ ID NO: 63828 - DNA, 22 bp, Artificial Sequence
  Description of Artificial Sequence: Synthetic oligonucleotide
cagcgacgtcggggagtaccgg

SEQ ID NO: 63829 - DNA, 22 bp, Artificial Sequence
  Description of Artificial Sequence: Synthetic oligonucleotide
agcgacgtcggggagtaccggg

SEQ ID NO: 63830 - DNA, 21 bp, Artificial Sequence
  Description of Artificial Sequence: Synthetic oligonucleotide
gcgacgtcggggagtaccggg

SEQ ID NO: 63831 - DNA, 21 bp, Artificial Sequence
  Description of Artificial Sequence: Synthetic oligonucleotide
cgacgtcggggagtaccgggc

SEQ ID NO: 63832 - DNA, 21 bp, Artificial Sequence
  Description of Artificial Sequence: Synthetic oligonucleotide
gacgtcggggagtaccgggcg

SEQ ID NO: 63833 - DNA, 22 bp, Artificial Sequence
  Description of Artificial Sequence: Synthetic oligonucleotide
acgtcggggagtaccgggcggt

SEQ ID NO: 63834 - DNA, 21 bp, Artificial Sequence
  Description of Artificial Sequence: Synthetic oligonucleotide
cgtcggggagtaccgggcggt

SEQ ID NO: 63835 - DNA, 22 bp, Artificial Sequence
  Description of Artificial Sequence: Synthetic oligonucleotide
gtcggggagtaccgggcggtga

SEQ ID NO: 63836 - DNA, 22 bp, Artificial Sequence
  Description of Artificial Sequence: Synthetic oligonucleotide
tcggggagtaccgggcggtgac

SEQ ID NO: 63837 - DNA, 21 bp, Artificial Sequence
  Description of Artificial Sequence: Synthetic oligonucleotide
cggggagtaccgggcggtgac

SEQ ID NO: 63838 - DNA, 39 bp, Artificial Sequence
  Description of Artificial Sequence: Synthetic oligonucleotide
ttaagtttgaatgtcatttcttcaatgggacggagcgtg

SEQ ID NO: 63839 - DNA, 38 bp, Artificial Sequence
  Description of Artificial Sequence: Synthetic oligonucleotide
taagtttgaatgtcatttcttcaatgggacggagcgtg

SEQ ID NO: 63840 - DNA, 37 bp, Artificial Sequence
  Description of Artificial Sequence: Synthetic oligonucleotide
aagtttgaatgtcatttcttcaatgggacggagcgtg

SEQ ID NO: 63841 - DNA, 36 bp, Artificial Sequence
  Description of Artificial Sequence: Synthetic oligonucleotide
agtttgaatgtcatttcttcaatgggacggagcgtg

SEQ ID NO: 63842 - DNA, 35 bp, Artificial Sequence
  Description of Artificial Sequence: Synthetic oligonucleotide
gtttgaatgtcatttcttcaatgggacggagcgtg

SEQ ID NO: 63843 - DNA, 36 bp, Artificial Sequence
  Description of Artificial Sequence: Synthetic oligonucleotide
tttgaatgtcatttcttcaatgggacggagcgtgtg

SEQ ID NO: 63844 - DNA, 35 bp, Artificial Sequence
  Description of Artificial Sequence: Synthetic oligonucleotide
ttgaatgtcatttcttcaatgggacggagcgtgtg

SEQ ID NO: 63845 - DNA, 34 bp, Artificial Sequence
  Description of Artificial Sequence: Synthetic oligonucleotide
tgaatgtcatttcttcaatgggacggagcgtgtg

SEQ ID NO: 63846 - DNA, 33 bp, Artificial Sequence
  Description of Artificial Sequence: Synthetic oligonucleotide
gaatgtcatttcttcaatgggacggagcgtgtg

SEQ ID NO: 63847 - DNA, 33 bp, Artificial Sequence
  Description of Artificial Sequence: Synthetic oligonucleotide
aatgtcatttcttcaatgggacggagcgtgtgc

SEQ ID NO: 63848 - DNA, 32 bp, Artificial Sequence
  Description of Artificial Sequence: Synthetic oligonucleotide
atgtcatttcttcaatgggacggagcgtgtgc

SEQ ID NO: 63849 - DNA, 31 bp, Artificial Sequence
  Description of Artificial Sequence: Synthetic oligonucleotide
tgtcatttcttcaatgggacggagcgtgtgc

SEQ ID NO: 63850 - DNA, 30 bp, Artificial Sequence
  Description of Artificial Sequence: Synthetic oligonucleotide
gtcatttcttcaatgggacggagcgtgtgc

SEQ ID NO: 63851 - DNA, 30 bp, Artificial Sequence
  Description of Artificial Sequence: Synthetic oligonucleotide
tcatttcttcaatgggacggagcgtgtgcg

SEQ ID NO: 63852 - DNA, 29 bp, Artificial Sequence
  Description of Artificial Sequence: Synthetic oligonucleotide
catttcttcaatgggacggagcgtgtgcg

SEQ ID NO: 63853 - DNA, 29 bp, Artificial Sequence
  Description of Artificial Sequence: Synthetic oligonucleotide
atttcttcaatgggacggagcgtgtgcgg

SEQ ID NO: 63854 - DNA, 28 bp, Artificial Sequence
  Description of Artificial Sequence: Synthetic oligonucleotide
tttcttcaatgggacggagcgtgtgcgg

SEQ ID NO: 63855 - DNA, 27 bp, Artificial Sequence
  Description of Artificial Sequence: Synthetic oligonucleotide
ttcttcaatgggacggagcgtgtgcgg

SEQ ID NO: 63856 - DNA, 27 bp, Artificial Sequence
  Description of Artificial Sequence: Synthetic oligonucleotide
tcttcaatgggacggagcgtgtgcggt

SEQ ID NO: 63857 - DNA, 27 bp, Artificial Sequence
  Description of Artificial Sequence: Synthetic oligonucleotide
cttcaatgggacggagcgtgtgcggtt

SEQ ID NO: 63858 - DNA, 27 bp, Artificial Sequence
  Description of Artificial Sequence: Synthetic oligonucleotide
ttcaatgggacggagcgtgtgcggttg

SEQ ID NO: 63859 - DNA, 26 bp, Artificial Sequence
  Description of Artificial Sequence: Synthetic oligonucleotide
tcaatgggacggagcgtgtgcggttg

SEQ ID NO: 63860 - DNA, 25 bp, Artificial Sequence
  Description of Artificial Sequence: Synthetic oligonucleotide
caatgggacggagcgtgtgcggttg

SEQ ID NO: 63861 - DNA, 26 bp, Artificial Sequence
  Description of Artificial Sequence: Synthetic oligonucleotide
aatgggacggagcgtgtgcggttgct

SEQ ID NO: 63862 - DNA, 25 bp, Artificial Sequence
  Description of Artificial Sequence: Synthetic oligonucleotide
atgggacggagcgtgtgcggttgct

SEQ ID NO: 63863 - DNA, 24 bp, Artificial Sequence
  Description of Artificial Sequence: Synthetic oligonucleotide
tgggacggagcgtgtgcggttgct

SEQ ID NO: 63864 - DNA, 23 bp, Artificial Sequence
  Description of Artificial Sequence: Synthetic oligonucleotide
gggacggagcgtgtgcggttgct

SEQ ID NO: 63865 - DNA, 23 bp, Artificial Sequence
  Description of Artificial Sequence: Synthetic oligonucleotide
ggacggagcgtgtgcggttgctg

SEQ ID NO: 63866 - DNA, 26 bp, Artificial Sequence
  Description of Artificial Sequence: Synthetic oligonucleotide
gacggagcgtgtgcggttgctggaaa

SEQ ID NO: 63867 - DNA, 27 bp, Artificial Sequence
  Description of Artificial Sequence: Synthetic oligonucleotide
acggagcgtgtgcggttgctggaaaga

SEQ ID NO: 63868 - DNA, 27 bp, Artificial Sequence
  Description of Artificial Sequence: Synthetic oligonucleotide
cggagcgtgtgcggttgctggaaagat

SEQ ID NO: 63869 - DNA, 27 bp, Artificial Sequence
  Description of Artificial Sequence: Synthetic oligonucleotide
ggagcgtgtgcggttgctggaaagatg

SEQ ID NO: 63870 - DNA, 27 bp, Artificial Sequence
  Description of Artificial Sequence: Synthetic oligonucleotide
gagcgtgtgcggttgctggaaagatgc

SEQ ID NO: 63871 - DNA, 29 bp, Artificial Sequence
  Description of Artificial Sequence: Synthetic oligonucleotide
agcgtgtgcggttgctggaaagatgcatc

SEQ ID NO: 63872 - DNA, 28 bp, Artificial Sequence
  Description of Artificial Sequence: Synthetic oligonucleotide
gcgtgtgcggttgctggaaagatgcatc

SEQ ID NO: 63873 - DNA, 33 bp, Artificial Sequence
  Description of Artificial Sequence: Synthetic oligonucleotide
cgtgtgcggttgctggaaagatgcatctataac

SEQ ID NO: 63874 - DNA, 33 bp, Artificial Sequence
  Description of Artificial Sequence: Synthetic oligonucleotide
gtgtgcggttgctggaaagatgcatctataacc

SEQ ID NO: 63875 - DNA, 35 bp, Artificial Sequence
  Description of Artificial Sequence: Synthetic oligonucleotide
tgtgcggttgctggaaagatgcatctataaccaag

SEQ ID NO: 63876 - DNA, 27 bp, Artificial Sequence
  Description of Artificial Sequence: Synthetic oligonucleotide
gagcgggtgcggttgctggaaagatgt

SEQ ID NO: 63877 - DNA, 29 bp, Artificial Sequence
  Description of Artificial Sequence: Synthetic oligonucleotide
agcgggtgcggttgctggaaagatgtatc

SEQ ID NO: 63878 - DNA, 28 bp, Artificial Sequence
  Description of Artificial Sequence: Synthetic oligonucleotide
gcgggtgcggttgctggaaagatgtatc

SEQ ID NO: 63879 - DNA, 33 bp, Artificial Sequence
  Description of Artificial Sequence: Synthetic oligonucleotide
cgggtgcggttgctggaaagatgtatctataac

SEQ ID NO: 63880 - DNA, 33 bp, Artificial Sequence
  Description of Artificial Sequence: Synthetic oligonucleotide
gggtgcggttgctggaaagatgtatctataacc

SEQ ID NO: 63881 - DNA, 35 bp, Artificial Sequence
  Description of Artificial Sequence: Synthetic oligonucleotide
ggtgcggttgctggaaagatgtatctataaccaag

SEQ ID NO: 63882 - DNA, 36 bp, Artificial Sequence
  Description of Artificial Sequence: Synthetic oligonucleotide
gtgcggttgctggaaagatgtatctataaccaagag

SEQ ID NO: 63883 - DNA, 36 bp, Artificial Sequence
  Description of Artificial Sequence: Synthetic oligonucleotide
tgcggttgctggaaagatgtatctataaccaagagg

SEQ ID NO: 63884 - DNA, 35 bp, Artificial Sequence
  Description of Artificial Sequence: Synthetic oligonucleotide
gcggttgctggaaagatgtatctataaccaagagg

SEQ ID NO: 63885 - DNA, 36 bp, Artificial Sequence
  Description of Artificial Sequence: Synthetic oligonucleotide
cggttgctggaaagatgtatctataaccaagaggag

SEQ ID NO: 63886 - DNA, 37 bp, Artificial Sequence
  Description of Artificial Sequence: Synthetic oligonucleotide
ggttgctggaaagatgtatctataaccaagaggagtc

SEQ ID NO: 63887 - DNA, 37 bp, Artificial Sequence
  Description of Artificial Sequence: Synthetic oligonucleotide
gttgctggaaagatgtatctataaccaagaggagtcc

SEQ ID NO: 63888 - DNA, 37 bp, Artificial Sequence
  Description of Artificial Sequence: Synthetic oligonucleotide
ttgctggaaagatgtatctataaccaagaggagtccg

SEQ ID NO: 63889 - DNA, 36 bp, Artificial Sequence
  Description of Artificial Sequence: Synthetic oligonucleotide
tgctggaaagatgtatctataaccaagaggagtccg

SEQ ID NO: 63890 - DNA, 35 bp, Artificial Sequence
  Description of Artificial Sequence: Synthetic oligonucleotide
gctggaaagatgtatctataaccaagaggagtccg

SEQ ID NO: 63891 - DNA, 36 bp, Artificial Sequence
  Description of Artificial Sequence: Synthetic oligonucleotide
ctggaaagatgtatctataaccaagaggagtccgtg

SEQ ID NO: 63892 - DNA, 36 bp, Artificial Sequence
  Description of Artificial Sequence: Synthetic oligonucleotide
tggaaagatgtatctataaccaagaggagtccgtgc

SEQ ID NO: 63893 - DNA, 35 bp, Artificial Sequence
  Description of Artificial Sequence: Synthetic oligonucleotide
ggaaagatgtatctataaccaagaggagtccgtgc

SEQ ID NO: 63894 - DNA, 35 bp, Artificial Sequence
  Description of Artificial Sequence: Synthetic oligonucleotide
gaaagatgtatctataaccaagaggagtccgtgcg

SEQ ID NO: 63895 - DNA, 35 bp, Artificial Sequence
  Description of Artificial Sequence: Synthetic oligonucleotide
aaagatgtatctataaccaagaggagtccgtgcgc

SEQ ID NO: 63896 - DNA, 34 bp, Artificial Sequence
  Description of Artificial Sequence: Synthetic oligonucleotide
aagatgtatctataaccaagaggagtccgtgcgc

SEQ ID NO: 63897 - DNA, 33 bp, Artificial Sequence
  Description of Artificial Sequence: Synthetic oligonucleotide
agatgtatctataaccaagaggagtccgtgcgc

SEQ ID NO: 63898 - DNA, 32 bp, Artificial Sequence
  Description of Artificial Sequence: Synthetic oligonucleotide
gatgtatctataaccaagaggagtccgtgcgc

SEQ ID NO: 63899 - DNA, 34 bp, Artificial Sequence
  Description of Artificial Sequence: Synthetic oligonucleotide
atgtatctataaccaagaggagtccgtgcgcttc

SEQ ID NO: 63900 - DNA, 33 bp, Artificial Sequence
  Description of Artificial Sequence: Synthetic oligonucleotide
tgtatctataaccaagaggagtccgtgcgcttc

SEQ ID NO: 63901 - DNA, 32 bp, Artificial Sequence
  Description of Artificial Sequence: Synthetic oligonucleotide
gtatctataaccaagaggagtccgtgcgcttc

SEQ ID NO: 63902 - DNA, 32 bp, Artificial Sequence
  Description of Artificial Sequence: Synthetic oligonucleotide
tatctataaccaagaggagtccgtgcgcttcg

SEQ ID NO: 63903 - DNA, 23 bp, Artificial Sequence
  Description of Artificial Sequence: Synthetic oligonucleotide
acctcctggagcagaggcgggca

SEQ ID NO: 63904 - DNA, 22 bp, Artificial Sequence
  Description of Artificial Sequence: Synthetic oligonucleotide
cctcctggagcagaggcgggca

SEQ ID NO: 63905 - DNA, 22 bp, Artificial Sequence
  Description of Artificial Sequence: Synthetic oligonucleotide
ctcctggagcagaggcgggcag

SEQ ID NO: 63906 - DNA, 22 bp, Artificial Sequence
  Description of Artificial Sequence: Synthetic oligonucleotide
tcctggagcagaggcgggcagc

SEQ ID NO: 63907 - DNA, 21 bp, Artificial Sequence
  Description of Artificial Sequence: Synthetic oligonucleotide
cctggagcagaggcgggcagc

SEQ ID NO: 63908 - DNA, 21 bp, Artificial Sequence
  Description of Artificial Sequence: Synthetic oligonucleotide
ctggagcagaggcgggcagcg

SEQ ID NO: 63909 - DNA, 22 bp, Artificial Sequence
  Description of Artificial Sequence: Synthetic oligonucleotide
tggagcagaggcgggcagcggt

SEQ ID NO: 63910 - DNA, 21 bp, Artificial Sequence
  Description of Artificial Sequence: Synthetic oligonucleotide
ggagcagaggcgggcagcggt

SEQ ID NO: 63911 - DNA, 21 bp, Artificial Sequence
  Description of Artificial Sequence: Synthetic oligonucleotide
gagcagaggcgggcagcggtg

SEQ ID NO: 63912 - DNA, 22 bp, Artificial Sequence
  Description of Artificial Sequence: Synthetic oligonucleotide
agcagaggcgggcagcggtgga

SEQ ID NO: 63913 - DNA, 21 bp, Artificial Sequence
  Description of Artificial Sequence: Synthetic oligonucleotide
gcagaggcgggcagcggtgga

SEQ ID NO: 63914 - DNA, 22 bp, Artificial Sequence
  Description of Artificial Sequence: Synthetic oligonucleotide
cagaggcgggcagcggtggaca

SEQ ID NO: 63915 - DNA, 22 bp, Artificial Sequence
  Description of Artificial Sequence: Synthetic oligonucleotide
agaggcgggcagcggtggacac

SEQ ID NO: 63916 - DNA, 21 bp, Artificial Sequence
  Description of Artificial Sequence: Synthetic oligonucleotide
gaggcgggcagcggtggacac

SEQ ID NO: 63917 - DNA, 23 bp, Artificial Sequence
  Description of Artificial Sequence: Synthetic oligonucleotide
aggcgggcagcggtggacaccta

SEQ ID NO: 63918 - DNA, 22 bp, Artificial Sequence
  Description of Artificial Sequence: Synthetic oligonucleotide
ggcgggcagcggtggacaccta

SEQ ID NO: 63919 - DNA, 23 bp, Artificial Sequence
  Description of Artificial Sequence: Synthetic oligonucleotide
gcgggcagcggtggacacctact

SEQ ID NO: 63920 - DNA, 23 bp, Artificial Sequence
  Description of Artificial Sequence: Synthetic oligonucleotide
cgggcagcggtggacacctactg

SEQ ID NO: 63921 - DNA, 24 bp, Artificial Sequence
  Description of Artificial Sequence: Synthetic oligonucleotide
gggcagcggtggacacctactgca

SEQ ID NO: 63922 - DNA, 25 bp, Artificial Sequence
  Description of Artificial Sequence: Synthetic oligonucleotide
ggcagcggtggacacctactgcaga

SEQ ID NO: 63923 - DNA, 26 bp, Artificial Sequence
  Description of Artificial Sequence: Synthetic oligonucleotide
gcagcggtggacacctactgcagaca

SEQ ID NO: 63924 - DNA, 27 bp, Artificial Sequence
  Description of Artificial Sequence: Synthetic oligonucleotide
cagcggtggacacctactgcagacaca

SEQ ID NO: 63925 - DNA, 28 bp, Artificial Sequence
  Description of Artificial Sequence: Synthetic oligonucleotide
agcggtggacacctactgcagacacaac

SEQ ID NO: 63926 - DNA, 21 bp, Artificial Sequence
  Description of Artificial Sequence: Synthetic oligonucleotide
gagctggggcggcctgatgcg

SEQ ID NO: 63927 - DNA, 22 bp, Artificial Sequence
  Description of Artificial Sequence: Synthetic oligonucleotide
agctggggcggcctgatgcgga

SEQ ID NO: 63928 - DNA, 21 bp, Artificial Sequence
  Description of Artificial Sequence: Synthetic oligonucleotide
gctggggcggcctgatgcgga

SEQ ID NO: 63929 - DNA, 23 bp, Artificial Sequence
  Description of Artificial Sequence: Synthetic oligonucleotide
ctggggcggcctgatgcggagta

SEQ ID NO: 63930 - DNA, 24 bp, Artificial Sequence
  Description of Artificial Sequence: Synthetic oligonucleotide
tggggcggcctgatgcggagtact

SEQ ID NO: 63931 - DNA, 23 bp, Artificial Sequence
  Description of Artificial Sequence: Synthetic oligonucleotide
ggggcggcctgatgcggagtact

SEQ ID NO: 63932 - DNA, 23 bp, Artificial Sequence
  Description of Artificial Sequence: Synthetic oligonucleotide
gggcggcctgatgcggagtactg

SEQ ID NO: 63933 - DNA, 25 bp, Artificial Sequence
  Description of Artificial Sequence: Synthetic oligonucleotide
ggcggcctgatgcggagtactggaa

SEQ ID NO: 63934 - DNA, 26 bp, Artificial Sequence
  Description of Artificial Sequence: Synthetic oligonucleotide
gcggcctgatgcggagtactggaaca

SEQ ID NO: 63935 - DNA, 26 bp, Artificial Sequence
  Description of Artificial Sequence: Synthetic oligonucleotide
cggcctgatgcggagtactggaacag

SEQ ID NO: 63936 - DNA, 26 bp, Artificial Sequence
  Description of Artificial Sequence: Synthetic oligonucleotide
ggcctgatgcggagtactggaacagc

SEQ ID NO: 63937 - DNA, 27 bp, Artificial Sequence
  Description of Artificial Sequence: Synthetic oligonucleotide
gcctgatgcggagtactggaacagcca

SEQ ID NO: 63938 - DNA, 27 bp, Artificial Sequence
  Description of Artificial Sequence: Synthetic oligonucleotide
cctgatgcggagtactggaacagccag

SEQ ID NO: 63939 - DNA, 29 bp, Artificial Sequence
  Description of Artificial Sequence: Synthetic oligonucleotide
ctgatgcggagtactggaacagccagaag

SEQ ID NO: 63940 - DNA, 29 bp, Artificial Sequence
  Description of Artificial Sequence: Synthetic oligonucleotide
tgatgcggagtactggaacagccagaagg

SEQ ID NO: 63941 - DNA, 28 bp, Artificial Sequence
  Description of Artificial Sequence: Synthetic oligonucleotide
gatgcggagtactggaacagccagaagg

SEQ ID NO: 63942 - DNA, 29 bp, Artificial Sequence
  Description of Artificial Sequence: Synthetic oligonucleotide
atgcggagtactggaacagccagaaggac

SEQ ID NO: 63943 - DNA, 26 bp, Artificial Sequence
  Description of Artificial Sequence: Synthetic oligonucleotide
agtccgtgcgcttcgacagcgacgtt

SEQ ID NO: 63944 - DNA, 25 bp, Artificial Sequence
  Description of Artificial Sequence: Synthetic oligonucleotide
gtccgtgcgcttcgacagcgacgtt

SEQ ID NO: 63945 - DNA, 25 bp, Artificial Sequence
  Description of Artificial Sequence: Synthetic oligonucleotide
tccgtgcgcttcgacagcgacgttg

SEQ ID NO: 63946 - DNA, 24 bp, Artificial Sequence
  Description of Artificial Sequence: Synthetic oligonucleotide
ccgtgcgcttcgacagcgacgttg

SEQ ID NO: 63947 - DNA, 24 bp, Artificial Sequence
  Description of Artificial Sequence: Synthetic oligonucleotide
cgtgcgcttcgacagcgacgttgg

SEQ ID NO: 63948 - DNA, 24 bp, Artificial Sequence
  Description of Artificial Sequence: Synthetic oligonucleotide
gtgcgcttcgacagcgacgttggg

SEQ ID NO: 63949 - DNA, 25 bp, Artificial Sequence
  Description of Artificial Sequence: Synthetic oligonucleotide
tgcgcttcgacagcgacgttgggga

SEQ ID NO: 63950 - DNA, 24 bp, Artificial Sequence
  Description of Artificial Sequence: Synthetic oligonucleotide
gcgcttcgacagcgacgttgggga

SEQ ID NO: 63951 - DNA, 26 bp, Artificial Sequence
  Description of Artificial Sequence: Synthetic oligonucleotide
cgcttcgacagcgacgttggggagta

SEQ ID NO: 63952 - DNA, 26 bp, Artificial Sequence
  Description of Artificial Sequence: Synthetic oligonucleotide
gcttcgacagcgacgttggggagtac

SEQ ID NO: 63953 - DNA, 26 bp, Artificial Sequence
  Description of Artificial Sequence: Synthetic oligonucleotide
cttcgacagcgacgttggggagtacc

SEQ ID NO: 63954 - DNA, 26 bp, Artificial Sequence
  Description of Artificial Sequence: Synthetic oligonucleotide
ttcgacagcgacgttggggagtaccg

SEQ ID NO: 63955 - DNA, 25 bp, Artificial Sequence
  Description of Artificial Sequence: Synthetic oligonucleotide
tcgacagcgacgttggggagtaccg

SEQ ID NO: 63956 - DNA, 24 bp, Artificial Sequence
  Description of Artificial Sequence: Synthetic oligonucleotide
cgacagcgacgttggggagtaccg

SEQ ID NO: 63957 - DNA, 24 bp, Artificial Sequence
  Description of Artificial Sequence: Synthetic oligonucleotide
gacagcgacgttggggagtaccgg

SEQ ID NO: 63958 - DNA, 24 bp, Artificial Sequence
  Description of Artificial Sequence: Synthetic oligonucleotide
acagcgacgttggggagtaccggg

SEQ ID NO: 63959 - DNA, 23 bp, Artificial Sequence
  Description of Artificial Sequence: Synthetic oligonucleotide
cagcgacgttggggagtaccggg

SEQ ID NO: 63960 - DNA, 23 bp, Artificial Sequence
  Description of Artificial Sequence: Synthetic oligonucleotide
agcgacgttggggagtaccgggc

SEQ ID NO: 63961 - DNA, 22 bp, Artificial Sequence
  Description of Artificial Sequence: Synthetic oligonucleotide
gcgacgttggggagtaccgggc

SEQ ID NO: 63962 - DNA, 22 bp, Artificial Sequence
  Description of Artificial Sequence: Synthetic oligonucleotide
cgacgttggggagtaccgggcg

SEQ ID NO: 63963 - DNA, 23 bp, Artificial Sequence
  Description of Artificial Sequence: Synthetic oligonucleotide
gacgttggggagtaccgggcggt

SEQ ID NO: 63964 - DNA, 24 bp, Artificial Sequence
  Description of Artificial Sequence: Synthetic oligonucleotide
acgttggggagtaccgggcggtga

SEQ ID NO: 63965 - DNA, 23 bp, Artificial Sequence
  Description of Artificial Sequence: Synthetic oligonucleotide
cgttggggagtaccgggcggtga

SEQ ID NO: 63966 - DNA, 23 bp, Artificial Sequence
  Description of Artificial Sequence: Synthetic oligonucleotide
gttggggagtaccgggcggtgac

SEQ ID NO: 63967 - DNA, 23 bp, Artificial Sequence
  Description of Artificial Sequence: Synthetic oligonucleotide
ttggggagtaccgggcggtgacg

SEQ ID NO: 63968 - DNA, 22 bp, Artificial Sequence
  Description of Artificial Sequence: Synthetic oligonucleotide
tggggagtaccgggcggtgacg

SEQ ID NO: 63969 - DNA, 20 bp, Artificial Sequence
  Description of Artificial Sequence: Synthetic oligonucleotide
ggagctggggcggcctgacg

SEQ ID NO: 63970 - DNA, 21 bp, Artificial Sequence
  Description of Artificial Sequence: Synthetic oligonucleotide
gagctggggcggcctgacgct

SEQ ID NO: 63971 - DNA, 22 bp, Artificial Sequence
  Description of Artificial Sequence: Synthetic oligonucleotide
agctggggcggcctgacgctga

SEQ ID NO: 63972 - DNA, 21 bp, Artificial Sequence
  Description of Artificial Sequence: Synthetic oligonucleotide
gctggggcggcctgacgctga

SEQ ID NO: 63973 - DNA, 23 bp, Artificial Sequence
  Description of Artificial Sequence: Synthetic oligonucleotide
ctggggcggcctgacgctgagta

SEQ ID NO: 63974 - DNA, 24 bp, Artificial Sequence
  Description of Artificial Sequence: Synthetic oligonucleotide
tggggcggcctgacgctgagtact

SEQ ID NO: 63975 - DNA, 23 bp, Artificial Sequence
  Description of Artificial Sequence: Synthetic oligonucleotide
ggggcggcctgacgctgagtact

SEQ ID NO: 63976 - DNA, 23 bp, Artificial Sequence
  Description of Artificial Sequence: Synthetic oligonucleotide
gggcggcctgacgctgagtactg

SEQ ID NO: 63977 - DNA, 25 bp, Artificial Sequence
  Description of Artificial Sequence: Synthetic oligonucleotide
ggcggcctgacgctgagtactggaa

SEQ ID NO: 63978 - DNA, 26 bp, Artificial Sequence
  Description of Artificial Sequence: Synthetic oligonucleotide
gcggcctgacgctgagtactggaaca

SEQ ID NO: 63979 - DNA, 26 bp, Artificial Sequence
  Description of Artificial Sequence: Synthetic oligonucleotide
cggcctgacgctgagtactggaacag

SEQ ID NO: 63980 - DNA, 26 bp, Artificial Sequence
  Description of Artificial Sequence: Synthetic oligonucleotide
ggcctgacgctgagtactggaacagc

SEQ ID NO: 63981 - DNA, 27 bp, Artificial Sequence
  Description of Artificial Sequence: Synthetic oligonucleotide
gcctgacgctgagtactggaacagcca

SEQ ID NO: 63982 - DNA, 27 bp, Artificial Sequence
  Description of Artificial Sequence: Synthetic oligonucleotide
cctgacgctgagtactggaacagccag

SEQ ID NO: 63983 - DNA, 29 bp, Artificial Sequence
  Description of Artificial Sequence: Synthetic oligonucleotide
ctgacgctgagtactggaacagccagaag

SEQ ID NO: 63984 - DNA, 29 bp, Artificial Sequence
  Description of Artificial Sequence: Synthetic oligonucleotide
tgacgctgagtactggaacagccagaagg

SEQ ID NO: 63985 - DNA, 28 bp, Artificial Sequence
  Description of Artificial Sequence: Synthetic oligonucleotide
gacgctgagtactggaacagccagaagg

SEQ ID NO: 63986 - DNA, 29 bp, Artificial Sequence
  Description of Artificial Sequence: Synthetic oligonucleotide
acgctgagtactggaacagccagaaggac

SEQ ID NO: 63987 - DNA, 28 bp, Artificial Sequence
  Description of Artificial Sequence: Synthetic oligonucleotide
cgctgagtactggaacagccagaaggac

SEQ ID NO: 63988 - DNA, 28 bp, Artificial Sequence
  Description of Artificial Sequence: Synthetic oligonucleotide
gctgagtactggaacagccagaaggacc

SEQ ID NO: 63989 - DNA, 29 bp, Artificial Sequence
  Description of Artificial Sequence: Synthetic oligonucleotide
ctgagtactggaacagccagaaggacctc

SEQ ID NO: 63990 - DNA, 29 bp, Artificial Sequence
  Description of Artificial Sequence: Synthetic oligonucleotide
tgagtactggaacagccagaaggacctcc

SEQ ID NO: 63991 - DNA, 23 bp, Artificial Sequence
  Description of Artificial Sequence: Synthetic oligonucleotide
gcgggccgcggtggacacctatt

SEQ ID NO: 63992 - DNA, 23 bp, Artificial Sequence
  Description of Artificial Sequence: Synthetic oligonucleotide
cgggccgcggtggacacctattg

SEQ ID NO: 63993 - DNA, 24 bp, Artificial Sequence
  Description of Artificial Sequence: Synthetic oligonucleotide
gggccgcggtggacacctattgca

SEQ ID NO: 63994 - DNA, 25 bp, Artificial Sequence
  Description of Artificial Sequence: Synthetic oligonucleotide
ggccgcggtggacacctattgcaga

SEQ ID NO: 63995 - DNA, 26 bp, Artificial Sequence
  Description of Artificial Sequence: Synthetic oligonucleotide
gccgcggtggacacctattgcagaca

SEQ ID NO: 63996 - DNA, 27 bp, Artificial Sequence
  Description of Artificial Sequence: Synthetic oligonucleotide
ccgcggtggacacctattgcagacaca

SEQ ID NO: 63997 - DNA, 28 bp, Artificial Sequence
  Description of Artificial Sequence: Synthetic oligonucleotide
cgcggtggacacctattgcagacacaac

SEQ ID NO: 63998 - DNA, 30 bp, Artificial Sequence
  Description of Artificial Sequence: Synthetic oligonucleotide
gcggtggacacctattgcagacacaactac

SEQ ID NO: 63999 - DNA, 30 bp, Artificial Sequence
  Description of Artificial Sequence: Synthetic oligonucleotide
cggtggacacctattgcagacacaactacg

SEQ ID NO: 64000 - DNA, 30 bp, Artificial Sequence
  Description of Artificial Sequence: Synthetic oligonucleotide
ggtggacacctattgcagacacaactacgg

SEQ ID NO: 64001 - DNA, 30 bp, Artificial Sequence
  Description of Artificial Sequence: Synthetic oligonucleotide
gtggacacctattgcagacacaactacggg

SEQ ID NO: 64002 - DNA, 30 bp, Artificial Sequence
  Description of Artificial Sequence: Synthetic oligonucleotide
tggacacctattgcagacacaactacgggg

SEQ ID NO: 64003 - DNA, 29 bp, Artificial Sequence
  Description of Artificial Sequence: Synthetic oligonucleotide
ggacacctattgcagacacaactacgggg

SEQ ID NO: 64004 - DNA, 29 bp, Artificial Sequence
  Description of Artificial Sequence: Synthetic oligonucleotide
gacacctattgcagacacaactacggggc

SEQ ID NO: 64005 - DNA, 30 bp, Artificial Sequence
  Description of Artificial Sequence: Synthetic oligonucleotide
acacctattgcagacacaactacggggctg

SEQ ID NO: 64006 - DNA, 29 bp, Artificial Sequence
  Description of Artificial Sequence: Synthetic oligonucleotide
cacctattgcagacacaactacggggctg

SEQ ID NO: 64007 - DNA, 30 bp, Artificial Sequence
  Description of Artificial Sequence: Synthetic oligonucleotide
acctattgcagacacaactacggggctgtg

SEQ ID NO: 64008 - DNA, 29 bp, Artificial Sequence
  Description of Artificial Sequence: Synthetic oligonucleotide
cctattgcagacacaactacggggctgtg

SEQ ID NO: 64009 - DNA, 29 bp, Artificial Sequence
  Description of Artificial Sequence: Synthetic oligonucleotide
ctattgcagacacaactacggggctgtgg

SEQ ID NO: 64010 - DNA, 30 bp, Artificial Sequence
  Description of Artificial Sequence: Synthetic oligonucleotide
tattgcagacacaactacggggctgtggag

SEQ ID NO: 64011 - DNA, 29 bp, Artificial Sequence
  Description of Artificial Sequence: Synthetic oligonucleotide
attgcagacacaactacggggctgtggag

SEQ ID NO: 64012 - DNA, 28 bp, Artificial Sequence
  Description of Artificial Sequence: Synthetic oligonucleotide
ttgcagacacaactacggggctgtggag

SEQ ID NO: 64013 - DNA, 27 bp, Artificial Sequence
  Description of Artificial Sequence: Synthetic oligonucleotide
tgcagacacaactacggggctgtggag

SEQ ID NO: 64014 - DNA, 27 bp, Artificial Sequence
  Description of Artificial Sequence: Synthetic oligonucleotide
gcagacacaactacggggctgtggaga

SEQ ID NO: 64015 - DNA, 27 bp, Artificial Sequence
  Description of Artificial Sequence: Synthetic oligonucleotide
cagacacaactacggggctgtggagag

SEQ ID NO: 64016 - DNA, 27 bp, Artificial Sequence
  Description of Artificial Sequence: Synthetic oligonucleotide
agacacaactacggggctgtggagagc

SEQ ID NO: 64017 - DNA, 27 bp, Artificial Sequence
  Description of Artificial Sequence: Synthetic oligonucleotide
gacacaactacggggctgtggagagct

SEQ ID NO: 64018 - DNA, 28 bp, Artificial Sequence
  Description of Artificial Sequence: Synthetic oligonucleotide
acacaactacggggctgtggagagcttc

SEQ ID NO: 64019 - DNA, 27 bp, Artificial Sequence
  Description of Artificial Sequence: Synthetic oligonucleotide
cacaactacggggctgtggagagcttc

SEQ ID NO: 64020 - DNA, 28 bp, Artificial Sequence
  Description of Artificial Sequence: Synthetic oligonucleotide
acaactacggggctgtggagagcttcac

SEQ ID NO: 64021 - DNA, 27 bp, Artificial Sequence
  Description of Artificial Sequence: Synthetic oligonucleotide
caactacggggctgtggagagcttcac

SEQ ID NO: 64022 - DNA, 28 bp, Artificial Sequence
  Description of Artificial Sequence: Synthetic oligonucleotide
aactacggggctgtggagagcttcacag

SEQ ID NO: 64023 - DNA, 27 bp, Artificial Sequence
  Description of Artificial Sequence: Synthetic oligonucleotide
actacggggctgtggagagcttcacag

SEQ ID NO: 64024 - DNA, 27 bp, Artificial Sequence
  Description of Artificial Sequence: Synthetic oligonucleotide
ctacggggctgtggagagcttcacagt

SEQ ID NO: 64025 - DNA, 27 bp, Artificial Sequence
  Description of Artificial Sequence: Synthetic oligonucleotide
tacggggctgtggagagcttcacagtg

SEQ ID NO: 64026 - DNA, 26 bp, Artificial Sequence
  Description of Artificial Sequence: Synthetic oligonucleotide
acggggctgtggagagcttcacagtg

SEQ ID NO: 64027 - DNA, 25 bp, Artificial Sequence
  Description of Artificial Sequence: Synthetic oligonucleotide
cggggctgtggagagcttcacagtg

SEQ ID NO: 64028 - DNA, 26 bp, Artificial Sequence
  Description of Artificial Sequence: Synthetic oligonucleotide
ggggctgtggagagcttcacagtgca

SEQ ID NO: 64029 - DNA, 26 bp, Artificial Sequence
  Description of Artificial Sequence: Synthetic oligonucleotide
gggctgtggagagcttcacagtgcag

SEQ ID NO: 64030 - DNA, 26 bp, Artificial Sequence
  Description of Artificial Sequence: Synthetic oligonucleotide
ggctgtggagagcttcacagtgcagc

SEQ ID NO: 64031 - DNA, 26 bp, Artificial Sequence
  Description of Artificial Sequence: Synthetic oligonucleotide
gctgtggagagcttcacagtgcagcg

SEQ ID NO: 64032 - DNA, 26 bp, Artificial Sequence
  Description of Artificial Sequence: Synthetic oligonucleotide
ctgtggagagcttcacagtgcagcgg

SEQ ID NO: 64033 - DNA, 26 bp, Artificial Sequence
  Description of Artificial Sequence: Synthetic oligonucleotide
tgtggagagcttcacagtgcagcggc

SEQ ID NO: 64034 - DNA, 25 bp, Artificial Sequence
  Description of Artificial Sequence: Synthetic oligonucleotide
gtggagagcttcacagtgcagcggc

SEQ ID NO: 64035 - DNA, 26 bp, Artificial Sequence
  Description of Artificial Sequence: Synthetic oligonucleotide
tggagagcttcacagtgcagcggcga

SEQ ID NO: 64036 - DNA, 25 bp, Artificial Sequence
  Description of Artificial Sequence: Synthetic oligonucleotide
ggagagcttcacagtgcagcggcga

SEQ ID NO: 64037 - DNA, 20 bp, Artificial Sequence
  Description of Artificial Sequence: Synthetic oligonucleotide
tggagcagaggcgggccgcc

SEQ ID NO: 64038 - DNA, 20 bp, Artificial Sequence
  Description of Artificial Sequence: Synthetic oligonucleotide
ggagcagaggcgggccgcct

SEQ ID NO: 64039 - DNA, 20 bp, Artificial Sequence
  Description of Artificial Sequence: Synthetic oligonucleotide
gagcagaggcgggccgccgt

SEQ ID NO: 64040 - DNA, 20 bp, Artificial Sequence
  Description of Artificial Sequence: Synthetic oligonucleotide
agcagaggcgggccgccgtg

SEQ ID NO: 64041 - DNA, 20 bp, Artificial Sequence
  Description of Artificial Sequence: Synthetic oligonucleotide
gcagaggcgggccgccgtgt

SEQ ID NO: 64042 - DNA, 20 bp, Artificial Sequence
  Description of Artificial Sequence: Synthetic oligonucleotide
cagaggcgggccgccgtgga

SEQ ID NO: 64043 - DNA, 21 bp, Artificial Sequence
  Description of Artificial Sequence: Synthetic oligonucleotide
agaggcgggccgccgtggaca

SEQ ID NO: 64044 - DNA, 20 bp, Artificial Sequence
  Description of Artificial Sequence: Synthetic oligonucleotide
gaggcgggccgccgtggaca

SEQ ID NO: 64045 - DNA, 20 bp, Artificial Sequence
  Description of Artificial Sequence: Synthetic oligonucleotide
aggcgggccgccgtggacac

SEQ ID NO: 64046 - DNA, 20 bp, Artificial Sequence
  Description of Artificial Sequence: Synthetic oligonucleotide
ggcgggccgccgtggacact

SEQ ID NO: 64047 - DNA, 23 bp, Artificial Sequence
  Description of Artificial Sequence: Synthetic oligonucleotide
gcgggccgccgtggacacctatt

SEQ ID NO: 64048 - DNA, 23 bp, Artificial Sequence
  Description of Artificial Sequence: Synthetic oligonucleotide
cgggccgccgtggacacctattg

SEQ ID NO: 64049 - DNA, 24 bp, Artificial Sequence
  Description of Artificial Sequence: Synthetic oligonucleotide
gggccgccgtggacacctattgca

SEQ ID NO: 64050 - DNA, 25 bp, Artificial Sequence
  Description of Artificial Sequence: Synthetic oligonucleotide
ggccgccgtggacacctattgcaga

SEQ ID NO: 64051 - DNA, 26 bp, Artificial Sequence
  Description of Artificial Sequence: Synthetic oligonucleotide
gccgccgtggacacctattgcagaca

SEQ ID NO: 64052 - DNA, 27 bp, Artificial Sequence
  Description of Artificial Sequence: Synthetic oligonucleotide
ccgccgtggacacctattgcagacaca

SEQ ID NO: 64053 - DNA, 28 bp, Artificial Sequence
  Description of Artificial Sequence: Synthetic oligonucleotide
cgccgtggacacctattgcagacacaac

SEQ ID NO: 64054 - DNA, 30 bp, Artificial Sequence
  Description of Artificial Sequence: Synthetic oligonucleotide
gccgtggacacctattgcagacacaactac

SEQ ID NO: 64055 - DNA, 30 bp, Artificial Sequence
  Description of Artificial Sequence: Synthetic oligonucleotide
ccgtggacacctattgcagacacaactacg

SEQ ID NO: 64056 - DNA, 30 bp, Artificial Sequence
  Description of Artificial Sequence: Synthetic oligonucleotide
cgtggacacctattgcagacacaactacgg

SEQ ID NO: 64057 - DNA, 33 bp, Artificial Sequence
  Description of Artificial Sequence: Synthetic oligonucleotide
gtgcggttgctggaaagatgcatctataaccag

SEQ ID NO: 64058 - DNA, 33 bp, Artificial Sequence
  Description of Artificial Sequence: Synthetic oligonucleotide
tgcggttgctggaaagatgcatctataaccagg

SEQ ID NO: 64059 - DNA, 32 bp, Artificial Sequence
  Description of Artificial Sequence: Synthetic oligonucleotide
gcggttgctggaaagatgcatctataaccagg

SEQ ID NO: 64060 - DNA, 33 bp, Artificial Sequence
  Description of Artificial Sequence: Synthetic oligonucleotide
cggttgctggaaagatgcatctataaccaggag

SEQ ID NO: 64061 - DNA, 33 bp, Artificial Sequence
  Description of Artificial Sequence: Synthetic oligonucleotide
ggttgctggaaagatgcatctataaccaggagg

SEQ ID NO: 64062 - DNA, 34 bp, Artificial Sequence
  Description of Artificial Sequence: Synthetic oligonucleotide
gttgctggaaagatgcatctataaccaggaggag

SEQ ID NO: 64063 - DNA, 35 bp, Artificial Sequence
  Description of Artificial Sequence: Synthetic oligonucleotide
ttgctggaaagatgcatctataaccaggaggagtc

SEQ ID NO: 64064 - DNA, 34 bp, Artificial Sequence
  Description of Artificial Sequence: Synthetic oligonucleotide
tgctggaaagatgcatctataaccaggaggagtc

SEQ ID NO: 64065 - DNA, 33 bp, Artificial Sequence
  Description of Artificial Sequence: Synthetic oligonucleotide
gctggaaagatgcatctataaccaggaggagtc

SEQ ID NO: 64066 - DNA, 33 bp, Artificial Sequence
  Description of Artificial Sequence: Synthetic oligonucleotide
ctggaaagatgcatctataaccaggaggagtcc

SEQ ID NO: 64067 - DNA, 33 bp, Artificial Sequence
  Description of Artificial Sequence: Synthetic oligonucleotide
tggaaagatgcatctataaccaggaggagtccg

SEQ ID NO: 64068 - DNA, 32 bp, Artificial Sequence
  Description of Artificial Sequence: Synthetic oligonucleotide
ggaaagatgcatctataaccaggaggagtccg

SEQ ID NO: 64069 - DNA, 33 bp, Artificial Sequence
  Description of Artificial Sequence: Synthetic oligonucleotide
gaaagatgcatctataaccaggaggagtccgtg

SEQ ID NO: 64070 - DNA, 33 bp, Artificial Sequence
  Description of Artificial Sequence: Synthetic oligonucleotide
aaagatgcatctataaccaggaggagtccgtgc

SEQ ID NO: 64071 - DNA, 32 bp, Artificial Sequence
  Description of Artificial Sequence: Synthetic oligonucleotide
aagatgcatctataaccaggaggagtccgtgc

SEQ ID NO: 64072 - DNA, 31 bp, Artificial Sequence
  Description of Artificial Sequence: Synthetic oligonucleotide
agatgcatctataaccaggaggagtccgtgc

SEQ ID NO: 64073 - DNA, 30 bp, Artificial Sequence
  Description of Artificial Sequence: Synthetic oligonucleotide
gatgcatctataaccaggaggagtccgtgc

SEQ ID NO: 64074 - DNA, 30 bp, Artificial Sequence
  Description of Artificial Sequence: Synthetic oligonucleotide
atgcatctataaccaggaggagtccgtgcg

SEQ ID NO: 64075 - DNA, 29 bp, Artificial Sequence
  Description of Artificial Sequence: Synthetic oligonucleotide
tgcatctataaccaggaggagtccgtgcg

SEQ ID NO: 64076 - DNA, 28 bp, Artificial Sequence
  Description of Artificial Sequence: Synthetic oligonucleotide
gcatctataaccaggaggagtccgtgcg

SEQ ID NO: 64077 - DNA, 28 bp, Artificial Sequence
  Description of Artificial Sequence: Synthetic oligonucleotide
catctataaccaggaggagtccgtgcgc

SEQ ID NO: 64078 - DNA, 30 bp, Artificial Sequence
  Description of Artificial Sequence: Synthetic oligonucleotide
atctataaccaggaggagtccgtgcgcttc

SEQ ID NO: 64079 - DNA, 29 bp, Artificial Sequence
  Description of Artificial Sequence: Synthetic oligonucleotide
tctataaccaggaggagtccgtgcgcttc

SEQ ID NO: 64080 - DNA, 28 bp, Artificial Sequence
  Description of Artificial Sequence: Synthetic oligonucleotide
ctataaccaggaggagtccgtgcgcttc

SEQ ID NO: 64081 - DNA, 28 bp, Artificial Sequence
  Description of Artificial Sequence: Synthetic oligonucleotide
tataaccaggaggagtccgtgcgcttcg

SEQ ID NO: 64082 - DNA, 27 bp, Artificial Sequence
  Description of Artificial Sequence: Synthetic oligonucleotide
ataaccaggaggagtccgtgcgcttcg

SEQ ID NO: 64083 - DNA, 27 bp, Artificial Sequence
  Description of Artificial Sequence: Synthetic oligonucleotide
taaccaggaggagtccgtgcgcttcga

SEQ ID NO: 64084 - DNA, 26 bp, Artificial Sequence
  Description of Artificial Sequence: Synthetic oligonucleotide
aaccaggaggagtccgtgcgcttcga

SEQ ID NO: 64085 - DNA, 25 bp, Artificial Sequence
  Description of Artificial Sequence: Synthetic oligonucleotide
accaggaggagtccgtgcgcttcga

SEQ ID NO: 64086 - DNA, 24 bp, Artificial Sequence
  Description of Artificial Sequence: Synthetic oligonucleotide
ccaggaggagtccgtgcgcttcga

SEQ ID NO: 64087 - DNA, 25 bp, Artificial Sequence
  Description of Artificial Sequence: Synthetic oligonucleotide
caggaggagtccgtgcgcttcgaca

SEQ ID NO: 64088 - DNA, 25 bp, Artificial Sequence
  Description of Artificial Sequence: Synthetic oligonucleotide
aggaggagtccgtgcgcttcgacag

SEQ ID NO: 64089 - DNA, 24 bp, Artificial Sequence
  Description of Artificial Sequence: Synthetic oligonucleotide
ggaggagtccgtgcgcttcgacag

SEQ ID NO: 64090 - DNA, 25 bp, Artificial Sequence
  Description of Artificial Sequence: Synthetic oligonucleotide
gagagcttcacagtgcagcggcgag

SEQ ID NO: 64091 - DNA, 22 bp, Artificial Sequence
  Description of Artificial Sequence: Synthetic oligonucleotide
ggagctggggcggcctgatgct

SEQ ID NO: 64092 - DNA, 23 bp, Artificial Sequence
  Description of Artificial Sequence: Synthetic oligonucleotide
gagctggggcggcctgatgctga

SEQ ID NO: 64093 - DNA, 25 bp, Artificial Sequence
  Description of Artificial Sequence: Synthetic oligonucleotide
agctggggcggcctgatgctgagta

SEQ ID NO: 64094 - DNA, 24 bp, Artificial Sequence
  Description of Artificial Sequence: Synthetic oligonucleotide
gctggggcggcctgatgctgagta

SEQ ID NO: 64095 - DNA, 25 bp, Artificial Sequence
  Description of Artificial Sequence: Synthetic oligonucleotide
ctggggcggcctgatgctgagtact

SEQ ID NO: 64096 - DNA, 25 bp, Artificial Sequence
  Description of Artificial Sequence: Synthetic oligonucleotide
tggggcggcctgatgctgagtactg

SEQ ID NO: 64097 - DNA, 24 bp, Artificial Sequence
  Description of Artificial Sequence: Synthetic oligonucleotide
ggggcggcctgatgctgagtactg

SEQ ID NO: 64098 - DNA, 26 bp, Artificial Sequence
  Description of Artificial Sequence: Synthetic oligonucleotide
gggcggcctgatgctgagtactggaa

SEQ ID NO: 64099 - DNA, 27 bp, Artificial Sequence
  Description of Artificial Sequence: Synthetic oligonucleotide
ggcggcctgatgctgagtactggaaca

SEQ ID NO: 64100 - DNA, 27 bp, Artificial Sequence
  Description of Artificial Sequence: Synthetic oligonucleotide
gcggcctgatgctgagtactggaacag

SEQ ID NO: 64101 - DNA, 27 bp, Artificial Sequence
  Description of Artificial Sequence: Synthetic oligonucleotide
cggcctgatgctgagtactggaacagc

SEQ ID NO: 64102 - DNA, 27 bp, Artificial Sequence
  Description of Artificial Sequence: Synthetic oligonucleotide
ggcctgatgctgagtactggaacagcc

SEQ ID NO: 64103 - DNA, 28 bp, Artificial Sequence
  Description of Artificial Sequence: Synthetic oligonucleotide
gcctgatgctgagtactggaacagccag

SEQ ID NO: 64104 - DNA, 30 bp, Artificial Sequence
  Description of Artificial Sequence: Synthetic oligonucleotide
cctgatgctgagtactggaacagccagaag

SEQ ID NO: 64105 - DNA, 30 bp, Artificial Sequence
  Description of Artificial Sequence: Synthetic oligonucleotide
ctgatgctgagtactggaacagccagaagg

SEQ ID NO: 64106 - DNA, 31 bp, Artificial Sequence
  Description of Artificial Sequence: Synthetic oligonucleotide
tgatgctgagtactggaacagccagaaggac

SEQ ID NO: 64107 - DNA, 30 bp, Artificial Sequence
  Description of Artificial Sequence: Synthetic oligonucleotide
gatgctgagtactggaacagccagaaggac

SEQ ID NO: 64108 - DNA, 30 bp, Artificial Sequence
  Description of Artificial Sequence: Synthetic oligonucleotide
atgctgagtactggaacagccagaaggacc

SEQ ID NO: 64109 - DNA, 29 bp, Artificial Sequence
  Description of Artificial Sequence: Synthetic oligonucleotide
tgctgagtactggaacagccagaaggacc

SEQ ID NO: 64110 - DNA, 31 bp, Artificial Sequence
  Description of Artificial Sequence: Synthetic oligonucleotide
tactggaacagccagaaggacatcctggaag

SEQ ID NO: 64111 - DNA, 30 bp, Artificial Sequence
  Description of Artificial Sequence: Synthetic oligonucleotide
actggaacagccagaaggacatcctggaag

SEQ ID NO: 64112 - DNA, 29 bp, Artificial Sequence
  Description of Artificial Sequence: Synthetic oligonucleotide
ctggaacagccagaaggacatcctggaag

SEQ ID NO: 64113 - DNA, 30 bp, Artificial Sequence
  Description of Artificial Sequence: Synthetic oligonucleotide
tggaacagccagaaggacatcctggaagac

SEQ ID NO: 64114 - DNA, 29 bp, Artificial Sequence
  Description of Artificial Sequence: Synthetic oligonucleotide
ggaacagccagaaggacatcctggaagac

SEQ ID NO: 64115 - DNA, 29 bp, Artificial Sequence
  Description of Artificial Sequence: Synthetic oligonucleotide
gaacagccagaaggacatcctggaagacg

SEQ ID NO: 64116 - DNA, 30 bp, Artificial Sequence
  Description of Artificial Sequence: Synthetic oligonucleotide
aacagccagaaggacatcctggaagacgag

SEQ ID NO: 64117 - DNA, 29 bp, Artificial Sequence
  Description of Artificial Sequence: Synthetic oligonucleotide
acagccagaaggacatcctggaagacgag

SEQ ID NO: 64118 - DNA, 28 bp, Artificial Sequence
  Description of Artificial Sequence: Synthetic oligonucleotide
cagccagaaggacatcctggaagacgag

SEQ ID NO: 64119 - DNA, 28 bp, Artificial Sequence
  Description of Artificial Sequence: Synthetic oligonucleotide
agccagaaggacatcctggaagacgagc

SEQ ID NO: 64120 - DNA, 27 bp, Artificial Sequence
  Description of Artificial Sequence: Synthetic oligonucleotide
gccagaaggacatcctggaagacgagc

SEQ ID NO: 64121 - DNA, 27 bp, Artificial Sequence
  Description of Artificial Sequence: Synthetic oligonucleotide
ccagaaggacatcctggaagacgagcg

SEQ ID NO: 64122 - DNA, 27 bp, Artificial Sequence
  Description of Artificial Sequence: Synthetic oligonucleotide
cagaaggacatcctggaagacgagcgg

SEQ ID NO: 64123 - DNA, 27 bp, Artificial Sequence
  Description of Artificial Sequence: Synthetic oligonucleotide
agaaggacatcctggaagacgagcggg

SEQ ID NO: 64124 - DNA, 26 bp, Artificial Sequence
  Description of Artificial Sequence: Synthetic oligonucleotide
gaaggacatcctggaagacgagcggg

SEQ ID NO: 64125 - DNA, 26 bp, Artificial Sequence
  Description of Artificial Sequence: Synthetic oligonucleotide
aaggacatcctggaagacgagcgggc

SEQ ID NO: 64126 - DNA, 25 bp, Artificial Sequence
  Description of Artificial Sequence: Synthetic oligonucleotide
aggacatcctggaagacgagcgggc

SEQ ID NO: 64127 - DNA, 24 bp, Artificial Sequence
  Description of Artificial Sequence: Synthetic oligonucleotide
ggacatcctggaagacgagcgggc

SEQ ID NO: 64128 - DNA, 24 bp, Artificial Sequence
  Description of Artificial Sequence: Synthetic oligonucleotide
gacatcctggaagacgagcgggcc

SEQ ID NO: 64129 - DNA, 24 bp, Artificial Sequence
  Description of Artificial Sequence: Synthetic oligonucleotide
acatcctggaagacgagcgggccg

SEQ ID NO: 64130 - DNA, 23 bp, Artificial Sequence
  Description of Artificial Sequence: Synthetic oligonucleotide
catcctggaagacgagcgggccg

SEQ ID NO: 64131 - DNA, 23 bp, Artificial Sequence
  Description of Artificial Sequence: Synthetic oligonucleotide
atcctggaagacgagcgggccgc

SEQ ID NO: 64132 - DNA, 22 bp, Artificial Sequence
  Description of Artificial Sequence: Synthetic oligonucleotide
tcctggaagacgagcgggccgc

SEQ ID NO: 64133 - DNA, 21 bp, Artificial Sequence
  Description of Artificial Sequence: Synthetic oligonucleotide
cctggaagacgagcgggccgc

SEQ ID NO: 64134 - DNA, 21 bp, Artificial Sequence
  Description of Artificial Sequence: Synthetic oligonucleotide
ctggaagacgagcgggccgcg

SEQ ID NO: 64135 - DNA, 22 bp, Artificial Sequence
  Description of Artificial Sequence: Synthetic oligonucleotide
tggaagacgagcgggccgcggt

SEQ ID NO: 64136 - DNA, 21 bp, Artificial Sequence
  Description of Artificial Sequence: Synthetic oligonucleotide
ggaagacgagcgggccgcggt

SEQ ID NO: 64137 - DNA, 21 bp, Artificial Sequence
  Description of Artificial Sequence: Synthetic oligonucleotide
gaagacgagcgggccgcggtg

SEQ ID NO: 64138 - DNA, 22 bp, Artificial Sequence
  Description of Artificial Sequence: Synthetic oligonucleotide
aagacgagcgggccgcggtgga

SEQ ID NO: 64139 - DNA, 21 bp, Artificial Sequence
  Description of Artificial Sequence: Synthetic oligonucleotide
agacgagcgggccgcggtgga

SEQ ID NO: 64140 - DNA, 20 bp, Artificial Sequence
  Description of Artificial Sequence: Synthetic oligonucleotide
gacgagcgggccgcggtgga

SEQ ID NO: 64141 - DNA, 21 bp, Artificial Sequence
  Description of Artificial Sequence: Synthetic oligonucleotide
acgagcgggccgcggtggaca

SEQ ID NO: 64142 - DNA, 20 bp, Artificial Sequence
  Description of Artificial Sequence: Synthetic oligonucleotide
cgagcgggccgcggtggaca

SEQ ID NO: 64143 - DNA, 20 bp, Artificial Sequence
  Description of Artificial Sequence: Synthetic oligonucleotide
gagcgggccgcggtggacac

SEQ ID NO: 64144 - DNA, 22 bp, Artificial Sequence
  Description of Artificial Sequence: Synthetic oligonucleotide
agcgggccgcggtggacaccta

SEQ ID NO: 64145 - DNA, 25 bp, Artificial Sequence
  Description of Artificial Sequence: Synthetic oligonucleotide
agaggcgggccgcggtggacaatta

SEQ ID NO: 64146 - DNA, 24 bp, Artificial Sequence
  Description of Artificial Sequence: Synthetic oligonucleotide
gaggcgggccgcggtggacaatta

SEQ ID NO: 64147 - DNA, 25 bp, Artificial Sequence
  Description of Artificial Sequence: Synthetic oligonucleotide
aggcgggccgcggtggacaattact

SEQ ID NO: 64148 - DNA, 24 bp, Artificial Sequence
  Description of Artificial Sequence: Synthetic oligonucleotide
ggcgggccgcggtggacaattact

SEQ ID NO: 64149 - DNA, 24 bp, Artificial Sequence
  Description of Artificial Sequence: Synthetic oligonucleotide
gcgggccgcggtggacaattactg

SEQ ID NO: 64150 - DNA, 25 bp, Artificial Sequence
  Description of Artificial Sequence: Synthetic oligonucleotide
cgggccgcggtggacaattactgca

SEQ ID NO: 64151 - DNA, 26 bp, Artificial Sequence
  Description of Artificial Sequence: Synthetic oligonucleotide
gggccgcggtggacaattactgcaga

SEQ ID NO: 64152 - DNA, 27 bp, Artificial Sequence
  Description of Artificial Sequence: Synthetic oligonucleotide
ggccgcggtggacaattactgcagaca

SEQ ID NO: 64153 - DNA, 27 bp, Artificial Sequence
  Description of Artificial Sequence: Synthetic oligonucleotide
gccgcggtggacaattactgcagacac

SEQ ID NO: 64154 - DNA, 29 bp, Artificial Sequence
  Description of Artificial Sequence: Synthetic oligonucleotide
ccgcggtggacaattactgcagacacaac

SEQ ID NO: 64155 - DNA, 31 bp, Artificial Sequence
  Description of Artificial Sequence: Synthetic oligonucleotide
cgcggtggacaattactgcagacacaactac

SEQ ID NO: 64156 - DNA, 31 bp, Artificial Sequence
  Description of Artificial Sequence: Synthetic oligonucleotide
gcggtggacaattactgcagacacaactacg

SEQ ID NO: 64157 - DNA, 31 bp, Artificial Sequence
  Description of Artificial Sequence: Synthetic oligonucleotide
cggtggacaattactgcagacacaactacgg

SEQ ID NO: 64158 - DNA, 31 bp, Artificial Sequence
  Description of Artificial Sequence: Synthetic oligonucleotide
ggtggacaattactgcagacacaactacggg

SEQ ID NO: 64159 - DNA, 31 bp, Artificial Sequence
  Description of Artificial Sequence: Synthetic oligonucleotide
gtggacaattactgcagacacaactacgggg

SEQ ID NO: 64160 - DNA, 33 bp, Artificial Sequence
  Description of Artificial Sequence: Synthetic oligonucleotide
tggacaattactgcagacacaactacggggttg

SEQ ID NO: 64161 - DNA, 32 bp, Artificial Sequence
  Description of Artificial Sequence: Synthetic oligonucleotide
ggacaattactgcagacacaactacggggttg

SEQ ID NO: 64162 - DNA, 33 bp, Artificial Sequence
  Description of Artificial Sequence: Synthetic oligonucleotide
gacaattactgcagacacaactacggggttgtg

SEQ ID NO: 64163 - DNA, 33 bp, Artificial Sequence
  Description of Artificial Sequence: Synthetic oligonucleotide
acaattactgcagacacaactacggggttgtgg

SEQ ID NO: 64164 - DNA, 32 bp, Artificial Sequence
  Description of Artificial Sequence: Synthetic oligonucleotide
caattactgcagacacaactacggggttgtgg

SEQ ID NO: 64165 - DNA, 33 bp, Artificial Sequence
  Description of Artificial Sequence: Synthetic oligonucleotide
aattactgcagacacaactacggggttgtggag

SEQ ID NO: 64166 - DNA, 32 bp, Artificial Sequence
  Description of Artificial Sequence: Synthetic oligonucleotide
attactgcagacacaactacggggttgtggag

SEQ ID NO: 64167 - DNA, 31 bp, Artificial Sequence
  Description of Artificial Sequence: Synthetic oligonucleotide
ttactgcagacacaactacggggttgtggag

SEQ ID NO: 64168 - DNA, 30 bp, Artificial Sequence
  Description of Artificial Sequence: Synthetic oligonucleotide
tactgcagacacaactacggggttgtggag

SEQ ID NO: 64169 - DNA, 29 bp, Artificial Sequence
  Description of Artificial Sequence: Synthetic oligonucleotide
actgcagacacaactacggggttgtggag

SEQ ID NO: 64170 - DNA, 28 bp, Artificial Sequence
  Description of Artificial Sequence: Synthetic oligonucleotide
ctgcagacacaactacggggttgtggag

SEQ ID NO: 64171 - DNA, 29 bp, Artificial Sequence
  Description of Artificial Sequence: Synthetic oligonucleotide
tgcagacacaactacggggttgtggagag

SEQ ID NO: 64172 - DNA, 28 bp, Artificial Sequence
  Description of Artificial Sequence: Synthetic oligonucleotide
gcagacacaactacggggttgtggagag

SEQ ID NO: 64173 - DNA, 28 bp, Artificial Sequence
  Description of Artificial Sequence: Synthetic oligonucleotide
cagacacaactacggggttgtggagagc

SEQ ID NO: 64174 - DNA, 30 bp, Artificial Sequence
  Description of Artificial Sequence: Synthetic oligonucleotide
agacacaactacggggttgtggagagcttc

SEQ ID NO: 64175 - DNA, 29 bp, Artificial Sequence
  Description of Artificial Sequence: Synthetic oligonucleotide
gacacaactacggggttgtggagagcttc

SEQ ID NO: 64176 - DNA, 30 bp, Artificial Sequence
  Description of Artificial Sequence: Synthetic oligonucleotide
acacaactacggggttgtggagagcttcac

SEQ ID NO: 64177 - DNA, 29 bp, Artificial Sequence
  Description of Artificial Sequence: Synthetic oligonucleotide
cacaactacggggttgtggagagcttcac

SEQ ID NO: 64178 - DNA, 30 bp, Artificial Sequence
  Description of Artificial Sequence: Synthetic oligonucleotide
acaactacggggttgtggagagcttcacag

SEQ ID NO: 64179 - DNA, 29 bp, Artificial Sequence
  Description of Artificial Sequence: Synthetic oligonucleotide
caactacggggttgtggagagcttcacag

SEQ ID NO: 64180 - DNA, 30 bp, Artificial Sequence
  Description of Artificial Sequence: Synthetic oligonucleotide
aactacggggttgtggagagcttcacagtg

SEQ ID NO: 64181 - DNA, 29 bp, Artificial Sequence
  Description of Artificial Sequence: Synthetic oligonucleotide
actacggggttgtggagagcttcacagtg

SEQ ID NO: 64182 - DNA, 28 bp, Artificial Sequence
  Description of Artificial Sequence: Synthetic oligonucleotide
ctacggggttgtggagagcttcacagtg

SEQ ID NO: 64183 - DNA, 28 bp, Artificial Sequence
  Description of Artificial Sequence: Synthetic oligonucleotide
tacggggttgtggagagcttcacagtgc

SEQ ID NO: 64184 - DNA, 27 bp, Artificial Sequence
  Description of Artificial Sequence: Synthetic oligonucleotide
acggggttgtggagagcttcacagtgc

SEQ ID NO: 64185 - DNA, 27 bp, Artificial Sequence
  Description of Artificial Sequence: Synthetic oligonucleotide
cggggttgtggagagcttcacagtgca

SEQ ID NO: 64186 - DNA, 27 bp, Artificial Sequence
  Description of Artificial Sequence: Synthetic oligonucleotide
ggggttgtggagagcttcacagtgcag

SEQ ID NO: 64187 - DNA, 27 bp, Artificial Sequence
  Description of Artificial Sequence: Synthetic oligonucleotide
gggttgtggagagcttcacagtgcagc

SEQ ID NO: 64188 - DNA, 27 bp, Artificial Sequence
  Description of Artificial Sequence: Synthetic oligonucleotide
ggttgtggagagcttcacagtgcagcg

SEQ ID NO: 64189 - DNA, 27 bp, Artificial Sequence
  Description of Artificial Sequence: Synthetic oligonucleotide
gttgtggagagcttcacagtgcagcgg

SEQ ID NO: 64190 - DNA, 27 bp, Artificial Sequence
  Description of Artificial Sequence: Synthetic oligonucleotide
ttgtggagagcttcacagtgcagcggc

SEQ ID NO: 64191 - DNA, 25 bp, Artificial Sequence
  Description of Artificial Sequence: Synthetic oligonucleotide
tccgtgcgcttcgacagcgacgtga

SEQ ID NO: 64192 - DNA, 24 bp, Artificial Sequence
  Description of Artificial Sequence: Synthetic oligonucleotide
ccgtgcgcttcgacagcgacgtga

SEQ ID NO: 64193 - DNA, 24 bp, Artificial Sequence
  Description of Artificial Sequence: Synthetic oligonucleotide
cgtgcgcttcgacagcgacgtgag

SEQ ID NO: 64194 - DNA, 24 bp, Artificial Sequence
  Description of Artificial Sequence: Synthetic oligonucleotide
gtgcgcttcgacagcgacgtgagg

SEQ ID NO: 64195 - DNA, 25 bp, Artificial Sequence
  Description of Artificial Sequence: Synthetic oligonucleotide
tgcgcttcgacagcgacgtgaggga

SEQ ID NO: 64196 - DNA, 24 bp, Artificial Sequence
  Description of Artificial Sequence: Synthetic oligonucleotide
gcgcttcgacagcgacgtgaggga

SEQ ID NO: 64197 - DNA, 26 bp, Artificial Sequence
  Description of Artificial Sequence: Synthetic oligonucleotide
cgcttcgacagcgacgtgagggagta

SEQ ID NO: 64198 - DNA, 26 bp, Artificial Sequence
  Description of Artificial Sequence: Synthetic oligonucleotide
gcttcgacagcgacgtgagggagtac

SEQ ID NO: 64199 - DNA, 26 bp, Artificial Sequence
  Description of Artificial Sequence: Synthetic oligonucleotide
cttcgacagcgacgtgagggagtacc

SEQ ID NO: 64200 - DNA, 26 bp, Artificial Sequence
  Description of Artificial Sequence: Synthetic oligonucleotide
ttcgacagcgacgtgagggagtaccg

SEQ ID NO: 64201 - DNA, 25 bp, Artificial Sequence
  Description of Artificial Sequence: Synthetic oligonucleotide
tcgacagcgacgtgagggagtaccg

SEQ ID NO: 64202 - DNA, 24 bp, Artificial Sequence
  Description of Artificial Sequence: Synthetic oligonucleotide
cgacagcgacgtgagggagtaccg

SEQ ID NO: 64203 - DNA, 24 bp, Artificial Sequence
  Description of Artificial Sequence: Synthetic oligonucleotide
gacagcgacgtgagggagtaccgg

SEQ ID NO: 64204 - DNA, 24 bp, Artificial Sequence
  Description of Artificial Sequence: Synthetic oligonucleotide
acagcgacgtgagggagtaccggg

SEQ ID NO: 64205 - DNA, 23 bp, Artificial Sequence
  Description of Artificial Sequence: Synthetic oligonucleotide
cagcgacgtgagggagtaccggg

SEQ ID NO: 64206 - DNA, 23 bp, Artificial Sequence
  Description of Artificial Sequence: Synthetic oligonucleotide
agcgacgtgagggagtaccgggc

SEQ ID NO: 64207 - DNA, 22 bp, Artificial Sequence
  Description of Artificial Sequence: Synthetic oligonucleotide
gcgacgtgagggagtaccgggc

SEQ ID NO: 64208 - DNA, 22 bp, Artificial Sequence
  Description of Artificial Sequence: Synthetic oligonucleotide
cgacgtgagggagtaccgggcg

SEQ ID NO: 64209 - DNA, 23 bp, Artificial Sequence
  Description of Artificial Sequence: Synthetic oligonucleotide
gacgtgagggagtaccgggcggt

SEQ ID NO: 64210 - DNA, 24 bp, Artificial Sequence
  Description of Artificial Sequence: Synthetic oligonucleotide
acgtgagggagtaccgggcggtga

SEQ ID NO: 64211 - DNA, 23 bp, Artificial Sequence
  Description of Artificial Sequence: Synthetic oligonucleotide
cgtgagggagtaccgggcggtga

SEQ ID NO: 64212 - DNA, 23 bp, Artificial Sequence
  Description of Artificial Sequence: Synthetic oligonucleotide
gtgagggagtaccgggcggtgac

SEQ ID NO: 64213 - DNA, 23 bp, Artificial Sequence
  Description of Artificial Sequence: Synthetic oligonucleotide
tgagggagtaccgggcggtgacg

SEQ ID NO: 64214 - DNA, 22 bp, Artificial Sequence
  Description of Artificial Sequence: Synthetic oligonucleotide
gagggagtaccgggcggtgacg

SEQ ID NO: 64215 - DNA, 23 bp, Artificial Sequence
  Description of Artificial Sequence: Synthetic oligonucleotide
agggagtaccgggcggtgacgga

SEQ ID NO: 64216 - DNA, 26 bp, Artificial Sequence
  Description of Artificial Sequence: Synthetic oligonucleotide
acagccagaaggacctcctggagcag

SEQ ID NO: 64217 - DNA, 25 bp, Artificial Sequence
  Description of Artificial Sequence: Synthetic oligonucleotide
cagccagaaggacctcctggagcag

SEQ ID NO: 64218 - DNA, 25 bp, Artificial Sequence
  Description of Artificial Sequence: Synthetic oligonucleotide
agccagaaggacctcctggagcagg

SEQ ID NO: 64219 - DNA, 24 bp, Artificial Sequence
  Description of Artificial Sequence: Synthetic oligonucleotide
gccagaaggacctcctggagcagg

SEQ ID NO: 64220 - DNA, 24 bp, Artificial Sequence
  Description of Artificial Sequence: Synthetic oligonucleotide
ccagaaggacctcctggagcaggc

SEQ ID NO: 64221 - DNA, 24 bp, Artificial Sequence
  Description of Artificial Sequence: Synthetic oligonucleotide
cagaaggacctcctggagcaggcg

SEQ ID NO: 64222 - DNA, 24 bp, Artificial Sequence
  Description of Artificial Sequence: Synthetic oligonucleotide
agaaggacctcctggagcaggcgc

SEQ ID NO: 64223 - DNA, 23 bp, Artificial Sequence
  Description of Artificial Sequence: Synthetic oligonucleotide
gaaggacctcctggagcaggcgc

SEQ ID NO: 64224 - DNA, 23 bp, Artificial Sequence
  Description of Artificial Sequence: Synthetic oligonucleotide
aaggacctcctggagcaggcgcg

SEQ ID NO: 64225 - DNA, 22 bp, Artificial Sequence
  Description of Artificial Sequence: Synthetic oligonucleotide
aggacctcctggagcaggcgcg

SEQ ID NO: 64226 - DNA, 21 bp, Artificial Sequence
  Description of Artificial Sequence: Synthetic oligonucleotide
ggacctcctggagcaggcgcg

SEQ ID NO: 64227 - DNA, 21 bp, Artificial Sequence
  Description of Artificial Sequence: Synthetic oligonucleotide
gacctcctggagcaggcgcgg

SEQ ID NO: 64228 - DNA, 21 bp, Artificial Sequence
  Description of Artificial Sequence: Synthetic oligonucleotide
acctcctggagcaggcgcggg

SEQ ID NO: 64229 - DNA, 20 bp, Artificial Sequence
  Description of Artificial Sequence: Synthetic oligonucleotide
cctcctggagcaggcgcggg

SEQ ID NO: 64230 - DNA, 20 bp, Artificial Sequence
  Description of Artificial Sequence: Synthetic oligonucleotide
ctcctggagcaggcgcgggc

SEQ ID NO: 64231 - DNA, 20 bp, Artificial Sequence
  Description of Artificial Sequence: Synthetic oligonucleotide
tcctggagcaggcgcgggcc

SEQ ID NO: 64232 - DNA, 20 bp, Artificial Sequence
  Description of Artificial Sequence: Synthetic oligonucleotide
cctggagcaggcgcgggcct

SEQ ID NO: 64233 - DNA, 20 bp, Artificial Sequence
  Description of Artificial Sequence: Synthetic oligonucleotide
ctggagcaggcgcgggccgt

SEQ ID NO: 64234 - DNA, 20 bp, Artificial Sequence
  Description of Artificial Sequence: Synthetic oligonucleotide
tggagcaggcgcgggccgct

SEQ ID NO: 64235 - DNA, 20 bp, Artificial Sequence
  Description of Artificial Sequence: Synthetic oligonucleotide
ggagcaggcgcgggccgctt

SEQ ID NO: 64236 - DNA, 20 bp, Artificial Sequence
  Description of Artificial Sequence: Synthetic oligonucleotide
gagcaggcgcgggccgcgtt

SEQ ID NO: 64237 - DNA, 20 bp, Artificial Sequence
  Description of Artificial Sequence: Synthetic oligonucleotide
agcaggcgcgggccgcggtt

SEQ ID NO: 64238 - DNA, 20 bp, Artificial Sequence
  Description of Artificial Sequence: Synthetic oligonucleotide
gcaggcgcgggccgcggttt

SEQ ID NO: 64239 - DNA, 20 bp, Artificial Sequence
  Description of Artificial Sequence: Synthetic oligonucleotide
caggcgcgggccgcggtgtt

SEQ ID NO: 64240 - DNA, 20 bp, Artificial Sequence
  Description of Artificial Sequence: Synthetic oligonucleotide
aggcgcgggccgcggtggat

SEQ ID NO: 64241 - DNA, 20 bp, Artificial Sequence
  Description of Artificial Sequence: Synthetic oligonucleotide
ggcgcgggccgcggtggatt

SEQ ID NO: 64242 - DNA, 20 bp, Artificial Sequence
  Description of Artificial Sequence: Synthetic oligonucleotide
gcgcgggccgcggtggacat

SEQ ID NO: 64243 - DNA, 20 bp, Artificial Sequence
  Description of Artificial Sequence: Synthetic oligonucleotide
cgcgggccgcggtggacact

SEQ ID NO: 64244 - DNA, 30 bp, Artificial Sequence
  Description of Artificial Sequence: Synthetic oligonucleotide
acctactgcagacacaactacggggttgtg

SEQ ID NO: 64245 - DNA, 29 bp, Artificial Sequence
  Description of Artificial Sequence: Synthetic oligonucleotide
cctactgcagacacaactacggggttgtg

SEQ ID NO: 64246 - DNA, 29 bp, Artificial Sequence
  Description of Artificial Sequence: Synthetic oligonucleotide
ctactgcagacacaactacggggttgtgg

SEQ ID NO: 64247 - DNA, 41 bp, Artificial Sequence
  Description of Artificial Sequence: Synthetic oligonucleotide
cacgtttcttgtgggagcttaagtttgaatgtcatttcttc

SEQ ID NO: 64248 - DNA, 44 bp, Artificial Sequence
  Description of Artificial Sequence: Synthetic oligonucleotide
acgtttcttgtgggagcttaagtttgaatgtcatttcttcaatg

SEQ ID NO: 64249 - DNA, 43 bp, Artificial Sequence
  Description of Artificial Sequence: Synthetic oligonucleotide
cgtttcttgtgggagcttaagtttgaatgtcatttcttcaatg

SEQ ID NO: 64250 - DNA, 43 bp, Artificial Sequence
  Description of Artificial Sequence: Synthetic oligonucleotide
gtttcttgtgggagcttaagtttgaatgtcatttcttcaatgg

SEQ ID NO: 64251 - DNA, 43 bp, Artificial Sequence
  Description of Artificial Sequence: Synthetic oligonucleotide
tttcttgtgggagcttaagtttgaatgtcatttcttcaatggg

SEQ ID NO: 64252 - DNA, 42 bp, Artificial Sequence
  Description of Artificial Sequence: Synthetic oligonucleotide
ttcttgtgggagcttaagtttgaatgtcatttcttcaatggg

SEQ ID NO: 64253 - DNA, 41 bp, Artificial Sequence
  Description of Artificial Sequence: Synthetic oligonucleotide
tcttgtgggagcttaagtttgaatgtcatttcttcaatggg

SEQ ID NO: 64254 - DNA, 40 bp, Artificial Sequence
  Description of Artificial Sequence: Synthetic oligonucleotide
cttgtgggagcttaagtttgaatgtcatttcttcaatggg

SEQ ID NO: 64255 - DNA, 41 bp, Artificial Sequence
  Description of Artificial Sequence: Synthetic oligonucleotide
ttgtgggagcttaagtttgaatgtcatttcttcaatgggac

SEQ ID NO: 64256 - DNA, 40 bp, Artificial Sequence
  Description of Artificial Sequence: Synthetic oligonucleotide
tgtgggagcttaagtttgaatgtcatttcttcaatgggac

SEQ ID NO: 64257 - DNA, 39 bp, Artificial Sequence
  Description of Artificial Sequence: Synthetic oligonucleotide
gtgggagcttaagtttgaatgtcatttcttcaatgggac

SEQ ID NO: 64258 - DNA, 39 bp, Artificial Sequence
  Description of Artificial Sequence: Synthetic oligonucleotide
tgggagcttaagtttgaatgtcatttcttcaatgggacg

SEQ ID NO: 64259 - DNA, 38 bp, Artificial Sequence
  Description of Artificial Sequence: Synthetic oligonucleotide
gggagcttaagtttgaatgtcatttcttcaatgggacg

SEQ ID NO: 64260 - DNA, 38 bp, Artificial Sequence
  Description of Artificial Sequence: Synthetic oligonucleotide
ggagcttaagtttgaatgtcatttcttcaatgggacgg

SEQ ID NO: 64261 - DNA, 39 bp, Artificial Sequence
  Description of Artificial Sequence: Synthetic oligonucleotide
gagcttaagtttgaatgtcatttcttcaatgggacggag

SEQ ID NO: 64262 - DNA, 37 bp, Artificial Sequence
  Description of Artificial Sequence: Synthetic oligonucleotide
gttgctggaaagatgcatctataaccaagaggagtac

SEQ ID NO: 64263 - DNA, 37 bp, Artificial Sequence
  Description of Artificial Sequence: Synthetic oligonucleotide
ttgctggaaagatgcatctataaccaagaggagtacg

SEQ ID NO: 64264 - DNA, 36 bp, Artificial Sequence
  Description of Artificial Sequence: Synthetic oligonucleotide
tgctggaaagatgcatctataaccaagaggagtacg

SEQ ID NO: 64265 - DNA, 35 bp, Artificial Sequence
  Description of Artificial Sequence: Synthetic oligonucleotide
gctggaaagatgcatctataaccaagaggagtacg

SEQ ID NO: 64266 - DNA, 36 bp, Artificial Sequence
  Description of Artificial Sequence: Synthetic oligonucleotide
ctggaaagatgcatctataaccaagaggagtacgtg

SEQ ID NO: 64267 - DNA, 36 bp, Artificial Sequence
  Description of Artificial Sequence: Synthetic oligonucleotide
tggaaagatgcatctataaccaagaggagtacgtgc

SEQ ID NO: 64268 - DNA, 35 bp, Artificial Sequence
  Description of Artificial Sequence: Synthetic oligonucleotide
ggaaagatgcatctataaccaagaggagtacgtgc

SEQ ID NO: 64269 - DNA, 35 bp, Artificial Sequence
  Description of Artificial Sequence: Synthetic oligonucleotide
gaaagatgcatctataaccaagaggagtacgtgcg

SEQ ID NO: 64270 - DNA, 35 bp, Artificial Sequence
  Description of Artificial Sequence: Synthetic oligonucleotide
aaagatgcatctataaccaagaggagtacgtgcgc

SEQ ID NO: 64271 - DNA, 34 bp, Artificial Sequence
  Description of Artificial Sequence: Synthetic oligonucleotide
aagatgcatctataaccaagaggagtacgtgcgc

SEQ ID NO: 64272 - DNA, 33 bp, Artificial Sequence
  Description of Artificial Sequence: Synthetic oligonucleotide
agatgcatctataaccaagaggagtacgtgcgc

SEQ ID NO: 64273 - DNA, 32 bp, Artificial Sequence
  Description of Artificial Sequence: Synthetic oligonucleotide
gatgcatctataaccaagaggagtacgtgcgc

SEQ ID NO: 64274 - DNA, 34 bp, Artificial Sequence
  Description of Artificial Sequence: Synthetic oligonucleotide
atgcatctataaccaagaggagtacgtgcgcttc

SEQ ID NO: 64275 - DNA, 33 bp, Artificial Sequence
  Description of Artificial Sequence: Synthetic oligonucleotide
tgcatctataaccaagaggagtacgtgcgcttc

SEQ ID NO: 64276 - DNA, 32 bp, Artificial Sequence
  Description of Artificial Sequence: Synthetic oligonucleotide
gcatctataaccaagaggagtacgtgcgcttc

SEQ ID NO: 64277 - DNA, 32 bp, Artificial Sequence
  Description of Artificial Sequence: Synthetic oligonucleotide
catctataaccaagaggagtacgtgcgcttcg

SEQ ID NO: 64278 - DNA, 33 bp, Artificial Sequence
  Description of Artificial Sequence: Synthetic oligonucleotide
atctataaccaagaggagtacgtgcgcttcgac

SEQ ID NO: 64279 - DNA, 32 bp, Artificial Sequence
  Description of Artificial Sequence: Synthetic oligonucleotide
tctataaccaagaggagtacgtgcgcttcgac

SEQ ID NO: 64280 - DNA, 31 bp, Artificial Sequence
  Description of Artificial Sequence: Synthetic oligonucleotide
ctataaccaagaggagtacgtgcgcttcgac

SEQ ID NO: 64281 - DNA, 32 bp, Artificial Sequence
  Description of Artificial Sequence: Synthetic oligonucleotide
tataaccaagaggagtacgtgcgcttcgacag

SEQ ID NO: 64282 - DNA, 31 bp, Artificial Sequence
  Description of Artificial Sequence: Synthetic oligonucleotide
ataaccaagaggagtacgtgcgcttcgacag

SEQ ID NO: 64283 - DNA, 30 bp, Artificial Sequence
  Description of Artificial Sequence: Synthetic oligonucleotide
taaccaagaggagtacgtgcgcttcgacag

SEQ ID NO: 64284 - DNA, 29 bp, Artificial Sequence
  Description of Artificial Sequence: Synthetic oligonucleotide
aaccaagaggagtacgtgcgcttcgacag

SEQ ID NO: 64285 - DNA, 28 bp, Artificial Sequence
  Description of Artificial Sequence: Synthetic oligonucleotide
accaagaggagtacgtgcgcttcgacag

SEQ ID NO: 64286 - DNA, 27 bp, Artificial Sequence
  Description of Artificial Sequence: Synthetic oligonucleotide
ccaagaggagtacgtgcgcttcgacag

SEQ ID NO: 64287 - DNA, 27 bp, Artificial Sequence
  Description of Artificial Sequence: Synthetic oligonucleotide
caagaggagtacgtgcgcttcgacagc

SEQ ID NO: 64288 - DNA, 27 bp, Artificial Sequence
  Description of Artificial Sequence: Synthetic oligonucleotide
aagaggagtacgtgcgcttcgacagcg

SEQ ID NO: 64289 - DNA, 27 bp, Artificial Sequence
  Description of Artificial Sequence: Synthetic oligonucleotide
cagccagaaggacctcctggagcagaa

SEQ ID NO: 64290 - DNA, 27 bp, Artificial Sequence
  Description of Artificial Sequence: Synthetic oligonucleotide
agccagaaggacctcctggagcagaag

SEQ ID NO: 64291 - DNA, 26 bp, Artificial Sequence
  Description of Artificial Sequence: Synthetic oligonucleotide
gccagaaggacctcctggagcagaag

SEQ ID NO: 64292 - DNA, 26 bp, Artificial Sequence
  Description of Artificial Sequence: Synthetic oligonucleotide
ccagaaggacctcctggagcagaagc

SEQ ID NO: 64293 - DNA, 26 bp, Artificial Sequence
  Description of Artificial Sequence: Synthetic oligonucleotide
cagaaggacctcctggagcagaagcg

SEQ ID NO: 64294 - DNA, 26 bp, Artificial Sequence
  Description of Artificial Sequence: Synthetic oligonucleotide
agaaggacctcctggagcagaagcgg

SEQ ID NO: 64295 - DNA, 25 bp, Artificial Sequence
  Description of Artificial Sequence: Synthetic oligonucleotide
gaaggacctcctggagcagaagcgg

SEQ ID NO: 64296 - DNA, 25 bp, Artificial Sequence
  Description of Artificial Sequence: Synthetic oligonucleotide
aaggacctcctggagcagaagcggg

SEQ ID NO: 64297 - DNA, 24 bp, Artificial Sequence
  Description of Artificial Sequence: Synthetic oligonucleotide
aggacctcctggagcagaagcggg

SEQ ID NO: 64298 - DNA, 23 bp, Artificial Sequence
  Description of Artificial Sequence: Synthetic oligonucleotide
ggacctcctggagcagaagcggg

SEQ ID NO: 64299 - DNA, 23 bp, Artificial Sequence
  Description of Artificial Sequence: Synthetic oligonucleotide
gacctcctggagcagaagcgggc

SEQ ID NO: 64300 - DNA, 23 bp, Artificial Sequence
  Description of Artificial Sequence: Synthetic oligonucleotide
acctcctggagcagaagcgggcc

SEQ ID NO: 64301 - DNA, 22 bp, Artificial Sequence
  Description of Artificial Sequence: Synthetic oligonucleotide
cctcctggagcagaagcgggcc

SEQ ID NO: 64302 - DNA, 22 bp, Artificial Sequence
  Description of Artificial Sequence: Synthetic oligonucleotide
ctcctggagcagaagcgggccg

SEQ ID NO: 64303 - DNA, 22 bp, Artificial Sequence
  Description of Artificial Sequence: Synthetic oligonucleotide
tcctggagcagaagcgggccgc

SEQ ID NO: 64304 - DNA, 21 bp, Artificial Sequence
  Description of Artificial Sequence: Synthetic oligonucleotide
cctggagcagaagcgggccgc

SEQ ID NO: 64305 - DNA, 21 bp, Artificial Sequence
  Description of Artificial Sequence: Synthetic oligonucleotide
ctggagcagaagcgggccgcg

SEQ ID NO: 64306 - DNA, 22 bp, Artificial Sequence
  Description of Artificial Sequence: Synthetic oligonucleotide
tggagcagaagcgggccgcggt

SEQ ID NO: 64307 - DNA, 21 bp, Artificial Sequence
  Description of Artificial Sequence: Synthetic oligonucleotide
ggagcagaagcgggccgcggt

SEQ ID NO: 64308 - DNA, 21 bp, Artificial Sequence
  Description of Artificial Sequence: Synthetic oligonucleotide
gagcagaagcgggccgcggtg

SEQ ID NO: 64309 - DNA, 22 bp, Artificial Sequence
  Description of Artificial Sequence: Synthetic oligonucleotide
agcagaagcgggccgcggtgga

SEQ ID NO: 64310 - DNA, 21 bp, Artificial Sequence
  Description of Artificial Sequence: Synthetic oligonucleotide
gcagaagcgggccgcggtgga

SEQ ID NO: 64311 - DNA, 22 bp, Artificial Sequence
  Description of Artificial Sequence: Synthetic oligonucleotide
cagaagcgggccgcggtggaca

SEQ ID NO: 64312 - DNA, 22 bp, Artificial Sequence
  Description of Artificial Sequence: Synthetic oligonucleotide
agaagcgggccgcggtggacac

SEQ ID NO: 64313 - DNA, 21 bp, Artificial Sequence
  Description of Artificial Sequence: Synthetic oligonucleotide
gaagcgggccgcggtggacac

SEQ ID NO: 64314 - DNA, 23 bp, Artificial Sequence
  Description of Artificial Sequence: Synthetic oligonucleotide
aagcgggccgcggtggacaccta

SEQ ID NO: 64315 - DNA, 32 bp, Artificial Sequence
  Description of Artificial Sequence: Synthetic oligonucleotide
gacaattactgcagacacaactacggggttgg

SEQ ID NO: 64316 - DNA, 33 bp, Artificial Sequence
  Description of Artificial Sequence: Synthetic oligonucleotide
acaattactgcagacacaactacggggttggtg

SEQ ID NO: 64317 - DNA, 32 bp, Artificial Sequence
  Description of Artificial Sequence: Synthetic oligonucleotide
caattactgcagacacaactacggggttggtg

SEQ ID NO: 64318 - DNA, 33 bp, Artificial Sequence
  Description of Artificial Sequence: Synthetic oligonucleotide
aattactgcagacacaactacggggttggtgag

SEQ ID NO: 64319 - DNA, 32 bp, Artificial Sequence
  Description of Artificial Sequence: Synthetic oligonucleotide
attactgcagacacaactacggggttggtgag

SEQ ID NO: 64320 - DNA, 31 bp, Artificial Sequence
  Description of Artificial Sequence: Synthetic oligonucleotide
ttactgcagacacaactacggggttggtgag

SEQ ID NO: 64321 - DNA, 26 bp, Artificial Sequence
  Description of Artificial Sequence: Synthetic oligonucleotide
cagaaggacctcctggagcagaggct

SEQ ID NO: 64322 - DNA, 26 bp, Artificial Sequence
  Description of Artificial Sequence: Synthetic oligonucleotide
agaaggacctcctggagcagaggctg

SEQ ID NO: 64323 - DNA, 25 bp, Artificial Sequence
  Description of Artificial Sequence: Synthetic oligonucleotide
gaaggacctcctggagcagaggctg

SEQ ID NO: 64324 - DNA, 25 bp, Artificial Sequence
  Description of Artificial Sequence: Synthetic oligonucleotide
aaggacctcctggagcagaggctgg

SEQ ID NO: 64325 - DNA, 24 bp, Artificial Sequence
  Description of Artificial Sequence: Synthetic oligonucleotide
aggacctcctggagcagaggctgg

SEQ ID NO: 64326 - DNA, 23 bp, Artificial Sequence
  Description of Artificial Sequence: Synthetic oligonucleotide
ggacctcctggagcagaggctgg

SEQ ID NO: 64327 - DNA, 23 bp, Artificial Sequence
  Description of Artificial Sequence: Synthetic oligonucleotide
gacctcctggagcagaggctggc

SEQ ID NO: 64328 - DNA, 23 bp, Artificial Sequence
  Description of Artificial Sequence: Synthetic oligonucleotide
acctcctggagcagaggctggcc

SEQ ID NO: 64329 - DNA, 22 bp, Artificial Sequence
  Description of Artificial Sequence: Synthetic oligonucleotide
cctcctggagcagaggctggcc

SEQ ID NO: 64330 - DNA, 22 bp, Artificial Sequence
  Description of Artificial Sequence: Synthetic oligonucleotide
ctcctggagcagaggctggccg

SEQ ID NO: 64331 - DNA, 22 bp, Artificial Sequence
  Description of Artificial Sequence: Synthetic oligonucleotide
tcctggagcagaggctggccgc

SEQ ID NO: 64332 - DNA, 21 bp, Artificial Sequence
  Description of Artificial Sequence: Synthetic oligonucleotide
cctggagcagaggctggccgc

SEQ ID NO: 64333 - DNA, 21 bp, Artificial Sequence
  Description of Artificial Sequence: Synthetic oligonucleotide
ctggagcagaggctggccgcg

SEQ ID NO: 64334 - DNA, 22 bp, Artificial Sequence
  Description of Artificial Sequence: Synthetic oligonucleotide
tggagcagaggctggccgcggt

SEQ ID NO: 64335 - DNA, 21 bp, Artificial Sequence
  Description of Artificial Sequence: Synthetic oligonucleotide
ggagcagaggctggccgcggt

SEQ ID NO: 64336 - DNA, 21 bp, Artificial Sequence
  Description of Artificial Sequence: Synthetic oligonucleotide
gagcagaggctggccgcggtg

SEQ ID NO: 64337 - DNA, 22 bp, Artificial Sequence
  Description of Artificial Sequence: Synthetic oligonucleotide
agcagaggctggccgcggtgga

SEQ ID NO: 64338 - DNA, 21 bp, Artificial Sequence
  Description of Artificial Sequence: Synthetic oligonucleotide
gcagaggctggccgcggtgga

SEQ ID NO: 64339 - DNA, 22 bp, Artificial Sequence
  Description of Artificial Sequence: Synthetic oligonucleotide
cagaggctggccgcggtggaca

SEQ ID NO: 64340 - DNA, 22 bp, Artificial Sequence
  Description of Artificial Sequence: Synthetic oligonucleotide
agaggctggccgcggtggacac

SEQ ID NO: 64341 - DNA, 21 bp, Artificial Sequence
  Description of Artificial Sequence: Synthetic oligonucleotide
gaggctggccgcggtggacac

SEQ ID NO: 64342 - DNA, 23 bp, Artificial Sequence
  Description of Artificial Sequence: Synthetic oligonucleotide
aggctggccgcggtggacaccta

SEQ ID NO: 64343 - DNA, 22 bp, Artificial Sequence
  Description of Artificial Sequence: Synthetic oligonucleotide
ggctggccgcggtggacaccta

SEQ ID NO: 64344 - DNA, 23 bp, Artificial Sequence
  Description of Artificial Sequence: Synthetic oligonucleotide
gctggccgcggtggacacctact

SEQ ID NO: 64345 - DNA, 23 bp, Artificial Sequence
  Description of Artificial Sequence: Synthetic oligonucleotide
ctggccgcggtggacacctactg

SEQ ID NO: 64346 - DNA, 24 bp, Artificial Sequence
  Description of Artificial Sequence: Synthetic oligonucleotide
tggccgcggtggacacctactgca

SEQ ID NO: 64347 - DNA, 43 bp, Artificial Sequence
  Description of Artificial Sequence: Synthetic oligonucleotide
acgtttcttgtggcagcttaagtttgaatgtcatttcttcaac

SEQ ID NO: 64348 - DNA, 42 bp, Artificial Sequence
  Description of Artificial Sequence: Synthetic oligonucleotide
cgtttcttgtggcagcttaagtttgaatgtcatttcttcaac

SEQ ID NO: 64349 - DNA, 42 bp, Artificial Sequence
  Description of Artificial Sequence: Synthetic oligonucleotide
gtttcttgtggcagcttaagtttgaatgtcatttcttcaacg

SEQ ID NO: 64350 - DNA, 42 bp, Artificial Sequence
  Description of Artificial Sequence: Synthetic oligonucleotide
tttcttgtggcagcttaagtttgaatgtcatttcttcaacgg

SEQ ID NO: 64351 - DNA, 41 bp, Artificial Sequence
  Description of Artificial Sequence: Synthetic oligonucleotide
ttcttgtggcagcttaagtttgaatgtcatttcttcaacgg

SEQ ID NO: 64352 - DNA, 40 bp, Artificial Sequence
  Description of Artificial Sequence: Synthetic oligonucleotide
tcttgtggcagcttaagtttgaatgtcatttcttcaacgg

SEQ ID NO: 64353 - DNA, 39 bp, Artificial Sequence
  Description of Artificial Sequence: Synthetic oligonucleotide
cttgtggcagcttaagtttgaatgtcatttcttcaacgg

SEQ ID NO: 64354 - DNA, 39 bp, Artificial Sequence
  Description of Artificial Sequence: Synthetic oligonucleotide
ttgtggcagcttaagtttgaatgtcatttcttcaacggg

SEQ ID NO: 64355 - DNA, 38 bp, Artificial Sequence
  Description of Artificial Sequence: Synthetic oligonucleotide
tgtggcagcttaagtttgaatgtcatttcttcaacggg

SEQ ID NO: 64356 - DNA, 37 bp, Artificial Sequence
  Description of Artificial Sequence: Synthetic oligonucleotide
gtggcagcttaagtttgaatgtcatttcttcaacggg

SEQ ID NO: 64357 - DNA, 38 bp, Artificial Sequence
  Description of Artificial Sequence: Synthetic oligonucleotide
tggcagcttaagtttgaatgtcatttcttcaacgggac

SEQ ID NO: 64358 - DNA, 37 bp, Artificial Sequence
  Description of Artificial Sequence: Synthetic oligonucleotide
ggcagcttaagtttgaatgtcatttcttcaacgggac

SEQ ID NO: 64359 - DNA, 37 bp, Artificial Sequence
  Description of Artificial Sequence: Synthetic oligonucleotide
gcagcttaagtttgaatgtcatttcttcaacgggacg

SEQ ID NO: 64360 - DNA, 37 bp, Artificial Sequence
  Description of Artificial Sequence: Synthetic oligonucleotide
cagcttaagtttgaatgtcatttcttcaacgggacgg

SEQ ID NO: 64361 - DNA, 38 bp, Artificial Sequence
  Description of Artificial Sequence: Synthetic oligonucleotide
agcttaagtttgaatgtcatttcttcaacgggacggag

SEQ ID NO: 64362 - DNA, 37 bp, Artificial Sequence
  Description of Artificial Sequence: Synthetic oligonucleotide
gcttaagtttgaatgtcatttcttcaacgggacggag

SEQ ID NO: 64363 - DNA, 37 bp, Artificial Sequence
  Description of Artificial Sequence: Synthetic oligonucleotide
cttaagtttgaatgtcatttcttcaacgggacggagc

SEQ ID NO: 64364 - DNA, 37 bp, Artificial Sequence
  Description of Artificial Sequence: Synthetic oligonucleotide
ttaagtttgaatgtcatttcttcaacgggacggagcg

SEQ ID NO: 64365 - DNA, 36 bp, Artificial Sequence
  Description of Artificial Sequence: Synthetic oligonucleotide
taagtttgaatgtcatttcttcaacgggacggagcg

SEQ ID NO: 64366 - DNA, 35 bp, Artificial Sequence
  Description of Artificial Sequence: Synthetic oligonucleotide
aagtttgaatgtcatttcttcaacgggacggagcg

SEQ ID NO: 64367 - DNA, 34 bp, Artificial Sequence
  Description of Artificial Sequence: Synthetic oligonucleotide
agtttgaatgtcatttcttcaacgggacggagcg

SEQ ID NO: 64368 - DNA, 33 bp, Artificial Sequence
  Description of Artificial Sequence: Synthetic oligonucleotide
gtttgaatgtcatttcttcaacgggacggagcg

SEQ ID NO: 64369 - DNA, 33 bp, Artificial Sequence
  Description of Artificial Sequence: Synthetic oligonucleotide
tttgaatgtcatttcttcaacgggacggagcgg

SEQ ID NO: 64370 - DNA, 32 bp, Artificial Sequence
  Description of Artificial Sequence: Synthetic oligonucleotide
ttgaatgtcatttcttcaacgggacggagcgg

SEQ ID NO: 64371 - DNA, 31 bp, Artificial Sequence
  Description of Artificial Sequence: Synthetic oligonucleotide
tgaatgtcatttcttcaacgggacggagcgg

SEQ ID NO: 64372 - DNA, 30 bp, Artificial Sequence
  Description of Artificial Sequence: Synthetic oligonucleotide
gaatgtcatttcttcaacgggacggagcgg

SEQ ID NO: 64373 - DNA, 30 bp, Artificial Sequence
  Description of Artificial Sequence: Synthetic oligonucleotide
aatgtcatttcttcaacgggacggagcggg

SEQ ID NO: 64374 - DNA, 29 bp, Artificial Sequence
  Description of Artificial Sequence: Synthetic oligonucleotide
atgtcatttcttcaacgggacggagcggg

SEQ ID NO: 64375 - DNA, 28 bp, Artificial Sequence
  Description of Artificial Sequence: Synthetic oligonucleotide
tgtcatttcttcaacgggacggagcggg

SEQ ID NO: 64376 - DNA, 27 bp, Artificial Sequence
  Description of Artificial Sequence: Synthetic oligonucleotide
gtcatttcttcaacgggacggagcggg

SEQ ID NO: 64377 - DNA, 28 bp, Artificial Sequence
  Description of Artificial Sequence: Synthetic oligonucleotide
tcatttcttcaacgggacggagcgggtg

SEQ ID NO: 64378 - DNA, 27 bp, Artificial Sequence
  Description of Artificial Sequence: Synthetic oligonucleotide
catttcttcaacgggacggagcgggtg

SEQ ID NO: 64379 - DNA, 27 bp, Artificial Sequence
  Description of Artificial Sequence: Synthetic oligonucleotide
atttcttcaacgggacggagcgggtgc

SEQ ID NO: 64380 - DNA, 27 bp, Artificial Sequence
  Description of Artificial Sequence: Synthetic oligonucleotide
tttcttcaacgggacggagcgggtgca

SEQ ID NO: 64381 - DNA, 26 bp, Artificial Sequence
  Description of Artificial Sequence: Synthetic oligonucleotide
ttcttcaacgggacggagcgggtgca

SEQ ID NO: 64382 - DNA, 25 bp, Artificial Sequence
  Description of Artificial Sequence: Synthetic oligonucleotide
tcttcaacgggacggagcgggtgca

SEQ ID NO: 64383 - DNA, 24 bp, Artificial Sequence
  Description of Artificial Sequence: Synthetic oligonucleotide
cttcaacgggacggagcgggtgca

SEQ ID NO: 64384 - DNA, 26 bp, Artificial Sequence
  Description of Artificial Sequence: Synthetic oligonucleotide
ttcaacgggacggagcgggtgcagtt

SEQ ID NO: 64385 - DNA, 25 bp, Artificial Sequence
  Description of Artificial Sequence: Synthetic oligonucleotide
tcaacgggacggagcgggtgcagtt

SEQ ID NO: 64386 - DNA, 24 bp, Artificial Sequence
  Description of Artificial Sequence: Synthetic oligonucleotide
caacgggacggagcgggtgcagtt

SEQ ID NO: 64387 - DNA, 24 bp, Artificial Sequence
  Description of Artificial Sequence: Synthetic oligonucleotide
aacgggacggagcgggtgcagttc

SEQ ID NO: 64388 - DNA, 23 bp, Artificial Sequence
  Description of Artificial Sequence: Synthetic oligonucleotide
acgggacggagcgggtgcagttc

SEQ ID NO: 64389 - DNA, 22 bp, Artificial Sequence
  Description of Artificial Sequence: Synthetic oligonucleotide
cgggacggagcgggtgcagttc

SEQ ID NO: 64390 - DNA, 23 bp, Artificial Sequence
  Description of Artificial Sequence: Synthetic oligonucleotide
gggacggagcgggtgcagttcct

SEQ ID NO: 64391 - DNA, 23 bp, Artificial Sequence
  Description of Artificial Sequence: Synthetic oligonucleotide
ggacggagcgggtgcagttcctg

SEQ ID NO: 64392 - DNA, 26 bp, Artificial Sequence
  Description of Artificial Sequence: Synthetic oligonucleotide
gacggagcgggtgcagttcctggaaa

SEQ ID NO: 64393 - DNA, 27 bp, Artificial Sequence
  Description of Artificial Sequence: Synthetic oligonucleotide
acggagcgggtgcagttcctggaaaga

SEQ ID NO: 64394 - DNA, 26 bp, Artificial Sequence
  Description of Artificial Sequence: Synthetic oligonucleotide
cggagcgggtgcagttcctggaaaga

SEQ ID NO: 64395 - DNA, 27 bp, Artificial Sequence
  Description of Artificial Sequence: Synthetic oligonucleotide
ggagcgggtgcagttcctggaaagact

SEQ ID NO: 64396 - DNA, 27 bp, Artificial Sequence
  Description of Artificial Sequence: Synthetic oligonucleotide
gagcgggtgcagttcctggaaagactc

SEQ ID NO: 64397 - DNA, 29 bp, Artificial Sequence
  Description of Artificial Sequence: Synthetic oligonucleotide
agcgggtgcagttcctggaaagactcttc

SEQ ID NO: 64398 - DNA, 28 bp, Artificial Sequence
  Description of Artificial Sequence: Synthetic oligonucleotide
gcgggtgcagttcctggaaagactcttc

SEQ ID NO: 64399 - DNA, 33 bp, Artificial Sequence
  Description of Artificial Sequence: Synthetic oligonucleotide
cgggtgcagttcctggaaagactcttctataac

SEQ ID NO: 64400 - DNA, 33 bp, Artificial Sequence
  Description of Artificial Sequence: Synthetic oligonucleotide
gggtgcagttcctggaaagactcttctataacc

SEQ ID NO: 64401 - DNA, 35 bp, Artificial Sequence
  Description of Artificial Sequence: Synthetic oligonucleotide
ggtgcagttcctggaaagactcttctataaccaag

SEQ ID NO: 64402 - DNA, 36 bp, Artificial Sequence
  Description of Artificial Sequence: Synthetic oligonucleotide
gtgcagttcctggaaagactcttctataaccaagag

SEQ ID NO: 64403 - DNA, 36 bp, Artificial Sequence
  Description of Artificial Sequence: Synthetic oligonucleotide
tgcagttcctggaaagactcttctataaccaagagg

SEQ ID NO: 64404 - DNA, 35 bp, Artificial Sequence
  Description of Artificial Sequence: Synthetic oligonucleotide
gcagttcctggaaagactcttctataaccaagagg

SEQ ID NO: 64405 - DNA, 36 bp, Artificial Sequence
  Description of Artificial Sequence: Synthetic oligonucleotide
cagttcctggaaagactcttctataaccaagaggag

SEQ ID NO: 64406 - DNA, 37 bp, Artificial Sequence
  Description of Artificial Sequence: Synthetic oligonucleotide
agttcctggaaagactcttctataaccaagaggagtc

SEQ ID NO: 64407 - DNA, 36 bp, Artificial Sequence
  Description of Artificial Sequence: Synthetic oligonucleotide
gttcctggaaagactcttctataaccaagaggagtc

SEQ ID NO: 64408 - DNA, 36 bp, Artificial Sequence
  Description of Artificial Sequence: Synthetic oligonucleotide
ttcctggaaagactcttctataaccaagaggagtcc

SEQ ID NO: 64409 - DNA, 35 bp, Artificial Sequence
  Description of Artificial Sequence: Synthetic oligonucleotide
tcctggaaagactcttctataaccaagaggagtcc

SEQ ID NO: 64410 - DNA, 34 bp, Artificial Sequence
  Description of Artificial Sequence: Synthetic oligonucleotide
cctggaaagactcttctataaccaagaggagtcc

SEQ ID NO: 64411 - DNA, 34 bp, Artificial Sequence
  Description of Artificial Sequence: Synthetic oligonucleotide
ctggaaagactcttctataaccaagaggagtccg

SEQ ID NO: 64412 - DNA, 35 bp, Artificial Sequence
  Description of Artificial Sequence: Synthetic oligonucleotide
tggaaagactcttctataaccaagaggagtccgtg

SEQ ID NO: 64413 - DNA, 34 bp, Artificial Sequence
  Description of Artificial Sequence: Synthetic oligonucleotide
ggaaagactcttctataaccaagaggagtccgtg

SEQ ID NO: 64414 - DNA, 34 bp, Artificial Sequence
  Description of Artificial Sequence: Synthetic oligonucleotide
gaaagactcttctataaccaagaggagtccgtgc

SEQ ID NO: 64415 - DNA, 34 bp, Artificial Sequence
  Description of Artificial Sequence: Synthetic oligonucleotide
aaagactcttctataaccaagaggagtccgtgcg

SEQ ID NO: 64416 - DNA, 33 bp, Artificial Sequence
  Description of Artificial Sequence: Synthetic oligonucleotide
aagactcttctataaccaagaggagtccgtgcg

SEQ ID NO: 64417 - DNA, 32 bp, Artificial Sequence
  Description of Artificial Sequence: Synthetic oligonucleotide
agactcttctataaccaagaggagtccgtgcg

SEQ ID NO: 64418 - DNA, 31 bp, Artificial Sequence
  Description of Artificial Sequence: Synthetic oligonucleotide
gactcttctataaccaagaggagtccgtgcg

SEQ ID NO: 64419 - DNA, 31 bp, Artificial Sequence
  Description of Artificial Sequence: Synthetic oligonucleotide
actcttctataaccaagaggagtccgtgcgc

SEQ ID NO: 64420 - DNA, 30 bp, Artificial Sequence
  Description of Artificial Sequence: Synthetic oligonucleotide
ctcttctataaccaagaggagtccgtgcgc

SEQ ID NO: 64421 - DNA, 32 bp, Artificial Sequence
  Description of Artificial Sequence: Synthetic oligonucleotide
tcttctataaccaagaggagtccgtgcgcttc

SEQ ID NO: 64422 - DNA, 31 bp, Artificial Sequence
  Description of Artificial Sequence: Synthetic oligonucleotide
cttctataaccaagaggagtccgtgcgcttc

SEQ ID NO: 64423 - DNA, 31 bp, Artificial Sequence
  Description of Artificial Sequence: Synthetic oligonucleotide
ttctataaccaagaggagtccgtgcgcttcg

SEQ ID NO: 64424 - DNA, 20 bp, Artificial Sequence
  Description of Artificial Sequence: Synthetic oligonucleotide
tggggcggcctgctgcggag

SEQ ID NO: 64425 - DNA, 20 bp, Artificial Sequence
  Description of Artificial Sequence: Synthetic oligonucleotide
ggggcggcctgctgcggagt

SEQ ID NO: 64426 - DNA, 20 bp, Artificial Sequence
  Description of Artificial Sequence: Synthetic oligonucleotide
gggcggcctgctgcggagca

SEQ ID NO: 64427 - DNA, 21 bp, Artificial Sequence
  Description of Artificial Sequence: Synthetic oligonucleotide
ggcggcctgctgcggagcact

SEQ ID NO: 64428 - DNA, 21 bp, Artificial Sequence
  Description of Artificial Sequence: Synthetic oligonucleotide
gcggcctgctgcggagcactg

SEQ ID NO: 64429 - DNA, 23 bp, Artificial Sequence
  Description of Artificial Sequence: Synthetic oligonucleotide
cggcctgctgcggagcactggaa

SEQ ID NO: 64430 - DNA, 24 bp, Artificial Sequence
  Description of Artificial Sequence: Synthetic oligonucleotide
ggcctgctgcggagcactggaaca

SEQ ID NO: 64431 - DNA, 24 bp, Artificial Sequence
  Description of Artificial Sequence: Synthetic oligonucleotide
gcctgctgcggagcactggaacag

SEQ ID NO: 64432 - DNA, 24 bp, Artificial Sequence
  Description of Artificial Sequence: Synthetic oligonucleotide
cctgctgcggagcactggaacagc

SEQ ID NO: 64433 - DNA, 25 bp, Artificial Sequence
  Description of Artificial Sequence: Synthetic oligonucleotide
ctgctgcggagcactggaacagcca

SEQ ID NO: 64434 - DNA, 27 bp, Artificial Sequence
  Description of Artificial Sequence: Synthetic oligonucleotide
tgctgcggagcactggaacagccagaa

SEQ ID NO: 64435 - DNA, 26 bp, Artificial Sequence
  Description of Artificial Sequence: Synthetic oligonucleotide
gctgcggagcactggaacagccagaa

SEQ ID NO: 64436 - DNA, 26 bp, Artificial Sequence
  Description of Artificial Sequence: Synthetic oligonucleotide
ctgcggagcactggaacagccagaag

SEQ ID NO: 64437 - DNA, 27 bp, Artificial Sequence
  Description of Artificial Sequence: Synthetic oligonucleotide
tgcggagcactggaacagccagaagga

SEQ ID NO: 64438 - DNA, 26 bp, Artificial Sequence
  Description of Artificial Sequence: Synthetic oligonucleotide
gcggagcactggaacagccagaagga

SEQ ID NO: 64439 - DNA, 26 bp, Artificial Sequence
  Description of Artificial Sequence: Synthetic oligonucleotide
cggagcactggaacagccagaaggac

SEQ ID NO: 64440 - DNA, 27 bp, Artificial Sequence
  Description of Artificial Sequence: Synthetic oligonucleotide
ggagcactggaacagccagaaggacct

SEQ ID NO: 64441 - DNA, 27 bp, Artificial Sequence
  Description of Artificial Sequence: Synthetic oligonucleotide
gagcactggaacagccagaaggacctc

SEQ ID NO: 64442 - DNA, 27 bp, Artificial Sequence
  Description of Artificial Sequence: Synthetic oligonucleotide
agcactggaacagccagaaggacctcc

SEQ ID NO: 64443 - DNA, 27 bp, Artificial Sequence
  Description of Artificial Sequence: Synthetic oligonucleotide
gcactggaacagccagaaggacctcct

SEQ ID NO: 64444 - DNA, 27 bp, Artificial Sequence
  Description of Artificial Sequence: Synthetic oligonucleotide
cactggaacagccagaaggacctcctg

SEQ ID NO: 64445 - DNA, 28 bp, Artificial Sequence
  Description of Artificial Sequence: Synthetic oligonucleotide
tggaacagccagaaggacatcctggagc

SEQ ID NO: 64446 - DNA, 27 bp, Artificial Sequence
  Description of Artificial Sequence: Synthetic oligonucleotide
ggaacagccagaaggacatcctggagc

SEQ ID NO: 64447 - DNA, 28 bp, Artificial Sequence
  Description of Artificial Sequence: Synthetic oligonucleotide
gaacagccagaaggacatcctggagcag

SEQ ID NO: 64448 - DNA, 28 bp, Artificial Sequence
  Description of Artificial Sequence: Synthetic oligonucleotide
aacagccagaaggacatcctggagcagg

SEQ ID NO: 64449 - DNA, 27 bp, Artificial Sequence
  Description of Artificial Sequence: Synthetic oligonucleotide
acagccagaaggacatcctggagcagg

SEQ ID NO: 64450 - DNA, 26 bp, Artificial Sequence
  Description of Artificial Sequence: Synthetic oligonucleotide
cagccagaaggacatcctggagcagg

SEQ ID NO: 64451 - DNA, 26 bp, Artificial Sequence
  Description of Artificial Sequence: Synthetic oligonucleotide
agccagaaggacatcctggagcaggc

SEQ ID NO: 64452 - DNA, 25 bp, Artificial Sequence
  Description of Artificial Sequence: Synthetic oligonucleotide
gccagaaggacatcctggagcaggc

SEQ ID NO: 64453 - DNA, 25 bp, Artificial Sequence
  Description of Artificial Sequence: Synthetic oligonucleotide
ccagaaggacatcctggagcaggcg

SEQ ID NO: 64454 - DNA, 25 bp, Artificial Sequence
  Description of Artificial Sequence: Synthetic oligonucleotide
cagaaggacatcctggagcaggcgc

SEQ ID NO: 64455 - DNA, 25 bp, Artificial Sequence
  Description of Artificial Sequence: Synthetic oligonucleotide
agaaggacatcctggagcaggcgcg

SEQ ID NO: 64456 - DNA, 24 bp, Artificial Sequence
  Description of Artificial Sequence: Synthetic oligonucleotide
gaaggacatcctggagcaggcgcg

SEQ ID NO: 64457 - DNA, 24 bp, Artificial Sequence
  Description of Artificial Sequence: Synthetic oligonucleotide
aaggacatcctggagcaggcgcgg

SEQ ID NO: 64458 - DNA, 23 bp, Artificial Sequence
  Description of Artificial Sequence: Synthetic oligonucleotide
aggacatcctggagcaggcgcgg

SEQ ID NO: 64459 - DNA, 22 bp, Artificial Sequence
  Description of Artificial Sequence: Synthetic oligonucleotide
ggacatcctggagcaggcgcgg

SEQ ID NO: 64460 - DNA, 22 bp, Artificial Sequence
  Description of Artificial Sequence: Synthetic oligonucleotide
gacatcctggagcaggcgcggg

SEQ ID NO: 64461 - DNA, 22 bp, Artificial Sequence
  Description of Artificial Sequence: Synthetic oligonucleotide
acatcctggagcaggcgcgggc

SEQ ID NO: 64462 - DNA, 21 bp, Artificial Sequence
  Description of Artificial Sequence: Synthetic oligonucleotide
catcctggagcaggcgcgggc

SEQ ID NO: 64463 - DNA, 21 bp, Artificial Sequence
  Description of Artificial Sequence: Synthetic oligonucleotide
atcctggagcaggcgcgggcc

SEQ ID NO: 64464 - DNA, 23 bp, Artificial Sequence
  Description of Artificial Sequence: Synthetic oligonucleotide
gacctcctggagcagaagcgggg

SEQ ID NO: 64465 - DNA, 23 bp, Artificial Sequence
  Description of Artificial Sequence: Synthetic oligonucleotide
acctcctggagcagaagcggggc

SEQ ID NO: 64466 - DNA, 22 bp, Artificial Sequence
  Description of Artificial Sequence: Synthetic oligonucleotide
cctcctggagcagaagcggggc

SEQ ID NO: 64467 - DNA, 22 bp, Artificial Sequence
  Description of Artificial Sequence: Synthetic oligonucleotide
ctcctggagcagaagcggggcc

SEQ ID NO: 64468 - DNA, 22 bp, Artificial Sequence
  Description of Artificial Sequence: Synthetic oligonucleotide
tcctggagcagaagcggggccg

SEQ ID NO: 64469 - DNA, 21 bp, Artificial Sequence
  Description of Artificial Sequence: Synthetic oligonucleotide
cctggagcagaagcggggccg

SEQ ID NO: 64470 - DNA, 21 bp, Artificial Sequence
  Description of Artificial Sequence: Synthetic oligonucleotide
ctggagcagaagcggggccgg

SEQ ID NO: 64471 - DNA, 22 bp, Artificial Sequence
  Description of Artificial Sequence: Synthetic oligonucleotide
tggagcagaagcggggccgggt

SEQ ID NO: 64472 - DNA, 21 bp, Artificial Sequence
  Description of Artificial Sequence: Synthetic oligonucleotide
ggagcagaagcggggccgggt

SEQ ID NO: 64473 - DNA, 21 bp, Artificial Sequence
  Description of Artificial Sequence: Synthetic oligonucleotide
gagcagaagcggggccgggtg

SEQ ID NO: 64474 - DNA, 22 bp, Artificial Sequence
  Description of Artificial Sequence: Synthetic oligonucleotide
agcagaagcggggccgggtgga

SEQ ID NO: 64475 - DNA, 21 bp, Artificial Sequence
  Description of Artificial Sequence: Synthetic oligonucleotide
gcagaagcggggccgggtgga

SEQ ID NO: 64476 - DNA, 23 bp, Artificial Sequence
  Description of Artificial Sequence: Synthetic oligonucleotide
cagaagcggggccgggtggacaa

SEQ ID NO: 64477 - DNA, 25 bp, Artificial Sequence
  Description of Artificial Sequence: Synthetic oligonucleotide
agaagcggggccgggtggacaacta

SEQ ID NO: 64478 - DNA, 24 bp, Artificial Sequence
  Description of Artificial Sequence: Synthetic oligonucleotide
gaagcggggccgggtggacaacta

SEQ ID NO: 64479 - DNA, 25 bp, Artificial Sequence
  Description of Artificial Sequence: Synthetic oligonucleotide
aagcggggccgggtggacaactact

SEQ ID NO: 64480 - DNA, 24 bp, Artificial Sequence
  Description of Artificial Sequence: Synthetic oligonucleotide
agcggggccgggtggacaactact

SEQ ID NO: 64481 - DNA, 23 bp, Artificial Sequence
  Description of Artificial Sequence: Synthetic oligonucleotide
gcggggccgggtggacaactact

SEQ ID NO: 64482 - DNA, 23 bp, Artificial Sequence
  Description of Artificial Sequence: Synthetic oligonucleotide
cggggccgggtggacaactactg

SEQ ID NO: 64483 - DNA, 24 bp, Artificial Sequence
  Description of Artificial Sequence: Synthetic oligonucleotide
ggggccgggtggacaactactgca

SEQ ID NO: 64484 - DNA, 25 bp, Artificial Sequence
  Description of Artificial Sequence: Synthetic oligonucleotide
gggccgggtggacaactactgcaga

SEQ ID NO: 64485 - DNA, 26 bp, Artificial Sequence
  Description of Artificial Sequence: Synthetic oligonucleotide
ggccgggtggacaactactgcagaca

SEQ ID NO: 64486 - DNA, 27 bp, Artificial Sequence
  Description of Artificial Sequence: Synthetic oligonucleotide
gccgggtggacaactactgcagacaca

SEQ ID NO: 64487 - DNA, 28 bp, Artificial Sequence
  Description of Artificial Sequence: Synthetic oligonucleotide
ccgggtggacaactactgcagacacaac

SEQ ID NO: 64488 - DNA, 30 bp, Artificial Sequence
  Description of Artificial Sequence: Synthetic oligonucleotide
cgggtggacaactactgcagacacaactac

SEQ ID NO: 64489 - DNA, 30 bp, Artificial Sequence
  Description of Artificial Sequence: Synthetic oligonucleotide
gggtggacaactactgcagacacaactacg

SEQ ID NO: 64490 - DNA, 30 bp, Artificial Sequence
  Description of Artificial Sequence: Synthetic oligonucleotide
ggtggacaactactgcagacacaactacgg

SEQ ID NO: 64491 - DNA, 30 bp, Artificial Sequence
  Description of Artificial Sequence: Synthetic oligonucleotide
gtggacaactactgcagacacaactacggg

SEQ ID NO: 64492 - DNA, 30 bp, Artificial Sequence
  Description of Artificial Sequence: Synthetic oligonucleotide
tggacaactactgcagacacaactacgggg

SEQ ID NO: 64493 - DNA, 29 bp, Artificial Sequence
  Description of Artificial Sequence: Synthetic oligonucleotide
ggacaactactgcagacacaactacgggg

SEQ ID NO: 64494 - DNA, 31 bp, Artificial Sequence
  Description of Artificial Sequence: Synthetic oligonucleotide
gacaactactgcagacacaactacggggttg

SEQ ID NO: 64495 - DNA, 31 bp, Artificial Sequence
  Description of Artificial Sequence: Synthetic oligonucleotide
acaactactgcagacacaactacggggttgg

SEQ ID NO: 64496 - DNA, 30 bp, Artificial Sequence
  Description of Artificial Sequence: Synthetic oligonucleotide
caactactgcagacacaactacggggttgg

SEQ ID NO: 64497 - DNA, 31 bp, Artificial Sequence
  Description of Artificial Sequence: Synthetic oligonucleotide
aactactgcagacacaactacggggttggtg

SEQ ID NO: 64498 - DNA, 30 bp, Artificial Sequence
  Description of Artificial Sequence: Synthetic oligonucleotide
actactgcagacacaactacggggttggtg

SEQ ID NO: 64499 - DNA, 22 bp, Artificial Sequence
  Description of Artificial Sequence: Synthetic oligonucleotide
tcctggagcagaggcgggccga

SEQ ID NO: 64500 - DNA, 21 bp, Artificial Sequence
  Description of Artificial Sequence: Synthetic oligonucleotide
cctggagcagaggcgggccga

SEQ ID NO: 64501 - DNA, 21 bp, Artificial Sequence
  Description of Artificial Sequence: Synthetic oligonucleotide
ctggagcagaggcgggccgag

SEQ ID NO: 64502 - DNA, 22 bp, Artificial Sequence
  Description of Artificial Sequence: Synthetic oligonucleotide
tggagcagaggcgggccgaggt

SEQ ID NO: 64503 - DNA, 21 bp, Artificial Sequence
  Description of Artificial Sequence: Synthetic oligonucleotide
ggagcagaggcgggccgaggt

SEQ ID NO: 64504 - DNA, 21 bp, Artificial Sequence
  Description of Artificial Sequence: Synthetic oligonucleotide
gagcagaggcgggccgaggtg

SEQ ID NO: 64505 - DNA, 22 bp, Artificial Sequence
  Description of Artificial Sequence: Synthetic oligonucleotide
agcagaggcgggccgaggtgga

SEQ ID NO: 64506 - DNA, 21 bp, Artificial Sequence
  Description of Artificial Sequence: Synthetic oligonucleotide
gcagaggcgggccgaggtgga

SEQ ID NO: 64507 - DNA, 22 bp, Artificial Sequence
  Description of Artificial Sequence: Synthetic oligonucleotide
cagaggcgggccgaggtggaca

SEQ ID NO: 64508 - DNA, 22 bp, Artificial Sequence
  Description of Artificial Sequence: Synthetic oligonucleotide
agaggcgggccgaggtggacac

SEQ ID NO: 64509 - DNA, 21 bp, Artificial Sequence
  Description of Artificial Sequence: Synthetic oligonucleotide
gaggcgggccgaggtggacac

SEQ ID NO: 64510 - DNA, 23 bp, Artificial Sequence
  Description of Artificial Sequence: Synthetic oligonucleotide
aggcgggccgaggtggacaccta

SEQ ID NO: 64511 - DNA, 22 bp, Artificial Sequence
  Description of Artificial Sequence: Synthetic oligonucleotide
ggcgggccgaggtggacaccta

SEQ ID NO: 64512 - DNA, 23 bp, Artificial Sequence
  Description of Artificial Sequence: Synthetic oligonucleotide
gcgggccgaggtggacacctact

SEQ ID NO: 64513 - DNA, 23 bp, Artificial Sequence
  Description of Artificial Sequence: Synthetic oligonucleotide
cgggccgaggtggacacctactg

SEQ ID NO: 64514 - DNA, 24 bp, Artificial Sequence
  Description of Artificial Sequence: Synthetic oligonucleotide
gggccgaggtggacacctactgca

SEQ ID NO: 64515 - DNA, 25 bp, Artificial Sequence
  Description of Artificial Sequence: Synthetic oligonucleotide
ggccgaggtggacacctactgcaga

SEQ ID NO: 64516 - DNA, 26 bp, Artificial Sequence
  Description of Artificial Sequence: Synthetic oligonucleotide
gccgaggtggacacctactgcagaca

SEQ ID NO: 64517 - DNA, 27 bp, Artificial Sequence
  Description of Artificial Sequence: Synthetic oligonucleotide
ccgaggtggacacctactgcagacaca

SEQ ID NO: 64518 - DNA, 28 bp, Artificial Sequence
  Description of Artificial Sequence: Synthetic oligonucleotide
cgaggtggacacctactgcagacacaac

SEQ ID NO: 64519 - DNA, 30 bp, Artificial Sequence
  Description of Artificial Sequence: Synthetic oligonucleotide
gaggtggacacctactgcagacacaactac

SEQ ID NO: 64520 - DNA, 30 bp, Artificial Sequence
  Description of Artificial Sequence: Synthetic oligonucleotide
aggtggacacctactgcagacacaactacg

SEQ ID NO: 64521 - DNA, 22 bp, Artificial Sequence
  Description of Artificial Sequence: Synthetic oligonucleotide
agcagaggcgggccgcggtgaa

SEQ ID NO: 64522 - DNA, 21 bp, Artificial Sequence
  Description of Artificial Sequence: Synthetic oligonucleotide
gcagaggcgggccgcggtgaa

SEQ ID NO: 64523 - DNA, 22 bp, Artificial Sequence
  Description of Artificial Sequence: Synthetic oligonucleotide
cagaggcgggccgcggtgaaca

SEQ ID NO: 64524 - DNA, 22 bp, Artificial Sequence
  Description of Artificial Sequence: Synthetic oligonucleotide
agaggcgggccgcggtgaacac

SEQ ID NO: 64525 - DNA, 21 bp, Artificial Sequence
  Description of Artificial Sequence: Synthetic oligonucleotide
gaggcgggccgcggtgaacac

SEQ ID NO: 64526 - DNA, 23 bp, Artificial Sequence
  Description of Artificial Sequence: Synthetic oligonucleotide
aggcgggccgcggtgaacaccta

SEQ ID NO: 64527 - DNA, 22 bp, Artificial Sequence
  Description of Artificial Sequence: Synthetic oligonucleotide
ggcgggccgcggtgaacaccta

SEQ ID NO: 64528 - DNA, 23 bp, Artificial Sequence
  Description of Artificial Sequence: Synthetic oligonucleotide
gcgggccgcggtgaacacctact

SEQ ID NO: 64529 - DNA, 23 bp, Artificial Sequence
  Description of Artificial Sequence: Synthetic oligonucleotide
cgggccgcggtgaacacctactg

SEQ ID NO: 64530 - DNA, 24 bp, Artificial Sequence
  Description of Artificial Sequence: Synthetic oligonucleotide
gggccgcggtgaacacctactgca

SEQ ID NO: 64531 - DNA, 25 bp, Artificial Sequence
  Description of Artificial Sequence: Synthetic oligonucleotide
ggccgcggtgaacacctactgcaga

SEQ ID NO: 64532 - DNA, 26 bp, Artificial Sequence
  Description of Artificial Sequence: Synthetic oligonucleotide
gccgcggtgaacacctactgcagaca

SEQ ID NO: 64533 - DNA, 27 bp, Artificial Sequence
  Description of Artificial Sequence: Synthetic oligonucleotide
ccgcggtgaacacctactgcagacaca

SEQ ID NO: 64534 - DNA, 28 bp, Artificial Sequence
  Description of Artificial Sequence: Synthetic oligonucleotide
cgcggtgaacacctactgcagacacaac

SEQ ID NO: 64535 - DNA, 30 bp, Artificial Sequence
  Description of Artificial Sequence: Synthetic oligonucleotide
gcggtgaacacctactgcagacacaactac

SEQ ID NO: 64536 - DNA, 30 bp, Artificial Sequence
  Description of Artificial Sequence: Synthetic oligonucleotide
cggtgaacacctactgcagacacaactacg

SEQ ID NO: 64537 - DNA, 30 bp, Artificial Sequence
  Description of Artificial Sequence: Synthetic oligonucleotide
ggtgaacacctactgcagacacaactacgg

SEQ ID NO: 64538 - DNA, 30 bp, Artificial Sequence
  Description of Artificial Sequence: Synthetic oligonucleotide
gtgaacacctactgcagacacaactacggg

SEQ ID NO: 64539 - DNA, 30 bp, Artificial Sequence
  Description of Artificial Sequence: Synthetic oligonucleotide
tgaacacctactgcagacacaactacgggg

SEQ ID NO: 64540 - DNA, 29 bp, Artificial Sequence
  Description of Artificial Sequence: Synthetic oligonucleotide
gaacacctactgcagacacaactacgggg

SEQ ID NO: 64541 - DNA, 31 bp, Artificial Sequence
  Description of Artificial Sequence: Synthetic oligonucleotide
aacacctactgcagacacaactacggggttg

SEQ ID NO: 64542 - DNA, 20 bp, Artificial Sequence
  Description of Artificial Sequence: Synthetic oligonucleotide
gcgggccgcggtggacacct

SEQ ID NO: 64543 - DNA, 20 bp, Artificial Sequence
  Description of Artificial Sequence: Synthetic oligonucleotide
cgggccgcggtggacaccgt

SEQ ID NO: 64544 - DNA, 21 bp, Artificial Sequence
  Description of Artificial Sequence: Synthetic oligonucleotide
gggccgcggtggacaccgtgt

SEQ ID NO: 64545 - DNA, 21 bp, Artificial Sequence
  Description of Artificial Sequence: Synthetic oligonucleotide
ggccgcggtggacaccgtgtg

SEQ ID NO: 64546 - DNA, 22 bp, Artificial Sequence
  Description of Artificial Sequence: Synthetic oligonucleotide
gccgcggtggacaccgtgtgca

SEQ ID NO: 64547 - DNA, 23 bp, Artificial Sequence
  Description of Artificial Sequence: Synthetic oligonucleotide
ccgcggtggacaccgtgtgcaga

SEQ ID NO: 64548 - DNA, 24 bp, Artificial Sequence
  Description of Artificial Sequence: Synthetic oligonucleotide
cgcggtggacaccgtgtgcagaca

SEQ ID NO: 64549 - DNA, 26 bp, Artificial Sequence
  Description of Artificial Sequence: Synthetic oligonucleotide
gcggtggacaccgtgtgcagacacaa

SEQ ID NO: 64550 - DNA, 27 bp, Artificial Sequence
  Description of Artificial Sequence: Synthetic oligonucleotide
cggtggacaccgtgtgcagacacaact

SEQ ID NO: 64551 - DNA, 28 bp, Artificial Sequence
  Description of Artificial Sequence: Synthetic oligonucleotide
ggtggacaccgtgtgcagacacaactac

SEQ ID NO: 64552 - DNA, 28 bp, Artificial Sequence
  Description of Artificial Sequence: Synthetic oligonucleotide
gtggacaccgtgtgcagacacaactacg

SEQ ID NO: 64553 - DNA, 28 bp, Artificial Sequence
  Description of Artificial Sequence: Synthetic oligonucleotide
tggacaccgtgtgcagacacaactacgg

SEQ ID NO: 64554 - DNA, 27 bp, Artificial Sequence
  Description of Artificial Sequence: Synthetic oligonucleotide
ggacaccgtgtgcagacacaactacgg

SEQ ID NO: 64555 - DNA, 27 bp, Artificial Sequence
  Description of Artificial Sequence: Synthetic oligonucleotide
gacaccgtgtgcagacacaactacggg

SEQ ID NO: 64556 - DNA, 27 bp, Artificial Sequence
  Description of Artificial Sequence: Synthetic oligonucleotide
acaccgtgtgcagacacaactacgggg

SEQ ID NO: 64557 - DNA, 27 bp, Artificial Sequence
  Description of Artificial Sequence: Synthetic oligonucleotide
caccgtgtgcagacacaactacggggt

SEQ ID NO: 64558 - DNA, 28 bp, Artificial Sequence
  Description of Artificial Sequence: Synthetic oligonucleotide
accgtgtgcagacacaactacggggttg

SEQ ID NO: 64559 - DNA, 27 bp, Artificial Sequence
  Description of Artificial Sequence: Synthetic oligonucleotide
ccgtgtgcagacacaactacggggttg

SEQ ID NO: 64560 - DNA, 27 bp, Artificial Sequence
  Description of Artificial Sequence: Synthetic oligonucleotide
cgtgtgcagacacaactacggggttgg

SEQ ID NO: 64561 - DNA, 28 bp, Artificial Sequence
  Description of Artificial Sequence: Synthetic oligonucleotide
gtgtgcagacacaactacggggttggtg

SEQ ID NO: 64562 - DNA, 29 bp, Artificial Sequence
  Description of Artificial Sequence: Synthetic oligonucleotide
tgtgcagacacaactacggggttggtgag

SEQ ID NO: 64563 - DNA, 28 bp, Artificial Sequence
  Description of Artificial Sequence: Synthetic oligonucleotide
gtgcagacacaactacggggttggtgag

SEQ ID NO: 64564 - DNA, 41 bp, Artificial Sequence
  Description of Artificial Sequence: Synthetic oligonucleotide
cacgtttcttgtggcagcttaactttgaatgtcatttcttc

SEQ ID NO: 64565 - DNA, 44 bp, Artificial Sequence
  Description of Artificial Sequence: Synthetic oligonucleotide
acgtttcttgtggcagcttaactttgaatgtcatttcttcaatg

SEQ ID NO: 64566 - DNA, 43 bp, Artificial Sequence
  Description of Artificial Sequence: Synthetic oligonucleotide
cgtttcttgtggcagcttaactttgaatgtcatttcttcaatg

SEQ ID NO: 64567 - DNA, 43 bp, Artificial Sequence
  Description of Artificial Sequence: Synthetic oligonucleotide
gtttcttgtggcagcttaactttgaatgtcatttcttcaatgg

SEQ ID NO: 64568 - DNA, 43 bp, Artificial Sequence
  Description of Artificial Sequence: Synthetic oligonucleotide
tttcttgtggcagcttaactttgaatgtcatttcttcaatggg

SEQ ID NO: 64569 - DNA, 42 bp, Artificial Sequence
  Description of Artificial Sequence: Synthetic oligonucleotide
ttcttgtggcagcttaactttgaatgtcatttcttcaatggg

SEQ ID NO: 64570 - DNA, 41 bp, Artificial Sequence
  Description of Artificial Sequence: Synthetic oligonucleotide
tcttgtggcagcttaactttgaatgtcatttcttcaatggg

SEQ ID NO: 64571 - DNA, 40 bp, Artificial Sequence
  Description of Artificial Sequence: Synthetic oligonucleotide
cttgtggcagcttaactttgaatgtcatttcttcaatggg

SEQ ID NO: 64572 - DNA, 41 bp, Artificial Sequence
  Description of Artificial Sequence: Synthetic oligonucleotide
ttgtggcagcttaactttgaatgtcatttcttcaatgggac

SEQ ID NO: 64573 - DNA, 40 bp, Artificial Sequence
  Description of Artificial Sequence: Synthetic oligonucleotide
tgtggcagcttaactttgaatgtcatttcttcaatgggac

SEQ ID NO: 64574 - DNA, 39 bp, Artificial Sequence
  Description of Artificial Sequence: Synthetic oligonucleotide
gtggcagcttaactttgaatgtcatttcttcaatgggac

SEQ ID NO: 64575 - DNA, 39 bp, Artificial Sequence
  Description of Artificial Sequence: Synthetic oligonucleotide
tggcagcttaactttgaatgtcatttcttcaatgggacg

SEQ ID NO: 64576 - DNA, 38 bp, Artificial Sequence
  Description of Artificial Sequence: Synthetic oligonucleotide
ggcagcttaactttgaatgtcatttcttcaatgggacg

SEQ ID NO: 64577 - DNA, 38 bp, Artificial Sequence
  Description of Artificial Sequence: Synthetic oligonucleotide
gcagcttaactttgaatgtcatttcttcaatgggacgg

SEQ ID NO: 64578 - DNA, 39 bp, Artificial Sequence
  Description of Artificial Sequence: Synthetic oligonucleotide
cagcttaactttgaatgtcatttcttcaatgggacggag

SEQ ID NO: 64579 - DNA, 39 bp, Artificial Sequence
  Description of Artificial Sequence: Synthetic oligonucleotide
agcttaactttgaatgtcatttcttcaatgggacggagc

SEQ ID NO: 64580 - DNA, 38 bp, Artificial Sequence
  Description of Artificial Sequence: Synthetic oligonucleotide
gcttaactttgaatgtcatttcttcaatgggacggagc

SEQ ID NO: 64581 - DNA, 38 bp, Artificial Sequence
  Description of Artificial Sequence: Synthetic oligonucleotide
cttaactttgaatgtcatttcttcaatgggacggagcg

SEQ ID NO: 64582 - DNA, 38 bp, Artificial Sequence
  Description of Artificial Sequence: Synthetic oligonucleotide
ttaactttgaatgtcatttcttcaatgggacggagcgg

SEQ ID NO: 64583 - DNA, 37 bp, Artificial Sequence
  Description of Artificial Sequence: Synthetic oligonucleotide
taactttgaatgtcatttcttcaatgggacggagcgg

SEQ ID NO: 64584 - DNA, 36 bp, Artificial Sequence
  Description of Artificial Sequence: Synthetic oligonucleotide
aactttgaatgtcatttcttcaatgggacggagcgg

SEQ ID NO: 64585 - DNA, 35 bp, Artificial Sequence
  Description of Artificial Sequence: Synthetic oligonucleotide
actttgaatgtcatttcttcaatgggacggagcgg

SEQ ID NO: 64586 - DNA, 34 bp, Artificial Sequence
  Description of Artificial Sequence: Synthetic oligonucleotide
ctttgaatgtcatttcttcaatgggacggagcgg

SEQ ID NO: 64587 - DNA, 28 bp, Artificial Sequence
  Description of Artificial Sequence: Synthetic oligonucleotide
tggaacagccagaaggacctcctggaag

SEQ ID NO: 64588 - DNA, 27 bp, Artificial Sequence
  Description of Artificial Sequence: Synthetic oligonucleotide
ggaacagccagaaggacctcctggaag

SEQ ID NO: 64589 - DNA, 28 bp, Artificial Sequence
  Description of Artificial Sequence: Synthetic oligonucleotide
gaacagccagaaggacctcctggaagac

SEQ ID NO: 64590 - DNA, 29 bp, Artificial Sequence
  Description of Artificial Sequence: Synthetic oligonucleotide
aacagccagaaggacctcctggaagacag

SEQ ID NO: 64591 - DNA, 28 bp, Artificial Sequence
  Description of Artificial Sequence: Synthetic oligonucleotide
acagccagaaggacctcctggaagacag

SEQ ID NO: 64592 - DNA, 27 bp, Artificial Sequence
  Description of Artificial Sequence: Synthetic oligonucleotide
cagccagaaggacctcctggaagacag

SEQ ID NO: 64593 - DNA, 27 bp, Artificial Sequence
  Description of Artificial Sequence: Synthetic oligonucleotide
agccagaaggacctcctggaagacagg

SEQ ID NO: 64594 - DNA, 26 bp, Artificial Sequence
  Description of Artificial Sequence: Synthetic oligonucleotide
gccagaaggacctcctggaagacagg

SEQ ID NO: 64595 - DNA, 26 bp, Artificial Sequence
  Description of Artificial Sequence: Synthetic oligonucleotide
ccagaaggacctcctggaagacaggc

SEQ ID NO: 64596 - DNA, 26 bp, Artificial Sequence
  Description of Artificial Sequence: Synthetic oligonucleotide
cagaaggacctcctggaagacaggcg

SEQ ID NO: 64597 - DNA, 26 bp, Artificial Sequence
  Description of Artificial Sequence: Synthetic oligonucleotide
agaaggacctcctggaagacaggcgc

SEQ ID NO: 64598 - DNA, 25 bp, Artificial Sequence
  Description of Artificial Sequence: Synthetic oligonucleotide
gaaggacctcctggaagacaggcgc

SEQ ID NO: 64599 - DNA, 25 bp, Artificial Sequence
  Description of Artificial Sequence: Synthetic oligonucleotide
aaggacctcctggaagacaggcgcg

SEQ ID NO: 64600 - DNA, 24 bp, Artificial Sequence
  Description of Artificial Sequence: Synthetic oligonucleotide
aggacctcctggaagacaggcgcg

SEQ ID NO: 64601 - DNA, 23 bp, Artificial Sequence
  Description of Artificial Sequence: Synthetic oligonucleotide
ggacctcctggaagacaggcgcg

SEQ ID NO: 64602 - DNA, 23 bp, Artificial Sequence
  Description of Artificial Sequence: Synthetic oligonucleotide
gacctcctggaagacaggcgcgc

SEQ ID NO: 64603 - DNA, 23 bp, Artificial Sequence
  Description of Artificial Sequence: Synthetic oligonucleotide
acctcctggaagacaggcgcgcc

SEQ ID NO: 64604 - DNA, 22 bp, Artificial Sequence
  Description of Artificial Sequence: Synthetic oligonucleotide
cctcctggaagacaggcgcgcc

SEQ ID NO: 64605 - DNA, 22 bp, Artificial Sequence
  Description of Artificial Sequence: Synthetic oligonucleotide
ctcctggaagacaggcgcgccg

SEQ ID NO: 64606 - DNA, 22 bp, Artificial Sequence
  Description of Artificial Sequence: Synthetic oligonucleotide
tcctggaagacaggcgcgccgc

SEQ ID NO: 64607 - DNA, 21 bp, Artificial Sequence
  Description of Artificial Sequence: Synthetic oligonucleotide
cctggaagacaggcgcgccgc

SEQ ID NO: 64608 - DNA, 21 bp, Artificial Sequence
  Description of Artificial Sequence: Synthetic oligonucleotide
ctggaagacaggcgcgccgcg

SEQ ID NO: 64609 - DNA, 22 bp, Artificial Sequence
  Description of Artificial Sequence: Synthetic oligonucleotide
tggaagacaggcgcgccgcggt

SEQ ID NO: 64610 - DNA, 21 bp, Artificial Sequence
  Description of Artificial Sequence: Synthetic oligonucleotide
ggaagacaggcgcgccgcggt

SEQ ID NO: 64611 - DNA, 21 bp, Artificial Sequence
  Description of Artificial Sequence: Synthetic oligonucleotide
gaagacaggcgcgccgcggtg

SEQ ID NO: 64612 - DNA, 22 bp, Artificial Sequence
  Description of Artificial Sequence: Synthetic oligonucleotide
aagacaggcgcgccgcggtgga

SEQ ID NO: 64613 - DNA, 21 bp, Artificial Sequence
  Description of Artificial Sequence: Synthetic oligonucleotide
agacaggcgcgccgcggtgga

SEQ ID NO: 64614 - DNA, 20 bp, Artificial Sequence
  Description of Artificial Sequence: Synthetic oligonucleotide
gacaggcgcgccgcggtgga

SEQ ID NO: 64615 - DNA, 21 bp, Artificial Sequence
  Description of Artificial Sequence: Synthetic oligonucleotide
acaggcgcgccgcggtggaca

SEQ ID NO: 64616 - DNA, 20 bp, Artificial Sequence
  Description of Artificial Sequence: Synthetic oligonucleotide
caggcgcgccgcggtggaca

SEQ ID NO: 64617 - DNA, 20 bp, Artificial Sequence
  Description of Artificial Sequence: Synthetic oligonucleotide
aggcgcgccgcggtggacac

SEQ ID NO: 64618 - DNA, 20 bp, Artificial Sequence
  Description of Artificial Sequence: Synthetic oligonucleotide
ggcgcgccgcggtggacact

SEQ ID NO: 64619 - DNA, 23 bp, Artificial Sequence
  Description of Artificial Sequence: Synthetic oligonucleotide
gcgcgccgcggtggacacctatt

SEQ ID NO: 64620 - DNA, 23 bp, Artificial Sequence
  Description of Artificial Sequence: Synthetic oligonucleotide
cgcgccgcggtggacacctattg

SEQ ID NO: 64621 - DNA, 24 bp, Artificial Sequence
  Description of Artificial Sequence: Synthetic oligonucleotide
gcgccgcggtggacacctattgca

SEQ ID NO: 64622 - DNA, 25 bp, Artificial Sequence
  Description of Artificial Sequence: Synthetic oligonucleotide
cgccgcggtggacacctattgcaga

SEQ ID NO: 64623 - DNA, 29 bp, Artificial Sequence
  Description of Artificial Sequence: Synthetic oligonucleotide
aacagccagaaggacatcctggagcagag

SEQ ID NO: 64624 - DNA, 28 bp, Artificial Sequence
  Description of Artificial Sequence: Synthetic oligonucleotide
acagccagaaggacatcctggagcagag

SEQ ID NO: 64625 - DNA, 27 bp, Artificial Sequence
  Description of Artificial Sequence: Synthetic oligonucleotide
cagccagaaggacatcctggagcagag

SEQ ID NO: 64626 - DNA, 27 bp, Artificial Sequence
  Description of Artificial Sequence: Synthetic oligonucleotide
agccagaaggacatcctggagcagagg

SEQ ID NO: 64627 - DNA, 26 bp, Artificial Sequence
  Description of Artificial Sequence: Synthetic oligonucleotide
gccagaaggacatcctggagcagagg

SEQ ID NO: 64628 - DNA, 26 bp, Artificial Sequence
  Description of Artificial Sequence: Synthetic oligonucleotide
ccagaaggacatcctggagcagaggc

SEQ ID NO: 64629 - DNA, 26 bp, Artificial Sequence
  Description of Artificial Sequence: Synthetic oligonucleotide
cagaaggacatcctggagcagaggcg

SEQ ID NO: 64630 - DNA, 26 bp, Artificial Sequence
  Description of Artificial Sequence: Synthetic oligonucleotide
agaaggacatcctggagcagaggcgg

SEQ ID NO: 64631 - DNA, 25 bp, Artificial Sequence
  Description of Artificial Sequence: Synthetic oligonucleotide
gaaggacatcctggagcagaggcgg

SEQ ID NO: 64632 - DNA, 25 bp, Artificial Sequence
  Description of Artificial Sequence: Synthetic oligonucleotide
aaggacatcctggagcagaggcggg

SEQ ID NO: 64633 - DNA, 24 bp, Artificial Sequence
  Description of Artificial Sequence: Synthetic oligonucleotide
aggacatcctggagcagaggcggg

SEQ ID NO: 64634 - DNA, 23 bp, Artificial Sequence
  Description of Artificial Sequence: Synthetic oligonucleotide
ggacatcctggagcagaggcggg

SEQ ID NO: 64635 - DNA, 23 bp, Artificial Sequence
  Description of Artificial Sequence: Synthetic oligonucleotide
gacatcctggagcagaggcgggc

SEQ ID NO: 64636 - DNA, 23 bp, Artificial Sequence
  Description of Artificial Sequence: Synthetic oligonucleotide
acatcctggagcagaggcgggcc

SEQ ID NO: 64637 - DNA, 22 bp, Artificial Sequence
  Description of Artificial Sequence: Synthetic oligonucleotide
catcctggagcagaggcgggcc

SEQ ID NO: 64638 - DNA, 22 bp, Artificial Sequence
  Description of Artificial Sequence: Synthetic oligonucleotide
atcctggagcagaggcgggccg

SEQ ID NO: 64639 - DNA, 40 bp, Artificial Sequence
  Description of Artificial Sequence: Synthetic oligonucleotide
agcttaagtttgaatgtcatttcttcaatgggacggagtg

SEQ ID NO: 64640 - DNA, 39 bp, Artificial Sequence
  Description of Artificial Sequence: Synthetic oligonucleotide
gcttaagtttgaatgtcatttcttcaatgggacggagtg

SEQ ID NO: 64641 - DNA, 39 bp, Artificial Sequence
  Description of Artificial Sequence: Synthetic oligonucleotide
cttaagtttgaatgtcatttcttcaatgggacggagtgg

SEQ ID NO: 64642 - DNA, 39 bp, Artificial Sequence
  Description of Artificial Sequence: Synthetic oligonucleotide
ttaagtttgaatgtcatttcttcaatgggacggagtggg

SEQ ID NO: 64643 - DNA, 38 bp, Artificial Sequence
  Description of Artificial Sequence: Synthetic oligonucleotide
taagtttgaatgtcatttcttcaatgggacggagtggg

SEQ ID NO: 64644 - DNA, 37 bp, Artificial Sequence
  Description of Artificial Sequence: Synthetic oligonucleotide
aagtttgaatgtcatttcttcaatgggacggagtggg

SEQ ID NO: 64645 - DNA, 36 bp, Artificial Sequence
  Description of Artificial Sequence: Synthetic oligonucleotide
agtttgaatgtcatttcttcaatgggacggagtggg

SEQ ID NO: 64646 - DNA, 35 bp, Artificial Sequence
  Description of Artificial Sequence: Synthetic oligonucleotide
gtttgaatgtcatttcttcaatgggacggagtggg

SEQ ID NO: 64647 - DNA, 36 bp, Artificial Sequence
  Description of Artificial Sequence: Synthetic oligonucleotide
tttgaatgtcatttcttcaatgggacggagtgggtg

SEQ ID NO: 64648 - DNA, 35 bp, Artificial Sequence
  Description of Artificial Sequence: Synthetic oligonucleotide
ttgaatgtcatttcttcaatgggacggagtgggtg

SEQ ID NO: 64649 - DNA, 34 bp, Artificial Sequence
  Description of Artificial Sequence: Synthetic oligonucleotide
tgaatgtcatttcttcaatgggacggagtgggtg

SEQ ID NO: 64650 - DNA, 33 bp, Artificial Sequence
  Description of Artificial Sequence: Synthetic oligonucleotide
gaatgtcatttcttcaatgggacggagtgggtg

SEQ ID NO: 64651 - DNA, 33 bp, Artificial Sequence
  Description of Artificial Sequence: Synthetic oligonucleotide
aatgtcatttcttcaatgggacggagtgggtgc

SEQ ID NO: 64652 - DNA, 32 bp, Artificial Sequence
  Description of Artificial Sequence: Synthetic oligonucleotide
atgtcatttcttcaatgggacggagtgggtgc

SEQ ID NO: 64653 - DNA, 31 bp, Artificial Sequence
  Description of Artificial Sequence: Synthetic oligonucleotide
tgtcatttcttcaatgggacggagtgggtgc

SEQ ID NO: 64654 - DNA, 30 bp, Artificial Sequence
  Description of Artificial Sequence: Synthetic oligonucleotide
gtcatttcttcaatgggacggagtgggtgc

SEQ ID NO: 64655 - DNA, 30 bp, Artificial Sequence
  Description of Artificial Sequence: Synthetic oligonucleotide
tcatttcttcaatgggacggagtgggtgcg

SEQ ID NO: 64656 - DNA, 29 bp, Artificial Sequence
  Description of Artificial Sequence: Synthetic oligonucleotide
catttcttcaatgggacggagtgggtgcg

SEQ ID NO: 64657 - DNA, 29 bp, Artificial Sequence
  Description of Artificial Sequence: Synthetic oligonucleotide
atttcttcaatgggacggagtgggtgcgg

SEQ ID NO: 64658 - DNA, 28 bp, Artificial Sequence
  Description of Artificial Sequence: Synthetic oligonucleotide
tttcttcaatgggacggagtgggtgcgg

SEQ ID NO: 64659 - DNA, 27 bp, Artificial Sequence
  Description of Artificial Sequence: Synthetic oligonucleotide
ttcttcaatgggacggagtgggtgcgg

SEQ ID NO: 64660 - DNA, 27 bp, Artificial Sequence
  Description of Artificial Sequence: Synthetic oligonucleotide
tcttcaatgggacggagtgggtgcggt

SEQ ID NO: 64661 - DNA, 27 bp, Artificial Sequence
  Description of Artificial Sequence: Synthetic oligonucleotide
cttcaatgggacggagtgggtgcggtt

SEQ ID NO: 64662 - DNA, 27 bp, Artificial Sequence
  Description of Artificial Sequence: Synthetic oligonucleotide
ttcaatgggacggagtgggtgcggttg

SEQ ID NO: 64663 - DNA, 26 bp, Artificial Sequence
  Description of Artificial Sequence: Synthetic oligonucleotide
tcaatgggacggagtgggtgcggttg

SEQ ID NO: 64664 - DNA, 25 bp, Artificial Sequence
  Description of Artificial Sequence: Synthetic oligonucleotide
caatgggacggagtgggtgcggttg

SEQ ID NO: 64665 - DNA, 26 bp, Artificial Sequence
  Description of Artificial Sequence: Synthetic oligonucleotide
aatgggacggagtgggtgcggttgct

SEQ ID NO: 64666 - DNA, 25 bp, Artificial Sequence
  Description of Artificial Sequence: Synthetic oligonucleotide
atgggacggagtgggtgcggttgct

SEQ ID NO: 64667 - DNA, 24 bp, Artificial Sequence
  Description of Artificial Sequence: Synthetic oligonucleotide
tgggacggagtgggtgcggttgct

SEQ ID NO: 64668 - DNA, 23 bp, Artificial Sequence
  Description of Artificial Sequence: Synthetic oligonucleotide
gggacggagtgggtgcggttgct

SEQ ID NO: 64669 - DNA, 23 bp, Artificial Sequence
  Description of Artificial Sequence: Synthetic oligonucleotide
ggacggagtgggtgcggttgctg

SEQ ID NO: 64670 - DNA, 26 bp, Artificial Sequence
  Description of Artificial Sequence: Synthetic oligonucleotide
gacggagtgggtgcggttgctggaaa

SEQ ID NO: 64671 - DNA, 27 bp, Artificial Sequence
  Description of Artificial Sequence: Synthetic oligonucleotide
acggagtgggtgcggttgctggaaaga

SEQ ID NO: 64672 - DNA, 27 bp, Artificial Sequence
  Description of Artificial Sequence: Synthetic oligonucleotide
cggagtgggtgcggttgctggaaagat

SEQ ID NO: 64673 - DNA, 27 bp, Artificial Sequence
  Description of Artificial Sequence: Synthetic oligonucleotide
ggagtgggtgcggttgctggaaagatg

SEQ ID NO: 64674 - DNA, 27 bp, Artificial Sequence
  Description of Artificial Sequence: Synthetic oligonucleotide
gagtgggtgcggttgctggaaagatgc

SEQ ID NO: 64675 - DNA, 29 bp, Artificial Sequence
  Description of Artificial Sequence: Synthetic oligonucleotide
agtgggtgcggttgctggaaagatgcatc

SEQ ID NO: 64676 - DNA, 28 bp, Artificial Sequence
  Description of Artificial Sequence: Synthetic oligonucleotide
gtgggtgcggttgctggaaagatgcatc

SEQ ID NO: 64677 - DNA, 33 bp, Artificial Sequence
  Description of Artificial Sequence: Synthetic oligonucleotide
tgggtgcggttgctggaaagatgcatctataac

SEQ ID NO: 64678 - DNA, 22 bp, Artificial Sequence
  Description of Artificial Sequence: Synthetic oligonucleotide
ctggggcggcctgatgccgagt

SEQ ID NO: 64679 - DNA, 22 bp, Artificial Sequence
  Description of Artificial Sequence: Synthetic oligonucleotide
tggggcggcctgatgccgagtc

SEQ ID NO: 64680 - DNA, 21 bp, Artificial Sequence
  Description of Artificial Sequence: Synthetic oligonucleotide
ggggcggcctgatgccgagtc

SEQ ID NO: 64681 - DNA, 22 bp, Artificial Sequence
  Description of Artificial Sequence: Synthetic oligonucleotide
gggcggcctgatgccgagtcct

SEQ ID NO: 64682 - DNA, 22 bp, Artificial Sequence
  Description of Artificial Sequence: Synthetic oligonucleotide
ggcggcctgatgccgagtcctg

SEQ ID NO: 64683 - DNA, 24 bp, Artificial Sequence
  Description of Artificial Sequence: Synthetic oligonucleotide
gcggcctgatgccgagtcctggaa

SEQ ID NO: 64684 - DNA, 25 bp, Artificial Sequence
  Description of Artificial Sequence: Synthetic oligonucleotide
cggcctgatgccgagtcctggaaca

SEQ ID NO: 64685 - DNA, 25 bp, Artificial Sequence
  Description of Artificial Sequence: Synthetic oligonucleotide
ggcctgatgccgagtcctggaacag

SEQ ID NO: 64686 - DNA, 25 bp, Artificial Sequence
  Description of Artificial Sequence: Synthetic oligonucleotide
gcctgatgccgagtcctggaacagc

SEQ ID NO: 64687 - DNA, 26 bp, Artificial Sequence
  Description of Artificial Sequence: Synthetic oligonucleotide
cctgatgccgagtcctggaacagcca

SEQ ID NO: 64688 - DNA, 27 bp, Artificial Sequence
  Description of Artificial Sequence: Synthetic oligonucleotide
ctgatgccgagtcctggaacagccaga

SEQ ID NO: 64689 - DNA, 28 bp, Artificial Sequence
  Description of Artificial Sequence: Synthetic oligonucleotide
tgatgccgagtcctggaacagccagaag

SEQ ID NO: 64690 - DNA, 27 bp, Artificial Sequence
  Description of Artificial Sequence: Synthetic oligonucleotide
gatgccgagtcctggaacagccagaag

SEQ ID NO: 64691 - DNA, 27 bp, Artificial Sequence
  Description of Artificial Sequence: Synthetic oligonucleotide
atgccgagtcctggaacagccagaagg

SEQ ID NO: 64692 - DNA, 27 bp, Artificial Sequence
  Description of Artificial Sequence: Synthetic oligonucleotide
tgccgagtcctggaacagccagaagga

SEQ ID NO: 64693 - DNA, 26 bp, Artificial Sequence
  Description of Artificial Sequence: Synthetic oligonucleotide
gccgagtcctggaacagccagaagga

SEQ ID NO: 64694 - DNA, 26 bp, Artificial Sequence
  Description of Artificial Sequence: Synthetic oligonucleotide
ccgagtcctggaacagccagaaggac

SEQ ID NO: 64695 - DNA, 27 bp, Artificial Sequence
  Description of Artificial Sequence: Synthetic oligonucleotide
cgagtcctggaacagccagaaggacct

SEQ ID NO: 64696 - DNA, 27 bp, Artificial Sequence
  Description of Artificial Sequence: Synthetic oligonucleotide
gagtcctggaacagccagaaggacctc

SEQ ID NO: 64697 - DNA, 27 bp, Artificial Sequence
  Description of Artificial Sequence: Synthetic oligonucleotide
agtcctggaacagccagaaggacctcc

SEQ ID NO: 64698 - DNA, 27 bp, Artificial Sequence
  Description of Artificial Sequence: Synthetic oligonucleotide
gtcctggaacagccagaaggacctcct

SEQ ID NO: 64699 - DNA, 27 bp, Artificial Sequence
  Description of Artificial Sequence: Synthetic oligonucleotide
tcctggaacagccagaaggacctcctg

SEQ ID NO: 64700 - DNA, 26 bp, Artificial Sequence
  Description of Artificial Sequence: Synthetic oligonucleotide
cctggaacagccagaaggacctcctg

SEQ ID NO: 64701 - DNA, 39 bp, Artificial Sequence
  Description of Artificial Sequence: Synthetic oligonucleotide
agcttaagtttgaatgtcatttcttcaatgggacggagg

SEQ ID NO: 64702 - DNA, 38 bp, Artificial Sequence
  Description of Artificial Sequence: Synthetic oligonucleotide
gcttaagtttgaatgtcatttcttcaatgggacggagg

SEQ ID NO: 64703 - DNA, 38 bp, Artificial Sequence
  Description of Artificial Sequence: Synthetic oligonucleotide
cttaagtttgaatgtcatttcttcaatgggacggaggg

SEQ ID NO: 64704 - DNA, 38 bp, Artificial Sequence
  Description of Artificial Sequence: Synthetic oligonucleotide
ttaagtttgaatgtcatttcttcaatgggacggagggg

SEQ ID NO: 64705 - DNA, 37 bp, Artificial Sequence
  Description of Artificial Sequence: Synthetic oligonucleotide
taagtttgaatgtcatttcttcaatgggacggagggg

SEQ ID NO: 64706 - DNA, 36 bp, Artificial Sequence
  Description of Artificial Sequence: Synthetic oligonucleotide
aagtttgaatgtcatttcttcaatgggacggagggg

SEQ ID NO: 64707 - DNA, 35 bp, Artificial Sequence
  Description of Artificial Sequence: Synthetic oligonucleotide
agtttgaatgtcatttcttcaatgggacggagggg

SEQ ID NO: 64708 - DNA, 34 bp, Artificial Sequence
  Description of Artificial Sequence: Synthetic oligonucleotide
gtttgaatgtcatttcttcaatgggacggagggg

SEQ ID NO: 64709 - DNA, 34 bp, Artificial Sequence
  Description of Artificial Sequence: Synthetic oligonucleotide
tttgaatgtcatttcttcaatgggacggaggggg

SEQ ID NO: 64710 - DNA, 33 bp, Artificial Sequence
  Description of Artificial Sequence: Synthetic oligonucleotide
ttgaatgtcatttcttcaatgggacggaggggg

SEQ ID NO: 64711 - DNA, 32 bp, Artificial Sequence
  Description of Artificial Sequence: Synthetic oligonucleotide
tgaatgtcatttcttcaatgggacggaggggg

SEQ ID NO: 64712 - DNA, 31 bp, Artificial Sequence
  Description of Artificial Sequence: Synthetic oligonucleotide
gaatgtcatttcttcaatgggacggaggggg

SEQ ID NO: 64713 - DNA, 32 bp, Artificial Sequence
  Description of Artificial Sequence: Synthetic oligonucleotide
aatgtcatttcttcaatgggacggagggggtg

SEQ ID NO: 64714 - DNA, 31 bp, Artificial Sequence
  Description of Artificial Sequence: Synthetic oligonucleotide
atgtcatttcttcaatgggacggagggggtg

SEQ ID NO: 64715 - DNA, 30 bp, Artificial Sequence
  Description of Artificial Sequence: Synthetic oligonucleotide
tgtcatttcttcaatgggacggagggggtg

SEQ ID NO: 64716 - DNA, 29 bp, Artificial Sequence
  Description of Artificial Sequence: Synthetic oligonucleotide
gtcatttcttcaatgggacggagggggtg

SEQ ID NO: 64717 - DNA, 29 bp, Artificial Sequence
  Description of Artificial Sequence: Synthetic oligonucleotide
tcatttcttcaatgggacggagggggtgc

SEQ ID NO: 64718 - DNA, 28 bp, Artificial Sequence
  Description of Artificial Sequence: Synthetic oligonucleotide
catttcttcaatgggacggagggggtgc

SEQ ID NO: 64719 - DNA, 28 bp, Artificial Sequence
  Description of Artificial Sequence: Synthetic oligonucleotide
atttcttcaatgggacggagggggtgcg

SEQ ID NO: 64720 - DNA, 27 bp, Artificial Sequence
  Description of Artificial Sequence: Synthetic oligonucleotide
tttcttcaatgggacggagggggtgcg

SEQ ID NO: 64721 - DNA, 26 bp, Artificial Sequence
  Description of Artificial Sequence: Synthetic oligonucleotide
ttcttcaatgggacggagggggtgcg

SEQ ID NO: 64722 - DNA, 25 bp, Artificial Sequence
  Description of Artificial Sequence: Synthetic oligonucleotide
tcttcaatgggacggagggggtgcg

SEQ ID NO: 64723 - DNA, 24 bp, Artificial Sequence
  Description of Artificial Sequence: Synthetic oligonucleotide
cttcaatgggacggagggggtgcg

SEQ ID NO: 64724 - DNA, 26 bp, Artificial Sequence
  Description of Artificial Sequence: Synthetic oligonucleotide
ttcaatgggacggagggggtgcggtt

SEQ ID NO: 64725 - DNA, 25 bp, Artificial Sequence
  Description of Artificial Sequence: Synthetic oligonucleotide
tcaatgggacggagggggtgcggtt

SEQ ID NO: 64726 - DNA, 24 bp, Artificial Sequence
  Description of Artificial Sequence: Synthetic oligonucleotide
caatgggacggagggggtgcggtt

SEQ ID NO: 64727 - DNA, 24 bp, Artificial Sequence
  Description of Artificial Sequence: Synthetic oligonucleotide
aatgggacggagggggtgcggttg

SEQ ID NO: 64728 - DNA, 23 bp, Artificial Sequence
  Description of Artificial Sequence: Synthetic oligonucleotide
atgggacggagggggtgcggttg

SEQ ID NO: 64729 - DNA, 22 bp, Artificial Sequence
  Description of Artificial Sequence: Synthetic oligonucleotide
tgggacggagggggtgcggttg

SEQ ID NO: 64730 - DNA, 21 bp, Artificial Sequence
  Description of Artificial Sequence: Synthetic oligonucleotide
gggacggagggggtgcggttg

SEQ ID NO: 64731 - DNA, 22 bp, Artificial Sequence
  Description of Artificial Sequence: Synthetic oligonucleotide
ggacggagggggtgcggttgct

SEQ ID NO: 64732 - DNA, 22 bp, Artificial Sequence
  Description of Artificial Sequence: Synthetic oligonucleotide
gacggagggggtgcggttgctg

SEQ ID NO: 64733 - DNA, 25 bp, Artificial Sequence
  Description of Artificial Sequence: Synthetic oligonucleotide
acggagggggtgcggttgctggaaa

SEQ ID NO: 64734 - DNA, 24 bp, Artificial Sequence
  Description of Artificial Sequence: Synthetic oligonucleotide
cggagggggtgcggttgctggaaa

SEQ ID NO: 64735 - DNA, 26 bp, Artificial Sequence
  Description of Artificial Sequence: Synthetic oligonucleotide
ggagggggtgcggttgctggaaagat

SEQ ID NO: 64736 - DNA, 26 bp, Artificial Sequence
  Description of Artificial Sequence: Synthetic oligonucleotide
gagggggtgcggttgctggaaagatg

SEQ ID NO: 64737 - DNA, 27 bp, Artificial Sequence
  Description of Artificial Sequence: Synthetic oligonucleotide
agggggtgcggttgctggaaagatgca

SEQ ID NO: 64738 - DNA, 27 bp, Artificial Sequence
  Description of Artificial Sequence: Synthetic oligonucleotide
gggggtgcggttgctggaaagatgcat

SEQ ID NO: 64739 - DNA, 27 bp, Artificial Sequence
  Description of Artificial Sequence: Synthetic oligonucleotide
ggggtgcggttgctggaaagatgcatc

SEQ ID NO: 64740 - DNA, 23 bp, Artificial Sequence
  Description of Artificial Sequence: Synthetic oligonucleotide
gtgggggagtaccgggcggtgat

SEQ ID NO: 64741 - DNA, 23 bp, Artificial Sequence
  Description of Artificial Sequence: Synthetic oligonucleotide
tgggggagtaccgggcggtgatg

SEQ ID NO: 64742 - DNA, 22 bp, Artificial Sequence
  Description of Artificial Sequence: Synthetic oligonucleotide
gggggagtaccgggcggtgatg

SEQ ID NO: 64743 - DNA, 23 bp, Artificial Sequence
  Description of Artificial Sequence: Synthetic oligonucleotide
ggggagtaccgggcggtgatgga

SEQ ID NO: 64744 - DNA, 23 bp, Artificial Sequence
  Description of Artificial Sequence: Synthetic oligonucleotide
gggagtaccgggcggtgatggag

SEQ ID NO: 64745 - DNA, 24 bp, Artificial Sequence
  Description of Artificial Sequence: Synthetic oligonucleotide
ggagtaccgggcggtgatggagct

SEQ ID NO: 64746 - DNA, 24 bp, Artificial Sequence
  Description of Artificial Sequence: Synthetic oligonucleotide
gagtaccgggcggtgatggagctg

SEQ ID NO: 64747 - DNA, 24 bp, Artificial Sequence
  Description of Artificial Sequence: Synthetic oligonucleotide
agtaccgggcggtgatggagctgg

SEQ ID NO: 64748 - DNA, 23 bp, Artificial Sequence
  Description of Artificial Sequence: Synthetic oligonucleotide
gtaccgggcggtgatggagctgg

SEQ ID NO: 64749 - DNA, 23 bp, Artificial Sequence
  Description of Artificial Sequence: Synthetic oligonucleotide
taccgggcggtgatggagctggg

SEQ ID NO: 64750 - DNA, 22 bp, Artificial Sequence
  Description of Artificial Sequence: Synthetic oligonucleotide
accgggcggtgatggagctggg

SEQ ID NO: 64751 - DNA, 21 bp, Artificial Sequence
  Description of Artificial Sequence: Synthetic oligonucleotide
ccgggcggtgatggagctggg

SEQ ID NO: 64752 - DNA, 21 bp, Artificial Sequence
  Description of Artificial Sequence: Synthetic oligonucleotide
cgggcggtgatggagctgggg

SEQ ID NO: 64753 - DNA, 21 bp, Artificial Sequence
  Description of Artificial Sequence: Synthetic oligonucleotide
gggcggtgatggagctggggc

SEQ ID NO: 64754 - DNA, 21 bp, Artificial Sequence
  Description of Artificial Sequence: Synthetic oligonucleotide
ggcggtgatggagctggggcg

SEQ ID NO: 64755 - DNA, 21 bp, Artificial Sequence
  Description of Artificial Sequence: Synthetic oligonucleotide
gcggtgatggagctggggcgg

SEQ ID NO: 64756 - DNA, 21 bp, Artificial Sequence
  Description of Artificial Sequence: Synthetic oligonucleotide
cggtgatggagctggggcggc

SEQ ID NO: 64757 - DNA, 22 bp, Artificial Sequence
  Description of Artificial Sequence: Synthetic oligonucleotide
ggtgatggagctggggcggcct

SEQ ID NO: 64758 - DNA, 24 bp, Artificial Sequence
  Description of Artificial Sequence: Synthetic oligonucleotide
gtgatggagctggggcggcctgat

SEQ ID NO: 64759 - DNA, 24 bp, Artificial Sequence
  Description of Artificial Sequence: Synthetic oligonucleotide
tgatggagctggggcggcctgatg

SEQ ID NO: 64760 - DNA, 23 bp, Artificial Sequence
  Description of Artificial Sequence: Synthetic oligonucleotide
gatggagctggggcggcctgatg

SEQ ID NO: 64761 - DNA, 23 bp, Artificial Sequence
  Description of Artificial Sequence: Synthetic oligonucleotide
atggagctggggcggcctgatgc

SEQ ID NO: 64762 - DNA, 22 bp, Artificial Sequence
  Description of Artificial Sequence: Synthetic oligonucleotide
tggagctggggcggcctgatgc

SEQ ID NO: 64763 - DNA, 26 bp, Artificial Sequence
  Description of Artificial Sequence: Synthetic oligonucleotide
gaacagccagaaggacctcctggagc

SEQ ID NO: 64764 - DNA, 26 bp, Artificial Sequence
  Description of Artificial Sequence: Synthetic oligonucleotide
aacagccagaaggacctcctggagcg

SEQ ID NO: 64765 - DNA, 25 bp, Artificial Sequence
  Description of Artificial Sequence: Synthetic oligonucleotide
acagccagaaggacctcctggagcg

SEQ ID NO: 64766 - DNA, 24 bp, Artificial Sequence
  Description of Artificial Sequence: Synthetic oligonucleotide
cagccagaaggacctcctggagcg

SEQ ID NO: 64767 - DNA, 25 bp, Artificial Sequence
  Description of Artificial Sequence: Synthetic oligonucleotide
agccagaaggacctcctggagcgga

SEQ ID NO: 64768 - DNA, 24 bp, Artificial Sequence
  Description of Artificial Sequence: Synthetic oligonucleotide
gccagaaggacctcctggagcgga

SEQ ID NO: 64769 - DNA, 24 bp, Artificial Sequence
  Description of Artificial Sequence: Synthetic oligonucleotide
ccagaaggacctcctggagcggag

SEQ ID NO: 64770 - DNA, 24 bp, Artificial Sequence
  Description of Artificial Sequence: Synthetic oligonucleotide
cagaaggacctcctggagcggagg

SEQ ID NO: 64771 - DNA, 24 bp, Artificial Sequence
  Description of Artificial Sequence: Synthetic oligonucleotide
agaaggacctcctggagcggaggc

SEQ ID NO: 64772 - DNA, 23 bp, Artificial Sequence
  Description of Artificial Sequence: Synthetic oligonucleotide
gaaggacctcctggagcggaggc

SEQ ID NO: 64773 - DNA, 23 bp, Artificial Sequence
  Description of Artificial Sequence: Synthetic oligonucleotide
aaggacctcctggagcggaggcg

SEQ ID NO: 64774 - DNA, 22 bp, Artificial Sequence
  Description of Artificial Sequence: Synthetic oligonucleotide
aggacctcctggagcggaggcg

SEQ ID NO: 64775 - DNA, 21 bp, Artificial Sequence
  Description of Artificial Sequence: Synthetic oligonucleotide
ggacctcctggagcggaggcg

SEQ ID NO: 64776 - DNA, 21 bp, Artificial Sequence
  Description of Artificial Sequence: Synthetic oligonucleotide
gacctcctggagcggaggcgg

SEQ ID NO: 64777 - DNA, 21 bp, Artificial Sequence
  Description of Artificial Sequence: Synthetic oligonucleotide
acctcctggagcggaggcggg

SEQ ID NO: 64778 - DNA, 20 bp, Artificial Sequence
  Description of Artificial Sequence: Synthetic oligonucleotide
cctcctggagcggaggcggg

SEQ ID NO: 64779 - DNA, 20 bp, Artificial Sequence
  Description of Artificial Sequence: Synthetic oligonucleotide
ctcctggagcggaggcgggc

SEQ ID NO: 64780 - DNA, 20 bp, Artificial Sequence
  Description of Artificial Sequence: Synthetic oligonucleotide
tcctggagcggaggcgggcc

SEQ ID NO: 64781 - DNA, 20 bp, Artificial Sequence
  Description of Artificial Sequence: Synthetic oligonucleotide
cctggagcggaggcgggcct

SEQ ID NO: 64782 - DNA, 20 bp, Artificial Sequence
  Description of Artificial Sequence: Synthetic oligonucleotide
ctggagcggaggcgggccgt

SEQ ID NO: 64783 - DNA, 20 bp, Artificial Sequence
  Description of Artificial Sequence: Synthetic oligonucleotide
tggagcggaggcgggccgct

SEQ ID NO: 64784 - DNA, 20 bp, Artificial Sequence
  Description of Artificial Sequence: Synthetic oligonucleotide
ggagcggaggcgggccgctt

SEQ ID NO: 64785 - DNA, 20 bp, Artificial Sequence
  Description of Artificial Sequence: Synthetic oligonucleotide
gagcggaggcgggccgcgtt

SEQ ID NO: 64786 - DNA, 20 bp, Artificial Sequence
  Description of Artificial Sequence: Synthetic oligonucleotide
agcggaggcgggccgcggtt

SEQ ID NO: 64787 - DNA, 20 bp, Artificial Sequence
  Description of Artificial Sequence: Synthetic oligonucleotide
gcggaggcgggccgcggttt

SEQ ID NO: 64788 - DNA, 20 bp, Artificial Sequence
  Description of Artificial Sequence: Synthetic oligonucleotide
cggaggcgggccgcggtgtt

SEQ ID NO: 64789 - DNA, 20 bp, Artificial Sequence
  Description of Artificial Sequence: Synthetic oligonucleotide
ggaggcgggccgcggtggat

SEQ ID NO: 64790 - DNA, 23 bp, Artificial Sequence
  Description of Artificial Sequence: Synthetic oligonucleotide
gagctggggcggcctgatgccaa

SEQ ID NO: 64791 - DNA, 25 bp, Artificial Sequence
  Description of Artificial Sequence: Synthetic oligonucleotide
agctggggcggcctgatgccaagta

SEQ ID NO: 64792 - DNA, 24 bp, Artificial Sequence
  Description of Artificial Sequence: Synthetic oligonucleotide
gctggggcggcctgatgccaagta

SEQ ID NO: 64793 - DNA, 25 bp, Artificial Sequence
  Description of Artificial Sequence: Synthetic oligonucleotide
ctggggcggcctgatgccaagtact

SEQ ID NO: 64794 - DNA, 25 bp, Artificial Sequence
  Description of Artificial Sequence: Synthetic oligonucleotide
tggggcggcctgatgccaagtactg

SEQ ID NO: 64795 - DNA, 24 bp, Artificial Sequence
  Description of Artificial Sequence: Synthetic oligonucleotide
ggggcggcctgatgccaagtactg

SEQ ID NO: 64796 - DNA, 26 bp, Artificial Sequence
  Description of Artificial Sequence: Synthetic oligonucleotide
gggcggcctgatgccaagtactggaa

SEQ ID NO: 64797 - DNA, 27 bp, Artificial Sequence
  Description of Artificial Sequence: Synthetic oligonucleotide
ggcggcctgatgccaagtactggaaca

SEQ ID NO: 64798 - DNA, 27 bp, Artificial Sequence
  Description of Artificial Sequence: Synthetic oligonucleotide
gcggcctgatgccaagtactggaacag

SEQ ID NO: 64799 - DNA, 27 bp, Artificial Sequence
  Description of Artificial Sequence: Synthetic oligonucleotide
cggcctgatgccaagtactggaacagc

SEQ ID NO: 64800 - DNA, 27 bp, Artificial Sequence
  Description of Artificial Sequence: Synthetic oligonucleotide
ggcctgatgccaagtactggaacagcc

SEQ ID NO: 64801 - DNA, 28 bp, Artificial Sequence
  Description of Artificial Sequence: Synthetic oligonucleotide
gcctgatgccaagtactggaacagccag

SEQ ID NO: 64802 - DNA, 30 bp, Artificial Sequence
  Description of Artificial Sequence: Synthetic oligonucleotide
cctgatgccaagtactggaacagccagaag

SEQ ID NO: 64803 - DNA, 30 bp, Artificial Sequence
  Description of Artificial Sequence: Synthetic oligonucleotide
ctgatgccaagtactggaacagccagaagg

SEQ ID NO: 64804 - DNA, 31 bp, Artificial Sequence
  Description of Artificial Sequence: Synthetic oligonucleotide
tgatgccaagtactggaacagccagaaggac

SEQ ID NO: 64805 - DNA, 30 bp, Artificial Sequence
  Description of Artificial Sequence: Synthetic oligonucleotide
gatgccaagtactggaacagccagaaggac

SEQ ID NO: 64806 - DNA, 30 bp, Artificial Sequence
  Description of Artificial Sequence: Synthetic oligonucleotide
atgccaagtactggaacagccagaaggacc

SEQ ID NO: 64807 - DNA, 29 bp, Artificial Sequence
  Description of Artificial Sequence: Synthetic oligonucleotide
tgccaagtactggaacagccagaaggacc

SEQ ID NO: 64808 - DNA, 28 bp, Artificial Sequence
  Description of Artificial Sequence: Synthetic oligonucleotide
gccaagtactggaacagccagaaggacc

SEQ ID NO: 64809 - DNA, 29 bp, Artificial Sequence
  Description of Artificial Sequence: Synthetic oligonucleotide
ccaagtactggaacagccagaaggacctc

SEQ ID NO: 64810 - DNA, 29 bp, Artificial Sequence
  Description of Artificial Sequence: Synthetic oligonucleotide
caagtactggaacagccagaaggacctcc

SEQ ID NO: 64811 - DNA, 30 bp, Artificial Sequence
  Description of Artificial Sequence: Synthetic oligonucleotide
aagtactggaacagccagaaggacctcctg

SEQ ID NO: 64812 - DNA, 26 bp, Artificial Sequence
  Description of Artificial Sequence: Synthetic oligonucleotide
ttcgacagcgacgtgggggagtacca

SEQ ID NO: 64813 - DNA, 25 bp, Artificial Sequence
  Description of Artificial Sequence: Synthetic oligonucleotide
tcgacagcgacgtgggggagtacca

SEQ ID NO: 64814 - DNA, 24 bp, Artificial Sequence
  Description of Artificial Sequence: Synthetic oligonucleotide
cgacagcgacgtgggggagtacca

SEQ ID NO: 64815 - DNA, 24 bp, Artificial Sequence
  Description of Artificial Sequence: Synthetic oligonucleotide
gacagcgacgtgggggagtaccag

SEQ ID NO: 64816 - DNA, 24 bp, Artificial Sequence
  Description of Artificial Sequence: Synthetic oligonucleotide
acagcgacgtgggggagtaccagg

SEQ ID NO: 64817 - DNA, 23 bp, Artificial Sequence
  Description of Artificial Sequence: Synthetic oligonucleotide
cagcgacgtgggggagtaccagg

SEQ ID NO: 64818 - DNA, 23 bp, Artificial Sequence
  Description of Artificial Sequence: Synthetic oligonucleotide
agcgacgtgggggagtaccaggc

SEQ ID NO: 64819 - DNA, 22 bp, Artificial Sequence
  Description of Artificial Sequence: Synthetic oligonucleotide
gcgacgtgggggagtaccaggc

SEQ ID NO: 64820 - DNA, 22 bp, Artificial Sequence
  Description of Artificial Sequence: Synthetic oligonucleotide
cgacgtgggggagtaccaggcg

SEQ ID NO: 64821 - DNA, 23 bp, Artificial Sequence
  Description of Artificial Sequence: Synthetic oligonucleotide
gacgtgggggagtaccaggcggt

SEQ ID NO: 64822 - DNA, 24 bp, Artificial Sequence
  Description of Artificial Sequence: Synthetic oligonucleotide
acgtgggggagtaccaggcggtga

SEQ ID NO: 64823 - DNA, 23 bp, Artificial Sequence
  Description of Artificial Sequence: Synthetic oligonucleotide
cgtgggggagtaccaggcggtga

SEQ ID NO: 64824 - DNA, 23 bp, Artificial Sequence
  Description of Artificial Sequence: Synthetic oligonucleotide
gtgggggagtaccaggcggtgac

SEQ ID NO: 64825 - DNA, 23 bp, Artificial Sequence
  Description of Artificial Sequence: Synthetic oligonucleotide
tgggggagtaccaggcggtgacg

SEQ ID NO: 64826 - DNA, 22 bp, Artificial Sequence
  Description of Artificial Sequence: Synthetic oligonucleotide
gggggagtaccaggcggtgacg

SEQ ID NO: 64827 - DNA, 23 bp, Artificial Sequence
  Description of Artificial Sequence: Synthetic oligonucleotide
ggggagtaccaggcggtgacgga

SEQ ID NO: 64828 - DNA, 23 bp, Artificial Sequence
  Description of Artificial Sequence: Synthetic oligonucleotide
gggagtaccaggcggtgacggag

SEQ ID NO: 64829 - DNA, 24 bp, Artificial Sequence
  Description of Artificial Sequence: Synthetic oligonucleotide
ggagtaccaggcggtgacggagct

SEQ ID NO: 64830 - DNA, 24 bp, Artificial Sequence
  Description of Artificial Sequence: Synthetic oligonucleotide
gagtaccaggcggtgacggagctg

SEQ ID NO: 64831 - DNA, 24 bp, Artificial Sequence
  Description of Artificial Sequence: Synthetic oligonucleotide
agtaccaggcggtgacggagctgg

SEQ ID NO: 64832 - DNA, 23 bp, Artificial Sequence
  Description of Artificial Sequence: Synthetic oligonucleotide
gtaccaggcggtgacggagctgg

SEQ ID NO: 64833 - DNA, 23 bp, Artificial Sequence
  Description of Artificial Sequence: Synthetic oligonucleotide
taccaggcggtgacggagctggg

SEQ ID NO: 64834 - DNA, 22 bp, Artificial Sequence
  Description of Artificial Sequence: Synthetic oligonucleotide
accaggcggtgacggagctggg

SEQ ID NO: 64835 - DNA, 21 bp, Artificial Sequence
  Description of Artificial Sequence: Synthetic oligonucleotide
ccaggcggtgacggagctggg

SEQ ID NO: 64836 - DNA, 21 bp, Artificial Sequence
  Description of Artificial Sequence: Synthetic oligonucleotide
caggcggtgacggagctgggg

SEQ ID NO: 64837 - DNA, 21 bp, Artificial Sequence
  Description of Artificial Sequence: Synthetic oligonucleotide
aggcggtgacggagctggggc

SEQ ID NO: 64838 - DNA, 30 bp, Artificial Sequence
  Description of Artificial Sequence: Synthetic oligonucleotide
ggtggacacctactgcagacacaactacag

SEQ ID NO: 64839 - DNA, 30 bp, Artificial Sequence
  Description of Artificial Sequence: Synthetic oligonucleotide
gtggacacctactgcagacacaactacagg

SEQ ID NO: 64840 - DNA, 30 bp, Artificial Sequence
  Description of Artificial Sequence: Synthetic oligonucleotide
tggacacctactgcagacacaactacaggg

SEQ ID NO: 64841 - DNA, 29 bp, Artificial Sequence
  Description of Artificial Sequence: Synthetic oligonucleotide
ggacacctactgcagacacaactacaggg

SEQ ID NO: 64842 - DNA, 31 bp, Artificial Sequence
  Description of Artificial Sequence: Synthetic oligonucleotide
gacacctactgcagacacaactacagggttg

SEQ ID NO: 64843 - DNA, 31 bp, Artificial Sequence
  Description of Artificial Sequence: Synthetic oligonucleotide
acacctactgcagacacaactacagggttgg

SEQ ID NO: 64844 - DNA, 30 bp, Artificial Sequence
  Description of Artificial Sequence: Synthetic oligonucleotide
cacctactgcagacacaactacagggttgg

SEQ ID NO: 64845 - DNA, 31 bp, Artificial Sequence
  Description of Artificial Sequence: Synthetic oligonucleotide
acctactgcagacacaactacagggttggtg

SEQ ID NO: 64846 - DNA, 30 bp, Artificial Sequence
  Description of Artificial Sequence: Synthetic oligonucleotide
cctactgcagacacaactacagggttggtg

SEQ ID NO: 64847 - DNA, 31 bp, Artificial Sequence
  Description of Artificial Sequence: Synthetic oligonucleotide
ctactgcagacacaactacagggttggtgag

SEQ ID NO: 64848 - DNA, 32 bp, Artificial Sequence
  Description of Artificial Sequence: Synthetic oligonucleotide
tactgcagacacaactacagggttggtgagag

SEQ ID NO: 64849 - DNA, 31 bp, Artificial Sequence
  Description of Artificial Sequence: Synthetic oligonucleotide
actgcagacacaactacagggttggtgagag

SEQ ID NO: 64850 - DNA, 30 bp, Artificial Sequence
  Description of Artificial Sequence: Synthetic oligonucleotide
ctgcagacacaactacagggttggtgagag

SEQ ID NO: 64851 - DNA, 30 bp, Artificial Sequence
  Description of Artificial Sequence: Synthetic oligonucleotide
tgcagacacaactacagggttggtgagagc

SEQ ID NO: 64852 - DNA, 29 bp, Artificial Sequence
  Description of Artificial Sequence: Synthetic oligonucleotide
gcagacacaactacagggttggtgagagc

SEQ ID NO: 64853 - DNA, 31 bp, Artificial Sequence
  Description of Artificial Sequence: Synthetic oligonucleotide
cagacacaactacagggttggtgagagcttc

SEQ ID NO: 64854 - DNA, 32 bp, Artificial Sequence
  Description of Artificial Sequence: Synthetic oligonucleotide
agacacaactacagggttggtgagagcttcac

SEQ ID NO: 64855 - DNA, 31 bp, Artificial Sequence
  Description of Artificial Sequence: Synthetic oligonucleotide
gacacaactacagggttggtgagagcttcac

SEQ ID NO: 64856 - DNA, 32 bp, Artificial Sequence
  Description of Artificial Sequence: Synthetic oligonucleotide
acacaactacagggttggtgagagcttcacag

SEQ ID NO: 64857 - DNA, 31 bp, Artificial Sequence
  Description of Artificial Sequence: Synthetic oligonucleotide
cacaactacagggttggtgagagcttcacag

SEQ ID NO: 64858 - DNA, 32 bp, Artificial Sequence
  Description of Artificial Sequence: Synthetic oligonucleotide
acaactacagggttggtgagagcttcacagtg

SEQ ID NO: 64859 - DNA, 31 bp, Artificial Sequence
  Description of Artificial Sequence: Synthetic oligonucleotide
caactacagggttggtgagagcttcacagtg

SEQ ID NO: 64860 - DNA, 31 bp, Artificial Sequence
  Description of Artificial Sequence: Synthetic oligonucleotide
aactacagggttggtgagagcttcacagtgc

SEQ ID NO: 64861 - DNA, 30 bp, Artificial Sequence
  Description of Artificial Sequence: Synthetic oligonucleotide
actacagggttggtgagagcttcacagtgc

SEQ ID NO: 64862 - DNA, 29 bp, Artificial Sequence
  Description of Artificial Sequence: Synthetic oligonucleotide
ctacagggttggtgagagcttcacagtgc

SEQ ID NO: 64863 - DNA, 30 bp, Artificial Sequence
  Description of Artificial Sequence: Synthetic oligonucleotide
tacagggttggtgagagcttcacagtgcag

SEQ ID NO: 64864 - DNA, 29 bp, Artificial Sequence
  Description of Artificial Sequence: Synthetic oligonucleotide
acagggttggtgagagcttcacagtgcag

SEQ ID NO: 64865 - DNA, 28 bp, Artificial Sequence
  Description of Artificial Sequence: Synthetic oligonucleotide
cagggttggtgagagcttcacagtgcag

SEQ ID NO: 64866 - DNA, 28 bp, Artificial Sequence
  Description of Artificial Sequence: Synthetic oligonucleotide
agggttggtgagagcttcacagtgcagc

SEQ ID NO: 64867 - DNA, 26 bp, Artificial Sequence
  Description of Artificial Sequence: Synthetic oligonucleotide
atggtgtgtctgaggctccctggagg

SEQ ID NO: 64868 - DNA, 25 bp, Artificial Sequence
  Description of Artificial Sequence: Synthetic oligonucleotide
tggtgtgtctgaggctccctggagg

SEQ ID NO: 64869 - DNA, 24 bp, Artificial Sequence
  Description of Artificial Sequence: Synthetic oligonucleotide
ggtgtgtctgaggctccctggagg

SEQ ID NO: 64870 - DNA, 25 bp, Artificial Sequence
  Description of Artificial Sequence: Synthetic oligonucleotide
gtgtgtctgaggctccctggaggct

SEQ ID NO: 64871 - DNA, 25 bp, Artificial Sequence
  Description of Artificial Sequence: Synthetic oligonucleotide
tgtgtctgaggctccctggaggctc

SEQ ID NO: 64872 - DNA, 24 bp, Artificial Sequence
  Description of Artificial Sequence: Synthetic oligonucleotide
gtgtctgaggctccctggaggctc

SEQ ID NO: 64873 - DNA, 25 bp, Artificial Sequence
  Description of Artificial Sequence: Synthetic oligonucleotide
tgtctgaggctccctggaggctcct

SEQ ID NO: 64874 - DNA, 24 bp, Artificial Sequence
  Description of Artificial Sequence: Synthetic oligonucleotide
gtctgaggctccctggaggctcct

SEQ ID NO: 64875 - DNA, 24 bp, Artificial Sequence
  Description of Artificial Sequence: Synthetic oligonucleotide
tctgaggctccctggaggctcctg

SEQ ID NO: 64876 - DNA, 23 bp, Artificial Sequence
  Description of Artificial Sequence: Synthetic oligonucleotide
ctgaggctccctggaggctcctg

SEQ ID NO: 64877 - DNA, 25 bp, Artificial Sequence
  Description of Artificial Sequence: Synthetic oligonucleotide
tgaggctccctggaggctcctgcat

SEQ ID NO: 64878 - DNA, 24 bp, Artificial Sequence
  Description of Artificial Sequence: Synthetic oligonucleotide
gaggctccctggaggctcctgcat

SEQ ID NO: 64879 - DNA, 24 bp, Artificial Sequence
  Description of Artificial Sequence: Synthetic oligonucleotide
aggctccctggaggctcctgcatg

SEQ ID NO: 64880 - DNA, 23 bp, Artificial Sequence
  Description of Artificial Sequence: Synthetic oligonucleotide
ggctccctggaggctcctgcatg

SEQ ID NO: 64881 - DNA, 23 bp, Artificial Sequence
  Description of Artificial Sequence: Synthetic oligonucleotide
gctccctggaggctcctgcatgg

SEQ ID NO: 64882 - DNA, 24 bp, Artificial Sequence
  Description of Artificial Sequence: Synthetic oligonucleotide
ctccctggaggctcctgcatggca

SEQ ID NO: 64883 - DNA, 26 bp, Artificial Sequence
  Description of Artificial Sequence: Synthetic oligonucleotide
tccctggaggctcctgcatggcagtt

SEQ ID NO: 64884 - DNA, 25 bp, Artificial Sequence
  Description of Artificial Sequence: Synthetic oligonucleotide
ccctggaggctcctgcatggcagtt

SEQ ID NO: 64885 - DNA, 26 bp, Artificial Sequence
  Description of Artificial Sequence: Synthetic oligonucleotide
cctggaggctcctgcatggcagttct

SEQ ID NO: 64886 - DNA, 27 bp, Artificial Sequence
  Description of Artificial Sequence: Synthetic oligonucleotide
ctggaggctcctgcatggcagttctga

SEQ ID NO: 64887 - DNA, 27 bp, Artificial Sequence
  Description of Artificial Sequence: Synthetic oligonucleotide
tggaggctcctgcatggcagttctgac

SEQ ID NO: 64888 - DNA, 27 bp, Artificial Sequence
  Description of Artificial Sequence: Synthetic oligonucleotide
ggaggctcctgcatggcagttctgaca

SEQ ID NO: 64889 - DNA, 27 bp, Artificial Sequence
  Description of Artificial Sequence: Synthetic oligonucleotide
gaggctcctgcatggcagttctgacag

SEQ ID NO: 64890 - DNA, 28 bp, Artificial Sequence
  Description of Artificial Sequence: Synthetic oligonucleotide
aggctcctgcatggcagttctgacagtg

SEQ ID NO: 64891 - DNA, 27 bp, Artificial Sequence
  Description of Artificial Sequence: Synthetic oligonucleotide
ggctcctgcatggcagttctgacagtg

SEQ ID NO: 64892 - DNA, 28 bp, Artificial Sequence
  Description of Artificial Sequence: Synthetic oligonucleotide
gctcctgcatggcagttctgacagtgac

SEQ ID NO: 64893 - DNA, 29 bp, Artificial Sequence
  Description of Artificial Sequence: Synthetic oligonucleotide
ctcctgcatggcagttctgacagtgacac

SEQ ID NO: 64894 - DNA, 30 bp, Artificial Sequence
  Description of Artificial Sequence: Synthetic oligonucleotide
tcctgcatggcagttctgacagtgacactg

SEQ ID NO: 64895 - DNA, 29 bp, Artificial Sequence
  Description of Artificial Sequence: Synthetic oligonucleotide
cctgcatggcagttctgacagtgacactg

SEQ ID NO: 64896 - DNA, 31 bp, Artificial Sequence
  Description of Artificial Sequence: Synthetic oligonucleotide
ctgcatggcagttctgacagtgacactgatg

SEQ ID NO: 64897 - DNA, 31 bp, Artificial Sequence
  Description of Artificial Sequence: Synthetic oligonucleotide
tgcatggcagttctgacagtgacactgatgg

SEQ ID NO: 64898 - DNA, 30 bp, Artificial Sequence
  Description of Artificial Sequence: Synthetic oligonucleotide
gcatggcagttctgacagtgacactgatgg

SEQ ID NO: 64899 - DNA, 31 bp, Artificial Sequence
  Description of Artificial Sequence: Synthetic oligonucleotide
catggcagttctgacagtgacactgatggtg

SEQ ID NO: 64900 - DNA, 31 bp, Artificial Sequence
  Description of Artificial Sequence: Synthetic oligonucleotide
atggcagttctgacagtgacactgatggtgc

SEQ ID NO: 64901 - DNA, 30 bp, Artificial Sequence
  Description of Artificial Sequence: Synthetic oligonucleotide
tggcagttctgacagtgacactgatggtgc

SEQ ID NO: 64902 - DNA, 29 bp, Artificial Sequence
  Description of Artificial Sequence: Synthetic oligonucleotide
ggcagttctgacagtgacactgatggtgc

SEQ ID NO: 64903 - DNA, 30 bp, Artificial Sequence
  Description of Artificial Sequence: Synthetic oligonucleotide
gcagttctgacagtgacactgatggtgctg

SEQ ID NO: 64904 - DNA, 31 bp, Artificial Sequence
  Description of Artificial Sequence: Synthetic oligonucleotide
cagttctgacagtgacactgatggtgctgag

SEQ ID NO: 64905 - DNA, 31 bp, Artificial Sequence
  Description of Artificial Sequence: Synthetic oligonucleotide
agttctgacagtgacactgatggtgctgagc

SEQ ID NO: 64906 - DNA, 30 bp, Artificial Sequence
  Description of Artificial Sequence: Synthetic oligonucleotide
gttctgacagtgacactgatggtgctgagc

SEQ ID NO: 64907 - DNA, 31 bp, Artificial Sequence
  Description of Artificial Sequence: Synthetic oligonucleotide
ttctgacagtgacactgatggtgctgagctc

SEQ ID NO: 64908 - DNA, 30 bp, Artificial Sequence
  Description of Artificial Sequence: Synthetic oligonucleotide
tctgacagtgacactgatggtgctgagctc

SEQ ID NO: 64909 - DNA, 25 bp, Artificial Sequence
  Description of Artificial Sequence: Synthetic oligonucleotide
ccactggctttggctggggacacca

SEQ ID NO: 64910 - DNA, 26 bp, Artificial Sequence
  Description of Artificial Sequence: Synthetic oligonucleotide
cactggctttggctggggacaccaga

SEQ ID NO: 64911 - DNA, 26 bp, Artificial Sequence
  Description of Artificial Sequence: Synthetic oligonucleotide
actggctttggctggggacaccagac

SEQ ID NO: 64912 - DNA, 25 bp, Artificial Sequence
  Description of Artificial Sequence: Synthetic oligonucleotide
ctggctttggctggggacaccagac

SEQ ID NO: 64913 - DNA, 26 bp, Artificial Sequence
  Description of Artificial Sequence: Synthetic oligonucleotide
tggctttggctggggacaccagacca

SEQ ID NO: 64914 - DNA, 25 bp, Artificial Sequence
  Description of Artificial Sequence: Synthetic oligonucleotide
ggctttggctggggacaccagacca

SEQ ID NO: 64915 - DNA, 25 bp, Artificial Sequence
  Description of Artificial Sequence: Synthetic oligonucleotide
gctttggctggggacaccagaccac

SEQ ID NO: 64916 - DNA, 27 bp, Artificial Sequence
  Description of Artificial Sequence: Synthetic oligonucleotide
ctttggctggggacaccagaccacgtt

SEQ ID NO: 64917 - DNA, 28 bp, Artificial Sequence
  Description of Artificial Sequence: Synthetic oligonucleotide
tttggctggggacaccagaccacgtttc

SEQ ID NO: 64918 - DNA, 27 bp, Artificial Sequence
  Description of Artificial Sequence: Synthetic oligonucleotide
ttggctggggacaccagaccacgtttc

SEQ ID NO: 64919 - DNA, 27 bp, Artificial Sequence
  Description of Artificial Sequence: Synthetic oligonucleotide
tggctggggacaccagaccacgtttct

SEQ ID NO: 64920 - DNA, 27 bp, Artificial Sequence
  Description of Artificial Sequence: Synthetic oligonucleotide
ggctggggacaccagaccacgtttctt

SEQ ID NO: 64921 - DNA, 27 bp, Artificial Sequence
  Description of Artificial Sequence: Synthetic oligonucleotide
gctggggacaccagaccacgtttcttg

SEQ ID NO: 64922 - DNA, 27 bp, Artificial Sequence
  Description of Artificial Sequence: Synthetic oligonucleotide
ctggggacaccagaccacgtttcttgg

SEQ ID NO: 64923 - DNA, 28 bp, Artificial Sequence
  Description of Artificial Sequence: Synthetic oligonucleotide
tggggacaccagaccacgtttcttggag

SEQ ID NO: 64924 - DNA, 27 bp, Artificial Sequence
  Description of Artificial Sequence: Synthetic oligonucleotide
ggggacaccagaccacgtttcttggag

SEQ ID NO: 64925 - DNA, 29 bp, Artificial Sequence
  Description of Artificial Sequence: Synthetic oligonucleotide
gggacaccagaccacgtttcttggagtac

SEQ ID NO: 64926 - DNA, 30 bp, Artificial Sequence
  Description of Artificial Sequence: Synthetic oligonucleotide
ggacaccagaccacgtttcttggagtactc

SEQ ID NO: 64927 - DNA, 32 bp, Artificial Sequence
  Description of Artificial Sequence: Synthetic oligonucleotide
gacaccagaccacgtttcttggagtactctac

SEQ ID NO: 64928 - DNA, 32 bp, Artificial Sequence
  Description of Artificial Sequence: Synthetic oligonucleotide
acaccagaccacgtttcttggagtactctacg

SEQ ID NO: 64929 - DNA, 31 bp, Artificial Sequence
  Description of Artificial Sequence: Synthetic oligonucleotide
caccagaccacgtttcttggagtactctacg

SEQ ID NO: 64930 - DNA, 32 bp, Artificial Sequence
  Description of Artificial Sequence: Synthetic oligonucleotide
accagaccacgtttcttggagtactctacgtc

SEQ ID NO: 64931 - DNA, 31 bp, Artificial Sequence
  Description of Artificial Sequence: Synthetic oligonucleotide
ccagaccacgtttcttggagtactctacgtc

SEQ ID NO: 64932 - DNA, 32 bp, Artificial Sequence
  Description of Artificial Sequence: Synthetic oligonucleotide
cagaccacgtttcttggagtactctacgtctg

SEQ ID NO: 64933 - DNA, 33 bp, Artificial Sequence
  Description of Artificial Sequence: Synthetic oligonucleotide
agaccacgtttcttggagtactctacgtctgag

SEQ ID NO: 64934 - DNA, 32 bp, Artificial Sequence
  Description of Artificial Sequence: Synthetic oligonucleotide
gaccacgtttcttggagtactctacgtctgag

SEQ ID NO: 64935 - DNA, 33 bp, Artificial Sequence
  Description of Artificial Sequence: Synthetic oligonucleotide
accacgtttcttggagtactctacgtctgagtg

SEQ ID NO: 64936 - DNA, 32 bp, Artificial Sequence
  Description of Artificial Sequence: Synthetic oligonucleotide
ccacgtttcttggagtactctacgtctgagtg

SEQ ID NO: 64937 - DNA, 33 bp, Artificial Sequence
  Description of Artificial Sequence: Synthetic oligonucleotide
cacgtttcttggagtactctacgtctgagtgtc

SEQ ID NO: 64938 - DNA, 37 bp, Artificial Sequence
  Description of Artificial Sequence: Synthetic oligonucleotide
acgtttcttggagtactctacgtctgagtgtcatttc

SEQ ID NO: 64939 - DNA, 36 bp, Artificial Sequence
  Description of Artificial Sequence: Synthetic oligonucleotide
cgtttcttggagtactctacgtctgagtgtcatttc

SEQ ID NO: 64940 - DNA, 38 bp, Artificial Sequence
  Description of Artificial Sequence: Synthetic oligonucleotide
gtttcttggagtactctacgtctgagtgtcatttcttc

SEQ ID NO: 64941 - DNA, 41 bp, Artificial Sequence
  Description of Artificial Sequence: Synthetic oligonucleotide
tttcttggagtactctacgtctgagtgtcatttcttcaatg

SEQ ID NO: 64942 - DNA, 40 bp, Artificial Sequence
  Description of Artificial Sequence: Synthetic oligonucleotide
ttcttggagtactctacgtctgagtgtcatttcttcaatg

SEQ ID NO: 64943 - DNA, 39 bp, Artificial Sequence
  Description of Artificial Sequence: Synthetic oligonucleotide
tcttggagtactctacgtctgagtgtcatttcttcaatg

SEQ ID NO: 64944 - DNA, 38 bp, Artificial Sequence
  Description of Artificial Sequence: Synthetic oligonucleotide
cttggagtactctacgtctgagtgtcatttcttcaatg

SEQ ID NO: 64945 - DNA, 38 bp, Artificial Sequence
  Description of Artificial Sequence: Synthetic oligonucleotide
ttggagtactctacgtctgagtgtcatttcttcaatgg

SEQ ID NO: 64946 - DNA, 37 bp, Artificial Sequence
  Description of Artificial Sequence: Synthetic oligonucleotide
tggagtactctacgtctgagtgtcatttcttcaatgg

SEQ ID NO: 64947 - DNA, 36 bp, Artificial Sequence
  Description of Artificial Sequence: Synthetic oligonucleotide
ggagtactctacgtctgagtgtcatttcttcaatgg

SEQ ID NO: 64948 - DNA, 36 bp, Artificial Sequence
  Description of Artificial Sequence: Synthetic oligonucleotide
gagtactctacgtctgagtgtcatttcttcaatggg

SEQ ID NO: 64949 - DNA, 37 bp, Artificial Sequence
  Description of Artificial Sequence: Synthetic oligonucleotide
agtactctacgtctgagtgtcatttcttcaatgggac

SEQ ID NO: 64950 - DNA, 36 bp, Artificial Sequence
  Description of Artificial Sequence: Synthetic oligonucleotide
gtactctacgtctgagtgtcatttcttcaatgggac

SEQ ID NO: 64951 - DNA, 36 bp, Artificial Sequence
  Description of Artificial Sequence: Synthetic oligonucleotide
tactctacgtctgagtgtcatttcttcaatgggacg

SEQ ID NO: 64952 - DNA, 35 bp, Artificial Sequence
  Description of Artificial Sequence: Synthetic oligonucleotide
actctacgtctgagtgtcatttcttcaatgggacg

SEQ ID NO: 64953 - DNA, 34 bp, Artificial Sequence
  Description of Artificial Sequence: Synthetic oligonucleotide
ctctacgtctgagtgtcatttcttcaatgggacg

SEQ ID NO: 64954 - DNA, 34 bp, Artificial Sequence
  Description of Artificial Sequence: Synthetic oligonucleotide
tctacgtctgagtgtcatttcttcaatgggacgg

SEQ ID NO: 64955 - DNA, 33 bp, Artificial Sequence
  Description of Artificial Sequence: Synthetic oligonucleotide
ctacgtctgagtgtcatttcttcaatgggacgg

SEQ ID NO: 64956 - DNA, 34 bp, Artificial Sequence
  Description of Artificial Sequence: Synthetic oligonucleotide
tacgtctgagtgtcatttcttcaatgggacggag

SEQ ID NO: 64957 - DNA, 33 bp, Artificial Sequence
  Description of Artificial Sequence: Synthetic oligonucleotide
acgtctgagtgtcatttcttcaatgggacggag

SEQ ID NO: 64958 - DNA, 32 bp, Artificial Sequence
  Description of Artificial Sequence: Synthetic oligonucleotide
cgtctgagtgtcatttcttcaatgggacggag

SEQ ID NO: 64959 - DNA, 32 bp, Artificial Sequence
  Description of Artificial Sequence: Synthetic oligonucleotide
gtctgagtgtcatttcttcaatgggacggagc

SEQ ID NO: 64960 - DNA, 32 bp, Artificial Sequence
  Description of Artificial Sequence: Synthetic oligonucleotide
tctgagtgtcatttcttcaatgggacggagcg

SEQ ID NO: 64961 - DNA, 31 bp, Artificial Sequence
  Description of Artificial Sequence: Synthetic oligonucleotide
ctgagtgtcatttcttcaatgggacggagcg

SEQ ID NO: 64962 - DNA, 31 bp, Artificial Sequence
  Description of Artificial Sequence: Synthetic oligonucleotide
tgagtgtcatttcttcaatgggacggagcgg

SEQ ID NO: 64963 - DNA, 30 bp, Artificial Sequence
  Description of Artificial Sequence: Synthetic oligonucleotide
gagtgtcatttcttcaatgggacggagcgg

SEQ ID NO: 64964 - DNA, 30 bp, Artificial Sequence
  Description of Artificial Sequence: Synthetic oligonucleotide
agtgtcatttcttcaatgggacggagcggg

SEQ ID NO: 64965 - DNA, 29 bp, Artificial Sequence
  Description of Artificial Sequence: Synthetic oligonucleotide
gtgtcatttcttcaatgggacggagcggg

SEQ ID NO: 64966 - DNA, 26 bp, Artificial Sequence
  Description of Artificial Sequence: Synthetic oligonucleotide
ttcaatgggacggagcgggtgcggta

SEQ ID NO: 64967 - DNA, 25 bp, Artificial Sequence
  Description of Artificial Sequence: Synthetic oligonucleotide
tcaatgggacggagcgggtgcggta

SEQ ID NO: 64968 - DNA, 24 bp, Artificial Sequence
  Description of Artificial Sequence: Synthetic oligonucleotide
caatgggacggagcgggtgcggta

SEQ ID NO: 64969 - DNA, 24 bp, Artificial Sequence
  Description of Artificial Sequence: Synthetic oligonucleotide
aatgggacggagcgggtgcggtac

SEQ ID NO: 64970 - DNA, 23 bp, Artificial Sequence
  Description of Artificial Sequence: Synthetic oligonucleotide
atgggacggagcgggtgcggtac

SEQ ID NO: 64971 - DNA, 22 bp, Artificial Sequence
  Description of Artificial Sequence: Synthetic oligonucleotide
tgggacggagcgggtgcggtac

SEQ ID NO: 64972 - DNA, 21 bp, Artificial Sequence
  Description of Artificial Sequence: Synthetic oligonucleotide
gggacggagcgggtgcggtac

SEQ ID NO: 64973 - DNA, 22 bp, Artificial Sequence
  Description of Artificial Sequence: Synthetic oligonucleotide
ggacggagcgggtgcggtacct

SEQ ID NO: 64974 - DNA, 22 bp, Artificial Sequence
  Description of Artificial Sequence: Synthetic oligonucleotide
gacggagcgggtgcggtacctg

SEQ ID NO: 64975 - DNA, 23 bp, Artificial Sequence
  Description of Artificial Sequence: Synthetic oligonucleotide
acggagcgggtgcggtacctgga

SEQ ID NO: 64976 - DNA, 22 bp, Artificial Sequence
  Description of Artificial Sequence: Synthetic oligonucleotide
cggagcgggtgcggtacctgga

SEQ ID NO: 64977 - DNA, 23 bp, Artificial Sequence
  Description of Artificial Sequence: Synthetic oligonucleotide
ggagcgggtgcggtacctggaca

SEQ ID NO: 64978 - DNA, 26 bp, Artificial Sequence
  Description of Artificial Sequence: Synthetic oligonucleotide
gagcgggtgcggtacctggacagata

SEQ ID NO: 64979 - DNA, 27 bp, Artificial Sequence
  Description of Artificial Sequence: Synthetic oligonucleotide
agcgggtgcggtacctggacagatact

SEQ ID NO: 64980 - DNA, 27 bp, Artificial Sequence
  Description of Artificial Sequence: Synthetic oligonucleotide
gcgggtgcggtacctggacagatactt

SEQ ID NO: 64981 - DNA, 27 bp, Artificial Sequence
  Description of Artificial Sequence: Synthetic oligonucleotide
cgggtgcggtacctggacagatacttc

SEQ ID NO: 64982 - DNA, 27 bp, Artificial Sequence
  Description of Artificial Sequence: Synthetic oligonucleotide
gggtgcggtacctggacagatacttcc

SEQ ID NO: 64983 - DNA, 31 bp, Artificial Sequence
  Description of Artificial Sequence: Synthetic oligonucleotide
ggtgcggtacctggacagatacttccataac

SEQ ID NO: 64984 - DNA, 31 bp, Artificial Sequence
  Description of Artificial Sequence: Synthetic oligonucleotide
gtgcggtacctggacagatacttccataacc

SEQ ID NO: 64985 - DNA, 32 bp, Artificial Sequence
  Description of Artificial Sequence: Synthetic oligonucleotide
tgcggtacctggacagatacttccataaccag

SEQ ID NO: 64986 - DNA, 31 bp, Artificial Sequence
  Description of Artificial Sequence: Synthetic oligonucleotide
gcggtacctggacagatacttccataaccag

SEQ ID NO: 64987 - DNA, 31 bp, Artificial Sequence
  Description of Artificial Sequence: Synthetic oligonucleotide
cggtacctggacagatacttccataaccagg

SEQ ID NO: 64988 - DNA, 32 bp, Artificial Sequence
  Description of Artificial Sequence: Synthetic oligonucleotide
ggtacctggacagatacttccataaccaggag

SEQ ID NO: 64989 - DNA, 32 bp, Artificial Sequence
  Description of Artificial Sequence: Synthetic oligonucleotide
gtacctggacagatacttccataaccaggagg

SEQ ID NO: 64990 - DNA, 33 bp, Artificial Sequence
  Description of Artificial Sequence: Synthetic oligonucleotide
tacctggacagatacttccataaccaggaggag

SEQ ID NO: 64991 - DNA, 32 bp, Artificial Sequence
  Description of Artificial Sequence: Synthetic oligonucleotide
acctggacagatacttccataaccaggaggag

SEQ ID NO: 64992 - DNA, 31 bp, Artificial Sequence
  Description of Artificial Sequence: Synthetic oligonucleotide
cctggacagatacttccataaccaggaggag

SEQ ID NO: 64993 - DNA, 33 bp, Artificial Sequence
  Description of Artificial Sequence: Synthetic oligonucleotide
ctggacagatacttccataaccaggaggagaac

SEQ ID NO: 64994 - DNA, 33 bp, Artificial Sequence
  Description of Artificial Sequence: Synthetic oligonucleotide
tggacagatacttccataaccaggaggagaacg

SEQ ID NO: 64995 - DNA, 32 bp, Artificial Sequence
  Description of Artificial Sequence: Synthetic oligonucleotide
ggacagatacttccataaccaggaggagaacg

SEQ ID NO: 64996 - DNA, 33 bp, Artificial Sequence
  Description of Artificial Sequence: Synthetic oligonucleotide
gacagatacttccataaccaggaggagaacgtg

SEQ ID NO: 64997 - DNA, 33 bp, Artificial Sequence
  Description of Artificial Sequence: Synthetic oligonucleotide
acagatacttccataaccaggaggagaacgtgc

SEQ ID NO: 64998 - DNA, 32 bp, Artificial Sequence
  Description of Artificial Sequence: Synthetic oligonucleotide
cagatacttccataaccaggaggagaacgtgc

SEQ ID NO: 64999 - DNA, 32 bp, Artificial Sequence
  Description of Artificial Sequence: Synthetic oligonucleotide
agatacttccataaccaggaggagaacgtgcg

SEQ ID NO: 65000 - DNA, 31 bp, Artificial Sequence
  Description of Artificial Sequence: Synthetic oligonucleotide
gatacttccataaccaggaggagaacgtgcg

SEQ ID NO: 65001 - DNA, 31 bp, Artificial Sequence
  Description of Artificial Sequence: Synthetic oligonucleotide
atacttccataaccaggaggagaacgtgcgc

SEQ ID NO: 65002 - DNA, 30 bp, Artificial Sequence
  Description of Artificial Sequence: Synthetic oligonucleotide
tacttccataaccaggaggagaacgtgcgc

SEQ ID NO: 65003 - DNA, 29 bp, Artificial Sequence
  Description of Artificial Sequence: Synthetic oligonucleotide
acttccataaccaggaggagaacgtgcgc

SEQ ID NO: 65004 - DNA, 28 bp, Artificial Sequence
  Description of Artificial Sequence: Synthetic oligonucleotide
cttccataaccaggaggagaacgtgcgc

SEQ ID NO: 65005 - DNA, 30 bp, Artificial Sequence
  Description of Artificial Sequence: Synthetic oligonucleotide
ttccataaccaggaggagaacgtgcgcttc

SEQ ID NO: 65006 - DNA, 29 bp, Artificial Sequence
  Description of Artificial Sequence: Synthetic oligonucleotide
tccataaccaggaggagaacgtgcgcttc

SEQ ID NO: 65007 - DNA, 28 bp, Artificial Sequence
  Description of Artificial Sequence: Synthetic oligonucleotide
ccataaccaggaggagaacgtgcgcttc

SEQ ID NO: 65008 - DNA, 28 bp, Artificial Sequence
  Description of Artificial Sequence: Synthetic oligonucleotide
cataaccaggaggagaacgtgcgcttcg

SEQ ID NO: 65009 - DNA, 29 bp, Artificial Sequence
  Description of Artificial Sequence: Synthetic oligonucleotide
ataaccaggaggagaacgtgcgcttcgac

SEQ ID NO: 65010 - DNA, 28 bp, Artificial Sequence
  Description of Artificial Sequence: Synthetic oligonucleotide
taaccaggaggagaacgtgcgcttcgac

SEQ ID NO: 65011 - DNA, 27 bp, Artificial Sequence
  Description of Artificial Sequence: Synthetic oligonucleotide
aaccaggaggagaacgtgcgcttcgac

SEQ ID NO: 65012 - DNA, 27 bp, Artificial Sequence
  Description of Artificial Sequence: Synthetic oligonucleotide
accaggaggagaacgtgcgcttcgaca

SEQ ID NO: 65013 - DNA, 26 bp, Artificial Sequence
  Description of Artificial Sequence: Synthetic oligonucleotide
ccaggaggagaacgtgcgcttcgaca

SEQ ID NO: 65014 - DNA, 26 bp, Artificial Sequence
  Description of Artificial Sequence: Synthetic oligonucleotide
caggaggagaacgtgcgcttcgacag

SEQ ID NO: 65015 - DNA, 26 bp, Artificial Sequence
  Description of Artificial Sequence: Synthetic oligonucleotide
aggaggagaacgtgcgcttcgacagc

SEQ ID NO: 65016 - DNA, 25 bp, Artificial Sequence
  Description of Artificial Sequence: Synthetic oligonucleotide
ggaggagaacgtgcgcttcgacagc

SEQ ID NO: 65017 - DNA, 26 bp, Artificial Sequence
  Description of Artificial Sequence: Synthetic oligonucleotide
gaggagaacgtgcgcttcgacagcga

SEQ ID NO: 65018 - DNA, 26 bp, Artificial Sequence
  Description of Artificial Sequence: Synthetic oligonucleotide
aggagaacgtgcgcttcgacagcgac

SEQ ID NO: 65019 - DNA, 25 bp, Artificial Sequence
  Description of Artificial Sequence: Synthetic oligonucleotide
ggagaacgtgcgcttcgacagcgac

SEQ ID NO: 65020 - DNA, 26 bp, Artificial Sequence
  Description of Artificial Sequence: Synthetic oligonucleotide
gagaacgtgcgcttcgacagcgacgt

SEQ ID NO: 65021 - DNA, 26 bp, Artificial Sequence
  Description of Artificial Sequence: Synthetic oligonucleotide
agaacgtgcgcttcgacagcgacgtg

SEQ ID NO: 65022 - DNA, 25 bp, Artificial Sequence
  Description of Artificial Sequence: Synthetic oligonucleotide
gaacgtgcgcttcgacagcgacgtg

SEQ ID NO: 65023 - DNA, 25 bp, Artificial Sequence
  Description of Artificial Sequence: Synthetic oligonucleotide
aacgtgcgcttcgacagcgacgtgg

SEQ ID NO: 65024 - DNA, 32 bp, Artificial Sequence
  Description of Artificial Sequence: Synthetic oligonucleotide
acaactactgcagacacaactacggggttgtg

SEQ ID NO: 65025 - DNA, 31 bp, Artificial Sequence
  Description of Artificial Sequence: Synthetic oligonucleotide
caactactgcagacacaactacggggttgtg

SEQ ID NO: 65026 - DNA, 31 bp, Artificial Sequence
  Description of Artificial Sequence: Synthetic oligonucleotide
aactactgcagacacaactacggggttgtgg

SEQ ID NO: 65027 - DNA, 30 bp, Artificial Sequence
  Description of Artificial Sequence: Synthetic oligonucleotide
actactgcagacacaactacggggttgtgg

SEQ ID NO: 65028 - DNA, 26 bp, Artificial Sequence
  Description of Artificial Sequence: Synthetic oligonucleotide
gagagcttcacagtgcagcggcgagt

SEQ ID NO: 65029 - DNA, 26 bp, Artificial Sequence
  Description of Artificial Sequence: Synthetic oligonucleotide
agagcttcacagtgcagcggcgagtc

SEQ ID NO: 65030 - DNA, 25 bp, Artificial Sequence
  Description of Artificial Sequence: Synthetic oligonucleotide
gagcttcacagtgcagcggcgagtc

SEQ ID NO: 65031 - DNA, 27 bp, Artificial Sequence
  Description of Artificial Sequence: Synthetic oligonucleotide
agcttcacagtgcagcggcgagtccat

SEQ ID NO: 65032 - DNA, 26 bp, Artificial Sequence
  Description of Artificial Sequence: Synthetic oligonucleotide
gcttcacagtgcagcggcgagtccat

SEQ ID NO: 65033 - DNA, 26 bp, Artificial Sequence
  Description of Artificial Sequence: Synthetic oligonucleotide
cttcacagtgcagcggcgagtccatc

SEQ ID NO: 65034 - DNA, 27 bp, Artificial Sequence
  Description of Artificial Sequence: Synthetic oligonucleotide
ttcacagtgcagcggcgagtccatcct

SEQ ID NO: 65035 - DNA, 27 bp, Artificial Sequence
  Description of Artificial Sequence: Synthetic oligonucleotide
tcacagtgcagcggcgagtccatccta

SEQ ID NO: 65036 - DNA, 27 bp, Artificial Sequence
  Description of Artificial Sequence: Synthetic oligonucleotide
cacagtgcagcggcgagtccatcctaa

SEQ ID NO: 65037 - DNA, 27 bp, Artificial Sequence
  Description of Artificial Sequence: Synthetic oligonucleotide
acagtgcagcggcgagtccatcctaag

SEQ ID NO: 65038 - DNA, 26 bp, Artificial Sequence
  Description of Artificial Sequence: Synthetic oligonucleotide
cagtgcagcggcgagtccatcctaag

SEQ ID NO: 65039 - DNA, 27 bp, Artificial Sequence
  Description of Artificial Sequence: Synthetic oligonucleotide
agtgcagcggcgagtccatcctaaggt

SEQ ID NO: 65040 - DNA, 26 bp, Artificial Sequence
  Description of Artificial Sequence: Synthetic oligonucleotide
gtgcagcggcgagtccatcctaaggt

SEQ ID NO: 65041 - DNA, 27 bp, Artificial Sequence
  Description of Artificial Sequence: Synthetic oligonucleotide
tgcagcggcgagtccatcctaaggtga

SEQ ID NO: 65042 - DNA, 26 bp, Artificial Sequence
  Description of Artificial Sequence: Synthetic oligonucleotide
gcagcggcgagtccatcctaaggtga

SEQ ID NO: 65043 - DNA, 27 bp, Artificial Sequence
  Description of Artificial Sequence: Synthetic oligonucleotide
cagcggcgagtccatcctaaggtgact

SEQ ID NO: 65044 - DNA, 27 bp, Artificial Sequence
  Description of Artificial Sequence: Synthetic oligonucleotide
agcggcgagtccatcctaaggtgactg

SEQ ID NO: 65045 - DNA, 27 bp, Artificial Sequence
  Description of Artificial Sequence: Synthetic oligonucleotide
gcggcgagtccatcctaaggtgactgt

SEQ ID NO: 65046 - DNA, 27 bp, Artificial Sequence
  Description of Artificial Sequence: Synthetic oligonucleotide
cggcgagtccatcctaaggtgactgtg

SEQ ID NO: 65047 - DNA, 30 bp, Artificial Sequence
  Description of Artificial Sequence: Synthetic oligonucleotide
ggcgagtccatcctaaggtgactgtgtatc

SEQ ID NO: 65048 - DNA, 30 bp, Artificial Sequence
  Description of Artificial Sequence: Synthetic oligonucleotide
gcgagtccatcctaaggtgactgtgtatcc

SEQ ID NO: 65049 - DNA, 32 bp, Artificial Sequence
  Description of Artificial Sequence: Synthetic oligonucleotide
cgagtccatcctaaggtgactgtgtatccttc

SEQ ID NO: 65050 - DNA, 35 bp, Artificial Sequence
  Description of Artificial Sequence: Synthetic oligonucleotide
gagtccatcctaaggtgactgtgtatccttcaaag

SEQ ID NO: 65051 - DNA, 36 bp, Artificial Sequence
  Description of Artificial Sequence: Synthetic oligonucleotide
agtccatcctaaggtgactgtgtatccttcaaagac

SEQ ID NO: 65052 - DNA, 35 bp, Artificial Sequence
  Description of Artificial Sequence: Synthetic oligonucleotide
gtccatcctaaggtgactgtgtatccttcaaagac

SEQ ID NO: 65053 - DNA, 35 bp, Artificial Sequence
  Description of Artificial Sequence: Synthetic oligonucleotide
tccatcctaaggtgactgtgtatccttcaaagacc

SEQ ID NO: 65054 - DNA, 34 bp, Artificial Sequence
  Description of Artificial Sequence: Synthetic oligonucleotide
ccatcctaaggtgactgtgtatccttcaaagacc

SEQ ID NO: 65055 - DNA, 34 bp, Artificial Sequence
  Description of Artificial Sequence: Synthetic oligonucleotide
catcctaaggtgactgtgtatccttcaaagaccc

SEQ ID NO: 65056 - DNA, 35 bp, Artificial Sequence
  Description of Artificial Sequence: Synthetic oligonucleotide
atcctaaggtgactgtgtatccttcaaagacccag

SEQ ID NO: 65057 - DNA, 34 bp, Artificial Sequence
  Description of Artificial Sequence: Synthetic oligonucleotide
tcctaaggtgactgtgtatccttcaaagacccag

SEQ ID NO: 65058 - DNA, 27 bp, Artificial Sequence
  Description of Artificial Sequence: Synthetic oligonucleotide
tcaaagacccagcccctgcagcaccat

SEQ ID NO: 65059 - DNA, 27 bp, Artificial Sequence
  Description of Artificial Sequence: Synthetic oligonucleotide
caaagacccagcccctgcagcaccata

SEQ ID NO: 65060 - DNA, 28 bp, Artificial Sequence
  Description of Artificial Sequence: Synthetic oligonucleotide
aaagacccagcccctgcagcaccataac

SEQ ID NO: 65061 - DNA, 27 bp, Artificial Sequence
  Description of Artificial Sequence: Synthetic oligonucleotide
aagacccagcccctgcagcaccataac

SEQ ID NO: 65062 - DNA, 26 bp, Artificial Sequence
  Description of Artificial Sequence: Synthetic oligonucleotide
agacccagcccctgcagcaccataac

SEQ ID NO: 65063 - DNA, 25 bp, Artificial Sequence
  Description of Artificial Sequence: Synthetic oligonucleotide
gacccagcccctgcagcaccataac

SEQ ID NO: 65064 - DNA, 26 bp, Artificial Sequence
  Description of Artificial Sequence: Synthetic oligonucleotide
acccagcccctgcagcaccataacct

SEQ ID NO: 65065 - DNA, 25 bp, Artificial Sequence
  Description of Artificial Sequence: Synthetic oligonucleotide
cccagcccctgcagcaccataacct

SEQ ID NO: 65066 - DNA, 25 bp, Artificial Sequence
  Description of Artificial Sequence: Synthetic oligonucleotide
ccagcccctgcagcaccataacctc

SEQ ID NO: 65067 - DNA, 26 bp, Artificial Sequence
  Description of Artificial Sequence: Synthetic oligonucleotide
cagcccctgcagcaccataacctcct

SEQ ID NO: 65068 - DNA, 26 bp, Artificial Sequence
  Description of Artificial Sequence: Synthetic oligonucleotide
agcccctgcagcaccataacctcctg

SEQ ID NO: 65069 - DNA, 25 bp, Artificial Sequence
  Description of Artificial Sequence: Synthetic oligonucleotide
gcccctgcagcaccataacctcctg

SEQ ID NO: 65070 - DNA, 26 bp, Artificial Sequence
  Description of Artificial Sequence: Synthetic oligonucleotide
cccctgcagcaccataacctcctggt

SEQ ID NO: 65071 - DNA, 27 bp, Artificial Sequence
  Description of Artificial Sequence: Synthetic oligonucleotide
ccctgcagcaccataacctcctggtct

SEQ ID NO: 65072 - DNA, 27 bp, Artificial Sequence
  Description of Artificial Sequence: Synthetic oligonucleotide
cctgcagcaccataacctcctggtctg

SEQ ID NO: 65073 - DNA, 29 bp, Artificial Sequence
  Description of Artificial Sequence: Synthetic oligonucleotide
ctgcagcaccataacctcctggtctgttc

SEQ ID NO: 65074 - DNA, 30 bp, Artificial Sequence
  Description of Artificial Sequence: Synthetic oligonucleotide
tgcagcaccataacctcctggtctgttctg

SEQ ID NO: 65075 - DNA, 29 bp, Artificial Sequence
  Description of Artificial Sequence: Synthetic oligonucleotide
gcagcaccataacctcctggtctgttctg

SEQ ID NO: 65076 - DNA, 30 bp, Artificial Sequence
  Description of Artificial Sequence: Synthetic oligonucleotide
cagcaccataacctcctggtctgttctgtg

SEQ ID NO: 65077 - DNA, 31 bp, Artificial Sequence
  Description of Artificial Sequence: Synthetic oligonucleotide
agcaccataacctcctggtctgttctgtgag

SEQ ID NO: 65078 - DNA, 30 bp, Artificial Sequence
  Description of Artificial Sequence: Synthetic oligonucleotide
gcaccataacctcctggtctgttctgtgag

SEQ ID NO: 65079 - DNA, 31 bp, Artificial Sequence
  Description of Artificial Sequence: Synthetic oligonucleotide
caccataacctcctggtctgttctgtgagtg

SEQ ID NO: 65080 - DNA, 31 bp, Artificial Sequence
  Description of Artificial Sequence: Synthetic oligonucleotide
accataacctcctggtctgttctgtgagtgg

SEQ ID NO: 65081 - DNA, 30 bp, Artificial Sequence
  Description of Artificial Sequence: Synthetic oligonucleotide
ccataacctcctggtctgttctgtgagtgg

SEQ ID NO: 65082 - DNA, 33 bp, Artificial Sequence
  Description of Artificial Sequence: Synthetic oligonucleotide
cataacctcctggtctgttctgtgagtggtttc

SEQ ID NO: 65083 - DNA, 36 bp, Artificial Sequence
  Description of Artificial Sequence: Synthetic oligonucleotide
ataacctcctggtctgttctgtgagtggtttctatc

SEQ ID NO: 65084 - DNA, 35 bp, Artificial Sequence
  Description of Artificial Sequence: Synthetic oligonucleotide
taacctcctggtctgttctgtgagtggtttctatc

SEQ ID NO: 65085 - DNA, 34 bp, Artificial Sequence
  Description of Artificial Sequence: Synthetic oligonucleotide
aacctcctggtctgttctgtgagtggtttctatc

SEQ ID NO: 65086 - DNA, 33 bp, Artificial Sequence
  Description of Artificial Sequence: Synthetic oligonucleotide
acctcctggtctgttctgtgagtggtttctatc

SEQ ID NO: 65087 - DNA, 32 bp, Artificial Sequence
  Description of Artificial Sequence: Synthetic oligonucleotide
cctcctggtctgttctgtgagtggtttctatc

SEQ ID NO: 65088 - DNA, 32 bp, Artificial Sequence
  Description of Artificial Sequence: Synthetic oligonucleotide
ctcctggtctgttctgtgagtggtttctatcc

SEQ ID NO: 65089 - DNA, 33 bp, Artificial Sequence
  Description of Artificial Sequence: Synthetic oligonucleotide
tcctggtctgttctgtgagtggtttctatccag

SEQ ID NO: 65090 - DNA, 32 bp, Artificial Sequence
  Description of Artificial Sequence: Synthetic oligonucleotide
cctggtctgttctgtgagtggtttctatccag

SEQ ID NO: 65091 - DNA, 32 bp, Artificial Sequence
  Description of Artificial Sequence: Synthetic oligonucleotide
ctggtctgttctgtgagtggtttctatccagg

SEQ ID NO: 65092 - DNA, 32 bp, Artificial Sequence
  Description of Artificial Sequence: Synthetic oligonucleotide
tggtctgttctgtgagtggtttctatccaggc

SEQ ID NO: 65093 - DNA, 31 bp, Artificial Sequence
  Description of Artificial Sequence: Synthetic oligonucleotide
ggtctgttctgtgagtggtttctatccaggc

SEQ ID NO: 65094 - DNA, 32 bp, Artificial Sequence
  Description of Artificial Sequence: Synthetic oligonucleotide
gtctgttctgtgagtggtttctatccaggcag

SEQ ID NO: 65095 - DNA, 32 bp, Artificial Sequence
  Description of Artificial Sequence: Synthetic oligonucleotide
tctgttctgtgagtggtttctatccaggcagc

SEQ ID NO: 65096 - DNA, 31 bp, Artificial Sequence
  Description of Artificial Sequence: Synthetic oligonucleotide
ctgttctgtgagtggtttctatccaggcagc

SEQ ID NO: 65097 - DNA, 34 bp, Artificial Sequence
  Description of Artificial Sequence: Synthetic oligonucleotide
tgttctgtgagtggtttctatccaggcagcattg

SEQ ID NO: 65098 - DNA, 33 bp, Artificial Sequence
  Description of Artificial Sequence: Synthetic oligonucleotide
gttctgtgagtggtttctatccaggcagcattg

SEQ ID NO: 65099 - DNA, 35 bp, Artificial Sequence
  Description of Artificial Sequence: Synthetic oligonucleotide
ttctgtgagtggtttctatccaggcagcattgaag

SEQ ID NO: 65100 - DNA, 30 bp, Artificial Sequence
  Description of Artificial Sequence: Synthetic oligonucleotide
gcagcattgaagtcaggtggttccggaatg

SEQ ID NO: 65101 - DNA, 30 bp, Artificial Sequence
  Description of Artificial Sequence: Synthetic oligonucleotide
cagcattgaagtcaggtggttccggaatgg

SEQ ID NO: 65102 - DNA, 30 bp, Artificial Sequence
  Description of Artificial Sequence: Synthetic oligonucleotide
agcattgaagtcaggtggttccggaatggc

SEQ ID NO: 65103 - DNA, 29 bp, Artificial Sequence
  Description of Artificial Sequence: Synthetic oligonucleotide
gcattgaagtcaggtggttccggaatggc

SEQ ID NO: 65104 - DNA, 29 bp, Artificial Sequence
  Description of Artificial Sequence: Synthetic oligonucleotide
cattgaagtcaggtggttccggaatggcc

SEQ ID NO: 65105 - DNA, 30 bp, Artificial Sequence
  Description of Artificial Sequence: Synthetic oligonucleotide
attgaagtcaggtggttccggaatggccag

SEQ ID NO: 65106 - DNA, 29 bp, Artificial Sequence
  Description of Artificial Sequence: Synthetic oligonucleotide
ttgaagtcaggtggttccggaatggccag

SEQ ID NO: 65107 - DNA, 28 bp, Artificial Sequence
  Description of Artificial Sequence: Synthetic oligonucleotide
tgaagtcaggtggttccggaatggccag

SEQ ID NO: 65108 - DNA, 27 bp, Artificial Sequence
  Description of Artificial Sequence: Synthetic oligonucleotide
gaagtcaggtggttccggaatggccag

SEQ ID NO: 65109 - DNA, 27 bp, Artificial Sequence
  Description of Artificial Sequence: Synthetic oligonucleotide
aagtcaggtggttccggaatggccagg

SEQ ID NO: 65110 - DNA, 27 bp, Artificial Sequence
  Description of Artificial Sequence: Synthetic oligonucleotide
agtcaggtggttccggaatggccagga

SEQ ID NO: 65111 - DNA, 27 bp, Artificial Sequence
  Description of Artificial Sequence: Synthetic oligonucleotide
gtcaggtggttccggaatggccaggaa

SEQ ID NO: 65112 - DNA, 27 bp, Artificial Sequence
  Description of Artificial Sequence: Synthetic oligonucleotide
tcaggtggttccggaatggccaggaag

SEQ ID NO: 65113 - DNA, 27 bp, Artificial Sequence
  Description of Artificial Sequence: Synthetic oligonucleotide
caggtggttccggaatggccaggaaga

SEQ ID NO: 65114 - DNA, 27 bp, Artificial Sequence
  Description of Artificial Sequence: Synthetic oligonucleotide
aggtggttccggaatggccaggaagag

SEQ ID NO: 65115 - DNA, 27 bp, Artificial Sequence
  Description of Artificial Sequence: Synthetic oligonucleotide
ggtggttccggaatggccaggaagaga

SEQ ID NO: 65116 - DNA, 28 bp, Artificial Sequence
  Description of Artificial Sequence: Synthetic oligonucleotide
gtggttccggaatggccaggaagagaag

SEQ ID NO: 65117 - DNA, 29 bp, Artificial Sequence
  Description of Artificial Sequence: Synthetic oligonucleotide
tggttccggaatggccaggaagagaagac

SEQ ID NO: 65118 - DNA, 28 bp, Artificial Sequence
  Description of Artificial Sequence: Synthetic oligonucleotide
ggttccggaatggccaggaagagaagac

SEQ ID NO: 65119 - DNA, 29 bp, Artificial Sequence
  Description of Artificial Sequence: Synthetic oligonucleotide
gttccggaatggccaggaagagaagactg

SEQ ID NO: 65120 - DNA, 29 bp, Artificial Sequence
  Description of Artificial Sequence: Synthetic oligonucleotide
ttccggaatggccaggaagagaagactgg

SEQ ID NO: 65121 - DNA, 28 bp, Artificial Sequence
  Description of Artificial Sequence: Synthetic oligonucleotide
tccggaatggccaggaagagaagactgg

SEQ ID NO: 65122 - DNA, 27 bp, Artificial Sequence
  Description of Artificial Sequence: Synthetic oligonucleotide
ccggaatggccaggaagagaagactgg

SEQ ID NO: 65123 - DNA, 27 bp, Artificial Sequence
  Description of Artificial Sequence: Synthetic oligonucleotide
cggaatggccaggaagagaagactggg

SEQ ID NO: 65124 - DNA, 27 bp, Artificial Sequence
  Description of Artificial Sequence: Synthetic oligonucleotide
ggaatggccaggaagagaagactgggg

SEQ ID NO: 65125 - DNA, 28 bp, Artificial Sequence
  Description of Artificial Sequence: Synthetic oligonucleotide
gaatggccaggaagagaagactggggtg

SEQ ID NO: 65126 - DNA, 28 bp, Artificial Sequence
  Description of Artificial Sequence: Synthetic oligonucleotide
aatggccaggaagagaagactggggtgg

SEQ ID NO: 65127 - DNA, 27 bp, Artificial Sequence
  Description of Artificial Sequence: Synthetic oligonucleotide
atggccaggaagagaagactggggtgg

SEQ ID NO: 65128 - DNA, 27 bp, Artificial Sequence
  Description of Artificial Sequence: Synthetic oligonucleotide
tggccaggaagagaagactggggtggt

SEQ ID NO: 65129 - DNA, 26 bp, Artificial Sequence
  Description of Artificial Sequence: Synthetic oligonucleotide
ggccaggaagagaagactggggtggt

SEQ ID NO: 65130 - DNA, 27 bp, Artificial Sequence
  Description of Artificial Sequence: Synthetic oligonucleotide
gccaggaagagaagactggggtggtgt

SEQ ID NO: 65131 - DNA, 27 bp, Artificial Sequence
  Description of Artificial Sequence: Synthetic oligonucleotide
ccaggaagagaagactggggtggtgtc

SEQ ID NO: 65132 - DNA, 27 bp, Artificial Sequence
  Description of Artificial Sequence: Synthetic oligonucleotide
caggaagagaagactggggtggtgtcc

SEQ ID NO: 65133 - DNA, 28 bp, Artificial Sequence
  Description of Artificial Sequence: Synthetic oligonucleotide
aggaagagaagactggggtggtgtccac

SEQ ID NO: 65134 - DNA, 27 bp, Artificial Sequence
  Description of Artificial Sequence: Synthetic oligonucleotide
ggaagagaagactggggtggtgtccac

SEQ ID NO: 65135 - DNA, 28 bp, Artificial Sequence
  Description of Artificial Sequence: Synthetic oligonucleotide
gaagagaagactggggtggtgtccacag

SEQ ID NO: 65136 - DNA, 28 bp, Artificial Sequence
  Description of Artificial Sequence: Synthetic oligonucleotide
aagagaagactggggtggtgtccacagg

SEQ ID NO: 65137 - DNA, 27 bp, Artificial Sequence
  Description of Artificial Sequence: Synthetic oligonucleotide
agagaagactggggtggtgtccacagg

SEQ ID NO: 65138 - DNA, 26 bp, Artificial Sequence
  Description of Artificial Sequence: Synthetic oligonucleotide
gagaagactggggtggtgtccacagg

SEQ ID NO: 65139 - DNA, 26 bp, Artificial Sequence
  Description of Artificial Sequence: Synthetic oligonucleotide
agaagactggggtggtgtccacaggc

SEQ ID NO: 65140 - DNA, 25 bp, Artificial Sequence
  Description of Artificial Sequence: Synthetic oligonucleotide
gaagactggggtggtgtccacaggc

SEQ ID NO: 65141 - DNA, 26 bp, Artificial Sequence
  Description of Artificial Sequence: Synthetic oligonucleotide
aagactggggtggtgtccacaggcct

SEQ ID NO: 65142 - DNA, 25 bp, Artificial Sequence
  Description of Artificial Sequence: Synthetic oligonucleotide
agactggggtggtgtccacaggcct

SEQ ID NO: 65143 - DNA, 24 bp, Artificial Sequence
  Description of Artificial Sequence: Synthetic oligonucleotide
gactggggtggtgtccacaggcct

SEQ ID NO: 65144 - DNA, 26 bp, Artificial Sequence
  Description of Artificial Sequence: Synthetic oligonucleotide
actggggtggtgtccacaggcctgat

SEQ ID NO: 65145 - DNA, 27 bp, Artificial Sequence
  Description of Artificial Sequence: Synthetic oligonucleotide
ggtggtgtccacaggcctgatccacaa

SEQ ID NO: 65146 - DNA, 28 bp, Artificial Sequence
  Description of Artificial Sequence: Synthetic oligonucleotide
gtggtgtccacaggcctgatccacaatg

SEQ ID NO: 65147 - DNA, 28 bp, Artificial Sequence
  Description of Artificial Sequence: Synthetic oligonucleotide
tggtgtccacaggcctgatccacaatgg

SEQ ID NO: 65148 - DNA, 27 bp, Artificial Sequence
  Description of Artificial Sequence: Synthetic oligonucleotide
ggtgtccacaggcctgatccacaatgg

SEQ ID NO: 65149 - DNA, 28 bp, Artificial Sequence
  Description of Artificial Sequence: Synthetic oligonucleotide
gtgtccacaggcctgatccacaatggag

SEQ ID NO: 65150 - DNA, 29 bp, Artificial Sequence
  Description of Artificial Sequence: Synthetic oligonucleotide
tgtccacaggcctgatccacaatggagac

SEQ ID NO: 65151 - DNA, 28 bp, Artificial Sequence
  Description of Artificial Sequence: Synthetic oligonucleotide
gtccacaggcctgatccacaatggagac

SEQ ID NO: 65152 - DNA, 29 bp, Artificial Sequence
  Description of Artificial Sequence: Synthetic oligonucleotide
tccacaggcctgatccacaatggagactg

SEQ ID NO: 65153 - DNA, 28 bp, Artificial Sequence
  Description of Artificial Sequence: Synthetic oligonucleotide
ccacaggcctgatccacaatggagactg

SEQ ID NO: 65154 - DNA, 28 bp, Artificial Sequence
  Description of Artificial Sequence: Synthetic oligonucleotide
cacaggcctgatccacaatggagactgg

SEQ ID NO: 65155 - DNA, 29 bp, Artificial Sequence
  Description of Artificial Sequence: Synthetic oligonucleotide
acaggcctgatccacaatggagactggac

SEQ ID NO: 65156 - DNA, 28 bp, Artificial Sequence
  Description of Artificial Sequence: Synthetic oligonucleotide
caggcctgatccacaatggagactggac

SEQ ID NO: 65157 - DNA, 28 bp, Artificial Sequence
  Description of Artificial Sequence: Synthetic oligonucleotide
aggcctgatccacaatggagactggacc

SEQ ID NO: 65158 - DNA, 27 bp, Artificial Sequence
  Description of Artificial Sequence: Synthetic oligonucleotide
ggcctgatccacaatggagactggacc

SEQ ID NO: 65159 - DNA, 29 bp, Artificial Sequence
  Description of Artificial Sequence: Synthetic oligonucleotide
gcctgatccacaatggagactggaccttc

SEQ ID NO: 65160 - DNA, 29 bp, Artificial Sequence
  Description of Artificial Sequence: Synthetic oligonucleotide
cctgatccacaatggagactggaccttcc

SEQ ID NO: 65161 - DNA, 30 bp, Artificial Sequence
  Description of Artificial Sequence: Synthetic oligonucleotide
ctgatccacaatggagactggaccttccag

SEQ ID NO: 65162 - DNA, 31 bp, Artificial Sequence
  Description of Artificial Sequence: Synthetic oligonucleotide
tgatccacaatggagactggaccttccagac

SEQ ID NO: 65163 - DNA, 30 bp, Artificial Sequence
  Description of Artificial Sequence: Synthetic oligonucleotide
gatccacaatggagactggaccttccagac

SEQ ID NO: 65164 - DNA, 30 bp, Artificial Sequence
  Description of Artificial Sequence: Synthetic oligonucleotide
atccacaatggagactggaccttccagacc

SEQ ID NO: 65165 - DNA, 29 bp, Artificial Sequence
  Description of Artificial Sequence: Synthetic oligonucleotide
tccacaatggagactggaccttccagacc

SEQ ID NO: 65166 - DNA, 28 bp, Artificial Sequence
  Description of Artificial Sequence: Synthetic oligonucleotide
ccacaatggagactggaccttccagacc

SEQ ID NO: 65167 - DNA, 28 bp, Artificial Sequence
  Description of Artificial Sequence: Synthetic oligonucleotide
cacaatggagactggaccttccagaccc

SEQ ID NO: 65168 - DNA, 29 bp, Artificial Sequence
  Description of Artificial Sequence: Synthetic oligonucleotide
acaatggagactggaccttccagaccctg

SEQ ID NO: 65169 - DNA, 28 bp, Artificial Sequence
  Description of Artificial Sequence: Synthetic oligonucleotide
caatggagactggaccttccagaccctg

SEQ ID NO: 65170 - DNA, 28 bp, Artificial Sequence
  Description of Artificial Sequence: Synthetic oligonucleotide
aatggagactggaccttccagaccctgg

SEQ ID NO: 65171 - DNA, 27 bp, Artificial Sequence
  Description of Artificial Sequence: Synthetic oligonucleotide
atggagactggaccttccagaccctgg

SEQ ID NO: 65172 - DNA, 27 bp, Artificial Sequence
  Description of Artificial Sequence: Synthetic oligonucleotide
tggagactggaccttccagaccctggt

SEQ ID NO: 65173 - DNA, 26 bp, Artificial Sequence
  Description of Artificial Sequence: Synthetic oligonucleotide
ggagactggaccttccagaccctggt

SEQ ID NO: 65174 - DNA, 27 bp, Artificial Sequence
  Description of Artificial Sequence: Synthetic oligonucleotide
gagactggaccttccagaccctggtga

SEQ ID NO: 65175 - DNA, 28 bp, Artificial Sequence
  Description of Artificial Sequence: Synthetic oligonucleotide
agactggaccttccagaccctggtgatg

SEQ ID NO: 65176 - DNA, 27 bp, Artificial Sequence
  Description of Artificial Sequence: Synthetic oligonucleotide
gactggaccttccagaccctggtgatg

SEQ ID NO: 65177 - DNA, 27 bp, Artificial Sequence
  Description of Artificial Sequence: Synthetic oligonucleotide
actggaccttccagaccctggtgatgc

SEQ ID NO: 65178 - DNA, 27 bp, Artificial Sequence
  Description of Artificial Sequence: Synthetic oligonucleotide
ctggaccttccagaccctggtgatgct

SEQ ID NO: 65179 - DNA, 29 bp, Artificial Sequence
  Description of Artificial Sequence: Synthetic oligonucleotide
tttacacctgccaagtggagcacccaagc

SEQ ID NO: 65180 - DNA, 28 bp, Artificial Sequence
  Description of Artificial Sequence: Synthetic oligonucleotide
ttacacctgccaagtggagcacccaagc

SEQ ID NO: 65181 - DNA, 27 bp, Artificial Sequence
  Description of Artificial Sequence: Synthetic oligonucleotide
tacacctgccaagtggagcacccaagc

SEQ ID NO: 65182 - DNA, 26 bp, Artificial Sequence
  Description of Artificial Sequence: Synthetic oligonucleotide
acacctgccaagtggagcacccaagc

SEQ ID NO: 65183 - DNA, 25 bp, Artificial Sequence
  Description of Artificial Sequence: Synthetic oligonucleotide
cacctgccaagtggagcacccaagc

SEQ ID NO: 65184 - DNA, 26 bp, Artificial Sequence
  Description of Artificial Sequence: Synthetic oligonucleotide
acctgccaagtggagcacccaagcgt

SEQ ID NO: 65185 - DNA, 25 bp, Artificial Sequence
  Description of Artificial Sequence: Synthetic oligonucleotide
cctgccaagtggagcacccaagcgt

SEQ ID NO: 65186 - DNA, 26 bp, Artificial Sequence
  Description of Artificial Sequence: Synthetic oligonucleotide
ctgccaagtggagcacccaagcgtga

SEQ ID NO: 65187 - DNA, 27 bp, Artificial Sequence
  Description of Artificial Sequence: Synthetic oligonucleotide
tgccaagtggagcacccaagcgtgaca

SEQ ID NO: 65188 - DNA, 27 bp, Artificial Sequence
  Description of Artificial Sequence: Synthetic oligonucleotide
gccaagtggagcacccaagcgtgacaa

SEQ ID NO: 65189 - DNA, 27 bp, Artificial Sequence
  Description of Artificial Sequence: Synthetic oligonucleotide
ccaagtggagcacccaagcgtgacaag

SEQ ID NO: 65190 - DNA, 27 bp, Artificial Sequence
  Description of Artificial Sequence: Synthetic oligonucleotide
caagtggagcacccaagcgtgacaagc

SEQ ID NO: 65191 - DNA, 27 bp, Artificial Sequence
  Description of Artificial Sequence: Synthetic oligonucleotide
aagtggagcacccaagcgtgacaagcc

SEQ ID NO: 65192 - DNA, 26 bp, Artificial Sequence
  Description of Artificial Sequence: Synthetic oligonucleotide
agtggagcacccaagcgtgacaagcc

SEQ ID NO: 65193 - DNA, 25 bp, Artificial Sequence
  Description of Artificial Sequence: Synthetic oligonucleotide
gtggagcacccaagcgtgacaagcc

SEQ ID NO: 65194 - DNA, 26 bp, Artificial Sequence
  Description of Artificial Sequence: Synthetic oligonucleotide
tggagcacccaagcgtgacaagccct

SEQ ID NO: 65195 - DNA, 25 bp, Artificial Sequence
  Description of Artificial Sequence: Synthetic oligonucleotide
ggagcacccaagcgtgacaagccct

SEQ ID NO: 65196 - DNA, 26 bp, Artificial Sequence
  Description of Artificial Sequence: Synthetic oligonucleotide
gagcacccaagcgtgacaagccctct

SEQ ID NO: 65197 - DNA, 27 bp, Artificial Sequence
  Description of Artificial Sequence: Synthetic oligonucleotide
agcacccaagcgtgacaagccctctca

SEQ ID NO: 65198 - DNA, 26 bp, Artificial Sequence
  Description of Artificial Sequence: Synthetic oligonucleotide
gcacccaagcgtgacaagccctctca

SEQ ID NO: 65199 - DNA, 27 bp, Artificial Sequence
  Description of Artificial Sequence: Synthetic oligonucleotide
cacccaagcgtgacaagccctctcaca

SEQ ID NO: 65200 - DNA, 27 bp, Artificial Sequence
  Description of Artificial Sequence: Synthetic oligonucleotide
acccaagcgtgacaagccctctcacag

SEQ ID NO: 65201 - DNA, 27 bp, Artificial Sequence
  Description of Artificial Sequence: Synthetic oligonucleotide
cccaagcgtgacaagccctctcacagt

SEQ ID NO: 65202 - DNA, 27 bp, Artificial Sequence
  Description of Artificial Sequence: Synthetic oligonucleotide
ccaagcgtgacaagccctctcacagtg

SEQ ID NO: 65203 - DNA, 27 bp, Artificial Sequence
  Description of Artificial Sequence: Synthetic oligonucleotide
caagcgtgacaagccctctcacagtgg

SEQ ID NO: 65204 - DNA, 30 bp, Artificial Sequence
  Description of Artificial Sequence: Synthetic oligonucleotide
aagcgtgacaagccctctcacagtggaatg

SEQ ID NO: 65205 - DNA, 29 bp, Artificial Sequence
  Description of Artificial Sequence: Synthetic oligonucleotide
agcgtgacaagccctctcacagtggaatg

SEQ ID NO: 65206 - DNA, 28 bp, Artificial Sequence
  Description of Artificial Sequence: Synthetic oligonucleotide
gcgtgacaagccctctcacagtggaatg

SEQ ID NO: 65207 - DNA, 28 bp, Artificial Sequence
  Description of Artificial Sequence: Synthetic oligonucleotide
cgtgacaagccctctcacagtggaatgg

SEQ ID NO: 65208 - DNA, 29 bp, Artificial Sequence
  Description of Artificial Sequence: Synthetic oligonucleotide
gtgacaagccctctcacagtggaatggag

SEQ ID NO: 65209 - DNA, 30 bp, Artificial Sequence
  Description of Artificial Sequence: Synthetic oligonucleotide
tgacaagccctctcacagtggaatggagag

SEQ ID NO: 65210 - DNA, 29 bp, Artificial Sequence
  Description of Artificial Sequence: Synthetic oligonucleotide
gacaagccctctcacagtggaatggagag

SEQ ID NO: 65211 - DNA, 29 bp, Artificial Sequence
  Description of Artificial Sequence: Synthetic oligonucleotide
acaagccctctcacagtggaatggagagc

SEQ ID NO: 65212 - DNA, 28 bp, Artificial Sequence
  Description of Artificial Sequence: Synthetic oligonucleotide
caagccctctcacagtggaatggagagc

SEQ ID NO: 65213 - DNA, 29 bp, Artificial Sequence
  Description of Artificial Sequence: Synthetic oligonucleotide
aagccctctcacagtggaatggagagcac

SEQ ID NO: 65214 - DNA, 28 bp, Artificial Sequence
  Description of Artificial Sequence: Synthetic oligonucleotide
aagatgctgagtggagtcgggggctttg

SEQ ID NO: 65215 - DNA, 27 bp, Artificial Sequence
  Description of Artificial Sequence: Synthetic oligonucleotide
agatgctgagtggagtcgggggctttg

SEQ ID NO: 65216 - DNA, 27 bp, Artificial Sequence
  Description of Artificial Sequence: Synthetic oligonucleotide
gatgctgagtggagtcgggggctttgt

SEQ ID NO: 65217 - DNA, 27 bp, Artificial Sequence
  Description of Artificial Sequence: Synthetic oligonucleotide
atgctgagtggagtcgggggctttgtg

SEQ ID NO: 65218 - DNA, 26 bp, Artificial Sequence
  Description of Artificial Sequence: Synthetic oligonucleotide
tgctgagtggagtcgggggctttgtg

SEQ ID NO: 65219 - DNA, 25 bp, Artificial Sequence
  Description of Artificial Sequence: Synthetic oligonucleotide
gctgagtggagtcgggggctttgtg

SEQ ID NO: 65220 - DNA, 26 bp, Artificial Sequence
  Description of Artificial Sequence: Synthetic oligonucleotide
ctgagtggagtcgggggctttgtgct

SEQ ID NO: 65221 - DNA, 26 bp, Artificial Sequence
  Description of Artificial Sequence: Synthetic oligonucleotide
tgagtggagtcgggggctttgtgctg

SEQ ID NO: 65222 - DNA, 25 bp, Artificial Sequence
  Description of Artificial Sequence: Synthetic oligonucleotide
gagtggagtcgggggctttgtgctg

SEQ ID NO: 65223 - DNA, 25 bp, Artificial Sequence
  Description of Artificial Sequence: Synthetic oligonucleotide
agtggagtcgggggctttgtgctgg

SEQ ID NO: 65224 - DNA, 24 bp, Artificial Sequence
  Description of Artificial Sequence: Synthetic oligonucleotide
gtggagtcgggggctttgtgctgg

SEQ ID NO: 65225 - DNA, 24 bp, Artificial Sequence
  Description of Artificial Sequence: Synthetic oligonucleotide
tggagtcgggggctttgtgctggg

SEQ ID NO: 65226 - DNA, 23 bp, Artificial Sequence
  Description of Artificial Sequence: Synthetic oligonucleotide
ggagtcgggggctttgtgctggg

SEQ ID NO: 65227 - DNA, 23 bp, Artificial Sequence
  Description of Artificial Sequence: Synthetic oligonucleotide
gagtcgggggctttgtgctgggc

SEQ ID NO: 65228 - DNA, 24 bp, Artificial Sequence
  Description of Artificial Sequence: Synthetic oligonucleotide
agtcgggggctttgtgctgggcct

SEQ ID NO: 65229 - DNA, 23 bp, Artificial Sequence
  Description of Artificial Sequence: Synthetic oligonucleotide
gtcgggggctttgtgctgggcct

SEQ ID NO: 65230 - DNA, 23 bp, Artificial Sequence
  Description of Artificial Sequence: Synthetic oligonucleotide
tcgggggctttgtgctgggcctg

SEQ ID NO: 65231 - DNA, 22 bp, Artificial Sequence
  Description of Artificial Sequence: Synthetic oligonucleotide
cgggggctttgtgctgggcctg

SEQ ID NO: 65232 - DNA, 23 bp, Artificial Sequence
  Description of Artificial Sequence: Synthetic oligonucleotide
gggggctttgtgctgggcctgct

SEQ ID NO: 65233 - DNA, 25 bp, Artificial Sequence
  Description of Artificial Sequence: Synthetic oligonucleotide
ggggctttgtgctgggcctgctctt

SEQ ID NO: 65234 - DNA, 25 bp, Artificial Sequence
  Description of Artificial Sequence: Synthetic oligonucleotide
gggctttgtgctgggcctgctcttc

SEQ ID NO: 65235 - DNA, 27 bp, Artificial Sequence
  Description of Artificial Sequence: Synthetic oligonucleotide
ggctttgtgctgggcctgctcttcctt

SEQ ID NO: 65236 - DNA, 27 bp, Artificial Sequence
  Description of Artificial Sequence: Synthetic oligonucleotide
gctttgtgctgggcctgctcttccttg

SEQ ID NO: 65237 - DNA, 27 bp, Artificial Sequence
  Description of Artificial Sequence: Synthetic oligonucleotide
ctttgtgctgggcctgctcttccttgg

SEQ ID NO: 65238 - DNA, 27 bp, Artificial Sequence
  Description of Artificial Sequence: Synthetic oligonucleotide
tttgtgctgggcctgctcttccttggg

SEQ ID NO: 65239 - DNA, 26 bp, Artificial Sequence
  Description of Artificial Sequence: Synthetic oligonucleotide
ttgtgctgggcctgctcttccttggg

SEQ ID NO: 65240 - DNA, 25 bp, Artificial Sequence
  Description of Artificial Sequence: Synthetic oligonucleotide
tgtgctgggcctgctcttccttggg

SEQ ID NO: 65241 - DNA, 33 bp, Artificial Sequence
  Description of Artificial Sequence: Synthetic oligonucleotide
gaatcagaaaggacactctggacttcagccaag

SEQ ID NO: 65242 - DNA, 34 bp, Artificial Sequence
  Description of Artificial Sequence: Synthetic oligonucleotide
aatcagaaaggacactctggacttcagccaagag

SEQ ID NO: 65243 - DNA, 33 bp, Artificial Sequence
  Description of Artificial Sequence: Synthetic oligonucleotide
atcagaaaggacactctggacttcagccaagag

SEQ ID NO: 65244 - DNA, 32 bp, Artificial Sequence
  Description of Artificial Sequence: Synthetic oligonucleotide
tcagaaaggacactctggacttcagccaagag

SEQ ID NO: 65245 - DNA, 31 bp, Artificial Sequence
  Description of Artificial Sequence: Synthetic oligonucleotide
cagaaaggacactctggacttcagccaagag

SEQ ID NO: 65246 - DNA, 31 bp, Artificial Sequence
  Description of Artificial Sequence: Synthetic oligonucleotide
agaaaggacactctggacttcagccaagagg

SEQ ID NO: 65247 - DNA, 30 bp, Artificial Sequence
  Description of Artificial Sequence: Synthetic oligonucleotide
gaaaggacactctggacttcagccaagagg

SEQ ID NO: 65248 - DNA, 33 bp, Artificial Sequence
  Description of Artificial Sequence: Synthetic oligonucleotide
aaaggacactctggacttcagccaagaggattc

SEQ ID NO: 65249 - DNA, 32 bp, Artificial Sequence
  Description of Artificial Sequence: Synthetic oligonucleotide
aaggacactctggacttcagccaagaggattc

SEQ ID NO: 65250 - DNA, 31 bp, Artificial Sequence
  Description of Artificial Sequence: Synthetic oligonucleotide
aggacactctggacttcagccaagaggattc

SEQ ID NO: 65251 - DNA, 30 bp, Artificial Sequence
  Description of Artificial Sequence: Synthetic oligonucleotide
ggacactctggacttcagccaagaggattc

SEQ ID NO: 65252 - DNA, 30 bp, Artificial Sequence
  Description of Artificial Sequence: Synthetic oligonucleotide
gacactctggacttcagccaagaggattcc

SEQ ID NO: 65253 - DNA, 31 bp, Artificial Sequence
  Description of Artificial Sequence: Synthetic oligonucleotide
acactctggacttcagccaagaggattcctg

SEQ ID NO: 65254 - DNA, 30 bp, Artificial Sequence
  Description of Artificial Sequence: Synthetic oligonucleotide
cactctggacttcagccaagaggattcctg

SEQ ID NO: 65255 - DNA, 31 bp, Artificial Sequence
  Description of Artificial Sequence: Synthetic oligonucleotide
actctggacttcagccaagaggattcctgag

SEQ ID NO: 65256 - DNA, 30 bp, Artificial Sequence
  Description of Artificial Sequence: Synthetic oligonucleotide
ctctggacttcagccaagaggattcctgag

SEQ ID NO: 65257 - DNA, 30 bp, Artificial Sequence
  Description of Artificial Sequence: Synthetic oligonucleotide
tctggacttcagccaagaggattcctgagc

SEQ ID NO: 65258 - DNA, 29 bp, Artificial Sequence
  Description of Artificial Sequence: Synthetic oligonucleotide
ctggacttcagccaagaggattcctgagc

SEQ ID NO: 65259 - DNA, 30 bp, Artificial Sequence
  Description of Artificial Sequence: Synthetic oligonucleotide
tggacttcagccaagaggattcctgagctg

SEQ ID NO: 65260 - DNA, 29 bp, Artificial Sequence
  Description of Artificial Sequence: Synthetic oligonucleotide
ggacttcagccaagaggattcctgagctg

SEQ ID NO: 65261 - DNA, 26 bp, Artificial Sequence
  Description of Artificial Sequence: Synthetic oligonucleotide
cagaagcggggccgggtggacaatta

SEQ ID NO: 65262 - DNA, 27 bp, Artificial Sequence
  Description of Artificial Sequence: Synthetic oligonucleotide
agaagcggggccgggtggacaattact

SEQ ID NO: 65263 - DNA, 26 bp, Artificial Sequence
  Description of Artificial Sequence: Synthetic oligonucleotide
gaagcggggccgggtggacaattact

SEQ ID NO: 65264 - DNA, 26 bp, Artificial Sequence
  Description of Artificial Sequence: Synthetic oligonucleotide
aagcggggccgggtggacaattactg

SEQ ID NO: 65265 - DNA, 25 bp, Artificial Sequence
  Description of Artificial Sequence: Synthetic oligonucleotide
agcggggccgggtggacaattactg

SEQ ID NO: 65266 - DNA, 24 bp, Artificial Sequence
  Description of Artificial Sequence: Synthetic oligonucleotide
gcggggccgggtggacaattactg

SEQ ID NO: 65267 - DNA, 25 bp, Artificial Sequence
  Description of Artificial Sequence: Synthetic oligonucleotide
cggggccgggtggacaattactgca

SEQ ID NO: 65268 - DNA, 26 bp, Artificial Sequence
  Description of Artificial Sequence: Synthetic oligonucleotide
ggggccgggtggacaattactgcaga

SEQ ID NO: 65269 - DNA, 27 bp, Artificial Sequence
  Description of Artificial Sequence: Synthetic oligonucleotide
gggccgggtggacaattactgcagaca

SEQ ID NO: 65270 - DNA, 27 bp, Artificial Sequence
  Description of Artificial Sequence: Synthetic oligonucleotide
ggccgggtggacaattactgcagacac

SEQ ID NO: 65271 - DNA, 29 bp, Artificial Sequence
  Description of Artificial Sequence: Synthetic oligonucleotide
gccgggtggacaattactgcagacacaac

SEQ ID NO: 65272 - DNA, 31 bp, Artificial Sequence
  Description of Artificial Sequence: Synthetic oligonucleotide
ccgggtggacaattactgcagacacaactac

SEQ ID NO: 65273 - DNA, 31 bp, Artificial Sequence
  Description of Artificial Sequence: Synthetic oligonucleotide
cgggtggacaattactgcagacacaactacg

SEQ ID NO: 65274 - DNA, 31 bp, Artificial Sequence
  Description of Artificial Sequence: Synthetic oligonucleotide
gggtggacaattactgcagacacaactacgg

SEQ ID NO: 65275 - DNA, 42 bp, Artificial Sequence
  Description of Artificial Sequence: Synthetic oligonucleotide
gtttcttggagtactctacgtctgagtgtcatttctttaatg

SEQ ID NO: 65276 - DNA, 42 bp, Artificial Sequence
  Description of Artificial Sequence: Synthetic oligonucleotide
tttcttggagtactctacgtctgagtgtcatttctttaatgg

SEQ ID NO: 65277 - DNA, 41 bp, Artificial Sequence
  Description of Artificial Sequence: Synthetic oligonucleotide
ttcttggagtactctacgtctgagtgtcatttctttaatgg

SEQ ID NO: 65278 - DNA, 40 bp, Artificial Sequence
  Description of Artificial Sequence: Synthetic oligonucleotide
tcttggagtactctacgtctgagtgtcatttctttaatgg

SEQ ID NO: 65279 - DNA, 39 bp, Artificial Sequence
  Description of Artificial Sequence: Synthetic oligonucleotide
cttggagtactctacgtctgagtgtcatttctttaatgg

SEQ ID NO: 65280 - DNA, 39 bp, Artificial Sequence
  Description of Artificial Sequence: Synthetic oligonucleotide
ttggagtactctacgtctgagtgtcatttctttaatggg

SEQ ID NO: 65281 - DNA, 38 bp, Artificial Sequence
  Description of Artificial Sequence: Synthetic oligonucleotide
tggagtactctacgtctgagtgtcatttctttaatggg

SEQ ID NO: 65282 - DNA, 37 bp, Artificial Sequence
  Description of Artificial Sequence: Synthetic oligonucleotide
ggagtactctacgtctgagtgtcatttctttaatggg

SEQ ID NO: 65283 - DNA, 38 bp, Artificial Sequence
  Description of Artificial Sequence: Synthetic oligonucleotide
gagtactctacgtctgagtgtcatttctttaatgggac

SEQ ID NO: 65284 - DNA, 38 bp, Artificial Sequence
  Description of Artificial Sequence: Synthetic oligonucleotide
agtactctacgtctgagtgtcatttctttaatgggacg

SEQ ID NO: 65285 - DNA, 37 bp, Artificial Sequence
  Description of Artificial Sequence: Synthetic oligonucleotide
gtactctacgtctgagtgtcatttctttaatgggacg

SEQ ID NO: 65286 - DNA, 37 bp, Artificial Sequence
  Description of Artificial Sequence: Synthetic oligonucleotide
tactctacgtctgagtgtcatttctttaatgggacgg

SEQ ID NO: 65287 - DNA, 36 bp, Artificial Sequence
  Description of Artificial Sequence: Synthetic oligonucleotide
actctacgtctgagtgtcatttctttaatgggacgg

SEQ ID NO: 65288 - DNA, 35 bp, Artificial Sequence
  Description of Artificial Sequence: Synthetic oligonucleotide
ctctacgtctgagtgtcatttctttaatgggacgg

SEQ ID NO: 65289 - DNA, 36 bp, Artificial Sequence
  Description of Artificial Sequence: Synthetic oligonucleotide
tctacgtctgagtgtcatttctttaatgggacggag

SEQ ID NO: 65290 - DNA, 35 bp, Artificial Sequence
  Description of Artificial Sequence: Synthetic oligonucleotide
ctacgtctgagtgtcatttctttaatgggacggag

SEQ ID NO: 65291 - DNA, 35 bp, Artificial Sequence
  Description of Artificial Sequence: Synthetic oligonucleotide
tacgtctgagtgtcatttctttaatgggacggagc

SEQ ID NO: 65292 - DNA, 34 bp, Artificial Sequence
  Description of Artificial Sequence: Synthetic oligonucleotide
acgtctgagtgtcatttctttaatgggacggagc

SEQ ID NO: 65293 - DNA, 33 bp, Artificial Sequence
  Description of Artificial Sequence: Synthetic oligonucleotide
cgtctgagtgtcatttctttaatgggacggagc

SEQ ID NO: 65294 - DNA, 33 bp, Artificial Sequence
  Description of Artificial Sequence: Synthetic oligonucleotide
gtctgagtgtcatttctttaatgggacggagcg

SEQ ID NO: 65295 - DNA, 33 bp, Artificial Sequence
  Description of Artificial Sequence: Synthetic oligonucleotide
tctgagtgtcatttctttaatgggacggagcgg

SEQ ID NO: 65296 - DNA, 32 bp, Artificial Sequence
  Description of Artificial Sequence: Synthetic oligonucleotide
ctgagtgtcatttctttaatgggacggagcgg

SEQ ID NO: 65297 - DNA, 32 bp, Artificial Sequence
  Description of Artificial Sequence: Synthetic oligonucleotide
tgagtgtcatttctttaatgggacggagcggg

SEQ ID NO: 65298 - DNA, 31 bp, Artificial Sequence
  Description of Artificial Sequence: Synthetic oligonucleotide
gagtgtcatttctttaatgggacggagcggg

SEQ ID NO: 65299 - DNA, 32 bp, Artificial Sequence
  Description of Artificial Sequence: Synthetic oligonucleotide
agtgtcatttctttaatgggacggagcgggtg

SEQ ID NO: 65300 - DNA, 31 bp, Artificial Sequence
  Description of Artificial Sequence: Synthetic oligonucleotide
gtgtcatttctttaatgggacggagcgggtg

SEQ ID NO: 65301 - DNA, 31 bp, Artificial Sequence
  Description of Artificial Sequence: Synthetic oligonucleotide
tgtcatttctttaatgggacggagcgggtgc

SEQ ID NO: 65302 - DNA, 30 bp, Artificial Sequence
  Description of Artificial Sequence: Synthetic oligonucleotide
gtcatttctttaatgggacggagcgggtgc

SEQ ID NO: 65303 - DNA, 30 bp, Artificial Sequence
  Description of Artificial Sequence: Synthetic oligonucleotide
tcatttctttaatgggacggagcgggtgcg

SEQ ID NO: 65304 - DNA, 29 bp, Artificial Sequence
  Description of Artificial Sequence: Synthetic oligonucleotide
catttctttaatgggacggagcgggtgcg

SEQ ID NO: 65305 - DNA, 29 bp, Artificial Sequence
  Description of Artificial Sequence: Synthetic oligonucleotide
atttctttaatgggacggagcgggtgcgg

SEQ ID NO: 65306 - DNA, 28 bp, Artificial Sequence
  Description of Artificial Sequence: Synthetic oligonucleotide
tttctttaatgggacggagcgggtgcgg

SEQ ID NO: 65307 - DNA, 27 bp, Artificial Sequence
  Description of Artificial Sequence: Synthetic oligonucleotide
ttctttaatgggacggagcgggtgcgg

SEQ ID NO: 65308 - DNA, 27 bp, Artificial Sequence
  Description of Artificial Sequence: Synthetic oligonucleotide
tctttaatgggacggagcgggtgcggt

SEQ ID NO: 65309 - DNA, 27 bp, Artificial Sequence
  Description of Artificial Sequence: Synthetic oligonucleotide
ctttaatgggacggagcgggtgcggta

SEQ ID NO: 65310 - DNA, 27 bp, Artificial Sequence
  Description of Artificial Sequence: Synthetic oligonucleotide
tttaatgggacggagcgggtgcggtac

SEQ ID NO: 65311 - DNA, 26 bp, Artificial Sequence
  Description of Artificial Sequence: Synthetic oligonucleotide
ttaatgggacggagcgggtgcggtac

SEQ ID NO: 65312 - DNA, 25 bp, Artificial Sequence
  Description of Artificial Sequence: Synthetic oligonucleotide
taatgggacggagcgggtgcggtac

SEQ ID NO: 65313 - DNA, 24 bp, Artificial Sequence
  Description of Artificial Sequence: Synthetic oligonucleotide
acctcctggagcagaagcggggca

SEQ ID NO: 65314 - DNA, 23 bp, Artificial Sequence
  Description of Artificial Sequence: Synthetic oligonucleotide
cctcctggagcagaagcggggca

SEQ ID NO: 65315 - DNA, 23 bp, Artificial Sequence
  Description of Artificial Sequence: Synthetic oligonucleotide
ctcctggagcagaagcggggcag

SEQ ID NO: 65316 - DNA, 23 bp, Artificial Sequence
  Description of Artificial Sequence: Synthetic oligonucleotide
tcctggagcagaagcggggcagg

SEQ ID NO: 65317 - DNA, 22 bp, Artificial Sequence
  Description of Artificial Sequence: Synthetic oligonucleotide
cctggagcagaagcggggcagg

SEQ ID NO: 65318 - DNA, 23 bp, Artificial Sequence
  Description of Artificial Sequence: Synthetic oligonucleotide
ctggagcagaagcggggcagggt

SEQ ID NO: 65319 - DNA, 23 bp, Artificial Sequence
  Description of Artificial Sequence: Synthetic oligonucleotide
tggagcagaagcggggcagggtg

SEQ ID NO: 65320 - DNA, 22 bp, Artificial Sequence
  Description of Artificial Sequence: Synthetic oligonucleotide
ggagcagaagcggggcagggtg

SEQ ID NO: 65321 - DNA, 23 bp, Artificial Sequence
  Description of Artificial Sequence: Synthetic oligonucleotide
gagcagaagcggggcagggtgga

SEQ ID NO: 65322 - DNA, 25 bp, Artificial Sequence
  Description of Artificial Sequence: Synthetic oligonucleotide
agcagaagcggggcagggtggacaa

SEQ ID NO: 65323 - DNA, 24 bp, Artificial Sequence
  Description of Artificial Sequence: Synthetic oligonucleotide
gcagaagcggggcagggtggacaa

SEQ ID NO: 65324 - DNA, 26 bp, Artificial Sequence
  Description of Artificial Sequence: Synthetic oligonucleotide
cagaagcggggcagggtggacaacta

SEQ ID NO: 65325 - DNA, 27 bp, Artificial Sequence
  Description of Artificial Sequence: Synthetic oligonucleotide
agaagcggggcagggtggacaactact

SEQ ID NO: 65326 - DNA, 26 bp, Artificial Sequence
  Description of Artificial Sequence: Synthetic oligonucleotide
gaagcggggcagggtggacaactact

SEQ ID NO: 65327 - DNA, 26 bp, Artificial Sequence
  Description of Artificial Sequence: Synthetic oligonucleotide
aagcggggcagggtggacaactactg

SEQ ID NO: 65328 - DNA, 25 bp, Artificial Sequence
  Description of Artificial Sequence: Synthetic oligonucleotide
agcggggcagggtggacaactactg

SEQ ID NO: 65329 - DNA, 24 bp, Artificial Sequence
  Description of Artificial Sequence: Synthetic oligonucleotide
gcggggcagggtggacaactactg

SEQ ID NO: 65330 - DNA, 25 bp, Artificial Sequence
  Description of Artificial Sequence: Synthetic oligonucleotide
cggggcagggtggacaactactgca

SEQ ID NO: 65331 - DNA, 26 bp, Artificial Sequence
  Description of Artificial Sequence: Synthetic oligonucleotide
ggggcagggtggacaactactgcaga

SEQ ID NO: 65332 - DNA, 27 bp, Artificial Sequence
  Description of Artificial Sequence: Synthetic oligonucleotide
gggcagggtggacaactactgcagaca

SEQ ID NO: 65333 - DNA, 27 bp, Artificial Sequence
  Description of Artificial Sequence: Synthetic oligonucleotide
ggcagggtggacaactactgcagacac

SEQ ID NO: 65334 - DNA, 29 bp, Artificial Sequence
  Description of Artificial Sequence: Synthetic oligonucleotide
gcagggtggacaactactgcagacacaac

SEQ ID NO: 65335 - DNA, 31 bp, Artificial Sequence
  Description of Artificial Sequence: Synthetic oligonucleotide
cagggtggacaactactgcagacacaactac

SEQ ID NO: 65336 - DNA, 31 bp, Artificial Sequence
  Description of Artificial Sequence: Synthetic oligonucleotide
agggtggacaactactgcagacacaactacg

SEQ ID NO: 65337 - DNA, 23 bp, Artificial Sequence
  Description of Artificial Sequence: Synthetic oligonucleotide
tgggggagttccgggcggtgaca

SEQ ID NO: 65338 - DNA, 22 bp, Artificial Sequence
  Description of Artificial Sequence: Synthetic oligonucleotide
gggggagttccgggcggtgaca

SEQ ID NO: 65339 - DNA, 23 bp, Artificial Sequence
  Description of Artificial Sequence: Synthetic oligonucleotide
ggggagttccgggcggtgacaga

SEQ ID NO: 65340 - DNA, 23 bp, Artificial Sequence
  Description of Artificial Sequence: Synthetic oligonucleotide
gggagttccgggcggtgacagag

SEQ ID NO: 65341 - DNA, 24 bp, Artificial Sequence
  Description of Artificial Sequence: Synthetic oligonucleotide
ggagttccgggcggtgacagagct

SEQ ID NO: 65342 - DNA, 24 bp, Artificial Sequence
  Description of Artificial Sequence: Synthetic oligonucleotide
gagttccgggcggtgacagagctg

SEQ ID NO: 65343 - DNA, 24 bp, Artificial Sequence
  Description of Artificial Sequence: Synthetic oligonucleotide
agttccgggcggtgacagagctgg

SEQ ID NO: 65344 - DNA, 23 bp, Artificial Sequence
  Description of Artificial Sequence: Synthetic oligonucleotide
gttccgggcggtgacagagctgg

SEQ ID NO: 65345 - DNA, 23 bp, Artificial Sequence
  Description of Artificial Sequence: Synthetic oligonucleotide
ttccgggcggtgacagagctggg

SEQ ID NO: 65346 - DNA, 22 bp, Artificial Sequence
  Description of Artificial Sequence: Synthetic oligonucleotide
tccgggcggtgacagagctggg

SEQ ID NO: 65347 - DNA, 21 bp, Artificial Sequence
  Description of Artificial Sequence: Synthetic oligonucleotide
ccgggcggtgacagagctggg

SEQ ID NO: 65348 - DNA, 21 bp, Artificial Sequence
  Description of Artificial Sequence: Synthetic oligonucleotide
cgggcggtgacagagctgggg

SEQ ID NO: 65349 - DNA, 21 bp, Artificial Sequence
  Description of Artificial Sequence: Synthetic oligonucleotide
gggcggtgacagagctggggc

SEQ ID NO: 65350 - DNA, 21 bp, Artificial Sequence
  Description of Artificial Sequence: Synthetic oligonucleotide
ggcggtgacagagctggggcg

SEQ ID NO: 65351 - DNA, 21 bp, Artificial Sequence
  Description of Artificial Sequence: Synthetic oligonucleotide
gcggtgacagagctggggcgg

SEQ ID NO: 65352 - DNA, 21 bp, Artificial Sequence
  Description of Artificial Sequence: Synthetic oligonucleotide
cggtgacagagctggggcggc

SEQ ID NO: 65353 - DNA, 22 bp, Artificial Sequence
  Description of Artificial Sequence: Synthetic oligonucleotide
ggtgacagagctggggcggcct

SEQ ID NO: 65354 - DNA, 24 bp, Artificial Sequence
  Description of Artificial Sequence: Synthetic oligonucleotide
gtgacagagctggggcggcctgat

SEQ ID NO: 65355 - DNA, 24 bp, Artificial Sequence
  Description of Artificial Sequence: Synthetic oligonucleotide
tgacagagctggggcggcctgatg

SEQ ID NO: 65356 - DNA, 23 bp, Artificial Sequence
  Description of Artificial Sequence: Synthetic oligonucleotide
gacagagctggggcggcctgatg

SEQ ID NO: 65357 - DNA, 23 bp, Artificial Sequence
  Description of Artificial Sequence: Synthetic oligonucleotide
acagagctggggcggcctgatgc

SEQ ID NO: 65358 - DNA, 22 bp, Artificial Sequence
  Description of Artificial Sequence: Synthetic oligonucleotide
cagagctggggcggcctgatgc

SEQ ID NO: 65359 - DNA, 22 bp, Artificial Sequence
  Description of Artificial Sequence: Synthetic oligonucleotide
agagctggggcggcctgatgcc

SEQ ID NO: 65360 - DNA, 25 bp, Artificial Sequence
  Description of Artificial Sequence: Synthetic oligonucleotide
ctggggcggcctgatgccgagtatt

SEQ ID NO: 65361 - DNA, 25 bp, Artificial Sequence
  Description of Artificial Sequence: Synthetic oligonucleotide
tggggcggcctgatgccgagtattg

SEQ ID NO: 65362 - DNA, 24 bp, Artificial Sequence
  Description of Artificial Sequence: Synthetic oligonucleotide
ggggcggcctgatgccgagtattg

SEQ ID NO: 65363 - DNA, 26 bp, Artificial Sequence
  Description of Artificial Sequence: Synthetic oligonucleotide
gggcggcctgatgccgagtattggaa

SEQ ID NO: 65364 - DNA, 27 bp, Artificial Sequence
  Description of Artificial Sequence: Synthetic oligonucleotide
ggcggcctgatgccgagtattggaaca

SEQ ID NO: 65365 - DNA, 27 bp, Artificial Sequence
  Description of Artificial Sequence: Synthetic oligonucleotide
gcggcctgatgccgagtattggaacag

SEQ ID NO: 65366 - DNA, 27 bp, Artificial Sequence
  Description of Artificial Sequence: Synthetic oligonucleotide
cggcctgatgccgagtattggaacagc

SEQ ID NO: 65367 - DNA, 27 bp, Artificial Sequence
  Description of Artificial Sequence: Synthetic oligonucleotide
ggcctgatgccgagtattggaacagcc

SEQ ID NO: 65368 - DNA, 28 bp, Artificial Sequence
  Description of Artificial Sequence: Synthetic oligonucleotide
gcctgatgccgagtattggaacagccag

SEQ ID NO: 65369 - DNA, 30 bp, Artificial Sequence
  Description of Artificial Sequence: Synthetic oligonucleotide
cctgatgccgagtattggaacagccagaag

SEQ ID NO: 65370 - DNA, 30 bp, Artificial Sequence
  Description of Artificial Sequence: Synthetic oligonucleotide
ctgatgccgagtattggaacagccagaagg

SEQ ID NO: 65371 - DNA, 31 bp, Artificial Sequence
  Description of Artificial Sequence: Synthetic oligonucleotide
tgatgccgagtattggaacagccagaaggac

SEQ ID NO: 65372 - DNA, 30 bp, Artificial Sequence
  Description of Artificial Sequence: Synthetic oligonucleotide
gatgccgagtattggaacagccagaaggac

SEQ ID NO: 65373 - DNA, 30 bp, Artificial Sequence
  Description of Artificial Sequence: Synthetic oligonucleotide
atgccgagtattggaacagccagaaggacc

SEQ ID NO: 65374 - DNA, 29 bp, Artificial Sequence
  Description of Artificial Sequence: Synthetic oligonucleotide
tgccgagtattggaacagccagaaggacc

SEQ ID NO: 65375 - DNA, 28 bp, Artificial Sequence
  Description of Artificial Sequence: Synthetic oligonucleotide
gccgagtattggaacagccagaaggacc

SEQ ID NO: 65376 - DNA, 29 bp, Artificial Sequence
  Description of Artificial Sequence: Synthetic oligonucleotide
ccgagtattggaacagccagaaggacctc

SEQ ID NO: 65377 - DNA, 29 bp, Artificial Sequence
  Description of Artificial Sequence: Synthetic oligonucleotide
cgagtattggaacagccagaaggacctcc

SEQ ID NO: 65378 - DNA, 30 bp, Artificial Sequence
  Description of Artificial Sequence: Synthetic oligonucleotide
gagtattggaacagccagaaggacctcctg

SEQ ID NO: 65379 - DNA, 30 bp, Artificial Sequence
  Description of Artificial Sequence: Synthetic oligonucleotide
agtattggaacagccagaaggacctcctgg

SEQ ID NO: 65380 - DNA, 29 bp, Artificial Sequence
  Description of Artificial Sequence: Synthetic oligonucleotide
gtattggaacagccagaaggacctcctgg

SEQ ID NO: 65381 - DNA, 30 bp, Artificial Sequence
  Description of Artificial Sequence: Synthetic oligonucleotide
tattggaacagccagaaggacctcctggag

SEQ ID NO: 65382 - DNA, 29 bp, Artificial Sequence
  Description of Artificial Sequence: Synthetic oligonucleotide
attggaacagccagaaggacctcctggag

SEQ ID NO: 65383 - DNA, 28 bp, Artificial Sequence
  Description of Artificial Sequence: Synthetic oligonucleotide
ttggaacagccagaaggacctcctggag

SEQ ID NO: 65384 - DNA, 27 bp, Artificial Sequence
  Description of Artificial Sequence: Synthetic oligonucleotide
ctgcagcaccacaacctcctggtctgt

SEQ ID NO: 65385 - DNA, 28 bp, Artificial Sequence
  Description of Artificial Sequence: Synthetic oligonucleotide
tgcagcaccacaacctcctggtctgttc

SEQ ID NO: 65386 - DNA, 27 bp, Artificial Sequence
  Description of Artificial Sequence: Synthetic oligonucleotide
gcagcaccacaacctcctggtctgttc

SEQ ID NO: 65387 - DNA, 28 bp, Artificial Sequence
  Description of Artificial Sequence: Synthetic oligonucleotide
cagcaccacaacctcctggtctgttctg

SEQ ID NO: 65388 - DNA, 29 bp, Artificial Sequence
  Description of Artificial Sequence: Synthetic oligonucleotide
agcaccacaacctcctggtctgttctgtg

SEQ ID NO: 65389 - DNA, 28 bp, Artificial Sequence
  Description of Artificial Sequence: Synthetic oligonucleotide
gcaccacaacctcctggtctgttctgtg

SEQ ID NO: 65390 - DNA, 29 bp, Artificial Sequence
  Description of Artificial Sequence: Synthetic oligonucleotide
caccacaacctcctggtctgttctgtgag

SEQ ID NO: 65391 - DNA, 30 bp, Artificial Sequence
  Description of Artificial Sequence: Synthetic oligonucleotide
accacaacctcctggtctgttctgtgagtg

SEQ ID NO: 65392 - DNA, 29 bp, Artificial Sequence
  Description of Artificial Sequence: Synthetic oligonucleotide
ccacaacctcctggtctgttctgtgagtg

SEQ ID NO: 65393 - DNA, 29 bp, Artificial Sequence
  Description of Artificial Sequence: Synthetic oligonucleotide
cacaacctcctggtctgttctgtgagtgg

SEQ ID NO: 65394 - DNA, 32 bp, Artificial Sequence
  Description of Artificial Sequence: Synthetic oligonucleotide
acaacctcctggtctgttctgtgagtggtttc

SEQ ID NO: 65395 - DNA, 31 bp, Artificial Sequence
  Description of Artificial Sequence: Synthetic oligonucleotide
caacctcctggtctgttctgtgagtggtttc

SEQ ID NO: 65396 - DNA, 25 bp, Artificial Sequence
  Description of Artificial Sequence: Synthetic oligonucleotide
agctggggcggcctgatgccgaata

SEQ ID NO: 65397 - DNA, 24 bp, Artificial Sequence
  Description of Artificial Sequence: Synthetic oligonucleotide
gctggggcggcctgatgccgaata

SEQ ID NO: 65398 - DNA, 25 bp, Artificial Sequence
  Description of Artificial Sequence: Synthetic oligonucleotide
ctggggcggcctgatgccgaatact

SEQ ID NO: 65399 - DNA, 25 bp, Artificial Sequence
  Description of Artificial Sequence: Synthetic oligonucleotide
tggggcggcctgatgccgaatactg

SEQ ID NO: 65400 - DNA, 24 bp, Artificial Sequence
  Description of Artificial Sequence: Synthetic oligonucleotide
ggggcggcctgatgccgaatactg

SEQ ID NO: 65401 - DNA, 26 bp, Artificial Sequence
  Description of Artificial Sequence: Synthetic oligonucleotide
gggcggcctgatgccgaatactggaa

SEQ ID NO: 65402 - DNA, 27 bp, Artificial Sequence
  Description of Artificial Sequence: Synthetic oligonucleotide
ggcggcctgatgccgaatactggaaca

SEQ ID NO: 65403 - DNA, 27 bp, Artificial Sequence
  Description of Artificial Sequence: Synthetic oligonucleotide
gcggcctgatgccgaatactggaacag

SEQ ID NO: 65404 - DNA, 27 bp, Artificial Sequence
  Description of Artificial Sequence: Synthetic oligonucleotide
cggcctgatgccgaatactggaacagc

SEQ ID NO: 65405 - DNA, 27 bp, Artificial Sequence
  Description of Artificial Sequence: Synthetic oligonucleotide
ggcctgatgccgaatactggaacagcc

SEQ ID NO: 65406 - DNA, 28 bp, Artificial Sequence
  Description of Artificial Sequence: Synthetic oligonucleotide
gcctgatgccgaatactggaacagccag

SEQ ID NO: 65407 - DNA, 30 bp, Artificial Sequence
  Description of Artificial Sequence: Synthetic oligonucleotide
cctgatgccgaatactggaacagccagaag

SEQ ID NO: 65408 - DNA, 30 bp, Artificial Sequence
  Description of Artificial Sequence: Synthetic oligonucleotide
ctgatgccgaatactggaacagccagaagg

SEQ ID NO: 65409 - DNA, 31 bp, Artificial Sequence
  Description of Artificial Sequence: Synthetic oligonucleotide
tgatgccgaatactggaacagccagaaggac

SEQ ID NO: 65410 - DNA, 30 bp, Artificial Sequence
  Description of Artificial Sequence: Synthetic oligonucleotide
gatgccgaatactggaacagccagaaggac

SEQ ID NO: 65411 - DNA, 30 bp, Artificial Sequence
  Description of Artificial Sequence: Synthetic oligonucleotide
atgccgaatactggaacagccagaaggacc

SEQ ID NO: 65412 - DNA, 29 bp, Artificial Sequence
  Description of Artificial Sequence: Synthetic oligonucleotide
tgccgaatactggaacagccagaaggacc

SEQ ID NO: 65413 - DNA, 28 bp, Artificial Sequence
  Description of Artificial Sequence: Synthetic oligonucleotide
gccgaatactggaacagccagaaggacc

SEQ ID NO: 65414 - DNA, 29 bp, Artificial Sequence
  Description of Artificial Sequence: Synthetic oligonucleotide
ccgaatactggaacagccagaaggacctc

SEQ ID NO: 65415 - DNA, 29 bp, Artificial Sequence
  Description of Artificial Sequence: Synthetic oligonucleotide
cgaatactggaacagccagaaggacctcc

SEQ ID NO: 65416 - DNA, 30 bp, Artificial Sequence
  Description of Artificial Sequence: Synthetic oligonucleotide
gaatactggaacagccagaaggacctcctg

SEQ ID NO: 65417 - DNA, 30 bp, Artificial Sequence
  Description of Artificial Sequence: Synthetic oligonucleotide
aatactggaacagccagaaggacctcctgg

SEQ ID NO: 65418 - DNA, 29 bp, Artificial Sequence
  Description of Artificial Sequence: Synthetic oligonucleotide
atactggaacagccagaaggacctcctgg

SEQ ID NO: 65419 - DNA, 24 bp, Artificial Sequence
  Description of Artificial Sequence: Synthetic oligonucleotide
aatgggacggagcgggtgcggttc

SEQ ID NO: 65420 - DNA, 23 bp, Artificial Sequence
  Description of Artificial Sequence: Synthetic oligonucleotide
atgggacggagcgggtgcggttc

SEQ ID NO: 65421 - DNA, 22 bp, Artificial Sequence
  Description of Artificial Sequence: Synthetic oligonucleotide
tgggacggagcgggtgcggttc

SEQ ID NO: 65422 - DNA, 21 bp, Artificial Sequence
  Description of Artificial Sequence: Synthetic oligonucleotide
gggacggagcgggtgcggttc

SEQ ID NO: 65423 - DNA, 22 bp, Artificial Sequence
  Description of Artificial Sequence: Synthetic oligonucleotide
ggacggagcgggtgcggttcct

SEQ ID NO: 65424 - DNA, 22 bp, Artificial Sequence
  Description of Artificial Sequence: Synthetic oligonucleotide
gacggagcgggtgcggttcctg

SEQ ID NO: 65425 - DNA, 23 bp, Artificial Sequence
  Description of Artificial Sequence: Synthetic oligonucleotide
acggagcgggtgcggttcctgga

SEQ ID NO: 65426 - DNA, 22 bp, Artificial Sequence
  Description of Artificial Sequence: Synthetic oligonucleotide
cggagcgggtgcggttcctgga

SEQ ID NO: 65427 - DNA, 23 bp, Artificial Sequence
  Description of Artificial Sequence: Synthetic oligonucleotide
ggagcgggtgcggttcctggaga

SEQ ID NO: 65428 - DNA, 26 bp, Artificial Sequence
  Description of Artificial Sequence: Synthetic oligonucleotide
gagcgggtgcggttcctggagagata

SEQ ID NO: 65429 - DNA, 27 bp, Artificial Sequence
  Description of Artificial Sequence: Synthetic oligonucleotide
agcgggtgcggttcctggagagatact

SEQ ID NO: 65430 - DNA, 27 bp, Artificial Sequence
  Description of Artificial Sequence: Synthetic oligonucleotide
gcgggtgcggttcctggagagatactt

SEQ ID NO: 65431 - DNA, 27 bp, Artificial Sequence
  Description of Artificial Sequence: Synthetic oligonucleotide
cgggtgcggttcctggagagatacttc

SEQ ID NO: 65432 - DNA, 27 bp, Artificial Sequence
  Description of Artificial Sequence: Synthetic oligonucleotide
gggtgcggttcctggagagatacttcc

SEQ ID NO: 65433 - DNA, 31 bp, Artificial Sequence
  Description of Artificial Sequence: Synthetic oligonucleotide
ggtgcggttcctggagagatacttccataac

SEQ ID NO: 65434 - DNA, 31 bp, Artificial Sequence
  Description of Artificial Sequence: Synthetic oligonucleotide
gtgcggttcctggagagatacttccataacc

SEQ ID NO: 65435 - DNA, 32 bp, Artificial Sequence
  Description of Artificial Sequence: Synthetic oligonucleotide
tgcggttcctggagagatacttccataaccag

SEQ ID NO: 65436 - DNA, 31 bp, Artificial Sequence
  Description of Artificial Sequence: Synthetic oligonucleotide
gcggttcctggagagatacttccataaccag

SEQ ID NO: 65437 - DNA, 31 bp, Artificial Sequence
  Description of Artificial Sequence: Synthetic oligonucleotide
cggttcctggagagatacttccataaccagg

SEQ ID NO: 65438 - DNA, 32 bp, Artificial Sequence
  Description of Artificial Sequence: Synthetic oligonucleotide
ggttcctggagagatacttccataaccaggag

SEQ ID NO: 65439 - DNA, 32 bp, Artificial Sequence
  Description of Artificial Sequence: Synthetic oligonucleotide
gttcctggagagatacttccataaccaggagg

SEQ ID NO: 65440 - DNA, 33 bp, Artificial Sequence
  Description of Artificial Sequence: Synthetic oligonucleotide
ttcctggagagatacttccataaccaggaggag

SEQ ID NO: 65441 - DNA, 32 bp, Artificial Sequence
  Description of Artificial Sequence: Synthetic oligonucleotide
tcctggagagatacttccataaccaggaggag

SEQ ID NO: 65442 - DNA, 31 bp, Artificial Sequence
  Description of Artificial Sequence: Synthetic oligonucleotide
cctggagagatacttccataaccaggaggag

SEQ ID NO: 65443 - DNA, 33 bp, Artificial Sequence
  Description of Artificial Sequence: Synthetic oligonucleotide
ctggagagatacttccataaccaggaggagaac

SEQ ID NO: 65444 - DNA, 33 bp, Artificial Sequence
  Description of Artificial Sequence: Synthetic oligonucleotide
tggagagatacttccataaccaggaggagaacg

SEQ ID NO: 65445 - DNA, 32 bp, Artificial Sequence
  Description of Artificial Sequence: Synthetic oligonucleotide
ggagagatacttccataaccaggaggagaacg

SEQ ID NO: 65446 - DNA, 33 bp, Artificial Sequence
  Description of Artificial Sequence: Synthetic oligonucleotide
gagagatacttccataaccaggaggagaacgtg

SEQ ID NO: 65447 - DNA, 33 bp, Artificial Sequence
  Description of Artificial Sequence: Synthetic oligonucleotide
agagatacttccataaccaggaggagaacgtgc

SEQ ID NO: 65448 - DNA, 32 bp, Artificial Sequence
  Description of Artificial Sequence: Synthetic oligonucleotide
gagatacttccataaccaggaggagaacgtgc

SEQ ID NO: 65449 - DNA, 32 bp, Artificial Sequence
  Description of Artificial Sequence: Synthetic oligonucleotide
ctggacagatacttccataaccaggaggagtc

SEQ ID NO: 65450 - DNA, 32 bp, Artificial Sequence
  Description of Artificial Sequence: Synthetic oligonucleotide
tggacagatacttccataaccaggaggagtcc

SEQ ID NO: 65451 - DNA, 31 bp, Artificial Sequence
  Description of Artificial Sequence: Synthetic oligonucleotide
ggacagatacttccataaccaggaggagtcc

SEQ ID NO: 65452 - DNA, 31 bp, Artificial Sequence
  Description of Artificial Sequence: Synthetic oligonucleotide
gacagatacttccataaccaggaggagtccg

SEQ ID NO: 65453 - DNA, 32 bp, Artificial Sequence
  Description of Artificial Sequence: Synthetic oligonucleotide
acagatacttccataaccaggaggagtccgtg

SEQ ID NO: 65454 - DNA, 31 bp, Artificial Sequence
  Description of Artificial Sequence: Synthetic oligonucleotide
cagatacttccataaccaggaggagtccgtg

SEQ ID NO: 65455 - DNA, 31 bp, Artificial Sequence
  Description of Artificial Sequence: Synthetic oligonucleotide
agatacttccataaccaggaggagtccgtgc

SEQ ID NO: 65456 - DNA, 30 bp, Artificial Sequence
  Description of Artificial Sequence: Synthetic oligonucleotide
gatacttccataaccaggaggagtccgtgc

SEQ ID NO: 65457 - DNA, 30 bp, Artificial Sequence
  Description of Artificial Sequence: Synthetic oligonucleotide
atacttccataaccaggaggagtccgtgcg

SEQ ID NO: 65458 - DNA, 29 bp, Artificial Sequence
  Description of Artificial Sequence: Synthetic oligonucleotide
tacttccataaccaggaggagtccgtgcg

SEQ ID NO: 65459 - DNA, 28 bp, Artificial Sequence
  Description of Artificial Sequence: Synthetic oligonucleotide
acttccataaccaggaggagtccgtgcg

SEQ ID NO: 65460 - DNA, 27 bp, Artificial Sequence
  Description of Artificial Sequence: Synthetic oligonucleotide
cttccataaccaggaggagtccgtgcg

SEQ ID NO: 65461 - DNA, 27 bp, Artificial Sequence
  Description of Artificial Sequence: Synthetic oligonucleotide
ttccataaccaggaggagtccgtgcgc

SEQ ID NO: 65462 - DNA, 27 bp, Artificial Sequence
  Description of Artificial Sequence: Synthetic oligonucleotide
tccataaccaggaggagtccgtgcgct

SEQ ID NO: 65463 - DNA, 27 bp, Artificial Sequence
  Description of Artificial Sequence: Synthetic oligonucleotide
ccataaccaggaggagtccgtgcgctt

SEQ ID NO: 65464 - DNA, 27 bp, Artificial Sequence
  Description of Artificial Sequence: Synthetic oligonucleotide
cataaccaggaggagtccgtgcgcttc

SEQ ID NO: 65465 - DNA, 23 bp, Artificial Sequence
  Description of Artificial Sequence: Synthetic oligonucleotide
ggagcgggtgcggttcctggaca

SEQ ID NO: 65466 - DNA, 26 bp, Artificial Sequence
  Description of Artificial Sequence: Synthetic oligonucleotide
gagcgggtgcggttcctggacagata

SEQ ID NO: 65467 - DNA, 27 bp, Artificial Sequence
  Description of Artificial Sequence: Synthetic oligonucleotide
agcgggtgcggttcctggacagatact

SEQ ID NO: 65468 - DNA, 27 bp, Artificial Sequence
  Description of Artificial Sequence: Synthetic oligonucleotide
gcgggtgcggttcctggacagatactt

SEQ ID NO: 65469 - DNA, 27 bp, Artificial Sequence
  Description of Artificial Sequence: Synthetic oligonucleotide
cgggtgcggttcctggacagatacttc

SEQ ID NO: 65470 - DNA, 27 bp, Artificial Sequence
  Description of Artificial Sequence: Synthetic oligonucleotide
gggtgcggttcctggacagatacttcc

SEQ ID NO: 65471 - DNA, 31 bp, Artificial Sequence
  Description of Artificial Sequence: Synthetic oligonucleotide
ggtgcggttcctggacagatacttccataac

SEQ ID NO: 65472 - DNA, 31 bp, Artificial Sequence
  Description of Artificial Sequence: Synthetic oligonucleotide
gtgcggttcctggacagatacttccataacc

SEQ ID NO: 65473 - DNA, 32 bp, Artificial Sequence
  Description of Artificial Sequence: Synthetic oligonucleotide
tgcggttcctggacagatacttccataaccag

SEQ ID NO: 65474 - DNA, 31 bp, Artificial Sequence
  Description of Artificial Sequence: Synthetic oligonucleotide
gcggttcctggacagatacttccataaccag

SEQ ID NO: 65475 - DNA, 31 bp, Artificial Sequence
  Description of Artificial Sequence: Synthetic oligonucleotide
cggttcctggacagatacttccataaccagg

SEQ ID NO: 65476 - DNA, 32 bp, Artificial Sequence
  Description of Artificial Sequence: Synthetic oligonucleotide
ggttcctggacagatacttccataaccaggag

SEQ ID NO: 65477 - DNA, 32 bp, Artificial Sequence
  Description of Artificial Sequence: Synthetic oligonucleotide
gttcctggacagatacttccataaccaggagg

SEQ ID NO: 65478 - DNA, 33 bp, Artificial Sequence
  Description of Artificial Sequence: Synthetic oligonucleotide
ttcctggacagatacttccataaccaggaggag

SEQ ID NO: 65479 - DNA, 32 bp, Artificial Sequence
  Description of Artificial Sequence: Synthetic oligonucleotide
tcctggacagatacttccataaccaggaggag

SEQ ID NO: 65480 - DNA, 31 bp, Artificial Sequence
  Description of Artificial Sequence: Synthetic oligonucleotide
tgcggtacctggacagatacttccataaccg

SEQ ID NO: 65481 - DNA, 30 bp, Artificial Sequence
  Description of Artificial Sequence: Synthetic oligonucleotide
gcggtacctggacagatacttccataaccg

SEQ ID NO: 65482 - DNA, 30 bp, Artificial Sequence
  Description of Artificial Sequence: Synthetic oligonucleotide
cggtacctggacagatacttccataaccgg

SEQ ID NO: 65483 - DNA, 30 bp, Artificial Sequence
  Description of Artificial Sequence: Synthetic oligonucleotide
ggtacctggacagatacttccataaccggg

SEQ ID NO: 65484 - DNA, 31 bp, Artificial Sequence
  Description of Artificial Sequence: Synthetic oligonucleotide
gtacctggacagatacttccataaccgggag

SEQ ID NO: 65485 - DNA, 31 bp, Artificial Sequence
  Description of Artificial Sequence: Synthetic oligonucleotide
tacctggacagatacttccataaccgggagg

SEQ ID NO: 65486 - DNA, 30 bp, Artificial Sequence
  Description of Artificial Sequence: Synthetic oligonucleotide
acctggacagatacttccataaccgggagg

SEQ ID NO: 65487 - DNA, 29 bp, Artificial Sequence
  Description of Artificial Sequence: Synthetic oligonucleotide
cctggacagatacttccataaccgggagg

SEQ ID NO: 65488 - DNA, 30 bp, Artificial Sequence
  Description of Artificial Sequence: Synthetic oligonucleotide
ctggacagatacttccataaccgggaggag

SEQ ID NO: 65489 - DNA, 32 bp, Artificial Sequence
  Description of Artificial Sequence: Synthetic oligonucleotide
tggacagatacttccataaccgggaggagaac

SEQ ID NO: 65490 - DNA, 31 bp, Artificial Sequence
  Description of Artificial Sequence: Synthetic oligonucleotide
ggacagatacttccataaccgggaggagaac

SEQ ID NO: 65491 - DNA, 31 bp, Artificial Sequence
  Description of Artificial Sequence: Synthetic oligonucleotide
gacagatacttccataaccgggaggagaacg

SEQ ID NO: 65492 - DNA, 32 bp, Artificial Sequence
  Description of Artificial Sequence: Synthetic oligonucleotide
acagatacttccataaccgggaggagaacgtg

SEQ ID NO: 65493 - DNA, 31 bp, Artificial Sequence
  Description of Artificial Sequence: Synthetic oligonucleotide
cagatacttccataaccgggaggagaacgtg

SEQ ID NO: 65494 - DNA, 31 bp, Artificial Sequence
  Description of Artificial Sequence: Synthetic oligonucleotide
agatacttccataaccgggaggagaacgtgc

SEQ ID NO: 65495 - DNA, 30 bp, Artificial Sequence
  Description of Artificial Sequence: Synthetic oligonucleotide
gatacttccataaccgggaggagaacgtgc

SEQ ID NO: 65496 - DNA, 30 bp, Artificial Sequence
  Description of Artificial Sequence: Synthetic oligonucleotide
atacttccataaccgggaggagaacgtgcg

SEQ ID NO: 65497 - DNA, 29 bp, Artificial Sequence
  Description of Artificial Sequence: Synthetic oligonucleotide
tacttccataaccgggaggagaacgtgcg

SEQ ID NO: 65498 - DNA, 28 bp, Artificial Sequence
  Description of Artificial Sequence: Synthetic oligonucleotide
acttccataaccgggaggagaacgtgcg

SEQ ID NO: 65499 - DNA, 27 bp, Artificial Sequence
  Description of Artificial Sequence: Synthetic oligonucleotide
cttccataaccgggaggagaacgtgcg

SEQ ID NO: 65500 - DNA, 27 bp, Artificial Sequence
  Description of Artificial Sequence: Synthetic oligonucleotide
ttccataaccgggaggagaacgtgcgc

SEQ ID NO: 65501 - DNA, 27 bp, Artificial Sequence
  Description of Artificial Sequence: Synthetic oligonucleotide
tccataaccgggaggagaacgtgcgct

SEQ ID NO: 65502 - DNA, 27 bp, Artificial Sequence
  Description of Artificial Sequence: Synthetic oligonucleotide
ccataaccgggaggagaacgtgcgctt

SEQ ID NO: 65503 - DNA, 27 bp, Artificial Sequence
  Description of Artificial Sequence: Synthetic oligonucleotide
cataaccgggaggagaacgtgcgcttc

SEQ ID NO: 65504 - DNA, 27 bp, Artificial Sequence
  Description of Artificial Sequence: Synthetic oligonucleotide
ataaccgggaggagaacgtgcgcttcg

SEQ ID NO: 65505 - DNA, 27 bp, Artificial Sequence
  Description of Artificial Sequence: Synthetic oligonucleotide
taaccgggaggagaacgtgcgcttcga

SEQ ID NO: 65506 - DNA, 26 bp, Artificial Sequence
  Description of Artificial Sequence: Synthetic oligonucleotide
aaccgggaggagaacgtgcgcttcga

SEQ ID NO: 65507 - DNA, 25 bp, Artificial Sequence
  Description of Artificial Sequence: Synthetic oligonucleotide
accgggaggagaacgtgcgcttcga

SEQ ID NO: 65508 - DNA, 24 bp, Artificial Sequence
  Description of Artificial Sequence: Synthetic oligonucleotide
ccgggaggagaacgtgcgcttcga

SEQ ID NO: 65509 - DNA, 25 bp, Artificial Sequence
  Description of Artificial Sequence: Synthetic oligonucleotide
cgggaggagaacgtgcgcttcgaca

SEQ ID NO: 65510 - DNA, 25 bp, Artificial Sequence
  Description of Artificial Sequence: Synthetic oligonucleotide
gggaggagaacgtgcgcttcgacag

SEQ ID NO: 65511 - DNA, 23 bp, Artificial Sequence
  Description of Artificial Sequence: Synthetic oligonucleotide
ctcctggagcagaagcggggcca

SEQ ID NO: 65512 - DNA, 23 bp, Artificial Sequence
  Description of Artificial Sequence: Synthetic oligonucleotide
tcctggagcagaagcggggccag

SEQ ID NO: 65513 - DNA, 22 bp, Artificial Sequence
  Description of Artificial Sequence: Synthetic oligonucleotide
cctggagcagaagcggggccag

SEQ ID NO: 65514 - DNA, 23 bp, Artificial Sequence
  Description of Artificial Sequence: Synthetic oligonucleotide
ctggagcagaagcggggccaggt

SEQ ID NO: 65515 - DNA, 23 bp, Artificial Sequence
  Description of Artificial Sequence: Synthetic oligonucleotide
tggagcagaagcggggccaggtg

SEQ ID NO: 65516 - DNA, 22 bp, Artificial Sequence
  Description of Artificial Sequence: Synthetic oligonucleotide
ggagcagaagcggggccaggtg

SEQ ID NO: 65517 - DNA, 23 bp, Artificial Sequence
  Description of Artificial Sequence: Synthetic oligonucleotide
gagcagaagcggggccaggtgga

SEQ ID NO: 65518 - DNA, 25 bp, Artificial Sequence
  Description of Artificial Sequence: Synthetic oligonucleotide
agcagaagcggggccaggtggacaa

SEQ ID NO: 65519 - DNA, 24 bp, Artificial Sequence
  Description of Artificial Sequence: Synthetic oligonucleotide
gcagaagcggggccaggtggacaa

SEQ ID NO: 65520 - DNA, 26 bp, Artificial Sequence
  Description of Artificial Sequence: Synthetic oligonucleotide
cagaagcggggccaggtggacaacta

SEQ ID NO: 65521 - DNA, 27 bp, Artificial Sequence
  Description of Artificial Sequence: Synthetic oligonucleotide
agaagcggggccaggtggacaactact

SEQ ID NO: 65522 - DNA, 26 bp, Artificial Sequence
  Description of Artificial Sequence: Synthetic oligonucleotide
gaagcggggccaggtggacaactact

SEQ ID NO: 65523 - DNA, 26 bp, Artificial Sequence
  Description of Artificial Sequence: Synthetic oligonucleotide
aagcggggccaggtggacaactactg

SEQ ID NO: 65524 - DNA, 25 bp, Artificial Sequence
  Description of Artificial Sequence: Synthetic oligonucleotide
agcggggccaggtggacaactactg

SEQ ID NO: 65525 - DNA, 24 bp, Artificial Sequence
  Description of Artificial Sequence: Synthetic oligonucleotide
gcggggccaggtggacaactactg

SEQ ID NO: 65526 - DNA, 25 bp, Artificial Sequence
  Description of Artificial Sequence: Synthetic oligonucleotide
cggggccaggtggacaactactgca

SEQ ID NO: 65527 - DNA, 26 bp, Artificial Sequence
  Description of Artificial Sequence: Synthetic oligonucleotide
ggggccaggtggacaactactgcaga

SEQ ID NO: 65528 - DNA, 27 bp, Artificial Sequence
  Description of Artificial Sequence: Synthetic oligonucleotide
gggccaggtggacaactactgcagaca

SEQ ID NO: 65529 - DNA, 27 bp, Artificial Sequence
  Description of Artificial Sequence: Synthetic oligonucleotide
ggccaggtggacaactactgcagacac

SEQ ID NO: 65530 - DNA, 29 bp, Artificial Sequence
  Description of Artificial Sequence: Synthetic oligonucleotide
gccaggtggacaactactgcagacacaac

SEQ ID NO: 65531 - DNA, 31 bp, Artificial Sequence
  Description of Artificial Sequence: Synthetic oligonucleotide
ccaggtggacaactactgcagacacaactac

SEQ ID NO: 65532 - DNA, 31 bp, Artificial Sequence
  Description of Artificial Sequence: Synthetic oligonucleotide
caggtggacaactactgcagacacaactacg

SEQ ID NO: 65533 - DNA, 31 bp, Artificial Sequence
  Description of Artificial Sequence: Synthetic oligonucleotide
aggtggacaactactgcagacacaactacgg

SEQ ID NO: 65534 - DNA, 27 bp, Artificial Sequence
  Description of Artificial Sequence: Synthetic oligonucleotide
agcagaagcggggccaggtggacaatt

SEQ ID NO: 65535 - DNA, 27 bp, Artificial Sequence
  Description of Artificial Sequence: Synthetic oligonucleotide
gcagaagcggggccaggtggacaatta

SEQ ID NO: 65536 - DNA, 27 bp, Artificial Sequence
  Description of Artificial Sequence: Synthetic oligonucleotide
cagaagcggggccaggtggacaattac

SEQ ID NO: 65537 - DNA, 28 bp, Artificial Sequence
  Description of Artificial Sequence: Synthetic oligonucleotide
agaagcggggccaggtggacaattactg

SEQ ID NO: 65538 - DNA, 27 bp, Artificial Sequence
  Description of Artificial Sequence: Synthetic oligonucleotide
gaagcggggccaggtggacaattactg

SEQ ID NO: 65539 - DNA, 27 bp, Artificial Sequence
  Description of Artificial Sequence: Synthetic oligonucleotide
aagcggggccaggtggacaattactgc

SEQ ID NO: 65540 - DNA, 27 bp, Artificial Sequence
  Description of Artificial Sequence: Synthetic oligonucleotide
agcggggccaggtggacaattactgca

SEQ ID NO: 65541 - DNA, 26 bp, Artificial Sequence
  Description of Artificial Sequence: Synthetic oligonucleotide
gcggggccaggtggacaattactgca

SEQ ID NO: 65542 - DNA, 27 bp, Artificial Sequence
  Description of Artificial Sequence: Synthetic oligonucleotide
cggggccaggtggacaattactgcaga

SEQ ID NO: 65543 - DNA, 27 bp, Artificial Sequence
  Description of Artificial Sequence: Synthetic oligonucleotide
ggggccaggtggacaattactgcagac

SEQ ID NO: 65544 - DNA, 28 bp, Artificial Sequence
  Description of Artificial Sequence: Synthetic oligonucleotide
gggccaggtggacaattactgcagacac

SEQ ID NO: 65545 - DNA, 30 bp, Artificial Sequence
  Description of Artificial Sequence: Synthetic oligonucleotide
ggccaggtggacaattactgcagacacaac

SEQ ID NO: 65546 - DNA, 32 bp, Artificial Sequence
  Description of Artificial Sequence: Synthetic oligonucleotide
gccaggtggacaattactgcagacacaactac

SEQ ID NO: 65547 - DNA, 32 bp, Artificial Sequence
  Description of Artificial Sequence: Synthetic oligonucleotide
ccaggtggacaattactgcagacacaactacg

SEQ ID NO: 65548 - DNA, 32 bp, Artificial Sequence
  Description of Artificial Sequence: Synthetic oligonucleotide
caggtggacaattactgcagacacaactacgg

SEQ ID NO: 65549 - DNA, 32 bp, Artificial Sequence
  Description of Artificial Sequence: Synthetic oligonucleotide
aggtggacaattactgcagacacaactacggg

SEQ ID NO: 65550 - DNA, 22 bp, Artificial Sequence
  Description of Artificial Sequence: Synthetic oligonucleotide
gtgacggagctggggcggccta

SEQ ID NO: 65551 - DNA, 22 bp, Artificial Sequence
  Description of Artificial Sequence: Synthetic oligonucleotide
tgacggagctggggcggcctag

SEQ ID NO: 65552 - DNA, 21 bp, Artificial Sequence
  Description of Artificial Sequence: Synthetic oligonucleotide
gacggagctggggcggcctag

SEQ ID NO: 65553 - DNA, 21 bp, Artificial Sequence
  Description of Artificial Sequence: Synthetic oligonucleotide
acggagctggggcggcctagc

SEQ ID NO: 65554 - DNA, 20 bp, Artificial Sequence
  Description of Artificial Sequence: Synthetic oligonucleotide
cggagctggggcggcctagc

SEQ ID NO: 65555 - DNA, 20 bp, Artificial Sequence
  Description of Artificial Sequence: Synthetic oligonucleotide
ggagctggggcggcctagcg

SEQ ID NO: 65556 - DNA, 20 bp, Artificial Sequence
  Description of Artificial Sequence: Synthetic oligonucleotide
gagctggggcggcctagcgc

SEQ ID NO: 65557 - DNA, 20 bp, Artificial Sequence
  Description of Artificial Sequence: Synthetic oligonucleotide
agctggggcggcctagcgcc

SEQ ID NO: 65558 - DNA, 20 bp, Artificial Sequence
  Description of Artificial Sequence: Synthetic oligonucleotide
gctggggcggcctagcgcct

SEQ ID NO: 65559 - DNA, 20 bp, Artificial Sequence
  Description of Artificial Sequence: Synthetic oligonucleotide
ctggggcggcctagcgccga

SEQ ID NO: 65560 - DNA, 22 bp, Artificial Sequence
  Description of Artificial Sequence: Synthetic oligonucleotide
tggggcggcctagcgccgagta

SEQ ID NO: 65561 - DNA, 22 bp, Artificial Sequence
  Description of Artificial Sequence: Synthetic oligonucleotide
cagaagcggggccgggtggaca

SEQ ID NO: 65562 - DNA, 22 bp, Artificial Sequence
  Description of Artificial Sequence: Synthetic oligonucleotide
agaagcggggccgggtggacac

SEQ ID NO: 65563 - DNA, 21 bp, Artificial Sequence
  Description of Artificial Sequence: Synthetic oligonucleotide
gaagcggggccgggtggacac

SEQ ID NO: 65564 - DNA, 23 bp, Artificial Sequence
  Description of Artificial Sequence: Synthetic oligonucleotide
aagcggggccgggtggacaccta

SEQ ID NO: 65565 - DNA, 22 bp, Artificial Sequence
  Description of Artificial Sequence: Synthetic oligonucleotide
agcggggccgggtggacaccta

SEQ ID NO: 65566 - DNA, 21 bp, Artificial Sequence
  Description of Artificial Sequence: Synthetic oligonucleotide
gcggggccgggtggacaccta

SEQ ID NO: 65567 - DNA, 22 bp, Artificial Sequence
  Description of Artificial Sequence: Synthetic oligonucleotide
cggggccgggtggacacctact

SEQ ID NO: 65568 - DNA, 22 bp, Artificial Sequence
  Description of Artificial Sequence: Synthetic oligonucleotide
ggggccgggtggacacctactg

SEQ ID NO: 65569 - DNA, 23 bp, Artificial Sequence
  Description of Artificial Sequence: Synthetic oligonucleotide
gggccgggtggacacctactgca

SEQ ID NO: 65570 - DNA, 24 bp, Artificial Sequence
  Description of Artificial Sequence: Synthetic oligonucleotide
ggccgggtggacacctactgcaga

SEQ ID NO: 65571 - DNA, 25 bp, Artificial Sequence
  Description of Artificial Sequence: Synthetic oligonucleotide
gccgggtggacacctactgcagaca

SEQ ID NO: 65572 - DNA, 27 bp, Artificial Sequence
  Description of Artificial Sequence: Synthetic oligonucleotide
ccgggtggacacctactgcagacacaa

SEQ ID NO: 65573 - DNA, 27 bp, Artificial Sequence
  Description of Artificial Sequence: Synthetic oligonucleotide
cgggtggacacctactgcagacacaac

SEQ ID NO: 65574 - DNA, 29 bp, Artificial Sequence
  Description of Artificial Sequence: Synthetic oligonucleotide
gggtggacacctactgcagacacaactac

SEQ ID NO: 65575 - DNA, 26 bp, Artificial Sequence
  Description of Artificial Sequence: Synthetic oligonucleotide
cttcgacagcgacgtgggggagttct

SEQ ID NO: 65576 - DNA, 26 bp, Artificial Sequence
  Description of Artificial Sequence: Synthetic oligonucleotide
ttcgacagcgacgtgggggagttctg

SEQ ID NO: 65577 - DNA, 25 bp, Artificial Sequence
  Description of Artificial Sequence: Synthetic oligonucleotide
tcgacagcgacgtgggggagttctg

SEQ ID NO: 65578 - DNA, 24 bp, Artificial Sequence
  Description of Artificial Sequence: Synthetic oligonucleotide
cgacagcgacgtgggggagttctg

SEQ ID NO: 65579 - DNA, 24 bp, Artificial Sequence
  Description of Artificial Sequence: Synthetic oligonucleotide
gacagcgacgtgggggagttctgg

SEQ ID NO: 65580 - DNA, 24 bp, Artificial Sequence
  Description of Artificial Sequence: Synthetic oligonucleotide
acagcgacgtgggggagttctggg

SEQ ID NO: 65581 - DNA, 23 bp, Artificial Sequence
  Description of Artificial Sequence: Synthetic oligonucleotide
cagcgacgtgggggagttctggg

SEQ ID NO: 65582 - DNA, 23 bp, Artificial Sequence
  Description of Artificial Sequence: Synthetic oligonucleotide
agcgacgtgggggagttctgggc

SEQ ID NO: 65583 - DNA, 22 bp, Artificial Sequence
  Description of Artificial Sequence: Synthetic oligonucleotide
gcgacgtgggggagttctgggc

SEQ ID NO: 65584 - DNA, 22 bp, Artificial Sequence
  Description of Artificial Sequence: Synthetic oligonucleotide
cgacgtgggggagttctgggcg

SEQ ID NO: 65585 - DNA, 23 bp, Artificial Sequence
  Description of Artificial Sequence: Synthetic oligonucleotide
gacgtgggggagttctgggcggt

SEQ ID NO: 65586 - DNA, 24 bp, Artificial Sequence
  Description of Artificial Sequence: Synthetic oligonucleotide
acgtgggggagttctgggcggtga

SEQ ID NO: 65587 - DNA, 23 bp, Artificial Sequence
  Description of Artificial Sequence: Synthetic oligonucleotide
cgtgggggagttctgggcggtga

SEQ ID NO: 65588 - DNA, 23 bp, Artificial Sequence
  Description of Artificial Sequence: Synthetic oligonucleotide
gtgggggagttctgggcggtgac

SEQ ID NO: 65589 - DNA, 23 bp, Artificial Sequence
  Description of Artificial Sequence: Synthetic oligonucleotide
tgggggagttctgggcggtgacg

SEQ ID NO: 65590 - DNA, 22 bp, Artificial Sequence
  Description of Artificial Sequence: Synthetic oligonucleotide
gggggagttctgggcggtgacg

SEQ ID NO: 65591 - DNA, 23 bp, Artificial Sequence
  Description of Artificial Sequence: Synthetic oligonucleotide
ggggagttctgggcggtgacgga

SEQ ID NO: 65592 - DNA, 23 bp, Artificial Sequence
  Description of Artificial Sequence: Synthetic oligonucleotide
gggagttctgggcggtgacggag

SEQ ID NO: 65593 - DNA, 24 bp, Artificial Sequence
  Description of Artificial Sequence: Synthetic oligonucleotide
ggagttctgggcggtgacggagct

SEQ ID NO: 65594 - DNA, 24 bp, Artificial Sequence
  Description of Artificial Sequence: Synthetic oligonucleotide
gagttctgggcggtgacggagctg

SEQ ID NO: 65595 - DNA, 24 bp, Artificial Sequence
  Description of Artificial Sequence: Synthetic oligonucleotide
agttctgggcggtgacggagctgg

SEQ ID NO: 65596 - DNA, 23 bp, Artificial Sequence
  Description of Artificial Sequence: Synthetic oligonucleotide
gttctgggcggtgacggagctgg

SEQ ID NO: 65597 - DNA, 23 bp, Artificial Sequence
  Description of Artificial Sequence: Synthetic oligonucleotide
ttctgggcggtgacggagctggg

SEQ ID NO: 65598 - DNA, 22 bp, Artificial Sequence
  Description of Artificial Sequence: Synthetic oligonucleotide
tctgggcggtgacggagctggg

SEQ ID NO: 65599 - DNA, 21 bp, Artificial Sequence
  Description of Artificial Sequence: Synthetic oligonucleotide
ctgggcggtgacggagctggg

SEQ ID NO: 65600 - DNA, 21 bp, Artificial Sequence
  Description of Artificial Sequence: Synthetic oligonucleotide
tgggcggtgacggagctgggg

SEQ ID NO: 65601 - DNA, 32 bp, Artificial Sequence
  Description of Artificial Sequence: Synthetic oligonucleotide
gggtgcggttcctggacagatacttctataac

SEQ ID NO: 65602 - DNA, 32 bp, Artificial Sequence
  Description of Artificial Sequence: Synthetic oligonucleotide
ggtgcggttcctggacagatacttctataacc

SEQ ID NO: 65603 - DNA, 34 bp, Artificial Sequence
  Description of Artificial Sequence: Synthetic oligonucleotide
gtgcggttcctggacagatacttctataaccaag

SEQ ID NO: 65604 - DNA, 35 bp, Artificial Sequence
  Description of Artificial Sequence: Synthetic oligonucleotide
tgcggttcctggacagatacttctataaccaagag

SEQ ID NO: 65605 - DNA, 34 bp, Artificial Sequence
  Description of Artificial Sequence: Synthetic oligonucleotide
gcggttcctggacagatacttctataaccaagag

SEQ ID NO: 65606 - DNA, 34 bp, Artificial Sequence
  Description of Artificial Sequence: Synthetic oligonucleotide
cggttcctggacagatacttctataaccaagagg

SEQ ID NO: 65607 - DNA, 35 bp, Artificial Sequence
  Description of Artificial Sequence: Synthetic oligonucleotide
ggttcctggacagatacttctataaccaagaggag

SEQ ID NO: 65608 - DNA, 37 bp, Artificial Sequence
  Description of Artificial Sequence: Synthetic oligonucleotide
gttcctggacagatacttctataaccaagaggagtac

SEQ ID NO: 65609 - DNA, 37 bp, Artificial Sequence
  Description of Artificial Sequence: Synthetic oligonucleotide
ttcctggacagatacttctataaccaagaggagtacg

SEQ ID NO: 65610 - DNA, 36 bp, Artificial Sequence
  Description of Artificial Sequence: Synthetic oligonucleotide
tcctggacagatacttctataaccaagaggagtacg

SEQ ID NO: 65611 - DNA, 35 bp, Artificial Sequence
  Description of Artificial Sequence: Synthetic oligonucleotide
cctggacagatacttctataaccaagaggagtacg

SEQ ID NO: 65612 - DNA, 36 bp, Artificial Sequence
  Description of Artificial Sequence: Synthetic oligonucleotide
ctggacagatacttctataaccaagaggagtacgtg

SEQ ID NO: 65613 - DNA, 36 bp, Artificial Sequence
  Description of Artificial Sequence: Synthetic oligonucleotide
tggacagatacttctataaccaagaggagtacgtgc

SEQ ID NO: 65614 - DNA, 35 bp, Artificial Sequence
  Description of Artificial Sequence: Synthetic oligonucleotide
ggacagatacttctataaccaagaggagtacgtgc

SEQ ID NO: 65615 - DNA, 35 bp, Artificial Sequence
  Description of Artificial Sequence: Synthetic oligonucleotide
gacagatacttctataaccaagaggagtacgtgcg

SEQ ID NO: 65616 - DNA, 35 bp, Artificial Sequence
  Description of Artificial Sequence: Synthetic oligonucleotide
acagatacttctataaccaagaggagtacgtgcgc

SEQ ID NO: 65617 - DNA, 34 bp, Artificial Sequence
  Description of Artificial Sequence: Synthetic oligonucleotide
cagatacttctataaccaagaggagtacgtgcgc

SEQ ID NO: 65618 - DNA, 36 bp, Artificial Sequence
  Description of Artificial Sequence: Synthetic oligonucleotide
agatacttctataaccaagaggagtacgtgcgcttc

SEQ ID NO: 65619 - DNA, 35 bp, Artificial Sequence
  Description of Artificial Sequence: Synthetic oligonucleotide
gatacttctataaccaagaggagtacgtgcgcttc

SEQ ID NO: 65620 - DNA, 35 bp, Artificial Sequence
  Description of Artificial Sequence: Synthetic oligonucleotide
atacttctataaccaagaggagtacgtgcgcttcg

SEQ ID NO: 65621 - DNA, 34 bp, Artificial Sequence
  Description of Artificial Sequence: Synthetic oligonucleotide
tacttctataaccaagaggagtacgtgcgcttcg

SEQ ID NO: 65622 - DNA, 33 bp, Artificial Sequence
  Description of Artificial Sequence: Synthetic oligonucleotide
acttctataaccaagaggagtacgtgcgcttcg

SEQ ID NO: 65623 - DNA, 32 bp, Artificial Sequence
  Description of Artificial Sequence: Synthetic oligonucleotide
cttctataaccaagaggagtacgtgcgcttcg

SEQ ID NO: 65624 - DNA, 33 bp, Artificial Sequence
  Description of Artificial Sequence: Synthetic oligonucleotide
ttctataaccaagaggagtacgtgcgcttcgac

SEQ ID NO: 65625 - DNA, 22 bp, Artificial Sequence
  Description of Artificial Sequence: Synthetic oligonucleotide
tgggggagtaccgggcggtgag

SEQ ID NO: 65626 - DNA, 21 bp, Artificial Sequence
  Description of Artificial Sequence: Synthetic oligonucleotide
gggggagtaccgggcggtgag

SEQ ID NO: 65627 - DNA, 21 bp, Artificial Sequence
  Description of Artificial Sequence: Synthetic oligonucleotide
ggggagtaccgggcggtgagg

SEQ ID NO: 65628 - DNA, 22 bp, Artificial Sequence
  Description of Artificial Sequence: Synthetic oligonucleotide
gggagtaccgggcggtgaggga

SEQ ID NO: 65629 - DNA, 22 bp, Artificial Sequence
  Description of Artificial Sequence: Synthetic oligonucleotide
ggagtaccgggcggtgagggag

SEQ ID NO: 65630 - DNA, 23 bp, Artificial Sequence
  Description of Artificial Sequence: Synthetic oligonucleotide
gagtaccgggcggtgagggagct

SEQ ID NO: 65631 - DNA, 23 bp, Artificial Sequence
  Description of Artificial Sequence: Synthetic oligonucleotide
agtaccgggcggtgagggagctg

SEQ ID NO: 65632 - DNA, 22 bp, Artificial Sequence
  Description of Artificial Sequence: Synthetic oligonucleotide
gtaccgggcggtgagggagctg

SEQ ID NO: 65633 - DNA, 22 bp, Artificial Sequence
  Description of Artificial Sequence: Synthetic oligonucleotide
taccgggcggtgagggagctgg

SEQ ID NO: 65634 - DNA, 21 bp, Artificial Sequence
  Description of Artificial Sequence: Synthetic oligonucleotide
accgggcggtgagggagctgg

SEQ ID NO: 65635 - DNA, 20 bp, Artificial Sequence
  Description of Artificial Sequence: Synthetic oligonucleotide
ccgggcggtgagggagctgg

SEQ ID NO: 65636 - DNA, 20 bp, Artificial Sequence
  Description of Artificial Sequence: Synthetic oligonucleotide
cgggcggtgagggagctggg

SEQ ID NO: 65637 - DNA, 20 bp, Artificial Sequence
  Description of Artificial Sequence: Synthetic oligonucleotide
gggcggtgagggagctgggg

SEQ ID NO: 65638 - DNA, 20 bp, Artificial Sequence
  Description of Artificial Sequence: Synthetic oligonucleotide
ggcggtgagggagctggggc

SEQ ID NO: 65639 - DNA, 20 bp, Artificial Sequence
  Description of Artificial Sequence: Synthetic oligonucleotide
gcggtgagggagctggggcg

SEQ ID NO: 65640 - DNA, 20 bp, Artificial Sequence
  Description of Artificial Sequence: Synthetic oligonucleotide
cggtgagggagctggggcgg

SEQ ID NO: 65641 - DNA, 20 bp, Artificial Sequence
  Description of Artificial Sequence: Synthetic oligonucleotide
ggtgagggagctggggcggc

SEQ ID NO: 65642 - DNA, 21 bp, Artificial Sequence
  Description of Artificial Sequence: Synthetic oligonucleotide
gtgagggagctggggcggcct

SEQ ID NO: 65643 - DNA, 23 bp, Artificial Sequence
  Description of Artificial Sequence: Synthetic oligonucleotide
tgagggagctggggcggcctgat

SEQ ID NO: 65644 - DNA, 22 bp, Artificial Sequence
  Description of Artificial Sequence: Synthetic oligonucleotide
gagggagctggggcggcctgat

SEQ ID NO: 65645 - DNA, 22 bp, Artificial Sequence
  Description of Artificial Sequence: Synthetic oligonucleotide
agggagctggggcggcctgatg

SEQ ID NO: 65646 - DNA, 21 bp, Artificial Sequence
  Description of Artificial Sequence: Synthetic oligonucleotide
gggagctggggcggcctgatg

SEQ ID NO: 65647 - DNA, 25 bp, Artificial Sequence
  Description of Artificial Sequence: Synthetic oligonucleotide
aacgtgcgcttcgacagcgacgtgc

SEQ ID NO: 65648 - DNA, 24 bp, Artificial Sequence
  Description of Artificial Sequence: Synthetic oligonucleotide
acgtgcgcttcgacagcgacgtgc

SEQ ID NO: 65649 - DNA, 23 bp, Artificial Sequence
  Description of Artificial Sequence: Synthetic oligonucleotide
cgtgcgcttcgacagcgacgtgc

SEQ ID NO: 65650 - DNA, 23 bp, Artificial Sequence
  Description of Artificial Sequence: Synthetic oligonucleotide
gtgcgcttcgacagcgacgtgcg

SEQ ID NO: 65651 - DNA, 23 bp, Artificial Sequence
  Description of Artificial Sequence: Synthetic oligonucleotide
tgcgcttcgacagcgacgtgcgg

SEQ ID NO: 65652 - DNA, 22 bp, Artificial Sequence
  Description of Artificial Sequence: Synthetic oligonucleotide
gcgcttcgacagcgacgtgcgg

SEQ ID NO: 65653 - DNA, 23 bp, Artificial Sequence
  Description of Artificial Sequence: Synthetic oligonucleotide
cgcttcgacagcgacgtgcggga

SEQ ID NO: 65654 - DNA, 25 bp, Artificial Sequence
  Description of Artificial Sequence: Synthetic oligonucleotide
gcttcgacagcgacgtgcgggagtt

SEQ ID NO: 65655 - DNA, 25 bp, Artificial Sequence
  Description of Artificial Sequence: Synthetic oligonucleotide
cttcgacagcgacgtgcgggagttc

SEQ ID NO: 65656 - DNA, 25 bp, Artificial Sequence
  Description of Artificial Sequence: Synthetic oligonucleotide
ttcgacagcgacgtgcgggagttcc

SEQ ID NO: 65657 - DNA, 24 bp, Artificial Sequence
  Description of Artificial Sequence: Synthetic oligonucleotide
tcgacagcgacgtgcgggagttcc

SEQ ID NO: 65658 - DNA, 23 bp, Artificial Sequence
  Description of Artificial Sequence: Synthetic oligonucleotide
cgacagcgacgtgcgggagttcc

SEQ ID NO: 65659 - DNA, 23 bp, Artificial Sequence
  Description of Artificial Sequence: Synthetic oligonucleotide
gacagcgacgtgcgggagttccg

SEQ ID NO: 65660 - DNA, 23 bp, Artificial Sequence
  Description of Artificial Sequence: Synthetic oligonucleotide
acagcgacgtgcgggagttccgg

SEQ ID NO: 65661 - DNA, 22 bp, Artificial Sequence
  Description of Artificial Sequence: Synthetic oligonucleotide
cagcgacgtgcgggagttccgg

SEQ ID NO: 65662 - DNA, 22 bp, Artificial Sequence
  Description of Artificial Sequence: Synthetic oligonucleotide
agcgacgtgcgggagttccggg

SEQ ID NO: 65663 - DNA, 21 bp, Artificial Sequence
  Description of Artificial Sequence: Synthetic oligonucleotide
gcgacgtgcgggagttccggg

SEQ ID NO: 65664 - DNA, 21 bp, Artificial Sequence
  Description of Artificial Sequence: Synthetic oligonucleotide
cgacgtgcgggagttccgggc

SEQ ID NO: 65665 - DNA, 21 bp, Artificial Sequence
  Description of Artificial Sequence: Synthetic oligonucleotide
gacgtgcgggagttccgggcg

SEQ ID NO: 65666 - DNA, 22 bp, Artificial Sequence
  Description of Artificial Sequence: Synthetic oligonucleotide
acgtgcgggagttccgggcggt

SEQ ID NO: 65667 - DNA, 21 bp, Artificial Sequence
  Description of Artificial Sequence: Synthetic oligonucleotide
cgtgcgggagttccgggcggt

SEQ ID NO: 65668 - DNA, 22 bp, Artificial Sequence
  Description of Artificial Sequence: Synthetic oligonucleotide
gtgcgggagttccgggcggtga

SEQ ID NO: 65669 - DNA, 22 bp, Artificial Sequence
  Description of Artificial Sequence: Synthetic oligonucleotide
tgcgggagttccgggcggtgac

SEQ ID NO: 65670 - DNA, 21 bp, Artificial Sequence
  Description of Artificial Sequence: Synthetic oligonucleotide
gcgggagttccgggcggtgac

SEQ ID NO: 65671 - DNA, 21 bp, Artificial Sequence
  Description of Artificial Sequence: Synthetic oligonucleotide
cgggagttccgggcggtgacg

SEQ ID NO: 65672 - DNA, 30 bp, Artificial Sequence
  Description of Artificial Sequence: Synthetic oligonucleotide
aacagccagaaggacatcctggagcagaag

SEQ ID NO: 65673 - DNA, 29 bp, Artificial Sequence
  Description of Artificial Sequence: Synthetic oligonucleotide
acagccagaaggacatcctggagcagaag

SEQ ID NO: 65674 - DNA, 28 bp, Artificial Sequence
  Description of Artificial Sequence: Synthetic oligonucleotide
cagccagaaggacatcctggagcagaag

SEQ ID NO: 65675 - DNA, 28 bp, Artificial Sequence
  Description of Artificial Sequence: Synthetic oligonucleotide
agccagaaggacatcctggagcagaagc

SEQ ID NO: 65676 - DNA, 27 bp, Artificial Sequence
  Description of Artificial Sequence: Synthetic oligonucleotide
gccagaaggacatcctggagcagaagc

SEQ ID NO: 65677 - DNA, 27 bp, Artificial Sequence
  Description of Artificial Sequence: Synthetic oligonucleotide
ccagaaggacatcctggagcagaagcg

SEQ ID NO: 65678 - DNA, 27 bp, Artificial Sequence
  Description of Artificial Sequence: Synthetic oligonucleotide
cagaaggacatcctggagcagaagcgg

SEQ ID NO: 65679 - DNA, 27 bp, Artificial Sequence
  Description of Artificial Sequence: Synthetic oligonucleotide
agaaggacatcctggagcagaagcggg

SEQ ID NO: 65680 - DNA, 26 bp, Artificial Sequence
  Description of Artificial Sequence: Synthetic oligonucleotide
gaaggacatcctggagcagaagcggg

SEQ ID NO: 65681 - DNA, 26 bp, Artificial Sequence
  Description of Artificial Sequence: Synthetic oligonucleotide
aaggacatcctggagcagaagcgggg

SEQ ID NO: 65682 - DNA, 25 bp, Artificial Sequence
  Description of Artificial Sequence: Synthetic oligonucleotide
aggacatcctggagcagaagcgggg

SEQ ID NO: 65683 - DNA, 24 bp, Artificial Sequence
  Description of Artificial Sequence: Synthetic oligonucleotide
ggacatcctggagcagaagcgggg

SEQ ID NO: 65684 - DNA, 24 bp, Artificial Sequence
  Description of Artificial Sequence: Synthetic oligonucleotide
gacatcctggagcagaagcggggc

SEQ ID NO: 65685 - DNA, 24 bp, Artificial Sequence
  Description of Artificial Sequence: Synthetic oligonucleotide
acatcctggagcagaagcggggcc

SEQ ID NO: 65686 - DNA, 23 bp, Artificial Sequence
  Description of Artificial Sequence: Synthetic oligonucleotide
catcctggagcagaagcggggcc

SEQ ID NO: 65687 - DNA, 23 bp, Artificial Sequence
  Description of Artificial Sequence: Synthetic oligonucleotide
atcctggagcagaagcggggccg

SEQ ID NO: 65688 - DNA, 29 bp, Artificial Sequence
  Description of Artificial Sequence: Synthetic oligonucleotide
gacaactactgcagacacaactacggggc

SEQ ID NO: 65689 - DNA, 30 bp, Artificial Sequence
  Description of Artificial Sequence: Synthetic oligonucleotide
acaactactgcagacacaactacggggctg

SEQ ID NO: 65690 - DNA, 29 bp, Artificial Sequence
  Description of Artificial Sequence: Synthetic oligonucleotide
caactactgcagacacaactacggggctg

SEQ ID NO: 65691 - DNA, 30 bp, Artificial Sequence
  Description of Artificial Sequence: Synthetic oligonucleotide
aactactgcagacacaactacggggctgtg

SEQ ID NO: 65692 - DNA, 29 bp, Artificial Sequence
  Description of Artificial Sequence: Synthetic oligonucleotide
actactgcagacacaactacggggctgtg

SEQ ID NO: 65693 - DNA, 28 bp, Artificial Sequence
  Description of Artificial Sequence: Synthetic oligonucleotide
ctactgcagacacaactacggggctgtg

SEQ ID NO: 65694 - DNA, 28 bp, Artificial Sequence
  Description of Artificial Sequence: Synthetic oligonucleotide
tactgcagacacaactacggggctgtgg

SEQ ID NO: 65695 - DNA, 27 bp, Artificial Sequence
  Description of Artificial Sequence: Synthetic oligonucleotide
actgcagacacaactacggggctgtgg

SEQ ID NO: 65696 - DNA, 27 bp, Artificial Sequence
  Description of Artificial Sequence: Synthetic oligonucleotide
ctgcagacacaactacggggctgtgga

SEQ ID NO: 65697 - DNA, 33 bp, Artificial Sequence
  Description of Artificial Sequence: Synthetic oligonucleotide
ctggacagatacttccataaccaggaggagttc

SEQ ID NO: 65698 - DNA, 33 bp, Artificial Sequence
  Description of Artificial Sequence: Synthetic oligonucleotide
tggacagatacttccataaccaggaggagttcg

SEQ ID NO: 65699 - DNA, 32 bp, Artificial Sequence
  Description of Artificial Sequence: Synthetic oligonucleotide
ggacagatacttccataaccaggaggagttcg

SEQ ID NO: 65700 - DNA, 33 bp, Artificial Sequence
  Description of Artificial Sequence: Synthetic oligonucleotide
gacagatacttccataaccaggaggagttcgtg

SEQ ID NO: 65701 - DNA, 33 bp, Artificial Sequence
  Description of Artificial Sequence: Synthetic oligonucleotide
acagatacttccataaccaggaggagttcgtgc

SEQ ID NO: 65702 - DNA, 32 bp, Artificial Sequence
  Description of Artificial Sequence: Synthetic oligonucleotide
cagatacttccataaccaggaggagttcgtgc

SEQ ID NO: 65703 - DNA, 32 bp, Artificial Sequence
  Description of Artificial Sequence: Synthetic oligonucleotide
agatacttccataaccaggaggagttcgtgcg

SEQ ID NO: 65704 - DNA, 31 bp, Artificial Sequence
  Description of Artificial Sequence: Synthetic oligonucleotide
gatacttccataaccaggaggagttcgtgcg

SEQ ID NO: 65705 - DNA, 31 bp, Artificial Sequence
  Description of Artificial Sequence: Synthetic oligonucleotide
atacttccataaccaggaggagttcgtgcgc

SEQ ID NO: 65706 - DNA, 30 bp, Artificial Sequence
  Description of Artificial Sequence: Synthetic oligonucleotide
tacttccataaccaggaggagttcgtgcgc

SEQ ID NO: 65707 - DNA, 29 bp, Artificial Sequence
  Description of Artificial Sequence: Synthetic oligonucleotide
acttccataaccaggaggagttcgtgcgc

SEQ ID NO: 65708 - DNA, 28 bp, Artificial Sequence
  Description of Artificial Sequence: Synthetic oligonucleotide
cttccataaccaggaggagttcgtgcgc

SEQ ID NO: 65709 - DNA, 30 bp, Artificial Sequence
  Description of Artificial Sequence: Synthetic oligonucleotide
ttccataaccaggaggagttcgtgcgcttc

SEQ ID NO: 65710 - DNA, 29 bp, Artificial Sequence
  Description of Artificial Sequence: Synthetic oligonucleotide
tccataaccaggaggagttcgtgcgcttc

SEQ ID NO: 65711 - DNA, 28 bp, Artificial Sequence
  Description of Artificial Sequence: Synthetic oligonucleotide
ccataaccaggaggagttcgtgcgcttc

SEQ ID NO: 65712 - DNA, 28 bp, Artificial Sequence
  Description of Artificial Sequence: Synthetic oligonucleotide
cataaccaggaggagttcgtgcgcttcg

SEQ ID NO: 65713 - DNA, 29 bp, Artificial Sequence
  Description of Artificial Sequence: Synthetic oligonucleotide
ataaccaggaggagttcgtgcgcttcgac

SEQ ID NO: 65714 - DNA, 28 bp, Artificial Sequence
  Description of Artificial Sequence: Synthetic oligonucleotide
taaccaggaggagttcgtgcgcttcgac

SEQ ID NO: 65715 - DNA, 27 bp, Artificial Sequence
  Description of Artificial Sequence: Synthetic oligonucleotide
aaccaggaggagttcgtgcgcttcgac

SEQ ID NO: 65716 - DNA, 27 bp, Artificial Sequence
  Description of Artificial Sequence: Synthetic oligonucleotide
accaggaggagttcgtgcgcttcgaca

SEQ ID NO: 65717 - DNA, 26 bp, Artificial Sequence
  Description of Artificial Sequence: Synthetic oligonucleotide
ccaggaggagttcgtgcgcttcgaca

SEQ ID NO: 65718 - DNA, 26 bp, Artificial Sequence
  Description of Artificial Sequence: Synthetic oligonucleotide
caggaggagttcgtgcgcttcgacag

SEQ ID NO: 65719 - DNA, 26 bp, Artificial Sequence
  Description of Artificial Sequence: Synthetic oligonucleotide
aggaggagttcgtgcgcttcgacagc

SEQ ID NO: 65720 - DNA, 27 bp, Artificial Sequence
  Description of Artificial Sequence: Synthetic oligonucleotide
gggtgcggtacctggacagatacttcg

SEQ ID NO: 65721 - DNA, 31 bp, Artificial Sequence
  Description of Artificial Sequence: Synthetic oligonucleotide
ggtgcggtacctggacagatacttcgataac

SEQ ID NO: 65722 - DNA, 31 bp, Artificial Sequence
  Description of Artificial Sequence: Synthetic oligonucleotide
gtgcggtacctggacagatacttcgataacc

SEQ ID NO: 65723 - DNA, 32 bp, Artificial Sequence
  Description of Artificial Sequence: Synthetic oligonucleotide
tgcggtacctggacagatacttcgataaccag

SEQ ID NO: 65724 - DNA, 31 bp, Artificial Sequence
  Description of Artificial Sequence: Synthetic oligonucleotide
gcggtacctggacagatacttcgataaccag

SEQ ID NO: 65725 - DNA, 31 bp, Artificial Sequence
  Description of Artificial Sequence: Synthetic oligonucleotide
cggtacctggacagatacttcgataaccagg

SEQ ID NO: 65726 - DNA, 32 bp, Artificial Sequence
  Description of Artificial Sequence: Synthetic oligonucleotide
ggtacctggacagatacttcgataaccaggag

SEQ ID NO: 65727 - DNA, 32 bp, Artificial Sequence
  Description of Artificial Sequence: Synthetic oligonucleotide
gtacctggacagatacttcgataaccaggagg

SEQ ID NO: 65728 - DNA, 33 bp, Artificial Sequence
  Description of Artificial Sequence: Synthetic oligonucleotide
tacctggacagatacttcgataaccaggaggag

SEQ ID NO: 65729 - DNA, 32 bp, Artificial Sequence
  Description of Artificial Sequence: Synthetic oligonucleotide
acctggacagatacttcgataaccaggaggag

SEQ ID NO: 65730 - DNA, 31 bp, Artificial Sequence
  Description of Artificial Sequence: Synthetic oligonucleotide
cctggacagatacttcgataaccaggaggag

SEQ ID NO: 65731 - DNA, 33 bp, Artificial Sequence
  Description of Artificial Sequence: Synthetic oligonucleotide
ctggacagatacttcgataaccaggaggagaac

SEQ ID NO: 65732 - DNA, 33 bp, Artificial Sequence
  Description of Artificial Sequence: Synthetic oligonucleotide
tggacagatacttcgataaccaggaggagaacg

SEQ ID NO: 65733 - DNA, 32 bp, Artificial Sequence
  Description of Artificial Sequence: Synthetic oligonucleotide
ggacagatacttcgataaccaggaggagaacg

SEQ ID NO: 65734 - DNA, 33 bp, Artificial Sequence
  Description of Artificial Sequence: Synthetic oligonucleotide
gacagatacttcgataaccaggaggagaacgtg

SEQ ID NO: 65735 - DNA, 33 bp, Artificial Sequence
  Description of Artificial Sequence: Synthetic oligonucleotide
acagatacttcgataaccaggaggagaacgtgc

SEQ ID NO: 65736 - DNA, 32 bp, Artificial Sequence
  Description of Artificial Sequence: Synthetic oligonucleotide
cagatacttcgataaccaggaggagaacgtgc

SEQ ID NO: 65737 - DNA, 32 bp, Artificial Sequence
  Description of Artificial Sequence: Synthetic oligonucleotide
agatacttcgataaccaggaggagaacgtgcg

SEQ ID NO: 65738 - DNA, 31 bp, Artificial Sequence
  Description of Artificial Sequence: Synthetic oligonucleotide
gatacttcgataaccaggaggagaacgtgcg

SEQ ID NO: 65739 - DNA, 31 bp, Artificial Sequence
  Description of Artificial Sequence: Synthetic oligonucleotide
atacttcgataaccaggaggagaacgtgcgc

SEQ ID NO: 65740 - DNA, 30 bp, Artificial Sequence
  Description of Artificial Sequence: Synthetic oligonucleotide
tacttcgataaccaggaggagaacgtgcgc

SEQ ID NO: 65741 - DNA, 29 bp, Artificial Sequence
  Description of Artificial Sequence: Synthetic oligonucleotide
acttcgataaccaggaggagaacgtgcgc

SEQ ID NO: 65742 - DNA, 28 bp, Artificial Sequence
  Description of Artificial Sequence: Synthetic oligonucleotide
cttcgataaccaggaggagaacgtgcgc

SEQ ID NO: 65743 - DNA, 30 bp, Artificial Sequence
  Description of Artificial Sequence: Synthetic oligonucleotide
ttcgataaccaggaggagaacgtgcgcttc

SEQ ID NO: 65744 - DNA, 29 bp, Artificial Sequence
  Description of Artificial Sequence: Synthetic oligonucleotide
tcgataaccaggaggagaacgtgcgcttc

SEQ ID NO: 65745 - DNA, 28 bp, Artificial Sequence
  Description of Artificial Sequence: Synthetic oligonucleotide
cgataaccaggaggagaacgtgcgcttc

SEQ ID NO: 65746 - DNA, 28 bp, Artificial Sequence
  Description of Artificial Sequence: Synthetic oligonucleotide
gataaccaggaggagaacgtgcgcttcg

SEQ ID NO: 65747 - DNA, 33 bp, Artificial Sequence
  Description of Artificial Sequence: Synthetic oligonucleotide
ctggacagatacttccataaccaggaggagtac

SEQ ID NO: 65748 - DNA, 33 bp, Artificial Sequence
  Description of Artificial Sequence: Synthetic oligonucleotide
tggacagatacttccataaccaggaggagtacg

SEQ ID NO: 65749 - DNA, 32 bp, Artificial Sequence
  Description of Artificial Sequence: Synthetic oligonucleotide
ggacagatacttccataaccaggaggagtacg

SEQ ID NO: 65750 - DNA, 33 bp, Artificial Sequence
  Description of Artificial Sequence: Synthetic oligonucleotide
gacagatacttccataaccaggaggagtacgtg

SEQ ID NO: 65751 - DNA, 33 bp, Artificial Sequence
  Description of Artificial Sequence: Synthetic oligonucleotide
acagatacttccataaccaggaggagtacgtgc

SEQ ID NO: 65752 - DNA, 32 bp, Artificial Sequence
  Description of Artificial Sequence: Synthetic oligonucleotide
cagatacttccataaccaggaggagtacgtgc

SEQ ID NO: 65753 - DNA, 32 bp, Artificial Sequence
  Description of Artificial Sequence: Synthetic oligonucleotide
agatacttccataaccaggaggagtacgtgcg

SEQ ID NO: 65754 - DNA, 31 bp, Artificial Sequence
  Description of Artificial Sequence: Synthetic oligonucleotide
gatacttccataaccaggaggagtacgtgcg

SEQ ID NO: 65755 - DNA, 31 bp, Artificial Sequence
  Description of Artificial Sequence: Synthetic oligonucleotide
atacttccataaccaggaggagtacgtgcgc

SEQ ID NO: 65756 - DNA, 30 bp, Artificial Sequence
  Description of Artificial Sequence: Synthetic oligonucleotide
tacttccataaccaggaggagtacgtgcgc

SEQ ID NO: 65757 - DNA, 29 bp, Artificial Sequence
  Description of Artificial Sequence: Synthetic oligonucleotide
acttccataaccaggaggagtacgtgcgc

SEQ ID NO: 65758 - DNA, 28 bp, Artificial Sequence
  Description of Artificial Sequence: Synthetic oligonucleotide
cttccataaccaggaggagtacgtgcgc

SEQ ID NO: 65759 - DNA, 30 bp, Artificial Sequence
  Description of Artificial Sequence: Synthetic oligonucleotide
ttccataaccaggaggagtacgtgcgcttc

SEQ ID NO: 65760 - DNA, 29 bp, Artificial Sequence
  Description of Artificial Sequence: Synthetic oligonucleotide
tccataaccaggaggagtacgtgcgcttc

SEQ ID NO: 65761 - DNA, 28 bp, Artificial Sequence
  Description of Artificial Sequence: Synthetic oligonucleotide
ccataaccaggaggagtacgtgcgcttc

SEQ ID NO: 65762 - DNA, 28 bp, Artificial Sequence
  Description of Artificial Sequence: Synthetic oligonucleotide
cataaccaggaggagtacgtgcgcttcg

SEQ ID NO: 65763 - DNA, 29 bp, Artificial Sequence
  Description of Artificial Sequence: Synthetic oligonucleotide
ataaccaggaggagtacgtgcgcttcgac

SEQ ID NO: 65764 - DNA, 28 bp, Artificial Sequence
  Description of Artificial Sequence: Synthetic oligonucleotide
taaccaggaggagtacgtgcgcttcgac

SEQ ID NO: 65765 - DNA, 27 bp, Artificial Sequence
  Description of Artificial Sequence: Synthetic oligonucleotide
aaccaggaggagtacgtgcgcttcgac

SEQ ID NO: 65766 - DNA, 27 bp, Artificial Sequence
  Description of Artificial Sequence: Synthetic oligonucleotide
accaggaggagtacgtgcgcttcgaca

SEQ ID NO: 65767 - DNA, 26 bp, Artificial Sequence
  Description of Artificial Sequence: Synthetic oligonucleotide
ccaggaggagtacgtgcgcttcgaca

SEQ ID NO: 65768 - DNA, 26 bp, Artificial Sequence
  Description of Artificial Sequence: Synthetic oligonucleotide
caggaggagtacgtgcgcttcgacag

SEQ ID NO: 65769 - DNA, 26 bp, Artificial Sequence
  Description of Artificial Sequence: Synthetic oligonucleotide
aggaggagtacgtgcgcttcgacagc

SEQ ID NO: 65770 - DNA, 25 bp, Artificial Sequence
  Description of Artificial Sequence: Synthetic oligonucleotide
ggaggagtacgtgcgcttcgacagc

SEQ ID NO: 65771 - DNA, 32 bp, Artificial Sequence
  Description of Artificial Sequence: Synthetic oligonucleotide
gacagatacttccataaccaggaggagaacgc

SEQ ID NO: 65772 - DNA, 32 bp, Artificial Sequence
  Description of Artificial Sequence: Synthetic oligonucleotide
acagatacttccataaccaggaggagaacgcg

SEQ ID NO: 65773 - DNA, 31 bp, Artificial Sequence
  Description of Artificial Sequence: Synthetic oligonucleotide
cagatacttccataaccaggaggagaacgcg

SEQ ID NO: 65774 - DNA, 31 bp, Artificial Sequence
  Description of Artificial Sequence: Synthetic oligonucleotide
agatacttccataaccaggaggagaacgcgc

SEQ ID NO: 65775 - DNA, 30 bp, Artificial Sequence
  Description of Artificial Sequence: Synthetic oligonucleotide
gatacttccataaccaggaggagaacgcgc

SEQ ID NO: 65776 - DNA, 30 bp, Artificial Sequence
  Description of Artificial Sequence: Synthetic oligonucleotide
atacttccataaccaggaggagaacgcgcg

SEQ ID NO: 65777 - DNA, 29 bp, Artificial Sequence
  Description of Artificial Sequence: Synthetic oligonucleotide
tacttccataaccaggaggagaacgcgcg

SEQ ID NO: 65778 - DNA, 28 bp, Artificial Sequence
  Description of Artificial Sequence: Synthetic oligonucleotide
acttccataaccaggaggagaacgcgcg

SEQ ID NO: 65779 - DNA, 27 bp, Artificial Sequence
  Description of Artificial Sequence: Synthetic oligonucleotide
cttccataaccaggaggagaacgcgcg

SEQ ID NO: 65780 - DNA, 27 bp, Artificial Sequence
  Description of Artificial Sequence: Synthetic oligonucleotide
ttccataaccaggaggagaacgcgcgc

SEQ ID NO: 65781 - DNA, 27 bp, Artificial Sequence
  Description of Artificial Sequence: Synthetic oligonucleotide
tccataaccaggaggagaacgcgcgct

SEQ ID NO: 65782 - DNA, 27 bp, Artificial Sequence
  Description of Artificial Sequence: Synthetic oligonucleotide
ccataaccaggaggagaacgcgcgctt

SEQ ID NO: 65783 - DNA, 27 bp, Artificial Sequence
  Description of Artificial Sequence: Synthetic oligonucleotide
cataaccaggaggagaacgcgcgcttc

SEQ ID NO: 65784 - DNA, 27 bp, Artificial Sequence
  Description of Artificial Sequence: Synthetic oligonucleotide
ataaccaggaggagaacgcgcgcttcg

SEQ ID NO: 65785 - DNA, 27 bp, Artificial Sequence
  Description of Artificial Sequence: Synthetic oligonucleotide
taaccaggaggagaacgcgcgcttcga

SEQ ID NO: 65786 - DNA, 26 bp, Artificial Sequence
  Description of Artificial Sequence: Synthetic oligonucleotide
aaccaggaggagaacgcgcgcttcga

SEQ ID NO: 65787 - DNA, 25 bp, Artificial Sequence
  Description of Artificial Sequence: Synthetic oligonucleotide
accaggaggagaacgcgcgcttcga

SEQ ID NO: 65788 - DNA, 24 bp, Artificial Sequence
  Description of Artificial Sequence: Synthetic oligonucleotide
ccaggaggagaacgcgcgcttcga

SEQ ID NO: 65789 - DNA, 25 bp, Artificial Sequence
  Description of Artificial Sequence: Synthetic oligonucleotide
caggaggagaacgcgcgcttcgaca

SEQ ID NO: 65790 - DNA, 25 bp, Artificial Sequence
  Description of Artificial Sequence: Synthetic oligonucleotide
aggaggagaacgcgcgcttcgacag

SEQ ID NO: 65791 - DNA, 24 bp, Artificial Sequence
  Description of Artificial Sequence: Synthetic oligonucleotide
ggaggagaacgcgcgcttcgacag

SEQ ID NO: 65792 - DNA, 24 bp, Artificial Sequence
  Description of Artificial Sequence: Synthetic oligonucleotide
gaggagaacgcgcgcttcgacagc

SEQ ID NO: 65793 - DNA, 25 bp, Artificial Sequence
  Description of Artificial Sequence: Synthetic oligonucleotide
aggagaacgcgcgcttcgacagcga

SEQ ID NO: 65794 - DNA, 24 bp, Artificial Sequence
  Description of Artificial Sequence: Synthetic oligonucleotide
ggagaacgcgcgcttcgacagcga

SEQ ID NO: 65795 - DNA, 24 bp, Artificial Sequence
  Description of Artificial Sequence: Synthetic oligonucleotide
gagaacgcgcgcttcgacagcgac

SEQ ID NO: 65796 - DNA, 25 bp, Artificial Sequence
  Description of Artificial Sequence: Synthetic oligonucleotide
agaacgcgcgcttcgacagcgacgt

SEQ ID NO: 65797 - DNA, 24 bp, Artificial Sequence
  Description of Artificial Sequence: Synthetic oligonucleotide
gaacgcgcgcttcgacagcgacgt

SEQ ID NO: 65798 - DNA, 24 bp, Artificial Sequence
  Description of Artificial Sequence: Synthetic oligonucleotide
aacgcgcgcttcgacagcgacgtg

SEQ ID NO: 65799 - DNA, 23 bp, Artificial Sequence
  Description of Artificial Sequence: Synthetic oligonucleotide
ggggagttccgggcggtgacgaa

SEQ ID NO: 65800 - DNA, 23 bp, Artificial Sequence
  Description of Artificial Sequence: Synthetic oligonucleotide
gggagttccgggcggtgacgaag

SEQ ID NO: 65801 - DNA, 24 bp, Artificial Sequence
  Description of Artificial Sequence: Synthetic oligonucleotide
ggagttccgggcggtgacgaagct

SEQ ID NO: 65802 - DNA, 24 bp, Artificial Sequence
  Description of Artificial Sequence: Synthetic oligonucleotide
gagttccgggcggtgacgaagctg

SEQ ID NO: 65803 - DNA, 24 bp, Artificial Sequence
  Description of Artificial Sequence: Synthetic oligonucleotide
agttccgggcggtgacgaagctgg

SEQ ID NO: 65804 - DNA, 23 bp, Artificial Sequence
  Description of Artificial Sequence: Synthetic oligonucleotide
gttccgggcggtgacgaagctgg

SEQ ID NO: 65805 - DNA, 23 bp, Artificial Sequence
  Description of Artificial Sequence: Synthetic oligonucleotide
ttccgggcggtgacgaagctggg

SEQ ID NO: 65806 - DNA, 22 bp, Artificial Sequence
  Description of Artificial Sequence: Synthetic oligonucleotide
tccgggcggtgacgaagctggg

SEQ ID NO: 65807 - DNA, 21 bp, Artificial Sequence
  Description of Artificial Sequence: Synthetic oligonucleotide
ccgggcggtgacgaagctggg

SEQ ID NO: 65808 - DNA, 21 bp, Artificial Sequence
  Description of Artificial Sequence: Synthetic oligonucleotide
cgggcggtgacgaagctgggg

SEQ ID NO: 65809 - DNA, 21 bp, Artificial Sequence
  Description of Artificial Sequence: Synthetic oligonucleotide
gggcggtgacgaagctggggc

SEQ ID NO: 65810 - DNA, 21 bp, Artificial Sequence
  Description of Artificial Sequence: Synthetic oligonucleotide
ggcggtgacgaagctggggcg

SEQ ID NO: 65811 - DNA, 21 bp, Artificial Sequence
  Description of Artificial Sequence: Synthetic oligonucleotide
gcggtgacgaagctggggcgg

SEQ ID NO: 65812 - DNA, 21 bp, Artificial Sequence
  Description of Artificial Sequence: Synthetic oligonucleotide
cggtgacgaagctggggcggc

SEQ ID NO: 65813 - DNA, 22 bp, Artificial Sequence
  Description of Artificial Sequence: Synthetic oligonucleotide
ggtgacgaagctggggcggcct

SEQ ID NO: 65814 - DNA, 24 bp, Artificial Sequence
  Description of Artificial Sequence: Synthetic oligonucleotide
gtgacgaagctggggcggcctgat

SEQ ID NO: 65815 - DNA, 24 bp, Artificial Sequence
  Description of Artificial Sequence: Synthetic oligonucleotide
tgacgaagctggggcggcctgatg

SEQ ID NO: 65816 - DNA, 23 bp, Artificial Sequence
  Description of Artificial Sequence: Synthetic oligonucleotide
gacgaagctggggcggcctgatg

SEQ ID NO: 65817 - DNA, 23 bp, Artificial Sequence
  Description of Artificial Sequence: Synthetic oligonucleotide
acgaagctggggcggcctgatgc

SEQ ID NO: 65818 - DNA, 22 bp, Artificial Sequence
  Description of Artificial Sequence: Synthetic oligonucleotide
cgaagctggggcggcctgatgc

SEQ ID NO: 65819 - DNA, 22 bp, Artificial Sequence
  Description of Artificial Sequence: Synthetic oligonucleotide
gaagctggggcggcctgatgcc

SEQ ID NO: 65820 - DNA, 23 bp, Artificial Sequence
  Description of Artificial Sequence: Synthetic oligonucleotide
aagctggggcggcctgatgccga

SEQ ID NO: 65821 - DNA, 22 bp, Artificial Sequence
  Description of Artificial Sequence: Synthetic oligonucleotide
ggacggagcgggtgcggtacgt

SEQ ID NO: 65822 - DNA, 22 bp, Artificial Sequence
  Description of Artificial Sequence: Synthetic oligonucleotide
gacggagcgggtgcggtacgtg

SEQ ID NO: 65823 - DNA, 23 bp, Artificial Sequence
  Description of Artificial Sequence: Synthetic oligonucleotide
acggagcgggtgcggtacgtgga

SEQ ID NO: 65824 - DNA, 22 bp, Artificial Sequence
  Description of Artificial Sequence: Synthetic oligonucleotide
cggagcgggtgcggtacgtgga

SEQ ID NO: 65825 - DNA, 23 bp, Artificial Sequence
  Description of Artificial Sequence: Synthetic oligonucleotide
ggagcgggtgcggtacgtggaca

SEQ ID NO: 65826 - DNA, 26 bp, Artificial Sequence
  Description of Artificial Sequence: Synthetic oligonucleotide
gagcgggtgcggtacgtggacagata

SEQ ID NO: 65827 - DNA, 27 bp, Artificial Sequence
  Description of Artificial Sequence: Synthetic oligonucleotide
agcgggtgcggtacgtggacagatact

SEQ ID NO: 65828 - DNA, 27 bp, Artificial Sequence
  Description of Artificial Sequence: Synthetic oligonucleotide
gcgggtgcggtacgtggacagatactt

SEQ ID NO: 65829 - DNA, 27 bp, Artificial Sequence
  Description of Artificial Sequence: Synthetic oligonucleotide
cgggtgcggtacgtggacagatacttc

SEQ ID NO: 65830 - DNA, 27 bp, Artificial Sequence
  Description of Artificial Sequence: Synthetic oligonucleotide
gggtgcggtacgtggacagatacttcc

SEQ ID NO: 65831 - DNA, 31 bp, Artificial Sequence
  Description of Artificial Sequence: Synthetic oligonucleotide
ggtgcggtacgtggacagatacttccataac

SEQ ID NO: 65832 - DNA, 31 bp, Artificial Sequence
  Description of Artificial Sequence: Synthetic oligonucleotide
gtgcggtacgtggacagatacttccataacc

SEQ ID NO: 65833 - DNA, 32 bp, Artificial Sequence
  Description of Artificial Sequence: Synthetic oligonucleotide
tgcggtacgtggacagatacttccataaccag

SEQ ID NO: 65834 - DNA, 31 bp, Artificial Sequence
  Description of Artificial Sequence: Synthetic oligonucleotide
gcggtacgtggacagatacttccataaccag

SEQ ID NO: 65835 - DNA, 31 bp, Artificial Sequence
  Description of Artificial Sequence: Synthetic oligonucleotide
cggtacgtggacagatacttccataaccagg

SEQ ID NO: 65836 - DNA, 32 bp, Artificial Sequence
  Description of Artificial Sequence: Synthetic oligonucleotide
ggtacgtggacagatacttccataaccaggag

SEQ ID NO: 65837 - DNA, 32 bp, Artificial Sequence
  Description of Artificial Sequence: Synthetic oligonucleotide
gtacgtggacagatacttccataaccaggagg

SEQ ID NO: 65838 - DNA, 33 bp, Artificial Sequence
  Description of Artificial Sequence: Synthetic oligonucleotide
tacgtggacagatacttccataaccaggaggag

SEQ ID NO: 65839 - DNA, 32 bp, Artificial Sequence
  Description of Artificial Sequence: Synthetic oligonucleotide
acgtggacagatacttccataaccaggaggag

SEQ ID NO: 65840 - DNA, 31 bp, Artificial Sequence
  Description of Artificial Sequence: Synthetic oligonucleotide
cgtggacagatacttccataaccaggaggag

SEQ ID NO: 65841 - DNA, 33 bp, Artificial Sequence
  Description of Artificial Sequence: Synthetic oligonucleotide
gtggacagatacttccataaccaggaggagaac

SEQ ID NO: 65842 - DNA, 23 bp, Artificial Sequence
  Description of Artificial Sequence: Synthetic oligonucleotide
gagcagaagcggggccgggtgaa

SEQ ID NO: 65843 - DNA, 25 bp, Artificial Sequence
  Description of Artificial Sequence: Synthetic oligonucleotide
agcagaagcggggccgggtgaacaa

SEQ ID NO: 65844 - DNA, 24 bp, Artificial Sequence
  Description of Artificial Sequence: Synthetic oligonucleotide
gcagaagcggggccgggtgaacaa

SEQ ID NO: 65845 - DNA, 26 bp, Artificial Sequence
  Description of Artificial Sequence: Synthetic oligonucleotide
cagaagcggggccgggtgaacaacta

SEQ ID NO: 65846 - DNA, 27 bp, Artificial Sequence
  Description of Artificial Sequence: Synthetic oligonucleotide
agaagcggggccgggtgaacaactact

SEQ ID NO: 65847 - DNA, 26 bp, Artificial Sequence
  Description of Artificial Sequence: Synthetic oligonucleotide
gaagcggggccgggtgaacaactact

SEQ ID NO: 65848 - DNA, 26 bp, Artificial Sequence
  Description of Artificial Sequence: Synthetic oligonucleotide
aagcggggccgggtgaacaactactg

SEQ ID NO: 65849 - DNA, 25 bp, Artificial Sequence
  Description of Artificial Sequence: Synthetic oligonucleotide
agcggggccgggtgaacaactactg

SEQ ID NO: 65850 - DNA, 24 bp, Artificial Sequence
  Description of Artificial Sequence: Synthetic oligonucleotide
gcggggccgggtgaacaactactg

SEQ ID NO: 65851 - DNA, 25 bp, Artificial Sequence
  Description of Artificial Sequence: Synthetic oligonucleotide
cggggccgggtgaacaactactgca

SEQ ID NO: 65852 - DNA, 26 bp, Artificial Sequence
  Description of Artificial Sequence: Synthetic oligonucleotide
ggggccgggtgaacaactactgcaga

SEQ ID NO: 65853 - DNA, 27 bp, Artificial Sequence
  Description of Artificial Sequence: Synthetic oligonucleotide
gggccgggtgaacaactactgcagaca

SEQ ID NO: 65854 - DNA, 27 bp, Artificial Sequence
  Description of Artificial Sequence: Synthetic oligonucleotide
ggccgggtgaacaactactgcagacac

SEQ ID NO: 65855 - DNA, 29 bp, Artificial Sequence
  Description of Artificial Sequence: Synthetic oligonucleotide
gccgggtgaacaactactgcagacacaac

SEQ ID NO: 65856 - DNA, 31 bp, Artificial Sequence
  Description of Artificial Sequence: Synthetic oligonucleotide
ccgggtgaacaactactgcagacacaactac

SEQ ID NO: 65857 - DNA, 31 bp, Artificial Sequence
  Description of Artificial Sequence: Synthetic oligonucleotide
cgggtgaacaactactgcagacacaactacg

SEQ ID NO: 65858 - DNA, 31 bp, Artificial Sequence
  Description of Artificial Sequence: Synthetic oligonucleotide
gggtgaacaactactgcagacacaactacgg

SEQ ID NO: 65859 - DNA, 31 bp, Artificial Sequence
  Description of Artificial Sequence: Synthetic oligonucleotide
ggtgaacaactactgcagacacaactacggg

SEQ ID NO: 65860 - DNA, 31 bp, Artificial Sequence
  Description of Artificial Sequence: Synthetic oligonucleotide
gtgaacaactactgcagacacaactacgggg

SEQ ID NO: 65861 - DNA, 33 bp, Artificial Sequence
  Description of Artificial Sequence: Synthetic oligonucleotide
tgaacaactactgcagacacaactacggggttg

SEQ ID NO: 65862 - DNA, 32 bp, Artificial Sequence
  Description of Artificial Sequence: Synthetic oligonucleotide
gaacaactactgcagacacaactacggggttg

SEQ ID NO: 65863 - DNA, 33 bp, Artificial Sequence
  Description of Artificial Sequence: Synthetic oligonucleotide
aacaactactgcagacacaactacggggttgtg

SEQ ID NO: 65864 - DNA, 37 bp, Artificial Sequence
  Description of Artificial Sequence: Synthetic oligonucleotide
acgtttcttggagtactctacgtctgagtgtcaattc

SEQ ID NO: 65865 - DNA, 36 bp, Artificial Sequence
  Description of Artificial Sequence: Synthetic oligonucleotide
cgtttcttggagtactctacgtctgagtgtcaattc

SEQ ID NO: 65866 - DNA, 38 bp, Artificial Sequence
  Description of Artificial Sequence: Synthetic oligonucleotide
gtttcttggagtactctacgtctgagtgtcaattcttc

SEQ ID NO: 65867 - DNA, 41 bp, Artificial Sequence
  Description of Artificial Sequence: Synthetic oligonucleotide
tttcttggagtactctacgtctgagtgtcaattcttcaatg

SEQ ID NO: 65868 - DNA, 40 bp, Artificial Sequence
  Description of Artificial Sequence: Synthetic oligonucleotide
ttcttggagtactctacgtctgagtgtcaattcttcaatg

SEQ ID NO: 65869 - DNA, 39 bp, Artificial Sequence
  Description of Artificial Sequence: Synthetic oligonucleotide
tcttggagtactctacgtctgagtgtcaattcttcaatg

SEQ ID NO: 65870 - DNA, 38 bp, Artificial Sequence
  Description of Artificial Sequence: Synthetic oligonucleotide
cttggagtactctacgtctgagtgtcaattcttcaatg

SEQ ID NO: 65871 - DNA, 38 bp, Artificial Sequence
  Description of Artificial Sequence: Synthetic oligonucleotide
ttggagtactctacgtctgagtgtcaattcttcaatgg

SEQ ID NO: 65872 - DNA, 37 bp, Artificial Sequence
  Description of Artificial Sequence: Synthetic oligonucleotide
tggagtactctacgtctgagtgtcaattcttcaatgg

SEQ ID NO: 65873 - DNA, 36 bp, Artificial Sequence
  Description of Artificial Sequence: Synthetic oligonucleotide
ggagtactctacgtctgagtgtcaattcttcaatgg

SEQ ID NO: 65874 - DNA, 36 bp, Artificial Sequence
  Description of Artificial Sequence: Synthetic oligonucleotide
gagtactctacgtctgagtgtcaattcttcaatggg

SEQ ID NO: 65875 - DNA, 37 bp, Artificial Sequence
  Description of Artificial Sequence: Synthetic oligonucleotide
agtactctacgtctgagtgtcaattcttcaatgggac

SEQ ID NO: 65876 - DNA, 36 bp, Artificial Sequence
  Description of Artificial Sequence: Synthetic oligonucleotide
gtactctacgtctgagtgtcaattcttcaatgggac

SEQ ID NO: 65877 - DNA, 36 bp, Artificial Sequence
  Description of Artificial Sequence: Synthetic oligonucleotide
tactctacgtctgagtgtcaattcttcaatgggacg

SEQ ID NO: 65878 - DNA, 35 bp, Artificial Sequence
  Description of Artificial Sequence: Synthetic oligonucleotide
actctacgtctgagtgtcaattcttcaatgggacg

SEQ ID NO: 65879 - DNA, 34 bp, Artificial Sequence
  Description of Artificial Sequence: Synthetic oligonucleotide
ctctacgtctgagtgtcaattcttcaatgggacg

SEQ ID NO: 65880 - DNA, 34 bp, Artificial Sequence
  Description of Artificial Sequence: Synthetic oligonucleotide
tctacgtctgagtgtcaattcttcaatgggacgg

SEQ ID NO: 65881 - DNA, 33 bp, Artificial Sequence
  Description of Artificial Sequence: Synthetic oligonucleotide
ctacgtctgagtgtcaattcttcaatgggacgg

SEQ ID NO: 65882 - DNA, 34 bp, Artificial Sequence
  Description of Artificial Sequence: Synthetic oligonucleotide
tacgtctgagtgtcaattcttcaatgggacggag

SEQ ID NO: 65883 - DNA, 33 bp, Artificial Sequence
  Description of Artificial Sequence: Synthetic oligonucleotide
acgtctgagtgtcaattcttcaatgggacggag

SEQ ID NO: 65884 - DNA, 32 bp, Artificial Sequence
  Description of Artificial Sequence: Synthetic oligonucleotide
cgtctgagtgtcaattcttcaatgggacggag

SEQ ID NO: 65885 - DNA, 32 bp, Artificial Sequence
  Description of Artificial Sequence: Synthetic oligonucleotide
gtctgagtgtcaattcttcaatgggacggagc

SEQ ID NO: 65886 - DNA, 32 bp, Artificial Sequence
  Description of Artificial Sequence: Synthetic oligonucleotide
tctgagtgtcaattcttcaatgggacggagcg

SEQ ID NO: 65887 - DNA, 31 bp, Artificial Sequence
  Description of Artificial Sequence: Synthetic oligonucleotide
ctgagtgtcaattcttcaatgggacggagcg

SEQ ID NO: 65888 - DNA, 31 bp, Artificial Sequence
  Description of Artificial Sequence: Synthetic oligonucleotide
tgagtgtcaattcttcaatgggacggagcgg

SEQ ID NO: 65889 - DNA, 30 bp, Artificial Sequence
  Description of Artificial Sequence: Synthetic oligonucleotide
gagtgtcaattcttcaatgggacggagcgg

SEQ ID NO: 65890 - DNA, 30 bp, Artificial Sequence
  Description of Artificial Sequence: Synthetic oligonucleotide
agtgtcaattcttcaatgggacggagcggg

SEQ ID NO: 65891 - DNA, 29 bp, Artificial Sequence
  Description of Artificial Sequence: Synthetic oligonucleotide
gtgtcaattcttcaatgggacggagcggg

SEQ ID NO: 65892 - DNA, 30 bp, Artificial Sequence
  Description of Artificial Sequence: Synthetic oligonucleotide
tgtcaattcttcaatgggacggagcgggtg

SEQ ID NO: 65893 - DNA, 29 bp, Artificial Sequence
  Description of Artificial Sequence: Synthetic oligonucleotide
gtcaattcttcaatgggacggagcgggtg

SEQ ID NO: 65894 - DNA, 29 bp, Artificial Sequence
  Description of Artificial Sequence: Synthetic oligonucleotide
tcaattcttcaatgggacggagcgggtgc

SEQ ID NO: 65895 - DNA, 28 bp, Artificial Sequence
  Description of Artificial Sequence: Synthetic oligonucleotide
caattcttcaatgggacggagcgggtgc

SEQ ID NO: 65896 - DNA, 28 bp, Artificial Sequence
  Description of Artificial Sequence: Synthetic oligonucleotide
aattcttcaatgggacggagcgggtgcg

SEQ ID NO: 65897 - DNA, 27 bp, Artificial Sequence
  Description of Artificial Sequence: Synthetic oligonucleotide
attcttcaatgggacggagcgggtgcg

SEQ ID NO: 65898 - DNA, 32 bp, Artificial Sequence
  Description of Artificial Sequence: Synthetic oligonucleotide
ggtgcggtacctggacagatacttccataaac

SEQ ID NO: 65899 - DNA, 33 bp, Artificial Sequence
  Description of Artificial Sequence: Synthetic oligonucleotide
gtgcggtacctggacagatacttccataaacag

SEQ ID NO: 65900 - DNA, 33 bp, Artificial Sequence
  Description of Artificial Sequence: Synthetic oligonucleotide
tgcggtacctggacagatacttccataaacagg

SEQ ID NO: 65901 - DNA, 32 bp, Artificial Sequence
  Description of Artificial Sequence: Synthetic oligonucleotide
gcggtacctggacagatacttccataaacagg

SEQ ID NO: 65902 - DNA, 33 bp, Artificial Sequence
  Description of Artificial Sequence: Synthetic oligonucleotide
cggtacctggacagatacttccataaacaggag

SEQ ID NO: 65903 - DNA, 33 bp, Artificial Sequence
  Description of Artificial Sequence: Synthetic oligonucleotide
ggtacctggacagatacttccataaacaggagg

SEQ ID NO: 65904 - DNA, 34 bp, Artificial Sequence
  Description of Artificial Sequence: Synthetic oligonucleotide
gtacctggacagatacttccataaacaggaggag

SEQ ID NO: 65905 - DNA, 36 bp, Artificial Sequence
  Description of Artificial Sequence: Synthetic oligonucleotide
tacctggacagatacttccataaacaggaggagaac

SEQ ID NO: 65906 - DNA, 35 bp, Artificial Sequence
  Description of Artificial Sequence: Synthetic oligonucleotide
acctggacagatacttccataaacaggaggagaac

SEQ ID NO: 65907 - DNA, 34 bp, Artificial Sequence
  Description of Artificial Sequence: Synthetic oligonucleotide
cctggacagatacttccataaacaggaggagaac

SEQ ID NO: 65908 - DNA, 34 bp, Artificial Sequence
  Description of Artificial Sequence: Synthetic oligonucleotide
ctggacagatacttccataaacaggaggagaacg

SEQ ID NO: 65909 - DNA, 35 bp, Artificial Sequence
  Description of Artificial Sequence: Synthetic oligonucleotide
tggacagatacttccataaacaggaggagaacgtg

SEQ ID NO: 65910 - DNA, 34 bp, Artificial Sequence
  Description of Artificial Sequence: Synthetic oligonucleotide
ggacagatacttccataaacaggaggagaacgtg

SEQ ID NO: 65911 - DNA, 34 bp, Artificial Sequence
  Description of Artificial Sequence: Synthetic oligonucleotide
gacagatacttccataaacaggaggagaacgtgc

SEQ ID NO: 65912 - DNA, 34 bp, Artificial Sequence
  Description of Artificial Sequence: Synthetic oligonucleotide
acagatacttccataaacaggaggagaacgtgcg

SEQ ID NO: 65913 - DNA, 33 bp, Artificial Sequence
  Description of Artificial Sequence: Synthetic oligonucleotide
cagatacttccataaacaggaggagaacgtgcg

SEQ ID NO: 65914 - DNA, 33 bp, Artificial Sequence
  Description of Artificial Sequence: Synthetic oligonucleotide
agatacttccataaacaggaggagaacgtgcgc

SEQ ID NO: 65915 - DNA, 32 bp, Artificial Sequence
  Description of Artificial Sequence: Synthetic oligonucleotide
gatacttccataaacaggaggagaacgtgcgc

SEQ ID NO: 65916 - DNA, 34 bp, Artificial Sequence
  Description of Artificial Sequence: Synthetic oligonucleotide
atacttccataaacaggaggagaacgtgcgcttc

SEQ ID NO: 65917 - DNA, 33 bp, Artificial Sequence
  Description of Artificial Sequence: Synthetic oligonucleotide
tacttccataaacaggaggagaacgtgcgcttc

SEQ ID NO: 65918 - DNA, 32 bp, Artificial Sequence
  Description of Artificial Sequence: Synthetic oligonucleotide
acttccataaacaggaggagaacgtgcgcttc

SEQ ID NO: 65919 - DNA, 31 bp, Artificial Sequence
  Description of Artificial Sequence: Synthetic oligonucleotide
cttccataaacaggaggagaacgtgcgcttc

SEQ ID NO: 65920 - DNA, 31 bp, Artificial Sequence
  Description of Artificial Sequence: Synthetic oligonucleotide
ttccataaacaggaggagaacgtgcgcttcg

SEQ ID NO: 65921 - DNA, 30 bp, Artificial Sequence
  Description of Artificial Sequence: Synthetic oligonucleotide
tccataaacaggaggagaacgtgcgcttcg

SEQ ID NO: 65922 - DNA, 29 bp, Artificial Sequence
  Description of Artificial Sequence: Synthetic oligonucleotide
ccataaacaggaggagaacgtgcgcttcg

SEQ ID NO: 65923 - DNA, 30 bp, Artificial Sequence
  Description of Artificial Sequence: Synthetic oligonucleotide
cataaacaggaggagaacgtgcgcttcgac

SEQ ID NO: 65924 - DNA, 31 bp, Artificial Sequence
  Description of Artificial Sequence: Synthetic oligonucleotide
ataaacaggaggagaacgtgcgcttcgacag

SEQ ID NO: 65925 - DNA, 30 bp, Artificial Sequence
  Description of Artificial Sequence: Synthetic oligonucleotide
taaacaggaggagaacgtgcgcttcgacag

SEQ ID NO: 65926 - DNA, 29 bp, Artificial Sequence
  Description of Artificial Sequence: Synthetic oligonucleotide
aaacaggaggagaacgtgcgcttcgacag

SEQ ID NO: 65927 - DNA, 28 bp, Artificial Sequence
  Description of Artificial Sequence: Synthetic oligonucleotide
aacaggaggagaacgtgcgcttcgacag

SEQ ID NO: 65928 - DNA, 27 bp, Artificial Sequence
  Description of Artificial Sequence: Synthetic oligonucleotide
acaggaggagaacgtgcgcttcgacag

SEQ ID NO: 65929 - DNA, 22 bp, Artificial Sequence
  Description of Artificial Sequence: Synthetic oligonucleotide
tgggggagttccgggcggtgag

SEQ ID NO: 65930 - DNA, 21 bp, Artificial Sequence
  Description of Artificial Sequence: Synthetic oligonucleotide
gggggagttccgggcggtgag

SEQ ID NO: 65931 - DNA, 21 bp, Artificial Sequence
  Description of Artificial Sequence: Synthetic oligonucleotide
ggggagttccgggcggtgagg

SEQ ID NO: 65932 - DNA, 22 bp, Artificial Sequence
  Description of Artificial Sequence: Synthetic oligonucleotide
gggagttccgggcggtgaggga

SEQ ID NO: 65933 - DNA, 22 bp, Artificial Sequence
  Description of Artificial Sequence: Synthetic oligonucleotide
ggagttccgggcggtgagggag

SEQ ID NO: 65934 - DNA, 23 bp, Artificial Sequence
  Description of Artificial Sequence: Synthetic oligonucleotide
gagttccgggcggtgagggagct

SEQ ID NO: 65935 - DNA, 23 bp, Artificial Sequence
  Description of Artificial Sequence: Synthetic oligonucleotide
agttccgggcggtgagggagctg

SEQ ID NO: 65936 - DNA, 22 bp, Artificial Sequence
  Description of Artificial Sequence: Synthetic oligonucleotide
gttccgggcggtgagggagctg

SEQ ID NO: 65937 - DNA, 22 bp, Artificial Sequence
  Description of Artificial Sequence: Synthetic oligonucleotide
ttccgggcggtgagggagctgg

SEQ ID NO: 65938 - DNA, 21 bp, Artificial Sequence
  Description of Artificial Sequence: Synthetic oligonucleotide
tccgggcggtgagggagctgg

SEQ ID NO: 65939 - DNA, 22 bp, Artificial Sequence
  Description of Artificial Sequence: Synthetic oligonucleotide
tgacggagctggggcggcctgt

SEQ ID NO: 65940 - DNA, 21 bp, Artificial Sequence
  Description of Artificial Sequence: Synthetic oligonucleotide
gacggagctggggcggcctgt

SEQ ID NO: 65941 - DNA, 21 bp, Artificial Sequence
  Description of Artificial Sequence: Synthetic oligonucleotide
acggagctggggcggcctgtc

SEQ ID NO: 65942 - DNA, 20 bp, Artificial Sequence
  Description of Artificial Sequence: Synthetic oligonucleotide
cggagctggggcggcctgtc

SEQ ID NO: 65943 - DNA, 20 bp, Artificial Sequence
  Description of Artificial Sequence: Synthetic oligonucleotide
ggagctggggcggcctgtcg

SEQ ID NO: 65944 - DNA, 20 bp, Artificial Sequence
  Description of Artificial Sequence: Synthetic oligonucleotide
gagctggggcggcctgtcgc

SEQ ID NO: 65945 - DNA, 20 bp, Artificial Sequence
  Description of Artificial Sequence: Synthetic oligonucleotide
agctggggcggcctgtcgcc

SEQ ID NO: 65946 - DNA, 20 bp, Artificial Sequence
  Description of Artificial Sequence: Synthetic oligonucleotide
gctggggcggcctgtcgcct

SEQ ID NO: 65947 - DNA, 20 bp, Artificial Sequence
  Description of Artificial Sequence: Synthetic oligonucleotide
ctggggcggcctgtcgccga

SEQ ID NO: 65948 - DNA, 21 bp, Artificial Sequence
  Description of Artificial Sequence: Synthetic oligonucleotide
tggggcggcctgtcgccgagt

SEQ ID NO: 65949 - DNA, 20 bp, Artificial Sequence
  Description of Artificial Sequence: Synthetic oligonucleotide
ggggcggcctgtcgccgagt

SEQ ID NO: 65950 - DNA, 20 bp, Artificial Sequence
  Description of Artificial Sequence: Synthetic oligonucleotide
gggcggcctgtcgccgagtc

SEQ ID NO: 65951 - DNA, 21 bp, Artificial Sequence
  Description of Artificial Sequence: Synthetic oligonucleotide
ggcggcctgtcgccgagtcct

SEQ ID NO: 65952 - DNA, 21 bp, Artificial Sequence
  Description of Artificial Sequence: Synthetic oligonucleotide
gcggcctgtcgccgagtcctg

SEQ ID NO: 65953 - DNA, 23 bp, Artificial Sequence
  Description of Artificial Sequence: Synthetic oligonucleotide
cggcctgtcgccgagtcctggaa

SEQ ID NO: 65954 - DNA, 24 bp, Artificial Sequence
  Description of Artificial Sequence: Synthetic oligonucleotide
ggcctgtcgccgagtcctggaaca

SEQ ID NO: 65955 - DNA, 24 bp, Artificial Sequence
  Description of Artificial Sequence: Synthetic oligonucleotide
gcctgtcgccgagtcctggaacag

SEQ ID NO: 65956 - DNA, 24 bp, Artificial Sequence
  Description of Artificial Sequence: Synthetic oligonucleotide
cctgtcgccgagtcctggaacagc

SEQ ID NO: 65957 - DNA, 25 bp, Artificial Sequence
  Description of Artificial Sequence: Synthetic oligonucleotide
ctgtcgccgagtcctggaacagcca

SEQ ID NO: 65958 - DNA, 27 bp, Artificial Sequence
  Description of Artificial Sequence: Synthetic oligonucleotide
tgtcgccgagtcctggaacagccagaa

SEQ ID NO: 65959 - DNA, 26 bp, Artificial Sequence
  Description of Artificial Sequence: Synthetic oligonucleotide
gtcgccgagtcctggaacagccagaa

SEQ ID NO: 65960 - DNA, 26 bp, Artificial Sequence
  Description of Artificial Sequence: Synthetic oligonucleotide
tcgccgagtcctggaacagccagaag

SEQ ID NO: 65961 - DNA, 25 bp, Artificial Sequence
  Description of Artificial Sequence: Synthetic oligonucleotide
cgccgagtcctggaacagccagaag

SEQ ID NO: 65962 - DNA, 21 bp, Artificial Sequence
  Description of Artificial Sequence: Synthetic oligonucleotide
ggacggagcgggtgcggtacc

SEQ ID NO: 65963 - DNA, 21 bp, Artificial Sequence
  Description of Artificial Sequence: Synthetic oligonucleotide
gacggagcgggtgcggtaccg

SEQ ID NO: 65964 - DNA, 21 bp, Artificial Sequence
  Description of Artificial Sequence: Synthetic oligonucleotide
acggagcgggtgcggtaccgg

SEQ ID NO: 65965 - DNA, 20 bp, Artificial Sequence
  Description of Artificial Sequence: Synthetic oligonucleotide
cggagcgggtgcggtaccgg

SEQ ID NO: 65966 - DNA, 21 bp, Artificial Sequence
  Description of Artificial Sequence: Synthetic oligonucleotide
ggagcgggtgcggtaccggga

SEQ ID NO: 65967 - DNA, 22 bp, Artificial Sequence
  Description of Artificial Sequence: Synthetic oligonucleotide
gagcgggtgcggtaccgggaca

SEQ ID NO: 65968 - DNA, 25 bp, Artificial Sequence
  Description of Artificial Sequence: Synthetic oligonucleotide
agcgggtgcggtaccgggacagata

SEQ ID NO: 65969 - DNA, 24 bp, Artificial Sequence
  Description of Artificial Sequence: Synthetic oligonucleotide
gcgggtgcggtaccgggacagata

SEQ ID NO: 65970 - DNA, 26 bp, Artificial Sequence
  Description of Artificial Sequence: Synthetic oligonucleotide
cgggtgcggtaccgggacagatactt

SEQ ID NO: 65971 - DNA, 26 bp, Artificial Sequence
  Description of Artificial Sequence: Synthetic oligonucleotide
gggtgcggtaccgggacagatacttc

SEQ ID NO: 65972 - DNA, 27 bp, Artificial Sequence
  Description of Artificial Sequence: Synthetic oligonucleotide
ggtgcggtaccgggacagatacttcca

SEQ ID NO: 65973 - DNA, 30 bp, Artificial Sequence
  Description of Artificial Sequence: Synthetic oligonucleotide
gtgcggtaccgggacagatacttccataac

SEQ ID NO: 65974 - DNA, 30 bp, Artificial Sequence
  Description of Artificial Sequence: Synthetic oligonucleotide
tgcggtaccgggacagatacttccataacc

SEQ ID NO: 65975 - DNA, 29 bp, Artificial Sequence
  Description of Artificial Sequence: Synthetic oligonucleotide
gcggtaccgggacagatacttccataacc

SEQ ID NO: 65976 - DNA, 30 bp, Artificial Sequence
  Description of Artificial Sequence: Synthetic oligonucleotide
cggtaccgggacagatacttccataaccag

SEQ ID NO: 65977 - DNA, 30 bp, Artificial Sequence
  Description of Artificial Sequence: Synthetic oligonucleotide
ggtaccgggacagatacttccataaccagg

SEQ ID NO: 65978 - DNA, 31 bp, Artificial Sequence
  Description of Artificial Sequence: Synthetic oligonucleotide
gtaccgggacagatacttccataaccaggag

SEQ ID NO: 65979 - DNA, 31 bp, Artificial Sequence
  Description of Artificial Sequence: Synthetic oligonucleotide
taccgggacagatacttccataaccaggagg

SEQ ID NO: 65980 - DNA, 30 bp, Artificial Sequence
  Description of Artificial Sequence: Synthetic oligonucleotide
accgggacagatacttccataaccaggagg

SEQ ID NO: 65981 - DNA, 29 bp, Artificial Sequence
  Description of Artificial Sequence: Synthetic oligonucleotide
ccgggacagatacttccataaccaggagg

SEQ ID NO: 65982 - DNA, 30 bp, Artificial Sequence
  Description of Artificial Sequence: Synthetic oligonucleotide
cgggacagatacttccataaccaggaggag

SEQ ID NO: 65983 - DNA, 32 bp, Artificial Sequence
  Description of Artificial Sequence: Synthetic oligonucleotide
gggacagatacttccataaccaggaggagaac

SEQ ID NO: 65984 - DNA, 31 bp, Artificial Sequence
  Description of Artificial Sequence: Synthetic oligonucleotide
cacgtttcttggagctgcgtaagtctgagtg

SEQ ID NO: 65985 - DNA, 32 bp, Artificial Sequence
  Description of Artificial Sequence: Synthetic oligonucleotide
acgtttcttggagctgcgtaagtctgagtgtc

SEQ ID NO: 65986 - DNA, 31 bp, Artificial Sequence
  Description of Artificial Sequence: Synthetic oligonucleotide
cgtttcttggagctgcgtaagtctgagtgtc

SEQ ID NO: 65987 - DNA, 35 bp, Artificial Sequence
  Description of Artificial Sequence: Synthetic oligonucleotide
gtttcttggagctgcgtaagtctgagtgtcatttc

SEQ ID NO: 65988 - DNA, 37 bp, Artificial Sequence
  Description of Artificial Sequence: Synthetic oligonucleotide
tttcttggagctgcgtaagtctgagtgtcatttcttc

SEQ ID NO: 65989 - DNA, 36 bp, Artificial Sequence
  Description of Artificial Sequence: Synthetic oligonucleotide
ttcttggagctgcgtaagtctgagtgtcatttcttc

SEQ ID NO: 65990 - DNA, 35 bp, Artificial Sequence
  Description of Artificial Sequence: Synthetic oligonucleotide
tcttggagctgcgtaagtctgagtgtcatttcttc

SEQ ID NO: 65991 - DNA, 34 bp, Artificial Sequence
  Description of Artificial Sequence: Synthetic oligonucleotide
cttggagctgcgtaagtctgagtgtcatttcttc

SEQ ID NO: 65992 - DNA, 37 bp, Artificial Sequence
  Description of Artificial Sequence: Synthetic oligonucleotide
ttggagctgcgtaagtctgagtgtcatttcttcaatg

SEQ ID NO: 65993 - DNA, 36 bp, Artificial Sequence
  Description of Artificial Sequence: Synthetic oligonucleotide
tggagctgcgtaagtctgagtgtcatttcttcaatg

SEQ ID NO: 65994 - DNA, 35 bp, Artificial Sequence
  Description of Artificial Sequence: Synthetic oligonucleotide
ggagctgcgtaagtctgagtgtcatttcttcaatg

SEQ ID NO: 65995 - DNA, 35 bp, Artificial Sequence
  Description of Artificial Sequence: Synthetic oligonucleotide
gagctgcgtaagtctgagtgtcatttcttcaatgg

SEQ ID NO: 65996 - DNA, 35 bp, Artificial Sequence
  Description of Artificial Sequence: Synthetic oligonucleotide
agctgcgtaagtctgagtgtcatttcttcaatggg

SEQ ID NO: 65997 - DNA, 34 bp, Artificial Sequence
  Description of Artificial Sequence: Synthetic oligonucleotide
gctgcgtaagtctgagtgtcatttcttcaatggg

SEQ ID NO: 65998 - DNA, 35 bp, Artificial Sequence
  Description of Artificial Sequence: Synthetic oligonucleotide
ctgcgtaagtctgagtgtcatttcttcaatgggac

SEQ ID NO: 65999 - DNA, 35 bp, Artificial Sequence
  Description of Artificial Sequence: Synthetic oligonucleotide
tgcgtaagtctgagtgtcatttcttcaatgggacg

SEQ ID NO: 66000 - DNA, 34 bp, Artificial Sequence
  Description of Artificial Sequence: Synthetic oligonucleotide
gcgtaagtctgagtgtcatttcttcaatgggacg

SEQ ID NO: 66001 - DNA, 34 bp, Artificial Sequence
  Description of Artificial Sequence: Synthetic oligonucleotide
cgtaagtctgagtgtcatttcttcaatgggacgg

SEQ ID NO: 66002 - DNA, 35 bp, Artificial Sequence
  Description of Artificial Sequence: Synthetic oligonucleotide
gtaagtctgagtgtcatttcttcaatgggacggag

SEQ ID NO: 66003 - DNA, 35 bp, Artificial Sequence
  Description of Artificial Sequence: Synthetic oligonucleotide
taagtctgagtgtcatttcttcaatgggacggagc

SEQ ID NO: 66004 - DNA, 34 bp, Artificial Sequence
  Description of Artificial Sequence: Synthetic oligonucleotide
aagtctgagtgtcatttcttcaatgggacggagc

SEQ ID NO: 66005 - DNA, 33 bp, Artificial Sequence
  Description of Artificial Sequence: Synthetic oligonucleotide
agtctgagtgtcatttcttcaatgggacggagc

SEQ ID NO: 66006 - DNA, 33 bp, Artificial Sequence
  Description of Artificial Sequence: Synthetic oligonucleotide
tggacagatacttccataaccaggaggagttcc

SEQ ID NO: 66007 - DNA, 32 bp, Artificial Sequence
  Description of Artificial Sequence: Synthetic oligonucleotide
ggacagatacttccataaccaggaggagttcc

SEQ ID NO: 66008 - DNA, 33 bp, Artificial Sequence
  Description of Artificial Sequence: Synthetic oligonucleotide
gacagatacttccataaccaggaggagttcctg

SEQ ID NO: 66009 - DNA, 33 bp, Artificial Sequence
  Description of Artificial Sequence: Synthetic oligonucleotide
acagatacttccataaccaggaggagttcctgc

SEQ ID NO: 66010 - DNA, 32 bp, Artificial Sequence
  Description of Artificial Sequence: Synthetic oligonucleotide
cagatacttccataaccaggaggagttcctgc

SEQ ID NO: 66011 - DNA, 32 bp, Artificial Sequence
  Description of Artificial Sequence: Synthetic oligonucleotide
agatacttccataaccaggaggagttcctgcg

SEQ ID NO: 66012 - DNA, 31 bp, Artificial Sequence
  Description of Artificial Sequence: Synthetic oligonucleotide
gatacttccataaccaggaggagttcctgcg

SEQ ID NO: 66013 - DNA, 31 bp, Artificial Sequence
  Description of Artificial Sequence: Synthetic oligonucleotide
atacttccataaccaggaggagttcctgcgc

SEQ ID NO: 66014 - DNA, 30 bp, Artificial Sequence
  Description of Artificial Sequence: Synthetic oligonucleotide
tacttccataaccaggaggagttcctgcgc

SEQ ID NO: 66015 - DNA, 29 bp, Artificial Sequence
  Description of Artificial Sequence: Synthetic oligonucleotide
acttccataaccaggaggagttcctgcgc

SEQ ID NO: 66016 - DNA, 28 bp, Artificial Sequence
  Description of Artificial Sequence: Synthetic oligonucleotide
cttccataaccaggaggagttcctgcgc

SEQ ID NO: 66017 - DNA, 30 bp, Artificial Sequence
  Description of Artificial Sequence: Synthetic oligonucleotide
ttccataaccaggaggagttcctgcgcttc

SEQ ID NO: 66018 - DNA, 29 bp, Artificial Sequence
  Description of Artificial Sequence: Synthetic oligonucleotide
tccataaccaggaggagttcctgcgcttc

SEQ ID NO: 66019 - DNA, 28 bp, Artificial Sequence
  Description of Artificial Sequence: Synthetic oligonucleotide
ccataaccaggaggagttcctgcgcttc

SEQ ID NO: 66020 - DNA, 28 bp, Artificial Sequence
  Description of Artificial Sequence: Synthetic oligonucleotide
cataaccaggaggagttcctgcgcttcg

SEQ ID NO: 66021 - DNA, 29 bp, Artificial Sequence
  Description of Artificial Sequence: Synthetic oligonucleotide
ataaccaggaggagttcctgcgcttcgac

SEQ ID NO: 66022 - DNA, 28 bp, Artificial Sequence
  Description of Artificial Sequence: Synthetic oligonucleotide
taaccaggaggagttcctgcgcttcgac

SEQ ID NO: 66023 - DNA, 27 bp, Artificial Sequence
  Description of Artificial Sequence: Synthetic oligonucleotide
aaccaggaggagttcctgcgcttcgac

SEQ ID NO: 66024 - DNA, 27 bp, Artificial Sequence
  Description of Artificial Sequence: Synthetic oligonucleotide
accaggaggagttcctgcgcttcgaca

SEQ ID NO: 66025 - DNA, 26 bp, Artificial Sequence
  Description of Artificial Sequence: Synthetic oligonucleotide
ccaggaggagttcctgcgcttcgaca

SEQ ID NO: 66026 - DNA, 26 bp, Artificial Sequence
  Description of Artificial Sequence: Synthetic oligonucleotide
caggaggagttcctgcgcttcgacag

SEQ ID NO: 66027 - DNA, 26 bp, Artificial Sequence
  Description of Artificial Sequence: Synthetic oligonucleotide
aggaggagttcctgcgcttcgacagc

SEQ ID NO: 66028 - DNA, 25 bp, Artificial Sequence
  Description of Artificial Sequence: Synthetic oligonucleotide
ggaggagttcctgcgcttcgacagc

SEQ ID NO: 66029 - DNA, 26 bp, Artificial Sequence
  Description of Artificial Sequence: Synthetic oligonucleotide
gaggagttcctgcgcttcgacagcga

SEQ ID NO: 66030 - DNA, 26 bp, Artificial Sequence
  Description of Artificial Sequence: Synthetic oligonucleotide
aggagttcctgcgcttcgacagcgac

SEQ ID NO: 66031 - DNA, 25 bp, Artificial Sequence
  Description of Artificial Sequence: Synthetic oligonucleotide
ggagttcctgcgcttcgacagcgac

SEQ ID NO: 66032 - DNA, 26 bp, Artificial Sequence
  Description of Artificial Sequence: Synthetic oligonucleotide
gagttcctgcgcttcgacagcgacgt

SEQ ID NO: 66033 - DNA, 26 bp, Artificial Sequence
  Description of Artificial Sequence: Synthetic oligonucleotide
agttcctgcgcttcgacagcgacgtg

SEQ ID NO: 66034 - DNA, 25 bp, Artificial Sequence
  Description of Artificial Sequence: Synthetic oligonucleotide
gttcctgcgcttcgacagcgacgtg

SEQ ID NO: 66035 - DNA, 25 bp, Artificial Sequence
  Description of Artificial Sequence: Synthetic oligonucleotide
ttcctgcgcttcgacagcgacgtgg

SEQ ID NO: 66036 - DNA, 24 bp, Artificial Sequence
  Description of Artificial Sequence: Synthetic oligonucleotide
tcctgcgcttcgacagcgacgtgg

SEQ ID NO: 66037 - DNA, 23 bp, Artificial Sequence
  Description of Artificial Sequence: Synthetic oligonucleotide
cctgcgcttcgacagcgacgtgg

SEQ ID NO: 66038 - DNA, 23 bp, Artificial Sequence
  Description of Artificial Sequence: Synthetic oligonucleotide
ctgcgcttcgacagcgacgtggg

SEQ ID NO: 66039 - DNA, 32 bp, Artificial Sequence
  Description of Artificial Sequence: Synthetic oligonucleotide
gacagatacttccataaccaggaggagtacgc

SEQ ID NO: 66040 - DNA, 32 bp, Artificial Sequence
  Description of Artificial Sequence: Synthetic oligonucleotide
acagatacttccataaccaggaggagtacgcg

SEQ ID NO: 66041 - DNA, 31 bp, Artificial Sequence
  Description of Artificial Sequence: Synthetic oligonucleotide
cagatacttccataaccaggaggagtacgcg

SEQ ID NO: 66042 - DNA, 31 bp, Artificial Sequence
  Description of Artificial Sequence: Synthetic oligonucleotide
agatacttccataaccaggaggagtacgcgc

SEQ ID NO: 66043 - DNA, 30 bp, Artificial Sequence
  Description of Artificial Sequence: Synthetic oligonucleotide
gatacttccataaccaggaggagtacgcgc

SEQ ID NO: 66044 - DNA, 30 bp, Artificial Sequence
  Description of Artificial Sequence: Synthetic oligonucleotide
atacttccataaccaggaggagtacgcgcg

SEQ ID NO: 66045 - DNA, 29 bp, Artificial Sequence
  Description of Artificial Sequence: Synthetic oligonucleotide
tacttccataaccaggaggagtacgcgcg

SEQ ID NO: 66046 - DNA, 28 bp, Artificial Sequence
  Description of Artificial Sequence: Synthetic oligonucleotide
acttccataaccaggaggagtacgcgcg

SEQ ID NO: 66047 - DNA, 27 bp, Artificial Sequence
  Description of Artificial Sequence: Synthetic oligonucleotide
cttccataaccaggaggagtacgcgcg

SEQ ID NO: 66048 - DNA, 27 bp, Artificial Sequence
  Description of Artificial Sequence: Synthetic oligonucleotide
ttccataaccaggaggagtacgcgcgc

SEQ ID NO: 66049 - DNA, 27 bp, Artificial Sequence
  Description of Artificial Sequence: Synthetic oligonucleotide
tccataaccaggaggagtacgcgcgct

SEQ ID NO: 66050 - DNA, 27 bp, Artificial Sequence
  Description of Artificial Sequence: Synthetic oligonucleotide
ccataaccaggaggagtacgcgcgctt

SEQ ID NO: 66051 - DNA, 27 bp, Artificial Sequence
  Description of Artificial Sequence: Synthetic oligonucleotide
cataaccaggaggagtacgcgcgcttc

SEQ ID NO: 66052 - DNA, 27 bp, Artificial Sequence
  Description of Artificial Sequence: Synthetic oligonucleotide
ataaccaggaggagtacgcgcgcttcg

SEQ ID NO: 66053 - DNA, 27 bp, Artificial Sequence
  Description of Artificial Sequence: Synthetic oligonucleotide
taaccaggaggagtacgcgcgcttcga

SEQ ID NO: 66054 - DNA, 26 bp, Artificial Sequence
  Description of Artificial Sequence: Synthetic oligonucleotide
aaccaggaggagtacgcgcgcttcga

SEQ ID NO: 66055 - DNA, 25 bp, Artificial Sequence
  Description of Artificial Sequence: Synthetic oligonucleotide
accaggaggagtacgcgcgcttcga

SEQ ID NO: 66056 - DNA, 24 bp, Artificial Sequence
  Description of Artificial Sequence: Synthetic oligonucleotide
ccaggaggagtacgcgcgcttcga

SEQ ID NO: 66057 - DNA, 25 bp, Artificial Sequence
  Description of Artificial Sequence: Synthetic oligonucleotide
caggaggagtacgcgcgcttcgaca

SEQ ID NO: 66058 - DNA, 25 bp, Artificial Sequence
  Description of Artificial Sequence: Synthetic oligonucleotide
aggaggagtacgcgcgcttcgacag

SEQ ID NO: 66059 - DNA, 38 bp, Artificial Sequence
  Description of Artificial Sequence: Synthetic oligonucleotide
agtactctacgtctgagtgtcatttcttcaatgggatg

SEQ ID NO: 66060 - DNA, 37 bp, Artificial Sequence
  Description of Artificial Sequence: Synthetic oligonucleotide
gtactctacgtctgagtgtcatttcttcaatgggatg

SEQ ID NO: 66061 - DNA, 37 bp, Artificial Sequence
  Description of Artificial Sequence: Synthetic oligonucleotide
tactctacgtctgagtgtcatttcttcaatgggatgg

SEQ ID NO: 66062 - DNA, 36 bp, Artificial Sequence
  Description of Artificial Sequence: Synthetic oligonucleotide
actctacgtctgagtgtcatttcttcaatgggatgg

SEQ ID NO: 66063 - DNA, 35 bp, Artificial Sequence
  Description of Artificial Sequence: Synthetic oligonucleotide
ctctacgtctgagtgtcatttcttcaatgggatgg

SEQ ID NO: 66064 - DNA, 36 bp, Artificial Sequence
  Description of Artificial Sequence: Synthetic oligonucleotide
tctacgtctgagtgtcatttcttcaatgggatggag

SEQ ID NO: 66065 - DNA, 35 bp, Artificial Sequence
  Description of Artificial Sequence: Synthetic oligonucleotide
ctacgtctgagtgtcatttcttcaatgggatggag

SEQ ID NO: 66066 - DNA, 35 bp, Artificial Sequence
  Description of Artificial Sequence: Synthetic oligonucleotide
tacgtctgagtgtcatttcttcaatgggatggagc

SEQ ID NO: 66067 - DNA, 34 bp, Artificial Sequence
  Description of Artificial Sequence: Synthetic oligonucleotide
acgtctgagtgtcatttcttcaatgggatggagc

SEQ ID NO: 66068 - DNA, 33 bp, Artificial Sequence
  Description of Artificial Sequence: Synthetic oligonucleotide
cgtctgagtgtcatttcttcaatgggatggagc

SEQ ID NO: 66069 - DNA, 33 bp, Artificial Sequence
  Description of Artificial Sequence: Synthetic oligonucleotide
gtctgagtgtcatttcttcaatgggatggagcg

SEQ ID NO: 66070 - DNA, 33 bp, Artificial Sequence
  Description of Artificial Sequence: Synthetic oligonucleotide
tctgagtgtcatttcttcaatgggatggagcgg

SEQ ID NO: 66071 - DNA, 32 bp, Artificial Sequence
  Description of Artificial Sequence: Synthetic oligonucleotide
ctgagtgtcatttcttcaatgggatggagcgg

SEQ ID NO: 66072 - DNA, 32 bp, Artificial Sequence
  Description of Artificial Sequence: Synthetic oligonucleotide
tgagtgtcatttcttcaatgggatggagcggg

SEQ ID NO: 66073 - DNA, 31 bp, Artificial Sequence
  Description of Artificial Sequence: Synthetic oligonucleotide
gagtgtcatttcttcaatgggatggagcggg

SEQ ID NO: 66074 - DNA, 32 bp, Artificial Sequence
  Description of Artificial Sequence: Synthetic oligonucleotide
agtgtcatttcttcaatgggatggagcgggtg

SEQ ID NO: 66075 - DNA, 31 bp, Artificial Sequence
  Description of Artificial Sequence: Synthetic oligonucleotide
gtgtcatttcttcaatgggatggagcgggtg

SEQ ID NO: 66076 - DNA, 31 bp, Artificial Sequence
  Description of Artificial Sequence: Synthetic oligonucleotide
tgtcatttcttcaatgggatggagcgggtgc

SEQ ID NO: 66077 - DNA, 30 bp, Artificial Sequence
  Description of Artificial Sequence: Synthetic oligonucleotide
gtcatttcttcaatgggatggagcgggtgc

SEQ ID NO: 66078 - DNA, 30 bp, Artificial Sequence
  Description of Artificial Sequence: Synthetic oligonucleotide
tcatttcttcaatgggatggagcgggtgcg

SEQ ID NO: 66079 - DNA, 29 bp, Artificial Sequence
  Description of Artificial Sequence: Synthetic oligonucleotide
catttcttcaatgggatggagcgggtgcg

SEQ ID NO: 66080 - DNA, 29 bp, Artificial Sequence
  Description of Artificial Sequence: Synthetic oligonucleotide
atttcttcaatgggatggagcgggtgcgg

SEQ ID NO: 66081 - DNA, 28 bp, Artificial Sequence
  Description of Artificial Sequence: Synthetic oligonucleotide
tttcttcaatgggatggagcgggtgcgg

SEQ ID NO: 66082 - DNA, 27 bp, Artificial Sequence
  Description of Artificial Sequence: Synthetic oligonucleotide
ttcttcaatgggatggagcgggtgcgg

SEQ ID NO: 66083 - DNA, 27 bp, Artificial Sequence
  Description of Artificial Sequence: Synthetic oligonucleotide
tcttcaatgggatggagcgggtgcggt

SEQ ID NO: 66084 - DNA, 27 bp, Artificial Sequence
  Description of Artificial Sequence: Synthetic oligonucleotide
cttcaatgggatggagcgggtgcggta

SEQ ID NO: 66085 - DNA, 27 bp, Artificial Sequence
  Description of Artificial Sequence: Synthetic oligonucleotide
ttcaatgggatggagcgggtgcggtac

SEQ ID NO: 66086 - DNA, 26 bp, Artificial Sequence
  Description of Artificial Sequence: Synthetic oligonucleotide
tcaatgggatggagcgggtgcggtac

SEQ ID NO: 66087 - DNA, 25 bp, Artificial Sequence
  Description of Artificial Sequence: Synthetic oligonucleotide
caatgggatggagcgggtgcggtac

SEQ ID NO: 66088 - DNA, 26 bp, Artificial Sequence
  Description of Artificial Sequence: Synthetic oligonucleotide
aatgggatggagcgggtgcggtacct

SEQ ID NO: 66089 - DNA, 25 bp, Artificial Sequence
  Description of Artificial Sequence: Synthetic oligonucleotide
atgggatggagcgggtgcggtacct

SEQ ID NO: 66090 - DNA, 24 bp, Artificial Sequence
  Description of Artificial Sequence: Synthetic oligonucleotide
tgggatggagcgggtgcggtacct

SEQ ID NO: 66091 - DNA, 23 bp, Artificial Sequence
  Description of Artificial Sequence: Synthetic oligonucleotide
gggatggagcgggtgcggtacct

SEQ ID NO: 66092 - DNA, 23 bp, Artificial Sequence
  Description of Artificial Sequence: Synthetic oligonucleotide
ggatggagcgggtgcggtacctg

SEQ ID NO: 66093 - DNA, 24 bp, Artificial Sequence
  Description of Artificial Sequence: Synthetic oligonucleotide
gatggagcgggtgcggtacctgga

SEQ ID NO: 66094 - DNA, 25 bp, Artificial Sequence
  Description of Artificial Sequence: Synthetic oligonucleotide
atggagcgggtgcggtacctggaca

SEQ ID NO: 66095 - DNA, 24 bp, Artificial Sequence
  Description of Artificial Sequence: Synthetic oligonucleotide
tggagcgggtgcggtacctggaca

SEQ ID NO: 66096 - DNA, 21 bp, Artificial Sequence
  Description of Artificial Sequence: Synthetic oligonucleotide
ggagctggggcggcctgatgg

SEQ ID NO: 66097 - DNA, 21 bp, Artificial Sequence
  Description of Artificial Sequence: Synthetic oligonucleotide
gagctggggcggcctgatggc

SEQ ID NO: 66098 - DNA, 22 bp, Artificial Sequence
  Description of Artificial Sequence: Synthetic oligonucleotide
agctggggcggcctgatggcga

SEQ ID NO: 66099 - DNA, 21 bp, Artificial Sequence
  Description of Artificial Sequence: Synthetic oligonucleotide
gctggggcggcctgatggcga

SEQ ID NO: 66100 - DNA, 23 bp, Artificial Sequence
  Description of Artificial Sequence: Synthetic oligonucleotide
ctggggcggcctgatggcgagta

SEQ ID NO: 66101 - DNA, 24 bp, Artificial Sequence
  Description of Artificial Sequence: Synthetic oligonucleotide
tggggcggcctgatggcgagtact

SEQ ID NO: 66102 - DNA, 23 bp, Artificial Sequence
  Description of Artificial Sequence: Synthetic oligonucleotide
ggggcggcctgatggcgagtact

SEQ ID NO: 66103 - DNA, 23 bp, Artificial Sequence
  Description of Artificial Sequence: Synthetic oligonucleotide
gggcggcctgatggcgagtactg

SEQ ID NO: 66104 - DNA, 25 bp, Artificial Sequence
  Description of Artificial Sequence: Synthetic oligonucleotide
ggcggcctgatggcgagtactggaa

SEQ ID NO: 66105 - DNA, 26 bp, Artificial Sequence
  Description of Artificial Sequence: Synthetic oligonucleotide
gcggcctgatggcgagtactggaaca

SEQ ID NO: 66106 - DNA, 26 bp, Artificial Sequence
  Description of Artificial Sequence: Synthetic oligonucleotide
cggcctgatggcgagtactggaacag

SEQ ID NO: 66107 - DNA, 26 bp, Artificial Sequence
  Description of Artificial Sequence: Synthetic oligonucleotide
ggcctgatggcgagtactggaacagc

SEQ ID NO: 66108 - DNA, 27 bp, Artificial Sequence
  Description of Artificial Sequence: Synthetic oligonucleotide
gcctgatggcgagtactggaacagcca

SEQ ID NO: 66109 - DNA, 27 bp, Artificial Sequence
  Description of Artificial Sequence: Synthetic oligonucleotide
cctgatggcgagtactggaacagccag

SEQ ID NO: 66110 - DNA, 29 bp, Artificial Sequence
  Description of Artificial Sequence: Synthetic oligonucleotide
ctgatggcgagtactggaacagccagaag

SEQ ID NO: 66111 - DNA, 29 bp, Artificial Sequence
  Description of Artificial Sequence: Synthetic oligonucleotide
tgatggcgagtactggaacagccagaagg

SEQ ID NO: 66112 - DNA, 28 bp, Artificial Sequence
  Description of Artificial Sequence: Synthetic oligonucleotide
gatggcgagtactggaacagccagaagg

SEQ ID NO: 66113 - DNA, 29 bp, Artificial Sequence
  Description of Artificial Sequence: Synthetic oligonucleotide
atggcgagtactggaacagccagaaggac

SEQ ID NO: 66114 - DNA, 28 bp, Artificial Sequence
  Description of Artificial Sequence: Synthetic oligonucleotide
tggcgagtactggaacagccagaaggac

SEQ ID NO: 66115 - DNA, 27 bp, Artificial Sequence
  Description of Artificial Sequence: Synthetic oligonucleotide
ggcgagtactggaacagccagaaggac

SEQ ID NO: 66116 - DNA, 27 bp, Artificial Sequence
  Description of Artificial Sequence: Synthetic oligonucleotide
gcgagtactggaacagccagaaggacc

SEQ ID NO: 66117 - DNA, 21 bp, Artificial Sequence
  Description of Artificial Sequence: Synthetic oligonucleotide
gtgacggagctggggcggcgt

SEQ ID NO: 66118 - DNA, 23 bp, Artificial Sequence
  Description of Artificial Sequence: Synthetic oligonucleotide
tgacggagctggggcggcgtgat

SEQ ID NO: 66119 - DNA, 22 bp, Artificial Sequence
  Description of Artificial Sequence: Synthetic oligonucleotide
gacggagctggggcggcgtgat

SEQ ID NO: 66120 - DNA, 22 bp, Artificial Sequence
  Description of Artificial Sequence: Synthetic oligonucleotide
acggagctggggcggcgtgatg

SEQ ID NO: 66121 - DNA, 21 bp, Artificial Sequence
  Description of Artificial Sequence: Synthetic oligonucleotide
cggagctggggcggcgtgatg

SEQ ID NO: 66122 - DNA, 21 bp, Artificial Sequence
  Description of Artificial Sequence: Synthetic oligonucleotide
ggagctggggcggcgtgatgc

SEQ ID NO: 66123 - DNA, 21 bp, Artificial Sequence
  Description of Artificial Sequence: Synthetic oligonucleotide
gagctggggcggcgtgatgcc

SEQ ID NO: 66124 - DNA, 22 bp, Artificial Sequence
  Description of Artificial Sequence: Synthetic oligonucleotide
agctggggcggcgtgatgccga

SEQ ID NO: 66125 - DNA, 21 bp, Artificial Sequence
  Description of Artificial Sequence: Synthetic oligonucleotide
gctggggcggcgtgatgccga

SEQ ID NO: 66126 - DNA, 23 bp, Artificial Sequence
  Description of Artificial Sequence: Synthetic oligonucleotide
ctggggcggcgtgatgccgagta

SEQ ID NO: 66127 - DNA, 24 bp, Artificial Sequence
  Description of Artificial Sequence: Synthetic oligonucleotide
tggggcggcgtgatgccgagtact

SEQ ID NO: 66128 - DNA, 23 bp, Artificial Sequence
  Description of Artificial Sequence: Synthetic oligonucleotide
ggggcggcgtgatgccgagtact

SEQ ID NO: 66129 - DNA, 23 bp, Artificial Sequence
  Description of Artificial Sequence: Synthetic oligonucleotide
gggcggcgtgatgccgagtactg

SEQ ID NO: 66130 - DNA, 25 bp, Artificial Sequence
  Description of Artificial Sequence: Synthetic oligonucleotide
ggcggcgtgatgccgagtactggaa

SEQ ID NO: 66131 - DNA, 26 bp, Artificial Sequence
  Description of Artificial Sequence: Synthetic oligonucleotide
gcggcgtgatgccgagtactggaaca

SEQ ID NO: 66132 - DNA, 26 bp, Artificial Sequence
  Description of Artificial Sequence: Synthetic oligonucleotide
cggcgtgatgccgagtactggaacag

SEQ ID NO: 66133 - DNA, 26 bp, Artificial Sequence
  Description of Artificial Sequence: Synthetic oligonucleotide
ggcgtgatgccgagtactggaacagc

SEQ ID NO: 66134 - DNA, 27 bp, Artificial Sequence
  Description of Artificial Sequence: Synthetic oligonucleotide
gcgtgatgccgagtactggaacagcca

SEQ ID NO: 66135 - DNA, 27 bp, Artificial Sequence
  Description of Artificial Sequence: Synthetic oligonucleotide
cgtgatgccgagtactggaacagccag

SEQ ID NO: 66136 - DNA, 29 bp, Artificial Sequence
  Description of Artificial Sequence: Synthetic oligonucleotide
gtgatgccgagtactggaacagccagaag

SEQ ID NO: 66137 - DNA, 33 bp, Artificial Sequence
  Description of Artificial Sequence: Synthetic oligonucleotide
tggacaactactgcagacacaactacgggattg

SEQ ID NO: 66138 - DNA, 32 bp, Artificial Sequence
  Description of Artificial Sequence: Synthetic oligonucleotide
ggacaactactgcagacacaactacgggattg

SEQ ID NO: 66139 - DNA, 33 bp, Artificial Sequence
  Description of Artificial Sequence: Synthetic oligonucleotide
gacaactactgcagacacaactacgggattgtg

SEQ ID NO: 66140 - DNA, 33 bp, Artificial Sequence
  Description of Artificial Sequence: Synthetic oligonucleotide
acaactactgcagacacaactacgggattgtgg

SEQ ID NO: 66141 - DNA, 32 bp, Artificial Sequence
  Description of Artificial Sequence: Synthetic oligonucleotide
caactactgcagacacaactacgggattgtgg

SEQ ID NO: 66142 - DNA, 33 bp, Artificial Sequence
  Description of Artificial Sequence: Synthetic oligonucleotide
aactactgcagacacaactacgggattgtggag

SEQ ID NO: 66143 - DNA, 32 bp, Artificial Sequence
  Description of Artificial Sequence: Synthetic oligonucleotide
actactgcagacacaactacgggattgtggag

SEQ ID NO: 66144 - DNA, 31 bp, Artificial Sequence
  Description of Artificial Sequence: Synthetic oligonucleotide
ctactgcagacacaactacgggattgtggag

SEQ ID NO: 66145 - DNA, 32 bp, Artificial Sequence
  Description of Artificial Sequence: Synthetic oligonucleotide
tactgcagacacaactacgggattgtggagag

SEQ ID NO: 66146 - DNA, 31 bp, Artificial Sequence
  Description of Artificial Sequence: Synthetic oligonucleotide
actgcagacacaactacgggattgtggagag

SEQ ID NO: 66147 - DNA, 30 bp, Artificial Sequence
  Description of Artificial Sequence: Synthetic oligonucleotide
ctgcagacacaactacgggattgtggagag

SEQ ID NO: 66148 - DNA, 30 bp, Artificial Sequence
  Description of Artificial Sequence: Synthetic oligonucleotide
tgcagacacaactacgggattgtggagagc

SEQ ID NO: 66149 - DNA, 29 bp, Artificial Sequence
  Description of Artificial Sequence: Synthetic oligonucleotide
gcagacacaactacgggattgtggagagc

SEQ ID NO: 66150 - DNA, 31 bp, Artificial Sequence
  Description of Artificial Sequence: Synthetic oligonucleotide
cagacacaactacgggattgtggagagcttc

SEQ ID NO: 66151 - DNA, 32 bp, Artificial Sequence
  Description of Artificial Sequence: Synthetic oligonucleotide
agacacaactacgggattgtggagagcttcac

SEQ ID NO: 66152 - DNA, 31 bp, Artificial Sequence
  Description of Artificial Sequence: Synthetic oligonucleotide
gacacaactacgggattgtggagagcttcac

SEQ ID NO: 66153 - DNA, 32 bp, Artificial Sequence
  Description of Artificial Sequence: Synthetic oligonucleotide
acacaactacgggattgtggagagcttcacag

SEQ ID NO: 66154 - DNA, 31 bp, Artificial Sequence
  Description of Artificial Sequence: Synthetic oligonucleotide
cacaactacgggattgtggagagcttcacag

SEQ ID NO: 66155 - DNA, 32 bp, Artificial Sequence
  Description of Artificial Sequence: Synthetic oligonucleotide
acaactacgggattgtggagagcttcacagtg

SEQ ID NO: 66156 - DNA, 31 bp, Artificial Sequence
  Description of Artificial Sequence: Synthetic oligonucleotide
caactacgggattgtggagagcttcacagtg

SEQ ID NO: 66157 - DNA, 31 bp, Artificial Sequence
  Description of Artificial Sequence: Synthetic oligonucleotide
aactacgggattgtggagagcttcacagtgc

SEQ ID NO: 66158 - DNA, 30 bp, Artificial Sequence
  Description of Artificial Sequence: Synthetic oligonucleotide
actacgggattgtggagagcttcacagtgc

SEQ ID NO: 66159 - DNA, 29 bp, Artificial Sequence
  Description of Artificial Sequence: Synthetic oligonucleotide
ctacgggattgtggagagcttcacagtgc

SEQ ID NO: 66160 - DNA, 30 bp, Artificial Sequence
  Description of Artificial Sequence: Synthetic oligonucleotide
tacgggattgtggagagcttcacagtgcag

SEQ ID NO: 66161 - DNA, 29 bp, Artificial Sequence
  Description of Artificial Sequence: Synthetic oligonucleotide
acgggattgtggagagcttcacagtgcag

SEQ ID NO: 66162 - DNA, 28 bp, Artificial Sequence
  Description of Artificial Sequence: Synthetic oligonucleotide
cgggattgtggagagcttcacagtgcag

SEQ ID NO: 66163 - DNA, 28 bp, Artificial Sequence
  Description of Artificial Sequence: Synthetic oligonucleotide
gggattgtggagagcttcacagtgcagc

SEQ ID NO: 66164 - DNA, 28 bp, Artificial Sequence
  Description of Artificial Sequence: Synthetic oligonucleotide
ggattgtggagagcttcacagtgcagcg

SEQ ID NO: 66165 - DNA, 28 bp, Artificial Sequence
  Description of Artificial Sequence: Synthetic oligonucleotide
gattgtggagagcttcacagtgcagcgg

SEQ ID NO: 66166 - DNA, 28 bp, Artificial Sequence
  Description of Artificial Sequence: Synthetic oligonucleotide
attgtggagagcttcacagtgcagcggc

SEQ ID NO: 66167 - DNA, 30 bp, Artificial Sequence
  Description of Artificial Sequence: Synthetic oligonucleotide
gggtgcggttcctggacagatacttctatc

SEQ ID NO: 66168 - DNA, 31 bp, Artificial Sequence
  Description of Artificial Sequence: Synthetic oligonucleotide
ggtgcggttcctggacagatacttctatcac

SEQ ID NO: 66169 - DNA, 31 bp, Artificial Sequence
  Description of Artificial Sequence: Synthetic oligonucleotide
gtgcggttcctggacagatacttctatcacc

SEQ ID NO: 66170 - DNA, 33 bp, Artificial Sequence
  Description of Artificial Sequence: Synthetic oligonucleotide
tgcggttcctggacagatacttctatcaccaag

SEQ ID NO: 66171 - DNA, 32 bp, Artificial Sequence
  Description of Artificial Sequence: Synthetic oligonucleotide
gcggttcctggacagatacttctatcaccaag

SEQ ID NO: 66172 - DNA, 33 bp, Artificial Sequence
  Description of Artificial Sequence: Synthetic oligonucleotide
cggttcctggacagatacttctatcaccaagag

SEQ ID NO: 66173 - DNA, 33 bp, Artificial Sequence
  Description of Artificial Sequence: Synthetic oligonucleotide
ggttcctggacagatacttctatcaccaagagg

SEQ ID NO: 66174 - DNA, 34 bp, Artificial Sequence
  Description of Artificial Sequence: Synthetic oligonucleotide
gttcctggacagatacttctatcaccaagaggag

SEQ ID NO: 66175 - DNA, 36 bp, Artificial Sequence
  Description of Artificial Sequence: Synthetic oligonucleotide
ttcctggacagatacttctatcaccaagaggagtac

SEQ ID NO: 66176 - DNA, 35 bp, Artificial Sequence
  Description of Artificial Sequence: Synthetic oligonucleotide
tcctggacagatacttctatcaccaagaggagtac

SEQ ID NO: 66177 - DNA, 34 bp, Artificial Sequence
  Description of Artificial Sequence: Synthetic oligonucleotide
cctggacagatacttctatcaccaagaggagtac

SEQ ID NO: 66178 - DNA, 34 bp, Artificial Sequence
  Description of Artificial Sequence: Synthetic oligonucleotide
ctggacagatacttctatcaccaagaggagtacg

SEQ ID NO: 66179 - DNA, 35 bp, Artificial Sequence
  Description of Artificial Sequence: Synthetic oligonucleotide
tggacagatacttctatcaccaagaggagtacgtg

SEQ ID NO: 66180 - DNA, 34 bp, Artificial Sequence
  Description of Artificial Sequence: Synthetic oligonucleotide
ggacagatacttctatcaccaagaggagtacgtg

SEQ ID NO: 66181 - DNA, 34 bp, Artificial Sequence
  Description of Artificial Sequence: Synthetic oligonucleotide
gacagatacttctatcaccaagaggagtacgtgc

SEQ ID NO: 66182 - DNA, 34 bp, Artificial Sequence
  Description of Artificial Sequence: Synthetic oligonucleotide
acagatacttctatcaccaagaggagtacgtgcg

SEQ ID NO: 66183 - DNA, 33 bp, Artificial Sequence
  Description of Artificial Sequence: Synthetic oligonucleotide
cagatacttctatcaccaagaggagtacgtgcg

SEQ ID NO: 66184 - DNA, 33 bp, Artificial Sequence
  Description of Artificial Sequence: Synthetic oligonucleotide
agatacttctatcaccaagaggagtacgtgcgc

SEQ ID NO: 66185 - DNA, 32 bp, Artificial Sequence
  Description of Artificial Sequence: Synthetic oligonucleotide
gatacttctatcaccaagaggagtacgtgcgc

SEQ ID NO: 66186 - DNA, 34 bp, Artificial Sequence
  Description of Artificial Sequence: Synthetic oligonucleotide
atacttctatcaccaagaggagtacgtgcgcttc

SEQ ID NO: 66187 - DNA, 33 bp, Artificial Sequence
  Description of Artificial Sequence: Synthetic oligonucleotide
tacttctatcaccaagaggagtacgtgcgcttc

SEQ ID NO: 66188 - DNA, 32 bp, Artificial Sequence
  Description of Artificial Sequence: Synthetic oligonucleotide
acttctatcaccaagaggagtacgtgcgcttc

SEQ ID NO: 66189 - DNA, 31 bp, Artificial Sequence
  Description of Artificial Sequence: Synthetic oligonucleotide
cttctatcaccaagaggagtacgtgcgcttc

SEQ ID NO: 66190 - DNA, 31 bp, Artificial Sequence
  Description of Artificial Sequence: Synthetic oligonucleotide
ttctatcaccaagaggagtacgtgcgcttcg

SEQ ID NO: 66191 - DNA, 30 bp, Artificial Sequence
  Description of Artificial Sequence: Synthetic oligonucleotide
tctatcaccaagaggagtacgtgcgcttcg

SEQ ID NO: 66192 - DNA, 29 bp, Artificial Sequence
  Description of Artificial Sequence: Synthetic oligonucleotide
ctatcaccaagaggagtacgtgcgcttcg

SEQ ID NO: 66193 - DNA, 30 bp, Artificial Sequence
  Description of Artificial Sequence: Synthetic oligonucleotide
tatcaccaagaggagtacgtgcgcttcgac

SEQ ID NO: 66194 - DNA, 29 bp, Artificial Sequence
  Description of Artificial Sequence: Synthetic oligonucleotide
atcaccaagaggagtacgtgcgcttcgac

SEQ ID NO: 66195 - DNA, 28 bp, Artificial Sequence
  Description of Artificial Sequence: Synthetic oligonucleotide
tcaccaagaggagtacgtgcgcttcgac

SEQ ID NO: 66196 - DNA, 27 bp, Artificial Sequence
  Description of Artificial Sequence: Synthetic oligonucleotide
caccaagaggagtacgtgcgcttcgac

SEQ ID NO: 66197 - DNA, 33 bp, Artificial Sequence
  Description of Artificial Sequence: Synthetic oligonucleotide
caggtttcttggagtactctacgtctgagtgtc

SEQ ID NO: 66198 - DNA, 37 bp, Artificial Sequence
  Description of Artificial Sequence: Synthetic oligonucleotide
aggtttcttggagtactctacgtctgagtgtcatttc

SEQ ID NO: 66199 - DNA, 36 bp, Artificial Sequence
  Description of Artificial Sequence: Synthetic oligonucleotide
ggtttcttggagtactctacgtctgagtgtcatttc

SEQ ID NO: 66200 - DNA, 24 bp, Artificial Sequence
  Description of Artificial Sequence: Synthetic oligonucleotide
ggggccgggtggacaactactgga

SEQ ID NO: 66201 - DNA, 25 bp, Artificial Sequence
  Description of Artificial Sequence: Synthetic oligonucleotide
gggccgggtggacaactactggaga

SEQ ID NO: 66202 - DNA, 26 bp, Artificial Sequence
  Description of Artificial Sequence: Synthetic oligonucleotide
ggccgggtggacaactactggagaca

SEQ ID NO: 66203 - DNA, 27 bp, Artificial Sequence
  Description of Artificial Sequence: Synthetic oligonucleotide
gccgggtggacaactactggagacaca

SEQ ID NO: 66204 - DNA, 28 bp, Artificial Sequence
  Description of Artificial Sequence: Synthetic oligonucleotide
ccgggtggacaactactggagacacaac

SEQ ID NO: 66205 - DNA, 30 bp, Artificial Sequence
  Description of Artificial Sequence: Synthetic oligonucleotide
cgggtggacaactactggagacacaactac

SEQ ID NO: 66206 - DNA, 30 bp, Artificial Sequence
  Description of Artificial Sequence: Synthetic oligonucleotide
gggtggacaactactggagacacaactacg

SEQ ID NO: 66207 - DNA, 30 bp, Artificial Sequence
  Description of Artificial Sequence: Synthetic oligonucleotide
ggtggacaactactggagacacaactacgg

SEQ ID NO: 66208 - DNA, 30 bp, Artificial Sequence
  Description of Artificial Sequence: Synthetic oligonucleotide
gtggacaactactggagacacaactacggg

SEQ ID NO: 66209 - DNA, 30 bp, Artificial Sequence
  Description of Artificial Sequence: Synthetic oligonucleotide
tggacaactactggagacacaactacgggg

SEQ ID NO: 66210 - DNA, 29 bp, Artificial Sequence
  Description of Artificial Sequence: Synthetic oligonucleotide
ggacaactactggagacacaactacgggg

SEQ ID NO: 66211 - DNA, 31 bp, Artificial Sequence
  Description of Artificial Sequence: Synthetic oligonucleotide
gacaactactggagacacaactacggggttg

SEQ ID NO: 66212 - DNA, 32 bp, Artificial Sequence
  Description of Artificial Sequence: Synthetic oligonucleotide
acaactactggagacacaactacggggttgtg

SEQ ID NO: 66213 - DNA, 31 bp, Artificial Sequence
  Description of Artificial Sequence: Synthetic oligonucleotide
caactactggagacacaactacggggttgtg

SEQ ID NO: 66214 - DNA, 31 bp, Artificial Sequence
  Description of Artificial Sequence: Synthetic oligonucleotide
aactactggagacacaactacggggttgtgg

SEQ ID NO: 66215 - DNA, 30 bp, Artificial Sequence
  Description of Artificial Sequence: Synthetic oligonucleotide
actactggagacacaactacggggttgtgg

SEQ ID NO: 66216 - DNA, 29 bp, Artificial Sequence
  Description of Artificial Sequence: Synthetic oligonucleotide
ctactggagacacaactacggggttgtgg

SEQ ID NO: 66217 - DNA, 30 bp, Artificial Sequence
  Description of Artificial Sequence: Synthetic oligonucleotide
tactggagacacaactacggggttgtggag

SEQ ID NO: 66218 - DNA, 29 bp, Artificial Sequence
  Description of Artificial Sequence: Synthetic oligonucleotide
actggagacacaactacggggttgtggag

SEQ ID NO: 66219 - DNA, 28 bp, Artificial Sequence
  Description of Artificial Sequence: Synthetic oligonucleotide
ctggagacacaactacggggttgtggag

SEQ ID NO: 66220 - DNA, 29 bp, Artificial Sequence
  Description of Artificial Sequence: Synthetic oligonucleotide
tggagacacaactacggggttgtggagag

SEQ ID NO: 66221 - DNA, 28 bp, Artificial Sequence
  Description of Artificial Sequence: Synthetic oligonucleotide
ggagacacaactacggggttgtggagag

SEQ ID NO: 66222 - DNA, 28 bp, Artificial Sequence
  Description of Artificial Sequence: Synthetic oligonucleotide
gagacacaactacggggttgtggagagc

SEQ ID NO: 66223 - DNA, 32 bp, Artificial Sequence
  Description of Artificial Sequence: Synthetic oligonucleotide
gggtgcggtacctggacagatacttctataac

SEQ ID NO: 66224 - DNA, 32 bp, Artificial Sequence
  Description of Artificial Sequence: Synthetic oligonucleotide
ggtgcggtacctggacagatacttctataacc

SEQ ID NO: 66225 - DNA, 34 bp, Artificial Sequence
  Description of Artificial Sequence: Synthetic oligonucleotide
gtgcggtacctggacagatacttctataaccaag

SEQ ID NO: 66226 - DNA, 35 bp, Artificial Sequence
  Description of Artificial Sequence: Synthetic oligonucleotide
tgcggtacctggacagatacttctataaccaagag

SEQ ID NO: 66227 - DNA, 34 bp, Artificial Sequence
  Description of Artificial Sequence: Synthetic oligonucleotide
gcggtacctggacagatacttctataaccaagag

SEQ ID NO: 66228 - DNA, 34 bp, Artificial Sequence
  Description of Artificial Sequence: Synthetic oligonucleotide
cggtacctggacagatacttctataaccaagagg

SEQ ID NO: 66229 - DNA, 35 bp, Artificial Sequence
  Description of Artificial Sequence: Synthetic oligonucleotide
ggtacctggacagatacttctataaccaagaggag

SEQ ID NO: 66230 - DNA, 37 bp, Artificial Sequence
  Description of Artificial Sequence: Synthetic oligonucleotide
gtacctggacagatacttctataaccaagaggagaac

SEQ ID NO: 66231 - DNA, 37 bp, Artificial Sequence
  Description of Artificial Sequence: Synthetic oligonucleotide
tacctggacagatacttctataaccaagaggagaacg

SEQ ID NO: 66232 - DNA, 36 bp, Artificial Sequence
  Description of Artificial Sequence: Synthetic oligonucleotide
acctggacagatacttctataaccaagaggagaacg

SEQ ID NO: 66233 - DNA, 35 bp, Artificial Sequence
  Description of Artificial Sequence: Synthetic oligonucleotide
cctggacagatacttctataaccaagaggagaacg

SEQ ID NO: 66234 - DNA, 36 bp, Artificial Sequence
  Description of Artificial Sequence: Synthetic oligonucleotide
ctggacagatacttctataaccaagaggagaacgtg

SEQ ID NO: 66235 - DNA, 36 bp, Artificial Sequence
  Description of Artificial Sequence: Synthetic oligonucleotide
tggacagatacttctataaccaagaggagaacgtgc

SEQ ID NO: 66236 - DNA, 35 bp, Artificial Sequence
  Description of Artificial Sequence: Synthetic oligonucleotide
ggacagatacttctataaccaagaggagaacgtgc

SEQ ID NO: 66237 - DNA, 35 bp, Artificial Sequence
  Description of Artificial Sequence: Synthetic oligonucleotide
gacagatacttctataaccaagaggagaacgtgcg

SEQ ID NO: 66238 - DNA, 35 bp, Artificial Sequence
  Description of Artificial Sequence: Synthetic oligonucleotide
acagatacttctataaccaagaggagaacgtgcgc

SEQ ID NO: 66239 - DNA, 34 bp, Artificial Sequence
  Description of Artificial Sequence: Synthetic oligonucleotide
cagatacttctataaccaagaggagaacgtgcgc

SEQ ID NO: 66240 - DNA, 36 bp, Artificial Sequence
  Description of Artificial Sequence: Synthetic oligonucleotide
agatacttctataaccaagaggagaacgtgcgcttc

SEQ ID NO: 66241 - DNA, 35 bp, Artificial Sequence
  Description of Artificial Sequence: Synthetic oligonucleotide
gatacttctataaccaagaggagaacgtgcgcttc

SEQ ID NO: 66242 - DNA, 35 bp, Artificial Sequence
  Description of Artificial Sequence: Synthetic oligonucleotide
atacttctataaccaagaggagaacgtgcgcttcg

SEQ ID NO: 66243 - DNA, 34 bp, Artificial Sequence
  Description of Artificial Sequence: Synthetic oligonucleotide
tacttctataaccaagaggagaacgtgcgcttcg

SEQ ID NO: 66244 - DNA, 33 bp, Artificial Sequence
  Description of Artificial Sequence: Synthetic oligonucleotide
acttctataaccaagaggagaacgtgcgcttcg

SEQ ID NO: 66245 - DNA, 32 bp, Artificial Sequence
  Description of Artificial Sequence: Synthetic oligonucleotide
cttctataaccaagaggagaacgtgcgcttcg

SEQ ID NO: 66246 - DNA, 33 bp, Artificial Sequence
  Description of Artificial Sequence: Synthetic oligonucleotide
ttctataaccaagaggagaacgtgcgcttcgac

SEQ ID NO: 66247 - DNA, 32 bp, Artificial Sequence
  Description of Artificial Sequence: Synthetic oligonucleotide
tctataaccaagaggagaacgtgcgcttcgac

SEQ ID NO: 66248 - DNA, 31 bp, Artificial Sequence
  Description of Artificial Sequence: Synthetic oligonucleotide
ctataaccaagaggagaacgtgcgcttcgac

SEQ ID NO: 66249 - DNA, 32 bp, Artificial Sequence
  Description of Artificial Sequence: Synthetic oligonucleotide
tataaccaagaggagaacgtgcgcttcgacag

SEQ ID NO: 66250 - DNA, 31 bp, Artificial Sequence
  Description of Artificial Sequence: Synthetic oligonucleotide
ataaccaagaggagaacgtgcgcttcgacag

SEQ ID NO: 66251 - DNA, 30 bp, Artificial Sequence
  Description of Artificial Sequence: Synthetic oligonucleotide
taaccaagaggagaacgtgcgcttcgacag

SEQ ID NO: 66252 - DNA, 29 bp, Artificial Sequence
  Description of Artificial Sequence: Synthetic oligonucleotide
aaccaagaggagaacgtgcgcttcgacag

SEQ ID NO: 66253 - DNA, 28 bp, Artificial Sequence
  Description of Artificial Sequence: Synthetic oligonucleotide
accaagaggagaacgtgcgcttcgacag

SEQ ID NO: 66254 - DNA, 27 bp, Artificial Sequence
  Description of Artificial Sequence: Synthetic oligonucleotide
ccaagaggagaacgtgcgcttcgacag

SEQ ID NO: 66255 - DNA, 27 bp, Artificial Sequence
  Description of Artificial Sequence: Synthetic oligonucleotide
caagaggagaacgtgcgcttcgacagc

SEQ ID NO: 66256 - DNA, 27 bp, Artificial Sequence
  Description of Artificial Sequence: Synthetic oligonucleotide
aagaggagaacgtgcgcttcgacagcg

SEQ ID NO: 66257 - DNA, 27 bp, Artificial Sequence
  Description of Artificial Sequence: Synthetic oligonucleotide
agaggagaacgtgcgcttcgacagcga

SEQ ID NO: 66258 - DNA, 22 bp, Artificial Sequence
  Description of Artificial Sequence: Synthetic oligonucleotide
agcgacgtgggggagtaccggc

SEQ ID NO: 66259 - DNA, 21 bp, Artificial Sequence
  Description of Artificial Sequence: Synthetic oligonucleotide
gcgacgtgggggagtaccggc

SEQ ID NO: 66260 - DNA, 21 bp, Artificial Sequence
  Description of Artificial Sequence: Synthetic oligonucleotide
cgacgtgggggagtaccggcc

SEQ ID NO: 66261 - DNA, 21 bp, Artificial Sequence
  Description of Artificial Sequence: Synthetic oligonucleotide
gacgtgggggagtaccggccg

SEQ ID NO: 66262 - DNA, 22 bp, Artificial Sequence
  Description of Artificial Sequence: Synthetic oligonucleotide
acgtgggggagtaccggccggt

SEQ ID NO: 66263 - DNA, 21 bp, Artificial Sequence
  Description of Artificial Sequence: Synthetic oligonucleotide
cgtgggggagtaccggccggt

SEQ ID NO: 66264 - DNA, 22 bp, Artificial Sequence
  Description of Artificial Sequence: Synthetic oligonucleotide
gtgggggagtaccggccggtga

SEQ ID NO: 66265 - DNA, 22 bp, Artificial Sequence
  Description of Artificial Sequence: Synthetic oligonucleotide
tgggggagtaccggccggtgac

SEQ ID NO: 66266 - DNA, 21 bp, Artificial Sequence
  Description of Artificial Sequence: Synthetic oligonucleotide
gggggagtaccggccggtgac

SEQ ID NO: 66267 - DNA, 21 bp, Artificial Sequence
  Description of Artificial Sequence: Synthetic oligonucleotide
ggggagtaccggccggtgacg

SEQ ID NO: 66268 - DNA, 22 bp, Artificial Sequence
  Description of Artificial Sequence: Synthetic oligonucleotide
gggagtaccggccggtgacgga

SEQ ID NO: 66269 - DNA, 22 bp, Artificial Sequence
  Description of Artificial Sequence: Synthetic oligonucleotide
ggagtaccggccggtgacggag

SEQ ID NO: 66270 - DNA, 23 bp, Artificial Sequence
  Description of Artificial Sequence: Synthetic oligonucleotide
gagtaccggccggtgacggagct

SEQ ID NO: 66271 - DNA, 23 bp, Artificial Sequence
  Description of Artificial Sequence: Synthetic oligonucleotide
agtaccggccggtgacggagctg

SEQ ID NO: 66272 - DNA, 22 bp, Artificial Sequence
  Description of Artificial Sequence: Synthetic oligonucleotide
gtaccggccggtgacggagctg

SEQ ID NO: 66273 - DNA, 22 bp, Artificial Sequence
  Description of Artificial Sequence: Synthetic oligonucleotide
taccggccggtgacggagctgg

SEQ ID NO: 66274 - DNA, 21 bp, Artificial Sequence
  Description of Artificial Sequence: Synthetic oligonucleotide
accggccggtgacggagctgg

SEQ ID NO: 66275 - DNA, 20 bp, Artificial Sequence
  Description of Artificial Sequence: Synthetic oligonucleotide
ccggccggtgacggagctgg

SEQ ID NO: 66276 - DNA, 20 bp, Artificial Sequence
  Description of Artificial Sequence: Synthetic oligonucleotide
cggccggtgacggagctggg

SEQ ID NO: 66277 - DNA, 20 bp, Artificial Sequence
  Description of Artificial Sequence: Synthetic oligonucleotide
ggccggtgacggagctgggg

SEQ ID NO: 66278 - DNA, 20 bp, Artificial Sequence
  Description of Artificial Sequence: Synthetic oligonucleotide
gccggtgacggagctggggc

SEQ ID NO: 66279 - DNA, 20 bp, Artificial Sequence
  Description of Artificial Sequence: Synthetic oligonucleotide
ccggtgacggagctggggcg

SEQ ID NO: 66280 - DNA, 29 bp, Artificial Sequence
  Description of Artificial Sequence: Synthetic oligonucleotide
atttcttcaatgggacggagcgggtgcag

SEQ ID NO: 66281 - DNA, 28 bp, Artificial Sequence
  Description of Artificial Sequence: Synthetic oligonucleotide
tttcttcaatgggacggagcgggtgcag

SEQ ID NO: 66282 - DNA, 27 bp, Artificial Sequence
  Description of Artificial Sequence: Synthetic oligonucleotide
ttcttcaatgggacggagcgggtgcag

SEQ ID NO: 66283 - DNA, 27 bp, Artificial Sequence
  Description of Artificial Sequence: Synthetic oligonucleotide
tcttcaatgggacggagcgggtgcagt

SEQ ID NO: 66284 - DNA, 27 bp, Artificial Sequence
  Description of Artificial Sequence: Synthetic oligonucleotide
cttcaatgggacggagcgggtgcagta

SEQ ID NO: 66285 - DNA, 27 bp, Artificial Sequence
  Description of Artificial Sequence: Synthetic oligonucleotide
ttcaatgggacggagcgggtgcagtac

SEQ ID NO: 66286 - DNA, 26 bp, Artificial Sequence
  Description of Artificial Sequence: Synthetic oligonucleotide
tcaatgggacggagcgggtgcagtac

SEQ ID NO: 66287 - DNA, 25 bp, Artificial Sequence
  Description of Artificial Sequence: Synthetic oligonucleotide
caatgggacggagcgggtgcagtac

SEQ ID NO: 66288 - DNA, 26 bp, Artificial Sequence
  Description of Artificial Sequence: Synthetic oligonucleotide
aatgggacggagcgggtgcagtacct

SEQ ID NO: 66289 - DNA, 25 bp, Artificial Sequence
  Description of Artificial Sequence: Synthetic oligonucleotide
atgggacggagcgggtgcagtacct

SEQ ID NO: 66290 - DNA, 24 bp, Artificial Sequence
  Description of Artificial Sequence: Synthetic oligonucleotide
tgggacggagcgggtgcagtacct

SEQ ID NO: 66291 - DNA, 23 bp, Artificial Sequence
  Description of Artificial Sequence: Synthetic oligonucleotide
gggacggagcgggtgcagtacct

SEQ ID NO: 66292 - DNA, 23 bp, Artificial Sequence
  Description of Artificial Sequence: Synthetic oligonucleotide
ggacggagcgggtgcagtacctg

SEQ ID NO: 66293 - DNA, 24 bp, Artificial Sequence
  Description of Artificial Sequence: Synthetic oligonucleotide
gacggagcgggtgcagtacctgga

SEQ ID NO: 66294 - DNA, 25 bp, Artificial Sequence
  Description of Artificial Sequence: Synthetic oligonucleotide
acggagcgggtgcagtacctggaca

SEQ ID NO: 66295 - DNA, 24 bp, Artificial Sequence
  Description of Artificial Sequence: Synthetic oligonucleotide
cggagcgggtgcagtacctggaca

SEQ ID NO: 66296 - DNA, 27 bp, Artificial Sequence
  Description of Artificial Sequence: Synthetic oligonucleotide
ggagcgggtgcagtacctggacagata

SEQ ID NO: 66297 - DNA, 27 bp, Artificial Sequence
  Description of Artificial Sequence: Synthetic oligonucleotide
gagcgggtgcagtacctggacagatac

SEQ ID NO: 66298 - DNA, 29 bp, Artificial Sequence
  Description of Artificial Sequence: Synthetic oligonucleotide
agcgggtgcagtacctggacagatacttc

SEQ ID NO: 66299 - DNA, 28 bp, Artificial Sequence
  Description of Artificial Sequence: Synthetic oligonucleotide
gcgggtgcagtacctggacagatacttc

SEQ ID NO: 66300 - DNA, 28 bp, Artificial Sequence
  Description of Artificial Sequence: Synthetic oligonucleotide
cgggtgcagtacctggacagatacttcc

SEQ ID NO: 66301 - DNA, 32 bp, Artificial Sequence
  Description of Artificial Sequence: Synthetic oligonucleotide
gggtgcagtacctggacagatacttccataac

SEQ ID NO: 66302 - DNA, 32 bp, Artificial Sequence
  Description of Artificial Sequence: Synthetic oligonucleotide
ggtgcagtacctggacagatacttccataacc

SEQ ID NO: 66303 - DNA, 33 bp, Artificial Sequence
  Description of Artificial Sequence: Synthetic oligonucleotide
gtgcagtacctggacagatacttccataaccag

SEQ ID NO: 66304 - DNA, 33 bp, Artificial Sequence
  Description of Artificial Sequence: Synthetic oligonucleotide
tgcagtacctggacagatacttccataaccagg

SEQ ID NO: 66305 - DNA, 32 bp, Artificial Sequence
  Description of Artificial Sequence: Synthetic oligonucleotide
gcagtacctggacagatacttccataaccagg

SEQ ID NO: 66306 - DNA, 33 bp, Artificial Sequence
  Description of Artificial Sequence: Synthetic oligonucleotide
cagtacctggacagatacttccataaccaggag

SEQ ID NO: 66307 - DNA, 33 bp, Artificial Sequence
  Description of Artificial Sequence: Synthetic oligonucleotide
agtacctggacagatacttccataaccaggagg

SEQ ID NO: 66308 - DNA, 26 bp, Artificial Sequence
  Description of Artificial Sequence: Synthetic oligonucleotide
ggggccgggtggacaactactgcata

SEQ ID NO: 66309 - DNA, 27 bp, Artificial Sequence
  Description of Artificial Sequence: Synthetic oligonucleotide
gggccgggtggacaactactgcataca

SEQ ID NO: 66310 - DNA, 27 bp, Artificial Sequence
  Description of Artificial Sequence: Synthetic oligonucleotide
ggccgggtggacaactactgcatacac

SEQ ID NO: 66311 - DNA, 29 bp, Artificial Sequence
  Description of Artificial Sequence: Synthetic oligonucleotide
gccgggtggacaactactgcatacacaac

SEQ ID NO: 66312 - DNA, 31 bp, Artificial Sequence
  Description of Artificial Sequence: Synthetic oligonucleotide
ccgggtggacaactactgcatacacaactac

SEQ ID NO: 66313 - DNA, 31 bp, Artificial Sequence
  Description of Artificial Sequence: Synthetic oligonucleotide
cgggtggacaactactgcatacacaactacg

SEQ ID NO: 66314 - DNA, 31 bp, Artificial Sequence
  Description of Artificial Sequence: Synthetic oligonucleotide
gggtggacaactactgcatacacaactacgg

SEQ ID NO: 66315 - DNA, 31 bp, Artificial Sequence
  Description of Artificial Sequence: Synthetic oligonucleotide
ggtggacaactactgcatacacaactacggg

SEQ ID NO: 66316 - DNA, 31 bp, Artificial Sequence
  Description of Artificial Sequence: Synthetic oligonucleotide
gtggacaactactgcatacacaactacgggg

SEQ ID NO: 66317 - DNA, 33 bp, Artificial Sequence
  Description of Artificial Sequence: Synthetic oligonucleotide
tggacaactactgcatacacaactacggggttg

SEQ ID NO: 66318 - DNA, 32 bp, Artificial Sequence
  Description of Artificial Sequence: Synthetic oligonucleotide
ggacaactactgcatacacaactacggggttg

SEQ ID NO: 66319 - DNA, 33 bp, Artificial Sequence
  Description of Artificial Sequence: Synthetic oligonucleotide
gacaactactgcatacacaactacggggttgtg

SEQ ID NO: 66320 - DNA, 33 bp, Artificial Sequence
  Description of Artificial Sequence: Synthetic oligonucleotide
acaactactgcatacacaactacggggttgtgg

SEQ ID NO: 66321 - DNA, 32 bp, Artificial Sequence
  Description of Artificial Sequence: Synthetic oligonucleotide
caactactgcatacacaactacggggttgtgg

SEQ ID NO: 66322 - DNA, 33 bp, Artificial Sequence
  Description of Artificial Sequence: Synthetic oligonucleotide
aactactgcatacacaactacggggttgtggag

SEQ ID NO: 66323 - DNA, 32 bp, Artificial Sequence
  Description of Artificial Sequence: Synthetic oligonucleotide
actactgcatacacaactacggggttgtggag

SEQ ID NO: 66324 - DNA, 31 bp, Artificial Sequence
  Description of Artificial Sequence: Synthetic oligonucleotide
ctactgcatacacaactacggggttgtggag

SEQ ID NO: 66325 - DNA, 32 bp, Artificial Sequence
  Description of Artificial Sequence: Synthetic oligonucleotide
tactgcatacacaactacggggttgtggagag

SEQ ID NO: 66326 - DNA, 31 bp, Artificial Sequence
  Description of Artificial Sequence: Synthetic oligonucleotide
actgcatacacaactacggggttgtggagag

SEQ ID NO: 66327 - DNA, 30 bp, Artificial Sequence
  Description of Artificial Sequence: Synthetic oligonucleotide
ctgcatacacaactacggggttgtggagag

SEQ ID NO: 66328 - DNA, 30 bp, Artificial Sequence
  Description of Artificial Sequence: Synthetic oligonucleotide
tgcatacacaactacggggttgtggagagc

SEQ ID NO: 66329 - DNA, 29 bp, Artificial Sequence
  Description of Artificial Sequence: Synthetic oligonucleotide
gcatacacaactacggggttgtggagagc

SEQ ID NO: 66330 - DNA, 31 bp, Artificial Sequence
  Description of Artificial Sequence: Synthetic oligonucleotide
catacacaactacggggttgtggagagcttc

SEQ ID NO: 66331 - DNA, 32 bp, Artificial Sequence
  Description of Artificial Sequence: Synthetic oligonucleotide
atacacaactacggggttgtggagagcttcac

SEQ ID NO: 66332 - DNA, 31 bp, Artificial Sequence
  Description of Artificial Sequence: Synthetic oligonucleotide
tacacaactacggggttgtggagagcttcac

SEQ ID NO: 66333 - DNA, 29 bp, Artificial Sequence
  Description of Artificial Sequence: Synthetic oligonucleotide
atggtgtgtctgaagttccctggaggctc

SEQ ID NO: 66334 - DNA, 28 bp, Artificial Sequence
  Description of Artificial Sequence: Synthetic oligonucleotide
tggtgtgtctgaagttccctggaggctc

SEQ ID NO: 66335 - DNA, 27 bp, Artificial Sequence
  Description of Artificial Sequence: Synthetic oligonucleotide
ggtgtgtctgaagttccctggaggctc

SEQ ID NO: 66336 - DNA, 27 bp, Artificial Sequence
  Description of Artificial Sequence: Synthetic oligonucleotide
gtgtgtctgaagttccctggaggctcc

SEQ ID NO: 66337 - DNA, 28 bp, Artificial Sequence
  Description of Artificial Sequence: Synthetic oligonucleotide
tgtgtctgaagttccctggaggctcctg

SEQ ID NO: 66338 - DNA, 27 bp, Artificial Sequence
  Description of Artificial Sequence: Synthetic oligonucleotide
gtgtctgaagttccctggaggctcctg

SEQ ID NO: 66339 - DNA, 27 bp, Artificial Sequence
  Description of Artificial Sequence: Synthetic oligonucleotide
tgtctgaagttccctggaggctcctgc

SEQ ID NO: 66340 - DNA, 27 bp, Artificial Sequence
  Description of Artificial Sequence: Synthetic oligonucleotide
gtctgaagttccctggaggctcctgca

SEQ ID NO: 66341 - DNA, 28 bp, Artificial Sequence
  Description of Artificial Sequence: Synthetic oligonucleotide
tctgaagttccctggaggctcctgcatg

SEQ ID NO: 66342 - DNA, 27 bp, Artificial Sequence
  Description of Artificial Sequence: Synthetic oligonucleotide
ctgaagttccctggaggctcctgcatg

SEQ ID NO: 66343 - DNA, 27 bp, Artificial Sequence
  Description of Artificial Sequence: Synthetic oligonucleotide
tgaagttccctggaggctcctgcatgg

SEQ ID NO: 66344 - DNA, 26 bp, Artificial Sequence
  Description of Artificial Sequence: Synthetic oligonucleotide
gaagttccctggaggctcctgcatgg

SEQ ID NO: 66345 - DNA, 27 bp, Artificial Sequence
  Description of Artificial Sequence: Synthetic oligonucleotide
aagttccctggaggctcctgcatggca

SEQ ID NO: 66346 - DNA, 26 bp, Artificial Sequence
  Description of Artificial Sequence: Synthetic oligonucleotide
agttccctggaggctcctgcatggca

SEQ ID NO: 66347 - DNA, 25 bp, Artificial Sequence
  Description of Artificial Sequence: Synthetic oligonucleotide
gttccctggaggctcctgcatggca

SEQ ID NO: 66348 - DNA, 25 bp, Artificial Sequence
  Description of Artificial Sequence: Synthetic oligonucleotide
ttccctggaggctcctgcatggcag

SEQ ID NO: 66349 - DNA, 24 bp, Artificial Sequence
  Description of Artificial Sequence: Synthetic oligonucleotide
tccctggaggctcctgcatggcag

SEQ ID NO: 66350 - DNA, 23 bp, Artificial Sequence
  Description of Artificial Sequence: Synthetic oligonucleotide
ccctggaggctcctgcatggcag

SEQ ID NO: 66351 - DNA, 24 bp, Artificial Sequence
  Description of Artificial Sequence: Synthetic oligonucleotide
cctggaggctcctgcatggcagct

SEQ ID NO: 66352 - DNA, 25 bp, Artificial Sequence
  Description of Artificial Sequence: Synthetic oligonucleotide
ctggaggctcctgcatggcagctct

SEQ ID NO: 66353 - DNA, 26 bp, Artificial Sequence
  Description of Artificial Sequence: Synthetic oligonucleotide
tggaggctcctgcatggcagctctga

SEQ ID NO: 66354 - DNA, 25 bp, Artificial Sequence
  Description of Artificial Sequence: Synthetic oligonucleotide
ggaggctcctgcatggcagctctga

SEQ ID NO: 66355 - DNA, 26 bp, Artificial Sequence
  Description of Artificial Sequence: Synthetic oligonucleotide
gaggctcctgcatggcagctctgaca

SEQ ID NO: 66356 - DNA, 27 bp, Artificial Sequence
  Description of Artificial Sequence: Synthetic oligonucleotide
aggctcctgcatggcagctctgacagt

SEQ ID NO: 66357 - DNA, 26 bp, Artificial Sequence
  Description of Artificial Sequence: Synthetic oligonucleotide
ggctcctgcatggcagctctgacagt

SEQ ID NO: 66358 - DNA, 27 bp, Artificial Sequence
  Description of Artificial Sequence: Synthetic oligonucleotide
gctcctgcatggcagctctgacagtga

SEQ ID NO: 66359 - DNA, 27 bp, Artificial Sequence
  Description of Artificial Sequence: Synthetic oligonucleotide
ctcctgcatggcagctctgacagtgac

SEQ ID NO: 66360 - DNA, 28 bp, Artificial Sequence
  Description of Artificial Sequence: Synthetic oligonucleotide
tcctgcatggcagctctgacagtgacac

SEQ ID NO: 66361 - DNA, 27 bp, Artificial Sequence
  Description of Artificial Sequence: Synthetic oligonucleotide
cctgcatggcagctctgacagtgacac

SEQ ID NO: 66362 - DNA, 28 bp, Artificial Sequence
  Description of Artificial Sequence: Synthetic oligonucleotide
ctgcatggcagctctgacagtgacactg

SEQ ID NO: 66363 - DNA, 30 bp, Artificial Sequence
  Description of Artificial Sequence: Synthetic oligonucleotide
tgcatggcagctctgacagtgacactgatg

SEQ ID NO: 66364 - DNA, 29 bp, Artificial Sequence
  Description of Artificial Sequence: Synthetic oligonucleotide
gcatggcagctctgacagtgacactgatg

SEQ ID NO: 66365 - DNA, 29 bp, Artificial Sequence
  Description of Artificial Sequence: Synthetic oligonucleotide
catggcagctctgacagtgacactgatgg

SEQ ID NO: 66366 - DNA, 30 bp, Artificial Sequence
  Description of Artificial Sequence: Synthetic oligonucleotide
atggcagctctgacagtgacactgatggtg

SEQ ID NO: 66367 - DNA, 29 bp, Artificial Sequence
  Description of Artificial Sequence: Synthetic oligonucleotide
tggcagctctgacagtgacactgatggtg

SEQ ID NO: 66368 - DNA, 28 bp, Artificial Sequence
  Description of Artificial Sequence: Synthetic oligonucleotide
ggcagctctgacagtgacactgatggtg

SEQ ID NO: 66369 - DNA, 28 bp, Artificial Sequence
  Description of Artificial Sequence: Synthetic oligonucleotide
gcagctctgacagtgacactgatggtgc

SEQ ID NO: 66370 - DNA, 29 bp, Artificial Sequence
  Description of Artificial Sequence: Synthetic oligonucleotide
cagctctgacagtgacactgatggtgctg

SEQ ID NO: 66371 - DNA, 30 bp, Artificial Sequence
  Description of Artificial Sequence: Synthetic oligonucleotide
agctctgacagtgacactgatggtgctgag

SEQ ID NO: 66372 - DNA, 29 bp, Artificial Sequence
  Description of Artificial Sequence: Synthetic oligonucleotide
gctctgacagtgacactgatggtgctgag

SEQ ID NO: 66373 - DNA, 29 bp, Artificial Sequence
  Description of Artificial Sequence: Synthetic oligonucleotide
ctctgacagtgacactgatggtgctgagc

SEQ ID NO: 66374 - DNA, 26 bp, Artificial Sequence
  Description of Artificial Sequence: Synthetic oligonucleotide
ctggggacacccgaccacgtttcttg

SEQ ID NO: 66375 - DNA, 27 bp, Artificial Sequence
  Description of Artificial Sequence: Synthetic oligonucleotide
tggggacacccgaccacgtttcttgga

SEQ ID NO: 66376 - DNA, 26 bp, Artificial Sequence
  Description of Artificial Sequence: Synthetic oligonucleotide
ggggacacccgaccacgtttcttgga

SEQ ID NO: 66377 - DNA, 26 bp, Artificial Sequence
  Description of Artificial Sequence: Synthetic oligonucleotide
gggacacccgaccacgtttcttggag

SEQ ID NO: 66378 - DNA, 27 bp, Artificial Sequence
  Description of Artificial Sequence: Synthetic oligonucleotide
ggacacccgaccacgtttcttggagca

SEQ ID NO: 66379 - DNA, 27 bp, Artificial Sequence
  Description of Artificial Sequence: Synthetic oligonucleotide
gacacccgaccacgtttcttggagcag

SEQ ID NO: 66380 - DNA, 27 bp, Artificial Sequence
  Description of Artificial Sequence: Synthetic oligonucleotide
acacccgaccacgtttcttggagcagg

SEQ ID NO: 66381 - DNA, 27 bp, Artificial Sequence
  Description of Artificial Sequence: Synthetic oligonucleotide
cacccgaccacgtttcttggagcaggt

SEQ ID NO: 66382 - DNA, 31 bp, Artificial Sequence
  Description of Artificial Sequence: Synthetic oligonucleotide
acccgaccacgtttcttggagcaggttaaac

SEQ ID NO: 66383 - DNA, 30 bp, Artificial Sequence
  Description of Artificial Sequence: Synthetic oligonucleotide
cccgaccacgtttcttggagcaggttaaac

SEQ ID NO: 66384 - DNA, 32 bp, Artificial Sequence
  Description of Artificial Sequence: Synthetic oligonucleotide
ccgaccacgtttcttggagcaggttaaacatg

SEQ ID NO: 66385 - DNA, 33 bp, Artificial Sequence
  Description of Artificial Sequence: Synthetic oligonucleotide
cgaccacgtttcttggagcaggttaaacatgag

SEQ ID NO: 66386 - DNA, 34 bp, Artificial Sequence
  Description of Artificial Sequence: Synthetic oligonucleotide
gaccacgtttcttggagcaggttaaacatgagtg

SEQ ID NO: 66387 - DNA, 35 bp, Artificial Sequence
  Description of Artificial Sequence: Synthetic oligonucleotide
accacgtttcttggagcaggttaaacatgagtgtc

SEQ ID NO: 66388 - DNA, 34 bp, Artificial Sequence
  Description of Artificial Sequence: Synthetic oligonucleotide
ccacgtttcttggagcaggttaaacatgagtgtc

SEQ ID NO: 66389 - DNA, 38 bp, Artificial Sequence
  Description of Artificial Sequence: Synthetic oligonucleotide
cacgtttcttggagcaggttaaacatgagtgtcatttc

SEQ ID NO: 66390 - DNA, 40 bp, Artificial Sequence
  Description of Artificial Sequence: Synthetic oligonucleotide
acgtttcttggagcaggttaaacatgagtgtcatttcttc

SEQ ID NO: 66391 - DNA, 39 bp, Artificial Sequence
  Description of Artificial Sequence: Synthetic oligonucleotide
cgtttcttggagcaggttaaacatgagtgtcatttcttc

SEQ ID NO: 66392 - DNA, 41 bp, Artificial Sequence
  Description of Artificial Sequence: Synthetic oligonucleotide
gtttcttggagcaggttaaacatgagtgtcatttcttcaac

SEQ ID NO: 66393 - DNA, 41 bp, Artificial Sequence
  Description of Artificial Sequence: Synthetic oligonucleotide
tttcttggagcaggttaaacatgagtgtcatttcttcaacg

SEQ ID NO: 66394 - DNA, 40 bp, Artificial Sequence
  Description of Artificial Sequence: Synthetic oligonucleotide
ttcttggagcaggttaaacatgagtgtcatttcttcaacg

SEQ ID NO: 66395 - DNA, 39 bp, Artificial Sequence
  Description of Artificial Sequence: Synthetic oligonucleotide
tcttggagcaggttaaacatgagtgtcatttcttcaacg

SEQ ID NO: 66396 - DNA, 38 bp, Artificial Sequence
  Description of Artificial Sequence: Synthetic oligonucleotide
cttggagcaggttaaacatgagtgtcatttcttcaacg

SEQ ID NO: 66397 - DNA, 38 bp, Artificial Sequence
  Description of Artificial Sequence: Synthetic oligonucleotide
ttggagcaggttaaacatgagtgtcatttcttcaacgg

SEQ ID NO: 66398 - DNA, 37 bp, Artificial Sequence
  Description of Artificial Sequence: Synthetic oligonucleotide
tggagcaggttaaacatgagtgtcatttcttcaacgg

SEQ ID NO: 66399 - DNA, 36 bp, Artificial Sequence
  Description of Artificial Sequence: Synthetic oligonucleotide
ggagcaggttaaacatgagtgtcatttcttcaacgg

SEQ ID NO: 66400 - DNA, 36 bp, Artificial Sequence
  Description of Artificial Sequence: Synthetic oligonucleotide
gagcaggttaaacatgagtgtcatttcttcaacggg

SEQ ID NO: 66401 - DNA, 37 bp, Artificial Sequence
  Description of Artificial Sequence: Synthetic oligonucleotide
agcaggttaaacatgagtgtcatttcttcaacgggac

SEQ ID NO: 66402 - DNA, 36 bp, Artificial Sequence
  Description of Artificial Sequence: Synthetic oligonucleotide
gcaggttaaacatgagtgtcatttcttcaacgggac

SEQ ID NO: 66403 - DNA, 36 bp, Artificial Sequence
  Description of Artificial Sequence: Synthetic oligonucleotide
caggttaaacatgagtgtcatttcttcaacgggacg

SEQ ID NO: 66404 - DNA, 36 bp, Artificial Sequence
  Description of Artificial Sequence: Synthetic oligonucleotide
aggttaaacatgagtgtcatttcttcaacgggacgg

SEQ ID NO: 66405 - DNA, 35 bp, Artificial Sequence
  Description of Artificial Sequence: Synthetic oligonucleotide
ggttaaacatgagtgtcatttcttcaacgggacgg

SEQ ID NO: 66406 - DNA, 36 bp, Artificial Sequence
  Description of Artificial Sequence: Synthetic oligonucleotide
gttaaacatgagtgtcatttcttcaacgggacggag

SEQ ID NO: 66407 - DNA, 36 bp, Artificial Sequence
  Description of Artificial Sequence: Synthetic oligonucleotide
ttaaacatgagtgtcatttcttcaacgggacggagc

SEQ ID NO: 66408 - DNA, 35 bp, Artificial Sequence
  Description of Artificial Sequence: Synthetic oligonucleotide
taaacatgagtgtcatttcttcaacgggacggagc

SEQ ID NO: 66409 - DNA, 34 bp, Artificial Sequence
  Description of Artificial Sequence: Synthetic oligonucleotide
aaacatgagtgtcatttcttcaacgggacggagc

SEQ ID NO: 66410 - DNA, 33 bp, Artificial Sequence
  Description of Artificial Sequence: Synthetic oligonucleotide
aacatgagtgtcatttcttcaacgggacggagc

SEQ ID NO: 66411 - DNA, 32 bp, Artificial Sequence
  Description of Artificial Sequence: Synthetic oligonucleotide
acatgagtgtcatttcttcaacgggacggagc

SEQ ID NO: 66412 - DNA, 31 bp, Artificial Sequence
  Description of Artificial Sequence: Synthetic oligonucleotide
catgagtgtcatttcttcaacgggacggagc

SEQ ID NO: 66413 - DNA, 31 bp, Artificial Sequence
  Description of Artificial Sequence: Synthetic oligonucleotide
atgagtgtcatttcttcaacgggacggagcg

SEQ ID NO: 66414 - DNA, 30 bp, Artificial Sequence
  Description of Artificial Sequence: Synthetic oligonucleotide
tgagtgtcatttcttcaacgggacggagcg

SEQ ID NO: 66415 - DNA, 29 bp, Artificial Sequence
  Description of Artificial Sequence: Synthetic oligonucleotide
gagtgtcatttcttcaacgggacggagcg

SEQ ID NO: 66416 - DNA, 29 bp, Artificial Sequence
  Description of Artificial Sequence: Synthetic oligonucleotide
agtgtcatttcttcaacgggacggagcgg

SEQ ID NO: 66417 - DNA, 28 bp, Artificial Sequence
  Description of Artificial Sequence: Synthetic oligonucleotide
gtgtcatttcttcaacgggacggagcgg

SEQ ID NO: 66418 - DNA, 26 bp, Artificial Sequence
  Description of Artificial Sequence: Synthetic oligonucleotide
tttcttcaacgggacggagcgggtgc

SEQ ID NO: 66419 - DNA, 25 bp, Artificial Sequence
  Description of Artificial Sequence: Synthetic oligonucleotide
ttcttcaacgggacggagcgggtgc

SEQ ID NO: 66420 - DNA, 24 bp, Artificial Sequence
  Description of Artificial Sequence: Synthetic oligonucleotide
tcttcaacgggacggagcgggtgc

SEQ ID NO: 66421 - DNA, 23 bp, Artificial Sequence
  Description of Artificial Sequence: Synthetic oligonucleotide
cttcaacgggacggagcgggtgc

SEQ ID NO: 66422 - DNA, 23 bp, Artificial Sequence
  Description of Artificial Sequence: Synthetic oligonucleotide
ttcaacgggacggagcgggtgcg

SEQ ID NO: 66423 - DNA, 22 bp, Artificial Sequence
  Description of Artificial Sequence: Synthetic oligonucleotide
tcaacgggacggagcgggtgcg

SEQ ID NO: 66424 - DNA, 21 bp, Artificial Sequence
  Description of Artificial Sequence: Synthetic oligonucleotide
caacgggacggagcgggtgcg

SEQ ID NO: 66425 - DNA, 23 bp, Artificial Sequence
  Description of Artificial Sequence: Synthetic oligonucleotide
aacgggacggagcgggtgcggtt

SEQ ID NO: 66426 - DNA, 22 bp, Artificial Sequence
  Description of Artificial Sequence: Synthetic oligonucleotide
acgggacggagcgggtgcggtt

SEQ ID NO: 66427 - DNA, 21 bp, Artificial Sequence
  Description of Artificial Sequence: Synthetic oligonucleotide
cgggacggagcgggtgcggtt

SEQ ID NO: 66428 - DNA, 27 bp, Artificial Sequence
  Description of Artificial Sequence: Synthetic oligonucleotide
agagcttcacagtgcagcggcgagtct

SEQ ID NO: 66429 - DNA, 27 bp, Artificial Sequence
  Description of Artificial Sequence: Synthetic oligonucleotide
gagcttcacagtgcagcggcgagtcta

SEQ ID NO: 66430 - DNA, 28 bp, Artificial Sequence
  Description of Artificial Sequence: Synthetic oligonucleotide
agcttcacagtgcagcggcgagtctatc

SEQ ID NO: 66431 - DNA, 27 bp, Artificial Sequence
  Description of Artificial Sequence: Synthetic oligonucleotide
gcttcacagtgcagcggcgagtctatc

SEQ ID NO: 66432 - DNA, 27 bp, Artificial Sequence
  Description of Artificial Sequence: Synthetic oligonucleotide
cttcacagtgcagcggcgagtctatcc

SEQ ID NO: 66433 - DNA, 28 bp, Artificial Sequence
  Description of Artificial Sequence: Synthetic oligonucleotide
ttcacagtgcagcggcgagtctatcctg

SEQ ID NO: 66434 - DNA, 27 bp, Artificial Sequence
  Description of Artificial Sequence: Synthetic oligonucleotide
tcacagtgcagcggcgagtctatcctg

SEQ ID NO: 66435 - DNA, 27 bp, Artificial Sequence
  Description of Artificial Sequence: Synthetic oligonucleotide
cacagtgcagcggcgagtctatcctga

SEQ ID NO: 66436 - DNA, 27 bp, Artificial Sequence
  Description of Artificial Sequence: Synthetic oligonucleotide
acagtgcagcggcgagtctatcctgag

SEQ ID NO: 66437 - DNA, 26 bp, Artificial Sequence
  Description of Artificial Sequence: Synthetic oligonucleotide
cagtgcagcggcgagtctatcctgag

SEQ ID NO: 66438 - DNA, 27 bp, Artificial Sequence
  Description of Artificial Sequence: Synthetic oligonucleotide
agtgcagcggcgagtctatcctgaggt

SEQ ID NO: 66439 - DNA, 26 bp, Artificial Sequence
  Description of Artificial Sequence: Synthetic oligonucleotide
gtgcagcggcgagtctatcctgaggt

SEQ ID NO: 66440 - DNA, 27 bp, Artificial Sequence
  Description of Artificial Sequence: Synthetic oligonucleotide
tgcagcggcgagtctatcctgaggtga

SEQ ID NO: 66441 - DNA, 26 bp, Artificial Sequence
  Description of Artificial Sequence: Synthetic oligonucleotide
gcagcggcgagtctatcctgaggtga

SEQ ID NO: 66442 - DNA, 27 bp, Artificial Sequence
  Description of Artificial Sequence: Synthetic oligonucleotide
cagcggcgagtctatcctgaggtgact

SEQ ID NO: 66443 - DNA, 27 bp, Artificial Sequence
  Description of Artificial Sequence: Synthetic oligonucleotide
agcggcgagtctatcctgaggtgactg

SEQ ID NO: 66444 - DNA, 27 bp, Artificial Sequence
  Description of Artificial Sequence: Synthetic oligonucleotide
gcggcgagtctatcctgaggtgactgt

SEQ ID NO: 66445 - DNA, 27 bp, Artificial Sequence
  Description of Artificial Sequence: Synthetic oligonucleotide
cggcgagtctatcctgaggtgactgtg

SEQ ID NO: 66446 - DNA, 30 bp, Artificial Sequence
  Description of Artificial Sequence: Synthetic oligonucleotide
ggcgagtctatcctgaggtgactgtgtatc

SEQ ID NO: 66447 - DNA, 30 bp, Artificial Sequence
  Description of Artificial Sequence: Synthetic oligonucleotide
gcgagtctatcctgaggtgactgtgtatcc

SEQ ID NO: 66448 - DNA, 31 bp, Artificial Sequence
  Description of Artificial Sequence: Synthetic oligonucleotide
cgagtctatcctgaggtgactgtgtatcctg

SEQ ID NO: 66449 - DNA, 31 bp, Artificial Sequence
  Description of Artificial Sequence: Synthetic oligonucleotide
gagtctatcctgaggtgactgtgtatcctgc

SEQ ID NO: 66450 - DNA, 34 bp, Artificial Sequence
  Description of Artificial Sequence: Synthetic oligonucleotide
agtctatcctgaggtgactgtgtatcctgcaaag

SEQ ID NO: 66451 - DNA, 33 bp, Artificial Sequence
  Description of Artificial Sequence: Synthetic oligonucleotide
gtctatcctgaggtgactgtgtatcctgcaaag

SEQ ID NO: 66452 - DNA, 34 bp, Artificial Sequence
  Description of Artificial Sequence: Synthetic oligonucleotide
tctatcctgaggtgactgtgtatcctgcaaagac

SEQ ID NO: 66453 - DNA, 33 bp, Artificial Sequence
  Description of Artificial Sequence: Synthetic oligonucleotide
ctatcctgaggtgactgtgtatcctgcaaagac

SEQ ID NO: 66454 - DNA, 33 bp, Artificial Sequence
  Description of Artificial Sequence: Synthetic oligonucleotide
tatcctgaggtgactgtgtatcctgcaaagacc

SEQ ID NO: 66455 - DNA, 32 bp, Artificial Sequence
  Description of Artificial Sequence: Synthetic oligonucleotide
atcctgaggtgactgtgtatcctgcaaagacc

SEQ ID NO: 66456 - DNA, 31 bp, Artificial Sequence
  Description of Artificial Sequence: Synthetic oligonucleotide
tcctgaggtgactgtgtatcctgcaaagacc

SEQ ID NO: 66457 - DNA, 30 bp, Artificial Sequence
  Description of Artificial Sequence: Synthetic oligonucleotide
cctgaggtgactgtgtatcctgcaaagacc

SEQ ID NO: 66458 - DNA, 30 bp, Artificial Sequence
  Description of Artificial Sequence: Synthetic oligonucleotide
ctgaggtgactgtgtatcctgcaaagaccc

SEQ ID NO: 66459 - DNA, 31 bp, Artificial Sequence
  Description of Artificial Sequence: Synthetic oligonucleotide
tgaggtgactgtgtatcctgcaaagacccag

SEQ ID NO: 66460 - DNA, 30 bp, Artificial Sequence
  Description of Artificial Sequence: Synthetic oligonucleotide
gaggtgactgtgtatcctgcaaagacccag

SEQ ID NO: 66461 - DNA, 30 bp, Artificial Sequence
  Description of Artificial Sequence: Synthetic oligonucleotide
aggtgactgtgtatcctgcaaagacccagc

SEQ ID NO: 66462 - DNA, 29 bp, Artificial Sequence
  Description of Artificial Sequence: Synthetic oligonucleotide
ggtgactgtgtatcctgcaaagacccagc

SEQ ID NO: 66463 - DNA, 29 bp, Artificial Sequence
  Description of Artificial Sequence: Synthetic oligonucleotide
gtgactgtgtatcctgcaaagacccagcc

SEQ ID NO: 66464 - DNA, 29 bp, Artificial Sequence
  Description of Artificial Sequence: Synthetic oligonucleotide
tgactgtgtatcctgcaaagacccagccc

SEQ ID NO: 66465 - DNA, 28 bp, Artificial Sequence
  Description of Artificial Sequence: Synthetic oligonucleotide
gactgtgtatcctgcaaagacccagccc

SEQ ID NO: 66466 - DNA, 28 bp, Artificial Sequence
  Description of Artificial Sequence: Synthetic oligonucleotide
actgtgtatcctgcaaagacccagcccc

SEQ ID NO: 66467 - DNA, 27 bp, Artificial Sequence
  Description of Artificial Sequence: Synthetic oligonucleotide
ctgtgtatcctgcaaagacccagcccc

SEQ ID NO: 66468 - DNA, 28 bp, Artificial Sequence
  Description of Artificial Sequence: Synthetic oligonucleotide
tgtgtatcctgcaaagacccagcccctg

SEQ ID NO: 66469 - DNA, 27 bp, Artificial Sequence
  Description of Artificial Sequence: Synthetic oligonucleotide
gtgtatcctgcaaagacccagcccctg

SEQ ID NO: 66470 - DNA, 27 bp, Artificial Sequence
  Description of Artificial Sequence: Synthetic oligonucleotide
tgtatcctgcaaagacccagcccctgc

SEQ ID NO: 66471 - DNA, 27 bp, Artificial Sequence
  Description of Artificial Sequence: Synthetic oligonucleotide
gtatcctgcaaagacccagcccctgca

SEQ ID NO: 66472 - DNA, 27 bp, Artificial Sequence
  Description of Artificial Sequence: Synthetic oligonucleotide
tatcctgcaaagacccagcccctgcag

SEQ ID NO: 66473 - DNA, 26 bp, Artificial Sequence
  Description of Artificial Sequence: Synthetic oligonucleotide
atcctgcaaagacccagcccctgcag

SEQ ID NO: 66474 - DNA, 25 bp, Artificial Sequence
  Description of Artificial Sequence: Synthetic oligonucleotide
tcctgcaaagacccagcccctgcag

SEQ ID NO: 66475 - DNA, 24 bp, Artificial Sequence
  Description of Artificial Sequence: Synthetic oligonucleotide
cctgcaaagacccagcccctgcag

SEQ ID NO: 66476 - DNA, 25 bp, Artificial Sequence
  Description of Artificial Sequence: Synthetic oligonucleotide
ctgcaaagacccagcccctgcagca

SEQ ID NO: 66477 - DNA, 25 bp, Artificial Sequence
  Description of Artificial Sequence: Synthetic oligonucleotide
tgcaaagacccagcccctgcagcac

SEQ ID NO: 66478 - DNA, 24 bp, Artificial Sequence
  Description of Artificial Sequence: Synthetic oligonucleotide
gcaaagacccagcccctgcagcac

SEQ ID NO: 66479 - DNA, 30 bp, Artificial Sequence
  Description of Artificial Sequence: Synthetic oligonucleotide
accacaacctcctggtctgctctgtgaatg

SEQ ID NO: 66480 - DNA, 29 bp, Artificial Sequence
  Description of Artificial Sequence: Synthetic oligonucleotide
ccacaacctcctggtctgctctgtgaatg

SEQ ID NO: 66481 - DNA, 29 bp, Artificial Sequence
  Description of Artificial Sequence: Synthetic oligonucleotide
cacaacctcctggtctgctctgtgaatgg

SEQ ID NO: 66482 - DNA, 32 bp, Artificial Sequence
  Description of Artificial Sequence: Synthetic oligonucleotide
acaacctcctggtctgctctgtgaatggtttc

SEQ ID NO: 66483 - DNA, 31 bp, Artificial Sequence
  Description of Artificial Sequence: Synthetic oligonucleotide
caacctcctggtctgctctgtgaatggtttc

SEQ ID NO: 66484 - DNA, 34 bp, Artificial Sequence
  Description of Artificial Sequence: Synthetic oligonucleotide
aacctcctggtctgctctgtgaatggtttctatc

SEQ ID NO: 66485 - DNA, 33 bp, Artificial Sequence
  Description of Artificial Sequence: Synthetic oligonucleotide
acctcctggtctgctctgtgaatggtttctatc

SEQ ID NO: 66486 - DNA, 32 bp, Artificial Sequence
  Description of Artificial Sequence: Synthetic oligonucleotide
cctcctggtctgctctgtgaatggtttctatc

SEQ ID NO: 66487 - DNA, 32 bp, Artificial Sequence
  Description of Artificial Sequence: Synthetic oligonucleotide
ctcctggtctgctctgtgaatggtttctatcc

SEQ ID NO: 66488 - DNA, 33 bp, Artificial Sequence
  Description of Artificial Sequence: Synthetic oligonucleotide
tcctggtctgctctgtgaatggtttctatccag

SEQ ID NO: 66489 - DNA, 32 bp, Artificial Sequence
  Description of Artificial Sequence: Synthetic oligonucleotide
cctggtctgctctgtgaatggtttctatccag

SEQ ID NO: 66490 - DNA, 32 bp, Artificial Sequence
  Description of Artificial Sequence: Synthetic oligonucleotide
ctggtctgctctgtgaatggtttctatccagg

SEQ ID NO: 66491 - DNA, 32 bp, Artificial Sequence
  Description of Artificial Sequence: Synthetic oligonucleotide
tggtctgctctgtgaatggtttctatccaggc

SEQ ID NO: 66492 - DNA, 31 bp, Artificial Sequence
  Description of Artificial Sequence: Synthetic oligonucleotide
ggtctgctctgtgaatggtttctatccaggc

SEQ ID NO: 66493 - DNA, 32 bp, Artificial Sequence
  Description of Artificial Sequence: Synthetic oligonucleotide
gtctgctctgtgaatggtttctatccaggcag

SEQ ID NO: 66494 - DNA, 32 bp, Artificial Sequence
  Description of Artificial Sequence: Synthetic oligonucleotide
tctgctctgtgaatggtttctatccaggcagc

SEQ ID NO: 66495 - DNA, 31 bp, Artificial Sequence
  Description of Artificial Sequence: Synthetic oligonucleotide
ctgctctgtgaatggtttctatccaggcagc

SEQ ID NO: 66496 - DNA, 34 bp, Artificial Sequence
  Description of Artificial Sequence: Synthetic oligonucleotide
tgctctgtgaatggtttctatccaggcagcattg

SEQ ID NO: 66497 - DNA, 33 bp, Artificial Sequence
  Description of Artificial Sequence: Synthetic oligonucleotide
gctctgtgaatggtttctatccaggcagcattg

SEQ ID NO: 66498 - DNA, 35 bp, Artificial Sequence
  Description of Artificial Sequence: Synthetic oligonucleotide
ctctgtgaatggtttctatccaggcagcattgaag

SEQ ID NO: 66499 - DNA, 36 bp, Artificial Sequence
  Description of Artificial Sequence: Synthetic oligonucleotide
tctgtgaatggtttctatccaggcagcattgaagtc

SEQ ID NO: 66500 - DNA, 35 bp, Artificial Sequence
  Description of Artificial Sequence: Synthetic oligonucleotide
ctgtgaatggtttctatccaggcagcattgaagtc

SEQ ID NO: 66501 - DNA, 36 bp, Artificial Sequence
  Description of Artificial Sequence: Synthetic oligonucleotide
tgtgaatggtttctatccaggcagcattgaagtcag

SEQ ID NO: 66502 - DNA, 35 bp, Artificial Sequence
  Description of Artificial Sequence: Synthetic oligonucleotide
gtgaatggtttctatccaggcagcattgaagtcag

SEQ ID NO: 66503 - DNA, 35 bp, Artificial Sequence
  Description of Artificial Sequence: Synthetic oligonucleotide
tgaatggtttctatccaggcagcattgaagtcagg

SEQ ID NO: 66504 - DNA, 34 bp, Artificial Sequence
  Description of Artificial Sequence: Synthetic oligonucleotide
gaatggtttctatccaggcagcattgaagtcagg

SEQ ID NO: 66505 - DNA, 35 bp, Artificial Sequence
  Description of Artificial Sequence: Synthetic oligonucleotide
aatggtttctatccaggcagcattgaagtcaggtg

SEQ ID NO: 66506 - DNA, 34 bp, Artificial Sequence
  Description of Artificial Sequence: Synthetic oligonucleotide
atggtttctatccaggcagcattgaagtcaggtg

SEQ ID NO: 66507 - DNA, 27 bp, Artificial Sequence
  Description of Artificial Sequence: Synthetic oligonucleotide
ggttccggaacggccaggaagagaaga

SEQ ID NO: 66508 - DNA, 27 bp, Artificial Sequence
  Description of Artificial Sequence: Synthetic oligonucleotide
gttccggaacggccaggaagagaagac

SEQ ID NO: 66509 - DNA, 28 bp, Artificial Sequence
  Description of Artificial Sequence: Synthetic oligonucleotide
ttccggaacggccaggaagagaagactg

SEQ ID NO: 66510 - DNA, 27 bp, Artificial Sequence
  Description of Artificial Sequence: Synthetic oligonucleotide
tccggaacggccaggaagagaagactg

SEQ ID NO: 66511 - DNA, 26 bp, Artificial Sequence
  Description of Artificial Sequence: Synthetic oligonucleotide
ccggaacggccaggaagagaagactg

SEQ ID NO: 66512 - DNA, 26 bp, Artificial Sequence
  Description of Artificial Sequence: Synthetic oligonucleotide
cggaacggccaggaagagaagactgg

SEQ ID NO: 66513 - DNA, 26 bp, Artificial Sequence
  Description of Artificial Sequence: Synthetic oligonucleotide
ggaacggccaggaagagaagactggg

SEQ ID NO: 66514 - DNA, 27 bp, Artificial Sequence
  Description of Artificial Sequence: Synthetic oligonucleotide
gaacggccaggaagagaagactggggt

SEQ ID NO: 66515 - DNA, 27 bp, Artificial Sequence
  Description of Artificial Sequence: Synthetic oligonucleotide
aacggccaggaagagaagactggggtg

SEQ ID NO: 66516 - DNA, 26 bp, Artificial Sequence
  Description of Artificial Sequence: Synthetic oligonucleotide
acggccaggaagagaagactggggtg

SEQ ID NO: 66517 - DNA, 25 bp, Artificial Sequence
  Description of Artificial Sequence: Synthetic oligonucleotide
cggccaggaagagaagactggggtg

SEQ ID NO: 66518 - DNA, 29 bp, Artificial Sequence
  Description of Artificial Sequence: Synthetic oligonucleotide
tgtccacaggcctgatccagaatggagac

SEQ ID NO: 66519 - DNA, 28 bp, Artificial Sequence
  Description of Artificial Sequence: Synthetic oligonucleotide
gtccacaggcctgatccagaatggagac

SEQ ID NO: 66520 - DNA, 29 bp, Artificial Sequence
  Description of Artificial Sequence: Synthetic oligonucleotide
tccacaggcctgatccagaatggagactg

SEQ ID NO: 66521 - DNA, 28 bp, Artificial Sequence
  Description of Artificial Sequence: Synthetic oligonucleotide
ccacaggcctgatccagaatggagactg

SEQ ID NO: 66522 - DNA, 28 bp, Artificial Sequence
  Description of Artificial Sequence: Synthetic oligonucleotide
cacaggcctgatccagaatggagactgg

SEQ ID NO: 66523 - DNA, 29 bp, Artificial Sequence
  Description of Artificial Sequence: Synthetic oligonucleotide
acaggcctgatccagaatggagactggac

SEQ ID NO: 66524 - DNA, 28 bp, Artificial Sequence
  Description of Artificial Sequence: Synthetic oligonucleotide
caggcctgatccagaatggagactggac

SEQ ID NO: 66525 - DNA, 28 bp, Artificial Sequence
  Description of Artificial Sequence: Synthetic oligonucleotide
aggcctgatccagaatggagactggacc

SEQ ID NO: 66526 - DNA, 27 bp, Artificial Sequence
  Description of Artificial Sequence: Synthetic oligonucleotide
ggcctgatccagaatggagactggacc

SEQ ID NO: 66527 - DNA, 29 bp, Artificial Sequence
  Description of Artificial Sequence: Synthetic oligonucleotide
gcctgatccagaatggagactggaccttc

SEQ ID NO: 66528 - DNA, 29 bp, Artificial Sequence
  Description of Artificial Sequence: Synthetic oligonucleotide
cctgatccagaatggagactggaccttcc

SEQ ID NO: 66529 - DNA, 30 bp, Artificial Sequence
  Description of Artificial Sequence: Synthetic oligonucleotide
ctgatccagaatggagactggaccttccag

SEQ ID NO: 66530 - DNA, 31 bp, Artificial Sequence
  Description of Artificial Sequence: Synthetic oligonucleotide
tgatccagaatggagactggaccttccagac

SEQ ID NO: 66531 - DNA, 30 bp, Artificial Sequence
  Description of Artificial Sequence: Synthetic oligonucleotide
gatccagaatggagactggaccttccagac

SEQ ID NO: 66532 - DNA, 30 bp, Artificial Sequence
  Description of Artificial Sequence: Synthetic oligonucleotide
atccagaatggagactggaccttccagacc

SEQ ID NO: 66533 - DNA, 29 bp, Artificial Sequence
  Description of Artificial Sequence: Synthetic oligonucleotide
tccagaatggagactggaccttccagacc

SEQ ID NO: 66534 - DNA, 28 bp, Artificial Sequence
  Description of Artificial Sequence: Synthetic oligonucleotide
ccagaatggagactggaccttccagacc

SEQ ID NO: 66535 - DNA, 28 bp, Artificial Sequence
  Description of Artificial Sequence: Synthetic oligonucleotide
cagaatggagactggaccttccagaccc

SEQ ID NO: 66536 - DNA, 29 bp, Artificial Sequence
  Description of Artificial Sequence: Synthetic oligonucleotide
agaatggagactggaccttccagaccctg

SEQ ID NO: 66537 - DNA, 28 bp, Artificial Sequence
  Description of Artificial Sequence: Synthetic oligonucleotide
gaatggagactggaccttccagaccctg

SEQ ID NO: 66538 - DNA, 26 bp, Artificial Sequence
  Description of Artificial Sequence: Synthetic oligonucleotide
acctgccaagtggagcacccaagcct

SEQ ID NO: 66539 - DNA, 25 bp, Artificial Sequence
  Description of Artificial Sequence: Synthetic oligonucleotide
cctgccaagtggagcacccaagcct

SEQ ID NO: 66540 - DNA, 26 bp, Artificial Sequence
  Description of Artificial Sequence: Synthetic oligonucleotide
ctgccaagtggagcacccaagcctga

SEQ ID NO: 66541 - DNA, 26 bp, Artificial Sequence
  Description of Artificial Sequence: Synthetic oligonucleotide
tgccaagtggagcacccaagcctgac

SEQ ID NO: 66542 - DNA, 25 bp, Artificial Sequence
  Description of Artificial Sequence: Synthetic oligonucleotide
gccaagtggagcacccaagcctgac

SEQ ID NO: 66543 - DNA, 26 bp, Artificial Sequence
  Description of Artificial Sequence: Synthetic oligonucleotide
ccaagtggagcacccaagcctgacga

SEQ ID NO: 66544 - DNA, 26 bp, Artificial Sequence
  Description of Artificial Sequence: Synthetic oligonucleotide
caagtggagcacccaagcctgacgag

SEQ ID NO: 66545 - DNA, 26 bp, Artificial Sequence
  Description of Artificial Sequence: Synthetic oligonucleotide
aagtggagcacccaagcctgacgagc

SEQ ID NO: 66546 - DNA, 25 bp, Artificial Sequence
  Description of Artificial Sequence: Synthetic oligonucleotide
agtggagcacccaagcctgacgagc

SEQ ID NO: 66547 - DNA, 24 bp, Artificial Sequence
  Description of Artificial Sequence: Synthetic oligonucleotide
gtggagcacccaagcctgacgagc

SEQ ID NO: 66548 - DNA, 24 bp, Artificial Sequence
  Description of Artificial Sequence: Synthetic oligonucleotide
tggagcacccaagcctgacgagcc

SEQ ID NO: 66549 - DNA, 23 bp, Artificial Sequence
  Description of Artificial Sequence: Synthetic oligonucleotide
ggagcacccaagcctgacgagcc

SEQ ID NO: 66550 - DNA, 24 bp, Artificial Sequence
  Description of Artificial Sequence: Synthetic oligonucleotide
gagcacccaagcctgacgagccct

SEQ ID NO: 66551 - DNA, 25 bp, Artificial Sequence
  Description of Artificial Sequence: Synthetic oligonucleotide
agcacccaagcctgacgagccctct

SEQ ID NO: 66552 - DNA, 24 bp, Artificial Sequence
  Description of Artificial Sequence: Synthetic oligonucleotide
gcacccaagcctgacgagccctct

SEQ ID NO: 66553 - DNA, 25 bp, Artificial Sequence
  Description of Artificial Sequence: Synthetic oligonucleotide
cacccaagcctgacgagccctctca

SEQ ID NO: 66554 - DNA, 26 bp, Artificial Sequence
  Description of Artificial Sequence: Synthetic oligonucleotide
acccaagcctgacgagccctctcaca

SEQ ID NO: 66555 - DNA, 25 bp, Artificial Sequence
  Description of Artificial Sequence: Synthetic oligonucleotide
cccaagcctgacgagccctctcaca

SEQ ID NO: 66556 - DNA, 26 bp, Artificial Sequence
  Description of Artificial Sequence: Synthetic oligonucleotide
ccaagcctgacgagccctctcacagt

SEQ ID NO: 66557 - DNA, 26 bp, Artificial Sequence
  Description of Artificial Sequence: Synthetic oligonucleotide
caagcctgacgagccctctcacagtg

SEQ ID NO: 66558 - DNA, 27 bp, Artificial Sequence
  Description of Artificial Sequence: Synthetic oligonucleotide
aagcctgacgagccctctcacagtgga

SEQ ID NO: 66559 - DNA, 27 bp, Artificial Sequence
  Description of Artificial Sequence: Synthetic oligonucleotide
agcctgacgagccctctcacagtggaa

SEQ ID NO: 66560 - DNA, 27 bp, Artificial Sequence
  Description of Artificial Sequence: Synthetic oligonucleotide
gcctgacgagccctctcacagtggaat

SEQ ID NO: 66561 - DNA, 27 bp, Artificial Sequence
  Description of Artificial Sequence: Synthetic oligonucleotide
cctgacgagccctctcacagtggaatg

SEQ ID NO: 66562 - DNA, 27 bp, Artificial Sequence
  Description of Artificial Sequence: Synthetic oligonucleotide
ctgacgagccctctcacagtggaatgg

SEQ ID NO: 66563 - DNA, 34 bp, Artificial Sequence
  Description of Artificial Sequence: Synthetic oligonucleotide
cggttcctggacagatacttctatcaccaagaag

SEQ ID NO: 66564 - DNA, 35 bp, Artificial Sequence
  Description of Artificial Sequence: Synthetic oligonucleotide
ggttcctggacagatacttctatcaccaagaagag

SEQ ID NO: 66565 - DNA, 37 bp, Artificial Sequence
  Description of Artificial Sequence: Synthetic oligonucleotide
gttcctggacagatacttctatcaccaagaagagtac

SEQ ID NO: 66566 - DNA, 37 bp, Artificial Sequence
  Description of Artificial Sequence: Synthetic oligonucleotide
ttcctggacagatacttctatcaccaagaagagtacg

SEQ ID NO: 66567 - DNA, 36 bp, Artificial Sequence
  Description of Artificial Sequence: Synthetic oligonucleotide
tcctggacagatacttctatcaccaagaagagtacg

SEQ ID NO: 66568 - DNA, 35 bp, Artificial Sequence
  Description of Artificial Sequence: Synthetic oligonucleotide
cctggacagatacttctatcaccaagaagagtacg

SEQ ID NO: 66569 - DNA, 36 bp, Artificial Sequence
  Description of Artificial Sequence: Synthetic oligonucleotide
ctggacagatacttctatcaccaagaagagtacgtg

SEQ ID NO: 66570 - DNA, 36 bp, Artificial Sequence
  Description of Artificial Sequence: Synthetic oligonucleotide
tggacagatacttctatcaccaagaagagtacgtgc

SEQ ID NO: 66571 - DNA, 35 bp, Artificial Sequence
  Description of Artificial Sequence: Synthetic oligonucleotide
ggacagatacttctatcaccaagaagagtacgtgc

SEQ ID NO: 66572 - DNA, 35 bp, Artificial Sequence
  Description of Artificial Sequence: Synthetic oligonucleotide
gacagatacttctatcaccaagaagagtacgtgcg

SEQ ID NO: 66573 - DNA, 35 bp, Artificial Sequence
  Description of Artificial Sequence: Synthetic oligonucleotide
acagatacttctatcaccaagaagagtacgtgcgc

SEQ ID NO: 66574 - DNA, 34 bp, Artificial Sequence
  Description of Artificial Sequence: Synthetic oligonucleotide
cagatacttctatcaccaagaagagtacgtgcgc

SEQ ID NO: 66575 - DNA, 36 bp, Artificial Sequence
  Description of Artificial Sequence: Synthetic oligonucleotide
agatacttctatcaccaagaagagtacgtgcgcttc

SEQ ID NO: 66576 - DNA, 35 bp, Artificial Sequence
  Description of Artificial Sequence: Synthetic oligonucleotide
gatacttctatcaccaagaagagtacgtgcgcttc

SEQ ID NO: 66577 - DNA, 35 bp, Artificial Sequence
  Description of Artificial Sequence: Synthetic oligonucleotide
atacttctatcaccaagaagagtacgtgcgcttcg

SEQ ID NO: 66578 - DNA, 34 bp, Artificial Sequence
  Description of Artificial Sequence: Synthetic oligonucleotide
tacttctatcaccaagaagagtacgtgcgcttcg

SEQ ID NO: 66579 - DNA, 33 bp, Artificial Sequence
  Description of Artificial Sequence: Synthetic oligonucleotide
acttctatcaccaagaagagtacgtgcgcttcg

SEQ ID NO: 66580 - DNA, 32 bp, Artificial Sequence
  Description of Artificial Sequence: Synthetic oligonucleotide
cttctatcaccaagaagagtacgtgcgcttcg

SEQ ID NO: 66581 - DNA, 33 bp, Artificial Sequence
  Description of Artificial Sequence: Synthetic oligonucleotide
ttctatcaccaagaagagtacgtgcgcttcgac

SEQ ID NO: 66582 - DNA, 32 bp, Artificial Sequence
  Description of Artificial Sequence: Synthetic oligonucleotide
tctatcaccaagaagagtacgtgcgcttcgac

SEQ ID NO: 66583 - DNA, 31 bp, Artificial Sequence
  Description of Artificial Sequence: Synthetic oligonucleotide
ctatcaccaagaagagtacgtgcgcttcgac

SEQ ID NO: 66584 - DNA, 32 bp, Artificial Sequence
  Description of Artificial Sequence: Synthetic oligonucleotide
tatcaccaagaagagtacgtgcgcttcgacag

SEQ ID NO: 66585 - DNA, 31 bp, Artificial Sequence
  Description of Artificial Sequence: Synthetic oligonucleotide
atcaccaagaagagtacgtgcgcttcgacag

SEQ ID NO: 66586 - DNA, 30 bp, Artificial Sequence
  Description of Artificial Sequence: Synthetic oligonucleotide
tcaccaagaagagtacgtgcgcttcgacag

SEQ ID NO: 66587 - DNA, 29 bp, Artificial Sequence
  Description of Artificial Sequence: Synthetic oligonucleotide
caccaagaagagtacgtgcgcttcgacag

SEQ ID NO: 66588 - DNA, 29 bp, Artificial Sequence
  Description of Artificial Sequence: Synthetic oligonucleotide
accaagaagagtacgtgcgcttcgacagc

SEQ ID NO: 66589 - DNA, 28 bp, Artificial Sequence
  Description of Artificial Sequence: Synthetic oligonucleotide
ccaagaagagtacgtgcgcttcgacagc

SEQ ID NO: 66590 - DNA, 28 bp, Artificial Sequence
  Description of Artificial Sequence: Synthetic oligonucleotide
caagaagagtacgtgcgcttcgacagcg

SEQ ID NO: 66591 - DNA, 29 bp, Artificial Sequence
  Description of Artificial Sequence: Synthetic oligonucleotide
aagaagagtacgtgcgcttcgacagcgac

SEQ ID NO: 66592 - DNA, 32 bp, Artificial Sequence
  Description of Artificial Sequence: Synthetic oligonucleotide
tgcggttcctggacagatacttctatcaccag

SEQ ID NO: 66593 - DNA, 31 bp, Artificial Sequence
  Description of Artificial Sequence: Synthetic oligonucleotide
gcggttcctggacagatacttctatcaccag

SEQ ID NO: 66594 - DNA, 31 bp, Artificial Sequence
  Description of Artificial Sequence: Synthetic oligonucleotide
cggttcctggacagatacttctatcaccagg

SEQ ID NO: 66595 - DNA, 32 bp, Artificial Sequence
  Description of Artificial Sequence: Synthetic oligonucleotide
ggttcctggacagatacttctatcaccaggag

SEQ ID NO: 66596 - DNA, 32 bp, Artificial Sequence
  Description of Artificial Sequence: Synthetic oligonucleotide
gttcctggacagatacttctatcaccaggagg

SEQ ID NO: 66597 - DNA, 33 bp, Artificial Sequence
  Description of Artificial Sequence: Synthetic oligonucleotide
ttcctggacagatacttctatcaccaggaggag

SEQ ID NO: 66598 - DNA, 32 bp, Artificial Sequence
  Description of Artificial Sequence: Synthetic oligonucleotide
tcctggacagatacttctatcaccaggaggag

SEQ ID NO: 66599 - DNA, 31 bp, Artificial Sequence
  Description of Artificial Sequence: Synthetic oligonucleotide
cctggacagatacttctatcaccaggaggag

SEQ ID NO: 66600 - DNA, 33 bp, Artificial Sequence
  Description of Artificial Sequence: Synthetic oligonucleotide
ctggacagatacttctatcaccaggaggagtac

SEQ ID NO: 66601 - DNA, 33 bp, Artificial Sequence
  Description of Artificial Sequence: Synthetic oligonucleotide
tggacagatacttctatcaccaggaggagtacg

SEQ ID NO: 66602 - DNA, 32 bp, Artificial Sequence
  Description of Artificial Sequence: Synthetic oligonucleotide
ggacagatacttctatcaccaggaggagtacg

SEQ ID NO: 66603 - DNA, 33 bp, Artificial Sequence
  Description of Artificial Sequence: Synthetic oligonucleotide
gacagatacttctatcaccaggaggagtacgtg

SEQ ID NO: 66604 - DNA, 33 bp, Artificial Sequence
  Description of Artificial Sequence: Synthetic oligonucleotide
acagatacttctatcaccaggaggagtacgtgc

SEQ ID NO: 66605 - DNA, 32 bp, Artificial Sequence
  Description of Artificial Sequence: Synthetic oligonucleotide
cagatacttctatcaccaggaggagtacgtgc

SEQ ID NO: 66606 - DNA, 32 bp, Artificial Sequence
  Description of Artificial Sequence: Synthetic oligonucleotide
agatacttctatcaccaggaggagtacgtgcg

SEQ ID NO: 66607 - DNA, 31 bp, Artificial Sequence
  Description of Artificial Sequence: Synthetic oligonucleotide
gatacttctatcaccaggaggagtacgtgcg

SEQ ID NO: 66608 - DNA, 31 bp, Artificial Sequence
  Description of Artificial Sequence: Synthetic oligonucleotide
atacttctatcaccaggaggagtacgtgcgc

SEQ ID NO: 66609 - DNA, 30 bp, Artificial Sequence
  Description of Artificial Sequence: Synthetic oligonucleotide
tacttctatcaccaggaggagtacgtgcgc

SEQ ID NO: 66610 - DNA, 29 bp, Artificial Sequence
  Description of Artificial Sequence: Synthetic oligonucleotide
acttctatcaccaggaggagtacgtgcgc

SEQ ID NO: 66611 - DNA, 28 bp, Artificial Sequence
  Description of Artificial Sequence: Synthetic oligonucleotide
cttctatcaccaggaggagtacgtgcgc

SEQ ID NO: 66612 - DNA, 30 bp, Artificial Sequence
  Description of Artificial Sequence: Synthetic oligonucleotide
ttctatcaccaggaggagtacgtgcgcttc

SEQ ID NO: 66613 - DNA, 29 bp, Artificial Sequence
  Description of Artificial Sequence: Synthetic oligonucleotide
tctatcaccaggaggagtacgtgcgcttc

SEQ ID NO: 66614 - DNA, 28 bp, Artificial Sequence
  Description of Artificial Sequence: Synthetic oligonucleotide
ctatcaccaggaggagtacgtgcgcttc

SEQ ID NO: 66615 - DNA, 28 bp, Artificial Sequence
  Description of Artificial Sequence: Synthetic oligonucleotide
tatcaccaggaggagtacgtgcgcttcg

SEQ ID NO: 66616 - DNA, 27 bp, Artificial Sequence
  Description of Artificial Sequence: Synthetic oligonucleotide
atcaccaggaggagtacgtgcgcttcg

SEQ ID NO: 66617 - DNA, 27 bp, Artificial Sequence
  Description of Artificial Sequence: Synthetic oligonucleotide
tcaccaggaggagtacgtgcgcttcga

SEQ ID NO: 66618 - DNA, 26 bp, Artificial Sequence
  Description of Artificial Sequence: Synthetic oligonucleotide
caccaggaggagtacgtgcgcttcga

SEQ ID NO: 66619 - DNA, 23 bp, Artificial Sequence
  Description of Artificial Sequence: Synthetic oligonucleotide
acagcgacgtgggggagtaccgc

SEQ ID NO: 66620 - DNA, 22 bp, Artificial Sequence
  Description of Artificial Sequence: Synthetic oligonucleotide
cagcgacgtgggggagtaccgc

SEQ ID NO: 66621 - DNA, 22 bp, Artificial Sequence
  Description of Artificial Sequence: Synthetic oligonucleotide
agcgacgtgggggagtaccgcg

SEQ ID NO: 66622 - DNA, 21 bp, Artificial Sequence
  Description of Artificial Sequence: Synthetic oligonucleotide
gcgacgtgggggagtaccgcg

SEQ ID NO: 66623 - DNA, 21 bp, Artificial Sequence
  Description of Artificial Sequence: Synthetic oligonucleotide
cgacgtgggggagtaccgcgc

SEQ ID NO: 66624 - DNA, 21 bp, Artificial Sequence
  Description of Artificial Sequence: Synthetic oligonucleotide
gacgtgggggagtaccgcgcg

SEQ ID NO: 66625 - DNA, 22 bp, Artificial Sequence
  Description of Artificial Sequence: Synthetic oligonucleotide
acgtgggggagtaccgcgcggt

SEQ ID NO: 66626 - DNA, 21 bp, Artificial Sequence
  Description of Artificial Sequence: Synthetic oligonucleotide
cgtgggggagtaccgcgcggt

SEQ ID NO: 66627 - DNA, 22 bp, Artificial Sequence
  Description of Artificial Sequence: Synthetic oligonucleotide
gtgggggagtaccgcgcggtga

SEQ ID NO: 66628 - DNA, 22 bp, Artificial Sequence
  Description of Artificial Sequence: Synthetic oligonucleotide
tgggggagtaccgcgcggtgac

SEQ ID NO: 66629 - DNA, 21 bp, Artificial Sequence
  Description of Artificial Sequence: Synthetic oligonucleotide
gggggagtaccgcgcggtgac

SEQ ID NO: 66630 - DNA, 21 bp, Artificial Sequence
  Description of Artificial Sequence: Synthetic oligonucleotide
ggggagtaccgcgcggtgacg

SEQ ID NO: 66631 - DNA, 22 bp, Artificial Sequence
  Description of Artificial Sequence: Synthetic oligonucleotide
gggagtaccgcgcggtgacgga

SEQ ID NO: 66632 - DNA, 22 bp, Artificial Sequence
  Description of Artificial Sequence: Synthetic oligonucleotide
ggagtaccgcgcggtgacggag

SEQ ID NO: 66633 - DNA, 23 bp, Artificial Sequence
  Description of Artificial Sequence: Synthetic oligonucleotide
gagtaccgcgcggtgacggagct

SEQ ID NO: 66634 - DNA, 23 bp, Artificial Sequence
  Description of Artificial Sequence: Synthetic oligonucleotide
agtaccgcgcggtgacggagctg

SEQ ID NO: 66635 - DNA, 22 bp, Artificial Sequence
  Description of Artificial Sequence: Synthetic oligonucleotide
gtaccgcgcggtgacggagctg

SEQ ID NO: 66636 - DNA, 22 bp, Artificial Sequence
  Description of Artificial Sequence: Synthetic oligonucleotide
taccgcgcggtgacggagctgg

SEQ ID NO: 66637 - DNA, 21 bp, Artificial Sequence
  Description of Artificial Sequence: Synthetic oligonucleotide
accgcgcggtgacggagctgg

SEQ ID NO: 66638 - DNA, 20 bp, Artificial Sequence
  Description of Artificial Sequence: Synthetic oligonucleotide
ccgcgcggtgacggagctgg

SEQ ID NO: 66639 - DNA, 20 bp, Artificial Sequence
  Description of Artificial Sequence: Synthetic oligonucleotide
cgcgcggtgacggagctggg

SEQ ID NO: 66640 - DNA, 20 bp, Artificial Sequence
  Description of Artificial Sequence: Synthetic oligonucleotide
gcgcggtgacggagctgggg

SEQ ID NO: 66641 - DNA, 20 bp, Artificial Sequence
  Description of Artificial Sequence: Synthetic oligonucleotide
cgcggtgacggagctggggc

SEQ ID NO: 66642 - DNA, 41 bp, Artificial Sequence
  Description of Artificial Sequence: Synthetic oligonucleotide
cacgtttcttggagcaggttaaacatgaatgtcatttcttc

SEQ ID NO: 66643 - DNA, 43 bp, Artificial Sequence
  Description of Artificial Sequence: Synthetic oligonucleotide
acgtttcttggagcaggttaaacatgaatgtcatttcttcaac

SEQ ID NO: 66644 - DNA, 42 bp, Artificial Sequence
  Description of Artificial Sequence: Synthetic oligonucleotide
cgtttcttggagcaggttaaacatgaatgtcatttcttcaac

SEQ ID NO: 66645 - DNA, 42 bp, Artificial Sequence
  Description of Artificial Sequence: Synthetic oligonucleotide
gtttcttggagcaggttaaacatgaatgtcatttcttcaacg

SEQ ID NO: 66646 - DNA, 42 bp, Artificial Sequence
  Description of Artificial Sequence: Synthetic oligonucleotide
tttcttggagcaggttaaacatgaatgtcatttcttcaacgg

SEQ ID NO: 66647 - DNA, 41 bp, Artificial Sequence
  Description of Artificial Sequence: Synthetic oligonucleotide
ttcttggagcaggttaaacatgaatgtcatttcttcaacgg

SEQ ID NO: 66648 - DNA, 40 bp, Artificial Sequence
  Description of Artificial Sequence: Synthetic oligonucleotide
tcttggagcaggttaaacatgaatgtcatttcttcaacgg

SEQ ID NO: 66649 - DNA, 39 bp, Artificial Sequence
  Description of Artificial Sequence: Synthetic oligonucleotide
cttggagcaggttaaacatgaatgtcatttcttcaacgg

SEQ ID NO: 66650 - DNA, 39 bp, Artificial Sequence
  Description of Artificial Sequence: Synthetic oligonucleotide
ttggagcaggttaaacatgaatgtcatttcttcaacggg

SEQ ID NO: 66651 - DNA, 38 bp, Artificial Sequence
  Description of Artificial Sequence: Synthetic oligonucleotide
tggagcaggttaaacatgaatgtcatttcttcaacggg

SEQ ID NO: 66652 - DNA, 37 bp, Artificial Sequence
  Description of Artificial Sequence: Synthetic oligonucleotide
ggagcaggttaaacatgaatgtcatttcttcaacggg

SEQ ID NO: 66653 - DNA, 38 bp, Artificial Sequence
  Description of Artificial Sequence: Synthetic oligonucleotide
gagcaggttaaacatgaatgtcatttcttcaacgggac

SEQ ID NO: 66654 - DNA, 38 bp, Artificial Sequence
  Description of Artificial Sequence: Synthetic oligonucleotide
agcaggttaaacatgaatgtcatttcttcaacgggacg

SEQ ID NO: 66655 - DNA, 37 bp, Artificial Sequence
  Description of Artificial Sequence: Synthetic oligonucleotide
gcaggttaaacatgaatgtcatttcttcaacgggacg

SEQ ID NO: 66656 - DNA, 37 bp, Artificial Sequence
  Description of Artificial Sequence: Synthetic oligonucleotide
caggttaaacatgaatgtcatttcttcaacgggacgg

SEQ ID NO: 66657 - DNA, 38 bp, Artificial Sequence
  Description of Artificial Sequence: Synthetic oligonucleotide
aggttaaacatgaatgtcatttcttcaacgggacggag

SEQ ID NO: 66658 - DNA, 37 bp, Artificial Sequence
  Description of Artificial Sequence: Synthetic oligonucleotide
ggttaaacatgaatgtcatttcttcaacgggacggag

SEQ ID NO: 66659 - DNA, 37 bp, Artificial Sequence
  Description of Artificial Sequence: Synthetic oligonucleotide
gttaaacatgaatgtcatttcttcaacgggacggagc

SEQ ID NO: 66660 - DNA, 37 bp, Artificial Sequence
  Description of Artificial Sequence: Synthetic oligonucleotide
ttaaacatgaatgtcatttcttcaacgggacggagcg

SEQ ID NO: 66661 - DNA, 36 bp, Artificial Sequence
  Description of Artificial Sequence: Synthetic oligonucleotide
taaacatgaatgtcatttcttcaacgggacggagcg

SEQ ID NO: 66662 - DNA, 35 bp, Artificial Sequence
  Description of Artificial Sequence: Synthetic oligonucleotide
aaacatgaatgtcatttcttcaacgggacggagcg

SEQ ID NO: 66663 - DNA, 34 bp, Artificial Sequence
  Description of Artificial Sequence: Synthetic oligonucleotide
aacatgaatgtcatttcttcaacgggacggagcg

SEQ ID NO: 66664 - DNA, 33 bp, Artificial Sequence
  Description of Artificial Sequence: Synthetic oligonucleotide
acatgaatgtcatttcttcaacgggacggagcg

SEQ ID NO: 66665 - DNA, 32 bp, Artificial Sequence
  Description of Artificial Sequence: Synthetic oligonucleotide
catgaatgtcatttcttcaacgggacggagcg

SEQ ID NO: 66666 - DNA, 32 bp, Artificial Sequence
  Description of Artificial Sequence: Synthetic oligonucleotide
atgaatgtcatttcttcaacgggacggagcgg

SEQ ID NO: 66667 - DNA, 37 bp, Artificial Sequence
  Description of Artificial Sequence: Synthetic oligonucleotide
ttaaacatgagtgtcatttcttcaacgggacggagag

SEQ ID NO: 66668 - DNA, 36 bp, Artificial Sequence
  Description of Artificial Sequence: Synthetic oligonucleotide
taaacatgagtgtcatttcttcaacgggacggagag

SEQ ID NO: 66669 - DNA, 35 bp, Artificial Sequence
  Description of Artificial Sequence: Synthetic oligonucleotide
aaacatgagtgtcatttcttcaacgggacggagag

SEQ ID NO: 66670 - DNA, 34 bp, Artificial Sequence
  Description of Artificial Sequence: Synthetic oligonucleotide
aacatgagtgtcatttcttcaacgggacggagag

SEQ ID NO: 66671 - DNA, 33 bp, Artificial Sequence
  Description of Artificial Sequence: Synthetic oligonucleotide
acatgagtgtcatttcttcaacgggacggagag

SEQ ID NO: 66672 - DNA, 32 bp, Artificial Sequence
  Description of Artificial Sequence: Synthetic oligonucleotide
catgagtgtcatttcttcaacgggacggagag

SEQ ID NO: 66673 - DNA, 32 bp, Artificial Sequence
  Description of Artificial Sequence: Synthetic oligonucleotide
atgagtgtcatttcttcaacgggacggagagg

SEQ ID NO: 66674 - DNA, 31 bp, Artificial Sequence
  Description of Artificial Sequence: Synthetic oligonucleotide
tgagtgtcatttcttcaacgggacggagagg

SEQ ID NO: 66675 - DNA, 30 bp, Artificial Sequence
  Description of Artificial Sequence: Synthetic oligonucleotide
gagtgtcatttcttcaacgggacggagagg

SEQ ID NO: 66676 - DNA, 30 bp, Artificial Sequence
  Description of Artificial Sequence: Synthetic oligonucleotide
agtgtcatttcttcaacgggacggagaggg

SEQ ID NO: 66677 - DNA, 29 bp, Artificial Sequence
  Description of Artificial Sequence: Synthetic oligonucleotide
gtgtcatttcttcaacgggacggagaggg

SEQ ID NO: 66678 - DNA, 30 bp, Artificial Sequence
  Description of Artificial Sequence: Synthetic oligonucleotide
tgtcatttcttcaacgggacggagagggtg

SEQ ID NO: 66679 - DNA, 29 bp, Artificial Sequence
  Description of Artificial Sequence: Synthetic oligonucleotide
gtcatttcttcaacgggacggagagggtg

SEQ ID NO: 66680 - DNA, 29 bp, Artificial Sequence
  Description of Artificial Sequence: Synthetic oligonucleotide
tcatttcttcaacgggacggagagggtgc

SEQ ID NO: 66681 - DNA, 28 bp, Artificial Sequence
  Description of Artificial Sequence: Synthetic oligonucleotide
catttcttcaacgggacggagagggtgc

SEQ ID NO: 66682 - DNA, 28 bp, Artificial Sequence
  Description of Artificial Sequence: Synthetic oligonucleotide
atttcttcaacgggacggagagggtgcg

SEQ ID NO: 66683 - DNA, 27 bp, Artificial Sequence
  Description of Artificial Sequence: Synthetic oligonucleotide
tttcttcaacgggacggagagggtgcg

SEQ ID NO: 66684 - DNA, 26 bp, Artificial Sequence
  Description of Artificial Sequence: Synthetic oligonucleotide
ttcttcaacgggacggagagggtgcg

SEQ ID NO: 66685 - DNA, 25 bp, Artificial Sequence
  Description of Artificial Sequence: Synthetic oligonucleotide
tcttcaacgggacggagagggtgcg

SEQ ID NO: 66686 - DNA, 24 bp, Artificial Sequence
  Description of Artificial Sequence: Synthetic oligonucleotide
cttcaacgggacggagagggtgcg

SEQ ID NO: 66687 - DNA, 26 bp, Artificial Sequence
  Description of Artificial Sequence: Synthetic oligonucleotide
ttcaacgggacggagagggtgcggtt

SEQ ID NO: 66688 - DNA, 25 bp, Artificial Sequence
  Description of Artificial Sequence: Synthetic oligonucleotide
tcaacgggacggagagggtgcggtt

SEQ ID NO: 66689 - DNA, 24 bp, Artificial Sequence
  Description of Artificial Sequence: Synthetic oligonucleotide
caacgggacggagagggtgcggtt

SEQ ID NO: 66690 - DNA, 24 bp, Artificial Sequence
  Description of Artificial Sequence: Synthetic oligonucleotide
aacgggacggagagggtgcggttc

SEQ ID NO: 66691 - DNA, 23 bp, Artificial Sequence
  Description of Artificial Sequence: Synthetic oligonucleotide
acgggacggagagggtgcggttc

SEQ ID NO: 66692 - DNA, 22 bp, Artificial Sequence
  Description of Artificial Sequence: Synthetic oligonucleotide
cgggacggagagggtgcggttc

SEQ ID NO: 66693 - DNA, 23 bp, Artificial Sequence
  Description of Artificial Sequence: Synthetic oligonucleotide
gggacggagagggtgcggttcct

SEQ ID NO: 66694 - DNA, 23 bp, Artificial Sequence
  Description of Artificial Sequence: Synthetic oligonucleotide
ggacggagagggtgcggttcctg

SEQ ID NO: 66695 - DNA, 24 bp, Artificial Sequence
  Description of Artificial Sequence: Synthetic oligonucleotide
gacggagagggtgcggttcctgga

SEQ ID NO: 66696 - DNA, 25 bp, Artificial Sequence
  Description of Artificial Sequence: Synthetic oligonucleotide
acggagagggtgcggttcctggaca

SEQ ID NO: 66697 - DNA, 24 bp, Artificial Sequence
  Description of Artificial Sequence: Synthetic oligonucleotide
cggagagggtgcggttcctggaca

SEQ ID NO: 66698 - DNA, 27 bp, Artificial Sequence
  Description of Artificial Sequence: Synthetic oligonucleotide
ggagagggtgcggttcctggacagata

SEQ ID NO: 66699 - DNA, 27 bp, Artificial Sequence
  Description of Artificial Sequence: Synthetic oligonucleotide
gagagggtgcggttcctggacagatac

SEQ ID NO: 66700 - DNA, 29 bp, Artificial Sequence
  Description of Artificial Sequence: Synthetic oligonucleotide
agagggtgcggttcctggacagatacttc

SEQ ID NO: 66701 - DNA, 28 bp, Artificial Sequence
  Description of Artificial Sequence: Synthetic oligonucleotide
gagggtgcggttcctggacagatacttc

SEQ ID NO: 66702 - DNA, 31 bp, Artificial Sequence
  Description of Artificial Sequence: Synthetic oligonucleotide
agggtgcggttcctggacagatacttctatc

SEQ ID NO: 66703 - DNA, 30 bp, Artificial Sequence
  Description of Artificial Sequence: Synthetic oligonucleotide
aactacggggttgtggagagcttcacagtc

SEQ ID NO: 66704 - DNA, 29 bp, Artificial Sequence
  Description of Artificial Sequence: Synthetic oligonucleotide
actacggggttgtggagagcttcacagtc

SEQ ID NO: 66705 - DNA, 28 bp, Artificial Sequence
  Description of Artificial Sequence: Synthetic oligonucleotide
ctacggggttgtggagagcttcacagtc

SEQ ID NO: 66706 - DNA, 28 bp, Artificial Sequence
  Description of Artificial Sequence: Synthetic oligonucleotide
tacggggttgtggagagcttcacagtcc

SEQ ID NO: 66707 - DNA, 27 bp, Artificial Sequence
  Description of Artificial Sequence: Synthetic oligonucleotide
acggggttgtggagagcttcacagtcc

SEQ ID NO: 66708 - DNA, 27 bp, Artificial Sequence
  Description of Artificial Sequence: Synthetic oligonucleotide
cggggttgtggagagcttcacagtcca

SEQ ID NO: 66709 - DNA, 27 bp, Artificial Sequence
  Description of Artificial Sequence: Synthetic oligonucleotide
ggggttgtggagagcttcacagtccag

SEQ ID NO: 66710 - DNA, 27 bp, Artificial Sequence
  Description of Artificial Sequence: Synthetic oligonucleotide
gggttgtggagagcttcacagtccagc

SEQ ID NO: 66711 - DNA, 27 bp, Artificial Sequence
  Description of Artificial Sequence: Synthetic oligonucleotide
ggttgtggagagcttcacagtccagcg

SEQ ID NO: 66712 - DNA, 27 bp, Artificial Sequence
  Description of Artificial Sequence: Synthetic oligonucleotide
gttgtggagagcttcacagtccagcgg

SEQ ID NO: 66713 - DNA, 27 bp, Artificial Sequence
  Description of Artificial Sequence: Synthetic oligonucleotide
ttgtggagagcttcacagtccagcggc

SEQ ID NO: 66714 - DNA, 26 bp, Artificial Sequence
  Description of Artificial Sequence: Synthetic oligonucleotide
tgtggagagcttcacagtccagcggc

SEQ ID NO: 66715 - DNA, 25 bp, Artificial Sequence
  Description of Artificial Sequence: Synthetic oligonucleotide
gtggagagcttcacagtccagcggc

SEQ ID NO: 66716 - DNA, 26 bp, Artificial Sequence
  Description of Artificial Sequence: Synthetic oligonucleotide
tggagagcttcacagtccagcggcga

SEQ ID NO: 66717 - DNA, 25 bp, Artificial Sequence
  Description of Artificial Sequence: Synthetic oligonucleotide
ggagagcttcacagtccagcggcga

SEQ ID NO: 66718 - DNA, 25 bp, Artificial Sequence
  Description of Artificial Sequence: Synthetic oligonucleotide
gagagcttcacagtccagcggcgag

SEQ ID NO: 66719 - DNA, 24 bp, Artificial Sequence
  Description of Artificial Sequence: Synthetic oligonucleotide
ggccgaggtggacacctactgcag

SEQ ID NO: 66720 - DNA, 24 bp, Artificial Sequence
  Description of Artificial Sequence: Synthetic oligonucleotide
gccgaggtggacacctactgcagg

SEQ ID NO: 66721 - DNA, 25 bp, Artificial Sequence
  Description of Artificial Sequence: Synthetic oligonucleotide
ccgaggtggacacctactgcaggca

SEQ ID NO: 66722 - DNA, 27 bp, Artificial Sequence
  Description of Artificial Sequence: Synthetic oligonucleotide
cgaggtggacacctactgcaggcacaa

SEQ ID NO: 66723 - DNA, 27 bp, Artificial Sequence
  Description of Artificial Sequence: Synthetic oligonucleotide
gaggtggacacctactgcaggcacaac

SEQ ID NO: 66724 - DNA, 29 bp, Artificial Sequence
  Description of Artificial Sequence: Synthetic oligonucleotide
aggtggacacctactgcaggcacaactac

SEQ ID NO: 66725 - DNA, 28 bp, Artificial Sequence
  Description of Artificial Sequence: Synthetic oligonucleotide
ggtggacacctactgcaggcacaactac

SEQ ID NO: 66726 - DNA, 28 bp, Artificial Sequence
  Description of Artificial Sequence: Synthetic oligonucleotide
gtggacacctactgcaggcacaactacg

SEQ ID NO: 66727 - DNA, 28 bp, Artificial Sequence
  Description of Artificial Sequence: Synthetic oligonucleotide
tggacacctactgcaggcacaactacgg

SEQ ID NO: 66728 - DNA, 27 bp, Artificial Sequence
  Description of Artificial Sequence: Synthetic oligonucleotide
ggacacctactgcaggcacaactacgg

SEQ ID NO: 66729 - DNA, 27 bp, Artificial Sequence
  Description of Artificial Sequence: Synthetic oligonucleotide
gacacctactgcaggcacaactacggg

SEQ ID NO: 66730 - DNA, 27 bp, Artificial Sequence
  Description of Artificial Sequence: Synthetic oligonucleotide
acacctactgcaggcacaactacgggg

SEQ ID NO: 66731 - DNA, 27 bp, Artificial Sequence
  Description of Artificial Sequence: Synthetic oligonucleotide
cacctactgcaggcacaactacggggt

SEQ ID NO: 66732 - DNA, 28 bp, Artificial Sequence
  Description of Artificial Sequence: Synthetic oligonucleotide
acctactgcaggcacaactacggggttg

SEQ ID NO: 66733 - DNA, 27 bp, Artificial Sequence
  Description of Artificial Sequence: Synthetic oligonucleotide
cctactgcaggcacaactacggggttg

SEQ ID NO: 66734 - DNA, 28 bp, Artificial Sequence
  Description of Artificial Sequence: Synthetic oligonucleotide
ctactgcaggcacaactacggggttgtg

SEQ ID NO: 66735 - DNA, 28 bp, Artificial Sequence
  Description of Artificial Sequence: Synthetic oligonucleotide
tactgcaggcacaactacggggttgtgg

SEQ ID NO: 66736 - DNA, 27 bp, Artificial Sequence
  Description of Artificial Sequence: Synthetic oligonucleotide
actgcaggcacaactacggggttgtgg

SEQ ID NO: 66737 - DNA, 27 bp, Artificial Sequence
  Description of Artificial Sequence: Synthetic oligonucleotide
ctgcaggcacaactacggggttgtgga

SEQ ID NO: 66738 - DNA, 27 bp, Artificial Sequence
  Description of Artificial Sequence: Synthetic oligonucleotide
tgcaggcacaactacggggttgtggag

SEQ ID NO: 66739 - DNA, 27 bp, Artificial Sequence
  Description of Artificial Sequence: Synthetic oligonucleotide
gcaggcacaactacggggttgtggaga

SEQ ID NO: 66740 - DNA, 27 bp, Artificial Sequence
  Description of Artificial Sequence: Synthetic oligonucleotide
caggcacaactacggggttgtggagag

SEQ ID NO: 66741 - DNA, 27 bp, Artificial Sequence
  Description of Artificial Sequence: Synthetic oligonucleotide
aggcacaactacggggttgtggagagc

SEQ ID NO: 66742 - DNA, 27 bp, Artificial Sequence
  Description of Artificial Sequence: Synthetic oligonucleotide
ggcacaactacggggttgtggagagct

SEQ ID NO: 66743 - DNA, 28 bp, Artificial Sequence
  Description of Artificial Sequence: Synthetic oligonucleotide
gcacaactacggggttgtggagagcttc

SEQ ID NO: 66744 - DNA, 29 bp, Artificial Sequence
  Description of Artificial Sequence: Synthetic oligonucleotide
cgagtactggaacagccagaaggaccttc

SEQ ID NO: 66745 - DNA, 30 bp, Artificial Sequence
  Description of Artificial Sequence: Synthetic oligonucleotide
gagtactggaacagccagaaggaccttctg

SEQ ID NO: 66746 - DNA, 30 bp, Artificial Sequence
  Description of Artificial Sequence: Synthetic oligonucleotide
agtactggaacagccagaaggaccttctgg

SEQ ID NO: 66747 - DNA, 29 bp, Artificial Sequence
  Description of Artificial Sequence: Synthetic oligonucleotide
gtactggaacagccagaaggaccttctgg

SEQ ID NO: 66748 - DNA, 30 bp, Artificial Sequence
  Description of Artificial Sequence: Synthetic oligonucleotide
tactggaacagccagaaggaccttctggag

SEQ ID NO: 66749 - DNA, 29 bp, Artificial Sequence
  Description of Artificial Sequence: Synthetic oligonucleotide
actggaacagccagaaggaccttctggag

SEQ ID NO: 66750 - DNA, 28 bp, Artificial Sequence
  Description of Artificial Sequence: Synthetic oligonucleotide
ctggaacagccagaaggaccttctggag

SEQ ID NO: 66751 - DNA, 28 bp, Artificial Sequence
  Description of Artificial Sequence: Synthetic oligonucleotide
tggaacagccagaaggaccttctggagc

SEQ ID NO: 66752 - DNA, 27 bp, Artificial Sequence
  Description of Artificial Sequence: Synthetic oligonucleotide
ggaacagccagaaggaccttctggagc

SEQ ID NO: 66753 - DNA, 28 bp, Artificial Sequence
  Description of Artificial Sequence: Synthetic oligonucleotide
gaacagccagaaggaccttctggagcag

SEQ ID NO: 66754 - DNA, 29 bp, Artificial Sequence
  Description of Artificial Sequence: Synthetic oligonucleotide
aacagccagaaggaccttctggagcagag

SEQ ID NO: 66755 - DNA, 28 bp, Artificial Sequence
  Description of Artificial Sequence: Synthetic oligonucleotide
acagccagaaggaccttctggagcagag

SEQ ID NO: 66756 - DNA, 27 bp, Artificial Sequence
  Description of Artificial Sequence: Synthetic oligonucleotide
cagccagaaggaccttctggagcagag

SEQ ID NO: 66757 - DNA, 27 bp, Artificial Sequence
  Description of Artificial Sequence: Synthetic oligonucleotide
agccagaaggaccttctggagcagagg

SEQ ID NO: 66758 - DNA, 26 bp, Artificial Sequence
  Description of Artificial Sequence: Synthetic oligonucleotide
gccagaaggaccttctggagcagagg

SEQ ID NO: 66759 - DNA, 26 bp, Artificial Sequence
  Description of Artificial Sequence: Synthetic oligonucleotide
ccagaaggaccttctggagcagaggc

SEQ ID NO: 66760 - DNA, 26 bp, Artificial Sequence
  Description of Artificial Sequence: Synthetic oligonucleotide
cagaaggaccttctggagcagaggcg

SEQ ID NO: 66761 - DNA, 26 bp, Artificial Sequence
  Description of Artificial Sequence: Synthetic oligonucleotide
agaaggaccttctggagcagaggcgg

SEQ ID NO: 66762 - DNA, 25 bp, Artificial Sequence
  Description of Artificial Sequence: Synthetic oligonucleotide
gaaggaccttctggagcagaggcgg

SEQ ID NO: 66763 - DNA, 25 bp, Artificial Sequence
  Description of Artificial Sequence: Synthetic oligonucleotide
aaggaccttctggagcagaggcggg

SEQ ID NO: 66764 - DNA, 24 bp, Artificial Sequence
  Description of Artificial Sequence: Synthetic oligonucleotide
aggaccttctggagcagaggcggg

SEQ ID NO: 66765 - DNA, 23 bp, Artificial Sequence
  Description of Artificial Sequence: Synthetic oligonucleotide
ggaccttctggagcagaggcggg

SEQ ID NO: 66766 - DNA, 23 bp, Artificial Sequence
  Description of Artificial Sequence: Synthetic oligonucleotide
gaccttctggagcagaggcgggc

SEQ ID NO: 66767 - DNA, 23 bp, Artificial Sequence
  Description of Artificial Sequence: Synthetic oligonucleotide
accttctggagcagaggcgggcc

SEQ ID NO: 66768 - DNA, 22 bp, Artificial Sequence
  Description of Artificial Sequence: Synthetic oligonucleotide
ccttctggagcagaggcgggcc

SEQ ID NO: 66769 - DNA, 22 bp, Artificial Sequence
  Description of Artificial Sequence: Synthetic oligonucleotide
cttctggagcagaggcgggccg

SEQ ID NO: 66770 - DNA, 22 bp, Artificial Sequence
  Description of Artificial Sequence: Synthetic oligonucleotide
ttctggagcagaggcgggccgc

SEQ ID NO: 66771 - DNA, 21 bp, Artificial Sequence
  Description of Artificial Sequence: Synthetic oligonucleotide
tctggagcagaggcgggccgc

SEQ ID NO: 66772 - DNA, 30 bp, Artificial Sequence
  Description of Artificial Sequence: Synthetic oligonucleotide
cggtggacacctactgcagacacaactatg

SEQ ID NO: 66773 - DNA, 30 bp, Artificial Sequence
  Description of Artificial Sequence: Synthetic oligonucleotide
ggtggacacctactgcagacacaactatgg

SEQ ID NO: 66774 - DNA, 30 bp, Artificial Sequence
  Description of Artificial Sequence: Synthetic oligonucleotide
gtggacacctactgcagacacaactatggg

SEQ ID NO: 66775 - DNA, 30 bp, Artificial Sequence
  Description of Artificial Sequence: Synthetic oligonucleotide
tggacacctactgcagacacaactatgggg

SEQ ID NO: 66776 - DNA, 29 bp, Artificial Sequence
  Description of Artificial Sequence: Synthetic oligonucleotide
ggacacctactgcagacacaactatgggg

SEQ ID NO: 66777 - DNA, 31 bp, Artificial Sequence
  Description of Artificial Sequence: Synthetic oligonucleotide
gacacctactgcagacacaactatggggttg

SEQ ID NO: 66778 - DNA, 32 bp, Artificial Sequence
  Description of Artificial Sequence: Synthetic oligonucleotide
acacctactgcagacacaactatggggttgtg

SEQ ID NO: 66779 - DNA, 31 bp, Artificial Sequence
  Description of Artificial Sequence: Synthetic oligonucleotide
cacctactgcagacacaactatggggttgtg

SEQ ID NO: 66780 - DNA, 31 bp, Artificial Sequence
  Description of Artificial Sequence: Synthetic oligonucleotide
acctactgcagacacaactatggggttgtgg

SEQ ID NO: 66781 - DNA, 30 bp, Artificial Sequence
  Description of Artificial Sequence: Synthetic oligonucleotide
cctactgcagacacaactatggggttgtgg

SEQ ID NO: 66782 - DNA, 31 bp, Artificial Sequence
  Description of Artificial Sequence: Synthetic oligonucleotide
ctactgcagacacaactatggggttgtggag

SEQ ID NO: 66783 - DNA, 32 bp, Artificial Sequence
  Description of Artificial Sequence: Synthetic oligonucleotide
tactgcagacacaactatggggttgtggagag

SEQ ID NO: 66784 - DNA, 31 bp, Artificial Sequence
  Description of Artificial Sequence: Synthetic oligonucleotide
actgcagacacaactatggggttgtggagag

SEQ ID NO: 66785 - DNA, 30 bp, Artificial Sequence
  Description of Artificial Sequence: Synthetic oligonucleotide
ctgcagacacaactatggggttgtggagag

SEQ ID NO: 66786 - DNA, 30 bp, Artificial Sequence
  Description of Artificial Sequence: Synthetic oligonucleotide
tgcagacacaactatggggttgtggagagc

SEQ ID NO: 66787 - DNA, 29 bp, Artificial Sequence
  Description of Artificial Sequence: Synthetic oligonucleotide
gcagacacaactatggggttgtggagagc

SEQ ID NO: 66788 - DNA, 31 bp, Artificial Sequence
  Description of Artificial Sequence: Synthetic oligonucleotide
cagacacaactatggggttgtggagagcttc

SEQ ID NO: 66789 - DNA, 32 bp, Artificial Sequence
  Description of Artificial Sequence: Synthetic oligonucleotide
agacacaactatggggttgtggagagcttcac

SEQ ID NO: 66790 - DNA, 31 bp, Artificial Sequence
  Description of Artificial Sequence: Synthetic oligonucleotide
gacacaactatggggttgtggagagcttcac

SEQ ID NO: 66791 - DNA, 32 bp, Artificial Sequence
  Description of Artificial Sequence: Synthetic oligonucleotide
acacaactatggggttgtggagagcttcacag

SEQ ID NO: 66792 - DNA, 31 bp, Artificial Sequence
  Description of Artificial Sequence: Synthetic oligonucleotide
cacaactatggggttgtggagagcttcacag

SEQ ID NO: 66793 - DNA, 32 bp, Artificial Sequence
  Description of Artificial Sequence: Synthetic oligonucleotide
acaactatggggttgtggagagcttcacagtg

SEQ ID NO: 66794 - DNA, 31 bp, Artificial Sequence
  Description of Artificial Sequence: Synthetic oligonucleotide
caactatggggttgtggagagcttcacagtg

SEQ ID NO: 66795 - DNA, 31 bp, Artificial Sequence
  Description of Artificial Sequence: Synthetic oligonucleotide
aactatggggttgtggagagcttcacagtgc

SEQ ID NO: 66796 - DNA, 30 bp, Artificial Sequence
  Description of Artificial Sequence: Synthetic oligonucleotide
actatggggttgtggagagcttcacagtgc

SEQ ID NO: 66797 - DNA, 29 bp, Artificial Sequence
  Description of Artificial Sequence: Synthetic oligonucleotide
ctatggggttgtggagagcttcacagtgc

SEQ ID NO: 66798 - DNA, 30 bp, Artificial Sequence
  Description of Artificial Sequence: Synthetic oligonucleotide
tatggggttgtggagagcttcacagtgcag

SEQ ID NO: 66799 - DNA, 29 bp, Artificial Sequence
  Description of Artificial Sequence: Synthetic oligonucleotide
atggggttgtggagagcttcacagtgcag

SEQ ID NO: 66800 - DNA, 28 bp, Artificial Sequence
  Description of Artificial Sequence: Synthetic oligonucleotide
tggggttgtggagagcttcacagtgcag

SEQ ID NO: 66801 - DNA, 24 bp, Artificial Sequence
  Description of Artificial Sequence: Synthetic oligonucleotide
aaggacctcctggagcagaggcgc

SEQ ID NO: 66802 - DNA, 23 bp, Artificial Sequence
  Description of Artificial Sequence: Synthetic oligonucleotide
aggacctcctggagcagaggcgc

SEQ ID NO: 66803 - DNA, 22 bp, Artificial Sequence
  Description of Artificial Sequence: Synthetic oligonucleotide
ggacctcctggagcagaggcgc

SEQ ID NO: 66804 - DNA, 22 bp, Artificial Sequence
  Description of Artificial Sequence: Synthetic oligonucleotide
gacctcctggagcagaggcgcg

SEQ ID NO: 66805 - DNA, 22 bp, Artificial Sequence
  Description of Artificial Sequence: Synthetic oligonucleotide
acctcctggagcagaggcgcgc

SEQ ID NO: 66806 - DNA, 21 bp, Artificial Sequence
  Description of Artificial Sequence: Synthetic oligonucleotide
cctcctggagcagaggcgcgc

SEQ ID NO: 66807 - DNA, 21 bp, Artificial Sequence
  Description of Artificial Sequence: Synthetic oligonucleotide
ctcctggagcagaggcgcgcc

SEQ ID NO: 66808 - DNA, 21 bp, Artificial Sequence
  Description of Artificial Sequence: Synthetic oligonucleotide
tcctggagcagaggcgcgccg

SEQ ID NO: 66809 - DNA, 20 bp, Artificial Sequence
  Description of Artificial Sequence: Synthetic oligonucleotide
cctggagcagaggcgcgccg

SEQ ID NO: 66810 - DNA, 20 bp, Artificial Sequence
  Description of Artificial Sequence: Synthetic oligonucleotide
ctggagcagaggcgcgccgc

SEQ ID NO: 66811 - DNA, 20 bp, Artificial Sequence
  Description of Artificial Sequence: Synthetic oligonucleotide
tggagcagaggcgcgccgcg

SEQ ID NO: 66812 - DNA, 20 bp, Artificial Sequence
  Description of Artificial Sequence: Synthetic oligonucleotide
ggagcagaggcgcgccgcgt

SEQ ID NO: 66813 - DNA, 20 bp, Artificial Sequence
  Description of Artificial Sequence: Synthetic oligonucleotide
gagcagaggcgcgccgcggt

SEQ ID NO: 66814 - DNA, 20 bp, Artificial Sequence
  Description of Artificial Sequence: Synthetic oligonucleotide
agcagaggcgcgccgcggtg

SEQ ID NO: 66815 - DNA, 20 bp, Artificial Sequence
  Description of Artificial Sequence: Synthetic oligonucleotide
gcagaggcgcgccgcggtgt

SEQ ID NO: 66816 - DNA, 20 bp, Artificial Sequence
  Description of Artificial Sequence: Synthetic oligonucleotide
cagaggcgcgccgcggtgga

SEQ ID NO: 66817 - DNA, 21 bp, Artificial Sequence
  Description of Artificial Sequence: Synthetic oligonucleotide
agaggcgcgccgcggtggaca

SEQ ID NO: 66818 - DNA, 20 bp, Artificial Sequence
  Description of Artificial Sequence: Synthetic oligonucleotide
gaggcgcgccgcggtggaca

SEQ ID NO: 66819 - DNA, 21 bp, Artificial Sequence
  Description of Artificial Sequence: Synthetic oligonucleotide
gcgcgccgcggtggacaccta

SEQ ID NO: 66820 - DNA, 22 bp, Artificial Sequence
  Description of Artificial Sequence: Synthetic oligonucleotide
cgcgccgcggtggacacctact

SEQ ID NO: 66821 - DNA, 22 bp, Artificial Sequence
  Description of Artificial Sequence: Synthetic oligonucleotide
gcgccgcggtggacacctactg

SEQ ID NO: 66822 - DNA, 23 bp, Artificial Sequence
  Description of Artificial Sequence: Synthetic oligonucleotide
cgccgcggtggacacctactgca

SEQ ID NO: 66823 - DNA, 33 bp, Artificial Sequence
  Description of Artificial Sequence: Synthetic oligonucleotide
agatacttctatcaccaagaggagtacgtgcgg

SEQ ID NO: 66824 - DNA, 32 bp, Artificial Sequence
  Description of Artificial Sequence: Synthetic oligonucleotide
gatacttctatcaccaagaggagtacgtgcgg

SEQ ID NO: 66825 - DNA, 34 bp, Artificial Sequence
  Description of Artificial Sequence: Synthetic oligonucleotide
atacttctatcaccaagaggagtacgtgcggttc

SEQ ID NO: 66826 - DNA, 33 bp, Artificial Sequence
  Description of Artificial Sequence: Synthetic oligonucleotide
tacttctatcaccaagaggagtacgtgcggttc

SEQ ID NO: 66827 - DNA, 32 bp, Artificial Sequence
  Description of Artificial Sequence: Synthetic oligonucleotide
acttctatcaccaagaggagtacgtgcggttc

SEQ ID NO: 66828 - DNA, 31 bp, Artificial Sequence
  Description of Artificial Sequence: Synthetic oligonucleotide
cttctatcaccaagaggagtacgtgcggttc

SEQ ID NO: 66829 - DNA, 31 bp, Artificial Sequence
  Description of Artificial Sequence: Synthetic oligonucleotide
ttctatcaccaagaggagtacgtgcggttcg

SEQ ID NO: 66830 - DNA, 30 bp, Artificial Sequence
  Description of Artificial Sequence: Synthetic oligonucleotide
tctatcaccaagaggagtacgtgcggttcg

SEQ ID NO: 66831 - DNA, 29 bp, Artificial Sequence
  Description of Artificial Sequence: Synthetic oligonucleotide
ctatcaccaagaggagtacgtgcggttcg

SEQ ID NO: 66832 - DNA, 30 bp, Artificial Sequence
  Description of Artificial Sequence: Synthetic oligonucleotide
tatcaccaagaggagtacgtgcggttcgac

SEQ ID NO: 66833 - DNA, 29 bp, Artificial Sequence
  Description of Artificial Sequence: Synthetic oligonucleotide
atcaccaagaggagtacgtgcggttcgac

SEQ ID NO: 66834 - DNA, 28 bp, Artificial Sequence
  Description of Artificial Sequence: Synthetic oligonucleotide
tcaccaagaggagtacgtgcggttcgac

SEQ ID NO: 66835 - DNA, 27 bp, Artificial Sequence
  Description of Artificial Sequence: Synthetic oligonucleotide
caccaagaggagtacgtgcggttcgac

SEQ ID NO: 66836 - DNA, 28 bp, Artificial Sequence
  Description of Artificial Sequence: Synthetic oligonucleotide
accaagaggagtacgtgcggttcgacag

SEQ ID NO: 66837 - DNA, 27 bp, Artificial Sequence
  Description of Artificial Sequence: Synthetic oligonucleotide
ccaagaggagtacgtgcggttcgacag

SEQ ID NO: 66838 - DNA, 27 bp, Artificial Sequence
  Description of Artificial Sequence: Synthetic oligonucleotide
caagaggagtacgtgcggttcgacagc

SEQ ID NO: 66839 - DNA, 27 bp, Artificial Sequence
  Description of Artificial Sequence: Synthetic oligonucleotide
aagaggagtacgtgcggttcgacagcg

SEQ ID NO: 66840 - DNA, 27 bp, Artificial Sequence
  Description of Artificial Sequence: Synthetic oligonucleotide
agaggagtacgtgcggttcgacagcga

SEQ ID NO: 66841 - DNA, 26 bp, Artificial Sequence
  Description of Artificial Sequence: Synthetic oligonucleotide
gaggagtacgtgcggttcgacagcga

SEQ ID NO: 66842 - DNA, 26 bp, Artificial Sequence
  Description of Artificial Sequence: Synthetic oligonucleotide
aggagtacgtgcggttcgacagcgac

SEQ ID NO: 66843 - DNA, 25 bp, Artificial Sequence
  Description of Artificial Sequence: Synthetic oligonucleotide
ggagtacgtgcggttcgacagcgac

SEQ ID NO: 66844 - DNA, 26 bp, Artificial Sequence
  Description of Artificial Sequence: Synthetic oligonucleotide
gagtacgtgcggttcgacagcgacgt

SEQ ID NO: 66845 - DNA, 26 bp, Artificial Sequence
  Description of Artificial Sequence: Synthetic oligonucleotide
agtacgtgcggttcgacagcgacgtg

SEQ ID NO: 66846 - DNA, 25 bp, Artificial Sequence
  Description of Artificial Sequence: Synthetic oligonucleotide
gtacgtgcggttcgacagcgacgtg

SEQ ID NO: 66847 - DNA, 25 bp, Artificial Sequence
  Description of Artificial Sequence: Synthetic oligonucleotide
tacgtgcggttcgacagcgacgtgg

SEQ ID NO: 66848 - DNA, 24 bp, Artificial Sequence
  Description of Artificial Sequence: Synthetic oligonucleotide
acgtgcggttcgacagcgacgtgg

SEQ ID NO: 66849 - DNA, 23 bp, Artificial Sequence
  Description of Artificial Sequence: Synthetic oligonucleotide
cgtgcggttcgacagcgacgtgg

SEQ ID NO: 66850 - DNA, 23 bp, Artificial Sequence
  Description of Artificial Sequence: Synthetic oligonucleotide
gtgcggttcgacagcgacgtggg

SEQ ID NO: 66851 - DNA, 23 bp, Artificial Sequence
  Description of Artificial Sequence: Synthetic oligonucleotide
tgcggttcgacagcgacgtgggg

SEQ ID NO: 66852 - DNA, 22 bp, Artificial Sequence
  Description of Artificial Sequence: Synthetic oligonucleotide
gcggttcgacagcgacgtgggg

SEQ ID NO: 66853 - DNA, 23 bp, Artificial Sequence
  Description of Artificial Sequence: Synthetic oligonucleotide
cggttcgacagcgacgtggggga

SEQ ID NO: 66854 - DNA, 25 bp, Artificial Sequence
  Description of Artificial Sequence: Synthetic oligonucleotide
ggttcgacagcgacgtgggggagta

SEQ ID NO: 66855 - DNA, 25 bp, Artificial Sequence
  Description of Artificial Sequence: Synthetic oligonucleotide
gttcgacagcgacgtgggggagtac

SEQ ID NO: 66856 - DNA, 28 bp, Artificial Sequence
  Description of Artificial Sequence: Synthetic oligonucleotide
gttggtgagagcttcacagtgcagcgac

SEQ ID NO: 66857 - DNA, 28 bp, Artificial Sequence
  Description of Artificial Sequence: Synthetic oligonucleotide
ttggtgagagcttcacagtgcagcgacg

SEQ ID NO: 66858 - DNA, 27 bp, Artificial Sequence
  Description of Artificial Sequence: Synthetic oligonucleotide
tggtgagagcttcacagtgcagcgacg

SEQ ID NO: 66859 - DNA, 27 bp, Artificial Sequence
  Description of Artificial Sequence: Synthetic oligonucleotide
ggtgagagcttcacagtgcagcgacga

SEQ ID NO: 66860 - DNA, 27 bp, Artificial Sequence
  Description of Artificial Sequence: Synthetic oligonucleotide
gtgagagcttcacagtgcagcgacgag

SEQ ID NO: 66861 - DNA, 26 bp, Artificial Sequence
  Description of Artificial Sequence: Synthetic oligonucleotide
cttcgacagcgacgtgggggagtaca

SEQ ID NO: 66862 - DNA, 26 bp, Artificial Sequence
  Description of Artificial Sequence: Synthetic oligonucleotide
ttcgacagcgacgtgggggagtacag

SEQ ID NO: 66863 - DNA, 25 bp, Artificial Sequence
  Description of Artificial Sequence: Synthetic oligonucleotide
tcgacagcgacgtgggggagtacag

SEQ ID NO: 66864 - DNA, 24 bp, Artificial Sequence
  Description of Artificial Sequence: Synthetic oligonucleotide
cgacagcgacgtgggggagtacag

SEQ ID NO: 66865 - DNA, 24 bp, Artificial Sequence
  Description of Artificial Sequence: Synthetic oligonucleotide
gacagcgacgtgggggagtacagg

SEQ ID NO: 66866 - DNA, 24 bp, Artificial Sequence
  Description of Artificial Sequence: Synthetic oligonucleotide
acagcgacgtgggggagtacaggg

SEQ ID NO: 66867 - DNA, 23 bp, Artificial Sequence
  Description of Artificial Sequence: Synthetic oligonucleotide
cagcgacgtgggggagtacaggg

SEQ ID NO: 66868 - DNA, 23 bp, Artificial Sequence
  Description of Artificial Sequence: Synthetic oligonucleotide
agcgacgtgggggagtacagggc

SEQ ID NO: 66869 - DNA, 22 bp, Artificial Sequence
  Description of Artificial Sequence: Synthetic oligonucleotide
gcgacgtgggggagtacagggc

SEQ ID NO: 66870 - DNA, 22 bp, Artificial Sequence
  Description of Artificial Sequence: Synthetic oligonucleotide
cgacgtgggggagtacagggcg

SEQ ID NO: 66871 - DNA, 23 bp, Artificial Sequence
  Description of Artificial Sequence: Synthetic oligonucleotide
gacgtgggggagtacagggcggt

SEQ ID NO: 66872 - DNA, 24 bp, Artificial Sequence
  Description of Artificial Sequence: Synthetic oligonucleotide
acgtgggggagtacagggcggtga

SEQ ID NO: 66873 - DNA, 23 bp, Artificial Sequence
  Description of Artificial Sequence: Synthetic oligonucleotide
cgtgggggagtacagggcggtga

SEQ ID NO: 66874 - DNA, 23 bp, Artificial Sequence
  Description of Artificial Sequence: Synthetic oligonucleotide
gtgggggagtacagggcggtgac

SEQ ID NO: 66875 - DNA, 23 bp, Artificial Sequence
  Description of Artificial Sequence: Synthetic oligonucleotide
tgggggagtacagggcggtgacg

SEQ ID NO: 66876 - DNA, 22 bp, Artificial Sequence
  Description of Artificial Sequence: Synthetic oligonucleotide
gggggagtacagggcggtgacg

SEQ ID NO: 66877 - DNA, 23 bp, Artificial Sequence
  Description of Artificial Sequence: Synthetic oligonucleotide
ggggagtacagggcggtgacgga

SEQ ID NO: 66878 - DNA, 23 bp, Artificial Sequence
  Description of Artificial Sequence: Synthetic oligonucleotide
gggagtacagggcggtgacggag

SEQ ID NO: 66879 - DNA, 24 bp, Artificial Sequence
  Description of Artificial Sequence: Synthetic oligonucleotide
ggagtacagggcggtgacggagct

SEQ ID NO: 66880 - DNA, 24 bp, Artificial Sequence
  Description of Artificial Sequence: Synthetic oligonucleotide
gagtacagggcggtgacggagctg

SEQ ID NO: 66881 - DNA, 24 bp, Artificial Sequence
  Description of Artificial Sequence: Synthetic oligonucleotide
agtacagggcggtgacggagctgg

SEQ ID NO: 66882 - DNA, 23 bp, Artificial Sequence
  Description of Artificial Sequence: Synthetic oligonucleotide
gtacagggcggtgacggagctgg

SEQ ID NO: 66883 - DNA, 23 bp, Artificial Sequence
  Description of Artificial Sequence: Synthetic oligonucleotide
tacagggcggtgacggagctggg

SEQ ID NO: 66884 - DNA, 22 bp, Artificial Sequence
  Description of Artificial Sequence: Synthetic oligonucleotide
acagggcggtgacggagctggg

SEQ ID NO: 66885 - DNA, 21 bp, Artificial Sequence
  Description of Artificial Sequence: Synthetic oligonucleotide
cagggcggtgacggagctggg

SEQ ID NO: 66886 - DNA, 21 bp, Artificial Sequence
  Description of Artificial Sequence: Synthetic oligonucleotide
agggcggtgacggagctgggg

SEQ ID NO: 66887 - DNA, 20 bp, Artificial Sequence
  Description of Artificial Sequence: Synthetic oligonucleotide
gtgacggagctggggcggcc

SEQ ID NO: 66888 - DNA, 21 bp, Artificial Sequence
  Description of Artificial Sequence: Synthetic oligonucleotide
tgacggagctggggcggccca

SEQ ID NO: 66889 - DNA, 20 bp, Artificial Sequence
  Description of Artificial Sequence: Synthetic oligonucleotide
gacggagctggggcggccca

SEQ ID NO: 66890 - DNA, 20 bp, Artificial Sequence
  Description of Artificial Sequence: Synthetic oligonucleotide
acggagctggggcggcccag

SEQ ID NO: 66891 - DNA, 20 bp, Artificial Sequence
  Description of Artificial Sequence: Synthetic oligonucleotide
cggagctggggcggcccagt

SEQ ID NO: 66892 - DNA, 20 bp, Artificial Sequence
  Description of Artificial Sequence: Synthetic oligonucleotide
ggagctggggcggcccagct

SEQ ID NO: 66893 - DNA, 20 bp, Artificial Sequence
  Description of Artificial Sequence: Synthetic oligonucleotide
gagctggggcggcccagcgt

SEQ ID NO: 66894 - DNA, 20 bp, Artificial Sequence
  Description of Artificial Sequence: Synthetic oligonucleotide
agctggggcggcccagcgct

SEQ ID NO: 66895 - DNA, 20 bp, Artificial Sequence
  Description of Artificial Sequence: Synthetic oligonucleotide
gctggggcggcccagcgctt

SEQ ID NO: 66896 - DNA, 20 bp, Artificial Sequence
  Description of Artificial Sequence: Synthetic oligonucleotide
ctggggcggcccagcgcctt

SEQ ID NO: 66897 - DNA, 20 bp, Artificial Sequence
  Description of Artificial Sequence: Synthetic oligonucleotide
tggggcggcccagcgccgat

SEQ ID NO: 66898 - DNA, 20 bp, Artificial Sequence
  Description of Artificial Sequence: Synthetic oligonucleotide
ggggcggcccagcgccgatt

SEQ ID NO: 66899 - DNA, 20 bp, Artificial Sequence
  Description of Artificial Sequence: Synthetic oligonucleotide
gggcggcccagcgccgagta

SEQ ID NO: 66900 - DNA, 21 bp, Artificial Sequence
  Description of Artificial Sequence: Synthetic oligonucleotide
ggcggcccagcgccgagtact

SEQ ID NO: 66901 - DNA, 21 bp, Artificial Sequence
  Description of Artificial Sequence: Synthetic oligonucleotide
gcggcccagcgccgagtactg

SEQ ID NO: 66902 - DNA, 23 bp, Artificial Sequence
  Description of Artificial Sequence: Synthetic oligonucleotide
cggcccagcgccgagtactggaa

SEQ ID NO: 66903 - DNA, 24 bp, Artificial Sequence
  Description of Artificial Sequence: Synthetic oligonucleotide
ggcccagcgccgagtactggaaca

SEQ ID NO: 66904 - DNA, 24 bp, Artificial Sequence
  Description of Artificial Sequence: Synthetic oligonucleotide
gcccagcgccgagtactggaacag

SEQ ID NO: 66905 - DNA, 24 bp, Artificial Sequence
  Description of Artificial Sequence: Synthetic oligonucleotide
cccagcgccgagtactggaacagc

SEQ ID NO: 66906 - DNA, 25 bp, Artificial Sequence
  Description of Artificial Sequence: Synthetic oligonucleotide
ccagcgccgagtactggaacagcca

SEQ ID NO: 66907 - DNA, 27 bp, Artificial Sequence
  Description of Artificial Sequence: Synthetic oligonucleotide
cagcgccgagtactggaacagccagaa

SEQ ID NO: 66908 - DNA, 36 bp, Artificial Sequence
  Description of Artificial Sequence: Synthetic oligonucleotide
gagcaggttaaacatgagtgtcatttcttcaacggc

SEQ ID NO: 66909 - DNA, 37 bp, Artificial Sequence
  Description of Artificial Sequence: Synthetic oligonucleotide
agcaggttaaacatgagtgtcatttcttcaacggcac

SEQ ID NO: 66910 - DNA, 36 bp, Artificial Sequence
  Description of Artificial Sequence: Synthetic oligonucleotide
gcaggttaaacatgagtgtcatttcttcaacggcac

SEQ ID NO: 66911 - DNA, 36 bp, Artificial Sequence
  Description of Artificial Sequence: Synthetic oligonucleotide
caggttaaacatgagtgtcatttcttcaacggcacg

SEQ ID NO: 66912 - DNA, 36 bp, Artificial Sequence
  Description of Artificial Sequence: Synthetic oligonucleotide
aggttaaacatgagtgtcatttcttcaacggcacgg

SEQ ID NO: 66913 - DNA, 35 bp, Artificial Sequence
  Description of Artificial Sequence: Synthetic oligonucleotide
ggttaaacatgagtgtcatttcttcaacggcacgg

SEQ ID NO: 66914 - DNA, 36 bp, Artificial Sequence
  Description of Artificial Sequence: Synthetic oligonucleotide
gttaaacatgagtgtcatttcttcaacggcacggag

SEQ ID NO: 66915 - DNA, 36 bp, Artificial Sequence
  Description of Artificial Sequence: Synthetic oligonucleotide
ttaaacatgagtgtcatttcttcaacggcacggagc

SEQ ID NO: 66916 - DNA, 35 bp, Artificial Sequence
  Description of Artificial Sequence: Synthetic oligonucleotide
taaacatgagtgtcatttcttcaacggcacggagc

SEQ ID NO: 66917 - DNA, 34 bp, Artificial Sequence
  Description of Artificial Sequence: Synthetic oligonucleotide
aaacatgagtgtcatttcttcaacggcacggagc

SEQ ID NO: 66918 - DNA, 33 bp, Artificial Sequence
  Description of Artificial Sequence: Synthetic oligonucleotide
aacatgagtgtcatttcttcaacggcacggagc

SEQ ID NO: 66919 - DNA, 32 bp, Artificial Sequence
  Description of Artificial Sequence: Synthetic oligonucleotide
acatgagtgtcatttcttcaacggcacggagc

SEQ ID NO: 66920 - DNA, 31 bp, Artificial Sequence
  Description of Artificial Sequence: Synthetic oligonucleotide
catgagtgtcatttcttcaacggcacggagc

SEQ ID NO: 66921 - DNA, 31 bp, Artificial Sequence
  Description of Artificial Sequence: Synthetic oligonucleotide
atgagtgtcatttcttcaacggcacggagcg

SEQ ID NO: 66922 - DNA, 30 bp, Artificial Sequence
  Description of Artificial Sequence: Synthetic oligonucleotide
tgagtgtcatttcttcaacggcacggagcg

SEQ ID NO: 66923 - DNA, 29 bp, Artificial Sequence
  Description of Artificial Sequence: Synthetic oligonucleotide
gagtgtcatttcttcaacggcacggagcg

SEQ ID NO: 66924 - DNA, 29 bp, Artificial Sequence
  Description of Artificial Sequence: Synthetic oligonucleotide
agtgtcatttcttcaacggcacggagcgg

SEQ ID NO: 66925 - DNA, 28 bp, Artificial Sequence
  Description of Artificial Sequence: Synthetic oligonucleotide
gtgtcatttcttcaacggcacggagcgg

SEQ ID NO: 66926 - DNA, 28 bp, Artificial Sequence
  Description of Artificial Sequence: Synthetic oligonucleotide
tgtcatttcttcaacggcacggagcggg

SEQ ID NO: 66927 - DNA, 27 bp, Artificial Sequence
  Description of Artificial Sequence: Synthetic oligonucleotide
gtcatttcttcaacggcacggagcggg

SEQ ID NO: 66928 - DNA, 28 bp, Artificial Sequence
  Description of Artificial Sequence: Synthetic oligonucleotide
tcatttcttcaacggcacggagcgggtg

SEQ ID NO: 66929 - DNA, 27 bp, Artificial Sequence
  Description of Artificial Sequence: Synthetic oligonucleotide
catttcttcaacggcacggagcgggtg

SEQ ID NO: 66930 - DNA, 27 bp, Artificial Sequence
  Description of Artificial Sequence: Synthetic oligonucleotide
atttcttcaacggcacggagcgggtgc

SEQ ID NO: 66931 - DNA, 26 bp, Artificial Sequence
  Description of Artificial Sequence: Synthetic oligonucleotide
tttcttcaacggcacggagcgggtgc

SEQ ID NO: 66932 - DNA, 25 bp, Artificial Sequence
  Description of Artificial Sequence: Synthetic oligonucleotide
ttcttcaacggcacggagcgggtgc

SEQ ID NO: 66933 - DNA, 24 bp, Artificial Sequence
  Description of Artificial Sequence: Synthetic oligonucleotide
tcttcaacggcacggagcgggtgc

SEQ ID NO: 66934 - DNA, 23 bp, Artificial Sequence
  Description of Artificial Sequence: Synthetic oligonucleotide
cttcaacggcacggagcgggtgc

SEQ ID NO: 66935 - DNA, 23 bp, Artificial Sequence
  Description of Artificial Sequence: Synthetic oligonucleotide
ttcaacggcacggagcgggtgcg

SEQ ID NO: 66936 - DNA, 22 bp, Artificial Sequence
  Description of Artificial Sequence: Synthetic oligonucleotide
tcaacggcacggagcgggtgcg

SEQ ID NO: 66937 - DNA, 21 bp, Artificial Sequence
  Description of Artificial Sequence: Synthetic oligonucleotide
caacggcacggagcgggtgcg

SEQ ID NO: 66938 - DNA, 23 bp, Artificial Sequence
  Description of Artificial Sequence: Synthetic oligonucleotide
aacggcacggagcgggtgcggtt

SEQ ID NO: 66939 - DNA, 22 bp, Artificial Sequence
  Description of Artificial Sequence: Synthetic oligonucleotide
acggcacggagcgggtgcggtt

SEQ ID NO: 66940 - DNA, 21 bp, Artificial Sequence
  Description of Artificial Sequence: Synthetic oligonucleotide
cggcacggagcgggtgcggtt

SEQ ID NO: 66941 - DNA, 21 bp, Artificial Sequence
  Description of Artificial Sequence: Synthetic oligonucleotide
ggcacggagcgggtgcggttc

SEQ ID NO: 66942 - DNA, 22 bp, Artificial Sequence
  Description of Artificial Sequence: Synthetic oligonucleotide
gcacggagcgggtgcggttcct

SEQ ID NO: 66943 - DNA, 22 bp, Artificial Sequence
  Description of Artificial Sequence: Synthetic oligonucleotide
cacggagcgggtgcggttcctg

SEQ ID NO: 66944 - DNA, 27 bp, Artificial Sequence
  Description of Artificial Sequence: Synthetic oligonucleotide
gagtacgtgcgcttcgacagcgacgta

SEQ ID NO: 66945 - DNA, 27 bp, Artificial Sequence
  Description of Artificial Sequence: Synthetic oligonucleotide
agtacgtgcgcttcgacagcgacgtag

SEQ ID NO: 66946 - DNA, 26 bp, Artificial Sequence
  Description of Artificial Sequence: Synthetic oligonucleotide
gtacgtgcgcttcgacagcgacgtag

SEQ ID NO: 66947 - DNA, 26 bp, Artificial Sequence
  Description of Artificial Sequence: Synthetic oligonucleotide
tacgtgcgcttcgacagcgacgtagg

SEQ ID NO: 66948 - DNA, 25 bp, Artificial Sequence
  Description of Artificial Sequence: Synthetic oligonucleotide
acgtgcgcttcgacagcgacgtagg

SEQ ID NO: 66949 - DNA, 35 bp, Artificial Sequence
  Description of Artificial Sequence: Synthetic oligonucleotide
ttcctggacagatacttctatcaccaagaggagtc

SEQ ID NO: 66950 - DNA, 34 bp, Artificial Sequence
  Description of Artificial Sequence: Synthetic oligonucleotide
tcctggacagatacttctatcaccaagaggagtc

SEQ ID NO: 66951 - DNA, 33 bp, Artificial Sequence
  Description of Artificial Sequence: Synthetic oligonucleotide
cctggacagatacttctatcaccaagaggagtc

SEQ ID NO: 66952 - DNA, 33 bp, Artificial Sequence
  Description of Artificial Sequence: Synthetic oligonucleotide
ctggacagatacttctatcaccaagaggagtcc

SEQ ID NO: 66953 - DNA, 33 bp, Artificial Sequence
  Description of Artificial Sequence: Synthetic oligonucleotide
tggacagatacttctatcaccaagaggagtccg

SEQ ID NO: 66954 - DNA, 32 bp, Artificial Sequence
  Description of Artificial Sequence: Synthetic oligonucleotide
ggacagatacttctatcaccaagaggagtccg

SEQ ID NO: 66955 - DNA, 33 bp, Artificial Sequence
  Description of Artificial Sequence: Synthetic oligonucleotide
gacagatacttctatcaccaagaggagtccgtg

SEQ ID NO: 66956 - DNA, 33 bp, Artificial Sequence
  Description of Artificial Sequence: Synthetic oligonucleotide
acagatacttctatcaccaagaggagtccgtgc

SEQ ID NO: 66957 - DNA, 32 bp, Artificial Sequence
  Description of Artificial Sequence: Synthetic oligonucleotide
cagatacttctatcaccaagaggagtccgtgc

SEQ ID NO: 66958 - DNA, 32 bp, Artificial Sequence
  Description of Artificial Sequence: Synthetic oligonucleotide
agatacttctatcaccaagaggagtccgtgcg

SEQ ID NO: 66959 - DNA, 31 bp, Artificial Sequence
  Description of Artificial Sequence: Synthetic oligonucleotide
gatacttctatcaccaagaggagtccgtgcg

SEQ ID NO: 66960 - DNA, 31 bp, Artificial Sequence
  Description of Artificial Sequence: Synthetic oligonucleotide
atacttctatcaccaagaggagtccgtgcgc

SEQ ID NO: 66961 - DNA, 30 bp, Artificial Sequence
  Description of Artificial Sequence: Synthetic oligonucleotide
tacttctatcaccaagaggagtccgtgcgc

SEQ ID NO: 66962 - DNA, 29 bp, Artificial Sequence
  Description of Artificial Sequence: Synthetic oligonucleotide
acttctatcaccaagaggagtccgtgcgc

SEQ ID NO: 66963 - DNA, 28 bp, Artificial Sequence
  Description of Artificial Sequence: Synthetic oligonucleotide
cttctatcaccaagaggagtccgtgcgc

SEQ ID NO: 66964 - DNA, 30 bp, Artificial Sequence
  Description of Artificial Sequence: Synthetic oligonucleotide
ttctatcaccaagaggagtccgtgcgcttc

SEQ ID NO: 66965 - DNA, 29 bp, Artificial Sequence
  Description of Artificial Sequence: Synthetic oligonucleotide
tctatcaccaagaggagtccgtgcgcttc

SEQ ID NO: 66966 - DNA, 28 bp, Artificial Sequence
  Description of Artificial Sequence: Synthetic oligonucleotide
ctatcaccaagaggagtccgtgcgcttc

SEQ ID NO: 66967 - DNA, 28 bp, Artificial Sequence
  Description of Artificial Sequence: Synthetic oligonucleotide
tatcaccaagaggagtccgtgcgcttcg

SEQ ID NO: 66968 - DNA, 27 bp, Artificial Sequence
  Description of Artificial Sequence: Synthetic oligonucleotide
atcaccaagaggagtccgtgcgcttcg

SEQ ID NO: 66969 - DNA, 27 bp, Artificial Sequence
  Description of Artificial Sequence: Synthetic oligonucleotide
tcaccaagaggagtccgtgcgcttcga

SEQ ID NO: 66970 - DNA, 26 bp, Artificial Sequence
  Description of Artificial Sequence: Synthetic oligonucleotide
caccaagaggagtccgtgcgcttcga

SEQ ID NO: 66971 - DNA, 28 bp, Artificial Sequence
  Description of Artificial Sequence: Synthetic oligonucleotide
acagtgcagcggcgagtctatcctgaag

SEQ ID NO: 66972 - DNA, 27 bp, Artificial Sequence
  Description of Artificial Sequence: Synthetic oligonucleotide
cagtgcagcggcgagtctatcctgaag

SEQ ID NO: 66973 - DNA, 28 bp, Artificial Sequence
  Description of Artificial Sequence: Synthetic oligonucleotide
agtgcagcggcgagtctatcctgaagtg

SEQ ID NO: 66974 - DNA, 27 bp, Artificial Sequence
  Description of Artificial Sequence: Synthetic oligonucleotide
gtgcagcggcgagtctatcctgaagtg

SEQ ID NO: 66975 - DNA, 28 bp, Artificial Sequence
  Description of Artificial Sequence: Synthetic oligonucleotide
tgcagcggcgagtctatcctgaagtgac

SEQ ID NO: 66976 - DNA, 27 bp, Artificial Sequence
  Description of Artificial Sequence: Synthetic oligonucleotide
gcagcggcgagtctatcctgaagtgac

SEQ ID NO: 66977 - DNA, 28 bp, Artificial Sequence
  Description of Artificial Sequence: Synthetic oligonucleotide
cagcggcgagtctatcctgaagtgactg

SEQ ID NO: 66978 - DNA, 29 bp, Artificial Sequence
  Description of Artificial Sequence: Synthetic oligonucleotide
agcggcgagtctatcctgaagtgactgtg

SEQ ID NO: 66979 - DNA, 28 bp, Artificial Sequence
  Description of Artificial Sequence: Synthetic oligonucleotide
gcggcgagtctatcctgaagtgactgtg

SEQ ID NO: 66980 - DNA, 31 bp, Artificial Sequence
  Description of Artificial Sequence: Synthetic oligonucleotide
cggcgagtctatcctgaagtgactgtgtatc

SEQ ID NO: 66981 - DNA, 31 bp, Artificial Sequence
  Description of Artificial Sequence: Synthetic oligonucleotide
ggcgagtctatcctgaagtgactgtgtatcc

SEQ ID NO: 66982 - DNA, 32 bp, Artificial Sequence
  Description of Artificial Sequence: Synthetic oligonucleotide
gcgagtctatcctgaagtgactgtgtatcctg

SEQ ID NO: 66983 - DNA, 32 bp, Artificial Sequence
  Description of Artificial Sequence: Synthetic oligonucleotide
cgagtctatcctgaagtgactgtgtatcctgc

SEQ ID NO: 66984 - DNA, 35 bp, Artificial Sequence
  Description of Artificial Sequence: Synthetic oligonucleotide
gagtctatcctgaagtgactgtgtatcctgcaaag

SEQ ID NO: 66985 - DNA, 36 bp, Artificial Sequence
  Description of Artificial Sequence: Synthetic oligonucleotide
agtctatcctgaagtgactgtgtatcctgcaaagac

SEQ ID NO: 66986 - DNA, 35 bp, Artificial Sequence
  Description of Artificial Sequence: Synthetic oligonucleotide
gtctatcctgaagtgactgtgtatcctgcaaagac

SEQ ID NO: 66987 - DNA, 35 bp, Artificial Sequence
  Description of Artificial Sequence: Synthetic oligonucleotide
tctatcctgaagtgactgtgtatcctgcaaagacc

SEQ ID NO: 66988 - DNA, 34 bp, Artificial Sequence
  Description of Artificial Sequence: Synthetic oligonucleotide
ctatcctgaagtgactgtgtatcctgcaaagacc

SEQ ID NO: 66989 - DNA, 34 bp, Artificial Sequence
  Description of Artificial Sequence: Synthetic oligonucleotide
tatcctgaagtgactgtgtatcctgcaaagaccc

SEQ ID NO: 66990 - DNA, 33 bp, Artificial Sequence
  Description of Artificial Sequence: Synthetic oligonucleotide
atcctgaagtgactgtgtatcctgcaaagaccc

SEQ ID NO: 66991 - DNA, 32 bp, Artificial Sequence
  Description of Artificial Sequence: Synthetic oligonucleotide
tcctgaagtgactgtgtatcctgcaaagaccc

SEQ ID NO: 66992 - DNA, 31 bp, Artificial Sequence
  Description of Artificial Sequence: Synthetic oligonucleotide
cctgaagtgactgtgtatcctgcaaagaccc

SEQ ID NO: 66993 - DNA, 32 bp, Artificial Sequence
  Description of Artificial Sequence: Synthetic oligonucleotide
ctgaagtgactgtgtatcctgcaaagacccag

SEQ ID NO: 66994 - DNA, 32 bp, Artificial Sequence
  Description of Artificial Sequence: Synthetic oligonucleotide
tgaagtgactgtgtatcctgcaaagacccagc

SEQ ID NO: 66995 - DNA, 31 bp, Artificial Sequence
  Description of Artificial Sequence: Synthetic oligonucleotide
gaagtgactgtgtatcctgcaaagacccagc

SEQ ID NO: 66996 - DNA, 31 bp, Artificial Sequence
  Description of Artificial Sequence: Synthetic oligonucleotide
aagtgactgtgtatcctgcaaagacccagcc

SEQ ID NO: 66997 - DNA, 30 bp, Artificial Sequence
  Description of Artificial Sequence: Synthetic oligonucleotide
agtgactgtgtatcctgcaaagacccagcc

SEQ ID NO: 66998 - DNA, 27 bp, Artificial Sequence
  Description of Artificial Sequence: Synthetic oligonucleotide
agccagaaggacctcctggagcagaga

SEQ ID NO: 66999 - DNA, 26 bp, Artificial Sequence
  Description of Artificial Sequence: Synthetic oligonucleotide
gccagaaggacctcctggagcagaga

SEQ ID NO: 67000 - DNA, 26 bp, Artificial Sequence
  Description of Artificial Sequence: Synthetic oligonucleotide
ccagaaggacctcctggagcagagac

SEQ ID NO: 67001 - DNA, 26 bp, Artificial Sequence
  Description of Artificial Sequence: Synthetic oligonucleotide
cagaaggacctcctggagcagagacg

SEQ ID NO: 67002 - DNA, 26 bp, Artificial Sequence
  Description of Artificial Sequence: Synthetic oligonucleotide
agaaggacctcctggagcagagacgg

SEQ ID NO: 67003 - DNA, 25 bp, Artificial Sequence
  Description of Artificial Sequence: Synthetic oligonucleotide
gaaggacctcctggagcagagacgg

SEQ ID NO: 67004 - DNA, 25 bp, Artificial Sequence
  Description of Artificial Sequence: Synthetic oligonucleotide
aaggacctcctggagcagagacggg

SEQ ID NO: 67005 - DNA, 24 bp, Artificial Sequence
  Description of Artificial Sequence: Synthetic oligonucleotide
aggacctcctggagcagagacggg

SEQ ID NO: 67006 - DNA, 23 bp, Artificial Sequence
  Description of Artificial Sequence: Synthetic oligonucleotide
ggacctcctggagcagagacggg

SEQ ID NO: 67007 - DNA, 23 bp, Artificial Sequence
  Description of Artificial Sequence: Synthetic oligonucleotide
gacctcctggagcagagacgggc

SEQ ID NO: 67008 - DNA, 23 bp, Artificial Sequence
  Description of Artificial Sequence: Synthetic oligonucleotide
acctcctggagcagagacgggcc

SEQ ID NO: 67009 - DNA, 22 bp, Artificial Sequence
  Description of Artificial Sequence: Synthetic oligonucleotide
cctcctggagcagagacgggcc

SEQ ID NO: 67010 - DNA, 23 bp, Artificial Sequence
  Description of Artificial Sequence: Synthetic oligonucleotide
ctcctggagcagagacgggccga

SEQ ID NO: 67011 - DNA, 23 bp, Artificial Sequence
  Description of Artificial Sequence: Synthetic oligonucleotide
tcctggagcagagacgggccgag

SEQ ID NO: 67012 - DNA, 22 bp, Artificial Sequence
  Description of Artificial Sequence: Synthetic oligonucleotide
cctggagcagagacgggccgag

SEQ ID NO: 67013 - DNA, 23 bp, Artificial Sequence
  Description of Artificial Sequence: Synthetic oligonucleotide
ctggagcagagacgggccgaggt

SEQ ID NO: 67014 - DNA, 23 bp, Artificial Sequence
  Description of Artificial Sequence: Synthetic oligonucleotide
tggagcagagacgggccgaggtg

SEQ ID NO: 67015 - DNA, 22 bp, Artificial Sequence
  Description of Artificial Sequence: Synthetic oligonucleotide
ggagcagagacgggccgaggtg

SEQ ID NO: 67016 - DNA, 23 bp, Artificial Sequence
  Description of Artificial Sequence: Synthetic oligonucleotide
gagcagagacgggccgaggtgga

SEQ ID NO: 67017 - DNA, 24 bp, Artificial Sequence
  Description of Artificial Sequence: Synthetic oligonucleotide
agcagagacgggccgaggtggaca

SEQ ID NO: 67018 - DNA, 23 bp, Artificial Sequence
  Description of Artificial Sequence: Synthetic oligonucleotide
gcagagacgggccgaggtggaca

SEQ ID NO: 67019 - DNA, 23 bp, Artificial Sequence
  Description of Artificial Sequence: Synthetic oligonucleotide
cagagacgggccgaggtggacac

SEQ ID NO: 67020 - DNA, 25 bp, Artificial Sequence
  Description of Artificial Sequence: Synthetic oligonucleotide
agagacgggccgaggtggacaccta

SEQ ID NO: 67021 - DNA, 24 bp, Artificial Sequence
  Description of Artificial Sequence: Synthetic oligonucleotide
gagacgggccgaggtggacaccta

SEQ ID NO: 67022 - DNA, 25 bp, Artificial Sequence
  Description of Artificial Sequence: Synthetic oligonucleotide
agacgggccgaggtggacacctact

SEQ ID NO: 67023 - DNA, 24 bp, Artificial Sequence
  Description of Artificial Sequence: Synthetic oligonucleotide
gacgggccgaggtggacacctact

SEQ ID NO: 67024 - DNA, 24 bp, Artificial Sequence
  Description of Artificial Sequence: Synthetic oligonucleotide
acgggccgaggtggacacctactg

SEQ ID NO: 67025 - DNA, 31 bp, Artificial Sequence
  Description of Artificial Sequence: Synthetic oligonucleotide
gaggtggacacctactgcagacacaactatg

SEQ ID NO: 67026 - DNA, 31 bp, Artificial Sequence
  Description of Artificial Sequence: Synthetic oligonucleotide
aggtggacacctactgcagacacaactatgg

SEQ ID NO: 67027 - DNA, 31 bp, Artificial Sequence
  Description of Artificial Sequence: Synthetic oligonucleotide
acacctactgcagacacaactatggggttgg

SEQ ID NO: 67028 - DNA, 30 bp, Artificial Sequence
  Description of Artificial Sequence: Synthetic oligonucleotide
cacctactgcagacacaactatggggttgg

SEQ ID NO: 67029 - DNA, 31 bp, Artificial Sequence
  Description of Artificial Sequence: Synthetic oligonucleotide
acctactgcagacacaactatggggttggtg

SEQ ID NO: 67030 - DNA, 30 bp, Artificial Sequence
  Description of Artificial Sequence: Synthetic oligonucleotide
cctactgcagacacaactatggggttggtg

SEQ ID NO: 67031 - DNA, 31 bp, Artificial Sequence
  Description of Artificial Sequence: Synthetic oligonucleotide
ctactgcagacacaactatggggttggtgag

SEQ ID NO: 67032 - DNA, 32 bp, Artificial Sequence
  Description of Artificial Sequence: Synthetic oligonucleotide
tactgcagacacaactatggggttggtgagag

SEQ ID NO: 67033 - DNA, 31 bp, Artificial Sequence
  Description of Artificial Sequence: Synthetic oligonucleotide
actgcagacacaactatggggttggtgagag

SEQ ID NO: 67034 - DNA, 30 bp, Artificial Sequence
  Description of Artificial Sequence: Synthetic oligonucleotide
ctgcagacacaactatggggttggtgagag

SEQ ID NO: 67035 - DNA, 30 bp, Artificial Sequence
  Description of Artificial Sequence: Synthetic oligonucleotide
tgcagacacaactatggggttggtgagagc

SEQ ID NO: 67036 - DNA, 29 bp, Artificial Sequence
  Description of Artificial Sequence: Synthetic oligonucleotide
gcagacacaactatggggttggtgagagc

SEQ ID NO: 67037 - DNA, 31 bp, Artificial Sequence
  Description of Artificial Sequence: Synthetic oligonucleotide
cagacacaactatggggttggtgagagcttc

SEQ ID NO: 67038 - DNA, 32 bp, Artificial Sequence
  Description of Artificial Sequence: Synthetic oligonucleotide
agacacaactatggggttggtgagagcttcac

SEQ ID NO: 67039 - DNA, 31 bp, Artificial Sequence
  Description of Artificial Sequence: Synthetic oligonucleotide
gacacaactatggggttggtgagagcttcac

SEQ ID NO: 67040 - DNA, 32 bp, Artificial Sequence
  Description of Artificial Sequence: Synthetic oligonucleotide
acacaactatggggttggtgagagcttcacag

SEQ ID NO: 67041 - DNA, 31 bp, Artificial Sequence
  Description of Artificial Sequence: Synthetic oligonucleotide
cacaactatggggttggtgagagcttcacag

SEQ ID NO: 67042 - DNA, 32 bp, Artificial Sequence
  Description of Artificial Sequence: Synthetic oligonucleotide
acaactatggggttggtgagagcttcacagtg

SEQ ID NO: 67043 - DNA, 31 bp, Artificial Sequence
  Description of Artificial Sequence: Synthetic oligonucleotide
caactatggggttggtgagagcttcacagtg

SEQ ID NO: 67044 - DNA, 31 bp, Artificial Sequence
  Description of Artificial Sequence: Synthetic oligonucleotide
aactatggggttggtgagagcttcacagtgc

SEQ ID NO: 67045 - DNA, 30 bp, Artificial Sequence
  Description of Artificial Sequence: Synthetic oligonucleotide
actatggggttggtgagagcttcacagtgc

SEQ ID NO: 67046 - DNA, 29 bp, Artificial Sequence
  Description of Artificial Sequence: Synthetic oligonucleotide
ctatggggttggtgagagcttcacagtgc

SEQ ID NO: 67047 - DNA, 30 bp, Artificial Sequence
  Description of Artificial Sequence: Synthetic oligonucleotide
tatggggttggtgagagcttcacagtgcag

SEQ ID NO: 67048 - DNA, 29 bp, Artificial Sequence
  Description of Artificial Sequence: Synthetic oligonucleotide
atggggttggtgagagcttcacagtgcag

SEQ ID NO: 67049 - DNA, 28 bp, Artificial Sequence
  Description of Artificial Sequence: Synthetic oligonucleotide
tggggttggtgagagcttcacagtgcag

SEQ ID NO: 67050 - DNA, 30 bp, Artificial Sequence
  Description of Artificial Sequence: Synthetic oligonucleotide
gaacagccagaaggacatcctggaagacag

SEQ ID NO: 67051 - DNA, 30 bp, Artificial Sequence
  Description of Artificial Sequence: Synthetic oligonucleotide
aacagccagaaggacatcctggaagacagg

SEQ ID NO: 67052 - DNA, 29 bp, Artificial Sequence
  Description of Artificial Sequence: Synthetic oligonucleotide
acagccagaaggacatcctggaagacagg

SEQ ID NO: 67053 - DNA, 28 bp, Artificial Sequence
  Description of Artificial Sequence: Synthetic oligonucleotide
cagccagaaggacatcctggaagacagg

SEQ ID NO: 67054 - DNA, 28 bp, Artificial Sequence
  Description of Artificial Sequence: Synthetic oligonucleotide
agccagaaggacatcctggaagacaggc

SEQ ID NO: 67055 - DNA, 27 bp, Artificial Sequence
  Description of Artificial Sequence: Synthetic oligonucleotide
gccagaaggacatcctggaagacaggc

SEQ ID NO: 67056 - DNA, 27 bp, Artificial Sequence
  Description of Artificial Sequence: Synthetic oligonucleotide
ccagaaggacatcctggaagacaggcg

SEQ ID NO: 67057 - DNA, 27 bp, Artificial Sequence
  Description of Artificial Sequence: Synthetic oligonucleotide
cagaaggacatcctggaagacaggcgg

SEQ ID NO: 67058 - DNA, 27 bp, Artificial Sequence
  Description of Artificial Sequence: Synthetic oligonucleotide
agaaggacatcctggaagacaggcggg

SEQ ID NO: 67059 - DNA, 26 bp, Artificial Sequence
  Description of Artificial Sequence: Synthetic oligonucleotide
gaaggacatcctggaagacaggcggg

SEQ ID NO: 67060 - DNA, 26 bp, Artificial Sequence
  Description of Artificial Sequence: Synthetic oligonucleotide
aaggacatcctggaagacaggcgggc

SEQ ID NO: 67061 - DNA, 25 bp, Artificial Sequence
  Description of Artificial Sequence: Synthetic oligonucleotide
aggacatcctggaagacaggcgggc

SEQ ID NO: 67062 - DNA, 24 bp, Artificial Sequence
  Description of Artificial Sequence: Synthetic oligonucleotide
ggacatcctggaagacaggcgggc

SEQ ID NO: 67063 - DNA, 24 bp, Artificial Sequence
  Description of Artificial Sequence: Synthetic oligonucleotide
gacatcctggaagacaggcgggcc

SEQ ID NO: 67064 - DNA, 25 bp, Artificial Sequence
  Description of Artificial Sequence: Synthetic oligonucleotide
acatcctggaagacaggcgggccct

SEQ ID NO: 67065 - DNA, 24 bp, Artificial Sequence
  Description of Artificial Sequence: Synthetic oligonucleotide
catcctggaagacaggcgggccct

SEQ ID NO: 67066 - DNA, 24 bp, Artificial Sequence
  Description of Artificial Sequence: Synthetic oligonucleotide
atcctggaagacaggcgggccctg

SEQ ID NO: 67067 - DNA, 23 bp, Artificial Sequence
  Description of Artificial Sequence: Synthetic oligonucleotide
tcctggaagacaggcgggccctg

SEQ ID NO: 67068 - DNA, 22 bp, Artificial Sequence
  Description of Artificial Sequence: Synthetic oligonucleotide
cctggaagacaggcgggccctg

SEQ ID NO: 67069 - DNA, 23 bp, Artificial Sequence
  Description of Artificial Sequence: Synthetic oligonucleotide
ctggaagacaggcgggccctggt

SEQ ID NO: 67070 - DNA, 23 bp, Artificial Sequence
  Description of Artificial Sequence: Synthetic oligonucleotide
tggaagacaggcgggccctggtg

SEQ ID NO: 67071 - DNA, 22 bp, Artificial Sequence
  Description of Artificial Sequence: Synthetic oligonucleotide
ggaagacaggcgggccctggtg

SEQ ID NO: 67072 - DNA, 23 bp, Artificial Sequence
  Description of Artificial Sequence: Synthetic oligonucleotide
gaagacaggcgggccctggtgga

SEQ ID NO: 67073 - DNA, 24 bp, Artificial Sequence
  Description of Artificial Sequence: Synthetic oligonucleotide
aagacaggcgggccctggtggaca

SEQ ID NO: 67074 - DNA, 23 bp, Artificial Sequence
  Description of Artificial Sequence: Synthetic oligonucleotide
agacaggcgggccctggtggaca

SEQ ID NO: 67075 - DNA, 22 bp, Artificial Sequence
  Description of Artificial Sequence: Synthetic oligonucleotide
gacaggcgggccctggtggaca

SEQ ID NO: 67076 - DNA, 22 bp, Artificial Sequence
  Description of Artificial Sequence: Synthetic oligonucleotide
acaggcgggccctggtggacac

SEQ ID NO: 67077 - DNA, 21 bp, Artificial Sequence
  Description of Artificial Sequence: Synthetic oligonucleotide
caggcgggccctggtggacac

SEQ ID NO: 67078 - DNA, 23 bp, Artificial Sequence
  Description of Artificial Sequence: Synthetic oligonucleotide
aggcgggccctggtggacaccta

SEQ ID NO: 67079 - DNA, 22 bp, Artificial Sequence
  Description of Artificial Sequence: Synthetic oligonucleotide
ggcgggccctggtggacaccta

SEQ ID NO: 67080 - DNA, 23 bp, Artificial Sequence
  Description of Artificial Sequence: Synthetic oligonucleotide
gcgggccctggtggacacctact

SEQ ID NO: 67081 - DNA, 23 bp, Artificial Sequence
  Description of Artificial Sequence: Synthetic oligonucleotide
cgggccctggtggacacctactg

SEQ ID NO: 67082 - DNA, 24 bp, Artificial Sequence
  Description of Artificial Sequence: Synthetic oligonucleotide
gggccctggtggacacctactgca

SEQ ID NO: 67083 - DNA, 25 bp, Artificial Sequence
  Description of Artificial Sequence: Synthetic oligonucleotide
ggccctggtggacacctactgcaga

SEQ ID NO: 67084 - DNA, 26 bp, Artificial Sequence
  Description of Artificial Sequence: Synthetic oligonucleotide
gccctggtggacacctactgcagaca

SEQ ID NO: 67085 - DNA, 27 bp, Artificial Sequence
  Description of Artificial Sequence: Synthetic oligonucleotide
ccctggtggacacctactgcagacaca

SEQ ID NO: 67086 - DNA, 28 bp, Artificial Sequence
  Description of Artificial Sequence: Synthetic oligonucleotide
cctggtggacacctactgcagacacaac

SEQ ID NO: 67087 - DNA, 30 bp, Artificial Sequence
  Description of Artificial Sequence: Synthetic oligonucleotide
ctggtggacacctactgcagacacaactac

SEQ ID NO: 67088 - DNA, 30 bp, Artificial Sequence
  Description of Artificial Sequence: Synthetic oligonucleotide
tggtggacacctactgcagacacaactacg

SEQ ID NO: 67089 - DNA, 31 bp, Artificial Sequence
  Description of Artificial Sequence: Synthetic oligonucleotide
tactggaacagccagaaggacttcctggaag

SEQ ID NO: 67090 - DNA, 30 bp, Artificial Sequence
  Description of Artificial Sequence: Synthetic oligonucleotide
actggaacagccagaaggacttcctggaag

SEQ ID NO: 67091 - DNA, 29 bp, Artificial Sequence
  Description of Artificial Sequence: Synthetic oligonucleotide
ctggaacagccagaaggacttcctggaag

SEQ ID NO: 67092 - DNA, 30 bp, Artificial Sequence
  Description of Artificial Sequence: Synthetic oligonucleotide
tggaacagccagaaggacttcctggaagac

SEQ ID NO: 67093 - DNA, 29 bp, Artificial Sequence
  Description of Artificial Sequence: Synthetic oligonucleotide
ggaacagccagaaggacttcctggaagac

SEQ ID NO: 67094 - DNA, 30 bp, Artificial Sequence
  Description of Artificial Sequence: Synthetic oligonucleotide
gaacagccagaaggacttcctggaagacag

SEQ ID NO: 67095 - DNA, 30 bp, Artificial Sequence
  Description of Artificial Sequence: Synthetic oligonucleotide
aacagccagaaggacttcctggaagacagg

SEQ ID NO: 67096 - DNA, 29 bp, Artificial Sequence
  Description of Artificial Sequence: Synthetic oligonucleotide
acagccagaaggacttcctggaagacagg

SEQ ID NO: 67097 - DNA, 28 bp, Artificial Sequence
  Description of Artificial Sequence: Synthetic oligonucleotide
cagccagaaggacttcctggaagacagg

SEQ ID NO: 67098 - DNA, 28 bp, Artificial Sequence
  Description of Artificial Sequence: Synthetic oligonucleotide
agccagaaggacttcctggaagacaggc

SEQ ID NO: 67099 - DNA, 27 bp, Artificial Sequence
  Description of Artificial Sequence: Synthetic oligonucleotide
gccagaaggacttcctggaagacaggc

SEQ ID NO: 67100 - DNA, 27 bp, Artificial Sequence
  Description of Artificial Sequence: Synthetic oligonucleotide
ccagaaggacttcctggaagacaggcg

SEQ ID NO: 67101 - DNA, 27 bp, Artificial Sequence
  Description of Artificial Sequence: Synthetic oligonucleotide
cagaaggacttcctggaagacaggcgg

SEQ ID NO: 67102 - DNA, 27 bp, Artificial Sequence
  Description of Artificial Sequence: Synthetic oligonucleotide
agaaggacttcctggaagacaggcggg

SEQ ID NO: 67103 - DNA, 26 bp, Artificial Sequence
  Description of Artificial Sequence: Synthetic oligonucleotide
gaaggacttcctggaagacaggcggg

SEQ ID NO: 67104 - DNA, 26 bp, Artificial Sequence
  Description of Artificial Sequence: Synthetic oligonucleotide
aaggacttcctggaagacaggcgggc

SEQ ID NO: 67105 - DNA, 25 bp, Artificial Sequence
  Description of Artificial Sequence: Synthetic oligonucleotide
aggacttcctggaagacaggcgggc

SEQ ID NO: 67106 - DNA, 24 bp, Artificial Sequence
  Description of Artificial Sequence: Synthetic oligonucleotide
ggacttcctggaagacaggcgggc

SEQ ID NO: 67107 - DNA, 24 bp, Artificial Sequence
  Description of Artificial Sequence: Synthetic oligonucleotide
gacttcctggaagacaggcgggcc

SEQ ID NO: 67108 - DNA, 24 bp, Artificial Sequence
  Description of Artificial Sequence: Synthetic oligonucleotide
acttcctggaagacaggcgggccg

SEQ ID NO: 67109 - DNA, 23 bp, Artificial Sequence
  Description of Artificial Sequence: Synthetic oligonucleotide
cttcctggaagacaggcgggccg

SEQ ID NO: 67110 - DNA, 23 bp, Artificial Sequence
  Description of Artificial Sequence: Synthetic oligonucleotide
ttcctggaagacaggcgggccgc

SEQ ID NO: 67111 - DNA, 22 bp, Artificial Sequence
  Description of Artificial Sequence: Synthetic oligonucleotide
tcctggaagacaggcgggccgc

SEQ ID NO: 67112 - DNA, 21 bp, Artificial Sequence
  Description of Artificial Sequence: Synthetic oligonucleotide
cctggaagacaggcgggccgc

SEQ ID NO: 67113 - DNA, 21 bp, Artificial Sequence
  Description of Artificial Sequence: Synthetic oligonucleotide
ctggaagacaggcgggccgcg

SEQ ID NO: 67114 - DNA, 22 bp, Artificial Sequence
  Description of Artificial Sequence: Synthetic oligonucleotide
tggaagacaggcgggccgcggt

SEQ ID NO: 67115 - DNA, 21 bp, Artificial Sequence
  Description of Artificial Sequence: Synthetic oligonucleotide
ggaagacaggcgggccgcggt

SEQ ID NO: 67116 - DNA, 21 bp, Artificial Sequence
  Description of Artificial Sequence: Synthetic oligonucleotide
gaagacaggcgggccgcggtg

SEQ ID NO: 67117 - DNA, 22 bp, Artificial Sequence
  Description of Artificial Sequence: Synthetic oligonucleotide
aagacaggcgggccgcggtgga

SEQ ID NO: 67118 - DNA, 21 bp, Artificial Sequence
  Description of Artificial Sequence: Synthetic oligonucleotide
agacaggcgggccgcggtgga

SEQ ID NO: 67119 - DNA, 20 bp, Artificial Sequence
  Description of Artificial Sequence: Synthetic oligonucleotide
gacaggcgggccgcggtgga

SEQ ID NO: 67120 - DNA, 21 bp, Artificial Sequence
  Description of Artificial Sequence: Synthetic oligonucleotide
acaggcgggccgcggtggaca

SEQ ID NO: 67121 - DNA, 20 bp, Artificial Sequence
  Description of Artificial Sequence: Synthetic oligonucleotide
caggcgggccgcggtggaca

SEQ ID NO: 67122 - DNA, 22 bp, Artificial Sequence
  Description of Artificial Sequence: Synthetic oligonucleotide
agctggggcggcctgatgccca

SEQ ID NO: 67123 - DNA, 21 bp, Artificial Sequence
  Description of Artificial Sequence: Synthetic oligonucleotide
gctggggcggcctgatgccca

SEQ ID NO: 67124 - DNA, 23 bp, Artificial Sequence
  Description of Artificial Sequence: Synthetic oligonucleotide
ctggggcggcctgatgcccagta

SEQ ID NO: 67125 - DNA, 24 bp, Artificial Sequence
  Description of Artificial Sequence: Synthetic oligonucleotide
tggggcggcctgatgcccagtact

SEQ ID NO: 67126 - DNA, 23 bp, Artificial Sequence
  Description of Artificial Sequence: Synthetic oligonucleotide
ggggcggcctgatgcccagtact

SEQ ID NO: 67127 - DNA, 23 bp, Artificial Sequence
  Description of Artificial Sequence: Synthetic oligonucleotide
gggcggcctgatgcccagtactg

SEQ ID NO: 67128 - DNA, 25 bp, Artificial Sequence
  Description of Artificial Sequence: Synthetic oligonucleotide
ggcggcctgatgcccagtactggaa

SEQ ID NO: 67129 - DNA, 26 bp, Artificial Sequence
  Description of Artificial Sequence: Synthetic oligonucleotide
gcggcctgatgcccagtactggaaca

SEQ ID NO: 67130 - DNA, 26 bp, Artificial Sequence
  Description of Artificial Sequence: Synthetic oligonucleotide
cggcctgatgcccagtactggaacag

SEQ ID NO: 67131 - DNA, 26 bp, Artificial Sequence
  Description of Artificial Sequence: Synthetic oligonucleotide
ggcctgatgcccagtactggaacagc

SEQ ID NO: 67132 - DNA, 27 bp, Artificial Sequence
  Description of Artificial Sequence: Synthetic oligonucleotide
gcctgatgcccagtactggaacagcca

SEQ ID NO: 67133 - DNA, 27 bp, Artificial Sequence
  Description of Artificial Sequence: Synthetic oligonucleotide
cctgatgcccagtactggaacagccag

SEQ ID NO: 67134 - DNA, 29 bp, Artificial Sequence
  Description of Artificial Sequence: Synthetic oligonucleotide
ctgatgcccagtactggaacagccagaag

SEQ ID NO: 67135 - DNA, 29 bp, Artificial Sequence
  Description of Artificial Sequence: Synthetic oligonucleotide
tgatgcccagtactggaacagccagaagg

SEQ ID NO: 67136 - DNA, 28 bp, Artificial Sequence
  Description of Artificial Sequence: Synthetic oligonucleotide
gatgcccagtactggaacagccagaagg

SEQ ID NO: 67137 - DNA, 29 bp, Artificial Sequence
  Description of Artificial Sequence: Synthetic oligonucleotide
atgcccagtactggaacagccagaaggac

SEQ ID NO: 67138 - DNA, 28 bp, Artificial Sequence
  Description of Artificial Sequence: Synthetic oligonucleotide
tgcccagtactggaacagccagaaggac

SEQ ID NO: 67139 - DNA, 27 bp, Artificial Sequence
  Description of Artificial Sequence: Synthetic oligonucleotide
gcccagtactggaacagccagaaggac

SEQ ID NO: 67140 - DNA, 27 bp, Artificial Sequence
  Description of Artificial Sequence: Synthetic oligonucleotide
cccagtactggaacagccagaaggacc

SEQ ID NO: 67141 - DNA, 28 bp, Artificial Sequence
  Description of Artificial Sequence: Synthetic oligonucleotide
ccagtactggaacagccagaaggacctc

SEQ ID NO: 67142 - DNA, 28 bp, Artificial Sequence
  Description of Artificial Sequence: Synthetic oligonucleotide
cagtactggaacagccagaaggacctcc

SEQ ID NO: 67143 - DNA, 31 bp, Artificial Sequence
  Description of Artificial Sequence: Synthetic oligonucleotide
cagacacaactacggggttgtggagagattc

SEQ ID NO: 67144 - DNA, 32 bp, Artificial Sequence
  Description of Artificial Sequence: Synthetic oligonucleotide
agacacaactacggggttgtggagagattcac

SEQ ID NO: 67145 - DNA, 31 bp, Artificial Sequence
  Description of Artificial Sequence: Synthetic oligonucleotide
gacacaactacggggttgtggagagattcac

SEQ ID NO: 67146 - DNA, 32 bp, Artificial Sequence
  Description of Artificial Sequence: Synthetic oligonucleotide
acacaactacggggttgtggagagattcacag

SEQ ID NO: 67147 - DNA, 31 bp, Artificial Sequence
  Description of Artificial Sequence: Synthetic oligonucleotide
cacaactacggggttgtggagagattcacag

SEQ ID NO: 67148 - DNA, 32 bp, Artificial Sequence
  Description of Artificial Sequence: Synthetic oligonucleotide
acaactacggggttgtggagagattcacagtg

SEQ ID NO: 67149 - DNA, 31 bp, Artificial Sequence
  Description of Artificial Sequence: Synthetic oligonucleotide
caactacggggttgtggagagattcacagtg

SEQ ID NO: 67150 - DNA, 31 bp, Artificial Sequence
  Description of Artificial Sequence: Synthetic oligonucleotide
aactacggggttgtggagagattcacagtgc

SEQ ID NO: 67151 - DNA, 30 bp, Artificial Sequence
  Description of Artificial Sequence: Synthetic oligonucleotide
actacggggttgtggagagattcacagtgc

SEQ ID NO: 67152 - DNA, 29 bp, Artificial Sequence
  Description of Artificial Sequence: Synthetic oligonucleotide
ctacggggttgtggagagattcacagtgc

SEQ ID NO: 67153 - DNA, 30 bp, Artificial Sequence
  Description of Artificial Sequence: Synthetic oligonucleotide
tacggggttgtggagagattcacagtgcag

SEQ ID NO: 67154 - DNA, 29 bp, Artificial Sequence
  Description of Artificial Sequence: Synthetic oligonucleotide
acggggttgtggagagattcacagtgcag

SEQ ID NO: 67155 - DNA, 28 bp, Artificial Sequence
  Description of Artificial Sequence: Synthetic oligonucleotide
cggggttgtggagagattcacagtgcag

SEQ ID NO: 67156 - DNA, 28 bp, Artificial Sequence
  Description of Artificial Sequence: Synthetic oligonucleotide
ggggttgtggagagattcacagtgcagc

SEQ ID NO: 67157 - DNA, 28 bp, Artificial Sequence
  Description of Artificial Sequence: Synthetic oligonucleotide
gggttgtggagagattcacagtgcagcg

SEQ ID NO: 67158 - DNA, 28 bp, Artificial Sequence
  Description of Artificial Sequence: Synthetic oligonucleotide
ggttgtggagagattcacagtgcagcgg

SEQ ID NO: 67159 - DNA, 28 bp, Artificial Sequence
  Description of Artificial Sequence: Synthetic oligonucleotide
gttgtggagagattcacagtgcagcggc

SEQ ID NO: 67160 - DNA, 28 bp, Artificial Sequence
  Description of Artificial Sequence: Synthetic oligonucleotide
ttgtggagagattcacagtgcagcggcg

SEQ ID NO: 67161 - DNA, 27 bp, Artificial Sequence
  Description of Artificial Sequence: Synthetic oligonucleotide
tgtggagagattcacagtgcagcggcg

SEQ ID NO: 67162 - DNA, 27 bp, Artificial Sequence
  Description of Artificial Sequence: Synthetic oligonucleotide
gtggagagattcacagtgcagcggcga

SEQ ID NO: 67163 - DNA, 27 bp, Artificial Sequence
  Description of Artificial Sequence: Synthetic oligonucleotide
tggagagattcacagtgcagcggcgag

SEQ ID NO: 67164 - DNA, 29 bp, Artificial Sequence
  Description of Artificial Sequence: Synthetic oligonucleotide
ccgagtactggaacagccagaaggacttc

SEQ ID NO: 67165 - DNA, 29 bp, Artificial Sequence
  Description of Artificial Sequence: Synthetic oligonucleotide
cgagtactggaacagccagaaggacttcc

SEQ ID NO: 67166 - DNA, 25 bp, Artificial Sequence
  Description of Artificial Sequence: Synthetic oligonucleotide
acttcctggaagacaggcgggccct

SEQ ID NO: 67167 - DNA, 24 bp, Artificial Sequence
  Description of Artificial Sequence: Synthetic oligonucleotide
cttcctggaagacaggcgggccct

SEQ ID NO: 67168 - DNA, 24 bp, Artificial Sequence
  Description of Artificial Sequence: Synthetic oligonucleotide
ttcctggaagacaggcgggccctg

SEQ ID NO: 67169 - DNA, 24 bp, Artificial Sequence
  Description of Artificial Sequence: Synthetic oligonucleotide
tgacggagctggggcggcctgata

SEQ ID NO: 67170 - DNA, 23 bp, Artificial Sequence
  Description of Artificial Sequence: Synthetic oligonucleotide
gacggagctggggcggcctgata

SEQ ID NO: 67171 - DNA, 23 bp, Artificial Sequence
  Description of Artificial Sequence: Synthetic oligonucleotide
acggagctggggcggcctgatac

SEQ ID NO: 67172 - DNA, 22 bp, Artificial Sequence
  Description of Artificial Sequence: Synthetic oligonucleotide
cggagctggggcggcctgatac

SEQ ID NO: 67173 - DNA, 22 bp, Artificial Sequence
  Description of Artificial Sequence: Synthetic oligonucleotide
ggagctggggcggcctgatacc

SEQ ID NO: 67174 - DNA, 23 bp, Artificial Sequence
  Description of Artificial Sequence: Synthetic oligonucleotide
gagctggggcggcctgataccga

SEQ ID NO: 67175 - DNA, 25 bp, Artificial Sequence
  Description of Artificial Sequence: Synthetic oligonucleotide
agctggggcggcctgataccgagta

SEQ ID NO: 67176 - DNA, 24 bp, Artificial Sequence
  Description of Artificial Sequence: Synthetic oligonucleotide
gctggggcggcctgataccgagta

SEQ ID NO: 67177 - DNA, 25 bp, Artificial Sequence
  Description of Artificial Sequence: Synthetic oligonucleotide
ctggggcggcctgataccgagtact

SEQ ID NO: 67178 - DNA, 25 bp, Artificial Sequence
  Description of Artificial Sequence: Synthetic oligonucleotide
tggggcggcctgataccgagtactg

SEQ ID NO: 67179 - DNA, 24 bp, Artificial Sequence
  Description of Artificial Sequence: Synthetic oligonucleotide
ggggcggcctgataccgagtactg

SEQ ID NO: 67180 - DNA, 26 bp, Artificial Sequence
  Description of Artificial Sequence: Synthetic oligonucleotide
gggcggcctgataccgagtactggaa

SEQ ID NO: 67181 - DNA, 27 bp, Artificial Sequence
  Description of Artificial Sequence: Synthetic oligonucleotide
ggcggcctgataccgagtactggaaca

SEQ ID NO: 67182 - DNA, 27 bp, Artificial Sequence
  Description of Artificial Sequence: Synthetic oligonucleotide
gcggcctgataccgagtactggaacag

SEQ ID NO: 67183 - DNA, 27 bp, Artificial Sequence
  Description of Artificial Sequence: Synthetic oligonucleotide
cggcctgataccgagtactggaacagc

SEQ ID NO: 67184 - DNA, 27 bp, Artificial Sequence
  Description of Artificial Sequence: Synthetic oligonucleotide
ggcctgataccgagtactggaacagcc

SEQ ID NO: 67185 - DNA, 28 bp, Artificial Sequence
  Description of Artificial Sequence: Synthetic oligonucleotide
gcctgataccgagtactggaacagccag

SEQ ID NO: 67186 - DNA, 30 bp, Artificial Sequence
  Description of Artificial Sequence: Synthetic oligonucleotide
cctgataccgagtactggaacagccagaag

SEQ ID NO: 67187 - DNA, 30 bp, Artificial Sequence
  Description of Artificial Sequence: Synthetic oligonucleotide
ctgataccgagtactggaacagccagaagg

SEQ ID NO: 67188 - DNA, 31 bp, Artificial Sequence
  Description of Artificial Sequence: Synthetic oligonucleotide
tgataccgagtactggaacagccagaaggac

SEQ ID NO: 67189 - DNA, 30 bp, Artificial Sequence
  Description of Artificial Sequence: Synthetic oligonucleotide
gataccgagtactggaacagccagaaggac

SEQ ID NO: 67190 - DNA, 30 bp, Artificial Sequence
  Description of Artificial Sequence: Synthetic oligonucleotide
ataccgagtactggaacagccagaaggacc

SEQ ID NO: 67191 - DNA, 29 bp, Artificial Sequence
  Description of Artificial Sequence: Synthetic oligonucleotide
taccgagtactggaacagccagaaggacc

SEQ ID NO: 67192 - DNA, 28 bp, Artificial Sequence
  Description of Artificial Sequence: Synthetic oligonucleotide
accgagtactggaacagccagaaggacc

SEQ ID NO: 67193 - DNA, 28 bp, Artificial Sequence
  Description of Artificial Sequence: Synthetic oligonucleotide
acacctactgcagacacaactacggggc

SEQ ID NO: 67194 - DNA, 27 bp, Artificial Sequence
  Description of Artificial Sequence: Synthetic oligonucleotide
cacctactgcagacacaactacggggc

SEQ ID NO: 67195 - DNA, 28 bp, Artificial Sequence
  Description of Artificial Sequence: Synthetic oligonucleotide
acctactgcagacacaactacggggctg

SEQ ID NO: 67196 - DNA, 27 bp, Artificial Sequence
  Description of Artificial Sequence: Synthetic oligonucleotide
cctactgcagacacaactacggggctg

SEQ ID NO: 67197 - DNA, 23 bp, Artificial Sequence
  Description of Artificial Sequence: Synthetic oligonucleotide
ggtgatggagctggggcggccta

SEQ ID NO: 67198 - DNA, 23 bp, Artificial Sequence
  Description of Artificial Sequence: Synthetic oligonucleotide
gtgatggagctggggcggcctag

SEQ ID NO: 67199 - DNA, 23 bp, Artificial Sequence
  Description of Artificial Sequence: Synthetic oligonucleotide
tgatggagctggggcggcctagc

SEQ ID NO: 67200 - DNA, 22 bp, Artificial Sequence
  Description of Artificial Sequence: Synthetic oligonucleotide
gatggagctggggcggcctagc

SEQ ID NO: 67201 - DNA, 22 bp, Artificial Sequence
  Description of Artificial Sequence: Synthetic oligonucleotide
atggagctggggcggcctagcg

SEQ ID NO: 67202 - DNA, 21 bp, Artificial Sequence
  Description of Artificial Sequence: Synthetic oligonucleotide
tggagctggggcggcctagcg

SEQ ID NO: 67203 - DNA, 23 bp, Artificial Sequence
  Description of Artificial Sequence: Synthetic oligonucleotide
agcgacgtgggggagtaccgggt

SEQ ID NO: 67204 - DNA, 22 bp, Artificial Sequence
  Description of Artificial Sequence: Synthetic oligonucleotide
gcgacgtgggggagtaccgggt

SEQ ID NO: 67205 - DNA, 22 bp, Artificial Sequence
  Description of Artificial Sequence: Synthetic oligonucleotide
cgacgtgggggagtaccgggtg

SEQ ID NO: 67206 - DNA, 23 bp, Artificial Sequence
  Description of Artificial Sequence: Synthetic oligonucleotide
gacgtgggggagtaccgggtggt

SEQ ID NO: 67207 - DNA, 24 bp, Artificial Sequence
  Description of Artificial Sequence: Synthetic oligonucleotide
acgtgggggagtaccgggtggtga

SEQ ID NO: 67208 - DNA, 23 bp, Artificial Sequence
  Description of Artificial Sequence: Synthetic oligonucleotide
cgtgggggagtaccgggtggtga

SEQ ID NO: 67209 - DNA, 23 bp, Artificial Sequence
  Description of Artificial Sequence: Synthetic oligonucleotide
gtgggggagtaccgggtggtgac

SEQ ID NO: 67210 - DNA, 23 bp, Artificial Sequence
  Description of Artificial Sequence: Synthetic oligonucleotide
tgggggagtaccgggtggtgacg

SEQ ID NO: 67211 - DNA, 22 bp, Artificial Sequence
  Description of Artificial Sequence: Synthetic oligonucleotide
gggggagtaccgggtggtgacg

SEQ ID NO: 67212 - DNA, 23 bp, Artificial Sequence
  Description of Artificial Sequence: Synthetic oligonucleotide
ggggagtaccgggtggtgacgga

SEQ ID NO: 67213 - DNA, 23 bp, Artificial Sequence
  Description of Artificial Sequence: Synthetic oligonucleotide
gggagtaccgggtggtgacggag

SEQ ID NO: 67214 - DNA, 24 bp, Artificial Sequence
  Description of Artificial Sequence: Synthetic oligonucleotide
ggagtaccgggtggtgacggagct

SEQ ID NO: 67215 - DNA, 24 bp, Artificial Sequence
  Description of Artificial Sequence: Synthetic oligonucleotide
gagtaccgggtggtgacggagctg

SEQ ID NO: 67216 - DNA, 24 bp, Artificial Sequence
  Description of Artificial Sequence: Synthetic oligonucleotide
agtaccgggtggtgacggagctgg

SEQ ID NO: 67217 - DNA, 23 bp, Artificial Sequence
  Description of Artificial Sequence: Synthetic oligonucleotide
gtaccgggtggtgacggagctgg

SEQ ID NO: 67218 - DNA, 23 bp, Artificial Sequence
  Description of Artificial Sequence: Synthetic oligonucleotide
taccgggtggtgacggagctggg

SEQ ID NO: 67219 - DNA, 22 bp, Artificial Sequence
  Description of Artificial Sequence: Synthetic oligonucleotide
accgggtggtgacggagctggg

SEQ ID NO: 67220 - DNA, 21 bp, Artificial Sequence
  Description of Artificial Sequence: Synthetic oligonucleotide
ccgggtggtgacggagctggg

SEQ ID NO: 67221 - DNA, 21 bp, Artificial Sequence
  Description of Artificial Sequence: Synthetic oligonucleotide
cgggtggtgacggagctgggg

SEQ ID NO: 67222 - DNA, 21 bp, Artificial Sequence
  Description of Artificial Sequence: Synthetic oligonucleotide
gggtggtgacggagctggggc

SEQ ID NO: 67223 - DNA, 21 bp, Artificial Sequence
  Description of Artificial Sequence: Synthetic oligonucleotide
ggtggtgacggagctggggcg

SEQ ID NO: 67224 - DNA, 21 bp, Artificial Sequence
  Description of Artificial Sequence: Synthetic oligonucleotide
gtggtgacggagctggggcgg

SEQ ID NO: 67225 - DNA, 21 bp, Artificial Sequence
  Description of Artificial Sequence: Synthetic oligonucleotide
tggtgacggagctggggcggc

SEQ ID NO: 67226 - DNA, 22 bp, Artificial Sequence
  Description of Artificial Sequence: Synthetic oligonucleotide
tcctggagcagaggcgggccct

SEQ ID NO: 67227 - DNA, 21 bp, Artificial Sequence
  Description of Artificial Sequence: Synthetic oligonucleotide
cctggagcagaggcgggccct

SEQ ID NO: 67228 - DNA, 21 bp, Artificial Sequence
  Description of Artificial Sequence: Synthetic oligonucleotide
ctggagcagaggcgggccctg

SEQ ID NO: 67229 - DNA, 22 bp, Artificial Sequence
  Description of Artificial Sequence: Synthetic oligonucleotide
tggagcagaggcgggccctggt

SEQ ID NO: 67230 - DNA, 21 bp, Artificial Sequence
  Description of Artificial Sequence: Synthetic oligonucleotide
ggagcagaggcgggccctggt

SEQ ID NO: 67231 - DNA, 21 bp, Artificial Sequence
  Description of Artificial Sequence: Synthetic oligonucleotide
gagcagaggcgggccctggtg

SEQ ID NO: 67232 - DNA, 22 bp, Artificial Sequence
  Description of Artificial Sequence: Synthetic oligonucleotide
agcagaggcgggccctggtgga

SEQ ID NO: 67233 - DNA, 21 bp, Artificial Sequence
  Description of Artificial Sequence: Synthetic oligonucleotide
gcagaggcgggccctggtgga

SEQ ID NO: 67234 - DNA, 22 bp, Artificial Sequence
  Description of Artificial Sequence: Synthetic oligonucleotide
cagaggcgggccctggtggaca

SEQ ID NO: 67235 - DNA, 22 bp, Artificial Sequence
  Description of Artificial Sequence: Synthetic oligonucleotide
agaggcgggccctggtggacac

SEQ ID NO: 67236 - DNA, 21 bp, Artificial Sequence
  Description of Artificial Sequence: Synthetic oligonucleotide
gaggcgggccctggtggacac

SEQ ID NO: 67237 - DNA, 26 bp, Artificial Sequence
  Description of Artificial Sequence: Synthetic oligonucleotide
cagaaggacctcctggagcagaggca

SEQ ID NO: 67238 - DNA, 26 bp, Artificial Sequence
  Description of Artificial Sequence: Synthetic oligonucleotide
agaaggacctcctggagcagaggcag

SEQ ID NO: 67239 - DNA, 25 bp, Artificial Sequence
  Description of Artificial Sequence: Synthetic oligonucleotide
gaaggacctcctggagcagaggcag

SEQ ID NO: 67240 - DNA, 25 bp, Artificial Sequence
  Description of Artificial Sequence: Synthetic oligonucleotide
aaggacctcctggagcagaggcagg

SEQ ID NO: 67241 - DNA, 24 bp, Artificial Sequence
  Description of Artificial Sequence: Synthetic oligonucleotide
aggacctcctggagcagaggcagg

SEQ ID NO: 67242 - DNA, 23 bp, Artificial Sequence
  Description of Artificial Sequence: Synthetic oligonucleotide
ggacctcctggagcagaggcagg

SEQ ID NO: 67243 - DNA, 23 bp, Artificial Sequence
  Description of Artificial Sequence: Synthetic oligonucleotide
gacctcctggagcagaggcaggc

SEQ ID NO: 67244 - DNA, 23 bp, Artificial Sequence
  Description of Artificial Sequence: Synthetic oligonucleotide
acctcctggagcagaggcaggcc

SEQ ID NO: 67245 - DNA, 22 bp, Artificial Sequence
  Description of Artificial Sequence: Synthetic oligonucleotide
cctcctggagcagaggcaggcc

SEQ ID NO: 67246 - DNA, 22 bp, Artificial Sequence
  Description of Artificial Sequence: Synthetic oligonucleotide
ctcctggagcagaggcaggccg

SEQ ID NO: 67247 - DNA, 22 bp, Artificial Sequence
  Description of Artificial Sequence: Synthetic oligonucleotide
tcctggagcagaggcaggccgc

SEQ ID NO: 67248 - DNA, 21 bp, Artificial Sequence
  Description of Artificial Sequence: Synthetic oligonucleotide
cctggagcagaggcaggccgc

SEQ ID NO: 67249 - DNA, 21 bp, Artificial Sequence
  Description of Artificial Sequence: Synthetic oligonucleotide
ctggagcagaggcaggccgcg

SEQ ID NO: 67250 - DNA, 22 bp, Artificial Sequence
  Description of Artificial Sequence: Synthetic oligonucleotide
tggagcagaggcaggccgcggt

SEQ ID NO: 67251 - DNA, 21 bp, Artificial Sequence
  Description of Artificial Sequence: Synthetic oligonucleotide
ggagcagaggcaggccgcggt

SEQ ID NO: 67252 - DNA, 21 bp, Artificial Sequence
  Description of Artificial Sequence: Synthetic oligonucleotide
gagcagaggcaggccgcggtg

SEQ ID NO: 67253 - DNA, 22 bp, Artificial Sequence
  Description of Artificial Sequence: Synthetic oligonucleotide
agcagaggcaggccgcggtgga

SEQ ID NO: 67254 - DNA, 21 bp, Artificial Sequence
  Description of Artificial Sequence: Synthetic oligonucleotide
gcagaggcaggccgcggtgga

SEQ ID NO: 67255 - DNA, 22 bp, Artificial Sequence
  Description of Artificial Sequence: Synthetic oligonucleotide
cagaggcaggccgcggtggaca

SEQ ID NO: 67256 - DNA, 22 bp, Artificial Sequence
  Description of Artificial Sequence: Synthetic oligonucleotide
agaggcaggccgcggtggacac

SEQ ID NO: 67257 - DNA, 21 bp, Artificial Sequence
  Description of Artificial Sequence: Synthetic oligonucleotide
gaggcaggccgcggtggacac

SEQ ID NO: 67258 - DNA, 23 bp, Artificial Sequence
  Description of Artificial Sequence: Synthetic oligonucleotide
aggcaggccgcggtggacaccta

SEQ ID NO: 67259 - DNA, 22 bp, Artificial Sequence
  Description of Artificial Sequence: Synthetic oligonucleotide
ggcaggccgcggtggacaccta

SEQ ID NO: 67260 - DNA, 23 bp, Artificial Sequence
  Description of Artificial Sequence: Synthetic oligonucleotide
gcaggccgcggtggacacctact

SEQ ID NO: 67261 - DNA, 23 bp, Artificial Sequence
  Description of Artificial Sequence: Synthetic oligonucleotide
caggccgcggtggacacctactg

SEQ ID NO: 67262 - DNA, 24 bp, Artificial Sequence
  Description of Artificial Sequence: Synthetic oligonucleotide
aggccgcggtggacacctactgca

SEQ ID NO: 67263 - DNA, 35 bp, Artificial Sequence
  Description of Artificial Sequence: Synthetic oligonucleotide
acagatacttctatcaccaagaggagtacgtgcac

SEQ ID NO: 67264 - DNA, 34 bp, Artificial Sequence
  Description of Artificial Sequence: Synthetic oligonucleotide
cagatacttctatcaccaagaggagtacgtgcac

SEQ ID NO: 67265 - DNA, 36 bp, Artificial Sequence
  Description of Artificial Sequence: Synthetic oligonucleotide
agatacttctatcaccaagaggagtacgtgcacttc

SEQ ID NO: 67266 - DNA, 35 bp, Artificial Sequence
  Description of Artificial Sequence: Synthetic oligonucleotide
gatacttctatcaccaagaggagtacgtgcacttc

SEQ ID NO: 67267 - DNA, 35 bp, Artificial Sequence
  Description of Artificial Sequence: Synthetic oligonucleotide
atacttctatcaccaagaggagtacgtgcacttcg

SEQ ID NO: 67268 - DNA, 34 bp, Artificial Sequence
  Description of Artificial Sequence: Synthetic oligonucleotide
tacttctatcaccaagaggagtacgtgcacttcg

SEQ ID NO: 67269 - DNA, 33 bp, Artificial Sequence
  Description of Artificial Sequence: Synthetic oligonucleotide
acttctatcaccaagaggagtacgtgcacttcg

SEQ ID NO: 67270 - DNA, 32 bp, Artificial Sequence
  Description of Artificial Sequence: Synthetic oligonucleotide
cttctatcaccaagaggagtacgtgcacttcg

SEQ ID NO: 67271 - DNA, 33 bp, Artificial Sequence
  Description of Artificial Sequence: Synthetic oligonucleotide
ttctatcaccaagaggagtacgtgcacttcgac

SEQ ID NO: 67272 - DNA, 32 bp, Artificial Sequence
  Description of Artificial Sequence: Synthetic oligonucleotide
tctatcaccaagaggagtacgtgcacttcgac

SEQ ID NO: 67273 - DNA, 31 bp, Artificial Sequence
  Description of Artificial Sequence: Synthetic oligonucleotide
ctatcaccaagaggagtacgtgcacttcgac

SEQ ID NO: 67274 - DNA, 32 bp, Artificial Sequence
  Description of Artificial Sequence: Synthetic oligonucleotide
tatcaccaagaggagtacgtgcacttcgacag

SEQ ID NO: 67275 - DNA, 31 bp, Artificial Sequence
  Description of Artificial Sequence: Synthetic oligonucleotide
atcaccaagaggagtacgtgcacttcgacag

SEQ ID NO: 67276 - DNA, 30 bp, Artificial Sequence
  Description of Artificial Sequence: Synthetic oligonucleotide
tcaccaagaggagtacgtgcacttcgacag

SEQ ID NO: 67277 - DNA, 29 bp, Artificial Sequence
  Description of Artificial Sequence: Synthetic oligonucleotide
caccaagaggagtacgtgcacttcgacag

SEQ ID NO: 67278 - DNA, 29 bp, Artificial Sequence
  Description of Artificial Sequence: Synthetic oligonucleotide
accaagaggagtacgtgcacttcgacagc

SEQ ID NO: 67279 - DNA, 28 bp, Artificial Sequence
  Description of Artificial Sequence: Synthetic oligonucleotide
ccaagaggagtacgtgcacttcgacagc

SEQ ID NO: 67280 - DNA, 28 bp, Artificial Sequence
  Description of Artificial Sequence: Synthetic oligonucleotide
caagaggagtacgtgcacttcgacagcg

SEQ ID NO: 67281 - DNA, 29 bp, Artificial Sequence
  Description of Artificial Sequence: Synthetic oligonucleotide
aagaggagtacgtgcacttcgacagcgac

SEQ ID NO: 67282 - DNA, 28 bp, Artificial Sequence
  Description of Artificial Sequence: Synthetic oligonucleotide
agaggagtacgtgcacttcgacagcgac

SEQ ID NO: 67283 - DNA, 27 bp, Artificial Sequence
  Description of Artificial Sequence: Synthetic oligonucleotide
gaggagtacgtgcacttcgacagcgac

SEQ ID NO: 67284 - DNA, 27 bp, Artificial Sequence
  Description of Artificial Sequence: Synthetic oligonucleotide
aggagtacgtgcacttcgacagcgacg

SEQ ID NO: 67285 - DNA, 27 bp, Artificial Sequence
  Description of Artificial Sequence: Synthetic oligonucleotide
ggagtacgtgcacttcgacagcgacgt

SEQ ID NO: 67286 - DNA, 27 bp, Artificial Sequence
  Description of Artificial Sequence: Synthetic oligonucleotide
gagtacgtgcacttcgacagcgacgtg

SEQ ID NO: 67287 - DNA, 27 bp, Artificial Sequence
  Description of Artificial Sequence: Synthetic oligonucleotide
agtacgtgcacttcgacagcgacgtgg

SEQ ID NO: 67288 - DNA, 26 bp, Artificial Sequence
  Description of Artificial Sequence: Synthetic oligonucleotide
gtacgtgcacttcgacagcgacgtgg

SEQ ID NO: 67289 - DNA, 26 bp, Artificial Sequence
  Description of Artificial Sequence: Synthetic oligonucleotide
tacgtgcacttcgacagcgacgtggg

SEQ ID NO: 67290 - DNA, 25 bp, Artificial Sequence
  Description of Artificial Sequence: Synthetic oligonucleotide
acgtgcacttcgacagcgacgtggg

SEQ ID NO: 67291 - DNA, 24 bp, Artificial Sequence
  Description of Artificial Sequence: Synthetic oligonucleotide
cgtgcacttcgacagcgacgtggg

SEQ ID NO: 67292 - DNA, 24 bp, Artificial Sequence
  Description of Artificial Sequence: Synthetic oligonucleotide
gtgcacttcgacagcgacgtgggg

SEQ ID NO: 67293 - DNA, 25 bp, Artificial Sequence
  Description of Artificial Sequence: Synthetic oligonucleotide
tgcacttcgacagcgacgtggggga

SEQ ID NO: 67294 - DNA, 24 bp, Artificial Sequence
  Description of Artificial Sequence: Synthetic oligonucleotide
gcacttcgacagcgacgtggggga

SEQ ID NO: 67295 - DNA, 26 bp, Artificial Sequence
  Description of Artificial Sequence: Synthetic oligonucleotide
cacttcgacagcgacgtgggggagta

SEQ ID NO: 67296 - DNA, 26 bp, Artificial Sequence
  Description of Artificial Sequence: Synthetic oligonucleotide
acttcgacagcgacgtgggggagtac

SEQ ID NO: 67297 - DNA, 33 bp, Artificial Sequence
  Description of Artificial Sequence: Synthetic oligonucleotide
cacgtttcttggagcaggttaaacctgagtgtc

SEQ ID NO: 67298 - DNA, 37 bp, Artificial Sequence
  Description of Artificial Sequence: Synthetic oligonucleotide
acgtttcttggagcaggttaaacctgagtgtcatttc

SEQ ID NO: 67299 - DNA, 36 bp, Artificial Sequence
  Description of Artificial Sequence: Synthetic oligonucleotide
cgtttcttggagcaggttaaacctgagtgtcatttc

SEQ ID NO: 67300 - DNA, 38 bp, Artificial Sequence
  Description of Artificial Sequence: Synthetic oligonucleotide
gtttcttggagcaggttaaacctgagtgtcatttcttc

SEQ ID NO: 67301 - DNA, 40 bp, Artificial Sequence
  Description of Artificial Sequence: Synthetic oligonucleotide
tttcttggagcaggttaaacctgagtgtcatttcttcaac

SEQ ID NO: 67302 - DNA, 39 bp, Artificial Sequence
  Description of Artificial Sequence: Synthetic oligonucleotide
ttcttggagcaggttaaacctgagtgtcatttcttcaac

SEQ ID NO: 67303 - DNA, 38 bp, Artificial Sequence
  Description of Artificial Sequence: Synthetic oligonucleotide
tcttggagcaggttaaacctgagtgtcatttcttcaac

SEQ ID NO: 67304 - DNA, 37 bp, Artificial Sequence
  Description of Artificial Sequence: Synthetic oligonucleotide
cttggagcaggttaaacctgagtgtcatttcttcaac

SEQ ID NO: 67305 - DNA, 37 bp, Artificial Sequence
  Description of Artificial Sequence: Synthetic oligonucleotide
ttggagcaggttaaacctgagtgtcatttcttcaacg

SEQ ID NO: 67306 - DNA, 36 bp, Artificial Sequence
  Description of Artificial Sequence: Synthetic oligonucleotide
tggagcaggttaaacctgagtgtcatttcttcaacg

SEQ ID NO: 67307 - DNA, 35 bp, Artificial Sequence
  Description of Artificial Sequence: Synthetic oligonucleotide
ggagcaggttaaacctgagtgtcatttcttcaacg

SEQ ID NO: 67308 - DNA, 35 bp, Artificial Sequence
  Description of Artificial Sequence: Synthetic oligonucleotide
gagcaggttaaacctgagtgtcatttcttcaacgg

SEQ ID NO: 67309 - DNA, 35 bp, Artificial Sequence
  Description of Artificial Sequence: Synthetic oligonucleotide
agcaggttaaacctgagtgtcatttcttcaacggg

SEQ ID NO: 67310 - DNA, 34 bp, Artificial Sequence
  Description of Artificial Sequence: Synthetic oligonucleotide
gcaggttaaacctgagtgtcatttcttcaacggg

SEQ ID NO: 67311 - DNA, 35 bp, Artificial Sequence
  Description of Artificial Sequence: Synthetic oligonucleotide
caggttaaacctgagtgtcatttcttcaacgggac

SEQ ID NO: 67312 - DNA, 35 bp, Artificial Sequence
  Description of Artificial Sequence: Synthetic oligonucleotide
aggttaaacctgagtgtcatttcttcaacgggacg

SEQ ID NO: 67313 - DNA, 34 bp, Artificial Sequence
  Description of Artificial Sequence: Synthetic oligonucleotide
ggttaaacctgagtgtcatttcttcaacgggacg

SEQ ID NO: 67314 - DNA, 34 bp, Artificial Sequence
  Description of Artificial Sequence: Synthetic oligonucleotide
gttaaacctgagtgtcatttcttcaacgggacgg

SEQ ID NO: 67315 - DNA, 35 bp, Artificial Sequence
  Description of Artificial Sequence: Synthetic oligonucleotide
ttaaacctgagtgtcatttcttcaacgggacggag

SEQ ID NO: 67316 - DNA, 34 bp, Artificial Sequence
  Description of Artificial Sequence: Synthetic oligonucleotide
taaacctgagtgtcatttcttcaacgggacggag

SEQ ID NO: 67317 - DNA, 33 bp, Artificial Sequence
  Description of Artificial Sequence: Synthetic oligonucleotide
aaacctgagtgtcatttcttcaacgggacggag

SEQ ID NO: 67318 - DNA, 32 bp, Artificial Sequence
  Description of Artificial Sequence: Synthetic oligonucleotide
aacctgagtgtcatttcttcaacgggacggag

SEQ ID NO: 67319 - DNA, 31 bp, Artificial Sequence
  Description of Artificial Sequence: Synthetic oligonucleotide
acctgagtgtcatttcttcaacgggacggag

SEQ ID NO: 67320 - DNA, 30 bp, Artificial Sequence
  Description of Artificial Sequence: Synthetic oligonucleotide
cctgagtgtcatttcttcaacgggacggag

SEQ ID NO: 67321 - DNA, 30 bp, Artificial Sequence
  Description of Artificial Sequence: Synthetic oligonucleotide
ctgagtgtcatttcttcaacgggacggagc

SEQ ID NO: 67322 - DNA, 28 bp, Artificial Sequence
  Description of Artificial Sequence: Synthetic oligonucleotide
aacagccagaaggacctcctggaagacg

SEQ ID NO: 67323 - DNA, 27 bp, Artificial Sequence
  Description of Artificial Sequence: Synthetic oligonucleotide
acagccagaaggacctcctggaagacg

SEQ ID NO: 67324 - DNA, 27 bp, Artificial Sequence
  Description of Artificial Sequence: Synthetic oligonucleotide
cagccagaaggacctcctggaagacga

SEQ ID NO: 67325 - DNA, 27 bp, Artificial Sequence
  Description of Artificial Sequence: Synthetic oligonucleotide
agccagaaggacctcctggaagacgag

SEQ ID NO: 67326 - DNA, 26 bp, Artificial Sequence
  Description of Artificial Sequence: Synthetic oligonucleotide
gccagaaggacctcctggaagacgag

SEQ ID NO: 67327 - DNA, 26 bp, Artificial Sequence
  Description of Artificial Sequence: Synthetic oligonucleotide
ccagaaggacctcctggaagacgagc

SEQ ID NO: 67328 - DNA, 26 bp, Artificial Sequence
  Description of Artificial Sequence: Synthetic oligonucleotide
cagaaggacctcctggaagacgagcg

SEQ ID NO: 67329 - DNA, 26 bp, Artificial Sequence
  Description of Artificial Sequence: Synthetic oligonucleotide
agaaggacctcctggaagacgagcgg

SEQ ID NO: 67330 - DNA, 25 bp, Artificial Sequence
  Description of Artificial Sequence: Synthetic oligonucleotide
gaaggacctcctggaagacgagcgg

SEQ ID NO: 67331 - DNA, 25 bp, Artificial Sequence
  Description of Artificial Sequence: Synthetic oligonucleotide
aaggacctcctggaagacgagcggg

SEQ ID NO: 67332 - DNA, 24 bp, Artificial Sequence
  Description of Artificial Sequence: Synthetic oligonucleotide
aggacctcctggaagacgagcggg

SEQ ID NO: 67333 - DNA, 23 bp, Artificial Sequence
  Description of Artificial Sequence: Synthetic oligonucleotide
ggacctcctggaagacgagcggg

SEQ ID NO: 67334 - DNA, 23 bp, Artificial Sequence
  Description of Artificial Sequence: Synthetic oligonucleotide
gacctcctggaagacgagcgggc

SEQ ID NO: 67335 - DNA, 23 bp, Artificial Sequence
  Description of Artificial Sequence: Synthetic oligonucleotide
acctcctggaagacgagcgggcc

SEQ ID NO: 67336 - DNA, 22 bp, Artificial Sequence
  Description of Artificial Sequence: Synthetic oligonucleotide
cctcctggaagacgagcgggcc

SEQ ID NO: 67337 - DNA, 22 bp, Artificial Sequence
  Description of Artificial Sequence: Synthetic oligonucleotide
ctcctggaagacgagcgggccg

SEQ ID NO: 67338 - DNA, 26 bp, Artificial Sequence
  Description of Artificial Sequence: Synthetic oligonucleotide
aaggacatcctggagcagaagcgggc

SEQ ID NO: 67339 - DNA, 25 bp, Artificial Sequence
  Description of Artificial Sequence: Synthetic oligonucleotide
aggacatcctggagcagaagcgggc

SEQ ID NO: 67340 - DNA, 24 bp, Artificial Sequence
  Description of Artificial Sequence: Synthetic oligonucleotide
ggacatcctggagcagaagcgggc

SEQ ID NO: 67341 - DNA, 24 bp, Artificial Sequence
  Description of Artificial Sequence: Synthetic oligonucleotide
gacatcctggagcagaagcgggcc

SEQ ID NO: 67342 - DNA, 24 bp, Artificial Sequence
  Description of Artificial Sequence: Synthetic oligonucleotide
acatcctggagcagaagcgggccg

SEQ ID NO: 67343 - DNA, 23 bp, Artificial Sequence
  Description of Artificial Sequence: Synthetic oligonucleotide
catcctggagcagaagcgggccg

SEQ ID NO: 67344 - DNA, 23 bp, Artificial Sequence
  Description of Artificial Sequence: Synthetic oligonucleotide
atcctggagcagaagcgggccgc

SEQ ID NO: 67345 - DNA, 25 bp, Artificial Sequence
  Description of Artificial Sequence: Synthetic oligonucleotide
gcttcgacagcgacgtgggggacta

SEQ ID NO: 67346 - DNA, 25 bp, Artificial Sequence
  Description of Artificial Sequence: Synthetic oligonucleotide
cttcgacagcgacgtgggggactac

SEQ ID NO: 67347 - DNA, 25 bp, Artificial Sequence
  Description of Artificial Sequence: Synthetic oligonucleotide
ttcgacagcgacgtgggggactacc

SEQ ID NO: 67348 - DNA, 24 bp, Artificial Sequence
  Description of Artificial Sequence: Synthetic oligonucleotide
tcgacagcgacgtgggggactacc

SEQ ID NO: 67349 - DNA, 23 bp, Artificial Sequence
  Description of Artificial Sequence: Synthetic oligonucleotide
cgacagcgacgtgggggactacc

SEQ ID NO: 67350 - DNA, 23 bp, Artificial Sequence
  Description of Artificial Sequence: Synthetic oligonucleotide
gacagcgacgtgggggactaccg

SEQ ID NO: 67351 - DNA, 23 bp, Artificial Sequence
  Description of Artificial Sequence: Synthetic oligonucleotide
acagcgacgtgggggactaccgg

SEQ ID NO: 67352 - DNA, 22 bp, Artificial Sequence
  Description of Artificial Sequence: Synthetic oligonucleotide
cagcgacgtgggggactaccgg

SEQ ID NO: 67353 - DNA, 22 bp, Artificial Sequence
  Description of Artificial Sequence: Synthetic oligonucleotide
agcgacgtgggggactaccggg

SEQ ID NO: 67354 - DNA, 21 bp, Artificial Sequence
  Description of Artificial Sequence: Synthetic oligonucleotide
gcgacgtgggggactaccggg

SEQ ID NO: 67355 - DNA, 21 bp, Artificial Sequence
  Description of Artificial Sequence: Synthetic oligonucleotide
cgacgtgggggactaccgggc

SEQ ID NO: 67356 - DNA, 21 bp, Artificial Sequence
  Description of Artificial Sequence: Synthetic oligonucleotide
gacgtgggggactaccgggcg

SEQ ID NO: 67357 - DNA, 22 bp, Artificial Sequence
  Description of Artificial Sequence: Synthetic oligonucleotide
acgtgggggactaccgggcggt

SEQ ID NO: 67358 - DNA, 21 bp, Artificial Sequence
  Description of Artificial Sequence: Synthetic oligonucleotide
cgtgggggactaccgggcggt

SEQ ID NO: 67359 - DNA, 22 bp, Artificial Sequence
  Description of Artificial Sequence: Synthetic oligonucleotide
gtgggggactaccgggcggtga

SEQ ID NO: 67360 - DNA, 22 bp, Artificial Sequence
  Description of Artificial Sequence: Synthetic oligonucleotide
tgggggactaccgggcggtgac

SEQ ID NO: 67361 - DNA, 21 bp, Artificial Sequence
  Description of Artificial Sequence: Synthetic oligonucleotide
gggggactaccgggcggtgac

SEQ ID NO: 67362 - DNA, 21 bp, Artificial Sequence
  Description of Artificial Sequence: Synthetic oligonucleotide
ggggactaccgggcggtgacg

SEQ ID NO: 67363 - DNA, 22 bp, Artificial Sequence
  Description of Artificial Sequence: Synthetic oligonucleotide
gggactaccgggcggtgacgga

SEQ ID NO: 67364 - DNA, 22 bp, Artificial Sequence
  Description of Artificial Sequence: Synthetic oligonucleotide
ggactaccgggcggtgacggag

SEQ ID NO: 67365 - DNA, 23 bp, Artificial Sequence
  Description of Artificial Sequence: Synthetic oligonucleotide
gactaccgggcggtgacggagct

SEQ ID NO: 67366 - DNA, 23 bp, Artificial Sequence
  Description of Artificial Sequence: Synthetic oligonucleotide
actaccgggcggtgacggagctg

SEQ ID NO: 67367 - DNA, 22 bp, Artificial Sequence
  Description of Artificial Sequence: Synthetic oligonucleotide
ctaccgggcggtgacggagctg

SEQ ID NO: 67368 - DNA, 36 bp, Artificial Sequence
  Description of Artificial Sequence: Synthetic oligonucleotide
ttcctggacagatacttctatcaccaagaggagaac

SEQ ID NO: 67369 - DNA, 35 bp, Artificial Sequence
  Description of Artificial Sequence: Synthetic oligonucleotide
tcctggacagatacttctatcaccaagaggagaac

SEQ ID NO: 67370 - DNA, 34 bp, Artificial Sequence
  Description of Artificial Sequence: Synthetic oligonucleotide
cctggacagatacttctatcaccaagaggagaac

SEQ ID NO: 67371 - DNA, 34 bp, Artificial Sequence
  Description of Artificial Sequence: Synthetic oligonucleotide
ctggacagatacttctatcaccaagaggagaacg

SEQ ID NO: 67372 - DNA, 35 bp, Artificial Sequence
  Description of Artificial Sequence: Synthetic oligonucleotide
tggacagatacttctatcaccaagaggagaacgtg

SEQ ID NO: 67373 - DNA, 34 bp, Artificial Sequence
  Description of Artificial Sequence: Synthetic oligonucleotide
ggacagatacttctatcaccaagaggagaacgtg

SEQ ID NO: 67374 - DNA, 34 bp, Artificial Sequence
  Description of Artificial Sequence: Synthetic oligonucleotide
gacagatacttctatcaccaagaggagaacgtgc

SEQ ID NO: 67375 - DNA, 34 bp, Artificial Sequence
  Description of Artificial Sequence: Synthetic oligonucleotide
acagatacttctatcaccaagaggagaacgtgcg

SEQ ID NO: 67376 - DNA, 33 bp, Artificial Sequence
  Description of Artificial Sequence: Synthetic oligonucleotide
cagatacttctatcaccaagaggagaacgtgcg

SEQ ID NO: 67377 - DNA, 33 bp, Artificial Sequence
  Description of Artificial Sequence: Synthetic oligonucleotide
agatacttctatcaccaagaggagaacgtgcgc

SEQ ID NO: 67378 - DNA, 32 bp, Artificial Sequence
  Description of Artificial Sequence: Synthetic oligonucleotide
gatacttctatcaccaagaggagaacgtgcgc

SEQ ID NO: 67379 - DNA, 34 bp, Artificial Sequence
  Description of Artificial Sequence: Synthetic oligonucleotide
atacttctatcaccaagaggagaacgtgcgcttc

SEQ ID NO: 67380 - DNA, 33 bp, Artificial Sequence
  Description of Artificial Sequence: Synthetic oligonucleotide
tacttctatcaccaagaggagaacgtgcgcttc

SEQ ID NO: 67381 - DNA, 32 bp, Artificial Sequence
  Description of Artificial Sequence: Synthetic oligonucleotide
acttctatcaccaagaggagaacgtgcgcttc

SEQ ID NO: 67382 - DNA, 31 bp, Artificial Sequence
  Description of Artificial Sequence: Synthetic oligonucleotide
cttctatcaccaagaggagaacgtgcgcttc

SEQ ID NO: 67383 - DNA, 31 bp, Artificial Sequence
  Description of Artificial Sequence: Synthetic oligonucleotide
ttctatcaccaagaggagaacgtgcgcttcg

SEQ ID NO: 67384 - DNA, 30 bp, Artificial Sequence
  Description of Artificial Sequence: Synthetic oligonucleotide
tctatcaccaagaggagaacgtgcgcttcg

SEQ ID NO: 67385 - DNA, 29 bp, Artificial Sequence
  Description of Artificial Sequence: Synthetic oligonucleotide
ctatcaccaagaggagaacgtgcgcttcg

SEQ ID NO: 67386 - DNA, 30 bp, Artificial Sequence
  Description of Artificial Sequence: Synthetic oligonucleotide
tatcaccaagaggagaacgtgcgcttcgac

SEQ ID NO: 67387 - DNA, 29 bp, Artificial Sequence
  Description of Artificial Sequence: Synthetic oligonucleotide
atcaccaagaggagaacgtgcgcttcgac

SEQ ID NO: 67388 - DNA, 28 bp, Artificial Sequence
  Description of Artificial Sequence: Synthetic oligonucleotide
tcaccaagaggagaacgtgcgcttcgac

SEQ ID NO: 67389 - DNA, 27 bp, Artificial Sequence
  Description of Artificial Sequence: Synthetic oligonucleotide
caccaagaggagaacgtgcgcttcgac

SEQ ID NO: 67390 - DNA, 31 bp, Artificial Sequence
  Description of Artificial Sequence: Synthetic oligonucleotide
atgagtgtcatttcttcaacgggacggagcc

SEQ ID NO: 67391 - DNA, 30 bp, Artificial Sequence
  Description of Artificial Sequence: Synthetic oligonucleotide
tgagtgtcatttcttcaacgggacggagcc

SEQ ID NO: 67392 - DNA, 29 bp, Artificial Sequence
  Description of Artificial Sequence: Synthetic oligonucleotide
gagtgtcatttcttcaacgggacggagcc

SEQ ID NO: 67393 - DNA, 29 bp, Artificial Sequence
  Description of Artificial Sequence: Synthetic oligonucleotide
agtgtcatttcttcaacgggacggagccg

SEQ ID NO: 67394 - DNA, 28 bp, Artificial Sequence
  Description of Artificial Sequence: Synthetic oligonucleotide
gtgtcatttcttcaacgggacggagccg

SEQ ID NO: 67395 - DNA, 28 bp, Artificial Sequence
  Description of Artificial Sequence: Synthetic oligonucleotide
tgtcatttcttcaacgggacggagccgg

SEQ ID NO: 67396 - DNA, 27 bp, Artificial Sequence
  Description of Artificial Sequence: Synthetic oligonucleotide
gtcatttcttcaacgggacggagccgg

SEQ ID NO: 67397 - DNA, 28 bp, Artificial Sequence
  Description of Artificial Sequence: Synthetic oligonucleotide
tcatttcttcaacgggacggagccggtg

SEQ ID NO: 67398 - DNA, 27 bp, Artificial Sequence
  Description of Artificial Sequence: Synthetic oligonucleotide
catttcttcaacgggacggagccggtg

SEQ ID NO: 67399 - DNA, 27 bp, Artificial Sequence
  Description of Artificial Sequence: Synthetic oligonucleotide
atttcttcaacgggacggagccggtgc

SEQ ID NO: 67400 - DNA, 26 bp, Artificial Sequence
  Description of Artificial Sequence: Synthetic oligonucleotide
tttcttcaacgggacggagccggtgc

SEQ ID NO: 67401 - DNA, 25 bp, Artificial Sequence
  Description of Artificial Sequence: Synthetic oligonucleotide
ttcttcaacgggacggagccggtgc

SEQ ID NO: 67402 - DNA, 24 bp, Artificial Sequence
  Description of Artificial Sequence: Synthetic oligonucleotide
tcttcaacgggacggagccggtgc

SEQ ID NO: 67403 - DNA, 23 bp, Artificial Sequence
  Description of Artificial Sequence: Synthetic oligonucleotide
cttcaacgggacggagccggtgc

SEQ ID NO: 67404 - DNA, 23 bp, Artificial Sequence
  Description of Artificial Sequence: Synthetic oligonucleotide
ttcaacgggacggagccggtgcg

SEQ ID NO: 67405 - DNA, 22 bp, Artificial Sequence
  Description of Artificial Sequence: Synthetic oligonucleotide
tcaacgggacggagccggtgcg

SEQ ID NO: 67406 - DNA, 21 bp, Artificial Sequence
  Description of Artificial Sequence: Synthetic oligonucleotide
caacgggacggagccggtgcg

SEQ ID NO: 67407 - DNA, 23 bp, Artificial Sequence
  Description of Artificial Sequence: Synthetic oligonucleotide
aacgggacggagccggtgcggtt

SEQ ID NO: 67408 - DNA, 22 bp, Artificial Sequence
  Description of Artificial Sequence: Synthetic oligonucleotide
acgggacggagccggtgcggtt

SEQ ID NO: 67409 - DNA, 21 bp, Artificial Sequence
  Description of Artificial Sequence: Synthetic oligonucleotide
cgggacggagccggtgcggtt

SEQ ID NO: 67410 - DNA, 21 bp, Artificial Sequence
  Description of Artificial Sequence: Synthetic oligonucleotide
gggacggagccggtgcggttc

SEQ ID NO: 67411 - DNA, 22 bp, Artificial Sequence
  Description of Artificial Sequence: Synthetic oligonucleotide
ggacggagccggtgcggttcct

SEQ ID NO: 67412 - DNA, 22 bp, Artificial Sequence
  Description of Artificial Sequence: Synthetic oligonucleotide
gacggagccggtgcggttcctg

SEQ ID NO: 67413 - DNA, 23 bp, Artificial Sequence
  Description of Artificial Sequence: Synthetic oligonucleotide
acggagccggtgcggttcctgga

SEQ ID NO: 67414 - DNA, 22 bp, Artificial Sequence
  Description of Artificial Sequence: Synthetic oligonucleotide
cggagccggtgcggttcctgga

SEQ ID NO: 67415 - DNA, 23 bp, Artificial Sequence
  Description of Artificial Sequence: Synthetic oligonucleotide
ggagccggtgcggttcctggaca

SEQ ID NO: 67416 - DNA, 26 bp, Artificial Sequence
  Description of Artificial Sequence: Synthetic oligonucleotide
gagccggtgcggttcctggacagata

SEQ ID NO: 67417 - DNA, 27 bp, Artificial Sequence
  Description of Artificial Sequence: Synthetic oligonucleotide
agccggtgcggttcctggacagatact

SEQ ID NO: 67418 - DNA, 27 bp, Artificial Sequence
  Description of Artificial Sequence: Synthetic oligonucleotide
gccggtgcggttcctggacagatactt

SEQ ID NO: 67419 - DNA, 27 bp, Artificial Sequence
  Description of Artificial Sequence: Synthetic oligonucleotide
ccggtgcggttcctggacagatacttc

SEQ ID NO: 67420 - DNA, 30 bp, Artificial Sequence
  Description of Artificial Sequence: Synthetic oligonucleotide
cggtgcggttcctggacagatacttctatc

SEQ ID NO: 67421 - DNA, 20 bp, Artificial Sequence
  Description of Artificial Sequence: Synthetic oligonucleotide
ggtgacggagctggggcggg

SEQ ID NO: 67422 - DNA, 21 bp, Artificial Sequence
  Description of Artificial Sequence: Synthetic oligonucleotide
gtgacggagctggggcgggct

SEQ ID NO: 67423 - DNA, 23 bp, Artificial Sequence
  Description of Artificial Sequence: Synthetic oligonucleotide
tgacggagctggggcgggctgat

SEQ ID NO: 67424 - DNA, 22 bp, Artificial Sequence
  Description of Artificial Sequence: Synthetic oligonucleotide
gacggagctggggcgggctgat

SEQ ID NO: 67425 - DNA, 22 bp, Artificial Sequence
  Description of Artificial Sequence: Synthetic oligonucleotide
acggagctggggcgggctgatg

SEQ ID NO: 67426 - DNA, 21 bp, Artificial Sequence
  Description of Artificial Sequence: Synthetic oligonucleotide
cggagctggggcgggctgatg

SEQ ID NO: 67427 - DNA, 21 bp, Artificial Sequence
  Description of Artificial Sequence: Synthetic oligonucleotide
ggagctggggcgggctgatgc

SEQ ID NO: 67428 - DNA, 21 bp, Artificial Sequence
  Description of Artificial Sequence: Synthetic oligonucleotide
gagctggggcgggctgatgcc

SEQ ID NO: 67429 - DNA, 22 bp, Artificial Sequence
  Description of Artificial Sequence: Synthetic oligonucleotide
agctggggcgggctgatgccga

SEQ ID NO: 67430 - DNA, 21 bp, Artificial Sequence
  Description of Artificial Sequence: Synthetic oligonucleotide
gctggggcgggctgatgccga

SEQ ID NO: 67431 - DNA, 23 bp, Artificial Sequence
  Description of Artificial Sequence: Synthetic oligonucleotide
ctggggcgggctgatgccgagta

SEQ ID NO: 67432 - DNA, 24 bp, Artificial Sequence
  Description of Artificial Sequence: Synthetic oligonucleotide
tggggcgggctgatgccgagtact

SEQ ID NO: 67433 - DNA, 23 bp, Artificial Sequence
  Description of Artificial Sequence: Synthetic oligonucleotide
ggggcgggctgatgccgagtact

SEQ ID NO: 67434 - DNA, 23 bp, Artificial Sequence
  Description of Artificial Sequence: Synthetic oligonucleotide
gggcgggctgatgccgagtactg

SEQ ID NO: 67435 - DNA, 25 bp, Artificial Sequence
  Description of Artificial Sequence: Synthetic oligonucleotide
ggcgggctgatgccgagtactggaa

SEQ ID NO: 67436 - DNA, 26 bp, Artificial Sequence
  Description of Artificial Sequence: Synthetic oligonucleotide
gcgggctgatgccgagtactggaaca

SEQ ID NO: 67437 - DNA, 26 bp, Artificial Sequence
  Description of Artificial Sequence: Synthetic oligonucleotide
cgggctgatgccgagtactggaacag

SEQ ID NO: 67438 - DNA, 26 bp, Artificial Sequence
  Description of Artificial Sequence: Synthetic oligonucleotide
gggctgatgccgagtactggaacagc

SEQ ID NO: 67439 - DNA, 27 bp, Artificial Sequence
  Description of Artificial Sequence: Synthetic oligonucleotide
ggctgatgccgagtactggaacagcca

SEQ ID NO: 67440 - DNA, 27 bp, Artificial Sequence
  Description of Artificial Sequence: Synthetic oligonucleotide
gctgatgccgagtactggaacagccag

SEQ ID NO: 67441 - DNA, 27 bp, Artificial Sequence
  Description of Artificial Sequence: Synthetic oligonucleotide
cagaaggacttcctggaagacaggcgc

SEQ ID NO: 67442 - DNA, 27 bp, Artificial Sequence
  Description of Artificial Sequence: Synthetic oligonucleotide
agaaggacttcctggaagacaggcgcg

SEQ ID NO: 67443 - DNA, 26 bp, Artificial Sequence
  Description of Artificial Sequence: Synthetic oligonucleotide
gaaggacttcctggaagacaggcgcg

SEQ ID NO: 67444 - DNA, 26 bp, Artificial Sequence
  Description of Artificial Sequence: Synthetic oligonucleotide
aaggacttcctggaagacaggcgcgc

SEQ ID NO: 67445 - DNA, 25 bp, Artificial Sequence
  Description of Artificial Sequence: Synthetic oligonucleotide
aggacttcctggaagacaggcgcgc

SEQ ID NO: 67446 - DNA, 24 bp, Artificial Sequence
  Description of Artificial Sequence: Synthetic oligonucleotide
ggacttcctggaagacaggcgcgc

SEQ ID NO: 67447 - DNA, 24 bp, Artificial Sequence
  Description of Artificial Sequence: Synthetic oligonucleotide
gacttcctggaagacaggcgcgcc

SEQ ID NO: 67448 - DNA, 24 bp, Artificial Sequence
  Description of Artificial Sequence: Synthetic oligonucleotide
acttcctggaagacaggcgcgccg

SEQ ID NO: 67449 - DNA, 23 bp, Artificial Sequence
  Description of Artificial Sequence: Synthetic oligonucleotide
cttcctggaagacaggcgcgccg

SEQ ID NO: 67450 - DNA, 23 bp, Artificial Sequence
  Description of Artificial Sequence: Synthetic oligonucleotide
ttcctggaagacaggcgcgccgc

SEQ ID NO: 67451 - DNA, 25 bp, Artificial Sequence
  Description of Artificial Sequence: Synthetic oligonucleotide
aaggacctcctggagcagaggcggt

SEQ ID NO: 67452 - DNA, 24 bp, Artificial Sequence
  Description of Artificial Sequence: Synthetic oligonucleotide
aggacctcctggagcagaggcggt

SEQ ID NO: 67453 - DNA, 23 bp, Artificial Sequence
  Description of Artificial Sequence: Synthetic oligonucleotide
ggacctcctggagcagaggcggt

SEQ ID NO: 67454 - DNA, 23 bp, Artificial Sequence
  Description of Artificial Sequence: Synthetic oligonucleotide
gacctcctggagcagaggcggtc

SEQ ID NO: 67455 - DNA, 23 bp, Artificial Sequence
  Description of Artificial Sequence: Synthetic oligonucleotide
acctcctggagcagaggcggtcc

SEQ ID NO: 67456 - DNA, 22 bp, Artificial Sequence
  Description of Artificial Sequence: Synthetic oligonucleotide
cctcctggagcagaggcggtcc

SEQ ID NO: 67457 - DNA, 22 bp, Artificial Sequence
  Description of Artificial Sequence: Synthetic oligonucleotide
ctcctggagcagaggcggtccg

SEQ ID NO: 67458 - DNA, 22 bp, Artificial Sequence
  Description of Artificial Sequence: Synthetic oligonucleotide
tcctggagcagaggcggtccgc

SEQ ID NO: 67459 - DNA, 21 bp, Artificial Sequence
  Description of Artificial Sequence: Synthetic oligonucleotide
cctggagcagaggcggtccgc

SEQ ID NO: 67460 - DNA, 21 bp, Artificial Sequence
  Description of Artificial Sequence: Synthetic oligonucleotide
ctggagcagaggcggtccgcg

SEQ ID NO: 67461 - DNA, 22 bp, Artificial Sequence
  Description of Artificial Sequence: Synthetic oligonucleotide
tggagcagaggcggtccgcggt

SEQ ID NO: 67462 - DNA, 21 bp, Artificial Sequence
  Description of Artificial Sequence: Synthetic oligonucleotide
ggagcagaggcggtccgcggt

SEQ ID NO: 67463 - DNA, 21 bp, Artificial Sequence
  Description of Artificial Sequence: Synthetic oligonucleotide
gagcagaggcggtccgcggtg

SEQ ID NO: 67464 - DNA, 22 bp, Artificial Sequence
  Description of Artificial Sequence: Synthetic oligonucleotide
agcagaggcggtccgcggtgga

SEQ ID NO: 67465 - DNA, 21 bp, Artificial Sequence
  Description of Artificial Sequence: Synthetic oligonucleotide
gcagaggcggtccgcggtgga

SEQ ID NO: 67466 - DNA, 22 bp, Artificial Sequence
  Description of Artificial Sequence: Synthetic oligonucleotide
cagaggcggtccgcggtggaca

SEQ ID NO: 67467 - DNA, 22 bp, Artificial Sequence
  Description of Artificial Sequence: Synthetic oligonucleotide
agaggcggtccgcggtggacac

SEQ ID NO: 67468 - DNA, 21 bp, Artificial Sequence
  Description of Artificial Sequence: Synthetic oligonucleotide
gaggcggtccgcggtggacac

SEQ ID NO: 67469 - DNA, 23 bp, Artificial Sequence
  Description of Artificial Sequence: Synthetic oligonucleotide
aggcggtccgcggtggacaccta

SEQ ID NO: 67470 - DNA, 22 bp, Artificial Sequence
  Description of Artificial Sequence: Synthetic oligonucleotide
ggcggtccgcggtggacaccta

SEQ ID NO: 67471 - DNA, 23 bp, Artificial Sequence
  Description of Artificial Sequence: Synthetic oligonucleotide
gcggtccgcggtggacacctact

SEQ ID NO: 67472 - DNA, 23 bp, Artificial Sequence
  Description of Artificial Sequence: Synthetic oligonucleotide
cggtccgcggtggacacctactg

SEQ ID NO: 67473 - DNA, 24 bp, Artificial Sequence
  Description of Artificial Sequence: Synthetic oligonucleotide
ggtccgcggtggacacctactgca

SEQ ID NO: 67474 - DNA, 25 bp, Artificial Sequence
  Description of Artificial Sequence: Synthetic oligonucleotide
gtccgcggtggacacctactgcaga

SEQ ID NO: 67475 - DNA, 26 bp, Artificial Sequence
  Description of Artificial Sequence: Synthetic oligonucleotide
tccgcggtggacacctactgcagaca

SEQ ID NO: 67476 - DNA, 41 bp, Artificial Sequence
  Description of Artificial Sequence: Synthetic oligonucleotide
cacgtttcttggagcagattaaacatgagtgtcatttcttc

SEQ ID NO: 67477 - DNA, 43 bp, Artificial Sequence
  Description of Artificial Sequence: Synthetic oligonucleotide
acgtttcttggagcagattaaacatgagtgtcatttcttcaac

SEQ ID NO: 67478 - DNA, 42 bp, Artificial Sequence
  Description of Artificial Sequence: Synthetic oligonucleotide
cgtttcttggagcagattaaacatgagtgtcatttcttcaac

SEQ ID NO: 67479 - DNA, 42 bp, Artificial Sequence
  Description of Artificial Sequence: Synthetic oligonucleotide
gtttcttggagcagattaaacatgagtgtcatttcttcaacg

SEQ ID NO: 67480 - DNA, 42 bp, Artificial Sequence
  Description of Artificial Sequence: Synthetic oligonucleotide
tttcttggagcagattaaacatgagtgtcatttcttcaacgg

SEQ ID NO: 67481 - DNA, 41 bp, Artificial Sequence
  Description of Artificial Sequence: Synthetic oligonucleotide
ttcttggagcagattaaacatgagtgtcatttcttcaacgg

SEQ ID NO: 67482 - DNA, 40 bp, Artificial Sequence
  Description of Artificial Sequence: Synthetic oligonucleotide
tcttggagcagattaaacatgagtgtcatttcttcaacgg

SEQ ID NO: 67483 - DNA, 39 bp, Artificial Sequence
  Description of Artificial Sequence: Synthetic oligonucleotide
cttggagcagattaaacatgagtgtcatttcttcaacgg

SEQ ID NO: 67484 - DNA, 39 bp, Artificial Sequence
  Description of Artificial Sequence: Synthetic oligonucleotide
ttggagcagattaaacatgagtgtcatttcttcaacggg

SEQ ID NO: 67485 - DNA, 38 bp, Artificial Sequence
  Description of Artificial Sequence: Synthetic oligonucleotide
tggagcagattaaacatgagtgtcatttcttcaacggg

SEQ ID NO: 67486 - DNA, 37 bp, Artificial Sequence
  Description of Artificial Sequence: Synthetic oligonucleotide
ggagcagattaaacatgagtgtcatttcttcaacggg

SEQ ID NO: 67487 - DNA, 38 bp, Artificial Sequence
  Description of Artificial Sequence: Synthetic oligonucleotide
gagcagattaaacatgagtgtcatttcttcaacgggac

SEQ ID NO: 67488 - DNA, 38 bp, Artificial Sequence
  Description of Artificial Sequence: Synthetic oligonucleotide
agcagattaaacatgagtgtcatttcttcaacgggacg

SEQ ID NO: 67489 - DNA, 37 bp, Artificial Sequence
  Description of Artificial Sequence: Synthetic oligonucleotide
gcagattaaacatgagtgtcatttcttcaacgggacg

SEQ ID NO: 67490 - DNA, 37 bp, Artificial Sequence
  Description of Artificial Sequence: Synthetic oligonucleotide
cagattaaacatgagtgtcatttcttcaacgggacgg

SEQ ID NO: 67491 - DNA, 38 bp, Artificial Sequence
  Description of Artificial Sequence: Synthetic oligonucleotide
agattaaacatgagtgtcatttcttcaacgggacggag

SEQ ID NO: 67492 - DNA, 37 bp, Artificial Sequence
  Description of Artificial Sequence: Synthetic oligonucleotide
gattaaacatgagtgtcatttcttcaacgggacggag

SEQ ID NO: 67493 - DNA, 37 bp, Artificial Sequence
  Description of Artificial Sequence: Synthetic oligonucleotide
attaaacatgagtgtcatttcttcaacgggacggagc

SEQ ID NO: 67494 - DNA, 21 bp, Artificial Sequence
  Description of Artificial Sequence: Synthetic oligonucleotide
aggcgggccgaggtggacacc

SEQ ID NO: 67495 - DNA, 20 bp, Artificial Sequence
  Description of Artificial Sequence: Synthetic oligonucleotide
ggcgggccgaggtggacacc

SEQ ID NO: 67496 - DNA, 21 bp, Artificial Sequence
  Description of Artificial Sequence: Synthetic oligonucleotide
gcgggccgaggtggacaccca

SEQ ID NO: 67497 - DNA, 22 bp, Artificial Sequence
  Description of Artificial Sequence: Synthetic oligonucleotide
cgggccgaggtggacacccact

SEQ ID NO: 67498 - DNA, 22 bp, Artificial Sequence
  Description of Artificial Sequence: Synthetic oligonucleotide
gggccgaggtggacacccactg

SEQ ID NO: 67499 - DNA, 23 bp, Artificial Sequence
  Description of Artificial Sequence: Synthetic oligonucleotide
ggccgaggtggacacccactgca

SEQ ID NO: 67500 - DNA, 24 bp, Artificial Sequence
  Description of Artificial Sequence: Synthetic oligonucleotide
gccgaggtggacacccactgcaga

SEQ ID NO: 67501 - DNA, 25 bp, Artificial Sequence
  Description of Artificial Sequence: Synthetic oligonucleotide
ccgaggtggacacccactgcagaca

SEQ ID NO: 67502 - DNA, 27 bp, Artificial Sequence
  Description of Artificial Sequence: Synthetic oligonucleotide
cgaggtggacacccactgcagacacaa

SEQ ID NO: 67503 - DNA, 27 bp, Artificial Sequence
  Description of Artificial Sequence: Synthetic oligonucleotide
gaggtggacacccactgcagacacaac

SEQ ID NO: 67504 - DNA, 29 bp, Artificial Sequence
  Description of Artificial Sequence: Synthetic oligonucleotide
aggtggacacccactgcagacacaactac

SEQ ID NO: 67505 - DNA, 28 bp, Artificial Sequence
  Description of Artificial Sequence: Synthetic oligonucleotide
ggtggacacccactgcagacacaactac

SEQ ID NO: 67506 - DNA, 28 bp, Artificial Sequence
  Description of Artificial Sequence: Synthetic oligonucleotide
gtggacacccactgcagacacaactacg

SEQ ID NO: 67507 - DNA, 28 bp, Artificial Sequence
  Description of Artificial Sequence: Synthetic oligonucleotide
tggacacccactgcagacacaactacgg

SEQ ID NO: 67508 - DNA, 27 bp, Artificial Sequence
  Description of Artificial Sequence: Synthetic oligonucleotide
ggacacccactgcagacacaactacgg

SEQ ID NO: 67509 - DNA, 27 bp, Artificial Sequence
  Description of Artificial Sequence: Synthetic oligonucleotide
gacacccactgcagacacaactacggg

SEQ ID NO: 67510 - DNA, 27 bp, Artificial Sequence
  Description of Artificial Sequence: Synthetic oligonucleotide
acacccactgcagacacaactacgggg

SEQ ID NO: 67511 - DNA, 27 bp, Artificial Sequence
  Description of Artificial Sequence: Synthetic oligonucleotide
cacccactgcagacacaactacggggt

SEQ ID NO: 67512 - DNA, 28 bp, Artificial Sequence
  Description of Artificial Sequence: Synthetic oligonucleotide
acccactgcagacacaactacggggttg

SEQ ID NO: 67513 - DNA, 27 bp, Artificial Sequence
  Description of Artificial Sequence: Synthetic oligonucleotide
cccactgcagacacaactacggggttg

SEQ ID NO: 67514 - DNA, 28 bp, Artificial Sequence
  Description of Artificial Sequence: Synthetic oligonucleotide
ccactgcagacacaactacggggttgtg

SEQ ID NO: 67515 - DNA, 28 bp, Artificial Sequence
  Description of Artificial Sequence: Synthetic oligonucleotide
cactgcagacacaactacggggttgtgg

SEQ ID NO: 67516 - DNA, 27 bp, Artificial Sequence
  Description of Artificial Sequence: Synthetic oligonucleotide
ggccgaggtggacacctactgcagata

SEQ ID NO: 67517 - DNA, 27 bp, Artificial Sequence
  Description of Artificial Sequence: Synthetic oligonucleotide
gccgaggtggacacctactgcagatac

SEQ ID NO: 67518 - DNA, 29 bp, Artificial Sequence
  Description of Artificial Sequence: Synthetic oligonucleotide
ccgaggtggacacctactgcagatacaac

SEQ ID NO: 67519 - DNA, 31 bp, Artificial Sequence
  Description of Artificial Sequence: Synthetic oligonucleotide
cgaggtggacacctactgcagatacaactac

SEQ ID NO: 67520 - DNA, 31 bp, Artificial Sequence
  Description of Artificial Sequence: Synthetic oligonucleotide
gaggtggacacctactgcagatacaactacg

SEQ ID NO: 67521 - DNA, 31 bp, Artificial Sequence
  Description of Artificial Sequence: Synthetic oligonucleotide
aggtggacacctactgcagatacaactacgg

SEQ ID NO: 67522 - DNA, 30 bp, Artificial Sequence
  Description of Artificial Sequence: Synthetic oligonucleotide
ggtggacacctactgcagatacaactacgg

SEQ ID NO: 67523 - DNA, 30 bp, Artificial Sequence
  Description of Artificial Sequence: Synthetic oligonucleotide
gtggacacctactgcagatacaactacggg

SEQ ID NO: 67524 - DNA, 30 bp, Artificial Sequence
  Description of Artificial Sequence: Synthetic oligonucleotide
tggacacctactgcagatacaactacgggg

SEQ ID NO: 67525 - DNA, 29 bp, Artificial Sequence
  Description of Artificial Sequence: Synthetic oligonucleotide
ggacacctactgcagatacaactacgggg

SEQ ID NO: 67526 - DNA, 31 bp, Artificial Sequence
  Description of Artificial Sequence: Synthetic oligonucleotide
gacacctactgcagatacaactacggggttg

SEQ ID NO: 67527 - DNA, 32 bp, Artificial Sequence
  Description of Artificial Sequence: Synthetic oligonucleotide
acacctactgcagatacaactacggggttgtg

SEQ ID NO: 67528 - DNA, 31 bp, Artificial Sequence
  Description of Artificial Sequence: Synthetic oligonucleotide
cacctactgcagatacaactacggggttgtg

SEQ ID NO: 67529 - DNA, 31 bp, Artificial Sequence
  Description of Artificial Sequence: Synthetic oligonucleotide
acctactgcagatacaactacggggttgtgg

SEQ ID NO: 67530 - DNA, 30 bp, Artificial Sequence
  Description of Artificial Sequence: Synthetic oligonucleotide
cctactgcagatacaactacggggttgtgg

SEQ ID NO: 67531 - DNA, 31 bp, Artificial Sequence
  Description of Artificial Sequence: Synthetic oligonucleotide
ctactgcagatacaactacggggttgtggag

SEQ ID NO: 67532 - DNA, 32 bp, Artificial Sequence
  Description of Artificial Sequence: Synthetic oligonucleotide
tactgcagatacaactacggggttgtggagag

SEQ ID NO: 67533 - DNA, 31 bp, Artificial Sequence
  Description of Artificial Sequence: Synthetic oligonucleotide
actgcagatacaactacggggttgtggagag

SEQ ID NO: 67534 - DNA, 30 bp, Artificial Sequence
  Description of Artificial Sequence: Synthetic oligonucleotide
ctgcagatacaactacggggttgtggagag

SEQ ID NO: 67535 - DNA, 30 bp, Artificial Sequence
  Description of Artificial Sequence: Synthetic oligonucleotide
tgcagatacaactacggggttgtggagagc

SEQ ID NO: 67536 - DNA, 29 bp, Artificial Sequence
  Description of Artificial Sequence: Synthetic oligonucleotide
gcagatacaactacggggttgtggagagc

SEQ ID NO: 67537 - DNA, 31 bp, Artificial Sequence
  Description of Artificial Sequence: Synthetic oligonucleotide
cagatacaactacggggttgtggagagcttc

SEQ ID NO: 67538 - DNA, 32 bp, Artificial Sequence
  Description of Artificial Sequence: Synthetic oligonucleotide
agatacaactacggggttgtggagagcttcac

SEQ ID NO: 67539 - DNA, 31 bp, Artificial Sequence
  Description of Artificial Sequence: Synthetic oligonucleotide
gatacaactacggggttgtggagagcttcac

SEQ ID NO: 67540 - DNA, 32 bp, Artificial Sequence
  Description of Artificial Sequence: Synthetic oligonucleotide
atacaactacggggttgtggagagcttcacag

SEQ ID NO: 67541 - DNA, 31 bp, Artificial Sequence
  Description of Artificial Sequence: Synthetic oligonucleotide
tacaactacggggttgtggagagcttcacag

SEQ ID NO: 67542 - DNA, 27 bp, Artificial Sequence
  Description of Artificial Sequence: Synthetic oligonucleotide
cagaaggacatcctggaagacaggcgc

SEQ ID NO: 67543 - DNA, 27 bp, Artificial Sequence
  Description of Artificial Sequence: Synthetic oligonucleotide
agaaggacatcctggaagacaggcgcg

SEQ ID NO: 67544 - DNA, 26 bp, Artificial Sequence
  Description of Artificial Sequence: Synthetic oligonucleotide
gaaggacatcctggaagacaggcgcg

SEQ ID NO: 67545 - DNA, 26 bp, Artificial Sequence
  Description of Artificial Sequence: Synthetic oligonucleotide
aaggacatcctggaagacaggcgcgc

SEQ ID NO: 67546 - DNA, 25 bp, Artificial Sequence
  Description of Artificial Sequence: Synthetic oligonucleotide
aggacatcctggaagacaggcgcgc

SEQ ID NO: 67547 - DNA, 24 bp, Artificial Sequence
  Description of Artificial Sequence: Synthetic oligonucleotide
ggacatcctggaagacaggcgcgc

SEQ ID NO: 67548 - DNA, 24 bp, Artificial Sequence
  Description of Artificial Sequence: Synthetic oligonucleotide
gacatcctggaagacaggcgcgcc

SEQ ID NO: 67549 - DNA, 24 bp, Artificial Sequence
  Description of Artificial Sequence: Synthetic oligonucleotide
acatcctggaagacaggcgcgccg

SEQ ID NO: 67550 - DNA, 23 bp, Artificial Sequence
  Description of Artificial Sequence: Synthetic oligonucleotide
catcctggaagacaggcgcgccg

SEQ ID NO: 67551 - DNA, 23 bp, Artificial Sequence
  Description of Artificial Sequence: Synthetic oligonucleotide
atcctggaagacaggcgcgccgc

SEQ ID NO: 67552 - DNA, 22 bp, Artificial Sequence
  Description of Artificial Sequence: Synthetic oligonucleotide
tggggcggcctagcgccgagaa

SEQ ID NO: 67553 - DNA, 21 bp, Artificial Sequence
  Description of Artificial Sequence: Synthetic oligonucleotide
ggggcggcctagcgccgagaa

SEQ ID NO: 67554 - DNA, 22 bp, Artificial Sequence
  Description of Artificial Sequence: Synthetic oligonucleotide
gggcggcctagcgccgagaact

SEQ ID NO: 67555 - DNA, 22 bp, Artificial Sequence
  Description of Artificial Sequence: Synthetic oligonucleotide
ggcggcctagcgccgagaactg

SEQ ID NO: 67556 - DNA, 24 bp, Artificial Sequence
  Description of Artificial Sequence: Synthetic oligonucleotide
gcggcctagcgccgagaactggaa

SEQ ID NO: 67557 - DNA, 25 bp, Artificial Sequence
  Description of Artificial Sequence: Synthetic oligonucleotide
cggcctagcgccgagaactggaaca

SEQ ID NO: 67558 - DNA, 25 bp, Artificial Sequence
  Description of Artificial Sequence: Synthetic oligonucleotide
ggcctagcgccgagaactggaacag

SEQ ID NO: 67559 - DNA, 25 bp, Artificial Sequence
  Description of Artificial Sequence: Synthetic oligonucleotide
gcctagcgccgagaactggaacagc

SEQ ID NO: 67560 - DNA, 26 bp, Artificial Sequence
  Description of Artificial Sequence: Synthetic oligonucleotide
cctagcgccgagaactggaacagcca

SEQ ID NO: 67561 - DNA, 27 bp, Artificial Sequence
  Description of Artificial Sequence: Synthetic oligonucleotide
ctagcgccgagaactggaacagccaga

SEQ ID NO: 67562 - DNA, 28 bp, Artificial Sequence
  Description of Artificial Sequence: Synthetic oligonucleotide
tagcgccgagaactggaacagccagaag

SEQ ID NO: 67563 - DNA, 27 bp, Artificial Sequence
  Description of Artificial Sequence: Synthetic oligonucleotide
agcgccgagaactggaacagccagaag

SEQ ID NO: 67564 - DNA, 26 bp, Artificial Sequence
  Description of Artificial Sequence: Synthetic oligonucleotide
gcgccgagaactggaacagccagaag

SEQ ID NO: 67565 - DNA, 27 bp, Artificial Sequence
  Description of Artificial Sequence: Synthetic oligonucleotide
cgccgagaactggaacagccagaagga

SEQ ID NO: 67566 - DNA, 27 bp, Artificial Sequence
  Description of Artificial Sequence: Synthetic oligonucleotide
gccgagaactggaacagccagaaggac

SEQ ID NO: 67567 - DNA, 27 bp, Artificial Sequence
  Description of Artificial Sequence: Synthetic oligonucleotide
ccgagaactggaacagccagaaggacc

SEQ ID NO: 67568 - DNA, 28 bp, Artificial Sequence
  Description of Artificial Sequence: Synthetic oligonucleotide
cgagaactggaacagccagaaggacctc

SEQ ID NO: 67569 - DNA, 28 bp, Artificial Sequence
  Description of Artificial Sequence: Synthetic oligonucleotide
gagaactggaacagccagaaggacctcc

SEQ ID NO: 67570 - DNA, 29 bp, Artificial Sequence
  Description of Artificial Sequence: Synthetic oligonucleotide
agaactggaacagccagaaggacctcctg

SEQ ID NO: 67571 - DNA, 28 bp, Artificial Sequence
  Description of Artificial Sequence: Synthetic oligonucleotide
gaactggaacagccagaaggacctcctg

SEQ ID NO: 67572 - DNA, 28 bp, Artificial Sequence
  Description of Artificial Sequence: Synthetic oligonucleotide
aactggaacagccagaaggacctcctgg

SEQ ID NO: 67573 - DNA, 26 bp, Artificial Sequence
  Description of Artificial Sequence: Synthetic oligonucleotide
agaaggacctcctggaagacaggcgg

SEQ ID NO: 67574 - DNA, 25 bp, Artificial Sequence
  Description of Artificial Sequence: Synthetic oligonucleotide
gaaggacctcctggaagacaggcgg

SEQ ID NO: 67575 - DNA, 25 bp, Artificial Sequence
  Description of Artificial Sequence: Synthetic oligonucleotide
aaggacctcctggaagacaggcggg

SEQ ID NO: 67576 - DNA, 24 bp, Artificial Sequence
  Description of Artificial Sequence: Synthetic oligonucleotide
aggacctcctggaagacaggcggg

SEQ ID NO: 67577 - DNA, 23 bp, Artificial Sequence
  Description of Artificial Sequence: Synthetic oligonucleotide
ggacctcctggaagacaggcggg

SEQ ID NO: 67578 - DNA, 23 bp, Artificial Sequence
  Description of Artificial Sequence: Synthetic oligonucleotide
gacctcctggaagacaggcgggc

SEQ ID NO: 67579 - DNA, 23 bp, Artificial Sequence
  Description of Artificial Sequence: Synthetic oligonucleotide
acctcctggaagacaggcgggcc

SEQ ID NO: 67580 - DNA, 22 bp, Artificial Sequence
  Description of Artificial Sequence: Synthetic oligonucleotide
cctcctggaagacaggcgggcc

SEQ ID NO: 67581 - DNA, 23 bp, Artificial Sequence
  Description of Artificial Sequence: Synthetic oligonucleotide
ctcctggaagacaggcgggccct

SEQ ID NO: 67582 - DNA, 27 bp, Artificial Sequence
  Description of Artificial Sequence: Synthetic oligonucleotide
gcggcctgatgccgagtactggaacaa

SEQ ID NO: 67583 - DNA, 27 bp, Artificial Sequence
  Description of Artificial Sequence: Synthetic oligonucleotide
cggcctgatgccgagtactggaacaac

SEQ ID NO: 67584 - DNA, 27 bp, Artificial Sequence
  Description of Artificial Sequence: Synthetic oligonucleotide
ggcctgatgccgagtactggaacaacc

SEQ ID NO: 67585 - DNA, 28 bp, Artificial Sequence
  Description of Artificial Sequence: Synthetic oligonucleotide
gcctgatgccgagtactggaacaaccag

SEQ ID NO: 67586 - DNA, 30 bp, Artificial Sequence
  Description of Artificial Sequence: Synthetic oligonucleotide
cctgatgccgagtactggaacaaccagaag

SEQ ID NO: 67587 - DNA, 30 bp, Artificial Sequence
  Description of Artificial Sequence: Synthetic oligonucleotide
ctgatgccgagtactggaacaaccagaagg

SEQ ID NO: 67588 - DNA, 31 bp, Artificial Sequence
  Description of Artificial Sequence: Synthetic oligonucleotide
tgatgccgagtactggaacaaccagaaggac

SEQ ID NO: 67589 - DNA, 30 bp, Artificial Sequence
  Description of Artificial Sequence: Synthetic oligonucleotide
gatgccgagtactggaacaaccagaaggac

SEQ ID NO: 67590 - DNA, 30 bp, Artificial Sequence
  Description of Artificial Sequence: Synthetic oligonucleotide
atgccgagtactggaacaaccagaaggacc

SEQ ID NO: 67591 - DNA, 29 bp, Artificial Sequence
  Description of Artificial Sequence: Synthetic oligonucleotide
tgccgagtactggaacaaccagaaggacc

SEQ ID NO: 67592 - DNA, 28 bp, Artificial Sequence
  Description of Artificial Sequence: Synthetic oligonucleotide
gccgagtactggaacaaccagaaggacc

SEQ ID NO: 67593 - DNA, 29 bp, Artificial Sequence
  Description of Artificial Sequence: Synthetic oligonucleotide
ccgagtactggaacaaccagaaggacctc

SEQ ID NO: 67594 - DNA, 29 bp, Artificial Sequence
  Description of Artificial Sequence: Synthetic oligonucleotide
cgagtactggaacaaccagaaggacctcc

SEQ ID NO: 67595 - DNA, 30 bp, Artificial Sequence
  Description of Artificial Sequence: Synthetic oligonucleotide
gagtactggaacaaccagaaggacctcctg

SEQ ID NO: 67596 - DNA, 30 bp, Artificial Sequence
  Description of Artificial Sequence: Synthetic oligonucleotide
agtactggaacaaccagaaggacctcctgg

SEQ ID NO: 67597 - DNA, 29 bp, Artificial Sequence
  Description of Artificial Sequence: Synthetic oligonucleotide
gtactggaacaaccagaaggacctcctgg

SEQ ID NO: 67598 - DNA, 30 bp, Artificial Sequence
  Description of Artificial Sequence: Synthetic oligonucleotide
tactggaacaaccagaaggacctcctggag

SEQ ID NO: 67599 - DNA, 29 bp, Artificial Sequence
  Description of Artificial Sequence: Synthetic oligonucleotide
actggaacaaccagaaggacctcctggag

SEQ ID NO: 67600 - DNA, 28 bp, Artificial Sequence
  Description of Artificial Sequence: Synthetic oligonucleotide
ctggaacaaccagaaggacctcctggag

SEQ ID NO: 67601 - DNA, 28 bp, Artificial Sequence
  Description of Artificial Sequence: Synthetic oligonucleotide
tggaacaaccagaaggacctcctggagc

SEQ ID NO: 67602 - DNA, 27 bp, Artificial Sequence
  Description of Artificial Sequence: Synthetic oligonucleotide
ggaacaaccagaaggacctcctggagc

SEQ ID NO: 67603 - DNA, 28 bp, Artificial Sequence
  Description of Artificial Sequence: Synthetic oligonucleotide
gaacaaccagaaggacctcctggagcag

SEQ ID NO: 67604 - DNA, 29 bp, Artificial Sequence
  Description of Artificial Sequence: Synthetic oligonucleotide
aacaaccagaaggacctcctggagcagag

SEQ ID NO: 67605 - DNA, 28 bp, Artificial Sequence
  Description of Artificial Sequence: Synthetic oligonucleotide
acaaccagaaggacctcctggagcagag

SEQ ID NO: 67606 - DNA, 27 bp, Artificial Sequence
  Description of Artificial Sequence: Synthetic oligonucleotide
caaccagaaggacctcctggagcagag

SEQ ID NO: 67607 - DNA, 27 bp, Artificial Sequence
  Description of Artificial Sequence: Synthetic oligonucleotide
aaccagaaggacctcctggagcagagg

SEQ ID NO: 67608 - DNA, 26 bp, Artificial Sequence
  Description of Artificial Sequence: Synthetic oligonucleotide
accagaaggacctcctggagcagagg

SEQ ID NO: 67609 - DNA, 41 bp, Artificial Sequence
  Description of Artificial Sequence: Synthetic oligonucleotide
cacgtttcttggagcaggttaaatatgagtgtcatttcttc

SEQ ID NO: 67610 - DNA, 43 bp, Artificial Sequence
  Description of Artificial Sequence: Synthetic oligonucleotide
acgtttcttggagcaggttaaatatgagtgtcatttcttcaac

SEQ ID NO: 67611 - DNA, 42 bp, Artificial Sequence
  Description of Artificial Sequence: Synthetic oligonucleotide
cgtttcttggagcaggttaaatatgagtgtcatttcttcaac

SEQ ID NO: 67612 - DNA, 42 bp, Artificial Sequence
  Description of Artificial Sequence: Synthetic oligonucleotide
gtttcttggagcaggttaaatatgagtgtcatttcttcaacg

SEQ ID NO: 67613 - DNA, 42 bp, Artificial Sequence
  Description of Artificial Sequence: Synthetic oligonucleotide
tttcttggagcaggttaaatatgagtgtcatttcttcaacgg

SEQ ID NO: 67614 - DNA, 41 bp, Artificial Sequence
  Description of Artificial Sequence: Synthetic oligonucleotide
ttcttggagcaggttaaatatgagtgtcatttcttcaacgg

SEQ ID NO: 67615 - DNA, 40 bp, Artificial Sequence
  Description of Artificial Sequence: Synthetic oligonucleotide
tcttggagcaggttaaatatgagtgtcatttcttcaacgg

SEQ ID NO: 67616 - DNA, 39 bp, Artificial Sequence
  Description of Artificial Sequence: Synthetic oligonucleotide
cttggagcaggttaaatatgagtgtcatttcttcaacgg

SEQ ID NO: 67617 - DNA, 39 bp, Artificial Sequence
  Description of Artificial Sequence: Synthetic oligonucleotide
ttggagcaggttaaatatgagtgtcatttcttcaacggg

SEQ ID NO: 67618 - DNA, 38 bp, Artificial Sequence
  Description of Artificial Sequence: Synthetic oligonucleotide
tggagcaggttaaatatgagtgtcatttcttcaacggg

SEQ ID NO: 67619 - DNA, 37 bp, Artificial Sequence
  Description of Artificial Sequence: Synthetic oligonucleotide
ggagcaggttaaatatgagtgtcatttcttcaacggg

SEQ ID NO: 67620 - DNA, 38 bp, Artificial Sequence
  Description of Artificial Sequence: Synthetic oligonucleotide
gagcaggttaaatatgagtgtcatttcttcaacgggac

SEQ ID NO: 67621 - DNA, 38 bp, Artificial Sequence
  Description of Artificial Sequence: Synthetic oligonucleotide
agcaggttaaatatgagtgtcatttcttcaacgggacg

SEQ ID NO: 67622 - DNA, 37 bp, Artificial Sequence
  Description of Artificial Sequence: Synthetic oligonucleotide
gcaggttaaatatgagtgtcatttcttcaacgggacg

SEQ ID NO: 67623 - DNA, 37 bp, Artificial Sequence
  Description of Artificial Sequence: Synthetic oligonucleotide
caggttaaatatgagtgtcatttcttcaacgggacgg

SEQ ID NO: 67624 - DNA, 38 bp, Artificial Sequence
  Description of Artificial Sequence: Synthetic oligonucleotide
aggttaaatatgagtgtcatttcttcaacgggacggag

SEQ ID NO: 67625 - DNA, 37 bp, Artificial Sequence
  Description of Artificial Sequence: Synthetic oligonucleotide
ggttaaatatgagtgtcatttcttcaacgggacggag

SEQ ID NO: 67626 - DNA, 37 bp, Artificial Sequence
  Description of Artificial Sequence: Synthetic oligonucleotide
gttaaatatgagtgtcatttcttcaacgggacggagc

SEQ ID NO: 67627 - DNA, 37 bp, Artificial Sequence
  Description of Artificial Sequence: Synthetic oligonucleotide
ttaaatatgagtgtcatttcttcaacgggacggagcg

SEQ ID NO: 67628 - DNA, 36 bp, Artificial Sequence
  Description of Artificial Sequence: Synthetic oligonucleotide
taaatatgagtgtcatttcttcaacgggacggagcg

SEQ ID NO: 67629 - DNA, 35 bp, Artificial Sequence
  Description of Artificial Sequence: Synthetic oligonucleotide
aaatatgagtgtcatttcttcaacgggacggagcg

SEQ ID NO: 67630 - DNA, 34 bp, Artificial Sequence
  Description of Artificial Sequence: Synthetic oligonucleotide
aatatgagtgtcatttcttcaacgggacggagcg

SEQ ID NO: 67631 - DNA, 33 bp, Artificial Sequence
  Description of Artificial Sequence: Synthetic oligonucleotide
atatgagtgtcatttcttcaacgggacggagcg

SEQ ID NO: 67632 - DNA, 32 bp, Artificial Sequence
  Description of Artificial Sequence: Synthetic oligonucleotide
tatgagtgtcatttcttcaacgggacggagcg

SEQ ID NO: 67633 - DNA, 27 bp, Artificial Sequence
  Description of Artificial Sequence: Synthetic oligonucleotide
acagccagaaggacctcctggagcagt

SEQ ID NO: 67634 - DNA, 26 bp, Artificial Sequence
  Description of Artificial Sequence: Synthetic oligonucleotide
cagccagaaggacctcctggagcagt

SEQ ID NO: 67635 - DNA, 26 bp, Artificial Sequence
  Description of Artificial Sequence: Synthetic oligonucleotide
agccagaaggacctcctggagcagtg

SEQ ID NO: 67636 - DNA, 25 bp, Artificial Sequence
  Description of Artificial Sequence: Synthetic oligonucleotide
gccagaaggacctcctggagcagtg

SEQ ID NO: 67637 - DNA, 25 bp, Artificial Sequence
  Description of Artificial Sequence: Synthetic oligonucleotide
ccagaaggacctcctggagcagtgg

SEQ ID NO: 67638 - DNA, 25 bp, Artificial Sequence
  Description of Artificial Sequence: Synthetic oligonucleotide
cagaaggacctcctggagcagtggc

SEQ ID NO: 67639 - DNA, 25 bp, Artificial Sequence
  Description of Artificial Sequence: Synthetic oligonucleotide
agaaggacctcctggagcagtggcg

SEQ ID NO: 67640 - DNA, 24 bp, Artificial Sequence
  Description of Artificial Sequence: Synthetic oligonucleotide
gaaggacctcctggagcagtggcg

SEQ ID NO: 67641 - DNA, 24 bp, Artificial Sequence
  Description of Artificial Sequence: Synthetic oligonucleotide
aaggacctcctggagcagtggcgg

SEQ ID NO: 67642 - DNA, 23 bp, Artificial Sequence
  Description of Artificial Sequence: Synthetic oligonucleotide
aggacctcctggagcagtggcgg

SEQ ID NO: 67643 - DNA, 22 bp, Artificial Sequence
  Description of Artificial Sequence: Synthetic oligonucleotide
ggacctcctggagcagtggcgg

SEQ ID NO: 67644 - DNA, 22 bp, Artificial Sequence
  Description of Artificial Sequence: Synthetic oligonucleotide
gacctcctggagcagtggcggg

SEQ ID NO: 67645 - DNA, 22 bp, Artificial Sequence
  Description of Artificial Sequence: Synthetic oligonucleotide
acctcctggagcagtggcgggc

SEQ ID NO: 67646 - DNA, 21 bp, Artificial Sequence
  Description of Artificial Sequence: Synthetic oligonucleotide
cctcctggagcagtggcgggc

SEQ ID NO: 67647 - DNA, 21 bp, Artificial Sequence
  Description of Artificial Sequence: Synthetic oligonucleotide
ctcctggagcagtggcgggcc

SEQ ID NO: 67648 - DNA, 22 bp, Artificial Sequence
  Description of Artificial Sequence: Synthetic oligonucleotide
tcctggagcagtggcgggccga

SEQ ID NO: 67649 - DNA, 21 bp, Artificial Sequence
  Description of Artificial Sequence: Synthetic oligonucleotide
cctggagcagtggcgggccga

SEQ ID NO: 67650 - DNA, 21 bp, Artificial Sequence
  Description of Artificial Sequence: Synthetic oligonucleotide
ctggagcagtggcgggccgag

SEQ ID NO: 67651 - DNA, 22 bp, Artificial Sequence
  Description of Artificial Sequence: Synthetic oligonucleotide
tggagcagtggcgggccgaggt

SEQ ID NO: 67652 - DNA, 21 bp, Artificial Sequence
  Description of Artificial Sequence: Synthetic oligonucleotide
ggagcagtggcgggccgaggt

SEQ ID NO: 67653 - DNA, 21 bp, Artificial Sequence
  Description of Artificial Sequence: Synthetic oligonucleotide
gagcagtggcgggccgaggtg

SEQ ID NO: 67654 - DNA, 22 bp, Artificial Sequence
  Description of Artificial Sequence: Synthetic oligonucleotide
agcagtggcgggccgaggtgga

SEQ ID NO: 67655 - DNA, 21 bp, Artificial Sequence
  Description of Artificial Sequence: Synthetic oligonucleotide
gcagtggcgggccgaggtgga

SEQ ID NO: 67656 - DNA, 22 bp, Artificial Sequence
  Description of Artificial Sequence: Synthetic oligonucleotide
cagtggcgggccgaggtggaca

SEQ ID NO: 67657 - DNA, 22 bp, Artificial Sequence
  Description of Artificial Sequence: Synthetic oligonucleotide
agtggcgggccgaggtggacac

SEQ ID NO: 67658 - DNA, 21 bp, Artificial Sequence
  Description of Artificial Sequence: Synthetic oligonucleotide
gtggcgggccgaggtggacac

SEQ ID NO: 67659 - DNA, 23 bp, Artificial Sequence
  Description of Artificial Sequence: Synthetic oligonucleotide
tggcgggccgaggtggacaccta

SEQ ID NO: 67660 - DNA, 31 bp, Artificial Sequence
  Description of Artificial Sequence: Synthetic oligonucleotide
cacgtttcttggagcaggctaagtctgagtg

SEQ ID NO: 67661 - DNA, 32 bp, Artificial Sequence
  Description of Artificial Sequence: Synthetic oligonucleotide
acgtttcttggagcaggctaagtctgagtgtc

SEQ ID NO: 67662 - DNA, 31 bp, Artificial Sequence
  Description of Artificial Sequence: Synthetic oligonucleotide
cgtttcttggagcaggctaagtctgagtgtc

SEQ ID NO: 67663 - DNA, 35 bp, Artificial Sequence
  Description of Artificial Sequence: Synthetic oligonucleotide
gtttcttggagcaggctaagtctgagtgtcatttc

SEQ ID NO: 67664 - DNA, 37 bp, Artificial Sequence
  Description of Artificial Sequence: Synthetic oligonucleotide
tttcttggagcaggctaagtctgagtgtcatttcttc

SEQ ID NO: 67665 - DNA, 36 bp, Artificial Sequence
  Description of Artificial Sequence: Synthetic oligonucleotide
ttcttggagcaggctaagtctgagtgtcatttcttc

SEQ ID NO: 67666 - DNA, 35 bp, Artificial Sequence
  Description of Artificial Sequence: Synthetic oligonucleotide
tcttggagcaggctaagtctgagtgtcatttcttc

SEQ ID NO: 67667 - DNA, 34 bp, Artificial Sequence
  Description of Artificial Sequence: Synthetic oligonucleotide
cttggagcaggctaagtctgagtgtcatttcttc

SEQ ID NO: 67668 - DNA, 36 bp, Artificial Sequence
  Description of Artificial Sequence: Synthetic oligonucleotide
ttggagcaggctaagtctgagtgtcatttcttcaac

SEQ ID NO: 67669 - DNA, 35 bp, Artificial Sequence
  Description of Artificial Sequence: Synthetic oligonucleotide
tggagcaggctaagtctgagtgtcatttcttcaac

SEQ ID NO: 67670 - DNA, 34 bp, Artificial Sequence
  Description of Artificial Sequence: Synthetic oligonucleotide
ggagcaggctaagtctgagtgtcatttcttcaac

SEQ ID NO: 67671 - DNA, 34 bp, Artificial Sequence
  Description of Artificial Sequence: Synthetic oligonucleotide
gagcaggctaagtctgagtgtcatttcttcaacg

SEQ ID NO: 67672 - DNA, 34 bp, Artificial Sequence
  Description of Artificial Sequence: Synthetic oligonucleotide
agcaggctaagtctgagtgtcatttcttcaacgg

SEQ ID NO: 67673 - DNA, 33 bp, Artificial Sequence
  Description of Artificial Sequence: Synthetic oligonucleotide
gcaggctaagtctgagtgtcatttcttcaacgg

SEQ ID NO: 67674 - DNA, 33 bp, Artificial Sequence
  Description of Artificial Sequence: Synthetic oligonucleotide
caggctaagtctgagtgtcatttcttcaacggg

SEQ ID NO: 67675 - DNA, 34 bp, Artificial Sequence
  Description of Artificial Sequence: Synthetic oligonucleotide
aggctaagtctgagtgtcatttcttcaacgggac

SEQ ID NO: 67676 - DNA, 33 bp, Artificial Sequence
  Description of Artificial Sequence: Synthetic oligonucleotide
ggctaagtctgagtgtcatttcttcaacgggac

SEQ ID NO: 67677 - DNA, 33 bp, Artificial Sequence
  Description of Artificial Sequence: Synthetic oligonucleotide
gctaagtctgagtgtcatttcttcaacgggacg

SEQ ID NO: 67678 - DNA, 33 bp, Artificial Sequence
  Description of Artificial Sequence: Synthetic oligonucleotide
ctaagtctgagtgtcatttcttcaacgggacgg

SEQ ID NO: 67679 - DNA, 34 bp, Artificial Sequence
  Description of Artificial Sequence: Synthetic oligonucleotide
taagtctgagtgtcatttcttcaacgggacggag

SEQ ID NO: 67680 - DNA, 33 bp, Artificial Sequence
  Description of Artificial Sequence: Synthetic oligonucleotide
aagtctgagtgtcatttcttcaacgggacggag

SEQ ID NO: 67681 - DNA, 32 bp, Artificial Sequence
  Description of Artificial Sequence: Synthetic oligonucleotide
agtctgagtgtcatttcttcaacgggacggag

SEQ ID NO: 67682 - DNA, 31 bp, Artificial Sequence
  Description of Artificial Sequence: Synthetic oligonucleotide
gtctgagtgtcatttcttcaacgggacggag

SEQ ID NO: 67683 - DNA, 31 bp, Artificial Sequence
  Description of Artificial Sequence: Synthetic oligonucleotide
tctgagtgtcatttcttcaacgggacggagc

SEQ ID NO: 67684 - DNA, 20 bp, Artificial Sequence
  Description of Artificial Sequence: Synthetic oligonucleotide
ctggagcggaggcgggccga

SEQ ID NO: 67685 - DNA, 20 bp, Artificial Sequence
  Description of Artificial Sequence: Synthetic oligonucleotide
tggagcggaggcgggccgag

SEQ ID NO: 67686 - DNA, 20 bp, Artificial Sequence
  Description of Artificial Sequence: Synthetic oligonucleotide
ggagcggaggcgggccgagt

SEQ ID NO: 67687 - DNA, 20 bp, Artificial Sequence
  Description of Artificial Sequence: Synthetic oligonucleotide
gagcggaggcgggccgaggt

SEQ ID NO: 67688 - DNA, 20 bp, Artificial Sequence
  Description of Artificial Sequence: Synthetic oligonucleotide
agcggaggcgggccgaggtg

SEQ ID NO: 67689 - DNA, 20 bp, Artificial Sequence
  Description of Artificial Sequence: Synthetic oligonucleotide
gcggaggcgggccgaggtgt

SEQ ID NO: 67690 - DNA, 20 bp, Artificial Sequence
  Description of Artificial Sequence: Synthetic oligonucleotide
cggaggcgggccgaggtgga

SEQ ID NO: 67691 - DNA, 21 bp, Artificial Sequence
  Description of Artificial Sequence: Synthetic oligonucleotide
ggaggcgggccgaggtggaca

SEQ ID NO: 67692 - DNA, 26 bp, Artificial Sequence
  Description of Artificial Sequence: Synthetic oligonucleotide
gccgcggtggacacctactgcagata

SEQ ID NO: 67693 - DNA, 27 bp, Artificial Sequence
  Description of Artificial Sequence: Synthetic oligonucleotide
ccgcggtggacacctactgcagataca

SEQ ID NO: 67694 - DNA, 28 bp, Artificial Sequence
  Description of Artificial Sequence: Synthetic oligonucleotide
cgcggtggacacctactgcagatacaac

SEQ ID NO: 67695 - DNA, 30 bp, Artificial Sequence
  Description of Artificial Sequence: Synthetic oligonucleotide
gcggtggacacctactgcagatacaactac

SEQ ID NO: 67696 - DNA, 30 bp, Artificial Sequence
  Description of Artificial Sequence: Synthetic oligonucleotide
cggtggacacctactgcagatacaactacg

SEQ ID NO: 67697 - DNA, 41 bp, Artificial Sequence
  Description of Artificial Sequence: Synthetic oligonucleotide
tttcttggagcaggttaaacatgagtgtcatttcttcaacc

SEQ ID NO: 67698 - DNA, 40 bp, Artificial Sequence
  Description of Artificial Sequence: Synthetic oligonucleotide
ttcttggagcaggttaaacatgagtgtcatttcttcaacc

SEQ ID NO: 67699 - DNA, 39 bp, Artificial Sequence
  Description of Artificial Sequence: Synthetic oligonucleotide
tcttggagcaggttaaacatgagtgtcatttcttcaacc

SEQ ID NO: 67700 - DNA, 38 bp, Artificial Sequence
  Description of Artificial Sequence: Synthetic oligonucleotide
cttggagcaggttaaacatgagtgtcatttcttcaacc

SEQ ID NO: 67701 - DNA, 38 bp, Artificial Sequence
  Description of Artificial Sequence: Synthetic oligonucleotide
ttggagcaggttaaacatgagtgtcatttcttcaaccg

SEQ ID NO: 67702 - DNA, 37 bp, Artificial Sequence
  Description of Artificial Sequence: Synthetic oligonucleotide
tggagcaggttaaacatgagtgtcatttcttcaaccg

SEQ ID NO: 67703 - DNA, 36 bp, Artificial Sequence
  Description of Artificial Sequence: Synthetic oligonucleotide
ggagcaggttaaacatgagtgtcatttcttcaaccg

SEQ ID NO: 67704 - DNA, 36 bp, Artificial Sequence
  Description of Artificial Sequence: Synthetic oligonucleotide
gagcaggttaaacatgagtgtcatttcttcaaccgg

SEQ ID NO: 67705 - DNA, 37 bp, Artificial Sequence
  Description of Artificial Sequence: Synthetic oligonucleotide
agcaggttaaacatgagtgtcatttcttcaaccggac

SEQ ID NO: 67706 - DNA, 36 bp, Artificial Sequence
  Description of Artificial Sequence: Synthetic oligonucleotide
gcaggttaaacatgagtgtcatttcttcaaccggac

SEQ ID NO: 67707 - DNA, 36 bp, Artificial Sequence
  Description of Artificial Sequence: Synthetic oligonucleotide
caggttaaacatgagtgtcatttcttcaaccggacg

SEQ ID NO: 67708 - DNA, 36 bp, Artificial Sequence
  Description of Artificial Sequence: Synthetic oligonucleotide
aggttaaacatgagtgtcatttcttcaaccggacgg

SEQ ID NO: 67709 - DNA, 35 bp, Artificial Sequence
  Description of Artificial Sequence: Synthetic oligonucleotide
ggttaaacatgagtgtcatttcttcaaccggacgg

SEQ ID NO: 67710 - DNA, 36 bp, Artificial Sequence
  Description of Artificial Sequence: Synthetic oligonucleotide
gttaaacatgagtgtcatttcttcaaccggacggag

SEQ ID NO: 67711 - DNA, 36 bp, Artificial Sequence
  Description of Artificial Sequence: Synthetic oligonucleotide
ttaaacatgagtgtcatttcttcaaccggacggagc

SEQ ID NO: 67712 - DNA, 35 bp, Artificial Sequence
  Description of Artificial Sequence: Synthetic oligonucleotide
taaacatgagtgtcatttcttcaaccggacggagc

SEQ ID NO: 67713 - DNA, 34 bp, Artificial Sequence
  Description of Artificial Sequence: Synthetic oligonucleotide
aaacatgagtgtcatttcttcaaccggacggagc

SEQ ID NO: 67714 - DNA, 33 bp, Artificial Sequence
  Description of Artificial Sequence: Synthetic oligonucleotide
aacatgagtgtcatttcttcaaccggacggagc

SEQ ID NO: 67715 - DNA, 32 bp, Artificial Sequence
  Description of Artificial Sequence: Synthetic oligonucleotide
acatgagtgtcatttcttcaaccggacggagc

SEQ ID NO: 67716 - DNA, 31 bp, Artificial Sequence
  Description of Artificial Sequence: Synthetic oligonucleotide
catgagtgtcatttcttcaaccggacggagc

SEQ ID NO: 67717 - DNA, 31 bp, Artificial Sequence
  Description of Artificial Sequence: Synthetic oligonucleotide
atgagtgtcatttcttcaaccggacggagcg

SEQ ID NO: 67718 - DNA, 30 bp, Artificial Sequence
  Description of Artificial Sequence: Synthetic oligonucleotide
tgagtgtcatttcttcaaccggacggagcg

SEQ ID NO: 67719 - DNA, 29 bp, Artificial Sequence
  Description of Artificial Sequence: Synthetic oligonucleotide
gagtgtcatttcttcaaccggacggagcg

SEQ ID NO: 67720 - DNA, 29 bp, Artificial Sequence
  Description of Artificial Sequence: Synthetic oligonucleotide
agtgtcatttcttcaaccggacggagcgg

SEQ ID NO: 67721 - DNA, 28 bp, Artificial Sequence
  Description of Artificial Sequence: Synthetic oligonucleotide
gtgtcatttcttcaaccggacggagcgg

SEQ ID NO: 67722 - DNA, 28 bp, Artificial Sequence
  Description of Artificial Sequence: Synthetic oligonucleotide
tgtcatttcttcaaccggacggagcggg

SEQ ID NO: 67723 - DNA, 27 bp, Artificial Sequence
  Description of Artificial Sequence: Synthetic oligonucleotide
gtcatttcttcaaccggacggagcggg

SEQ ID NO: 67724 - DNA, 28 bp, Artificial Sequence
  Description of Artificial Sequence: Synthetic oligonucleotide
tcatttcttcaaccggacggagcgggtg

SEQ ID NO: 67725 - DNA, 27 bp, Artificial Sequence
  Description of Artificial Sequence: Synthetic oligonucleotide
catttcttcaaccggacggagcgggtg

SEQ ID NO: 67726 - DNA, 27 bp, Artificial Sequence
  Description of Artificial Sequence: Synthetic oligonucleotide
atttcttcaaccggacggagcgggtgc

SEQ ID NO: 67727 - DNA, 26 bp, Artificial Sequence
  Description of Artificial Sequence: Synthetic oligonucleotide
tttcttcaaccggacggagcgggtgc

SEQ ID NO: 67728 - DNA, 25 bp, Artificial Sequence
  Description of Artificial Sequence: Synthetic oligonucleotide
ttcttcaaccggacggagcgggtgc

SEQ ID NO: 67729 - DNA, 24 bp, Artificial Sequence
  Description of Artificial Sequence: Synthetic oligonucleotide
tcttcaaccggacggagcgggtgc

SEQ ID NO: 67730 - DNA, 23 bp, Artificial Sequence
  Description of Artificial Sequence: Synthetic oligonucleotide
cttcaaccggacggagcgggtgc

SEQ ID NO: 67731 - DNA, 23 bp, Artificial Sequence
  Description of Artificial Sequence: Synthetic oligonucleotide
ttcaaccggacggagcgggtgcg

SEQ ID NO: 67732 - DNA, 22 bp, Artificial Sequence
  Description of Artificial Sequence: Synthetic oligonucleotide
tcaaccggacggagcgggtgcg

SEQ ID NO: 67733 - DNA, 21 bp, Artificial Sequence
  Description of Artificial Sequence: Synthetic oligonucleotide
caaccggacggagcgggtgcg

SEQ ID NO: 67734 - DNA, 23 bp, Artificial Sequence
  Description of Artificial Sequence: Synthetic oligonucleotide
aaccggacggagcgggtgcggtt

SEQ ID NO: 67735 - DNA, 22 bp, Artificial Sequence
  Description of Artificial Sequence: Synthetic oligonucleotide
accggacggagcgggtgcggtt

SEQ ID NO: 67736 - DNA, 21 bp, Artificial Sequence
  Description of Artificial Sequence: Synthetic oligonucleotide
ccggacggagcgggtgcggtt

SEQ ID NO: 67737 - DNA, 21 bp, Artificial Sequence
  Description of Artificial Sequence: Synthetic oligonucleotide
cggacggagcgggtgcggttc

SEQ ID NO: 67738 - DNA, 23 bp, Artificial Sequence
  Description of Artificial Sequence: Synthetic oligonucleotide
cagaagcgggccgcggtggacaa

SEQ ID NO: 67739 - DNA, 25 bp, Artificial Sequence
  Description of Artificial Sequence: Synthetic oligonucleotide
agaagcgggccgcggtggacaacta

SEQ ID NO: 67740 - DNA, 24 bp, Artificial Sequence
  Description of Artificial Sequence: Synthetic oligonucleotide
gaagcgggccgcggtggacaacta

SEQ ID NO: 67741 - DNA, 25 bp, Artificial Sequence
  Description of Artificial Sequence: Synthetic oligonucleotide
aagcgggccgcggtggacaactact

SEQ ID NO: 67742 - DNA, 24 bp, Artificial Sequence
  Description of Artificial Sequence: Synthetic oligonucleotide
agcgggccgcggtggacaactact

SEQ ID NO: 67743 - DNA, 23 bp, Artificial Sequence
  Description of Artificial Sequence: Synthetic oligonucleotide
gcgggccgcggtggacaactact

SEQ ID NO: 67744 - DNA, 23 bp, Artificial Sequence
  Description of Artificial Sequence: Synthetic oligonucleotide
cgggccgcggtggacaactactg

SEQ ID NO: 67745 - DNA, 24 bp, Artificial Sequence
  Description of Artificial Sequence: Synthetic oligonucleotide
gggccgcggtggacaactactgca

SEQ ID NO: 67746 - DNA, 25 bp, Artificial Sequence
  Description of Artificial Sequence: Synthetic oligonucleotide
ggccgcggtggacaactactgcaga

SEQ ID NO: 67747 - DNA, 26 bp, Artificial Sequence
  Description of Artificial Sequence: Synthetic oligonucleotide
gccgcggtggacaactactgcagaca

SEQ ID NO: 67748 - DNA, 27 bp, Artificial Sequence
  Description of Artificial Sequence: Synthetic oligonucleotide
ccgcggtggacaactactgcagacaca

SEQ ID NO: 67749 - DNA, 28 bp, Artificial Sequence
  Description of Artificial Sequence: Synthetic oligonucleotide
cgcggtggacaactactgcagacacaac

SEQ ID NO: 67750 - DNA, 30 bp, Artificial Sequence
  Description of Artificial Sequence: Synthetic oligonucleotide
gcggtggacaactactgcagacacaactac

SEQ ID NO: 67751 - DNA, 30 bp, Artificial Sequence
  Description of Artificial Sequence: Synthetic oligonucleotide
cggtggacaactactgcagacacaactacg

SEQ ID NO: 67752 - DNA, 26 bp, Artificial Sequence
  Description of Artificial Sequence: Synthetic oligonucleotide
cagaagcgggccgcggtggacaatta

SEQ ID NO: 67753 - DNA, 27 bp, Artificial Sequence
  Description of Artificial Sequence: Synthetic oligonucleotide
agaagcgggccgcggtggacaattact

SEQ ID NO: 67754 - DNA, 26 bp, Artificial Sequence
  Description of Artificial Sequence: Synthetic oligonucleotide
gaagcgggccgcggtggacaattact

SEQ ID NO: 67755 - DNA, 26 bp, Artificial Sequence
  Description of Artificial Sequence: Synthetic oligonucleotide
aagcgggccgcggtggacaattactg

SEQ ID NO: 67756 - DNA, 25 bp, Artificial Sequence
  Description of Artificial Sequence: Synthetic oligonucleotide
agcgggccgcggtggacaattactg

SEQ ID NO: 67757 - DNA, 30 bp, Artificial Sequence
  Description of Artificial Sequence: Synthetic oligonucleotide
gctgagtactggaacagccagaaggacatc

SEQ ID NO: 67758 - DNA, 30 bp, Artificial Sequence
  Description of Artificial Sequence: Synthetic oligonucleotide
ctgagtactggaacagccagaaggacatcc

SEQ ID NO: 67759 - DNA, 31 bp, Artificial Sequence
  Description of Artificial Sequence: Synthetic oligonucleotide
tgagtactggaacagccagaaggacatcctg

SEQ ID NO: 67760 - DNA, 26 bp, Artificial Sequence
  Description of Artificial Sequence: Synthetic oligonucleotide
cagaggcgggccgaggtggacaatta

SEQ ID NO: 67761 - DNA, 27 bp, Artificial Sequence
  Description of Artificial Sequence: Synthetic oligonucleotide
agaggcgggccgaggtggacaattact

SEQ ID NO: 67762 - DNA, 26 bp, Artificial Sequence
  Description of Artificial Sequence: Synthetic oligonucleotide
gaggcgggccgaggtggacaattact

SEQ ID NO: 67763 - DNA, 26 bp, Artificial Sequence
  Description of Artificial Sequence: Synthetic oligonucleotide
aggcgggccgaggtggacaattactg

SEQ ID NO: 67764 - DNA, 25 bp, Artificial Sequence
  Description of Artificial Sequence: Synthetic oligonucleotide
ggcgggccgaggtggacaattactg

SEQ ID NO: 67765 - DNA, 26 bp, Artificial Sequence
  Description of Artificial Sequence: Synthetic oligonucleotide
gcgggccgaggtggacaattactgca

SEQ ID NO: 67766 - DNA, 27 bp, Artificial Sequence
  Description of Artificial Sequence: Synthetic oligonucleotide
cgggccgaggtggacaattactgcaga

SEQ ID NO: 67767 - DNA, 27 bp, Artificial Sequence
  Description of Artificial Sequence: Synthetic oligonucleotide
gggccgaggtggacaattactgcagac

SEQ ID NO: 67768 - DNA, 28 bp, Artificial Sequence
  Description of Artificial Sequence: Synthetic oligonucleotide
ggccgaggtggacaattactgcagacac

SEQ ID NO: 67769 - DNA, 30 bp, Artificial Sequence
  Description of Artificial Sequence: Synthetic oligonucleotide
gccgaggtggacaattactgcagacacaac

SEQ ID NO: 67770 - DNA, 32 bp, Artificial Sequence
  Description of Artificial Sequence: Synthetic oligonucleotide
ccgaggtggacaattactgcagacacaactac

SEQ ID NO: 67771 - DNA, 32 bp, Artificial Sequence
  Description of Artificial Sequence: Synthetic oligonucleotide
cgaggtggacaattactgcagacacaactacg

SEQ ID NO: 67772 - DNA, 32 bp, Artificial Sequence
  Description of Artificial Sequence: Synthetic oligonucleotide
gaggtggacaattactgcagacacaactacgg

SEQ ID NO: 67773 - DNA, 26 bp, Artificial Sequence
  Description of Artificial Sequence: Synthetic oligonucleotide
agccagaaggacctcctggagcagac

SEQ ID NO: 67774 - DNA, 25 bp, Artificial Sequence
  Description of Artificial Sequence: Synthetic oligonucleotide
gccagaaggacctcctggagcagac

SEQ ID NO: 67775 - DNA, 25 bp, Artificial Sequence
  Description of Artificial Sequence: Synthetic oligonucleotide
ccagaaggacctcctggagcagacg

SEQ ID NO: 67776 - DNA, 25 bp, Artificial Sequence
  Description of Artificial Sequence: Synthetic oligonucleotide
cagaaggacctcctggagcagacgc

SEQ ID NO: 67777 - DNA, 25 bp, Artificial Sequence
  Description of Artificial Sequence: Synthetic oligonucleotide
agaaggacctcctggagcagacgcg

SEQ ID NO: 67778 - DNA, 24 bp, Artificial Sequence
  Description of Artificial Sequence: Synthetic oligonucleotide
gaaggacctcctggagcagacgcg

SEQ ID NO: 67779 - DNA, 24 bp, Artificial Sequence
  Description of Artificial Sequence: Synthetic oligonucleotide
aaggacctcctggagcagacgcgg

SEQ ID NO: 67780 - DNA, 23 bp, Artificial Sequence
  Description of Artificial Sequence: Synthetic oligonucleotide
aggacctcctggagcagacgcgg

SEQ ID NO: 67781 - DNA, 22 bp, Artificial Sequence
  Description of Artificial Sequence: Synthetic oligonucleotide
ggacctcctggagcagacgcgg

SEQ ID NO: 67782 - DNA, 22 bp, Artificial Sequence
  Description of Artificial Sequence: Synthetic oligonucleotide
gacctcctggagcagacgcggg

SEQ ID NO: 67783 - DNA, 22 bp, Artificial Sequence
  Description of Artificial Sequence: Synthetic oligonucleotide
acctcctggagcagacgcgggc

SEQ ID NO: 67784 - DNA, 21 bp, Artificial Sequence
  Description of Artificial Sequence: Synthetic oligonucleotide
cctcctggagcagacgcgggc

SEQ ID NO: 67785 - DNA, 21 bp, Artificial Sequence
  Description of Artificial Sequence: Synthetic oligonucleotide
ctcctggagcagacgcgggcc

SEQ ID NO: 67786 - DNA, 21 bp, Artificial Sequence
  Description of Artificial Sequence: Synthetic oligonucleotide
tcctggagcagacgcgggccg

SEQ ID NO: 67787 - DNA, 20 bp, Artificial Sequence
  Description of Artificial Sequence: Synthetic oligonucleotide
cctggagcagacgcgggccg

SEQ ID NO: 67788 - DNA, 20 bp, Artificial Sequence
  Description of Artificial Sequence: Synthetic oligonucleotide
ctggagcagacgcgggccgc

SEQ ID NO: 67789 - DNA, 20 bp, Artificial Sequence
  Description of Artificial Sequence: Synthetic oligonucleotide
tggagcagacgcgggccgcg

SEQ ID NO: 67790 - DNA, 20 bp, Artificial Sequence
  Description of Artificial Sequence: Synthetic oligonucleotide
ggagcagacgcgggccgcgt

SEQ ID NO: 67791 - DNA, 20 bp, Artificial Sequence
  Description of Artificial Sequence: Synthetic oligonucleotide
gagcagacgcgggccgcggt

SEQ ID NO: 67792 - DNA, 20 bp, Artificial Sequence
  Description of Artificial Sequence: Synthetic oligonucleotide
agcagacgcgggccgcggtg

SEQ ID NO: 67793 - DNA, 20 bp, Artificial Sequence
  Description of Artificial Sequence: Synthetic oligonucleotide
gcagacgcgggccgcggtgt

SEQ ID NO: 67794 - DNA, 20 bp, Artificial Sequence
  Description of Artificial Sequence: Synthetic oligonucleotide
cagacgcgggccgcggtgga

SEQ ID NO: 67795 - DNA, 21 bp, Artificial Sequence
  Description of Artificial Sequence: Synthetic oligonucleotide
agacgcgggccgcggtggaca

SEQ ID NO: 67796 - DNA, 20 bp, Artificial Sequence
  Description of Artificial Sequence: Synthetic oligonucleotide
gacgcgggccgcggtggaca

SEQ ID NO: 67797 - DNA, 20 bp, Artificial Sequence
  Description of Artificial Sequence: Synthetic oligonucleotide
acgcgggccgcggtggacac

SEQ ID NO: 67798 - DNA, 24 bp, Artificial Sequence
  Description of Artificial Sequence: Synthetic oligonucleotide
ggagtaccgggcggtgacggagat

SEQ ID NO: 67799 - DNA, 24 bp, Artificial Sequence
  Description of Artificial Sequence: Synthetic oligonucleotide
gagtaccgggcggtgacggagatg

SEQ ID NO: 67800 - DNA, 24 bp, Artificial Sequence
  Description of Artificial Sequence: Synthetic oligonucleotide
agtaccgggcggtgacggagatgg

SEQ ID NO: 67801 - DNA, 23 bp, Artificial Sequence
  Description of Artificial Sequence: Synthetic oligonucleotide
gtaccgggcggtgacggagatgg

SEQ ID NO: 67802 - DNA, 23 bp, Artificial Sequence
  Description of Artificial Sequence: Synthetic oligonucleotide
taccgggcggtgacggagatggg

SEQ ID NO: 67803 - DNA, 22 bp, Artificial Sequence
  Description of Artificial Sequence: Synthetic oligonucleotide
accgggcggtgacggagatggg

SEQ ID NO: 67804 - DNA, 21 bp, Artificial Sequence
  Description of Artificial Sequence: Synthetic oligonucleotide
ccgggcggtgacggagatggg

SEQ ID NO: 67805 - DNA, 21 bp, Artificial Sequence
  Description of Artificial Sequence: Synthetic oligonucleotide
cgggcggtgacggagatgggg

SEQ ID NO: 67806 - DNA, 21 bp, Artificial Sequence
  Description of Artificial Sequence: Synthetic oligonucleotide
gggcggtgacggagatggggc

SEQ ID NO: 67807 - DNA, 21 bp, Artificial Sequence
  Description of Artificial Sequence: Synthetic oligonucleotide
ggcggtgacggagatggggcg

SEQ ID NO: 67808 - DNA, 21 bp, Artificial Sequence
  Description of Artificial Sequence: Synthetic oligonucleotide
gcggtgacggagatggggcgg

SEQ ID NO: 67809 - DNA, 21 bp, Artificial Sequence
  Description of Artificial Sequence: Synthetic oligonucleotide
cggtgacggagatggggcggc

SEQ ID NO: 67810 - DNA, 22 bp, Artificial Sequence
  Description of Artificial Sequence: Synthetic oligonucleotide
ggtgacggagatggggcggcct

SEQ ID NO: 67811 - DNA, 24 bp, Artificial Sequence
  Description of Artificial Sequence: Synthetic oligonucleotide
gtgacggagatggggcggcctgat

SEQ ID NO: 67812 - DNA, 24 bp, Artificial Sequence
  Description of Artificial Sequence: Synthetic oligonucleotide
tgacggagatggggcggcctgatg

SEQ ID NO: 67813 - DNA, 23 bp, Artificial Sequence
  Description of Artificial Sequence: Synthetic oligonucleotide
gacggagatggggcggcctgatg

SEQ ID NO: 67814 - DNA, 23 bp, Artificial Sequence
  Description of Artificial Sequence: Synthetic oligonucleotide
acggagatggggcggcctgatgc

SEQ ID NO: 67815 - DNA, 22 bp, Artificial Sequence
  Description of Artificial Sequence: Synthetic oligonucleotide
cggagatggggcggcctgatgc

SEQ ID NO: 67816 - DNA, 22 bp, Artificial Sequence
  Description of Artificial Sequence: Synthetic oligonucleotide
ggagatggggcggcctgatgcc

SEQ ID NO: 67817 - DNA, 23 bp, Artificial Sequence
  Description of Artificial Sequence: Synthetic oligonucleotide
gagatggggcggcctgatgccga

SEQ ID NO: 67818 - DNA, 25 bp, Artificial Sequence
  Description of Artificial Sequence: Synthetic oligonucleotide
agatggggcggcctgatgccgagta

SEQ ID NO: 67819 - DNA, 24 bp, Artificial Sequence
  Description of Artificial Sequence: Synthetic oligonucleotide
gatggggcggcctgatgccgagta

SEQ ID NO: 67820 - DNA, 25 bp, Artificial Sequence
  Description of Artificial Sequence: Synthetic oligonucleotide
atggggcggcctgatgccgagtact

SEQ ID NO: 67821 - DNA, 23 bp, Artificial Sequence
  Description of Artificial Sequence: Synthetic oligonucleotide
gcttcgacagcgacgtgggggag

SEQ ID NO: 67822 - DNA, 24 bp, Artificial Sequence
  Description of Artificial Sequence: Synthetic oligonucleotide
cttcgacagcgacgtgggggagca

SEQ ID NO: 67823 - DNA, 24 bp, Artificial Sequence
  Description of Artificial Sequence: Synthetic oligonucleotide
ttcgacagcgacgtgggggagcac

SEQ ID NO: 67824 - DNA, 23 bp, Artificial Sequence
  Description of Artificial Sequence: Synthetic oligonucleotide
tcgacagcgacgtgggggagcac

SEQ ID NO: 67825 - DNA, 22 bp, Artificial Sequence
  Description of Artificial Sequence: Synthetic oligonucleotide
cgacagcgacgtgggggagcac

SEQ ID NO: 67826 - DNA, 22 bp, Artificial Sequence
  Description of Artificial Sequence: Synthetic oligonucleotide
gacagcgacgtgggggagcacc

SEQ ID NO: 67827 - DNA, 22 bp, Artificial Sequence
  Description of Artificial Sequence: Synthetic oligonucleotide
acagcgacgtgggggagcaccg

SEQ ID NO: 67828 - DNA, 21 bp, Artificial Sequence
  Description of Artificial Sequence: Synthetic oligonucleotide
cagcgacgtgggggagcaccg

SEQ ID NO: 67829 - DNA, 21 bp, Artificial Sequence
  Description of Artificial Sequence: Synthetic oligonucleotide
agcgacgtgggggagcaccgg

SEQ ID NO: 67830 - DNA, 20 bp, Artificial Sequence
  Description of Artificial Sequence: Synthetic oligonucleotide
gcgacgtgggggagcaccgg

SEQ ID NO: 67831 - DNA, 20 bp, Artificial Sequence
  Description of Artificial Sequence: Synthetic oligonucleotide
cgacgtgggggagcaccggg

SEQ ID NO: 67832 - DNA, 20 bp, Artificial Sequence
  Description of Artificial Sequence: Synthetic oligonucleotide
gacgtgggggagcaccgggc

SEQ ID NO: 67833 - DNA, 20 bp, Artificial Sequence
  Description of Artificial Sequence: Synthetic oligonucleotide
acgtgggggagcaccgggcg

SEQ ID NO: 67834 - DNA, 20 bp, Artificial Sequence
  Description of Artificial Sequence: Synthetic oligonucleotide
cgtgggggagcaccgggcgt

SEQ ID NO: 67835 - DNA, 20 bp, Artificial Sequence
  Description of Artificial Sequence: Synthetic oligonucleotide
gtgggggagcaccgggcggt

SEQ ID NO: 67836 - DNA, 21 bp, Artificial Sequence
  Description of Artificial Sequence: Synthetic oligonucleotide
tgggggagcaccgggcggtga

SEQ ID NO: 67837 - DNA, 20 bp, Artificial Sequence
  Description of Artificial Sequence: Synthetic oligonucleotide
gggggagcaccgggcggtga

SEQ ID NO: 67838 - DNA, 20 bp, Artificial Sequence
  Description of Artificial Sequence: Synthetic oligonucleotide
ggggagcaccgggcggtgac

SEQ ID NO: 67839 - DNA, 20 bp, Artificial Sequence
  Description of Artificial Sequence: Synthetic oligonucleotide
gggagcaccgggcggtgacg

SEQ ID NO: 67840 - DNA, 21 bp, Artificial Sequence
  Description of Artificial Sequence: Synthetic oligonucleotide
ggagcaccgggcggtgacgga

SEQ ID NO: 67841 - DNA, 21 bp, Artificial Sequence
  Description of Artificial Sequence: Synthetic oligonucleotide
gagcaccgggcggtgacggag

SEQ ID NO: 67842 - DNA, 22 bp, Artificial Sequence
  Description of Artificial Sequence: Synthetic oligonucleotide
agcaccgggcggtgacggagct

SEQ ID NO: 67843 - DNA, 21 bp, Artificial Sequence
  Description of Artificial Sequence: Synthetic oligonucleotide
gcaccgggcggtgacggagct

SEQ ID NO: 67844 - DNA, 21 bp, Artificial Sequence
  Description of Artificial Sequence: Synthetic oligonucleotide
caccgggcggtgacggagctg

SEQ ID NO: 67845 - DNA, 28 bp, Artificial Sequence
  Description of Artificial Sequence: Synthetic oligonucleotide
tggaacagccagaaggacttcctggagc

SEQ ID NO: 67846 - DNA, 27 bp, Artificial Sequence
  Description of Artificial Sequence: Synthetic oligonucleotide
ggaacagccagaaggacttcctggagc

SEQ ID NO: 67847 - DNA, 28 bp, Artificial Sequence
  Description of Artificial Sequence: Synthetic oligonucleotide
gaacagccagaaggacttcctggagcag

SEQ ID NO: 67848 - DNA, 29 bp, Artificial Sequence
  Description of Artificial Sequence: Synthetic oligonucleotide
aacagccagaaggacttcctggagcagag

SEQ ID NO: 67849 - DNA, 28 bp, Artificial Sequence
  Description of Artificial Sequence: Synthetic oligonucleotide
acagccagaaggacttcctggagcagag

SEQ ID NO: 67850 - DNA, 27 bp, Artificial Sequence
  Description of Artificial Sequence: Synthetic oligonucleotide
cagccagaaggacttcctggagcagag

SEQ ID NO: 67851 - DNA, 27 bp, Artificial Sequence
  Description of Artificial Sequence: Synthetic oligonucleotide
agccagaaggacttcctggagcagagg

SEQ ID NO: 67852 - DNA, 26 bp, Artificial Sequence
  Description of Artificial Sequence: Synthetic oligonucleotide
gccagaaggacttcctggagcagagg

SEQ ID NO: 67853 - DNA, 26 bp, Artificial Sequence
  Description of Artificial Sequence: Synthetic oligonucleotide
ccagaaggacttcctggagcagaggc

SEQ ID NO: 67854 - DNA, 26 bp, Artificial Sequence
  Description of Artificial Sequence: Synthetic oligonucleotide
cagaaggacttcctggagcagaggcg

SEQ ID NO: 67855 - DNA, 26 bp, Artificial Sequence
  Description of Artificial Sequence: Synthetic oligonucleotide
agaaggacttcctggagcagaggcgg

SEQ ID NO: 67856 - DNA, 25 bp, Artificial Sequence
  Description of Artificial Sequence: Synthetic oligonucleotide
gaaggacttcctggagcagaggcgg

SEQ ID NO: 67857 - DNA, 25 bp, Artificial Sequence
  Description of Artificial Sequence: Synthetic oligonucleotide
aaggacttcctggagcagaggcggg

SEQ ID NO: 67858 - DNA, 24 bp, Artificial Sequence
  Description of Artificial Sequence: Synthetic oligonucleotide
aggacttcctggagcagaggcggg

SEQ ID NO: 67859 - DNA, 23 bp, Artificial Sequence
  Description of Artificial Sequence: Synthetic oligonucleotide
ggacttcctggagcagaggcggg

SEQ ID NO: 67860 - DNA, 23 bp, Artificial Sequence
  Description of Artificial Sequence: Synthetic oligonucleotide
gacttcctggagcagaggcgggc

SEQ ID NO: 67861 - DNA, 23 bp, Artificial Sequence
  Description of Artificial Sequence: Synthetic oligonucleotide
acttcctggagcagaggcgggcc

SEQ ID NO: 67862 - DNA, 22 bp, Artificial Sequence
  Description of Artificial Sequence: Synthetic oligonucleotide
cttcctggagcagaggcgggcc

SEQ ID NO: 67863 - DNA, 22 bp, Artificial Sequence
  Description of Artificial Sequence: Synthetic oligonucleotide
ttcctggagcagaggcgggccg

SEQ ID NO: 67864 - DNA, 24 bp, Artificial Sequence
  Description of Artificial Sequence: Synthetic oligonucleotide
agaaggacctcctggagcaggcgg

SEQ ID NO: 67865 - DNA, 23 bp, Artificial Sequence
  Description of Artificial Sequence: Synthetic oligonucleotide
gaaggacctcctggagcaggcgg

SEQ ID NO: 67866 - DNA, 23 bp, Artificial Sequence
  Description of Artificial Sequence: Synthetic oligonucleotide
aaggacctcctggagcaggcggg

SEQ ID NO: 67867 - DNA, 22 bp, Artificial Sequence
  Description of Artificial Sequence: Synthetic oligonucleotide
aggacctcctggagcaggcggg

SEQ ID NO: 67868 - DNA, 21 bp, Artificial Sequence
  Description of Artificial Sequence: Synthetic oligonucleotide
ggacctcctggagcaggcggg

SEQ ID NO: 67869 - DNA, 21 bp, Artificial Sequence
  Description of Artificial Sequence: Synthetic oligonucleotide
gacctcctggagcaggcgggc

SEQ ID NO: 67870 - DNA, 21 bp, Artificial Sequence
  Description of Artificial Sequence: Synthetic oligonucleotide
acctcctggagcaggcgggcc

SEQ ID NO: 67871 - DNA, 20 bp, Artificial Sequence
  Description of Artificial Sequence: Synthetic oligonucleotide
cctcctggagcaggcgggcc

SEQ ID NO: 67872 - DNA, 20 bp, Artificial Sequence
  Description of Artificial Sequence: Synthetic oligonucleotide
ctcctggagcaggcgggccg

SEQ ID NO: 67873 - DNA, 20 bp, Artificial Sequence
  Description of Artificial Sequence: Synthetic oligonucleotide
tcctggagcaggcgggccgc

SEQ ID NO: 67874 - DNA, 20 bp, Artificial Sequence
  Description of Artificial Sequence: Synthetic oligonucleotide
cctggagcaggcgggccgct

SEQ ID NO: 67875 - DNA, 20 bp, Artificial Sequence
  Description of Artificial Sequence: Synthetic oligonucleotide
ctggagcaggcgggccgcgt

SEQ ID NO: 67876 - DNA, 20 bp, Artificial Sequence
  Description of Artificial Sequence: Synthetic oligonucleotide
tggagcaggcgggccgcggt

SEQ ID NO: 67877 - DNA, 20 bp, Artificial Sequence
  Description of Artificial Sequence: Synthetic oligonucleotide
ggagcaggcgggccgcggtt

SEQ ID NO: 67878 - DNA, 20 bp, Artificial Sequence
  Description of Artificial Sequence: Synthetic oligonucleotide
gagcaggcgggccgcggtgt

SEQ ID NO: 67879 - DNA, 20 bp, Artificial Sequence
  Description of Artificial Sequence: Synthetic oligonucleotide
agcaggcgggccgcggtgga

SEQ ID NO: 67880 - DNA, 20 bp, Artificial Sequence
  Description of Artificial Sequence: Synthetic oligonucleotide
gcaggcgggccgcggtggat

SEQ ID NO: 67881 - DNA, 27 bp, Artificial Sequence
  Description of Artificial Sequence: Synthetic oligonucleotide
ccgagtcctggaacagccagaaggaca

SEQ ID NO: 67882 - DNA, 28 bp, Artificial Sequence
  Description of Artificial Sequence: Synthetic oligonucleotide
cgagtcctggaacagccagaaggacatc

SEQ ID NO: 67883 - DNA, 28 bp, Artificial Sequence
  Description of Artificial Sequence: Synthetic oligonucleotide
gagtcctggaacagccagaaggacatcc

SEQ ID NO: 67884 - DNA, 29 bp, Artificial Sequence
  Description of Artificial Sequence: Synthetic oligonucleotide
agtcctggaacagccagaaggacatcctg

SEQ ID NO: 67885 - DNA, 28 bp, Artificial Sequence
  Description of Artificial Sequence: Synthetic oligonucleotide
gtcctggaacagccagaaggacatcctg

SEQ ID NO: 67886 - DNA, 28 bp, Artificial Sequence
  Description of Artificial Sequence: Synthetic oligonucleotide
tcctggaacagccagaaggacatcctgg

SEQ ID NO: 67887 - DNA, 27 bp, Artificial Sequence
  Description of Artificial Sequence: Synthetic oligonucleotide
cctggaacagccagaaggacatcctgg

SEQ ID NO: 67888 - DNA, 31 bp, Artificial Sequence
  Description of Artificial Sequence: Synthetic oligonucleotide
ggtgcggttcctggacagatacttctatctc

SEQ ID NO: 67889 - DNA, 31 bp, Artificial Sequence
  Description of Artificial Sequence: Synthetic oligonucleotide
gtgcggttcctggacagatacttctatctcc

SEQ ID NO: 67890 - DNA, 33 bp, Artificial Sequence
  Description of Artificial Sequence: Synthetic oligonucleotide
tgcggttcctggacagatacttctatctccaag

SEQ ID NO: 67891 - DNA, 32 bp, Artificial Sequence
  Description of Artificial Sequence: Synthetic oligonucleotide
gcggttcctggacagatacttctatctccaag

SEQ ID NO: 67892 - DNA, 33 bp, Artificial Sequence
  Description of Artificial Sequence: Synthetic oligonucleotide
cggttcctggacagatacttctatctccaagag

SEQ ID NO: 67893 - DNA, 33 bp, Artificial Sequence
  Description of Artificial Sequence: Synthetic oligonucleotide
ggttcctggacagatacttctatctccaagagg

SEQ ID NO: 67894 - DNA, 34 bp, Artificial Sequence
  Description of Artificial Sequence: Synthetic oligonucleotide
gttcctggacagatacttctatctccaagaggag

SEQ ID NO: 67895 - DNA, 36 bp, Artificial Sequence
  Description of Artificial Sequence: Synthetic oligonucleotide
ttcctggacagatacttctatctccaagaggagtac

SEQ ID NO: 67896 - DNA, 35 bp, Artificial Sequence
  Description of Artificial Sequence: Synthetic oligonucleotide
tcctggacagatacttctatctccaagaggagtac

SEQ ID NO: 67897 - DNA, 34 bp, Artificial Sequence
  Description of Artificial Sequence: Synthetic oligonucleotide
cctggacagatacttctatctccaagaggagtac

SEQ ID NO: 67898 - DNA, 34 bp, Artificial Sequence
  Description of Artificial Sequence: Synthetic oligonucleotide
ctggacagatacttctatctccaagaggagtacg

SEQ ID NO: 67899 - DNA, 35 bp, Artificial Sequence
  Description of Artificial Sequence: Synthetic oligonucleotide
tggacagatacttctatctccaagaggagtacgtg

SEQ ID NO: 67900 - DNA, 34 bp, Artificial Sequence
  Description of Artificial Sequence: Synthetic oligonucleotide
ggacagatacttctatctccaagaggagtacgtg

SEQ ID NO: 67901 - DNA, 34 bp, Artificial Sequence
  Description of Artificial Sequence: Synthetic oligonucleotide
gacagatacttctatctccaagaggagtacgtgc

SEQ ID NO: 67902 - DNA, 34 bp, Artificial Sequence
  Description of Artificial Sequence: Synthetic oligonucleotide
acagatacttctatctccaagaggagtacgtgcg

SEQ ID NO: 67903 - DNA, 33 bp, Artificial Sequence
  Description of Artificial Sequence: Synthetic oligonucleotide
cagatacttctatctccaagaggagtacgtgcg

SEQ ID NO: 67904 - DNA, 33 bp, Artificial Sequence
  Description of Artificial Sequence: Synthetic oligonucleotide
agatacttctatctccaagaggagtacgtgcgc

SEQ ID NO: 67905 - DNA, 32 bp, Artificial Sequence
  Description of Artificial Sequence: Synthetic oligonucleotide
gatacttctatctccaagaggagtacgtgcgc

SEQ ID NO: 67906 - DNA, 34 bp, Artificial Sequence
  Description of Artificial Sequence: Synthetic oligonucleotide
atacttctatctccaagaggagtacgtgcgcttc

SEQ ID NO: 67907 - DNA, 33 bp, Artificial Sequence
  Description of Artificial Sequence: Synthetic oligonucleotide
tacttctatctccaagaggagtacgtgcgcttc

SEQ ID NO: 67908 - DNA, 32 bp, Artificial Sequence
  Description of Artificial Sequence: Synthetic oligonucleotide
acttctatctccaagaggagtacgtgcgcttc

SEQ ID NO: 67909 - DNA, 31 bp, Artificial Sequence
  Description of Artificial Sequence: Synthetic oligonucleotide
cttctatctccaagaggagtacgtgcgcttc

SEQ ID NO: 67910 - DNA, 31 bp, Artificial Sequence
  Description of Artificial Sequence: Synthetic oligonucleotide
ttctatctccaagaggagtacgtgcgcttcg

SEQ ID NO: 67911 - DNA, 30 bp, Artificial Sequence
  Description of Artificial Sequence: Synthetic oligonucleotide
tctatctccaagaggagtacgtgcgcttcg

SEQ ID NO: 67912 - DNA, 29 bp, Artificial Sequence
  Description of Artificial Sequence: Synthetic oligonucleotide
ctatctccaagaggagtacgtgcgcttcg

SEQ ID NO: 67913 - DNA, 30 bp, Artificial Sequence
  Description of Artificial Sequence: Synthetic oligonucleotide
tatctccaagaggagtacgtgcgcttcgac

SEQ ID NO: 67914 - DNA, 29 bp, Artificial Sequence
  Description of Artificial Sequence: Synthetic oligonucleotide
atctccaagaggagtacgtgcgcttcgac

SEQ ID NO: 67915 - DNA, 28 bp, Artificial Sequence
  Description of Artificial Sequence: Synthetic oligonucleotide
tctccaagaggagtacgtgcgcttcgac

SEQ ID NO: 67916 - DNA, 27 bp, Artificial Sequence
  Description of Artificial Sequence: Synthetic oligonucleotide
ctccaagaggagtacgtgcgcttcgac

SEQ ID NO: 67917 - DNA, 28 bp, Artificial Sequence
  Description of Artificial Sequence: Synthetic oligonucleotide
tccaagaggagtacgtgcgcttcgacag

SEQ ID NO: 67918 - DNA, 41 bp, Artificial Sequence
  Description of Artificial Sequence: Synthetic oligonucleotide
caagtttcttggagcaggttaaacatgagtgtcatttcttc

SEQ ID NO: 67919 - DNA, 43 bp, Artificial Sequence
  Description of Artificial Sequence: Synthetic oligonucleotide
aagtttcttggagcaggttaaacatgagtgtcatttcttcaac

SEQ ID NO: 67920 - DNA, 42 bp, Artificial Sequence
  Description of Artificial Sequence: Synthetic oligonucleotide
agtttcttggagcaggttaaacatgagtgtcatttcttcaac

SEQ ID NO: 67921 - DNA, 25 bp, Artificial Sequence
  Description of Artificial Sequence: Synthetic oligonucleotide
tgcgcttcgacagcgacgtggggaa

SEQ ID NO: 67922 - DNA, 24 bp, Artificial Sequence
  Description of Artificial Sequence: Synthetic oligonucleotide
gcgcttcgacagcgacgtggggaa

SEQ ID NO: 67923 - DNA, 26 bp, Artificial Sequence
  Description of Artificial Sequence: Synthetic oligonucleotide
cgcttcgacagcgacgtggggaagta

SEQ ID NO: 67924 - DNA, 26 bp, Artificial Sequence
  Description of Artificial Sequence: Synthetic oligonucleotide
gcttcgacagcgacgtggggaagtac

SEQ ID NO: 67925 - DNA, 26 bp, Artificial Sequence
  Description of Artificial Sequence: Synthetic oligonucleotide
cttcgacagcgacgtggggaagtacc

SEQ ID NO: 67926 - DNA, 26 bp, Artificial Sequence
  Description of Artificial Sequence: Synthetic oligonucleotide
ttcgacagcgacgtggggaagtaccg

SEQ ID NO: 67927 - DNA, 25 bp, Artificial Sequence
  Description of Artificial Sequence: Synthetic oligonucleotide
tcgacagcgacgtggggaagtaccg

SEQ ID NO: 67928 - DNA, 24 bp, Artificial Sequence
  Description of Artificial Sequence: Synthetic oligonucleotide
cgacagcgacgtggggaagtaccg

SEQ ID NO: 67929 - DNA, 24 bp, Artificial Sequence
  Description of Artificial Sequence: Synthetic oligonucleotide
gacagcgacgtggggaagtaccgg

SEQ ID NO: 67930 - DNA, 24 bp, Artificial Sequence
  Description of Artificial Sequence: Synthetic oligonucleotide
acagcgacgtggggaagtaccggg

SEQ ID NO: 67931 - DNA, 23 bp, Artificial Sequence
  Description of Artificial Sequence: Synthetic oligonucleotide
cagcgacgtggggaagtaccggg

SEQ ID NO: 67932 - DNA, 23 bp, Artificial Sequence
  Description of Artificial Sequence: Synthetic oligonucleotide
agcgacgtggggaagtaccgggc

SEQ ID NO: 67933 - DNA, 22 bp, Artificial Sequence
  Description of Artificial Sequence: Synthetic oligonucleotide
gcgacgtggggaagtaccgggc

SEQ ID NO: 67934 - DNA, 22 bp, Artificial Sequence
  Description of Artificial Sequence: Synthetic oligonucleotide
cgacgtggggaagtaccgggcg

SEQ ID NO: 67935 - DNA, 23 bp, Artificial Sequence
  Description of Artificial Sequence: Synthetic oligonucleotide
gacgtggggaagtaccgggcggt

SEQ ID NO: 67936 - DNA, 24 bp, Artificial Sequence
  Description of Artificial Sequence: Synthetic oligonucleotide
acgtggggaagtaccgggcggtga

SEQ ID NO: 67937 - DNA, 23 bp, Artificial Sequence
  Description of Artificial Sequence: Synthetic oligonucleotide
cgtggggaagtaccgggcggtga

SEQ ID NO: 67938 - DNA, 23 bp, Artificial Sequence
  Description of Artificial Sequence: Synthetic oligonucleotide
gtggggaagtaccgggcggtgac

SEQ ID NO: 67939 - DNA, 23 bp, Artificial Sequence
  Description of Artificial Sequence: Synthetic oligonucleotide
tggggaagtaccgggcggtgacg

SEQ ID NO: 67940 - DNA, 22 bp, Artificial Sequence
  Description of Artificial Sequence: Synthetic oligonucleotide
ggggaagtaccgggcggtgacg

SEQ ID NO: 67941 - DNA, 23 bp, Artificial Sequence
  Description of Artificial Sequence: Synthetic oligonucleotide
gggaagtaccgggcggtgacgga

SEQ ID NO: 67942 - DNA, 23 bp, Artificial Sequence
  Description of Artificial Sequence: Synthetic oligonucleotide
ggaagtaccgggcggtgacggag

SEQ ID NO: 67943 - DNA, 24 bp, Artificial Sequence
  Description of Artificial Sequence: Synthetic oligonucleotide
gaagtaccgggcggtgacggagct

SEQ ID NO: 67944 - DNA, 24 bp, Artificial Sequence
  Description of Artificial Sequence: Synthetic oligonucleotide
aagtaccgggcggtgacggagctg

SEQ ID NO: 67945 - DNA, 31 bp, Artificial Sequence
  Description of Artificial Sequence: Synthetic oligonucleotide
acacctactgcagatacaactacggggttgg

SEQ ID NO: 67946 - DNA, 30 bp, Artificial Sequence
  Description of Artificial Sequence: Synthetic oligonucleotide
cacctactgcagatacaactacggggttgg

SEQ ID NO: 67947 - DNA, 31 bp, Artificial Sequence
  Description of Artificial Sequence: Synthetic oligonucleotide
acctactgcagatacaactacggggttggtg

SEQ ID NO: 67948 - DNA, 30 bp, Artificial Sequence
  Description of Artificial Sequence: Synthetic oligonucleotide
cctactgcagatacaactacggggttggtg

SEQ ID NO: 67949 - DNA, 31 bp, Artificial Sequence
  Description of Artificial Sequence: Synthetic oligonucleotide
ctactgcagatacaactacggggttggtgag

SEQ ID NO: 67950 - DNA, 32 bp, Artificial Sequence
  Description of Artificial Sequence: Synthetic oligonucleotide
tactgcagatacaactacggggttggtgagag

SEQ ID NO: 67951 - DNA, 31 bp, Artificial Sequence
  Description of Artificial Sequence: Synthetic oligonucleotide
actgcagatacaactacggggttggtgagag

SEQ ID NO: 67952 - DNA, 30 bp, Artificial Sequence
  Description of Artificial Sequence: Synthetic oligonucleotide
ctgcagatacaactacggggttggtgagag

SEQ ID NO: 67953 - DNA, 30 bp, Artificial Sequence
  Description of Artificial Sequence: Synthetic oligonucleotide
tgcagatacaactacggggttggtgagagc

SEQ ID NO: 67954 - DNA, 29 bp, Artificial Sequence
  Description of Artificial Sequence: Synthetic oligonucleotide
gcagatacaactacggggttggtgagagc

SEQ ID NO: 67955 - DNA, 31 bp, Artificial Sequence
  Description of Artificial Sequence: Synthetic oligonucleotide
cagatacaactacggggttggtgagagcttc

SEQ ID NO: 67956 - DNA, 32 bp, Artificial Sequence
  Description of Artificial Sequence: Synthetic oligonucleotide
agatacaactacggggttggtgagagcttcac

SEQ ID NO: 67957 - DNA, 31 bp, Artificial Sequence
  Description of Artificial Sequence: Synthetic oligonucleotide
gatacaactacggggttggtgagagcttcac

SEQ ID NO: 67958 - DNA, 32 bp, Artificial Sequence
  Description of Artificial Sequence: Synthetic oligonucleotide
atacaactacggggttggtgagagcttcacag

SEQ ID NO: 67959 - DNA, 31 bp, Artificial Sequence
  Description of Artificial Sequence: Synthetic oligonucleotide
tacaactacggggttggtgagagcttcacag

SEQ ID NO: 67960 - DNA, 23 bp, Artificial Sequence
  Description of Artificial Sequence: Synthetic oligonucleotide
atcctggagcagaggcgggccga

SEQ ID NO: 67961 - DNA, 22 bp, Artificial Sequence
  Description of Artificial Sequence: Synthetic oligonucleotide
cgcttcgacagcgacgtggggg

SEQ ID NO: 67962 - DNA, 22 bp, Artificial Sequence
  Description of Artificial Sequence: Synthetic oligonucleotide
gcttcgacagcgacgtgggggg

SEQ ID NO: 67963 - DNA, 24 bp, Artificial Sequence
  Description of Artificial Sequence: Synthetic oligonucleotide
cttcgacagcgacgtgggggggta

SEQ ID NO: 67964 - DNA, 24 bp, Artificial Sequence
  Description of Artificial Sequence: Synthetic oligonucleotide
ttcgacagcgacgtgggggggtac

SEQ ID NO: 67965 - DNA, 23 bp, Artificial Sequence
  Description of Artificial Sequence: Synthetic oligonucleotide
tcgacagcgacgtgggggggtac

SEQ ID NO: 67966 - DNA, 22 bp, Artificial Sequence
  Description of Artificial Sequence: Synthetic oligonucleotide
cgacagcgacgtgggggggtac

SEQ ID NO: 67967 - DNA, 22 bp, Artificial Sequence
  Description of Artificial Sequence: Synthetic oligonucleotide
gacagcgacgtgggggggtacc

SEQ ID NO: 67968 - DNA, 22 bp, Artificial Sequence
  Description of Artificial Sequence: Synthetic oligonucleotide
acagcgacgtgggggggtaccg

SEQ ID NO: 67969 - DNA, 21 bp, Artificial Sequence
  Description of Artificial Sequence: Synthetic oligonucleotide
cagcgacgtgggggggtaccg

SEQ ID NO: 67970 - DNA, 21 bp, Artificial Sequence
  Description of Artificial Sequence: Synthetic oligonucleotide
agcgacgtgggggggtaccgg

SEQ ID NO: 67971 - DNA, 20 bp, Artificial Sequence
  Description of Artificial Sequence: Synthetic oligonucleotide
gcgacgtgggggggtaccgg

SEQ ID NO: 67972 - DNA, 20 bp, Artificial Sequence
  Description of Artificial Sequence: Synthetic oligonucleotide
cgacgtgggggggtaccggg

SEQ ID NO: 67973 - DNA, 20 bp, Artificial Sequence
  Description of Artificial Sequence: Synthetic oligonucleotide
gacgtgggggggtaccgggc

SEQ ID NO: 67974 - DNA, 20 bp, Artificial Sequence
  Description of Artificial Sequence: Synthetic oligonucleotide
acgtgggggggtaccgggcg

SEQ ID NO: 67975 - DNA, 20 bp, Artificial Sequence
  Description of Artificial Sequence: Synthetic oligonucleotide
cgtgggggggtaccgggcgt

SEQ ID NO: 67976 - DNA, 20 bp, Artificial Sequence
  Description of Artificial Sequence: Synthetic oligonucleotide
gtgggggggtaccgggcggt

SEQ ID NO: 67977 - DNA, 21 bp, Artificial Sequence
  Description of Artificial Sequence: Synthetic oligonucleotide
tgggggggtaccgggcggtga

SEQ ID NO: 67978 - DNA, 20 bp, Artificial Sequence
  Description of Artificial Sequence: Synthetic oligonucleotide
gggggggtaccgggcggtga

SEQ ID NO: 67979 - DNA, 20 bp, Artificial Sequence
  Description of Artificial Sequence: Synthetic oligonucleotide
ggggggtaccgggcggtgac

SEQ ID NO: 67980 - DNA, 20 bp, Artificial Sequence
  Description of Artificial Sequence: Synthetic oligonucleotide
gggggtaccgggcggtgacg

SEQ ID NO: 67981 - DNA, 21 bp, Artificial Sequence
  Description of Artificial Sequence: Synthetic oligonucleotide
ggggtaccgggcggtgacgga

SEQ ID NO: 67982 - DNA, 21 bp, Artificial Sequence
  Description of Artificial Sequence: Synthetic oligonucleotide
gggtaccgggcggtgacggag

SEQ ID NO: 67983 - DNA, 22 bp, Artificial Sequence
  Description of Artificial Sequence: Synthetic oligonucleotide
ggtaccgggcggtgacggagct

SEQ ID NO: 67984 - DNA, 26 bp, Artificial Sequence
  Description of Artificial Sequence: Synthetic oligonucleotide
tgaagctccctggaggctcctgcatg

SEQ ID NO: 67985 - DNA, 25 bp, Artificial Sequence
  Description of Artificial Sequence: Synthetic oligonucleotide
gaagctccctggaggctcctgcatg

SEQ ID NO: 67986 - DNA, 25 bp, Artificial Sequence
  Description of Artificial Sequence: Synthetic oligonucleotide
aagctccctggaggctcctgcatgg

SEQ ID NO: 67987 - DNA, 24 bp, Artificial Sequence
  Description of Artificial Sequence: Synthetic oligonucleotide
agctccctggaggctcctgcatgg

SEQ ID NO: 67988 - DNA, 26 bp, Artificial Sequence
  Description of Artificial Sequence: Synthetic oligonucleotide
cactggctttggctggggacacccaa

SEQ ID NO: 67989 - DNA, 26 bp, Artificial Sequence
  Description of Artificial Sequence: Synthetic oligonucleotide
actggctttggctggggacacccaac

SEQ ID NO: 67990 - DNA, 25 bp, Artificial Sequence
  Description of Artificial Sequence: Synthetic oligonucleotide
ctggctttggctggggacacccaac

SEQ ID NO: 67991 - DNA, 26 bp, Artificial Sequence
  Description of Artificial Sequence: Synthetic oligonucleotide
tggctttggctggggacacccaacca

SEQ ID NO: 67992 - DNA, 25 bp, Artificial Sequence
  Description of Artificial Sequence: Synthetic oligonucleotide
ggctttggctggggacacccaacca

SEQ ID NO: 67993 - DNA, 25 bp, Artificial Sequence
  Description of Artificial Sequence: Synthetic oligonucleotide
gctttggctggggacacccaaccac

SEQ ID NO: 67994 - DNA, 27 bp, Artificial Sequence
  Description of Artificial Sequence: Synthetic oligonucleotide
ctttggctggggacacccaaccacgtt

SEQ ID NO: 67995 - DNA, 28 bp, Artificial Sequence
  Description of Artificial Sequence: Synthetic oligonucleotide
tttggctggggacacccaaccacgtttc

SEQ ID NO: 67996 - DNA, 27 bp, Artificial Sequence
  Description of Artificial Sequence: Synthetic oligonucleotide
ttggctggggacacccaaccacgtttc

SEQ ID NO: 67997 - DNA, 26 bp, Artificial Sequence
  Description of Artificial Sequence: Synthetic oligonucleotide
tggctggggacacccaaccacgtttc

SEQ ID NO: 67998 - DNA, 25 bp, Artificial Sequence
  Description of Artificial Sequence: Synthetic oligonucleotide
ggctggggacacccaaccacgtttc

SEQ ID NO: 67999 - DNA, 26 bp, Artificial Sequence
  Description of Artificial Sequence: Synthetic oligonucleotide
gctggggacacccaaccacgtttcct

SEQ ID NO: 68000 - DNA, 27 bp, Artificial Sequence
  Description of Artificial Sequence: Synthetic oligonucleotide
ctggggacacccaaccacgtttcctgt

SEQ ID NO: 68001 - DNA, 27 bp, Artificial Sequence
  Description of Artificial Sequence: Synthetic oligonucleotide
tggggacacccaaccacgtttcctgtg

SEQ ID NO: 68002 - DNA, 26 bp, Artificial Sequence
  Description of Artificial Sequence: Synthetic oligonucleotide
ggggacacccaaccacgtttcctgtg

SEQ ID NO: 68003 - DNA, 26 bp, Artificial Sequence
  Description of Artificial Sequence: Synthetic oligonucleotide
gggacacccaaccacgtttcctgtgg

SEQ ID NO: 68004 - DNA, 27 bp, Artificial Sequence
  Description of Artificial Sequence: Synthetic oligonucleotide
ggacacccaaccacgtttcctgtggca

SEQ ID NO: 68005 - DNA, 27 bp, Artificial Sequence
  Description of Artificial Sequence: Synthetic oligonucleotide
gacacccaaccacgtttcctgtggcag

SEQ ID NO: 68006 - DNA, 27 bp, Artificial Sequence
  Description of Artificial Sequence: Synthetic oligonucleotide
acacccaaccacgtttcctgtggcagg

SEQ ID NO: 68007 - DNA, 26 bp, Artificial Sequence
  Description of Artificial Sequence: Synthetic oligonucleotide
cacccaaccacgtttcctgtggcagg

SEQ ID NO: 68008 - DNA, 27 bp, Artificial Sequence
  Description of Artificial Sequence: Synthetic oligonucleotide
acccaaccacgtttcctgtggcagggt

SEQ ID NO: 68009 - DNA, 27 bp, Artificial Sequence
  Description of Artificial Sequence: Synthetic oligonucleotide
cccaaccacgtttcctgtggcagggta

SEQ ID NO: 68010 - DNA, 28 bp, Artificial Sequence
  Description of Artificial Sequence: Synthetic oligonucleotide
ccaaccacgtttcctgtggcagggtaag

SEQ ID NO: 68011 - DNA, 33 bp, Artificial Sequence
  Description of Artificial Sequence: Synthetic oligonucleotide
caaccacgtttcctgtggcagggtaagtataag

SEQ ID NO: 68012 - DNA, 34 bp, Artificial Sequence
  Description of Artificial Sequence: Synthetic oligonucleotide
aaccacgtttcctgtggcagggtaagtataagtg

SEQ ID NO: 68013 - DNA, 33 bp, Artificial Sequence
  Description of Artificial Sequence: Synthetic oligonucleotide
accacgtttcctgtggcagggtaagtataagtg

SEQ ID NO: 68014 - DNA, 32 bp, Artificial Sequence
  Description of Artificial Sequence: Synthetic oligonucleotide
ccacgtttcctgtggcagggtaagtataagtg

SEQ ID NO: 68015 - DNA, 33 bp, Artificial Sequence
  Description of Artificial Sequence: Synthetic oligonucleotide
cacgtttcctgtggcagggtaagtataagtgtc

SEQ ID NO: 68016 - DNA, 37 bp, Artificial Sequence
  Description of Artificial Sequence: Synthetic oligonucleotide
acgtttcctgtggcagggtaagtataagtgtcatttc

SEQ ID NO: 68017 - DNA, 36 bp, Artificial Sequence
  Description of Artificial Sequence: Synthetic oligonucleotide
cgtttcctgtggcagggtaagtataagtgtcatttc

SEQ ID NO: 68018 - DNA, 38 bp, Artificial Sequence
  Description of Artificial Sequence: Synthetic oligonucleotide
gtttcctgtggcagggtaagtataagtgtcatttcttc

SEQ ID NO: 68019 - DNA, 40 bp, Artificial Sequence
  Description of Artificial Sequence: Synthetic oligonucleotide
tttcctgtggcagggtaagtataagtgtcatttcttcaac

SEQ ID NO: 68020 - DNA, 39 bp, Artificial Sequence
  Description of Artificial Sequence: Synthetic oligonucleotide
ttcctgtggcagggtaagtataagtgtcatttcttcaac

SEQ ID NO: 68021 - DNA, 38 bp, Artificial Sequence
  Description of Artificial Sequence: Synthetic oligonucleotide
tcctgtggcagggtaagtataagtgtcatttcttcaac

SEQ ID NO: 68022 - DNA, 37 bp, Artificial Sequence
  Description of Artificial Sequence: Synthetic oligonucleotide
cctgtggcagggtaagtataagtgtcatttcttcaac

SEQ ID NO: 68023 - DNA, 37 bp, Artificial Sequence
  Description of Artificial Sequence: Synthetic oligonucleotide
ctgtggcagggtaagtataagtgtcatttcttcaacg

SEQ ID NO: 68024 - DNA, 37 bp, Artificial Sequence
  Description of Artificial Sequence: Synthetic oligonucleotide
tgtggcagggtaagtataagtgtcatttcttcaacgg

SEQ ID NO: 68025 - DNA, 36 bp, Artificial Sequence
  Description of Artificial Sequence: Synthetic oligonucleotide
gtggcagggtaagtataagtgtcatttcttcaacgg

SEQ ID NO: 68026 - DNA, 36 bp, Artificial Sequence
  Description of Artificial Sequence: Synthetic oligonucleotide
tggcagggtaagtataagtgtcatttcttcaacggg

SEQ ID NO: 68027 - DNA, 35 bp, Artificial Sequence
  Description of Artificial Sequence: Synthetic oligonucleotide
ggcagggtaagtataagtgtcatttcttcaacggg

SEQ ID NO: 68028 - DNA, 36 bp, Artificial Sequence
  Description of Artificial Sequence: Synthetic oligonucleotide
gcagggtaagtataagtgtcatttcttcaacgggac

SEQ ID NO: 68029 - DNA, 36 bp, Artificial Sequence
  Description of Artificial Sequence: Synthetic oligonucleotide
cagggtaagtataagtgtcatttcttcaacgggacg

SEQ ID NO: 68030 - DNA, 36 bp, Artificial Sequence
  Description of Artificial Sequence: Synthetic oligonucleotide
agggtaagtataagtgtcatttcttcaacgggacgg

SEQ ID NO: 68031 - DNA, 35 bp, Artificial Sequence
  Description of Artificial Sequence: Synthetic oligonucleotide
gggtaagtataagtgtcatttcttcaacgggacgg

SEQ ID NO: 68032 - DNA, 36 bp, Artificial Sequence
  Description of Artificial Sequence: Synthetic oligonucleotide
ggtaagtataagtgtcatttcttcaacgggacggag

SEQ ID NO: 68033 - DNA, 36 bp, Artificial Sequence
  Description of Artificial Sequence: Synthetic oligonucleotide
gtaagtataagtgtcatttcttcaacgggacggagc

SEQ ID NO: 68034 - DNA, 36 bp, Artificial Sequence
  Description of Artificial Sequence: Synthetic oligonucleotide
taagtataagtgtcatttcttcaacgggacggagcg

SEQ ID NO: 68035 - DNA, 35 bp, Artificial Sequence
  Description of Artificial Sequence: Synthetic oligonucleotide
aagtataagtgtcatttcttcaacgggacggagcg

SEQ ID NO: 68036 - DNA, 34 bp, Artificial Sequence
  Description of Artificial Sequence: Synthetic oligonucleotide
agtataagtgtcatttcttcaacgggacggagcg

SEQ ID NO: 68037 - DNA, 33 bp, Artificial Sequence
  Description of Artificial Sequence: Synthetic oligonucleotide
gtataagtgtcatttcttcaacgggacggagcg

SEQ ID NO: 68038 - DNA, 33 bp, Artificial Sequence
  Description of Artificial Sequence: Synthetic oligonucleotide
tataagtgtcatttcttcaacgggacggagcgg

SEQ ID NO: 68039 - DNA, 32 bp, Artificial Sequence
  Description of Artificial Sequence: Synthetic oligonucleotide
ataagtgtcatttcttcaacgggacggagcgg

SEQ ID NO: 68040 - DNA, 31 bp, Artificial Sequence
  Description of Artificial Sequence: Synthetic oligonucleotide
taagtgtcatttcttcaacgggacggagcgg

SEQ ID NO: 68041 - DNA, 30 bp, Artificial Sequence
  Description of Artificial Sequence: Synthetic oligonucleotide
aagtgtcatttcttcaacgggacggagcgg

SEQ ID NO: 68042 - DNA, 34 bp, Artificial Sequence
  Description of Artificial Sequence: Synthetic oligonucleotide
ggtgcagttcctggaaagactcttctataaccag

SEQ ID NO: 68043 - DNA, 34 bp, Artificial Sequence
  Description of Artificial Sequence: Synthetic oligonucleotide
gtgcagttcctggaaagactcttctataaccagg

SEQ ID NO: 68044 - DNA, 35 bp, Artificial Sequence
  Description of Artificial Sequence: Synthetic oligonucleotide
tgcagttcctggaaagactcttctataaccaggag

SEQ ID NO: 68045 - DNA, 34 bp, Artificial Sequence
  Description of Artificial Sequence: Synthetic oligonucleotide
gcagttcctggaaagactcttctataaccaggag

SEQ ID NO: 68046 - DNA, 34 bp, Artificial Sequence
  Description of Artificial Sequence: Synthetic oligonucleotide
cagttcctggaaagactcttctataaccaggagg

SEQ ID NO: 68047 - DNA, 35 bp, Artificial Sequence
  Description of Artificial Sequence: Synthetic oligonucleotide
agttcctggaaagactcttctataaccaggaggag

SEQ ID NO: 68048 - DNA, 34 bp, Artificial Sequence
  Description of Artificial Sequence: Synthetic oligonucleotide
gttcctggaaagactcttctataaccaggaggag

SEQ ID NO: 68049 - DNA, 36 bp, Artificial Sequence
  Description of Artificial Sequence: Synthetic oligonucleotide
ttcctggaaagactcttctataaccaggaggagttc

SEQ ID NO: 68050 - DNA, 35 bp, Artificial Sequence
  Description of Artificial Sequence: Synthetic oligonucleotide
tcctggaaagactcttctataaccaggaggagttc

SEQ ID NO: 68051 - DNA, 34 bp, Artificial Sequence
  Description of Artificial Sequence: Synthetic oligonucleotide
cctggaaagactcttctataaccaggaggagttc

SEQ ID NO: 68052 - DNA, 34 bp, Artificial Sequence
  Description of Artificial Sequence: Synthetic oligonucleotide
ctggaaagactcttctataaccaggaggagttcg

SEQ ID NO: 68053 - DNA, 35 bp, Artificial Sequence
  Description of Artificial Sequence: Synthetic oligonucleotide
tggaaagactcttctataaccaggaggagttcgtg

SEQ ID NO: 68054 - DNA, 34 bp, Artificial Sequence
  Description of Artificial Sequence: Synthetic oligonucleotide
ggaaagactcttctataaccaggaggagttcgtg

SEQ ID NO: 68055 - DNA, 34 bp, Artificial Sequence
  Description of Artificial Sequence: Synthetic oligonucleotide
gaaagactcttctataaccaggaggagttcgtgc

SEQ ID NO: 68056 - DNA, 34 bp, Artificial Sequence
  Description of Artificial Sequence: Synthetic oligonucleotide
aaagactcttctataaccaggaggagttcgtgcg

SEQ ID NO: 68057 - DNA, 33 bp, Artificial Sequence
  Description of Artificial Sequence: Synthetic oligonucleotide
aagactcttctataaccaggaggagttcgtgcg

SEQ ID NO: 68058 - DNA, 32 bp, Artificial Sequence
  Description of Artificial Sequence: Synthetic oligonucleotide
agactcttctataaccaggaggagttcgtgcg

SEQ ID NO: 68059 - DNA, 31 bp, Artificial Sequence
  Description of Artificial Sequence: Synthetic oligonucleotide
gactcttctataaccaggaggagttcgtgcg

SEQ ID NO: 68060 - DNA, 31 bp, Artificial Sequence
  Description of Artificial Sequence: Synthetic oligonucleotide
actcttctataaccaggaggagttcgtgcgc

SEQ ID NO: 68061 - DNA, 30 bp, Artificial Sequence
  Description of Artificial Sequence: Synthetic oligonucleotide
ctcttctataaccaggaggagttcgtgcgc

SEQ ID NO: 68062 - DNA, 32 bp, Artificial Sequence
  Description of Artificial Sequence: Synthetic oligonucleotide
tcttctataaccaggaggagttcgtgcgcttc

SEQ ID NO: 68063 - DNA, 31 bp, Artificial Sequence
  Description of Artificial Sequence: Synthetic oligonucleotide
cttctataaccaggaggagttcgtgcgcttc

SEQ ID NO: 68064 - DNA, 31 bp, Artificial Sequence
  Description of Artificial Sequence: Synthetic oligonucleotide
ttctataaccaggaggagttcgtgcgcttcg

SEQ ID NO: 68065 - DNA, 30 bp, Artificial Sequence
  Description of Artificial Sequence: Synthetic oligonucleotide
tctataaccaggaggagttcgtgcgcttcg

SEQ ID NO: 68066 - DNA, 29 bp, Artificial Sequence
  Description of Artificial Sequence: Synthetic oligonucleotide
ctataaccaggaggagttcgtgcgcttcg

SEQ ID NO: 68067 - DNA, 30 bp, Artificial Sequence
  Description of Artificial Sequence: Synthetic oligonucleotide
tataaccaggaggagttcgtgcgcttcgac

SEQ ID NO: 68068 - DNA, 24 bp, Artificial Sequence
  Description of Artificial Sequence: Synthetic oligonucleotide
gagtaccgggcggtgacggagcta

SEQ ID NO: 68069 - DNA, 24 bp, Artificial Sequence
  Description of Artificial Sequence: Synthetic oligonucleotide
agtaccgggcggtgacggagctag

SEQ ID NO: 68070 - DNA, 23 bp, Artificial Sequence
  Description of Artificial Sequence: Synthetic oligonucleotide
gtaccgggcggtgacggagctag

SEQ ID NO: 68071 - DNA, 23 bp, Artificial Sequence
  Description of Artificial Sequence: Synthetic oligonucleotide
taccgggcggtgacggagctagg

SEQ ID NO: 68072 - DNA, 22 bp, Artificial Sequence
  Description of Artificial Sequence: Synthetic oligonucleotide
accgggcggtgacggagctagg

SEQ ID NO: 68073 - DNA, 21 bp, Artificial Sequence
  Description of Artificial Sequence: Synthetic oligonucleotide
ccgggcggtgacggagctagg

SEQ ID NO: 68074 - DNA, 21 bp, Artificial Sequence
  Description of Artificial Sequence: Synthetic oligonucleotide
cgggcggtgacggagctaggg

SEQ ID NO: 68075 - DNA, 21 bp, Artificial Sequence
  Description of Artificial Sequence: Synthetic oligonucleotide
gggcggtgacggagctagggc

SEQ ID NO: 68076 - DNA, 21 bp, Artificial Sequence
  Description of Artificial Sequence: Synthetic oligonucleotide
ggcggtgacggagctagggcg

SEQ ID NO: 68077 - DNA, 21 bp, Artificial Sequence
  Description of Artificial Sequence: Synthetic oligonucleotide
gcggtgacggagctagggcgg

SEQ ID NO: 68078 - DNA, 21 bp, Artificial Sequence
  Description of Artificial Sequence: Synthetic oligonucleotide
cggtgacggagctagggcggc

SEQ ID NO: 68079 - DNA, 22 bp, Artificial Sequence
  Description of Artificial Sequence: Synthetic oligonucleotide
ggtgacggagctagggcggcct

SEQ ID NO: 68080 - DNA, 23 bp, Artificial Sequence
  Description of Artificial Sequence: Synthetic oligonucleotide
gtgacggagctagggcggcctgt

SEQ ID NO: 68081 - DNA, 23 bp, Artificial Sequence
  Description of Artificial Sequence: Synthetic oligonucleotide
tgacggagctagggcggcctgtc

SEQ ID NO: 68082 - DNA, 22 bp, Artificial Sequence
  Description of Artificial Sequence: Synthetic oligonucleotide
gacggagctagggcggcctgtc

SEQ ID NO: 68083 - DNA, 22 bp, Artificial Sequence
  Description of Artificial Sequence: Synthetic oligonucleotide
acggagctagggcggcctgtcg

SEQ ID NO: 68084 - DNA, 21 bp, Artificial Sequence
  Description of Artificial Sequence: Synthetic oligonucleotide
cggagctagggcggcctgtcg

SEQ ID NO: 68085 - DNA, 21 bp, Artificial Sequence
  Description of Artificial Sequence: Synthetic oligonucleotide
ggagctagggcggcctgtcgc

SEQ ID NO: 68086 - DNA, 21 bp, Artificial Sequence
  Description of Artificial Sequence: Synthetic oligonucleotide
gagctagggcggcctgtcgcc

SEQ ID NO: 68087 - DNA, 22 bp, Artificial Sequence
  Description of Artificial Sequence: Synthetic oligonucleotide
agctagggcggcctgtcgccga

SEQ ID NO: 68088 - DNA, 21 bp, Artificial Sequence
  Description of Artificial Sequence: Synthetic oligonucleotide
gctagggcggcctgtcgccga

SEQ ID NO: 68089 - DNA, 22 bp, Artificial Sequence
  Description of Artificial Sequence: Synthetic oligonucleotide
ctagggcggcctgtcgccgagt

SEQ ID NO: 68090 - DNA, 22 bp, Artificial Sequence
  Description of Artificial Sequence: Synthetic oligonucleotide
tagggcggcctgtcgccgagtc

SEQ ID NO: 68091 - DNA, 21 bp, Artificial Sequence
  Description of Artificial Sequence: Synthetic oligonucleotide
agggcggcctgtcgccgagtc

SEQ ID NO: 68092 - DNA, 28 bp, Artificial Sequence
  Description of Artificial Sequence: Synthetic oligonucleotide
gaacagccagaaggacatcctggaggac

SEQ ID NO: 68093 - DNA, 29 bp, Artificial Sequence
  Description of Artificial Sequence: Synthetic oligonucleotide
aacagccagaaggacatcctggaggacag

SEQ ID NO: 68094 - DNA, 28 bp, Artificial Sequence
  Description of Artificial Sequence: Synthetic oligonucleotide
acagccagaaggacatcctggaggacag

SEQ ID NO: 68095 - DNA, 27 bp, Artificial Sequence
  Description of Artificial Sequence: Synthetic oligonucleotide
cagccagaaggacatcctggaggacag

SEQ ID NO: 68096 - DNA, 27 bp, Artificial Sequence
  Description of Artificial Sequence: Synthetic oligonucleotide
agccagaaggacatcctggaggacagg

SEQ ID NO: 68097 - DNA, 26 bp, Artificial Sequence
  Description of Artificial Sequence: Synthetic oligonucleotide
gccagaaggacatcctggaggacagg

SEQ ID NO: 68098 - DNA, 26 bp, Artificial Sequence
  Description of Artificial Sequence: Synthetic oligonucleotide
ccagaaggacatcctggaggacaggc

SEQ ID NO: 68099 - DNA, 26 bp, Artificial Sequence
  Description of Artificial Sequence: Synthetic oligonucleotide
cagaaggacatcctggaggacaggcg

SEQ ID NO: 68100 - DNA, 26 bp, Artificial Sequence
  Description of Artificial Sequence: Synthetic oligonucleotide
agaaggacatcctggaggacaggcgg

SEQ ID NO: 68101 - DNA, 25 bp, Artificial Sequence
  Description of Artificial Sequence: Synthetic oligonucleotide
gaaggacatcctggaggacaggcgg

SEQ ID NO: 68102 - DNA, 25 bp, Artificial Sequence
  Description of Artificial Sequence: Synthetic oligonucleotide
aaggacatcctggaggacaggcggg

SEQ ID NO: 68103 - DNA, 24 bp, Artificial Sequence
  Description of Artificial Sequence: Synthetic oligonucleotide
aggacatcctggaggacaggcggg

SEQ ID NO: 68104 - DNA, 23 bp, Artificial Sequence
  Description of Artificial Sequence: Synthetic oligonucleotide
ggacatcctggaggacaggcggg

SEQ ID NO: 68105 - DNA, 23 bp, Artificial Sequence
  Description of Artificial Sequence: Synthetic oligonucleotide
gacatcctggaggacaggcgggg

SEQ ID NO: 68106 - DNA, 23 bp, Artificial Sequence
  Description of Artificial Sequence: Synthetic oligonucleotide
acatcctggaggacaggcggggc

SEQ ID NO: 68107 - DNA, 22 bp, Artificial Sequence
  Description of Artificial Sequence: Synthetic oligonucleotide
catcctggaggacaggcggggc

SEQ ID NO: 68108 - DNA, 23 bp, Artificial Sequence
  Description of Artificial Sequence: Synthetic oligonucleotide
atcctggaggacaggcggggcca

SEQ ID NO: 68109 - DNA, 22 bp, Artificial Sequence
  Description of Artificial Sequence: Synthetic oligonucleotide
tcctggaggacaggcggggcca

SEQ ID NO: 68110 - DNA, 21 bp, Artificial Sequence
  Description of Artificial Sequence: Synthetic oligonucleotide
cctggaggacaggcggggcca

SEQ ID NO: 68111 - DNA, 21 bp, Artificial Sequence
  Description of Artificial Sequence: Synthetic oligonucleotide
ctggaggacaggcggggccag

SEQ ID NO: 68112 - DNA, 22 bp, Artificial Sequence
  Description of Artificial Sequence: Synthetic oligonucleotide
tggaggacaggcggggccaggt

SEQ ID NO: 68113 - DNA, 21 bp, Artificial Sequence
  Description of Artificial Sequence: Synthetic oligonucleotide
ggaggacaggcggggccaggt

SEQ ID NO: 68114 - DNA, 21 bp, Artificial Sequence
  Description of Artificial Sequence: Synthetic oligonucleotide
gaggacaggcggggccaggtg

SEQ ID NO: 68115 - DNA, 22 bp, Artificial Sequence
  Description of Artificial Sequence: Synthetic oligonucleotide
aggacaggcggggccaggtgga

SEQ ID NO: 68116 - DNA, 21 bp, Artificial Sequence
  Description of Artificial Sequence: Synthetic oligonucleotide
ggacaggcggggccaggtgga

SEQ ID NO: 68117 - DNA, 22 bp, Artificial Sequence
  Description of Artificial Sequence: Synthetic oligonucleotide
gacaggcggggccaggtggaca

SEQ ID NO: 68118 - DNA, 22 bp, Artificial Sequence
  Description of Artificial Sequence: Synthetic oligonucleotide
acaggcggggccaggtggacac

SEQ ID NO: 68119 - DNA, 21 bp, Artificial Sequence
  Description of Artificial Sequence: Synthetic oligonucleotide
caggcggggccaggtggacac

SEQ ID NO: 68120 - DNA, 21 bp, Artificial Sequence
  Description of Artificial Sequence: Synthetic oligonucleotide
aggcggggccaggtggacacc

SEQ ID NO: 68121 - DNA, 20 bp, Artificial Sequence
  Description of Artificial Sequence: Synthetic oligonucleotide
ggcggggccaggtggacacc

SEQ ID NO: 68122 - DNA, 21 bp, Artificial Sequence
  Description of Artificial Sequence: Synthetic oligonucleotide
gcggggccaggtggacaccgt

SEQ ID NO: 68123 - DNA, 22 bp, Artificial Sequence
  Description of Artificial Sequence: Synthetic oligonucleotide
cggggccaggtggacaccgtgt

SEQ ID NO: 68124 - DNA, 22 bp, Artificial Sequence
  Description of Artificial Sequence: Synthetic oligonucleotide
ggggccaggtggacaccgtgtg

SEQ ID NO: 68125 - DNA, 23 bp, Artificial Sequence
  Description of Artificial Sequence: Synthetic oligonucleotide
gggccaggtggacaccgtgtgca

SEQ ID NO: 68126 - DNA, 24 bp, Artificial Sequence
  Description of Artificial Sequence: Synthetic oligonucleotide
ggccaggtggacaccgtgtgcaga

SEQ ID NO: 68127 - DNA, 25 bp, Artificial Sequence
  Description of Artificial Sequence: Synthetic oligonucleotide
gccaggtggacaccgtgtgcagaca

SEQ ID NO: 68128 - DNA, 27 bp, Artificial Sequence
  Description of Artificial Sequence: Synthetic oligonucleotide
ccaggtggacaccgtgtgcagacacaa

SEQ ID NO: 68129 - DNA, 27 bp, Artificial Sequence
  Description of Artificial Sequence: Synthetic oligonucleotide
caggtggacaccgtgtgcagacacaac

SEQ ID NO: 68130 - DNA, 29 bp, Artificial Sequence
  Description of Artificial Sequence: Synthetic oligonucleotide
aggtggacaccgtgtgcagacacaactac

SEQ ID NO: 68131 - DNA, 26 bp, Artificial Sequence
  Description of Artificial Sequence: Synthetic oligonucleotide
tcacagtgcagcggcgagtccatcct

SEQ ID NO: 68132 - DNA, 25 bp, Artificial Sequence
  Description of Artificial Sequence: Synthetic oligonucleotide
cacagtgcagcggcgagtccatcct

SEQ ID NO: 68133 - DNA, 26 bp, Artificial Sequence
  Description of Artificial Sequence: Synthetic oligonucleotide
acagtgcagcggcgagtccatcctga

SEQ ID NO: 68134 - DNA, 25 bp, Artificial Sequence
  Description of Artificial Sequence: Synthetic oligonucleotide
cagtgcagcggcgagtccatcctga

SEQ ID NO: 68135 - DNA, 25 bp, Artificial Sequence
  Description of Artificial Sequence: Synthetic oligonucleotide
agtgcagcggcgagtccatcctgag

SEQ ID NO: 68136 - DNA, 24 bp, Artificial Sequence
  Description of Artificial Sequence: Synthetic oligonucleotide
gtgcagcggcgagtccatcctgag

SEQ ID NO: 68137 - DNA, 25 bp, Artificial Sequence
  Description of Artificial Sequence: Synthetic oligonucleotide
tgcagcggcgagtccatcctgaggt

SEQ ID NO: 68138 - DNA, 24 bp, Artificial Sequence
  Description of Artificial Sequence: Synthetic oligonucleotide
gcagcggcgagtccatcctgaggt

SEQ ID NO: 68139 - DNA, 25 bp, Artificial Sequence
  Description of Artificial Sequence: Synthetic oligonucleotide
cagcggcgagtccatcctgaggtga

SEQ ID NO: 68140 - DNA, 26 bp, Artificial Sequence
  Description of Artificial Sequence: Synthetic oligonucleotide
agcggcgagtccatcctgaggtgact

SEQ ID NO: 68141 - DNA, 25 bp, Artificial Sequence
  Description of Artificial Sequence: Synthetic oligonucleotide
gcggcgagtccatcctgaggtgact

SEQ ID NO: 68142 - DNA, 26 bp, Artificial Sequence
  Description of Artificial Sequence: Synthetic oligonucleotide
cggcgagtccatcctgaggtgactgt

SEQ ID NO: 68143 - DNA, 27 bp, Artificial Sequence
  Description of Artificial Sequence: Synthetic oligonucleotide
ggcgagtccatcctgaggtgactgtgt

SEQ ID NO: 68144 - DNA, 29 bp, Artificial Sequence
  Description of Artificial Sequence: Synthetic oligonucleotide
gcgagtccatcctgaggtgactgtgtatc

SEQ ID NO: 68145 - DNA, 29 bp, Artificial Sequence
  Description of Artificial Sequence: Synthetic oligonucleotide
cgagtccatcctgaggtgactgtgtatcc

SEQ ID NO: 68146 - DNA, 30 bp, Artificial Sequence
  Description of Artificial Sequence: Synthetic oligonucleotide
gagtccatcctgaggtgactgtgtatcctg

SEQ ID NO: 68147 - DNA, 30 bp, Artificial Sequence
  Description of Artificial Sequence: Synthetic oligonucleotide
agtccatcctgaggtgactgtgtatcctgc

SEQ ID NO: 68148 - DNA, 29 bp, Artificial Sequence
  Description of Artificial Sequence: Synthetic oligonucleotide
gtccatcctgaggtgactgtgtatcctgc

SEQ ID NO: 68149 - DNA, 29 bp, Artificial Sequence
  Description of Artificial Sequence: Synthetic oligonucleotide
tccatcctgaggtgactgtgtatcctgcc

SEQ ID NO: 68150 - DNA, 28 bp, Artificial Sequence
  Description of Artificial Sequence: Synthetic oligonucleotide
ccatcctgaggtgactgtgtatcctgcc

SEQ ID NO: 68151 - DNA, 30 bp, Artificial Sequence
  Description of Artificial Sequence: Synthetic oligonucleotide
catcctgaggtgactgtgtatcctgccaag

SEQ ID NO: 68152 - DNA, 31 bp, Artificial Sequence
  Description of Artificial Sequence: Synthetic oligonucleotide
atcctgaggtgactgtgtatcctgccaagac

SEQ ID NO: 68153 - DNA, 30 bp, Artificial Sequence
  Description of Artificial Sequence: Synthetic oligonucleotide
tcctgaggtgactgtgtatcctgccaagac

SEQ ID NO: 68154 - DNA, 29 bp, Artificial Sequence
  Description of Artificial Sequence: Synthetic oligonucleotide
cctgaggtgactgtgtatcctgccaagac

SEQ ID NO: 68155 - DNA, 30 bp, Artificial Sequence
  Description of Artificial Sequence: Synthetic oligonucleotide
ctgaggtgactgtgtatcctgccaagactc

SEQ ID NO: 68156 - DNA, 31 bp, Artificial Sequence
  Description of Artificial Sequence: Synthetic oligonucleotide
tgaggtgactgtgtatcctgccaagactcag

SEQ ID NO: 68157 - DNA, 30 bp, Artificial Sequence
  Description of Artificial Sequence: Synthetic oligonucleotide
gaggtgactgtgtatcctgccaagactcag

SEQ ID NO: 68158 - DNA, 30 bp, Artificial Sequence
  Description of Artificial Sequence: Synthetic oligonucleotide
aggtgactgtgtatcctgccaagactcagc

SEQ ID NO: 68159 - DNA, 29 bp, Artificial Sequence
  Description of Artificial Sequence: Synthetic oligonucleotide
ggtgactgtgtatcctgccaagactcagc

SEQ ID NO: 68160 - DNA, 29 bp, Artificial Sequence
  Description of Artificial Sequence: Synthetic oligonucleotide
gtgactgtgtatcctgccaagactcagcc

SEQ ID NO: 68161 - DNA, 29 bp, Artificial Sequence
  Description of Artificial Sequence: Synthetic oligonucleotide
tgactgtgtatcctgccaagactcagccc

SEQ ID NO: 68162 - DNA, 28 bp, Artificial Sequence
  Description of Artificial Sequence: Synthetic oligonucleotide
gactgtgtatcctgccaagactcagccc

SEQ ID NO: 68163 - DNA, 28 bp, Artificial Sequence
  Description of Artificial Sequence: Synthetic oligonucleotide
actgtgtatcctgccaagactcagcccc

SEQ ID NO: 68164 - DNA, 27 bp, Artificial Sequence
  Description of Artificial Sequence: Synthetic oligonucleotide
ctgtgtatcctgccaagactcagcccc

SEQ ID NO: 68165 - DNA, 28 bp, Artificial Sequence
  Description of Artificial Sequence: Synthetic oligonucleotide
tgtgtatcctgccaagactcagcccctg

SEQ ID NO: 68166 - DNA, 27 bp, Artificial Sequence
  Description of Artificial Sequence: Synthetic oligonucleotide
gtgtatcctgccaagactcagcccctg

SEQ ID NO: 68167 - DNA, 27 bp, Artificial Sequence
  Description of Artificial Sequence: Synthetic oligonucleotide
tgtatcctgccaagactcagcccctgc

SEQ ID NO: 68168 - DNA, 27 bp, Artificial Sequence
  Description of Artificial Sequence: Synthetic oligonucleotide
gtatcctgccaagactcagcccctgca

SEQ ID NO: 68169 - DNA, 27 bp, Artificial Sequence
  Description of Artificial Sequence: Synthetic oligonucleotide
tatcctgccaagactcagcccctgcag

SEQ ID NO: 68170 - DNA, 26 bp, Artificial Sequence
  Description of Artificial Sequence: Synthetic oligonucleotide
atcctgccaagactcagcccctgcag

SEQ ID NO: 68171 - DNA, 25 bp, Artificial Sequence
  Description of Artificial Sequence: Synthetic oligonucleotide
tcctgccaagactcagcccctgcag

SEQ ID NO: 68172 - DNA, 24 bp, Artificial Sequence
  Description of Artificial Sequence: Synthetic oligonucleotide
cctgccaagactcagcccctgcag

SEQ ID NO: 68173 - DNA, 25 bp, Artificial Sequence
  Description of Artificial Sequence: Synthetic oligonucleotide
ctgccaagactcagcccctgcagca

SEQ ID NO: 68174 - DNA, 25 bp, Artificial Sequence
  Description of Artificial Sequence: Synthetic oligonucleotide
tgccaagactcagcccctgcagcac

SEQ ID NO: 68175 - DNA, 24 bp, Artificial Sequence
  Description of Artificial Sequence: Synthetic oligonucleotide
gccaagactcagcccctgcagcac

SEQ ID NO: 68176 - DNA, 25 bp, Artificial Sequence
  Description of Artificial Sequence: Synthetic oligonucleotide
ccaagactcagcccctgcagcacca

SEQ ID NO: 68177 - DNA, 27 bp, Artificial Sequence
  Description of Artificial Sequence: Synthetic oligonucleotide
caagactcagcccctgcagcaccacaa

SEQ ID NO: 68178 - DNA, 27 bp, Artificial Sequence
  Description of Artificial Sequence: Synthetic oligonucleotide
aagactcagcccctgcagcaccacaac

SEQ ID NO: 68179 - DNA, 26 bp, Artificial Sequence
  Description of Artificial Sequence: Synthetic oligonucleotide
agactcagcccctgcagcaccacaac

SEQ ID NO: 68180 - DNA, 25 bp, Artificial Sequence
  Description of Artificial Sequence: Synthetic oligonucleotide
gactcagcccctgcagcaccacaac

SEQ ID NO: 68181 - DNA, 26 bp, Artificial Sequence
  Description of Artificial Sequence: Synthetic oligonucleotide
actcagcccctgcagcaccacaacct

SEQ ID NO: 68182 - DNA, 25 bp, Artificial Sequence
  Description of Artificial Sequence: Synthetic oligonucleotide
ctcagcccctgcagcaccacaacct

SEQ ID NO: 68183 - DNA, 25 bp, Artificial Sequence
  Description of Artificial Sequence: Synthetic oligonucleotide
tcagcccctgcagcaccacaacctc

SEQ ID NO: 68184 - DNA, 31 bp, Artificial Sequence
  Description of Artificial Sequence: Synthetic oligonucleotide
atgctggaaacagttcctcggagtggagaag

SEQ ID NO: 68185 - DNA, 30 bp, Artificial Sequence
  Description of Artificial Sequence: Synthetic oligonucleotide
tgctggaaacagttcctcggagtggagaag

SEQ ID NO: 68186 - DNA, 29 bp, Artificial Sequence
  Description of Artificial Sequence: Synthetic oligonucleotide
gctggaaacagttcctcggagtggagaag

SEQ ID NO: 68187 - DNA, 33 bp, Artificial Sequence
  Description of Artificial Sequence: Synthetic oligonucleotide
ctggaaacagttcctcggagtggagaagtttac

SEQ ID NO: 68188 - DNA, 34 bp, Artificial Sequence
  Description of Artificial Sequence: Synthetic oligonucleotide
tggaaacagttcctcggagtggagaagtttacac

SEQ ID NO: 68189 - DNA, 33 bp, Artificial Sequence
  Description of Artificial Sequence: Synthetic oligonucleotide
ggaaacagttcctcggagtggagaagtttacac

SEQ ID NO: 68190 - DNA, 33 bp, Artificial Sequence
  Description of Artificial Sequence: Synthetic oligonucleotide
gaaacagttcctcggagtggagaagtttacacc

SEQ ID NO: 68191 - DNA, 34 bp, Artificial Sequence
  Description of Artificial Sequence: Synthetic oligonucleotide
aaacagttcctcggagtggagaagtttacacctg

SEQ ID NO: 68192 - DNA, 33 bp, Artificial Sequence
  Description of Artificial Sequence: Synthetic oligonucleotide
aacagttcctcggagtggagaagtttacacctg

SEQ ID NO: 68193 - DNA, 32 bp, Artificial Sequence
  Description of Artificial Sequence: Synthetic oligonucleotide
acagttcctcggagtggagaagtttacacctg

SEQ ID NO: 68194 - DNA, 31 bp, Artificial Sequence
  Description of Artificial Sequence: Synthetic oligonucleotide
cagttcctcggagtggagaagtttacacctg

SEQ ID NO: 68195 - DNA, 31 bp, Artificial Sequence
  Description of Artificial Sequence: Synthetic oligonucleotide
agttcctcggagtggagaagtttacacctgc

SEQ ID NO: 68196 - DNA, 30 bp, Artificial Sequence
  Description of Artificial Sequence: Synthetic oligonucleotide
gttcctcggagtggagaagtttacacctgc

SEQ ID NO: 68197 - DNA, 30 bp, Artificial Sequence
  Description of Artificial Sequence: Synthetic oligonucleotide
ttcctcggagtggagaagtttacacctgcc

SEQ ID NO: 68198 - DNA, 29 bp, Artificial Sequence
  Description of Artificial Sequence: Synthetic oligonucleotide
tcctcggagtggagaagtttacacctgcc

SEQ ID NO: 68199 - DNA, 28 bp, Artificial Sequence
  Description of Artificial Sequence: Synthetic oligonucleotide
cctcggagtggagaagtttacacctgcc

SEQ ID NO: 68200 - DNA, 30 bp, Artificial Sequence
  Description of Artificial Sequence: Synthetic oligonucleotide
ctcggagtggagaagtttacacctgccaag

SEQ ID NO: 68201 - DNA, 31 bp, Artificial Sequence
  Description of Artificial Sequence: Synthetic oligonucleotide
tcggagtggagaagtttacacctgccaagtg

SEQ ID NO: 68202 - DNA, 30 bp, Artificial Sequence
  Description of Artificial Sequence: Synthetic oligonucleotide
cggagtggagaagtttacacctgccaagtg

SEQ ID NO: 68203 - DNA, 30 bp, Artificial Sequence
  Description of Artificial Sequence: Synthetic oligonucleotide
ggagtggagaagtttacacctgccaagtgg

SEQ ID NO: 68204 - DNA, 31 bp, Artificial Sequence
  Description of Artificial Sequence: Synthetic oligonucleotide
gagtggagaagtttacacctgccaagtggag

SEQ ID NO: 68205 - DNA, 31 bp, Artificial Sequence
  Description of Artificial Sequence: Synthetic oligonucleotide
agtggagaagtttacacctgccaagtggagc

SEQ ID NO: 68206 - DNA, 30 bp, Artificial Sequence
  Description of Artificial Sequence: Synthetic oligonucleotide
gtggagaagtttacacctgccaagtggagc

SEQ ID NO: 68207 - DNA, 31 bp, Artificial Sequence
  Description of Artificial Sequence: Synthetic oligonucleotide
tggagaagtttacacctgccaagtggagcac

SEQ ID NO: 68208 - DNA, 30 bp, Artificial Sequence
  Description of Artificial Sequence: Synthetic oligonucleotide
ggagaagtttacacctgccaagtggagcac

SEQ ID NO: 68209 - DNA, 30 bp, Artificial Sequence
  Description of Artificial Sequence: Synthetic oligonucleotide
gagaagtttacacctgccaagtggagcacc

SEQ ID NO: 68210 - DNA, 30 bp, Artificial Sequence
  Description of Artificial Sequence: Synthetic oligonucleotide
agaagtttacacctgccaagtggagcaccc

SEQ ID NO: 68211 - DNA, 29 bp, Artificial Sequence
  Description of Artificial Sequence: Synthetic oligonucleotide
gaagtttacacctgccaagtggagcaccc

SEQ ID NO: 68212 - DNA, 31 bp, Artificial Sequence
  Description of Artificial Sequence: Synthetic oligonucleotide
aagtttacacctgccaagtggagcacccaag

SEQ ID NO: 68213 - DNA, 30 bp, Artificial Sequence
  Description of Artificial Sequence: Synthetic oligonucleotide
agtttacacctgccaagtggagcacccaag

SEQ ID NO: 68214 - DNA, 28 bp, Artificial Sequence
  Description of Artificial Sequence: Synthetic oligonucleotide
ctgccaagtggagcacccaagtgtgatg

SEQ ID NO: 68215 - DNA, 29 bp, Artificial Sequence
  Description of Artificial Sequence: Synthetic oligonucleotide
tgccaagtggagcacccaagtgtgatgag

SEQ ID NO: 68216 - DNA, 28 bp, Artificial Sequence
  Description of Artificial Sequence: Synthetic oligonucleotide
gccaagtggagcacccaagtgtgatgag

SEQ ID NO: 68217 - DNA, 28 bp, Artificial Sequence
  Description of Artificial Sequence: Synthetic oligonucleotide
ccaagtggagcacccaagtgtgatgagc

SEQ ID NO: 68218 - DNA, 28 bp, Artificial Sequence
  Description of Artificial Sequence: Synthetic oligonucleotide
caagtggagcacccaagtgtgatgagcc

SEQ ID NO: 68219 - DNA, 28 bp, Artificial Sequence
  Description of Artificial Sequence: Synthetic oligonucleotide
aagtggagcacccaagtgtgatgagccc

SEQ ID NO: 68220 - DNA, 27 bp, Artificial Sequence
  Description of Artificial Sequence: Synthetic oligonucleotide
agtggagcacccaagtgtgatgagccc

SEQ ID NO: 68221 - DNA, 27 bp, Artificial Sequence
  Description of Artificial Sequence: Synthetic oligonucleotide
gtggagcacccaagtgtgatgagccct

SEQ ID NO: 68222 - DNA, 27 bp, Artificial Sequence
  Description of Artificial Sequence: Synthetic oligonucleotide
tggagcacccaagtgtgatgagccctc

SEQ ID NO: 68223 - DNA, 27 bp, Artificial Sequence
  Description of Artificial Sequence: Synthetic oligonucleotide
ggagcacccaagtgtgatgagccctct

SEQ ID NO: 68224 - DNA, 27 bp, Artificial Sequence
  Description of Artificial Sequence: Synthetic oligonucleotide
gagcacccaagtgtgatgagccctctc

SEQ ID NO: 68225 - DNA, 28 bp, Artificial Sequence
  Description of Artificial Sequence: Synthetic oligonucleotide
agcacccaagtgtgatgagccctctcac

SEQ ID NO: 68226 - DNA, 27 bp, Artificial Sequence
  Description of Artificial Sequence: Synthetic oligonucleotide
gcacccaagtgtgatgagccctctcac

SEQ ID NO: 68227 - DNA, 28 bp, Artificial Sequence
  Description of Artificial Sequence: Synthetic oligonucleotide
cacccaagtgtgatgagccctctcacag

SEQ ID NO: 68228 - DNA, 29 bp, Artificial Sequence
  Description of Artificial Sequence: Synthetic oligonucleotide
acccaagtgtgatgagccctctcacagtg

SEQ ID NO: 68229 - DNA, 28 bp, Artificial Sequence
  Description of Artificial Sequence: Synthetic oligonucleotide
cccaagtgtgatgagccctctcacagtg

SEQ ID NO: 68230 - DNA, 28 bp, Artificial Sequence
  Description of Artificial Sequence: Synthetic oligonucleotide
ccaagtgtgatgagccctctcacagtgg

SEQ ID NO: 68231 - DNA, 31 bp, Artificial Sequence
  Description of Artificial Sequence: Synthetic oligonucleotide
caagtgtgatgagccctctcacagtggaatg

SEQ ID NO: 68232 - DNA, 31 bp, Artificial Sequence
  Description of Artificial Sequence: Synthetic oligonucleotide
aagtgtgatgagccctctcacagtggaatgg

SEQ ID NO: 68233 - DNA, 30 bp, Artificial Sequence
  Description of Artificial Sequence: Synthetic oligonucleotide
agtgtgatgagccctctcacagtggaatgg

SEQ ID NO: 68234 - DNA, 29 bp, Artificial Sequence
  Description of Artificial Sequence: Synthetic oligonucleotide
gtgtgatgagccctctcacagtggaatgg

SEQ ID NO: 68235 - DNA, 30 bp, Artificial Sequence
  Description of Artificial Sequence: Synthetic oligonucleotide
tgtgatgagccctctcacagtggaatggag

SEQ ID NO: 68236 - DNA, 29 bp, Artificial Sequence
  Description of Artificial Sequence: Synthetic oligonucleotide
gtgatgagccctctcacagtggaatggag

SEQ ID NO: 68237 - DNA, 30 bp, Artificial Sequence
  Description of Artificial Sequence: Synthetic oligonucleotide
tgatgagccctctcacagtggaatggagag

SEQ ID NO: 68238 - DNA, 29 bp, Artificial Sequence
  Description of Artificial Sequence: Synthetic oligonucleotide
gatgagccctctcacagtggaatggagag

SEQ ID NO: 68239 - DNA, 29 bp, Artificial Sequence
  Description of Artificial Sequence: Synthetic oligonucleotide
atgagccctctcacagtggaatggagagc

SEQ ID NO: 68240 - DNA, 28 bp, Artificial Sequence
  Description of Artificial Sequence: Synthetic oligonucleotide
tgagccctctcacagtggaatggagagc

SEQ ID NO: 68241 - DNA, 24 bp, Artificial Sequence
  Description of Artificial Sequence: Synthetic oligonucleotide
cctgctcttccttggggccgggtt

SEQ ID NO: 68242 - DNA, 26 bp, Artificial Sequence
  Description of Artificial Sequence: Synthetic oligonucleotide
ctgctcttccttggggccgggttgtt

SEQ ID NO: 68243 - DNA, 27 bp, Artificial Sequence
  Description of Artificial Sequence: Synthetic oligonucleotide
tgctcttccttggggccgggttgttca

SEQ ID NO: 68244 - DNA, 27 bp, Artificial Sequence
  Description of Artificial Sequence: Synthetic oligonucleotide
gctcttccttggggccgggttgttcat

SEQ ID NO: 68245 - DNA, 27 bp, Artificial Sequence
  Description of Artificial Sequence: Synthetic oligonucleotide
ctcttccttggggccgggttgttcatc

SEQ ID NO: 68246 - DNA, 29 bp, Artificial Sequence
  Description of Artificial Sequence: Synthetic oligonucleotide
tcttccttggggccgggttgttcatctac

SEQ ID NO: 68247 - DNA, 28 bp, Artificial Sequence
  Description of Artificial Sequence: Synthetic oligonucleotide
cttccttggggccgggttgttcatctac

SEQ ID NO: 68248 - DNA, 30 bp, Artificial Sequence
  Description of Artificial Sequence: Synthetic oligonucleotide
ttccttggggccgggttgttcatctacttc

SEQ ID NO: 68249 - DNA, 29 bp, Artificial Sequence
  Description of Artificial Sequence: Synthetic oligonucleotide
tccttggggccgggttgttcatctacttc

SEQ ID NO: 68250 - DNA, 28 bp, Artificial Sequence
  Description of Artificial Sequence: Synthetic oligonucleotide
ccttggggccgggttgttcatctacttc

SEQ ID NO: 68251 - DNA, 29 bp, Artificial Sequence
  Description of Artificial Sequence: Synthetic oligonucleotide
cttggggccgggttgttcatctacttcag

SEQ ID NO: 68252 - DNA, 29 bp, Artificial Sequence
  Description of Artificial Sequence: Synthetic oligonucleotide
ttggggccgggttgttcatctacttcagg

SEQ ID NO: 68253 - DNA, 28 bp, Artificial Sequence
  Description of Artificial Sequence: Synthetic oligonucleotide
tggggccgggttgttcatctacttcagg

SEQ ID NO: 68254 - DNA, 27 bp, Artificial Sequence
  Description of Artificial Sequence: Synthetic oligonucleotide
ggggccgggttgttcatctacttcagg

SEQ ID NO: 68255 - DNA, 30 bp, Artificial Sequence
  Description of Artificial Sequence: Synthetic oligonucleotide
gggccgggttgttcatctacttcaggaatc

SEQ ID NO: 68256 - DNA, 31 bp, Artificial Sequence
  Description of Artificial Sequence: Synthetic oligonucleotide
ggccgggttgttcatctacttcaggaatcag

SEQ ID NO: 68257 - DNA, 34 bp, Artificial Sequence
  Description of Artificial Sequence: Synthetic oligonucleotide
gccgggttgttcatctacttcaggaatcagaaag

SEQ ID NO: 68258 - DNA, 34 bp, Artificial Sequence
  Description of Artificial Sequence: Synthetic oligonucleotide
ccgggttgttcatctacttcaggaatcagaaagg

SEQ ID NO: 68259 - DNA, 35 bp, Artificial Sequence
  Description of Artificial Sequence: Synthetic oligonucleotide
cgggttgttcatctacttcaggaatcagaaaggac

SEQ ID NO: 68260 - DNA, 36 bp, Artificial Sequence
  Description of Artificial Sequence: Synthetic oligonucleotide
gggttgttcatctacttcaggaatcagaaaggacac

SEQ ID NO: 68261 - DNA, 37 bp, Artificial Sequence
  Description of Artificial Sequence: Synthetic oligonucleotide
ggttgttcatctacttcaggaatcagaaaggacactc

SEQ ID NO: 68262 - DNA, 38 bp, Artificial Sequence
  Description of Artificial Sequence: Synthetic oligonucleotide
gttgttcatctacttcaggaatcagaaaggacactctg

SEQ ID NO: 68263 - DNA, 38 bp, Artificial Sequence
  Description of Artificial Sequence: Synthetic oligonucleotide
ttgttcatctacttcaggaatcagaaaggacactctgg

SEQ ID NO: 68264 - DNA, 38 bp, Artificial Sequence
  Description of Artificial Sequence: Synthetic oligonucleotide
cacgtttcctgtggcagggtaaatataagtgtcatttc

SEQ ID NO: 68265 - DNA, 40 bp, Artificial Sequence
  Description of Artificial Sequence: Synthetic oligonucleotide
acgtttcctgtggcagggtaaatataagtgtcatttcttc

SEQ ID NO: 68266 - DNA, 39 bp, Artificial Sequence
  Description of Artificial Sequence: Synthetic oligonucleotide
cgtttcctgtggcagggtaaatataagtgtcatttcttc

SEQ ID NO: 68267 - DNA, 41 bp, Artificial Sequence
  Description of Artificial Sequence: Synthetic oligonucleotide
gtttcctgtggcagggtaaatataagtgtcatttcttcaac

SEQ ID NO: 68268 - DNA, 41 bp, Artificial Sequence
  Description of Artificial Sequence: Synthetic oligonucleotide
tttcctgtggcagggtaaatataagtgtcatttcttcaacg

SEQ ID NO: 68269 - DNA, 40 bp, Artificial Sequence
  Description of Artificial Sequence: Synthetic oligonucleotide
ttcctgtggcagggtaaatataagtgtcatttcttcaacg

SEQ ID NO: 68270 - DNA, 39 bp, Artificial Sequence
  Description of Artificial Sequence: Synthetic oligonucleotide
tcctgtggcagggtaaatataagtgtcatttcttcaacg

SEQ ID NO: 68271 - DNA, 38 bp, Artificial Sequence
  Description of Artificial Sequence: Synthetic oligonucleotide
cctgtggcagggtaaatataagtgtcatttcttcaacg

SEQ ID NO: 68272 - DNA, 38 bp, Artificial Sequence
  Description of Artificial Sequence: Synthetic oligonucleotide
ctgtggcagggtaaatataagtgtcatttcttcaacgg

SEQ ID NO: 68273 - DNA, 38 bp, Artificial Sequence
  Description of Artificial Sequence: Synthetic oligonucleotide
tgtggcagggtaaatataagtgtcatttcttcaacggg

SEQ ID NO: 68274 - DNA, 37 bp, Artificial Sequence
  Description of Artificial Sequence: Synthetic oligonucleotide
gtggcagggtaaatataagtgtcatttcttcaacggg

SEQ ID NO: 68275 - DNA, 38 bp, Artificial Sequence
  Description of Artificial Sequence: Synthetic oligonucleotide
tggcagggtaaatataagtgtcatttcttcaacgggac

SEQ ID NO: 68276 - DNA, 37 bp, Artificial Sequence
  Description of Artificial Sequence: Synthetic oligonucleotide
ggcagggtaaatataagtgtcatttcttcaacgggac

SEQ ID NO: 68277 - DNA, 37 bp, Artificial Sequence
  Description of Artificial Sequence: Synthetic oligonucleotide
gcagggtaaatataagtgtcatttcttcaacgggacg

SEQ ID NO: 68278 - DNA, 37 bp, Artificial Sequence
  Description of Artificial Sequence: Synthetic oligonucleotide
cagggtaaatataagtgtcatttcttcaacgggacgg

SEQ ID NO: 68279 - DNA, 38 bp, Artificial Sequence
  Description of Artificial Sequence: Synthetic oligonucleotide
agggtaaatataagtgtcatttcttcaacgggacggag

SEQ ID NO: 68280 - DNA, 37 bp, Artificial Sequence
  Description of Artificial Sequence: Synthetic oligonucleotide
gggtaaatataagtgtcatttcttcaacgggacggag

SEQ ID NO: 68281 - DNA, 37 bp, Artificial Sequence
  Description of Artificial Sequence: Synthetic oligonucleotide
ggtaaatataagtgtcatttcttcaacgggacggagc

SEQ ID NO: 68282 - DNA, 37 bp, Artificial Sequence
  Description of Artificial Sequence: Synthetic oligonucleotide
gtaaatataagtgtcatttcttcaacgggacggagcg

SEQ ID NO: 68283 - DNA, 37 bp, Artificial Sequence
  Description of Artificial Sequence: Synthetic oligonucleotide
taaatataagtgtcatttcttcaacgggacggagcgg

SEQ ID NO: 68284 - DNA, 36 bp, Artificial Sequence
  Description of Artificial Sequence: Synthetic oligonucleotide
aaatataagtgtcatttcttcaacgggacggagcgg

SEQ ID NO: 68285 - DNA, 35 bp, Artificial Sequence
  Description of Artificial Sequence: Synthetic oligonucleotide
aatataagtgtcatttcttcaacgggacggagcgg

SEQ ID NO: 68286 - DNA, 34 bp, Artificial Sequence
  Description of Artificial Sequence: Synthetic oligonucleotide
atataagtgtcatttcttcaacgggacggagcgg

SEQ ID NO: 68287 - DNA, 37 bp, Artificial Sequence
  Description of Artificial Sequence: Synthetic oligonucleotide
gtaagtataagtgtcatttcttcaacgggacggagag

SEQ ID NO: 68288 - DNA, 37 bp, Artificial Sequence
  Description of Artificial Sequence: Synthetic oligonucleotide
taagtataagtgtcatttcttcaacgggacggagagg

SEQ ID NO: 68289 - DNA, 36 bp, Artificial Sequence
  Description of Artificial Sequence: Synthetic oligonucleotide
aagtataagtgtcatttcttcaacgggacggagagg

SEQ ID NO: 68290 - DNA, 35 bp, Artificial Sequence
  Description of Artificial Sequence: Synthetic oligonucleotide
agtataagtgtcatttcttcaacgggacggagagg

SEQ ID NO: 68291 - DNA, 34 bp, Artificial Sequence
  Description of Artificial Sequence: Synthetic oligonucleotide
gtataagtgtcatttcttcaacgggacggagagg

SEQ ID NO: 68292 - DNA, 34 bp, Artificial Sequence
  Description of Artificial Sequence: Synthetic oligonucleotide
tataagtgtcatttcttcaacgggacggagaggg

SEQ ID NO: 68293 - DNA, 33 bp, Artificial Sequence
  Description of Artificial Sequence: Synthetic oligonucleotide
ataagtgtcatttcttcaacgggacggagaggg

SEQ ID NO: 68294 - DNA, 32 bp, Artificial Sequence
  Description of Artificial Sequence: Synthetic oligonucleotide
taagtgtcatttcttcaacgggacggagaggg

SEQ ID NO: 68295 - DNA, 31 bp, Artificial Sequence
  Description of Artificial Sequence: Synthetic oligonucleotide
aagtgtcatttcttcaacgggacggagaggg

SEQ ID NO: 68296 - DNA, 29 bp, Artificial Sequence
  Description of Artificial Sequence: Synthetic oligonucleotide
atttcttcaacgggacggagagggtgcag

SEQ ID NO: 68297 - DNA, 28 bp, Artificial Sequence
  Description of Artificial Sequence: Synthetic oligonucleotide
tttcttcaacgggacggagagggtgcag

SEQ ID NO: 68298 - DNA, 27 bp, Artificial Sequence
  Description of Artificial Sequence: Synthetic oligonucleotide
ttcttcaacgggacggagagggtgcag

SEQ ID NO: 68299 - DNA, 27 bp, Artificial Sequence
  Description of Artificial Sequence: Synthetic oligonucleotide
tcttcaacgggacggagagggtgcagt

SEQ ID NO: 68300 - DNA, 27 bp, Artificial Sequence
  Description of Artificial Sequence: Synthetic oligonucleotide
cttcaacgggacggagagggtgcagtt

SEQ ID NO: 68301 - DNA, 27 bp, Artificial Sequence
  Description of Artificial Sequence: Synthetic oligonucleotide
ttcaacgggacggagagggtgcagttc

SEQ ID NO: 68302 - DNA, 26 bp, Artificial Sequence
  Description of Artificial Sequence: Synthetic oligonucleotide
tcaacgggacggagagggtgcagttc

SEQ ID NO: 68303 - DNA, 25 bp, Artificial Sequence
  Description of Artificial Sequence: Synthetic oligonucleotide
caacgggacggagagggtgcagttc

SEQ ID NO: 68304 - DNA, 26 bp, Artificial Sequence
  Description of Artificial Sequence: Synthetic oligonucleotide
aacgggacggagagggtgcagttcct

SEQ ID NO: 68305 - DNA, 25 bp, Artificial Sequence
  Description of Artificial Sequence: Synthetic oligonucleotide
acgggacggagagggtgcagttcct

SEQ ID NO: 68306 - DNA, 24 bp, Artificial Sequence
  Description of Artificial Sequence: Synthetic oligonucleotide
cgggacggagagggtgcagttcct

SEQ ID NO: 68307 - DNA, 24 bp, Artificial Sequence
  Description of Artificial Sequence: Synthetic oligonucleotide
gggacggagagggtgcagttcctg

SEQ ID NO: 68308 - DNA, 27 bp, Artificial Sequence
  Description of Artificial Sequence: Synthetic oligonucleotide
ggacggagagggtgcagttcctggaaa

SEQ ID NO: 68309 - DNA, 27 bp, Artificial Sequence
  Description of Artificial Sequence: Synthetic oligonucleotide
gacggagagggtgcagttcctggaaag

SEQ ID NO: 68310 - DNA, 28 bp, Artificial Sequence
  Description of Artificial Sequence: Synthetic oligonucleotide
acggagagggtgcagttcctggaaagac

SEQ ID NO: 68311 - DNA, 27 bp, Artificial Sequence
  Description of Artificial Sequence: Synthetic oligonucleotide
cggagagggtgcagttcctggaaagac

SEQ ID NO: 68312 - DNA, 28 bp, Artificial Sequence
  Description of Artificial Sequence: Synthetic oligonucleotide
ggagagggtgcagttcctggaaagactc

SEQ ID NO: 68313 - DNA, 30 bp, Artificial Sequence
  Description of Artificial Sequence: Synthetic oligonucleotide
gagagggtgcagttcctggaaagactcttc

SEQ ID NO: 68314 - DNA, 35 bp, Artificial Sequence
  Description of Artificial Sequence: Synthetic oligonucleotide
agagggtgcagttcctggaaagactcttctataac

SEQ ID NO: 68315 - DNA, 34 bp, Artificial Sequence
  Description of Artificial Sequence: Synthetic oligonucleotide
gagggtgcagttcctggaaagactcttctataac

SEQ ID NO: 68316 - DNA, 34 bp, Artificial Sequence
  Description of Artificial Sequence: Synthetic oligonucleotide
agggtgcagttcctggaaagactcttctataacc

SEQ ID NO: 68317 - DNA, 27 bp, Artificial Sequence
  Description of Artificial Sequence: Synthetic oligonucleotide
acggagcgggtgcagttcctggaaagt

SEQ ID NO: 68318 - DNA, 26 bp, Artificial Sequence
  Description of Artificial Sequence: Synthetic oligonucleotide
cggagcgggtgcagttcctggaaagt

SEQ ID NO: 68319 - DNA, 27 bp, Artificial Sequence
  Description of Artificial Sequence: Synthetic oligonucleotide
ggagcgggtgcagttcctggaaagtct

SEQ ID NO: 68320 - DNA, 27 bp, Artificial Sequence
  Description of Artificial Sequence: Synthetic oligonucleotide
gagcgggtgcagttcctggaaagtctc

SEQ ID NO: 68321 - DNA, 29 bp, Artificial Sequence
  Description of Artificial Sequence: Synthetic oligonucleotide
agcgggtgcagttcctggaaagtctcttc

SEQ ID NO: 68322 - DNA, 28 bp, Artificial Sequence
  Description of Artificial Sequence: Synthetic oligonucleotide
gcgggtgcagttcctggaaagtctcttc

SEQ ID NO: 68323 - DNA, 33 bp, Artificial Sequence
  Description of Artificial Sequence: Synthetic oligonucleotide
cgggtgcagttcctggaaagtctcttctataac

SEQ ID NO: 68324 - DNA, 33 bp, Artificial Sequence
  Description of Artificial Sequence: Synthetic oligonucleotide
gggtgcagttcctggaaagtctcttctataacc

SEQ ID NO: 68325 - DNA, 34 bp, Artificial Sequence
  Description of Artificial Sequence: Synthetic oligonucleotide
ggtgcagttcctggaaagtctcttctataaccag

SEQ ID NO: 68326 - DNA, 34 bp, Artificial Sequence
  Description of Artificial Sequence: Synthetic oligonucleotide
gtgcagttcctggaaagtctcttctataaccagg

SEQ ID NO: 68327 - DNA, 35 bp, Artificial Sequence
  Description of Artificial Sequence: Synthetic oligonucleotide
tgcagttcctggaaagtctcttctataaccaggag

SEQ ID NO: 68328 - DNA, 34 bp, Artificial Sequence
  Description of Artificial Sequence: Synthetic oligonucleotide
gcagttcctggaaagtctcttctataaccaggag

SEQ ID NO: 68329 - DNA, 34 bp, Artificial Sequence
  Description of Artificial Sequence: Synthetic oligonucleotide
cagttcctggaaagtctcttctataaccaggagg

SEQ ID NO: 68330 - DNA, 35 bp, Artificial Sequence
  Description of Artificial Sequence: Synthetic oligonucleotide
agttcctggaaagtctcttctataaccaggaggag

SEQ ID NO: 68331 - DNA, 34 bp, Artificial Sequence
  Description of Artificial Sequence: Synthetic oligonucleotide
gttcctggaaagtctcttctataaccaggaggag

SEQ ID NO: 68332 - DNA, 36 bp, Artificial Sequence
  Description of Artificial Sequence: Synthetic oligonucleotide
ttcctggaaagtctcttctataaccaggaggagttc

SEQ ID NO: 68333 - DNA, 35 bp, Artificial Sequence
  Description of Artificial Sequence: Synthetic oligonucleotide
tcctggaaagtctcttctataaccaggaggagttc

SEQ ID NO: 68334 - DNA, 34 bp, Artificial Sequence
  Description of Artificial Sequence: Synthetic oligonucleotide
cctggaaagtctcttctataaccaggaggagttc

SEQ ID NO: 68335 - DNA, 34 bp, Artificial Sequence
  Description of Artificial Sequence: Synthetic oligonucleotide
ctggaaagtctcttctataaccaggaggagttcg

SEQ ID NO: 68336 - DNA, 35 bp, Artificial Sequence
  Description of Artificial Sequence: Synthetic oligonucleotide
tggaaagtctcttctataaccaggaggagttcgtg

SEQ ID NO: 68337 - DNA, 34 bp, Artificial Sequence
  Description of Artificial Sequence: Synthetic oligonucleotide
ggaaagtctcttctataaccaggaggagttcgtg

SEQ ID NO: 68338 - DNA, 34 bp, Artificial Sequence
  Description of Artificial Sequence: Synthetic oligonucleotide
gaaagtctcttctataaccaggaggagttcgtgc

SEQ ID NO: 68339 - DNA, 34 bp, Artificial Sequence
  Description of Artificial Sequence: Synthetic oligonucleotide
aaagtctcttctataaccaggaggagttcgtgcg

SEQ ID NO: 68340 - DNA, 33 bp, Artificial Sequence
  Description of Artificial Sequence: Synthetic oligonucleotide
aagtctcttctataaccaggaggagttcgtgcg

SEQ ID NO: 68341 - DNA, 32 bp, Artificial Sequence
  Description of Artificial Sequence: Synthetic oligonucleotide
agtctcttctataaccaggaggagttcgtgcg

SEQ ID NO: 68342 - DNA, 31 bp, Artificial Sequence
  Description of Artificial Sequence: Synthetic oligonucleotide
gtctcttctataaccaggaggagttcgtgcg

SEQ ID NO: 68343 - DNA, 31 bp, Artificial Sequence
  Description of Artificial Sequence: Synthetic oligonucleotide
tctcttctataaccaggaggagttcgtgcgc

SEQ ID NO: 68344 - DNA, 26 bp, Artificial Sequence
  Description of Artificial Sequence: Synthetic oligonucleotide
gacaggcggggccaggtggacaatta

SEQ ID NO: 68345 - DNA, 27 bp, Artificial Sequence
  Description of Artificial Sequence: Synthetic oligonucleotide
acaggcggggccaggtggacaattact

SEQ ID NO: 68346 - DNA, 26 bp, Artificial Sequence
  Description of Artificial Sequence: Synthetic oligonucleotide
caggcggggccaggtggacaattact

SEQ ID NO: 68347 - DNA, 26 bp, Artificial Sequence
  Description of Artificial Sequence: Synthetic oligonucleotide
aggcggggccaggtggacaattactg

SEQ ID NO: 68348 - DNA, 25 bp, Artificial Sequence
  Description of Artificial Sequence: Synthetic oligonucleotide
ggcggggccaggtggacaattactg

SEQ ID NO: 68349 - DNA, 24 bp, Artificial Sequence
  Description of Artificial Sequence: Synthetic oligonucleotide
ctgtcgccgagtcctggaacagcc

SEQ ID NO: 68350 - DNA, 24 bp, Artificial Sequence
  Description of Artificial Sequence: Synthetic oligonucleotide
tgtcgccgagtcctggaacagccg

SEQ ID NO: 68351 - DNA, 23 bp, Artificial Sequence
  Description of Artificial Sequence: Synthetic oligonucleotide
gtcgccgagtcctggaacagccg

SEQ ID NO: 68352 - DNA, 25 bp, Artificial Sequence
  Description of Artificial Sequence: Synthetic oligonucleotide
tcgccgagtcctggaacagccggaa

SEQ ID NO: 68353 - DNA, 24 bp, Artificial Sequence
  Description of Artificial Sequence: Synthetic oligonucleotide
cgccgagtcctggaacagccggaa

SEQ ID NO: 68354 - DNA, 24 bp, Artificial Sequence
  Description of Artificial Sequence: Synthetic oligonucleotide
gccgagtcctggaacagccggaag

SEQ ID NO: 68355 - DNA, 25 bp, Artificial Sequence
  Description of Artificial Sequence: Synthetic oligonucleotide
ccgagtcctggaacagccggaagga

SEQ ID NO: 68356 - DNA, 27 bp, Artificial Sequence
  Description of Artificial Sequence: Synthetic oligonucleotide
cgagtcctggaacagccggaaggacat

SEQ ID NO: 68357 - DNA, 27 bp, Artificial Sequence
  Description of Artificial Sequence: Synthetic oligonucleotide
gagtcctggaacagccggaaggacatc

SEQ ID NO: 68358 - DNA, 27 bp, Artificial Sequence
  Description of Artificial Sequence: Synthetic oligonucleotide
agtcctggaacagccggaaggacatcc

SEQ ID NO: 68359 - DNA, 27 bp, Artificial Sequence
  Description of Artificial Sequence: Synthetic oligonucleotide
gtcctggaacagccggaaggacatcct

SEQ ID NO: 68360 - DNA, 27 bp, Artificial Sequence
  Description of Artificial Sequence: Synthetic oligonucleotide
tcctggaacagccggaaggacatcctg

SEQ ID NO: 68361 - DNA, 26 bp, Artificial Sequence
  Description of Artificial Sequence: Synthetic oligonucleotide
cctggaacagccggaaggacatcctg

SEQ ID NO: 68362 - DNA, 27 bp, Artificial Sequence
  Description of Artificial Sequence: Synthetic oligonucleotide
ctggaacagccggaaggacatcctgga

SEQ ID NO: 68363 - DNA, 27 bp, Artificial Sequence
  Description of Artificial Sequence: Synthetic oligonucleotide
tggaacagccggaaggacatcctggag

SEQ ID NO: 68364 - DNA, 26 bp, Artificial Sequence
  Description of Artificial Sequence: Synthetic oligonucleotide
ggaacagccggaaggacatcctggag

SEQ ID NO: 68365 - DNA, 27 bp, Artificial Sequence
  Description of Artificial Sequence: Synthetic oligonucleotide
gaacagccggaaggacatcctggagga

SEQ ID NO: 68366 - DNA, 27 bp, Artificial Sequence
  Description of Artificial Sequence: Synthetic oligonucleotide
aacagccggaaggacatcctggaggac

SEQ ID NO: 68367 - DNA, 27 bp, Artificial Sequence
  Description of Artificial Sequence: Synthetic oligonucleotide
acagccggaaggacatcctggaggaca

SEQ ID NO: 68368 - DNA, 26 bp, Artificial Sequence
  Description of Artificial Sequence: Synthetic oligonucleotide
cagccggaaggacatcctggaggaca

SEQ ID NO: 68369 - DNA, 26 bp, Artificial Sequence
  Description of Artificial Sequence: Synthetic oligonucleotide
agccggaaggacatcctggaggacag

SEQ ID NO: 68370 - DNA, 25 bp, Artificial Sequence
  Description of Artificial Sequence: Synthetic oligonucleotide
gccggaaggacatcctggaggacag

SEQ ID NO: 68371 - DNA, 25 bp, Artificial Sequence
  Description of Artificial Sequence: Synthetic oligonucleotide
ccggaaggacatcctggaggacagg

SEQ ID NO: 68372 - DNA, 25 bp, Artificial Sequence
  Description of Artificial Sequence: Synthetic oligonucleotide
cggaaggacatcctggaggacaggc

SEQ ID NO: 68373 - DNA, 25 bp, Artificial Sequence
  Description of Artificial Sequence: Synthetic oligonucleotide
ggaaggacatcctggaggacaggcg

SEQ ID NO: 68374 - DNA, 22 bp, Artificial Sequence
  Description of Artificial Sequence: Synthetic oligonucleotide
gtgacggagctagggcggcctg

SEQ ID NO: 68375 - DNA, 23 bp, Artificial Sequence
  Description of Artificial Sequence: Synthetic oligonucleotide
tgacggagctagggcggcctgct

SEQ ID NO: 68376 - DNA, 22 bp, Artificial Sequence
  Description of Artificial Sequence: Synthetic oligonucleotide
gacggagctagggcggcctgct

SEQ ID NO: 68377 - DNA, 22 bp, Artificial Sequence
  Description of Artificial Sequence: Synthetic oligonucleotide
acggagctagggcggcctgctg

SEQ ID NO: 68378 - DNA, 21 bp, Artificial Sequence
  Description of Artificial Sequence: Synthetic oligonucleotide
cggagctagggcggcctgctg

SEQ ID NO: 68379 - DNA, 21 bp, Artificial Sequence
  Description of Artificial Sequence: Synthetic oligonucleotide
ggagctagggcggcctgctgc

SEQ ID NO: 68380 - DNA, 21 bp, Artificial Sequence
  Description of Artificial Sequence: Synthetic oligonucleotide
gagctagggcggcctgctgcg

SEQ ID NO: 68381 - DNA, 22 bp, Artificial Sequence
  Description of Artificial Sequence: Synthetic oligonucleotide
agctagggcggcctgctgcgga

SEQ ID NO: 68382 - DNA, 21 bp, Artificial Sequence
  Description of Artificial Sequence: Synthetic oligonucleotide
gctagggcggcctgctgcgga

SEQ ID NO: 68383 - DNA, 23 bp, Artificial Sequence
  Description of Artificial Sequence: Synthetic oligonucleotide
ctagggcggcctgctgcggagta

SEQ ID NO: 68384 - DNA, 24 bp, Artificial Sequence
  Description of Artificial Sequence: Synthetic oligonucleotide
tagggcggcctgctgcggagtact

SEQ ID NO: 68385 - DNA, 23 bp, Artificial Sequence
  Description of Artificial Sequence: Synthetic oligonucleotide
agggcggcctgctgcggagtact

SEQ ID NO: 68386 - DNA, 22 bp, Artificial Sequence
  Description of Artificial Sequence: Synthetic oligonucleotide
cgggcggtgacggagctagggt

SEQ ID NO: 68387 - DNA, 22 bp, Artificial Sequence
  Description of Artificial Sequence: Synthetic oligonucleotide
gggcggtgacggagctagggtg

SEQ ID NO: 68388 - DNA, 22 bp, Artificial Sequence
  Description of Artificial Sequence: Synthetic oligonucleotide
ggcggtgacggagctagggtgg

SEQ ID NO: 68389 - DNA, 22 bp, Artificial Sequence
  Description of Artificial Sequence: Synthetic oligonucleotide
gcggtgacggagctagggtggc

SEQ ID NO: 68390 - DNA, 23 bp, Artificial Sequence
  Description of Artificial Sequence: Synthetic oligonucleotide
cggtgacggagctagggtggcct

SEQ ID NO: 68391 - DNA, 24 bp, Artificial Sequence
  Description of Artificial Sequence: Synthetic oligonucleotide
ggtgacggagctagggtggcctgt

SEQ ID NO: 68392 - DNA, 24 bp, Artificial Sequence
  Description of Artificial Sequence: Synthetic oligonucleotide
gtgacggagctagggtggcctgtc

SEQ ID NO: 68393 - DNA, 24 bp, Artificial Sequence
  Description of Artificial Sequence: Synthetic oligonucleotide
tgacggagctagggtggcctgtcg

SEQ ID NO: 68394 - DNA, 23 bp, Artificial Sequence
  Description of Artificial Sequence: Synthetic oligonucleotide
gacggagctagggtggcctgtcg

SEQ ID NO: 68395 - DNA, 23 bp, Artificial Sequence
  Description of Artificial Sequence: Synthetic oligonucleotide
acggagctagggtggcctgtcgc

SEQ ID NO: 68396 - DNA, 22 bp, Artificial Sequence
  Description of Artificial Sequence: Synthetic oligonucleotide
cggagctagggtggcctgtcgc

SEQ ID NO: 68397 - DNA, 22 bp, Artificial Sequence
  Description of Artificial Sequence: Synthetic oligonucleotide
ggagctagggtggcctgtcgcc

SEQ ID NO: 68398 - DNA, 23 bp, Artificial Sequence
  Description of Artificial Sequence: Synthetic oligonucleotide
gagctagggtggcctgtcgccga

SEQ ID NO: 68399 - DNA, 24 bp, Artificial Sequence
  Description of Artificial Sequence: Synthetic oligonucleotide
agctagggtggcctgtcgccgagt

SEQ ID NO: 68400 - DNA, 23 bp, Artificial Sequence
  Description of Artificial Sequence: Synthetic oligonucleotide
gctagggtggcctgtcgccgagt

SEQ ID NO: 68401 - DNA, 23 bp, Artificial Sequence
  Description of Artificial Sequence: Synthetic oligonucleotide
ctagggtggcctgtcgccgagtc

SEQ ID NO: 68402 - DNA, 24 bp, Artificial Sequence
  Description of Artificial Sequence: Synthetic oligonucleotide
tagggtggcctgtcgccgagtcct

SEQ ID NO: 68403 - DNA, 23 bp, Artificial Sequence
  Description of Artificial Sequence: Synthetic oligonucleotide
agggtggcctgtcgccgagtcct

SEQ ID NO: 68404 - DNA, 22 bp, Artificial Sequence
  Description of Artificial Sequence: Synthetic oligonucleotide
gggtggcctgtcgccgagtcct

SEQ ID NO: 68405 - DNA, 22 bp, Artificial Sequence
  Description of Artificial Sequence: Synthetic oligonucleotide
ggtggcctgtcgccgagtcctg

SEQ ID NO: 68406 - DNA, 24 bp, Artificial Sequence
  Description of Artificial Sequence: Synthetic oligonucleotide
gtggcctgtcgccgagtcctggaa

SEQ ID NO: 68407 - DNA, 25 bp, Artificial Sequence
  Description of Artificial Sequence: Synthetic oligonucleotide
tggcctgtcgccgagtcctggaaca

SEQ ID NO: 68408 - DNA, 34 bp, Artificial Sequence
  Description of Artificial Sequence: Synthetic oligonucleotide
ttcctggaaagactcttctataaccaggaggagg

SEQ ID NO: 68409 - DNA, 33 bp, Artificial Sequence
  Description of Artificial Sequence: Synthetic oligonucleotide
tcctggaaagactcttctataaccaggaggagg

SEQ ID NO: 68410 - DNA, 32 bp, Artificial Sequence
  Description of Artificial Sequence: Synthetic oligonucleotide
cctggaaagactcttctataaccaggaggagg

SEQ ID NO: 68411 - DNA, 33 bp, Artificial Sequence
  Description of Artificial Sequence: Synthetic oligonucleotide
ctggaaagactcttctataaccaggaggaggtc

SEQ ID NO: 68412 - DNA, 33 bp, Artificial Sequence
  Description of Artificial Sequence: Synthetic oligonucleotide
tggaaagactcttctataaccaggaggaggtcg

SEQ ID NO: 68413 - DNA, 32 bp, Artificial Sequence
  Description of Artificial Sequence: Synthetic oligonucleotide
ggaaagactcttctataaccaggaggaggtcg

SEQ ID NO: 68414 - DNA, 33 bp, Artificial Sequence
  Description of Artificial Sequence: Synthetic oligonucleotide
gaaagactcttctataaccaggaggaggtcgtg

SEQ ID NO: 68415 - DNA, 33 bp, Artificial Sequence
  Description of Artificial Sequence: Synthetic oligonucleotide
aaagactcttctataaccaggaggaggtcgtgc

SEQ ID NO: 68416 - DNA, 32 bp, Artificial Sequence
  Description of Artificial Sequence: Synthetic oligonucleotide
aagactcttctataaccaggaggaggtcgtgc

SEQ ID NO: 68417 - DNA, 31 bp, Artificial Sequence
  Description of Artificial Sequence: Synthetic oligonucleotide
agactcttctataaccaggaggaggtcgtgc

SEQ ID NO: 68418 - DNA, 30 bp, Artificial Sequence
  Description of Artificial Sequence: Synthetic oligonucleotide
gactcttctataaccaggaggaggtcgtgc

SEQ ID NO: 68419 - DNA, 30 bp, Artificial Sequence
  Description of Artificial Sequence: Synthetic oligonucleotide
actcttctataaccaggaggaggtcgtgcg

SEQ ID NO: 68420 - DNA, 29 bp, Artificial Sequence
  Description of Artificial Sequence: Synthetic oligonucleotide
ctcttctataaccaggaggaggtcgtgcg

SEQ ID NO: 68421 - DNA, 29 bp, Artificial Sequence
  Description of Artificial Sequence: Synthetic oligonucleotide
tcttctataaccaggaggaggtcgtgcgc

SEQ ID NO: 68422 - DNA, 28 bp, Artificial Sequence
  Description of Artificial Sequence: Synthetic oligonucleotide
cttctataaccaggaggaggtcgtgcgc

SEQ ID NO: 68423 - DNA, 30 bp, Artificial Sequence
  Description of Artificial Sequence: Synthetic oligonucleotide
ttctataaccaggaggaggtcgtgcgcttc

SEQ ID NO: 68424 - DNA, 29 bp, Artificial Sequence
  Description of Artificial Sequence: Synthetic oligonucleotide
tctataaccaggaggaggtcgtgcgcttc

SEQ ID NO: 68425 - DNA, 28 bp, Artificial Sequence
  Description of Artificial Sequence: Synthetic oligonucleotide
ctataaccaggaggaggtcgtgcgcttc

SEQ ID NO: 68426 - DNA, 28 bp, Artificial Sequence
  Description of Artificial Sequence: Synthetic oligonucleotide
tataaccaggaggaggtcgtgcgcttcg

SEQ ID NO: 68427 - DNA, 27 bp, Artificial Sequence
  Description of Artificial Sequence: Synthetic oligonucleotide
ataaccaggaggaggtcgtgcgcttcg

SEQ ID NO: 68428 - DNA, 27 bp, Artificial Sequence
  Description of Artificial Sequence: Synthetic oligonucleotide
taaccaggaggaggtcgtgcgcttcga

SEQ ID NO: 68429 - DNA, 26 bp, Artificial Sequence
  Description of Artificial Sequence: Synthetic oligonucleotide
aaccaggaggaggtcgtgcgcttcga

SEQ ID NO: 68430 - DNA, 25 bp, Artificial Sequence
  Description of Artificial Sequence: Synthetic oligonucleotide
accaggaggaggtcgtgcgcttcga

SEQ ID NO: 68431 - DNA, 24 bp, Artificial Sequence
  Description of Artificial Sequence: Synthetic oligonucleotide
ccaggaggaggtcgtgcgcttcga

SEQ ID NO: 68432 - DNA, 25 bp, Artificial Sequence
  Description of Artificial Sequence: Synthetic oligonucleotide
caggaggaggtcgtgcgcttcgaca

SEQ ID NO: 68433 - DNA, 25 bp, Artificial Sequence
  Description of Artificial Sequence: Synthetic oligonucleotide
aggaggaggtcgtgcgcttcgacag

SEQ ID NO: 68434 - DNA, 24 bp, Artificial Sequence
  Description of Artificial Sequence: Synthetic oligonucleotide
ggaggaggtcgtgcgcttcgacag

SEQ ID NO: 68435 - DNA, 24 bp, Artificial Sequence
  Description of Artificial Sequence: Synthetic oligonucleotide
gaggaggtcgtgcgcttcgacagc

SEQ ID NO: 68436 - DNA, 25 bp, Artificial Sequence
  Description of Artificial Sequence: Synthetic oligonucleotide
aggaggtcgtgcgcttcgacagcga

SEQ ID NO: 68437 - DNA, 24 bp, Artificial Sequence
  Description of Artificial Sequence: Synthetic oligonucleotide
ggaggtcgtgcgcttcgacagcga

SEQ ID NO: 68438 - DNA, 24 bp, Artificial Sequence
  Description of Artificial Sequence: Synthetic oligonucleotide
gaggtcgtgcgcttcgacagcgac

SEQ ID NO: 68439 - DNA, 25 bp, Artificial Sequence
  Description of Artificial Sequence: Synthetic oligonucleotide
aggtcgtgcgcttcgacagcgacgt

SEQ ID NO: 68440 - DNA, 24 bp, Artificial Sequence
  Description of Artificial Sequence: Synthetic oligonucleotide
ggtcgtgcgcttcgacagcgacgt

SEQ ID NO: 68441 - DNA, 24 bp, Artificial Sequence
  Description of Artificial Sequence: Synthetic oligonucleotide
gtcgtgcgcttcgacagcgacgtg

SEQ ID NO: 68442 - DNA, 27 bp, Artificial Sequence
  Description of Artificial Sequence: Synthetic oligonucleotide
cggagcgggtgcagttcctggaaagat

SEQ ID NO: 68443 - DNA, 28 bp, Artificial Sequence
  Description of Artificial Sequence: Synthetic oligonucleotide
ggagcgggtgcagttcctggaaagattc

SEQ ID NO: 68444 - DNA, 30 bp, Artificial Sequence
  Description of Artificial Sequence: Synthetic oligonucleotide
gagcgggtgcagttcctggaaagattcttc

SEQ ID NO: 68445 - DNA, 35 bp, Artificial Sequence
  Description of Artificial Sequence: Synthetic oligonucleotide
agcgggtgcagttcctggaaagattcttctataac

SEQ ID NO: 68446 - DNA, 34 bp, Artificial Sequence
  Description of Artificial Sequence: Synthetic oligonucleotide
gcgggtgcagttcctggaaagattcttctataac

SEQ ID NO: 68447 - DNA, 34 bp, Artificial Sequence
  Description of Artificial Sequence: Synthetic oligonucleotide
cgggtgcagttcctggaaagattcttctataacc

SEQ ID NO: 68448 - DNA, 35 bp, Artificial Sequence
  Description of Artificial Sequence: Synthetic oligonucleotide
gggtgcagttcctggaaagattcttctataaccag

SEQ ID NO: 68449 - DNA, 35 bp, Artificial Sequence
  Description of Artificial Sequence: Synthetic oligonucleotide
ggtgcagttcctggaaagattcttctataaccagg

SEQ ID NO: 68450 - DNA, 36 bp, Artificial Sequence
  Description of Artificial Sequence: Synthetic oligonucleotide
gtgcagttcctggaaagattcttctataaccaggag

SEQ ID NO: 68451 - DNA, 36 bp, Artificial Sequence
  Description of Artificial Sequence: Synthetic oligonucleotide
tgcagttcctggaaagattcttctataaccaggagg

SEQ ID NO: 68452 - DNA, 35 bp, Artificial Sequence
  Description of Artificial Sequence: Synthetic oligonucleotide
gcagttcctggaaagattcttctataaccaggagg

SEQ ID NO: 68453 - DNA, 36 bp, Artificial Sequence
  Description of Artificial Sequence: Synthetic oligonucleotide
cagttcctggaaagattcttctataaccaggaggag

SEQ ID NO: 68454 - DNA, 38 bp, Artificial Sequence
  Description of Artificial Sequence: Synthetic oligonucleotide
agttcctggaaagattcttctataaccaggaggagttc

SEQ ID NO: 68455 - DNA, 37 bp, Artificial Sequence
  Description of Artificial Sequence: Synthetic oligonucleotide
gttcctggaaagattcttctataaccaggaggagttc

SEQ ID NO: 68456 - DNA, 37 bp, Artificial Sequence
  Description of Artificial Sequence: Synthetic oligonucleotide
ttcctggaaagattcttctataaccaggaggagttcg

SEQ ID NO: 68457 - DNA, 36 bp, Artificial Sequence
  Description of Artificial Sequence: Synthetic oligonucleotide
tcctggaaagattcttctataaccaggaggagttcg

SEQ ID NO: 68458 - DNA, 35 bp, Artificial Sequence
  Description of Artificial Sequence: Synthetic oligonucleotide
cctggaaagattcttctataaccaggaggagttcg

SEQ ID NO: 68459 - DNA, 36 bp, Artificial Sequence
  Description of Artificial Sequence: Synthetic oligonucleotide
ctggaaagattcttctataaccaggaggagttcgtg

SEQ ID NO: 68460 - DNA, 36 bp, Artificial Sequence
  Description of Artificial Sequence: Synthetic oligonucleotide
tggaaagattcttctataaccaggaggagttcgtgc

SEQ ID NO: 68461 - DNA, 35 bp, Artificial Sequence
  Description of Artificial Sequence: Synthetic oligonucleotide
ggaaagattcttctataaccaggaggagttcgtgc

SEQ ID NO: 68462 - DNA, 35 bp, Artificial Sequence
  Description of Artificial Sequence: Synthetic oligonucleotide
gaaagattcttctataaccaggaggagttcgtgcg

SEQ ID NO: 68463 - DNA, 35 bp, Artificial Sequence
  Description of Artificial Sequence: Synthetic oligonucleotide
aaagattcttctataaccaggaggagttcgtgcgc

SEQ ID NO: 68464 - DNA, 34 bp, Artificial Sequence
  Description of Artificial Sequence: Synthetic oligonucleotide
aagattcttctataaccaggaggagttcgtgcgc

SEQ ID NO: 68465 - DNA, 33 bp, Artificial Sequence
  Description of Artificial Sequence: Synthetic oligonucleotide
agattcttctataaccaggaggagttcgtgcgc

SEQ ID NO: 68466 - DNA, 32 bp, Artificial Sequence
  Description of Artificial Sequence: Synthetic oligonucleotide
gattcttctataaccaggaggagttcgtgcgc

SEQ ID NO: 68467 - DNA, 34 bp, Artificial Sequence
  Description of Artificial Sequence: Synthetic oligonucleotide
attcttctataaccaggaggagttcgtgcgcttc

SEQ ID NO: 68468 - DNA, 33 bp, Artificial Sequence
  Description of Artificial Sequence: Synthetic oligonucleotide
ttcttctataaccaggaggagttcgtgcgcttc

SEQ ID NO: 68469 - DNA, 28 bp, Artificial Sequence
  Description of Artificial Sequence: Synthetic oligonucleotide
gagcgggtgcagttcctggaaagacttc

SEQ ID NO: 68470 - DNA, 33 bp, Artificial Sequence
  Description of Artificial Sequence: Synthetic oligonucleotide
agcgggtgcagttcctggaaagacttctataac

SEQ ID NO: 68471 - DNA, 32 bp, Artificial Sequence
  Description of Artificial Sequence: Synthetic oligonucleotide
gcgggtgcagttcctggaaagacttctataac

SEQ ID NO: 68472 - DNA, 32 bp, Artificial Sequence
  Description of Artificial Sequence: Synthetic oligonucleotide
cgggtgcagttcctggaaagacttctataacc

SEQ ID NO: 68473 - DNA, 33 bp, Artificial Sequence
  Description of Artificial Sequence: Synthetic oligonucleotide
gggtgcagttcctggaaagacttctataaccag

SEQ ID NO: 68474 - DNA, 33 bp, Artificial Sequence
  Description of Artificial Sequence: Synthetic oligonucleotide
ggtgcagttcctggaaagacttctataaccagg

SEQ ID NO: 68475 - DNA, 34 bp, Artificial Sequence
  Description of Artificial Sequence: Synthetic oligonucleotide
gtgcagttcctggaaagacttctataaccaggag

SEQ ID NO: 68476 - DNA, 34 bp, Artificial Sequence
  Description of Artificial Sequence: Synthetic oligonucleotide
tgcagttcctggaaagacttctataaccaggagg

SEQ ID NO: 68477 - DNA, 33 bp, Artificial Sequence
  Description of Artificial Sequence: Synthetic oligonucleotide
gcagttcctggaaagacttctataaccaggagg

SEQ ID NO: 68478 - DNA, 34 bp, Artificial Sequence
  Description of Artificial Sequence: Synthetic oligonucleotide
cagttcctggaaagacttctataaccaggaggag

SEQ ID NO: 68479 - DNA, 36 bp, Artificial Sequence
  Description of Artificial Sequence: Synthetic oligonucleotide
agttcctggaaagacttctataaccaggaggagttc

SEQ ID NO: 68480 - DNA, 35 bp, Artificial Sequence
  Description of Artificial Sequence: Synthetic oligonucleotide
gttcctggaaagacttctataaccaggaggagttc

SEQ ID NO: 68481 - DNA, 35 bp, Artificial Sequence
  Description of Artificial Sequence: Synthetic oligonucleotide
ttcctggaaagacttctataaccaggaggagttcg

SEQ ID NO: 68482 - DNA, 34 bp, Artificial Sequence
  Description of Artificial Sequence: Synthetic oligonucleotide
tcctggaaagacttctataaccaggaggagttcg

SEQ ID NO: 68483 - DNA, 33 bp, Artificial Sequence
  Description of Artificial Sequence: Synthetic oligonucleotide
cctggaaagacttctataaccaggaggagttcg

SEQ ID NO: 68484 - DNA, 34 bp, Artificial Sequence
  Description of Artificial Sequence: Synthetic oligonucleotide
ctggaaagacttctataaccaggaggagttcgtg

SEQ ID NO: 68485 - DNA, 34 bp, Artificial Sequence
  Description of Artificial Sequence: Synthetic oligonucleotide
tggaaagacttctataaccaggaggagttcgtgc

SEQ ID NO: 68486 - DNA, 33 bp, Artificial Sequence
  Description of Artificial Sequence: Synthetic oligonucleotide
ggaaagacttctataaccaggaggagttcgtgc

SEQ ID NO: 68487 - DNA, 33 bp, Artificial Sequence
  Description of Artificial Sequence: Synthetic oligonucleotide
gaaagacttctataaccaggaggagttcgtgcg

SEQ ID NO: 68488 - DNA, 33 bp, Artificial Sequence
  Description of Artificial Sequence: Synthetic oligonucleotide
aaagacttctataaccaggaggagttcgtgcgc

SEQ ID NO: 68489 - DNA, 32 bp, Artificial Sequence
  Description of Artificial Sequence: Synthetic oligonucleotide
aagacttctataaccaggaggagttcgtgcgc

SEQ ID NO: 68490 - DNA, 31 bp, Artificial Sequence
  Description of Artificial Sequence: Synthetic oligonucleotide
agacttctataaccaggaggagttcgtgcgc

SEQ ID NO: 68491 - DNA, 30 bp, Artificial Sequence
  Description of Artificial Sequence: Synthetic oligonucleotide
gacttctataaccaggaggagttcgtgcgc

SEQ ID NO: 68492 - DNA, 32 bp, Artificial Sequence
  Description of Artificial Sequence: Synthetic oligonucleotide
acttctataaccaggaggagttcgtgcgcttc

SEQ ID NO: 68493 - DNA, 23 bp, Artificial Sequence
  Description of Artificial Sequence: Synthetic oligonucleotide
aggcggggccaggtggacaccta

SEQ ID NO: 68494 - DNA, 22 bp, Artificial Sequence
  Description of Artificial Sequence: Synthetic oligonucleotide
ggcggggccaggtggacaccta

SEQ ID NO: 68495 - DNA, 23 bp, Artificial Sequence
  Description of Artificial Sequence: Synthetic oligonucleotide
gcggggccaggtggacacctact

SEQ ID NO: 68496 - DNA, 23 bp, Artificial Sequence
  Description of Artificial Sequence: Synthetic oligonucleotide
cggggccaggtggacacctactg

SEQ ID NO: 68497 - DNA, 24 bp, Artificial Sequence
  Description of Artificial Sequence: Synthetic oligonucleotide
ggggccaggtggacacctactgca

SEQ ID NO: 68498 - DNA, 25 bp, Artificial Sequence
  Description of Artificial Sequence: Synthetic oligonucleotide
gggccaggtggacacctactgcaga

SEQ ID NO: 68499 - DNA, 26 bp, Artificial Sequence
  Description of Artificial Sequence: Synthetic oligonucleotide
ggccaggtggacacctactgcagaca

SEQ ID NO: 68500 - DNA, 27 bp, Artificial Sequence
  Description of Artificial Sequence: Synthetic oligonucleotide
gccaggtggacacctactgcagacaca

SEQ ID NO: 68501 - DNA, 28 bp, Artificial Sequence
  Description of Artificial Sequence: Synthetic oligonucleotide
ccaggtggacacctactgcagacacaac

SEQ ID NO: 68502 - DNA, 30 bp, Artificial Sequence
  Description of Artificial Sequence: Synthetic oligonucleotide
caggtggacacctactgcagacacaactac

SEQ ID NO: 68503 - DNA, 24 bp, Artificial Sequence
  Description of Artificial Sequence: Synthetic oligonucleotide
ggtgacggagctagggcggcctat

SEQ ID NO: 68504 - DNA, 24 bp, Artificial Sequence
  Description of Artificial Sequence: Synthetic oligonucleotide
gtgacggagctagggcggcctatc

SEQ ID NO: 68505 - DNA, 24 bp, Artificial Sequence
  Description of Artificial Sequence: Synthetic oligonucleotide
tgacggagctagggcggcctatcg

SEQ ID NO: 68506 - DNA, 23 bp, Artificial Sequence
  Description of Artificial Sequence: Synthetic oligonucleotide
gacggagctagggcggcctatcg

SEQ ID NO: 68507 - DNA, 23 bp, Artificial Sequence
  Description of Artificial Sequence: Synthetic oligonucleotide
acggagctagggcggcctatcgc

SEQ ID NO: 68508 - DNA, 22 bp, Artificial Sequence
  Description of Artificial Sequence: Synthetic oligonucleotide
cggagctagggcggcctatcgc

SEQ ID NO: 68509 - DNA, 22 bp, Artificial Sequence
  Description of Artificial Sequence: Synthetic oligonucleotide
ggagctagggcggcctatcgcc

SEQ ID NO: 68510 - DNA, 23 bp, Artificial Sequence
  Description of Artificial Sequence: Synthetic oligonucleotide
gagctagggcggcctatcgccga

SEQ ID NO: 68511 - DNA, 24 bp, Artificial Sequence
  Description of Artificial Sequence: Synthetic oligonucleotide
agctagggcggcctatcgccgagt

SEQ ID NO: 68512 - DNA, 23 bp, Artificial Sequence
  Description of Artificial Sequence: Synthetic oligonucleotide
gctagggcggcctatcgccgagt

SEQ ID NO: 68513 - DNA, 23 bp, Artificial Sequence
  Description of Artificial Sequence: Synthetic oligonucleotide
ctagggcggcctatcgccgagtc

SEQ ID NO: 68514 - DNA, 24 bp, Artificial Sequence
  Description of Artificial Sequence: Synthetic oligonucleotide
tagggcggcctatcgccgagtcct

SEQ ID NO: 68515 - DNA, 23 bp, Artificial Sequence
  Description of Artificial Sequence: Synthetic oligonucleotide
agggcggcctatcgccgagtcct

SEQ ID NO: 68516 - DNA, 22 bp, Artificial Sequence
  Description of Artificial Sequence: Synthetic oligonucleotide
gggcggcctatcgccgagtcct

SEQ ID NO: 68517 - DNA, 22 bp, Artificial Sequence
  Description of Artificial Sequence: Synthetic oligonucleotide
ggcggcctatcgccgagtcctg

SEQ ID NO: 68518 - DNA, 24 bp, Artificial Sequence
  Description of Artificial Sequence: Synthetic oligonucleotide
gcggcctatcgccgagtcctggaa

SEQ ID NO: 68519 - DNA, 25 bp, Artificial Sequence
  Description of Artificial Sequence: Synthetic oligonucleotide
cggcctatcgccgagtcctggaaca

SEQ ID NO: 68520 - DNA, 25 bp, Artificial Sequence
  Description of Artificial Sequence: Synthetic oligonucleotide
ggcctatcgccgagtcctggaacag

SEQ ID NO: 68521 - DNA, 25 bp, Artificial Sequence
  Description of Artificial Sequence: Synthetic oligonucleotide
gcctatcgccgagtcctggaacagc

SEQ ID NO: 68522 - DNA, 26 bp, Artificial Sequence
  Description of Artificial Sequence: Synthetic oligonucleotide
cctatcgccgagtcctggaacagcca

SEQ ID NO: 68523 - DNA, 27 bp, Artificial Sequence
  Description of Artificial Sequence: Synthetic oligonucleotide
ctatcgccgagtcctggaacagccaga

SEQ ID NO: 68524 - DNA, 28 bp, Artificial Sequence
  Description of Artificial Sequence: Synthetic oligonucleotide
tatcgccgagtcctggaacagccagaag

SEQ ID NO: 68525 - DNA, 27 bp, Artificial Sequence
  Description of Artificial Sequence: Synthetic oligonucleotide
atcgccgagtcctggaacagccagaag

SEQ ID NO: 68526 - DNA, 22 bp, Artificial Sequence
  Description of Artificial Sequence: Synthetic oligonucleotide
gggcggtgacggagctagggct

SEQ ID NO: 68527 - DNA, 22 bp, Artificial Sequence
  Description of Artificial Sequence: Synthetic oligonucleotide
ggcggtgacggagctagggctg

SEQ ID NO: 68528 - DNA, 22 bp, Artificial Sequence
  Description of Artificial Sequence: Synthetic oligonucleotide
gcggtgacggagctagggctgc

SEQ ID NO: 68529 - DNA, 23 bp, Artificial Sequence
  Description of Artificial Sequence: Synthetic oligonucleotide
cggtgacggagctagggctgcct

SEQ ID NO: 68530 - DNA, 24 bp, Artificial Sequence
  Description of Artificial Sequence: Synthetic oligonucleotide
ggtgacggagctagggctgcctgt

SEQ ID NO: 68531 - DNA, 24 bp, Artificial Sequence
  Description of Artificial Sequence: Synthetic oligonucleotide
gtgacggagctagggctgcctgtc

SEQ ID NO: 68532 - DNA, 24 bp, Artificial Sequence
  Description of Artificial Sequence: Synthetic oligonucleotide
tgacggagctagggctgcctgtcg

SEQ ID NO: 68533 - DNA, 23 bp, Artificial Sequence
  Description of Artificial Sequence: Synthetic oligonucleotide
gacggagctagggctgcctgtcg

SEQ ID NO: 68534 - DNA, 23 bp, Artificial Sequence
  Description of Artificial Sequence: Synthetic oligonucleotide
acggagctagggctgcctgtcgc

SEQ ID NO: 68535 - DNA, 22 bp, Artificial Sequence
  Description of Artificial Sequence: Synthetic oligonucleotide
cggagctagggctgcctgtcgc

SEQ ID NO: 68536 - DNA, 22 bp, Artificial Sequence
  Description of Artificial Sequence: Synthetic oligonucleotide
ggagctagggctgcctgtcgcc

SEQ ID NO: 68537 - DNA, 23 bp, Artificial Sequence
  Description of Artificial Sequence: Synthetic oligonucleotide
gagctagggctgcctgtcgccga

SEQ ID NO: 68538 - DNA, 24 bp, Artificial Sequence
  Description of Artificial Sequence: Synthetic oligonucleotide
agctagggctgcctgtcgccgagt

SEQ ID NO: 68539 - DNA, 23 bp, Artificial Sequence
  Description of Artificial Sequence: Synthetic oligonucleotide
gctagggctgcctgtcgccgagt

SEQ ID NO: 68540 - DNA, 23 bp, Artificial Sequence
  Description of Artificial Sequence: Synthetic oligonucleotide
ctagggctgcctgtcgccgagtc

SEQ ID NO: 68541 - DNA, 24 bp, Artificial Sequence
  Description of Artificial Sequence: Synthetic oligonucleotide
tagggctgcctgtcgccgagtcct

SEQ ID NO: 68542 - DNA, 23 bp, Artificial Sequence
  Description of Artificial Sequence: Synthetic oligonucleotide
agggctgcctgtcgccgagtcct

SEQ ID NO: 68543 - DNA, 22 bp, Artificial Sequence
  Description of Artificial Sequence: Synthetic oligonucleotide
gggctgcctgtcgccgagtcct

SEQ ID NO: 68544 - DNA, 22 bp, Artificial Sequence
  Description of Artificial Sequence: Synthetic oligonucleotide
ggctgcctgtcgccgagtcctg

SEQ ID NO: 68545 - DNA, 24 bp, Artificial Sequence
  Description of Artificial Sequence: Synthetic oligonucleotide
gctgcctgtcgccgagtcctggaa

SEQ ID NO: 68546 - DNA, 25 bp, Artificial Sequence
  Description of Artificial Sequence: Synthetic oligonucleotide
ctgcctgtcgccgagtcctggaaca

SEQ ID NO: 68547 - DNA, 25 bp, Artificial Sequence
  Description of Artificial Sequence: Synthetic oligonucleotide
tgcctgtcgccgagtcctggaacag

SEQ ID NO: 68548 - DNA, 34 bp, Artificial Sequence
  Description of Artificial Sequence: Synthetic oligonucleotide
tgcagttcctggaaagactcttctataaccaggg

SEQ ID NO: 68549 - DNA, 33 bp, Artificial Sequence
  Description of Artificial Sequence: Synthetic oligonucleotide
gcagttcctggaaagactcttctataaccaggg

SEQ ID NO: 68550 - DNA, 33 bp, Artificial Sequence
  Description of Artificial Sequence: Synthetic oligonucleotide
cagttcctggaaagactcttctataaccagggg

SEQ ID NO: 68551 - DNA, 33 bp, Artificial Sequence
  Description of Artificial Sequence: Synthetic oligonucleotide
agttcctggaaagactcttctataaccaggggg

SEQ ID NO: 68552 - DNA, 32 bp, Artificial Sequence
  Description of Artificial Sequence: Synthetic oligonucleotide
gttcctggaaagactcttctataaccaggggg

SEQ ID NO: 68553 - DNA, 33 bp, Artificial Sequence
  Description of Artificial Sequence: Synthetic oligonucleotide
ttcctggaaagactcttctataaccagggggag

SEQ ID NO: 68554 - DNA, 32 bp, Artificial Sequence
  Description of Artificial Sequence: Synthetic oligonucleotide
tcctggaaagactcttctataaccagggggag

SEQ ID NO: 68555 - DNA, 31 bp, Artificial Sequence
  Description of Artificial Sequence: Synthetic oligonucleotide
cctggaaagactcttctataaccagggggag

SEQ ID NO: 68556 - DNA, 33 bp, Artificial Sequence
  Description of Artificial Sequence: Synthetic oligonucleotide
ctggaaagactcttctataaccagggggagttc

SEQ ID NO: 68557 - DNA, 33 bp, Artificial Sequence
  Description of Artificial Sequence: Synthetic oligonucleotide
tggaaagactcttctataaccagggggagttcg

SEQ ID NO: 68558 - DNA, 32 bp, Artificial Sequence
  Description of Artificial Sequence: Synthetic oligonucleotide
ggaaagactcttctataaccagggggagttcg

SEQ ID NO: 68559 - DNA, 33 bp, Artificial Sequence
  Description of Artificial Sequence: Synthetic oligonucleotide
gaaagactcttctataaccagggggagttcgtg

SEQ ID NO: 68560 - DNA, 33 bp, Artificial Sequence
  Description of Artificial Sequence: Synthetic oligonucleotide
aaagactcttctataaccagggggagttcgtgc

SEQ ID NO: 68561 - DNA, 32 bp, Artificial Sequence
  Description of Artificial Sequence: Synthetic oligonucleotide
aagactcttctataaccagggggagttcgtgc

SEQ ID NO: 68562 - DNA, 31 bp, Artificial Sequence
  Description of Artificial Sequence: Synthetic oligonucleotide
agactcttctataaccagggggagttcgtgc

SEQ ID NO: 68563 - DNA, 30 bp, Artificial Sequence
  Description of Artificial Sequence: Synthetic oligonucleotide
gactcttctataaccagggggagttcgtgc

SEQ ID NO: 68564 - DNA, 30 bp, Artificial Sequence
  Description of Artificial Sequence: Synthetic oligonucleotide
actcttctataaccagggggagttcgtgcg

SEQ ID NO: 68565 - DNA, 29 bp, Artificial Sequence
  Description of Artificial Sequence: Synthetic oligonucleotide
ctcttctataaccagggggagttcgtgcg

SEQ ID NO: 68566 - DNA, 29 bp, Artificial Sequence
  Description of Artificial Sequence: Synthetic oligonucleotide
tcttctataaccagggggagttcgtgcgc

SEQ ID NO: 68567 - DNA, 28 bp, Artificial Sequence
  Description of Artificial Sequence: Synthetic oligonucleotide
cttctataaccagggggagttcgtgcgc

SEQ ID NO: 68568 - DNA, 30 bp, Artificial Sequence
  Description of Artificial Sequence: Synthetic oligonucleotide
ttctataaccagggggagttcgtgcgcttc

SEQ ID NO: 68569 - DNA, 29 bp, Artificial Sequence
  Description of Artificial Sequence: Synthetic oligonucleotide
tctataaccagggggagttcgtgcgcttc

SEQ ID NO: 68570 - DNA, 28 bp, Artificial Sequence
  Description of Artificial Sequence: Synthetic oligonucleotide
ctataaccagggggagttcgtgcgcttc

SEQ ID NO: 68571 - DNA, 28 bp, Artificial Sequence
  Description of Artificial Sequence: Synthetic oligonucleotide
tataaccagggggagttcgtgcgcttcg

SEQ ID NO: 68572 - DNA, 27 bp, Artificial Sequence
  Description of Artificial Sequence: Synthetic oligonucleotide
ataaccagggggagttcgtgcgcttcg

SEQ ID NO: 68573 - DNA, 27 bp, Artificial Sequence
  Description of Artificial Sequence: Synthetic oligonucleotide
taaccagggggagttcgtgcgcttcga

SEQ ID NO: 68574 - DNA, 26 bp, Artificial Sequence
  Description of Artificial Sequence: Synthetic oligonucleotide
aaccagggggagttcgtgcgcttcga

SEQ ID NO: 68575 - DNA, 25 bp, Artificial Sequence
  Description of Artificial Sequence: Synthetic oligonucleotide
accagggggagttcgtgcgcttcga

SEQ ID NO: 68576 - DNA, 24 bp, Artificial Sequence
  Description of Artificial Sequence: Synthetic oligonucleotide
ccagggggagttcgtgcgcttcga

SEQ ID NO: 68577 - DNA, 25 bp, Artificial Sequence
  Description of Artificial Sequence: Synthetic oligonucleotide
cagggggagttcgtgcgcttcgaca

SEQ ID NO: 68578 - DNA, 25 bp, Artificial Sequence
  Description of Artificial Sequence: Synthetic oligonucleotide
agggggagttcgtgcgcttcgacag

SEQ ID NO: 68579 - DNA, 24 bp, Artificial Sequence
  Description of Artificial Sequence: Synthetic oligonucleotide
gggggagttcgtgcgcttcgacag

SEQ ID NO: 68580 - DNA, 24 bp, Artificial Sequence
  Description of Artificial Sequence: Synthetic oligonucleotide
ggggagttcgtgcgcttcgacagc

SEQ ID NO: 68581 - DNA, 25 bp, Artificial Sequence
  Description of Artificial Sequence: Synthetic oligonucleotide
gggagttcgtgcgcttcgacagcga

SEQ ID NO: 68582 - DNA, 37 bp, Artificial Sequence
  Description of Artificial Sequence: Synthetic oligonucleotide
gcagggtaagtataagtgtcatttcttcaacgggaag

SEQ ID NO: 68583 - DNA, 37 bp, Artificial Sequence
  Description of Artificial Sequence: Synthetic oligonucleotide
cagggtaagtataagtgtcatttcttcaacgggaagg

SEQ ID NO: 68584 - DNA, 38 bp, Artificial Sequence
  Description of Artificial Sequence: Synthetic oligonucleotide
agggtaagtataagtgtcatttcttcaacgggaaggag

SEQ ID NO: 68585 - DNA, 37 bp, Artificial Sequence
  Description of Artificial Sequence: Synthetic oligonucleotide
gggtaagtataagtgtcatttcttcaacgggaaggag

SEQ ID NO: 68586 - DNA, 37 bp, Artificial Sequence
  Description of Artificial Sequence: Synthetic oligonucleotide
ggtaagtataagtgtcatttcttcaacgggaaggagc

SEQ ID NO: 68587 - DNA, 37 bp, Artificial Sequence
  Description of Artificial Sequence: Synthetic oligonucleotide
gtaagtataagtgtcatttcttcaacgggaaggagcg

SEQ ID NO: 68588 - DNA, 37 bp, Artificial Sequence
  Description of Artificial Sequence: Synthetic oligonucleotide
taagtataagtgtcatttcttcaacgggaaggagcgg

SEQ ID NO: 68589 - DNA, 36 bp, Artificial Sequence
  Description of Artificial Sequence: Synthetic oligonucleotide
aagtataagtgtcatttcttcaacgggaaggagcgg

SEQ ID NO: 68590 - DNA, 35 bp, Artificial Sequence
  Description of Artificial Sequence: Synthetic oligonucleotide
agtataagtgtcatttcttcaacgggaaggagcgg

SEQ ID NO: 68591 - DNA, 34 bp, Artificial Sequence
  Description of Artificial Sequence: Synthetic oligonucleotide
gtataagtgtcatttcttcaacgggaaggagcgg

SEQ ID NO: 68592 - DNA, 34 bp, Artificial Sequence
  Description of Artificial Sequence: Synthetic oligonucleotide
tataagtgtcatttcttcaacgggaaggagcggg

SEQ ID NO: 68593 - DNA, 33 bp, Artificial Sequence
  Description of Artificial Sequence: Synthetic oligonucleotide
ataagtgtcatttcttcaacgggaaggagcggg

SEQ ID NO: 68594 - DNA, 32 bp, Artificial Sequence
  Description of Artificial Sequence: Synthetic oligonucleotide
taagtgtcatttcttcaacgggaaggagcggg

SEQ ID NO: 68595 - DNA, 31 bp, Artificial Sequence
  Description of Artificial Sequence: Synthetic oligonucleotide
aagtgtcatttcttcaacgggaaggagcggg

SEQ ID NO: 68596 - DNA, 30 bp, Artificial Sequence
  Description of Artificial Sequence: Synthetic oligonucleotide
agtgtcatttcttcaacgggaaggagcggg

SEQ ID NO: 68597 - DNA, 29 bp, Artificial Sequence
  Description of Artificial Sequence: Synthetic oligonucleotide
gtgtcatttcttcaacgggaaggagcggg

SEQ ID NO: 68598 - DNA, 30 bp, Artificial Sequence
  Description of Artificial Sequence: Synthetic oligonucleotide
tgtcatttcttcaacgggaaggagcgggtg

SEQ ID NO: 68599 - DNA, 29 bp, Artificial Sequence
  Description of Artificial Sequence: Synthetic oligonucleotide
gtcatttcttcaacgggaaggagcgggtg

SEQ ID NO: 68600 - DNA, 29 bp, Artificial Sequence
  Description of Artificial Sequence: Synthetic oligonucleotide
tcatttcttcaacgggaaggagcgggtgc

SEQ ID NO: 68601 - DNA, 28 bp, Artificial Sequence
  Description of Artificial Sequence: Synthetic oligonucleotide
catttcttcaacgggaaggagcgggtgc

SEQ ID NO: 68602 - DNA, 29 bp, Artificial Sequence
  Description of Artificial Sequence: Synthetic oligonucleotide
atttcttcaacgggaaggagcgggtgcag

SEQ ID NO: 68603 - DNA, 28 bp, Artificial Sequence
  Description of Artificial Sequence: Synthetic oligonucleotide
tttcttcaacgggaaggagcgggtgcag

SEQ ID NO: 68604 - DNA, 27 bp, Artificial Sequence
  Description of Artificial Sequence: Synthetic oligonucleotide
ttcttcaacgggaaggagcgggtgcag

SEQ ID NO: 68605 - DNA, 27 bp, Artificial Sequence
  Description of Artificial Sequence: Synthetic oligonucleotide
tcttcaacgggaaggagcgggtgcagt

SEQ ID NO: 68606 - DNA, 27 bp, Artificial Sequence
  Description of Artificial Sequence: Synthetic oligonucleotide
cttcaacgggaaggagcgggtgcagtt

SEQ ID NO: 68607 - DNA, 27 bp, Artificial Sequence
  Description of Artificial Sequence: Synthetic oligonucleotide
ttcaacgggaaggagcgggtgcagttc

SEQ ID NO: 68608 - DNA, 26 bp, Artificial Sequence
  Description of Artificial Sequence: Synthetic oligonucleotide
tcaacgggaaggagcgggtgcagttc

SEQ ID NO: 68609 - DNA, 25 bp, Artificial Sequence
  Description of Artificial Sequence: Synthetic oligonucleotide
caacgggaaggagcgggtgcagttc

SEQ ID NO: 68610 - DNA, 26 bp, Artificial Sequence
  Description of Artificial Sequence: Synthetic oligonucleotide
aacgggaaggagcgggtgcagttcct

SEQ ID NO: 68611 - DNA, 25 bp, Artificial Sequence
  Description of Artificial Sequence: Synthetic oligonucleotide
acgggaaggagcgggtgcagttcct

SEQ ID NO: 68612 - DNA, 24 bp, Artificial Sequence
  Description of Artificial Sequence: Synthetic oligonucleotide
cgggaaggagcgggtgcagttcct

SEQ ID NO: 68613 - DNA, 24 bp, Artificial Sequence
  Description of Artificial Sequence: Synthetic oligonucleotide
gggaaggagcgggtgcagttcctg

SEQ ID NO: 68614 - DNA, 27 bp, Artificial Sequence
  Description of Artificial Sequence: Synthetic oligonucleotide
ggaaggagcgggtgcagttcctggaaa

SEQ ID NO: 68615 - DNA, 27 bp, Artificial Sequence
  Description of Artificial Sequence: Synthetic oligonucleotide
gaaggagcgggtgcagttcctggaaag

SEQ ID NO: 68616 - DNA, 28 bp, Artificial Sequence
  Description of Artificial Sequence: Synthetic oligonucleotide
aaggagcgggtgcagttcctggaaagac

SEQ ID NO: 68617 - DNA, 27 bp, Artificial Sequence
  Description of Artificial Sequence: Synthetic oligonucleotide
aggagcgggtgcagttcctggaaagac

SEQ ID NO: 68618 - DNA, 36 bp, Artificial Sequence
  Description of Artificial Sequence: Synthetic oligonucleotide
gtaagtataagtgtcatttcttcaacgggacggagg

SEQ ID NO: 68619 - DNA, 36 bp, Artificial Sequence
  Description of Artificial Sequence: Synthetic oligonucleotide
taagtataagtgtcatttcttcaacgggacggaggg

SEQ ID NO: 68620 - DNA, 35 bp, Artificial Sequence
  Description of Artificial Sequence: Synthetic oligonucleotide
aagtataagtgtcatttcttcaacgggacggaggg

SEQ ID NO: 68621 - DNA, 34 bp, Artificial Sequence
  Description of Artificial Sequence: Synthetic oligonucleotide
agtataagtgtcatttcttcaacgggacggaggg

SEQ ID NO: 68622 - DNA, 33 bp, Artificial Sequence
  Description of Artificial Sequence: Synthetic oligonucleotide
gtataagtgtcatttcttcaacgggacggaggg

SEQ ID NO: 68623 - DNA, 33 bp, Artificial Sequence
  Description of Artificial Sequence: Synthetic oligonucleotide
tataagtgtcatttcttcaacgggacggagggg

SEQ ID NO: 68624 - DNA, 32 bp, Artificial Sequence
  Description of Artificial Sequence: Synthetic oligonucleotide
ataagtgtcatttcttcaacgggacggagggg

SEQ ID NO: 68625 - DNA, 31 bp, Artificial Sequence
  Description of Artificial Sequence: Synthetic oligonucleotide
taagtgtcatttcttcaacgggacggagggg

SEQ ID NO: 68626 - DNA, 30 bp, Artificial Sequence
  Description of Artificial Sequence: Synthetic oligonucleotide
aagtgtcatttcttcaacgggacggagggg

SEQ ID NO: 68627 - DNA, 29 bp, Artificial Sequence
  Description of Artificial Sequence: Synthetic oligonucleotide
agtgtcatttcttcaacgggacggagggg

SEQ ID NO: 68628 - DNA, 28 bp, Artificial Sequence
  Description of Artificial Sequence: Synthetic oligonucleotide
gtgtcatttcttcaacgggacggagggg

SEQ ID NO: 68629 - DNA, 28 bp, Artificial Sequence
  Description of Artificial Sequence: Synthetic oligonucleotide
tgtcatttcttcaacgggacggaggggg

SEQ ID NO: 68630 - DNA, 27 bp, Artificial Sequence
  Description of Artificial Sequence: Synthetic oligonucleotide
gtcatttcttcaacgggacggaggggg

SEQ ID NO: 68631 - DNA, 28 bp, Artificial Sequence
  Description of Artificial Sequence: Synthetic oligonucleotide
tcatttcttcaacgggacggagggggtg

SEQ ID NO: 68632 - DNA, 27 bp, Artificial Sequence
  Description of Artificial Sequence: Synthetic oligonucleotide
catttcttcaacgggacggagggggtg

SEQ ID NO: 68633 - DNA, 27 bp, Artificial Sequence
  Description of Artificial Sequence: Synthetic oligonucleotide
atttcttcaacgggacggagggggtgc

SEQ ID NO: 68634 - DNA, 27 bp, Artificial Sequence
  Description of Artificial Sequence: Synthetic oligonucleotide
tttcttcaacgggacggagggggtgca

SEQ ID NO: 68635 - DNA, 26 bp, Artificial Sequence
  Description of Artificial Sequence: Synthetic oligonucleotide
ttcttcaacgggacggagggggtgca

SEQ ID NO: 68636 - DNA, 25 bp, Artificial Sequence
  Description of Artificial Sequence: Synthetic oligonucleotide
tcttcaacgggacggagggggtgca

SEQ ID NO: 68637 - DNA, 24 bp, Artificial Sequence
  Description of Artificial Sequence: Synthetic oligonucleotide
cttcaacgggacggagggggtgca

SEQ ID NO: 68638 - DNA, 26 bp, Artificial Sequence
  Description of Artificial Sequence: Synthetic oligonucleotide
ttcaacgggacggagggggtgcagtt

SEQ ID NO: 68639 - DNA, 25 bp, Artificial Sequence
  Description of Artificial Sequence: Synthetic oligonucleotide
tcaacgggacggagggggtgcagtt

SEQ ID NO: 68640 - DNA, 24 bp, Artificial Sequence
  Description of Artificial Sequence: Synthetic oligonucleotide
caacgggacggagggggtgcagtt

SEQ ID NO: 68641 - DNA, 24 bp, Artificial Sequence
  Description of Artificial Sequence: Synthetic oligonucleotide
aacgggacggagggggtgcagttc

SEQ ID NO: 68642 - DNA, 23 bp, Artificial Sequence
  Description of Artificial Sequence: Synthetic oligonucleotide
acgggacggagggggtgcagttc

SEQ ID NO: 68643 - DNA, 22 bp, Artificial Sequence
  Description of Artificial Sequence: Synthetic oligonucleotide
cgggacggagggggtgcagttc

SEQ ID NO: 68644 - DNA, 23 bp, Artificial Sequence
  Description of Artificial Sequence: Synthetic oligonucleotide
gggacggagggggtgcagttcct

SEQ ID NO: 68645 - DNA, 23 bp, Artificial Sequence
  Description of Artificial Sequence: Synthetic oligonucleotide
ggacggagggggtgcagttcctg

SEQ ID NO: 68646 - DNA, 26 bp, Artificial Sequence
  Description of Artificial Sequence: Synthetic oligonucleotide
gacggagggggtgcagttcctggaaa

SEQ ID NO: 68647 - DNA, 27 bp, Artificial Sequence
  Description of Artificial Sequence: Synthetic oligonucleotide
acggagggggtgcagttcctggaaaga

SEQ ID NO: 68648 - DNA, 26 bp, Artificial Sequence
  Description of Artificial Sequence: Synthetic oligonucleotide
cggagggggtgcagttcctggaaaga

SEQ ID NO: 68649 - DNA, 27 bp, Artificial Sequence
  Description of Artificial Sequence: Synthetic oligonucleotide
ggagggggtgcagttcctggaaagact

SEQ ID NO: 68650 - DNA, 27 bp, Artificial Sequence
  Description of Artificial Sequence: Synthetic oligonucleotide
gagggggtgcagttcctggaaagactc

SEQ ID NO: 68651 - DNA, 29 bp, Artificial Sequence
  Description of Artificial Sequence: Synthetic oligonucleotide
agggggtgcagttcctggaaagactcttc

SEQ ID NO: 68652 - DNA, 28 bp, Artificial Sequence
  Description of Artificial Sequence: Synthetic oligonucleotide
gggggtgcagttcctggaaagactcttc

SEQ ID NO: 68653 - DNA, 33 bp, Artificial Sequence
  Description of Artificial Sequence: Synthetic oligonucleotide
ggggtgcagttcctggaaagactcttctataac

SEQ ID NO: 68654 - DNA, 27 bp, Artificial Sequence
  Description of Artificial Sequence: Synthetic oligonucleotide
gccagaaggacatcctggaggacaggt

SEQ ID NO: 68655 - DNA, 27 bp, Artificial Sequence
  Description of Artificial Sequence: Synthetic oligonucleotide
ccagaaggacatcctggaggacaggtg

SEQ ID NO: 68656 - DNA, 27 bp, Artificial Sequence
  Description of Artificial Sequence: Synthetic oligonucleotide
cagaaggacatcctggaggacaggtgg

SEQ ID NO: 68657 - DNA, 27 bp, Artificial Sequence
  Description of Artificial Sequence: Synthetic oligonucleotide
agaaggacatcctggaggacaggtggg

SEQ ID NO: 68658 - DNA, 26 bp, Artificial Sequence
  Description of Artificial Sequence: Synthetic oligonucleotide
gaaggacatcctggaggacaggtggg

SEQ ID NO: 68659 - DNA, 26 bp, Artificial Sequence
  Description of Artificial Sequence: Synthetic oligonucleotide
aaggacatcctggaggacaggtgggg

SEQ ID NO: 68660 - DNA, 25 bp, Artificial Sequence
  Description of Artificial Sequence: Synthetic oligonucleotide
aggacatcctggaggacaggtgggg

SEQ ID NO: 68661 - DNA, 24 bp, Artificial Sequence
  Description of Artificial Sequence: Synthetic oligonucleotide
ggacatcctggaggacaggtgggg

SEQ ID NO: 68662 - DNA, 24 bp, Artificial Sequence
  Description of Artificial Sequence: Synthetic oligonucleotide
gacatcctggaggacaggtggggc

SEQ ID NO: 68663 - DNA, 25 bp, Artificial Sequence
  Description of Artificial Sequence: Synthetic oligonucleotide
acatcctggaggacaggtggggcca

SEQ ID NO: 68664 - DNA, 24 bp, Artificial Sequence
  Description of Artificial Sequence: Synthetic oligonucleotide
catcctggaggacaggtggggcca

SEQ ID NO: 68665 - DNA, 24 bp, Artificial Sequence
  Description of Artificial Sequence: Synthetic oligonucleotide
atcctggaggacaggtggggccag

SEQ ID NO: 68666 - DNA, 23 bp, Artificial Sequence
  Description of Artificial Sequence: Synthetic oligonucleotide
tcctggaggacaggtggggccag

SEQ ID NO: 68667 - DNA, 22 bp, Artificial Sequence
  Description of Artificial Sequence: Synthetic oligonucleotide
cctggaggacaggtggggccag

SEQ ID NO: 68668 - DNA, 23 bp, Artificial Sequence
  Description of Artificial Sequence: Synthetic oligonucleotide
ctggaggacaggtggggccaggt

SEQ ID NO: 68669 - DNA, 23 bp, Artificial Sequence
  Description of Artificial Sequence: Synthetic oligonucleotide
tggaggacaggtggggccaggtg

SEQ ID NO: 68670 - DNA, 22 bp, Artificial Sequence
  Description of Artificial Sequence: Synthetic oligonucleotide
ggaggacaggtggggccaggtg

SEQ ID NO: 68671 - DNA, 23 bp, Artificial Sequence
  Description of Artificial Sequence: Synthetic oligonucleotide
gaggacaggtggggccaggtgga

SEQ ID NO: 68672 - DNA, 24 bp, Artificial Sequence
  Description of Artificial Sequence: Synthetic oligonucleotide
aggacaggtggggccaggtggaca

SEQ ID NO: 68673 - DNA, 23 bp, Artificial Sequence
  Description of Artificial Sequence: Synthetic oligonucleotide
ggacaggtggggccaggtggaca

SEQ ID NO: 68674 - DNA, 23 bp, Artificial Sequence
  Description of Artificial Sequence: Synthetic oligonucleotide
gacaggtggggccaggtggacac

SEQ ID NO: 68675 - DNA, 23 bp, Artificial Sequence
  Description of Artificial Sequence: Synthetic oligonucleotide
acaggtggggccaggtggacacc

SEQ ID NO: 68676 - DNA, 22 bp, Artificial Sequence
  Description of Artificial Sequence: Synthetic oligonucleotide
caggtggggccaggtggacacc

SEQ ID NO: 68677 - DNA, 23 bp, Artificial Sequence
  Description of Artificial Sequence: Synthetic oligonucleotide
aggtggggccaggtggacaccgt

SEQ ID NO: 68678 - DNA, 22 bp, Artificial Sequence
  Description of Artificial Sequence: Synthetic oligonucleotide
ggtggggccaggtggacaccgt

SEQ ID NO: 68679 - DNA, 23 bp, Artificial Sequence
  Description of Artificial Sequence: Synthetic oligonucleotide
gtggggccaggtggacaccgtgt

SEQ ID NO: 68680 - DNA, 23 bp, Artificial Sequence
  Description of Artificial Sequence: Synthetic oligonucleotide
tggggccaggtggacaccgtgtg

SEQ ID NO: 68681 - DNA, 23 bp, Artificial Sequence
  Description of Artificial Sequence: Synthetic oligonucleotide
gacgtgggggagtaccgggcgtt

SEQ ID NO: 68682 - DNA, 24 bp, Artificial Sequence
  Description of Artificial Sequence: Synthetic oligonucleotide
acgtgggggagtaccgggcgttga

SEQ ID NO: 68683 - DNA, 23 bp, Artificial Sequence
  Description of Artificial Sequence: Synthetic oligonucleotide
cgtgggggagtaccgggcgttga

SEQ ID NO: 68684 - DNA, 23 bp, Artificial Sequence
  Description of Artificial Sequence: Synthetic oligonucleotide
gtgggggagtaccgggcgttgac

SEQ ID NO: 68685 - DNA, 23 bp, Artificial Sequence
  Description of Artificial Sequence: Synthetic oligonucleotide
tgggggagtaccgggcgttgacg

SEQ ID NO: 68686 - DNA, 22 bp, Artificial Sequence
  Description of Artificial Sequence: Synthetic oligonucleotide
gggggagtaccgggcgttgacg

SEQ ID NO: 68687 - DNA, 23 bp, Artificial Sequence
  Description of Artificial Sequence: Synthetic oligonucleotide
ggggagtaccgggcgttgacgga

SEQ ID NO: 68688 - DNA, 23 bp, Artificial Sequence
  Description of Artificial Sequence: Synthetic oligonucleotide
gggagtaccgggcgttgacggag

SEQ ID NO: 68689 - DNA, 25 bp, Artificial Sequence
  Description of Artificial Sequence: Synthetic oligonucleotide
ggagtaccgggcgttgacggagcta

SEQ ID NO: 68690 - DNA, 25 bp, Artificial Sequence
  Description of Artificial Sequence: Synthetic oligonucleotide
gagtaccgggcgttgacggagctag

SEQ ID NO: 68691 - DNA, 25 bp, Artificial Sequence
  Description of Artificial Sequence: Synthetic oligonucleotide
agtaccgggcgttgacggagctagg

SEQ ID NO: 68692 - DNA, 24 bp, Artificial Sequence
  Description of Artificial Sequence: Synthetic oligonucleotide
gtaccgggcgttgacggagctagg

SEQ ID NO: 68693 - DNA, 24 bp, Artificial Sequence
  Description of Artificial Sequence: Synthetic oligonucleotide
taccgggcgttgacggagctaggg

SEQ ID NO: 68694 - DNA, 23 bp, Artificial Sequence
  Description of Artificial Sequence: Synthetic oligonucleotide
accgggcgttgacggagctaggg

SEQ ID NO: 68695 - DNA, 22 bp, Artificial Sequence
  Description of Artificial Sequence: Synthetic oligonucleotide
ccgggcgttgacggagctaggg

SEQ ID NO: 68696 - DNA, 22 bp, Artificial Sequence
  Description of Artificial Sequence: Synthetic oligonucleotide
cgggcgttgacggagctagggc

SEQ ID NO: 68697 - DNA, 22 bp, Artificial Sequence
  Description of Artificial Sequence: Synthetic oligonucleotide
gggcgttgacggagctagggcg

SEQ ID NO: 68698 - DNA, 22 bp, Artificial Sequence
  Description of Artificial Sequence: Synthetic oligonucleotide
ggcgttgacggagctagggcgg

SEQ ID NO: 68699 - DNA, 22 bp, Artificial Sequence
  Description of Artificial Sequence: Synthetic oligonucleotide
gcgttgacggagctagggcggc

SEQ ID NO: 68700 - DNA, 23 bp, Artificial Sequence
  Description of Artificial Sequence: Synthetic oligonucleotide
cgttgacggagctagggcggcct

SEQ ID NO: 68701 - DNA, 24 bp, Artificial Sequence
  Description of Artificial Sequence: Synthetic oligonucleotide
gttgacggagctagggcggcctgt

SEQ ID NO: 68702 - DNA, 24 bp, Artificial Sequence
  Description of Artificial Sequence: Synthetic oligonucleotide
ttgacggagctagggcggcctgtc

SEQ ID NO: 68703 - DNA, 27 bp, Artificial Sequence
  Description of Artificial Sequence: Synthetic oligonucleotide
gggacacccgaccacgtttcttggagt

SEQ ID NO: 68704 - DNA, 28 bp, Artificial Sequence
  Description of Artificial Sequence: Synthetic oligonucleotide
ggacacccgaccacgtttcttggagtac

SEQ ID NO: 68705 - DNA, 29 bp, Artificial Sequence
  Description of Artificial Sequence: Synthetic oligonucleotide
gacacccgaccacgtttcttggagtactc

SEQ ID NO: 68706 - DNA, 31 bp, Artificial Sequence
  Description of Artificial Sequence: Synthetic oligonucleotide
acacccgaccacgtttcttggagtactctac

SEQ ID NO: 68707 - DNA, 30 bp, Artificial Sequence
  Description of Artificial Sequence: Synthetic oligonucleotide
cacccgaccacgtttcttggagtactctac

SEQ ID NO: 68708 - DNA, 30 bp, Artificial Sequence
  Description of Artificial Sequence: Synthetic oligonucleotide
acccgaccacgtttcttggagtactctacg

SEQ ID NO: 68709 - DNA, 29 bp, Artificial Sequence
  Description of Artificial Sequence: Synthetic oligonucleotide
cccgaccacgtttcttggagtactctacg

SEQ ID NO: 68710 - DNA, 29 bp, Artificial Sequence
  Description of Artificial Sequence: Synthetic oligonucleotide
ccgaccacgtttcttggagtactctacgg

SEQ ID NO: 68711 - DNA, 29 bp, Artificial Sequence
  Description of Artificial Sequence: Synthetic oligonucleotide
cgaccacgtttcttggagtactctacggg

SEQ ID NO: 68712 - DNA, 30 bp, Artificial Sequence
  Description of Artificial Sequence: Synthetic oligonucleotide
gaccacgtttcttggagtactctacgggtg

SEQ ID NO: 68713 - DNA, 31 bp, Artificial Sequence
  Description of Artificial Sequence: Synthetic oligonucleotide
accacgtttcttggagtactctacgggtgag

SEQ ID NO: 68714 - DNA, 30 bp, Artificial Sequence
  Description of Artificial Sequence: Synthetic oligonucleotide
ccacgtttcttggagtactctacgggtgag

SEQ ID NO: 68715 - DNA, 31 bp, Artificial Sequence
  Description of Artificial Sequence: Synthetic oligonucleotide
cacgtttcttggagtactctacgggtgagtg

SEQ ID NO: 68716 - DNA, 37 bp, Artificial Sequence
  Description of Artificial Sequence: Synthetic oligonucleotide
acgtttcttggagtactctacgggtgagtgttatttc

SEQ ID NO: 68717 - DNA, 36 bp, Artificial Sequence
  Description of Artificial Sequence: Synthetic oligonucleotide
cgtttcttggagtactctacgggtgagtgttatttc

SEQ ID NO: 68718 - DNA, 38 bp, Artificial Sequence
  Description of Artificial Sequence: Synthetic oligonucleotide
gtttcttggagtactctacgggtgagtgttatttcttc

SEQ ID NO: 68719 - DNA, 41 bp, Artificial Sequence
  Description of Artificial Sequence: Synthetic oligonucleotide
tttcttggagtactctacgggtgagtgttatttcttcaatg

SEQ ID NO: 68720 - DNA, 40 bp, Artificial Sequence
  Description of Artificial Sequence: Synthetic oligonucleotide
ttcttggagtactctacgggtgagtgttatttcttcaatg

SEQ ID NO: 68721 - DNA, 39 bp, Artificial Sequence
  Description of Artificial Sequence: Synthetic oligonucleotide
tcttggagtactctacgggtgagtgttatttcttcaatg

SEQ ID NO: 68722 - DNA, 38 bp, Artificial Sequence
  Description of Artificial Sequence: Synthetic oligonucleotide
cttggagtactctacgggtgagtgttatttcttcaatg

SEQ ID NO: 68723 - DNA, 38 bp, Artificial Sequence
  Description of Artificial Sequence: Synthetic oligonucleotide
ttggagtactctacgggtgagtgttatttcttcaatgg

SEQ ID NO: 68724 - DNA, 37 bp, Artificial Sequence
  Description of Artificial Sequence: Synthetic oligonucleotide
tggagtactctacgggtgagtgttatttcttcaatgg

SEQ ID NO: 68725 - DNA, 36 bp, Artificial Sequence
  Description of Artificial Sequence: Synthetic oligonucleotide
ggagtactctacgggtgagtgttatttcttcaatgg

SEQ ID NO: 68726 - DNA, 36 bp, Artificial Sequence
  Description of Artificial Sequence: Synthetic oligonucleotide
gagtactctacgggtgagtgttatttcttcaatggg

SEQ ID NO: 68727 - DNA, 37 bp, Artificial Sequence
  Description of Artificial Sequence: Synthetic oligonucleotide
agtactctacgggtgagtgttatttcttcaatgggac

SEQ ID NO: 68728 - DNA, 36 bp, Artificial Sequence
  Description of Artificial Sequence: Synthetic oligonucleotide
gtactctacgggtgagtgttatttcttcaatgggac

SEQ ID NO: 68729 - DNA, 36 bp, Artificial Sequence
  Description of Artificial Sequence: Synthetic oligonucleotide
tactctacgggtgagtgttatttcttcaatgggacg

SEQ ID NO: 68730 - DNA, 35 bp, Artificial Sequence
  Description of Artificial Sequence: Synthetic oligonucleotide
actctacgggtgagtgttatttcttcaatgggacg

SEQ ID NO: 68731 - DNA, 34 bp, Artificial Sequence
  Description of Artificial Sequence: Synthetic oligonucleotide
ctctacgggtgagtgttatttcttcaatgggacg

SEQ ID NO: 68732 - DNA, 34 bp, Artificial Sequence
  Description of Artificial Sequence: Synthetic oligonucleotide
tctacgggtgagtgttatttcttcaatgggacgg

SEQ ID NO: 68733 - DNA, 33 bp, Artificial Sequence
  Description of Artificial Sequence: Synthetic oligonucleotide
ctacgggtgagtgttatttcttcaatgggacgg

SEQ ID NO: 68734 - DNA, 34 bp, Artificial Sequence
  Description of Artificial Sequence: Synthetic oligonucleotide
tacgggtgagtgttatttcttcaatgggacggag

SEQ ID NO: 68735 - DNA, 33 bp, Artificial Sequence
  Description of Artificial Sequence: Synthetic oligonucleotide
acgggtgagtgttatttcttcaatgggacggag

SEQ ID NO: 68736 - DNA, 32 bp, Artificial Sequence
  Description of Artificial Sequence: Synthetic oligonucleotide
cgggtgagtgttatttcttcaatgggacggag

SEQ ID NO: 68737 - DNA, 32 bp, Artificial Sequence
  Description of Artificial Sequence: Synthetic oligonucleotide
gggtgagtgttatttcttcaatgggacggagc

SEQ ID NO: 68738 - DNA, 32 bp, Artificial Sequence
  Description of Artificial Sequence: Synthetic oligonucleotide
ggtgagtgttatttcttcaatgggacggagcg

SEQ ID NO: 68739 - DNA, 32 bp, Artificial Sequence
  Description of Artificial Sequence: Synthetic oligonucleotide
gtgagtgttatttcttcaatgggacggagcgg

SEQ ID NO: 68740 - DNA, 32 bp, Artificial Sequence
  Description of Artificial Sequence: Synthetic oligonucleotide
tgagtgttatttcttcaatgggacggagcggg

SEQ ID NO: 68741 - DNA, 31 bp, Artificial Sequence
  Description of Artificial Sequence: Synthetic oligonucleotide
gagtgttatttcttcaatgggacggagcggg

SEQ ID NO: 68742 - DNA, 32 bp, Artificial Sequence
  Description of Artificial Sequence: Synthetic oligonucleotide
agtgttatttcttcaatgggacggagcgggtg

SEQ ID NO: 68743 - DNA, 31 bp, Artificial Sequence
  Description of Artificial Sequence: Synthetic oligonucleotide
gtgttatttcttcaatgggacggagcgggtg

SEQ ID NO: 68744 - DNA, 31 bp, Artificial Sequence
  Description of Artificial Sequence: Synthetic oligonucleotide
tgttatttcttcaatgggacggagcgggtgc

SEQ ID NO: 68745 - DNA, 30 bp, Artificial Sequence
  Description of Artificial Sequence: Synthetic oligonucleotide
gttatttcttcaatgggacggagcgggtgc

SEQ ID NO: 68746 - DNA, 30 bp, Artificial Sequence
  Description of Artificial Sequence: Synthetic oligonucleotide
ttatttcttcaatgggacggagcgggtgcg

SEQ ID NO: 68747 - DNA, 29 bp, Artificial Sequence
  Description of Artificial Sequence: Synthetic oligonucleotide
tatttcttcaatgggacggagcgggtgcg

SEQ ID NO: 68748 - DNA, 25 bp, Artificial Sequence
  Description of Artificial Sequence: Synthetic oligonucleotide
agagcttcacggtgcagcggcgagt

SEQ ID NO: 68749 - DNA, 24 bp, Artificial Sequence
  Description of Artificial Sequence: Synthetic oligonucleotide
gagcttcacggtgcagcggcgagt

SEQ ID NO: 68750 - DNA, 24 bp, Artificial Sequence
  Description of Artificial Sequence: Synthetic oligonucleotide
agcttcacggtgcagcggcgagtc

SEQ ID NO: 68751 - DNA, 23 bp, Artificial Sequence
  Description of Artificial Sequence: Synthetic oligonucleotide
gcttcacggtgcagcggcgagtc

SEQ ID NO: 68752 - DNA, 25 bp, Artificial Sequence
  Description of Artificial Sequence: Synthetic oligonucleotide
cttcacggtgcagcggcgagtccat

SEQ ID NO: 68753 - DNA, 25 bp, Artificial Sequence
  Description of Artificial Sequence: Synthetic oligonucleotide
ttcacggtgcagcggcgagtccatc

SEQ ID NO: 68754 - DNA, 24 bp, Artificial Sequence
  Description of Artificial Sequence: Synthetic oligonucleotide
tcacggtgcagcggcgagtccatc

SEQ ID NO: 68755 - DNA, 23 bp, Artificial Sequence
  Description of Artificial Sequence: Synthetic oligonucleotide
cacggtgcagcggcgagtccatc

SEQ ID NO: 68756 - DNA, 26 bp, Artificial Sequence
  Description of Artificial Sequence: Synthetic oligonucleotide
acggtgcagcggcgagtccatcctaa

SEQ ID NO: 68757 - DNA, 25 bp, Artificial Sequence
  Description of Artificial Sequence: Synthetic oligonucleotide
cggtgcagcggcgagtccatcctaa

SEQ ID NO: 68758 - DNA, 25 bp, Artificial Sequence
  Description of Artificial Sequence: Synthetic oligonucleotide
ggtgcagcggcgagtccatcctaag

SEQ ID NO: 68759 - DNA, 25 bp, Artificial Sequence
  Description of Artificial Sequence: Synthetic oligonucleotide
acctgccaagtggagcacccaagcg

SEQ ID NO: 68760 - DNA, 27 bp, Artificial Sequence
  Description of Artificial Sequence: Synthetic oligonucleotide
gagcgggtgcggttcctggacagatat

SEQ ID NO: 68761 - DNA, 29 bp, Artificial Sequence
  Description of Artificial Sequence: Synthetic oligonucleotide
agcgggtgcggttcctggacagatatttc

SEQ ID NO: 68762 - DNA, 28 bp, Artificial Sequence
  Description of Artificial Sequence: Synthetic oligonucleotide
gcgggtgcggttcctggacagatatttc

SEQ ID NO: 68763 - DNA, 33 bp, Artificial Sequence
  Description of Artificial Sequence: Synthetic oligonucleotide
cgggtgcggttcctggacagatatttctataac

SEQ ID NO: 68764 - DNA, 33 bp, Artificial Sequence
  Description of Artificial Sequence: Synthetic oligonucleotide
gggtgcggttcctggacagatatttctataacc

SEQ ID NO: 68765 - DNA, 35 bp, Artificial Sequence
  Description of Artificial Sequence: Synthetic oligonucleotide
ggtgcggttcctggacagatatttctataaccaag

SEQ ID NO: 68766 - DNA, 36 bp, Artificial Sequence
  Description of Artificial Sequence: Synthetic oligonucleotide
gtgcggttcctggacagatatttctataaccaagag

SEQ ID NO: 68767 - DNA, 36 bp, Artificial Sequence
  Description of Artificial Sequence: Synthetic oligonucleotide
tgcggttcctggacagatatttctataaccaagagg

SEQ ID NO: 68768 - DNA, 35 bp, Artificial Sequence
  Description of Artificial Sequence: Synthetic oligonucleotide
gcggttcctggacagatatttctataaccaagagg

SEQ ID NO: 68769 - DNA, 36 bp, Artificial Sequence
  Description of Artificial Sequence: Synthetic oligonucleotide
cggttcctggacagatatttctataaccaagaggag

SEQ ID NO: 68770 - DNA, 38 bp, Artificial Sequence
  Description of Artificial Sequence: Synthetic oligonucleotide
ggttcctggacagatatttctataaccaagaggagtac

SEQ ID NO: 68771 - DNA, 38 bp, Artificial Sequence
  Description of Artificial Sequence: Synthetic oligonucleotide
gttcctggacagatatttctataaccaagaggagtacg

SEQ ID NO: 68772 - DNA, 39 bp, Artificial Sequence
  Description of Artificial Sequence: Synthetic oligonucleotide
ttcctggacagatatttctataaccaagaggagtacgtg

SEQ ID NO: 68773 - DNA, 38 bp, Artificial Sequence
  Description of Artificial Sequence: Synthetic oligonucleotide
tcctggacagatatttctataaccaagaggagtacgtg

SEQ ID NO: 68774 - DNA, 37 bp, Artificial Sequence
  Description of Artificial Sequence: Synthetic oligonucleotide
cctggacagatatttctataaccaagaggagtacgtg

SEQ ID NO: 68775 - DNA, 37 bp, Artificial Sequence
  Description of Artificial Sequence: Synthetic oligonucleotide
ctggacagatatttctataaccaagaggagtacgtgc

SEQ ID NO: 68776 - DNA, 37 bp, Artificial Sequence
  Description of Artificial Sequence: Synthetic oligonucleotide
tggacagatatttctataaccaagaggagtacgtgcg

SEQ ID NO: 68777 - DNA, 36 bp, Artificial Sequence
  Description of Artificial Sequence: Synthetic oligonucleotide
ggacagatatttctataaccaagaggagtacgtgcg

SEQ ID NO: 68778 - DNA, 36 bp, Artificial Sequence
  Description of Artificial Sequence: Synthetic oligonucleotide
gacagatatttctataaccaagaggagtacgtgcgc

SEQ ID NO: 68779 - DNA, 38 bp, Artificial Sequence
  Description of Artificial Sequence: Synthetic oligonucleotide
acagatatttctataaccaagaggagtacgtgcgcttc

SEQ ID NO: 68780 - DNA, 37 bp, Artificial Sequence
  Description of Artificial Sequence: Synthetic oligonucleotide
cagatatttctataaccaagaggagtacgtgcgcttc

SEQ ID NO: 68781 - DNA, 37 bp, Artificial Sequence
  Description of Artificial Sequence: Synthetic oligonucleotide
agatatttctataaccaagaggagtacgtgcgcttcg

SEQ ID NO: 68782 - DNA, 36 bp, Artificial Sequence
  Description of Artificial Sequence: Synthetic oligonucleotide
gatatttctataaccaagaggagtacgtgcgcttcg

SEQ ID NO: 68783 - DNA, 37 bp, Artificial Sequence
  Description of Artificial Sequence: Synthetic oligonucleotide
atatttctataaccaagaggagtacgtgcgcttcgac

SEQ ID NO: 68784 - DNA, 36 bp, Artificial Sequence
  Description of Artificial Sequence: Synthetic oligonucleotide
tatttctataaccaagaggagtacgtgcgcttcgac

SEQ ID NO: 68785 - DNA, 35 bp, Artificial Sequence
  Description of Artificial Sequence: Synthetic oligonucleotide
atttctataaccaagaggagtacgtgcgcttcgac

SEQ ID NO: 68786 - DNA, 34 bp, Artificial Sequence
  Description of Artificial Sequence: Synthetic oligonucleotide
tttctataaccaagaggagtacgtgcgcttcgac

SEQ ID NO: 68787 - DNA, 31 bp, Artificial Sequence
  Description of Artificial Sequence: Synthetic oligonucleotide
accagaccacgtttcttggagtactctacgg

SEQ ID NO: 68788 - DNA, 30 bp, Artificial Sequence
  Description of Artificial Sequence: Synthetic oligonucleotide
ccagaccacgtttcttggagtactctacgg

SEQ ID NO: 68789 - DNA, 30 bp, Artificial Sequence
  Description of Artificial Sequence: Synthetic oligonucleotide
cagaccacgtttcttggagtactctacggg

SEQ ID NO: 68790 - DNA, 31 bp, Artificial Sequence
  Description of Artificial Sequence: Synthetic oligonucleotide
agaccacgtttcttggagtactctacgggtg

SEQ ID NO: 68791 - DNA, 30 bp, Artificial Sequence
  Description of Artificial Sequence: Synthetic oligonucleotide
tgacaagccctctcacagtggaatggagtg

SEQ ID NO: 68792 - DNA, 29 bp, Artificial Sequence
  Description of Artificial Sequence: Synthetic oligonucleotide
gacaagccctctcacagtggaatggagtg

SEQ ID NO: 68793 - DNA, 29 bp, Artificial Sequence
  Description of Artificial Sequence: Synthetic oligonucleotide
acaagccctctcacagtggaatggagtgc

SEQ ID NO: 68794 - DNA, 28 bp, Artificial Sequence
  Description of Artificial Sequence: Synthetic oligonucleotide
caagccctctcacagtggaatggagtgc

SEQ ID NO: 68795 - DNA, 29 bp, Artificial Sequence
  Description of Artificial Sequence: Synthetic oligonucleotide
aagccctctcacagtggaatggagtgcac

SEQ ID NO: 68796 - DNA, 28 bp, Artificial Sequence
  Description of Artificial Sequence: Synthetic oligonucleotide
agccctctcacagtggaatggagtgcac

SEQ ID NO: 68797 - DNA, 27 bp, Artificial Sequence
  Description of Artificial Sequence: Synthetic oligonucleotide
gccctctcacagtggaatggagtgcac

SEQ ID NO: 68798 - DNA, 27 bp, Artificial Sequence
  Description of Artificial Sequence: Synthetic oligonucleotide
ccctctcacagtggaatggagtgcacg

SEQ ID NO: 68799 - DNA, 27 bp, Artificial Sequence
  Description of Artificial Sequence: Synthetic oligonucleotide
cctctcacagtggaatggagtgcacgg

SEQ ID NO: 68800 - DNA, 28 bp, Artificial Sequence
  Description of Artificial Sequence: Synthetic oligonucleotide
ctctcacagtggaatggagtgcacggtc

SEQ ID NO: 68801 - DNA, 29 bp, Artificial Sequence
  Description of Artificial Sequence: Synthetic oligonucleotide
tctcacagtggaatggagtgcacggtctg

SEQ ID NO: 68802 - DNA, 28 bp, Artificial Sequence
  Description of Artificial Sequence: Synthetic oligonucleotide
ctcacagtggaatggagtgcacggtctg

SEQ ID NO: 68803 - DNA, 31 bp, Artificial Sequence
  Description of Artificial Sequence: Synthetic oligonucleotide
tcacagtggaatggagtgcacggtctgaatc

SEQ ID NO: 68804 - DNA, 30 bp, Artificial Sequence
  Description of Artificial Sequence: Synthetic oligonucleotide
cacagtggaatggagtgcacggtctgaatc

SEQ ID NO: 68805 - DNA, 31 bp, Artificial Sequence
  Description of Artificial Sequence: Synthetic oligonucleotide
acagtggaatggagtgcacggtctgaatctg

SEQ ID NO: 68806 - DNA, 30 bp, Artificial Sequence
  Description of Artificial Sequence: Synthetic oligonucleotide
cagtggaatggagtgcacggtctgaatctg

SEQ ID NO: 68807 - DNA, 30 bp, Artificial Sequence
  Description of Artificial Sequence: Synthetic oligonucleotide
agtggaatggagtgcacggtctgaatctgc

SEQ ID NO: 68808 - DNA, 29 bp, Artificial Sequence
  Description of Artificial Sequence: Synthetic oligonucleotide
gtggaatggagtgcacggtctgaatctgc

SEQ ID NO: 68809 - DNA, 30 bp, Artificial Sequence
  Description of Artificial Sequence: Synthetic oligonucleotide
tggaatggagtgcacggtctgaatctgcac

SEQ ID NO: 68810 - DNA, 29 bp, Artificial Sequence
  Description of Artificial Sequence: Synthetic oligonucleotide
ggaatggagtgcacggtctgaatctgcac

SEQ ID NO: 68811 - DNA, 30 bp, Artificial Sequence
  Description of Artificial Sequence: Synthetic oligonucleotide
gaatggagtgcacggtctgaatctgcacag

SEQ ID NO: 68812 - DNA, 31 bp, Artificial Sequence
  Description of Artificial Sequence: Synthetic oligonucleotide
aatggagtgcacggtctgaatctgcacagag

SEQ ID NO: 68813 - DNA, 30 bp, Artificial Sequence
  Description of Artificial Sequence: Synthetic oligonucleotide
atggagtgcacggtctgaatctgcacagag

SEQ ID NO: 68814 - DNA, 29 bp, Artificial Sequence
  Description of Artificial Sequence: Synthetic oligonucleotide
tggagtgcacggtctgaatctgcacagag

SEQ ID NO: 68815 - DNA, 28 bp, Artificial Sequence
  Description of Artificial Sequence: Synthetic oligonucleotide
ggagtgcacggtctgaatctgcacagag

SEQ ID NO: 68816 - DNA, 28 bp, Artificial Sequence
  Description of Artificial Sequence: Synthetic oligonucleotide
gagtgcacggtctgaatctgcacagagc

SEQ ID NO: 68817 - DNA, 30 bp, Artificial Sequence
  Description of Artificial Sequence: Synthetic oligonucleotide
agtgcacggtctgaatctgcacagagcaag

SEQ ID NO: 68818 - DNA, 29 bp, Artificial Sequence
  Description of Artificial Sequence: Synthetic oligonucleotide
gtgcacggtctgaatctgcacagagcaag

SEQ ID NO: 68819 - DNA, 31 bp, Artificial Sequence
  Description of Artificial Sequence: Synthetic oligonucleotide
tgcacggtctgaatctgcacagagcaagatg

SEQ ID NO: 68820 - DNA, 40 bp, Artificial Sequence
  Description of Artificial Sequence: Synthetic oligonucleotide
tttcttggagtactctacgggtgagtgttatttcttcaac

SEQ ID NO: 68821 - DNA, 39 bp, Artificial Sequence
  Description of Artificial Sequence: Synthetic oligonucleotide
ttcttggagtactctacgggtgagtgttatttcttcaac

SEQ ID NO: 68822 - DNA, 38 bp, Artificial Sequence
  Description of Artificial Sequence: Synthetic oligonucleotide
tcttggagtactctacgggtgagtgttatttcttcaac

SEQ ID NO: 68823 - DNA, 37 bp, Artificial Sequence
  Description of Artificial Sequence: Synthetic oligonucleotide
cttggagtactctacgggtgagtgttatttcttcaac

SEQ ID NO: 68824 - DNA, 37 bp, Artificial Sequence
  Description of Artificial Sequence: Synthetic oligonucleotide
ttggagtactctacgggtgagtgttatttcttcaacg

SEQ ID NO: 68825 - DNA, 36 bp, Artificial Sequence
  Description of Artificial Sequence: Synthetic oligonucleotide
tggagtactctacgggtgagtgttatttcttcaacg

SEQ ID NO: 68826 - DNA, 35 bp, Artificial Sequence
  Description of Artificial Sequence: Synthetic oligonucleotide
ggagtactctacgggtgagtgttatttcttcaacg

SEQ ID NO: 68827 - DNA, 35 bp, Artificial Sequence
  Description of Artificial Sequence: Synthetic oligonucleotide
gagtactctacgggtgagtgttatttcttcaacgg

SEQ ID NO: 68828 - DNA, 35 bp, Artificial Sequence
  Description of Artificial Sequence: Synthetic oligonucleotide
agtactctacgggtgagtgttatttcttcaacggg

SEQ ID NO: 68829 - DNA, 34 bp, Artificial Sequence
  Description of Artificial Sequence: Synthetic oligonucleotide
gtactctacgggtgagtgttatttcttcaacggg

SEQ ID NO: 68830 - DNA, 35 bp, Artificial Sequence
  Description of Artificial Sequence: Synthetic oligonucleotide
tactctacgggtgagtgttatttcttcaacgggac

SEQ ID NO: 68831 - DNA, 34 bp, Artificial Sequence
  Description of Artificial Sequence: Synthetic oligonucleotide
actctacgggtgagtgttatttcttcaacgggac

SEQ ID NO: 68832 - DNA, 33 bp, Artificial Sequence
  Description of Artificial Sequence: Synthetic oligonucleotide
ctctacgggtgagtgttatttcttcaacgggac

SEQ ID NO: 68833 - DNA, 33 bp, Artificial Sequence
  Description of Artificial Sequence: Synthetic oligonucleotide
tctacgggtgagtgttatttcttcaacgggacg

SEQ ID NO: 68834 - DNA, 32 bp, Artificial Sequence
  Description of Artificial Sequence: Synthetic oligonucleotide
ctacgggtgagtgttatttcttcaacgggacg

SEQ ID NO: 68835 - DNA, 32 bp, Artificial Sequence
  Description of Artificial Sequence: Synthetic oligonucleotide
tacgggtgagtgttatttcttcaacgggacgg

SEQ ID NO: 68836 - DNA, 31 bp, Artificial Sequence
  Description of Artificial Sequence: Synthetic oligonucleotide
acgggtgagtgttatttcttcaacgggacgg

SEQ ID NO: 68837 - DNA, 30 bp, Artificial Sequence
  Description of Artificial Sequence: Synthetic oligonucleotide
cgggtgagtgttatttcttcaacgggacgg

SEQ ID NO: 68838 - DNA, 31 bp, Artificial Sequence
  Description of Artificial Sequence: Synthetic oligonucleotide
gggtgagtgttatttcttcaacgggacggag

SEQ ID NO: 68839 - DNA, 31 bp, Artificial Sequence
  Description of Artificial Sequence: Synthetic oligonucleotide
ggtgagtgttatttcttcaacgggacggagc

SEQ ID NO: 68840 - DNA, 31 bp, Artificial Sequence
  Description of Artificial Sequence: Synthetic oligonucleotide
gtgagtgttatttcttcaacgggacggagcg

SEQ ID NO: 68841 - DNA, 31 bp, Artificial Sequence
  Description of Artificial Sequence: Synthetic oligonucleotide
tgagtgttatttcttcaacgggacggagcgg

SEQ ID NO: 68842 - DNA, 30 bp, Artificial Sequence
  Description of Artificial Sequence: Synthetic oligonucleotide
gagtgttatttcttcaacgggacggagcgg

SEQ ID NO: 68843 - DNA, 30 bp, Artificial Sequence
  Description of Artificial Sequence: Synthetic oligonucleotide
agtgttatttcttcaacgggacggagcggg

SEQ ID NO: 68844 - DNA, 29 bp, Artificial Sequence
  Description of Artificial Sequence: Synthetic oligonucleotide
gtgttatttcttcaacgggacggagcggg

SEQ ID NO: 68845 - DNA, 30 bp, Artificial Sequence
  Description of Artificial Sequence: Synthetic oligonucleotide
tgttatttcttcaacgggacggagcgggtg

SEQ ID NO: 68846 - DNA, 29 bp, Artificial Sequence
  Description of Artificial Sequence: Synthetic oligonucleotide
gttatttcttcaacgggacggagcgggtg

SEQ ID NO: 68847 - DNA, 29 bp, Artificial Sequence
  Description of Artificial Sequence: Synthetic oligonucleotide
ttatttcttcaacgggacggagcgggtgc

SEQ ID NO: 68848 - DNA, 28 bp, Artificial Sequence
  Description of Artificial Sequence: Synthetic oligonucleotide
tatttcttcaacgggacggagcgggtgc

SEQ ID NO: 68849 - DNA, 23 bp, Artificial Sequence
  Description of Artificial Sequence: Synthetic oligonucleotide
tgggggagtaccgggcggtgaca

SEQ ID NO: 68850 - DNA, 22 bp, Artificial Sequence
  Description of Artificial Sequence: Synthetic oligonucleotide
gggggagtaccgggcggtgaca

SEQ ID NO: 68851 - DNA, 23 bp, Artificial Sequence
  Description of Artificial Sequence: Synthetic oligonucleotide
ggggagtaccgggcggtgacaga

SEQ ID NO: 68852 - DNA, 23 bp, Artificial Sequence
  Description of Artificial Sequence: Synthetic oligonucleotide
gggagtaccgggcggtgacagag

SEQ ID NO: 68853 - DNA, 24 bp, Artificial Sequence
  Description of Artificial Sequence: Synthetic oligonucleotide
ggagtaccgggcggtgacagagct

SEQ ID NO: 68854 - DNA, 24 bp, Artificial Sequence
  Description of Artificial Sequence: Synthetic oligonucleotide
gagtaccgggcggtgacagagctg

SEQ ID NO: 68855 - DNA, 24 bp, Artificial Sequence
  Description of Artificial Sequence: Synthetic oligonucleotide
agtaccgggcggtgacagagctgg

SEQ ID NO: 68856 - DNA, 23 bp, Artificial Sequence
  Description of Artificial Sequence: Synthetic oligonucleotide
gtaccgggcggtgacagagctgg

SEQ ID NO: 68857 - DNA, 23 bp, Artificial Sequence
  Description of Artificial Sequence: Synthetic oligonucleotide
taccgggcggtgacagagctggg

SEQ ID NO: 68858 - DNA, 22 bp, Artificial Sequence
  Description of Artificial Sequence: Synthetic oligonucleotide
accgggcggtgacagagctggg

SEQ ID NO: 68859 - DNA, 36 bp, Artificial Sequence
  Description of Artificial Sequence: Synthetic oligonucleotide
atctacttcaggaatcagaaaggacactctggactc

SEQ ID NO: 68860 - DNA, 35 bp, Artificial Sequence
  Description of Artificial Sequence: Synthetic oligonucleotide
tctacttcaggaatcagaaaggacactctggactc

SEQ ID NO: 68861 - DNA, 34 bp, Artificial Sequence
  Description of Artificial Sequence: Synthetic oligonucleotide
ctacttcaggaatcagaaaggacactctggactc

SEQ ID NO: 68862 - DNA, 34 bp, Artificial Sequence
  Description of Artificial Sequence: Synthetic oligonucleotide
tacttcaggaatcagaaaggacactctggactcc

SEQ ID NO: 68863 - DNA, 33 bp, Artificial Sequence
  Description of Artificial Sequence: Synthetic oligonucleotide
acttcaggaatcagaaaggacactctggactcc

SEQ ID NO: 68864 - DNA, 32 bp, Artificial Sequence
  Description of Artificial Sequence: Synthetic oligonucleotide
cttcaggaatcagaaaggacactctggactcc

SEQ ID NO: 68865 - DNA, 33 bp, Artificial Sequence
  Description of Artificial Sequence: Synthetic oligonucleotide
ttcaggaatcagaaaggacactctggactccag

SEQ ID NO: 68866 - DNA, 32 bp, Artificial Sequence
  Description of Artificial Sequence: Synthetic oligonucleotide
tcaggaatcagaaaggacactctggactccag

SEQ ID NO: 68867 - DNA, 31 bp, Artificial Sequence
  Description of Artificial Sequence: Synthetic oligonucleotide
caggaatcagaaaggacactctggactccag

SEQ ID NO: 68868 - DNA, 31 bp, Artificial Sequence
  Description of Artificial Sequence: Synthetic oligonucleotide
aggaatcagaaaggacactctggactccagc

SEQ ID NO: 68869 - DNA, 30 bp, Artificial Sequence
  Description of Artificial Sequence: Synthetic oligonucleotide
ggaatcagaaaggacactctggactccagc

SEQ ID NO: 68870 - DNA, 30 bp, Artificial Sequence
  Description of Artificial Sequence: Synthetic oligonucleotide
gaatcagaaaggacactctggactccagcc

SEQ ID NO: 68871 - DNA, 32 bp, Artificial Sequence
  Description of Artificial Sequence: Synthetic oligonucleotide
aatcagaaaggacactctggactccagccaac

SEQ ID NO: 68872 - DNA, 31 bp, Artificial Sequence
  Description of Artificial Sequence: Synthetic oligonucleotide
atcagaaaggacactctggactccagccaac

SEQ ID NO: 68873 - DNA, 30 bp, Artificial Sequence
  Description of Artificial Sequence: Synthetic oligonucleotide
tcagaaaggacactctggactccagccaac

SEQ ID NO: 68874 - DNA, 29 bp, Artificial Sequence
  Description of Artificial Sequence: Synthetic oligonucleotide
cagaaaggacactctggactccagccaac

SEQ ID NO: 68875 - DNA, 30 bp, Artificial Sequence
  Description of Artificial Sequence: Synthetic oligonucleotide
agaaaggacactctggactccagccaacag

SEQ ID NO: 68876 - DNA, 29 bp, Artificial Sequence
  Description of Artificial Sequence: Synthetic oligonucleotide
gaaaggacactctggactccagccaacag

SEQ ID NO: 68877 - DNA, 29 bp, Artificial Sequence
  Description of Artificial Sequence: Synthetic oligonucleotide
aaaggacactctggactccagccaacagg

SEQ ID NO: 68878 - DNA, 28 bp, Artificial Sequence
  Description of Artificial Sequence: Synthetic oligonucleotide
aaggacactctggactccagccaacagg

SEQ ID NO: 68879 - DNA, 27 bp, Artificial Sequence
  Description of Artificial Sequence: Synthetic oligonucleotide
aggacactctggactccagccaacagg

SEQ ID NO: 68880 - DNA, 27 bp, Artificial Sequence
  Description of Artificial Sequence: Synthetic oligonucleotide
ggacactctggactccagccaacagga

SEQ ID NO: 68881 - DNA, 29 bp, Artificial Sequence
  Description of Artificial Sequence: Synthetic oligonucleotide
gacactctggactccagccaacaggattc

SEQ ID NO: 68882 - DNA, 29 bp, Artificial Sequence
  Description of Artificial Sequence: Synthetic oligonucleotide
acactctggactccagccaacaggattcc

SEQ ID NO: 68883 - DNA, 28 bp, Artificial Sequence
  Description of Artificial Sequence: Synthetic oligonucleotide
cactctggactccagccaacaggattcc

SEQ ID NO: 68884 - DNA, 29 bp, Artificial Sequence
  Description of Artificial Sequence: Synthetic oligonucleotide
actctggactccagccaacaggattcctg

SEQ ID NO: 68885 - DNA, 28 bp, Artificial Sequence
  Description of Artificial Sequence: Synthetic oligonucleotide
ctctggactccagccaacaggattcctg

SEQ ID NO: 68886 - DNA, 29 bp, Artificial Sequence
  Description of Artificial Sequence: Synthetic oligonucleotide
tctggactccagccaacaggattcctgag

SEQ ID NO: 68887 - DNA, 28 bp, Artificial Sequence
  Description of Artificial Sequence: Synthetic oligonucleotide
ctggactccagccaacaggattcctgag

SEQ ID NO: 68888 - DNA, 28 bp, Artificial Sequence
  Description of Artificial Sequence: Synthetic oligonucleotide
tggactccagccaacaggattcctgagc

SEQ ID NO: 68889 - DNA, 27 bp, Artificial Sequence
  Description of Artificial Sequence: Synthetic oligonucleotide
ggactccagccaacaggattcctgagc

SEQ ID NO: 68890 - DNA, 28 bp, Artificial Sequence
  Description of Artificial Sequence: Synthetic oligonucleotide
gactccagccaacaggattcctgagctg

SEQ ID NO: 68891 - DNA, 31 bp, Artificial Sequence
  Description of Artificial Sequence: Synthetic oligonucleotide
acctactgcagacacaactacggggttgttg

SEQ ID NO: 68892 - DNA, 30 bp, Artificial Sequence
  Description of Artificial Sequence: Synthetic oligonucleotide
cctactgcagacacaactacggggttgttg

SEQ ID NO: 68893 - DNA, 31 bp, Artificial Sequence
  Description of Artificial Sequence: Synthetic oligonucleotide
ctactgcagacacaactacggggttgttgag

SEQ ID NO: 68894 - DNA, 32 bp, Artificial Sequence
  Description of Artificial Sequence: Synthetic oligonucleotide
tactgcagacacaactacggggttgttgagag

SEQ ID NO: 68895 - DNA, 31 bp, Artificial Sequence
  Description of Artificial Sequence: Synthetic oligonucleotide
actgcagacacaactacggggttgttgagag

SEQ ID NO: 68896 - DNA, 30 bp, Artificial Sequence
  Description of Artificial Sequence: Synthetic oligonucleotide
ctgcagacacaactacggggttgttgagag

SEQ ID NO: 68897 - DNA, 30 bp, Artificial Sequence
  Description of Artificial Sequence: Synthetic oligonucleotide
tgcagacacaactacggggttgttgagagc

SEQ ID NO: 68898 - DNA, 29 bp, Artificial Sequence
  Description of Artificial Sequence: Synthetic oligonucleotide
gcagacacaactacggggttgttgagagc

SEQ ID NO: 68899 - DNA, 31 bp, Artificial Sequence
  Description of Artificial Sequence: Synthetic oligonucleotide
cagacacaactacggggttgttgagagcttc

SEQ ID NO: 68900 - DNA, 32 bp, Artificial Sequence
  Description of Artificial Sequence: Synthetic oligonucleotide
agacacaactacggggttgttgagagcttcac

SEQ ID NO: 68901 - DNA, 31 bp, Artificial Sequence
  Description of Artificial Sequence: Synthetic oligonucleotide
gacacaactacggggttgttgagagcttcac

SEQ ID NO: 68902 - DNA, 32 bp, Artificial Sequence
  Description of Artificial Sequence: Synthetic oligonucleotide
acacaactacggggttgttgagagcttcacag

SEQ ID NO: 68903 - DNA, 31 bp, Artificial Sequence
  Description of Artificial Sequence: Synthetic oligonucleotide
cacaactacggggttgttgagagcttcacag

SEQ ID NO: 68904 - DNA, 32 bp, Artificial Sequence
  Description of Artificial Sequence: Synthetic oligonucleotide
acaactacggggttgttgagagcttcacagtg

SEQ ID NO: 68905 - DNA, 31 bp, Artificial Sequence
  Description of Artificial Sequence: Synthetic oligonucleotide
caactacggggttgttgagagcttcacagtg

SEQ ID NO: 68906 - DNA, 31 bp, Artificial Sequence
  Description of Artificial Sequence: Synthetic oligonucleotide
aactacggggttgttgagagcttcacagtgc

SEQ ID NO: 68907 - DNA, 30 bp, Artificial Sequence
  Description of Artificial Sequence: Synthetic oligonucleotide
actacggggttgttgagagcttcacagtgc

SEQ ID NO: 68908 - DNA, 29 bp, Artificial Sequence
  Description of Artificial Sequence: Synthetic oligonucleotide
ctacggggttgttgagagcttcacagtgc

SEQ ID NO: 68909 - DNA, 30 bp, Artificial Sequence
  Description of Artificial Sequence: Synthetic oligonucleotide
tacggggttgttgagagcttcacagtgcag

SEQ ID NO: 68910 - DNA, 29 bp, Artificial Sequence
  Description of Artificial Sequence: Synthetic oligonucleotide
acggggttgttgagagcttcacagtgcag

SEQ ID NO: 68911 - DNA, 28 bp, Artificial Sequence
  Description of Artificial Sequence: Synthetic oligonucleotide
cggggttgttgagagcttcacagtgcag

SEQ ID NO: 68912 - DNA, 28 bp, Artificial Sequence
  Description of Artificial Sequence: Synthetic oligonucleotide
ggggttgttgagagcttcacagtgcagc

SEQ ID NO: 68913 - DNA, 28 bp, Artificial Sequence
  Description of Artificial Sequence: Synthetic oligonucleotide
gggttgttgagagcttcacagtgcagcg

SEQ ID NO: 68914 - DNA, 28 bp, Artificial Sequence
  Description of Artificial Sequence: Synthetic oligonucleotide
ggttgttgagagcttcacagtgcagcgg

SEQ ID NO: 68915 - DNA, 31 bp, Artificial Sequence
  Description of Artificial Sequence: Synthetic oligonucleotide
acacaactacggggttgttgagagcttcacg

SEQ ID NO: 68916 - DNA, 30 bp, Artificial Sequence
  Description of Artificial Sequence: Synthetic oligonucleotide
cacaactacggggttgttgagagcttcacg

SEQ ID NO: 68917 - DNA, 30 bp, Artificial Sequence
  Description of Artificial Sequence: Synthetic oligonucleotide
acaactacggggttgttgagagcttcacgg

SEQ ID NO: 68918 - DNA, 29 bp, Artificial Sequence
  Description of Artificial Sequence: Synthetic oligonucleotide
caactacggggttgttgagagcttcacgg

SEQ ID NO: 68919 - DNA, 30 bp, Artificial Sequence
  Description of Artificial Sequence: Synthetic oligonucleotide
aactacggggttgttgagagcttcacggtg

SEQ ID NO: 68920 - DNA, 29 bp, Artificial Sequence
  Description of Artificial Sequence: Synthetic oligonucleotide
actacggggttgttgagagcttcacggtg

SEQ ID NO: 68921 - DNA, 28 bp, Artificial Sequence
  Description of Artificial Sequence: Synthetic oligonucleotide
ctacggggttgttgagagcttcacggtg

SEQ ID NO: 68922 - DNA, 28 bp, Artificial Sequence
  Description of Artificial Sequence: Synthetic oligonucleotide
tacggggttgttgagagcttcacggtgc

SEQ ID NO: 68923 - DNA, 27 bp, Artificial Sequence
  Description of Artificial Sequence: Synthetic oligonucleotide
acggggttgttgagagcttcacggtgc

SEQ ID NO: 68924 - DNA, 27 bp, Artificial Sequence
  Description of Artificial Sequence: Synthetic oligonucleotide
cggggttgttgagagcttcacggtgca

SEQ ID NO: 68925 - DNA, 27 bp, Artificial Sequence
  Description of Artificial Sequence: Synthetic oligonucleotide
ggggttgttgagagcttcacggtgcag

SEQ ID NO: 68926 - DNA, 27 bp, Artificial Sequence
  Description of Artificial Sequence: Synthetic oligonucleotide
gggttgttgagagcttcacggtgcagc

SEQ ID NO: 68927 - DNA, 27 bp, Artificial Sequence
  Description of Artificial Sequence: Synthetic oligonucleotide
ggttgttgagagcttcacggtgcagcg

SEQ ID NO: 68928 - DNA, 27 bp, Artificial Sequence
  Description of Artificial Sequence: Synthetic oligonucleotide
gttgttgagagcttcacggtgcagcgg

SEQ ID NO: 68929 - DNA, 27 bp, Artificial Sequence
  Description of Artificial Sequence: Synthetic oligonucleotide
ttgttgagagcttcacggtgcagcggc

SEQ ID NO: 68930 - DNA, 26 bp, Artificial Sequence
  Description of Artificial Sequence: Synthetic oligonucleotide
tgttgagagcttcacggtgcagcggc

SEQ ID NO: 68931 - DNA, 25 bp, Artificial Sequence
  Description of Artificial Sequence: Synthetic oligonucleotide
gttgagagcttcacggtgcagcggc

SEQ ID NO: 68932 - DNA, 26 bp, Artificial Sequence
  Description of Artificial Sequence: Synthetic oligonucleotide
ttgagagcttcacggtgcagcggcga

SEQ ID NO: 68933 - DNA, 29 bp, Artificial Sequence
  Description of Artificial Sequence: Synthetic oligonucleotide
acaactacggggttgtggagagcttcacg

SEQ ID NO: 68934 - DNA, 28 bp, Artificial Sequence
  Description of Artificial Sequence: Synthetic oligonucleotide
caactacggggttgtggagagcttcacg

SEQ ID NO: 68935 - DNA, 28 bp, Artificial Sequence
  Description of Artificial Sequence: Synthetic oligonucleotide
aactacggggttgtggagagcttcacgg

SEQ ID NO: 68936 - DNA, 27 bp, Artificial Sequence
  Description of Artificial Sequence: Synthetic oligonucleotide
actacggggttgtggagagcttcacgg

SEQ ID NO: 68937 - DNA, 27 bp, Artificial Sequence
  Description of Artificial Sequence: Synthetic oligonucleotide
ctacggggttgtggagagcttcacggt

SEQ ID NO: 68938 - DNA, 27 bp, Artificial Sequence
  Description of Artificial Sequence: Synthetic oligonucleotide
tacggggttgtggagagcttcacggtg

SEQ ID NO: 68939 - DNA, 26 bp, Artificial Sequence
  Description of Artificial Sequence: Synthetic oligonucleotide
acggggttgtggagagcttcacggtg

SEQ ID NO: 68940 - DNA, 25 bp, Artificial Sequence
  Description of Artificial Sequence: Synthetic oligonucleotide
cggggttgtggagagcttcacggtg

SEQ ID NO: 68941 - DNA, 26 bp, Artificial Sequence
  Description of Artificial Sequence: Synthetic oligonucleotide
ggggttgtggagagcttcacggtgca

SEQ ID NO: 68942 - DNA, 26 bp, Artificial Sequence
  Description of Artificial Sequence: Synthetic oligonucleotide
gggttgtggagagcttcacggtgcag

SEQ ID NO: 68943 - DNA, 26 bp, Artificial Sequence
  Description of Artificial Sequence: Synthetic oligonucleotide
ggttgtggagagcttcacggtgcagc

SEQ ID NO: 68944 - DNA, 26 bp, Artificial Sequence
  Description of Artificial Sequence: Synthetic oligonucleotide
gttgtggagagcttcacggtgcagcg

SEQ ID NO: 68945 - DNA, 26 bp, Artificial Sequence
  Description of Artificial Sequence: Synthetic oligonucleotide
ttgtggagagcttcacggtgcagcgg

SEQ ID NO: 68946 - DNA, 25 bp, Artificial Sequence
  Description of Artificial Sequence: Synthetic oligonucleotide
tgtggagagcttcacggtgcagcgg

SEQ ID NO: 68947 - DNA, 24 bp, Artificial Sequence
  Description of Artificial Sequence: Synthetic oligonucleotide
gtggagagcttcacggtgcagcgg

SEQ ID NO: 68948 - DNA, 24 bp, Artificial Sequence
  Description of Artificial Sequence: Synthetic oligonucleotide
tggagagcttcacggtgcagcggc

SEQ ID NO: 68949 - DNA, 23 bp, Artificial Sequence
  Description of Artificial Sequence: Synthetic oligonucleotide
ggagagcttcacggtgcagcggc

SEQ ID NO: 68950 - DNA, 36 bp, Artificial Sequence
  Description of Artificial Sequence: Synthetic oligonucleotide
ctggacagatacttctataaccaagaggagtacgtc

SEQ ID NO: 68951 - DNA, 36 bp, Artificial Sequence
  Description of Artificial Sequence: Synthetic oligonucleotide
tggacagatacttctataaccaagaggagtacgtcc

SEQ ID NO: 68952 - DNA, 35 bp, Artificial Sequence
  Description of Artificial Sequence: Synthetic oligonucleotide
ggacagatacttctataaccaagaggagtacgtcc

SEQ ID NO: 68953 - DNA, 35 bp, Artificial Sequence
  Description of Artificial Sequence: Synthetic oligonucleotide
gacagatacttctataaccaagaggagtacgtccg

SEQ ID NO: 68954 - DNA, 35 bp, Artificial Sequence
  Description of Artificial Sequence: Synthetic oligonucleotide
acagatacttctataaccaagaggagtacgtccgc

SEQ ID NO: 68955 - DNA, 34 bp, Artificial Sequence
  Description of Artificial Sequence: Synthetic oligonucleotide
cagatacttctataaccaagaggagtacgtccgc

SEQ ID NO: 68956 - DNA, 36 bp, Artificial Sequence
  Description of Artificial Sequence: Synthetic oligonucleotide
agatacttctataaccaagaggagtacgtccgcttc

SEQ ID NO: 68957 - DNA, 35 bp, Artificial Sequence
  Description of Artificial Sequence: Synthetic oligonucleotide
gatacttctataaccaagaggagtacgtccgcttc

SEQ ID NO: 68958 - DNA, 35 bp, Artificial Sequence
  Description of Artificial Sequence: Synthetic oligonucleotide
atacttctataaccaagaggagtacgtccgcttcg

SEQ ID NO: 68959 - DNA, 34 bp, Artificial Sequence
  Description of Artificial Sequence: Synthetic oligonucleotide
tacttctataaccaagaggagtacgtccgcttcg

SEQ ID NO: 68960 - DNA, 33 bp, Artificial Sequence
  Description of Artificial Sequence: Synthetic oligonucleotide
acttctataaccaagaggagtacgtccgcttcg

SEQ ID NO: 68961 - DNA, 32 bp, Artificial Sequence
  Description of Artificial Sequence: Synthetic oligonucleotide
cttctataaccaagaggagtacgtccgcttcg

SEQ ID NO: 68962 - DNA, 33 bp, Artificial Sequence
  Description of Artificial Sequence: Synthetic oligonucleotide
ttctataaccaagaggagtacgtccgcttcgac

SEQ ID NO: 68963 - DNA, 32 bp, Artificial Sequence
  Description of Artificial Sequence: Synthetic oligonucleotide
tctataaccaagaggagtacgtccgcttcgac

SEQ ID NO: 68964 - DNA, 31 bp, Artificial Sequence
  Description of Artificial Sequence: Synthetic oligonucleotide
ctataaccaagaggagtacgtccgcttcgac

SEQ ID NO: 68965 - DNA, 32 bp, Artificial Sequence
  Description of Artificial Sequence: Synthetic oligonucleotide
tataaccaagaggagtacgtccgcttcgacag

SEQ ID NO: 68966 - DNA, 31 bp, Artificial Sequence
  Description of Artificial Sequence: Synthetic oligonucleotide
ataaccaagaggagtacgtccgcttcgacag

SEQ ID NO: 68967 - DNA, 30 bp, Artificial Sequence
  Description of Artificial Sequence: Synthetic oligonucleotide
taaccaagaggagtacgtccgcttcgacag

SEQ ID NO: 68968 - DNA, 29 bp, Artificial Sequence
  Description of Artificial Sequence: Synthetic oligonucleotide
aaccaagaggagtacgtccgcttcgacag

SEQ ID NO: 68969 - DNA, 28 bp, Artificial Sequence
  Description of Artificial Sequence: Synthetic oligonucleotide
accaagaggagtacgtccgcttcgacag

SEQ ID NO: 68970 - DNA, 27 bp, Artificial Sequence
  Description of Artificial Sequence: Synthetic oligonucleotide
ccaagaggagtacgtccgcttcgacag

SEQ ID NO: 68971 - DNA, 27 bp, Artificial Sequence
  Description of Artificial Sequence: Synthetic oligonucleotide
caagaggagtacgtccgcttcgacagc

SEQ ID NO: 68972 - DNA, 27 bp, Artificial Sequence
  Description of Artificial Sequence: Synthetic oligonucleotide
aagaggagtacgtccgcttcgacagcg

SEQ ID NO: 68973 - DNA, 27 bp, Artificial Sequence
  Description of Artificial Sequence: Synthetic oligonucleotide
agaggagtacgtccgcttcgacagcga

SEQ ID NO: 68974 - DNA, 26 bp, Artificial Sequence
  Description of Artificial Sequence: Synthetic oligonucleotide
gaggagtacgtccgcttcgacagcga

SEQ ID NO: 68975 - DNA, 26 bp, Artificial Sequence
  Description of Artificial Sequence: Synthetic oligonucleotide
aggagtacgtccgcttcgacagcgac

SEQ ID NO: 68976 - DNA, 25 bp, Artificial Sequence
  Description of Artificial Sequence: Synthetic oligonucleotide
ggagtacgtccgcttcgacagcgac

SEQ ID NO: 68977 - DNA, 26 bp, Artificial Sequence
  Description of Artificial Sequence: Synthetic oligonucleotide
gagtacgtccgcttcgacagcgacgt

SEQ ID NO: 68978 - DNA, 26 bp, Artificial Sequence
  Description of Artificial Sequence: Synthetic oligonucleotide
agtacgtccgcttcgacagcgacgtg

SEQ ID NO: 68979 - DNA, 25 bp, Artificial Sequence
  Description of Artificial Sequence: Synthetic oligonucleotide
gtacgtccgcttcgacagcgacgtg

SEQ ID NO: 68980 - DNA, 25 bp, Artificial Sequence
  Description of Artificial Sequence: Synthetic oligonucleotide
tacgtccgcttcgacagcgacgtgg

SEQ ID NO: 68981 - DNA, 24 bp, Artificial Sequence
  Description of Artificial Sequence: Synthetic oligonucleotide
acgtccgcttcgacagcgacgtgg

SEQ ID NO: 68982 - DNA, 23 bp, Artificial Sequence
  Description of Artificial Sequence: Synthetic oligonucleotide
cgtccgcttcgacagcgacgtgg

SEQ ID NO: 68983 - DNA, 23 bp, Artificial Sequence
  Description of Artificial Sequence: Synthetic oligonucleotide
gtccgcttcgacagcgacgtggg

SEQ ID NO: 68984 - DNA, 23 bp, Artificial Sequence
  Description of Artificial Sequence: Synthetic oligonucleotide
tccgcttcgacagcgacgtgggg

SEQ ID NO: 68985 - DNA, 22 bp, Artificial Sequence
  Description of Artificial Sequence: Synthetic oligonucleotide
ccgcttcgacagcgacgtgggg

SEQ ID NO: 68986 - DNA, 23 bp, Artificial Sequence
  Description of Artificial Sequence: Synthetic oligonucleotide
tgacggagctggggcggcctgtt

SEQ ID NO: 68987 - DNA, 22 bp, Artificial Sequence
  Description of Artificial Sequence: Synthetic oligonucleotide
gacggagctggggcggcctgtt

SEQ ID NO: 68988 - DNA, 22 bp, Artificial Sequence
  Description of Artificial Sequence: Synthetic oligonucleotide
acggagctggggcggcctgttg

SEQ ID NO: 68989 - DNA, 21 bp, Artificial Sequence
  Description of Artificial Sequence: Synthetic oligonucleotide
cggagctggggcggcctgttg

SEQ ID NO: 68990 - DNA, 21 bp, Artificial Sequence
  Description of Artificial Sequence: Synthetic oligonucleotide
ggagctggggcggcctgttgc

SEQ ID NO: 68991 - DNA, 21 bp, Artificial Sequence
  Description of Artificial Sequence: Synthetic oligonucleotide
gagctggggcggcctgttgcc

SEQ ID NO: 68992 - DNA, 22 bp, Artificial Sequence
  Description of Artificial Sequence: Synthetic oligonucleotide
agctggggcggcctgttgccga

SEQ ID NO: 68993 - DNA, 21 bp, Artificial Sequence
  Description of Artificial Sequence: Synthetic oligonucleotide
gctggggcggcctgttgccga

SEQ ID NO: 68994 - DNA, 23 bp, Artificial Sequence
  Description of Artificial Sequence: Synthetic oligonucleotide
ctggggcggcctgttgccgagta

SEQ ID NO: 68995 - DNA, 24 bp, Artificial Sequence
  Description of Artificial Sequence: Synthetic oligonucleotide
tggggcggcctgttgccgagtact

SEQ ID NO: 68996 - DNA, 29 bp, Artificial Sequence
  Description of Artificial Sequence: Synthetic oligonucleotide
ttgccgagtactggaacagccagaaggac

SEQ ID NO: 68997 - DNA, 27 bp, Artificial Sequence
  Description of Artificial Sequence: Synthetic oligonucleotide
cggagcactggaacagccagaaggact

SEQ ID NO: 68998 - DNA, 28 bp, Artificial Sequence
  Description of Artificial Sequence: Synthetic oligonucleotide
ggagcactggaacagccagaaggacttc

SEQ ID NO: 68999 - DNA, 28 bp, Artificial Sequence
  Description of Artificial Sequence: Synthetic oligonucleotide
gagcactggaacagccagaaggacttcc

SEQ ID NO: 69000 - DNA, 29 bp, Artificial Sequence
  Description of Artificial Sequence: Synthetic oligonucleotide
agcactggaacagccagaaggacttcctg

SEQ ID NO: 69001 - DNA, 28 bp, Artificial Sequence
  Description of Artificial Sequence: Synthetic oligonucleotide
gcactggaacagccagaaggacttcctg

SEQ ID NO: 69002 - DNA, 28 bp, Artificial Sequence
  Description of Artificial Sequence: Synthetic oligonucleotide
cactggaacagccagaaggacttcctgg

SEQ ID NO: 69003 - DNA, 20 bp, Artificial Sequence
  Description of Artificial Sequence: Synthetic oligonucleotide
agctggggcggcctgctgcc

SEQ ID NO: 69004 - DNA, 20 bp, Artificial Sequence
  Description of Artificial Sequence: Synthetic oligonucleotide
gctggggcggcctgctgcct

SEQ ID NO: 69005 - DNA, 20 bp, Artificial Sequence
  Description of Artificial Sequence: Synthetic oligonucleotide
ctggggcggcctgctgccga

SEQ ID NO: 69006 - DNA, 22 bp, Artificial Sequence
  Description of Artificial Sequence: Synthetic oligonucleotide
tggggcggcctgctgccgagta

SEQ ID NO: 69007 - DNA, 21 bp, Artificial Sequence
  Description of Artificial Sequence: Synthetic oligonucleotide
ggggcggcctgctgccgagta

SEQ ID NO: 69008 - DNA, 22 bp, Artificial Sequence
  Description of Artificial Sequence: Synthetic oligonucleotide
gggcggcctgctgccgagtact

SEQ ID NO: 69009 - DNA, 22 bp, Artificial Sequence
  Description of Artificial Sequence: Synthetic oligonucleotide
ggcggcctgctgccgagtactg

SEQ ID NO: 69010 - DNA, 24 bp, Artificial Sequence
  Description of Artificial Sequence: Synthetic oligonucleotide
gcggcctgctgccgagtactggaa

SEQ ID NO: 69011 - DNA, 25 bp, Artificial Sequence
  Description of Artificial Sequence: Synthetic oligonucleotide
cggcctgctgccgagtactggaaca

SEQ ID NO: 69012 - DNA, 25 bp, Artificial Sequence
  Description of Artificial Sequence: Synthetic oligonucleotide
ggcctgctgccgagtactggaacag

SEQ ID NO: 69013 - DNA, 25 bp, Artificial Sequence
  Description of Artificial Sequence: Synthetic oligonucleotide
gcctgctgccgagtactggaacagc

SEQ ID NO: 69014 - DNA, 26 bp, Artificial Sequence
  Description of Artificial Sequence: Synthetic oligonucleotide
cctgctgccgagtactggaacagcca

SEQ ID NO: 69015 - DNA, 27 bp, Artificial Sequence
  Description of Artificial Sequence: Synthetic oligonucleotide
ctgctgccgagtactggaacagccaga

SEQ ID NO: 69016 - DNA, 28 bp, Artificial Sequence
  Description of Artificial Sequence: Synthetic oligonucleotide
tgctgccgagtactggaacagccagaag

SEQ ID NO: 69017 - DNA, 27 bp, Artificial Sequence
  Description of Artificial Sequence: Synthetic oligonucleotide
gctgccgagtactggaacagccagaag

SEQ ID NO: 69018 - DNA, 27 bp, Artificial Sequence
  Description of Artificial Sequence: Synthetic oligonucleotide
ctgccgagtactggaacagccagaagg

SEQ ID NO: 69019 - DNA, 31 bp, Artificial Sequence
  Description of Artificial Sequence: Synthetic oligonucleotide
cacgtttcttggagtactctaggggtgagtg

SEQ ID NO: 69020 - DNA, 37 bp, Artificial Sequence
  Description of Artificial Sequence: Synthetic oligonucleotide
acgtttcttggagtactctaggggtgagtgttatttc

SEQ ID NO: 69021 - DNA, 36 bp, Artificial Sequence
  Description of Artificial Sequence: Synthetic oligonucleotide
cgtttcttggagtactctaggggtgagtgttatttc

SEQ ID NO: 69022 - DNA, 38 bp, Artificial Sequence
  Description of Artificial Sequence: Synthetic oligonucleotide
gtttcttggagtactctaggggtgagtgttatttcttc

SEQ ID NO: 69023 - DNA, 41 bp, Artificial Sequence
  Description of Artificial Sequence: Synthetic oligonucleotide
tttcttggagtactctaggggtgagtgttatttcttcaatg

SEQ ID NO: 69024 - DNA, 40 bp, Artificial Sequence
  Description of Artificial Sequence: Synthetic oligonucleotide
ttcttggagtactctaggggtgagtgttatttcttcaatg

SEQ ID NO: 69025 - DNA, 39 bp, Artificial Sequence
  Description of Artificial Sequence: Synthetic oligonucleotide
tcttggagtactctaggggtgagtgttatttcttcaatg

SEQ ID NO: 69026 - DNA, 38 bp, Artificial Sequence
  Description of Artificial Sequence: Synthetic oligonucleotide
cttggagtactctaggggtgagtgttatttcttcaatg

SEQ ID NO: 69027 - DNA, 38 bp, Artificial Sequence
  Description of Artificial Sequence: Synthetic oligonucleotide
ttggagtactctaggggtgagtgttatttcttcaatgg

SEQ ID NO: 69028 - DNA, 37 bp, Artificial Sequence
  Description of Artificial Sequence: Synthetic oligonucleotide
tggagtactctaggggtgagtgttatttcttcaatgg

SEQ ID NO: 69029 - DNA, 36 bp, Artificial Sequence
  Description of Artificial Sequence: Synthetic oligonucleotide
ggagtactctaggggtgagtgttatttcttcaatgg

SEQ ID NO: 69030 - DNA, 36 bp, Artificial Sequence
  Description of Artificial Sequence: Synthetic oligonucleotide
gagtactctaggggtgagtgttatttcttcaatggg

SEQ ID NO: 69031 - DNA, 37 bp, Artificial Sequence
  Description of Artificial Sequence: Synthetic oligonucleotide
agtactctaggggtgagtgttatttcttcaatgggac

SEQ ID NO: 69032 - DNA, 36 bp, Artificial Sequence
  Description of Artificial Sequence: Synthetic oligonucleotide
gtactctaggggtgagtgttatttcttcaatgggac

SEQ ID NO: 69033 - DNA, 36 bp, Artificial Sequence
  Description of Artificial Sequence: Synthetic oligonucleotide
tactctaggggtgagtgttatttcttcaatgggacg

SEQ ID NO: 69034 - DNA, 35 bp, Artificial Sequence
  Description of Artificial Sequence: Synthetic oligonucleotide
actctaggggtgagtgttatttcttcaatgggacg

SEQ ID NO: 69035 - DNA, 34 bp, Artificial Sequence
  Description of Artificial Sequence: Synthetic oligonucleotide
ctctaggggtgagtgttatttcttcaatgggacg

SEQ ID NO: 69036 - DNA, 34 bp, Artificial Sequence
  Description of Artificial Sequence: Synthetic oligonucleotide
tctaggggtgagtgttatttcttcaatgggacgg

SEQ ID NO: 69037 - DNA, 33 bp, Artificial Sequence
  Description of Artificial Sequence: Synthetic oligonucleotide
ctaggggtgagtgttatttcttcaatgggacgg

SEQ ID NO: 69038 - DNA, 34 bp, Artificial Sequence
  Description of Artificial Sequence: Synthetic oligonucleotide
taggggtgagtgttatttcttcaatgggacggag

SEQ ID NO: 69039 - DNA, 33 bp, Artificial Sequence
  Description of Artificial Sequence: Synthetic oligonucleotide
aggggtgagtgttatttcttcaatgggacggag

SEQ ID NO: 69040 - DNA, 32 bp, Artificial Sequence
  Description of Artificial Sequence: Synthetic oligonucleotide
ggggtgagtgttatttcttcaatgggacggag

SEQ ID NO: 69041 - DNA, 21 bp, Artificial Sequence
  Description of Artificial Sequence: Synthetic oligonucleotide
ctggggcggcctgatgcggag

SEQ ID NO: 69042 - DNA, 22 bp, Artificial Sequence
  Description of Artificial Sequence: Synthetic oligonucleotide
tggggcggcctgatgcggagca

SEQ ID NO: 69043 - DNA, 21 bp, Artificial Sequence
  Description of Artificial Sequence: Synthetic oligonucleotide
ggggcggcctgatgcggagca

SEQ ID NO: 69044 - DNA, 22 bp, Artificial Sequence
  Description of Artificial Sequence: Synthetic oligonucleotide
gggcggcctgatgcggagcact

SEQ ID NO: 69045 - DNA, 22 bp, Artificial Sequence
  Description of Artificial Sequence: Synthetic oligonucleotide
ggcggcctgatgcggagcactg

SEQ ID NO: 69046 - DNA, 24 bp, Artificial Sequence
  Description of Artificial Sequence: Synthetic oligonucleotide
gcggcctgatgcggagcactggaa

SEQ ID NO: 69047 - DNA, 25 bp, Artificial Sequence
  Description of Artificial Sequence: Synthetic oligonucleotide
cggcctgatgcggagcactggaaca

SEQ ID NO: 69048 - DNA, 25 bp, Artificial Sequence
  Description of Artificial Sequence: Synthetic oligonucleotide
ggcctgatgcggagcactggaacag

SEQ ID NO: 69049 - DNA, 25 bp, Artificial Sequence
  Description of Artificial Sequence: Synthetic oligonucleotide
gcctgatgcggagcactggaacagc

SEQ ID NO: 69050 - DNA, 26 bp, Artificial Sequence
  Description of Artificial Sequence: Synthetic oligonucleotide
cctgatgcggagcactggaacagcca

SEQ ID NO: 69051 - DNA, 27 bp, Artificial Sequence
  Description of Artificial Sequence: Synthetic oligonucleotide
ctgatgcggagcactggaacagccaga

SEQ ID NO: 69052 - DNA, 28 bp, Artificial Sequence
  Description of Artificial Sequence: Synthetic oligonucleotide
tgatgcggagcactggaacagccagaag

SEQ ID NO: 69053 - DNA, 27 bp, Artificial Sequence
  Description of Artificial Sequence: Synthetic oligonucleotide
gatgcggagcactggaacagccagaag

SEQ ID NO: 69054 - DNA, 27 bp, Artificial Sequence
  Description of Artificial Sequence: Synthetic oligonucleotide
atgcggagcactggaacagccagaagg

SEQ ID NO: 69055 - DNA, 27 bp, Artificial Sequence
  Description of Artificial Sequence: Synthetic oligonucleotide
cggagcactggaacagccagaaggaca

SEQ ID NO: 69056 - DNA, 28 bp, Artificial Sequence
  Description of Artificial Sequence: Synthetic oligonucleotide
ggagcactggaacagccagaaggacatc

SEQ ID NO: 69057 - DNA, 28 bp, Artificial Sequence
  Description of Artificial Sequence: Synthetic oligonucleotide
gagcactggaacagccagaaggacatcc

SEQ ID NO: 69058 - DNA, 29 bp, Artificial Sequence
  Description of Artificial Sequence: Synthetic oligonucleotide
agcactggaacagccagaaggacatcctg

SEQ ID NO: 69059 - DNA, 28 bp, Artificial Sequence
  Description of Artificial Sequence: Synthetic oligonucleotide
gcactggaacagccagaaggacatcctg

SEQ ID NO: 69060 - DNA, 28 bp, Artificial Sequence
  Description of Artificial Sequence: Synthetic oligonucleotide
cactggaacagccagaaggacatcctgg

SEQ ID NO: 69061 - DNA, 35 bp, Artificial Sequence
  Description of Artificial Sequence: Synthetic oligonucleotide
gttcctggacagatacttctataaccaagaggagg

SEQ ID NO: 69062 - DNA, 36 bp, Artificial Sequence
  Description of Artificial Sequence: Synthetic oligonucleotide
ttcctggacagatacttctataaccaagaggaggac

SEQ ID NO: 69063 - DNA, 35 bp, Artificial Sequence
  Description of Artificial Sequence: Synthetic oligonucleotide
tcctggacagatacttctataaccaagaggaggac

SEQ ID NO: 69064 - DNA, 34 bp, Artificial Sequence
  Description of Artificial Sequence: Synthetic oligonucleotide
cctggacagatacttctataaccaagaggaggac

SEQ ID NO: 69065 - DNA, 34 bp, Artificial Sequence
  Description of Artificial Sequence: Synthetic oligonucleotide
ctggacagatacttctataaccaagaggaggacg

SEQ ID NO: 69066 - DNA, 35 bp, Artificial Sequence
  Description of Artificial Sequence: Synthetic oligonucleotide
tggacagatacttctataaccaagaggaggacgtg

SEQ ID NO: 69067 - DNA, 34 bp, Artificial Sequence
  Description of Artificial Sequence: Synthetic oligonucleotide
ggacagatacttctataaccaagaggaggacgtg

SEQ ID NO: 69068 - DNA, 34 bp, Artificial Sequence
  Description of Artificial Sequence: Synthetic oligonucleotide
gacagatacttctataaccaagaggaggacgtgc

SEQ ID NO: 69069 - DNA, 34 bp, Artificial Sequence
  Description of Artificial Sequence: Synthetic oligonucleotide
acagatacttctataaccaagaggaggacgtgcg

SEQ ID NO: 69070 - DNA, 33 bp, Artificial Sequence
  Description of Artificial Sequence: Synthetic oligonucleotide
cagatacttctataaccaagaggaggacgtgcg

SEQ ID NO: 69071 - DNA, 33 bp, Artificial Sequence
  Description of Artificial Sequence: Synthetic oligonucleotide
agatacttctataaccaagaggaggacgtgcgc

SEQ ID NO: 69072 - DNA, 32 bp, Artificial Sequence
  Description of Artificial Sequence: Synthetic oligonucleotide
gatacttctataaccaagaggaggacgtgcgc

SEQ ID NO: 69073 - DNA, 34 bp, Artificial Sequence
  Description of Artificial Sequence: Synthetic oligonucleotide
atacttctataaccaagaggaggacgtgcgcttc

SEQ ID NO: 69074 - DNA, 33 bp, Artificial Sequence
  Description of Artificial Sequence: Synthetic oligonucleotide
tacttctataaccaagaggaggacgtgcgcttc

SEQ ID NO: 69075 - DNA, 32 bp, Artificial Sequence
  Description of Artificial Sequence: Synthetic oligonucleotide
acttctataaccaagaggaggacgtgcgcttc

SEQ ID NO: 69076 - DNA, 31 bp, Artificial Sequence
  Description of Artificial Sequence: Synthetic oligonucleotide
cttctataaccaagaggaggacgtgcgcttc

SEQ ID NO: 69077 - DNA, 31 bp, Artificial Sequence
  Description of Artificial Sequence: Synthetic oligonucleotide
ttctataaccaagaggaggacgtgcgcttcg

SEQ ID NO: 69078 - DNA, 30 bp, Artificial Sequence
  Description of Artificial Sequence: Synthetic oligonucleotide
tctataaccaagaggaggacgtgcgcttcg

SEQ ID NO: 69079 - DNA, 29 bp, Artificial Sequence
  Description of Artificial Sequence: Synthetic oligonucleotide
ctataaccaagaggaggacgtgcgcttcg

SEQ ID NO: 69080 - DNA, 30 bp, Artificial Sequence
  Description of Artificial Sequence: Synthetic oligonucleotide
tataaccaagaggaggacgtgcgcttcgac

SEQ ID NO: 69081 - DNA, 29 bp, Artificial Sequence
  Description of Artificial Sequence: Synthetic oligonucleotide
ataaccaagaggaggacgtgcgcttcgac

SEQ ID NO: 69082 - DNA, 28 bp, Artificial Sequence
  Description of Artificial Sequence: Synthetic oligonucleotide
taaccaagaggaggacgtgcgcttcgac

SEQ ID NO: 69083 - DNA, 27 bp, Artificial Sequence
  Description of Artificial Sequence: Synthetic oligonucleotide
aaccaagaggaggacgtgcgcttcgac

SEQ ID NO: 69084 - DNA, 27 bp, Artificial Sequence
  Description of Artificial Sequence: Synthetic oligonucleotide
accaagaggaggacgtgcgcttcgaca

SEQ ID NO: 69085 - DNA, 26 bp, Artificial Sequence
  Description of Artificial Sequence: Synthetic oligonucleotide
ccaagaggaggacgtgcgcttcgaca

SEQ ID NO: 69086 - DNA, 26 bp, Artificial Sequence
  Description of Artificial Sequence: Synthetic oligonucleotide
caagaggaggacgtgcgcttcgacag

SEQ ID NO: 69087 - DNA, 26 bp, Artificial Sequence
  Description of Artificial Sequence: Synthetic oligonucleotide
aagaggaggacgtgcgcttcgacagc

SEQ ID NO: 69088 - DNA, 24 bp, Artificial Sequence
  Description of Artificial Sequence: Synthetic oligonucleotide
acatcctggaagacaggcgggccg

SEQ ID NO: 69089 - DNA, 23 bp, Artificial Sequence
  Description of Artificial Sequence: Synthetic oligonucleotide
catcctggaagacaggcgggccg

SEQ ID NO: 69090 - DNA, 23 bp, Artificial Sequence
  Description of Artificial Sequence: Synthetic oligonucleotide
atcctggaagacaggcgggccgc

SEQ ID NO: 69091 - DNA, 23 bp, Artificial Sequence
  Description of Artificial Sequence: Synthetic oligonucleotide
gtgacggagctggggcggcctat

SEQ ID NO: 69092 - DNA, 23 bp, Artificial Sequence
  Description of Artificial Sequence: Synthetic oligonucleotide
tgacggagctggggcggcctatc

SEQ ID NO: 69093 - DNA, 22 bp, Artificial Sequence
  Description of Artificial Sequence: Synthetic oligonucleotide
gacggagctggggcggcctatc

SEQ ID NO: 69094 - DNA, 22 bp, Artificial Sequence
  Description of Artificial Sequence: Synthetic oligonucleotide
acggagctggggcggcctatcg

SEQ ID NO: 69095 - DNA, 21 bp, Artificial Sequence
  Description of Artificial Sequence: Synthetic oligonucleotide
cggagctggggcggcctatcg

SEQ ID NO: 69096 - DNA, 21 bp, Artificial Sequence
  Description of Artificial Sequence: Synthetic oligonucleotide
ggagctggggcggcctatcgc

SEQ ID NO: 69097 - DNA, 21 bp, Artificial Sequence
  Description of Artificial Sequence: Synthetic oligonucleotide
gagctggggcggcctatcgcc

SEQ ID NO: 69098 - DNA, 22 bp, Artificial Sequence
  Description of Artificial Sequence: Synthetic oligonucleotide
agctggggcggcctatcgccga

SEQ ID NO: 69099 - DNA, 21 bp, Artificial Sequence
  Description of Artificial Sequence: Synthetic oligonucleotide
gctggggcggcctatcgccga

SEQ ID NO: 69100 - DNA, 23 bp, Artificial Sequence
  Description of Artificial Sequence: Synthetic oligonucleotide
ctggggcggcctatcgccgagta

SEQ ID NO: 69101 - DNA, 24 bp, Artificial Sequence
  Description of Artificial Sequence: Synthetic oligonucleotide
tggggcggcctatcgccgagtact

SEQ ID NO: 69102 - DNA, 23 bp, Artificial Sequence
  Description of Artificial Sequence: Synthetic oligonucleotide
ggggcggcctatcgccgagtact

SEQ ID NO: 69103 - DNA, 23 bp, Artificial Sequence
  Description of Artificial Sequence: Synthetic oligonucleotide
gggcggcctatcgccgagtactg

SEQ ID NO: 69104 - DNA, 25 bp, Artificial Sequence
  Description of Artificial Sequence: Synthetic oligonucleotide
ggcggcctatcgccgagtactggaa

SEQ ID NO: 69105 - DNA, 26 bp, Artificial Sequence
  Description of Artificial Sequence: Synthetic oligonucleotide
gcggcctatcgccgagtactggaaca

SEQ ID NO: 69106 - DNA, 26 bp, Artificial Sequence
  Description of Artificial Sequence: Synthetic oligonucleotide
cggcctatcgccgagtactggaacag

SEQ ID NO: 69107 - DNA, 26 bp, Artificial Sequence
  Description of Artificial Sequence: Synthetic oligonucleotide
ggcctatcgccgagtactggaacagc

SEQ ID NO: 69108 - DNA, 27 bp, Artificial Sequence
  Description of Artificial Sequence: Synthetic oligonucleotide
gcctatcgccgagtactggaacagcca

SEQ ID NO: 69109 - DNA, 27 bp, Artificial Sequence
  Description of Artificial Sequence: Synthetic oligonucleotide
cctatcgccgagtactggaacagccag

SEQ ID NO: 69110 - DNA, 29 bp, Artificial Sequence
  Description of Artificial Sequence: Synthetic oligonucleotide
ctatcgccgagtactggaacagccagaag

SEQ ID NO: 69111 - DNA, 29 bp, Artificial Sequence
  Description of Artificial Sequence: Synthetic oligonucleotide
tatcgccgagtactggaacagccagaagg

SEQ ID NO: 69112 - DNA, 28 bp, Artificial Sequence
  Description of Artificial Sequence: Synthetic oligonucleotide
atcgccgagtactggaacagccagaagg

SEQ ID NO: 69113 - DNA, 38 bp, Artificial Sequence
  Description of Artificial Sequence: Synthetic oligonucleotide
cacgtttcttggagtactctatgggtgagtgttatttc

SEQ ID NO: 69114 - DNA, 40 bp, Artificial Sequence
  Description of Artificial Sequence: Synthetic oligonucleotide
acgtttcttggagtactctatgggtgagtgttatttcttc

SEQ ID NO: 69115 - DNA, 39 bp, Artificial Sequence
  Description of Artificial Sequence: Synthetic oligonucleotide
cgtttcttggagtactctatgggtgagtgttatttcttc

SEQ ID NO: 69116 - DNA, 42 bp, Artificial Sequence
  Description of Artificial Sequence: Synthetic oligonucleotide
gtttcttggagtactctatgggtgagtgttatttcttcaatg

SEQ ID NO: 69117 - DNA, 42 bp, Artificial Sequence
  Description of Artificial Sequence: Synthetic oligonucleotide
tttcttggagtactctatgggtgagtgttatttcttcaatgg

SEQ ID NO: 69118 - DNA, 41 bp, Artificial Sequence
  Description of Artificial Sequence: Synthetic oligonucleotide
ttcttggagtactctatgggtgagtgttatttcttcaatgg

SEQ ID NO: 69119 - DNA, 40 bp, Artificial Sequence
  Description of Artificial Sequence: Synthetic oligonucleotide
tcttggagtactctatgggtgagtgttatttcttcaatgg

SEQ ID NO: 69120 - DNA, 39 bp, Artificial Sequence
  Description of Artificial Sequence: Synthetic oligonucleotide
cttggagtactctatgggtgagtgttatttcttcaatgg

SEQ ID NO: 69121 - DNA, 39 bp, Artificial Sequence
  Description of Artificial Sequence: Synthetic oligonucleotide
ttggagtactctatgggtgagtgttatttcttcaatggg

SEQ ID NO: 69122 - DNA, 38 bp, Artificial Sequence
  Description of Artificial Sequence: Synthetic oligonucleotide
tggagtactctatgggtgagtgttatttcttcaatggg

SEQ ID NO: 69123 - DNA, 37 bp, Artificial Sequence
  Description of Artificial Sequence: Synthetic oligonucleotide
ggagtactctatgggtgagtgttatttcttcaatggg

SEQ ID NO: 69124 - DNA, 38 bp, Artificial Sequence
  Description of Artificial Sequence: Synthetic oligonucleotide
gagtactctatgggtgagtgttatttcttcaatgggac

SEQ ID NO: 69125 - DNA, 38 bp, Artificial Sequence
  Description of Artificial Sequence: Synthetic oligonucleotide
agtactctatgggtgagtgttatttcttcaatgggacg

SEQ ID NO: 69126 - DNA, 37 bp, Artificial Sequence
  Description of Artificial Sequence: Synthetic oligonucleotide
gtactctatgggtgagtgttatttcttcaatgggacg

SEQ ID NO: 69127 - DNA, 37 bp, Artificial Sequence
  Description of Artificial Sequence: Synthetic oligonucleotide
tactctatgggtgagtgttatttcttcaatgggacgg

SEQ ID NO: 69128 - DNA, 36 bp, Artificial Sequence
  Description of Artificial Sequence: Synthetic oligonucleotide
actctatgggtgagtgttatttcttcaatgggacgg

SEQ ID NO: 69129 - DNA, 35 bp, Artificial Sequence
  Description of Artificial Sequence: Synthetic oligonucleotide
ctctatgggtgagtgttatttcttcaatgggacgg

SEQ ID NO: 69130 - DNA, 36 bp, Artificial Sequence
  Description of Artificial Sequence: Synthetic oligonucleotide
tctatgggtgagtgttatttcttcaatgggacggag

SEQ ID NO: 69131 - DNA, 35 bp, Artificial Sequence
  Description of Artificial Sequence: Synthetic oligonucleotide
ctatgggtgagtgttatttcttcaatgggacggag

SEQ ID NO: 69132 - DNA, 35 bp, Artificial Sequence
  Description of Artificial Sequence: Synthetic oligonucleotide
tatgggtgagtgttatttcttcaatgggacggagc

SEQ ID NO: 69133 - DNA, 34 bp, Artificial Sequence
  Description of Artificial Sequence: Synthetic oligonucleotide
atgggtgagtgttatttcttcaatgggacggagc

SEQ ID NO: 69134 - DNA, 33 bp, Artificial Sequence
  Description of Artificial Sequence: Synthetic oligonucleotide
tgggtgagtgttatttcttcaatgggacggagc

SEQ ID NO: 69135 - DNA, 27 bp, Artificial Sequence
  Description of Artificial Sequence: Synthetic oligonucleotide
aactacggggctgtggagagcttcacg

SEQ ID NO: 69136 - DNA, 26 bp, Artificial Sequence
  Description of Artificial Sequence: Synthetic oligonucleotide
actacggggctgtggagagcttcacg

SEQ ID NO: 69137 - DNA, 25 bp, Artificial Sequence
  Description of Artificial Sequence: Synthetic oligonucleotide
ctacggggctgtggagagcttcacg

SEQ ID NO: 69138 - DNA, 26 bp, Artificial Sequence
  Description of Artificial Sequence: Synthetic oligonucleotide
tacggggctgtggagagcttcacggt

SEQ ID NO: 69139 - DNA, 25 bp, Artificial Sequence
  Description of Artificial Sequence: Synthetic oligonucleotide
acggggctgtggagagcttcacggt

SEQ ID NO: 69140 - DNA, 24 bp, Artificial Sequence
  Description of Artificial Sequence: Synthetic oligonucleotide
cggggctgtggagagcttcacggt

SEQ ID NO: 69141 - DNA, 24 bp, Artificial Sequence
  Description of Artificial Sequence: Synthetic oligonucleotide
ggggctgtggagagcttcacggtg

SEQ ID NO: 69142 - DNA, 25 bp, Artificial Sequence
  Description of Artificial Sequence: Synthetic oligonucleotide
gggctgtggagagcttcacggtgca

SEQ ID NO: 69143 - DNA, 25 bp, Artificial Sequence
  Description of Artificial Sequence: Synthetic oligonucleotide
ggctgtggagagcttcacggtgcag

SEQ ID NO: 69144 - DNA, 25 bp, Artificial Sequence
  Description of Artificial Sequence: Synthetic oligonucleotide
gctgtggagagcttcacggtgcagc

SEQ ID NO: 69145 - DNA, 25 bp, Artificial Sequence
  Description of Artificial Sequence: Synthetic oligonucleotide
ctgtggagagcttcacggtgcagcg

SEQ ID NO: 69146 - DNA, 27 bp, Artificial Sequence
  Description of Artificial Sequence: Synthetic oligonucleotide
agtacgtgcgcttcgacagcgacgtga

SEQ ID NO: 69147 - DNA, 26 bp, Artificial Sequence
  Description of Artificial Sequence: Synthetic oligonucleotide
gtacgtgcgcttcgacagcgacgtga

SEQ ID NO: 69148 - DNA, 26 bp, Artificial Sequence
  Description of Artificial Sequence: Synthetic oligonucleotide
tacgtgcgcttcgacagcgacgtgag

SEQ ID NO: 69149 - DNA, 25 bp, Artificial Sequence
  Description of Artificial Sequence: Synthetic oligonucleotide
acgtgcgcttcgacagcgacgtgag

SEQ ID NO: 69150 - DNA, 31 bp, Artificial Sequence
  Description of Artificial Sequence: Synthetic oligonucleotide
ttatttcttcaatgggacggagcgggtgctg

SEQ ID NO: 69151 - DNA, 30 bp, Artificial Sequence
  Description of Artificial Sequence: Synthetic oligonucleotide
tatttcttcaatgggacggagcgggtgctg

SEQ ID NO: 69152 - DNA, 29 bp, Artificial Sequence
  Description of Artificial Sequence: Synthetic oligonucleotide
atttcttcaatgggacggagcgggtgctg

SEQ ID NO: 69153 - DNA, 28 bp, Artificial Sequence
  Description of Artificial Sequence: Synthetic oligonucleotide
tttcttcaatgggacggagcgggtgctg

SEQ ID NO: 69154 - DNA, 27 bp, Artificial Sequence
  Description of Artificial Sequence: Synthetic oligonucleotide
ttcttcaatgggacggagcgggtgctg

SEQ ID NO: 69155 - DNA, 27 bp, Artificial Sequence
  Description of Artificial Sequence: Synthetic oligonucleotide
tcttcaatgggacggagcgggtgctgt

SEQ ID NO: 69156 - DNA, 27 bp, Artificial Sequence
  Description of Artificial Sequence: Synthetic oligonucleotide
cttcaatgggacggagcgggtgctgtt

SEQ ID NO: 69157 - DNA, 27 bp, Artificial Sequence
  Description of Artificial Sequence: Synthetic oligonucleotide
ttcaatgggacggagcgggtgctgttc

SEQ ID NO: 69158 - DNA, 26 bp, Artificial Sequence
  Description of Artificial Sequence: Synthetic oligonucleotide
tcaatgggacggagcgggtgctgttc

SEQ ID NO: 69159 - DNA, 25 bp, Artificial Sequence
  Description of Artificial Sequence: Synthetic oligonucleotide
caatgggacggagcgggtgctgttc

SEQ ID NO: 69160 - DNA, 26 bp, Artificial Sequence
  Description of Artificial Sequence: Synthetic oligonucleotide
aatgggacggagcgggtgctgttcct

SEQ ID NO: 69161 - DNA, 25 bp, Artificial Sequence
  Description of Artificial Sequence: Synthetic oligonucleotide
atgggacggagcgggtgctgttcct

SEQ ID NO: 69162 - DNA, 24 bp, Artificial Sequence
  Description of Artificial Sequence: Synthetic oligonucleotide
tgggacggagcgggtgctgttcct

SEQ ID NO: 69163 - DNA, 23 bp, Artificial Sequence
  Description of Artificial Sequence: Synthetic oligonucleotide
gggacggagcgggtgctgttcct

SEQ ID NO: 69164 - DNA, 23 bp, Artificial Sequence
  Description of Artificial Sequence: Synthetic oligonucleotide
ggacggagcgggtgctgttcctg

SEQ ID NO: 69165 - DNA, 24 bp, Artificial Sequence
  Description of Artificial Sequence: Synthetic oligonucleotide
gacggagcgggtgctgttcctgga

SEQ ID NO: 69166 - DNA, 25 bp, Artificial Sequence
  Description of Artificial Sequence: Synthetic oligonucleotide
acggagcgggtgctgttcctggaca

SEQ ID NO: 69167 - DNA, 24 bp, Artificial Sequence
  Description of Artificial Sequence: Synthetic oligonucleotide
cggagcgggtgctgttcctggaca

SEQ ID NO: 69168 - DNA, 27 bp, Artificial Sequence
  Description of Artificial Sequence: Synthetic oligonucleotide
ggagcgggtgctgttcctggacagata

SEQ ID NO: 69169 - DNA, 27 bp, Artificial Sequence
  Description of Artificial Sequence: Synthetic oligonucleotide
gagcgggtgctgttcctggacagatac

SEQ ID NO: 69170 - DNA, 29 bp, Artificial Sequence
  Description of Artificial Sequence: Synthetic oligonucleotide
agcgggtgctgttcctggacagatacttc

SEQ ID NO: 69171 - DNA, 28 bp, Artificial Sequence
  Description of Artificial Sequence: Synthetic oligonucleotide
gcgggtgctgttcctggacagatacttc

SEQ ID NO: 69172 - DNA, 33 bp, Artificial Sequence
  Description of Artificial Sequence: Synthetic oligonucleotide
cgggtgctgttcctggacagatacttctataac

SEQ ID NO: 69173 - DNA, 33 bp, Artificial Sequence
  Description of Artificial Sequence: Synthetic oligonucleotide
gggtgctgttcctggacagatacttctataacc

SEQ ID NO: 69174 - DNA, 35 bp, Artificial Sequence
  Description of Artificial Sequence: Synthetic oligonucleotide
ggtgctgttcctggacagatacttctataaccaag

SEQ ID NO: 69175 - DNA, 36 bp, Artificial Sequence
  Description of Artificial Sequence: Synthetic oligonucleotide
gtgctgttcctggacagatacttctataaccaagag

SEQ ID NO: 69176 - DNA, 36 bp, Artificial Sequence
  Description of Artificial Sequence: Synthetic oligonucleotide
tgctgttcctggacagatacttctataaccaagagg

SEQ ID NO: 69177 - DNA, 35 bp, Artificial Sequence
  Description of Artificial Sequence: Synthetic oligonucleotide
gctgttcctggacagatacttctataaccaagagg

SEQ ID NO: 69178 - DNA, 36 bp, Artificial Sequence
  Description of Artificial Sequence: Synthetic oligonucleotide
ctgttcctggacagatacttctataaccaagaggag

SEQ ID NO: 69179 - DNA, 38 bp, Artificial Sequence
  Description of Artificial Sequence: Synthetic oligonucleotide
tgttcctggacagatacttctataaccaagaggagtac

SEQ ID NO: 69180 - DNA, 32 bp, Artificial Sequence
  Description of Artificial Sequence: Synthetic oligonucleotide
gtgcggttcctggacagatacttctataaccg

SEQ ID NO: 69181 - DNA, 33 bp, Artificial Sequence
  Description of Artificial Sequence: Synthetic oligonucleotide
tgcggttcctggacagatacttctataaccgag

SEQ ID NO: 69182 - DNA, 32 bp, Artificial Sequence
  Description of Artificial Sequence: Synthetic oligonucleotide
gcggttcctggacagatacttctataaccgag

SEQ ID NO: 69183 - DNA, 33 bp, Artificial Sequence
  Description of Artificial Sequence: Synthetic oligonucleotide
cggttcctggacagatacttctataaccgagag

SEQ ID NO: 69184 - DNA, 33 bp, Artificial Sequence
  Description of Artificial Sequence: Synthetic oligonucleotide
ggttcctggacagatacttctataaccgagagg

SEQ ID NO: 69185 - DNA, 34 bp, Artificial Sequence
  Description of Artificial Sequence: Synthetic oligonucleotide
gttcctggacagatacttctataaccgagaggag

SEQ ID NO: 69186 - DNA, 36 bp, Artificial Sequence
  Description of Artificial Sequence: Synthetic oligonucleotide
ttcctggacagatacttctataaccgagaggagtac

SEQ ID NO: 69187 - DNA, 35 bp, Artificial Sequence
  Description of Artificial Sequence: Synthetic oligonucleotide
tcctggacagatacttctataaccgagaggagtac

SEQ ID NO: 69188 - DNA, 34 bp, Artificial Sequence
  Description of Artificial Sequence: Synthetic oligonucleotide
cctggacagatacttctataaccgagaggagtac

SEQ ID NO: 69189 - DNA, 34 bp, Artificial Sequence
  Description of Artificial Sequence: Synthetic oligonucleotide
ctggacagatacttctataaccgagaggagtacg

SEQ ID NO: 69190 - DNA, 35 bp, Artificial Sequence
  Description of Artificial Sequence: Synthetic oligonucleotide
tggacagatacttctataaccgagaggagtacgtg

SEQ ID NO: 69191 - DNA, 34 bp, Artificial Sequence
  Description of Artificial Sequence: Synthetic oligonucleotide
ggacagatacttctataaccgagaggagtacgtg

SEQ ID NO: 69192 - DNA, 34 bp, Artificial Sequence
  Description of Artificial Sequence: Synthetic oligonucleotide
gacagatacttctataaccgagaggagtacgtgc

SEQ ID NO: 69193 - DNA, 34 bp, Artificial Sequence
  Description of Artificial Sequence: Synthetic oligonucleotide
acagatacttctataaccgagaggagtacgtgcg

SEQ ID NO: 69194 - DNA, 33 bp, Artificial Sequence
  Description of Artificial Sequence: Synthetic oligonucleotide
cagatacttctataaccgagaggagtacgtgcg

SEQ ID NO: 69195 - DNA, 33 bp, Artificial Sequence
  Description of Artificial Sequence: Synthetic oligonucleotide
agatacttctataaccgagaggagtacgtgcgc

SEQ ID NO: 69196 - DNA, 32 bp, Artificial Sequence
  Description of Artificial Sequence: Synthetic oligonucleotide
gatacttctataaccgagaggagtacgtgcgc

SEQ ID NO: 69197 - DNA, 34 bp, Artificial Sequence
  Description of Artificial Sequence: Synthetic oligonucleotide
atacttctataaccgagaggagtacgtgcgcttc

SEQ ID NO: 69198 - DNA, 33 bp, Artificial Sequence
  Description of Artificial Sequence: Synthetic oligonucleotide
tacttctataaccgagaggagtacgtgcgcttc

SEQ ID NO: 69199 - DNA, 32 bp, Artificial Sequence
  Description of Artificial Sequence: Synthetic oligonucleotide
acttctataaccgagaggagtacgtgcgcttc

SEQ ID NO: 69200 - DNA, 31 bp, Artificial Sequence
  Description of Artificial Sequence: Synthetic oligonucleotide
cttctataaccgagaggagtacgtgcgcttc

SEQ ID NO: 69201 - DNA, 31 bp, Artificial Sequence
  Description of Artificial Sequence: Synthetic oligonucleotide
ttctataaccgagaggagtacgtgcgcttcg

SEQ ID NO: 69202 - DNA, 25 bp, Artificial Sequence
  Description of Artificial Sequence: Synthetic oligonucleotide
acatcctggaagacaggcgggccga

SEQ ID NO: 69203 - DNA, 24 bp, Artificial Sequence
  Description of Artificial Sequence: Synthetic oligonucleotide
catcctggaagacaggcgggccga

SEQ ID NO: 69204 - DNA, 24 bp, Artificial Sequence
  Description of Artificial Sequence: Synthetic oligonucleotide
atcctggaagacaggcgggccgag

SEQ ID NO: 69205 - DNA, 23 bp, Artificial Sequence
  Description of Artificial Sequence: Synthetic oligonucleotide
tcctggaagacaggcgggccgag

SEQ ID NO: 69206 - DNA, 22 bp, Artificial Sequence
  Description of Artificial Sequence: Synthetic oligonucleotide
cctggaagacaggcgggccgag

SEQ ID NO: 69207 - DNA, 23 bp, Artificial Sequence
  Description of Artificial Sequence: Synthetic oligonucleotide
ctggaagacaggcgggccgaggt

SEQ ID NO: 69208 - DNA, 23 bp, Artificial Sequence
  Description of Artificial Sequence: Synthetic oligonucleotide
tggaagacaggcgggccgaggtg

SEQ ID NO: 69209 - DNA, 22 bp, Artificial Sequence
  Description of Artificial Sequence: Synthetic oligonucleotide
ggaagacaggcgggccgaggtg

SEQ ID NO: 69210 - DNA, 23 bp, Artificial Sequence
  Description of Artificial Sequence: Synthetic oligonucleotide
gaagacaggcgggccgaggtgga

SEQ ID NO: 69211 - DNA, 24 bp, Artificial Sequence
  Description of Artificial Sequence: Synthetic oligonucleotide
aagacaggcgggccgaggtggaca

SEQ ID NO: 69212 - DNA, 23 bp, Artificial Sequence
  Description of Artificial Sequence: Synthetic oligonucleotide
agacaggcgggccgaggtggaca

SEQ ID NO: 69213 - DNA, 22 bp, Artificial Sequence
  Description of Artificial Sequence: Synthetic oligonucleotide
gacaggcgggccgaggtggaca

SEQ ID NO: 69214 - DNA, 22 bp, Artificial Sequence
  Description of Artificial Sequence: Synthetic oligonucleotide
acaggcgggccgaggtggacac

SEQ ID NO: 69215 - DNA, 21 bp, Artificial Sequence
  Description of Artificial Sequence: Synthetic oligonucleotide
caggcgggccgaggtggacac

SEQ ID NO: 69216 - DNA, 32 bp, Artificial Sequence
  Description of Artificial Sequence: Synthetic oligonucleotide
atgctgagtactggaacagccagaaggacatc

SEQ ID NO: 69217 - DNA, 31 bp, Artificial Sequence
  Description of Artificial Sequence: Synthetic oligonucleotide
tgctgagtactggaacagccagaaggacatc

SEQ ID NO: 69218 - DNA, 27 bp, Artificial Sequence
  Description of Artificial Sequence: Synthetic oligonucleotide
ttcaatgggacggagcgggtgcggtta

SEQ ID NO: 69219 - DNA, 26 bp, Artificial Sequence
  Description of Artificial Sequence: Synthetic oligonucleotide
tcaatgggacggagcgggtgcggtta

SEQ ID NO: 69220 - DNA, 25 bp, Artificial Sequence
  Description of Artificial Sequence: Synthetic oligonucleotide
caatgggacggagcgggtgcggtta

SEQ ID NO: 69221 - DNA, 26 bp, Artificial Sequence
  Description of Artificial Sequence: Synthetic oligonucleotide
aatgggacggagcgggtgcggttact

SEQ ID NO: 69222 - DNA, 25 bp, Artificial Sequence
  Description of Artificial Sequence: Synthetic oligonucleotide
atgggacggagcgggtgcggttact

SEQ ID NO: 69223 - DNA, 24 bp, Artificial Sequence
  Description of Artificial Sequence: Synthetic oligonucleotide
tgggacggagcgggtgcggttact

SEQ ID NO: 69224 - DNA, 23 bp, Artificial Sequence
  Description of Artificial Sequence: Synthetic oligonucleotide
gggacggagcgggtgcggttact

SEQ ID NO: 69225 - DNA, 23 bp, Artificial Sequence
  Description of Artificial Sequence: Synthetic oligonucleotide
ggacggagcgggtgcggttactg

SEQ ID NO: 69226 - DNA, 24 bp, Artificial Sequence
  Description of Artificial Sequence: Synthetic oligonucleotide
gacggagcgggtgcggttactgga

SEQ ID NO: 69227 - DNA, 25 bp, Artificial Sequence
  Description of Artificial Sequence: Synthetic oligonucleotide
acggagcgggtgcggttactggaga

SEQ ID NO: 69228 - DNA, 24 bp, Artificial Sequence
  Description of Artificial Sequence: Synthetic oligonucleotide
cggagcgggtgcggttactggaga

SEQ ID NO: 69229 - DNA, 25 bp, Artificial Sequence
  Description of Artificial Sequence: Synthetic oligonucleotide
ggagcgggtgcggttactggagaga

SEQ ID NO: 69230 - DNA, 26 bp, Artificial Sequence
  Description of Artificial Sequence: Synthetic oligonucleotide
gagcgggtgcggttactggagagaca

SEQ ID NO: 69231 - DNA, 27 bp, Artificial Sequence
  Description of Artificial Sequence: Synthetic oligonucleotide
agcgggtgcggttactggagagacact

SEQ ID NO: 69232 - DNA, 27 bp, Artificial Sequence
  Description of Artificial Sequence: Synthetic oligonucleotide
gcgggtgcggttactggagagacactt

SEQ ID NO: 69233 - DNA, 27 bp, Artificial Sequence
  Description of Artificial Sequence: Synthetic oligonucleotide
cgggtgcggttactggagagacacttc

SEQ ID NO: 69234 - DNA, 27 bp, Artificial Sequence
  Description of Artificial Sequence: Synthetic oligonucleotide
gggtgcggttactggagagacacttcc

SEQ ID NO: 69235 - DNA, 31 bp, Artificial Sequence
  Description of Artificial Sequence: Synthetic oligonucleotide
ggtgcggttactggagagacacttccataac

SEQ ID NO: 69236 - DNA, 31 bp, Artificial Sequence
  Description of Artificial Sequence: Synthetic oligonucleotide
gtgcggttactggagagacacttccataacc

SEQ ID NO: 69237 - DNA, 32 bp, Artificial Sequence
  Description of Artificial Sequence: Synthetic oligonucleotide
tgcggttactggagagacacttccataaccag

SEQ ID NO: 69238 - DNA, 31 bp, Artificial Sequence
  Description of Artificial Sequence: Synthetic oligonucleotide
gcggttactggagagacacttccataaccag

SEQ ID NO: 69239 - DNA, 31 bp, Artificial Sequence
  Description of Artificial Sequence: Synthetic oligonucleotide
cggttactggagagacacttccataaccagg

SEQ ID NO: 69240 - DNA, 32 bp, Artificial Sequence
  Description of Artificial Sequence: Synthetic oligonucleotide
ggttactggagagacacttccataaccaggag

SEQ ID NO: 69241 - DNA, 32 bp, Artificial Sequence
  Description of Artificial Sequence: Synthetic oligonucleotide
gttactggagagacacttccataaccaggagg

SEQ ID NO: 69242 - DNA, 33 bp, Artificial Sequence
  Description of Artificial Sequence: Synthetic oligonucleotide
ttactggagagacacttccataaccaggaggag

SEQ ID NO: 69243 - DNA, 32 bp, Artificial Sequence
  Description of Artificial Sequence: Synthetic oligonucleotide
tactggagagacacttccataaccaggaggag

SEQ ID NO: 69244 - DNA, 31 bp, Artificial Sequence
  Description of Artificial Sequence: Synthetic oligonucleotide
actggagagacacttccataaccaggaggag

SEQ ID NO: 69245 - DNA, 30 bp, Artificial Sequence
  Description of Artificial Sequence: Synthetic oligonucleotide
ctggagagacacttccataaccaggaggag

SEQ ID NO: 69246 - DNA, 30 bp, Artificial Sequence
  Description of Artificial Sequence: Synthetic oligonucleotide
tggagagacacttccataaccaggaggagc

SEQ ID NO: 69247 - DNA, 29 bp, Artificial Sequence
  Description of Artificial Sequence: Synthetic oligonucleotide
ggagagacacttccataaccaggaggagc

SEQ ID NO: 69248 - DNA, 30 bp, Artificial Sequence
  Description of Artificial Sequence: Synthetic oligonucleotide
gagagacacttccataaccaggaggagctc

SEQ ID NO: 69249 - DNA, 30 bp, Artificial Sequence
  Description of Artificial Sequence: Synthetic oligonucleotide
agagacacttccataaccaggaggagctcc

SEQ ID NO: 69250 - DNA, 29 bp, Artificial Sequence
  Description of Artificial Sequence: Synthetic oligonucleotide
gagacacttccataaccaggaggagctcc

SEQ ID NO: 69251 - DNA, 30 bp, Artificial Sequence
  Description of Artificial Sequence: Synthetic oligonucleotide
agacacttccataaccaggaggagctcctg

SEQ ID NO: 69252 - DNA, 29 bp, Artificial Sequence
  Description of Artificial Sequence: Synthetic oligonucleotide
gacacttccataaccaggaggagctcctg

SEQ ID NO: 69253 - DNA, 29 bp, Artificial Sequence
  Description of Artificial Sequence: Synthetic oligonucleotide
acacttccataaccaggaggagctcctgc

SEQ ID NO: 69254 - DNA, 28 bp, Artificial Sequence
  Description of Artificial Sequence: Synthetic oligonucleotide
cacttccataaccaggaggagctcctgc

SEQ ID NO: 69255 - DNA, 28 bp, Artificial Sequence
  Description of Artificial Sequence: Synthetic oligonucleotide
acttccataaccaggaggagctcctgcg

SEQ ID NO: 69256 - DNA, 27 bp, Artificial Sequence
  Description of Artificial Sequence: Synthetic oligonucleotide
cttccataaccaggaggagctcctgcg

SEQ ID NO: 69257 - DNA, 27 bp, Artificial Sequence
  Description of Artificial Sequence: Synthetic oligonucleotide
ttccataaccaggaggagctcctgcgc

SEQ ID NO: 69258 - DNA, 27 bp, Artificial Sequence
  Description of Artificial Sequence: Synthetic oligonucleotide
tccataaccaggaggagctcctgcgct

SEQ ID NO: 69259 - DNA, 27 bp, Artificial Sequence
  Description of Artificial Sequence: Synthetic oligonucleotide
ccataaccaggaggagctcctgcgctt

SEQ ID NO: 69260 - DNA, 27 bp, Artificial Sequence
  Description of Artificial Sequence: Synthetic oligonucleotide
cataaccaggaggagctcctgcgcttc

SEQ ID NO: 69261 - DNA, 27 bp, Artificial Sequence
  Description of Artificial Sequence: Synthetic oligonucleotide
ataaccaggaggagctcctgcgcttcg

SEQ ID NO: 69262 - DNA, 27 bp, Artificial Sequence
  Description of Artificial Sequence: Synthetic oligonucleotide
taaccaggaggagctcctgcgcttcga

SEQ ID NO: 69263 - DNA, 26 bp, Artificial Sequence
  Description of Artificial Sequence: Synthetic oligonucleotide
aaccaggaggagctcctgcgcttcga

SEQ ID NO: 69264 - DNA, 25 bp, Artificial Sequence
  Description of Artificial Sequence: Synthetic oligonucleotide
accaggaggagctcctgcgcttcga

SEQ ID NO: 69265 - DNA, 24 bp, Artificial Sequence
  Description of Artificial Sequence: Synthetic oligonucleotide
ccaggaggagctcctgcgcttcga

SEQ ID NO: 69266 - DNA, 25 bp, Artificial Sequence
  Description of Artificial Sequence: Synthetic oligonucleotide
caggaggagctcctgcgcttcgaca

SEQ ID NO: 69267 - DNA, 25 bp, Artificial Sequence
  Description of Artificial Sequence: Synthetic oligonucleotide
aggaggagctcctgcgcttcgacag

SEQ ID NO: 69268 - DNA, 24 bp, Artificial Sequence
  Description of Artificial Sequence: Synthetic oligonucleotide
ggaggagctcctgcgcttcgacag

SEQ ID NO: 69269 - DNA, 24 bp, Artificial Sequence
  Description of Artificial Sequence: Synthetic oligonucleotide
gaggagctcctgcgcttcgacagc

SEQ ID NO: 69270 - DNA, 25 bp, Artificial Sequence
  Description of Artificial Sequence: Synthetic oligonucleotide
aggagctcctgcgcttcgacagcga

SEQ ID NO: 69271 - DNA, 24 bp, Artificial Sequence
  Description of Artificial Sequence: Synthetic oligonucleotide
ggagctcctgcgcttcgacagcga

SEQ ID NO: 69272 - DNA, 24 bp, Artificial Sequence
  Description of Artificial Sequence: Synthetic oligonucleotide
gagctcctgcgcttcgacagcgac

SEQ ID NO: 69273 - DNA, 25 bp, Artificial Sequence
  Description of Artificial Sequence: Synthetic oligonucleotide
agctcctgcgcttcgacagcgacgt

SEQ ID NO: 69274 - DNA, 24 bp, Artificial Sequence
  Description of Artificial Sequence: Synthetic oligonucleotide
gctcctgcgcttcgacagcgacgt

SEQ ID NO: 69275 - DNA, 24 bp, Artificial Sequence
  Description of Artificial Sequence: Synthetic oligonucleotide
ctcctgcgcttcgacagcgacgtg

SEQ ID NO: 69276 - DNA, 26 bp, Artificial Sequence
  Description of Artificial Sequence: Synthetic oligonucleotide
cttcgacagcgacgtgggggagtact

SEQ ID NO: 69277 - DNA, 26 bp, Artificial Sequence
  Description of Artificial Sequence: Synthetic oligonucleotide
ttcgacagcgacgtgggggagtactg

SEQ ID NO: 69278 - DNA, 25 bp, Artificial Sequence
  Description of Artificial Sequence: Synthetic oligonucleotide
tcgacagcgacgtgggggagtactg

SEQ ID NO: 69279 - DNA, 24 bp, Artificial Sequence
  Description of Artificial Sequence: Synthetic oligonucleotide
cgacagcgacgtgggggagtactg

SEQ ID NO: 69280 - DNA, 24 bp, Artificial Sequence
  Description of Artificial Sequence: Synthetic oligonucleotide
gacagcgacgtgggggagtactgg

SEQ ID NO: 69281 - DNA, 24 bp, Artificial Sequence
  Description of Artificial Sequence: Synthetic oligonucleotide
acagcgacgtgggggagtactggg

SEQ ID NO: 69282 - DNA, 23 bp, Artificial Sequence
  Description of Artificial Sequence: Synthetic oligonucleotide
cagcgacgtgggggagtactggg

SEQ ID NO: 69283 - DNA, 23 bp, Artificial Sequence
  Description of Artificial Sequence: Synthetic oligonucleotide
agcgacgtgggggagtactgggc

SEQ ID NO: 69284 - DNA, 22 bp, Artificial Sequence
  Description of Artificial Sequence: Synthetic oligonucleotide
gcgacgtgggggagtactgggc

SEQ ID NO: 69285 - DNA, 22 bp, Artificial Sequence
  Description of Artificial Sequence: Synthetic oligonucleotide
cgacgtgggggagtactgggcg

SEQ ID NO: 69286 - DNA, 23 bp, Artificial Sequence
  Description of Artificial Sequence: Synthetic oligonucleotide
gacgtgggggagtactgggcggt

SEQ ID NO: 69287 - DNA, 24 bp, Artificial Sequence
  Description of Artificial Sequence: Synthetic oligonucleotide
acgtgggggagtactgggcggtga

SEQ ID NO: 69288 - DNA, 23 bp, Artificial Sequence
  Description of Artificial Sequence: Synthetic oligonucleotide
cgtgggggagtactgggcggtga

SEQ ID NO: 69289 - DNA, 23 bp, Artificial Sequence
  Description of Artificial Sequence: Synthetic oligonucleotide
gtgggggagtactgggcggtgac

SEQ ID NO: 69290 - DNA, 23 bp, Artificial Sequence
  Description of Artificial Sequence: Synthetic oligonucleotide
tgggggagtactgggcggtgacg

SEQ ID NO: 69291 - DNA, 22 bp, Artificial Sequence
  Description of Artificial Sequence: Synthetic oligonucleotide
gggggagtactgggcggtgacg

SEQ ID NO: 69292 - DNA, 23 bp, Artificial Sequence
  Description of Artificial Sequence: Synthetic oligonucleotide
ggggagtactgggcggtgacgga

SEQ ID NO: 69293 - DNA, 23 bp, Artificial Sequence
  Description of Artificial Sequence: Synthetic oligonucleotide
gggagtactgggcggtgacggag

SEQ ID NO: 69294 - DNA, 24 bp, Artificial Sequence
  Description of Artificial Sequence: Synthetic oligonucleotide
ggagtactgggcggtgacggagct

SEQ ID NO: 69295 - DNA, 24 bp, Artificial Sequence
  Description of Artificial Sequence: Synthetic oligonucleotide
gagtactgggcggtgacggagctg

SEQ ID NO: 69296 - DNA, 24 bp, Artificial Sequence
  Description of Artificial Sequence: Synthetic oligonucleotide
agtactgggcggtgacggagctgg

SEQ ID NO: 69297 - DNA, 23 bp, Artificial Sequence
  Description of Artificial Sequence: Synthetic oligonucleotide
gtactgggcggtgacggagctgg

SEQ ID NO: 69298 - DNA, 23 bp, Artificial Sequence
  Description of Artificial Sequence: Synthetic oligonucleotide
tactgggcggtgacggagctggg

SEQ ID NO: 69299 - DNA, 22 bp, Artificial Sequence
  Description of Artificial Sequence: Synthetic oligonucleotide
actgggcggtgacggagctggg

SEQ ID NO: 69300 - DNA, 33 bp, Artificial Sequence
  Description of Artificial Sequence: Synthetic oligonucleotide
tgcggttcctggacagatacttccataaccaag

SEQ ID NO: 69301 - DNA, 32 bp, Artificial Sequence
  Description of Artificial Sequence: Synthetic oligonucleotide
gcggttcctggacagatacttccataaccaag

SEQ ID NO: 69302 - DNA, 33 bp, Artificial Sequence
  Description of Artificial Sequence: Synthetic oligonucleotide
cggttcctggacagatacttccataaccaagag

SEQ ID NO: 69303 - DNA, 33 bp, Artificial Sequence
  Description of Artificial Sequence: Synthetic oligonucleotide
ggttcctggacagatacttccataaccaagagg

SEQ ID NO: 69304 - DNA, 34 bp, Artificial Sequence
  Description of Artificial Sequence: Synthetic oligonucleotide
gttcctggacagatacttccataaccaagaggag

SEQ ID NO: 69305 - DNA, 36 bp, Artificial Sequence
  Description of Artificial Sequence: Synthetic oligonucleotide
ttcctggacagatacttccataaccaagaggagtac

SEQ ID NO: 69306 - DNA, 35 bp, Artificial Sequence
  Description of Artificial Sequence: Synthetic oligonucleotide
tcctggacagatacttccataaccaagaggagtac

SEQ ID NO: 69307 - DNA, 34 bp, Artificial Sequence
  Description of Artificial Sequence: Synthetic oligonucleotide
cctggacagatacttccataaccaagaggagtac

SEQ ID NO: 69308 - DNA, 34 bp, Artificial Sequence
  Description of Artificial Sequence: Synthetic oligonucleotide
ctggacagatacttccataaccaagaggagtacg

SEQ ID NO: 69309 - DNA, 35 bp, Artificial Sequence
  Description of Artificial Sequence: Synthetic oligonucleotide
tggacagatacttccataaccaagaggagtacgtg

SEQ ID NO: 69310 - DNA, 34 bp, Artificial Sequence
  Description of Artificial Sequence: Synthetic oligonucleotide
ggacagatacttccataaccaagaggagtacgtg

SEQ ID NO: 69311 - DNA, 34 bp, Artificial Sequence
  Description of Artificial Sequence: Synthetic oligonucleotide
gacagatacttccataaccaagaggagtacgtgc

SEQ ID NO: 69312 - DNA, 34 bp, Artificial Sequence
  Description of Artificial Sequence: Synthetic oligonucleotide
acagatacttccataaccaagaggagtacgtgcg

SEQ ID NO: 69313 - DNA, 33 bp, Artificial Sequence
  Description of Artificial Sequence: Synthetic oligonucleotide
cagatacttccataaccaagaggagtacgtgcg

SEQ ID NO: 69314 - DNA, 33 bp, Artificial Sequence
  Description of Artificial Sequence: Synthetic oligonucleotide
agatacttccataaccaagaggagtacgtgcgc

SEQ ID NO: 69315 - DNA, 32 bp, Artificial Sequence
  Description of Artificial Sequence: Synthetic oligonucleotide
gatacttccataaccaagaggagtacgtgcgc

SEQ ID NO: 69316 - DNA, 34 bp, Artificial Sequence
  Description of Artificial Sequence: Synthetic oligonucleotide
atacttccataaccaagaggagtacgtgcgcttc

SEQ ID NO: 69317 - DNA, 33 bp, Artificial Sequence
  Description of Artificial Sequence: Synthetic oligonucleotide
tacttccataaccaagaggagtacgtgcgcttc

SEQ ID NO: 69318 - DNA, 32 bp, Artificial Sequence
  Description of Artificial Sequence: Synthetic oligonucleotide
acttccataaccaagaggagtacgtgcgcttc

SEQ ID NO: 69319 - DNA, 31 bp, Artificial Sequence
  Description of Artificial Sequence: Synthetic oligonucleotide
cttccataaccaagaggagtacgtgcgcttc

SEQ ID NO: 69320 - DNA, 31 bp, Artificial Sequence
  Description of Artificial Sequence: Synthetic oligonucleotide
ttccataaccaagaggagtacgtgcgcttcg

SEQ ID NO: 69321 - DNA, 30 bp, Artificial Sequence
  Description of Artificial Sequence: Synthetic oligonucleotide
tccataaccaagaggagtacgtgcgcttcg

SEQ ID NO: 69322 - DNA, 29 bp, Artificial Sequence
  Description of Artificial Sequence: Synthetic oligonucleotide
ccataaccaagaggagtacgtgcgcttcg

SEQ ID NO: 69323 - DNA, 30 bp, Artificial Sequence
  Description of Artificial Sequence: Synthetic oligonucleotide
cataaccaagaggagtacgtgcgcttcgac

SEQ ID NO: 69324 - DNA, 30 bp, Artificial Sequence
  Description of Artificial Sequence: Synthetic oligonucleotide
tgcagacacaactacggggttggtgagaac

SEQ ID NO: 69325 - DNA, 29 bp, Artificial Sequence
  Description of Artificial Sequence: Synthetic oligonucleotide
gcagacacaactacggggttggtgagaac

SEQ ID NO: 69326 - DNA, 31 bp, Artificial Sequence
  Description of Artificial Sequence: Synthetic oligonucleotide
cagacacaactacggggttggtgagaacttc

SEQ ID NO: 69327 - DNA, 32 bp, Artificial Sequence
  Description of Artificial Sequence: Synthetic oligonucleotide
agacacaactacggggttggtgagaacttcac

SEQ ID NO: 69328 - DNA, 31 bp, Artificial Sequence
  Description of Artificial Sequence: Synthetic oligonucleotide
gacacaactacggggttggtgagaacttcac

SEQ ID NO: 69329 - DNA, 31 bp, Artificial Sequence
  Description of Artificial Sequence: Synthetic oligonucleotide
acacaactacggggttggtgagaacttcacg

SEQ ID NO: 69330 - DNA, 30 bp, Artificial Sequence
  Description of Artificial Sequence: Synthetic oligonucleotide
cacaactacggggttggtgagaacttcacg

SEQ ID NO: 69331 - DNA, 30 bp, Artificial Sequence
  Description of Artificial Sequence: Synthetic oligonucleotide
acaactacggggttggtgagaacttcacgg

SEQ ID NO: 69332 - DNA, 29 bp, Artificial Sequence
  Description of Artificial Sequence: Synthetic oligonucleotide
caactacggggttggtgagaacttcacgg

SEQ ID NO: 69333 - DNA, 30 bp, Artificial Sequence
  Description of Artificial Sequence: Synthetic oligonucleotide
aactacggggttggtgagaacttcacggtg

SEQ ID NO: 69334 - DNA, 29 bp, Artificial Sequence
  Description of Artificial Sequence: Synthetic oligonucleotide
actacggggttggtgagaacttcacggtg

SEQ ID NO: 69335 - DNA, 28 bp, Artificial Sequence
  Description of Artificial Sequence: Synthetic oligonucleotide
ctacggggttggtgagaacttcacggtg

SEQ ID NO: 69336 - DNA, 28 bp, Artificial Sequence
  Description of Artificial Sequence: Synthetic oligonucleotide
tacggggttggtgagaacttcacggtgc

SEQ ID NO: 69337 - DNA, 27 bp, Artificial Sequence
  Description of Artificial Sequence: Synthetic oligonucleotide
acggggttggtgagaacttcacggtgc

SEQ ID NO: 69338 - DNA, 27 bp, Artificial Sequence
  Description of Artificial Sequence: Synthetic oligonucleotide
cggggttggtgagaacttcacggtgca

SEQ ID NO: 69339 - DNA, 27 bp, Artificial Sequence
  Description of Artificial Sequence: Synthetic oligonucleotide
ggggttggtgagaacttcacggtgcag

SEQ ID NO: 69340 - DNA, 27 bp, Artificial Sequence
  Description of Artificial Sequence: Synthetic oligonucleotide
gggttggtgagaacttcacggtgcagc

SEQ ID NO: 69341 - DNA, 27 bp, Artificial Sequence
  Description of Artificial Sequence: Synthetic oligonucleotide
ggttggtgagaacttcacggtgcagcg

SEQ ID NO: 69342 - DNA, 27 bp, Artificial Sequence
  Description of Artificial Sequence: Synthetic oligonucleotide
gttggtgagaacttcacggtgcagcgg

SEQ ID NO: 69343 - DNA, 27 bp, Artificial Sequence
  Description of Artificial Sequence: Synthetic oligonucleotide
ttggtgagaacttcacggtgcagcggc

SEQ ID NO: 69344 - DNA, 26 bp, Artificial Sequence
  Description of Artificial Sequence: Synthetic oligonucleotide
tggtgagaacttcacggtgcagcggc

SEQ ID NO: 69345 - DNA, 25 bp, Artificial Sequence
  Description of Artificial Sequence: Synthetic oligonucleotide
ggtgagaacttcacggtgcagcggc

SEQ ID NO: 69346 - DNA, 26 bp, Artificial Sequence
  Description of Artificial Sequence: Synthetic oligonucleotide
gtgagaacttcacggtgcagcggcga

SEQ ID NO: 69347 - DNA, 26 bp, Artificial Sequence
  Description of Artificial Sequence: Synthetic oligonucleotide
tgagaacttcacggtgcagcggcgag

SEQ ID NO: 69348 - DNA, 31 bp, Artificial Sequence
  Description of Artificial Sequence: Synthetic oligonucleotide
gaacagccagaaggacatcctggaagacaag

SEQ ID NO: 69349 - DNA, 31 bp, Artificial Sequence
  Description of Artificial Sequence: Synthetic oligonucleotide
aacagccagaaggacatcctggaagacaagc

SEQ ID NO: 69350 - DNA, 30 bp, Artificial Sequence
  Description of Artificial Sequence: Synthetic oligonucleotide
acagccagaaggacatcctggaagacaagc

SEQ ID NO: 69351 - DNA, 29 bp, Artificial Sequence
  Description of Artificial Sequence: Synthetic oligonucleotide
cagccagaaggacatcctggaagacaagc

SEQ ID NO: 69352 - DNA, 29 bp, Artificial Sequence
  Description of Artificial Sequence: Synthetic oligonucleotide
agccagaaggacatcctggaagacaagcg

SEQ ID NO: 69353 - DNA, 28 bp, Artificial Sequence
  Description of Artificial Sequence: Synthetic oligonucleotide
gccagaaggacatcctggaagacaagcg

SEQ ID NO: 69354 - DNA, 28 bp, Artificial Sequence
  Description of Artificial Sequence: Synthetic oligonucleotide
ccagaaggacatcctggaagacaagcgg

SEQ ID NO: 69355 - DNA, 28 bp, Artificial Sequence
  Description of Artificial Sequence: Synthetic oligonucleotide
cagaaggacatcctggaagacaagcggg

SEQ ID NO: 69356 - DNA, 28 bp, Artificial Sequence
  Description of Artificial Sequence: Synthetic oligonucleotide
agaaggacatcctggaagacaagcgggc

SEQ ID NO: 69357 - DNA, 27 bp, Artificial Sequence
  Description of Artificial Sequence: Synthetic oligonucleotide
gaaggacatcctggaagacaagcgggc

SEQ ID NO: 69358 - DNA, 27 bp, Artificial Sequence
  Description of Artificial Sequence: Synthetic oligonucleotide
aaggacatcctggaagacaagcgggcc

SEQ ID NO: 69359 - DNA, 26 bp, Artificial Sequence
  Description of Artificial Sequence: Synthetic oligonucleotide
aggacatcctggaagacaagcgggcc

SEQ ID NO: 69360 - DNA, 25 bp, Artificial Sequence
  Description of Artificial Sequence: Synthetic oligonucleotide
ggacatcctggaagacaagcgggcc

SEQ ID NO: 69361 - DNA, 25 bp, Artificial Sequence
  Description of Artificial Sequence: Synthetic oligonucleotide
gacatcctggaagacaagcgggccg

SEQ ID NO: 69362 - DNA, 25 bp, Artificial Sequence
  Description of Artificial Sequence: Synthetic oligonucleotide
acatcctggaagacaagcgggccgc

SEQ ID NO: 69363 - DNA, 24 bp, Artificial Sequence
  Description of Artificial Sequence: Synthetic oligonucleotide
catcctggaagacaagcgggccgc

SEQ ID NO: 69364 - DNA, 24 bp, Artificial Sequence
  Description of Artificial Sequence: Synthetic oligonucleotide
atcctggaagacaagcgggccgcg

SEQ ID NO: 69365 - DNA, 23 bp, Artificial Sequence
  Description of Artificial Sequence: Synthetic oligonucleotide
tcctggaagacaagcgggccgcg

SEQ ID NO: 69366 - DNA, 22 bp, Artificial Sequence
  Description of Artificial Sequence: Synthetic oligonucleotide
cctggaagacaagcgggccgcg

SEQ ID NO: 69367 - DNA, 23 bp, Artificial Sequence
  Description of Artificial Sequence: Synthetic oligonucleotide
ctggaagacaagcgggccgcggt

SEQ ID NO: 69368 - DNA, 23 bp, Artificial Sequence
  Description of Artificial Sequence: Synthetic oligonucleotide
tggaagacaagcgggccgcggtg

SEQ ID NO: 69369 - DNA, 22 bp, Artificial Sequence
  Description of Artificial Sequence: Synthetic oligonucleotide
ggaagacaagcgggccgcggtg

SEQ ID NO: 69370 - DNA, 23 bp, Artificial Sequence
  Description of Artificial Sequence: Synthetic oligonucleotide
gaagacaagcgggccgcggtgga

SEQ ID NO: 69371 - DNA, 24 bp, Artificial Sequence
  Description of Artificial Sequence: Synthetic oligonucleotide
aagacaagcgggccgcggtggaca

SEQ ID NO: 69372 - DNA, 23 bp, Artificial Sequence
  Description of Artificial Sequence: Synthetic oligonucleotide
agacaagcgggccgcggtggaca

SEQ ID NO: 69373 - DNA, 22 bp, Artificial Sequence
  Description of Artificial Sequence: Synthetic oligonucleotide
gacaagcgggccgcggtggaca

SEQ ID NO: 69374 - DNA, 22 bp, Artificial Sequence
  Description of Artificial Sequence: Synthetic oligonucleotide
acaagcgggccgcggtggacac

SEQ ID NO: 69375 - DNA, 21 bp, Artificial Sequence
  Description of Artificial Sequence: Synthetic oligonucleotide
caagcgggccgcggtggacac

SEQ ID NO: 69376 - DNA, 27 bp, Artificial Sequence
  Description of Artificial Sequence: Synthetic oligonucleotide
tggctggggacacccaaccacgtttct

SEQ ID NO: 69377 - DNA, 27 bp, Artificial Sequence
  Description of Artificial Sequence: Synthetic oligonucleotide
ggctggggacacccaaccacgtttctt

SEQ ID NO: 69378 - DNA, 27 bp, Artificial Sequence
  Description of Artificial Sequence: Synthetic oligonucleotide
gctggggacacccaaccacgtttcttg

SEQ ID NO: 69379 - DNA, 29 bp, Artificial Sequence
  Description of Artificial Sequence: Synthetic oligonucleotide
ctggggacacccaaccacgtttcttgaag

SEQ ID NO: 69380 - DNA, 29 bp, Artificial Sequence
  Description of Artificial Sequence: Synthetic oligonucleotide
tggggacacccaaccacgtttcttgaagc

SEQ ID NO: 69381 - DNA, 28 bp, Artificial Sequence
  Description of Artificial Sequence: Synthetic oligonucleotide
ggggacacccaaccacgtttcttgaagc

SEQ ID NO: 69382 - DNA, 29 bp, Artificial Sequence
  Description of Artificial Sequence: Synthetic oligonucleotide
gggacacccaaccacgtttcttgaagcag

SEQ ID NO: 69383 - DNA, 29 bp, Artificial Sequence
  Description of Artificial Sequence: Synthetic oligonucleotide
ggacacccaaccacgtttcttgaagcagg

SEQ ID NO: 69384 - DNA, 33 bp, Artificial Sequence
  Description of Artificial Sequence: Synthetic oligonucleotide
gacacccaaccacgtttcttgaagcaggataag

SEQ ID NO: 69385 - DNA, 36 bp, Artificial Sequence
  Description of Artificial Sequence: Synthetic oligonucleotide
acacccaaccacgtttcttgaagcaggataagtttg

SEQ ID NO: 69386 - DNA, 35 bp, Artificial Sequence
  Description of Artificial Sequence: Synthetic oligonucleotide
cacccaaccacgtttcttgaagcaggataagtttg

SEQ ID NO: 69387 - DNA, 36 bp, Artificial Sequence
  Description of Artificial Sequence: Synthetic oligonucleotide
acccaaccacgtttcttgaagcaggataagtttgag

SEQ ID NO: 69388 - DNA, 35 bp, Artificial Sequence
  Description of Artificial Sequence: Synthetic oligonucleotide
cccaaccacgtttcttgaagcaggataagtttgag

SEQ ID NO: 69389 - DNA, 36 bp, Artificial Sequence
  Description of Artificial Sequence: Synthetic oligonucleotide
ccaaccacgtttcttgaagcaggataagtttgagtg

SEQ ID NO: 69390 - DNA, 37 bp, Artificial Sequence
  Description of Artificial Sequence: Synthetic oligonucleotide
caaccacgtttcttgaagcaggataagtttgagtgtc

SEQ ID NO: 69391 - DNA, 41 bp, Artificial Sequence
  Description of Artificial Sequence: Synthetic oligonucleotide
aaccacgtttcttgaagcaggataagtttgagtgtcatttc

SEQ ID NO: 69392 - DNA, 40 bp, Artificial Sequence
  Description of Artificial Sequence: Synthetic oligonucleotide
accacgtttcttgaagcaggataagtttgagtgtcatttc

SEQ ID NO: 69393 - DNA, 39 bp, Artificial Sequence
  Description of Artificial Sequence: Synthetic oligonucleotide
ccacgtttcttgaagcaggataagtttgagtgtcatttc

SEQ ID NO: 69394 - DNA, 41 bp, Artificial Sequence
  Description of Artificial Sequence: Synthetic oligonucleotide
cacgtttcttgaagcaggataagtttgagtgtcatttcttc

SEQ ID NO: 69395 - DNA, 43 bp, Artificial Sequence
  Description of Artificial Sequence: Synthetic oligonucleotide
acgtttcttgaagcaggataagtttgagtgtcatttcttcaac

SEQ ID NO: 69396 - DNA, 42 bp, Artificial Sequence
  Description of Artificial Sequence: Synthetic oligonucleotide
cgtttcttgaagcaggataagtttgagtgtcatttcttcaac

SEQ ID NO: 69397 - DNA, 42 bp, Artificial Sequence
  Description of Artificial Sequence: Synthetic oligonucleotide
gtttcttgaagcaggataagtttgagtgtcatttcttcaacg

SEQ ID NO: 69398 - DNA, 42 bp, Artificial Sequence
  Description of Artificial Sequence: Synthetic oligonucleotide
tttcttgaagcaggataagtttgagtgtcatttcttcaacgg

SEQ ID NO: 69399 - DNA, 41 bp, Artificial Sequence
  Description of Artificial Sequence: Synthetic oligonucleotide
ttcttgaagcaggataagtttgagtgtcatttcttcaacgg

SEQ ID NO: 69400 - DNA, 40 bp, Artificial Sequence
  Description of Artificial Sequence: Synthetic oligonucleotide
tcttgaagcaggataagtttgagtgtcatttcttcaacgg

SEQ ID NO: 69401 - DNA, 39 bp, Artificial Sequence
  Description of Artificial Sequence: Synthetic oligonucleotide
cttgaagcaggataagtttgagtgtcatttcttcaacgg

SEQ ID NO: 69402 - DNA, 39 bp, Artificial Sequence
  Description of Artificial Sequence: Synthetic oligonucleotide
ttgaagcaggataagtttgagtgtcatttcttcaacggg

SEQ ID NO: 69403 - DNA, 38 bp, Artificial Sequence
  Description of Artificial Sequence: Synthetic oligonucleotide
tgaagcaggataagtttgagtgtcatttcttcaacggg

SEQ ID NO: 69404 - DNA, 37 bp, Artificial Sequence
  Description of Artificial Sequence: Synthetic oligonucleotide
gaagcaggataagtttgagtgtcatttcttcaacggg

SEQ ID NO: 69405 - DNA, 38 bp, Artificial Sequence
  Description of Artificial Sequence: Synthetic oligonucleotide
aagcaggataagtttgagtgtcatttcttcaacgggac

SEQ ID NO: 69406 - DNA, 37 bp, Artificial Sequence
  Description of Artificial Sequence: Synthetic oligonucleotide
agcaggataagtttgagtgtcatttcttcaacgggac

SEQ ID NO: 69407 - DNA, 36 bp, Artificial Sequence
  Description of Artificial Sequence: Synthetic oligonucleotide
gcaggataagtttgagtgtcatttcttcaacgggac

SEQ ID NO: 69408 - DNA, 36 bp, Artificial Sequence
  Description of Artificial Sequence: Synthetic oligonucleotide
caggataagtttgagtgtcatttcttcaacgggacg

SEQ ID NO: 69409 - DNA, 36 bp, Artificial Sequence
  Description of Artificial Sequence: Synthetic oligonucleotide
aggataagtttgagtgtcatttcttcaacgggacgg

SEQ ID NO: 69410 - DNA, 35 bp, Artificial Sequence
  Description of Artificial Sequence: Synthetic oligonucleotide
ggataagtttgagtgtcatttcttcaacgggacgg

SEQ ID NO: 69411 - DNA, 36 bp, Artificial Sequence
  Description of Artificial Sequence: Synthetic oligonucleotide
gataagtttgagtgtcatttcttcaacgggacggag

SEQ ID NO: 69412 - DNA, 36 bp, Artificial Sequence
  Description of Artificial Sequence: Synthetic oligonucleotide
ataagtttgagtgtcatttcttcaacgggacggagc

SEQ ID NO: 69413 - DNA, 35 bp, Artificial Sequence
  Description of Artificial Sequence: Synthetic oligonucleotide
taagtttgagtgtcatttcttcaacgggacggagc

SEQ ID NO: 69414 - DNA, 34 bp, Artificial Sequence
  Description of Artificial Sequence: Synthetic oligonucleotide
aagtttgagtgtcatttcttcaacgggacggagc

SEQ ID NO: 69415 - DNA, 33 bp, Artificial Sequence
  Description of Artificial Sequence: Synthetic oligonucleotide
agtttgagtgtcatttcttcaacgggacggagc

SEQ ID NO: 69416 - DNA, 32 bp, Artificial Sequence
  Description of Artificial Sequence: Synthetic oligonucleotide
gtttgagtgtcatttcttcaacgggacggagc

SEQ ID NO: 69417 - DNA, 32 bp, Artificial Sequence
  Description of Artificial Sequence: Synthetic oligonucleotide
tttgagtgtcatttcttcaacgggacggagcg

SEQ ID NO: 69418 - DNA, 31 bp, Artificial Sequence
  Description of Artificial Sequence: Synthetic oligonucleotide
ttgagtgtcatttcttcaacgggacggagcg

SEQ ID NO: 69419 - DNA, 24 bp, Artificial Sequence
  Description of Artificial Sequence: Synthetic oligonucleotide
aacgggacggagcgggtgcggtat

SEQ ID NO: 69420 - DNA, 23 bp, Artificial Sequence
  Description of Artificial Sequence: Synthetic oligonucleotide
acgggacggagcgggtgcggtat

SEQ ID NO: 69421 - DNA, 22 bp, Artificial Sequence
  Description of Artificial Sequence: Synthetic oligonucleotide
cgggacggagcgggtgcggtat

SEQ ID NO: 69422 - DNA, 23 bp, Artificial Sequence
  Description of Artificial Sequence: Synthetic oligonucleotide
gggacggagcgggtgcggtatct

SEQ ID NO: 69423 - DNA, 23 bp, Artificial Sequence
  Description of Artificial Sequence: Synthetic oligonucleotide
ggacggagcgggtgcggtatctg

SEQ ID NO: 69424 - DNA, 24 bp, Artificial Sequence
  Description of Artificial Sequence: Synthetic oligonucleotide
gacggagcgggtgcggtatctgca

SEQ ID NO: 69425 - DNA, 25 bp, Artificial Sequence
  Description of Artificial Sequence: Synthetic oligonucleotide
acggagcgggtgcggtatctgcaca

SEQ ID NO: 69426 - DNA, 24 bp, Artificial Sequence
  Description of Artificial Sequence: Synthetic oligonucleotide
cggagcgggtgcggtatctgcaca

SEQ ID NO: 69427 - DNA, 25 bp, Artificial Sequence
  Description of Artificial Sequence: Synthetic oligonucleotide
ggagcgggtgcggtatctgcacaga

SEQ ID NO: 69428 - DNA, 25 bp, Artificial Sequence
  Description of Artificial Sequence: Synthetic oligonucleotide
gagcgggtgcggtatctgcacagag

SEQ ID NO: 69429 - DNA, 25 bp, Artificial Sequence
  Description of Artificial Sequence: Synthetic oligonucleotide
agcgggtgcggtatctgcacagagg

SEQ ID NO: 69430 - DNA, 24 bp, Artificial Sequence
  Description of Artificial Sequence: Synthetic oligonucleotide
gcgggtgcggtatctgcacagagg

SEQ ID NO: 69431 - DNA, 26 bp, Artificial Sequence
  Description of Artificial Sequence: Synthetic oligonucleotide
cgggtgcggtatctgcacagaggcat

SEQ ID NO: 69432 - DNA, 27 bp, Artificial Sequence
  Description of Artificial Sequence: Synthetic oligonucleotide
gggtgcggtatctgcacagaggcatct

SEQ ID NO: 69433 - DNA, 31 bp, Artificial Sequence
  Description of Artificial Sequence: Synthetic oligonucleotide
ggtgcggtatctgcacagaggcatctataac

SEQ ID NO: 69434 - DNA, 31 bp, Artificial Sequence
  Description of Artificial Sequence: Synthetic oligonucleotide
gtgcggtatctgcacagaggcatctataacc

SEQ ID NO: 69435 - DNA, 33 bp, Artificial Sequence
  Description of Artificial Sequence: Synthetic oligonucleotide
tgcggtatctgcacagaggcatctataaccaag

SEQ ID NO: 69436 - DNA, 32 bp, Artificial Sequence
  Description of Artificial Sequence: Synthetic oligonucleotide
gcggtatctgcacagaggcatctataaccaag

SEQ ID NO: 69437 - DNA, 33 bp, Artificial Sequence
  Description of Artificial Sequence: Synthetic oligonucleotide
cggtatctgcacagaggcatctataaccaagag

SEQ ID NO: 69438 - DNA, 33 bp, Artificial Sequence
  Description of Artificial Sequence: Synthetic oligonucleotide
ggtatctgcacagaggcatctataaccaagagg

SEQ ID NO: 69439 - DNA, 34 bp, Artificial Sequence
  Description of Artificial Sequence: Synthetic oligonucleotide
gtatctgcacagaggcatctataaccaagaggag

SEQ ID NO: 69440 - DNA, 36 bp, Artificial Sequence
  Description of Artificial Sequence: Synthetic oligonucleotide
tatctgcacagaggcatctataaccaagaggagaac

SEQ ID NO: 69441 - DNA, 35 bp, Artificial Sequence
  Description of Artificial Sequence: Synthetic oligonucleotide
atctgcacagaggcatctataaccaagaggagaac

SEQ ID NO: 69442 - DNA, 34 bp, Artificial Sequence
  Description of Artificial Sequence: Synthetic oligonucleotide
tctgcacagaggcatctataaccaagaggagaac

SEQ ID NO: 69443 - DNA, 33 bp, Artificial Sequence
  Description of Artificial Sequence: Synthetic oligonucleotide
ctgcacagaggcatctataaccaagaggagaac

SEQ ID NO: 69444 - DNA, 33 bp, Artificial Sequence
  Description of Artificial Sequence: Synthetic oligonucleotide
tgcacagaggcatctataaccaagaggagaacg

SEQ ID NO: 69445 - DNA, 32 bp, Artificial Sequence
  Description of Artificial Sequence: Synthetic oligonucleotide
gcacagaggcatctataaccaagaggagaacg

SEQ ID NO: 69446 - DNA, 33 bp, Artificial Sequence
  Description of Artificial Sequence: Synthetic oligonucleotide
cacagaggcatctataaccaagaggagaacgtg

SEQ ID NO: 69447 - DNA, 33 bp, Artificial Sequence
  Description of Artificial Sequence: Synthetic oligonucleotide
acagaggcatctataaccaagaggagaacgtgc

SEQ ID NO: 69448 - DNA, 32 bp, Artificial Sequence
  Description of Artificial Sequence: Synthetic oligonucleotide
cagaggcatctataaccaagaggagaacgtgc

SEQ ID NO: 69449 - DNA, 32 bp, Artificial Sequence
  Description of Artificial Sequence: Synthetic oligonucleotide
agaggcatctataaccaagaggagaacgtgcg

SEQ ID NO: 69450 - DNA, 31 bp, Artificial Sequence
  Description of Artificial Sequence: Synthetic oligonucleotide
gaggcatctataaccaagaggagaacgtgcg

SEQ ID NO: 69451 - DNA, 31 bp, Artificial Sequence
  Description of Artificial Sequence: Synthetic oligonucleotide
aggcatctataaccaagaggagaacgtgcgc

SEQ ID NO: 69452 - DNA, 30 bp, Artificial Sequence
  Description of Artificial Sequence: Synthetic oligonucleotide
ggcatctataaccaagaggagaacgtgcgc

SEQ ID NO: 69453 - DNA, 32 bp, Artificial Sequence
  Description of Artificial Sequence: Synthetic oligonucleotide
gcatctataaccaagaggagaacgtgcgcttc

SEQ ID NO: 69454 - DNA, 32 bp, Artificial Sequence
  Description of Artificial Sequence: Synthetic oligonucleotide
catctataaccaagaggagaacgtgcgcttcg

SEQ ID NO: 69455 - DNA, 33 bp, Artificial Sequence
  Description of Artificial Sequence: Synthetic oligonucleotide
atctataaccaagaggagaacgtgcgcttcgac

SEQ ID NO: 69456 - DNA, 27 bp, Artificial Sequence
  Description of Artificial Sequence: Synthetic oligonucleotide
ccgagtcctggaacagccagaaggact

SEQ ID NO: 69457 - DNA, 28 bp, Artificial Sequence
  Description of Artificial Sequence: Synthetic oligonucleotide
cgagtcctggaacagccagaaggacttc

SEQ ID NO: 69458 - DNA, 28 bp, Artificial Sequence
  Description of Artificial Sequence: Synthetic oligonucleotide
gagtcctggaacagccagaaggacttcc

SEQ ID NO: 69459 - DNA, 29 bp, Artificial Sequence
  Description of Artificial Sequence: Synthetic oligonucleotide
agtcctggaacagccagaaggacttcctg

SEQ ID NO: 69460 - DNA, 28 bp, Artificial Sequence
  Description of Artificial Sequence: Synthetic oligonucleotide
gtcctggaacagccagaaggacttcctg

SEQ ID NO: 69461 - DNA, 28 bp, Artificial Sequence
  Description of Artificial Sequence: Synthetic oligonucleotide
tcctggaacagccagaaggacttcctgg

SEQ ID NO: 69462 - DNA, 27 bp, Artificial Sequence
  Description of Artificial Sequence: Synthetic oligonucleotide
cctggaacagccagaaggacttcctgg

SEQ ID NO: 69463 - DNA, 27 bp, Artificial Sequence
  Description of Artificial Sequence: Synthetic oligonucleotide
gaacagccagaaggacttcctggagcg

SEQ ID NO: 69464 - DNA, 27 bp, Artificial Sequence
  Description of Artificial Sequence: Synthetic oligonucleotide
aacagccagaaggacttcctggagcgg

SEQ ID NO: 69465 - DNA, 27 bp, Artificial Sequence
  Description of Artificial Sequence: Synthetic oligonucleotide
acagccagaaggacttcctggagcgga

SEQ ID NO: 69466 - DNA, 26 bp, Artificial Sequence
  Description of Artificial Sequence: Synthetic oligonucleotide
cagccagaaggacttcctggagcgga

SEQ ID NO: 69467 - DNA, 26 bp, Artificial Sequence
  Description of Artificial Sequence: Synthetic oligonucleotide
agccagaaggacttcctggagcggag

SEQ ID NO: 69468 - DNA, 25 bp, Artificial Sequence
  Description of Artificial Sequence: Synthetic oligonucleotide
gccagaaggacttcctggagcggag

SEQ ID NO: 69469 - DNA, 25 bp, Artificial Sequence
  Description of Artificial Sequence: Synthetic oligonucleotide
ccagaaggacttcctggagcggagg

SEQ ID NO: 69470 - DNA, 25 bp, Artificial Sequence
  Description of Artificial Sequence: Synthetic oligonucleotide
cagaaggacttcctggagcggaggc

SEQ ID NO: 69471 - DNA, 25 bp, Artificial Sequence
  Description of Artificial Sequence: Synthetic oligonucleotide
agaaggacttcctggagcggaggcg

SEQ ID NO: 69472 - DNA, 24 bp, Artificial Sequence
  Description of Artificial Sequence: Synthetic oligonucleotide
gaaggacttcctggagcggaggcg

SEQ ID NO: 69473 - DNA, 24 bp, Artificial Sequence
  Description of Artificial Sequence: Synthetic oligonucleotide
aaggacttcctggagcggaggcgg

SEQ ID NO: 69474 - DNA, 23 bp, Artificial Sequence
  Description of Artificial Sequence: Synthetic oligonucleotide
aggacttcctggagcggaggcgg

SEQ ID NO: 69475 - DNA, 22 bp, Artificial Sequence
  Description of Artificial Sequence: Synthetic oligonucleotide
ggacttcctggagcggaggcgg

SEQ ID NO: 69476 - DNA, 22 bp, Artificial Sequence
  Description of Artificial Sequence: Synthetic oligonucleotide
gacttcctggagcggaggcggg

SEQ ID NO: 69477 - DNA, 22 bp, Artificial Sequence
  Description of Artificial Sequence: Synthetic oligonucleotide
acttcctggagcggaggcgggc

SEQ ID NO: 69478 - DNA, 21 bp, Artificial Sequence
  Description of Artificial Sequence: Synthetic oligonucleotide
cttcctggagcggaggcgggc

SEQ ID NO: 69479 - DNA, 21 bp, Artificial Sequence
  Description of Artificial Sequence: Synthetic oligonucleotide
ttcctggagcggaggcgggcc

SEQ ID NO: 69480 - DNA, 21 bp, Artificial Sequence
  Description of Artificial Sequence: Synthetic oligonucleotide
gcgggccgaggtggacaccgt

SEQ ID NO: 69481 - DNA, 22 bp, Artificial Sequence
  Description of Artificial Sequence: Synthetic oligonucleotide
cgggccgaggtggacaccgtgt

SEQ ID NO: 69482 - DNA, 22 bp, Artificial Sequence
  Description of Artificial Sequence: Synthetic oligonucleotide
gggccgaggtggacaccgtgtg

SEQ ID NO: 69483 - DNA, 23 bp, Artificial Sequence
  Description of Artificial Sequence: Synthetic oligonucleotide
ggccgaggtggacaccgtgtgca

SEQ ID NO: 69484 - DNA, 24 bp, Artificial Sequence
  Description of Artificial Sequence: Synthetic oligonucleotide
gccgaggtggacaccgtgtgcaga

SEQ ID NO: 69485 - DNA, 25 bp, Artificial Sequence
  Description of Artificial Sequence: Synthetic oligonucleotide
ccgaggtggacaccgtgtgcagaca

SEQ ID NO: 69486 - DNA, 27 bp, Artificial Sequence
  Description of Artificial Sequence: Synthetic oligonucleotide
cgaggtggacaccgtgtgcagacacaa

SEQ ID NO: 69487 - DNA, 27 bp, Artificial Sequence
  Description of Artificial Sequence: Synthetic oligonucleotide
gaggtggacaccgtgtgcagacacaac

SEQ ID NO: 69488 - DNA, 28 bp, Artificial Sequence
  Description of Artificial Sequence: Synthetic oligonucleotide
gggttggtgagagcttcacagtgcagag

SEQ ID NO: 69489 - DNA, 28 bp, Artificial Sequence
  Description of Artificial Sequence: Synthetic oligonucleotide
ggttggtgagagcttcacagtgcagagg

SEQ ID NO: 69490 - DNA, 28 bp, Artificial Sequence
  Description of Artificial Sequence: Synthetic oligonucleotide
gttggtgagagcttcacagtgcagaggc

SEQ ID NO: 69491 - DNA, 28 bp, Artificial Sequence
  Description of Artificial Sequence: Synthetic oligonucleotide
ttggtgagagcttcacagtgcagaggcg

SEQ ID NO: 69492 - DNA, 27 bp, Artificial Sequence
  Description of Artificial Sequence: Synthetic oligonucleotide
tggtgagagcttcacagtgcagaggcg

SEQ ID NO: 69493 - DNA, 27 bp, Artificial Sequence
  Description of Artificial Sequence: Synthetic oligonucleotide
ggtgagagcttcacagtgcagaggcga

SEQ ID NO: 69494 - DNA, 27 bp, Artificial Sequence
  Description of Artificial Sequence: Synthetic oligonucleotide
gtgagagcttcacagtgcagaggcgag

SEQ ID NO: 69495 - DNA, 28 bp, Artificial Sequence
  Description of Artificial Sequence: Synthetic oligonucleotide
tgagagcttcacagtgcagaggcgagtc

SEQ ID NO: 69496 - DNA, 27 bp, Artificial Sequence
  Description of Artificial Sequence: Synthetic oligonucleotide
gagagcttcacagtgcagaggcgagtc

SEQ ID NO: 69497 - DNA, 27 bp, Artificial Sequence
  Description of Artificial Sequence: Synthetic oligonucleotide
agagcttcacagtgcagaggcgagtcc

SEQ ID NO: 69498 - DNA, 27 bp, Artificial Sequence
  Description of Artificial Sequence: Synthetic oligonucleotide
gagcttcacagtgcagaggcgagtcca

SEQ ID NO: 69499 - DNA, 28 bp, Artificial Sequence
  Description of Artificial Sequence: Synthetic oligonucleotide
agcttcacagtgcagaggcgagtccatc

SEQ ID NO: 69500 - DNA, 27 bp, Artificial Sequence
  Description of Artificial Sequence: Synthetic oligonucleotide
gcttcacagtgcagaggcgagtccatc

SEQ ID NO: 69501 - DNA, 27 bp, Artificial Sequence
  Description of Artificial Sequence: Synthetic oligonucleotide
cttcacagtgcagaggcgagtccatcc

SEQ ID NO: 69502 - DNA, 28 bp, Artificial Sequence
  Description of Artificial Sequence: Synthetic oligonucleotide
ttcacagtgcagaggcgagtccatcctg

SEQ ID NO: 69503 - DNA, 27 bp, Artificial Sequence
  Description of Artificial Sequence: Synthetic oligonucleotide
tcacagtgcagaggcgagtccatcctg

SEQ ID NO: 69504 - DNA, 27 bp, Artificial Sequence
  Description of Artificial Sequence: Synthetic oligonucleotide
cacagtgcagaggcgagtccatcctga

SEQ ID NO: 69505 - DNA, 27 bp, Artificial Sequence
  Description of Artificial Sequence: Synthetic oligonucleotide
acagtgcagaggcgagtccatcctgag

SEQ ID NO: 69506 - DNA, 26 bp, Artificial Sequence
  Description of Artificial Sequence: Synthetic oligonucleotide
cagtgcagaggcgagtccatcctgag

SEQ ID NO: 69507 - DNA, 27 bp, Artificial Sequence
  Description of Artificial Sequence: Synthetic oligonucleotide
agtgcagaggcgagtccatcctgaggt

SEQ ID NO: 69508 - DNA, 26 bp, Artificial Sequence
  Description of Artificial Sequence: Synthetic oligonucleotide
gtgcagaggcgagtccatcctgaggt

SEQ ID NO: 69509 - DNA, 27 bp, Artificial Sequence
  Description of Artificial Sequence: Synthetic oligonucleotide
tgcagaggcgagtccatcctgaggtga

SEQ ID NO: 69510 - DNA, 26 bp, Artificial Sequence
  Description of Artificial Sequence: Synthetic oligonucleotide
gcagaggcgagtccatcctgaggtga

SEQ ID NO: 69511 - DNA, 27 bp, Artificial Sequence
  Description of Artificial Sequence: Synthetic oligonucleotide
cagaggcgagtccatcctgaggtgact

SEQ ID NO: 69512 - DNA, 27 bp, Artificial Sequence
  Description of Artificial Sequence: Synthetic oligonucleotide
agaggcgagtccatcctgaggtgactg

SEQ ID NO: 69513 - DNA, 27 bp, Artificial Sequence
  Description of Artificial Sequence: Synthetic oligonucleotide
gaggcgagtccatcctgaggtgactgt

SEQ ID NO: 69514 - DNA, 27 bp, Artificial Sequence
  Description of Artificial Sequence: Synthetic oligonucleotide
aggcgagtccatcctgaggtgactgtg

SEQ ID NO: 69515 - DNA, 36 bp, Artificial Sequence
  Description of Artificial Sequence: Synthetic oligonucleotide
caggataagtttgagtgtcatttcttcaacgggacc

SEQ ID NO: 69516 - DNA, 36 bp, Artificial Sequence
  Description of Artificial Sequence: Synthetic oligonucleotide
aggataagtttgagtgtcatttcttcaacgggaccg

SEQ ID NO: 69517 - DNA, 35 bp, Artificial Sequence
  Description of Artificial Sequence: Synthetic oligonucleotide
ggataagtttgagtgtcatttcttcaacgggaccg

SEQ ID NO: 69518 - DNA, 36 bp, Artificial Sequence
  Description of Artificial Sequence: Synthetic oligonucleotide
gataagtttgagtgtcatttcttcaacgggaccgag

SEQ ID NO: 69519 - DNA, 36 bp, Artificial Sequence
  Description of Artificial Sequence: Synthetic oligonucleotide
ataagtttgagtgtcatttcttcaacgggaccgagc

SEQ ID NO: 69520 - DNA, 35 bp, Artificial Sequence
  Description of Artificial Sequence: Synthetic oligonucleotide
taagtttgagtgtcatttcttcaacgggaccgagc

SEQ ID NO: 69521 - DNA, 34 bp, Artificial Sequence
  Description of Artificial Sequence: Synthetic oligonucleotide
aagtttgagtgtcatttcttcaacgggaccgagc

SEQ ID NO: 69522 - DNA, 33 bp, Artificial Sequence
  Description of Artificial Sequence: Synthetic oligonucleotide
agtttgagtgtcatttcttcaacgggaccgagc

SEQ ID NO: 69523 - DNA, 32 bp, Artificial Sequence
  Description of Artificial Sequence: Synthetic oligonucleotide
gtttgagtgtcatttcttcaacgggaccgagc

SEQ ID NO: 69524 - DNA, 32 bp, Artificial Sequence
  Description of Artificial Sequence: Synthetic oligonucleotide
tttgagtgtcatttcttcaacgggaccgagcg

SEQ ID NO: 69525 - DNA, 31 bp, Artificial Sequence
  Description of Artificial Sequence: Synthetic oligonucleotide
ttgagtgtcatttcttcaacgggaccgagcg

SEQ ID NO: 69526 - DNA, 30 bp, Artificial Sequence
  Description of Artificial Sequence: Synthetic oligonucleotide
tgagtgtcatttcttcaacgggaccgagcg

SEQ ID NO: 69527 - DNA, 29 bp, Artificial Sequence
  Description of Artificial Sequence: Synthetic oligonucleotide
gagtgtcatttcttcaacgggaccgagcg

SEQ ID NO: 69528 - DNA, 29 bp, Artificial Sequence
  Description of Artificial Sequence: Synthetic oligonucleotide
agtgtcatttcttcaacgggaccgagcgg

SEQ ID NO: 69529 - DNA, 28 bp, Artificial Sequence
  Description of Artificial Sequence: Synthetic oligonucleotide
gtgtcatttcttcaacgggaccgagcgg

SEQ ID NO: 69530 - DNA, 28 bp, Artificial Sequence
  Description of Artificial Sequence: Synthetic oligonucleotide
tgtcatttcttcaacgggaccgagcggg

SEQ ID NO: 69531 - DNA, 27 bp, Artificial Sequence
  Description of Artificial Sequence: Synthetic oligonucleotide
gtcatttcttcaacgggaccgagcggg

SEQ ID NO: 69532 - DNA, 28 bp, Artificial Sequence
  Description of Artificial Sequence: Synthetic oligonucleotide
tcatttcttcaacgggaccgagcgggtg

SEQ ID NO: 69533 - DNA, 27 bp, Artificial Sequence
  Description of Artificial Sequence: Synthetic oligonucleotide
catttcttcaacgggaccgagcgggtg

SEQ ID NO: 69534 - DNA, 27 bp, Artificial Sequence
  Description of Artificial Sequence: Synthetic oligonucleotide
atttcttcaacgggaccgagcgggtgc

SEQ ID NO: 69535 - DNA, 26 bp, Artificial Sequence
  Description of Artificial Sequence: Synthetic oligonucleotide
tttcttcaacgggaccgagcgggtgc

SEQ ID NO: 69536 - DNA, 25 bp, Artificial Sequence
  Description of Artificial Sequence: Synthetic oligonucleotide
ttcttcaacgggaccgagcgggtgc

SEQ ID NO: 69537 - DNA, 24 bp, Artificial Sequence
  Description of Artificial Sequence: Synthetic oligonucleotide
tcttcaacgggaccgagcgggtgc

SEQ ID NO: 69538 - DNA, 23 bp, Artificial Sequence
  Description of Artificial Sequence: Synthetic oligonucleotide
cttcaacgggaccgagcgggtgc

SEQ ID NO: 69539 - DNA, 23 bp, Artificial Sequence
  Description of Artificial Sequence: Synthetic oligonucleotide
ttcaacgggaccgagcgggtgcg

SEQ ID NO: 69540 - DNA, 22 bp, Artificial Sequence
  Description of Artificial Sequence: Synthetic oligonucleotide
tcaacgggaccgagcgggtgcg

SEQ ID NO: 69541 - DNA, 21 bp, Artificial Sequence
  Description of Artificial Sequence: Synthetic oligonucleotide
caacgggaccgagcgggtgcg

SEQ ID NO: 69542 - DNA, 24 bp, Artificial Sequence
  Description of Artificial Sequence: Synthetic oligonucleotide
aacgggaccgagcgggtgcggtat

SEQ ID NO: 69543 - DNA, 23 bp, Artificial Sequence
  Description of Artificial Sequence: Synthetic oligonucleotide
acgggaccgagcgggtgcggtat

SEQ ID NO: 69544 - DNA, 22 bp, Artificial Sequence
  Description of Artificial Sequence: Synthetic oligonucleotide
cgggaccgagcgggtgcggtat

SEQ ID NO: 69545 - DNA, 23 bp, Artificial Sequence
  Description of Artificial Sequence: Synthetic oligonucleotide
gggaccgagcgggtgcggtatct

SEQ ID NO: 69546 - DNA, 23 bp, Artificial Sequence
  Description of Artificial Sequence: Synthetic oligonucleotide
ggaccgagcgggtgcggtatctg

SEQ ID NO: 69547 - DNA, 24 bp, Artificial Sequence
  Description of Artificial Sequence: Synthetic oligonucleotide
gaccgagcgggtgcggtatctgca

SEQ ID NO: 69548 - DNA, 25 bp, Artificial Sequence
  Description of Artificial Sequence: Synthetic oligonucleotide
accgagcgggtgcggtatctgcaca

SEQ ID NO: 69549 - DNA, 24 bp, Artificial Sequence
  Description of Artificial Sequence: Synthetic oligonucleotide
ccgagcgggtgcggtatctgcaca

SEQ ID NO: 69550 - DNA, 25 bp, Artificial Sequence
  Description of Artificial Sequence: Synthetic oligonucleotide
cgagcgggtgcggtatctgcacaga

SEQ ID NO: 69551 - DNA, 32 bp, Artificial Sequence
  Description of Artificial Sequence: Synthetic oligonucleotide
tgcggtatctgcacagaggcatctataaccag

SEQ ID NO: 69552 - DNA, 31 bp, Artificial Sequence
  Description of Artificial Sequence: Synthetic oligonucleotide
gcggtatctgcacagaggcatctataaccag

SEQ ID NO: 69553 - DNA, 31 bp, Artificial Sequence
  Description of Artificial Sequence: Synthetic oligonucleotide
cggtatctgcacagaggcatctataaccagg

SEQ ID NO: 69554 - DNA, 32 bp, Artificial Sequence
  Description of Artificial Sequence: Synthetic oligonucleotide
ggtatctgcacagaggcatctataaccaggag

SEQ ID NO: 69555 - DNA, 32 bp, Artificial Sequence
  Description of Artificial Sequence: Synthetic oligonucleotide
gtatctgcacagaggcatctataaccaggagg

SEQ ID NO: 69556 - DNA, 33 bp, Artificial Sequence
  Description of Artificial Sequence: Synthetic oligonucleotide
tatctgcacagaggcatctataaccaggaggag

SEQ ID NO: 69557 - DNA, 32 bp, Artificial Sequence
  Description of Artificial Sequence: Synthetic oligonucleotide
atctgcacagaggcatctataaccaggaggag

SEQ ID NO: 69558 - DNA, 31 bp, Artificial Sequence
  Description of Artificial Sequence: Synthetic oligonucleotide
tctgcacagaggcatctataaccaggaggag

SEQ ID NO: 69559 - DNA, 30 bp, Artificial Sequence
  Description of Artificial Sequence: Synthetic oligonucleotide
ctgcacagaggcatctataaccaggaggag

SEQ ID NO: 69560 - DNA, 32 bp, Artificial Sequence
  Description of Artificial Sequence: Synthetic oligonucleotide
tgcacagaggcatctataaccaggaggagaac

SEQ ID NO: 69561 - DNA, 31 bp, Artificial Sequence
  Description of Artificial Sequence: Synthetic oligonucleotide
gcacagaggcatctataaccaggaggagaac

SEQ ID NO: 69562 - DNA, 31 bp, Artificial Sequence
  Description of Artificial Sequence: Synthetic oligonucleotide
cacagaggcatctataaccaggaggagaacg

SEQ ID NO: 69563 - DNA, 32 bp, Artificial Sequence
  Description of Artificial Sequence: Synthetic oligonucleotide
acagaggcatctataaccaggaggagaacgtg

SEQ ID NO: 69564 - DNA, 31 bp, Artificial Sequence
  Description of Artificial Sequence: Synthetic oligonucleotide
cagaggcatctataaccaggaggagaacgtg

SEQ ID NO: 69565 - DNA, 31 bp, Artificial Sequence
  Description of Artificial Sequence: Synthetic oligonucleotide
agaggcatctataaccaggaggagaacgtgc

SEQ ID NO: 69566 - DNA, 30 bp, Artificial Sequence
  Description of Artificial Sequence: Synthetic oligonucleotide
gaggcatctataaccaggaggagaacgtgc

SEQ ID NO: 69567 - DNA, 30 bp, Artificial Sequence
  Description of Artificial Sequence: Synthetic oligonucleotide
aggcatctataaccaggaggagaacgtgcg

SEQ ID NO: 69568 - DNA, 29 bp, Artificial Sequence
  Description of Artificial Sequence: Synthetic oligonucleotide
ggcatctataaccaggaggagaacgtgcg

SEQ ID NO: 69569 - DNA, 29 bp, Artificial Sequence
  Description of Artificial Sequence: Synthetic oligonucleotide
gcatctataaccaggaggagaacgtgcgc

SEQ ID NO: 69570 - DNA, 31 bp, Artificial Sequence
  Description of Artificial Sequence: Synthetic oligonucleotide
catctataaccaggaggagaacgtgcgcttc

SEQ ID NO: 69571 - DNA, 31 bp, Artificial Sequence
  Description of Artificial Sequence: Synthetic oligonucleotide
atctataaccaggaggagaacgtgcgcttcg

SEQ ID NO: 69572 - DNA, 30 bp, Artificial Sequence
  Description of Artificial Sequence: Synthetic oligonucleotide
tctataaccaggaggagaacgtgcgcttcg

SEQ ID NO: 69573 - DNA, 29 bp, Artificial Sequence
  Description of Artificial Sequence: Synthetic oligonucleotide
ctataaccaggaggagaacgtgcgcttcg

SEQ ID NO: 69574 - DNA, 30 bp, Artificial Sequence
  Description of Artificial Sequence: Synthetic oligonucleotide
tataaccaggaggagaacgtgcgcttcgac

SEQ ID NO: 69575 - DNA, 21 bp, Artificial Sequence
  Description of Artificial Sequence: Synthetic oligonucleotide
gacgtgggggagtaccgggcc

SEQ ID NO: 69576 - DNA, 22 bp, Artificial Sequence
  Description of Artificial Sequence: Synthetic oligonucleotide
acgtgggggagtaccgggccgt

SEQ ID NO: 69577 - DNA, 21 bp, Artificial Sequence
  Description of Artificial Sequence: Synthetic oligonucleotide
cgtgggggagtaccgggccgt

SEQ ID NO: 69578 - DNA, 22 bp, Artificial Sequence
  Description of Artificial Sequence: Synthetic oligonucleotide
gtgggggagtaccgggccgtga

SEQ ID NO: 69579 - DNA, 22 bp, Artificial Sequence
  Description of Artificial Sequence: Synthetic oligonucleotide
tgggggagtaccgggccgtgac

SEQ ID NO: 69580 - DNA, 21 bp, Artificial Sequence
  Description of Artificial Sequence: Synthetic oligonucleotide
gggggagtaccgggccgtgac

SEQ ID NO: 69581 - DNA, 21 bp, Artificial Sequence
  Description of Artificial Sequence: Synthetic oligonucleotide
ggggagtaccgggccgtgacg

SEQ ID NO: 69582 - DNA, 22 bp, Artificial Sequence
  Description of Artificial Sequence: Synthetic oligonucleotide
gggagtaccgggccgtgacgga

SEQ ID NO: 69583 - DNA, 22 bp, Artificial Sequence
  Description of Artificial Sequence: Synthetic oligonucleotide
ggagtaccgggccgtgacggag

SEQ ID NO: 69584 - DNA, 23 bp, Artificial Sequence
  Description of Artificial Sequence: Synthetic oligonucleotide
gagtaccgggccgtgacggagct

SEQ ID NO: 69585 - DNA, 23 bp, Artificial Sequence
  Description of Artificial Sequence: Synthetic oligonucleotide
agtaccgggccgtgacggagctg

SEQ ID NO: 69586 - DNA, 22 bp, Artificial Sequence
  Description of Artificial Sequence: Synthetic oligonucleotide
gtaccgggccgtgacggagctg

SEQ ID NO: 69587 - DNA, 22 bp, Artificial Sequence
  Description of Artificial Sequence: Synthetic oligonucleotide
taccgggccgtgacggagctgg

SEQ ID NO: 69588 - DNA, 21 bp, Artificial Sequence
  Description of Artificial Sequence: Synthetic oligonucleotide
accgggccgtgacggagctgg

SEQ ID NO: 69589 - DNA, 20 bp, Artificial Sequence
  Description of Artificial Sequence: Synthetic oligonucleotide
ccgggccgtgacggagctgg

SEQ ID NO: 69590 - DNA, 20 bp, Artificial Sequence
  Description of Artificial Sequence: Synthetic oligonucleotide
cgggccgtgacggagctggg

SEQ ID NO: 69591 - DNA, 20 bp, Artificial Sequence
  Description of Artificial Sequence: Synthetic oligonucleotide
gggccgtgacggagctgggg

SEQ ID NO: 69592 - DNA, 20 bp, Artificial Sequence
  Description of Artificial Sequence: Synthetic oligonucleotide
ggccgtgacggagctggggc

SEQ ID NO: 69593 - DNA, 20 bp, Artificial Sequence
  Description of Artificial Sequence: Synthetic oligonucleotide
gccgtgacggagctggggcg

SEQ ID NO: 69594 - DNA, 20 bp, Artificial Sequence
  Description of Artificial Sequence: Synthetic oligonucleotide
ccgtgacggagctggggcgg

SEQ ID NO: 69595 - DNA, 20 bp, Artificial Sequence
  Description of Artificial Sequence: Synthetic oligonucleotide
cgtgacggagctggggcggc

SEQ ID NO: 69596 - DNA, 29 bp, Artificial Sequence
  Description of Artificial Sequence: Synthetic oligonucleotide
aacagccagaaggacttcctggagcgaag

SEQ ID NO: 69597 - DNA, 28 bp, Artificial Sequence
  Description of Artificial Sequence: Synthetic oligonucleotide
acagccagaaggacttcctggagcgaag

SEQ ID NO: 69598 - DNA, 27 bp, Artificial Sequence
  Description of Artificial Sequence: Synthetic oligonucleotide
cagccagaaggacttcctggagcgaag

SEQ ID NO: 69599 - DNA, 27 bp, Artificial Sequence
  Description of Artificial Sequence: Synthetic oligonucleotide
agccagaaggacttcctggagcgaagg

SEQ ID NO: 69600 - DNA, 26 bp, Artificial Sequence
  Description of Artificial Sequence: Synthetic oligonucleotide
gccagaaggacttcctggagcgaagg

SEQ ID NO: 69601 - DNA, 26 bp, Artificial Sequence
  Description of Artificial Sequence: Synthetic oligonucleotide
ccagaaggacttcctggagcgaaggc

SEQ ID NO: 69602 - DNA, 26 bp, Artificial Sequence
  Description of Artificial Sequence: Synthetic oligonucleotide
cagaaggacttcctggagcgaaggcg

SEQ ID NO: 69603 - DNA, 26 bp, Artificial Sequence
  Description of Artificial Sequence: Synthetic oligonucleotide
agaaggacttcctggagcgaaggcgg

SEQ ID NO: 69604 - DNA, 25 bp, Artificial Sequence
  Description of Artificial Sequence: Synthetic oligonucleotide
gaaggacttcctggagcgaaggcgg

SEQ ID NO: 69605 - DNA, 25 bp, Artificial Sequence
  Description of Artificial Sequence: Synthetic oligonucleotide
aaggacttcctggagcgaaggcggg

SEQ ID NO: 69606 - DNA, 24 bp, Artificial Sequence
  Description of Artificial Sequence: Synthetic oligonucleotide
aggacttcctggagcgaaggcggg

SEQ ID NO: 69607 - DNA, 23 bp, Artificial Sequence
  Description of Artificial Sequence: Synthetic oligonucleotide
ggacttcctggagcgaaggcggg

SEQ ID NO: 69608 - DNA, 23 bp, Artificial Sequence
  Description of Artificial Sequence: Synthetic oligonucleotide
gacttcctggagcgaaggcgggc

SEQ ID NO: 69609 - DNA, 23 bp, Artificial Sequence
  Description of Artificial Sequence: Synthetic oligonucleotide
acttcctggagcgaaggcgggcc

SEQ ID NO: 69610 - DNA, 22 bp, Artificial Sequence
  Description of Artificial Sequence: Synthetic oligonucleotide
cttcctggagcgaaggcgggcc

SEQ ID NO: 69611 - DNA, 23 bp, Artificial Sequence
  Description of Artificial Sequence: Synthetic oligonucleotide
ttcctggagcgaaggcgggccga

SEQ ID NO: 69612 - DNA, 22 bp, Artificial Sequence
  Description of Artificial Sequence: Synthetic oligonucleotide
tcctggagcgaaggcgggccga

SEQ ID NO: 69613 - DNA, 21 bp, Artificial Sequence
  Description of Artificial Sequence: Synthetic oligonucleotide
cctggagcgaaggcgggccga

SEQ ID NO: 69614 - DNA, 21 bp, Artificial Sequence
  Description of Artificial Sequence: Synthetic oligonucleotide
ctggagcgaaggcgggccgag

SEQ ID NO: 69615 - DNA, 22 bp, Artificial Sequence
  Description of Artificial Sequence: Synthetic oligonucleotide
tggagcgaaggcgggccgaggt

SEQ ID NO: 69616 - DNA, 21 bp, Artificial Sequence
  Description of Artificial Sequence: Synthetic oligonucleotide
ggagcgaaggcgggccgaggt

SEQ ID NO: 69617 - DNA, 21 bp, Artificial Sequence
  Description of Artificial Sequence: Synthetic oligonucleotide
gagcgaaggcgggccgaggtg

SEQ ID NO: 69618 - DNA, 22 bp, Artificial Sequence
  Description of Artificial Sequence: Synthetic oligonucleotide
agcgaaggcgggccgaggtgga

SEQ ID NO: 69619 - DNA, 21 bp, Artificial Sequence
  Description of Artificial Sequence: Synthetic oligonucleotide
gcgaaggcgggccgaggtgga

SEQ ID NO: 69620 - DNA, 22 bp, Artificial Sequence
  Description of Artificial Sequence: Synthetic oligonucleotide
cgaaggcgggccgaggtggaca

SEQ ID NO: 69621 - DNA, 22 bp, Artificial Sequence
  Description of Artificial Sequence: Synthetic oligonucleotide
gaaggcgggccgaggtggacac

SEQ ID NO: 69622 - DNA, 22 bp, Artificial Sequence
  Description of Artificial Sequence: Synthetic oligonucleotide
aaggcgggccgaggtggacacc

SEQ ID NO: 69623 - DNA, 23 bp, Artificial Sequence
  Description of Artificial Sequence: Synthetic oligonucleotide
acttcctggagcggaggcgggct

SEQ ID NO: 69624 - DNA, 22 bp, Artificial Sequence
  Description of Artificial Sequence: Synthetic oligonucleotide
cttcctggagcggaggcgggct

SEQ ID NO: 69625 - DNA, 23 bp, Artificial Sequence
  Description of Artificial Sequence: Synthetic oligonucleotide
ttcctggagcggaggcgggctga

SEQ ID NO: 69626 - DNA, 22 bp, Artificial Sequence
  Description of Artificial Sequence: Synthetic oligonucleotide
tcctggagcggaggcgggctga

SEQ ID NO: 69627 - DNA, 21 bp, Artificial Sequence
  Description of Artificial Sequence: Synthetic oligonucleotide
cctggagcggaggcgggctga

SEQ ID NO: 69628 - DNA, 21 bp, Artificial Sequence
  Description of Artificial Sequence: Synthetic oligonucleotide
ctggagcggaggcgggctgag

SEQ ID NO: 69629 - DNA, 22 bp, Artificial Sequence
  Description of Artificial Sequence: Synthetic oligonucleotide
tggagcggaggcgggctgaggt

SEQ ID NO: 69630 - DNA, 21 bp, Artificial Sequence
  Description of Artificial Sequence: Synthetic oligonucleotide
ggagcggaggcgggctgaggt

SEQ ID NO: 69631 - DNA, 21 bp, Artificial Sequence
  Description of Artificial Sequence: Synthetic oligonucleotide
gagcggaggcgggctgaggtg

SEQ ID NO: 69632 - DNA, 22 bp, Artificial Sequence
  Description of Artificial Sequence: Synthetic oligonucleotide
agcggaggcgggctgaggtgga

SEQ ID NO: 69633 - DNA, 21 bp, Artificial Sequence
  Description of Artificial Sequence: Synthetic oligonucleotide
gcggaggcgggctgaggtgga

SEQ ID NO: 69634 - DNA, 22 bp, Artificial Sequence
  Description of Artificial Sequence: Synthetic oligonucleotide
cggaggcgggctgaggtggaca

SEQ ID NO: 69635 - DNA, 22 bp, Artificial Sequence
  Description of Artificial Sequence: Synthetic oligonucleotide
ggaggcgggctgaggtggacac

SEQ ID NO: 69636 - DNA, 22 bp, Artificial Sequence
  Description of Artificial Sequence: Synthetic oligonucleotide
gaggcgggctgaggtggacacc

SEQ ID NO: 69637 - DNA, 23 bp, Artificial Sequence
  Description of Artificial Sequence: Synthetic oligonucleotide
aggcgggctgaggtggacaccgt

SEQ ID NO: 69638 - DNA, 22 bp, Artificial Sequence
  Description of Artificial Sequence: Synthetic oligonucleotide
ggcgggctgaggtggacaccgt

SEQ ID NO: 69639 - DNA, 23 bp, Artificial Sequence
  Description of Artificial Sequence: Synthetic oligonucleotide
gcgggctgaggtggacaccgtgt

SEQ ID NO: 69640 - DNA, 23 bp, Artificial Sequence
  Description of Artificial Sequence: Synthetic oligonucleotide
cgggctgaggtggacaccgtgtg

SEQ ID NO: 69641 - DNA, 24 bp, Artificial Sequence
  Description of Artificial Sequence: Synthetic oligonucleotide
gggctgaggtggacaccgtgtgca

SEQ ID NO: 69642 - DNA, 25 bp, Artificial Sequence
  Description of Artificial Sequence: Synthetic oligonucleotide
ggctgaggtggacaccgtgtgcaga

SEQ ID NO: 69643 - DNA, 26 bp, Artificial Sequence
  Description of Artificial Sequence: Synthetic oligonucleotide
gctgaggtggacaccgtgtgcagaca

SEQ ID NO: 69644 - DNA, 27 bp, Artificial Sequence
  Description of Artificial Sequence: Synthetic oligonucleotide
ctgaggtggacaccgtgtgcagacaca

SEQ ID NO: 69645 - DNA, 28 bp, Artificial Sequence
  Description of Artificial Sequence: Synthetic oligonucleotide
tgaggtggacaccgtgtgcagacacaac

SEQ ID NO: 69646 - DNA, 30 bp, Artificial Sequence
  Description of Artificial Sequence: Synthetic oligonucleotide
gctgagtactggaacagccagaaggacttc

SEQ ID NO: 69647 - DNA, 30 bp, Artificial Sequence
  Description of Artificial Sequence: Synthetic oligonucleotide
ctgagtactggaacagccagaaggacttcc

SEQ ID NO: 69648 - DNA, 31 bp, Artificial Sequence
  Description of Artificial Sequence: Synthetic oligonucleotide
tgagtactggaacagccagaaggacttcctg

SEQ ID NO: 69649 - DNA, 25 bp, Artificial Sequence
  Description of Artificial Sequence: Synthetic oligonucleotide
acttcctggaagacaggcgcgccga

SEQ ID NO: 69650 - DNA, 24 bp, Artificial Sequence
  Description of Artificial Sequence: Synthetic oligonucleotide
cttcctggaagacaggcgcgccga

SEQ ID NO: 69651 - DNA, 24 bp, Artificial Sequence
  Description of Artificial Sequence: Synthetic oligonucleotide
ttcctggaagacaggcgcgccgag

SEQ ID NO: 69652 - DNA, 23 bp, Artificial Sequence
  Description of Artificial Sequence: Synthetic oligonucleotide
tcctggaagacaggcgcgccgag

SEQ ID NO: 69653 - DNA, 22 bp, Artificial Sequence
  Description of Artificial Sequence: Synthetic oligonucleotide
cctggaagacaggcgcgccgag

SEQ ID NO: 69654 - DNA, 23 bp, Artificial Sequence
  Description of Artificial Sequence: Synthetic oligonucleotide
ctggaagacaggcgcgccgaggt

SEQ ID NO: 69655 - DNA, 23 bp, Artificial Sequence
  Description of Artificial Sequence: Synthetic oligonucleotide
tggaagacaggcgcgccgaggtg

SEQ ID NO: 69656 - DNA, 22 bp, Artificial Sequence
  Description of Artificial Sequence: Synthetic oligonucleotide
ggaagacaggcgcgccgaggtg

SEQ ID NO: 69657 - DNA, 23 bp, Artificial Sequence
  Description of Artificial Sequence: Synthetic oligonucleotide
gaagacaggcgcgccgaggtgga

SEQ ID NO: 69658 - DNA, 24 bp, Artificial Sequence
  Description of Artificial Sequence: Synthetic oligonucleotide
aagacaggcgcgccgaggtggaca

SEQ ID NO: 69659 - DNA, 23 bp, Artificial Sequence
  Description of Artificial Sequence: Synthetic oligonucleotide
agacaggcgcgccgaggtggaca

SEQ ID NO: 69660 - DNA, 22 bp, Artificial Sequence
  Description of Artificial Sequence: Synthetic oligonucleotide
gacaggcgcgccgaggtggaca

SEQ ID NO: 69661 - DNA, 22 bp, Artificial Sequence
  Description of Artificial Sequence: Synthetic oligonucleotide
acaggcgcgccgaggtggacac

SEQ ID NO: 69662 - DNA, 21 bp, Artificial Sequence
  Description of Artificial Sequence: Synthetic oligonucleotide
caggcgcgccgaggtggacac

SEQ ID NO: 69663 - DNA, 21 bp, Artificial Sequence
  Description of Artificial Sequence: Synthetic oligonucleotide
aggcgcgccgaggtggacacc

SEQ ID NO: 69664 - DNA, 20 bp, Artificial Sequence
  Description of Artificial Sequence: Synthetic oligonucleotide
ggcgcgccgaggtggacacc

SEQ ID NO: 69665 - DNA, 21 bp, Artificial Sequence
  Description of Artificial Sequence: Synthetic oligonucleotide
gcgcgccgaggtggacaccgt

SEQ ID NO: 69666 - DNA, 22 bp, Artificial Sequence
  Description of Artificial Sequence: Synthetic oligonucleotide
cgcgccgaggtggacaccgtgt

SEQ ID NO: 69667 - DNA, 22 bp, Artificial Sequence
  Description of Artificial Sequence: Synthetic oligonucleotide
gcgccgaggtggacaccgtgtg

SEQ ID NO: 69668 - DNA, 23 bp, Artificial Sequence
  Description of Artificial Sequence: Synthetic oligonucleotide
cgccgaggtggacaccgtgtgca

SEQ ID NO: 69669 - DNA, 28 bp, Artificial Sequence
  Description of Artificial Sequence: Synthetic oligonucleotide
cgtgtgcagacacaactacggggttgtg

SEQ ID NO: 69670 - DNA, 28 bp, Artificial Sequence
  Description of Artificial Sequence: Synthetic oligonucleotide
gtgtgcagacacaactacggggttgtgg

SEQ ID NO: 69671 - DNA, 29 bp, Artificial Sequence
  Description of Artificial Sequence: Synthetic oligonucleotide
tgtgcagacacaactacggggttgtggag

SEQ ID NO: 69672 - DNA, 28 bp, Artificial Sequence
  Description of Artificial Sequence: Synthetic oligonucleotide
gtgcagacacaactacggggttgtggag

SEQ ID NO: 69673 - DNA, 28 bp, Artificial Sequence
  Description of Artificial Sequence: Synthetic oligonucleotide
gggttgtggagagcttcacagtgcagag

SEQ ID NO: 69674 - DNA, 28 bp, Artificial Sequence
  Description of Artificial Sequence: Synthetic oligonucleotide
ggttgtggagagcttcacagtgcagagg

SEQ ID NO: 69675 - DNA, 28 bp, Artificial Sequence
  Description of Artificial Sequence: Synthetic oligonucleotide
gttgtggagagcttcacagtgcagaggc

SEQ ID NO: 69676 - DNA, 28 bp, Artificial Sequence
  Description of Artificial Sequence: Synthetic oligonucleotide
ttgtggagagcttcacagtgcagaggcg

SEQ ID NO: 69677 - DNA, 27 bp, Artificial Sequence
  Description of Artificial Sequence: Synthetic oligonucleotide
tgtggagagcttcacagtgcagaggcg

SEQ ID NO: 69678 - DNA, 27 bp, Artificial Sequence
  Description of Artificial Sequence: Synthetic oligonucleotide
gtggagagcttcacagtgcagaggcga

SEQ ID NO: 69679 - DNA, 27 bp, Artificial Sequence
  Description of Artificial Sequence: Synthetic oligonucleotide
tggagagcttcacagtgcagaggcgag

SEQ ID NO: 69680 - DNA, 38 bp, Artificial Sequence
  Description of Artificial Sequence: Synthetic oligonucleotide
cacgtttcttgcagcaggataagtatgagtgtcatttc

SEQ ID NO: 69681 - DNA, 40 bp, Artificial Sequence
  Description of Artificial Sequence: Synthetic oligonucleotide
acgtttcttgcagcaggataagtatgagtgtcatttcttc

SEQ ID NO: 69682 - DNA, 39 bp, Artificial Sequence
  Description of Artificial Sequence: Synthetic oligonucleotide
cgtttcttgcagcaggataagtatgagtgtcatttcttc

SEQ ID NO: 69683 - DNA, 41 bp, Artificial Sequence
  Description of Artificial Sequence: Synthetic oligonucleotide
gtttcttgcagcaggataagtatgagtgtcatttcttcaac

SEQ ID NO: 69684 - DNA, 41 bp, Artificial Sequence
  Description of Artificial Sequence: Synthetic oligonucleotide
tttcttgcagcaggataagtatgagtgtcatttcttcaacg

SEQ ID NO: 69685 - DNA, 40 bp, Artificial Sequence
  Description of Artificial Sequence: Synthetic oligonucleotide
ttcttgcagcaggataagtatgagtgtcatttcttcaacg

SEQ ID NO: 69686 - DNA, 39 bp, Artificial Sequence
  Description of Artificial Sequence: Synthetic oligonucleotide
tcttgcagcaggataagtatgagtgtcatttcttcaacg

SEQ ID NO: 69687 - DNA, 38 bp, Artificial Sequence
  Description of Artificial Sequence: Synthetic oligonucleotide
cttgcagcaggataagtatgagtgtcatttcttcaacg

SEQ ID NO: 69688 - DNA, 38 bp, Artificial Sequence
  Description of Artificial Sequence: Synthetic oligonucleotide
ttgcagcaggataagtatgagtgtcatttcttcaacgg

SEQ ID NO: 69689 - DNA, 37 bp, Artificial Sequence
  Description of Artificial Sequence: Synthetic oligonucleotide
tgcagcaggataagtatgagtgtcatttcttcaacgg

SEQ ID NO: 69690 - DNA, 36 bp, Artificial Sequence
  Description of Artificial Sequence: Synthetic oligonucleotide
gcagcaggataagtatgagtgtcatttcttcaacgg

SEQ ID NO: 69691 - DNA, 36 bp, Artificial Sequence
  Description of Artificial Sequence: Synthetic oligonucleotide
cagcaggataagtatgagtgtcatttcttcaacggg

SEQ ID NO: 69692 - DNA, 37 bp, Artificial Sequence
  Description of Artificial Sequence: Synthetic oligonucleotide
agcaggataagtatgagtgtcatttcttcaacgggac

SEQ ID NO: 69693 - DNA, 36 bp, Artificial Sequence
  Description of Artificial Sequence: Synthetic oligonucleotide
gcaggataagtatgagtgtcatttcttcaacgggac

SEQ ID NO: 69694 - DNA, 36 bp, Artificial Sequence
  Description of Artificial Sequence: Synthetic oligonucleotide
caggataagtatgagtgtcatttcttcaacgggacg

SEQ ID NO: 69695 - DNA, 36 bp, Artificial Sequence
  Description of Artificial Sequence: Synthetic oligonucleotide
aggataagtatgagtgtcatttcttcaacgggacgg

SEQ ID NO: 69696 - DNA, 35 bp, Artificial Sequence
  Description of Artificial Sequence: Synthetic oligonucleotide
ggataagtatgagtgtcatttcttcaacgggacgg

SEQ ID NO: 69697 - DNA, 36 bp, Artificial Sequence
  Description of Artificial Sequence: Synthetic oligonucleotide
gataagtatgagtgtcatttcttcaacgggacggag

SEQ ID NO: 69698 - DNA, 36 bp, Artificial Sequence
  Description of Artificial Sequence: Synthetic oligonucleotide
ataagtatgagtgtcatttcttcaacgggacggagc

SEQ ID NO: 69699 - DNA, 35 bp, Artificial Sequence
  Description of Artificial Sequence: Synthetic oligonucleotide
taagtatgagtgtcatttcttcaacgggacggagc

SEQ ID NO: 69700 - DNA, 34 bp, Artificial Sequence
  Description of Artificial Sequence: Synthetic oligonucleotide
aagtatgagtgtcatttcttcaacgggacggagc

SEQ ID NO: 69701 - DNA, 33 bp, Artificial Sequence
  Description of Artificial Sequence: Synthetic oligonucleotide
agtatgagtgtcatttcttcaacgggacggagc

SEQ ID NO: 69702 - DNA, 32 bp, Artificial Sequence
  Description of Artificial Sequence: Synthetic oligonucleotide
gtatgagtgtcatttcttcaacgggacggagc

SEQ ID NO: 69703 - DNA, 21 bp, Artificial Sequence
  Description of Artificial Sequence: Synthetic oligonucleotide
tggggcggcctagcgccgagt

SEQ ID NO: 69704 - DNA, 20 bp, Artificial Sequence
  Description of Artificial Sequence: Synthetic oligonucleotide
ggggcggcctagcgccgagt

SEQ ID NO: 69705 - DNA, 20 bp, Artificial Sequence
  Description of Artificial Sequence: Synthetic oligonucleotide
gggcggcctagcgccgagtc

SEQ ID NO: 69706 - DNA, 21 bp, Artificial Sequence
  Description of Artificial Sequence: Synthetic oligonucleotide
ggcggcctagcgccgagtcct

SEQ ID NO: 69707 - DNA, 21 bp, Artificial Sequence
  Description of Artificial Sequence: Synthetic oligonucleotide
gcggcctagcgccgagtcctg

SEQ ID NO: 69708 - DNA, 23 bp, Artificial Sequence
  Description of Artificial Sequence: Synthetic oligonucleotide
cggcctagcgccgagtcctggaa

SEQ ID NO: 69709 - DNA, 24 bp, Artificial Sequence
  Description of Artificial Sequence: Synthetic oligonucleotide
ggcctagcgccgagtcctggaaca

SEQ ID NO: 69710 - DNA, 24 bp, Artificial Sequence
  Description of Artificial Sequence: Synthetic oligonucleotide
gcctagcgccgagtcctggaacag

SEQ ID NO: 69711 - DNA, 24 bp, Artificial Sequence
  Description of Artificial Sequence: Synthetic oligonucleotide
cctagcgccgagtcctggaacagc

SEQ ID NO: 69712 - DNA, 25 bp, Artificial Sequence
  Description of Artificial Sequence: Synthetic oligonucleotide
ctagcgccgagtcctggaacagcca

SEQ ID NO: 69713 - DNA, 27 bp, Artificial Sequence
  Description of Artificial Sequence: Synthetic oligonucleotide
tagcgccgagtcctggaacagccagaa

SEQ ID NO: 69714 - DNA, 26 bp, Artificial Sequence
  Description of Artificial Sequence: Synthetic oligonucleotide
agcgccgagtcctggaacagccagaa

SEQ ID NO: 69715 - DNA, 25 bp, Artificial Sequence
  Description of Artificial Sequence: Synthetic oligonucleotide
gcgccgagtcctggaacagccagaa

SEQ ID NO: 69716 - DNA, 31 bp, Artificial Sequence
  Description of Artificial Sequence: Synthetic oligonucleotide
tgtgcagacacaactacggggttggtgaatg

SEQ ID NO: 69717 - DNA, 30 bp, Artificial Sequence
  Description of Artificial Sequence: Synthetic oligonucleotide
gtgcagacacaactacggggttggtgaatg

SEQ ID NO: 69718 - DNA, 30 bp, Artificial Sequence
  Description of Artificial Sequence: Synthetic oligonucleotide
tgcagacacaactacggggttggtgaatgc

SEQ ID NO: 69719 - DNA, 29 bp, Artificial Sequence
  Description of Artificial Sequence: Synthetic oligonucleotide
gcagacacaactacggggttggtgaatgc

SEQ ID NO: 69720 - DNA, 31 bp, Artificial Sequence
  Description of Artificial Sequence: Synthetic oligonucleotide
cagacacaactacggggttggtgaatgcttc

SEQ ID NO: 69721 - DNA, 32 bp, Artificial Sequence
  Description of Artificial Sequence: Synthetic oligonucleotide
agacacaactacggggttggtgaatgcttcac

SEQ ID NO: 69722 - DNA, 31 bp, Artificial Sequence
  Description of Artificial Sequence: Synthetic oligonucleotide
gacacaactacggggttggtgaatgcttcac

SEQ ID NO: 69723 - DNA, 32 bp, Artificial Sequence
  Description of Artificial Sequence: Synthetic oligonucleotide
acacaactacggggttggtgaatgcttcacag

SEQ ID NO: 69724 - DNA, 31 bp, Artificial Sequence
  Description of Artificial Sequence: Synthetic oligonucleotide
cacaactacggggttggtgaatgcttcacag

SEQ ID NO: 69725 - DNA, 32 bp, Artificial Sequence
  Description of Artificial Sequence: Synthetic oligonucleotide
acaactacggggttggtgaatgcttcacagtg

SEQ ID NO: 69726 - DNA, 31 bp, Artificial Sequence
  Description of Artificial Sequence: Synthetic oligonucleotide
caactacggggttggtgaatgcttcacagtg

SEQ ID NO: 69727 - DNA, 31 bp, Artificial Sequence
  Description of Artificial Sequence: Synthetic oligonucleotide
aactacggggttggtgaatgcttcacagtgc

SEQ ID NO: 69728 - DNA, 30 bp, Artificial Sequence
  Description of Artificial Sequence: Synthetic oligonucleotide
actacggggttggtgaatgcttcacagtgc

SEQ ID NO: 69729 - DNA, 29 bp, Artificial Sequence
  Description of Artificial Sequence: Synthetic oligonucleotide
ctacggggttggtgaatgcttcacagtgc

SEQ ID NO: 69730 - DNA, 30 bp, Artificial Sequence
  Description of Artificial Sequence: Synthetic oligonucleotide
tacggggttggtgaatgcttcacagtgcag

SEQ ID NO: 69731 - DNA, 29 bp, Artificial Sequence
  Description of Artificial Sequence: Synthetic oligonucleotide
acggggttggtgaatgcttcacagtgcag

SEQ ID NO: 69732 - DNA, 28 bp, Artificial Sequence
  Description of Artificial Sequence: Synthetic oligonucleotide
cggggttggtgaatgcttcacagtgcag

SEQ ID NO: 69733 - DNA, 29 bp, Artificial Sequence
  Description of Artificial Sequence: Synthetic oligonucleotide
ggggttggtgaatgcttcacagtgcagag

SEQ ID NO: 69734 - DNA, 29 bp, Artificial Sequence
  Description of Artificial Sequence: Synthetic oligonucleotide
gggttggtgaatgcttcacagtgcagagg

SEQ ID NO: 69735 - DNA, 29 bp, Artificial Sequence
  Description of Artificial Sequence: Synthetic oligonucleotide
ggttggtgaatgcttcacagtgcagaggc

SEQ ID NO: 69736 - DNA, 29 bp, Artificial Sequence
  Description of Artificial Sequence: Synthetic oligonucleotide
gttggtgaatgcttcacagtgcagaggcg

SEQ ID NO: 69737 - DNA, 30 bp, Artificial Sequence
  Description of Artificial Sequence: Synthetic oligonucleotide
ttggtgaatgcttcacagtgcagaggcgag

SEQ ID NO: 69738 - DNA, 27 bp, Artificial Sequence
  Description of Artificial Sequence: Synthetic oligonucleotide
gggacaccagaccacgtttcttggagg

SEQ ID NO: 69739 - DNA, 28 bp, Artificial Sequence
  Description of Artificial Sequence: Synthetic oligonucleotide
ggacaccagaccacgtttcttggaggag

SEQ ID NO: 69740 - DNA, 28 bp, Artificial Sequence
  Description of Artificial Sequence: Synthetic oligonucleotide
gacaccagaccacgtttcttggaggagg

SEQ ID NO: 69741 - DNA, 32 bp, Artificial Sequence
  Description of Artificial Sequence: Synthetic oligonucleotide
acaccagaccacgtttcttggaggaggttaag

SEQ ID NO: 69742 - DNA, 31 bp, Artificial Sequence
  Description of Artificial Sequence: Synthetic oligonucleotide
caccagaccacgtttcttggaggaggttaag

SEQ ID NO: 69743 - DNA, 34 bp, Artificial Sequence
  Description of Artificial Sequence: Synthetic oligonucleotide
accagaccacgtttcttggaggaggttaagtttg

SEQ ID NO: 69744 - DNA, 33 bp, Artificial Sequence
  Description of Artificial Sequence: Synthetic oligonucleotide
ccagaccacgtttcttggaggaggttaagtttg

SEQ ID NO: 69745 - DNA, 34 bp, Artificial Sequence
  Description of Artificial Sequence: Synthetic oligonucleotide
cagaccacgtttcttggaggaggttaagtttgag

SEQ ID NO: 69746 - DNA, 35 bp, Artificial Sequence
  Description of Artificial Sequence: Synthetic oligonucleotide
agaccacgtttcttggaggaggttaagtttgagtg

SEQ ID NO: 69747 - DNA, 34 bp, Artificial Sequence
  Description of Artificial Sequence: Synthetic oligonucleotide
gaccacgtttcttggaggaggttaagtttgagtg

SEQ ID NO: 69748 - DNA, 35 bp, Artificial Sequence
  Description of Artificial Sequence: Synthetic oligonucleotide
accacgtttcttggaggaggttaagtttgagtgtc

SEQ ID NO: 69749 - DNA, 34 bp, Artificial Sequence
  Description of Artificial Sequence: Synthetic oligonucleotide
ccacgtttcttggaggaggttaagtttgagtgtc

SEQ ID NO: 69750 - DNA, 38 bp, Artificial Sequence
  Description of Artificial Sequence: Synthetic oligonucleotide
cacgtttcttggaggaggttaagtttgagtgtcatttc

SEQ ID NO: 69751 - DNA, 40 bp, Artificial Sequence
  Description of Artificial Sequence: Synthetic oligonucleotide
acgtttcttggaggaggttaagtttgagtgtcatttcttc

SEQ ID NO: 69752 - DNA, 39 bp, Artificial Sequence
  Description of Artificial Sequence: Synthetic oligonucleotide
cgtttcttggaggaggttaagtttgagtgtcatttcttc

SEQ ID NO: 69753 - DNA, 41 bp, Artificial Sequence
  Description of Artificial Sequence: Synthetic oligonucleotide
gtttcttggaggaggttaagtttgagtgtcatttcttcaac

SEQ ID NO: 69754 - DNA, 41 bp, Artificial Sequence
  Description of Artificial Sequence: Synthetic oligonucleotide
tttcttggaggaggttaagtttgagtgtcatttcttcaacg

SEQ ID NO: 69755 - DNA, 40 bp, Artificial Sequence
  Description of Artificial Sequence: Synthetic oligonucleotide
ttcttggaggaggttaagtttgagtgtcatttcttcaacg

SEQ ID NO: 69756 - DNA, 39 bp, Artificial Sequence
  Description of Artificial Sequence: Synthetic oligonucleotide
tcttggaggaggttaagtttgagtgtcatttcttcaacg

SEQ ID NO: 69757 - DNA, 38 bp, Artificial Sequence
  Description of Artificial Sequence: Synthetic oligonucleotide
cttggaggaggttaagtttgagtgtcatttcttcaacg

SEQ ID NO: 69758 - DNA, 38 bp, Artificial Sequence
  Description of Artificial Sequence: Synthetic oligonucleotide
ttggaggaggttaagtttgagtgtcatttcttcaacgg

SEQ ID NO: 69759 - DNA, 37 bp, Artificial Sequence
  Description of Artificial Sequence: Synthetic oligonucleotide
tggaggaggttaagtttgagtgtcatttcttcaacgg

SEQ ID NO: 69760 - DNA, 36 bp, Artificial Sequence
  Description of Artificial Sequence: Synthetic oligonucleotide
ggaggaggttaagtttgagtgtcatttcttcaacgg

SEQ ID NO: 69761 - DNA, 36 bp, Artificial Sequence
  Description of Artificial Sequence: Synthetic oligonucleotide
gaggaggttaagtttgagtgtcatttcttcaacggg

SEQ ID NO: 69762 - DNA, 37 bp, Artificial Sequence
  Description of Artificial Sequence: Synthetic oligonucleotide
aggaggttaagtttgagtgtcatttcttcaacgggac

SEQ ID NO: 69763 - DNA, 36 bp, Artificial Sequence
  Description of Artificial Sequence: Synthetic oligonucleotide
ggaggttaagtttgagtgtcatttcttcaacgggac

SEQ ID NO: 69764 - DNA, 36 bp, Artificial Sequence
  Description of Artificial Sequence: Synthetic oligonucleotide
gaggttaagtttgagtgtcatttcttcaacgggacg

SEQ ID NO: 69765 - DNA, 36 bp, Artificial Sequence
  Description of Artificial Sequence: Synthetic oligonucleotide
aggttaagtttgagtgtcatttcttcaacgggacgg

SEQ ID NO: 69766 - DNA, 35 bp, Artificial Sequence
  Description of Artificial Sequence: Synthetic oligonucleotide
ggttaagtttgagtgtcatttcttcaacgggacgg

SEQ ID NO: 69767 - DNA, 36 bp, Artificial Sequence
  Description of Artificial Sequence: Synthetic oligonucleotide
gttaagtttgagtgtcatttcttcaacgggacggag

SEQ ID NO: 69768 - DNA, 36 bp, Artificial Sequence
  Description of Artificial Sequence: Synthetic oligonucleotide
ttaagtttgagtgtcatttcttcaacgggacggagc

SEQ ID NO: 69769 - DNA, 25 bp, Artificial Sequence
  Description of Artificial Sequence: Synthetic oligonucleotide
ggagcgggtgcggttgctggaaaga

SEQ ID NO: 69770 - DNA, 25 bp, Artificial Sequence
  Description of Artificial Sequence: Synthetic oligonucleotide
gagcgggtgcggttgctggaaagac

SEQ ID NO: 69771 - DNA, 25 bp, Artificial Sequence
  Description of Artificial Sequence: Synthetic oligonucleotide
agcgggtgcggttgctggaaagacg

SEQ ID NO: 69772 - DNA, 24 bp, Artificial Sequence
  Description of Artificial Sequence: Synthetic oligonucleotide
gcgggtgcggttgctggaaagacg

SEQ ID NO: 69773 - DNA, 24 bp, Artificial Sequence
  Description of Artificial Sequence: Synthetic oligonucleotide
cgggtgcggttgctggaaagacgc

SEQ ID NO: 69774 - DNA, 25 bp, Artificial Sequence
  Description of Artificial Sequence: Synthetic oligonucleotide
gggtgcggttgctggaaagacgcgt

SEQ ID NO: 69775 - DNA, 25 bp, Artificial Sequence
  Description of Artificial Sequence: Synthetic oligonucleotide
ggtgcggttgctggaaagacgcgtc

SEQ ID NO: 69776 - DNA, 27 bp, Artificial Sequence
  Description of Artificial Sequence: Synthetic oligonucleotide
gtgcggttgctggaaagacgcgtccat

SEQ ID NO: 69777 - DNA, 29 bp, Artificial Sequence
  Description of Artificial Sequence: Synthetic oligonucleotide
tgcggttgctggaaagacgcgtccataac

SEQ ID NO: 69778 - DNA, 28 bp, Artificial Sequence
  Description of Artificial Sequence: Synthetic oligonucleotide
gcggttgctggaaagacgcgtccataac

SEQ ID NO: 69779 - DNA, 28 bp, Artificial Sequence
  Description of Artificial Sequence: Synthetic oligonucleotide
cggttgctggaaagacgcgtccataacc

SEQ ID NO: 69780 - DNA, 30 bp, Artificial Sequence
  Description of Artificial Sequence: Synthetic oligonucleotide
ggttgctggaaagacgcgtccataaccaag

SEQ ID NO: 69781 - DNA, 31 bp, Artificial Sequence
  Description of Artificial Sequence: Synthetic oligonucleotide
gttgctggaaagacgcgtccataaccaagag

SEQ ID NO: 69782 - DNA, 31 bp, Artificial Sequence
  Description of Artificial Sequence: Synthetic oligonucleotide
ttgctggaaagacgcgtccataaccaagagg

SEQ ID NO: 69783 - DNA, 30 bp, Artificial Sequence
  Description of Artificial Sequence: Synthetic oligonucleotide
tgctggaaagacgcgtccataaccaagagg

SEQ ID NO: 69784 - DNA, 29 bp, Artificial Sequence
  Description of Artificial Sequence: Synthetic oligonucleotide
gctggaaagacgcgtccataaccaagagg

SEQ ID NO: 69785 - DNA, 30 bp, Artificial Sequence
  Description of Artificial Sequence: Synthetic oligonucleotide
ctggaaagacgcgtccataaccaagaggag

SEQ ID NO: 69786 - DNA, 32 bp, Artificial Sequence
  Description of Artificial Sequence: Synthetic oligonucleotide
tggaaagacgcgtccataaccaagaggagtac

SEQ ID NO: 69787 - DNA, 31 bp, Artificial Sequence
  Description of Artificial Sequence: Synthetic oligonucleotide
ggaaagacgcgtccataaccaagaggagtac

SEQ ID NO: 69788 - DNA, 31 bp, Artificial Sequence
  Description of Artificial Sequence: Synthetic oligonucleotide
gaaagacgcgtccataaccaagaggagtacg

SEQ ID NO: 69789 - DNA, 31 bp, Artificial Sequence
  Description of Artificial Sequence: Synthetic oligonucleotide
aaagacgcgtccataaccaagaggagtacgc

SEQ ID NO: 69790 - DNA, 30 bp, Artificial Sequence
  Description of Artificial Sequence: Synthetic oligonucleotide
aagacgcgtccataaccaagaggagtacgc

SEQ ID NO: 69791 - DNA, 29 bp, Artificial Sequence
  Description of Artificial Sequence: Synthetic oligonucleotide
agacgcgtccataaccaagaggagtacgc

SEQ ID NO: 69792 - DNA, 28 bp, Artificial Sequence
  Description of Artificial Sequence: Synthetic oligonucleotide
gacgcgtccataaccaagaggagtacgc

SEQ ID NO: 69793 - DNA, 28 bp, Artificial Sequence
  Description of Artificial Sequence: Synthetic oligonucleotide
acgcgtccataaccaagaggagtacgcg

SEQ ID NO: 69794 - DNA, 27 bp, Artificial Sequence
  Description of Artificial Sequence: Synthetic oligonucleotide
cgcgtccataaccaagaggagtacgcg

SEQ ID NO: 69795 - DNA, 27 bp, Artificial Sequence
  Description of Artificial Sequence: Synthetic oligonucleotide
gcgtccataaccaagaggagtacgcgc

SEQ ID NO: 69796 - DNA, 27 bp, Artificial Sequence
  Description of Artificial Sequence: Synthetic oligonucleotide
cgtccataaccaagaggagtacgcgcg

SEQ ID NO: 69797 - DNA, 27 bp, Artificial Sequence
  Description of Artificial Sequence: Synthetic oligonucleotide
gtccataaccaagaggagtacgcgcgc

SEQ ID NO: 69798 - DNA, 29 bp, Artificial Sequence
  Description of Artificial Sequence: Synthetic oligonucleotide
tccataaccaagaggagtacgcgcgctac

SEQ ID NO: 69799 - DNA, 28 bp, Artificial Sequence
  Description of Artificial Sequence: Synthetic oligonucleotide
ccataaccaagaggagtacgcgcgctac

SEQ ID NO: 69800 - DNA, 28 bp, Artificial Sequence
  Description of Artificial Sequence: Synthetic oligonucleotide
cataaccaagaggagtacgcgcgctacg

SEQ ID NO: 69801 - DNA, 29 bp, Artificial Sequence
  Description of Artificial Sequence: Synthetic oligonucleotide
ataaccaagaggagtacgcgcgctacgac

SEQ ID NO: 69802 - DNA, 28 bp, Artificial Sequence
  Description of Artificial Sequence: Synthetic oligonucleotide
taaccaagaggagtacgcgcgctacgac

SEQ ID NO: 69803 - DNA, 27 bp, Artificial Sequence
  Description of Artificial Sequence: Synthetic oligonucleotide
aaccaagaggagtacgcgcgctacgac

SEQ ID NO: 69804 - DNA, 27 bp, Artificial Sequence
  Description of Artificial Sequence: Synthetic oligonucleotide
accaagaggagtacgcgcgctacgaca

SEQ ID NO: 69805 - DNA, 26 bp, Artificial Sequence
  Description of Artificial Sequence: Synthetic oligonucleotide
ccaagaggagtacgcgcgctacgaca

SEQ ID NO: 69806 - DNA, 26 bp, Artificial Sequence
  Description of Artificial Sequence: Synthetic oligonucleotide
caagaggagtacgcgcgctacgacag

SEQ ID NO: 69807 - DNA, 26 bp, Artificial Sequence
  Description of Artificial Sequence: Synthetic oligonucleotide
aagaggagtacgcgcgctacgacagc

SEQ ID NO: 69808 - DNA, 25 bp, Artificial Sequence
  Description of Artificial Sequence: Synthetic oligonucleotide
agaggagtacgcgcgctacgacagc

SEQ ID NO: 69809 - DNA, 24 bp, Artificial Sequence
  Description of Artificial Sequence: Synthetic oligonucleotide
gaggagtacgcgcgctacgacagc

SEQ ID NO: 69810 - DNA, 25 bp, Artificial Sequence
  Description of Artificial Sequence: Synthetic oligonucleotide
aggagtacgcgcgctacgacagcga

SEQ ID NO: 69811 - DNA, 24 bp, Artificial Sequence
  Description of Artificial Sequence: Synthetic oligonucleotide
ggagtacgcgcgctacgacagcga

SEQ ID NO: 69812 - DNA, 24 bp, Artificial Sequence
  Description of Artificial Sequence: Synthetic oligonucleotide
gagtacgcgcgctacgacagcgac

SEQ ID NO: 69813 - DNA, 25 bp, Artificial Sequence
  Description of Artificial Sequence: Synthetic oligonucleotide
agtacgcgcgctacgacagcgacgt

SEQ ID NO: 69814 - DNA, 24 bp, Artificial Sequence
  Description of Artificial Sequence: Synthetic oligonucleotide
gtacgcgcgctacgacagcgacgt

SEQ ID NO: 69815 - DNA, 24 bp, Artificial Sequence
  Description of Artificial Sequence: Synthetic oligonucleotide
tacgcgcgctacgacagcgacgtg

SEQ ID NO: 69816 - DNA, 23 bp, Artificial Sequence
  Description of Artificial Sequence: Synthetic oligonucleotide
acgcgcgctacgacagcgacgtg

SEQ ID NO: 69817 - DNA, 22 bp, Artificial Sequence
  Description of Artificial Sequence: Synthetic oligonucleotide
cgcgcgctacgacagcgacgtg

SEQ ID NO: 69818 - DNA, 22 bp, Artificial Sequence
  Description of Artificial Sequence: Synthetic oligonucleotide
gcgcgctacgacagcgacgtgg

SEQ ID NO: 69819 - DNA, 22 bp, Artificial Sequence
  Description of Artificial Sequence: Synthetic oligonucleotide
cgcgctacgacagcgacgtggg

SEQ ID NO: 69820 - DNA, 22 bp, Artificial Sequence
  Description of Artificial Sequence: Synthetic oligonucleotide
gcgctacgacagcgacgtgggg

SEQ ID NO: 69821 - DNA, 23 bp, Artificial Sequence
  Description of Artificial Sequence: Synthetic oligonucleotide
cgctacgacagcgacgtggggga

SEQ ID NO: 69822 - DNA, 25 bp, Artificial Sequence
  Description of Artificial Sequence: Synthetic oligonucleotide
gctacgacagcgacgtgggggagta

SEQ ID NO: 69823 - DNA, 25 bp, Artificial Sequence
  Description of Artificial Sequence: Synthetic oligonucleotide
ctacgacagcgacgtgggggagtac

SEQ ID NO: 69824 - DNA, 25 bp, Artificial Sequence
  Description of Artificial Sequence: Synthetic oligonucleotide
tacgacagcgacgtgggggagtacc

SEQ ID NO: 69825 - DNA, 24 bp, Artificial Sequence
  Description of Artificial Sequence: Synthetic oligonucleotide
acgacagcgacgtgggggagtacc

SEQ ID NO: 69826 - DNA, 24 bp, Artificial Sequence
  Description of Artificial Sequence: Synthetic oligonucleotide
aaggacctcctggagcggaggcgt

SEQ ID NO: 69827 - DNA, 23 bp, Artificial Sequence
  Description of Artificial Sequence: Synthetic oligonucleotide
aggacctcctggagcggaggcgt

SEQ ID NO: 69828 - DNA, 22 bp, Artificial Sequence
  Description of Artificial Sequence: Synthetic oligonucleotide
ggacctcctggagcggaggcgt

SEQ ID NO: 69829 - DNA, 22 bp, Artificial Sequence
  Description of Artificial Sequence: Synthetic oligonucleotide
gacctcctggagcggaggcgtg

SEQ ID NO: 69830 - DNA, 22 bp, Artificial Sequence
  Description of Artificial Sequence: Synthetic oligonucleotide
acctcctggagcggaggcgtgc

SEQ ID NO: 69831 - DNA, 21 bp, Artificial Sequence
  Description of Artificial Sequence: Synthetic oligonucleotide
cctcctggagcggaggcgtgc

SEQ ID NO: 69832 - DNA, 21 bp, Artificial Sequence
  Description of Artificial Sequence: Synthetic oligonucleotide
ctcctggagcggaggcgtgcc

SEQ ID NO: 69833 - DNA, 21 bp, Artificial Sequence
  Description of Artificial Sequence: Synthetic oligonucleotide
tcctggagcggaggcgtgccg

SEQ ID NO: 69834 - DNA, 20 bp, Artificial Sequence
  Description of Artificial Sequence: Synthetic oligonucleotide
cctggagcggaggcgtgccg

SEQ ID NO: 69835 - DNA, 20 bp, Artificial Sequence
  Description of Artificial Sequence: Synthetic oligonucleotide
ctggagcggaggcgtgccgc

SEQ ID NO: 69836 - DNA, 20 bp, Artificial Sequence
  Description of Artificial Sequence: Synthetic oligonucleotide
tggagcggaggcgtgccgcg

SEQ ID NO: 69837 - DNA, 20 bp, Artificial Sequence
  Description of Artificial Sequence: Synthetic oligonucleotide
ggagcggaggcgtgccgcgt

SEQ ID NO: 69838 - DNA, 20 bp, Artificial Sequence
  Description of Artificial Sequence: Synthetic oligonucleotide
gagcggaggcgtgccgcggt

SEQ ID NO: 69839 - DNA, 20 bp, Artificial Sequence
  Description of Artificial Sequence: Synthetic oligonucleotide
agcggaggcgtgccgcggtg

SEQ ID NO: 69840 - DNA, 20 bp, Artificial Sequence
  Description of Artificial Sequence: Synthetic oligonucleotide
gcggaggcgtgccgcggtgt

SEQ ID NO: 69841 - DNA, 20 bp, Artificial Sequence
  Description of Artificial Sequence: Synthetic oligonucleotide
cggaggcgtgccgcggtgga

SEQ ID NO: 69842 - DNA, 21 bp, Artificial Sequence
  Description of Artificial Sequence: Synthetic oligonucleotide
ggaggcgtgccgcggtggaca

SEQ ID NO: 69843 - DNA, 21 bp, Artificial Sequence
  Description of Artificial Sequence: Synthetic oligonucleotide
gaggcgtgccgcggtggacac

SEQ ID NO: 69844 - DNA, 23 bp, Artificial Sequence
  Description of Artificial Sequence: Synthetic oligonucleotide
aggcgtgccgcggtggacaccta

SEQ ID NO: 69845 - DNA, 22 bp, Artificial Sequence
  Description of Artificial Sequence: Synthetic oligonucleotide
ggcgtgccgcggtggacaccta

SEQ ID NO: 69846 - DNA, 23 bp, Artificial Sequence
  Description of Artificial Sequence: Synthetic oligonucleotide
gcgtgccgcggtggacacctact

SEQ ID NO: 69847 - DNA, 23 bp, Artificial Sequence
  Description of Artificial Sequence: Synthetic oligonucleotide
cgtgccgcggtggacacctactg

SEQ ID NO: 69848 - DNA, 24 bp, Artificial Sequence
  Description of Artificial Sequence: Synthetic oligonucleotide
gtgccgcggtggacacctactgca

SEQ ID NO: 69849 - DNA, 25 bp, Artificial Sequence
  Description of Artificial Sequence: Synthetic oligonucleotide
tgccgcggtggacacctactgcaga

SEQ ID NO: 69850 - DNA, 27 bp, Artificial Sequence
  Description of Artificial Sequence: Synthetic oligonucleotide
agagcttcacagtgcagcggcgagttc

SEQ ID NO: 69851 - DNA, 27 bp, Artificial Sequence
  Description of Artificial Sequence: Synthetic oligonucleotide
gagcttcacagtgcagcggcgagttca

SEQ ID NO: 69852 - DNA, 28 bp, Artificial Sequence
  Description of Artificial Sequence: Synthetic oligonucleotide
agcttcacagtgcagcggcgagttcaac

SEQ ID NO: 69853 - DNA, 27 bp, Artificial Sequence
  Description of Artificial Sequence: Synthetic oligonucleotide
gcttcacagtgcagcggcgagttcaac

SEQ ID NO: 69854 - DNA, 27 bp, Artificial Sequence
  Description of Artificial Sequence: Synthetic oligonucleotide
cttcacagtgcagcggcgagttcaacc

SEQ ID NO: 69855 - DNA, 30 bp, Artificial Sequence
  Description of Artificial Sequence: Synthetic oligonucleotide
ttcacagtgcagcggcgagttcaacctaag

SEQ ID NO: 69856 - DNA, 29 bp, Artificial Sequence
  Description of Artificial Sequence: Synthetic oligonucleotide
tcacagtgcagcggcgagttcaacctaag

SEQ ID NO: 69857 - DNA, 28 bp, Artificial Sequence
  Description of Artificial Sequence: Synthetic oligonucleotide
cacagtgcagcggcgagttcaacctaag

SEQ ID NO: 69858 - DNA, 28 bp, Artificial Sequence
  Description of Artificial Sequence: Synthetic oligonucleotide
acagtgcagcggcgagttcaacctaagg

SEQ ID NO: 69859 - DNA, 27 bp, Artificial Sequence
  Description of Artificial Sequence: Synthetic oligonucleotide
cagtgcagcggcgagttcaacctaagg

SEQ ID NO: 69860 - DNA, 28 bp, Artificial Sequence
  Description of Artificial Sequence: Synthetic oligonucleotide
agtgcagcggcgagttcaacctaaggtg

SEQ ID NO: 69861 - DNA, 27 bp, Artificial Sequence
  Description of Artificial Sequence: Synthetic oligonucleotide
gtgcagcggcgagttcaacctaaggtg

SEQ ID NO: 69862 - DNA, 28 bp, Artificial Sequence
  Description of Artificial Sequence: Synthetic oligonucleotide
tgcagcggcgagttcaacctaaggtgac

SEQ ID NO: 69863 - DNA, 27 bp, Artificial Sequence
  Description of Artificial Sequence: Synthetic oligonucleotide
gcagcggcgagttcaacctaaggtgac

SEQ ID NO: 69864 - DNA, 28 bp, Artificial Sequence
  Description of Artificial Sequence: Synthetic oligonucleotide
cagcggcgagttcaacctaaggtgactg

SEQ ID NO: 69865 - DNA, 29 bp, Artificial Sequence
  Description of Artificial Sequence: Synthetic oligonucleotide
agcggcgagttcaacctaaggtgactgtg

SEQ ID NO: 69866 - DNA, 28 bp, Artificial Sequence
  Description of Artificial Sequence: Synthetic oligonucleotide
gcggcgagttcaacctaaggtgactgtg

SEQ ID NO: 69867 - DNA, 31 bp, Artificial Sequence
  Description of Artificial Sequence: Synthetic oligonucleotide
cggcgagttcaacctaaggtgactgtgtatc

SEQ ID NO: 69868 - DNA, 31 bp, Artificial Sequence
  Description of Artificial Sequence: Synthetic oligonucleotide
ggcgagttcaacctaaggtgactgtgtatcc

SEQ ID NO: 69869 - DNA, 33 bp, Artificial Sequence
  Description of Artificial Sequence: Synthetic oligonucleotide
gcgagttcaacctaaggtgactgtgtatccttc

SEQ ID NO: 69870 - DNA, 36 bp, Artificial Sequence
  Description of Artificial Sequence: Synthetic oligonucleotide
cgagttcaacctaaggtgactgtgtatccttcaaag

SEQ ID NO: 69871 - DNA, 37 bp, Artificial Sequence
  Description of Artificial Sequence: Synthetic oligonucleotide
gagttcaacctaaggtgactgtgtatccttcaaagac

SEQ ID NO: 69872 - DNA, 37 bp, Artificial Sequence
  Description of Artificial Sequence: Synthetic oligonucleotide
agttcaacctaaggtgactgtgtatccttcaaagacc

SEQ ID NO: 69873 - DNA, 36 bp, Artificial Sequence
  Description of Artificial Sequence: Synthetic oligonucleotide
gttcaacctaaggtgactgtgtatccttcaaagacc

SEQ ID NO: 69874 - DNA, 36 bp, Artificial Sequence
  Description of Artificial Sequence: Synthetic oligonucleotide
ttcaacctaaggtgactgtgtatccttcaaagaccc

SEQ ID NO: 69875 - DNA, 35 bp, Artificial Sequence
  Description of Artificial Sequence: Synthetic oligonucleotide
tcaacctaaggtgactgtgtatccttcaaagaccc

SEQ ID NO: 69876 - DNA, 34 bp, Artificial Sequence
  Description of Artificial Sequence: Synthetic oligonucleotide
caacctaaggtgactgtgtatccttcaaagaccc

SEQ ID NO: 69877 - DNA, 35 bp, Artificial Sequence
  Description of Artificial Sequence: Synthetic oligonucleotide
aacctaaggtgactgtgtatccttcaaagacccag

SEQ ID NO: 69878 - DNA, 34 bp, Artificial Sequence
  Description of Artificial Sequence: Synthetic oligonucleotide
acctaaggtgactgtgtatccttcaaagacccag

SEQ ID NO: 69879 - DNA, 31 bp, Artificial Sequence
  Description of Artificial Sequence: Synthetic oligonucleotide
caccacaacctcctggtctgttctgtgaatg

SEQ ID NO: 69880 - DNA, 31 bp, Artificial Sequence
  Description of Artificial Sequence: Synthetic oligonucleotide
accacaacctcctggtctgttctgtgaatgg

SEQ ID NO: 69881 - DNA, 30 bp, Artificial Sequence
  Description of Artificial Sequence: Synthetic oligonucleotide
ccacaacctcctggtctgttctgtgaatgg

SEQ ID NO: 69882 - DNA, 33 bp, Artificial Sequence
  Description of Artificial Sequence: Synthetic oligonucleotide
cacaacctcctggtctgttctgtgaatggtttc

SEQ ID NO: 69883 - DNA, 36 bp, Artificial Sequence
  Description of Artificial Sequence: Synthetic oligonucleotide
acaacctcctggtctgttctgtgaatggtttctatc

SEQ ID NO: 69884 - DNA, 35 bp, Artificial Sequence
  Description of Artificial Sequence: Synthetic oligonucleotide
caacctcctggtctgttctgtgaatggtttctatc

SEQ ID NO: 69885 - DNA, 35 bp, Artificial Sequence
  Description of Artificial Sequence: Synthetic oligonucleotide
aacctcctggtctgttctgtgaatggtttctatcc

SEQ ID NO: 69886 - DNA, 34 bp, Artificial Sequence
  Description of Artificial Sequence: Synthetic oligonucleotide
acctcctggtctgttctgtgaatggtttctatcc

SEQ ID NO: 69887 - DNA, 33 bp, Artificial Sequence
  Description of Artificial Sequence: Synthetic oligonucleotide
cctcctggtctgttctgtgaatggtttctatcc

SEQ ID NO: 69888 - DNA, 34 bp, Artificial Sequence
  Description of Artificial Sequence: Synthetic oligonucleotide
ctcctggtctgttctgtgaatggtttctatccag

SEQ ID NO: 69889 - DNA, 34 bp, Artificial Sequence
  Description of Artificial Sequence: Synthetic oligonucleotide
tcctggtctgttctgtgaatggtttctatccagg

SEQ ID NO: 69890 - DNA, 33 bp, Artificial Sequence
  Description of Artificial Sequence: Synthetic oligonucleotide
cctggtctgttctgtgaatggtttctatccagg

SEQ ID NO: 69891 - DNA, 33 bp, Artificial Sequence
  Description of Artificial Sequence: Synthetic oligonucleotide
ctggtctgttctgtgaatggtttctatccaggc

SEQ ID NO: 69892 - DNA, 34 bp, Artificial Sequence
  Description of Artificial Sequence: Synthetic oligonucleotide
tggtctgttctgtgaatggtttctatccaggcag

SEQ ID NO: 69893 - DNA, 33 bp, Artificial Sequence
  Description of Artificial Sequence: Synthetic oligonucleotide
ggtctgttctgtgaatggtttctatccaggcag

SEQ ID NO: 69894 - DNA, 33 bp, Artificial Sequence
  Description of Artificial Sequence: Synthetic oligonucleotide
gtctgttctgtgaatggtttctatccaggcagc

SEQ ID NO: 69895 - DNA, 36 bp, Artificial Sequence
  Description of Artificial Sequence: Synthetic oligonucleotide
tctgttctgtgaatggtttctatccaggcagcattg

SEQ ID NO: 69896 - DNA, 35 bp, Artificial Sequence
  Description of Artificial Sequence: Synthetic oligonucleotide
ctgttctgtgaatggtttctatccaggcagcattg

SEQ ID NO: 69897 - DNA, 37 bp, Artificial Sequence
  Description of Artificial Sequence: Synthetic oligonucleotide
tgttctgtgaatggtttctatccaggcagcattgaag

SEQ ID NO: 69898 - DNA, 36 bp, Artificial Sequence
  Description of Artificial Sequence: Synthetic oligonucleotide
gttctgtgaatggtttctatccaggcagcattgaag

SEQ ID NO: 69899 - DNA, 37 bp, Artificial Sequence
  Description of Artificial Sequence: Synthetic oligonucleotide
ttctgtgaatggtttctatccaggcagcattgaagtc

SEQ ID NO: 69900 - DNA, 27 bp, Artificial Sequence
  Description of Artificial Sequence: Synthetic oligonucleotide
gaagagaagactggggtggtgtccacg

SEQ ID NO: 69901 - DNA, 27 bp, Artificial Sequence
  Description of Artificial Sequence: Synthetic oligonucleotide
aagagaagactggggtggtgtccacgg

SEQ ID NO: 69902 - DNA, 26 bp, Artificial Sequence
  Description of Artificial Sequence: Synthetic oligonucleotide
agagaagactggggtggtgtccacgg

SEQ ID NO: 69903 - DNA, 25 bp, Artificial Sequence
  Description of Artificial Sequence: Synthetic oligonucleotide
gagaagactggggtggtgtccacgg

SEQ ID NO: 69904 - DNA, 25 bp, Artificial Sequence
  Description of Artificial Sequence: Synthetic oligonucleotide
agaagactggggtggtgtccacggg

SEQ ID NO: 69905 - DNA, 24 bp, Artificial Sequence
  Description of Artificial Sequence: Synthetic oligonucleotide
gaagactggggtggtgtccacggg

SEQ ID NO: 69906 - DNA, 24 bp, Artificial Sequence
  Description of Artificial Sequence: Synthetic oligonucleotide
aagactggggtggtgtccacgggc

SEQ ID NO: 69907 - DNA, 23 bp, Artificial Sequence
  Description of Artificial Sequence: Synthetic oligonucleotide
agactggggtggtgtccacgggc

SEQ ID NO: 69908 - DNA, 22 bp, Artificial Sequence
  Description of Artificial Sequence: Synthetic oligonucleotide
gactggggtggtgtccacgggc

SEQ ID NO: 69909 - DNA, 23 bp, Artificial Sequence
  Description of Artificial Sequence: Synthetic oligonucleotide
actggggtggtgtccacgggcct

SEQ ID NO: 69910 - DNA, 22 bp, Artificial Sequence
  Description of Artificial Sequence: Synthetic oligonucleotide
ctggggtggtgtccacgggcct

SEQ ID NO: 69911 - DNA, 24 bp, Artificial Sequence
  Description of Artificial Sequence: Synthetic oligonucleotide
tggggtggtgtccacgggcctgat

SEQ ID NO: 69912 - DNA, 23 bp, Artificial Sequence
  Description of Artificial Sequence: Synthetic oligonucleotide
ggggtggtgtccacgggcctgat

SEQ ID NO: 69913 - DNA, 23 bp, Artificial Sequence
  Description of Artificial Sequence: Synthetic oligonucleotide
gggtggtgtccacgggcctgatc

SEQ ID NO: 69914 - DNA, 24 bp, Artificial Sequence
  Description of Artificial Sequence: Synthetic oligonucleotide
ggtggtgtccacgggcctgatcca

SEQ ID NO: 69915 - DNA, 27 bp, Artificial Sequence
  Description of Artificial Sequence: Synthetic oligonucleotide
gtggtgtccacgggcctgatccagaat

SEQ ID NO: 69916 - DNA, 27 bp, Artificial Sequence
  Description of Artificial Sequence: Synthetic oligonucleotide
tggtgtccacgggcctgatccagaatg

SEQ ID NO: 69917 - DNA, 26 bp, Artificial Sequence
  Description of Artificial Sequence: Synthetic oligonucleotide
ggtgtccacgggcctgatccagaatg

SEQ ID NO: 69918 - DNA, 27 bp, Artificial Sequence
  Description of Artificial Sequence: Synthetic oligonucleotide
gtgtccacgggcctgatccagaatgga

SEQ ID NO: 69919 - DNA, 27 bp, Artificial Sequence
  Description of Artificial Sequence: Synthetic oligonucleotide
tgtccacgggcctgatccagaatggag

SEQ ID NO: 69920 - DNA, 27 bp, Artificial Sequence
  Description of Artificial Sequence: Synthetic oligonucleotide
gtccacgggcctgatccagaatggaga

SEQ ID NO: 69921 - DNA, 27 bp, Artificial Sequence
  Description of Artificial Sequence: Synthetic oligonucleotide
tccacgggcctgatccagaatggagac

SEQ ID NO: 69922 - DNA, 27 bp, Artificial Sequence
  Description of Artificial Sequence: Synthetic oligonucleotide
ccacgggcctgatccagaatggagact

SEQ ID NO: 69923 - DNA, 27 bp, Artificial Sequence
  Description of Artificial Sequence: Synthetic oligonucleotide
cacgggcctgatccagaatggagactg

SEQ ID NO: 69924 - DNA, 27 bp, Artificial Sequence
  Description of Artificial Sequence: Synthetic oligonucleotide
acgggcctgatccagaatggagactgg

SEQ ID NO: 69925 - DNA, 27 bp, Artificial Sequence
  Description of Artificial Sequence: Synthetic oligonucleotide
cgggcctgatccagaatggagactgga

SEQ ID NO: 69926 - DNA, 27 bp, Artificial Sequence
  Description of Artificial Sequence: Synthetic oligonucleotide
gggcctgatccagaatggagactggac

SEQ ID NO: 69927 - DNA, 30 bp, Artificial Sequence
  Description of Artificial Sequence: Synthetic oligonucleotide
accctggtgatgctggaaacagttcctcag

SEQ ID NO: 69928 - DNA, 29 bp, Artificial Sequence
  Description of Artificial Sequence: Synthetic oligonucleotide
ccctggtgatgctggaaacagttcctcag

SEQ ID NO: 69929 - DNA, 30 bp, Artificial Sequence
  Description of Artificial Sequence: Synthetic oligonucleotide
cctggtgatgctggaaacagttcctcagag

SEQ ID NO: 69930 - DNA, 31 bp, Artificial Sequence
  Description of Artificial Sequence: Synthetic oligonucleotide
ctggtgatgctggaaacagttcctcagagtg

SEQ ID NO: 69931 - DNA, 31 bp, Artificial Sequence
  Description of Artificial Sequence: Synthetic oligonucleotide
tggtgatgctggaaacagttcctcagagtgg

SEQ ID NO: 69932 - DNA, 30 bp, Artificial Sequence
  Description of Artificial Sequence: Synthetic oligonucleotide
ggtgatgctggaaacagttcctcagagtgg

SEQ ID NO: 69933 - DNA, 31 bp, Artificial Sequence
  Description of Artificial Sequence: Synthetic oligonucleotide
gtgatgctggaaacagttcctcagagtggag

SEQ ID NO: 69934 - DNA, 32 bp, Artificial Sequence
  Description of Artificial Sequence: Synthetic oligonucleotide
tgatgctggaaacagttcctcagagtggagag

SEQ ID NO: 69935 - DNA, 31 bp, Artificial Sequence
  Description of Artificial Sequence: Synthetic oligonucleotide
gatgctggaaacagttcctcagagtggagag

SEQ ID NO: 69936 - DNA, 31 bp, Artificial Sequence
  Description of Artificial Sequence: Synthetic oligonucleotide
atgctggaaacagttcctcagagtggagagg

SEQ ID NO: 69937 - DNA, 30 bp, Artificial Sequence
  Description of Artificial Sequence: Synthetic oligonucleotide
tgctggaaacagttcctcagagtggagagg

SEQ ID NO: 69938 - DNA, 29 bp, Artificial Sequence
  Description of Artificial Sequence: Synthetic oligonucleotide
gctggaaacagttcctcagagtggagagg

SEQ ID NO: 69939 - DNA, 33 bp, Artificial Sequence
  Description of Artificial Sequence: Synthetic oligonucleotide
ctggaaacagttcctcagagtggagaggtttac

SEQ ID NO: 69940 - DNA, 34 bp, Artificial Sequence
  Description of Artificial Sequence: Synthetic oligonucleotide
tggaaacagttcctcagagtggagaggtttacac

SEQ ID NO: 69941 - DNA, 33 bp, Artificial Sequence
  Description of Artificial Sequence: Synthetic oligonucleotide
ggaaacagttcctcagagtggagaggtttacac

SEQ ID NO: 69942 - DNA, 33 bp, Artificial Sequence
  Description of Artificial Sequence: Synthetic oligonucleotide
gaaacagttcctcagagtggagaggtttacacc

SEQ ID NO: 69943 - DNA, 34 bp, Artificial Sequence
  Description of Artificial Sequence: Synthetic oligonucleotide
aaacagttcctcagagtggagaggtttacacctg

SEQ ID NO: 69944 - DNA, 33 bp, Artificial Sequence
  Description of Artificial Sequence: Synthetic oligonucleotide
aacagttcctcagagtggagaggtttacacctg

SEQ ID NO: 69945 - DNA, 32 bp, Artificial Sequence
  Description of Artificial Sequence: Synthetic oligonucleotide
acagttcctcagagtggagaggtttacacctg

SEQ ID NO: 69946 - DNA, 31 bp, Artificial Sequence
  Description of Artificial Sequence: Synthetic oligonucleotide
cagttcctcagagtggagaggtttacacctg

SEQ ID NO: 69947 - DNA, 31 bp, Artificial Sequence
  Description of Artificial Sequence: Synthetic oligonucleotide
agttcctcagagtggagaggtttacacctgc

SEQ ID NO: 69948 - DNA, 30 bp, Artificial Sequence
  Description of Artificial Sequence: Synthetic oligonucleotide
gttcctcagagtggagaggtttacacctgc

SEQ ID NO: 69949 - DNA, 30 bp, Artificial Sequence
  Description of Artificial Sequence: Synthetic oligonucleotide
ttcctcagagtggagaggtttacacctgcc

SEQ ID NO: 69950 - DNA, 29 bp, Artificial Sequence
  Description of Artificial Sequence: Synthetic oligonucleotide
tcctcagagtggagaggtttacacctgcc

SEQ ID NO: 69951 - DNA, 28 bp, Artificial Sequence
  Description of Artificial Sequence: Synthetic oligonucleotide
cctcagagtggagaggtttacacctgcc

SEQ ID NO: 69952 - DNA, 30 bp, Artificial Sequence
  Description of Artificial Sequence: Synthetic oligonucleotide
ctcagagtggagaggtttacacctgccaag

SEQ ID NO: 69953 - DNA, 31 bp, Artificial Sequence
  Description of Artificial Sequence: Synthetic oligonucleotide
tcagagtggagaggtttacacctgccaagtg

SEQ ID NO: 69954 - DNA, 30 bp, Artificial Sequence
  Description of Artificial Sequence: Synthetic oligonucleotide
cagagtggagaggtttacacctgccaagtg

SEQ ID NO: 69955 - DNA, 30 bp, Artificial Sequence
  Description of Artificial Sequence: Synthetic oligonucleotide
agagtggagaggtttacacctgccaagtgg

SEQ ID NO: 69956 - DNA, 35 bp, Artificial Sequence
  Description of Artificial Sequence: Synthetic oligonucleotide
tacttcaggaatcagaaaggacactctggacttcc

SEQ ID NO: 69957 - DNA, 34 bp, Artificial Sequence
  Description of Artificial Sequence: Synthetic oligonucleotide
acttcaggaatcagaaaggacactctggacttcc

SEQ ID NO: 69958 - DNA, 33 bp, Artificial Sequence
  Description of Artificial Sequence: Synthetic oligonucleotide
cttcaggaatcagaaaggacactctggacttcc

SEQ ID NO: 69959 - DNA, 33 bp, Artificial Sequence
  Description of Artificial Sequence: Synthetic oligonucleotide
ttcaggaatcagaaaggacactctggacttccg

SEQ ID NO: 69960 - DNA, 32 bp, Artificial Sequence
  Description of Artificial Sequence: Synthetic oligonucleotide
tcaggaatcagaaaggacactctggacttccg

SEQ ID NO: 69961 - DNA, 31 bp, Artificial Sequence
  Description of Artificial Sequence: Synthetic oligonucleotide
caggaatcagaaaggacactctggacttccg

SEQ ID NO: 69962 - DNA, 31 bp, Artificial Sequence
  Description of Artificial Sequence: Synthetic oligonucleotide
aggaatcagaaaggacactctggacttccgc

SEQ ID NO: 69963 - DNA, 30 bp, Artificial Sequence
  Description of Artificial Sequence: Synthetic oligonucleotide
ggaatcagaaaggacactctggacttccgc

SEQ ID NO: 69964 - DNA, 30 bp, Artificial Sequence
  Description of Artificial Sequence: Synthetic oligonucleotide
gaatcagaaaggacactctggacttccgcc

SEQ ID NO: 69965 - DNA, 32 bp, Artificial Sequence
  Description of Artificial Sequence: Synthetic oligonucleotide
aatcagaaaggacactctggacttccgccaac

SEQ ID NO: 69966 - DNA, 31 bp, Artificial Sequence
  Description of Artificial Sequence: Synthetic oligonucleotide
atcagaaaggacactctggacttccgccaac

SEQ ID NO: 69967 - DNA, 30 bp, Artificial Sequence
  Description of Artificial Sequence: Synthetic oligonucleotide
tcagaaaggacactctggacttccgccaac

SEQ ID NO: 69968 - DNA, 29 bp, Artificial Sequence
  Description of Artificial Sequence: Synthetic oligonucleotide
cagaaaggacactctggacttccgccaac

SEQ ID NO: 69969 - DNA, 30 bp, Artificial Sequence
  Description of Artificial Sequence: Synthetic oligonucleotide
agaaaggacactctggacttccgccaacag

SEQ ID NO: 69970 - DNA, 29 bp, Artificial Sequence
  Description of Artificial Sequence: Synthetic oligonucleotide
gaaaggacactctggacttccgccaacag

SEQ ID NO: 69971 - DNA, 29 bp, Artificial Sequence
  Description of Artificial Sequence: Synthetic oligonucleotide
aaaggacactctggacttccgccaacagg

SEQ ID NO: 69972 - DNA, 28 bp, Artificial Sequence
  Description of Artificial Sequence: Synthetic oligonucleotide
aaggacactctggacttccgccaacagg

SEQ ID NO: 69973 - DNA, 27 bp, Artificial Sequence
  Description of Artificial Sequence: Synthetic oligonucleotide
aggacactctggacttccgccaacagg

SEQ ID NO: 69974 - DNA, 27 bp, Artificial Sequence
  Description of Artificial Sequence: Synthetic oligonucleotide
ggacactctggacttccgccaacagga

SEQ ID NO: 69975 - DNA, 29 bp, Artificial Sequence
  Description of Artificial Sequence: Synthetic oligonucleotide
gacactctggacttccgccaacaggattc

SEQ ID NO: 69976 - DNA, 29 bp, Artificial Sequence
  Description of Artificial Sequence: Synthetic oligonucleotide
acactctggacttccgccaacaggattcc

SEQ ID NO: 69977 - DNA, 28 bp, Artificial Sequence
  Description of Artificial Sequence: Synthetic oligonucleotide
cactctggacttccgccaacaggattcc

SEQ ID NO: 69978 - DNA, 29 bp, Artificial Sequence
  Description of Artificial Sequence: Synthetic oligonucleotide
actctggacttccgccaacaggattcctg

SEQ ID NO: 69979 - DNA, 28 bp, Artificial Sequence
  Description of Artificial Sequence: Synthetic oligonucleotide
ctctggacttccgccaacaggattcctg

SEQ ID NO: 69980 - DNA, 29 bp, Artificial Sequence
  Description of Artificial Sequence: Synthetic oligonucleotide
tctggacttccgccaacaggattcctgag

SEQ ID NO: 69981 - DNA, 28 bp, Artificial Sequence
  Description of Artificial Sequence: Synthetic oligonucleotide
ctggacttccgccaacaggattcctgag

SEQ ID NO: 69982 - DNA, 28 bp, Artificial Sequence
  Description of Artificial Sequence: Synthetic oligonucleotide
tggacttccgccaacaggattcctgagc

SEQ ID NO: 69983 - DNA, 27 bp, Artificial Sequence
  Description of Artificial Sequence: Synthetic oligonucleotide
ggacttccgccaacaggattcctgagc

SEQ ID NO: 69984 - DNA, 28 bp, Artificial Sequence
  Description of Artificial Sequence: Synthetic oligonucleotide
gacttccgccaacaggattcctgagctg

SEQ ID NO: 69985 - DNA, 21 bp, Artificial Sequence
  Description of Artificial Sequence: Synthetic oligonucleotide
gacctcctggagcggaggcgc

SEQ ID NO: 69986 - DNA, 21 bp, Artificial Sequence
  Description of Artificial Sequence: Synthetic oligonucleotide
acctcctggagcggaggcgcg

SEQ ID NO: 69987 - DNA, 20 bp, Artificial Sequence
  Description of Artificial Sequence: Synthetic oligonucleotide
cctcctggagcggaggcgcg

SEQ ID NO: 69988 - DNA, 20 bp, Artificial Sequence
  Description of Artificial Sequence: Synthetic oligonucleotide
ctcctggagcggaggcgcgc

SEQ ID NO: 69989 - DNA, 20 bp, Artificial Sequence
  Description of Artificial Sequence: Synthetic oligonucleotide
tcctggagcggaggcgcgcc

SEQ ID NO: 69990 - DNA, 20 bp, Artificial Sequence
  Description of Artificial Sequence: Synthetic oligonucleotide
cctggagcggaggcgcgcct

SEQ ID NO: 69991 - DNA, 20 bp, Artificial Sequence
  Description of Artificial Sequence: Synthetic oligonucleotide
ctggagcggaggcgcgccgt

SEQ ID NO: 69992 - DNA, 20 bp, Artificial Sequence
  Description of Artificial Sequence: Synthetic oligonucleotide
tggagcggaggcgcgccgct

SEQ ID NO: 69993 - DNA, 20 bp, Artificial Sequence
  Description of Artificial Sequence: Synthetic oligonucleotide
ggagcggaggcgcgccgctt

SEQ ID NO: 69994 - DNA, 20 bp, Artificial Sequence
  Description of Artificial Sequence: Synthetic oligonucleotide
gagcggaggcgcgccgcgtt

SEQ ID NO: 69995 - DNA, 20 bp, Artificial Sequence
  Description of Artificial Sequence: Synthetic oligonucleotide
agcggaggcgcgccgcggtt

SEQ ID NO: 69996 - DNA, 20 bp, Artificial Sequence
  Description of Artificial Sequence: Synthetic oligonucleotide
gcggaggcgcgccgcggttt

SEQ ID NO: 69997 - DNA, 20 bp, Artificial Sequence
  Description of Artificial Sequence: Synthetic oligonucleotide
cggaggcgcgccgcggtgtt

SEQ ID NO: 69998 - DNA, 20 bp, Artificial Sequence
  Description of Artificial Sequence: Synthetic oligonucleotide
ggaggcgcgccgcggtggat

SEQ ID NO: 69999 - DNA, 29 bp, Artificial Sequence
  Description of Artificial Sequence: Synthetic oligonucleotide
tccataaccaagaggagtacgcgcgcttc

SEQ ID NO: 70000 - DNA, 28 bp, Artificial Sequence
  Description of Artificial Sequence: Synthetic oligonucleotide
ccataaccaagaggagtacgcgcgcttc

SEQ ID NO: 70001 - DNA, 28 bp, Artificial Sequence
  Description of Artificial Sequence: Synthetic oligonucleotide
cataaccaagaggagtacgcgcgcttcg

SEQ ID NO: 70002 - DNA, 29 bp, Artificial Sequence
  Description of Artificial Sequence: Synthetic oligonucleotide
ataaccaagaggagtacgcgcgcttcgac

SEQ ID NO: 70003 - DNA, 28 bp, Artificial Sequence
  Description of Artificial Sequence: Synthetic oligonucleotide
taaccaagaggagtacgcgcgcttcgac

SEQ ID NO: 70004 - DNA, 27 bp, Artificial Sequence
  Description of Artificial Sequence: Synthetic oligonucleotide
aaccaagaggagtacgcgcgcttcgac

SEQ ID NO: 70005 - DNA, 27 bp, Artificial Sequence
  Description of Artificial Sequence: Synthetic oligonucleotide
accaagaggagtacgcgcgcttcgaca

SEQ ID NO: 70006 - DNA, 26 bp, Artificial Sequence
  Description of Artificial Sequence: Synthetic oligonucleotide
ccaagaggagtacgcgcgcttcgaca

SEQ ID NO: 70007 - DNA, 26 bp, Artificial Sequence
  Description of Artificial Sequence: Synthetic oligonucleotide
caagaggagtacgcgcgcttcgacag

SEQ ID NO: 70008 - DNA, 26 bp, Artificial Sequence
  Description of Artificial Sequence: Synthetic oligonucleotide
aagaggagtacgcgcgcttcgacagc

SEQ ID NO: 70009 - DNA, 40 bp, Artificial Sequence
  Description of Artificial Sequence: Synthetic oligonucleotide
tttcttggagtactctacgtctgagtgtcatttcttcaac

SEQ ID NO: 70010 - DNA, 39 bp, Artificial Sequence
  Description of Artificial Sequence: Synthetic oligonucleotide
ttcttggagtactctacgtctgagtgtcatttcttcaac

SEQ ID NO: 70011 - DNA, 38 bp, Artificial Sequence
  Description of Artificial Sequence: Synthetic oligonucleotide
tcttggagtactctacgtctgagtgtcatttcttcaac

SEQ ID NO: 70012 - DNA, 37 bp, Artificial Sequence
  Description of Artificial Sequence: Synthetic oligonucleotide
cttggagtactctacgtctgagtgtcatttcttcaac

SEQ ID NO: 70013 - DNA, 37 bp, Artificial Sequence
  Description of Artificial Sequence: Synthetic oligonucleotide
ttggagtactctacgtctgagtgtcatttcttcaacg

SEQ ID NO: 70014 - DNA, 36 bp, Artificial Sequence
  Description of Artificial Sequence: Synthetic oligonucleotide
tggagtactctacgtctgagtgtcatttcttcaacg

SEQ ID NO: 70015 - DNA, 35 bp, Artificial Sequence
  Description of Artificial Sequence: Synthetic oligonucleotide
ggagtactctacgtctgagtgtcatttcttcaacg

SEQ ID NO: 70016 - DNA, 35 bp, Artificial Sequence
  Description of Artificial Sequence: Synthetic oligonucleotide
gagtactctacgtctgagtgtcatttcttcaacgg

SEQ ID NO: 70017 - DNA, 35 bp, Artificial Sequence
  Description of Artificial Sequence: Synthetic oligonucleotide
agtactctacgtctgagtgtcatttcttcaacggg

SEQ ID NO: 70018 - DNA, 34 bp, Artificial Sequence
  Description of Artificial Sequence: Synthetic oligonucleotide
gtactctacgtctgagtgtcatttcttcaacggg

SEQ ID NO: 70019 - DNA, 35 bp, Artificial Sequence
  Description of Artificial Sequence: Synthetic oligonucleotide
tactctacgtctgagtgtcatttcttcaacgggac

SEQ ID NO: 70020 - DNA, 34 bp, Artificial Sequence
  Description of Artificial Sequence: Synthetic oligonucleotide
actctacgtctgagtgtcatttcttcaacgggac

SEQ ID NO: 70021 - DNA, 33 bp, Artificial Sequence
  Description of Artificial Sequence: Synthetic oligonucleotide
ctctacgtctgagtgtcatttcttcaacgggac

SEQ ID NO: 70022 - DNA, 33 bp, Artificial Sequence
  Description of Artificial Sequence: Synthetic oligonucleotide
tctacgtctgagtgtcatttcttcaacgggacg

SEQ ID NO: 70023 - DNA, 32 bp, Artificial Sequence
  Description of Artificial Sequence: Synthetic oligonucleotide
ctacgtctgagtgtcatttcttcaacgggacg

SEQ ID NO: 70024 - DNA, 32 bp, Artificial Sequence
  Description of Artificial Sequence: Synthetic oligonucleotide
tacgtctgagtgtcatttcttcaacgggacgg

SEQ ID NO: 70025 - DNA, 31 bp, Artificial Sequence
  Description of Artificial Sequence: Synthetic oligonucleotide
acgtctgagtgtcatttcttcaacgggacgg

SEQ ID NO: 70026 - DNA, 30 bp, Artificial Sequence
  Description of Artificial Sequence: Synthetic oligonucleotide
cgtctgagtgtcatttcttcaacgggacgg

SEQ ID NO: 70027 - DNA, 31 bp, Artificial Sequence
  Description of Artificial Sequence: Synthetic oligonucleotide
gacacctattgcagacacaactacggggttg

SEQ ID NO: 70028 - DNA, 31 bp, Artificial Sequence
  Description of Artificial Sequence: Synthetic oligonucleotide
acacctattgcagacacaactacggggttgg

SEQ ID NO: 70029 - DNA, 30 bp, Artificial Sequence
  Description of Artificial Sequence: Synthetic oligonucleotide
cacctattgcagacacaactacggggttgg

SEQ ID NO: 70030 - DNA, 31 bp, Artificial Sequence
  Description of Artificial Sequence: Synthetic oligonucleotide
acctattgcagacacaactacggggttggtg

SEQ ID NO: 70031 - DNA, 30 bp, Artificial Sequence
  Description of Artificial Sequence: Synthetic oligonucleotide
cctattgcagacacaactacggggttggtg

SEQ ID NO: 70032 - DNA, 31 bp, Artificial Sequence
  Description of Artificial Sequence: Synthetic oligonucleotide
ctattgcagacacaactacggggttggtgag

SEQ ID NO: 70033 - DNA, 32 bp, Artificial Sequence
  Description of Artificial Sequence: Synthetic oligonucleotide
tattgcagacacaactacggggttggtgagag

SEQ ID NO: 70034 - DNA, 31 bp, Artificial Sequence
  Description of Artificial Sequence: Synthetic oligonucleotide
attgcagacacaactacggggttggtgagag

SEQ ID NO: 70035 - DNA, 30 bp, Artificial Sequence
  Description of Artificial Sequence: Synthetic oligonucleotide
ttgcagacacaactacggggttggtgagag

SEQ ID NO: 70036 - DNA, 24 bp, Artificial Sequence
  Description of Artificial Sequence: Synthetic oligonucleotide
gacagcgacgtgggggagttccga

SEQ ID NO: 70037 - DNA, 24 bp, Artificial Sequence
  Description of Artificial Sequence: Synthetic oligonucleotide
acagcgacgtgggggagttccgag

SEQ ID NO: 70038 - DNA, 23 bp, Artificial Sequence
  Description of Artificial Sequence: Synthetic oligonucleotide
cagcgacgtgggggagttccgag

SEQ ID NO: 70039 - DNA, 23 bp, Artificial Sequence
  Description of Artificial Sequence: Synthetic oligonucleotide
agcgacgtgggggagttccgagc

SEQ ID NO: 70040 - DNA, 22 bp, Artificial Sequence
  Description of Artificial Sequence: Synthetic oligonucleotide
gcgacgtgggggagttccgagc

SEQ ID NO: 70041 - DNA, 22 bp, Artificial Sequence
  Description of Artificial Sequence: Synthetic oligonucleotide
cgacgtgggggagttccgagcg

SEQ ID NO: 70042 - DNA, 23 bp, Artificial Sequence
  Description of Artificial Sequence: Synthetic oligonucleotide
gacgtgggggagttccgagcggt

SEQ ID NO: 70043 - DNA, 24 bp, Artificial Sequence
  Description of Artificial Sequence: Synthetic oligonucleotide
acgtgggggagttccgagcggtga

SEQ ID NO: 70044 - DNA, 23 bp, Artificial Sequence
  Description of Artificial Sequence: Synthetic oligonucleotide
cgtgggggagttccgagcggtga

SEQ ID NO: 70045 - DNA, 23 bp, Artificial Sequence
  Description of Artificial Sequence: Synthetic oligonucleotide
gtgggggagttccgagcggtgac

SEQ ID NO: 70046 - DNA, 23 bp, Artificial Sequence
  Description of Artificial Sequence: Synthetic oligonucleotide
tgggggagttccgagcggtgacg

SEQ ID NO: 70047 - DNA, 22 bp, Artificial Sequence
  Description of Artificial Sequence: Synthetic oligonucleotide
gggggagttccgagcggtgacg

SEQ ID NO: 70048 - DNA, 23 bp, Artificial Sequence
  Description of Artificial Sequence: Synthetic oligonucleotide
ggggagttccgagcggtgacgga

SEQ ID NO: 70049 - DNA, 23 bp, Artificial Sequence
  Description of Artificial Sequence: Synthetic oligonucleotide
gggagttccgagcggtgacggag

SEQ ID NO: 70050 - DNA, 24 bp, Artificial Sequence
  Description of Artificial Sequence: Synthetic oligonucleotide
ggagttccgagcggtgacggagct

SEQ ID NO: 70051 - DNA, 24 bp, Artificial Sequence
  Description of Artificial Sequence: Synthetic oligonucleotide
gagttccgagcggtgacggagctg

SEQ ID NO: 70052 - DNA, 24 bp, Artificial Sequence
  Description of Artificial Sequence: Synthetic oligonucleotide
agttccgagcggtgacggagctgg

SEQ ID NO: 70053 - DNA, 23 bp, Artificial Sequence
  Description of Artificial Sequence: Synthetic oligonucleotide
gttccgagcggtgacggagctgg

SEQ ID NO: 70054 - DNA, 23 bp, Artificial Sequence
  Description of Artificial Sequence: Synthetic oligonucleotide
ttccgagcggtgacggagctggg

SEQ ID NO: 70055 - DNA, 22 bp, Artificial Sequence
  Description of Artificial Sequence: Synthetic oligonucleotide
tccgagcggtgacggagctggg

SEQ ID NO: 70056 - DNA, 21 bp, Artificial Sequence
  Description of Artificial Sequence: Synthetic oligonucleotide
ccgagcggtgacggagctggg

SEQ ID NO: 70057 - DNA, 21 bp, Artificial Sequence
  Description of Artificial Sequence: Synthetic oligonucleotide
cgagcggtgacggagctgggg

SEQ ID NO: 70058 - DNA, 21 bp, Artificial Sequence
  Description of Artificial Sequence: Synthetic oligonucleotide
gagcggtgacggagctggggc

SEQ ID NO: 70059 - DNA, 21 bp, Artificial Sequence
  Description of Artificial Sequence: Synthetic oligonucleotide
agcggtgacggagctggggcg

SEQ ID NO: 70060 - DNA, 28 bp, Artificial Sequence
  Description of Artificial Sequence: Synthetic oligonucleotide
cagaaggacttcctggaagacaggcgtg

SEQ ID NO: 70061 - DNA, 28 bp, Artificial Sequence
  Description of Artificial Sequence: Synthetic oligonucleotide
agaaggacttcctggaagacaggcgtgc

SEQ ID NO: 70062 - DNA, 27 bp, Artificial Sequence
  Description of Artificial Sequence: Synthetic oligonucleotide
gaaggacttcctggaagacaggcgtgc

SEQ ID NO: 70063 - DNA, 27 bp, Artificial Sequence
  Description of Artificial Sequence: Synthetic oligonucleotide
aaggacttcctggaagacaggcgtgcc

SEQ ID NO: 70064 - DNA, 26 bp, Artificial Sequence
  Description of Artificial Sequence: Synthetic oligonucleotide
aggacttcctggaagacaggcgtgcc

SEQ ID NO: 70065 - DNA, 25 bp, Artificial Sequence
  Description of Artificial Sequence: Synthetic oligonucleotide
ggacttcctggaagacaggcgtgcc

SEQ ID NO: 70066 - DNA, 25 bp, Artificial Sequence
  Description of Artificial Sequence: Synthetic oligonucleotide
gacttcctggaagacaggcgtgccg

SEQ ID NO: 70067 - DNA, 25 bp, Artificial Sequence
  Description of Artificial Sequence: Synthetic oligonucleotide
acttcctggaagacaggcgtgccgc

SEQ ID NO: 70068 - DNA, 24 bp, Artificial Sequence
  Description of Artificial Sequence: Synthetic oligonucleotide
cttcctggaagacaggcgtgccgc

SEQ ID NO: 70069 - DNA, 24 bp, Artificial Sequence
  Description of Artificial Sequence: Synthetic oligonucleotide
ttcctggaagacaggcgtgccgcg

SEQ ID NO: 70070 - DNA, 23 bp, Artificial Sequence
  Description of Artificial Sequence: Synthetic oligonucleotide
tcctggaagacaggcgtgccgcg

SEQ ID NO: 70071 - DNA, 22 bp, Artificial Sequence
  Description of Artificial Sequence: Synthetic oligonucleotide
cctggaagacaggcgtgccgcg

SEQ ID NO: 70072 - DNA, 23 bp, Artificial Sequence
  Description of Artificial Sequence: Synthetic oligonucleotide
ctggaagacaggcgtgccgcggt

SEQ ID NO: 70073 - DNA, 23 bp, Artificial Sequence
  Description of Artificial Sequence: Synthetic oligonucleotide
tggaagacaggcgtgccgcggtg

SEQ ID NO: 70074 - DNA, 22 bp, Artificial Sequence
  Description of Artificial Sequence: Synthetic oligonucleotide
ggaagacaggcgtgccgcggtg

SEQ ID NO: 70075 - DNA, 23 bp, Artificial Sequence
  Description of Artificial Sequence: Synthetic oligonucleotide
gaagacaggcgtgccgcggtgga

SEQ ID NO: 70076 - DNA, 24 bp, Artificial Sequence
  Description of Artificial Sequence: Synthetic oligonucleotide
aagacaggcgtgccgcggtggaca

SEQ ID NO: 70077 - DNA, 23 bp, Artificial Sequence
  Description of Artificial Sequence: Synthetic oligonucleotide
agacaggcgtgccgcggtggaca

SEQ ID NO: 70078 - DNA, 22 bp, Artificial Sequence
  Description of Artificial Sequence: Synthetic oligonucleotide
gacaggcgtgccgcggtggaca

SEQ ID NO: 70079 - DNA, 22 bp, Artificial Sequence
  Description of Artificial Sequence: Synthetic oligonucleotide
acaggcgtgccgcggtggacac

SEQ ID NO: 70080 - DNA, 21 bp, Artificial Sequence
  Description of Artificial Sequence: Synthetic oligonucleotide
caggcgtgccgcggtggacac

SEQ ID NO: 70081 - DNA, 22 bp, Artificial Sequence
  Description of Artificial Sequence: Synthetic oligonucleotide
cgacgtgggggagttccgggca

SEQ ID NO: 70082 - DNA, 23 bp, Artificial Sequence
  Description of Artificial Sequence: Synthetic oligonucleotide
gacgtgggggagttccgggcagt

SEQ ID NO: 70083 - DNA, 24 bp, Artificial Sequence
  Description of Artificial Sequence: Synthetic oligonucleotide
acgtgggggagttccgggcagtga

SEQ ID NO: 70084 - DNA, 23 bp, Artificial Sequence
  Description of Artificial Sequence: Synthetic oligonucleotide
cgtgggggagttccgggcagtga

SEQ ID NO: 70085 - DNA, 23 bp, Artificial Sequence
  Description of Artificial Sequence: Synthetic oligonucleotide
gtgggggagttccgggcagtgac

SEQ ID NO: 70086 - DNA, 23 bp, Artificial Sequence
  Description of Artificial Sequence: Synthetic oligonucleotide
tgggggagttccgggcagtgacg

SEQ ID NO: 70087 - DNA, 22 bp, Artificial Sequence
  Description of Artificial Sequence: Synthetic oligonucleotide
gggggagttccgggcagtgacg

SEQ ID NO: 70088 - DNA, 23 bp, Artificial Sequence
  Description of Artificial Sequence: Synthetic oligonucleotide
ggggagttccgggcagtgacgga

SEQ ID NO: 70089 - DNA, 23 bp, Artificial Sequence
  Description of Artificial Sequence: Synthetic oligonucleotide
gggagttccgggcagtgacggag

SEQ ID NO: 70090 - DNA, 24 bp, Artificial Sequence
  Description of Artificial Sequence: Synthetic oligonucleotide
ggagttccgggcagtgacggagct

SEQ ID NO: 70091 - DNA, 24 bp, Artificial Sequence
  Description of Artificial Sequence: Synthetic oligonucleotide
gagttccgggcagtgacggagctg

SEQ ID NO: 70092 - DNA, 24 bp, Artificial Sequence
  Description of Artificial Sequence: Synthetic oligonucleotide
agttccgggcagtgacggagctgg

SEQ ID NO: 70093 - DNA, 23 bp, Artificial Sequence
  Description of Artificial Sequence: Synthetic oligonucleotide
gttccgggcagtgacggagctgg

SEQ ID NO: 70094 - DNA, 23 bp, Artificial Sequence
  Description of Artificial Sequence: Synthetic oligonucleotide
ttccgggcagtgacggagctggg

SEQ ID NO: 70095 - DNA, 22 bp, Artificial Sequence
  Description of Artificial Sequence: Synthetic oligonucleotide
tccgggcagtgacggagctggg

SEQ ID NO: 70096 - DNA, 21 bp, Artificial Sequence
  Description of Artificial Sequence: Synthetic oligonucleotide
ccgggcagtgacggagctggg

SEQ ID NO: 70097 - DNA, 21 bp, Artificial Sequence
  Description of Artificial Sequence: Synthetic oligonucleotide
cgggcagtgacggagctgggg

SEQ ID NO: 70098 - DNA, 21 bp, Artificial Sequence
  Description of Artificial Sequence: Synthetic oligonucleotide
gggcagtgacggagctggggc

SEQ ID NO: 70099 - DNA, 21 bp, Artificial Sequence
  Description of Artificial Sequence: Synthetic oligonucleotide
ggcagtgacggagctggggcg

SEQ ID NO: 70100 - DNA, 21 bp, Artificial Sequence
  Description of Artificial Sequence: Synthetic oligonucleotide
gcagtgacggagctggggcgg

SEQ ID NO: 70101 - DNA, 21 bp, Artificial Sequence
  Description of Artificial Sequence: Synthetic oligonucleotide
cagtgacggagctggggcggc

SEQ ID NO: 70102 - DNA, 22 bp, Artificial Sequence
  Description of Artificial Sequence: Synthetic oligonucleotide
agtgacggagctggggcggcct

SEQ ID NO: 70103 - DNA, 29 bp, Artificial Sequence
  Description of Artificial Sequence: Synthetic oligonucleotide
gaacagccagaaggacttcctggaagacg

SEQ ID NO: 70104 - DNA, 30 bp, Artificial Sequence
  Description of Artificial Sequence: Synthetic oligonucleotide
aacagccagaaggacttcctggaagacgag

SEQ ID NO: 70105 - DNA, 29 bp, Artificial Sequence
  Description of Artificial Sequence: Synthetic oligonucleotide
acagccagaaggacttcctggaagacgag

SEQ ID NO: 70106 - DNA, 28 bp, Artificial Sequence
  Description of Artificial Sequence: Synthetic oligonucleotide
cagccagaaggacttcctggaagacgag

SEQ ID NO: 70107 - DNA, 28 bp, Artificial Sequence
  Description of Artificial Sequence: Synthetic oligonucleotide
agccagaaggacttcctggaagacgagc

SEQ ID NO: 70108 - DNA, 27 bp, Artificial Sequence
  Description of Artificial Sequence: Synthetic oligonucleotide
gccagaaggacttcctggaagacgagc

SEQ ID NO: 70109 - DNA, 27 bp, Artificial Sequence
  Description of Artificial Sequence: Synthetic oligonucleotide
ccagaaggacttcctggaagacgagcg

SEQ ID NO: 70110 - DNA, 27 bp, Artificial Sequence
  Description of Artificial Sequence: Synthetic oligonucleotide
cagaaggacttcctggaagacgagcgg

SEQ ID NO: 70111 - DNA, 27 bp, Artificial Sequence
  Description of Artificial Sequence: Synthetic oligonucleotide
agaaggacttcctggaagacgagcggg

SEQ ID NO: 70112 - DNA, 26 bp, Artificial Sequence
  Description of Artificial Sequence: Synthetic oligonucleotide
gaaggacttcctggaagacgagcggg

SEQ ID NO: 70113 - DNA, 26 bp, Artificial Sequence
  Description of Artificial Sequence: Synthetic oligonucleotide
aaggacttcctggaagacgagcgggc

SEQ ID NO: 70114 - DNA, 25 bp, Artificial Sequence
  Description of Artificial Sequence: Synthetic oligonucleotide
aggacttcctggaagacgagcgggc

SEQ ID NO: 70115 - DNA, 24 bp, Artificial Sequence
  Description of Artificial Sequence: Synthetic oligonucleotide
ggacttcctggaagacgagcgggc

SEQ ID NO: 70116 - DNA, 24 bp, Artificial Sequence
  Description of Artificial Sequence: Synthetic oligonucleotide
gacttcctggaagacgagcgggcc

SEQ ID NO: 70117 - DNA, 24 bp, Artificial Sequence
  Description of Artificial Sequence: Synthetic oligonucleotide
acttcctggaagacgagcgggccg

SEQ ID NO: 70118 - DNA, 23 bp, Artificial Sequence
  Description of Artificial Sequence: Synthetic oligonucleotide
cttcctggaagacgagcgggccg

SEQ ID NO: 70119 - DNA, 23 bp, Artificial Sequence
  Description of Artificial Sequence: Synthetic oligonucleotide
ttcctggaagacgagcgggccgc

SEQ ID NO: 70120 - DNA, 32 bp, Artificial Sequence
  Description of Artificial Sequence: Synthetic oligonucleotide
acacctattgcagacacaactacggggttgtg

SEQ ID NO: 70121 - DNA, 31 bp, Artificial Sequence
  Description of Artificial Sequence: Synthetic oligonucleotide
cacctattgcagacacaactacggggttgtg

SEQ ID NO: 70122 - DNA, 31 bp, Artificial Sequence
  Description of Artificial Sequence: Synthetic oligonucleotide
acctattgcagacacaactacggggttgtgg

SEQ ID NO: 70123 - DNA, 30 bp, Artificial Sequence
  Description of Artificial Sequence: Synthetic oligonucleotide
cctattgcagacacaactacggggttgtgg

SEQ ID NO: 70124 - DNA, 31 bp, Artificial Sequence
  Description of Artificial Sequence: Synthetic oligonucleotide
ctattgcagacacaactacggggttgtggag

SEQ ID NO: 70125 - DNA, 32 bp, Artificial Sequence
  Description of Artificial Sequence: Synthetic oligonucleotide
tattgcagacacaactacggggttgtggagag

SEQ ID NO: 70126 - DNA, 31 bp, Artificial Sequence
  Description of Artificial Sequence: Synthetic oligonucleotide
attgcagacacaactacggggttgtggagag

SEQ ID NO: 70127 - DNA, 30 bp, Artificial Sequence
  Description of Artificial Sequence: Synthetic oligonucleotide
ttgcagacacaactacggggttgtggagag

SEQ ID NO: 70128 - DNA, 33 bp, Artificial Sequence
  Description of Artificial Sequence: Synthetic oligonucleotide
gtgcggttcctggacagatacttctataaccag

SEQ ID NO: 70129 - DNA, 33 bp, Artificial Sequence
  Description of Artificial Sequence: Synthetic oligonucleotide
tgcggttcctggacagatacttctataaccagg

SEQ ID NO: 70130 - DNA, 32 bp, Artificial Sequence
  Description of Artificial Sequence: Synthetic oligonucleotide
gcggttcctggacagatacttctataaccagg

SEQ ID NO: 70131 - DNA, 33 bp, Artificial Sequence
  Description of Artificial Sequence: Synthetic oligonucleotide
cggttcctggacagatacttctataaccaggag

SEQ ID NO: 70132 - DNA, 33 bp, Artificial Sequence
  Description of Artificial Sequence: Synthetic oligonucleotide
ggttcctggacagatacttctataaccaggagg

SEQ ID NO: 70133 - DNA, 34 bp, Artificial Sequence
  Description of Artificial Sequence: Synthetic oligonucleotide
gttcctggacagatacttctataaccaggaggag

SEQ ID NO: 70134 - DNA, 36 bp, Artificial Sequence
  Description of Artificial Sequence: Synthetic oligonucleotide
ttcctggacagatacttctataaccaggaggagtac

SEQ ID NO: 70135 - DNA, 35 bp, Artificial Sequence
  Description of Artificial Sequence: Synthetic oligonucleotide
tcctggacagatacttctataaccaggaggagtac

SEQ ID NO: 70136 - DNA, 34 bp, Artificial Sequence
  Description of Artificial Sequence: Synthetic oligonucleotide
cctggacagatacttctataaccaggaggagtac

SEQ ID NO: 70137 - DNA, 34 bp, Artificial Sequence
  Description of Artificial Sequence: Synthetic oligonucleotide
ctggacagatacttctataaccaggaggagtacg

SEQ ID NO: 70138 - DNA, 35 bp, Artificial Sequence
  Description of Artificial Sequence: Synthetic oligonucleotide
tggacagatacttctataaccaggaggagtacgtg

SEQ ID NO: 70139 - DNA, 34 bp, Artificial Sequence
  Description of Artificial Sequence: Synthetic oligonucleotide
ggacagatacttctataaccaggaggagtacgtg

SEQ ID NO: 70140 - DNA, 34 bp, Artificial Sequence
  Description of Artificial Sequence: Synthetic oligonucleotide
gacagatacttctataaccaggaggagtacgtgc

SEQ ID NO: 70141 - DNA, 34 bp, Artificial Sequence
  Description of Artificial Sequence: Synthetic oligonucleotide
acagatacttctataaccaggaggagtacgtgcg

SEQ ID NO: 70142 - DNA, 33 bp, Artificial Sequence
  Description of Artificial Sequence: Synthetic oligonucleotide
cagatacttctataaccaggaggagtacgtgcg

SEQ ID NO: 70143 - DNA, 33 bp, Artificial Sequence
  Description of Artificial Sequence: Synthetic oligonucleotide
agatacttctataaccaggaggagtacgtgcgc

SEQ ID NO: 70144 - DNA, 32 bp, Artificial Sequence
  Description of Artificial Sequence: Synthetic oligonucleotide
gatacttctataaccaggaggagtacgtgcgc

SEQ ID NO: 70145 - DNA, 34 bp, Artificial Sequence
  Description of Artificial Sequence: Synthetic oligonucleotide
atacttctataaccaggaggagtacgtgcgcttc

SEQ ID NO: 70146 - DNA, 33 bp, Artificial Sequence
  Description of Artificial Sequence: Synthetic oligonucleotide
tacttctataaccaggaggagtacgtgcgcttc

SEQ ID NO: 70147 - DNA, 32 bp, Artificial Sequence
  Description of Artificial Sequence: Synthetic oligonucleotide
acttctataaccaggaggagtacgtgcgcttc

SEQ ID NO: 70148 - DNA, 31 bp, Artificial Sequence
  Description of Artificial Sequence: Synthetic oligonucleotide
cttctataaccaggaggagtacgtgcgcttc

SEQ ID NO: 70149 - DNA, 31 bp, Artificial Sequence
  Description of Artificial Sequence: Synthetic oligonucleotide
ttctataaccaggaggagtacgtgcgcttcg

SEQ ID NO: 70150 - DNA, 30 bp, Artificial Sequence
  Description of Artificial Sequence: Synthetic oligonucleotide
tctataaccaggaggagtacgtgcgcttcg

SEQ ID NO: 70151 - DNA, 29 bp, Artificial Sequence
  Description of Artificial Sequence: Synthetic oligonucleotide
ctataaccaggaggagtacgtgcgcttcg

SEQ ID NO: 70152 - DNA, 30 bp, Artificial Sequence
  Description of Artificial Sequence: Synthetic oligonucleotide
tataaccaggaggagtacgtgcgcttcgac

SEQ ID NO: 70153 - DNA, 32 bp, Artificial Sequence
  Description of Artificial Sequence: Synthetic oligonucleotide
acgtttcttggagtactctacgggtgagtgtc

SEQ ID NO: 70154 - DNA, 31 bp, Artificial Sequence
  Description of Artificial Sequence: Synthetic oligonucleotide
cgtttcttggagtactctacgggtgagtgtc

SEQ ID NO: 70155 - DNA, 35 bp, Artificial Sequence
  Description of Artificial Sequence: Synthetic oligonucleotide
gtttcttggagtactctacgggtgagtgtcatttc

SEQ ID NO: 70156 - DNA, 37 bp, Artificial Sequence
  Description of Artificial Sequence: Synthetic oligonucleotide
tttcttggagtactctacgggtgagtgtcatttcttc

SEQ ID NO: 70157 - DNA, 36 bp, Artificial Sequence
  Description of Artificial Sequence: Synthetic oligonucleotide
ttcttggagtactctacgggtgagtgtcatttcttc

SEQ ID NO: 70158 - DNA, 35 bp, Artificial Sequence
  Description of Artificial Sequence: Synthetic oligonucleotide
tcttggagtactctacgggtgagtgtcatttcttc

SEQ ID NO: 70159 - DNA, 34 bp, Artificial Sequence
  Description of Artificial Sequence: Synthetic oligonucleotide
cttggagtactctacgggtgagtgtcatttcttc

SEQ ID NO: 70160 - DNA, 37 bp, Artificial Sequence
  Description of Artificial Sequence: Synthetic oligonucleotide
ttggagtactctacgggtgagtgtcatttcttcaatg

SEQ ID NO: 70161 - DNA, 36 bp, Artificial Sequence
  Description of Artificial Sequence: Synthetic oligonucleotide
tggagtactctacgggtgagtgtcatttcttcaatg

SEQ ID NO: 70162 - DNA, 35 bp, Artificial Sequence
  Description of Artificial Sequence: Synthetic oligonucleotide
ggagtactctacgggtgagtgtcatttcttcaatg

SEQ ID NO: 70163 - DNA, 35 bp, Artificial Sequence
  Description of Artificial Sequence: Synthetic oligonucleotide
gagtactctacgggtgagtgtcatttcttcaatgg

SEQ ID NO: 70164 - DNA, 35 bp, Artificial Sequence
  Description of Artificial Sequence: Synthetic oligonucleotide
agtactctacgggtgagtgtcatttcttcaatggg

SEQ ID NO: 70165 - DNA, 34 bp, Artificial Sequence
  Description of Artificial Sequence: Synthetic oligonucleotide
gtactctacgggtgagtgtcatttcttcaatggg

SEQ ID NO: 70166 - DNA, 35 bp, Artificial Sequence
  Description of Artificial Sequence: Synthetic oligonucleotide
tactctacgggtgagtgtcatttcttcaatgggac

SEQ ID NO: 70167 - DNA, 34 bp, Artificial Sequence
  Description of Artificial Sequence: Synthetic oligonucleotide
actctacgggtgagtgtcatttcttcaatgggac

SEQ ID NO: 70168 - DNA, 33 bp, Artificial Sequence
  Description of Artificial Sequence: Synthetic oligonucleotide
ctctacgggtgagtgtcatttcttcaatgggac

SEQ ID NO: 70169 - DNA, 33 bp, Artificial Sequence
  Description of Artificial Sequence: Synthetic oligonucleotide
tctacgggtgagtgtcatttcttcaatgggacg

SEQ ID NO: 70170 - DNA, 32 bp, Artificial Sequence
  Description of Artificial Sequence: Synthetic oligonucleotide
ctacgggtgagtgtcatttcttcaatgggacg

SEQ ID NO: 70171 - DNA, 32 bp, Artificial Sequence
  Description of Artificial Sequence: Synthetic oligonucleotide
tacgggtgagtgtcatttcttcaatgggacgg

SEQ ID NO: 70172 - DNA, 31 bp, Artificial Sequence
  Description of Artificial Sequence: Synthetic oligonucleotide
acgggtgagtgtcatttcttcaatgggacgg

SEQ ID NO: 70173 - DNA, 30 bp, Artificial Sequence
  Description of Artificial Sequence: Synthetic oligonucleotide
cgggtgagtgtcatttcttcaatgggacgg

SEQ ID NO: 70174 - DNA, 31 bp, Artificial Sequence
  Description of Artificial Sequence: Synthetic oligonucleotide
gggtgagtgtcatttcttcaatgggacggag

SEQ ID NO: 70175 - DNA, 31 bp, Artificial Sequence
  Description of Artificial Sequence: Synthetic oligonucleotide
ggtgagtgtcatttcttcaatgggacggagc

SEQ ID NO: 70176 - DNA, 31 bp, Artificial Sequence
  Description of Artificial Sequence: Synthetic oligonucleotide
gtgagtgtcatttcttcaatgggacggagcg

SEQ ID NO: 70177 - DNA, 22 bp, Artificial Sequence
  Description of Artificial Sequence: Synthetic oligonucleotide
ctcctggaagacaggcgggccg

SEQ ID NO: 70178 - DNA, 30 bp, Artificial Sequence
  Description of Artificial Sequence: Synthetic oligonucleotide
ccgaccacgtttcttggagtactctacgtc

SEQ ID NO: 70179 - DNA, 31 bp, Artificial Sequence
  Description of Artificial Sequence: Synthetic oligonucleotide
cgaccacgtttcttggagtactctacgtctg

SEQ ID NO: 70180 - DNA, 37 bp, Artificial Sequence
  Description of Artificial Sequence: Synthetic oligonucleotide
gttcctggacagatacttctataaccaagaggagttc

SEQ ID NO: 70181 - DNA, 37 bp, Artificial Sequence
  Description of Artificial Sequence: Synthetic oligonucleotide
ttcctggacagatacttctataaccaagaggagttcg

SEQ ID NO: 70182 - DNA, 36 bp, Artificial Sequence
  Description of Artificial Sequence: Synthetic oligonucleotide
tcctggacagatacttctataaccaagaggagttcg

SEQ ID NO: 70183 - DNA, 35 bp, Artificial Sequence
  Description of Artificial Sequence: Synthetic oligonucleotide
cctggacagatacttctataaccaagaggagttcg

SEQ ID NO: 70184 - DNA, 36 bp, Artificial Sequence
  Description of Artificial Sequence: Synthetic oligonucleotide
ctggacagatacttctataaccaagaggagttcgtg

SEQ ID NO: 70185 - DNA, 36 bp, Artificial Sequence
  Description of Artificial Sequence: Synthetic oligonucleotide
tggacagatacttctataaccaagaggagttcgtgc

SEQ ID NO: 70186 - DNA, 35 bp, Artificial Sequence
  Description of Artificial Sequence: Synthetic oligonucleotide
ggacagatacttctataaccaagaggagttcgtgc

SEQ ID NO: 70187 - DNA, 35 bp, Artificial Sequence
  Description of Artificial Sequence: Synthetic oligonucleotide
gacagatacttctataaccaagaggagttcgtgcg

SEQ ID NO: 70188 - DNA, 35 bp, Artificial Sequence
  Description of Artificial Sequence: Synthetic oligonucleotide
acagatacttctataaccaagaggagttcgtgcgc

SEQ ID NO: 70189 - DNA, 34 bp, Artificial Sequence
  Description of Artificial Sequence: Synthetic oligonucleotide
cagatacttctataaccaagaggagttcgtgcgc

SEQ ID NO: 70190 - DNA, 36 bp, Artificial Sequence
  Description of Artificial Sequence: Synthetic oligonucleotide
agatacttctataaccaagaggagttcgtgcgcttc

SEQ ID NO: 70191 - DNA, 35 bp, Artificial Sequence
  Description of Artificial Sequence: Synthetic oligonucleotide
gatacttctataaccaagaggagttcgtgcgcttc

SEQ ID NO: 70192 - DNA, 35 bp, Artificial Sequence
  Description of Artificial Sequence: Synthetic oligonucleotide
atacttctataaccaagaggagttcgtgcgcttcg

SEQ ID NO: 70193 - DNA, 34 bp, Artificial Sequence
  Description of Artificial Sequence: Synthetic oligonucleotide
tacttctataaccaagaggagttcgtgcgcttcg

SEQ ID NO: 70194 - DNA, 33 bp, Artificial Sequence
  Description of Artificial Sequence: Synthetic oligonucleotide
acttctataaccaagaggagttcgtgcgcttcg

SEQ ID NO: 70195 - DNA, 32 bp, Artificial Sequence
  Description of Artificial Sequence: Synthetic oligonucleotide
cttctataaccaagaggagttcgtgcgcttcg

SEQ ID NO: 70196 - DNA, 33 bp, Artificial Sequence
  Description of Artificial Sequence: Synthetic oligonucleotide
ttctataaccaagaggagttcgtgcgcttcgac

SEQ ID NO: 70197 - DNA, 32 bp, Artificial Sequence
  Description of Artificial Sequence: Synthetic oligonucleotide
tctataaccaagaggagttcgtgcgcttcgac

SEQ ID NO: 70198 - DNA, 31 bp, Artificial Sequence
  Description of Artificial Sequence: Synthetic oligonucleotide
ctataaccaagaggagttcgtgcgcttcgac

SEQ ID NO: 70199 - DNA, 32 bp, Artificial Sequence
  Description of Artificial Sequence: Synthetic oligonucleotide
tataaccaagaggagttcgtgcgcttcgacag

SEQ ID NO: 70200 - DNA, 31 bp, Artificial Sequence
  Description of Artificial Sequence: Synthetic oligonucleotide
ataaccaagaggagttcgtgcgcttcgacag

SEQ ID NO: 70201 - DNA, 30 bp, Artificial Sequence
  Description of Artificial Sequence: Synthetic oligonucleotide
taaccaagaggagttcgtgcgcttcgacag

SEQ ID NO: 70202 - DNA, 29 bp, Artificial Sequence
  Description of Artificial Sequence: Synthetic oligonucleotide
aaccaagaggagttcgtgcgcttcgacag

SEQ ID NO: 70203 - DNA, 28 bp, Artificial Sequence
  Description of Artificial Sequence: Synthetic oligonucleotide
accaagaggagttcgtgcgcttcgacag

SEQ ID NO: 70204 - DNA, 27 bp, Artificial Sequence
  Description of Artificial Sequence: Synthetic oligonucleotide
ccaagaggagttcgtgcgcttcgacag

SEQ ID NO: 70205 - DNA, 27 bp, Artificial Sequence
  Description of Artificial Sequence: Synthetic oligonucleotide
caagaggagttcgtgcgcttcgacagc

SEQ ID NO: 70206 - DNA, 27 bp, Artificial Sequence
  Description of Artificial Sequence: Synthetic oligonucleotide
aagaggagttcgtgcgcttcgacagcg

SEQ ID NO: 70207 - DNA, 27 bp, Artificial Sequence
  Description of Artificial Sequence: Synthetic oligonucleotide
agaggagttcgtgcgcttcgacagcga

SEQ ID NO: 70208 - DNA, 36 bp, Artificial Sequence
  Description of Artificial Sequence: Synthetic oligonucleotide
ttcctggacagatacttctataaccaggaggagttc

SEQ ID NO: 70209 - DNA, 35 bp, Artificial Sequence
  Description of Artificial Sequence: Synthetic oligonucleotide
tcctggacagatacttctataaccaggaggagttc

SEQ ID NO: 70210 - DNA, 34 bp, Artificial Sequence
  Description of Artificial Sequence: Synthetic oligonucleotide
cctggacagatacttctataaccaggaggagttc

SEQ ID NO: 70211 - DNA, 34 bp, Artificial Sequence
  Description of Artificial Sequence: Synthetic oligonucleotide
ctggacagatacttctataaccaggaggagttcg

SEQ ID NO: 70212 - DNA, 35 bp, Artificial Sequence
  Description of Artificial Sequence: Synthetic oligonucleotide
tggacagatacttctataaccaggaggagttcgtg

SEQ ID NO: 70213 - DNA, 34 bp, Artificial Sequence
  Description of Artificial Sequence: Synthetic oligonucleotide
ggacagatacttctataaccaggaggagttcgtg

SEQ ID NO: 70214 - DNA, 34 bp, Artificial Sequence
  Description of Artificial Sequence: Synthetic oligonucleotide
gacagatacttctataaccaggaggagttcgtgc

SEQ ID NO: 70215 - DNA, 34 bp, Artificial Sequence
  Description of Artificial Sequence: Synthetic oligonucleotide
acagatacttctataaccaggaggagttcgtgcg

SEQ ID NO: 70216 - DNA, 33 bp, Artificial Sequence
  Description of Artificial Sequence: Synthetic oligonucleotide
cagatacttctataaccaggaggagttcgtgcg

SEQ ID NO: 70217 - DNA, 33 bp, Artificial Sequence
  Description of Artificial Sequence: Synthetic oligonucleotide
agatacttctataaccaggaggagttcgtgcgc

SEQ ID NO: 70218 - DNA, 32 bp, Artificial Sequence
  Description of Artificial Sequence: Synthetic oligonucleotide
gatacttctataaccaggaggagttcgtgcgc

SEQ ID NO: 70219 - DNA, 34 bp, Artificial Sequence
  Description of Artificial Sequence: Synthetic oligonucleotide
atacttctataaccaggaggagttcgtgcgcttc

SEQ ID NO: 70220 - DNA, 33 bp, Artificial Sequence
  Description of Artificial Sequence: Synthetic oligonucleotide
tacttctataaccaggaggagttcgtgcgcttc

SEQ ID NO: 70221 - DNA, 24 bp, Artificial Sequence
  Description of Artificial Sequence: Synthetic oligonucleotide
cagcccctgcagcaccacaacctg

SEQ ID NO: 70222 - DNA, 25 bp, Artificial Sequence
  Description of Artificial Sequence: Synthetic oligonucleotide
agcccctgcagcaccacaacctgct

SEQ ID NO: 70223 - DNA, 24 bp, Artificial Sequence
  Description of Artificial Sequence: Synthetic oligonucleotide
gcccctgcagcaccacaacctgct

SEQ ID NO: 70224 - DNA, 24 bp, Artificial Sequence
  Description of Artificial Sequence: Synthetic oligonucleotide
cccctgcagcaccacaacctgctg

SEQ ID NO: 70225 - DNA, 25 bp, Artificial Sequence
  Description of Artificial Sequence: Synthetic oligonucleotide
ccctgcagcaccacaacctgctggt

SEQ ID NO: 70226 - DNA, 26 bp, Artificial Sequence
  Description of Artificial Sequence: Synthetic oligonucleotide
cctgcagcaccacaacctgctggtct

SEQ ID NO: 70227 - DNA, 27 bp, Artificial Sequence
  Description of Artificial Sequence: Synthetic oligonucleotide
ctgcagcaccacaacctgctggtctgt

SEQ ID NO: 70228 - DNA, 28 bp, Artificial Sequence
  Description of Artificial Sequence: Synthetic oligonucleotide
tgcagcaccacaacctgctggtctgttc

SEQ ID NO: 70229 - DNA, 27 bp, Artificial Sequence
  Description of Artificial Sequence: Synthetic oligonucleotide
gcagcaccacaacctgctggtctgttc

SEQ ID NO: 70230 - DNA, 28 bp, Artificial Sequence
  Description of Artificial Sequence: Synthetic oligonucleotide
cagcaccacaacctgctggtctgttctg

SEQ ID NO: 70231 - DNA, 29 bp, Artificial Sequence
  Description of Artificial Sequence: Synthetic oligonucleotide
agcaccacaacctgctggtctgttctgtg

SEQ ID NO: 70232 - DNA, 28 bp, Artificial Sequence
  Description of Artificial Sequence: Synthetic oligonucleotide
gcaccacaacctgctggtctgttctgtg

SEQ ID NO: 70233 - DNA, 29 bp, Artificial Sequence
  Description of Artificial Sequence: Synthetic oligonucleotide
caccacaacctgctggtctgttctgtgag

SEQ ID NO: 70234 - DNA, 30 bp, Artificial Sequence
  Description of Artificial Sequence: Synthetic oligonucleotide
accacaacctgctggtctgttctgtgagtg

SEQ ID NO: 70235 - DNA, 29 bp, Artificial Sequence
  Description of Artificial Sequence: Synthetic oligonucleotide
ccacaacctgctggtctgttctgtgagtg

SEQ ID NO: 70236 - DNA, 29 bp, Artificial Sequence
  Description of Artificial Sequence: Synthetic oligonucleotide
cacaacctgctggtctgttctgtgagtgg

SEQ ID NO: 70237 - DNA, 32 bp, Artificial Sequence
  Description of Artificial Sequence: Synthetic oligonucleotide
acaacctgctggtctgttctgtgagtggtttc

SEQ ID NO: 70238 - DNA, 31 bp, Artificial Sequence
  Description of Artificial Sequence: Synthetic oligonucleotide
caacctgctggtctgttctgtgagtggtttc

SEQ ID NO: 70239 - DNA, 34 bp, Artificial Sequence
  Description of Artificial Sequence: Synthetic oligonucleotide
aacctgctggtctgttctgtgagtggtttctatc

SEQ ID NO: 70240 - DNA, 33 bp, Artificial Sequence
  Description of Artificial Sequence: Synthetic oligonucleotide
acctgctggtctgttctgtgagtggtttctatc

SEQ ID NO: 70241 - DNA, 32 bp, Artificial Sequence
  Description of Artificial Sequence: Synthetic oligonucleotide
cctgctggtctgttctgtgagtggtttctatc

SEQ ID NO: 70242 - DNA, 32 bp, Artificial Sequence
  Description of Artificial Sequence: Synthetic oligonucleotide
ctgctggtctgttctgtgagtggtttctatcc

SEQ ID NO: 70243 - DNA, 33 bp, Artificial Sequence
  Description of Artificial Sequence: Synthetic oligonucleotide
tgctggtctgttctgtgagtggtttctatccag

SEQ ID NO: 70244 - DNA, 32 bp, Artificial Sequence
  Description of Artificial Sequence: Synthetic oligonucleotide
gctggtctgttctgtgagtggtttctatccag

SEQ ID NO: 70245 - DNA, 28 bp, Artificial Sequence
  Description of Artificial Sequence: Synthetic oligonucleotide
gttccggaatggccaggaagagaagacg

SEQ ID NO: 70246 - DNA, 28 bp, Artificial Sequence
  Description of Artificial Sequence: Synthetic oligonucleotide
ttccggaatggccaggaagagaagacgg

SEQ ID NO: 70247 - DNA, 27 bp, Artificial Sequence
  Description of Artificial Sequence: Synthetic oligonucleotide
tccggaatggccaggaagagaagacgg

SEQ ID NO: 70248 - DNA, 26 bp, Artificial Sequence
  Description of Artificial Sequence: Synthetic oligonucleotide
ccggaatggccaggaagagaagacgg

SEQ ID NO: 70249 - DNA, 26 bp, Artificial Sequence
  Description of Artificial Sequence: Synthetic oligonucleotide
cggaatggccaggaagagaagacggg

SEQ ID NO: 70250 - DNA, 26 bp, Artificial Sequence
  Description of Artificial Sequence: Synthetic oligonucleotide
ggaatggccaggaagagaagacgggg

SEQ ID NO: 70251 - DNA, 27 bp, Artificial Sequence
  Description of Artificial Sequence: Synthetic oligonucleotide
gaatggccaggaagagaagacgggggt

SEQ ID NO: 70252 - DNA, 27 bp, Artificial Sequence
  Description of Artificial Sequence: Synthetic oligonucleotide
aatggccaggaagagaagacgggggtg

SEQ ID NO: 70253 - DNA, 26 bp, Artificial Sequence
  Description of Artificial Sequence: Synthetic oligonucleotide
atggccaggaagagaagacgggggtg

SEQ ID NO: 70254 - DNA, 25 bp, Artificial Sequence
  Description of Artificial Sequence: Synthetic oligonucleotide
tggccaggaagagaagacgggggtg

SEQ ID NO: 70255 - DNA, 24 bp, Artificial Sequence
  Description of Artificial Sequence: Synthetic oligonucleotide
ggccaggaagagaagacgggggtg

SEQ ID NO: 70256 - DNA, 25 bp, Artificial Sequence
  Description of Artificial Sequence: Synthetic oligonucleotide
gccaggaagagaagacgggggtggt

SEQ ID NO: 70257 - DNA, 26 bp, Artificial Sequence
  Description of Artificial Sequence: Synthetic oligonucleotide
ccaggaagagaagacgggggtggtgt

SEQ ID NO: 70258 - DNA, 26 bp, Artificial Sequence
  Description of Artificial Sequence: Synthetic oligonucleotide
caggaagagaagacgggggtggtgtc

SEQ ID NO: 70259 - DNA, 27 bp, Artificial Sequence
  Description of Artificial Sequence: Synthetic oligonucleotide
aggaagagaagacgggggtggtgtcca

SEQ ID NO: 70260 - DNA, 26 bp, Artificial Sequence
  Description of Artificial Sequence: Synthetic oligonucleotide
ggaagagaagacgggggtggtgtcca

SEQ ID NO: 70261 - DNA, 27 bp, Artificial Sequence
  Description of Artificial Sequence: Synthetic oligonucleotide
gaagagaagacgggggtggtgtccaca

SEQ ID NO: 70262 - DNA, 27 bp, Artificial Sequence
  Description of Artificial Sequence: Synthetic oligonucleotide
aagagaagacgggggtggtgtccacag

SEQ ID NO: 70263 - DNA, 26 bp, Artificial Sequence
  Description of Artificial Sequence: Synthetic oligonucleotide
agagaagacgggggtggtgtccacag

SEQ ID NO: 70264 - DNA, 25 bp, Artificial Sequence
  Description of Artificial Sequence: Synthetic oligonucleotide
gagaagacgggggtggtgtccacag

SEQ ID NO: 70265 - DNA, 25 bp, Artificial Sequence
  Description of Artificial Sequence: Synthetic oligonucleotide
agaagacgggggtggtgtccacagg

SEQ ID NO: 70266 - DNA, 24 bp, Artificial Sequence
  Description of Artificial Sequence: Synthetic oligonucleotide
gaagacgggggtggtgtccacagg

SEQ ID NO: 70267 - DNA, 24 bp, Artificial Sequence
  Description of Artificial Sequence: Synthetic oligonucleotide
aagacgggggtggtgtccacaggc

SEQ ID NO: 70268 - DNA, 23 bp, Artificial Sequence
  Description of Artificial Sequence: Synthetic oligonucleotide
agacgggggtggtgtccacaggc

SEQ ID NO: 70269 - DNA, 22 bp, Artificial Sequence
  Description of Artificial Sequence: Synthetic oligonucleotide
gacgggggtggtgtccacaggc

SEQ ID NO: 70270 - DNA, 23 bp, Artificial Sequence
  Description of Artificial Sequence: Synthetic oligonucleotide
acgggggtggtgtccacaggcct

SEQ ID NO: 70271 - DNA, 22 bp, Artificial Sequence
  Description of Artificial Sequence: Synthetic oligonucleotide
cgggggtggtgtccacaggcct

SEQ ID NO: 70272 - DNA, 24 bp, Artificial Sequence
  Description of Artificial Sequence: Synthetic oligonucleotide
gggggtggtgtccacaggcctgat

SEQ ID NO: 70273 - DNA, 36 bp, Artificial Sequence
  Description of Artificial Sequence: Synthetic oligonucleotide
ctggacagatacttctataaccaagaggaggacttg

SEQ ID NO: 70274 - DNA, 36 bp, Artificial Sequence
  Description of Artificial Sequence: Synthetic oligonucleotide
tggacagatacttctataaccaagaggaggacttgc

SEQ ID NO: 70275 - DNA, 35 bp, Artificial Sequence
  Description of Artificial Sequence: Synthetic oligonucleotide
ggacagatacttctataaccaagaggaggacttgc

SEQ ID NO: 70276 - DNA, 35 bp, Artificial Sequence
  Description of Artificial Sequence: Synthetic oligonucleotide
gacagatacttctataaccaagaggaggacttgcg

SEQ ID NO: 70277 - DNA, 35 bp, Artificial Sequence
  Description of Artificial Sequence: Synthetic oligonucleotide
acagatacttctataaccaagaggaggacttgcgc

SEQ ID NO: 70278 - DNA, 34 bp, Artificial Sequence
  Description of Artificial Sequence: Synthetic oligonucleotide
cagatacttctataaccaagaggaggacttgcgc

SEQ ID NO: 70279 - DNA, 36 bp, Artificial Sequence
  Description of Artificial Sequence: Synthetic oligonucleotide
agatacttctataaccaagaggaggacttgcgcttc

SEQ ID NO: 70280 - DNA, 35 bp, Artificial Sequence
  Description of Artificial Sequence: Synthetic oligonucleotide
gatacttctataaccaagaggaggacttgcgcttc

SEQ ID NO: 70281 - DNA, 35 bp, Artificial Sequence
  Description of Artificial Sequence: Synthetic oligonucleotide
atacttctataaccaagaggaggacttgcgcttcg

SEQ ID NO: 70282 - DNA, 34 bp, Artificial Sequence
  Description of Artificial Sequence: Synthetic oligonucleotide
tacttctataaccaagaggaggacttgcgcttcg

SEQ ID NO: 70283 - DNA, 33 bp, Artificial Sequence
  Description of Artificial Sequence: Synthetic oligonucleotide
acttctataaccaagaggaggacttgcgcttcg

SEQ ID NO: 70284 - DNA, 32 bp, Artificial Sequence
  Description of Artificial Sequence: Synthetic oligonucleotide
cttctataaccaagaggaggacttgcgcttcg

SEQ ID NO: 70285 - DNA, 33 bp, Artificial Sequence
  Description of Artificial Sequence: Synthetic oligonucleotide
ttctataaccaagaggaggacttgcgcttcgac

SEQ ID NO: 70286 - DNA, 32 bp, Artificial Sequence
  Description of Artificial Sequence: Synthetic oligonucleotide
tctataaccaagaggaggacttgcgcttcgac

SEQ ID NO: 70287 - DNA, 31 bp, Artificial Sequence
  Description of Artificial Sequence: Synthetic oligonucleotide
ctataaccaagaggaggacttgcgcttcgac

SEQ ID NO: 70288 - DNA, 32 bp, Artificial Sequence
  Description of Artificial Sequence: Synthetic oligonucleotide
tataaccaagaggaggacttgcgcttcgacag

SEQ ID NO: 70289 - DNA, 31 bp, Artificial Sequence
  Description of Artificial Sequence: Synthetic oligonucleotide
ataaccaagaggaggacttgcgcttcgacag

SEQ ID NO: 70290 - DNA, 30 bp, Artificial Sequence
  Description of Artificial Sequence: Synthetic oligonucleotide
taaccaagaggaggacttgcgcttcgacag

SEQ ID NO: 70291 - DNA, 29 bp, Artificial Sequence
  Description of Artificial Sequence: Synthetic oligonucleotide
aaccaagaggaggacttgcgcttcgacag

SEQ ID NO: 70292 - DNA, 28 bp, Artificial Sequence
  Description of Artificial Sequence: Synthetic oligonucleotide
accaagaggaggacttgcgcttcgacag

SEQ ID NO: 70293 - DNA, 27 bp, Artificial Sequence
  Description of Artificial Sequence: Synthetic oligonucleotide
ccaagaggaggacttgcgcttcgacag

SEQ ID NO: 70294 - DNA, 27 bp, Artificial Sequence
  Description of Artificial Sequence: Synthetic oligonucleotide
caagaggaggacttgcgcttcgacagc

SEQ ID NO: 70295 - DNA, 27 bp, Artificial Sequence
  Description of Artificial Sequence: Synthetic oligonucleotide
aagaggaggacttgcgcttcgacagcg

SEQ ID NO: 70296 - DNA, 27 bp, Artificial Sequence
  Description of Artificial Sequence: Synthetic oligonucleotide
agaggaggacttgcgcttcgacagcga

SEQ ID NO: 70297 - DNA, 26 bp, Artificial Sequence
  Description of Artificial Sequence: Synthetic oligonucleotide
gaggaggacttgcgcttcgacagcga

SEQ ID NO: 70298 - DNA, 26 bp, Artificial Sequence
  Description of Artificial Sequence: Synthetic oligonucleotide
aggaggacttgcgcttcgacagcgac

SEQ ID NO: 70299 - DNA, 25 bp, Artificial Sequence
  Description of Artificial Sequence: Synthetic oligonucleotide
ggaggacttgcgcttcgacagcgac

SEQ ID NO: 70300 - DNA, 26 bp, Artificial Sequence
  Description of Artificial Sequence: Synthetic oligonucleotide
gaggacttgcgcttcgacagcgacgt

SEQ ID NO: 70301 - DNA, 26 bp, Artificial Sequence
  Description of Artificial Sequence: Synthetic oligonucleotide
aggacttgcgcttcgacagcgacgtg

SEQ ID NO: 70302 - DNA, 25 bp, Artificial Sequence
  Description of Artificial Sequence: Synthetic oligonucleotide
ggacttgcgcttcgacagcgacgtg

SEQ ID NO: 70303 - DNA, 25 bp, Artificial Sequence
  Description of Artificial Sequence: Synthetic oligonucleotide
gacttgcgcttcgacagcgacgtgg

SEQ ID NO: 70304 - DNA, 25 bp, Artificial Sequence
  Description of Artificial Sequence: Synthetic oligonucleotide
acttgcgcttcgacagcgacgtggg

SEQ ID NO: 70305 - DNA, 24 bp, Artificial Sequence
  Description of Artificial Sequence: Synthetic oligonucleotide
cttgcgcttcgacagcgacgtggg

SEQ ID NO: 70306 - DNA, 24 bp, Artificial Sequence
  Description of Artificial Sequence: Synthetic oligonucleotide
ttgcgcttcgacagcgacgtgggg

SEQ ID NO: 70307 - DNA, 25 bp, Artificial Sequence
  Description of Artificial Sequence: Synthetic oligonucleotide
aggcgggccgaggtggacacctatt

SEQ ID NO: 70308 - DNA, 24 bp, Artificial Sequence
  Description of Artificial Sequence: Synthetic oligonucleotide
ggcgggccgaggtggacacctatt

SEQ ID NO: 70309 - DNA, 24 bp, Artificial Sequence
  Description of Artificial Sequence: Synthetic oligonucleotide
gcgggccgaggtggacacctattg

SEQ ID NO: 70310 - DNA, 25 bp, Artificial Sequence
  Description of Artificial Sequence: Synthetic oligonucleotide
cgggccgaggtggacacctattgca

SEQ ID NO: 70311 - DNA, 26 bp, Artificial Sequence
  Description of Artificial Sequence: Synthetic oligonucleotide
gggccgaggtggacacctattgcaga

SEQ ID NO: 70312 - DNA, 27 bp, Artificial Sequence
  Description of Artificial Sequence: Synthetic oligonucleotide
ggccgaggtggacacctattgcagaca

SEQ ID NO: 70313 - DNA, 27 bp, Artificial Sequence
  Description of Artificial Sequence: Synthetic oligonucleotide
gccgaggtggacacctattgcagacac

SEQ ID NO: 70314 - DNA, 29 bp, Artificial Sequence
  Description of Artificial Sequence: Synthetic oligonucleotide
ccgaggtggacacctattgcagacacaac

SEQ ID NO: 70315 - DNA, 31 bp, Artificial Sequence
  Description of Artificial Sequence: Synthetic oligonucleotide
cgaggtggacacctattgcagacacaactac

SEQ ID NO: 70316 - DNA, 31 bp, Artificial Sequence
  Description of Artificial Sequence: Synthetic oligonucleotide
gaggtggacacctattgcagacacaactacg

SEQ ID NO: 70317 - DNA, 31 bp, Artificial Sequence
  Description of Artificial Sequence: Synthetic oligonucleotide
aggtggacacctattgcagacacaactacgg

SEQ ID NO: 70318 - DNA, 42 bp, Artificial Sequence
  Description of Artificial Sequence: Synthetic oligonucleotide
gtttcttggagcaggttaaacatgagtgtcatttcttcaatg

SEQ ID NO: 70319 - DNA, 42 bp, Artificial Sequence
  Description of Artificial Sequence: Synthetic oligonucleotide
tttcttggagcaggttaaacatgagtgtcatttcttcaatgg

SEQ ID NO: 70320 - DNA, 41 bp, Artificial Sequence
  Description of Artificial Sequence: Synthetic oligonucleotide
ttcttggagcaggttaaacatgagtgtcatttcttcaatgg

SEQ ID NO: 70321 - DNA, 40 bp, Artificial Sequence
  Description of Artificial Sequence: Synthetic oligonucleotide
tcttggagcaggttaaacatgagtgtcatttcttcaatgg

SEQ ID NO: 70322 - DNA, 39 bp, Artificial Sequence
  Description of Artificial Sequence: Synthetic oligonucleotide
cttggagcaggttaaacatgagtgtcatttcttcaatgg

SEQ ID NO: 70323 - DNA, 39 bp, Artificial Sequence
  Description of Artificial Sequence: Synthetic oligonucleotide
ttggagcaggttaaacatgagtgtcatttcttcaatggg

SEQ ID NO: 70324 - DNA, 38 bp, Artificial Sequence
  Description of Artificial Sequence: Synthetic oligonucleotide
tggagcaggttaaacatgagtgtcatttcttcaatggg

SEQ ID NO: 70325 - DNA, 37 bp, Artificial Sequence
  Description of Artificial Sequence: Synthetic oligonucleotide
ggagcaggttaaacatgagtgtcatttcttcaatggg

SEQ ID NO: 70326 - DNA, 38 bp, Artificial Sequence
  Description of Artificial Sequence: Synthetic oligonucleotide
gagcaggttaaacatgagtgtcatttcttcaatgggac

SEQ ID NO: 70327 - DNA, 38 bp, Artificial Sequence
  Description of Artificial Sequence: Synthetic oligonucleotide
agcaggttaaacatgagtgtcatttcttcaatgggacg

SEQ ID NO: 70328 - DNA, 37 bp, Artificial Sequence
  Description of Artificial Sequence: Synthetic oligonucleotide
gcaggttaaacatgagtgtcatttcttcaatgggacg

SEQ ID NO: 70329 - DNA, 37 bp, Artificial Sequence
  Description of Artificial Sequence: Synthetic oligonucleotide
caggttaaacatgagtgtcatttcttcaatgggacgg

SEQ ID NO: 70330 - DNA, 38 bp, Artificial Sequence
  Description of Artificial Sequence: Synthetic oligonucleotide
aggttaaacatgagtgtcatttcttcaatgggacggag

SEQ ID NO: 70331 - DNA, 37 bp, Artificial Sequence
  Description of Artificial Sequence: Synthetic oligonucleotide
ggttaaacatgagtgtcatttcttcaatgggacggag

SEQ ID NO: 70332 - DNA, 37 bp, Artificial Sequence
  Description of Artificial Sequence: Synthetic oligonucleotide
gttaaacatgagtgtcatttcttcaatgggacggagc

SEQ ID NO: 70333 - DNA, 37 bp, Artificial Sequence
  Description of Artificial Sequence: Synthetic oligonucleotide
ttaaacatgagtgtcatttcttcaatgggacggagcg

SEQ ID NO: 70334 - DNA, 36 bp, Artificial Sequence
  Description of Artificial Sequence: Synthetic oligonucleotide
taaacatgagtgtcatttcttcaatgggacggagcg

SEQ ID NO: 70335 - DNA, 35 bp, Artificial Sequence
  Description of Artificial Sequence: Synthetic oligonucleotide
aaacatgagtgtcatttcttcaatgggacggagcg

SEQ ID NO: 70336 - DNA, 34 bp, Artificial Sequence
  Description of Artificial Sequence: Synthetic oligonucleotide
aacatgagtgtcatttcttcaatgggacggagcg

SEQ ID NO: 70337 - DNA, 33 bp, Artificial Sequence
  Description of Artificial Sequence: Synthetic oligonucleotide
acatgagtgtcatttcttcaatgggacggagcg

SEQ ID NO: 70338 - DNA, 32 bp, Artificial Sequence
  Description of Artificial Sequence: Synthetic oligonucleotide
catgagtgtcatttcttcaatgggacggagcg

SEQ ID NO: 70339 - DNA, 32 bp, Artificial Sequence
  Description of Artificial Sequence: Synthetic oligonucleotide
atgagtgtcatttcttcaatgggacggagcgg

SEQ ID NO: 70340 - DNA, 25 bp, Artificial Sequence
  Description of Artificial Sequence: Synthetic oligonucleotide
acaggcgggccgcggtggacaatta

SEQ ID NO: 70341 - DNA, 24 bp, Artificial Sequence
  Description of Artificial Sequence: Synthetic oligonucleotide
caggcgggccgcggtggacaatta

SEQ ID NO: 70342 - DNA, 22 bp, Artificial Sequence
  Description of Artificial Sequence: Synthetic oligonucleotide
acaggcgggccgcggtggacaa

SEQ ID NO: 70343 - DNA, 21 bp, Artificial Sequence
  Description of Artificial Sequence: Synthetic oligonucleotide
caggcgggccgcggtggacaa

SEQ ID NO: 70344 - DNA, 23 bp, Artificial Sequence
  Description of Artificial Sequence: Synthetic oligonucleotide
aggcgggccgcggtggacaacta

SEQ ID NO: 70345 - DNA, 22 bp, Artificial Sequence
  Description of Artificial Sequence: Synthetic oligonucleotide
ggcgggccgcggtggacaacta

SEQ ID NO: 70346 - DNA, 37 bp, Artificial Sequence
  Description of Artificial Sequence: Synthetic oligonucleotide
gttcctggacagatacttctataaccaagaggagaac

SEQ ID NO: 70347 - DNA, 37 bp, Artificial Sequence
  Description of Artificial Sequence: Synthetic oligonucleotide
ttcctggacagatacttctataaccaagaggagaacg

SEQ ID NO: 70348 - DNA, 36 bp, Artificial Sequence
  Description of Artificial Sequence: Synthetic oligonucleotide
tcctggacagatacttctataaccaagaggagaacg

SEQ ID NO: 70349 - DNA, 36 bp, Artificial Sequence
  Description of Artificial Sequence: Synthetic oligonucleotide
ttcctggacagatacttctataaccaggaggagaac

SEQ ID NO: 70350 - DNA, 35 bp, Artificial Sequence
  Description of Artificial Sequence: Synthetic oligonucleotide
tcctggacagatacttctataaccaggaggagaac

SEQ ID NO: 70351 - DNA, 34 bp, Artificial Sequence
  Description of Artificial Sequence: Synthetic oligonucleotide
cctggacagatacttctataaccaggaggagaac

SEQ ID NO: 70352 - DNA, 34 bp, Artificial Sequence
  Description of Artificial Sequence: Synthetic oligonucleotide
ctggacagatacttctataaccaggaggagaacg

SEQ ID NO: 70353 - DNA, 35 bp, Artificial Sequence
  Description of Artificial Sequence: Synthetic oligonucleotide
tggacagatacttctataaccaggaggagaacgtg

SEQ ID NO: 70354 - DNA, 34 bp, Artificial Sequence
  Description of Artificial Sequence: Synthetic oligonucleotide
ggacagatacttctataaccaggaggagaacgtg

SEQ ID NO: 70355 - DNA, 34 bp, Artificial Sequence
  Description of Artificial Sequence: Synthetic oligonucleotide
gacagatacttctataaccaggaggagaacgtgc

SEQ ID NO: 70356 - DNA, 34 bp, Artificial Sequence
  Description of Artificial Sequence: Synthetic oligonucleotide
acagatacttctataaccaggaggagaacgtgcg

SEQ ID NO: 70357 - DNA, 33 bp, Artificial Sequence
  Description of Artificial Sequence: Synthetic oligonucleotide
cagatacttctataaccaggaggagaacgtgcg

SEQ ID NO: 70358 - DNA, 33 bp, Artificial Sequence
  Description of Artificial Sequence: Synthetic oligonucleotide
agatacttctataaccaggaggagaacgtgcgc

SEQ ID NO: 70359 - DNA, 32 bp, Artificial Sequence
  Description of Artificial Sequence: Synthetic oligonucleotide
gatacttctataaccaggaggagaacgtgcgc

SEQ ID NO: 70360 - DNA, 34 bp, Artificial Sequence
  Description of Artificial Sequence: Synthetic oligonucleotide
atacttctataaccaggaggagaacgtgcgcttc

SEQ ID NO: 70361 - DNA, 33 bp, Artificial Sequence
  Description of Artificial Sequence: Synthetic oligonucleotide
tacttctataaccaggaggagaacgtgcgcttc

SEQ ID NO: 70362 - DNA, 32 bp, Artificial Sequence
  Description of Artificial Sequence: Synthetic oligonucleotide
acttctataaccaggaggagaacgtgcgcttc

SEQ ID NO: 70363 - DNA, 31 bp, Artificial Sequence
  Description of Artificial Sequence: Synthetic oligonucleotide
cttctataaccaggaggagaacgtgcgcttc

SEQ ID NO: 70364 - DNA, 31 bp, Artificial Sequence
  Description of Artificial Sequence: Synthetic oligonucleotide
ttctataaccaggaggagaacgtgcgcttcg

SEQ ID NO: 70365 - DNA, 36 bp, Artificial Sequence
  Description of Artificial Sequence: Synthetic oligonucleotide
gttcctggacagatacttctataaccaagaggagtc

SEQ ID NO: 70366 - DNA, 36 bp, Artificial Sequence
  Description of Artificial Sequence: Synthetic oligonucleotide
ttcctggacagatacttctataaccaagaggagtcc

SEQ ID NO: 70367 - DNA, 35 bp, Artificial Sequence
  Description of Artificial Sequence: Synthetic oligonucleotide
tcctggacagatacttctataaccaagaggagtcc

SEQ ID NO: 70368 - DNA, 34 bp, Artificial Sequence
  Description of Artificial Sequence: Synthetic oligonucleotide
cctggacagatacttctataaccaagaggagtcc

SEQ ID NO: 70369 - DNA, 34 bp, Artificial Sequence
  Description of Artificial Sequence: Synthetic oligonucleotide
ctggacagatacttctataaccaagaggagtccg

SEQ ID NO: 70370 - DNA, 35 bp, Artificial Sequence
  Description of Artificial Sequence: Synthetic oligonucleotide
tggacagatacttctataaccaagaggagtccgtg

SEQ ID NO: 70371 - DNA, 34 bp, Artificial Sequence
  Description of Artificial Sequence: Synthetic oligonucleotide
ggacagatacttctataaccaagaggagtccgtg

SEQ ID NO: 70372 - DNA, 34 bp, Artificial Sequence
  Description of Artificial Sequence: Synthetic oligonucleotide
gacagatacttctataaccaagaggagtccgtgc

SEQ ID NO: 70373 - DNA, 34 bp, Artificial Sequence
  Description of Artificial Sequence: Synthetic oligonucleotide
acagatacttctataaccaagaggagtccgtgcg

SEQ ID NO: 70374 - DNA, 33 bp, Artificial Sequence
  Description of Artificial Sequence: Synthetic oligonucleotide
cagatacttctataaccaagaggagtccgtgcg

SEQ ID NO: 70375 - DNA, 33 bp, Artificial Sequence
  Description of Artificial Sequence: Synthetic oligonucleotide
agatacttctataaccaagaggagtccgtgcgc

SEQ ID NO: 70376 - DNA, 32 bp, Artificial Sequence
  Description of Artificial Sequence: Synthetic oligonucleotide
gatacttctataaccaagaggagtccgtgcgc

SEQ ID NO: 70377 - DNA, 34 bp, Artificial Sequence
  Description of Artificial Sequence: Synthetic oligonucleotide
atacttctataaccaagaggagtccgtgcgcttc

SEQ ID NO: 70378 - DNA, 33 bp, Artificial Sequence
  Description of Artificial Sequence: Synthetic oligonucleotide
tacttctataaccaagaggagtccgtgcgcttc

SEQ ID NO: 70379 - DNA, 32 bp, Artificial Sequence
  Description of Artificial Sequence: Synthetic oligonucleotide
acttctataaccaagaggagtccgtgcgcttc

SEQ ID NO: 70380 - DNA, 33 bp, Artificial Sequence
  Description of Artificial Sequence: Synthetic oligonucleotide
cacgtttcttggagctgcttaagtctgagtgtc

SEQ ID NO: 70381 - DNA, 37 bp, Artificial Sequence
  Description of Artificial Sequence: Synthetic oligonucleotide
acgtttcttggagctgcttaagtctgagtgtcatttc

SEQ ID NO: 70382 - DNA, 36 bp, Artificial Sequence
  Description of Artificial Sequence: Synthetic oligonucleotide
cgtttcttggagctgcttaagtctgagtgtcatttc

SEQ ID NO: 70383 - DNA, 38 bp, Artificial Sequence
  Description of Artificial Sequence: Synthetic oligonucleotide
gtttcttggagctgcttaagtctgagtgtcatttcttc

SEQ ID NO: 70384 - DNA, 41 bp, Artificial Sequence
  Description of Artificial Sequence: Synthetic oligonucleotide
tttcttggagctgcttaagtctgagtgtcatttcttcaatg

SEQ ID NO: 70385 - DNA, 40 bp, Artificial Sequence
  Description of Artificial Sequence: Synthetic oligonucleotide
ttcttggagctgcttaagtctgagtgtcatttcttcaatg

SEQ ID NO: 70386 - DNA, 39 bp, Artificial Sequence
  Description of Artificial Sequence: Synthetic oligonucleotide
tcttggagctgcttaagtctgagtgtcatttcttcaatg

SEQ ID NO: 70387 - DNA, 38 bp, Artificial Sequence
  Description of Artificial Sequence: Synthetic oligonucleotide
cttggagctgcttaagtctgagtgtcatttcttcaatg

SEQ ID NO: 70388 - DNA, 38 bp, Artificial Sequence
  Description of Artificial Sequence: Synthetic oligonucleotide
ttggagctgcttaagtctgagtgtcatttcttcaatgg

SEQ ID NO: 70389 - DNA, 37 bp, Artificial Sequence
  Description of Artificial Sequence: Synthetic oligonucleotide
tggagctgcttaagtctgagtgtcatttcttcaatgg

SEQ ID NO: 70390 - DNA, 36 bp, Artificial Sequence
  Description of Artificial Sequence: Synthetic oligonucleotide
ggagctgcttaagtctgagtgtcatttcttcaatgg

SEQ ID NO: 70391 - DNA, 36 bp, Artificial Sequence
  Description of Artificial Sequence: Synthetic oligonucleotide
gagctgcttaagtctgagtgtcatttcttcaatggg

SEQ ID NO: 70392 - DNA, 37 bp, Artificial Sequence
  Description of Artificial Sequence: Synthetic oligonucleotide
agctgcttaagtctgagtgtcatttcttcaatgggac

SEQ ID NO: 70393 - DNA, 36 bp, Artificial Sequence
  Description of Artificial Sequence: Synthetic oligonucleotide
gctgcttaagtctgagtgtcatttcttcaatgggac

SEQ ID NO: 70394 - DNA, 36 bp, Artificial Sequence
  Description of Artificial Sequence: Synthetic oligonucleotide
ctgcttaagtctgagtgtcatttcttcaatgggacg

SEQ ID NO: 70395 - DNA, 36 bp, Artificial Sequence
  Description of Artificial Sequence: Synthetic oligonucleotide
tgcttaagtctgagtgtcatttcttcaatgggacgg

SEQ ID NO: 70396 - DNA, 35 bp, Artificial Sequence
  Description of Artificial Sequence: Synthetic oligonucleotide
gcttaagtctgagtgtcatttcttcaatgggacgg

SEQ ID NO: 70397 - DNA, 36 bp, Artificial Sequence
  Description of Artificial Sequence: Synthetic oligonucleotide
cttaagtctgagtgtcatttcttcaatgggacggag

SEQ ID NO: 70398 - DNA, 36 bp, Artificial Sequence
  Description of Artificial Sequence: Synthetic oligonucleotide
ttaagtctgagtgtcatttcttcaatgggacggagc

SEQ ID NO: 70399 - DNA, 23 bp, Artificial Sequence
  Description of Artificial Sequence: Synthetic oligonucleotide
agctggggcggcctgatgaggag

SEQ ID NO: 70400 - DNA, 22 bp, Artificial Sequence
  Description of Artificial Sequence: Synthetic oligonucleotide
gctggggcggcctgatgaggag

SEQ ID NO: 70401 - DNA, 23 bp, Artificial Sequence
  Description of Artificial Sequence: Synthetic oligonucleotide
ctggggcggcctgatgaggagca

SEQ ID NO: 70402 - DNA, 24 bp, Artificial Sequence
  Description of Artificial Sequence: Synthetic oligonucleotide
tggggcggcctgatgaggagcact

SEQ ID NO: 70403 - DNA, 23 bp, Artificial Sequence
  Description of Artificial Sequence: Synthetic oligonucleotide
ggggcggcctgatgaggagcact

SEQ ID NO: 70404 - DNA, 23 bp, Artificial Sequence
  Description of Artificial Sequence: Synthetic oligonucleotide
gggcggcctgatgaggagcactg

SEQ ID NO: 70405 - DNA, 25 bp, Artificial Sequence
  Description of Artificial Sequence: Synthetic oligonucleotide
ggcggcctgatgaggagcactggaa

SEQ ID NO: 70406 - DNA, 26 bp, Artificial Sequence
  Description of Artificial Sequence: Synthetic oligonucleotide
gcggcctgatgaggagcactggaaca

SEQ ID NO: 70407 - DNA, 26 bp, Artificial Sequence
  Description of Artificial Sequence: Synthetic oligonucleotide
cggcctgatgaggagcactggaacag

SEQ ID NO: 70408 - DNA, 26 bp, Artificial Sequence
  Description of Artificial Sequence: Synthetic oligonucleotide
ggcctgatgaggagcactggaacagc

SEQ ID NO: 70409 - DNA, 27 bp, Artificial Sequence
  Description of Artificial Sequence: Synthetic oligonucleotide
gcctgatgaggagcactggaacagcca

SEQ ID NO: 70410 - DNA, 27 bp, Artificial Sequence
  Description of Artificial Sequence: Synthetic oligonucleotide
cctgatgaggagcactggaacagccag

SEQ ID NO: 70411 - DNA, 29 bp, Artificial Sequence
  Description of Artificial Sequence: Synthetic oligonucleotide
ctgatgaggagcactggaacagccagaag

SEQ ID NO: 70412 - DNA, 29 bp, Artificial Sequence
  Description of Artificial Sequence: Synthetic oligonucleotide
tgatgaggagcactggaacagccagaagg

SEQ ID NO: 70413 - DNA, 28 bp, Artificial Sequence
  Description of Artificial Sequence: Synthetic oligonucleotide
gatgaggagcactggaacagccagaagg

SEQ ID NO: 70414 - DNA, 29 bp, Artificial Sequence
  Description of Artificial Sequence: Synthetic oligonucleotide
atgaggagcactggaacagccagaaggac

SEQ ID NO: 70415 - DNA, 28 bp, Artificial Sequence
  Description of Artificial Sequence: Synthetic oligonucleotide
tgaggagcactggaacagccagaaggac

SEQ ID NO: 70416 - DNA, 27 bp, Artificial Sequence
  Description of Artificial Sequence: Synthetic oligonucleotide
gaggagcactggaacagccagaaggac

SEQ ID NO: 70417 - DNA, 29 bp, Artificial Sequence
  Description of Artificial Sequence: Synthetic oligonucleotide
aggagcactggaacagccagaaggacatc

SEQ ID NO: 70418 - DNA, 25 bp, Artificial Sequence
  Description of Artificial Sequence: Synthetic oligonucleotide
acttcctggaagacaggcgggccgt

SEQ ID NO: 70419 - DNA, 24 bp, Artificial Sequence
  Description of Artificial Sequence: Synthetic oligonucleotide
cttcctggaagacaggcgggccgt

SEQ ID NO: 70420 - DNA, 24 bp, Artificial Sequence
  Description of Artificial Sequence: Synthetic oligonucleotide
ttcctggaagacaggcgggccgtg

SEQ ID NO: 70421 - DNA, 23 bp, Artificial Sequence
  Description of Artificial Sequence: Synthetic oligonucleotide
tcctggaagacaggcgggccgtg

SEQ ID NO: 70422 - DNA, 22 bp, Artificial Sequence
  Description of Artificial Sequence: Synthetic oligonucleotide
cctggaagacaggcgggccgtg

SEQ ID NO: 70423 - DNA, 23 bp, Artificial Sequence
  Description of Artificial Sequence: Synthetic oligonucleotide
ctggaagacaggcgggccgtggt

SEQ ID NO: 70424 - DNA, 23 bp, Artificial Sequence
  Description of Artificial Sequence: Synthetic oligonucleotide
tggaagacaggcgggccgtggtg

SEQ ID NO: 70425 - DNA, 22 bp, Artificial Sequence
  Description of Artificial Sequence: Synthetic oligonucleotide
ggaagacaggcgggccgtggtg

SEQ ID NO: 70426 - DNA, 23 bp, Artificial Sequence
  Description of Artificial Sequence: Synthetic oligonucleotide
gaagacaggcgggccgtggtgga

SEQ ID NO: 70427 - DNA, 24 bp, Artificial Sequence
  Description of Artificial Sequence: Synthetic oligonucleotide
aagacaggcgggccgtggtggaca

SEQ ID NO: 70428 - DNA, 23 bp, Artificial Sequence
  Description of Artificial Sequence: Synthetic oligonucleotide
agacaggcgggccgtggtggaca

SEQ ID NO: 70429 - DNA, 22 bp, Artificial Sequence
  Description of Artificial Sequence: Synthetic oligonucleotide
gacaggcgggccgtggtggaca

SEQ ID NO: 70430 - DNA, 22 bp, Artificial Sequence
  Description of Artificial Sequence: Synthetic oligonucleotide
acaggcgggccgtggtggacac

SEQ ID NO: 70431 - DNA, 21 bp, Artificial Sequence
  Description of Artificial Sequence: Synthetic oligonucleotide
caggcgggccgtggtggacac

SEQ ID NO: 70432 - DNA, 23 bp, Artificial Sequence
  Description of Artificial Sequence: Synthetic oligonucleotide
aggcgggccgtggtggacaccta

SEQ ID NO: 70433 - DNA, 22 bp, Artificial Sequence
  Description of Artificial Sequence: Synthetic oligonucleotide
ggcgggccgtggtggacaccta

SEQ ID NO: 70434 - DNA, 23 bp, Artificial Sequence
  Description of Artificial Sequence: Synthetic oligonucleotide
gcgggccgtggtggacacctact

SEQ ID NO: 70435 - DNA, 23 bp, Artificial Sequence
  Description of Artificial Sequence: Synthetic oligonucleotide
cgggccgtggtggacacctactg

SEQ ID NO: 70436 - DNA, 24 bp, Artificial Sequence
  Description of Artificial Sequence: Synthetic oligonucleotide
gggccgtggtggacacctactgca

SEQ ID NO: 70437 - DNA, 25 bp, Artificial Sequence
  Description of Artificial Sequence: Synthetic oligonucleotide
ggccgtggtggacacctactgcaga

SEQ ID NO: 70438 - DNA, 26 bp, Artificial Sequence
  Description of Artificial Sequence: Synthetic oligonucleotide
gccgtggtggacacctactgcagaca

SEQ ID NO: 70439 - DNA, 27 bp, Artificial Sequence
  Description of Artificial Sequence: Synthetic oligonucleotide
ccgtggtggacacctactgcagacaca

SEQ ID NO: 70440 - DNA, 28 bp, Artificial Sequence
  Description of Artificial Sequence: Synthetic oligonucleotide
cgtggtggacacctactgcagacacaac

SEQ ID NO: 70441 - DNA, 30 bp, Artificial Sequence
  Description of Artificial Sequence: Synthetic oligonucleotide
gtggtggacacctactgcagacacaactac

SEQ ID NO: 70442 - DNA, 32 bp, Artificial Sequence
  Description of Artificial Sequence: Synthetic oligonucleotide
atgaggactactggaacagccagaaggacttc

SEQ ID NO: 70443 - DNA, 31 bp, Artificial Sequence
  Description of Artificial Sequence: Synthetic oligonucleotide
tgaggactactggaacagccagaaggacttc

SEQ ID NO: 70444 - DNA, 30 bp, Artificial Sequence
  Description of Artificial Sequence: Synthetic oligonucleotide
gaggactactggaacagccagaaggacttc

SEQ ID NO: 70445 - DNA, 30 bp, Artificial Sequence
  Description of Artificial Sequence: Synthetic oligonucleotide
aggactactggaacagccagaaggacttcc

SEQ ID NO: 70446 - DNA, 29 bp, Artificial Sequence
  Description of Artificial Sequence: Synthetic oligonucleotide
ggactactggaacagccagaaggacttcc

SEQ ID NO: 70447 - DNA, 30 bp, Artificial Sequence
  Description of Artificial Sequence: Synthetic oligonucleotide
gactactggaacagccagaaggacttcctg

SEQ ID NO: 70448 - DNA, 30 bp, Artificial Sequence
  Description of Artificial Sequence: Synthetic oligonucleotide
actactggaacagccagaaggacttcctgg

SEQ ID NO: 70449 - DNA, 29 bp, Artificial Sequence
  Description of Artificial Sequence: Synthetic oligonucleotide
ctactggaacagccagaaggacttcctgg

SEQ ID NO: 70450 - DNA, 22 bp, Artificial Sequence
  Description of Artificial Sequence: Synthetic oligonucleotide
gagctggggcggcctgatgagg

SEQ ID NO: 70451 - DNA, 22 bp, Artificial Sequence
  Description of Artificial Sequence: Synthetic oligonucleotide
agctggggcggcctgatgaggg

SEQ ID NO: 70452 - DNA, 21 bp, Artificial Sequence
  Description of Artificial Sequence: Synthetic oligonucleotide
gctggggcggcctgatgaggg

SEQ ID NO: 70453 - DNA, 23 bp, Artificial Sequence
  Description of Artificial Sequence: Synthetic oligonucleotide
ctggggcggcctgatgaggggta

SEQ ID NO: 70454 - DNA, 24 bp, Artificial Sequence
  Description of Artificial Sequence: Synthetic oligonucleotide
tggggcggcctgatgaggggtact

SEQ ID NO: 70455 - DNA, 23 bp, Artificial Sequence
  Description of Artificial Sequence: Synthetic oligonucleotide
ggggcggcctgatgaggggtact

SEQ ID NO: 70456 - DNA, 23 bp, Artificial Sequence
  Description of Artificial Sequence: Synthetic oligonucleotide
gggcggcctgatgaggggtactg

SEQ ID NO: 70457 - DNA, 25 bp, Artificial Sequence
  Description of Artificial Sequence: Synthetic oligonucleotide
ggcggcctgatgaggggtactggaa

SEQ ID NO: 70458 - DNA, 26 bp, Artificial Sequence
  Description of Artificial Sequence: Synthetic oligonucleotide
gcggcctgatgaggggtactggaaca

SEQ ID NO: 70459 - DNA, 26 bp, Artificial Sequence
  Description of Artificial Sequence: Synthetic oligonucleotide
cggcctgatgaggggtactggaacag

SEQ ID NO: 70460 - DNA, 26 bp, Artificial Sequence
  Description of Artificial Sequence: Synthetic oligonucleotide
ggcctgatgaggggtactggaacagc

SEQ ID NO: 70461 - DNA, 27 bp, Artificial Sequence
  Description of Artificial Sequence: Synthetic oligonucleotide
gcctgatgaggggtactggaacagcca

SEQ ID NO: 70462 - DNA, 27 bp, Artificial Sequence
  Description of Artificial Sequence: Synthetic oligonucleotide
cctgatgaggggtactggaacagccag

SEQ ID NO: 70463 - DNA, 29 bp, Artificial Sequence
  Description of Artificial Sequence: Synthetic oligonucleotide
ctgatgaggggtactggaacagccagaag

SEQ ID NO: 70464 - DNA, 29 bp, Artificial Sequence
  Description of Artificial Sequence: Synthetic oligonucleotide
tgatgaggggtactggaacagccagaagg

SEQ ID NO: 70465 - DNA, 28 bp, Artificial Sequence
  Description of Artificial Sequence: Synthetic oligonucleotide
gatgaggggtactggaacagccagaagg

SEQ ID NO: 70466 - DNA, 29 bp, Artificial Sequence
  Description of Artificial Sequence: Synthetic oligonucleotide
atgaggggtactggaacagccagaaggac

SEQ ID NO: 70467 - DNA, 28 bp, Artificial Sequence
  Description of Artificial Sequence: Synthetic oligonucleotide
tgaggggtactggaacagccagaaggac

SEQ ID NO: 70468 - DNA, 27 bp, Artificial Sequence
  Description of Artificial Sequence: Synthetic oligonucleotide
gaggggtactggaacagccagaaggac

SEQ ID NO: 70469 - DNA, 29 bp, Artificial Sequence
  Description of Artificial Sequence: Synthetic oligonucleotide
aggggtactggaacagccagaaggacttc

SEQ ID NO: 70470 - DNA, 28 bp, Artificial Sequence
  Description of Artificial Sequence: Synthetic oligonucleotide
ggggtactggaacagccagaaggacttc

SEQ ID NO: 70471 - DNA, 28 bp, Artificial Sequence
  Description of Artificial Sequence: Synthetic oligonucleotide
gggtactggaacagccagaaggacttcc

SEQ ID NO: 70472 - DNA, 29 bp, Artificial Sequence
  Description of Artificial Sequence: Synthetic oligonucleotide
ggtactggaacagccagaaggacttcctg

SEQ ID NO: 70473 - DNA, 23 bp, Artificial Sequence
  Description of Artificial Sequence: Synthetic oligonucleotide
agggagctggggcggcctgatga

SEQ ID NO: 70474 - DNA, 22 bp, Artificial Sequence
  Description of Artificial Sequence: Synthetic oligonucleotide
gggagctggggcggcctgatga

SEQ ID NO: 70475 - DNA, 35 bp, Artificial Sequence
  Description of Artificial Sequence: Synthetic oligonucleotide
ctggacagatacttctataaccaagaggagtacgc

SEQ ID NO: 70476 - DNA, 35 bp, Artificial Sequence
  Description of Artificial Sequence: Synthetic oligonucleotide
tggacagatacttctataaccaagaggagtacgcg

SEQ ID NO: 70477 - DNA, 34 bp, Artificial Sequence
  Description of Artificial Sequence: Synthetic oligonucleotide
ggacagatacttctataaccaagaggagtacgcg

SEQ ID NO: 70478 - DNA, 34 bp, Artificial Sequence
  Description of Artificial Sequence: Synthetic oligonucleotide
gacagatacttctataaccaagaggagtacgcgc

SEQ ID NO: 70479 - DNA, 34 bp, Artificial Sequence
  Description of Artificial Sequence: Synthetic oligonucleotide
acagatacttctataaccaagaggagtacgcgcg

SEQ ID NO: 70480 - DNA, 33 bp, Artificial Sequence
  Description of Artificial Sequence: Synthetic oligonucleotide
cagatacttctataaccaagaggagtacgcgcg

SEQ ID NO: 70481 - DNA, 33 bp, Artificial Sequence
  Description of Artificial Sequence: Synthetic oligonucleotide
agatacttctataaccaagaggagtacgcgcgc

SEQ ID NO: 70482 - DNA, 32 bp, Artificial Sequence
  Description of Artificial Sequence: Synthetic oligonucleotide
gatacttctataaccaagaggagtacgcgcgc

SEQ ID NO: 70483 - DNA, 34 bp, Artificial Sequence
  Description of Artificial Sequence: Synthetic oligonucleotide
atacttctataaccaagaggagtacgcgcgcttc

SEQ ID NO: 70484 - DNA, 33 bp, Artificial Sequence
  Description of Artificial Sequence: Synthetic oligonucleotide
tacttctataaccaagaggagtacgcgcgcttc

SEQ ID NO: 70485 - DNA, 32 bp, Artificial Sequence
  Description of Artificial Sequence: Synthetic oligonucleotide
acttctataaccaagaggagtacgcgcgcttc

SEQ ID NO: 70486 - DNA, 31 bp, Artificial Sequence
  Description of Artificial Sequence: Synthetic oligonucleotide
cttctataaccaagaggagtacgcgcgcttc

SEQ ID NO: 70487 - DNA, 31 bp, Artificial Sequence
  Description of Artificial Sequence: Synthetic oligonucleotide
ttctataaccaagaggagtacgcgcgcttcg

SEQ ID NO: 70488 - DNA, 30 bp, Artificial Sequence
  Description of Artificial Sequence: Synthetic oligonucleotide
tctataaccaagaggagtacgcgcgcttcg

SEQ ID NO: 70489 - DNA, 29 bp, Artificial Sequence
  Description of Artificial Sequence: Synthetic oligonucleotide
ctataaccaagaggagtacgcgcgcttcg

SEQ ID NO: 70490 - DNA, 30 bp, Artificial Sequence
  Description of Artificial Sequence: Synthetic oligonucleotide
tataaccaagaggagtacgcgcgcttcgac

SEQ ID NO: 70491 - DNA, 28 bp, Artificial Sequence
  Description of Artificial Sequence: Synthetic oligonucleotide
ccagaaggacttcctggaagacaggcag

SEQ ID NO: 70492 - DNA, 28 bp, Artificial Sequence
  Description of Artificial Sequence: Synthetic oligonucleotide
cagaaggacttcctggaagacaggcagg

SEQ ID NO: 70493 - DNA, 28 bp, Artificial Sequence
  Description of Artificial Sequence: Synthetic oligonucleotide
agaaggacttcctggaagacaggcaggc

SEQ ID NO: 70494 - DNA, 27 bp, Artificial Sequence
  Description of Artificial Sequence: Synthetic oligonucleotide
gaaggacttcctggaagacaggcaggc

SEQ ID NO: 70495 - DNA, 27 bp, Artificial Sequence
  Description of Artificial Sequence: Synthetic oligonucleotide
aaggacttcctggaagacaggcaggcc

SEQ ID NO: 70496 - DNA, 26 bp, Artificial Sequence
  Description of Artificial Sequence: Synthetic oligonucleotide
aggacttcctggaagacaggcaggcc

SEQ ID NO: 70497 - DNA, 25 bp, Artificial Sequence
  Description of Artificial Sequence: Synthetic oligonucleotide
ggacttcctggaagacaggcaggcc

SEQ ID NO: 70498 - DNA, 25 bp, Artificial Sequence
  Description of Artificial Sequence: Synthetic oligonucleotide
gacttcctggaagacaggcaggccg

SEQ ID NO: 70499 - DNA, 25 bp, Artificial Sequence
  Description of Artificial Sequence: Synthetic oligonucleotide
acttcctggaagacaggcaggccgc

SEQ ID NO: 70500 - DNA, 24 bp, Artificial Sequence
  Description of Artificial Sequence: Synthetic oligonucleotide
cttcctggaagacaggcaggccgc

SEQ ID NO: 70501 - DNA, 24 bp, Artificial Sequence
  Description of Artificial Sequence: Synthetic oligonucleotide
ttcctggaagacaggcaggccgcg

SEQ ID NO: 70502 - DNA, 23 bp, Artificial Sequence
  Description of Artificial Sequence: Synthetic oligonucleotide
tcctggaagacaggcaggccgcg

SEQ ID NO: 70503 - DNA, 22 bp, Artificial Sequence
  Description of Artificial Sequence: Synthetic oligonucleotide
cctggaagacaggcaggccgcg

SEQ ID NO: 70504 - DNA, 23 bp, Artificial Sequence
  Description of Artificial Sequence: Synthetic oligonucleotide
ctggaagacaggcaggccgcggt

SEQ ID NO: 70505 - DNA, 23 bp, Artificial Sequence
  Description of Artificial Sequence: Synthetic oligonucleotide
tggaagacaggcaggccgcggtg

SEQ ID NO: 70506 - DNA, 22 bp, Artificial Sequence
  Description of Artificial Sequence: Synthetic oligonucleotide
ggaagacaggcaggccgcggtg

SEQ ID NO: 70507 - DNA, 23 bp, Artificial Sequence
  Description of Artificial Sequence: Synthetic oligonucleotide
gaagacaggcaggccgcggtgga

SEQ ID NO: 70508 - DNA, 24 bp, Artificial Sequence
  Description of Artificial Sequence: Synthetic oligonucleotide
aagacaggcaggccgcggtggaca

SEQ ID NO: 70509 - DNA, 23 bp, Artificial Sequence
  Description of Artificial Sequence: Synthetic oligonucleotide
agacaggcaggccgcggtggaca

SEQ ID NO: 70510 - DNA, 22 bp, Artificial Sequence
  Description of Artificial Sequence: Synthetic oligonucleotide
gacaggcaggccgcggtggaca

SEQ ID NO: 70511 - DNA, 22 bp, Artificial Sequence
  Description of Artificial Sequence: Synthetic oligonucleotide
acaggcaggccgcggtggacac

SEQ ID NO: 70512 - DNA, 21 bp, Artificial Sequence
  Description of Artificial Sequence: Synthetic oligonucleotide
caggcaggccgcggtggacac

SEQ ID NO: 70513 - DNA, 27 bp, Artificial Sequence
  Description of Artificial Sequence: Synthetic oligonucleotide
aggagcactggaacagccagaaggacc

SEQ ID NO: 70514 - DNA, 30 bp, Artificial Sequence
  Description of Artificial Sequence: Synthetic oligonucleotide
aacagccagaaggacttcctggagcagaag

SEQ ID NO: 70515 - DNA, 29 bp, Artificial Sequence
  Description of Artificial Sequence: Synthetic oligonucleotide
acagccagaaggacttcctggagcagaag

SEQ ID NO: 70516 - DNA, 28 bp, Artificial Sequence
  Description of Artificial Sequence: Synthetic oligonucleotide
cagccagaaggacttcctggagcagaag

SEQ ID NO: 70517 - DNA, 28 bp, Artificial Sequence
  Description of Artificial Sequence: Synthetic oligonucleotide
agccagaaggacttcctggagcagaagc

SEQ ID NO: 70518 - DNA, 27 bp, Artificial Sequence
  Description of Artificial Sequence: Synthetic oligonucleotide
gccagaaggacttcctggagcagaagc

SEQ ID NO: 70519 - DNA, 27 bp, Artificial Sequence
  Description of Artificial Sequence: Synthetic oligonucleotide
ccagaaggacttcctggagcagaagcg

SEQ ID NO: 70520 - DNA, 27 bp, Artificial Sequence
  Description of Artificial Sequence: Synthetic oligonucleotide
cagaaggacttcctggagcagaagcgg

SEQ ID NO: 70521 - DNA, 27 bp, Artificial Sequence
  Description of Artificial Sequence: Synthetic oligonucleotide
agaaggacttcctggagcagaagcggg

SEQ ID NO: 70522 - DNA, 26 bp, Artificial Sequence
  Description of Artificial Sequence: Synthetic oligonucleotide
gaaggacttcctggagcagaagcggg

SEQ ID NO: 70523 - DNA, 26 bp, Artificial Sequence
  Description of Artificial Sequence: Synthetic oligonucleotide
aaggacttcctggagcagaagcgggg

SEQ ID NO: 70524 - DNA, 25 bp, Artificial Sequence
  Description of Artificial Sequence: Synthetic oligonucleotide
aggacttcctggagcagaagcgggg

SEQ ID NO: 70525 - DNA, 24 bp, Artificial Sequence
  Description of Artificial Sequence: Synthetic oligonucleotide
ggacttcctggagcagaagcgggg

SEQ ID NO: 70526 - DNA, 24 bp, Artificial Sequence
  Description of Artificial Sequence: Synthetic oligonucleotide
gacttcctggagcagaagcggggc

SEQ ID NO: 70527 - DNA, 25 bp, Artificial Sequence
  Description of Artificial Sequence: Synthetic oligonucleotide
acttcctggagcagaagcggggcca

SEQ ID NO: 70528 - DNA, 24 bp, Artificial Sequence
  Description of Artificial Sequence: Synthetic oligonucleotide
cttcctggagcagaagcggggcca

SEQ ID NO: 70529 - DNA, 24 bp, Artificial Sequence
  Description of Artificial Sequence: Synthetic oligonucleotide
ttcctggagcagaagcggggccag

SEQ ID NO: 70530 - DNA, 24 bp, Artificial Sequence
  Description of Artificial Sequence: Synthetic oligonucleotide
agcagaagcggggccaggtggaca

SEQ ID NO: 70531 - DNA, 23 bp, Artificial Sequence
  Description of Artificial Sequence: Synthetic oligonucleotide
gcagaagcggggccaggtggaca

SEQ ID NO: 70532 - DNA, 23 bp, Artificial Sequence
  Description of Artificial Sequence: Synthetic oligonucleotide
cagaagcggggccaggtggacac

SEQ ID NO: 70533 - DNA, 25 bp, Artificial Sequence
  Description of Artificial Sequence: Synthetic oligonucleotide
agaagcggggccaggtggacaccta

SEQ ID NO: 70534 - DNA, 24 bp, Artificial Sequence
  Description of Artificial Sequence: Synthetic oligonucleotide
gaagcggggccaggtggacaccta

SEQ ID NO: 70535 - DNA, 25 bp, Artificial Sequence
  Description of Artificial Sequence: Synthetic oligonucleotide
aagcggggccaggtggacacctact

SEQ ID NO: 70536 - DNA, 24 bp, Artificial Sequence
  Description of Artificial Sequence: Synthetic oligonucleotide
agcggggccaggtggacacctact

SEQ ID NO: 70537 - DNA, 25 bp, Artificial Sequence
  Description of Artificial Sequence: Synthetic oligonucleotide
acttcctggaagacaggcgggccga

SEQ ID NO: 70538 - DNA, 24 bp, Artificial Sequence
  Description of Artificial Sequence: Synthetic oligonucleotide
cttcctggaagacaggcgggccga

SEQ ID NO: 70539 - DNA, 24 bp, Artificial Sequence
  Description of Artificial Sequence: Synthetic oligonucleotide
ttcctggaagacaggcgggccgag

SEQ ID NO: 70540 - DNA, 25 bp, Artificial Sequence
  Description of Artificial Sequence: Synthetic oligonucleotide
acttcctggaagacgagcgggccct

SEQ ID NO: 70541 - DNA, 24 bp, Artificial Sequence
  Description of Artificial Sequence: Synthetic oligonucleotide
cttcctggaagacgagcgggccct

SEQ ID NO: 70542 - DNA, 24 bp, Artificial Sequence
  Description of Artificial Sequence: Synthetic oligonucleotide
ttcctggaagacgagcgggccctg

SEQ ID NO: 70543 - DNA, 23 bp, Artificial Sequence
  Description of Artificial Sequence: Synthetic oligonucleotide
tcctggaagacgagcgggccctg

SEQ ID NO: 70544 - DNA, 22 bp, Artificial Sequence
  Description of Artificial Sequence: Synthetic oligonucleotide
cctggaagacgagcgggccctg

SEQ ID NO: 70545 - DNA, 23 bp, Artificial Sequence
  Description of Artificial Sequence: Synthetic oligonucleotide
ctggaagacgagcgggccctggt

SEQ ID NO: 70546 - DNA, 23 bp, Artificial Sequence
  Description of Artificial Sequence: Synthetic oligonucleotide
tggaagacgagcgggccctggtg

SEQ ID NO: 70547 - DNA, 22 bp, Artificial Sequence
  Description of Artificial Sequence: Synthetic oligonucleotide
ggaagacgagcgggccctggtg

SEQ ID NO: 70548 - DNA, 23 bp, Artificial Sequence
  Description of Artificial Sequence: Synthetic oligonucleotide
gaagacgagcgggccctggtgga

SEQ ID NO: 70549 - DNA, 24 bp, Artificial Sequence
  Description of Artificial Sequence: Synthetic oligonucleotide
aagacgagcgggccctggtggaca

SEQ ID NO: 70550 - DNA, 23 bp, Artificial Sequence
  Description of Artificial Sequence: Synthetic oligonucleotide
agacgagcgggccctggtggaca

SEQ ID NO: 70551 - DNA, 22 bp, Artificial Sequence
  Description of Artificial Sequence: Synthetic oligonucleotide
gacgagcgggccctggtggaca

SEQ ID NO: 70552 - DNA, 22 bp, Artificial Sequence
  Description of Artificial Sequence: Synthetic oligonucleotide
acgagcgggccctggtggacac

SEQ ID NO: 70553 - DNA, 21 bp, Artificial Sequence
  Description of Artificial Sequence: Synthetic oligonucleotide
cgagcgggccctggtggacac

SEQ ID NO: 70554 - DNA, 23 bp, Artificial Sequence
  Description of Artificial Sequence: Synthetic oligonucleotide
gagcgggccctggtggacaccta

SEQ ID NO: 70555 - DNA, 24 bp, Artificial Sequence
  Description of Artificial Sequence: Synthetic oligonucleotide
agcgggccctggtggacacctact

SEQ ID NO: 70556 - DNA, 23 bp, Artificial Sequence
  Description of Artificial Sequence: Synthetic oligonucleotide
agcgacgtgggggagttccggga

SEQ ID NO: 70557 - DNA, 22 bp, Artificial Sequence
  Description of Artificial Sequence: Synthetic oligonucleotide
gcgacgtgggggagttccggga

SEQ ID NO: 70558 - DNA, 22 bp, Artificial Sequence
  Description of Artificial Sequence: Synthetic oligonucleotide
cgacgtgggggagttccgggag

SEQ ID NO: 70559 - DNA, 23 bp, Artificial Sequence
  Description of Artificial Sequence: Synthetic oligonucleotide
gacgtgggggagttccgggaggt

SEQ ID NO: 70560 - DNA, 24 bp, Artificial Sequence
  Description of Artificial Sequence: Synthetic oligonucleotide
acgtgggggagttccgggaggtga

SEQ ID NO: 70561 - DNA, 23 bp, Artificial Sequence
  Description of Artificial Sequence: Synthetic oligonucleotide
cgtgggggagttccgggaggtga

SEQ ID NO: 70562 - DNA, 23 bp, Artificial Sequence
  Description of Artificial Sequence: Synthetic oligonucleotide
gtgggggagttccgggaggtgac

SEQ ID NO: 70563 - DNA, 23 bp, Artificial Sequence
  Description of Artificial Sequence: Synthetic oligonucleotide
tgggggagttccgggaggtgacg

SEQ ID NO: 70564 - DNA, 22 bp, Artificial Sequence
  Description of Artificial Sequence: Synthetic oligonucleotide
gggggagttccgggaggtgacg

SEQ ID NO: 70565 - DNA, 23 bp, Artificial Sequence
  Description of Artificial Sequence: Synthetic oligonucleotide
ggggagttccgggaggtgacgga

SEQ ID NO: 70566 - DNA, 23 bp, Artificial Sequence
  Description of Artificial Sequence: Synthetic oligonucleotide
gggagttccgggaggtgacggag

SEQ ID NO: 70567 - DNA, 24 bp, Artificial Sequence
  Description of Artificial Sequence: Synthetic oligonucleotide
ggagttccgggaggtgacggagct

SEQ ID NO: 70568 - DNA, 24 bp, Artificial Sequence
  Description of Artificial Sequence: Synthetic oligonucleotide
gagttccgggaggtgacggagctg

SEQ ID NO: 70569 - DNA, 24 bp, Artificial Sequence
  Description of Artificial Sequence: Synthetic oligonucleotide
agttccgggaggtgacggagctgg

SEQ ID NO: 70570 - DNA, 23 bp, Artificial Sequence
  Description of Artificial Sequence: Synthetic oligonucleotide
gttccgggaggtgacggagctgg

SEQ ID NO: 70571 - DNA, 23 bp, Artificial Sequence
  Description of Artificial Sequence: Synthetic oligonucleotide
ttccgggaggtgacggagctggg

SEQ ID NO: 70572 - DNA, 22 bp, Artificial Sequence
  Description of Artificial Sequence: Synthetic oligonucleotide
tccgggaggtgacggagctggg

SEQ ID NO: 70573 - DNA, 21 bp, Artificial Sequence
  Description of Artificial Sequence: Synthetic oligonucleotide
ccgggaggtgacggagctggg

SEQ ID NO: 70574 - DNA, 21 bp, Artificial Sequence
  Description of Artificial Sequence: Synthetic oligonucleotide
cgggaggtgacggagctgggg

SEQ ID NO: 70575 - DNA, 21 bp, Artificial Sequence
  Description of Artificial Sequence: Synthetic oligonucleotide
gggaggtgacggagctggggc

SEQ ID NO: 70576 - DNA, 21 bp, Artificial Sequence
  Description of Artificial Sequence: Synthetic oligonucleotide
ggaggtgacggagctggggcg

SEQ ID NO: 70577 - DNA, 21 bp, Artificial Sequence
  Description of Artificial Sequence: Synthetic oligonucleotide
gaggtgacggagctggggcgg

SEQ ID NO: 70578 - DNA, 21 bp, Artificial Sequence
  Description of Artificial Sequence: Synthetic oligonucleotide
aggtgacggagctggggcggc

SEQ ID NO: 70579 - DNA, 37 bp, Artificial Sequence
  Description of Artificial Sequence: Synthetic oligonucleotide
atacttctataaccaagaggagtacgtgcgcttcaac

SEQ ID NO: 70580 - DNA, 36 bp, Artificial Sequence
  Description of Artificial Sequence: Synthetic oligonucleotide
tacttctataaccaagaggagtacgtgcgcttcaac

SEQ ID NO: 70581 - DNA, 35 bp, Artificial Sequence
  Description of Artificial Sequence: Synthetic oligonucleotide
acttctataaccaagaggagtacgtgcgcttcaac

SEQ ID NO: 70582 - DNA, 34 bp, Artificial Sequence
  Description of Artificial Sequence: Synthetic oligonucleotide
cttctataaccaagaggagtacgtgcgcttcaac

SEQ ID NO: 70583 - DNA, 35 bp, Artificial Sequence
  Description of Artificial Sequence: Synthetic oligonucleotide
ttctataaccaagaggagtacgtgcgcttcaacag

SEQ ID NO: 70584 - DNA, 34 bp, Artificial Sequence
  Description of Artificial Sequence: Synthetic oligonucleotide
tctataaccaagaggagtacgtgcgcttcaacag

SEQ ID NO: 70585 - DNA, 33 bp, Artificial Sequence
  Description of Artificial Sequence: Synthetic oligonucleotide
ctataaccaagaggagtacgtgcgcttcaacag

SEQ ID NO: 70586 - DNA, 33 bp, Artificial Sequence
  Description of Artificial Sequence: Synthetic oligonucleotide
tataaccaagaggagtacgtgcgcttcaacagc

SEQ ID NO: 70587 - DNA, 32 bp, Artificial Sequence
  Description of Artificial Sequence: Synthetic oligonucleotide
ataaccaagaggagtacgtgcgcttcaacagc

SEQ ID NO: 70588 - DNA, 31 bp, Artificial Sequence
  Description of Artificial Sequence: Synthetic oligonucleotide
taaccaagaggagtacgtgcgcttcaacagc

SEQ ID NO: 70589 - DNA, 30 bp, Artificial Sequence
  Description of Artificial Sequence: Synthetic oligonucleotide
aaccaagaggagtacgtgcgcttcaacagc

SEQ ID NO: 70590 - DNA, 29 bp, Artificial Sequence
  Description of Artificial Sequence: Synthetic oligonucleotide
accaagaggagtacgtgcgcttcaacagc

SEQ ID NO: 70591 - DNA, 28 bp, Artificial Sequence
  Description of Artificial Sequence: Synthetic oligonucleotide
ccaagaggagtacgtgcgcttcaacagc

SEQ ID NO: 70592 - DNA, 28 bp, Artificial Sequence
  Description of Artificial Sequence: Synthetic oligonucleotide
caagaggagtacgtgcgcttcaacagcg

SEQ ID NO: 70593 - DNA, 29 bp, Artificial Sequence
  Description of Artificial Sequence: Synthetic oligonucleotide
aagaggagtacgtgcgcttcaacagcgac

SEQ ID NO: 70594 - DNA, 28 bp, Artificial Sequence
  Description of Artificial Sequence: Synthetic oligonucleotide
agaggagtacgtgcgcttcaacagcgac

SEQ ID NO: 70595 - DNA, 27 bp, Artificial Sequence
  Description of Artificial Sequence: Synthetic oligonucleotide
gaggagtacgtgcgcttcaacagcgac

SEQ ID NO: 70596 - DNA, 27 bp, Artificial Sequence
  Description of Artificial Sequence: Synthetic oligonucleotide
aggagtacgtgcgcttcaacagcgacg

SEQ ID NO: 70597 - DNA, 27 bp, Artificial Sequence
  Description of Artificial Sequence: Synthetic oligonucleotide
ggagtacgtgcgcttcaacagcgacgt

SEQ ID NO: 70598 - DNA, 27 bp, Artificial Sequence
  Description of Artificial Sequence: Synthetic oligonucleotide
gagtacgtgcgcttcaacagcgacgtg

SEQ ID NO: 70599 - DNA, 27 bp, Artificial Sequence
  Description of Artificial Sequence: Synthetic oligonucleotide
agtacgtgcgcttcaacagcgacgtgg

SEQ ID NO: 70600 - DNA, 26 bp, Artificial Sequence
  Description of Artificial Sequence: Synthetic oligonucleotide
gtacgtgcgcttcaacagcgacgtgg

SEQ ID NO: 70601 - DNA, 26 bp, Artificial Sequence
  Description of Artificial Sequence: Synthetic oligonucleotide
tacgtgcgcttcaacagcgacgtggg

SEQ ID NO: 70602 - DNA, 25 bp, Artificial Sequence
  Description of Artificial Sequence: Synthetic oligonucleotide
acgtgcgcttcaacagcgacgtggg

SEQ ID NO: 70603 - DNA, 24 bp, Artificial Sequence
  Description of Artificial Sequence: Synthetic oligonucleotide
cgtgcgcttcaacagcgacgtggg

SEQ ID NO: 70604 - DNA, 24 bp, Artificial Sequence
  Description of Artificial Sequence: Synthetic oligonucleotide
gtgcgcttcaacagcgacgtgggg

SEQ ID NO: 70605 - DNA, 25 bp, Artificial Sequence
  Description of Artificial Sequence: Synthetic oligonucleotide
tgcgcttcaacagcgacgtggggga

SEQ ID NO: 70606 - DNA, 24 bp, Artificial Sequence
  Description of Artificial Sequence: Synthetic oligonucleotide
gcgcttcaacagcgacgtggggga

SEQ ID NO: 70607 - DNA, 26 bp, Artificial Sequence
  Description of Artificial Sequence: Synthetic oligonucleotide
cgcttcaacagcgacgtgggggagtt

SEQ ID NO: 70608 - DNA, 26 bp, Artificial Sequence
  Description of Artificial Sequence: Synthetic oligonucleotide
gcttcaacagcgacgtgggggagttc

SEQ ID NO: 70609 - DNA, 26 bp, Artificial Sequence
  Description of Artificial Sequence: Synthetic oligonucleotide
cttcaacagcgacgtgggggagttcc

SEQ ID NO: 70610 - DNA, 26 bp, Artificial Sequence
  Description of Artificial Sequence: Synthetic oligonucleotide
ttcaacagcgacgtgggggagttccg

SEQ ID NO: 70611 - DNA, 25 bp, Artificial Sequence
  Description of Artificial Sequence: Synthetic oligonucleotide
tcaacagcgacgtgggggagttccg

SEQ ID NO: 70612 - DNA, 24 bp, Artificial Sequence
  Description of Artificial Sequence: Synthetic oligonucleotide
caacagcgacgtgggggagttccg

SEQ ID NO: 70613 - DNA, 24 bp, Artificial Sequence
  Description of Artificial Sequence: Synthetic oligonucleotide
aacagcgacgtgggggagttccgg

SEQ ID NO: 70614 - DNA, 23 bp, Artificial Sequence
  Description of Artificial Sequence: Synthetic oligonucleotide
gtgggggagttccgggcggtgat

SEQ ID NO: 70615 - DNA, 23 bp, Artificial Sequence
  Description of Artificial Sequence: Synthetic oligonucleotide
tgggggagttccgggcggtgatg

SEQ ID NO: 70616 - DNA, 22 bp, Artificial Sequence
  Description of Artificial Sequence: Synthetic oligonucleotide
gggggagttccgggcggtgatg

SEQ ID NO: 70617 - DNA, 23 bp, Artificial Sequence
  Description of Artificial Sequence: Synthetic oligonucleotide
ggggagttccgggcggtgatgga

SEQ ID NO: 70618 - DNA, 23 bp, Artificial Sequence
  Description of Artificial Sequence: Synthetic oligonucleotide
gggagttccgggcggtgatggag

SEQ ID NO: 70619 - DNA, 24 bp, Artificial Sequence
  Description of Artificial Sequence: Synthetic oligonucleotide
ggagttccgggcggtgatggagct

SEQ ID NO: 70620 - DNA, 24 bp, Artificial Sequence
  Description of Artificial Sequence: Synthetic oligonucleotide
gagttccgggcggtgatggagctg

SEQ ID NO: 70621 - DNA, 24 bp, Artificial Sequence
  Description of Artificial Sequence: Synthetic oligonucleotide
agttccgggcggtgatggagctgg

SEQ ID NO: 70622 - DNA, 23 bp, Artificial Sequence
  Description of Artificial Sequence: Synthetic oligonucleotide
gttccgggcggtgatggagctgg

SEQ ID NO: 70623 - DNA, 23 bp, Artificial Sequence
  Description of Artificial Sequence: Synthetic oligonucleotide
ttccgggcggtgatggagctggg

SEQ ID NO: 70624 - DNA, 22 bp, Artificial Sequence
  Description of Artificial Sequence: Synthetic oligonucleotide
tccgggcggtgatggagctggg

SEQ ID NO: 70625 - DNA, 25 bp, Artificial Sequence
  Description of Artificial Sequence: Synthetic oligonucleotide
tgatggagctggggcggcctgatga

SEQ ID NO: 70626 - DNA, 24 bp, Artificial Sequence
  Description of Artificial Sequence: Synthetic oligonucleotide
gatggagctggggcggcctgatga

SEQ ID NO: 70627 - DNA, 24 bp, Artificial Sequence
  Description of Artificial Sequence: Synthetic oligonucleotide
atggagctggggcggcctgatgag

SEQ ID NO: 70628 - DNA, 23 bp, Artificial Sequence
  Description of Artificial Sequence: Synthetic oligonucleotide
tggagctggggcggcctgatgag

SEQ ID NO: 70629 - DNA, 28 bp, Artificial Sequence
  Description of Artificial Sequence: Synthetic oligonucleotide
aacagccagaaggacttcctggagcagg

SEQ ID NO: 70630 - DNA, 27 bp, Artificial Sequence
  Description of Artificial Sequence: Synthetic oligonucleotide
acagccagaaggacttcctggagcagg

SEQ ID NO: 70631 - DNA, 26 bp, Artificial Sequence
  Description of Artificial Sequence: Synthetic oligonucleotide
cagccagaaggacttcctggagcagg

SEQ ID NO: 70632 - DNA, 26 bp, Artificial Sequence
  Description of Artificial Sequence: Synthetic oligonucleotide
agccagaaggacttcctggagcaggc

SEQ ID NO: 70633 - DNA, 25 bp, Artificial Sequence
  Description of Artificial Sequence: Synthetic oligonucleotide
gccagaaggacttcctggagcaggc

SEQ ID NO: 70634 - DNA, 25 bp, Artificial Sequence
  Description of Artificial Sequence: Synthetic oligonucleotide
ccagaaggacttcctggagcaggcg

SEQ ID NO: 70635 - DNA, 25 bp, Artificial Sequence
  Description of Artificial Sequence: Synthetic oligonucleotide
cagaaggacttcctggagcaggcgc

SEQ ID NO: 70636 - DNA, 25 bp, Artificial Sequence
  Description of Artificial Sequence: Synthetic oligonucleotide
agaaggacttcctggagcaggcgcg

SEQ ID NO: 70637 - DNA, 24 bp, Artificial Sequence
  Description of Artificial Sequence: Synthetic oligonucleotide
gaaggacttcctggagcaggcgcg

SEQ ID NO: 70638 - DNA, 24 bp, Artificial Sequence
  Description of Artificial Sequence: Synthetic oligonucleotide
aaggacttcctggagcaggcgcgg

SEQ ID NO: 70639 - DNA, 23 bp, Artificial Sequence
  Description of Artificial Sequence: Synthetic oligonucleotide
aggacttcctggagcaggcgcgg

SEQ ID NO: 70640 - DNA, 22 bp, Artificial Sequence
  Description of Artificial Sequence: Synthetic oligonucleotide
ggacttcctggagcaggcgcgg

SEQ ID NO: 70641 - DNA, 22 bp, Artificial Sequence
  Description of Artificial Sequence: Synthetic oligonucleotide
gacttcctggagcaggcgcggg

SEQ ID NO: 70642 - DNA, 22 bp, Artificial Sequence
  Description of Artificial Sequence: Synthetic oligonucleotide
acttcctggagcaggcgcgggc

SEQ ID NO: 70643 - DNA, 21 bp, Artificial Sequence
  Description of Artificial Sequence: Synthetic oligonucleotide
cttcctggagcaggcgcgggc

SEQ ID NO: 70644 - DNA, 21 bp, Artificial Sequence
  Description of Artificial Sequence: Synthetic oligonucleotide
ttcctggagcaggcgcgggcc

SEQ ID NO: 70645 - DNA, 25 bp, Artificial Sequence
  Description of Artificial Sequence: Synthetic oligonucleotide
acatcctggaagacgagcgggccgt

SEQ ID NO: 70646 - DNA, 24 bp, Artificial Sequence
  Description of Artificial Sequence: Synthetic oligonucleotide
catcctggaagacgagcgggccgt

SEQ ID NO: 70647 - DNA, 24 bp, Artificial Sequence
  Description of Artificial Sequence: Synthetic oligonucleotide
atcctggaagacgagcgggccgtg

SEQ ID NO: 70648 - DNA, 23 bp, Artificial Sequence
  Description of Artificial Sequence: Synthetic oligonucleotide
tcctggaagacgagcgggccgtg

SEQ ID NO: 70649 - DNA, 22 bp, Artificial Sequence
  Description of Artificial Sequence: Synthetic oligonucleotide
cctggaagacgagcgggccgtg

SEQ ID NO: 70650 - DNA, 23 bp, Artificial Sequence
  Description of Artificial Sequence: Synthetic oligonucleotide
ctggaagacgagcgggccgtggt

SEQ ID NO: 70651 - DNA, 23 bp, Artificial Sequence
  Description of Artificial Sequence: Synthetic oligonucleotide
tggaagacgagcgggccgtggtg

SEQ ID NO: 70652 - DNA, 22 bp, Artificial Sequence
  Description of Artificial Sequence: Synthetic oligonucleotide
ggaagacgagcgggccgtggtg

SEQ ID NO: 70653 - DNA, 23 bp, Artificial Sequence
  Description of Artificial Sequence: Synthetic oligonucleotide
gaagacgagcgggccgtggtgga

SEQ ID NO: 70654 - DNA, 24 bp, Artificial Sequence
  Description of Artificial Sequence: Synthetic oligonucleotide
aagacgagcgggccgtggtggaca

SEQ ID NO: 70655 - DNA, 23 bp, Artificial Sequence
  Description of Artificial Sequence: Synthetic oligonucleotide
agacgagcgggccgtggtggaca

SEQ ID NO: 70656 - DNA, 22 bp, Artificial Sequence
  Description of Artificial Sequence: Synthetic oligonucleotide
gacgagcgggccgtggtggaca

SEQ ID NO: 70657 - DNA, 22 bp, Artificial Sequence
  Description of Artificial Sequence: Synthetic oligonucleotide
acgagcgggccgtggtggacac

SEQ ID NO: 70658 - DNA, 21 bp, Artificial Sequence
  Description of Artificial Sequence: Synthetic oligonucleotide
cgagcgggccgtggtggacac

SEQ ID NO: 70659 - DNA, 23 bp, Artificial Sequence
  Description of Artificial Sequence: Synthetic oligonucleotide
gagcgggccgtggtggacaccta

SEQ ID NO: 70660 - DNA, 24 bp, Artificial Sequence
  Description of Artificial Sequence: Synthetic oligonucleotide
agcgggccgtggtggacacctact

SEQ ID NO: 70661 - DNA, 30 bp, Artificial Sequence
  Description of Artificial Sequence: Synthetic oligonucleotide
gtggacacctactgcagacacaactacgag

SEQ ID NO: 70662 - DNA, 30 bp, Artificial Sequence
  Description of Artificial Sequence: Synthetic oligonucleotide
tggacacctactgcagacacaactacgagg

SEQ ID NO: 70663 - DNA, 29 bp, Artificial Sequence
  Description of Artificial Sequence: Synthetic oligonucleotide
ggacacctactgcagacacaactacgagg

SEQ ID NO: 70664 - DNA, 31 bp, Artificial Sequence
  Description of Artificial Sequence: Synthetic oligonucleotide
gacacctactgcagacacaactacgaggttg

SEQ ID NO: 70665 - DNA, 31 bp, Artificial Sequence
  Description of Artificial Sequence: Synthetic oligonucleotide
acacctactgcagacacaactacgaggttgg

SEQ ID NO: 70666 - DNA, 30 bp, Artificial Sequence
  Description of Artificial Sequence: Synthetic oligonucleotide
cacctactgcagacacaactacgaggttgg

SEQ ID NO: 70667 - DNA, 31 bp, Artificial Sequence
  Description of Artificial Sequence: Synthetic oligonucleotide
acctactgcagacacaactacgaggttggtg

SEQ ID NO: 70668 - DNA, 30 bp, Artificial Sequence
  Description of Artificial Sequence: Synthetic oligonucleotide
cctactgcagacacaactacgaggttggtg

SEQ ID NO: 70669 - DNA, 31 bp, Artificial Sequence
  Description of Artificial Sequence: Synthetic oligonucleotide
ctactgcagacacaactacgaggttggtgag

SEQ ID NO: 70670 - DNA, 32 bp, Artificial Sequence
  Description of Artificial Sequence: Synthetic oligonucleotide
tactgcagacacaactacgaggttggtgagag

SEQ ID NO: 70671 - DNA, 31 bp, Artificial Sequence
  Description of Artificial Sequence: Synthetic oligonucleotide
actgcagacacaactacgaggttggtgagag

SEQ ID NO: 70672 - DNA, 30 bp, Artificial Sequence
  Description of Artificial Sequence: Synthetic oligonucleotide
ctgcagacacaactacgaggttggtgagag

SEQ ID NO: 70673 - DNA, 30 bp, Artificial Sequence
  Description of Artificial Sequence: Synthetic oligonucleotide
tgcagacacaactacgaggttggtgagagc

SEQ ID NO: 70674 - DNA, 29 bp, Artificial Sequence
  Description of Artificial Sequence: Synthetic oligonucleotide
gcagacacaactacgaggttggtgagagc

SEQ ID NO: 70675 - DNA, 31 bp, Artificial Sequence
  Description of Artificial Sequence: Synthetic oligonucleotide
cagacacaactacgaggttggtgagagcttc

SEQ ID NO: 70676 - DNA, 32 bp, Artificial Sequence
  Description of Artificial Sequence: Synthetic oligonucleotide
agacacaactacgaggttggtgagagcttcac

SEQ ID NO: 70677 - DNA, 31 bp, Artificial Sequence
  Description of Artificial Sequence: Synthetic oligonucleotide
gacacaactacgaggttggtgagagcttcac

SEQ ID NO: 70678 - DNA, 32 bp, Artificial Sequence
  Description of Artificial Sequence: Synthetic oligonucleotide
acacaactacgaggttggtgagagcttcacag

SEQ ID NO: 70679 - DNA, 31 bp, Artificial Sequence
  Description of Artificial Sequence: Synthetic oligonucleotide
cacaactacgaggttggtgagagcttcacag

SEQ ID NO: 70680 - DNA, 32 bp, Artificial Sequence
  Description of Artificial Sequence: Synthetic oligonucleotide
acaactacgaggttggtgagagcttcacagtg

SEQ ID NO: 70681 - DNA, 31 bp, Artificial Sequence
  Description of Artificial Sequence: Synthetic oligonucleotide
caactacgaggttggtgagagcttcacagtg

SEQ ID NO: 70682 - DNA, 31 bp, Artificial Sequence
  Description of Artificial Sequence: Synthetic oligonucleotide
aactacgaggttggtgagagcttcacagtgc

SEQ ID NO: 70683 - DNA, 30 bp, Artificial Sequence
  Description of Artificial Sequence: Synthetic oligonucleotide
actacgaggttggtgagagcttcacagtgc

SEQ ID NO: 70684 - DNA, 29 bp, Artificial Sequence
  Description of Artificial Sequence: Synthetic oligonucleotide
ctacgaggttggtgagagcttcacagtgc

SEQ ID NO: 70685 - DNA, 30 bp, Artificial Sequence
  Description of Artificial Sequence: Synthetic oligonucleotide
tacgaggttggtgagagcttcacagtgcag

SEQ ID NO: 70686 - DNA, 29 bp, Artificial Sequence
  Description of Artificial Sequence: Synthetic oligonucleotide
acgaggttggtgagagcttcacagtgcag

SEQ ID NO: 70687 - DNA, 28 bp, Artificial Sequence
  Description of Artificial Sequence: Synthetic oligonucleotide
cgaggttggtgagagcttcacagtgcag

SEQ ID NO: 70688 - DNA, 28 bp, Artificial Sequence
  Description of Artificial Sequence: Synthetic oligonucleotide
gaggttggtgagagcttcacagtgcagc

SEQ ID NO: 70689 - DNA, 28 bp, Artificial Sequence
  Description of Artificial Sequence: Synthetic oligonucleotide
aggttggtgagagcttcacagtgcagcg

SEQ ID NO: 70690 - DNA, 21 bp, Artificial Sequence
  Description of Artificial Sequence: Synthetic oligonucleotide
gtgggggagttccgggcggtg

SEQ ID NO: 70691 - DNA, 21 bp, Artificial Sequence
  Description of Artificial Sequence: Synthetic oligonucleotide
tgggggagttccgggcggtgg

SEQ ID NO: 70692 - DNA, 20 bp, Artificial Sequence
  Description of Artificial Sequence: Synthetic oligonucleotide
gggggagttccgggcggtgg

SEQ ID NO: 70693 - DNA, 20 bp, Artificial Sequence
  Description of Artificial Sequence: Synthetic oligonucleotide
ggggagttccgggcggtggc

SEQ ID NO: 70694 - DNA, 20 bp, Artificial Sequence
  Description of Artificial Sequence: Synthetic oligonucleotide
gggagttccgggcggtggcg

SEQ ID NO: 70695 - DNA, 21 bp, Artificial Sequence
  Description of Artificial Sequence: Synthetic oligonucleotide
ggagttccgggcggtggcgga

SEQ ID NO: 70696 - DNA, 21 bp, Artificial Sequence
  Description of Artificial Sequence: Synthetic oligonucleotide
gagttccgggcggtggcggag

SEQ ID NO: 70697 - DNA, 22 bp, Artificial Sequence
  Description of Artificial Sequence: Synthetic oligonucleotide
agttccgggcggtggcggagct

SEQ ID NO: 70698 - DNA, 21 bp, Artificial Sequence
  Description of Artificial Sequence: Synthetic oligonucleotide
gttccgggcggtggcggagct

SEQ ID NO: 70699 - DNA, 21 bp, Artificial Sequence
  Description of Artificial Sequence: Synthetic oligonucleotide
ttccgggcggtggcggagctg

SEQ ID NO: 70700 - DNA, 20 bp, Artificial Sequence
  Description of Artificial Sequence: Synthetic oligonucleotide
tccgggcggtggcggagctg

SEQ ID NO: 70701 - DNA, 20 bp, Artificial Sequence
  Description of Artificial Sequence: Synthetic oligonucleotide
ccgggcggtggcggagctgt

SEQ ID NO: 70702 - DNA, 20 bp, Artificial Sequence
  Description of Artificial Sequence: Synthetic oligonucleotide
cgggcggtggcggagctggt

SEQ ID NO: 70703 - DNA, 20 bp, Artificial Sequence
  Description of Artificial Sequence: Synthetic oligonucleotide
gggcggtggcggagctgggt

SEQ ID NO: 70704 - DNA, 20 bp, Artificial Sequence
  Description of Artificial Sequence: Synthetic oligonucleotide
ggcggtggcggagctggggt

SEQ ID NO: 70705 - DNA, 20 bp, Artificial Sequence
  Description of Artificial Sequence: Synthetic oligonucleotide
gcggtggcggagctggggct

SEQ ID NO: 70706 - DNA, 20 bp, Artificial Sequence
  Description of Artificial Sequence: Synthetic oligonucleotide
cggtggcggagctggggcgt

SEQ ID NO: 70707 - DNA, 20 bp, Artificial Sequence
  Description of Artificial Sequence: Synthetic oligonucleotide
ggtggcggagctggggcggt

SEQ ID NO: 70708 - DNA, 20 bp, Artificial Sequence
  Description of Artificial Sequence: Synthetic oligonucleotide
gtggcggagctggggcggct

SEQ ID NO: 70709 - DNA, 20 bp, Artificial Sequence
  Description of Artificial Sequence: Synthetic oligonucleotide
tggcggagctggggcggcct

SEQ ID NO: 70710 - DNA, 20 bp, Artificial Sequence
  Description of Artificial Sequence: Synthetic oligonucleotide
ggcggagctggggcggcctt

SEQ ID NO: 70711 - DNA, 21 bp, Artificial Sequence
  Description of Artificial Sequence: Synthetic oligonucleotide
gcggagctggggcggcctgat

SEQ ID NO: 70712 - DNA, 37 bp, Artificial Sequence
  Description of Artificial Sequence: Synthetic oligonucleotide
ttcctggacagatacttctataaccaagaggagtacc

SEQ ID NO: 70713 - DNA, 36 bp, Artificial Sequence
  Description of Artificial Sequence: Synthetic oligonucleotide
tcctggacagatacttctataaccaagaggagtacc

SEQ ID NO: 70714 - DNA, 35 bp, Artificial Sequence
  Description of Artificial Sequence: Synthetic oligonucleotide
cctggacagatacttctataaccaagaggagtacc

SEQ ID NO: 70715 - DNA, 36 bp, Artificial Sequence
  Description of Artificial Sequence: Synthetic oligonucleotide
ctggacagatacttctataaccaagaggagtacctg

SEQ ID NO: 70716 - DNA, 36 bp, Artificial Sequence
  Description of Artificial Sequence: Synthetic oligonucleotide
tggacagatacttctataaccaagaggagtacctgc

SEQ ID NO: 70717 - DNA, 35 bp, Artificial Sequence
  Description of Artificial Sequence: Synthetic oligonucleotide
ggacagatacttctataaccaagaggagtacctgc

SEQ ID NO: 70718 - DNA, 35 bp, Artificial Sequence
  Description of Artificial Sequence: Synthetic oligonucleotide
gacagatacttctataaccaagaggagtacctgcg

SEQ ID NO: 70719 - DNA, 35 bp, Artificial Sequence
  Description of Artificial Sequence: Synthetic oligonucleotide
acagatacttctataaccaagaggagtacctgcgc

SEQ ID NO: 70720 - DNA, 34 bp, Artificial Sequence
  Description of Artificial Sequence: Synthetic oligonucleotide
cagatacttctataaccaagaggagtacctgcgc

SEQ ID NO: 70721 - DNA, 36 bp, Artificial Sequence
  Description of Artificial Sequence: Synthetic oligonucleotide
agatacttctataaccaagaggagtacctgcgcttc

SEQ ID NO: 70722 - DNA, 35 bp, Artificial Sequence
  Description of Artificial Sequence: Synthetic oligonucleotide
gatacttctataaccaagaggagtacctgcgcttc

SEQ ID NO: 70723 - DNA, 35 bp, Artificial Sequence
  Description of Artificial Sequence: Synthetic oligonucleotide
atacttctataaccaagaggagtacctgcgcttcg

SEQ ID NO: 70724 - DNA, 34 bp, Artificial Sequence
  Description of Artificial Sequence: Synthetic oligonucleotide
tacttctataaccaagaggagtacctgcgcttcg

SEQ ID NO: 70725 - DNA, 33 bp, Artificial Sequence
  Description of Artificial Sequence: Synthetic oligonucleotide
acttctataaccaagaggagtacctgcgcttcg

SEQ ID NO: 70726 - DNA, 32 bp, Artificial Sequence
  Description of Artificial Sequence: Synthetic oligonucleotide
cttctataaccaagaggagtacctgcgcttcg

SEQ ID NO: 70727 - DNA, 33 bp, Artificial Sequence
  Description of Artificial Sequence: Synthetic oligonucleotide
ttctataaccaagaggagtacctgcgcttcgac

SEQ ID NO: 70728 - DNA, 32 bp, Artificial Sequence
  Description of Artificial Sequence: Synthetic oligonucleotide
tctataaccaagaggagtacctgcgcttcgac

SEQ ID NO: 70729 - DNA, 31 bp, Artificial Sequence
  Description of Artificial Sequence: Synthetic oligonucleotide
ctataaccaagaggagtacctgcgcttcgac

SEQ ID NO: 70730 - DNA, 32 bp, Artificial Sequence
  Description of Artificial Sequence: Synthetic oligonucleotide
tataaccaagaggagtacctgcgcttcgacag

SEQ ID NO: 70731 - DNA, 31 bp, Artificial Sequence
  Description of Artificial Sequence: Synthetic oligonucleotide
ataaccaagaggagtacctgcgcttcgacag

SEQ ID NO: 70732 - DNA, 30 bp, Artificial Sequence
  Description of Artificial Sequence: Synthetic oligonucleotide
taaccaagaggagtacctgcgcttcgacag

SEQ ID NO: 70733 - DNA, 29 bp, Artificial Sequence
  Description of Artificial Sequence: Synthetic oligonucleotide
aaccaagaggagtacctgcgcttcgacag

SEQ ID NO: 70734 - DNA, 28 bp, Artificial Sequence
  Description of Artificial Sequence: Synthetic oligonucleotide
accaagaggagtacctgcgcttcgacag

SEQ ID NO: 70735 - DNA, 27 bp, Artificial Sequence
  Description of Artificial Sequence: Synthetic oligonucleotide
ccaagaggagtacctgcgcttcgacag

SEQ ID NO: 70736 - DNA, 27 bp, Artificial Sequence
  Description of Artificial Sequence: Synthetic oligonucleotide
caagaggagtacctgcgcttcgacagc

SEQ ID NO: 70737 - DNA, 27 bp, Artificial Sequence
  Description of Artificial Sequence: Synthetic oligonucleotide
aagaggagtacctgcgcttcgacagcg

SEQ ID NO: 70738 - DNA, 27 bp, Artificial Sequence
  Description of Artificial Sequence: Synthetic oligonucleotide
agaggagtacctgcgcttcgacagcga

SEQ ID NO: 70739 - DNA, 26 bp, Artificial Sequence
  Description of Artificial Sequence: Synthetic oligonucleotide
gaggagtacctgcgcttcgacagcga

SEQ ID NO: 70740 - DNA, 26 bp, Artificial Sequence
  Description of Artificial Sequence: Synthetic oligonucleotide
aggagtacctgcgcttcgacagcgac

SEQ ID NO: 70741 - DNA, 25 bp, Artificial Sequence
  Description of Artificial Sequence: Synthetic oligonucleotide
ggagtacctgcgcttcgacagcgac

SEQ ID NO: 70742 - DNA, 26 bp, Artificial Sequence
  Description of Artificial Sequence: Synthetic oligonucleotide
gagtacctgcgcttcgacagcgacgt

SEQ ID NO: 70743 - DNA, 26 bp, Artificial Sequence
  Description of Artificial Sequence: Synthetic oligonucleotide
agtacctgcgcttcgacagcgacgtg

SEQ ID NO: 70744 - DNA, 25 bp, Artificial Sequence
  Description of Artificial Sequence: Synthetic oligonucleotide
gtacctgcgcttcgacagcgacgtg

SEQ ID NO: 70745 - DNA, 25 bp, Artificial Sequence
  Description of Artificial Sequence: Synthetic oligonucleotide
tacctgcgcttcgacagcgacgtgg

SEQ ID NO: 70746 - DNA, 24 bp, Artificial Sequence
  Description of Artificial Sequence: Synthetic oligonucleotide
acctgcgcttcgacagcgacgtgg

SEQ ID NO: 70747 - DNA, 27 bp, Artificial Sequence
  Description of Artificial Sequence: Synthetic oligonucleotide
cggtggacacctactgcagacacaacc

SEQ ID NO: 70748 - DNA, 28 bp, Artificial Sequence
  Description of Artificial Sequence: Synthetic oligonucleotide
ggtggacacctactgcagacacaaccac

SEQ ID NO: 70749 - DNA, 28 bp, Artificial Sequence
  Description of Artificial Sequence: Synthetic oligonucleotide
gtggacacctactgcagacacaaccacg

SEQ ID NO: 70750 - DNA, 28 bp, Artificial Sequence
  Description of Artificial Sequence: Synthetic oligonucleotide
tggacacctactgcagacacaaccacgg

SEQ ID NO: 70751 - DNA, 27 bp, Artificial Sequence
  Description of Artificial Sequence: Synthetic oligonucleotide
ggacacctactgcagacacaaccacgg

SEQ ID NO: 70752 - DNA, 27 bp, Artificial Sequence
  Description of Artificial Sequence: Synthetic oligonucleotide
gacacctactgcagacacaaccacggg

SEQ ID NO: 70753 - DNA, 27 bp, Artificial Sequence
  Description of Artificial Sequence: Synthetic oligonucleotide
acacctactgcagacacaaccacgggg

SEQ ID NO: 70754 - DNA, 27 bp, Artificial Sequence
  Description of Artificial Sequence: Synthetic oligonucleotide
cacctactgcagacacaaccacggggt

SEQ ID NO: 70755 - DNA, 28 bp, Artificial Sequence
  Description of Artificial Sequence: Synthetic oligonucleotide
acctactgcagacacaaccacggggttg

SEQ ID NO: 70756 - DNA, 27 bp, Artificial Sequence
  Description of Artificial Sequence: Synthetic oligonucleotide
cctactgcagacacaaccacggggttg

SEQ ID NO: 70757 - DNA, 28 bp, Artificial Sequence
  Description of Artificial Sequence: Synthetic oligonucleotide
ctactgcagacacaaccacggggttgtg

SEQ ID NO: 70758 - DNA, 28 bp, Artificial Sequence
  Description of Artificial Sequence: Synthetic oligonucleotide
tactgcagacacaaccacggggttgtgg

SEQ ID NO: 70759 - DNA, 27 bp, Artificial Sequence
  Description of Artificial Sequence: Synthetic oligonucleotide
actgcagacacaaccacggggttgtgg

SEQ ID NO: 70760 - DNA, 27 bp, Artificial Sequence
  Description of Artificial Sequence: Synthetic oligonucleotide
ctgcagacacaaccacggggttgtgga

SEQ ID NO: 70761 - DNA, 27 bp, Artificial Sequence
  Description of Artificial Sequence: Synthetic oligonucleotide
tgcagacacaaccacggggttgtggag

SEQ ID NO: 70762 - DNA, 27 bp, Artificial Sequence
  Description of Artificial Sequence: Synthetic oligonucleotide
gcagacacaaccacggggttgtggaga

SEQ ID NO: 70763 - DNA, 27 bp, Artificial Sequence
  Description of Artificial Sequence: Synthetic oligonucleotide
cagacacaaccacggggttgtggagag

SEQ ID NO: 70764 - DNA, 27 bp, Artificial Sequence
  Description of Artificial Sequence: Synthetic oligonucleotide
agacacaaccacggggttgtggagagc

SEQ ID NO: 70765 - DNA, 27 bp, Artificial Sequence
  Description of Artificial Sequence: Synthetic oligonucleotide
gacacaaccacggggttgtggagagct

SEQ ID NO: 70766 - DNA, 28 bp, Artificial Sequence
  Description of Artificial Sequence: Synthetic oligonucleotide
acacaaccacggggttgtggagagcttc

SEQ ID NO: 70767 - DNA, 27 bp, Artificial Sequence
  Description of Artificial Sequence: Synthetic oligonucleotide
cacaaccacggggttgtggagagcttc

SEQ ID NO: 70768 - DNA, 28 bp, Artificial Sequence
  Description of Artificial Sequence: Synthetic oligonucleotide
acaaccacggggttgtggagagcttcac

SEQ ID NO: 70769 - DNA, 27 bp, Artificial Sequence
  Description of Artificial Sequence: Synthetic oligonucleotide
caaccacggggttgtggagagcttcac

SEQ ID NO: 70770 - DNA, 28 bp, Artificial Sequence
  Description of Artificial Sequence: Synthetic oligonucleotide
aaccacggggttgtggagagcttcacag

SEQ ID NO: 70771 - DNA, 27 bp, Artificial Sequence
  Description of Artificial Sequence: Synthetic oligonucleotide
accacggggttgtggagagcttcacag

SEQ ID NO: 70772 - DNA, 27 bp, Artificial Sequence
  Description of Artificial Sequence: Synthetic oligonucleotide
ccacggggttgtggagagcttcacagt

SEQ ID NO: 70773 - DNA, 27 bp, Artificial Sequence
  Description of Artificial Sequence: Synthetic oligonucleotide
cacggggttgtggagagcttcacagtg

SEQ ID NO: 70774 - DNA, 39 bp, Artificial Sequence
  Description of Artificial Sequence: Synthetic oligonucleotide
tttcttggagtactctacgtctgagtgtcatttcttcag

SEQ ID NO: 70775 - DNA, 38 bp, Artificial Sequence
  Description of Artificial Sequence: Synthetic oligonucleotide
ttcttggagtactctacgtctgagtgtcatttcttcag

SEQ ID NO: 70776 - DNA, 37 bp, Artificial Sequence
  Description of Artificial Sequence: Synthetic oligonucleotide
tcttggagtactctacgtctgagtgtcatttcttcag

SEQ ID NO: 70777 - DNA, 36 bp, Artificial Sequence
  Description of Artificial Sequence: Synthetic oligonucleotide
cttggagtactctacgtctgagtgtcatttcttcag

SEQ ID NO: 70778 - DNA, 37 bp, Artificial Sequence
  Description of Artificial Sequence: Synthetic oligonucleotide
ttggagtactctacgtctgagtgtcatttcttcagtg

SEQ ID NO: 70779 - DNA, 36 bp, Artificial Sequence
  Description of Artificial Sequence: Synthetic oligonucleotide
tggagtactctacgtctgagtgtcatttcttcagtg

SEQ ID NO: 70780 - DNA, 35 bp, Artificial Sequence
  Description of Artificial Sequence: Synthetic oligonucleotide
ggagtactctacgtctgagtgtcatttcttcagtg

SEQ ID NO: 70781 - DNA, 35 bp, Artificial Sequence
  Description of Artificial Sequence: Synthetic oligonucleotide
gagtactctacgtctgagtgtcatttcttcagtgg

SEQ ID NO: 70782 - DNA, 35 bp, Artificial Sequence
  Description of Artificial Sequence: Synthetic oligonucleotide
agtactctacgtctgagtgtcatttcttcagtggg

SEQ ID NO: 70783 - DNA, 34 bp, Artificial Sequence
  Description of Artificial Sequence: Synthetic oligonucleotide
gtactctacgtctgagtgtcatttcttcagtggg

SEQ ID NO: 70784 - DNA, 35 bp, Artificial Sequence
  Description of Artificial Sequence: Synthetic oligonucleotide
tactctacgtctgagtgtcatttcttcagtgggac

SEQ ID NO: 70785 - DNA, 34 bp, Artificial Sequence
  Description of Artificial Sequence: Synthetic oligonucleotide
actctacgtctgagtgtcatttcttcagtgggac

SEQ ID NO: 70786 - DNA, 33 bp, Artificial Sequence
  Description of Artificial Sequence: Synthetic oligonucleotide
ctctacgtctgagtgtcatttcttcagtgggac

SEQ ID NO: 70787 - DNA, 33 bp, Artificial Sequence
  Description of Artificial Sequence: Synthetic oligonucleotide
tctacgtctgagtgtcatttcttcagtgggacg

SEQ ID NO: 70788 - DNA, 32 bp, Artificial Sequence
  Description of Artificial Sequence: Synthetic oligonucleotide
ctacgtctgagtgtcatttcttcagtgggacg

SEQ ID NO: 70789 - DNA, 32 bp, Artificial Sequence
  Description of Artificial Sequence: Synthetic oligonucleotide
tacgtctgagtgtcatttcttcagtgggacgg

SEQ ID NO: 70790 - DNA, 31 bp, Artificial Sequence
  Description of Artificial Sequence: Synthetic oligonucleotide
acgtctgagtgtcatttcttcagtgggacgg

SEQ ID NO: 70791 - DNA, 30 bp, Artificial Sequence
  Description of Artificial Sequence: Synthetic oligonucleotide
cgtctgagtgtcatttcttcagtgggacgg

SEQ ID NO: 70792 - DNA, 31 bp, Artificial Sequence
  Description of Artificial Sequence: Synthetic oligonucleotide
gtctgagtgtcatttcttcagtgggacggag

SEQ ID NO: 70793 - DNA, 31 bp, Artificial Sequence
  Description of Artificial Sequence: Synthetic oligonucleotide
tctgagtgtcatttcttcagtgggacggagc

SEQ ID NO: 70794 - DNA, 30 bp, Artificial Sequence
  Description of Artificial Sequence: Synthetic oligonucleotide
ctgagtgtcatttcttcagtgggacggagc

SEQ ID NO: 70795 - DNA, 30 bp, Artificial Sequence
  Description of Artificial Sequence: Synthetic oligonucleotide
tgagtgtcatttcttcagtgggacggagcg

SEQ ID NO: 70796 - DNA, 29 bp, Artificial Sequence
  Description of Artificial Sequence: Synthetic oligonucleotide
gagtgtcatttcttcagtgggacggagcg

SEQ ID NO: 70797 - DNA, 29 bp, Artificial Sequence
  Description of Artificial Sequence: Synthetic oligonucleotide
agtgtcatttcttcagtgggacggagcgg

SEQ ID NO: 70798 - DNA, 28 bp, Artificial Sequence
  Description of Artificial Sequence: Synthetic oligonucleotide
gtgtcatttcttcagtgggacggagcgg

SEQ ID NO: 70799 - DNA, 28 bp, Artificial Sequence
  Description of Artificial Sequence: Synthetic oligonucleotide
tgtcatttcttcagtgggacggagcggg

SEQ ID NO: 70800 - DNA, 27 bp, Artificial Sequence
  Description of Artificial Sequence: Synthetic oligonucleotide
gtcatttcttcagtgggacggagcggg

SEQ ID NO: 70801 - DNA, 28 bp, Artificial Sequence
  Description of Artificial Sequence: Synthetic oligonucleotide
tcatttcttcagtgggacggagcgggtg

SEQ ID NO: 70802 - DNA, 27 bp, Artificial Sequence
  Description of Artificial Sequence: Synthetic oligonucleotide
catttcttcagtgggacggagcgggtg

SEQ ID NO: 70803 - DNA, 27 bp, Artificial Sequence
  Description of Artificial Sequence: Synthetic oligonucleotide
atttcttcagtgggacggagcgggtgc

SEQ ID NO: 70804 - DNA, 26 bp, Artificial Sequence
  Description of Artificial Sequence: Synthetic oligonucleotide
tttcttcagtgggacggagcgggtgc

SEQ ID NO: 70805 - DNA, 25 bp, Artificial Sequence
  Description of Artificial Sequence: Synthetic oligonucleotide
ttcttcagtgggacggagcgggtgc

SEQ ID NO: 70806 - DNA, 24 bp, Artificial Sequence
  Description of Artificial Sequence: Synthetic oligonucleotide
tcttcagtgggacggagcgggtgc

SEQ ID NO: 70807 - DNA, 23 bp, Artificial Sequence
  Description of Artificial Sequence: Synthetic oligonucleotide
cttcagtgggacggagcgggtgc

SEQ ID NO: 70808 - DNA, 23 bp, Artificial Sequence
  Description of Artificial Sequence: Synthetic oligonucleotide
ttcagtgggacggagcgggtgcg

SEQ ID NO: 70809 - DNA, 22 bp, Artificial Sequence
  Description of Artificial Sequence: Synthetic oligonucleotide
tcagtgggacggagcgggtgcg

SEQ ID NO: 70810 - DNA, 21 bp, Artificial Sequence
  Description of Artificial Sequence: Synthetic oligonucleotide
cagtgggacggagcgggtgcg

SEQ ID NO: 70811 - DNA, 23 bp, Artificial Sequence
  Description of Artificial Sequence: Synthetic oligonucleotide
agtgggacggagcgggtgcggtt

SEQ ID NO: 70812 - DNA, 22 bp, Artificial Sequence
  Description of Artificial Sequence: Synthetic oligonucleotide
gtgggacggagcgggtgcggtt

SEQ ID NO: 70813 - DNA, 33 bp, Artificial Sequence
  Description of Artificial Sequence: Synthetic oligonucleotide
tgcggtacctggacagatacttccataaccaag

SEQ ID NO: 70814 - DNA, 32 bp, Artificial Sequence
  Description of Artificial Sequence: Synthetic oligonucleotide
gcggtacctggacagatacttccataaccaag

SEQ ID NO: 70815 - DNA, 33 bp, Artificial Sequence
  Description of Artificial Sequence: Synthetic oligonucleotide
cggtacctggacagatacttccataaccaagag

SEQ ID NO: 70816 - DNA, 33 bp, Artificial Sequence
  Description of Artificial Sequence: Synthetic oligonucleotide
ggtacctggacagatacttccataaccaagagg

SEQ ID NO: 70817 - DNA, 34 bp, Artificial Sequence
  Description of Artificial Sequence: Synthetic oligonucleotide
gtacctggacagatacttccataaccaagaggag

SEQ ID NO: 70818 - DNA, 36 bp, Artificial Sequence
  Description of Artificial Sequence: Synthetic oligonucleotide
tacctggacagatacttccataaccaagaggagtac

SEQ ID NO: 70819 - DNA, 35 bp, Artificial Sequence
  Description of Artificial Sequence: Synthetic oligonucleotide
acctggacagatacttccataaccaagaggagtac

SEQ ID NO: 70820 - DNA, 27 bp, Artificial Sequence
  Description of Artificial Sequence: Synthetic oligonucleotide
ccgcggtggacacctactgcagacaaa

SEQ ID NO: 70821 - DNA, 28 bp, Artificial Sequence
  Description of Artificial Sequence: Synthetic oligonucleotide
cgcggtggacacctactgcagacaaaac

SEQ ID NO: 70822 - DNA, 30 bp, Artificial Sequence
  Description of Artificial Sequence: Synthetic oligonucleotide
gcggtggacacctactgcagacaaaactac

SEQ ID NO: 70823 - DNA, 30 bp, Artificial Sequence
  Description of Artificial Sequence: Synthetic oligonucleotide
cggtggacacctactgcagacaaaactacg

SEQ ID NO: 70824 - DNA, 30 bp, Artificial Sequence
  Description of Artificial Sequence: Synthetic oligonucleotide
ggtggacacctactgcagacaaaactacgg

SEQ ID NO: 70825 - DNA, 30 bp, Artificial Sequence
  Description of Artificial Sequence: Synthetic oligonucleotide
gtggacacctactgcagacaaaactacggg

SEQ ID NO: 70826 - DNA, 30 bp, Artificial Sequence
  Description of Artificial Sequence: Synthetic oligonucleotide
tggacacctactgcagacaaaactacgggg

SEQ ID NO: 70827 - DNA, 29 bp, Artificial Sequence
  Description of Artificial Sequence: Synthetic oligonucleotide
ggacacctactgcagacaaaactacgggg

SEQ ID NO: 70828 - DNA, 31 bp, Artificial Sequence
  Description of Artificial Sequence: Synthetic oligonucleotide
gacacctactgcagacaaaactacggggttg

SEQ ID NO: 70829 - DNA, 31 bp, Artificial Sequence
  Description of Artificial Sequence: Synthetic oligonucleotide
acacctactgcagacaaaactacggggttgg

SEQ ID NO: 70830 - DNA, 30 bp, Artificial Sequence
  Description of Artificial Sequence: Synthetic oligonucleotide
cacctactgcagacaaaactacggggttgg

SEQ ID NO: 70831 - DNA, 31 bp, Artificial Sequence
  Description of Artificial Sequence: Synthetic oligonucleotide
acctactgcagacaaaactacggggttggtg

SEQ ID NO: 70832 - DNA, 30 bp, Artificial Sequence
  Description of Artificial Sequence: Synthetic oligonucleotide
cctactgcagacaaaactacggggttggtg

SEQ ID NO: 70833 - DNA, 31 bp, Artificial Sequence
  Description of Artificial Sequence: Synthetic oligonucleotide
ctactgcagacaaaactacggggttggtgag

SEQ ID NO: 70834 - DNA, 32 bp, Artificial Sequence
  Description of Artificial Sequence: Synthetic oligonucleotide
tactgcagacaaaactacggggttggtgagag

SEQ ID NO: 70835 - DNA, 31 bp, Artificial Sequence
  Description of Artificial Sequence: Synthetic oligonucleotide
actgcagacaaaactacggggttggtgagag

SEQ ID NO: 70836 - DNA, 30 bp, Artificial Sequence
  Description of Artificial Sequence: Synthetic oligonucleotide
ctgcagacaaaactacggggttggtgagag

SEQ ID NO: 70837 - DNA, 30 bp, Artificial Sequence
  Description of Artificial Sequence: Synthetic oligonucleotide
tgcagacaaaactacggggttggtgagagc

SEQ ID NO: 70838 - DNA, 29 bp, Artificial Sequence
  Description of Artificial Sequence: Synthetic oligonucleotide
gcagacaaaactacggggttggtgagagc

SEQ ID NO: 70839 - DNA, 31 bp, Artificial Sequence
  Description of Artificial Sequence: Synthetic oligonucleotide
cagacaaaactacggggttggtgagagcttc

SEQ ID NO: 70840 - DNA, 32 bp, Artificial Sequence
  Description of Artificial Sequence: Synthetic oligonucleotide
agacaaaactacggggttggtgagagcttcac

SEQ ID NO: 70841 - DNA, 31 bp, Artificial Sequence
  Description of Artificial Sequence: Synthetic oligonucleotide
gacaaaactacggggttggtgagagcttcac

SEQ ID NO: 70842 - DNA, 32 bp, Artificial Sequence
  Description of Artificial Sequence: Synthetic oligonucleotide
acaaaactacggggttggtgagagcttcacag

SEQ ID NO: 70843 - DNA, 31 bp, Artificial Sequence
  Description of Artificial Sequence: Synthetic oligonucleotide
caaaactacggggttggtgagagcttcacag

SEQ ID NO: 70844 - DNA, 32 bp, Artificial Sequence
  Description of Artificial Sequence: Synthetic oligonucleotide
aaaactacggggttggtgagagcttcacagtg

SEQ ID NO: 70845 - DNA, 31 bp, Artificial Sequence
  Description of Artificial Sequence: Synthetic oligonucleotide
aaactacggggttggtgagagcttcacagtg

SEQ ID NO: 70846 - DNA, 31 bp, Artificial Sequence
  Description of Artificial Sequence: Synthetic oligonucleotide
acctactgcagacacaactacggggttgatg

SEQ ID NO: 70847 - DNA, 30 bp, Artificial Sequence
  Description of Artificial Sequence: Synthetic oligonucleotide
cctactgcagacacaactacggggttgatg

SEQ ID NO: 70848 - DNA, 31 bp, Artificial Sequence
  Description of Artificial Sequence: Synthetic oligonucleotide
ctactgcagacacaactacggggttgatgag

SEQ ID NO: 70849 - DNA, 32 bp, Artificial Sequence
  Description of Artificial Sequence: Synthetic oligonucleotide
tactgcagacacaactacggggttgatgagag

SEQ ID NO: 70850 - DNA, 31 bp, Artificial Sequence
  Description of Artificial Sequence: Synthetic oligonucleotide
actgcagacacaactacggggttgatgagag

SEQ ID NO: 70851 - DNA, 30 bp, Artificial Sequence
  Description of Artificial Sequence: Synthetic oligonucleotide
ctgcagacacaactacggggttgatgagag

SEQ ID NO: 70852 - DNA, 30 bp, Artificial Sequence
  Description of Artificial Sequence: Synthetic oligonucleotide
tgcagacacaactacggggttgatgagagc

SEQ ID NO: 70853 - DNA, 29 bp, Artificial Sequence
  Description of Artificial Sequence: Synthetic oligonucleotide
gcagacacaactacggggttgatgagagc

SEQ ID NO: 70854 - DNA, 31 bp, Artificial Sequence
  Description of Artificial Sequence: Synthetic oligonucleotide
cagacacaactacggggttgatgagagcttc

SEQ ID NO: 70855 - DNA, 32 bp, Artificial Sequence
  Description of Artificial Sequence: Synthetic oligonucleotide
agacacaactacggggttgatgagagcttcac

SEQ ID NO: 70856 - DNA, 31 bp, Artificial Sequence
  Description of Artificial Sequence: Synthetic oligonucleotide
gacacaactacggggttgatgagagcttcac

SEQ ID NO: 70857 - DNA, 32 bp, Artificial Sequence
  Description of Artificial Sequence: Synthetic oligonucleotide
acacaactacggggttgatgagagcttcacag

SEQ ID NO: 70858 - DNA, 31 bp, Artificial Sequence
  Description of Artificial Sequence: Synthetic oligonucleotide
cacaactacggggttgatgagagcttcacag

SEQ ID NO: 70859 - DNA, 32 bp, Artificial Sequence
  Description of Artificial Sequence: Synthetic oligonucleotide
acaactacggggttgatgagagcttcacagtg

SEQ ID NO: 70860 - DNA, 31 bp, Artificial Sequence
  Description of Artificial Sequence: Synthetic oligonucleotide
caactacggggttgatgagagcttcacagtg

SEQ ID NO: 70861 - DNA, 31 bp, Artificial Sequence
  Description of Artificial Sequence: Synthetic oligonucleotide
aactacggggttgatgagagcttcacagtgc

SEQ ID NO: 70862 - DNA, 30 bp, Artificial Sequence
  Description of Artificial Sequence: Synthetic oligonucleotide
actacggggttgatgagagcttcacagtgc

SEQ ID NO: 70863 - DNA, 29 bp, Artificial Sequence
  Description of Artificial Sequence: Synthetic oligonucleotide
ctacggggttgatgagagcttcacagtgc

SEQ ID NO: 70864 - DNA, 30 bp, Artificial Sequence
  Description of Artificial Sequence: Synthetic oligonucleotide
tacggggttgatgagagcttcacagtgcag

SEQ ID NO: 70865 - DNA, 29 bp, Artificial Sequence
  Description of Artificial Sequence: Synthetic oligonucleotide
acggggttgatgagagcttcacagtgcag

SEQ ID NO: 70866 - DNA, 28 bp, Artificial Sequence
  Description of Artificial Sequence: Synthetic oligonucleotide
cggggttgatgagagcttcacagtgcag

SEQ ID NO: 70867 - DNA, 28 bp, Artificial Sequence
  Description of Artificial Sequence: Synthetic oligonucleotide
ggggttgatgagagcttcacagtgcagc

SEQ ID NO: 70868 - DNA, 28 bp, Artificial Sequence
  Description of Artificial Sequence: Synthetic oligonucleotide
gggttgatgagagcttcacagtgcagcg

SEQ ID NO: 70869 - DNA, 28 bp, Artificial Sequence
  Description of Artificial Sequence: Synthetic oligonucleotide
ggttgatgagagcttcacagtgcagcgg

SEQ ID NO: 70870 - DNA, 28 bp, Artificial Sequence
  Description of Artificial Sequence: Synthetic oligonucleotide
gttgatgagagcttcacagtgcagcggc

SEQ ID NO: 70871 - DNA, 28 bp, Artificial Sequence
  Description of Artificial Sequence: Synthetic oligonucleotide
ttgatgagagcttcacagtgcagcggcg

SEQ ID NO: 70872 - DNA, 27 bp, Artificial Sequence
  Description of Artificial Sequence: Synthetic oligonucleotide
tgatgagagcttcacagtgcagcggcg

SEQ ID NO: 70873 - DNA, 27 bp, Artificial Sequence
  Description of Artificial Sequence: Synthetic oligonucleotide
gatgagagcttcacagtgcagcggcga

SEQ ID NO: 70874 - DNA, 27 bp, Artificial Sequence
  Description of Artificial Sequence: Synthetic oligonucleotide
atgagagcttcacagtgcagcggcgag

SEQ ID NO: 70875 - DNA, 32 bp, Artificial Sequence
  Description of Artificial Sequence: Synthetic oligonucleotide
agtgtcatttcttcaatgggacggagcggatg

SEQ ID NO: 70876 - DNA, 31 bp, Artificial Sequence
  Description of Artificial Sequence: Synthetic oligonucleotide
gtgtcatttcttcaatgggacggagcggatg

SEQ ID NO: 70877 - DNA, 31 bp, Artificial Sequence
  Description of Artificial Sequence: Synthetic oligonucleotide
tgtcatttcttcaatgggacggagcggatgc

SEQ ID NO: 70878 - DNA, 30 bp, Artificial Sequence
  Description of Artificial Sequence: Synthetic oligonucleotide
gtcatttcttcaatgggacggagcggatgc

SEQ ID NO: 70879 - DNA, 30 bp, Artificial Sequence
  Description of Artificial Sequence: Synthetic oligonucleotide
tcatttcttcaatgggacggagcggatgcg

SEQ ID NO: 70880 - DNA, 29 bp, Artificial Sequence
  Description of Artificial Sequence: Synthetic oligonucleotide
catttcttcaatgggacggagcggatgcg

SEQ ID NO: 70881 - DNA, 29 bp, Artificial Sequence
  Description of Artificial Sequence: Synthetic oligonucleotide
atttcttcaatgggacggagcggatgcgg

SEQ ID NO: 70882 - DNA, 28 bp, Artificial Sequence
  Description of Artificial Sequence: Synthetic oligonucleotide
tttcttcaatgggacggagcggatgcgg

SEQ ID NO: 70883 - DNA, 27 bp, Artificial Sequence
  Description of Artificial Sequence: Synthetic oligonucleotide
ttcttcaatgggacggagcggatgcgg

SEQ ID NO: 70884 - DNA, 27 bp, Artificial Sequence
  Description of Artificial Sequence: Synthetic oligonucleotide
tcttcaatgggacggagcggatgcggt

SEQ ID NO: 70885 - DNA, 27 bp, Artificial Sequence
  Description of Artificial Sequence: Synthetic oligonucleotide
cttcaatgggacggagcggatgcggtt

SEQ ID NO: 70886 - DNA, 27 bp, Artificial Sequence
  Description of Artificial Sequence: Synthetic oligonucleotide
ttcaatgggacggagcggatgcggttc

SEQ ID NO: 70887 - DNA, 26 bp, Artificial Sequence
  Description of Artificial Sequence: Synthetic oligonucleotide
tcaatgggacggagcggatgcggttc

SEQ ID NO: 70888 - DNA, 25 bp, Artificial Sequence
  Description of Artificial Sequence: Synthetic oligonucleotide
caatgggacggagcggatgcggttc

SEQ ID NO: 70889 - DNA, 26 bp, Artificial Sequence
  Description of Artificial Sequence: Synthetic oligonucleotide
aatgggacggagcggatgcggttcct

SEQ ID NO: 70890 - DNA, 25 bp, Artificial Sequence
  Description of Artificial Sequence: Synthetic oligonucleotide
atgggacggagcggatgcggttcct

SEQ ID NO: 70891 - DNA, 24 bp, Artificial Sequence
  Description of Artificial Sequence: Synthetic oligonucleotide
tgggacggagcggatgcggttcct

SEQ ID NO: 70892 - DNA, 23 bp, Artificial Sequence
  Description of Artificial Sequence: Synthetic oligonucleotide
gggacggagcggatgcggttcct

SEQ ID NO: 70893 - DNA, 23 bp, Artificial Sequence
  Description of Artificial Sequence: Synthetic oligonucleotide
ggacggagcggatgcggttcctg

SEQ ID NO: 70894 - DNA, 24 bp, Artificial Sequence
  Description of Artificial Sequence: Synthetic oligonucleotide
gacggagcggatgcggttcctgga

SEQ ID NO: 70895 - DNA, 25 bp, Artificial Sequence
  Description of Artificial Sequence: Synthetic oligonucleotide
acggagcggatgcggttcctggaca

SEQ ID NO: 70896 - DNA, 24 bp, Artificial Sequence
  Description of Artificial Sequence: Synthetic oligonucleotide
cggagcggatgcggttcctggaca

SEQ ID NO: 70897 - DNA, 27 bp, Artificial Sequence
  Description of Artificial Sequence: Synthetic oligonucleotide
ggagcggatgcggttcctggacagata

SEQ ID NO: 70898 - DNA, 27 bp, Artificial Sequence
  Description of Artificial Sequence: Synthetic oligonucleotide
gagcggatgcggttcctggacagatac

SEQ ID NO: 70899 - DNA, 29 bp, Artificial Sequence
  Description of Artificial Sequence: Synthetic oligonucleotide
agcggatgcggttcctggacagatacttc

SEQ ID NO: 70900 - DNA, 28 bp, Artificial Sequence
  Description of Artificial Sequence: Synthetic oligonucleotide
gcggatgcggttcctggacagatacttc

SEQ ID NO: 70901 - DNA, 33 bp, Artificial Sequence
  Description of Artificial Sequence: Synthetic oligonucleotide
cggatgcggttcctggacagatacttctataac

SEQ ID NO: 70902 - DNA, 33 bp, Artificial Sequence
  Description of Artificial Sequence: Synthetic oligonucleotide
ggatgcggttcctggacagatacttctataacc

SEQ ID NO: 70903 - DNA, 35 bp, Artificial Sequence
  Description of Artificial Sequence: Synthetic oligonucleotide
gatgcggttcctggacagatacttctataaccaag

SEQ ID NO: 70904 - DNA, 36 bp, Artificial Sequence
  Description of Artificial Sequence: Synthetic oligonucleotide
atgcggttcctggacagatacttctataaccaagag

SEQ ID NO: 70905 - DNA, 31 bp, Artificial Sequence
  Description of Artificial Sequence: Synthetic oligonucleotide
gacacctactgcagacacaactacgggattg

SEQ ID NO: 70906 - DNA, 31 bp, Artificial Sequence
  Description of Artificial Sequence: Synthetic oligonucleotide
acacctactgcagacacaactacgggattgg

SEQ ID NO: 70907 - DNA, 30 bp, Artificial Sequence
  Description of Artificial Sequence: Synthetic oligonucleotide
cacctactgcagacacaactacgggattgg

SEQ ID NO: 70908 - DNA, 31 bp, Artificial Sequence
  Description of Artificial Sequence: Synthetic oligonucleotide
acctactgcagacacaactacgggattggtg

SEQ ID NO: 70909 - DNA, 30 bp, Artificial Sequence
  Description of Artificial Sequence: Synthetic oligonucleotide
cctactgcagacacaactacgggattggtg

SEQ ID NO: 70910 - DNA, 31 bp, Artificial Sequence
  Description of Artificial Sequence: Synthetic oligonucleotide
ctactgcagacacaactacgggattggtgag

SEQ ID NO: 70911 - DNA, 32 bp, Artificial Sequence
  Description of Artificial Sequence: Synthetic oligonucleotide
tactgcagacacaactacgggattggtgagag

SEQ ID NO: 70912 - DNA, 31 bp, Artificial Sequence
  Description of Artificial Sequence: Synthetic oligonucleotide
actgcagacacaactacgggattggtgagag

SEQ ID NO: 70913 - DNA, 30 bp, Artificial Sequence
  Description of Artificial Sequence: Synthetic oligonucleotide
ctgcagacacaactacgggattggtgagag

SEQ ID NO: 70914 - DNA, 30 bp, Artificial Sequence
  Description of Artificial Sequence: Synthetic oligonucleotide
tgcagacacaactacgggattggtgagagc

SEQ ID NO: 70915 - DNA, 29 bp, Artificial Sequence
  Description of Artificial Sequence: Synthetic oligonucleotide
gcagacacaactacgggattggtgagagc

SEQ ID NO: 70916 - DNA, 31 bp, Artificial Sequence
  Description of Artificial Sequence: Synthetic oligonucleotide
cagacacaactacgggattggtgagagcttc

SEQ ID NO: 70917 - DNA, 32 bp, Artificial Sequence
  Description of Artificial Sequence: Synthetic oligonucleotide
agacacaactacgggattggtgagagcttcac

SEQ ID NO: 70918 - DNA, 31 bp, Artificial Sequence
  Description of Artificial Sequence: Synthetic oligonucleotide
gacacaactacgggattggtgagagcttcac

SEQ ID NO: 70919 - DNA, 32 bp, Artificial Sequence
  Description of Artificial Sequence: Synthetic oligonucleotide
acacaactacgggattggtgagagcttcacag

SEQ ID NO: 70920 - DNA, 31 bp, Artificial Sequence
  Description of Artificial Sequence: Synthetic oligonucleotide
cacaactacgggattggtgagagcttcacag

SEQ ID NO: 70921 - DNA, 32 bp, Artificial Sequence
  Description of Artificial Sequence: Synthetic oligonucleotide
acaactacgggattggtgagagcttcacagtg

SEQ ID NO: 70922 - DNA, 31 bp, Artificial Sequence
  Description of Artificial Sequence: Synthetic oligonucleotide
caactacgggattggtgagagcttcacagtg

SEQ ID NO: 70923 - DNA, 31 bp, Artificial Sequence
  Description of Artificial Sequence: Synthetic oligonucleotide
aactacgggattggtgagagcttcacagtgc

SEQ ID NO: 70924 - DNA, 30 bp, Artificial Sequence
  Description of Artificial Sequence: Synthetic oligonucleotide
actacgggattggtgagagcttcacagtgc

SEQ ID NO: 70925 - DNA, 29 bp, Artificial Sequence
  Description of Artificial Sequence: Synthetic oligonucleotide
ctacgggattggtgagagcttcacagtgc

SEQ ID NO: 70926 - DNA, 30 bp, Artificial Sequence
  Description of Artificial Sequence: Synthetic oligonucleotide
tacgggattggtgagagcttcacagtgcag

SEQ ID NO: 70927 - DNA, 29 bp, Artificial Sequence
  Description of Artificial Sequence: Synthetic oligonucleotide
acgggattggtgagagcttcacagtgcag

SEQ ID NO: 70928 - DNA, 28 bp, Artificial Sequence
  Description of Artificial Sequence: Synthetic oligonucleotide
cgggattggtgagagcttcacagtgcag

SEQ ID NO: 70929 - DNA, 28 bp, Artificial Sequence
  Description of Artificial Sequence: Synthetic oligonucleotide
gggattggtgagagcttcacagtgcagc

SEQ ID NO: 70930 - DNA, 28 bp, Artificial Sequence
  Description of Artificial Sequence: Synthetic oligonucleotide
ggattggtgagagcttcacagtgcagcg

SEQ ID NO: 70931 - DNA, 28 bp, Artificial Sequence
  Description of Artificial Sequence: Synthetic oligonucleotide
gattggtgagagcttcacagtgcagcgg

SEQ ID NO: 70932 - DNA, 28 bp, Artificial Sequence
  Description of Artificial Sequence: Synthetic oligonucleotide
attggtgagagcttcacagtgcagcggc

SEQ ID NO: 70933 - DNA, 31 bp, Artificial Sequence
  Description of Artificial Sequence: Synthetic oligonucleotide
gaacagccagaaggacttcctggaagacaag

SEQ ID NO: 70934 - DNA, 31 bp, Artificial Sequence
  Description of Artificial Sequence: Synthetic oligonucleotide
aacagccagaaggacttcctggaagacaagc

SEQ ID NO: 70935 - DNA, 30 bp, Artificial Sequence
  Description of Artificial Sequence: Synthetic oligonucleotide
acagccagaaggacttcctggaagacaagc

SEQ ID NO: 70936 - DNA, 29 bp, Artificial Sequence
  Description of Artificial Sequence: Synthetic oligonucleotide
cagccagaaggacttcctggaagacaagc

SEQ ID NO: 70937 - DNA, 29 bp, Artificial Sequence
  Description of Artificial Sequence: Synthetic oligonucleotide
agccagaaggacttcctggaagacaagcg

SEQ ID NO: 70938 - DNA, 28 bp, Artificial Sequence
  Description of Artificial Sequence: Synthetic oligonucleotide
gccagaaggacttcctggaagacaagcg

SEQ ID NO: 70939 - DNA, 28 bp, Artificial Sequence
  Description of Artificial Sequence: Synthetic oligonucleotide
ccagaaggacttcctggaagacaagcgg

SEQ ID NO: 70940 - DNA, 28 bp, Artificial Sequence
  Description of Artificial Sequence: Synthetic oligonucleotide
cagaaggacttcctggaagacaagcggg

SEQ ID NO: 70941 - DNA, 28 bp, Artificial Sequence
  Description of Artificial Sequence: Synthetic oligonucleotide
agaaggacttcctggaagacaagcgggc

SEQ ID NO: 70942 - DNA, 27 bp, Artificial Sequence
  Description of Artificial Sequence: Synthetic oligonucleotide
gaaggacttcctggaagacaagcgggc

SEQ ID NO: 70943 - DNA, 27 bp, Artificial Sequence
  Description of Artificial Sequence: Synthetic oligonucleotide
aaggacttcctggaagacaagcgggcc

SEQ ID NO: 70944 - DNA, 26 bp, Artificial Sequence
  Description of Artificial Sequence: Synthetic oligonucleotide
aggacttcctggaagacaagcgggcc

SEQ ID NO: 70945 - DNA, 25 bp, Artificial Sequence
  Description of Artificial Sequence: Synthetic oligonucleotide
ggacttcctggaagacaagcgggcc

SEQ ID NO: 70946 - DNA, 25 bp, Artificial Sequence
  Description of Artificial Sequence: Synthetic oligonucleotide
gacttcctggaagacaagcgggccg

SEQ ID NO: 70947 - DNA, 25 bp, Artificial Sequence
  Description of Artificial Sequence: Synthetic oligonucleotide
acttcctggaagacaagcgggccgc

SEQ ID NO: 70948 - DNA, 24 bp, Artificial Sequence
  Description of Artificial Sequence: Synthetic oligonucleotide
cttcctggaagacaagcgggccgc

SEQ ID NO: 70949 - DNA, 24 bp, Artificial Sequence
  Description of Artificial Sequence: Synthetic oligonucleotide
ttcctggaagacaagcgggccgcg

SEQ ID NO: 70950 - DNA, 21 bp, Artificial Sequence
  Description of Artificial Sequence: Synthetic oligonucleotide
ggcggtgacggagctggggca

SEQ ID NO: 70951 - DNA, 21 bp, Artificial Sequence
  Description of Artificial Sequence: Synthetic oligonucleotide
gcggtgacggagctggggcag

SEQ ID NO: 70952 - DNA, 21 bp, Artificial Sequence
  Description of Artificial Sequence: Synthetic oligonucleotide
cggtgacggagctggggcagc

SEQ ID NO: 70953 - DNA, 22 bp, Artificial Sequence
  Description of Artificial Sequence: Synthetic oligonucleotide
ggtgacggagctggggcagcct

SEQ ID NO: 70954 - DNA, 24 bp, Artificial Sequence
  Description of Artificial Sequence: Synthetic oligonucleotide
gtgacggagctggggcagcctgat

SEQ ID NO: 70955 - DNA, 25 bp, Artificial Sequence
  Description of Artificial Sequence: Synthetic oligonucleotide
tgacggagctggggcagcctgatga

SEQ ID NO: 70956 - DNA, 24 bp, Artificial Sequence
  Description of Artificial Sequence: Synthetic oligonucleotide
gacggagctggggcagcctgatga

SEQ ID NO: 70957 - DNA, 24 bp, Artificial Sequence
  Description of Artificial Sequence: Synthetic oligonucleotide
acggagctggggcagcctgatgag

SEQ ID NO: 70958 - DNA, 23 bp, Artificial Sequence
  Description of Artificial Sequence: Synthetic oligonucleotide
cggagctggggcagcctgatgag

SEQ ID NO: 70959 - DNA, 24 bp, Artificial Sequence
  Description of Artificial Sequence: Synthetic oligonucleotide
ggagctggggcagcctgatgagga

SEQ ID NO: 70960 - DNA, 26 bp, Artificial Sequence
  Description of Artificial Sequence: Synthetic oligonucleotide
gagctggggcagcctgatgaggagta

SEQ ID NO: 70961 - DNA, 27 bp, Artificial Sequence
  Description of Artificial Sequence: Synthetic oligonucleotide
agctggggcagcctgatgaggagtact

SEQ ID NO: 70962 - DNA, 26 bp, Artificial Sequence
  Description of Artificial Sequence: Synthetic oligonucleotide
gctggggcagcctgatgaggagtact

SEQ ID NO: 70963 - DNA, 26 bp, Artificial Sequence
  Description of Artificial Sequence: Synthetic oligonucleotide
ctggggcagcctgatgaggagtactg

SEQ ID NO: 70964 - DNA, 27 bp, Artificial Sequence
  Description of Artificial Sequence: Synthetic oligonucleotide
tggggcagcctgatgaggagtactgga

SEQ ID NO: 70965 - DNA, 27 bp, Artificial Sequence
  Description of Artificial Sequence: Synthetic oligonucleotide
ggggcagcctgatgaggagtactggaa

SEQ ID NO: 70966 - DNA, 27 bp, Artificial Sequence
  Description of Artificial Sequence: Synthetic oligonucleotide
gggcagcctgatgaggagtactggaac

SEQ ID NO: 70967 - DNA, 28 bp, Artificial Sequence
  Description of Artificial Sequence: Synthetic oligonucleotide
ggcagcctgatgaggagtactggaacag

SEQ ID NO: 70968 - DNA, 28 bp, Artificial Sequence
  Description of Artificial Sequence: Synthetic oligonucleotide
gcagcctgatgaggagtactggaacagc

SEQ ID NO: 70969 - DNA, 28 bp, Artificial Sequence
  Description of Artificial Sequence: Synthetic oligonucleotide
cagcctgatgaggagtactggaacagcc

SEQ ID NO: 70970 - DNA, 29 bp, Artificial Sequence
  Description of Artificial Sequence: Synthetic oligonucleotide
agcctgatgaggagtactggaacagccag

SEQ ID NO: 70971 - DNA, 31 bp, Artificial Sequence
  Description of Artificial Sequence: Synthetic oligonucleotide
cacgtttcttggagtgctctacgtctgagtg

SEQ ID NO: 70972 - DNA, 32 bp, Artificial Sequence
  Description of Artificial Sequence: Synthetic oligonucleotide
acgtttcttggagtgctctacgtctgagtgtc

SEQ ID NO: 70973 - DNA, 31 bp, Artificial Sequence
  Description of Artificial Sequence: Synthetic oligonucleotide
cgtttcttggagtgctctacgtctgagtgtc

SEQ ID NO: 70974 - DNA, 35 bp, Artificial Sequence
  Description of Artificial Sequence: Synthetic oligonucleotide
gtttcttggagtgctctacgtctgagtgtcatttc

SEQ ID NO: 70975 - DNA, 37 bp, Artificial Sequence
  Description of Artificial Sequence: Synthetic oligonucleotide
tttcttggagtgctctacgtctgagtgtcatttcttc

SEQ ID NO: 70976 - DNA, 36 bp, Artificial Sequence
  Description of Artificial Sequence: Synthetic oligonucleotide
ttcttggagtgctctacgtctgagtgtcatttcttc

SEQ ID NO: 70977 - DNA, 35 bp, Artificial Sequence
  Description of Artificial Sequence: Synthetic oligonucleotide
tcttggagtgctctacgtctgagtgtcatttcttc

SEQ ID NO: 70978 - DNA, 34 bp, Artificial Sequence
  Description of Artificial Sequence: Synthetic oligonucleotide
cttggagtgctctacgtctgagtgtcatttcttc

SEQ ID NO: 70979 - DNA, 37 bp, Artificial Sequence
  Description of Artificial Sequence: Synthetic oligonucleotide
ttggagtgctctacgtctgagtgtcatttcttcaatg

SEQ ID NO: 70980 - DNA, 36 bp, Artificial Sequence
  Description of Artificial Sequence: Synthetic oligonucleotide
tggagtgctctacgtctgagtgtcatttcttcaatg

SEQ ID NO: 70981 - DNA, 35 bp, Artificial Sequence
  Description of Artificial Sequence: Synthetic oligonucleotide
ggagtgctctacgtctgagtgtcatttcttcaatg

SEQ ID NO: 70982 - DNA, 35 bp, Artificial Sequence
  Description of Artificial Sequence: Synthetic oligonucleotide
gagtgctctacgtctgagtgtcatttcttcaatgg

SEQ ID NO: 70983 - DNA, 35 bp, Artificial Sequence
  Description of Artificial Sequence: Synthetic oligonucleotide
agtgctctacgtctgagtgtcatttcttcaatggg

SEQ ID NO: 70984 - DNA, 34 bp, Artificial Sequence
  Description of Artificial Sequence: Synthetic oligonucleotide
gtgctctacgtctgagtgtcatttcttcaatggg

SEQ ID NO: 70985 - DNA, 35 bp, Artificial Sequence
  Description of Artificial Sequence: Synthetic oligonucleotide
tgctctacgtctgagtgtcatttcttcaatgggac

SEQ ID NO: 70986 - DNA, 34 bp, Artificial Sequence
  Description of Artificial Sequence: Synthetic oligonucleotide
gctctacgtctgagtgtcatttcttcaatgggac

SEQ ID NO: 70987 - DNA, 29 bp, Artificial Sequence
  Description of Artificial Sequence: Synthetic oligonucleotide
aggagcactggaacagccagaaggacttc

SEQ ID NO: 70988 - DNA, 27 bp, Artificial Sequence
  Description of Artificial Sequence: Synthetic oligonucleotide
gtggtgtccacgggcctgatccacaat

SEQ ID NO: 70989 - DNA, 27 bp, Artificial Sequence
  Description of Artificial Sequence: Synthetic oligonucleotide
tggtgtccacgggcctgatccacaatg

SEQ ID NO: 70990 - DNA, 26 bp, Artificial Sequence
  Description of Artificial Sequence: Synthetic oligonucleotide
ggtgtccacgggcctgatccacaatg

SEQ ID NO: 70991 - DNA, 27 bp, Artificial Sequence
  Description of Artificial Sequence: Synthetic oligonucleotide
gtgtccacgggcctgatccacaatgga

SEQ ID NO: 70992 - DNA, 27 bp, Artificial Sequence
  Description of Artificial Sequence: Synthetic oligonucleotide
tgtccacgggcctgatccacaatggag

SEQ ID NO: 70993 - DNA, 27 bp, Artificial Sequence
  Description of Artificial Sequence: Synthetic oligonucleotide
gtccacgggcctgatccacaatggaga

SEQ ID NO: 70994 - DNA, 27 bp, Artificial Sequence
  Description of Artificial Sequence: Synthetic oligonucleotide
tccacgggcctgatccacaatggagac

SEQ ID NO: 70995 - DNA, 27 bp, Artificial Sequence
  Description of Artificial Sequence: Synthetic oligonucleotide
ccacgggcctgatccacaatggagact

SEQ ID NO: 70996 - DNA, 27 bp, Artificial Sequence
  Description of Artificial Sequence: Synthetic oligonucleotide
cacgggcctgatccacaatggagactg

SEQ ID NO: 70997 - DNA, 27 bp, Artificial Sequence
  Description of Artificial Sequence: Synthetic oligonucleotide
acgggcctgatccacaatggagactgg

SEQ ID NO: 70998 - DNA, 27 bp, Artificial Sequence
  Description of Artificial Sequence: Synthetic oligonucleotide
cgggcctgatccacaatggagactgga

SEQ ID NO: 70999 - DNA, 27 bp, Artificial Sequence
  Description of Artificial Sequence: Synthetic oligonucleotide
gggcctgatccacaatggagactggac

SEQ ID NO: 71000 - DNA, 31 bp, Artificial Sequence
  Description of Artificial Sequence: Synthetic oligonucleotide
gcggtggacacctattgcagacacaactatg

SEQ ID NO: 71001 - DNA, 31 bp, Artificial Sequence
  Description of Artificial Sequence: Synthetic oligonucleotide
cggtggacacctattgcagacacaactatgg

SEQ ID NO: 71002 - DNA, 31 bp, Artificial Sequence
  Description of Artificial Sequence: Synthetic oligonucleotide
ggtggacacctattgcagacacaactatggg

SEQ ID NO: 71003 - DNA, 31 bp, Artificial Sequence
  Description of Artificial Sequence: Synthetic oligonucleotide
gtggacacctattgcagacacaactatgggg

SEQ ID NO: 71004 - DNA, 31 bp, Artificial Sequence
  Description of Artificial Sequence: Synthetic oligonucleotide
tggacacctattgcagacacaactatggggc

SEQ ID NO: 71005 - DNA, 30 bp, Artificial Sequence
  Description of Artificial Sequence: Synthetic oligonucleotide
ggacacctattgcagacacaactatggggc

SEQ ID NO: 71006 - DNA, 31 bp, Artificial Sequence
  Description of Artificial Sequence: Synthetic oligonucleotide
gacacctattgcagacacaactatggggctg

SEQ ID NO: 71007 - DNA, 32 bp, Artificial Sequence
  Description of Artificial Sequence: Synthetic oligonucleotide
acacctattgcagacacaactatggggctgtg

SEQ ID NO: 71008 - DNA, 31 bp, Artificial Sequence
  Description of Artificial Sequence: Synthetic oligonucleotide
cacctattgcagacacaactatggggctgtg

SEQ ID NO: 71009 - DNA, 31 bp, Artificial Sequence
  Description of Artificial Sequence: Synthetic oligonucleotide
acctattgcagacacaactatggggctgtgg

SEQ ID NO: 71010 - DNA, 30 bp, Artificial Sequence
  Description of Artificial Sequence: Synthetic oligonucleotide
cctattgcagacacaactatggggctgtgg

SEQ ID NO: 71011 - DNA, 31 bp, Artificial Sequence
  Description of Artificial Sequence: Synthetic oligonucleotide
ctattgcagacacaactatggggctgtggag

SEQ ID NO: 71012 - DNA, 32 bp, Artificial Sequence
  Description of Artificial Sequence: Synthetic oligonucleotide
tattgcagacacaactatggggctgtggagag

SEQ ID NO: 71013 - DNA, 31 bp, Artificial Sequence
  Description of Artificial Sequence: Synthetic oligonucleotide
attgcagacacaactatggggctgtggagag

SEQ ID NO: 71014 - DNA, 30 bp, Artificial Sequence
  Description of Artificial Sequence: Synthetic oligonucleotide
ttgcagacacaactatggggctgtggagag

SEQ ID NO: 71015 - DNA, 29 bp, Artificial Sequence
  Description of Artificial Sequence: Synthetic oligonucleotide
tgcagacacaactatggggctgtggagag

SEQ ID NO: 71016 - DNA, 28 bp, Artificial Sequence
  Description of Artificial Sequence: Synthetic oligonucleotide
gcagacacaactatggggctgtggagag

SEQ ID NO: 71017 - DNA, 28 bp, Artificial Sequence
  Description of Artificial Sequence: Synthetic oligonucleotide
cagacacaactatggggctgtggagagc

SEQ ID NO: 71018 - DNA, 30 bp, Artificial Sequence
  Description of Artificial Sequence: Synthetic oligonucleotide
agacacaactatggggctgtggagagcttc

SEQ ID NO: 71019 - DNA, 29 bp, Artificial Sequence
  Description of Artificial Sequence: Synthetic oligonucleotide
gacacaactatggggctgtggagagcttc

SEQ ID NO: 71020 - DNA, 30 bp, Artificial Sequence
  Description of Artificial Sequence: Synthetic oligonucleotide
acacaactatggggctgtggagagcttcac

SEQ ID NO: 71021 - DNA, 29 bp, Artificial Sequence
  Description of Artificial Sequence: Synthetic oligonucleotide
cacaactatggggctgtggagagcttcac

SEQ ID NO: 71022 - DNA, 30 bp, Artificial Sequence
  Description of Artificial Sequence: Synthetic oligonucleotide
acaactatggggctgtggagagcttcacag

SEQ ID NO: 71023 - DNA, 29 bp, Artificial Sequence
  Description of Artificial Sequence: Synthetic oligonucleotide
caactatggggctgtggagagcttcacag

SEQ ID NO: 71024 - DNA, 30 bp, Artificial Sequence
  Description of Artificial Sequence: Synthetic oligonucleotide
aactatggggctgtggagagcttcacagtg

SEQ ID NO: 71025 - DNA, 29 bp, Artificial Sequence
  Description of Artificial Sequence: Synthetic oligonucleotide
actatggggctgtggagagcttcacagtg

SEQ ID NO: 71026 - DNA, 28 bp, Artificial Sequence
  Description of Artificial Sequence: Synthetic oligonucleotide
ctatggggctgtggagagcttcacagtg

SEQ ID NO: 71027 - DNA, 28 bp, Artificial Sequence
  Description of Artificial Sequence: Synthetic oligonucleotide
tatggggctgtggagagcttcacagtgc

SEQ ID NO: 71028 - DNA, 27 bp, Artificial Sequence
  Description of Artificial Sequence: Synthetic oligonucleotide
atggggctgtggagagcttcacagtgc

SEQ ID NO: 71029 - DNA, 27 bp, Artificial Sequence
  Description of Artificial Sequence: Synthetic oligonucleotide
tggggctgtggagagcttcacagtgca

SEQ ID NO: 71030 - DNA, 26 bp, Artificial Sequence
  Description of Artificial Sequence: Synthetic oligonucleotide
agctcctgcgcttcgacagcgacgta

SEQ ID NO: 71031 - DNA, 25 bp, Artificial Sequence
  Description of Artificial Sequence: Synthetic oligonucleotide
gctcctgcgcttcgacagcgacgta

SEQ ID NO: 71032 - DNA, 25 bp, Artificial Sequence
  Description of Artificial Sequence: Synthetic oligonucleotide
ctcctgcgcttcgacagcgacgtag

SEQ ID NO: 71033 - DNA, 25 bp, Artificial Sequence
  Description of Artificial Sequence: Synthetic oligonucleotide
tcctgcgcttcgacagcgacgtagg

SEQ ID NO: 71034 - DNA, 24 bp, Artificial Sequence
  Description of Artificial Sequence: Synthetic oligonucleotide
cctgcgcttcgacagcgacgtagg

SEQ ID NO: 71035 - DNA, 24 bp, Artificial Sequence
  Description of Artificial Sequence: Synthetic oligonucleotide
ctgcgcttcgacagcgacgtaggg

SEQ ID NO: 71036 - DNA, 26 bp, Artificial Sequence
  Description of Artificial Sequence: Synthetic oligonucleotide
cgcttcgacagcgacgtaggggagtt

SEQ ID NO: 71037 - DNA, 26 bp, Artificial Sequence
  Description of Artificial Sequence: Synthetic oligonucleotide
gcttcgacagcgacgtaggggagttc

SEQ ID NO: 71038 - DNA, 26 bp, Artificial Sequence
  Description of Artificial Sequence: Synthetic oligonucleotide
cttcgacagcgacgtaggggagttcc

SEQ ID NO: 71039 - DNA, 26 bp, Artificial Sequence
  Description of Artificial Sequence: Synthetic oligonucleotide
ttcgacagcgacgtaggggagttccg

SEQ ID NO: 71040 - DNA, 25 bp, Artificial Sequence
  Description of Artificial Sequence: Synthetic oligonucleotide
tcgacagcgacgtaggggagttccg

SEQ ID NO: 71041 - DNA, 24 bp, Artificial Sequence
  Description of Artificial Sequence: Synthetic oligonucleotide
cgacagcgacgtaggggagttccg

SEQ ID NO: 71042 - DNA, 24 bp, Artificial Sequence
  Description of Artificial Sequence: Synthetic oligonucleotide
gacagcgacgtaggggagttccgg

SEQ ID NO: 71043 - DNA, 24 bp, Artificial Sequence
  Description of Artificial Sequence: Synthetic oligonucleotide
acagcgacgtaggggagttccggg

SEQ ID NO: 71044 - DNA, 23 bp, Artificial Sequence
  Description of Artificial Sequence: Synthetic oligonucleotide
cagcgacgtaggggagttccggg

SEQ ID NO: 71045 - DNA, 23 bp, Artificial Sequence
  Description of Artificial Sequence: Synthetic oligonucleotide
agcgacgtaggggagttccgggc

SEQ ID NO: 71046 - DNA, 22 bp, Artificial Sequence
  Description of Artificial Sequence: Synthetic oligonucleotide
gcgacgtaggggagttccgggc

SEQ ID NO: 71047 - DNA, 22 bp, Artificial Sequence
  Description of Artificial Sequence: Synthetic oligonucleotide
cgacgtaggggagttccgggcg

SEQ ID NO: 71048 - DNA, 23 bp, Artificial Sequence
  Description of Artificial Sequence: Synthetic oligonucleotide
gacgtaggggagttccgggcggt

SEQ ID NO: 71049 - DNA, 24 bp, Artificial Sequence
  Description of Artificial Sequence: Synthetic oligonucleotide
acgtaggggagttccgggcggtga

SEQ ID NO: 71050 - DNA, 23 bp, Artificial Sequence
  Description of Artificial Sequence: Synthetic oligonucleotide
cgtaggggagttccgggcggtga

SEQ ID NO: 71051 - DNA, 23 bp, Artificial Sequence
  Description of Artificial Sequence: Synthetic oligonucleotide
gtaggggagttccgggcggtgac

SEQ ID NO: 71052 - DNA, 23 bp, Artificial Sequence
  Description of Artificial Sequence: Synthetic oligonucleotide
taggggagttccgggcggtgacg

SEQ ID NO: 71053 - DNA, 22 bp, Artificial Sequence
  Description of Artificial Sequence: Synthetic oligonucleotide
aggggagttccgggcggtgacg

SEQ ID NO: 71054 - DNA, 32 bp, Artificial Sequence
  Description of Artificial Sequence: Synthetic oligonucleotide
tggagagacacttccataaccaggaggagttc

SEQ ID NO: 71055 - DNA, 31 bp, Artificial Sequence
  Description of Artificial Sequence: Synthetic oligonucleotide
ggagagacacttccataaccaggaggagttc

SEQ ID NO: 71056 - DNA, 31 bp, Artificial Sequence
  Description of Artificial Sequence: Synthetic oligonucleotide
gagagacacttccataaccaggaggagttcc

SEQ ID NO: 71057 - DNA, 32 bp, Artificial Sequence
  Description of Artificial Sequence: Synthetic oligonucleotide
agagacacttccataaccaggaggagttcctg

SEQ ID NO: 71058 - DNA, 31 bp, Artificial Sequence
  Description of Artificial Sequence: Synthetic oligonucleotide
gagacacttccataaccaggaggagttcctg

SEQ ID NO: 71059 - DNA, 31 bp, Artificial Sequence
  Description of Artificial Sequence: Synthetic oligonucleotide
agacacttccataaccaggaggagttcctgc

SEQ ID NO: 71060 - DNA, 30 bp, Artificial Sequence
  Description of Artificial Sequence: Synthetic oligonucleotide
gacacttccataaccaggaggagttcctgc

SEQ ID NO: 71061 - DNA, 30 bp, Artificial Sequence
  Description of Artificial Sequence: Synthetic oligonucleotide
acacttccataaccaggaggagttcctgcg

SEQ ID NO: 71062 - DNA, 29 bp, Artificial Sequence
  Description of Artificial Sequence: Synthetic oligonucleotide
cacttccataaccaggaggagttcctgcg

SEQ ID NO: 71063 - DNA, 23 bp, Artificial Sequence
  Description of Artificial Sequence: Synthetic oligonucleotide
agtcgggggctttgtgctgggcc

SEQ ID NO: 71064 - DNA, 27 bp, Artificial Sequence
  Description of Artificial Sequence: Synthetic oligonucleotide
ctggaacagccagaaggacatcctggg

SEQ ID NO: 71065 - DNA, 28 bp, Artificial Sequence
  Description of Artificial Sequence: Synthetic oligonucleotide
tggaacagccagaaggacatcctgggag

SEQ ID NO: 71066 - DNA, 27 bp, Artificial Sequence
  Description of Artificial Sequence: Synthetic oligonucleotide
ggaacagccagaaggacatcctgggag

SEQ ID NO: 71067 - DNA, 28 bp, Artificial Sequence
  Description of Artificial Sequence: Synthetic oligonucleotide
gaacagccagaaggacatcctgggagac

SEQ ID NO: 71068 - DNA, 29 bp, Artificial Sequence
  Description of Artificial Sequence: Synthetic oligonucleotide
aacagccagaaggacatcctgggagacag

SEQ ID NO: 71069 - DNA, 28 bp, Artificial Sequence
  Description of Artificial Sequence: Synthetic oligonucleotide
acagccagaaggacatcctgggagacag

SEQ ID NO: 71070 - DNA, 27 bp, Artificial Sequence
  Description of Artificial Sequence: Synthetic oligonucleotide
cagccagaaggacatcctgggagacag

SEQ ID NO: 71071 - DNA, 27 bp, Artificial Sequence
  Description of Artificial Sequence: Synthetic oligonucleotide
agccagaaggacatcctgggagacagg

SEQ ID NO: 71072 - DNA, 26 bp, Artificial Sequence
  Description of Artificial Sequence: Synthetic oligonucleotide
gccagaaggacatcctgggagacagg

SEQ ID NO: 71073 - DNA, 26 bp, Artificial Sequence
  Description of Artificial Sequence: Synthetic oligonucleotide
ccagaaggacatcctgggagacaggc

SEQ ID NO: 71074 - DNA, 26 bp, Artificial Sequence
  Description of Artificial Sequence: Synthetic oligonucleotide
cagaaggacatcctgggagacaggcg

SEQ ID NO: 71075 - DNA, 26 bp, Artificial Sequence
  Description of Artificial Sequence: Synthetic oligonucleotide
agaaggacatcctgggagacaggcgc

SEQ ID NO: 71076 - DNA, 25 bp, Artificial Sequence
  Description of Artificial Sequence: Synthetic oligonucleotide
gaaggacatcctgggagacaggcgc

SEQ ID NO: 71077 - DNA, 25 bp, Artificial Sequence
  Description of Artificial Sequence: Synthetic oligonucleotide
aaggacatcctgggagacaggcgcg

SEQ ID NO: 71078 - DNA, 24 bp, Artificial Sequence
  Description of Artificial Sequence: Synthetic oligonucleotide
aggacatcctgggagacaggcgcg

SEQ ID NO: 71079 - DNA, 23 bp, Artificial Sequence
  Description of Artificial Sequence: Synthetic oligonucleotide
ggacatcctgggagacaggcgcg

SEQ ID NO: 71080 - DNA, 23 bp, Artificial Sequence
  Description of Artificial Sequence: Synthetic oligonucleotide
gacatcctgggagacaggcgcgc

SEQ ID NO: 71081 - DNA, 23 bp, Artificial Sequence
  Description of Artificial Sequence: Synthetic oligonucleotide
acatcctgggagacaggcgcgcc

SEQ ID NO: 71082 - DNA, 22 bp, Artificial Sequence
  Description of Artificial Sequence: Synthetic oligonucleotide
catcctgggagacaggcgcgcc

SEQ ID NO: 71083 - DNA, 22 bp, Artificial Sequence
  Description of Artificial Sequence: Synthetic oligonucleotide
atcctgggagacaggcgcgccg

SEQ ID NO: 71084 - DNA, 21 bp, Artificial Sequence
  Description of Artificial Sequence: Synthetic oligonucleotide
tcctgggagacaggcgcgccg

SEQ ID NO: 71085 - DNA, 20 bp, Artificial Sequence
  Description of Artificial Sequence: Synthetic oligonucleotide
cctgggagacaggcgcgccg

SEQ ID NO: 71086 - DNA, 20 bp, Artificial Sequence
  Description of Artificial Sequence: Synthetic oligonucleotide
ctgggagacaggcgcgccgc

SEQ ID NO: 71087 - DNA, 20 bp, Artificial Sequence
  Description of Artificial Sequence: Synthetic oligonucleotide
tgggagacaggcgcgccgcg

SEQ ID NO: 71088 - DNA, 20 bp, Artificial Sequence
  Description of Artificial Sequence: Synthetic oligonucleotide
gggagacaggcgcgccgcgt

SEQ ID NO: 71089 - DNA, 20 bp, Artificial Sequence
  Description of Artificial Sequence: Synthetic oligonucleotide
ggagacaggcgcgccgcggt

SEQ ID NO: 71090 - DNA, 20 bp, Artificial Sequence
  Description of Artificial Sequence: Synthetic oligonucleotide
gagacaggcgcgccgcggtg

SEQ ID NO: 71091 - DNA, 24 bp, Artificial Sequence
  Description of Artificial Sequence: Synthetic oligonucleotide
gagcgggtgcggttcctggagaga

SEQ ID NO: 71092 - DNA, 25 bp, Artificial Sequence
  Description of Artificial Sequence: Synthetic oligonucleotide
agcgggtgcggttcctggagagaca

SEQ ID NO: 71093 - DNA, 24 bp, Artificial Sequence
  Description of Artificial Sequence: Synthetic oligonucleotide
gcgggtgcggttcctggagagaca

SEQ ID NO: 71094 - DNA, 26 bp, Artificial Sequence
  Description of Artificial Sequence: Synthetic oligonucleotide
cgggtgcggttcctggagagacactt

SEQ ID NO: 71095 - DNA, 26 bp, Artificial Sequence
  Description of Artificial Sequence: Synthetic oligonucleotide
gggtgcggttcctggagagacacttc

SEQ ID NO: 71096 - DNA, 27 bp, Artificial Sequence
  Description of Artificial Sequence: Synthetic oligonucleotide
ggtgcggttcctggagagacacttcca

SEQ ID NO: 71097 - DNA, 30 bp, Artificial Sequence
  Description of Artificial Sequence: Synthetic oligonucleotide
gtgcggttcctggagagacacttccataac

SEQ ID NO: 71098 - DNA, 30 bp, Artificial Sequence
  Description of Artificial Sequence: Synthetic oligonucleotide
tgcggttcctggagagacacttccataacc

SEQ ID NO: 71099 - DNA, 29 bp, Artificial Sequence
  Description of Artificial Sequence: Synthetic oligonucleotide
gcggttcctggagagacacttccataacc

SEQ ID NO: 71100 - DNA, 30 bp, Artificial Sequence
  Description of Artificial Sequence: Synthetic oligonucleotide
cggttcctggagagacacttccataaccag

SEQ ID NO: 71101 - DNA, 30 bp, Artificial Sequence
  Description of Artificial Sequence: Synthetic oligonucleotide
ggttcctggagagacacttccataaccagg

SEQ ID NO: 71102 - DNA, 31 bp, Artificial Sequence
  Description of Artificial Sequence: Synthetic oligonucleotide
gttcctggagagacacttccataaccaggag

SEQ ID NO: 71103 - DNA, 31 bp, Artificial Sequence
  Description of Artificial Sequence: Synthetic oligonucleotide
ttcctggagagacacttccataaccaggagg

SEQ ID NO: 71104 - DNA, 30 bp, Artificial Sequence
  Description of Artificial Sequence: Synthetic oligonucleotide
tcctggagagacacttccataaccaggagg

SEQ ID NO: 71105 - DNA, 29 bp, Artificial Sequence
  Description of Artificial Sequence: Synthetic oligonucleotide
cctggagagacacttccataaccaggagg

SEQ ID NO: 71106 - DNA, 27 bp, Artificial Sequence
  Description of Artificial Sequence: Synthetic oligonucleotide
ctccctggaggctcctgcatggcaatt

SEQ ID NO: 71107 - DNA, 27 bp, Artificial Sequence
  Description of Artificial Sequence: Synthetic oligonucleotide
tccctggaggctcctgcatggcaattc

SEQ ID NO: 71108 - DNA, 27 bp, Artificial Sequence
  Description of Artificial Sequence: Synthetic oligonucleotide
ccctggaggctcctgcatggcaattct

SEQ ID NO: 71109 - DNA, 27 bp, Artificial Sequence
  Description of Artificial Sequence: Synthetic oligonucleotide
cctggaggctcctgcatggcaattctg

SEQ ID NO: 71110 - DNA, 28 bp, Artificial Sequence
  Description of Artificial Sequence: Synthetic oligonucleotide
ctggaggctcctgcatggcaattctgac

SEQ ID NO: 71111 - DNA, 29 bp, Artificial Sequence
  Description of Artificial Sequence: Synthetic oligonucleotide
tggaggctcctgcatggcaattctgacag

SEQ ID NO: 71112 - DNA, 28 bp, Artificial Sequence
  Description of Artificial Sequence: Synthetic oligonucleotide
ggaggctcctgcatggcaattctgacag

SEQ ID NO: 71113 - DNA, 29 bp, Artificial Sequence
  Description of Artificial Sequence: Synthetic oligonucleotide
gaggctcctgcatggcaattctgacagtg

SEQ ID NO: 71114 - DNA, 30 bp, Artificial Sequence
  Description of Artificial Sequence: Synthetic oligonucleotide
aggctcctgcatggcaattctgacagtgac

SEQ ID NO: 71115 - DNA, 29 bp, Artificial Sequence
  Description of Artificial Sequence: Synthetic oligonucleotide
ggctcctgcatggcaattctgacagtgac

SEQ ID NO: 71116 - DNA, 30 bp, Artificial Sequence
  Description of Artificial Sequence: Synthetic oligonucleotide
gctcctgcatggcaattctgacagtgacac

SEQ ID NO: 71117 - DNA, 31 bp, Artificial Sequence
  Description of Artificial Sequence: Synthetic oligonucleotide
ctcctgcatggcaattctgacagtgacactg

SEQ ID NO: 71118 - DNA, 33 bp, Artificial Sequence
  Description of Artificial Sequence: Synthetic oligonucleotide
tcctgcatggcaattctgacagtgacactgatg

SEQ ID NO: 71119 - DNA, 32 bp, Artificial Sequence
  Description of Artificial Sequence: Synthetic oligonucleotide
cctgcatggcaattctgacagtgacactgatg

SEQ ID NO: 71120 - DNA, 32 bp, Artificial Sequence
  Description of Artificial Sequence: Synthetic oligonucleotide
ctgcatggcaattctgacagtgacactgatgg

SEQ ID NO: 71121 - DNA, 33 bp, Artificial Sequence
  Description of Artificial Sequence: Synthetic oligonucleotide
tgcatggcaattctgacagtgacactgatggtg

SEQ ID NO: 71122 - DNA, 32 bp, Artificial Sequence
  Description of Artificial Sequence: Synthetic oligonucleotide
gcatggcaattctgacagtgacactgatggtg

SEQ ID NO: 71123 - DNA, 32 bp, Artificial Sequence
  Description of Artificial Sequence: Synthetic oligonucleotide
catggcaattctgacagtgacactgatggtgc

SEQ ID NO: 71124 - DNA, 33 bp, Artificial Sequence
  Description of Artificial Sequence: Synthetic oligonucleotide
atggcaattctgacagtgacactgatggtgctg

SEQ ID NO: 71125 - DNA, 32 bp, Artificial Sequence
  Description of Artificial Sequence: Synthetic oligonucleotide
tggcaattctgacagtgacactgatggtgctg

SEQ ID NO: 71126 - DNA, 31 bp, Artificial Sequence
  Description of Artificial Sequence: Synthetic oligonucleotide
ggcaattctgacagtgacactgatggtgctg

SEQ ID NO: 71127 - DNA, 32 bp, Artificial Sequence
  Description of Artificial Sequence: Synthetic oligonucleotide
gcaattctgacagtgacactgatggtgctgag

SEQ ID NO: 71128 - DNA, 32 bp, Artificial Sequence
  Description of Artificial Sequence: Synthetic oligonucleotide
caattctgacagtgacactgatggtgctgagc

SEQ ID NO: 71129 - DNA, 33 bp, Artificial Sequence
  Description of Artificial Sequence: Synthetic oligonucleotide
aattctgacagtgacactgatggtgctgagctc

SEQ ID NO: 71130 - DNA, 32 bp, Artificial Sequence
  Description of Artificial Sequence: Synthetic oligonucleotide
attctgacagtgacactgatggtgctgagctc

SEQ ID NO: 71131 - DNA, 24 bp, Artificial Sequence
  Description of Artificial Sequence: Synthetic oligonucleotide
cttcgacagcgacgtgggggagct

SEQ ID NO: 71132 - DNA, 24 bp, Artificial Sequence
  Description of Artificial Sequence: Synthetic oligonucleotide
ttcgacagcgacgtgggggagctc

SEQ ID NO: 71133 - DNA, 23 bp, Artificial Sequence
  Description of Artificial Sequence: Synthetic oligonucleotide
tcgacagcgacgtgggggagctc

SEQ ID NO: 71134 - DNA, 22 bp, Artificial Sequence
  Description of Artificial Sequence: Synthetic oligonucleotide
cgacagcgacgtgggggagctc

SEQ ID NO: 71135 - DNA, 22 bp, Artificial Sequence
  Description of Artificial Sequence: Synthetic oligonucleotide
gacagcgacgtgggggagctcc

SEQ ID NO: 71136 - DNA, 22 bp, Artificial Sequence
  Description of Artificial Sequence: Synthetic oligonucleotide
acagcgacgtgggggagctccg

SEQ ID NO: 71137 - DNA, 21 bp, Artificial Sequence
  Description of Artificial Sequence: Synthetic oligonucleotide
cagcgacgtgggggagctccg

SEQ ID NO: 71138 - DNA, 21 bp, Artificial Sequence
  Description of Artificial Sequence: Synthetic oligonucleotide
agcgacgtgggggagctccgg

SEQ ID NO: 71139 - DNA, 20 bp, Artificial Sequence
  Description of Artificial Sequence: Synthetic oligonucleotide
gcgacgtgggggagctccgg

SEQ ID NO: 71140 - DNA, 20 bp, Artificial Sequence
  Description of Artificial Sequence: Synthetic oligonucleotide
cgacgtgggggagctccggg

SEQ ID NO: 71141 - DNA, 20 bp, Artificial Sequence
  Description of Artificial Sequence: Synthetic oligonucleotide
gacgtgggggagctccgggc

SEQ ID NO: 71142 - DNA, 20 bp, Artificial Sequence
  Description of Artificial Sequence: Synthetic oligonucleotide
acgtgggggagctccgggcg

SEQ ID NO: 71143 - DNA, 20 bp, Artificial Sequence
  Description of Artificial Sequence: Synthetic oligonucleotide
cgtgggggagctccgggcgt

SEQ ID NO: 71144 - DNA, 20 bp, Artificial Sequence
  Description of Artificial Sequence: Synthetic oligonucleotide
gtgggggagctccgggcggt

SEQ ID NO: 71145 - DNA, 21 bp, Artificial Sequence
  Description of Artificial Sequence: Synthetic oligonucleotide
tgggggagctccgggcggtga

SEQ ID NO: 71146 - DNA, 20 bp, Artificial Sequence
  Description of Artificial Sequence: Synthetic oligonucleotide
gggggagctccgggcggtga

SEQ ID NO: 71147 - DNA, 20 bp, Artificial Sequence
  Description of Artificial Sequence: Synthetic oligonucleotide
ggggagctccgggcggtgac

SEQ ID NO: 71148 - DNA, 20 bp, Artificial Sequence
  Description of Artificial Sequence: Synthetic oligonucleotide
gggagctccgggcggtgacg

SEQ ID NO: 71149 - DNA, 21 bp, Artificial Sequence
  Description of Artificial Sequence: Synthetic oligonucleotide
ggagctccgggcggtgacgga

SEQ ID NO: 71150 - DNA, 21 bp, Artificial Sequence
  Description of Artificial Sequence: Synthetic oligonucleotide
gagctccgggcggtgacggag

SEQ ID NO: 71151 - DNA, 22 bp, Artificial Sequence
  Description of Artificial Sequence: Synthetic oligonucleotide
agctccgggcggtgacggagct

SEQ ID NO: 71152 - DNA, 21 bp, Artificial Sequence
  Description of Artificial Sequence: Synthetic oligonucleotide
gctccgggcggtgacggagct

SEQ ID NO: 71153 - DNA, 21 bp, Artificial Sequence
  Description of Artificial Sequence: Synthetic oligonucleotide
ctccgggcggtgacggagctg

SEQ ID NO: 71154 - DNA, 28 bp, Artificial Sequence
  Description of Artificial Sequence: Synthetic oligonucleotide
ttcaatgggacggagcgggtgctgttac

SEQ ID NO: 71155 - DNA, 27 bp, Artificial Sequence
  Description of Artificial Sequence: Synthetic oligonucleotide
tcaatgggacggagcgggtgctgttac

SEQ ID NO: 71156 - DNA, 27 bp, Artificial Sequence
  Description of Artificial Sequence: Synthetic oligonucleotide
caatgggacggagcgggtgctgttact

SEQ ID NO: 71157 - DNA, 27 bp, Artificial Sequence
  Description of Artificial Sequence: Synthetic oligonucleotide
aatgggacggagcgggtgctgttactg

SEQ ID NO: 71158 - DNA, 26 bp, Artificial Sequence
  Description of Artificial Sequence: Synthetic oligonucleotide
atgggacggagcgggtgctgttactg

SEQ ID NO: 71159 - DNA, 25 bp, Artificial Sequence
  Description of Artificial Sequence: Synthetic oligonucleotide
tgggacggagcgggtgctgttactg

SEQ ID NO: 71160 - DNA, 24 bp, Artificial Sequence
  Description of Artificial Sequence: Synthetic oligonucleotide
gggacggagcgggtgctgttactg

SEQ ID NO: 71161 - DNA, 25 bp, Artificial Sequence
  Description of Artificial Sequence: Synthetic oligonucleotide
ggacggagcgggtgctgttactgga

SEQ ID NO: 71162 - DNA, 26 bp, Artificial Sequence
  Description of Artificial Sequence: Synthetic oligonucleotide
gacggagcgggtgctgttactggaga

SEQ ID NO: 71163 - DNA, 27 bp, Artificial Sequence
  Description of Artificial Sequence: Synthetic oligonucleotide
acggagcgggtgctgttactggagaga

SEQ ID NO: 71164 - DNA, 26 bp, Artificial Sequence
  Description of Artificial Sequence: Synthetic oligonucleotide
cggagcgggtgctgttactggagaga

SEQ ID NO: 71165 - DNA, 27 bp, Artificial Sequence
  Description of Artificial Sequence: Synthetic oligonucleotide
ggagcgggtgctgttactggagagaca

SEQ ID NO: 71166 - DNA, 27 bp, Artificial Sequence
  Description of Artificial Sequence: Synthetic oligonucleotide
gagcgggtgctgttactggagagacac

SEQ ID NO: 71167 - DNA, 29 bp, Artificial Sequence
  Description of Artificial Sequence: Synthetic oligonucleotide
agcgggtgctgttactggagagacacttc

SEQ ID NO: 71168 - DNA, 28 bp, Artificial Sequence
  Description of Artificial Sequence: Synthetic oligonucleotide
gcgggtgctgttactggagagacacttc

SEQ ID NO: 71169 - DNA, 28 bp, Artificial Sequence
  Description of Artificial Sequence: Synthetic oligonucleotide
cgggtgctgttactggagagacacttcc

SEQ ID NO: 71170 - DNA, 32 bp, Artificial Sequence
  Description of Artificial Sequence: Synthetic oligonucleotide
gggtgctgttactggagagacacttccataac

SEQ ID NO: 71171 - DNA, 32 bp, Artificial Sequence
  Description of Artificial Sequence: Synthetic oligonucleotide
ggtgctgttactggagagacacttccataacc

SEQ ID NO: 71172 - DNA, 33 bp, Artificial Sequence
  Description of Artificial Sequence: Synthetic oligonucleotide
gtgctgttactggagagacacttccataaccag

SEQ ID NO: 71173 - DNA, 33 bp, Artificial Sequence
  Description of Artificial Sequence: Synthetic oligonucleotide
tgctgttactggagagacacttccataaccagg

SEQ ID NO: 71174 - DNA, 32 bp, Artificial Sequence
  Description of Artificial Sequence: Synthetic oligonucleotide
gctgttactggagagacacttccataaccagg

SEQ ID NO: 71175 - DNA, 33 bp, Artificial Sequence
  Description of Artificial Sequence: Synthetic oligonucleotide
ctgttactggagagacacttccataaccaggag

SEQ ID NO: 71176 - DNA, 33 bp, Artificial Sequence
  Description of Artificial Sequence: Synthetic oligonucleotide
tgttactggagagacacttccataaccaggagg

SEQ ID NO: 71177 - DNA, 31 bp, Artificial Sequence
  Description of Artificial Sequence: Synthetic oligonucleotide
gagagacacttccataaccaggaggagttcg

SEQ ID NO: 71178 - DNA, 32 bp, Artificial Sequence
  Description of Artificial Sequence: Synthetic oligonucleotide
agagacacttccataaccaggaggagttcgtg

SEQ ID NO: 71179 - DNA, 31 bp, Artificial Sequence
  Description of Artificial Sequence: Synthetic oligonucleotide
gagacacttccataaccaggaggagttcgtg

SEQ ID NO: 71180 - DNA, 31 bp, Artificial Sequence
  Description of Artificial Sequence: Synthetic oligonucleotide
agacacttccataaccaggaggagttcgtgc

SEQ ID NO: 71181 - DNA, 30 bp, Artificial Sequence
  Description of Artificial Sequence: Synthetic oligonucleotide
gacacttccataaccaggaggagttcgtgc

SEQ ID NO: 71182 - DNA, 30 bp, Artificial Sequence
  Description of Artificial Sequence: Synthetic oligonucleotide
acacttccataaccaggaggagttcgtgcg

SEQ ID NO: 71183 - DNA, 29 bp, Artificial Sequence
  Description of Artificial Sequence: Synthetic oligonucleotide
cacttccataaccaggaggagttcgtgcg

SEQ ID NO: 71184 - DNA, 20 bp, Artificial Sequence
  Description of Artificial Sequence: Synthetic oligonucleotide
ctggggcggcctgtcgccca

SEQ ID NO: 71185 - DNA, 21 bp, Artificial Sequence
  Description of Artificial Sequence: Synthetic oligonucleotide
tggggcggcctgtcgcccagt

SEQ ID NO: 71186 - DNA, 20 bp, Artificial Sequence
  Description of Artificial Sequence: Synthetic oligonucleotide
ggggcggcctgtcgcccagt

SEQ ID NO: 71187 - DNA, 20 bp, Artificial Sequence
  Description of Artificial Sequence: Synthetic oligonucleotide
gggcggcctgtcgcccagtc

SEQ ID NO: 71188 - DNA, 21 bp, Artificial Sequence
  Description of Artificial Sequence: Synthetic oligonucleotide
ggcggcctgtcgcccagtcct

SEQ ID NO: 71189 - DNA, 21 bp, Artificial Sequence
  Description of Artificial Sequence: Synthetic oligonucleotide
gcggcctgtcgcccagtcctg

SEQ ID NO: 71190 - DNA, 23 bp, Artificial Sequence
  Description of Artificial Sequence: Synthetic oligonucleotide
cggcctgtcgcccagtcctggaa

SEQ ID NO: 71191 - DNA, 24 bp, Artificial Sequence
  Description of Artificial Sequence: Synthetic oligonucleotide
ggcctgtcgcccagtcctggaaca

SEQ ID NO: 71192 - DNA, 24 bp, Artificial Sequence
  Description of Artificial Sequence: Synthetic oligonucleotide
gcctgtcgcccagtcctggaacag

SEQ ID NO: 71193 - DNA, 24 bp, Artificial Sequence
  Description of Artificial Sequence: Synthetic oligonucleotide
cctgtcgcccagtcctggaacagc

SEQ ID NO: 71194 - DNA, 25 bp, Artificial Sequence
  Description of Artificial Sequence: Synthetic oligonucleotide
ctgtcgcccagtcctggaacagcca

SEQ ID NO: 71195 - DNA, 27 bp, Artificial Sequence
  Description of Artificial Sequence: Synthetic oligonucleotide
tgtcgcccagtcctggaacagccagaa

SEQ ID NO: 71196 - DNA, 26 bp, Artificial Sequence
  Description of Artificial Sequence: Synthetic oligonucleotide
gtcgcccagtcctggaacagccagaa

SEQ ID NO: 71197 - DNA, 26 bp, Artificial Sequence
  Description of Artificial Sequence: Synthetic oligonucleotide
tcgcccagtcctggaacagccagaag

SEQ ID NO: 71198 - DNA, 25 bp, Artificial Sequence
  Description of Artificial Sequence: Synthetic oligonucleotide
cgcccagtcctggaacagccagaag

SEQ ID NO: 71199 - DNA, 26 bp, Artificial Sequence
  Description of Artificial Sequence: Synthetic oligonucleotide
gcccagtcctggaacagccagaagga

SEQ ID NO: 71200 - DNA, 27 bp, Artificial Sequence
  Description of Artificial Sequence: Synthetic oligonucleotide
cccagtcctggaacagccagaaggact

SEQ ID NO: 71201 - DNA, 28 bp, Artificial Sequence
  Description of Artificial Sequence: Synthetic oligonucleotide
ccagtcctggaacagccagaaggacttc

SEQ ID NO: 71202 - DNA, 28 bp, Artificial Sequence
  Description of Artificial Sequence: Synthetic oligonucleotide
cagtcctggaacagccagaaggacttcc

SEQ ID NO: 71203 - DNA, 38 bp, Artificial Sequence
  Description of Artificial Sequence: Synthetic oligonucleotide
cacgtttcttggagtactctacgtgtgagtgttatttc

SEQ ID NO: 71204 - DNA, 40 bp, Artificial Sequence
  Description of Artificial Sequence: Synthetic oligonucleotide
acgtttcttggagtactctacgtgtgagtgttatttcttc

SEQ ID NO: 71205 - DNA, 39 bp, Artificial Sequence
  Description of Artificial Sequence: Synthetic oligonucleotide
cgtttcttggagtactctacgtgtgagtgttatttcttc

SEQ ID NO: 71206 - DNA, 42 bp, Artificial Sequence
  Description of Artificial Sequence: Synthetic oligonucleotide
gtttcttggagtactctacgtgtgagtgttatttcttcaatg

SEQ ID NO: 71207 - DNA, 42 bp, Artificial Sequence
  Description of Artificial Sequence: Synthetic oligonucleotide
tttcttggagtactctacgtgtgagtgttatttcttcaatgg

SEQ ID NO: 71208 - DNA, 41 bp, Artificial Sequence
  Description of Artificial Sequence: Synthetic oligonucleotide
ttcttggagtactctacgtgtgagtgttatttcttcaatgg

SEQ ID NO: 71209 - DNA, 40 bp, Artificial Sequence
  Description of Artificial Sequence: Synthetic oligonucleotide
tcttggagtactctacgtgtgagtgttatttcttcaatgg

SEQ ID NO: 71210 - DNA, 39 bp, Artificial Sequence
  Description of Artificial Sequence: Synthetic oligonucleotide
cttggagtactctacgtgtgagtgttatttcttcaatgg

SEQ ID NO: 71211 - DNA, 39 bp, Artificial Sequence
  Description of Artificial Sequence: Synthetic oligonucleotide
ttggagtactctacgtgtgagtgttatttcttcaatggg

SEQ ID NO: 71212 - DNA, 38 bp, Artificial Sequence
  Description of Artificial Sequence: Synthetic oligonucleotide
tggagtactctacgtgtgagtgttatttcttcaatggg

SEQ ID NO: 71213 - DNA, 37 bp, Artificial Sequence
  Description of Artificial Sequence: Synthetic oligonucleotide
ggagtactctacgtgtgagtgttatttcttcaatggg

SEQ ID NO: 71214 - DNA, 38 bp, Artificial Sequence
  Description of Artificial Sequence: Synthetic oligonucleotide
gagtactctacgtgtgagtgttatttcttcaatgggac

SEQ ID NO: 71215 - DNA, 38 bp, Artificial Sequence
  Description of Artificial Sequence: Synthetic oligonucleotide
agtactctacgtgtgagtgttatttcttcaatgggacg

SEQ ID NO: 71216 - DNA, 37 bp, Artificial Sequence
  Description of Artificial Sequence: Synthetic oligonucleotide
gtactctacgtgtgagtgttatttcttcaatgggacg

SEQ ID NO: 71217 - DNA, 37 bp, Artificial Sequence
  Description of Artificial Sequence: Synthetic oligonucleotide
tactctacgtgtgagtgttatttcttcaatgggacgg

SEQ ID NO: 71218 - DNA, 36 bp, Artificial Sequence
  Description of Artificial Sequence: Synthetic oligonucleotide
actctacgtgtgagtgttatttcttcaatgggacgg

SEQ ID NO: 71219 - DNA, 35 bp, Artificial Sequence
  Description of Artificial Sequence: Synthetic oligonucleotide
ctctacgtgtgagtgttatttcttcaatgggacgg

SEQ ID NO: 71220 - DNA, 36 bp, Artificial Sequence
  Description of Artificial Sequence: Synthetic oligonucleotide
tctacgtgtgagtgttatttcttcaatgggacggag

SEQ ID NO: 71221 - DNA, 35 bp, Artificial Sequence
  Description of Artificial Sequence: Synthetic oligonucleotide
ctacgtgtgagtgttatttcttcaatgggacggag

SEQ ID NO: 71222 - DNA, 35 bp, Artificial Sequence
  Description of Artificial Sequence: Synthetic oligonucleotide
tacgtgtgagtgttatttcttcaatgggacggagc

SEQ ID NO: 71223 - DNA, 34 bp, Artificial Sequence
  Description of Artificial Sequence: Synthetic oligonucleotide
acgtgtgagtgttatttcttcaatgggacggagc

SEQ ID NO: 71224 - DNA, 33 bp, Artificial Sequence
  Description of Artificial Sequence: Synthetic oligonucleotide
cgtgtgagtgttatttcttcaatgggacggagc

SEQ ID NO: 71225 - DNA, 33 bp, Artificial Sequence
  Description of Artificial Sequence: Synthetic oligonucleotide
gtgtgagtgttatttcttcaatgggacggagcg

SEQ ID NO: 71226 - DNA, 33 bp, Artificial Sequence
  Description of Artificial Sequence: Synthetic oligonucleotide
tgtgagtgttatttcttcaatgggacggagcgg

SEQ ID NO: 71227 - DNA, 25 bp, Artificial Sequence
  Description of Artificial Sequence: Synthetic oligonucleotide
acaggcgcgccgcggtggacaatta

SEQ ID NO: 71228 - DNA, 24 bp, Artificial Sequence
  Description of Artificial Sequence: Synthetic oligonucleotide
caggcgcgccgcggtggacaatta

SEQ ID NO: 71229 - DNA, 25 bp, Artificial Sequence
  Description of Artificial Sequence: Synthetic oligonucleotide
aggcgcgccgcggtggacaattact

SEQ ID NO: 71230 - DNA, 24 bp, Artificial Sequence
  Description of Artificial Sequence: Synthetic oligonucleotide
ggcgcgccgcggtggacaattact

SEQ ID NO: 71231 - DNA, 24 bp, Artificial Sequence
  Description of Artificial Sequence: Synthetic oligonucleotide
gcgcgccgcggtggacaattactg

SEQ ID NO: 71232 - DNA, 25 bp, Artificial Sequence
  Description of Artificial Sequence: Synthetic oligonucleotide
cgcgccgcggtggacaattactgca

SEQ ID NO: 71233 - DNA, 26 bp, Artificial Sequence
  Description of Artificial Sequence: Synthetic oligonucleotide
gcgccgcggtggacaattactgcaga

SEQ ID NO: 71234 - DNA, 27 bp, Artificial Sequence
  Description of Artificial Sequence: Synthetic oligonucleotide
cgccgcggtggacaattactgcagaca

SEQ ID NO: 71235 - DNA, 32 bp, Artificial Sequence
  Description of Artificial Sequence: Synthetic oligonucleotide
tgttatttcttcaatgggacggagcgggtgtg

SEQ ID NO: 71236 - DNA, 31 bp, Artificial Sequence
  Description of Artificial Sequence: Synthetic oligonucleotide
gttatttcttcaatgggacggagcgggtgtg

SEQ ID NO: 71237 - DNA, 31 bp, Artificial Sequence
  Description of Artificial Sequence: Synthetic oligonucleotide
ttatttcttcaatgggacggagcgggtgtgg

SEQ ID NO: 71238 - DNA, 30 bp, Artificial Sequence
  Description of Artificial Sequence: Synthetic oligonucleotide
tatttcttcaatgggacggagcgggtgtgg

SEQ ID NO: 71239 - DNA, 29 bp, Artificial Sequence
  Description of Artificial Sequence: Synthetic oligonucleotide
atttcttcaatgggacggagcgggtgtgg

SEQ ID NO: 71240 - DNA, 28 bp, Artificial Sequence
  Description of Artificial Sequence: Synthetic oligonucleotide
tttcttcaatgggacggagcgggtgtgg

SEQ ID NO: 71241 - DNA, 27 bp, Artificial Sequence
  Description of Artificial Sequence: Synthetic oligonucleotide
ttcttcaatgggacggagcgggtgtgg

SEQ ID NO: 71242 - DNA, 27 bp, Artificial Sequence
  Description of Artificial Sequence: Synthetic oligonucleotide
tcttcaatgggacggagcgggtgtggt

SEQ ID NO: 71243 - DNA, 27 bp, Artificial Sequence
  Description of Artificial Sequence: Synthetic oligonucleotide
cttcaatgggacggagcgggtgtggtt

SEQ ID NO: 71244 - DNA, 28 bp, Artificial Sequence
  Description of Artificial Sequence: Synthetic oligonucleotide
ttcaatgggacggagcgggtgtggttac

SEQ ID NO: 71245 - DNA, 27 bp, Artificial Sequence
  Description of Artificial Sequence: Synthetic oligonucleotide
tcaatgggacggagcgggtgtggttac

SEQ ID NO: 71246 - DNA, 27 bp, Artificial Sequence
  Description of Artificial Sequence: Synthetic oligonucleotide
caatgggacggagcgggtgtggttact

SEQ ID NO: 71247 - DNA, 27 bp, Artificial Sequence
  Description of Artificial Sequence: Synthetic oligonucleotide
aatgggacggagcgggtgtggttactg

SEQ ID NO: 71248 - DNA, 26 bp, Artificial Sequence
  Description of Artificial Sequence: Synthetic oligonucleotide
atgggacggagcgggtgtggttactg

SEQ ID NO: 71249 - DNA, 25 bp, Artificial Sequence
  Description of Artificial Sequence: Synthetic oligonucleotide
tgggacggagcgggtgtggttactg

SEQ ID NO: 71250 - DNA, 24 bp, Artificial Sequence
  Description of Artificial Sequence: Synthetic oligonucleotide
gggacggagcgggtgtggttactg

SEQ ID NO: 71251 - DNA, 25 bp, Artificial Sequence
  Description of Artificial Sequence: Synthetic oligonucleotide
ggacggagcgggtgtggttactgga

SEQ ID NO: 71252 - DNA, 26 bp, Artificial Sequence
  Description of Artificial Sequence: Synthetic oligonucleotide
gacggagcgggtgtggttactggaga

SEQ ID NO: 71253 - DNA, 27 bp, Artificial Sequence
  Description of Artificial Sequence: Synthetic oligonucleotide
acggagcgggtgtggttactggagaga

SEQ ID NO: 71254 - DNA, 26 bp, Artificial Sequence
  Description of Artificial Sequence: Synthetic oligonucleotide
cggagcgggtgtggttactggagaga

SEQ ID NO: 71255 - DNA, 27 bp, Artificial Sequence
  Description of Artificial Sequence: Synthetic oligonucleotide
ggagcgggtgtggttactggagagaca

SEQ ID NO: 71256 - DNA, 27 bp, Artificial Sequence
  Description of Artificial Sequence: Synthetic oligonucleotide
gagcgggtgtggttactggagagacac

SEQ ID NO: 71257 - DNA, 29 bp, Artificial Sequence
  Description of Artificial Sequence: Synthetic oligonucleotide
agcgggtgtggttactggagagacacttc

SEQ ID NO: 71258 - DNA, 28 bp, Artificial Sequence
  Description of Artificial Sequence: Synthetic oligonucleotide
gcgggtgtggttactggagagacacttc

SEQ ID NO: 71259 - DNA, 28 bp, Artificial Sequence
  Description of Artificial Sequence: Synthetic oligonucleotide
cgggtgtggttactggagagacacttcc

SEQ ID NO: 71260 - DNA, 32 bp, Artificial Sequence
  Description of Artificial Sequence: Synthetic oligonucleotide
gggtgtggttactggagagacacttccataac

SEQ ID NO: 71261 - DNA, 32 bp, Artificial Sequence
  Description of Artificial Sequence: Synthetic oligonucleotide
ggtgtggttactggagagacacttccataacc

SEQ ID NO: 71262 - DNA, 33 bp, Artificial Sequence
  Description of Artificial Sequence: Synthetic oligonucleotide
gtgtggttactggagagacacttccataaccag

SEQ ID NO: 71263 - DNA, 33 bp, Artificial Sequence
  Description of Artificial Sequence: Synthetic oligonucleotide
tgtggttactggagagacacttccataaccagg

SEQ ID NO: 71264 - DNA, 32 bp, Artificial Sequence
  Description of Artificial Sequence: Synthetic oligonucleotide
gtggttactggagagacacttccataaccagg

SEQ ID NO: 71265 - DNA, 33 bp, Artificial Sequence
  Description of Artificial Sequence: Synthetic oligonucleotide
tggttactggagagacacttccataaccaggag

SEQ ID NO: 71266 - DNA, 22 bp, Artificial Sequence
  Description of Artificial Sequence: Synthetic oligonucleotide
ggcggcctgtcgccgagtccta

SEQ ID NO: 71267 - DNA, 24 bp, Artificial Sequence
  Description of Artificial Sequence: Synthetic oligonucleotide
gcggcctgtcgccgagtcctagaa

SEQ ID NO: 71268 - DNA, 25 bp, Artificial Sequence
  Description of Artificial Sequence: Synthetic oligonucleotide
cggcctgtcgccgagtcctagaaca

SEQ ID NO: 71269 - DNA, 25 bp, Artificial Sequence
  Description of Artificial Sequence: Synthetic oligonucleotide
ggcctgtcgccgagtcctagaacag

SEQ ID NO: 71270 - DNA, 25 bp, Artificial Sequence
  Description of Artificial Sequence: Synthetic oligonucleotide
gcctgtcgccgagtcctagaacagc

SEQ ID NO: 71271 - DNA, 26 bp, Artificial Sequence
  Description of Artificial Sequence: Synthetic oligonucleotide
cctgtcgccgagtcctagaacagcca

SEQ ID NO: 71272 - DNA, 27 bp, Artificial Sequence
  Description of Artificial Sequence: Synthetic oligonucleotide
ctgtcgccgagtcctagaacagccaga

SEQ ID NO: 71273 - DNA, 28 bp, Artificial Sequence
  Description of Artificial Sequence: Synthetic oligonucleotide
tgtcgccgagtcctagaacagccagaag

SEQ ID NO: 71274 - DNA, 27 bp, Artificial Sequence
  Description of Artificial Sequence: Synthetic oligonucleotide
gtcgccgagtcctagaacagccagaag

SEQ ID NO: 71275 - DNA, 27 bp, Artificial Sequence
  Description of Artificial Sequence: Synthetic oligonucleotide
tcgccgagtcctagaacagccagaagg

SEQ ID NO: 71276 - DNA, 27 bp, Artificial Sequence
  Description of Artificial Sequence: Synthetic oligonucleotide
cgccgagtcctagaacagccagaagga

SEQ ID NO: 71277 - DNA, 27 bp, Artificial Sequence
  Description of Artificial Sequence: Synthetic oligonucleotide
gccgagtcctagaacagccagaaggac

SEQ ID NO: 71278 - DNA, 29 bp, Artificial Sequence
  Description of Artificial Sequence: Synthetic oligonucleotide
ccgagtcctagaacagccagaaggacatc

SEQ ID NO: 71279 - DNA, 29 bp, Artificial Sequence
  Description of Artificial Sequence: Synthetic oligonucleotide
cgagtcctagaacagccagaaggacatcc

SEQ ID NO: 71280 - DNA, 30 bp, Artificial Sequence
  Description of Artificial Sequence: Synthetic oligonucleotide
gagtcctagaacagccagaaggacatcctg

SEQ ID NO: 71281 - DNA, 30 bp, Artificial Sequence
  Description of Artificial Sequence: Synthetic oligonucleotide
agtcctagaacagccagaaggacatcctgg

SEQ ID NO: 71282 - DNA, 29 bp, Artificial Sequence
  Description of Artificial Sequence: Synthetic oligonucleotide
gtcctagaacagccagaaggacatcctgg

SEQ ID NO: 71283 - DNA, 31 bp, Artificial Sequence
  Description of Artificial Sequence: Synthetic oligonucleotide
tcctagaacagccagaaggacatcctggaag

SEQ ID NO: 71284 - DNA, 30 bp, Artificial Sequence
  Description of Artificial Sequence: Synthetic oligonucleotide
cctagaacagccagaaggacatcctggaag

SEQ ID NO: 71285 - DNA, 31 bp, Artificial Sequence
  Description of Artificial Sequence: Synthetic oligonucleotide
ctagaacagccagaaggacatcctggaagac

SEQ ID NO: 71286 - DNA, 32 bp, Artificial Sequence
  Description of Artificial Sequence: Synthetic oligonucleotide
tagaacagccagaaggacatcctggaagacag

SEQ ID NO: 71287 - DNA, 31 bp, Artificial Sequence
  Description of Artificial Sequence: Synthetic oligonucleotide
agaacagccagaaggacatcctggaagacag

SEQ ID NO: 71288 - DNA, 27 bp, Artificial Sequence
  Description of Artificial Sequence: Synthetic oligonucleotide
aaggacatcctggaagacgagcgggct

SEQ ID NO: 71289 - DNA, 26 bp, Artificial Sequence
  Description of Artificial Sequence: Synthetic oligonucleotide
aggacatcctggaagacgagcgggct

SEQ ID NO: 71290 - DNA, 25 bp, Artificial Sequence
  Description of Artificial Sequence: Synthetic oligonucleotide
ggacatcctggaagacgagcgggct

SEQ ID NO: 71291 - DNA, 25 bp, Artificial Sequence
  Description of Artificial Sequence: Synthetic oligonucleotide
gacatcctggaagacgagcgggctg

SEQ ID NO: 71292 - DNA, 25 bp, Artificial Sequence
  Description of Artificial Sequence: Synthetic oligonucleotide
acatcctggaagacgagcgggctgc

SEQ ID NO: 71293 - DNA, 24 bp, Artificial Sequence
  Description of Artificial Sequence: Synthetic oligonucleotide
catcctggaagacgagcgggctgc

SEQ ID NO: 71294 - DNA, 24 bp, Artificial Sequence
  Description of Artificial Sequence: Synthetic oligonucleotide
atcctggaagacgagcgggctgcg

SEQ ID NO: 71295 - DNA, 23 bp, Artificial Sequence
  Description of Artificial Sequence: Synthetic oligonucleotide
tcctggaagacgagcgggctgcg

SEQ ID NO: 71296 - DNA, 22 bp, Artificial Sequence
  Description of Artificial Sequence: Synthetic oligonucleotide
cctggaagacgagcgggctgcg

SEQ ID NO: 71297 - DNA, 23 bp, Artificial Sequence
  Description of Artificial Sequence: Synthetic oligonucleotide
ctggaagacgagcgggctgcggt

SEQ ID NO: 71298 - DNA, 23 bp, Artificial Sequence
  Description of Artificial Sequence: Synthetic oligonucleotide
tggaagacgagcgggctgcggtg

SEQ ID NO: 71299 - DNA, 22 bp, Artificial Sequence
  Description of Artificial Sequence: Synthetic oligonucleotide
ggaagacgagcgggctgcggtg

SEQ ID NO: 71300 - DNA, 23 bp, Artificial Sequence
  Description of Artificial Sequence: Synthetic oligonucleotide
gaagacgagcgggctgcggtgga

SEQ ID NO: 71301 - DNA, 24 bp, Artificial Sequence
  Description of Artificial Sequence: Synthetic oligonucleotide
aagacgagcgggctgcggtggaca

SEQ ID NO: 71302 - DNA, 23 bp, Artificial Sequence
  Description of Artificial Sequence: Synthetic oligonucleotide
agacgagcgggctgcggtggaca

SEQ ID NO: 71303 - DNA, 22 bp, Artificial Sequence
  Description of Artificial Sequence: Synthetic oligonucleotide
gacgagcgggctgcggtggaca

SEQ ID NO: 71304 - DNA, 22 bp, Artificial Sequence
  Description of Artificial Sequence: Synthetic oligonucleotide
acgagcgggctgcggtggacac

SEQ ID NO: 71305 - DNA, 21 bp, Artificial Sequence
  Description of Artificial Sequence: Synthetic oligonucleotide
cgagcgggctgcggtggacac

SEQ ID NO: 71306 - DNA, 23 bp, Artificial Sequence
  Description of Artificial Sequence: Synthetic oligonucleotide
gagcgggctgcggtggacaccta

SEQ ID NO: 71307 - DNA, 24 bp, Artificial Sequence
  Description of Artificial Sequence: Synthetic oligonucleotide
agcgggctgcggtggacacctact

SEQ ID NO: 71308 - DNA, 23 bp, Artificial Sequence
  Description of Artificial Sequence: Synthetic oligonucleotide
gcgggctgcggtggacacctact

SEQ ID NO: 71309 - DNA, 23 bp, Artificial Sequence
  Description of Artificial Sequence: Synthetic oligonucleotide
cgggctgcggtggacacctactg

SEQ ID NO: 71310 - DNA, 24 bp, Artificial Sequence
  Description of Artificial Sequence: Synthetic oligonucleotide
gggctgcggtggacacctactgca

SEQ ID NO: 71311 - DNA, 25 bp, Artificial Sequence
  Description of Artificial Sequence: Synthetic oligonucleotide
ggctgcggtggacacctactgcaga

SEQ ID NO: 71312 - DNA, 26 bp, Artificial Sequence
  Description of Artificial Sequence: Synthetic oligonucleotide
gctgcggtggacacctactgcagaca

SEQ ID NO: 71313 - DNA, 27 bp, Artificial Sequence
  Description of Artificial Sequence: Synthetic oligonucleotide
ctgcggtggacacctactgcagacaca

SEQ ID NO: 71314 - DNA, 28 bp, Artificial Sequence
  Description of Artificial Sequence: Synthetic oligonucleotide
tgcggtggacacctactgcagacacaac

SEQ ID NO: 71315 - DNA, 24 bp, Artificial Sequence
  Description of Artificial Sequence: Synthetic oligonucleotide
agcgggccgcggtggacacctatt

SEQ ID NO: 71316 - DNA, 21 bp, Artificial Sequence
  Description of Artificial Sequence: Synthetic oligonucleotide
ggggagttccgggcggtgacc

SEQ ID NO: 71317 - DNA, 22 bp, Artificial Sequence
  Description of Artificial Sequence: Synthetic oligonucleotide
gggagttccgggcggtgaccga

SEQ ID NO: 71318 - DNA, 22 bp, Artificial Sequence
  Description of Artificial Sequence: Synthetic oligonucleotide
ggagttccgggcggtgaccgag

SEQ ID NO: 71319 - DNA, 23 bp, Artificial Sequence
  Description of Artificial Sequence: Synthetic oligonucleotide
gagttccgggcggtgaccgagct

SEQ ID NO: 71320 - DNA, 23 bp, Artificial Sequence
  Description of Artificial Sequence: Synthetic oligonucleotide
agttccgggcggtgaccgagctg

SEQ ID NO: 71321 - DNA, 22 bp, Artificial Sequence
  Description of Artificial Sequence: Synthetic oligonucleotide
gttccgggcggtgaccgagctg

SEQ ID NO: 71322 - DNA, 22 bp, Artificial Sequence
  Description of Artificial Sequence: Synthetic oligonucleotide
ttccgggcggtgaccgagctgg

SEQ ID NO: 71323 - DNA, 21 bp, Artificial Sequence
  Description of Artificial Sequence: Synthetic oligonucleotide
tccgggcggtgaccgagctgg

SEQ ID NO: 71324 - DNA, 20 bp, Artificial Sequence
  Description of Artificial Sequence: Synthetic oligonucleotide
ccgggcggtgaccgagctgg

SEQ ID NO: 71325 - DNA, 20 bp, Artificial Sequence
  Description of Artificial Sequence: Synthetic oligonucleotide
cgggcggtgaccgagctggg

SEQ ID NO: 71326 - DNA, 20 bp, Artificial Sequence
  Description of Artificial Sequence: Synthetic oligonucleotide
gggcggtgaccgagctgggg

SEQ ID NO: 71327 - DNA, 20 bp, Artificial Sequence
  Description of Artificial Sequence: Synthetic oligonucleotide
ggcggtgaccgagctggggc

SEQ ID NO: 71328 - DNA, 20 bp, Artificial Sequence
  Description of Artificial Sequence: Synthetic oligonucleotide
gcggtgaccgagctggggcg

SEQ ID NO: 71329 - DNA, 20 bp, Artificial Sequence
  Description of Artificial Sequence: Synthetic oligonucleotide
cggtgaccgagctggggcgg

SEQ ID NO: 71330 - DNA, 20 bp, Artificial Sequence
  Description of Artificial Sequence: Synthetic oligonucleotide
ggtgaccgagctggggcggc

SEQ ID NO: 71331 - DNA, 21 bp, Artificial Sequence
  Description of Artificial Sequence: Synthetic oligonucleotide
gtgaccgagctggggcggcct

SEQ ID NO: 71332 - DNA, 23 bp, Artificial Sequence
  Description of Artificial Sequence: Synthetic oligonucleotide
tgaccgagctggggcggcctgat

SEQ ID NO: 71333 - DNA, 22 bp, Artificial Sequence
  Description of Artificial Sequence: Synthetic oligonucleotide
gaccgagctggggcggcctgat

SEQ ID NO: 71334 - DNA, 22 bp, Artificial Sequence
  Description of Artificial Sequence: Synthetic oligonucleotide
accgagctggggcggcctgatg

SEQ ID NO: 71335 - DNA, 21 bp, Artificial Sequence
  Description of Artificial Sequence: Synthetic oligonucleotide
ccgagctggggcggcctgatg

SEQ ID NO: 71336 - DNA, 21 bp, Artificial Sequence
  Description of Artificial Sequence: Synthetic oligonucleotide
cgagctggggcggcctgatgc

SEQ ID NO: 71337 - DNA, 31 bp, Artificial Sequence
  Description of Artificial Sequence: Synthetic oligonucleotide
gagtactggaacagccagaaggacatcctag

SEQ ID NO: 71338 - DNA, 33 bp, Artificial Sequence
  Description of Artificial Sequence: Synthetic oligonucleotide
agtactggaacagccagaaggacatcctagaag

SEQ ID NO: 71339 - DNA, 32 bp, Artificial Sequence
  Description of Artificial Sequence: Synthetic oligonucleotide
gtactggaacagccagaaggacatcctagaag

SEQ ID NO: 71340 - DNA, 33 bp, Artificial Sequence
  Description of Artificial Sequence: Synthetic oligonucleotide
tactggaacagccagaaggacatcctagaagac

SEQ ID NO: 71341 - DNA, 32 bp, Artificial Sequence
  Description of Artificial Sequence: Synthetic oligonucleotide
actggaacagccagaaggacatcctagaagac

SEQ ID NO: 71342 - DNA, 31 bp, Artificial Sequence
  Description of Artificial Sequence: Synthetic oligonucleotide
ctggaacagccagaaggacatcctagaagac

SEQ ID NO: 71343 - DNA, 31 bp, Artificial Sequence
  Description of Artificial Sequence: Synthetic oligonucleotide
tggaacagccagaaggacatcctagaagacg

SEQ ID NO: 71344 - DNA, 30 bp, Artificial Sequence
  Description of Artificial Sequence: Synthetic oligonucleotide
ggaacagccagaaggacatcctagaagacg

SEQ ID NO: 71345 - DNA, 31 bp, Artificial Sequence
  Description of Artificial Sequence: Synthetic oligonucleotide
gaacagccagaaggacatcctagaagacgag

SEQ ID NO: 71346 - DNA, 31 bp, Artificial Sequence
  Description of Artificial Sequence: Synthetic oligonucleotide
aacagccagaaggacatcctagaagacgagc

SEQ ID NO: 71347 - DNA, 30 bp, Artificial Sequence
  Description of Artificial Sequence: Synthetic oligonucleotide
acagccagaaggacatcctagaagacgagc

SEQ ID NO: 71348 - DNA, 29 bp, Artificial Sequence
  Description of Artificial Sequence: Synthetic oligonucleotide
cagccagaaggacatcctagaagacgagc

SEQ ID NO: 71349 - DNA, 29 bp, Artificial Sequence
  Description of Artificial Sequence: Synthetic oligonucleotide
agccagaaggacatcctagaagacgagcg

SEQ ID NO: 71350 - DNA, 28 bp, Artificial Sequence
  Description of Artificial Sequence: Synthetic oligonucleotide
gccagaaggacatcctagaagacgagcg

SEQ ID NO: 71351 - DNA, 28 bp, Artificial Sequence
  Description of Artificial Sequence: Synthetic oligonucleotide
ccagaaggacatcctagaagacgagcgg

SEQ ID NO: 71352 - DNA, 28 bp, Artificial Sequence
  Description of Artificial Sequence: Synthetic oligonucleotide
cagaaggacatcctagaagacgagcggg

SEQ ID NO: 71353 - DNA, 28 bp, Artificial Sequence
  Description of Artificial Sequence: Synthetic oligonucleotide
agaaggacatcctagaagacgagcgggc

SEQ ID NO: 71354 - DNA, 27 bp, Artificial Sequence
  Description of Artificial Sequence: Synthetic oligonucleotide
gaaggacatcctagaagacgagcgggc

SEQ ID NO: 71355 - DNA, 27 bp, Artificial Sequence
  Description of Artificial Sequence: Synthetic oligonucleotide
aaggacatcctagaagacgagcgggcc

SEQ ID NO: 71356 - DNA, 26 bp, Artificial Sequence
  Description of Artificial Sequence: Synthetic oligonucleotide
aggacatcctagaagacgagcgggcc

SEQ ID NO: 71357 - DNA, 25 bp, Artificial Sequence
  Description of Artificial Sequence: Synthetic oligonucleotide
ggacatcctagaagacgagcgggcc

SEQ ID NO: 71358 - DNA, 25 bp, Artificial Sequence
  Description of Artificial Sequence: Synthetic oligonucleotide
gacatcctagaagacgagcgggccg

SEQ ID NO: 71359 - DNA, 25 bp, Artificial Sequence
  Description of Artificial Sequence: Synthetic oligonucleotide
acatcctagaagacgagcgggccgc

SEQ ID NO: 71360 - DNA, 24 bp, Artificial Sequence
  Description of Artificial Sequence: Synthetic oligonucleotide
catcctagaagacgagcgggccgc

SEQ ID NO: 71361 - DNA, 24 bp, Artificial Sequence
  Description of Artificial Sequence: Synthetic oligonucleotide
atcctagaagacgagcgggccgcg

SEQ ID NO: 71362 - DNA, 23 bp, Artificial Sequence
  Description of Artificial Sequence: Synthetic oligonucleotide
tcctagaagacgagcgggccgcg

SEQ ID NO: 71363 - DNA, 22 bp, Artificial Sequence
  Description of Artificial Sequence: Synthetic oligonucleotide
cctagaagacgagcgggccgcg

SEQ ID NO: 71364 - DNA, 23 bp, Artificial Sequence
  Description of Artificial Sequence: Synthetic oligonucleotide
ctagaagacgagcgggccgcggt

SEQ ID NO: 71365 - DNA, 23 bp, Artificial Sequence
  Description of Artificial Sequence: Synthetic oligonucleotide
tagaagacgagcgggccgcggtg

SEQ ID NO: 71366 - DNA, 22 bp, Artificial Sequence
  Description of Artificial Sequence: Synthetic oligonucleotide
agaagacgagcgggccgcggtg

SEQ ID NO: 71367 - DNA, 27 bp, Artificial Sequence
  Description of Artificial Sequence: Synthetic oligonucleotide
cagaaggacatcctggaagacgagcgc

SEQ ID NO: 71368 - DNA, 27 bp, Artificial Sequence
  Description of Artificial Sequence: Synthetic oligonucleotide
agaaggacatcctggaagacgagcgcg

SEQ ID NO: 71369 - DNA, 26 bp, Artificial Sequence
  Description of Artificial Sequence: Synthetic oligonucleotide
gaaggacatcctggaagacgagcgcg

SEQ ID NO: 71370 - DNA, 26 bp, Artificial Sequence
  Description of Artificial Sequence: Synthetic oligonucleotide
aaggacatcctggaagacgagcgcgc

SEQ ID NO: 71371 - DNA, 25 bp, Artificial Sequence
  Description of Artificial Sequence: Synthetic oligonucleotide
aggacatcctggaagacgagcgcgc

SEQ ID NO: 71372 - DNA, 24 bp, Artificial Sequence
  Description of Artificial Sequence: Synthetic oligonucleotide
ggacatcctggaagacgagcgcgc

SEQ ID NO: 71373 - DNA, 24 bp, Artificial Sequence
  Description of Artificial Sequence: Synthetic oligonucleotide
gacatcctggaagacgagcgcgcc

SEQ ID NO: 71374 - DNA, 24 bp, Artificial Sequence
  Description of Artificial Sequence: Synthetic oligonucleotide
acatcctggaagacgagcgcgccg

SEQ ID NO: 71375 - DNA, 23 bp, Artificial Sequence
  Description of Artificial Sequence: Synthetic oligonucleotide
catcctggaagacgagcgcgccg

SEQ ID NO: 71376 - DNA, 23 bp, Artificial Sequence
  Description of Artificial Sequence: Synthetic oligonucleotide
atcctggaagacgagcgcgccgc

SEQ ID NO: 71377 - DNA, 22 bp, Artificial Sequence
  Description of Artificial Sequence: Synthetic oligonucleotide
tcctggaagacgagcgcgccgc

SEQ ID NO: 71378 - DNA, 21 bp, Artificial Sequence
  Description of Artificial Sequence: Synthetic oligonucleotide
cctggaagacgagcgcgccgc

SEQ ID NO: 71379 - DNA, 21 bp, Artificial Sequence
  Description of Artificial Sequence: Synthetic oligonucleotide
ctggaagacgagcgcgccgcg

SEQ ID NO: 71380 - DNA, 22 bp, Artificial Sequence
  Description of Artificial Sequence: Synthetic oligonucleotide
tggaagacgagcgcgccgcggt

SEQ ID NO: 71381 - DNA, 21 bp, Artificial Sequence
  Description of Artificial Sequence: Synthetic oligonucleotide
ggaagacgagcgcgccgcggt

SEQ ID NO: 71382 - DNA, 21 bp, Artificial Sequence
  Description of Artificial Sequence: Synthetic oligonucleotide
gaagacgagcgcgccgcggtg

SEQ ID NO: 71383 - DNA, 22 bp, Artificial Sequence
  Description of Artificial Sequence: Synthetic oligonucleotide
aagacgagcgcgccgcggtgga

SEQ ID NO: 71384 - DNA, 21 bp, Artificial Sequence
  Description of Artificial Sequence: Synthetic oligonucleotide
agacgagcgcgccgcggtgga

SEQ ID NO: 71385 - DNA, 20 bp, Artificial Sequence
  Description of Artificial Sequence: Synthetic oligonucleotide
gacgagcgcgccgcggtgga

SEQ ID NO: 71386 - DNA, 21 bp, Artificial Sequence
  Description of Artificial Sequence: Synthetic oligonucleotide
acgagcgcgccgcggtggaca

SEQ ID NO: 71387 - DNA, 20 bp, Artificial Sequence
  Description of Artificial Sequence: Synthetic oligonucleotide
cgagcgcgccgcggtggaca

SEQ ID NO: 71388 - DNA, 20 bp, Artificial Sequence
  Description of Artificial Sequence: Synthetic oligonucleotide
gagcgcgccgcggtggacac

SEQ ID NO: 71389 - DNA, 22 bp, Artificial Sequence
  Description of Artificial Sequence: Synthetic oligonucleotide
agcgcgccgcggtggacaccta

SEQ ID NO: 71390 - DNA, 22 bp, Artificial Sequence
  Description of Artificial Sequence: Synthetic oligonucleotide
cgacgtgggggagtaccgggca

SEQ ID NO: 71391 - DNA, 23 bp, Artificial Sequence
  Description of Artificial Sequence: Synthetic oligonucleotide
gacgtgggggagtaccgggcagt

SEQ ID NO: 71392 - DNA, 24 bp, Artificial Sequence
  Description of Artificial Sequence: Synthetic oligonucleotide
acgtgggggagtaccgggcagtga

SEQ ID NO: 71393 - DNA, 23 bp, Artificial Sequence
  Description of Artificial Sequence: Synthetic oligonucleotide
cgtgggggagtaccgggcagtga

SEQ ID NO: 71394 - DNA, 23 bp, Artificial Sequence
  Description of Artificial Sequence: Synthetic oligonucleotide
gtgggggagtaccgggcagtgac

SEQ ID NO: 71395 - DNA, 23 bp, Artificial Sequence
  Description of Artificial Sequence: Synthetic oligonucleotide
tgggggagtaccgggcagtgacg

SEQ ID NO: 71396 - DNA, 22 bp, Artificial Sequence
  Description of Artificial Sequence: Synthetic oligonucleotide
gggggagtaccgggcagtgacg

SEQ ID NO: 71397 - DNA, 23 bp, Artificial Sequence
  Description of Artificial Sequence: Synthetic oligonucleotide
ggggagtaccgggcagtgacgga

SEQ ID NO: 71398 - DNA, 23 bp, Artificial Sequence
  Description of Artificial Sequence: Synthetic oligonucleotide
gggagtaccgggcagtgacggag

SEQ ID NO: 71399 - DNA, 24 bp, Artificial Sequence
  Description of Artificial Sequence: Synthetic oligonucleotide
ggagtaccgggcagtgacggagct

SEQ ID NO: 71400 - DNA, 24 bp, Artificial Sequence
  Description of Artificial Sequence: Synthetic oligonucleotide
gagtaccgggcagtgacggagctg

SEQ ID NO: 71401 - DNA, 24 bp, Artificial Sequence
  Description of Artificial Sequence: Synthetic oligonucleotide
agtaccgggcagtgacggagctgg

SEQ ID NO: 71402 - DNA, 23 bp, Artificial Sequence
  Description of Artificial Sequence: Synthetic oligonucleotide
gtaccgggcagtgacggagctgg

SEQ ID NO: 71403 - DNA, 23 bp, Artificial Sequence
  Description of Artificial Sequence: Synthetic oligonucleotide
taccgggcagtgacggagctggg

SEQ ID NO: 71404 - DNA, 22 bp, Artificial Sequence
  Description of Artificial Sequence: Synthetic oligonucleotide
accgggcagtgacggagctggg

SEQ ID NO: 71405 - DNA, 23 bp, Artificial Sequence
  Description of Artificial Sequence: Synthetic oligonucleotide
agtgacggagctggggcggccta

SEQ ID NO: 71406 - DNA, 21 bp, Artificial Sequence
  Description of Artificial Sequence: Synthetic oligonucleotide
cgggcggtgacggagctggga

SEQ ID NO: 71407 - DNA, 21 bp, Artificial Sequence
  Description of Artificial Sequence: Synthetic oligonucleotide
gggcggtgacggagctgggac

SEQ ID NO: 71408 - DNA, 21 bp, Artificial Sequence
  Description of Artificial Sequence: Synthetic oligonucleotide
ggcggtgacggagctgggacg

SEQ ID NO: 71409 - DNA, 21 bp, Artificial Sequence
  Description of Artificial Sequence: Synthetic oligonucleotide
gcggtgacggagctgggacgg

SEQ ID NO: 71410 - DNA, 21 bp, Artificial Sequence
  Description of Artificial Sequence: Synthetic oligonucleotide
cggtgacggagctgggacggc

SEQ ID NO: 71411 - DNA, 23 bp, Artificial Sequence
  Description of Artificial Sequence: Synthetic oligonucleotide
ggtgacggagctgggacggccta

SEQ ID NO: 71412 - DNA, 23 bp, Artificial Sequence
  Description of Artificial Sequence: Synthetic oligonucleotide
gtgacggagctgggacggcctag

SEQ ID NO: 71413 - DNA, 23 bp, Artificial Sequence
  Description of Artificial Sequence: Synthetic oligonucleotide
tgacggagctgggacggcctagc

SEQ ID NO: 71414 - DNA, 22 bp, Artificial Sequence
  Description of Artificial Sequence: Synthetic oligonucleotide
gacggagctgggacggcctagc

SEQ ID NO: 71415 - DNA, 22 bp, Artificial Sequence
  Description of Artificial Sequence: Synthetic oligonucleotide
acggagctgggacggcctagcg

SEQ ID NO: 71416 - DNA, 21 bp, Artificial Sequence
  Description of Artificial Sequence: Synthetic oligonucleotide
cggagctgggacggcctagcg

SEQ ID NO: 71417 - DNA, 21 bp, Artificial Sequence
  Description of Artificial Sequence: Synthetic oligonucleotide
ggagctgggacggcctagcgc

SEQ ID NO: 71418 - DNA, 21 bp, Artificial Sequence
  Description of Artificial Sequence: Synthetic oligonucleotide
gagctgggacggcctagcgcc

SEQ ID NO: 71419 - DNA, 22 bp, Artificial Sequence
  Description of Artificial Sequence: Synthetic oligonucleotide
agctgggacggcctagcgccga

SEQ ID NO: 71420 - DNA, 21 bp, Artificial Sequence
  Description of Artificial Sequence: Synthetic oligonucleotide
gctgggacggcctagcgccga

SEQ ID NO: 71421 - DNA, 23 bp, Artificial Sequence
  Description of Artificial Sequence: Synthetic oligonucleotide
ctgggacggcctagcgccgagta

SEQ ID NO: 71422 - DNA, 24 bp, Artificial Sequence
  Description of Artificial Sequence: Synthetic oligonucleotide
tgggacggcctagcgccgagtact

SEQ ID NO: 71423 - DNA, 23 bp, Artificial Sequence
  Description of Artificial Sequence: Synthetic oligonucleotide
gggacggcctagcgccgagtact

SEQ ID NO: 71424 - DNA, 23 bp, Artificial Sequence
  Description of Artificial Sequence: Synthetic oligonucleotide
ggacggcctagcgccgagtactg

SEQ ID NO: 71425 - DNA, 25 bp, Artificial Sequence
  Description of Artificial Sequence: Synthetic oligonucleotide
gacggcctagcgccgagtactggaa

SEQ ID NO: 71426 - DNA, 26 bp, Artificial Sequence
  Description of Artificial Sequence: Synthetic oligonucleotide
acggcctagcgccgagtactggaaca

SEQ ID NO: 71427 - DNA, 32 bp, Artificial Sequence
  Description of Artificial Sequence: Synthetic oligonucleotide
cacgtttcttggagtactctacgtctgagtgc

SEQ ID NO: 71428 - DNA, 32 bp, Artificial Sequence
  Description of Artificial Sequence: Synthetic oligonucleotide
acgtttcttggagtactctacgtctgagtgcc

SEQ ID NO: 71429 - DNA, 31 bp, Artificial Sequence
  Description of Artificial Sequence: Synthetic oligonucleotide
cgtttcttggagtactctacgtctgagtgcc

SEQ ID NO: 71430 - DNA, 35 bp, Artificial Sequence
  Description of Artificial Sequence: Synthetic oligonucleotide
gtttcttggagtactctacgtctgagtgccatttc

SEQ ID NO: 71431 - DNA, 37 bp, Artificial Sequence
  Description of Artificial Sequence: Synthetic oligonucleotide
tttcttggagtactctacgtctgagtgccatttcttc

SEQ ID NO: 71432 - DNA, 36 bp, Artificial Sequence
  Description of Artificial Sequence: Synthetic oligonucleotide
ttcttggagtactctacgtctgagtgccatttcttc

SEQ ID NO: 71433 - DNA, 35 bp, Artificial Sequence
  Description of Artificial Sequence: Synthetic oligonucleotide
tcttggagtactctacgtctgagtgccatttcttc

SEQ ID NO: 71434 - DNA, 34 bp, Artificial Sequence
  Description of Artificial Sequence: Synthetic oligonucleotide
cttggagtactctacgtctgagtgccatttcttc

SEQ ID NO: 71435 - DNA, 37 bp, Artificial Sequence
  Description of Artificial Sequence: Synthetic oligonucleotide
ttggagtactctacgtctgagtgccatttcttcaatg

SEQ ID NO: 71436 - DNA, 36 bp, Artificial Sequence
  Description of Artificial Sequence: Synthetic oligonucleotide
tggagtactctacgtctgagtgccatttcttcaatg

SEQ ID NO: 71437 - DNA, 35 bp, Artificial Sequence
  Description of Artificial Sequence: Synthetic oligonucleotide
ggagtactctacgtctgagtgccatttcttcaatg

SEQ ID NO: 71438 - DNA, 35 bp, Artificial Sequence
  Description of Artificial Sequence: Synthetic oligonucleotide
gagtactctacgtctgagtgccatttcttcaatgg

SEQ ID NO: 71439 - DNA, 35 bp, Artificial Sequence
  Description of Artificial Sequence: Synthetic oligonucleotide
agtactctacgtctgagtgccatttcttcaatggg

SEQ ID NO: 71440 - DNA, 34 bp, Artificial Sequence
  Description of Artificial Sequence: Synthetic oligonucleotide
gtactctacgtctgagtgccatttcttcaatggg

SEQ ID NO: 71441 - DNA, 35 bp, Artificial Sequence
  Description of Artificial Sequence: Synthetic oligonucleotide
tactctacgtctgagtgccatttcttcaatgggac

SEQ ID NO: 71442 - DNA, 34 bp, Artificial Sequence
  Description of Artificial Sequence: Synthetic oligonucleotide
actctacgtctgagtgccatttcttcaatgggac

SEQ ID NO: 71443 - DNA, 33 bp, Artificial Sequence
  Description of Artificial Sequence: Synthetic oligonucleotide
ctctacgtctgagtgccatttcttcaatgggac

SEQ ID NO: 71444 - DNA, 33 bp, Artificial Sequence
  Description of Artificial Sequence: Synthetic oligonucleotide
tctacgtctgagtgccatttcttcaatgggacg

SEQ ID NO: 71445 - DNA, 32 bp, Artificial Sequence
  Description of Artificial Sequence: Synthetic oligonucleotide
ctacgtctgagtgccatttcttcaatgggacg

SEQ ID NO: 71446 - DNA, 32 bp, Artificial Sequence
  Description of Artificial Sequence: Synthetic oligonucleotide
tacgtctgagtgccatttcttcaatgggacgg

SEQ ID NO: 71447 - DNA, 31 bp, Artificial Sequence
  Description of Artificial Sequence: Synthetic oligonucleotide
acgtctgagtgccatttcttcaatgggacgg

SEQ ID NO: 71448 - DNA, 30 bp, Artificial Sequence
  Description of Artificial Sequence: Synthetic oligonucleotide
cgtctgagtgccatttcttcaatgggacgg

SEQ ID NO: 71449 - DNA, 31 bp, Artificial Sequence
  Description of Artificial Sequence: Synthetic oligonucleotide
gtctgagtgccatttcttcaatgggacggag

SEQ ID NO: 71450 - DNA, 31 bp, Artificial Sequence
  Description of Artificial Sequence: Synthetic oligonucleotide
tctgagtgccatttcttcaatgggacggagc

SEQ ID NO: 71451 - DNA, 30 bp, Artificial Sequence
  Description of Artificial Sequence: Synthetic oligonucleotide
ctgagtgccatttcttcaatgggacggagc

SEQ ID NO: 71452 - DNA, 30 bp, Artificial Sequence
  Description of Artificial Sequence: Synthetic oligonucleotide
tgagtgccatttcttcaatgggacggagcg

SEQ ID NO: 71453 - DNA, 29 bp, Artificial Sequence
  Description of Artificial Sequence: Synthetic oligonucleotide
gagtgccatttcttcaatgggacggagcg

SEQ ID NO: 71454 - DNA, 29 bp, Artificial Sequence
  Description of Artificial Sequence: Synthetic oligonucleotide
agtgccatttcttcaatgggacggagcgg

SEQ ID NO: 71455 - DNA, 28 bp, Artificial Sequence
  Description of Artificial Sequence: Synthetic oligonucleotide
gtgccatttcttcaatgggacggagcgg

SEQ ID NO: 71456 - DNA, 28 bp, Artificial Sequence
  Description of Artificial Sequence: Synthetic oligonucleotide
tgccatttcttcaatgggacggagcggg

SEQ ID NO: 71457 - DNA, 27 bp, Artificial Sequence
  Description of Artificial Sequence: Synthetic oligonucleotide
gccatttcttcaatgggacggagcggg

SEQ ID NO: 71458 - DNA, 28 bp, Artificial Sequence
  Description of Artificial Sequence: Synthetic oligonucleotide
ccatttcttcaatgggacggagcgggtg

SEQ ID NO: 71459 - DNA, 25 bp, Artificial Sequence
  Description of Artificial Sequence: Synthetic oligonucleotide
gtgagagcttcacagtgcagcggcg

SEQ ID NO: 71460 - DNA, 25 bp, Artificial Sequence
  Description of Artificial Sequence: Synthetic oligonucleotide
gagcgggtgcggttcctggacagat

SEQ ID NO: 71461 - DNA, 25 bp, Artificial Sequence
  Description of Artificial Sequence: Synthetic oligonucleotide
agcgggtgcggttcctggacagatc

SEQ ID NO: 71462 - DNA, 24 bp, Artificial Sequence
  Description of Artificial Sequence: Synthetic oligonucleotide
gcgggtgcggttcctggacagatc

SEQ ID NO: 71463 - DNA, 26 bp, Artificial Sequence
  Description of Artificial Sequence: Synthetic oligonucleotide
cgggtgcggttcctggacagatcctt

SEQ ID NO: 71464 - DNA, 27 bp, Artificial Sequence
  Description of Artificial Sequence: Synthetic oligonucleotide
gggtgcggttcctggacagatccttct

SEQ ID NO: 71465 - DNA, 31 bp, Artificial Sequence
  Description of Artificial Sequence: Synthetic oligonucleotide
ggtgcggttcctggacagatccttctataac

SEQ ID NO: 71466 - DNA, 31 bp, Artificial Sequence
  Description of Artificial Sequence: Synthetic oligonucleotide
gtgcggttcctggacagatccttctataacc

SEQ ID NO: 71467 - DNA, 33 bp, Artificial Sequence
  Description of Artificial Sequence: Synthetic oligonucleotide
tgcggttcctggacagatccttctataaccaag

SEQ ID NO: 71468 - DNA, 32 bp, Artificial Sequence
  Description of Artificial Sequence: Synthetic oligonucleotide
gcggttcctggacagatccttctataaccaag

SEQ ID NO: 71469 - DNA, 33 bp, Artificial Sequence
  Description of Artificial Sequence: Synthetic oligonucleotide
cggttcctggacagatccttctataaccaagag

SEQ ID NO: 71470 - DNA, 33 bp, Artificial Sequence
  Description of Artificial Sequence: Synthetic oligonucleotide
ggttcctggacagatccttctataaccaagagg

SEQ ID NO: 71471 - DNA, 34 bp, Artificial Sequence
  Description of Artificial Sequence: Synthetic oligonucleotide
gttcctggacagatccttctataaccaagaggag

SEQ ID NO: 71472 - DNA, 36 bp, Artificial Sequence
  Description of Artificial Sequence: Synthetic oligonucleotide
ttcctggacagatccttctataaccaagaggagtac

SEQ ID NO: 71473 - DNA, 35 bp, Artificial Sequence
  Description of Artificial Sequence: Synthetic oligonucleotide
tcctggacagatccttctataaccaagaggagtac

SEQ ID NO: 71474 - DNA, 34 bp, Artificial Sequence
  Description of Artificial Sequence: Synthetic oligonucleotide
cctggacagatccttctataaccaagaggagtac

SEQ ID NO: 71475 - DNA, 34 bp, Artificial Sequence
  Description of Artificial Sequence: Synthetic oligonucleotide
ctggacagatccttctataaccaagaggagtacg

SEQ ID NO: 71476 - DNA, 35 bp, Artificial Sequence
  Description of Artificial Sequence: Synthetic oligonucleotide
tggacagatccttctataaccaagaggagtacgtg

SEQ ID NO: 71477 - DNA, 34 bp, Artificial Sequence
  Description of Artificial Sequence: Synthetic oligonucleotide
ggacagatccttctataaccaagaggagtacgtg

SEQ ID NO: 71478 - DNA, 34 bp, Artificial Sequence
  Description of Artificial Sequence: Synthetic oligonucleotide
gacagatccttctataaccaagaggagtacgtgc

SEQ ID NO: 71479 - DNA, 34 bp, Artificial Sequence
  Description of Artificial Sequence: Synthetic oligonucleotide
acagatccttctataaccaagaggagtacgtgcg

SEQ ID NO: 71480 - DNA, 33 bp, Artificial Sequence
  Description of Artificial Sequence: Synthetic oligonucleotide
cagatccttctataaccaagaggagtacgtgcg

SEQ ID NO: 71481 - DNA, 33 bp, Artificial Sequence
  Description of Artificial Sequence: Synthetic oligonucleotide
agatccttctataaccaagaggagtacgtgcgc

SEQ ID NO: 71482 - DNA, 32 bp, Artificial Sequence
  Description of Artificial Sequence: Synthetic oligonucleotide
gatccttctataaccaagaggagtacgtgcgc

SEQ ID NO: 71483 - DNA, 34 bp, Artificial Sequence
  Description of Artificial Sequence: Synthetic oligonucleotide
atccttctataaccaagaggagtacgtgcgcttc

SEQ ID NO: 71484 - DNA, 33 bp, Artificial Sequence
  Description of Artificial Sequence: Synthetic oligonucleotide
tccttctataaccaagaggagtacgtgcgcttc

SEQ ID NO: 71485 - DNA, 32 bp, Artificial Sequence
  Description of Artificial Sequence: Synthetic oligonucleotide
ccttctataaccaagaggagtacgtgcgcttc

SEQ ID NO: 71486 - DNA, 33 bp, Artificial Sequence
  Description of Artificial Sequence: Synthetic oligonucleotide
ctggagagatacttccataaccaggaggagttc

SEQ ID NO: 71487 - DNA, 33 bp, Artificial Sequence
  Description of Artificial Sequence: Synthetic oligonucleotide
tggagagatacttccataaccaggaggagttcg

SEQ ID NO: 71488 - DNA, 32 bp, Artificial Sequence
  Description of Artificial Sequence: Synthetic oligonucleotide
ggagagatacttccataaccaggaggagttcg

SEQ ID NO: 71489 - DNA, 33 bp, Artificial Sequence
  Description of Artificial Sequence: Synthetic oligonucleotide
gagagatacttccataaccaggaggagttcgtg

SEQ ID NO: 71490 - DNA, 33 bp, Artificial Sequence
  Description of Artificial Sequence: Synthetic oligonucleotide
agagatacttccataaccaggaggagttcgtgc

SEQ ID NO: 71491 - DNA, 32 bp, Artificial Sequence
  Description of Artificial Sequence: Synthetic oligonucleotide
gagatacttccataaccaggaggagttcgtgc

SEQ ID NO: 71492 - DNA, 29 bp, Artificial Sequence
  Description of Artificial Sequence: Synthetic oligonucleotide
ggtggacacctactgcagacacaactacc

SEQ ID NO: 71493 - DNA, 29 bp, Artificial Sequence
  Description of Artificial Sequence: Synthetic oligonucleotide
gtggacacctactgcagacacaactaccg

SEQ ID NO: 71494 - DNA, 29 bp, Artificial Sequence
  Description of Artificial Sequence: Synthetic oligonucleotide
tggacacctactgcagacacaactaccgg

SEQ ID NO: 71495 - DNA, 28 bp, Artificial Sequence
  Description of Artificial Sequence: Synthetic oligonucleotide
ggacacctactgcagacacaactaccgg

SEQ ID NO: 71496 - DNA, 28 bp, Artificial Sequence
  Description of Artificial Sequence: Synthetic oligonucleotide
gacacctactgcagacacaactaccggg

SEQ ID NO: 71497 - DNA, 30 bp, Artificial Sequence
  Description of Artificial Sequence: Synthetic oligonucleotide
acacctactgcagacacaactaccgggttg

SEQ ID NO: 71498 - DNA, 29 bp, Artificial Sequence
  Description of Artificial Sequence: Synthetic oligonucleotide
cacctactgcagacacaactaccgggttg

SEQ ID NO: 71499 - DNA, 30 bp, Artificial Sequence
  Description of Artificial Sequence: Synthetic oligonucleotide
acctactgcagacacaactaccgggttgtg

SEQ ID NO: 71500 - DNA, 29 bp, Artificial Sequence
  Description of Artificial Sequence: Synthetic oligonucleotide
cctactgcagacacaactaccgggttgtg

SEQ ID NO: 71501 - DNA, 29 bp, Artificial Sequence
  Description of Artificial Sequence: Synthetic oligonucleotide
ctactgcagacacaactaccgggttgtgg

SEQ ID NO: 71502 - DNA, 30 bp, Artificial Sequence
  Description of Artificial Sequence: Synthetic oligonucleotide
tactgcagacacaactaccgggttgtggag

SEQ ID NO: 71503 - DNA, 29 bp, Artificial Sequence
  Description of Artificial Sequence: Synthetic oligonucleotide
actgcagacacaactaccgggttgtggag

SEQ ID NO: 71504 - DNA, 28 bp, Artificial Sequence
  Description of Artificial Sequence: Synthetic oligonucleotide
ctgcagacacaactaccgggttgtggag

SEQ ID NO: 71505 - DNA, 29 bp, Artificial Sequence
  Description of Artificial Sequence: Synthetic oligonucleotide
tgcagacacaactaccgggttgtggagag

SEQ ID NO: 71506 - DNA, 28 bp, Artificial Sequence
  Description of Artificial Sequence: Synthetic oligonucleotide
gcagacacaactaccgggttgtggagag

SEQ ID NO: 71507 - DNA, 28 bp, Artificial Sequence
  Description of Artificial Sequence: Synthetic oligonucleotide
cagacacaactaccgggttgtggagagc

SEQ ID NO: 71508 - DNA, 30 bp, Artificial Sequence
  Description of Artificial Sequence: Synthetic oligonucleotide
agacacaactaccgggttgtggagagcttc

SEQ ID NO: 71509 - DNA, 29 bp, Artificial Sequence
  Description of Artificial Sequence: Synthetic oligonucleotide
gacacaactaccgggttgtggagagcttc

SEQ ID NO: 71510 - DNA, 30 bp, Artificial Sequence
  Description of Artificial Sequence: Synthetic oligonucleotide
acacaactaccgggttgtggagagcttcac

SEQ ID NO: 71511 - DNA, 22 bp, Artificial Sequence
  Description of Artificial Sequence: Synthetic oligonucleotide
tggggcggcctgtcgccgagta

SEQ ID NO: 71512 - DNA, 25 bp, Artificial Sequence
  Description of Artificial Sequence: Synthetic oligonucleotide
aagacaagcgggccgcggtggacaa

SEQ ID NO: 71513 - DNA, 24 bp, Artificial Sequence
  Description of Artificial Sequence: Synthetic oligonucleotide
agacaagcgggccgcggtggacaa

SEQ ID NO: 71514 - DNA, 23 bp, Artificial Sequence
  Description of Artificial Sequence: Synthetic oligonucleotide
gacaagcgggccgcggtggacaa

SEQ ID NO: 71515 - DNA, 25 bp, Artificial Sequence
  Description of Artificial Sequence: Synthetic oligonucleotide
acaagcgggccgcggtggacaacta

SEQ ID NO: 71516 - DNA, 24 bp, Artificial Sequence
  Description of Artificial Sequence: Synthetic oligonucleotide
caagcgggccgcggtggacaacta

SEQ ID NO: 71517 - DNA, 27 bp, Artificial Sequence
  Description of Artificial Sequence: Synthetic oligonucleotide
aagacaagcgggccgcggtggacaatt

SEQ ID NO: 71518 - DNA, 27 bp, Artificial Sequence
  Description of Artificial Sequence: Synthetic oligonucleotide
agacaagcgggccgcggtggacaatta

SEQ ID NO: 71519 - DNA, 26 bp, Artificial Sequence
  Description of Artificial Sequence: Synthetic oligonucleotide
gacaagcgggccgcggtggacaatta

SEQ ID NO: 71520 - DNA, 27 bp, Artificial Sequence
  Description of Artificial Sequence: Synthetic oligonucleotide
acaagcgggccgcggtggacaattact

SEQ ID NO: 71521 - DNA, 26 bp, Artificial Sequence
  Description of Artificial Sequence: Synthetic oligonucleotide
caagcgggccgcggtggacaattact

SEQ ID NO: 71522 - DNA, 33 bp, Artificial Sequence
  Description of Artificial Sequence: Synthetic oligonucleotide
tggacagatacttccataaccaggaggagaacc

SEQ ID NO: 71523 - DNA, 32 bp, Artificial Sequence
  Description of Artificial Sequence: Synthetic oligonucleotide
ggacagatacttccataaccaggaggagaacc

SEQ ID NO: 71524 - DNA, 33 bp, Artificial Sequence
  Description of Artificial Sequence: Synthetic oligonucleotide
gacagatacttccataaccaggaggagaacctg

SEQ ID NO: 71525 - DNA, 33 bp, Artificial Sequence
  Description of Artificial Sequence: Synthetic oligonucleotide
acagatacttccataaccaggaggagaacctgc

SEQ ID NO: 71526 - DNA, 32 bp, Artificial Sequence
  Description of Artificial Sequence: Synthetic oligonucleotide
cagatacttccataaccaggaggagaacctgc

SEQ ID NO: 71527 - DNA, 32 bp, Artificial Sequence
  Description of Artificial Sequence: Synthetic oligonucleotide
agatacttccataaccaggaggagaacctgcg

SEQ ID NO: 71528 - DNA, 31 bp, Artificial Sequence
  Description of Artificial Sequence: Synthetic oligonucleotide
gatacttccataaccaggaggagaacctgcg

SEQ ID NO: 71529 - DNA, 31 bp, Artificial Sequence
  Description of Artificial Sequence: Synthetic oligonucleotide
atacttccataaccaggaggagaacctgcgc

SEQ ID NO: 71530 - DNA, 30 bp, Artificial Sequence
  Description of Artificial Sequence: Synthetic oligonucleotide
tacttccataaccaggaggagaacctgcgc

SEQ ID NO: 71531 - DNA, 29 bp, Artificial Sequence
  Description of Artificial Sequence: Synthetic oligonucleotide
acttccataaccaggaggagaacctgcgc

SEQ ID NO: 71532 - DNA, 28 bp, Artificial Sequence
  Description of Artificial Sequence: Synthetic oligonucleotide
cttccataaccaggaggagaacctgcgc

SEQ ID NO: 71533 - DNA, 30 bp, Artificial Sequence
  Description of Artificial Sequence: Synthetic oligonucleotide
ttccataaccaggaggagaacctgcgcttc

SEQ ID NO: 71534 - DNA, 29 bp, Artificial Sequence
  Description of Artificial Sequence: Synthetic oligonucleotide
tccataaccaggaggagaacctgcgcttc

SEQ ID NO: 71535 - DNA, 28 bp, Artificial Sequence
  Description of Artificial Sequence: Synthetic oligonucleotide
ccataaccaggaggagaacctgcgcttc

SEQ ID NO: 71536 - DNA, 28 bp, Artificial Sequence
  Description of Artificial Sequence: Synthetic oligonucleotide
cataaccaggaggagaacctgcgcttcg

SEQ ID NO: 71537 - DNA, 29 bp, Artificial Sequence
  Description of Artificial Sequence: Synthetic oligonucleotide
ataaccaggaggagaacctgcgcttcgac

SEQ ID NO: 71538 - DNA, 28 bp, Artificial Sequence
  Description of Artificial Sequence: Synthetic oligonucleotide
taaccaggaggagaacctgcgcttcgac

SEQ ID NO: 71539 - DNA, 27 bp, Artificial Sequence
  Description of Artificial Sequence: Synthetic oligonucleotide
aaccaggaggagaacctgcgcttcgac

SEQ ID NO: 71540 - DNA, 27 bp, Artificial Sequence
  Description of Artificial Sequence: Synthetic oligonucleotide
accaggaggagaacctgcgcttcgaca

SEQ ID NO: 71541 - DNA, 26 bp, Artificial Sequence
  Description of Artificial Sequence: Synthetic oligonucleotide
ccaggaggagaacctgcgcttcgaca

SEQ ID NO: 71542 - DNA, 26 bp, Artificial Sequence
  Description of Artificial Sequence: Synthetic oligonucleotide
caggaggagaacctgcgcttcgacag

SEQ ID NO: 71543 - DNA, 26 bp, Artificial Sequence
  Description of Artificial Sequence: Synthetic oligonucleotide
aggaggagaacctgcgcttcgacagc

SEQ ID NO: 71544 - DNA, 25 bp, Artificial Sequence
  Description of Artificial Sequence: Synthetic oligonucleotide
ggaggagaacctgcgcttcgacagc

SEQ ID NO: 71545 - DNA, 26 bp, Artificial Sequence
  Description of Artificial Sequence: Synthetic oligonucleotide
gaggagaacctgcgcttcgacagcga

SEQ ID NO: 71546 - DNA, 26 bp, Artificial Sequence
  Description of Artificial Sequence: Synthetic oligonucleotide
aggagaacctgcgcttcgacagcgac

SEQ ID NO: 71547 - DNA, 25 bp, Artificial Sequence
  Description of Artificial Sequence: Synthetic oligonucleotide
ggagaacctgcgcttcgacagcgac

SEQ ID NO: 71548 - DNA, 26 bp, Artificial Sequence
  Description of Artificial Sequence: Synthetic oligonucleotide
gagaacctgcgcttcgacagcgacgt

SEQ ID NO: 71549 - DNA, 26 bp, Artificial Sequence
  Description of Artificial Sequence: Synthetic oligonucleotide
agaacctgcgcttcgacagcgacgtg

SEQ ID NO: 71550 - DNA, 25 bp, Artificial Sequence
  Description of Artificial Sequence: Synthetic oligonucleotide
gaacctgcgcttcgacagcgacgtg

SEQ ID NO: 71551 - DNA, 25 bp, Artificial Sequence
  Description of Artificial Sequence: Synthetic oligonucleotide
aacctgcgcttcgacagcgacgtgg

SEQ ID NO: 71552 - DNA, 26 bp, Artificial Sequence
  Description of Artificial Sequence: Synthetic oligonucleotide
ttcgacagcgacgtgggggagttcct

SEQ ID NO: 71553 - DNA, 25 bp, Artificial Sequence
  Description of Artificial Sequence: Synthetic oligonucleotide
tcgacagcgacgtgggggagttcct

SEQ ID NO: 71554 - DNA, 24 bp, Artificial Sequence
  Description of Artificial Sequence: Synthetic oligonucleotide
cgacagcgacgtgggggagttcct

SEQ ID NO: 71555 - DNA, 24 bp, Artificial Sequence
  Description of Artificial Sequence: Synthetic oligonucleotide
gacagcgacgtgggggagttcctg

SEQ ID NO: 71556 - DNA, 24 bp, Artificial Sequence
  Description of Artificial Sequence: Synthetic oligonucleotide
acagcgacgtgggggagttcctgg

SEQ ID NO: 71557 - DNA, 23 bp, Artificial Sequence
  Description of Artificial Sequence: Synthetic oligonucleotide
cagcgacgtgggggagttcctgg

SEQ ID NO: 71558 - DNA, 23 bp, Artificial Sequence
  Description of Artificial Sequence: Synthetic oligonucleotide
agcgacgtgggggagttcctggc

SEQ ID NO: 71559 - DNA, 22 bp, Artificial Sequence
  Description of Artificial Sequence: Synthetic oligonucleotide
gcgacgtgggggagttcctggc

SEQ ID NO: 71560 - DNA, 22 bp, Artificial Sequence
  Description of Artificial Sequence: Synthetic oligonucleotide
cgacgtgggggagttcctggcg

SEQ ID NO: 71561 - DNA, 23 bp, Artificial Sequence
  Description of Artificial Sequence: Synthetic oligonucleotide
gacgtgggggagttcctggcggt

SEQ ID NO: 71562 - DNA, 24 bp, Artificial Sequence
  Description of Artificial Sequence: Synthetic oligonucleotide
acgtgggggagttcctggcggtga

SEQ ID NO: 71563 - DNA, 23 bp, Artificial Sequence
  Description of Artificial Sequence: Synthetic oligonucleotide
cgtgggggagttcctggcggtga

SEQ ID NO: 71564 - DNA, 23 bp, Artificial Sequence
  Description of Artificial Sequence: Synthetic oligonucleotide
gtgggggagttcctggcggtgac

SEQ ID NO: 71565 - DNA, 23 bp, Artificial Sequence
  Description of Artificial Sequence: Synthetic oligonucleotide
tgggggagttcctggcggtgacg

SEQ ID NO: 71566 - DNA, 22 bp, Artificial Sequence
  Description of Artificial Sequence: Synthetic oligonucleotide
gggggagttcctggcggtgacg

SEQ ID NO: 71567 - DNA, 23 bp, Artificial Sequence
  Description of Artificial Sequence: Synthetic oligonucleotide
ggggagttcctggcggtgacgga

SEQ ID NO: 71568 - DNA, 23 bp, Artificial Sequence
  Description of Artificial Sequence: Synthetic oligonucleotide
gggagttcctggcggtgacggag

SEQ ID NO: 71569 - DNA, 24 bp, Artificial Sequence
  Description of Artificial Sequence: Synthetic oligonucleotide
ggagttcctggcggtgacggagct

SEQ ID NO: 71570 - DNA, 24 bp, Artificial Sequence
  Description of Artificial Sequence: Synthetic oligonucleotide
gagttcctggcggtgacggagctg

SEQ ID NO: 71571 - DNA, 24 bp, Artificial Sequence
  Description of Artificial Sequence: Synthetic oligonucleotide
agttcctggcggtgacggagctgg

SEQ ID NO: 71572 - DNA, 23 bp, Artificial Sequence
  Description of Artificial Sequence: Synthetic oligonucleotide
gttcctggcggtgacggagctgg

SEQ ID NO: 71573 - DNA, 23 bp, Artificial Sequence
  Description of Artificial Sequence: Synthetic oligonucleotide
ttcctggcggtgacggagctggg

SEQ ID NO: 71574 - DNA, 22 bp, Artificial Sequence
  Description of Artificial Sequence: Synthetic oligonucleotide
tcctggcggtgacggagctggg

SEQ ID NO: 71575 - DNA, 21 bp, Artificial Sequence
  Description of Artificial Sequence: Synthetic oligonucleotide
cctggcggtgacggagctggg

SEQ ID NO: 71576 - DNA, 21 bp, Artificial Sequence
  Description of Artificial Sequence: Synthetic oligonucleotide
ctggcggtgacggagctgggg

SEQ ID NO: 71577 - DNA, 21 bp, Artificial Sequence
  Description of Artificial Sequence: Synthetic oligonucleotide
tggcggtgacggagctggggc

SEQ ID NO: 71578 - DNA, 25 bp, Artificial Sequence
  Description of Artificial Sequence: Synthetic oligonucleotide
tggagagcttcacagtgcagcggcg

SEQ ID NO: 71579 - DNA, 23 bp, Artificial Sequence
  Description of Artificial Sequence: Synthetic oligonucleotide
gacgtgggggagttccgggcgtt

SEQ ID NO: 71580 - DNA, 24 bp, Artificial Sequence
  Description of Artificial Sequence: Synthetic oligonucleotide
acgtgggggagttccgggcgttga

SEQ ID NO: 71581 - DNA, 23 bp, Artificial Sequence
  Description of Artificial Sequence: Synthetic oligonucleotide
cgtgggggagttccgggcgttga

SEQ ID NO: 71582 - DNA, 23 bp, Artificial Sequence
  Description of Artificial Sequence: Synthetic oligonucleotide
gtgggggagttccgggcgttgac

SEQ ID NO: 71583 - DNA, 23 bp, Artificial Sequence
  Description of Artificial Sequence: Synthetic oligonucleotide
tgggggagttccgggcgttgacg

SEQ ID NO: 71584 - DNA, 22 bp, Artificial Sequence
  Description of Artificial Sequence: Synthetic oligonucleotide
gggggagttccgggcgttgacg

SEQ ID NO: 71585 - DNA, 23 bp, Artificial Sequence
  Description of Artificial Sequence: Synthetic oligonucleotide
ggggagttccgggcgttgacgga

SEQ ID NO: 71586 - DNA, 23 bp, Artificial Sequence
  Description of Artificial Sequence: Synthetic oligonucleotide
gggagttccgggcgttgacggag

SEQ ID NO: 71587 - DNA, 24 bp, Artificial Sequence
  Description of Artificial Sequence: Synthetic oligonucleotide
ggagttccgggcgttgacggagct

SEQ ID NO: 71588 - DNA, 24 bp, Artificial Sequence
  Description of Artificial Sequence: Synthetic oligonucleotide
gagttccgggcgttgacggagctg

SEQ ID NO: 71589 - DNA, 24 bp, Artificial Sequence
  Description of Artificial Sequence: Synthetic oligonucleotide
agttccgggcgttgacggagctgg

SEQ ID NO: 71590 - DNA, 23 bp, Artificial Sequence
  Description of Artificial Sequence: Synthetic oligonucleotide
gttccgggcgttgacggagctgg

SEQ ID NO: 71591 - DNA, 23 bp, Artificial Sequence
  Description of Artificial Sequence: Synthetic oligonucleotide
ttccgggcgttgacggagctggg

SEQ ID NO: 71592 - DNA, 22 bp, Artificial Sequence
  Description of Artificial Sequence: Synthetic oligonucleotide
tccgggcgttgacggagctggg

SEQ ID NO: 71593 - DNA, 21 bp, Artificial Sequence
  Description of Artificial Sequence: Synthetic oligonucleotide
ccgggcgttgacggagctggg

SEQ ID NO: 71594 - DNA, 21 bp, Artificial Sequence
  Description of Artificial Sequence: Synthetic oligonucleotide
cgggcgttgacggagctgggg

SEQ ID NO: 71595 - DNA, 21 bp, Artificial Sequence
  Description of Artificial Sequence: Synthetic oligonucleotide
gggcgttgacggagctggggc

SEQ ID NO: 71596 - DNA, 21 bp, Artificial Sequence
  Description of Artificial Sequence: Synthetic oligonucleotide
ggcgttgacggagctggggcg

SEQ ID NO: 71597 - DNA, 21 bp, Artificial Sequence
  Description of Artificial Sequence: Synthetic oligonucleotide
gcgttgacggagctggggcgg

SEQ ID NO: 71598 - DNA, 21 bp, Artificial Sequence
  Description of Artificial Sequence: Synthetic oligonucleotide
cgttgacggagctggggcggc

SEQ ID NO: 71599 - DNA, 22 bp, Artificial Sequence
  Description of Artificial Sequence: Synthetic oligonucleotide
gttgacggagctggggcggcct

SEQ ID NO: 71600 - DNA, 24 bp, Artificial Sequence
  Description of Artificial Sequence: Synthetic oligonucleotide
ttgacggagctggggcggcctgat

SEQ ID NO: 71601 - DNA, 22 bp, Artificial Sequence
  Description of Artificial Sequence: Synthetic oligonucleotide
ggacggagcgggtgcggttcca

SEQ ID NO: 71602 - DNA, 22 bp, Artificial Sequence
  Description of Artificial Sequence: Synthetic oligonucleotide
gacggagcgggtgcggttccag

SEQ ID NO: 71603 - DNA, 23 bp, Artificial Sequence
  Description of Artificial Sequence: Synthetic oligonucleotide
acggagcgggtgcggttccagga

SEQ ID NO: 71604 - DNA, 22 bp, Artificial Sequence
  Description of Artificial Sequence: Synthetic oligonucleotide
cggagcgggtgcggttccagga

SEQ ID NO: 71605 - DNA, 23 bp, Artificial Sequence
  Description of Artificial Sequence: Synthetic oligonucleotide
ggagcgggtgcggttccaggaca

SEQ ID NO: 71606 - DNA, 26 bp, Artificial Sequence
  Description of Artificial Sequence: Synthetic oligonucleotide
gagcgggtgcggttccaggacagata

SEQ ID NO: 71607 - DNA, 27 bp, Artificial Sequence
  Description of Artificial Sequence: Synthetic oligonucleotide
agcgggtgcggttccaggacagatact

SEQ ID NO: 71608 - DNA, 27 bp, Artificial Sequence
  Description of Artificial Sequence: Synthetic oligonucleotide
gcgggtgcggttccaggacagatactt

SEQ ID NO: 71609 - DNA, 27 bp, Artificial Sequence
  Description of Artificial Sequence: Synthetic oligonucleotide
cgggtgcggttccaggacagatacttc

SEQ ID NO: 71610 - DNA, 27 bp, Artificial Sequence
  Description of Artificial Sequence: Synthetic oligonucleotide
gggtgcggttccaggacagatacttcc

SEQ ID NO: 71611 - DNA, 31 bp, Artificial Sequence
  Description of Artificial Sequence: Synthetic oligonucleotide
ggtgcggttccaggacagatacttccataac

SEQ ID NO: 71612 - DNA, 31 bp, Artificial Sequence
  Description of Artificial Sequence: Synthetic oligonucleotide
gtgcggttccaggacagatacttccataacc

SEQ ID NO: 71613 - DNA, 32 bp, Artificial Sequence
  Description of Artificial Sequence: Synthetic oligonucleotide
tgcggttccaggacagatacttccataaccag

SEQ ID NO: 71614 - DNA, 31 bp, Artificial Sequence
  Description of Artificial Sequence: Synthetic oligonucleotide
gcggttccaggacagatacttccataaccag

SEQ ID NO: 71615 - DNA, 31 bp, Artificial Sequence
  Description of Artificial Sequence: Synthetic oligonucleotide
cggttccaggacagatacttccataaccagg

SEQ ID NO: 71616 - DNA, 32 bp, Artificial Sequence
  Description of Artificial Sequence: Synthetic oligonucleotide
ggttccaggacagatacttccataaccaggag

SEQ ID NO: 71617 - DNA, 32 bp, Artificial Sequence
  Description of Artificial Sequence: Synthetic oligonucleotide
gttccaggacagatacttccataaccaggagg

SEQ ID NO: 71618 - DNA, 33 bp, Artificial Sequence
  Description of Artificial Sequence: Synthetic oligonucleotide
ttccaggacagatacttccataaccaggaggag

SEQ ID NO: 71619 - DNA, 32 bp, Artificial Sequence
  Description of Artificial Sequence: Synthetic oligonucleotide
tccaggacagatacttccataaccaggaggag

SEQ ID NO: 71620 - DNA, 31 bp, Artificial Sequence
  Description of Artificial Sequence: Synthetic oligonucleotide
ccaggacagatacttccataaccaggaggag

SEQ ID NO: 71621 - DNA, 33 bp, Artificial Sequence
  Description of Artificial Sequence: Synthetic oligonucleotide
caggacagatacttccataaccaggaggagaac

SEQ ID NO: 71622 - DNA, 33 bp, Artificial Sequence
  Description of Artificial Sequence: Synthetic oligonucleotide
aggacagatacttccataaccaggaggagaacg

SEQ ID NO: 71623 - DNA, 35 bp, Artificial Sequence
  Description of Artificial Sequence: Synthetic oligonucleotide
ttcctggacagatacttctataaccaggaggagtc

SEQ ID NO: 71624 - DNA, 34 bp, Artificial Sequence
  Description of Artificial Sequence: Synthetic oligonucleotide
tcctggacagatacttctataaccaggaggagtc

SEQ ID NO: 71625 - DNA, 33 bp, Artificial Sequence
  Description of Artificial Sequence: Synthetic oligonucleotide
cctggacagatacttctataaccaggaggagtc

SEQ ID NO: 71626 - DNA, 33 bp, Artificial Sequence
  Description of Artificial Sequence: Synthetic oligonucleotide
ctggacagatacttctataaccaggaggagtcc

SEQ ID NO: 71627 - DNA, 33 bp, Artificial Sequence
  Description of Artificial Sequence: Synthetic oligonucleotide
tggacagatacttctataaccaggaggagtccg

SEQ ID NO: 71628 - DNA, 32 bp, Artificial Sequence
  Description of Artificial Sequence: Synthetic oligonucleotide
ggacagatacttctataaccaggaggagtccg

SEQ ID NO: 71629 - DNA, 33 bp, Artificial Sequence
  Description of Artificial Sequence: Synthetic oligonucleotide
gacagatacttctataaccaggaggagtccgtg

SEQ ID NO: 71630 - DNA, 33 bp, Artificial Sequence
  Description of Artificial Sequence: Synthetic oligonucleotide
acagatacttctataaccaggaggagtccgtgc

SEQ ID NO: 71631 - DNA, 32 bp, Artificial Sequence
  Description of Artificial Sequence: Synthetic oligonucleotide
cagatacttctataaccaggaggagtccgtgc

SEQ ID NO: 71632 - DNA, 32 bp, Artificial Sequence
  Description of Artificial Sequence: Synthetic oligonucleotide
agatacttctataaccaggaggagtccgtgcg

SEQ ID NO: 71633 - DNA, 31 bp, Artificial Sequence
  Description of Artificial Sequence: Synthetic oligonucleotide
gatacttctataaccaggaggagtccgtgcg

SEQ ID NO: 71634 - DNA, 31 bp, Artificial Sequence
  Description of Artificial Sequence: Synthetic oligonucleotide
atacttctataaccaggaggagtccgtgcgc

SEQ ID NO: 71635 - DNA, 30 bp, Artificial Sequence
  Description of Artificial Sequence: Synthetic oligonucleotide
tacttctataaccaggaggagtccgtgcgc

SEQ ID NO: 71636 - DNA, 29 bp, Artificial Sequence
  Description of Artificial Sequence: Synthetic oligonucleotide
acttctataaccaggaggagtccgtgcgc

SEQ ID NO: 71637 - DNA, 28 bp, Artificial Sequence
  Description of Artificial Sequence: Synthetic oligonucleotide
cttctataaccaggaggagtccgtgcgc

SEQ ID NO: 71638 - DNA, 30 bp, Artificial Sequence
  Description of Artificial Sequence: Synthetic oligonucleotide
ttctataaccaggaggagtccgtgcgcttc

SEQ ID NO: 71639 - DNA, 25 bp, Artificial Sequence
  Description of Artificial Sequence: Synthetic oligonucleotide
acgagcgggccgcggtggacaatta

SEQ ID NO: 71640 - DNA, 24 bp, Artificial Sequence
  Description of Artificial Sequence: Synthetic oligonucleotide
cgagcgggccgcggtggacaatta

SEQ ID NO: 71641 - DNA, 25 bp, Artificial Sequence
  Description of Artificial Sequence: Synthetic oligonucleotide
gagcgggccgcggtggacaattact

SEQ ID NO: 71642 - DNA, 31 bp, Artificial Sequence
  Description of Artificial Sequence: Synthetic oligonucleotide
ctggacagatacttccataaccaggaggagg

SEQ ID NO: 71643 - DNA, 32 bp, Artificial Sequence
  Description of Artificial Sequence: Synthetic oligonucleotide
tggacagatacttccataaccaggaggaggac

SEQ ID NO: 71644 - DNA, 31 bp, Artificial Sequence
  Description of Artificial Sequence: Synthetic oligonucleotide
ggacagatacttccataaccaggaggaggac

SEQ ID NO: 71645 - DNA, 31 bp, Artificial Sequence
  Description of Artificial Sequence: Synthetic oligonucleotide
gacagatacttccataaccaggaggaggacg

SEQ ID NO: 71646 - DNA, 32 bp, Artificial Sequence
  Description of Artificial Sequence: Synthetic oligonucleotide
acagatacttccataaccaggaggaggacgtg

SEQ ID NO: 71647 - DNA, 31 bp, Artificial Sequence
  Description of Artificial Sequence: Synthetic oligonucleotide
cagatacttccataaccaggaggaggacgtg

SEQ ID NO: 71648 - DNA, 31 bp, Artificial Sequence
  Description of Artificial Sequence: Synthetic oligonucleotide
agatacttccataaccaggaggaggacgtgc

SEQ ID NO: 71649 - DNA, 30 bp, Artificial Sequence
  Description of Artificial Sequence: Synthetic oligonucleotide
gatacttccataaccaggaggaggacgtgc

SEQ ID NO: 71650 - DNA, 30 bp, Artificial Sequence
  Description of Artificial Sequence: Synthetic oligonucleotide
atacttccataaccaggaggaggacgtgcg

SEQ ID NO: 71651 - DNA, 29 bp, Artificial Sequence
  Description of Artificial Sequence: Synthetic oligonucleotide
tacttccataaccaggaggaggacgtgcg

SEQ ID NO: 71652 - DNA, 28 bp, Artificial Sequence
  Description of Artificial Sequence: Synthetic oligonucleotide
acttccataaccaggaggaggacgtgcg

SEQ ID NO: 71653 - DNA, 27 bp, Artificial Sequence
  Description of Artificial Sequence: Synthetic oligonucleotide
cttccataaccaggaggaggacgtgcg

SEQ ID NO: 71654 - DNA, 27 bp, Artificial Sequence
  Description of Artificial Sequence: Synthetic oligonucleotide
ttccataaccaggaggaggacgtgcgc

SEQ ID NO: 71655 - DNA, 27 bp, Artificial Sequence
  Description of Artificial Sequence: Synthetic oligonucleotide
tccataaccaggaggaggacgtgcgct

SEQ ID NO: 71656 - DNA, 27 bp, Artificial Sequence
  Description of Artificial Sequence: Synthetic oligonucleotide
ccataaccaggaggaggacgtgcgctt

SEQ ID NO: 71657 - DNA, 27 bp, Artificial Sequence
  Description of Artificial Sequence: Synthetic oligonucleotide
cataaccaggaggaggacgtgcgcttc

SEQ ID NO: 71658 - DNA, 27 bp, Artificial Sequence
  Description of Artificial Sequence: Synthetic oligonucleotide
ataaccaggaggaggacgtgcgcttcg

SEQ ID NO: 71659 - DNA, 27 bp, Artificial Sequence
  Description of Artificial Sequence: Synthetic oligonucleotide
taaccaggaggaggacgtgcgcttcga

SEQ ID NO: 71660 - DNA, 26 bp, Artificial Sequence
  Description of Artificial Sequence: Synthetic oligonucleotide
aaccaggaggaggacgtgcgcttcga

SEQ ID NO: 71661 - DNA, 25 bp, Artificial Sequence
  Description of Artificial Sequence: Synthetic oligonucleotide
accaggaggaggacgtgcgcttcga

SEQ ID NO: 71662 - DNA, 24 bp, Artificial Sequence
  Description of Artificial Sequence: Synthetic oligonucleotide
ccaggaggaggacgtgcgcttcga

SEQ ID NO: 71663 - DNA, 25 bp, Artificial Sequence
  Description of Artificial Sequence: Synthetic oligonucleotide
caggaggaggacgtgcgcttcgaca

SEQ ID NO: 71664 - DNA, 25 bp, Artificial Sequence
  Description of Artificial Sequence: Synthetic oligonucleotide
aggaggaggacgtgcgcttcgacag

SEQ ID NO: 71665 - DNA, 24 bp, Artificial Sequence
  Description of Artificial Sequence: Synthetic oligonucleotide
ggaggaggacgtgcgcttcgacag

SEQ ID NO: 71666 - DNA, 28 bp, Artificial Sequence
  Description of Artificial Sequence: Synthetic oligonucleotide
cgggtgctgttcctggacagatacttcc

SEQ ID NO: 71667 - DNA, 32 bp, Artificial Sequence
  Description of Artificial Sequence: Synthetic oligonucleotide
gggtgctgttcctggacagatacttccataac

SEQ ID NO: 71668 - DNA, 32 bp, Artificial Sequence
  Description of Artificial Sequence: Synthetic oligonucleotide
ggtgctgttcctggacagatacttccataacc

SEQ ID NO: 71669 - DNA, 33 bp, Artificial Sequence
  Description of Artificial Sequence: Synthetic oligonucleotide
gtgctgttcctggacagatacttccataaccag

SEQ ID NO: 71670 - DNA, 33 bp, Artificial Sequence
  Description of Artificial Sequence: Synthetic oligonucleotide
tgctgttcctggacagatacttccataaccagg

SEQ ID NO: 71671 - DNA, 32 bp, Artificial Sequence
  Description of Artificial Sequence: Synthetic oligonucleotide
gctgttcctggacagatacttccataaccagg

SEQ ID NO: 71672 - DNA, 33 bp, Artificial Sequence
  Description of Artificial Sequence: Synthetic oligonucleotide
ctgttcctggacagatacttccataaccaggag

SEQ ID NO: 71673 - DNA, 33 bp, Artificial Sequence
  Description of Artificial Sequence: Synthetic oligonucleotide
tgttcctggacagatacttccataaccaggagg

SEQ ID NO: 71674 - DNA, 29 bp, Artificial Sequence
  Description of Artificial Sequence: Synthetic oligonucleotide
gagtactggaacagccagaaggacatccg

SEQ ID NO: 71675 - DNA, 29 bp, Artificial Sequence
  Description of Artificial Sequence: Synthetic oligonucleotide
agtactggaacagccagaaggacatccgg

SEQ ID NO: 71676 - DNA, 28 bp, Artificial Sequence
  Description of Artificial Sequence: Synthetic oligonucleotide
gtactggaacagccagaaggacatccgg

SEQ ID NO: 71677 - DNA, 28 bp, Artificial Sequence
  Description of Artificial Sequence: Synthetic oligonucleotide
tactggaacagccagaaggacatccggg

SEQ ID NO: 71678 - DNA, 27 bp, Artificial Sequence
  Description of Artificial Sequence: Synthetic oligonucleotide
actggaacagccagaaggacatccggg

SEQ ID NO: 71679 - DNA, 27 bp, Artificial Sequence
  Description of Artificial Sequence: Synthetic oligonucleotide
ctggaacagccagaaggacatccggga

SEQ ID NO: 71680 - DNA, 28 bp, Artificial Sequence
  Description of Artificial Sequence: Synthetic oligonucleotide
tggaacagccagaaggacatccgggaag

SEQ ID NO: 71681 - DNA, 27 bp, Artificial Sequence
  Description of Artificial Sequence: Synthetic oligonucleotide
ggaacagccagaaggacatccgggaag

SEQ ID NO: 71682 - DNA, 28 bp, Artificial Sequence
  Description of Artificial Sequence: Synthetic oligonucleotide
gaacagccagaaggacatccgggaagac

SEQ ID NO: 71683 - DNA, 28 bp, Artificial Sequence
  Description of Artificial Sequence: Synthetic oligonucleotide
aacagccagaaggacatccgggaagacg

SEQ ID NO: 71684 - DNA, 27 bp, Artificial Sequence
  Description of Artificial Sequence: Synthetic oligonucleotide
acagccagaaggacatccgggaagacg

SEQ ID NO: 71685 - DNA, 27 bp, Artificial Sequence
  Description of Artificial Sequence: Synthetic oligonucleotide
cagccagaaggacatccgggaagacga

SEQ ID NO: 71686 - DNA, 27 bp, Artificial Sequence
  Description of Artificial Sequence: Synthetic oligonucleotide
agccagaaggacatccgggaagacgag

SEQ ID NO: 71687 - DNA, 26 bp, Artificial Sequence
  Description of Artificial Sequence: Synthetic oligonucleotide
gccagaaggacatccgggaagacgag

SEQ ID NO: 71688 - DNA, 26 bp, Artificial Sequence
  Description of Artificial Sequence: Synthetic oligonucleotide
ccagaaggacatccgggaagacgagc

SEQ ID NO: 71689 - DNA, 26 bp, Artificial Sequence
  Description of Artificial Sequence: Synthetic oligonucleotide
cagaaggacatccgggaagacgagcg

SEQ ID NO: 71690 - DNA, 26 bp, Artificial Sequence
  Description of Artificial Sequence: Synthetic oligonucleotide
agaaggacatccgggaagacgagcgg

SEQ ID NO: 71691 - DNA, 25 bp, Artificial Sequence
  Description of Artificial Sequence: Synthetic oligonucleotide
gaaggacatccgggaagacgagcgg

SEQ ID NO: 71692 - DNA, 25 bp, Artificial Sequence
  Description of Artificial Sequence: Synthetic oligonucleotide
aaggacatccgggaagacgagcggg

SEQ ID NO: 71693 - DNA, 24 bp, Artificial Sequence
  Description of Artificial Sequence: Synthetic oligonucleotide
aggacatccgggaagacgagcggg

SEQ ID NO: 71694 - DNA, 23 bp, Artificial Sequence
  Description of Artificial Sequence: Synthetic oligonucleotide
ggacatccgggaagacgagcggg

SEQ ID NO: 71695 - DNA, 23 bp, Artificial Sequence
  Description of Artificial Sequence: Synthetic oligonucleotide
gacatccgggaagacgagcgggc

SEQ ID NO: 71696 - DNA, 23 bp, Artificial Sequence
  Description of Artificial Sequence: Synthetic oligonucleotide
acatccgggaagacgagcgggcc

SEQ ID NO: 71697 - DNA, 22 bp, Artificial Sequence
  Description of Artificial Sequence: Synthetic oligonucleotide
catccgggaagacgagcgggcc

SEQ ID NO: 71698 - DNA, 22 bp, Artificial Sequence
  Description of Artificial Sequence: Synthetic oligonucleotide
atccgggaagacgagcgggccg

SEQ ID NO: 71699 - DNA, 21 bp, Artificial Sequence
  Description of Artificial Sequence: Synthetic oligonucleotide
tccgggaagacgagcgggccg

SEQ ID NO: 71700 - DNA, 20 bp, Artificial Sequence
  Description of Artificial Sequence: Synthetic oligonucleotide
ccgggaagacgagcgggccg

SEQ ID NO: 71701 - DNA, 20 bp, Artificial Sequence
  Description of Artificial Sequence: Synthetic oligonucleotide
cgggaagacgagcgggccgc

SEQ ID NO: 71702 - DNA, 20 bp, Artificial Sequence
  Description of Artificial Sequence: Synthetic oligonucleotide
gggaagacgagcgggccgcg

SEQ ID NO: 71703 - DNA, 25 bp, Artificial Sequence
  Description of Artificial Sequence: Synthetic oligonucleotide
acatcctggaagacgagcgggccga

SEQ ID NO: 71704 - DNA, 24 bp, Artificial Sequence
  Description of Artificial Sequence: Synthetic oligonucleotide
catcctggaagacgagcgggccga

SEQ ID NO: 71705 - DNA, 24 bp, Artificial Sequence
  Description of Artificial Sequence: Synthetic oligonucleotide
atcctggaagacgagcgggccgag

SEQ ID NO: 71706 - DNA, 23 bp, Artificial Sequence
  Description of Artificial Sequence: Synthetic oligonucleotide
tcctggaagacgagcgggccgag

SEQ ID NO: 71707 - DNA, 22 bp, Artificial Sequence
  Description of Artificial Sequence: Synthetic oligonucleotide
cctggaagacgagcgggccgag

SEQ ID NO: 71708 - DNA, 23 bp, Artificial Sequence
  Description of Artificial Sequence: Synthetic oligonucleotide
ctggaagacgagcgggccgaggt

SEQ ID NO: 71709 - DNA, 23 bp, Artificial Sequence
  Description of Artificial Sequence: Synthetic oligonucleotide
tggaagacgagcgggccgaggtg

SEQ ID NO: 71710 - DNA, 22 bp, Artificial Sequence
  Description of Artificial Sequence: Synthetic oligonucleotide
ggaagacgagcgggccgaggtg

SEQ ID NO: 71711 - DNA, 23 bp, Artificial Sequence
  Description of Artificial Sequence: Synthetic oligonucleotide
gaagacgagcgggccgaggtgga

SEQ ID NO: 71712 - DNA, 24 bp, Artificial Sequence
  Description of Artificial Sequence: Synthetic oligonucleotide
aagacgagcgggccgaggtggaca

SEQ ID NO: 71713 - DNA, 23 bp, Artificial Sequence
  Description of Artificial Sequence: Synthetic oligonucleotide
agacgagcgggccgaggtggaca

SEQ ID NO: 71714 - DNA, 22 bp, Artificial Sequence
  Description of Artificial Sequence: Synthetic oligonucleotide
gacgagcgggccgaggtggaca

SEQ ID NO: 71715 - DNA, 22 bp, Artificial Sequence
  Description of Artificial Sequence: Synthetic oligonucleotide
acgagcgggccgaggtggacac

SEQ ID NO: 71716 - DNA, 21 bp, Artificial Sequence
  Description of Artificial Sequence: Synthetic oligonucleotide
cgagcgggccgaggtggacac

SEQ ID NO: 71717 - DNA, 25 bp, Artificial Sequence
  Description of Artificial Sequence: Synthetic oligonucleotide
gagcgggccgaggtggacacctatt

SEQ ID NO: 71718 - DNA, 25 bp, Artificial Sequence
  Description of Artificial Sequence: Synthetic oligonucleotide
agcgggccgaggtggacacctattg

SEQ ID NO: 71719 - DNA, 32 bp, Artificial Sequence
  Description of Artificial Sequence: Synthetic oligonucleotide
gggtgcggttcctggagagatacttctataac

SEQ ID NO: 71720 - DNA, 32 bp, Artificial Sequence
  Description of Artificial Sequence: Synthetic oligonucleotide
ggtgcggttcctggagagatacttctataacc

SEQ ID NO: 71721 - DNA, 34 bp, Artificial Sequence
  Description of Artificial Sequence: Synthetic oligonucleotide
gtgcggttcctggagagatacttctataaccaag

SEQ ID NO: 71722 - DNA, 35 bp, Artificial Sequence
  Description of Artificial Sequence: Synthetic oligonucleotide
tgcggttcctggagagatacttctataaccaagag

SEQ ID NO: 71723 - DNA, 34 bp, Artificial Sequence
  Description of Artificial Sequence: Synthetic oligonucleotide
gcggttcctggagagatacttctataaccaagag

SEQ ID NO: 71724 - DNA, 34 bp, Artificial Sequence
  Description of Artificial Sequence: Synthetic oligonucleotide
cggttcctggagagatacttctataaccaagagg

SEQ ID NO: 71725 - DNA, 35 bp, Artificial Sequence
  Description of Artificial Sequence: Synthetic oligonucleotide
ggttcctggagagatacttctataaccaagaggag

SEQ ID NO: 71726 - DNA, 37 bp, Artificial Sequence
  Description of Artificial Sequence: Synthetic oligonucleotide
gttcctggagagatacttctataaccaagaggagtac

SEQ ID NO: 71727 - DNA, 37 bp, Artificial Sequence
  Description of Artificial Sequence: Synthetic oligonucleotide
ttcctggagagatacttctataaccaagaggagtacg

SEQ ID NO: 71728 - DNA, 36 bp, Artificial Sequence
  Description of Artificial Sequence: Synthetic oligonucleotide
tcctggagagatacttctataaccaagaggagtacg

SEQ ID NO: 71729 - DNA, 35 bp, Artificial Sequence
  Description of Artificial Sequence: Synthetic oligonucleotide
cctggagagatacttctataaccaagaggagtacg

SEQ ID NO: 71730 - DNA, 36 bp, Artificial Sequence
  Description of Artificial Sequence: Synthetic oligonucleotide
ctggagagatacttctataaccaagaggagtacgtg

SEQ ID NO: 71731 - DNA, 36 bp, Artificial Sequence
  Description of Artificial Sequence: Synthetic oligonucleotide
tggagagatacttctataaccaagaggagtacgtgc

SEQ ID NO: 71732 - DNA, 35 bp, Artificial Sequence
  Description of Artificial Sequence: Synthetic oligonucleotide
ggagagatacttctataaccaagaggagtacgtgc

SEQ ID NO: 71733 - DNA, 35 bp, Artificial Sequence
  Description of Artificial Sequence: Synthetic oligonucleotide
gagagatacttctataaccaagaggagtacgtgcg

SEQ ID NO: 71734 - DNA, 35 bp, Artificial Sequence
  Description of Artificial Sequence: Synthetic oligonucleotide
agagatacttctataaccaagaggagtacgtgcgc

SEQ ID NO: 71735 - DNA, 34 bp, Artificial Sequence
  Description of Artificial Sequence: Synthetic oligonucleotide
gagatacttctataaccaagaggagtacgtgcgc

SEQ ID NO: 71736 - DNA, 33 bp, Artificial Sequence
  Description of Artificial Sequence: Synthetic oligonucleotide
ctggacagatacttccataaccaggaggagatc

SEQ ID NO: 71737 - DNA, 33 bp, Artificial Sequence
  Description of Artificial Sequence: Synthetic oligonucleotide
tggacagatacttccataaccaggaggagatcg

SEQ ID NO: 71738 - DNA, 32 bp, Artificial Sequence
  Description of Artificial Sequence: Synthetic oligonucleotide
ggacagatacttccataaccaggaggagatcg

SEQ ID NO: 71739 - DNA, 33 bp, Artificial Sequence
  Description of Artificial Sequence: Synthetic oligonucleotide
gacagatacttccataaccaggaggagatcgtg

SEQ ID NO: 71740 - DNA, 33 bp, Artificial Sequence
  Description of Artificial Sequence: Synthetic oligonucleotide
acagatacttccataaccaggaggagatcgtgc

SEQ ID NO: 71741 - DNA, 32 bp, Artificial Sequence
  Description of Artificial Sequence: Synthetic oligonucleotide
cagatacttccataaccaggaggagatcgtgc

SEQ ID NO: 71742 - DNA, 32 bp, Artificial Sequence
  Description of Artificial Sequence: Synthetic oligonucleotide
agatacttccataaccaggaggagatcgtgcg

SEQ ID NO: 71743 - DNA, 31 bp, Artificial Sequence
  Description of Artificial Sequence: Synthetic oligonucleotide
gatacttccataaccaggaggagatcgtgcg

SEQ ID NO: 71744 - DNA, 31 bp, Artificial Sequence
  Description of Artificial Sequence: Synthetic oligonucleotide
atacttccataaccaggaggagatcgtgcgc

SEQ ID NO: 71745 - DNA, 30 bp, Artificial Sequence
  Description of Artificial Sequence: Synthetic oligonucleotide
tacttccataaccaggaggagatcgtgcgc

SEQ ID NO: 71746 - DNA, 29 bp, Artificial Sequence
  Description of Artificial Sequence: Synthetic oligonucleotide
acttccataaccaggaggagatcgtgcgc

SEQ ID NO: 71747 - DNA, 28 bp, Artificial Sequence
  Description of Artificial Sequence: Synthetic oligonucleotide
cttccataaccaggaggagatcgtgcgc

SEQ ID NO: 71748 - DNA, 30 bp, Artificial Sequence
  Description of Artificial Sequence: Synthetic oligonucleotide
ttccataaccaggaggagatcgtgcgcttc

SEQ ID NO: 71749 - DNA, 29 bp, Artificial Sequence
  Description of Artificial Sequence: Synthetic oligonucleotide
tccataaccaggaggagatcgtgcgcttc

SEQ ID NO: 71750 - DNA, 28 bp, Artificial Sequence
  Description of Artificial Sequence: Synthetic oligonucleotide
ccataaccaggaggagatcgtgcgcttc

SEQ ID NO: 71751 - DNA, 28 bp, Artificial Sequence
  Description of Artificial Sequence: Synthetic oligonucleotide
cataaccaggaggagatcgtgcgcttcg

SEQ ID NO: 71752 - DNA, 29 bp, Artificial Sequence
  Description of Artificial Sequence: Synthetic oligonucleotide
ataaccaggaggagatcgtgcgcttcgac

SEQ ID NO: 71753 - DNA, 28 bp, Artificial Sequence
  Description of Artificial Sequence: Synthetic oligonucleotide
taaccaggaggagatcgtgcgcttcgac

SEQ ID NO: 71754 - DNA, 27 bp, Artificial Sequence
  Description of Artificial Sequence: Synthetic oligonucleotide
aaccaggaggagatcgtgcgcttcgac

SEQ ID NO: 71755 - DNA, 27 bp, Artificial Sequence
  Description of Artificial Sequence: Synthetic oligonucleotide
accaggaggagatcgtgcgcttcgaca

SEQ ID NO: 71756 - DNA, 26 bp, Artificial Sequence
  Description of Artificial Sequence: Synthetic oligonucleotide
ccaggaggagatcgtgcgcttcgaca

SEQ ID NO: 71757 - DNA, 26 bp, Artificial Sequence
  Description of Artificial Sequence: Synthetic oligonucleotide
caggaggagatcgtgcgcttcgacag

SEQ ID NO: 71758 - DNA, 26 bp, Artificial Sequence
  Description of Artificial Sequence: Synthetic oligonucleotide
aggaggagatcgtgcgcttcgacagc

SEQ ID NO: 71759 - DNA, 25 bp, Artificial Sequence
  Description of Artificial Sequence: Synthetic oligonucleotide
ggaggagatcgtgcgcttcgacagc

SEQ ID NO: 71760 - DNA, 26 bp, Artificial Sequence
  Description of Artificial Sequence: Synthetic oligonucleotide
gaggagatcgtgcgcttcgacagcga

SEQ ID NO: 71761 - DNA, 26 bp, Artificial Sequence
  Description of Artificial Sequence: Synthetic oligonucleotide
aggagatcgtgcgcttcgacagcgac

SEQ ID NO: 71762 - DNA, 25 bp, Artificial Sequence
  Description of Artificial Sequence: Synthetic oligonucleotide
ggagatcgtgcgcttcgacagcgac

SEQ ID NO: 71763 - DNA, 30 bp, Artificial Sequence
  Description of Artificial Sequence: Synthetic oligonucleotide
aacagccagaaggacctcctggaagacaag

SEQ ID NO: 71764 - DNA, 29 bp, Artificial Sequence
  Description of Artificial Sequence: Synthetic oligonucleotide
acagccagaaggacctcctggaagacaag

SEQ ID NO: 71765 - DNA, 28 bp, Artificial Sequence
  Description of Artificial Sequence: Synthetic oligonucleotide
cagccagaaggacctcctggaagacaag

SEQ ID NO: 71766 - DNA, 28 bp, Artificial Sequence
  Description of Artificial Sequence: Synthetic oligonucleotide
agccagaaggacctcctggaagacaagc

SEQ ID NO: 71767 - DNA, 27 bp, Artificial Sequence
  Description of Artificial Sequence: Synthetic oligonucleotide
gccagaaggacctcctggaagacaagc

SEQ ID NO: 71768 - DNA, 27 bp, Artificial Sequence
  Description of Artificial Sequence: Synthetic oligonucleotide
ccagaaggacctcctggaagacaagcg

SEQ ID NO: 71769 - DNA, 27 bp, Artificial Sequence
  Description of Artificial Sequence: Synthetic oligonucleotide
cagaaggacctcctggaagacaagcgg

SEQ ID NO: 71770 - DNA, 27 bp, Artificial Sequence
  Description of Artificial Sequence: Synthetic oligonucleotide
agaaggacctcctggaagacaagcggg

SEQ ID NO: 71771 - DNA, 26 bp, Artificial Sequence
  Description of Artificial Sequence: Synthetic oligonucleotide
gaaggacctcctggaagacaagcggg

SEQ ID NO: 71772 - DNA, 26 bp, Artificial Sequence
  Description of Artificial Sequence: Synthetic oligonucleotide
aaggacctcctggaagacaagcgggc

SEQ ID NO: 71773 - DNA, 25 bp, Artificial Sequence
  Description of Artificial Sequence: Synthetic oligonucleotide
aggacctcctggaagacaagcgggc

SEQ ID NO: 71774 - DNA, 24 bp, Artificial Sequence
  Description of Artificial Sequence: Synthetic oligonucleotide
ggacctcctggaagacaagcgggc

SEQ ID NO: 71775 - DNA, 24 bp, Artificial Sequence
  Description of Artificial Sequence: Synthetic oligonucleotide
gacctcctggaagacaagcgggcc

SEQ ID NO: 71776 - DNA, 24 bp, Artificial Sequence
  Description of Artificial Sequence: Synthetic oligonucleotide
acctcctggaagacaagcgggccg

SEQ ID NO: 71777 - DNA, 23 bp, Artificial Sequence
  Description of Artificial Sequence: Synthetic oligonucleotide
cctcctggaagacaagcgggccg

SEQ ID NO: 71778 - DNA, 23 bp, Artificial Sequence
  Description of Artificial Sequence: Synthetic oligonucleotide
ctcctggaagacaagcgggccgc

SEQ ID NO: 71779 - DNA, 23 bp, Artificial Sequence
  Description of Artificial Sequence: Synthetic oligonucleotide
ggtgacggagctggggcggctta

SEQ ID NO: 71780 - DNA, 23 bp, Artificial Sequence
  Description of Artificial Sequence: Synthetic oligonucleotide
gtgacggagctggggcggcttag

SEQ ID NO: 71781 - DNA, 23 bp, Artificial Sequence
  Description of Artificial Sequence: Synthetic oligonucleotide
tgacggagctggggcggcttagc

SEQ ID NO: 71782 - DNA, 22 bp, Artificial Sequence
  Description of Artificial Sequence: Synthetic oligonucleotide
gacggagctggggcggcttagc

SEQ ID NO: 71783 - DNA, 22 bp, Artificial Sequence
  Description of Artificial Sequence: Synthetic oligonucleotide
acggagctggggcggcttagcg

SEQ ID NO: 71784 - DNA, 21 bp, Artificial Sequence
  Description of Artificial Sequence: Synthetic oligonucleotide
cggagctggggcggcttagcg

SEQ ID NO: 71785 - DNA, 21 bp, Artificial Sequence
  Description of Artificial Sequence: Synthetic oligonucleotide
ggagctggggcggcttagcgc

SEQ ID NO: 71786 - DNA, 21 bp, Artificial Sequence
  Description of Artificial Sequence: Synthetic oligonucleotide
gagctggggcggcttagcgcc

SEQ ID NO: 71787 - DNA, 22 bp, Artificial Sequence
  Description of Artificial Sequence: Synthetic oligonucleotide
agctggggcggcttagcgccga

SEQ ID NO: 71788 - DNA, 21 bp, Artificial Sequence
  Description of Artificial Sequence: Synthetic oligonucleotide
gctggggcggcttagcgccga

SEQ ID NO: 71789 - DNA, 23 bp, Artificial Sequence
  Description of Artificial Sequence: Synthetic oligonucleotide
ctggggcggcttagcgccgagta

SEQ ID NO: 71790 - DNA, 24 bp, Artificial Sequence
  Description of Artificial Sequence: Synthetic oligonucleotide
tggggcggcttagcgccgagtact

SEQ ID NO: 71791 - DNA, 23 bp, Artificial Sequence
  Description of Artificial Sequence: Synthetic oligonucleotide
ggggcggcttagcgccgagtact

SEQ ID NO: 71792 - DNA, 23 bp, Artificial Sequence
  Description of Artificial Sequence: Synthetic oligonucleotide
gggcggcttagcgccgagtactg

SEQ ID NO: 71793 - DNA, 25 bp, Artificial Sequence
  Description of Artificial Sequence: Synthetic oligonucleotide
ggcggcttagcgccgagtactggaa

SEQ ID NO: 71794 - DNA, 26 bp, Artificial Sequence
  Description of Artificial Sequence: Synthetic oligonucleotide
gcggcttagcgccgagtactggaaca

SEQ ID NO: 71795 - DNA, 26 bp, Artificial Sequence
  Description of Artificial Sequence: Synthetic oligonucleotide
cggcttagcgccgagtactggaacag

SEQ ID NO: 71796 - DNA, 26 bp, Artificial Sequence
  Description of Artificial Sequence: Synthetic oligonucleotide
ggcttagcgccgagtactggaacagc

SEQ ID NO: 71797 - DNA, 27 bp, Artificial Sequence
  Description of Artificial Sequence: Synthetic oligonucleotide
gcttagcgccgagtactggaacagcca

SEQ ID NO: 71798 - DNA, 27 bp, Artificial Sequence
  Description of Artificial Sequence: Synthetic oligonucleotide
cttagcgccgagtactggaacagccag

SEQ ID NO: 71799 - DNA, 29 bp, Artificial Sequence
  Description of Artificial Sequence: Synthetic oligonucleotide
ttagcgccgagtactggaacagccagaag

SEQ ID NO: 71800 - DNA, 34 bp, Artificial Sequence
  Description of Artificial Sequence: Synthetic oligonucleotide
acagatacttccataaccaggaggagaacgtgtg

SEQ ID NO: 71801 - DNA, 33 bp, Artificial Sequence
  Description of Artificial Sequence: Synthetic oligonucleotide
cagatacttccataaccaggaggagaacgtgtg

SEQ ID NO: 71802 - DNA, 33 bp, Artificial Sequence
  Description of Artificial Sequence: Synthetic oligonucleotide
agatacttccataaccaggaggagaacgtgtgc

SEQ ID NO: 71803 - DNA, 32 bp, Artificial Sequence
  Description of Artificial Sequence: Synthetic oligonucleotide
gatacttccataaccaggaggagaacgtgtgc

SEQ ID NO: 71804 - DNA, 34 bp, Artificial Sequence
  Description of Artificial Sequence: Synthetic oligonucleotide
atacttccataaccaggaggagaacgtgtgcttc

SEQ ID NO: 71805 - DNA, 33 bp, Artificial Sequence
  Description of Artificial Sequence: Synthetic oligonucleotide
tacttccataaccaggaggagaacgtgtgcttc

SEQ ID NO: 71806 - DNA, 32 bp, Artificial Sequence
  Description of Artificial Sequence: Synthetic oligonucleotide
acttccataaccaggaggagaacgtgtgcttc

SEQ ID NO: 71807 - DNA, 31 bp, Artificial Sequence
  Description of Artificial Sequence: Synthetic oligonucleotide
cttccataaccaggaggagaacgtgtgcttc

SEQ ID NO: 71808 - DNA, 31 bp, Artificial Sequence
  Description of Artificial Sequence: Synthetic oligonucleotide
ttccataaccaggaggagaacgtgtgcttcg

SEQ ID NO: 71809 - DNA, 30 bp, Artificial Sequence
  Description of Artificial Sequence: Synthetic oligonucleotide
tccataaccaggaggagaacgtgtgcttcg

SEQ ID NO: 71810 - DNA, 29 bp, Artificial Sequence
  Description of Artificial Sequence: Synthetic oligonucleotide
ccataaccaggaggagaacgtgtgcttcg

SEQ ID NO: 71811 - DNA, 30 bp, Artificial Sequence
  Description of Artificial Sequence: Synthetic oligonucleotide
cataaccaggaggagaacgtgtgcttcgac

SEQ ID NO: 71812 - DNA, 31 bp, Artificial Sequence
  Description of Artificial Sequence: Synthetic oligonucleotide
ataaccaggaggagaacgtgtgcttcgacag

SEQ ID NO: 71813 - DNA, 30 bp, Artificial Sequence
  Description of Artificial Sequence: Synthetic oligonucleotide
taaccaggaggagaacgtgtgcttcgacag

SEQ ID NO: 71814 - DNA, 29 bp, Artificial Sequence
  Description of Artificial Sequence: Synthetic oligonucleotide
aaccaggaggagaacgtgtgcttcgacag

SEQ ID NO: 71815 - DNA, 28 bp, Artificial Sequence
  Description of Artificial Sequence: Synthetic oligonucleotide
accaggaggagaacgtgtgcttcgacag

SEQ ID NO: 71816 - DNA, 27 bp, Artificial Sequence
  Description of Artificial Sequence: Synthetic oligonucleotide
ccaggaggagaacgtgtgcttcgacag

SEQ ID NO: 71817 - DNA, 27 bp, Artificial Sequence
  Description of Artificial Sequence: Synthetic oligonucleotide
caggaggagaacgtgtgcttcgacagc

SEQ ID NO: 71818 - DNA, 27 bp, Artificial Sequence
  Description of Artificial Sequence: Synthetic oligonucleotide
aggaggagaacgtgtgcttcgacagcg

SEQ ID NO: 71819 - DNA, 27 bp, Artificial Sequence
  Description of Artificial Sequence: Synthetic oligonucleotide
ggaggagaacgtgtgcttcgacagcga

SEQ ID NO: 71820 - DNA, 27 bp, Artificial Sequence
  Description of Artificial Sequence: Synthetic oligonucleotide
gaggagaacgtgtgcttcgacagcgac

SEQ ID NO: 71821 - DNA, 27 bp, Artificial Sequence
  Description of Artificial Sequence: Synthetic oligonucleotide
aggagaacgtgtgcttcgacagcgacg

SEQ ID NO: 71822 - DNA, 27 bp, Artificial Sequence
  Description of Artificial Sequence: Synthetic oligonucleotide
ggagaacgtgtgcttcgacagcgacgt

SEQ ID NO: 71823 - DNA, 27 bp, Artificial Sequence
  Description of Artificial Sequence: Synthetic oligonucleotide
gagaacgtgtgcttcgacagcgacgtg

SEQ ID NO: 71824 - DNA, 27 bp, Artificial Sequence
  Description of Artificial Sequence: Synthetic oligonucleotide
agaacgtgtgcttcgacagcgacgtgg

SEQ ID NO: 71825 - DNA, 26 bp, Artificial Sequence
  Description of Artificial Sequence: Synthetic oligonucleotide
gaacgtgtgcttcgacagcgacgtgg

SEQ ID NO: 71826 - DNA, 26 bp, Artificial Sequence
  Description of Artificial Sequence: Synthetic oligonucleotide
aacgtgtgcttcgacagcgacgtggg

SEQ ID NO: 71827 - DNA, 25 bp, Artificial Sequence
  Description of Artificial Sequence: Synthetic oligonucleotide
acgtgtgcttcgacagcgacgtggg

SEQ ID NO: 71828 - DNA, 24 bp, Artificial Sequence
  Description of Artificial Sequence: Synthetic oligonucleotide
cgtgtgcttcgacagcgacgtggg

SEQ ID NO: 71829 - DNA, 24 bp, Artificial Sequence
  Description of Artificial Sequence: Synthetic oligonucleotide
gtgtgcttcgacagcgacgtgggg

SEQ ID NO: 71830 - DNA, 25 bp, Artificial Sequence
  Description of Artificial Sequence: Synthetic oligonucleotide
tgtgcttcgacagcgacgtggggga

SEQ ID NO: 71831 - DNA, 24 bp, Artificial Sequence
  Description of Artificial Sequence: Synthetic oligonucleotide
gtgcttcgacagcgacgtggggga

SEQ ID NO: 71832 - DNA, 26 bp, Artificial Sequence
  Description of Artificial Sequence: Synthetic oligonucleotide
tgcttcgacagcgacgtgggggagtt

SEQ ID NO: 71833 - DNA, 27 bp, Artificial Sequence
  Description of Artificial Sequence: Synthetic oligonucleotide
cttcaatgggacggagcgggtgcagtt

SEQ ID NO: 71834 - DNA, 27 bp, Artificial Sequence
  Description of Artificial Sequence: Synthetic oligonucleotide
ttcaatgggacggagcgggtgcagttc

SEQ ID NO: 71835 - DNA, 26 bp, Artificial Sequence
  Description of Artificial Sequence: Synthetic oligonucleotide
tcaatgggacggagcgggtgcagttc

SEQ ID NO: 71836 - DNA, 25 bp, Artificial Sequence
  Description of Artificial Sequence: Synthetic oligonucleotide
caatgggacggagcgggtgcagttc

SEQ ID NO: 71837 - DNA, 26 bp, Artificial Sequence
  Description of Artificial Sequence: Synthetic oligonucleotide
aatgggacggagcgggtgcagttcct

SEQ ID NO: 71838 - DNA, 25 bp, Artificial Sequence
  Description of Artificial Sequence: Synthetic oligonucleotide
atgggacggagcgggtgcagttcct

SEQ ID NO: 71839 - DNA, 24 bp, Artificial Sequence
  Description of Artificial Sequence: Synthetic oligonucleotide
tgggacggagcgggtgcagttcct

SEQ ID NO: 71840 - DNA, 24 bp, Artificial Sequence
  Description of Artificial Sequence: Synthetic oligonucleotide
gacggagcgggtgcagttcctgga

SEQ ID NO: 71841 - DNA, 25 bp, Artificial Sequence
  Description of Artificial Sequence: Synthetic oligonucleotide
acggagcgggtgcagttcctggaca

SEQ ID NO: 71842 - DNA, 24 bp, Artificial Sequence
  Description of Artificial Sequence: Synthetic oligonucleotide
cggagcgggtgcagttcctggaca

SEQ ID NO: 71843 - DNA, 27 bp, Artificial Sequence
  Description of Artificial Sequence: Synthetic oligonucleotide
ggagcgggtgcagttcctggacagata

SEQ ID NO: 71844 - DNA, 27 bp, Artificial Sequence
  Description of Artificial Sequence: Synthetic oligonucleotide
gagcgggtgcagttcctggacagatac

SEQ ID NO: 71845 - DNA, 29 bp, Artificial Sequence
  Description of Artificial Sequence: Synthetic oligonucleotide
agcgggtgcagttcctggacagatacttc

SEQ ID NO: 71846 - DNA, 28 bp, Artificial Sequence
  Description of Artificial Sequence: Synthetic oligonucleotide
gcgggtgcagttcctggacagatacttc

SEQ ID NO: 71847 - DNA, 28 bp, Artificial Sequence
  Description of Artificial Sequence: Synthetic oligonucleotide
cgggtgcagttcctggacagatacttcc

SEQ ID NO: 71848 - DNA, 32 bp, Artificial Sequence
  Description of Artificial Sequence: Synthetic oligonucleotide
gggtgcagttcctggacagatacttccataac

SEQ ID NO: 71849 - DNA, 32 bp, Artificial Sequence
  Description of Artificial Sequence: Synthetic oligonucleotide
ggtgcagttcctggacagatacttccataacc

SEQ ID NO: 71850 - DNA, 33 bp, Artificial Sequence
  Description of Artificial Sequence: Synthetic oligonucleotide
gtgcagttcctggacagatacttccataaccag

SEQ ID NO: 71851 - DNA, 33 bp, Artificial Sequence
  Description of Artificial Sequence: Synthetic oligonucleotide
tgcagttcctggacagatacttccataaccagg

SEQ ID NO: 71852 - DNA, 32 bp, Artificial Sequence
  Description of Artificial Sequence: Synthetic oligonucleotide
gcagttcctggacagatacttccataaccagg

SEQ ID NO: 71853 - DNA, 33 bp, Artificial Sequence
  Description of Artificial Sequence: Synthetic oligonucleotide
cagttcctggacagatacttccataaccaggag

SEQ ID NO: 71854 - DNA, 33 bp, Artificial Sequence
  Description of Artificial Sequence: Synthetic oligonucleotide
agttcctggacagatacttccataaccaggagg

SEQ ID NO: 71855 - DNA, 29 bp, Artificial Sequence
  Description of Artificial Sequence: Synthetic oligonucleotide
aagaggagtacgtgcgcttcgacagctac

SEQ ID NO: 71856 - DNA, 28 bp, Artificial Sequence
  Description of Artificial Sequence: Synthetic oligonucleotide
agaggagtacgtgcgcttcgacagctac

SEQ ID NO: 71857 - DNA, 27 bp, Artificial Sequence
  Description of Artificial Sequence: Synthetic oligonucleotide
gaggagtacgtgcgcttcgacagctac

SEQ ID NO: 71858 - DNA, 27 bp, Artificial Sequence
  Description of Artificial Sequence: Synthetic oligonucleotide
aggagtacgtgcgcttcgacagctacg

SEQ ID NO: 71859 - DNA, 27 bp, Artificial Sequence
  Description of Artificial Sequence: Synthetic oligonucleotide
ggagtacgtgcgcttcgacagctacgt

SEQ ID NO: 71860 - DNA, 27 bp, Artificial Sequence
  Description of Artificial Sequence: Synthetic oligonucleotide
gagtacgtgcgcttcgacagctacgtg

SEQ ID NO: 71861 - DNA, 27 bp, Artificial Sequence
  Description of Artificial Sequence: Synthetic oligonucleotide
agtacgtgcgcttcgacagctacgtgg

SEQ ID NO: 71862 - DNA, 26 bp, Artificial Sequence
  Description of Artificial Sequence: Synthetic oligonucleotide
gtacgtgcgcttcgacagctacgtgg

SEQ ID NO: 71863 - DNA, 26 bp, Artificial Sequence
  Description of Artificial Sequence: Synthetic oligonucleotide
tacgtgcgcttcgacagctacgtggg

SEQ ID NO: 71864 - DNA, 25 bp, Artificial Sequence
  Description of Artificial Sequence: Synthetic oligonucleotide
acgtgcgcttcgacagctacgtggg

SEQ ID NO: 71865 - DNA, 24 bp, Artificial Sequence
  Description of Artificial Sequence: Synthetic oligonucleotide
cgtgcgcttcgacagctacgtggg

SEQ ID NO: 71866 - DNA, 24 bp, Artificial Sequence
  Description of Artificial Sequence: Synthetic oligonucleotide
gtgcgcttcgacagctacgtgggg

SEQ ID NO: 71867 - DNA, 25 bp, Artificial Sequence
  Description of Artificial Sequence: Synthetic oligonucleotide
tgcgcttcgacagctacgtggggga

SEQ ID NO: 71868 - DNA, 24 bp, Artificial Sequence
  Description of Artificial Sequence: Synthetic oligonucleotide
gcgcttcgacagctacgtggggga

SEQ ID NO: 71869 - DNA, 26 bp, Artificial Sequence
  Description of Artificial Sequence: Synthetic oligonucleotide
cgcttcgacagctacgtgggggagta

SEQ ID NO: 71870 - DNA, 26 bp, Artificial Sequence
  Description of Artificial Sequence: Synthetic oligonucleotide
gcttcgacagctacgtgggggagtac

SEQ ID NO: 71871 - DNA, 26 bp, Artificial Sequence
  Description of Artificial Sequence: Synthetic oligonucleotide
cttcgacagctacgtgggggagtacc

SEQ ID NO: 71872 - DNA, 26 bp, Artificial Sequence
  Description of Artificial Sequence: Synthetic oligonucleotide
ttcgacagctacgtgggggagtaccg

SEQ ID NO: 71873 - DNA, 25 bp, Artificial Sequence
  Description of Artificial Sequence: Synthetic oligonucleotide
tcgacagctacgtgggggagtaccg

SEQ ID NO: 71874 - DNA, 24 bp, Artificial Sequence
  Description of Artificial Sequence: Synthetic oligonucleotide
cgacagctacgtgggggagtaccg

SEQ ID NO: 71875 - DNA, 24 bp, Artificial Sequence
  Description of Artificial Sequence: Synthetic oligonucleotide
gacagctacgtgggggagtaccgg

SEQ ID NO: 71876 - DNA, 24 bp, Artificial Sequence
  Description of Artificial Sequence: Synthetic oligonucleotide
acagctacgtgggggagtaccggg

SEQ ID NO: 71877 - DNA, 23 bp, Artificial Sequence
  Description of Artificial Sequence: Synthetic oligonucleotide
cagctacgtgggggagtaccggg

SEQ ID NO: 71878 - DNA, 23 bp, Artificial Sequence
  Description of Artificial Sequence: Synthetic oligonucleotide
agctacgtgggggagtaccgggc

SEQ ID NO: 71879 - DNA, 22 bp, Artificial Sequence
  Description of Artificial Sequence: Synthetic oligonucleotide
gctacgtgggggagtaccgggc

SEQ ID NO: 71880 - DNA, 22 bp, Artificial Sequence
  Description of Artificial Sequence: Synthetic oligonucleotide
ctacgtgggggagtaccgggcg

SEQ ID NO: 71881 - DNA, 23 bp, Artificial Sequence
  Description of Artificial Sequence: Synthetic oligonucleotide
tacgtgggggagtaccgggcggt

SEQ ID NO: 71882 - DNA, 22 bp, Artificial Sequence
  Description of Artificial Sequence: Synthetic oligonucleotide
acgagcgggccgcggtggacaa

SEQ ID NO: 71883 - DNA, 21 bp, Artificial Sequence
  Description of Artificial Sequence: Synthetic oligonucleotide
cgagcgggccgcggtggacaa

SEQ ID NO: 71884 - DNA, 23 bp, Artificial Sequence
  Description of Artificial Sequence: Synthetic oligonucleotide
gagcgggccgcggtggacaacta

SEQ ID NO: 71885 - DNA, 32 bp, Artificial Sequence
  Description of Artificial Sequence: Synthetic oligonucleotide
acacctactgcagacacaactacggggttatg

SEQ ID NO: 71886 - DNA, 31 bp, Artificial Sequence
  Description of Artificial Sequence: Synthetic oligonucleotide
cacctactgcagacacaactacggggttatg

SEQ ID NO: 71887 - DNA, 31 bp, Artificial Sequence
  Description of Artificial Sequence: Synthetic oligonucleotide
acctactgcagacacaactacggggttatgg

SEQ ID NO: 71888 - DNA, 30 bp, Artificial Sequence
  Description of Artificial Sequence: Synthetic oligonucleotide
cctactgcagacacaactacggggttatgg

SEQ ID NO: 71889 - DNA, 31 bp, Artificial Sequence
  Description of Artificial Sequence: Synthetic oligonucleotide
ctactgcagacacaactacggggttatggag

SEQ ID NO: 71890 - DNA, 32 bp, Artificial Sequence
  Description of Artificial Sequence: Synthetic oligonucleotide
tactgcagacacaactacggggttatggagag

SEQ ID NO: 71891 - DNA, 31 bp, Artificial Sequence
  Description of Artificial Sequence: Synthetic oligonucleotide
actgcagacacaactacggggttatggagag

SEQ ID NO: 71892 - DNA, 30 bp, Artificial Sequence
  Description of Artificial Sequence: Synthetic oligonucleotide
ctgcagacacaactacggggttatggagag

SEQ ID NO: 71893 - DNA, 30 bp, Artificial Sequence
  Description of Artificial Sequence: Synthetic oligonucleotide
tgcagacacaactacggggttatggagagc

SEQ ID NO: 71894 - DNA, 29 bp, Artificial Sequence
  Description of Artificial Sequence: Synthetic oligonucleotide
gcagacacaactacggggttatggagagc

SEQ ID NO: 71895 - DNA, 31 bp, Artificial Sequence
  Description of Artificial Sequence: Synthetic oligonucleotide
cagacacaactacggggttatggagagcttc

SEQ ID NO: 71896 - DNA, 32 bp, Artificial Sequence
  Description of Artificial Sequence: Synthetic oligonucleotide
agacacaactacggggttatggagagcttcac

SEQ ID NO: 71897 - DNA, 31 bp, Artificial Sequence
  Description of Artificial Sequence: Synthetic oligonucleotide
gacacaactacggggttatggagagcttcac

SEQ ID NO: 71898 - DNA, 32 bp, Artificial Sequence
  Description of Artificial Sequence: Synthetic oligonucleotide
acacaactacggggttatggagagcttcacag

SEQ ID NO: 71899 - DNA, 31 bp, Artificial Sequence
  Description of Artificial Sequence: Synthetic oligonucleotide
cacaactacggggttatggagagcttcacag

SEQ ID NO: 71900 - DNA, 32 bp, Artificial Sequence
  Description of Artificial Sequence: Synthetic oligonucleotide
acaactacggggttatggagagcttcacagtg

SEQ ID NO: 71901 - DNA, 31 bp, Artificial Sequence
  Description of Artificial Sequence: Synthetic oligonucleotide
caactacggggttatggagagcttcacagtg

SEQ ID NO: 71902 - DNA, 31 bp, Artificial Sequence
  Description of Artificial Sequence: Synthetic oligonucleotide
aactacggggttatggagagcttcacagtgc

SEQ ID NO: 71903 - DNA, 30 bp, Artificial Sequence
  Description of Artificial Sequence: Synthetic oligonucleotide
actacggggttatggagagcttcacagtgc

SEQ ID NO: 71904 - DNA, 29 bp, Artificial Sequence
  Description of Artificial Sequence: Synthetic oligonucleotide
ctacggggttatggagagcttcacagtgc

SEQ ID NO: 71905 - DNA, 30 bp, Artificial Sequence
  Description of Artificial Sequence: Synthetic oligonucleotide
tacggggttatggagagcttcacagtgcag

SEQ ID NO: 71906 - DNA, 29 bp, Artificial Sequence
  Description of Artificial Sequence: Synthetic oligonucleotide
acggggttatggagagcttcacagtgcag

SEQ ID NO: 71907 - DNA, 28 bp, Artificial Sequence
  Description of Artificial Sequence: Synthetic oligonucleotide
cggggttatggagagcttcacagtgcag

SEQ ID NO: 71908 - DNA, 28 bp, Artificial Sequence
  Description of Artificial Sequence: Synthetic oligonucleotide
ggggttatggagagcttcacagtgcagc

SEQ ID NO: 71909 - DNA, 28 bp, Artificial Sequence
  Description of Artificial Sequence: Synthetic oligonucleotide
gggttatggagagcttcacagtgcagcg

SEQ ID NO: 71910 - DNA, 28 bp, Artificial Sequence
  Description of Artificial Sequence: Synthetic oligonucleotide
ggttatggagagcttcacagtgcagcgg

SEQ ID NO: 71911 - DNA, 28 bp, Artificial Sequence
  Description of Artificial Sequence: Synthetic oligonucleotide
gttatggagagcttcacagtgcagcggc

SEQ ID NO: 71912 - DNA, 28 bp, Artificial Sequence
  Description of Artificial Sequence: Synthetic oligonucleotide
ttatggagagcttcacagtgcagcggcg

SEQ ID NO: 71913 - DNA, 27 bp, Artificial Sequence
  Description of Artificial Sequence: Synthetic oligonucleotide
tatggagagcttcacagtgcagcggcg

SEQ ID NO: 71914 - DNA, 27 bp, Artificial Sequence
  Description of Artificial Sequence: Synthetic oligonucleotide
atggagagcttcacagtgcagcggcga

SEQ ID NO: 71915 - DNA, 23 bp, Artificial Sequence
  Description of Artificial Sequence: Synthetic oligonucleotide
gtgggggagttccgggcggtgaa

SEQ ID NO: 71916 - DNA, 23 bp, Artificial Sequence
  Description of Artificial Sequence: Synthetic oligonucleotide
tgggggagttccgggcggtgaag

SEQ ID NO: 71917 - DNA, 22 bp, Artificial Sequence
  Description of Artificial Sequence: Synthetic oligonucleotide
gggggagttccgggcggtgaag

SEQ ID NO: 71918 - DNA, 23 bp, Artificial Sequence
  Description of Artificial Sequence: Synthetic oligonucleotide
ggggagttccgggcggtgaagga

SEQ ID NO: 71919 - DNA, 23 bp, Artificial Sequence
  Description of Artificial Sequence: Synthetic oligonucleotide
gggagttccgggcggtgaaggag

SEQ ID NO: 71920 - DNA, 24 bp, Artificial Sequence
  Description of Artificial Sequence: Synthetic oligonucleotide
ggagttccgggcggtgaaggagct

SEQ ID NO: 71921 - DNA, 24 bp, Artificial Sequence
  Description of Artificial Sequence: Synthetic oligonucleotide
gagttccgggcggtgaaggagctg

SEQ ID NO: 71922 - DNA, 24 bp, Artificial Sequence
  Description of Artificial Sequence: Synthetic oligonucleotide
agttccgggcggtgaaggagctgg

SEQ ID NO: 71923 - DNA, 23 bp, Artificial Sequence
  Description of Artificial Sequence: Synthetic oligonucleotide
gttccgggcggtgaaggagctgg

SEQ ID NO: 71924 - DNA, 23 bp, Artificial Sequence
  Description of Artificial Sequence: Synthetic oligonucleotide
ttccgggcggtgaaggagctggg

SEQ ID NO: 71925 - DNA, 22 bp, Artificial Sequence
  Description of Artificial Sequence: Synthetic oligonucleotide
tccgggcggtgaaggagctggg

SEQ ID NO: 71926 - DNA, 21 bp, Artificial Sequence
  Description of Artificial Sequence: Synthetic oligonucleotide
ccgggcggtgaaggagctggg

SEQ ID NO: 71927 - DNA, 21 bp, Artificial Sequence
  Description of Artificial Sequence: Synthetic oligonucleotide
cgggcggtgaaggagctgggg

SEQ ID NO: 71928 - DNA, 21 bp, Artificial Sequence
  Description of Artificial Sequence: Synthetic oligonucleotide
gggcggtgaaggagctggggc

SEQ ID NO: 71929 - DNA, 21 bp, Artificial Sequence
  Description of Artificial Sequence: Synthetic oligonucleotide
ggcggtgaaggagctggggcg

SEQ ID NO: 71930 - DNA, 21 bp, Artificial Sequence
  Description of Artificial Sequence: Synthetic oligonucleotide
gcggtgaaggagctggggcgg

SEQ ID NO: 71931 - DNA, 21 bp, Artificial Sequence
  Description of Artificial Sequence: Synthetic oligonucleotide
cggtgaaggagctggggcggc

SEQ ID NO: 71932 - DNA, 22 bp, Artificial Sequence
  Description of Artificial Sequence: Synthetic oligonucleotide
ggtgaaggagctggggcggcct

SEQ ID NO: 71933 - DNA, 24 bp, Artificial Sequence
  Description of Artificial Sequence: Synthetic oligonucleotide
gtgaaggagctggggcggcctgat

SEQ ID NO: 71934 - DNA, 24 bp, Artificial Sequence
  Description of Artificial Sequence: Synthetic oligonucleotide
tgaaggagctggggcggcctgatg

SEQ ID NO: 71935 - DNA, 23 bp, Artificial Sequence
  Description of Artificial Sequence: Synthetic oligonucleotide
gaaggagctggggcggcctgatg

SEQ ID NO: 71936 - DNA, 23 bp, Artificial Sequence
  Description of Artificial Sequence: Synthetic oligonucleotide
aaggagctggggcggcctgatgc

SEQ ID NO: 71937 - DNA, 22 bp, Artificial Sequence
  Description of Artificial Sequence: Synthetic oligonucleotide
aggagctggggcggcctgatgc

SEQ ID NO: 71938 - DNA, 27 bp, Artificial Sequence
  Description of Artificial Sequence: Synthetic oligonucleotide
cttcaaagacccagcccctgcagcact

SEQ ID NO: 71939 - DNA, 28 bp, Artificial Sequence
  Description of Artificial Sequence: Synthetic oligonucleotide
ttcaaagacccagcccctgcagcactac

SEQ ID NO: 71940 - DNA, 27 bp, Artificial Sequence
  Description of Artificial Sequence: Synthetic oligonucleotide
tcaaagacccagcccctgcagcactac

SEQ ID NO: 71941 - DNA, 27 bp, Artificial Sequence
  Description of Artificial Sequence: Synthetic oligonucleotide
caaagacccagcccctgcagcactaca

SEQ ID NO: 71942 - DNA, 28 bp, Artificial Sequence
  Description of Artificial Sequence: Synthetic oligonucleotide
aaagacccagcccctgcagcactacaac

SEQ ID NO: 71943 - DNA, 27 bp, Artificial Sequence
  Description of Artificial Sequence: Synthetic oligonucleotide
aagacccagcccctgcagcactacaac

SEQ ID NO: 71944 - DNA, 26 bp, Artificial Sequence
  Description of Artificial Sequence: Synthetic oligonucleotide
agacccagcccctgcagcactacaac

SEQ ID NO: 71945 - DNA, 25 bp, Artificial Sequence
  Description of Artificial Sequence: Synthetic oligonucleotide
gacccagcccctgcagcactacaac

SEQ ID NO: 71946 - DNA, 26 bp, Artificial Sequence
  Description of Artificial Sequence: Synthetic oligonucleotide
acccagcccctgcagcactacaacct

SEQ ID NO: 71947 - DNA, 25 bp, Artificial Sequence
  Description of Artificial Sequence: Synthetic oligonucleotide
cccagcccctgcagcactacaacct

SEQ ID NO: 71948 - DNA, 25 bp, Artificial Sequence
  Description of Artificial Sequence: Synthetic oligonucleotide
ccagcccctgcagcactacaacctg

SEQ ID NO: 71949 - DNA, 26 bp, Artificial Sequence
  Description of Artificial Sequence: Synthetic oligonucleotide
cagcccctgcagcactacaacctgct

SEQ ID NO: 71950 - DNA, 26 bp, Artificial Sequence
  Description of Artificial Sequence: Synthetic oligonucleotide
agcccctgcagcactacaacctgctg

SEQ ID NO: 71951 - DNA, 25 bp, Artificial Sequence
  Description of Artificial Sequence: Synthetic oligonucleotide
gcccctgcagcactacaacctgctg

SEQ ID NO: 71952 - DNA, 26 bp, Artificial Sequence
  Description of Artificial Sequence: Synthetic oligonucleotide
cccctgcagcactacaacctgctggt

SEQ ID NO: 71953 - DNA, 27 bp, Artificial Sequence
  Description of Artificial Sequence: Synthetic oligonucleotide
ccctgcagcactacaacctgctggtct

SEQ ID NO: 71954 - DNA, 27 bp, Artificial Sequence
  Description of Artificial Sequence: Synthetic oligonucleotide
cctgcagcactacaacctgctggtctg

SEQ ID NO: 71955 - DNA, 29 bp, Artificial Sequence
  Description of Artificial Sequence: Synthetic oligonucleotide
ctgcagcactacaacctgctggtctgttc

SEQ ID NO: 71956 - DNA, 30 bp, Artificial Sequence
  Description of Artificial Sequence: Synthetic oligonucleotide
tgcagcactacaacctgctggtctgttctg

SEQ ID NO: 71957 - DNA, 29 bp, Artificial Sequence
  Description of Artificial Sequence: Synthetic oligonucleotide
gcagcactacaacctgctggtctgttctg

SEQ ID NO: 71958 - DNA, 30 bp, Artificial Sequence
  Description of Artificial Sequence: Synthetic oligonucleotide
cagcactacaacctgctggtctgttctgtg

SEQ ID NO: 71959 - DNA, 31 bp, Artificial Sequence
  Description of Artificial Sequence: Synthetic oligonucleotide
agcactacaacctgctggtctgttctgtgag

SEQ ID NO: 71960 - DNA, 30 bp, Artificial Sequence
  Description of Artificial Sequence: Synthetic oligonucleotide
gcactacaacctgctggtctgttctgtgag

SEQ ID NO: 71961 - DNA, 31 bp, Artificial Sequence
  Description of Artificial Sequence: Synthetic oligonucleotide
cactacaacctgctggtctgttctgtgagtg

SEQ ID NO: 71962 - DNA, 31 bp, Artificial Sequence
  Description of Artificial Sequence: Synthetic oligonucleotide
actacaacctgctggtctgttctgtgagtgg

SEQ ID NO: 71963 - DNA, 30 bp, Artificial Sequence
  Description of Artificial Sequence: Synthetic oligonucleotide
ctacaacctgctggtctgttctgtgagtgg

SEQ ID NO: 71964 - DNA, 33 bp, Artificial Sequence
  Description of Artificial Sequence: Synthetic oligonucleotide
tacaacctgctggtctgttctgtgagtggtttc

SEQ ID NO: 71965 - DNA, 33 bp, Artificial Sequence
  Description of Artificial Sequence: Synthetic oligonucleotide
ggttcctggacagatacttccataaccaggaag

SEQ ID NO: 71966 - DNA, 34 bp, Artificial Sequence
  Description of Artificial Sequence: Synthetic oligonucleotide
gttcctggacagatacttccataaccaggaagag

SEQ ID NO: 71967 - DNA, 36 bp, Artificial Sequence
  Description of Artificial Sequence: Synthetic oligonucleotide
ttcctggacagatacttccataaccaggaagagttc

SEQ ID NO: 71968 - DNA, 35 bp, Artificial Sequence
  Description of Artificial Sequence: Synthetic oligonucleotide
tcctggacagatacttccataaccaggaagagttc

SEQ ID NO: 71969 - DNA, 34 bp, Artificial Sequence
  Description of Artificial Sequence: Synthetic oligonucleotide
cctggacagatacttccataaccaggaagagttc

SEQ ID NO: 71970 - DNA, 34 bp, Artificial Sequence
  Description of Artificial Sequence: Synthetic oligonucleotide
ctggacagatacttccataaccaggaagagttcg

SEQ ID NO: 71971 - DNA, 35 bp, Artificial Sequence
  Description of Artificial Sequence: Synthetic oligonucleotide
tggacagatacttccataaccaggaagagttcgtg

SEQ ID NO: 71972 - DNA, 34 bp, Artificial Sequence
  Description of Artificial Sequence: Synthetic oligonucleotide
ggacagatacttccataaccaggaagagttcgtg

SEQ ID NO: 71973 - DNA, 34 bp, Artificial Sequence
  Description of Artificial Sequence: Synthetic oligonucleotide
gacagatacttccataaccaggaagagttcgtgc

SEQ ID NO: 71974 - DNA, 34 bp, Artificial Sequence
  Description of Artificial Sequence: Synthetic oligonucleotide
acagatacttccataaccaggaagagttcgtgcg

SEQ ID NO: 71975 - DNA, 33 bp, Artificial Sequence
  Description of Artificial Sequence: Synthetic oligonucleotide
cagatacttccataaccaggaagagttcgtgcg

SEQ ID NO: 71976 - DNA, 33 bp, Artificial Sequence
  Description of Artificial Sequence: Synthetic oligonucleotide
agatacttccataaccaggaagagttcgtgcgc

SEQ ID NO: 71977 - DNA, 32 bp, Artificial Sequence
  Description of Artificial Sequence: Synthetic oligonucleotide
gatacttccataaccaggaagagttcgtgcgc

SEQ ID NO: 71978 - DNA, 34 bp, Artificial Sequence
  Description of Artificial Sequence: Synthetic oligonucleotide
atacttccataaccaggaagagttcgtgcgcttc

SEQ ID NO: 71979 - DNA, 33 bp, Artificial Sequence
  Description of Artificial Sequence: Synthetic oligonucleotide
tacttccataaccaggaagagttcgtgcgcttc

SEQ ID NO: 71980 - DNA, 32 bp, Artificial Sequence
  Description of Artificial Sequence: Synthetic oligonucleotide
acttccataaccaggaagagttcgtgcgcttc

SEQ ID NO: 71981 - DNA, 31 bp, Artificial Sequence
  Description of Artificial Sequence: Synthetic oligonucleotide
cttccataaccaggaagagttcgtgcgcttc

SEQ ID NO: 71982 - DNA, 31 bp, Artificial Sequence
  Description of Artificial Sequence: Synthetic oligonucleotide
ttccataaccaggaagagttcgtgcgcttcg

SEQ ID NO: 71983 - DNA, 30 bp, Artificial Sequence
  Description of Artificial Sequence: Synthetic oligonucleotide
tccataaccaggaagagttcgtgcgcttcg

SEQ ID NO: 71984 - DNA, 29 bp, Artificial Sequence
  Description of Artificial Sequence: Synthetic oligonucleotide
ccataaccaggaagagttcgtgcgcttcg

SEQ ID NO: 71985 - DNA, 30 bp, Artificial Sequence
  Description of Artificial Sequence: Synthetic oligonucleotide
cataaccaggaagagttcgtgcgcttcgac

SEQ ID NO: 71986 - DNA, 31 bp, Artificial Sequence
  Description of Artificial Sequence: Synthetic oligonucleotide
ataaccaggaagagttcgtgcgcttcgacag

SEQ ID NO: 71987 - DNA, 30 bp, Artificial Sequence
  Description of Artificial Sequence: Synthetic oligonucleotide
taaccaggaagagttcgtgcgcttcgacag

SEQ ID NO: 71988 - DNA, 29 bp, Artificial Sequence
  Description of Artificial Sequence: Synthetic oligonucleotide
aaccaggaagagttcgtgcgcttcgacag

SEQ ID NO: 71989 - DNA, 28 bp, Artificial Sequence
  Description of Artificial Sequence: Synthetic oligonucleotide
accaggaagagttcgtgcgcttcgacag

SEQ ID NO: 71990 - DNA, 27 bp, Artificial Sequence
  Description of Artificial Sequence: Synthetic oligonucleotide
ccaggaagagttcgtgcgcttcgacag

SEQ ID NO: 71991 - DNA, 27 bp, Artificial Sequence
  Description of Artificial Sequence: Synthetic oligonucleotide
caggaagagttcgtgcgcttcgacagc

SEQ ID NO: 71992 - DNA, 27 bp, Artificial Sequence
  Description of Artificial Sequence: Synthetic oligonucleotide
aggaagagttcgtgcgcttcgacagcg

SEQ ID NO: 71993 - DNA, 26 bp, Artificial Sequence
  Description of Artificial Sequence: Synthetic oligonucleotide
gcttcgacagcgacgtgggggagtat

SEQ ID NO: 71994 - DNA, 26 bp, Artificial Sequence
  Description of Artificial Sequence: Synthetic oligonucleotide
cttcgacagcgacgtgggggagtatc

SEQ ID NO: 71995 - DNA, 26 bp, Artificial Sequence
  Description of Artificial Sequence: Synthetic oligonucleotide
ttcgacagcgacgtgggggagtatcg

SEQ ID NO: 71996 - DNA, 25 bp, Artificial Sequence
  Description of Artificial Sequence: Synthetic oligonucleotide
tcgacagcgacgtgggggagtatcg

SEQ ID NO: 71997 - DNA, 24 bp, Artificial Sequence
  Description of Artificial Sequence: Synthetic oligonucleotide
cgacagcgacgtgggggagtatcg

SEQ ID NO: 71998 - DNA, 24 bp, Artificial Sequence
  Description of Artificial Sequence: Synthetic oligonucleotide
gacagcgacgtgggggagtatcgg

SEQ ID NO: 71999 - DNA, 24 bp, Artificial Sequence
  Description of Artificial Sequence: Synthetic oligonucleotide
acagcgacgtgggggagtatcggg

SEQ ID NO: 72000 - DNA, 23 bp, Artificial Sequence
  Description of Artificial Sequence: Synthetic oligonucleotide
cagcgacgtgggggagtatcggg

SEQ ID NO: 72001 - DNA, 23 bp, Artificial Sequence
  Description of Artificial Sequence: Synthetic oligonucleotide
agcgacgtgggggagtatcgggc

SEQ ID NO: 72002 - DNA, 22 bp, Artificial Sequence
  Description of Artificial Sequence: Synthetic oligonucleotide
gcgacgtgggggagtatcgggc

SEQ ID NO: 72003 - DNA, 22 bp, Artificial Sequence
  Description of Artificial Sequence: Synthetic oligonucleotide
cgacgtgggggagtatcgggcg

SEQ ID NO: 72004 - DNA, 23 bp, Artificial Sequence
  Description of Artificial Sequence: Synthetic oligonucleotide
gacgtgggggagtatcgggcggt

SEQ ID NO: 72005 - DNA, 24 bp, Artificial Sequence
  Description of Artificial Sequence: Synthetic oligonucleotide
acgtgggggagtatcgggcggtga

SEQ ID NO: 72006 - DNA, 23 bp, Artificial Sequence
  Description of Artificial Sequence: Synthetic oligonucleotide
cgtgggggagtatcgggcggtga

SEQ ID NO: 72007 - DNA, 23 bp, Artificial Sequence
  Description of Artificial Sequence: Synthetic oligonucleotide
gtgggggagtatcgggcggtgac

SEQ ID NO: 72008 - DNA, 23 bp, Artificial Sequence
  Description of Artificial Sequence: Synthetic oligonucleotide
tgggggagtatcgggcggtgacg

SEQ ID NO: 72009 - DNA, 22 bp, Artificial Sequence
  Description of Artificial Sequence: Synthetic oligonucleotide
gggggagtatcgggcggtgacg

SEQ ID NO: 72010 - DNA, 23 bp, Artificial Sequence
  Description of Artificial Sequence: Synthetic oligonucleotide
ggggagtatcgggcggtgacgga

SEQ ID NO: 72011 - DNA, 23 bp, Artificial Sequence
  Description of Artificial Sequence: Synthetic oligonucleotide
gggagtatcgggcggtgacggag

SEQ ID NO: 72012 - DNA, 24 bp, Artificial Sequence
  Description of Artificial Sequence: Synthetic oligonucleotide
ggagtatcgggcggtgacggagct

SEQ ID NO: 72013 - DNA, 24 bp, Artificial Sequence
  Description of Artificial Sequence: Synthetic oligonucleotide
gagtatcgggcggtgacggagctg

SEQ ID NO: 72014 - DNA, 24 bp, Artificial Sequence
  Description of Artificial Sequence: Synthetic oligonucleotide
agtatcgggcggtgacggagctgg

SEQ ID NO: 72015 - DNA, 23 bp, Artificial Sequence
  Description of Artificial Sequence: Synthetic oligonucleotide
gtatcgggcggtgacggagctgg

SEQ ID NO: 72016 - DNA, 23 bp, Artificial Sequence
  Description of Artificial Sequence: Synthetic oligonucleotide
tatcgggcggtgacggagctggg

SEQ ID NO: 72017 - DNA, 22 bp, Artificial Sequence
  Description of Artificial Sequence: Synthetic oligonucleotide
atcgggcggtgacggagctggg

SEQ ID NO: 72018 - DNA, 21 bp, Artificial Sequence
  Description of Artificial Sequence: Synthetic oligonucleotide
tcgggcggtgacggagctggg

SEQ ID NO: 72019 - DNA, 25 bp, Artificial Sequence
  Description of Artificial Sequence: Synthetic oligonucleotide
ttcgtgcgcttcgacagcgacgtgc

SEQ ID NO: 72020 - DNA, 24 bp, Artificial Sequence
  Description of Artificial Sequence: Synthetic oligonucleotide
tcgtgcgcttcgacagcgacgtgc

SEQ ID NO: 72021 - DNA, 25 bp, Artificial Sequence
  Description of Artificial Sequence: Synthetic oligonucleotide
gcttcgacagcgacgtgcgggagta

SEQ ID NO: 72022 - DNA, 25 bp, Artificial Sequence
  Description of Artificial Sequence: Synthetic oligonucleotide
cttcgacagcgacgtgcgggagtac

SEQ ID NO: 72023 - DNA, 25 bp, Artificial Sequence
  Description of Artificial Sequence: Synthetic oligonucleotide
ttcgacagcgacgtgcgggagtacc

SEQ ID NO: 72024 - DNA, 24 bp, Artificial Sequence
  Description of Artificial Sequence: Synthetic oligonucleotide
tcgacagcgacgtgcgggagtacc

SEQ ID NO: 72025 - DNA, 23 bp, Artificial Sequence
  Description of Artificial Sequence: Synthetic oligonucleotide
cgacagcgacgtgcgggagtacc

SEQ ID NO: 72026 - DNA, 23 bp, Artificial Sequence
  Description of Artificial Sequence: Synthetic oligonucleotide
gacagcgacgtgcgggagtaccg

SEQ ID NO: 72027 - DNA, 23 bp, Artificial Sequence
  Description of Artificial Sequence: Synthetic oligonucleotide
acagcgacgtgcgggagtaccgg

SEQ ID NO: 72028 - DNA, 22 bp, Artificial Sequence
  Description of Artificial Sequence: Synthetic oligonucleotide
cagcgacgtgcgggagtaccgg

SEQ ID NO: 72029 - DNA, 22 bp, Artificial Sequence
  Description of Artificial Sequence: Synthetic oligonucleotide
agcgacgtgcgggagtaccggg

SEQ ID NO: 72030 - DNA, 21 bp, Artificial Sequence
  Description of Artificial Sequence: Synthetic oligonucleotide
gcgacgtgcgggagtaccggg

SEQ ID NO: 72031 - DNA, 21 bp, Artificial Sequence
  Description of Artificial Sequence: Synthetic oligonucleotide
cgacgtgcgggagtaccgggc

SEQ ID NO: 72032 - DNA, 21 bp, Artificial Sequence
  Description of Artificial Sequence: Synthetic oligonucleotide
gacgtgcgggagtaccgggcg

SEQ ID NO: 72033 - DNA, 22 bp, Artificial Sequence
  Description of Artificial Sequence: Synthetic oligonucleotide
acgtgcgggagtaccgggcggt

SEQ ID NO: 72034 - DNA, 21 bp, Artificial Sequence
  Description of Artificial Sequence: Synthetic oligonucleotide
cgtgcgggagtaccgggcggt

SEQ ID NO: 72035 - DNA, 22 bp, Artificial Sequence
  Description of Artificial Sequence: Synthetic oligonucleotide
gtgcgggagtaccgggcggtga

SEQ ID NO: 72036 - DNA, 22 bp, Artificial Sequence
  Description of Artificial Sequence: Synthetic oligonucleotide
tgcgggagtaccgggcggtgac

SEQ ID NO: 72037 - DNA, 21 bp, Artificial Sequence
  Description of Artificial Sequence: Synthetic oligonucleotide
gcgggagtaccgggcggtgac

SEQ ID NO: 72038 - DNA, 21 bp, Artificial Sequence
  Description of Artificial Sequence: Synthetic oligonucleotide
cgggagtaccgggcggtgacg

SEQ ID NO: 72039 - DNA, 25 bp, Artificial Sequence
  Description of Artificial Sequence: Synthetic oligonucleotide
ggaggcgggccgaggtggacaatta

SEQ ID NO: 72040 - DNA, 31 bp, Artificial Sequence
  Description of Artificial Sequence: Synthetic oligonucleotide
cacgtttcttggagtaccctacgtctgagtg

SEQ ID NO: 72041 - DNA, 32 bp, Artificial Sequence
  Description of Artificial Sequence: Synthetic oligonucleotide
acgtttcttggagtaccctacgtctgagtgtc

SEQ ID NO: 72042 - DNA, 31 bp, Artificial Sequence
  Description of Artificial Sequence: Synthetic oligonucleotide
cgtttcttggagtaccctacgtctgagtgtc

SEQ ID NO: 72043 - DNA, 35 bp, Artificial Sequence
  Description of Artificial Sequence: Synthetic oligonucleotide
gtttcttggagtaccctacgtctgagtgtcatttc

SEQ ID NO: 72044 - DNA, 37 bp, Artificial Sequence
  Description of Artificial Sequence: Synthetic oligonucleotide
tttcttggagtaccctacgtctgagtgtcatttcttc

SEQ ID NO: 72045 - DNA, 36 bp, Artificial Sequence
  Description of Artificial Sequence: Synthetic oligonucleotide
ttcttggagtaccctacgtctgagtgtcatttcttc

SEQ ID NO: 72046 - DNA, 35 bp, Artificial Sequence
  Description of Artificial Sequence: Synthetic oligonucleotide
tcttggagtaccctacgtctgagtgtcatttcttc

SEQ ID NO: 72047 - DNA, 34 bp, Artificial Sequence
  Description of Artificial Sequence: Synthetic oligonucleotide
cttggagtaccctacgtctgagtgtcatttcttc

SEQ ID NO: 72048 - DNA, 37 bp, Artificial Sequence
  Description of Artificial Sequence: Synthetic oligonucleotide
ttggagtaccctacgtctgagtgtcatttcttcaatg

SEQ ID NO: 72049 - DNA, 36 bp, Artificial Sequence
  Description of Artificial Sequence: Synthetic oligonucleotide
tggagtaccctacgtctgagtgtcatttcttcaatg

SEQ ID NO: 72050 - DNA, 35 bp, Artificial Sequence
  Description of Artificial Sequence: Synthetic oligonucleotide
ggagtaccctacgtctgagtgtcatttcttcaatg

SEQ ID NO: 72051 - DNA, 35 bp, Artificial Sequence
  Description of Artificial Sequence: Synthetic oligonucleotide
gagtaccctacgtctgagtgtcatttcttcaatgg

SEQ ID NO: 72052 - DNA, 35 bp, Artificial Sequence
  Description of Artificial Sequence: Synthetic oligonucleotide
agtaccctacgtctgagtgtcatttcttcaatggg

SEQ ID NO: 72053 - DNA, 34 bp, Artificial Sequence
  Description of Artificial Sequence: Synthetic oligonucleotide
gtaccctacgtctgagtgtcatttcttcaatggg

SEQ ID NO: 72054 - DNA, 35 bp, Artificial Sequence
  Description of Artificial Sequence: Synthetic oligonucleotide
taccctacgtctgagtgtcatttcttcaatgggac

SEQ ID NO: 72055 - DNA, 34 bp, Artificial Sequence
  Description of Artificial Sequence: Synthetic oligonucleotide
accctacgtctgagtgtcatttcttcaatgggac

SEQ ID NO: 72056 - DNA, 33 bp, Artificial Sequence
  Description of Artificial Sequence: Synthetic oligonucleotide
ccctacgtctgagtgtcatttcttcaatgggac

SEQ ID NO: 72057 - DNA, 33 bp, Artificial Sequence
  Description of Artificial Sequence: Synthetic oligonucleotide
cctacgtctgagtgtcatttcttcaatgggacg

SEQ ID NO: 72058 - DNA, 33 bp, Artificial Sequence
  Description of Artificial Sequence: Synthetic oligonucleotide
tggagagatacttccataaccaggaggagttcc

SEQ ID NO: 72059 - DNA, 32 bp, Artificial Sequence
  Description of Artificial Sequence: Synthetic oligonucleotide
ggagagatacttccataaccaggaggagttcc

SEQ ID NO: 72060 - DNA, 33 bp, Artificial Sequence
  Description of Artificial Sequence: Synthetic oligonucleotide
gagagatacttccataaccaggaggagttcctg

SEQ ID NO: 72061 - DNA, 33 bp, Artificial Sequence
  Description of Artificial Sequence: Synthetic oligonucleotide
agagatacttccataaccaggaggagttcctgc

SEQ ID NO: 72062 - DNA, 32 bp, Artificial Sequence
  Description of Artificial Sequence: Synthetic oligonucleotide
gagatacttccataaccaggaggagttcctgc

SEQ ID NO: 72063 - DNA, 20 bp, Artificial Sequence
  Description of Artificial Sequence: Synthetic oligonucleotide
ggaggcgggccgaggtggac

SEQ ID NO: 72064 - DNA, 20 bp, Artificial Sequence
  Description of Artificial Sequence: Synthetic oligonucleotide
gaggcgggccgaggtggacg

SEQ ID NO: 72065 - DNA, 20 bp, Artificial Sequence
  Description of Artificial Sequence: Synthetic oligonucleotide
aggcgggccgaggtggacgc

SEQ ID NO: 72066 - DNA, 20 bp, Artificial Sequence
  Description of Artificial Sequence: Synthetic oligonucleotide
ggcgggccgaggtggacgct

SEQ ID NO: 72067 - DNA, 23 bp, Artificial Sequence
  Description of Artificial Sequence: Synthetic oligonucleotide
gcgggccgaggtggacgcctatt

SEQ ID NO: 72068 - DNA, 23 bp, Artificial Sequence
  Description of Artificial Sequence: Synthetic oligonucleotide
cgggccgaggtggacgcctattg

SEQ ID NO: 72069 - DNA, 24 bp, Artificial Sequence
  Description of Artificial Sequence: Synthetic oligonucleotide
gggccgaggtggacgcctattgca

SEQ ID NO: 72070 - DNA, 25 bp, Artificial Sequence
  Description of Artificial Sequence: Synthetic oligonucleotide
ggccgaggtggacgcctattgcaga

SEQ ID NO: 72071 - DNA, 26 bp, Artificial Sequence
  Description of Artificial Sequence: Synthetic oligonucleotide
gccgaggtggacgcctattgcagaca

SEQ ID NO: 72072 - DNA, 27 bp, Artificial Sequence
  Description of Artificial Sequence: Synthetic oligonucleotide
ccgaggtggacgcctattgcagacaca

SEQ ID NO: 72073 - DNA, 28 bp, Artificial Sequence
  Description of Artificial Sequence: Synthetic oligonucleotide
cgaggtggacgcctattgcagacacaac

SEQ ID NO: 72074 - DNA, 30 bp, Artificial Sequence
  Description of Artificial Sequence: Synthetic oligonucleotide
gaggtggacgcctattgcagacacaactac

SEQ ID NO: 72075 - DNA, 30 bp, Artificial Sequence
  Description of Artificial Sequence: Synthetic oligonucleotide
aggtggacgcctattgcagacacaactacg

SEQ ID NO: 72076 - DNA, 29 bp, Artificial Sequence
  Description of Artificial Sequence: Synthetic oligonucleotide
ggtggacgcctattgcagacacaactacg

SEQ ID NO: 72077 - DNA, 29 bp, Artificial Sequence
  Description of Artificial Sequence: Synthetic oligonucleotide
gtggacgcctattgcagacacaactacgg

SEQ ID NO: 72078 - DNA, 29 bp, Artificial Sequence
  Description of Artificial Sequence: Synthetic oligonucleotide
tggacgcctattgcagacacaactacggg

SEQ ID NO: 72079 - DNA, 28 bp, Artificial Sequence
  Description of Artificial Sequence: Synthetic oligonucleotide
ggacgcctattgcagacacaactacggg

SEQ ID NO: 72080 - DNA, 28 bp, Artificial Sequence
  Description of Artificial Sequence: Synthetic oligonucleotide
gacgcctattgcagacacaactacgggg

SEQ ID NO: 72081 - DNA, 30 bp, Artificial Sequence
  Description of Artificial Sequence: Synthetic oligonucleotide
acgcctattgcagacacaactacggggttg

SEQ ID NO: 72082 - DNA, 29 bp, Artificial Sequence
  Description of Artificial Sequence: Synthetic oligonucleotide
cgcctattgcagacacaactacggggttg

SEQ ID NO: 72083 - DNA, 30 bp, Artificial Sequence
  Description of Artificial Sequence: Synthetic oligonucleotide
gcctattgcagacacaactacggggttgtg

SEQ ID NO: 72084 - DNA, 27 bp, Artificial Sequence
  Description of Artificial Sequence: Synthetic oligonucleotide
gaacagccagaaggacatcctggagcg

SEQ ID NO: 72085 - DNA, 27 bp, Artificial Sequence
  Description of Artificial Sequence: Synthetic oligonucleotide
aacagccagaaggacatcctggagcgg

SEQ ID NO: 72086 - DNA, 27 bp, Artificial Sequence
  Description of Artificial Sequence: Synthetic oligonucleotide
acagccagaaggacatcctggagcgga

SEQ ID NO: 72087 - DNA, 26 bp, Artificial Sequence
  Description of Artificial Sequence: Synthetic oligonucleotide
cagccagaaggacatcctggagcgga

SEQ ID NO: 72088 - DNA, 26 bp, Artificial Sequence
  Description of Artificial Sequence: Synthetic oligonucleotide
agccagaaggacatcctggagcggag

SEQ ID NO: 72089 - DNA, 25 bp, Artificial Sequence
  Description of Artificial Sequence: Synthetic oligonucleotide
gccagaaggacatcctggagcggag

SEQ ID NO: 72090 - DNA, 25 bp, Artificial Sequence
  Description of Artificial Sequence: Synthetic oligonucleotide
ccagaaggacatcctggagcggagg

SEQ ID NO: 72091 - DNA, 25 bp, Artificial Sequence
  Description of Artificial Sequence: Synthetic oligonucleotide
cagaaggacatcctggagcggaggc

SEQ ID NO: 72092 - DNA, 25 bp, Artificial Sequence
  Description of Artificial Sequence: Synthetic oligonucleotide
agaaggacatcctggagcggaggcg

SEQ ID NO: 72093 - DNA, 24 bp, Artificial Sequence
  Description of Artificial Sequence: Synthetic oligonucleotide
gaaggacatcctggagcggaggcg

SEQ ID NO: 72094 - DNA, 24 bp, Artificial Sequence
  Description of Artificial Sequence: Synthetic oligonucleotide
aaggacatcctggagcggaggcgg

SEQ ID NO: 72095 - DNA, 23 bp, Artificial Sequence
  Description of Artificial Sequence: Synthetic oligonucleotide
aggacatcctggagcggaggcgg

SEQ ID NO: 72096 - DNA, 22 bp, Artificial Sequence
  Description of Artificial Sequence: Synthetic oligonucleotide
ggacatcctggagcggaggcgg

SEQ ID NO: 72097 - DNA, 22 bp, Artificial Sequence
  Description of Artificial Sequence: Synthetic oligonucleotide
gacatcctggagcggaggcggg

SEQ ID NO: 72098 - DNA, 22 bp, Artificial Sequence
  Description of Artificial Sequence: Synthetic oligonucleotide
acatcctggagcggaggcgggc

SEQ ID NO: 72099 - DNA, 21 bp, Artificial Sequence
  Description of Artificial Sequence: Synthetic oligonucleotide
catcctggagcggaggcgggc

SEQ ID NO: 72100 - DNA, 21 bp, Artificial Sequence
  Description of Artificial Sequence: Synthetic oligonucleotide
atcctggagcggaggcgggcc

SEQ ID NO: 72101 - DNA, 27 bp, Artificial Sequence
  Description of Artificial Sequence: Synthetic oligonucleotide
gggacaccagaccacgtttcttggagc

SEQ ID NO: 72102 - DNA, 28 bp, Artificial Sequence
  Description of Artificial Sequence: Synthetic oligonucleotide
ggacaccagaccacgtttcttggagctg

SEQ ID NO: 72103 - DNA, 28 bp, Artificial Sequence
  Description of Artificial Sequence: Synthetic oligonucleotide
gacaccagaccacgtttcttggagctgc

SEQ ID NO: 72104 - DNA, 28 bp, Artificial Sequence
  Description of Artificial Sequence: Synthetic oligonucleotide
acaccagaccacgtttcttggagctgcg

SEQ ID NO: 72105 - DNA, 27 bp, Artificial Sequence
  Description of Artificial Sequence: Synthetic oligonucleotide
caccagaccacgtttcttggagctgcg

SEQ ID NO: 72106 - DNA, 30 bp, Artificial Sequence
  Description of Artificial Sequence: Synthetic oligonucleotide
accagaccacgtttcttggagctgcgtaag

SEQ ID NO: 72107 - DNA, 29 bp, Artificial Sequence
  Description of Artificial Sequence: Synthetic oligonucleotide
ccagaccacgtttcttggagctgcgtaag

SEQ ID NO: 72108 - DNA, 30 bp, Artificial Sequence
  Description of Artificial Sequence: Synthetic oligonucleotide
cagaccacgtttcttggagctgcgtaagtc

SEQ ID NO: 72109 - DNA, 31 bp, Artificial Sequence
  Description of Artificial Sequence: Synthetic oligonucleotide
agaccacgtttcttggagctgcgtaagtctg

SEQ ID NO: 72110 - DNA, 30 bp, Artificial Sequence
  Description of Artificial Sequence: Synthetic oligonucleotide
gaccacgtttcttggagctgcgtaagtctg

SEQ ID NO: 72111 - DNA, 31 bp, Artificial Sequence
  Description of Artificial Sequence: Synthetic oligonucleotide
accacgtttcttggagctgcgtaagtctgag

SEQ ID NO: 72112 - DNA, 30 bp, Artificial Sequence
  Description of Artificial Sequence: Synthetic oligonucleotide
ccacgtttcttggagctgcgtaagtctgag

SEQ ID NO: 72113 - DNA, 20 bp, Artificial Sequence
  Description of Artificial Sequence: Synthetic oligonucleotide
ctggagcggaggcgggccct

SEQ ID NO: 72114 - DNA, 20 bp, Artificial Sequence
  Description of Artificial Sequence: Synthetic oligonucleotide
tggagcggaggcgggccctg

SEQ ID NO: 72115 - DNA, 20 bp, Artificial Sequence
  Description of Artificial Sequence: Synthetic oligonucleotide
ggagcggaggcgggccctgt

SEQ ID NO: 72116 - DNA, 20 bp, Artificial Sequence
  Description of Artificial Sequence: Synthetic oligonucleotide
gagcggaggcgggccctggt

SEQ ID NO: 72117 - DNA, 20 bp, Artificial Sequence
  Description of Artificial Sequence: Synthetic oligonucleotide
agcggaggcgggccctggtg

SEQ ID NO: 72118 - DNA, 20 bp, Artificial Sequence
  Description of Artificial Sequence: Synthetic oligonucleotide
gcggaggcgggccctggtgt

SEQ ID NO: 72119 - DNA, 20 bp, Artificial Sequence
  Description of Artificial Sequence: Synthetic oligonucleotide
cggaggcgggccctggtgga

SEQ ID NO: 72120 - DNA, 21 bp, Artificial Sequence
  Description of Artificial Sequence: Synthetic oligonucleotide
ggaggcgggccctggtggaca

SEQ ID NO: 72121 - DNA, 25 bp, Artificial Sequence
  Description of Artificial Sequence: Synthetic oligonucleotide
aggcgggccctggtggacacctatt

SEQ ID NO: 72122 - DNA, 24 bp, Artificial Sequence
  Description of Artificial Sequence: Synthetic oligonucleotide
ggcgggccctggtggacacctatt

SEQ ID NO: 72123 - DNA, 24 bp, Artificial Sequence
  Description of Artificial Sequence: Synthetic oligonucleotide
gcgggccctggtggacacctattg

SEQ ID NO: 72124 - DNA, 25 bp, Artificial Sequence
  Description of Artificial Sequence: Synthetic oligonucleotide
cgggccctggtggacacctattgca

SEQ ID NO: 72125 - DNA, 26 bp, Artificial Sequence
  Description of Artificial Sequence: Synthetic oligonucleotide
gggccctggtggacacctattgcaga

SEQ ID NO: 72126 - DNA, 27 bp, Artificial Sequence
  Description of Artificial Sequence: Synthetic oligonucleotide
ggccctggtggacacctattgcagaca

SEQ ID NO: 72127 - DNA, 27 bp, Artificial Sequence
  Description of Artificial Sequence: Synthetic oligonucleotide
gccctggtggacacctattgcagacac

SEQ ID NO: 72128 - DNA, 29 bp, Artificial Sequence
  Description of Artificial Sequence: Synthetic oligonucleotide
ccctggtggacacctattgcagacacaac

SEQ ID NO: 72129 - DNA, 31 bp, Artificial Sequence
  Description of Artificial Sequence: Synthetic oligonucleotide
cctggtggacacctattgcagacacaactac

SEQ ID NO: 72130 - DNA, 31 bp, Artificial Sequence
  Description of Artificial Sequence: Synthetic oligonucleotide
ctggtggacacctattgcagacacaactacg

SEQ ID NO: 72131 - DNA, 31 bp, Artificial Sequence
  Description of Artificial Sequence: Synthetic oligonucleotide
tggtggacacctattgcagacacaactacgg

SEQ ID NO: 72132 - DNA, 22 bp, Artificial Sequence
  Description of Artificial Sequence: Synthetic oligonucleotide
gacctcctggagcggaggcggt

SEQ ID NO: 72133 - DNA, 22 bp, Artificial Sequence
  Description of Artificial Sequence: Synthetic oligonucleotide
acctcctggagcggaggcggtc

SEQ ID NO: 72134 - DNA, 21 bp, Artificial Sequence
  Description of Artificial Sequence: Synthetic oligonucleotide
cctcctggagcggaggcggtc

SEQ ID NO: 72135 - DNA, 21 bp, Artificial Sequence
  Description of Artificial Sequence: Synthetic oligonucleotide
ctcctggagcggaggcggtcc

SEQ ID NO: 72136 - DNA, 22 bp, Artificial Sequence
  Description of Artificial Sequence: Synthetic oligonucleotide
tcctggagcggaggcggtccga

SEQ ID NO: 72137 - DNA, 21 bp, Artificial Sequence
  Description of Artificial Sequence: Synthetic oligonucleotide
cctggagcggaggcggtccga

SEQ ID NO: 72138 - DNA, 21 bp, Artificial Sequence
  Description of Artificial Sequence: Synthetic oligonucleotide
ctggagcggaggcggtccgag

SEQ ID NO: 72139 - DNA, 22 bp, Artificial Sequence
  Description of Artificial Sequence: Synthetic oligonucleotide
tggagcggaggcggtccgaggt

SEQ ID NO: 72140 - DNA, 21 bp, Artificial Sequence
  Description of Artificial Sequence: Synthetic oligonucleotide
ggagcggaggcggtccgaggt

SEQ ID NO: 72141 - DNA, 21 bp, Artificial Sequence
  Description of Artificial Sequence: Synthetic oligonucleotide
gagcggaggcggtccgaggtg

SEQ ID NO: 72142 - DNA, 22 bp, Artificial Sequence
  Description of Artificial Sequence: Synthetic oligonucleotide
agcggaggcggtccgaggtgga

SEQ ID NO: 72143 - DNA, 21 bp, Artificial Sequence
  Description of Artificial Sequence: Synthetic oligonucleotide
gcggaggcggtccgaggtgga

SEQ ID NO: 72144 - DNA, 22 bp, Artificial Sequence
  Description of Artificial Sequence: Synthetic oligonucleotide
cggaggcggtccgaggtggaca

SEQ ID NO: 72145 - DNA, 22 bp, Artificial Sequence
  Description of Artificial Sequence: Synthetic oligonucleotide
ggaggcggtccgaggtggacac

SEQ ID NO: 72146 - DNA, 26 bp, Artificial Sequence
  Description of Artificial Sequence: Synthetic oligonucleotide
gaggcggtccgaggtggacacctatt

SEQ ID NO: 72147 - DNA, 26 bp, Artificial Sequence
  Description of Artificial Sequence: Synthetic oligonucleotide
aggcggtccgaggtggacacctattg

SEQ ID NO: 72148 - DNA, 25 bp, Artificial Sequence
  Description of Artificial Sequence: Synthetic oligonucleotide
ggcggtccgaggtggacacctattg

SEQ ID NO: 72149 - DNA, 26 bp, Artificial Sequence
  Description of Artificial Sequence: Synthetic oligonucleotide
gcggtccgaggtggacacctattgca

SEQ ID NO: 72150 - DNA, 27 bp, Artificial Sequence
  Description of Artificial Sequence: Synthetic oligonucleotide
cggtccgaggtggacacctattgcaga

SEQ ID NO: 72151 - DNA, 27 bp, Artificial Sequence
  Description of Artificial Sequence: Synthetic oligonucleotide
ggtccgaggtggacacctattgcagac

SEQ ID NO: 72152 - DNA, 28 bp, Artificial Sequence
  Description of Artificial Sequence: Synthetic oligonucleotide
gtccgaggtggacacctattgcagacac

SEQ ID NO: 72153 - DNA, 30 bp, Artificial Sequence
  Description of Artificial Sequence: Synthetic oligonucleotide
tccgaggtggacacctattgcagacacaac

SEQ ID NO: 72154 - DNA, 28 bp, Artificial Sequence
  Description of Artificial Sequence: Synthetic oligonucleotide
ggacaccagaccacgtttcttggagcag

SEQ ID NO: 72155 - DNA, 28 bp, Artificial Sequence
  Description of Artificial Sequence: Synthetic oligonucleotide
gacaccagaccacgtttcttggagcagg

SEQ ID NO: 72156 - DNA, 33 bp, Artificial Sequence
  Description of Artificial Sequence: Synthetic oligonucleotide
acaccagaccacgtttcttggagcaggttaaac

SEQ ID NO: 72157 - DNA, 32 bp, Artificial Sequence
  Description of Artificial Sequence: Synthetic oligonucleotide
caccagaccacgtttcttggagcaggttaaac

SEQ ID NO: 72158 - DNA, 34 bp, Artificial Sequence
  Description of Artificial Sequence: Synthetic oligonucleotide
accagaccacgtttcttggagcaggttaaacatg

SEQ ID NO: 72159 - DNA, 33 bp, Artificial Sequence
  Description of Artificial Sequence: Synthetic oligonucleotide
ccagaccacgtttcttggagcaggttaaacatg

SEQ ID NO: 72160 - DNA, 34 bp, Artificial Sequence
  Description of Artificial Sequence: Synthetic oligonucleotide
cagaccacgtttcttggagcaggttaaacatgag

SEQ ID NO: 72161 - DNA, 35 bp, Artificial Sequence
  Description of Artificial Sequence: Synthetic oligonucleotide
agaccacgtttcttggagcaggttaaacatgagtg

SEQ ID NO: 72162 - DNA, 27 bp, Artificial Sequence
  Description of Artificial Sequence: Synthetic oligonucleotide
agttcgtgcgcttcgacagcgacgtga

SEQ ID NO: 72163 - DNA, 26 bp, Artificial Sequence
  Description of Artificial Sequence: Synthetic oligonucleotide
gttcgtgcgcttcgacagcgacgtga

SEQ ID NO: 72164 - DNA, 26 bp, Artificial Sequence
  Description of Artificial Sequence: Synthetic oligonucleotide
ttcgtgcgcttcgacagcgacgtgag

SEQ ID NO: 72165 - DNA, 25 bp, Artificial Sequence
  Description of Artificial Sequence: Synthetic oligonucleotide
tcgtgcgcttcgacagcgacgtgag

SEQ ID NO: 72166 - DNA, 23 bp, Artificial Sequence
  Description of Artificial Sequence: Synthetic oligonucleotide
tgacggagctggggcggcctact

SEQ ID NO: 72167 - DNA, 22 bp, Artificial Sequence
  Description of Artificial Sequence: Synthetic oligonucleotide
gacggagctggggcggcctact

SEQ ID NO: 72168 - DNA, 22 bp, Artificial Sequence
  Description of Artificial Sequence: Synthetic oligonucleotide
acggagctggggcggcctactg

SEQ ID NO: 72169 - DNA, 21 bp, Artificial Sequence
  Description of Artificial Sequence: Synthetic oligonucleotide
cggagctggggcggcctactg

SEQ ID NO: 72170 - DNA, 21 bp, Artificial Sequence
  Description of Artificial Sequence: Synthetic oligonucleotide
ggagctggggcggcctactgc

SEQ ID NO: 72171 - DNA, 21 bp, Artificial Sequence
  Description of Artificial Sequence: Synthetic oligonucleotide
gagctggggcggcctactgcg

SEQ ID NO: 72172 - DNA, 22 bp, Artificial Sequence
  Description of Artificial Sequence: Synthetic oligonucleotide
agctggggcggcctactgcgga

SEQ ID NO: 72173 - DNA, 21 bp, Artificial Sequence
  Description of Artificial Sequence: Synthetic oligonucleotide
gctggggcggcctactgcgga

SEQ ID NO: 72174 - DNA, 21 bp, Artificial Sequence
  Description of Artificial Sequence: Synthetic oligonucleotide
ctggggcggcctactgcggag

SEQ ID NO: 72175 - DNA, 22 bp, Artificial Sequence
  Description of Artificial Sequence: Synthetic oligonucleotide
tggggcggcctactgcggagca

SEQ ID NO: 72176 - DNA, 21 bp, Artificial Sequence
  Description of Artificial Sequence: Synthetic oligonucleotide
ggggcggcctactgcggagca

SEQ ID NO: 72177 - DNA, 22 bp, Artificial Sequence
  Description of Artificial Sequence: Synthetic oligonucleotide
gggcggcctactgcggagcact

SEQ ID NO: 72178 - DNA, 22 bp, Artificial Sequence
  Description of Artificial Sequence: Synthetic oligonucleotide
ggcggcctactgcggagcactg

SEQ ID NO: 72179 - DNA, 24 bp, Artificial Sequence
  Description of Artificial Sequence: Synthetic oligonucleotide
gcggcctactgcggagcactggaa

SEQ ID NO: 72180 - DNA, 25 bp, Artificial Sequence
  Description of Artificial Sequence: Synthetic oligonucleotide
cggcctactgcggagcactggaaca

SEQ ID NO: 72181 - DNA, 25 bp, Artificial Sequence
  Description of Artificial Sequence: Synthetic oligonucleotide
ggcctactgcggagcactggaacag

SEQ ID NO: 72182 - DNA, 25 bp, Artificial Sequence
  Description of Artificial Sequence: Synthetic oligonucleotide
gcctactgcggagcactggaacagc

SEQ ID NO: 72183 - DNA, 26 bp, Artificial Sequence
  Description of Artificial Sequence: Synthetic oligonucleotide
cctactgcggagcactggaacagcca

SEQ ID NO: 72184 - DNA, 27 bp, Artificial Sequence
  Description of Artificial Sequence: Synthetic oligonucleotide
ctactgcggagcactggaacagccaga

SEQ ID NO: 72185 - DNA, 28 bp, Artificial Sequence
  Description of Artificial Sequence: Synthetic oligonucleotide
tactgcggagcactggaacagccagaag

SEQ ID NO: 72186 - DNA, 27 bp, Artificial Sequence
  Description of Artificial Sequence: Synthetic oligonucleotide
actgcggagcactggaacagccagaag

SEQ ID NO: 72187 - DNA, 24 bp, Artificial Sequence
  Description of Artificial Sequence: Synthetic oligonucleotide
gagcgggtgcggttcctggacaga

SEQ ID NO: 72188 - DNA, 25 bp, Artificial Sequence
  Description of Artificial Sequence: Synthetic oligonucleotide
agcgggtgcggttcctggacagaca

SEQ ID NO: 72189 - DNA, 24 bp, Artificial Sequence
  Description of Artificial Sequence: Synthetic oligonucleotide
gcgggtgcggttcctggacagaca

SEQ ID NO: 72190 - DNA, 26 bp, Artificial Sequence
  Description of Artificial Sequence: Synthetic oligonucleotide
cgggtgcggttcctggacagacactt

SEQ ID NO: 72191 - DNA, 26 bp, Artificial Sequence
  Description of Artificial Sequence: Synthetic oligonucleotide
gggtgcggttcctggacagacacttc

SEQ ID NO: 72192 - DNA, 27 bp, Artificial Sequence
  Description of Artificial Sequence: Synthetic oligonucleotide
ggtgcggttcctggacagacacttcca

SEQ ID NO: 72193 - DNA, 30 bp, Artificial Sequence
  Description of Artificial Sequence: Synthetic oligonucleotide
gtgcggttcctggacagacacttccataac

SEQ ID NO: 72194 - DNA, 30 bp, Artificial Sequence
  Description of Artificial Sequence: Synthetic oligonucleotide
tgcggttcctggacagacacttccataacc

SEQ ID NO: 72195 - DNA, 29 bp, Artificial Sequence
  Description of Artificial Sequence: Synthetic oligonucleotide
gcggttcctggacagacacttccataacc

SEQ ID NO: 72196 - DNA, 30 bp, Artificial Sequence
  Description of Artificial Sequence: Synthetic oligonucleotide
cggttcctggacagacacttccataaccag

SEQ ID NO: 72197 - DNA, 30 bp, Artificial Sequence
  Description of Artificial Sequence: Synthetic oligonucleotide
ggttcctggacagacacttccataaccagg

SEQ ID NO: 72198 - DNA, 31 bp, Artificial Sequence
  Description of Artificial Sequence: Synthetic oligonucleotide
gttcctggacagacacttccataaccaggag

SEQ ID NO: 72199 - DNA, 31 bp, Artificial Sequence
  Description of Artificial Sequence: Synthetic oligonucleotide
ttcctggacagacacttccataaccaggagg

SEQ ID NO: 72200 - DNA, 30 bp, Artificial Sequence
  Description of Artificial Sequence: Synthetic oligonucleotide
tcctggacagacacttccataaccaggagg

SEQ ID NO: 72201 - DNA, 29 bp, Artificial Sequence
  Description of Artificial Sequence: Synthetic oligonucleotide
cctggacagacacttccataaccaggagg

SEQ ID NO: 72202 - DNA, 30 bp, Artificial Sequence
  Description of Artificial Sequence: Synthetic oligonucleotide
ctggacagacacttccataaccaggaggag

SEQ ID NO: 72203 - DNA, 32 bp, Artificial Sequence
  Description of Artificial Sequence: Synthetic oligonucleotide
tggacagacacttccataaccaggaggagttc

SEQ ID NO: 72204 - DNA, 31 bp, Artificial Sequence
  Description of Artificial Sequence: Synthetic oligonucleotide
ggacagacacttccataaccaggaggagttc

SEQ ID NO: 72205 - DNA, 31 bp, Artificial Sequence
  Description of Artificial Sequence: Synthetic oligonucleotide
gacagacacttccataaccaggaggagttcg

SEQ ID NO: 72206 - DNA, 32 bp, Artificial Sequence
  Description of Artificial Sequence: Synthetic oligonucleotide
acagacacttccataaccaggaggagttcgtg

SEQ ID NO: 72207 - DNA, 31 bp, Artificial Sequence
  Description of Artificial Sequence: Synthetic oligonucleotide
cagacacttccataaccaggaggagttcgtg

SEQ ID NO: 72208 - DNA, 33 bp, Artificial Sequence
  Description of Artificial Sequence: Synthetic oligonucleotide
gacacctattgcagacacaactacggggttatg

SEQ ID NO: 72209 - DNA, 33 bp, Artificial Sequence
  Description of Artificial Sequence: Synthetic oligonucleotide
acacctattgcagacacaactacggggttatgg

SEQ ID NO: 72210 - DNA, 32 bp, Artificial Sequence
  Description of Artificial Sequence: Synthetic oligonucleotide
cacctattgcagacacaactacggggttatgg

SEQ ID NO: 72211 - DNA, 33 bp, Artificial Sequence
  Description of Artificial Sequence: Synthetic oligonucleotide
acctattgcagacacaactacggggttatggag

SEQ ID NO: 72212 - DNA, 32 bp, Artificial Sequence
  Description of Artificial Sequence: Synthetic oligonucleotide
cctattgcagacacaactacggggttatggag

SEQ ID NO: 72213 - DNA, 33 bp, Artificial Sequence
  Description of Artificial Sequence: Synthetic oligonucleotide
ctattgcagacacaactacggggttatggagag

SEQ ID NO: 72214 - DNA, 33 bp, Artificial Sequence
  Description of Artificial Sequence: Synthetic oligonucleotide
tattgcagacacaactacggggttatggagagc

SEQ ID NO: 72215 - DNA, 32 bp, Artificial Sequence
  Description of Artificial Sequence: Synthetic oligonucleotide
attgcagacacaactacggggttatggagagc

SEQ ID NO: 72216 - DNA, 31 bp, Artificial Sequence
  Description of Artificial Sequence: Synthetic oligonucleotide
ttgcagacacaactacggggttatggagagc

SEQ ID NO: 72217 - DNA, 21 bp, Artificial Sequence
  Description of Artificial Sequence: Synthetic oligonucleotide
ctggggcggcctgatgccgag

SEQ ID NO: 72218 - DNA, 22 bp, Artificial Sequence
  Description of Artificial Sequence: Synthetic oligonucleotide
tggggcggcctgatgccgagca

SEQ ID NO: 72219 - DNA, 21 bp, Artificial Sequence
  Description of Artificial Sequence: Synthetic oligonucleotide
ggggcggcctgatgccgagca

SEQ ID NO: 72220 - DNA, 22 bp, Artificial Sequence
  Description of Artificial Sequence: Synthetic oligonucleotide
gggcggcctgatgccgagcact

SEQ ID NO: 72221 - DNA, 22 bp, Artificial Sequence
  Description of Artificial Sequence: Synthetic oligonucleotide
ggcggcctgatgccgagcactg

SEQ ID NO: 72222 - DNA, 24 bp, Artificial Sequence
  Description of Artificial Sequence: Synthetic oligonucleotide
gcggcctgatgccgagcactggaa

SEQ ID NO: 72223 - DNA, 25 bp, Artificial Sequence
  Description of Artificial Sequence: Synthetic oligonucleotide
cggcctgatgccgagcactggaaca

SEQ ID NO: 72224 - DNA, 25 bp, Artificial Sequence
  Description of Artificial Sequence: Synthetic oligonucleotide
ggcctgatgccgagcactggaacag

SEQ ID NO: 72225 - DNA, 25 bp, Artificial Sequence
  Description of Artificial Sequence: Synthetic oligonucleotide
gcctgatgccgagcactggaacagc

SEQ ID NO: 72226 - DNA, 26 bp, Artificial Sequence
  Description of Artificial Sequence: Synthetic oligonucleotide
cctgatgccgagcactggaacagcca

SEQ ID NO: 72227 - DNA, 27 bp, Artificial Sequence
  Description of Artificial Sequence: Synthetic oligonucleotide
ctgatgccgagcactggaacagccaga

SEQ ID NO: 72228 - DNA, 28 bp, Artificial Sequence
  Description of Artificial Sequence: Synthetic oligonucleotide
tgatgccgagcactggaacagccagaag

SEQ ID NO: 72229 - DNA, 27 bp, Artificial Sequence
  Description of Artificial Sequence: Synthetic oligonucleotide
gatgccgagcactggaacagccagaag

SEQ ID NO: 72230 - DNA, 27 bp, Artificial Sequence
  Description of Artificial Sequence: Synthetic oligonucleotide
atgccgagcactggaacagccagaagg

SEQ ID NO: 72231 - DNA, 27 bp, Artificial Sequence
  Description of Artificial Sequence: Synthetic oligonucleotide
tgccgagcactggaacagccagaagga

SEQ ID NO: 72232 - DNA, 26 bp, Artificial Sequence
  Description of Artificial Sequence: Synthetic oligonucleotide
gccgagcactggaacagccagaagga

SEQ ID NO: 72233 - DNA, 26 bp, Artificial Sequence
  Description of Artificial Sequence: Synthetic oligonucleotide
ccgagcactggaacagccagaaggac

SEQ ID NO: 72234 - DNA, 27 bp, Artificial Sequence
  Description of Artificial Sequence: Synthetic oligonucleotide
cgagcactggaacagccagaaggacct

SEQ ID NO: 72235 - DNA, 26 bp, Artificial Sequence
  Description of Artificial Sequence: Synthetic oligonucleotide
aatgggacggagcgggtgcggttcat

SEQ ID NO: 72236 - DNA, 25 bp, Artificial Sequence
  Description of Artificial Sequence: Synthetic oligonucleotide
atgggacggagcgggtgcggttcat

SEQ ID NO: 72237 - DNA, 24 bp, Artificial Sequence
  Description of Artificial Sequence: Synthetic oligonucleotide
tgggacggagcgggtgcggttcat

SEQ ID NO: 72238 - DNA, 23 bp, Artificial Sequence
  Description of Artificial Sequence: Synthetic oligonucleotide
gggacggagcgggtgcggttcat

SEQ ID NO: 72239 - DNA, 23 bp, Artificial Sequence
  Description of Artificial Sequence: Synthetic oligonucleotide
ggacggagcgggtgcggttcatg

SEQ ID NO: 72240 - DNA, 24 bp, Artificial Sequence
  Description of Artificial Sequence: Synthetic oligonucleotide
gacggagcgggtgcggttcatgga

SEQ ID NO: 72241 - DNA, 25 bp, Artificial Sequence
  Description of Artificial Sequence: Synthetic oligonucleotide
acggagcgggtgcggttcatggaga

SEQ ID NO: 72242 - DNA, 24 bp, Artificial Sequence
  Description of Artificial Sequence: Synthetic oligonucleotide
cggagcgggtgcggttcatggaga

SEQ ID NO: 72243 - DNA, 27 bp, Artificial Sequence
  Description of Artificial Sequence: Synthetic oligonucleotide
ggagcgggtgcggttcatggagagata

SEQ ID NO: 72244 - DNA, 27 bp, Artificial Sequence
  Description of Artificial Sequence: Synthetic oligonucleotide
gagcgggtgcggttcatggagagatac

SEQ ID NO: 72245 - DNA, 29 bp, Artificial Sequence
  Description of Artificial Sequence: Synthetic oligonucleotide
agcgggtgcggttcatggagagatacttc

SEQ ID NO: 72246 - DNA, 28 bp, Artificial Sequence
  Description of Artificial Sequence: Synthetic oligonucleotide
gcgggtgcggttcatggagagatacttc

SEQ ID NO: 72247 - DNA, 28 bp, Artificial Sequence
  Description of Artificial Sequence: Synthetic oligonucleotide
cgggtgcggttcatggagagatacttcc

SEQ ID NO: 72248 - DNA, 32 bp, Artificial Sequence
  Description of Artificial Sequence: Synthetic oligonucleotide
gggtgcggttcatggagagatacttccataac

SEQ ID NO: 72249 - DNA, 32 bp, Artificial Sequence
  Description of Artificial Sequence: Synthetic oligonucleotide
ggtgcggttcatggagagatacttccataacc

SEQ ID NO: 72250 - DNA, 33 bp, Artificial Sequence
  Description of Artificial Sequence: Synthetic oligonucleotide
gtgcggttcatggagagatacttccataaccag

SEQ ID NO: 72251 - DNA, 33 bp, Artificial Sequence
  Description of Artificial Sequence: Synthetic oligonucleotide
tgcggttcatggagagatacttccataaccagg

SEQ ID NO: 72252 - DNA, 32 bp, Artificial Sequence
  Description of Artificial Sequence: Synthetic oligonucleotide
gcggttcatggagagatacttccataaccagg

SEQ ID NO: 72253 - DNA, 33 bp, Artificial Sequence
  Description of Artificial Sequence: Synthetic oligonucleotide
cggttcatggagagatacttccataaccaggag

SEQ ID NO: 72254 - DNA, 33 bp, Artificial Sequence
  Description of Artificial Sequence: Synthetic oligonucleotide
ggttcatggagagatacttccataaccaggagg

SEQ ID NO: 72255 - DNA, 34 bp, Artificial Sequence
  Description of Artificial Sequence: Synthetic oligonucleotide
gttcatggagagatacttccataaccaggaggag

SEQ ID NO: 72256 - DNA, 36 bp, Artificial Sequence
  Description of Artificial Sequence: Synthetic oligonucleotide
ttcatggagagatacttccataaccaggaggagaac

SEQ ID NO: 72257 - DNA, 35 bp, Artificial Sequence
  Description of Artificial Sequence: Synthetic oligonucleotide
tcatggagagatacttccataaccaggaggagaac

SEQ ID NO: 72258 - DNA, 34 bp, Artificial Sequence
  Description of Artificial Sequence: Synthetic oligonucleotide
catggagagatacttccataaccaggaggagaac

SEQ ID NO: 72259 - DNA, 34 bp, Artificial Sequence
  Description of Artificial Sequence: Synthetic oligonucleotide
atggagagatacttccataaccaggaggagaacg

SEQ ID NO: 72260 - DNA, 21 bp, Artificial Sequence
  Description of Artificial Sequence: Synthetic oligonucleotide
tgagggagctggggcggcctg

SEQ ID NO: 72261 - DNA, 20 bp, Artificial Sequence
  Description of Artificial Sequence: Synthetic oligonucleotide
gagggagctggggcggcctg

SEQ ID NO: 72262 - DNA, 21 bp, Artificial Sequence
  Description of Artificial Sequence: Synthetic oligonucleotide
agggagctggggcggcctgct

SEQ ID NO: 72263 - DNA, 20 bp, Artificial Sequence
  Description of Artificial Sequence: Synthetic oligonucleotide
gggagctggggcggcctgct

SEQ ID NO: 72264 - DNA, 22 bp, Artificial Sequence
  Description of Artificial Sequence: Synthetic oligonucleotide
tggagcggaggcgggccgagat

SEQ ID NO: 72265 - DNA, 21 bp, Artificial Sequence
  Description of Artificial Sequence: Synthetic oligonucleotide
ggagcggaggcgggccgagat

SEQ ID NO: 72266 - DNA, 21 bp, Artificial Sequence
  Description of Artificial Sequence: Synthetic oligonucleotide
gagcggaggcgggccgagatg

SEQ ID NO: 72267 - DNA, 22 bp, Artificial Sequence
  Description of Artificial Sequence: Synthetic oligonucleotide
agcggaggcgggccgagatgga

SEQ ID NO: 72268 - DNA, 21 bp, Artificial Sequence
  Description of Artificial Sequence: Synthetic oligonucleotide
gcggaggcgggccgagatgga

SEQ ID NO: 72269 - DNA, 22 bp, Artificial Sequence
  Description of Artificial Sequence: Synthetic oligonucleotide
cggaggcgggccgagatggaca

SEQ ID NO: 72270 - DNA, 22 bp, Artificial Sequence
  Description of Artificial Sequence: Synthetic oligonucleotide
ggaggcgggccgagatggacac

SEQ ID NO: 72271 - DNA, 26 bp, Artificial Sequence
  Description of Artificial Sequence: Synthetic oligonucleotide
gaggcgggccgagatggacacctatt

SEQ ID NO: 72272 - DNA, 26 bp, Artificial Sequence
  Description of Artificial Sequence: Synthetic oligonucleotide
aggcgggccgagatggacacctattg

SEQ ID NO: 72273 - DNA, 25 bp, Artificial Sequence
  Description of Artificial Sequence: Synthetic oligonucleotide
ggcgggccgagatggacacctattg

SEQ ID NO: 72274 - DNA, 26 bp, Artificial Sequence
  Description of Artificial Sequence: Synthetic oligonucleotide
gcgggccgagatggacacctattgca

SEQ ID NO: 72275 - DNA, 27 bp, Artificial Sequence
  Description of Artificial Sequence: Synthetic oligonucleotide
cgggccgagatggacacctattgcaga

SEQ ID NO: 72276 - DNA, 27 bp, Artificial Sequence
  Description of Artificial Sequence: Synthetic oligonucleotide
gggccgagatggacacctattgcagac

SEQ ID NO: 72277 - DNA, 28 bp, Artificial Sequence
  Description of Artificial Sequence: Synthetic oligonucleotide
ggccgagatggacacctattgcagacac

SEQ ID NO: 72278 - DNA, 30 bp, Artificial Sequence
  Description of Artificial Sequence: Synthetic oligonucleotide
gccgagatggacacctattgcagacacaac

SEQ ID NO: 72279 - DNA, 32 bp, Artificial Sequence
  Description of Artificial Sequence: Synthetic oligonucleotide
ccgagatggacacctattgcagacacaactac

SEQ ID NO: 72280 - DNA, 32 bp, Artificial Sequence
  Description of Artificial Sequence: Synthetic oligonucleotide
cgagatggacacctattgcagacacaactacg

SEQ ID NO: 72281 - DNA, 32 bp, Artificial Sequence
  Description of Artificial Sequence: Synthetic oligonucleotide
gagatggacacctattgcagacacaactacgg

SEQ ID NO: 72282 - DNA, 32 bp, Artificial Sequence
  Description of Artificial Sequence: Synthetic oligonucleotide
agatggacacctattgcagacacaactacggg

SEQ ID NO: 72283 - DNA, 31 bp, Artificial Sequence
  Description of Artificial Sequence: Synthetic oligonucleotide
gatggacacctattgcagacacaactacggg

SEQ ID NO: 72284 - DNA, 31 bp, Artificial Sequence
  Description of Artificial Sequence: Synthetic oligonucleotide
atggacacctattgcagacacaactacgggg

SEQ ID NO: 72285 - DNA, 22 bp, Artificial Sequence
  Description of Artificial Sequence: Synthetic oligonucleotide
gtgacggagctggggcagcctg

SEQ ID NO: 72286 - DNA, 23 bp, Artificial Sequence
  Description of Artificial Sequence: Synthetic oligonucleotide
tgacggagctggggcagcctgct

SEQ ID NO: 72287 - DNA, 22 bp, Artificial Sequence
  Description of Artificial Sequence: Synthetic oligonucleotide
gacggagctggggcagcctgct

SEQ ID NO: 72288 - DNA, 22 bp, Artificial Sequence
  Description of Artificial Sequence: Synthetic oligonucleotide
acggagctggggcagcctgctg

SEQ ID NO: 72289 - DNA, 21 bp, Artificial Sequence
  Description of Artificial Sequence: Synthetic oligonucleotide
cggagctggggcagcctgctg

SEQ ID NO: 72290 - DNA, 21 bp, Artificial Sequence
  Description of Artificial Sequence: Synthetic oligonucleotide
ggagctggggcagcctgctgc

SEQ ID NO: 72291 - DNA, 21 bp, Artificial Sequence
  Description of Artificial Sequence: Synthetic oligonucleotide
gagctggggcagcctgctgcg

SEQ ID NO: 72292 - DNA, 22 bp, Artificial Sequence
  Description of Artificial Sequence: Synthetic oligonucleotide
agctggggcagcctgctgcgga

SEQ ID NO: 72293 - DNA, 21 bp, Artificial Sequence
  Description of Artificial Sequence: Synthetic oligonucleotide
gctggggcagcctgctgcgga

SEQ ID NO: 72294 - DNA, 21 bp, Artificial Sequence
  Description of Artificial Sequence: Synthetic oligonucleotide
ctggggcagcctgctgcggag

SEQ ID NO: 72295 - DNA, 22 bp, Artificial Sequence
  Description of Artificial Sequence: Synthetic oligonucleotide
tggggcagcctgctgcggagca

SEQ ID NO: 72296 - DNA, 21 bp, Artificial Sequence
  Description of Artificial Sequence: Synthetic oligonucleotide
ggggcagcctgctgcggagca

SEQ ID NO: 72297 - DNA, 22 bp, Artificial Sequence
  Description of Artificial Sequence: Synthetic oligonucleotide
gggcagcctgctgcggagcact

SEQ ID NO: 72298 - DNA, 22 bp, Artificial Sequence
  Description of Artificial Sequence: Synthetic oligonucleotide
ggcagcctgctgcggagcactg

SEQ ID NO: 72299 - DNA, 24 bp, Artificial Sequence
  Description of Artificial Sequence: Synthetic oligonucleotide
gcagcctgctgcggagcactggaa

SEQ ID NO: 72300 - DNA, 25 bp, Artificial Sequence
  Description of Artificial Sequence: Synthetic oligonucleotide
cagcctgctgcggagcactggaaca

SEQ ID NO: 72301 - DNA, 25 bp, Artificial Sequence
  Description of Artificial Sequence: Synthetic oligonucleotide
agcctgctgcggagcactggaacag

SEQ ID NO: 72302 - DNA, 20 bp, Artificial Sequence
  Description of Artificial Sequence: Synthetic oligonucleotide
ggcggtgacggagctggggg

SEQ ID NO: 72303 - DNA, 20 bp, Artificial Sequence
  Description of Artificial Sequence: Synthetic oligonucleotide
gcggtgacggagctgggggg

SEQ ID NO: 72304 - DNA, 20 bp, Artificial Sequence
  Description of Artificial Sequence: Synthetic oligonucleotide
cggtgacggagctggggggg

SEQ ID NO: 72305 - DNA, 20 bp, Artificial Sequence
  Description of Artificial Sequence: Synthetic oligonucleotide
ggtgacggagctgggggggc

SEQ ID NO: 72306 - DNA, 21 bp, Artificial Sequence
  Description of Artificial Sequence: Synthetic oligonucleotide
gtgacggagctgggggggcct

SEQ ID NO: 72307 - DNA, 21 bp, Artificial Sequence
  Description of Artificial Sequence: Synthetic oligonucleotide
tgacggagctgggggggcctg

SEQ ID NO: 72308 - DNA, 20 bp, Artificial Sequence
  Description of Artificial Sequence: Synthetic oligonucleotide
gacggagctgggggggcctg

SEQ ID NO: 72309 - DNA, 21 bp, Artificial Sequence
  Description of Artificial Sequence: Synthetic oligonucleotide
acggagctgggggggcctgct

SEQ ID NO: 72310 - DNA, 20 bp, Artificial Sequence
  Description of Artificial Sequence: Synthetic oligonucleotide
cggagctgggggggcctgct

SEQ ID NO: 72311 - DNA, 20 bp, Artificial Sequence
  Description of Artificial Sequence: Synthetic oligonucleotide
ggagctgggggggcctgctg

SEQ ID NO: 72312 - DNA, 20 bp, Artificial Sequence
  Description of Artificial Sequence: Synthetic oligonucleotide
gagctgggggggcctgctgc

SEQ ID NO: 72313 - DNA, 20 bp, Artificial Sequence
  Description of Artificial Sequence: Synthetic oligonucleotide
agctgggggggcctgctgcg

SEQ ID NO: 72314 - DNA, 20 bp, Artificial Sequence
  Description of Artificial Sequence: Synthetic oligonucleotide
gctgggggggcctgctgcgt

SEQ ID NO: 72315 - DNA, 20 bp, Artificial Sequence
  Description of Artificial Sequence: Synthetic oligonucleotide
ctgggggggcctgctgcgga

SEQ ID NO: 72316 - DNA, 20 bp, Artificial Sequence
  Description of Artificial Sequence: Synthetic oligonucleotide
tgggggggcctgctgcggag

SEQ ID NO: 72317 - DNA, 20 bp, Artificial Sequence
  Description of Artificial Sequence: Synthetic oligonucleotide
gggggggcctgctgcggagt

SEQ ID NO: 72318 - DNA, 20 bp, Artificial Sequence
  Description of Artificial Sequence: Synthetic oligonucleotide
ggggggcctgctgcggagca

SEQ ID NO: 72319 - DNA, 21 bp, Artificial Sequence
  Description of Artificial Sequence: Synthetic oligonucleotide
gggggcctgctgcggagcact

SEQ ID NO: 72320 - DNA, 21 bp, Artificial Sequence
  Description of Artificial Sequence: Synthetic oligonucleotide
ggggcctgctgcggagcactg

SEQ ID NO: 72321 - DNA, 23 bp, Artificial Sequence
  Description of Artificial Sequence: Synthetic oligonucleotide
gggcctgctgcggagcactggaa

SEQ ID NO: 72322 - DNA, 33 bp, Artificial Sequence
  Description of Artificial Sequence: Synthetic oligonucleotide
cggttcctggacagatacttccataaccagtag

SEQ ID NO: 72323 - DNA, 33 bp, Artificial Sequence
  Description of Artificial Sequence: Synthetic oligonucleotide
ggttcctggacagatacttccataaccagtagg

SEQ ID NO: 72324 - DNA, 34 bp, Artificial Sequence
  Description of Artificial Sequence: Synthetic oligonucleotide
gttcctggacagatacttccataaccagtaggag

SEQ ID NO: 72325 - DNA, 36 bp, Artificial Sequence
  Description of Artificial Sequence: Synthetic oligonucleotide
ttcctggacagatacttccataaccagtaggagttc

SEQ ID NO: 72326 - DNA, 35 bp, Artificial Sequence
  Description of Artificial Sequence: Synthetic oligonucleotide
tcctggacagatacttccataaccagtaggagttc

SEQ ID NO: 72327 - DNA, 34 bp, Artificial Sequence
  Description of Artificial Sequence: Synthetic oligonucleotide
cctggacagatacttccataaccagtaggagttc

SEQ ID NO: 72328 - DNA, 34 bp, Artificial Sequence
  Description of Artificial Sequence: Synthetic oligonucleotide
ctggacagatacttccataaccagtaggagttcg

SEQ ID NO: 72329 - DNA, 35 bp, Artificial Sequence
  Description of Artificial Sequence: Synthetic oligonucleotide
tggacagatacttccataaccagtaggagttcgtg

SEQ ID NO: 72330 - DNA, 34 bp, Artificial Sequence
  Description of Artificial Sequence: Synthetic oligonucleotide
ggacagatacttccataaccagtaggagttcgtg

SEQ ID NO: 72331 - DNA, 34 bp, Artificial Sequence
  Description of Artificial Sequence: Synthetic oligonucleotide
gacagatacttccataaccagtaggagttcgtgc

SEQ ID NO: 72332 - DNA, 34 bp, Artificial Sequence
  Description of Artificial Sequence: Synthetic oligonucleotide
acagatacttccataaccagtaggagttcgtgcg

SEQ ID NO: 72333 - DNA, 33 bp, Artificial Sequence
  Description of Artificial Sequence: Synthetic oligonucleotide
cagatacttccataaccagtaggagttcgtgcg

SEQ ID NO: 72334 - DNA, 33 bp, Artificial Sequence
  Description of Artificial Sequence: Synthetic oligonucleotide
agatacttccataaccagtaggagttcgtgcgc

SEQ ID NO: 72335 - DNA, 32 bp, Artificial Sequence
  Description of Artificial Sequence: Synthetic oligonucleotide
gatacttccataaccagtaggagttcgtgcgc

SEQ ID NO: 72336 - DNA, 34 bp, Artificial Sequence
  Description of Artificial Sequence: Synthetic oligonucleotide
atacttccataaccagtaggagttcgtgcgcttc

SEQ ID NO: 72337 - DNA, 33 bp, Artificial Sequence
  Description of Artificial Sequence: Synthetic oligonucleotide
tacttccataaccagtaggagttcgtgcgcttc

SEQ ID NO: 72338 - DNA, 32 bp, Artificial Sequence
  Description of Artificial Sequence: Synthetic oligonucleotide
acttccataaccagtaggagttcgtgcgcttc

SEQ ID NO: 72339 - DNA, 31 bp, Artificial Sequence
  Description of Artificial Sequence: Synthetic oligonucleotide
cttccataaccagtaggagttcgtgcgcttc

SEQ ID NO: 72340 - DNA, 31 bp, Artificial Sequence
  Description of Artificial Sequence: Synthetic oligonucleotide
ttccataaccagtaggagttcgtgcgcttcg

SEQ ID NO: 72341 - DNA, 30 bp, Artificial Sequence
  Description of Artificial Sequence: Synthetic oligonucleotide
tccataaccagtaggagttcgtgcgcttcg

SEQ ID NO: 72342 - DNA, 29 bp, Artificial Sequence
  Description of Artificial Sequence: Synthetic oligonucleotide
ccataaccagtaggagttcgtgcgcttcg

SEQ ID NO: 72343 - DNA, 30 bp, Artificial Sequence
  Description of Artificial Sequence: Synthetic oligonucleotide
cataaccagtaggagttcgtgcgcttcgac

SEQ ID NO: 72344 - DNA, 31 bp, Artificial Sequence
  Description of Artificial Sequence: Synthetic oligonucleotide
ataaccagtaggagttcgtgcgcttcgacag

SEQ ID NO: 72345 - DNA, 30 bp, Artificial Sequence
  Description of Artificial Sequence: Synthetic oligonucleotide
taaccagtaggagttcgtgcgcttcgacag

SEQ ID NO: 72346 - DNA, 29 bp, Artificial Sequence
  Description of Artificial Sequence: Synthetic oligonucleotide
aaccagtaggagttcgtgcgcttcgacag

SEQ ID NO: 72347 - DNA, 28 bp, Artificial Sequence
  Description of Artificial Sequence: Synthetic oligonucleotide
accagtaggagttcgtgcgcttcgacag

SEQ ID NO: 72348 - DNA, 27 bp, Artificial Sequence
  Description of Artificial Sequence: Synthetic oligonucleotide
ccagtaggagttcgtgcgcttcgacag

SEQ ID NO: 72349 - DNA, 27 bp, Artificial Sequence
  Description of Artificial Sequence: Synthetic oligonucleotide
cagtaggagttcgtgcgcttcgacagc

SEQ ID NO: 72350 - DNA, 27 bp, Artificial Sequence
  Description of Artificial Sequence: Synthetic oligonucleotide
agtaggagttcgtgcgcttcgacagcg

SEQ ID NO: 72351 - DNA, 27 bp, Artificial Sequence
  Description of Artificial Sequence: Synthetic oligonucleotide
gtaggagttcgtgcgcttcgacagcga

SEQ ID NO: 72352 - DNA, 27 bp, Artificial Sequence
  Description of Artificial Sequence: Synthetic oligonucleotide
taggagttcgtgcgcttcgacagcgac

SEQ ID NO: 72353 - DNA, 22 bp, Artificial Sequence
  Description of Artificial Sequence: Synthetic oligonucleotide
ggaggcgggccgaggtggacaa

SEQ ID NO: 72354 - DNA, 24 bp, Artificial Sequence
  Description of Artificial Sequence: Synthetic oligonucleotide
gaggcgggccgaggtggacaacta

SEQ ID NO: 72355 - DNA, 25 bp, Artificial Sequence
  Description of Artificial Sequence: Synthetic oligonucleotide
aggcgggccgaggtggacaactact

SEQ ID NO: 72356 - DNA, 24 bp, Artificial Sequence
  Description of Artificial Sequence: Synthetic oligonucleotide
ggcgggccgaggtggacaactact

SEQ ID NO: 72357 - DNA, 24 bp, Artificial Sequence
  Description of Artificial Sequence: Synthetic oligonucleotide
gcgggccgaggtggacaactactg

SEQ ID NO: 72358 - DNA, 25 bp, Artificial Sequence
  Description of Artificial Sequence: Synthetic oligonucleotide
cgggccgaggtggacaactactgca

SEQ ID NO: 72359 - DNA, 26 bp, Artificial Sequence
  Description of Artificial Sequence: Synthetic oligonucleotide
gggccgaggtggacaactactgcaga

SEQ ID NO: 72360 - DNA, 27 bp, Artificial Sequence
  Description of Artificial Sequence: Synthetic oligonucleotide
ggccgaggtggacaactactgcagaca

SEQ ID NO: 72361 - DNA, 27 bp, Artificial Sequence
  Description of Artificial Sequence: Synthetic oligonucleotide
gccgaggtggacaactactgcagacac

SEQ ID NO: 72362 - DNA, 29 bp, Artificial Sequence
  Description of Artificial Sequence: Synthetic oligonucleotide
ccgaggtggacaactactgcagacacaac

SEQ ID NO: 72363 - DNA, 31 bp, Artificial Sequence
  Description of Artificial Sequence: Synthetic oligonucleotide
cgaggtggacaactactgcagacacaactac

SEQ ID NO: 72364 - DNA, 31 bp, Artificial Sequence
  Description of Artificial Sequence: Synthetic oligonucleotide
gaggtggacaactactgcagacacaactacg

SEQ ID NO: 72365 - DNA, 32 bp, Artificial Sequence
  Description of Artificial Sequence: Synthetic oligonucleotide
ctggagagatacttccataaccaggaggagtc

SEQ ID NO: 72366 - DNA, 32 bp, Artificial Sequence
  Description of Artificial Sequence: Synthetic oligonucleotide
tggagagatacttccataaccaggaggagtcc

SEQ ID NO: 72367 - DNA, 31 bp, Artificial Sequence
  Description of Artificial Sequence: Synthetic oligonucleotide
ggagagatacttccataaccaggaggagtcc

SEQ ID NO: 72368 - DNA, 31 bp, Artificial Sequence
  Description of Artificial Sequence: Synthetic oligonucleotide
gagagatacttccataaccaggaggagtccg

SEQ ID NO: 72369 - DNA, 32 bp, Artificial Sequence
  Description of Artificial Sequence: Synthetic oligonucleotide
agagatacttccataaccaggaggagtccgtg

SEQ ID NO: 72370 - DNA, 31 bp, Artificial Sequence
  Description of Artificial Sequence: Synthetic oligonucleotide
gagatacttccataaccaggaggagtccgtg

SEQ ID NO: 72371 - DNA, 27 bp, Artificial Sequence
  Description of Artificial Sequence: Synthetic oligonucleotide
aagacaggcgggccctggtggacaatt

SEQ ID NO: 72372 - DNA, 27 bp, Artificial Sequence
  Description of Artificial Sequence: Synthetic oligonucleotide
agacaggcgggccctggtggacaatta

SEQ ID NO: 72373 - DNA, 26 bp, Artificial Sequence
  Description of Artificial Sequence: Synthetic oligonucleotide
gacaggcgggccctggtggacaatta

SEQ ID NO: 72374 - DNA, 27 bp, Artificial Sequence
  Description of Artificial Sequence: Synthetic oligonucleotide
acaggcgggccctggtggacaattact

SEQ ID NO: 72375 - DNA, 26 bp, Artificial Sequence
  Description of Artificial Sequence: Synthetic oligonucleotide
caggcgggccctggtggacaattact

SEQ ID NO: 72376 - DNA, 26 bp, Artificial Sequence
  Description of Artificial Sequence: Synthetic oligonucleotide
aggcgggccctggtggacaattactg

SEQ ID NO: 72377 - DNA, 25 bp, Artificial Sequence
  Description of Artificial Sequence: Synthetic oligonucleotide
ggcgggccctggtggacaattactg

SEQ ID NO: 72378 - DNA, 26 bp, Artificial Sequence
  Description of Artificial Sequence: Synthetic oligonucleotide
gcgggccctggtggacaattactgca

SEQ ID NO: 72379 - DNA, 27 bp, Artificial Sequence
  Description of Artificial Sequence: Synthetic oligonucleotide
cgggccctggtggacaattactgcaga

SEQ ID NO: 72380 - DNA, 27 bp, Artificial Sequence
  Description of Artificial Sequence: Synthetic oligonucleotide
gggccctggtggacaattactgcagac

SEQ ID NO: 72381 - DNA, 28 bp, Artificial Sequence
  Description of Artificial Sequence: Synthetic oligonucleotide
ggccctggtggacaattactgcagacac

SEQ ID NO: 72382 - DNA, 30 bp, Artificial Sequence
  Description of Artificial Sequence: Synthetic oligonucleotide
gccctggtggacaattactgcagacacaac

SEQ ID NO: 72383 - DNA, 32 bp, Artificial Sequence
  Description of Artificial Sequence: Synthetic oligonucleotide
ccctggtggacaattactgcagacacaactac

SEQ ID NO: 72384 - DNA, 32 bp, Artificial Sequence
  Description of Artificial Sequence: Synthetic oligonucleotide
cctggtggacaattactgcagacacaactacg

SEQ ID NO: 72385 - DNA, 32 bp, Artificial Sequence
  Description of Artificial Sequence: Synthetic oligonucleotide
ctggtggacaattactgcagacacaactacgg

SEQ ID NO: 72386 - DNA, 32 bp, Artificial Sequence
  Description of Artificial Sequence: Synthetic oligonucleotide
tggtggacaattactgcagacacaactacggg

SEQ ID NO: 72387 - DNA, 27 bp, Artificial Sequence
  Description of Artificial Sequence: Synthetic oligonucleotide
tggtgctgagctccccactggctttgt

SEQ ID NO: 72388 - DNA, 26 bp, Artificial Sequence
  Description of Artificial Sequence: Synthetic oligonucleotide
ggtgctgagctccccactggctttgt

SEQ ID NO: 72389 - DNA, 27 bp, Artificial Sequence
  Description of Artificial Sequence: Synthetic oligonucleotide
gtgctgagctccccactggctttgtct

SEQ ID NO: 72390 - DNA, 27 bp, Artificial Sequence
  Description of Artificial Sequence: Synthetic oligonucleotide
tgctgagctccccactggctttgtctg

SEQ ID NO: 72391 - DNA, 26 bp, Artificial Sequence
  Description of Artificial Sequence: Synthetic oligonucleotide
gctgagctccccactggctttgtctg

SEQ ID NO: 72392 - DNA, 26 bp, Artificial Sequence
  Description of Artificial Sequence: Synthetic oligonucleotide
ctgagctccccactggctttgtctgg

SEQ ID NO: 72393 - DNA, 26 bp, Artificial Sequence
  Description of Artificial Sequence: Synthetic oligonucleotide
tgagctccccactggctttgtctggg

SEQ ID NO: 72394 - DNA, 25 bp, Artificial Sequence
  Description of Artificial Sequence: Synthetic oligonucleotide
gagctccccactggctttgtctggg

SEQ ID NO: 72395 - DNA, 26 bp, Artificial Sequence
  Description of Artificial Sequence: Synthetic oligonucleotide
agctccccactggctttgtctgggga

SEQ ID NO: 72396 - DNA, 25 bp, Artificial Sequence
  Description of Artificial Sequence: Synthetic oligonucleotide
gctccccactggctttgtctgggga

SEQ ID NO: 72397 - DNA, 26 bp, Artificial Sequence
  Description of Artificial Sequence: Synthetic oligonucleotide
ctccccactggctttgtctggggaca

SEQ ID NO: 72398 - DNA, 26 bp, Artificial Sequence
  Description of Artificial Sequence: Synthetic oligonucleotide
tccccactggctttgtctggggacac

SEQ ID NO: 72399 - DNA, 25 bp, Artificial Sequence
  Description of Artificial Sequence: Synthetic oligonucleotide
ccccactggctttgtctggggacac

SEQ ID NO: 72400 - DNA, 25 bp, Artificial Sequence
  Description of Artificial Sequence: Synthetic oligonucleotide
cccactggctttgtctggggacacc

SEQ ID NO: 72401 - DNA, 25 bp, Artificial Sequence
  Description of Artificial Sequence: Synthetic oligonucleotide
ccactggctttgtctggggacaccc

SEQ ID NO: 72402 - DNA, 26 bp, Artificial Sequence
  Description of Artificial Sequence: Synthetic oligonucleotide
cactggctttgtctggggacacccga

SEQ ID NO: 72403 - DNA, 26 bp, Artificial Sequence
  Description of Artificial Sequence: Synthetic oligonucleotide
actggctttgtctggggacacccgac

SEQ ID NO: 72404 - DNA, 25 bp, Artificial Sequence
  Description of Artificial Sequence: Synthetic oligonucleotide
ctggctttgtctggggacacccgac

SEQ ID NO: 72405 - DNA, 26 bp, Artificial Sequence
  Description of Artificial Sequence: Synthetic oligonucleotide
tggctttgtctggggacacccgacca

SEQ ID NO: 72406 - DNA, 25 bp, Artificial Sequence
  Description of Artificial Sequence: Synthetic oligonucleotide
ggctttgtctggggacacccgacca

SEQ ID NO: 72407 - DNA, 25 bp, Artificial Sequence
  Description of Artificial Sequence: Synthetic oligonucleotide
gctttgtctggggacacccgaccac

SEQ ID NO: 72408 - DNA, 27 bp, Artificial Sequence
  Description of Artificial Sequence: Synthetic oligonucleotide
ctttgtctggggacacccgaccacgtt

SEQ ID NO: 72409 - DNA, 28 bp, Artificial Sequence
  Description of Artificial Sequence: Synthetic oligonucleotide
tttgtctggggacacccgaccacgtttc

SEQ ID NO: 72410 - DNA, 27 bp, Artificial Sequence
  Description of Artificial Sequence: Synthetic oligonucleotide
ttgtctggggacacccgaccacgtttc

SEQ ID NO: 72411 - DNA, 26 bp, Artificial Sequence
  Description of Artificial Sequence: Synthetic oligonucleotide
tgtctggggacacccgaccacgtttc

SEQ ID NO: 72412 - DNA, 25 bp, Artificial Sequence
  Description of Artificial Sequence: Synthetic oligonucleotide
gtctggggacacccgaccacgtttc

SEQ ID NO: 72413 - DNA, 26 bp, Artificial Sequence
  Description of Artificial Sequence: Synthetic oligonucleotide
tctggggacacccgaccacgtttcct

SEQ ID NO: 72414 - DNA, 25 bp, Artificial Sequence
  Description of Artificial Sequence: Synthetic oligonucleotide
ctggggacacccgaccacgtttcct

SEQ ID NO: 72415 - DNA, 26 bp, Artificial Sequence
  Description of Artificial Sequence: Synthetic oligonucleotide
tggggacacccgaccacgtttcctgt

SEQ ID NO: 72416 - DNA, 25 bp, Artificial Sequence
  Description of Artificial Sequence: Synthetic oligonucleotide
ggggacacccgaccacgtttcctgt

SEQ ID NO: 72417 - DNA, 25 bp, Artificial Sequence
  Description of Artificial Sequence: Synthetic oligonucleotide
gggacacccgaccacgtttcctgtg

SEQ ID NO: 72418 - DNA, 25 bp, Artificial Sequence
  Description of Artificial Sequence: Synthetic oligonucleotide
ggacacccgaccacgtttcctgtgg

SEQ ID NO: 72419 - DNA, 26 bp, Artificial Sequence
  Description of Artificial Sequence: Synthetic oligonucleotide
gacacccgaccacgtttcctgtggca

SEQ ID NO: 72420 - DNA, 26 bp, Artificial Sequence
  Description of Artificial Sequence: Synthetic oligonucleotide
acacccgaccacgtttcctgtggcag

SEQ ID NO: 72421 - DNA, 25 bp, Artificial Sequence
  Description of Artificial Sequence: Synthetic oligonucleotide
cacccgaccacgtttcctgtggcag

SEQ ID NO: 72422 - DNA, 25 bp, Artificial Sequence
  Description of Artificial Sequence: Synthetic oligonucleotide
acccgaccacgtttcctgtggcagc

SEQ ID NO: 72423 - DNA, 24 bp, Artificial Sequence
  Description of Artificial Sequence: Synthetic oligonucleotide
cccgaccacgtttcctgtggcagc

SEQ ID NO: 72424 - DNA, 27 bp, Artificial Sequence
  Description of Artificial Sequence: Synthetic oligonucleotide
ccgaccacgtttcctgtggcagcctaa

SEQ ID NO: 72425 - DNA, 27 bp, Artificial Sequence
  Description of Artificial Sequence: Synthetic oligonucleotide
cgaccacgtttcctgtggcagcctaag

SEQ ID NO: 72426 - DNA, 28 bp, Artificial Sequence
  Description of Artificial Sequence: Synthetic oligonucleotide
gaccacgtttcctgtggcagcctaagag

SEQ ID NO: 72427 - DNA, 28 bp, Artificial Sequence
  Description of Artificial Sequence: Synthetic oligonucleotide
accacgtttcctgtggcagcctaagagg

SEQ ID NO: 72428 - DNA, 27 bp, Artificial Sequence
  Description of Artificial Sequence: Synthetic oligonucleotide
ccacgtttcctgtggcagcctaagagg

SEQ ID NO: 72429 - DNA, 27 bp, Artificial Sequence
  Description of Artificial Sequence: Synthetic oligonucleotide
cacgtttcctgtggcagcctaagaggg

SEQ ID NO: 72430 - DNA, 28 bp, Artificial Sequence
  Description of Artificial Sequence: Synthetic oligonucleotide
acgtttcctgtggcagcctaagagggag

SEQ ID NO: 72431 - DNA, 27 bp, Artificial Sequence
  Description of Artificial Sequence: Synthetic oligonucleotide
cgtttcctgtggcagcctaagagggag

SEQ ID NO: 72432 - DNA, 28 bp, Artificial Sequence
  Description of Artificial Sequence: Synthetic oligonucleotide
gtttcctgtggcagcctaagagggagtg

SEQ ID NO: 72433 - DNA, 29 bp, Artificial Sequence
  Description of Artificial Sequence: Synthetic oligonucleotide
tttcctgtggcagcctaagagggagtgtc

SEQ ID NO: 72434 - DNA, 28 bp, Artificial Sequence
  Description of Artificial Sequence: Synthetic oligonucleotide
ttcctgtggcagcctaagagggagtgtc

SEQ ID NO: 72435 - DNA, 27 bp, Artificial Sequence
  Description of Artificial Sequence: Synthetic oligonucleotide
tcctgtggcagcctaagagggagtgtc

SEQ ID NO: 72436 - DNA, 27 bp, Artificial Sequence
  Description of Artificial Sequence: Synthetic oligonucleotide
cctgtggcagcctaagagggagtgtca

SEQ ID NO: 72437 - DNA, 30 bp, Artificial Sequence
  Description of Artificial Sequence: Synthetic oligonucleotide
ctgtggcagcctaagagggagtgtcatttc

SEQ ID NO: 72438 - DNA, 32 bp, Artificial Sequence
  Description of Artificial Sequence: Synthetic oligonucleotide
tgtggcagcctaagagggagtgtcatttcttc

SEQ ID NO: 72439 - DNA, 31 bp, Artificial Sequence
  Description of Artificial Sequence: Synthetic oligonucleotide
gtggcagcctaagagggagtgtcatttcttc

SEQ ID NO: 72440 - DNA, 34 bp, Artificial Sequence
  Description of Artificial Sequence: Synthetic oligonucleotide
tggcagcctaagagggagtgtcatttcttcaatg

SEQ ID NO: 72441 - DNA, 33 bp, Artificial Sequence
  Description of Artificial Sequence: Synthetic oligonucleotide
ggcagcctaagagggagtgtcatttcttcaatg

SEQ ID NO: 72442 - DNA, 33 bp, Artificial Sequence
  Description of Artificial Sequence: Synthetic oligonucleotide
gcagcctaagagggagtgtcatttcttcaatgg

SEQ ID NO: 72443 - DNA, 33 bp, Artificial Sequence
  Description of Artificial Sequence: Synthetic oligonucleotide
cagcctaagagggagtgtcatttcttcaatggg

SEQ ID NO: 72444 - DNA, 34 bp, Artificial Sequence
  Description of Artificial Sequence: Synthetic oligonucleotide
agcctaagagggagtgtcatttcttcaatgggac

SEQ ID NO: 72445 - DNA, 33 bp, Artificial Sequence
  Description of Artificial Sequence: Synthetic oligonucleotide
gcctaagagggagtgtcatttcttcaatgggac

SEQ ID NO: 72446 - DNA, 33 bp, Artificial Sequence
  Description of Artificial Sequence: Synthetic oligonucleotide
cctaagagggagtgtcatttcttcaatgggacg

SEQ ID NO: 72447 - DNA, 33 bp, Artificial Sequence
  Description of Artificial Sequence: Synthetic oligonucleotide
ctaagagggagtgtcatttcttcaatgggacgg

SEQ ID NO: 72448 - DNA, 34 bp, Artificial Sequence
  Description of Artificial Sequence: Synthetic oligonucleotide
taagagggagtgtcatttcttcaatgggacggag

SEQ ID NO: 72449 - DNA, 33 bp, Artificial Sequence
  Description of Artificial Sequence: Synthetic oligonucleotide
aagagggagtgtcatttcttcaatgggacggag

SEQ ID NO: 72450 - DNA, 32 bp, Artificial Sequence
  Description of Artificial Sequence: Synthetic oligonucleotide
agagggagtgtcatttcttcaatgggacggag

SEQ ID NO: 72451 - DNA, 31 bp, Artificial Sequence
  Description of Artificial Sequence: Synthetic oligonucleotide
gagggagtgtcatttcttcaatgggacggag

SEQ ID NO: 72452 - DNA, 31 bp, Artificial Sequence
  Description of Artificial Sequence: Synthetic oligonucleotide
agggagtgtcatttcttcaatgggacggagc

SEQ ID NO: 72453 - DNA, 30 bp, Artificial Sequence
  Description of Artificial Sequence: Synthetic oligonucleotide
gggagtgtcatttcttcaatgggacggagc

SEQ ID NO: 72454 - DNA, 30 bp, Artificial Sequence
  Description of Artificial Sequence: Synthetic oligonucleotide
ggagtgtcatttcttcaatgggacggagcg

SEQ ID NO: 72455 - DNA, 27 bp, Artificial Sequence
  Description of Artificial Sequence: Synthetic oligonucleotide
agcttcacagtgcagcggcgagtccaa

SEQ ID NO: 72456 - DNA, 26 bp, Artificial Sequence
  Description of Artificial Sequence: Synthetic oligonucleotide
gcttcacagtgcagcggcgagtccaa

SEQ ID NO: 72457 - DNA, 26 bp, Artificial Sequence
  Description of Artificial Sequence: Synthetic oligonucleotide
cttcacagtgcagcggcgagtccaac

SEQ ID NO: 72458 - DNA, 27 bp, Artificial Sequence
  Description of Artificial Sequence: Synthetic oligonucleotide
ttcacagtgcagcggcgagtccaacct

SEQ ID NO: 72459 - DNA, 27 bp, Artificial Sequence
  Description of Artificial Sequence: Synthetic oligonucleotide
tcacagtgcagcggcgagtccaaccta

SEQ ID NO: 72460 - DNA, 27 bp, Artificial Sequence
  Description of Artificial Sequence: Synthetic oligonucleotide
cacagtgcagcggcgagtccaacctaa

SEQ ID NO: 72461 - DNA, 27 bp, Artificial Sequence
  Description of Artificial Sequence: Synthetic oligonucleotide
acagtgcagcggcgagtccaacctaag

SEQ ID NO: 72462 - DNA, 26 bp, Artificial Sequence
  Description of Artificial Sequence: Synthetic oligonucleotide
cagtgcagcggcgagtccaacctaag

SEQ ID NO: 72463 - DNA, 27 bp, Artificial Sequence
  Description of Artificial Sequence: Synthetic oligonucleotide
agtgcagcggcgagtccaacctaaggt

SEQ ID NO: 72464 - DNA, 26 bp, Artificial Sequence
  Description of Artificial Sequence: Synthetic oligonucleotide
gtgcagcggcgagtccaacctaaggt

SEQ ID NO: 72465 - DNA, 27 bp, Artificial Sequence
  Description of Artificial Sequence: Synthetic oligonucleotide
tgcagcggcgagtccaacctaaggtga

SEQ ID NO: 72466 - DNA, 26 bp, Artificial Sequence
  Description of Artificial Sequence: Synthetic oligonucleotide
gcagcggcgagtccaacctaaggtga

SEQ ID NO: 72467 - DNA, 27 bp, Artificial Sequence
  Description of Artificial Sequence: Synthetic oligonucleotide
cagcggcgagtccaacctaaggtgact

SEQ ID NO: 72468 - DNA, 27 bp, Artificial Sequence
  Description of Artificial Sequence: Synthetic oligonucleotide
agcggcgagtccaacctaaggtgactg

SEQ ID NO: 72469 - DNA, 27 bp, Artificial Sequence
  Description of Artificial Sequence: Synthetic oligonucleotide
gcggcgagtccaacctaaggtgactgt

SEQ ID NO: 72470 - DNA, 31 bp, Artificial Sequence
  Description of Artificial Sequence: Synthetic oligonucleotide
cggcgagtccaacctaaggtgactgtatatc

SEQ ID NO: 72471 - DNA, 31 bp, Artificial Sequence
  Description of Artificial Sequence: Synthetic oligonucleotide
ggcgagtccaacctaaggtgactgtatatcc

SEQ ID NO: 72472 - DNA, 33 bp, Artificial Sequence
  Description of Artificial Sequence: Synthetic oligonucleotide
gcgagtccaacctaaggtgactgtatatccttc

SEQ ID NO: 72473 - DNA, 36 bp, Artificial Sequence
  Description of Artificial Sequence: Synthetic oligonucleotide
cgagtccaacctaaggtgactgtatatccttcaaag

SEQ ID NO: 72474 - DNA, 37 bp, Artificial Sequence
  Description of Artificial Sequence: Synthetic oligonucleotide
gagtccaacctaaggtgactgtatatccttcaaagac

SEQ ID NO: 72475 - DNA, 37 bp, Artificial Sequence
  Description of Artificial Sequence: Synthetic oligonucleotide
agtccaacctaaggtgactgtatatccttcaaagacc

SEQ ID NO: 72476 - DNA, 36 bp, Artificial Sequence
  Description of Artificial Sequence: Synthetic oligonucleotide
gtccaacctaaggtgactgtatatccttcaaagacc

SEQ ID NO: 72477 - DNA, 36 bp, Artificial Sequence
  Description of Artificial Sequence: Synthetic oligonucleotide
tccaacctaaggtgactgtatatccttcaaagaccc

SEQ ID NO: 72478 - DNA, 35 bp, Artificial Sequence
  Description of Artificial Sequence: Synthetic oligonucleotide
ccaacctaaggtgactgtatatccttcaaagaccc

SEQ ID NO: 72479 - DNA, 36 bp, Artificial Sequence
  Description of Artificial Sequence: Synthetic oligonucleotide
caacctaaggtgactgtatatccttcaaagacccag

SEQ ID NO: 72480 - DNA, 36 bp, Artificial Sequence
  Description of Artificial Sequence: Synthetic oligonucleotide
aacctaaggtgactgtatatccttcaaagacccagc

SEQ ID NO: 72481 - DNA, 35 bp, Artificial Sequence
  Description of Artificial Sequence: Synthetic oligonucleotide
acctaaggtgactgtatatccttcaaagacccagc

SEQ ID NO: 72482 - DNA, 34 bp, Artificial Sequence
  Description of Artificial Sequence: Synthetic oligonucleotide
cctaaggtgactgtatatccttcaaagacccagc

SEQ ID NO: 72483 - DNA, 34 bp, Artificial Sequence
  Description of Artificial Sequence: Synthetic oligonucleotide
ctaaggtgactgtatatccttcaaagacccagcc

SEQ ID NO: 72484 - DNA, 34 bp, Artificial Sequence
  Description of Artificial Sequence: Synthetic oligonucleotide
taaggtgactgtatatccttcaaagacccagccc

SEQ ID NO: 72485 - DNA, 33 bp, Artificial Sequence
  Description of Artificial Sequence: Synthetic oligonucleotide
aaggtgactgtatatccttcaaagacccagccc

SEQ ID NO: 72486 - DNA, 32 bp, Artificial Sequence
  Description of Artificial Sequence: Synthetic oligonucleotide
aggtgactgtatatccttcaaagacccagccc

SEQ ID NO: 72487 - DNA, 31 bp, Artificial Sequence
  Description of Artificial Sequence: Synthetic oligonucleotide
ggtgactgtatatccttcaaagacccagccc

SEQ ID NO: 72488 - DNA, 31 bp, Artificial Sequence
  Description of Artificial Sequence: Synthetic oligonucleotide
gtgactgtatatccttcaaagacccagcccc

SEQ ID NO: 72489 - DNA, 32 bp, Artificial Sequence
  Description of Artificial Sequence: Synthetic oligonucleotide
tgactgtatatccttcaaagacccagcccctg

SEQ ID NO: 72490 - DNA, 31 bp, Artificial Sequence
  Description of Artificial Sequence: Synthetic oligonucleotide
gactgtatatccttcaaagacccagcccctg

SEQ ID NO: 72491 - DNA, 31 bp, Artificial Sequence
  Description of Artificial Sequence: Synthetic oligonucleotide
actgtatatccttcaaagacccagcccctgc

SEQ ID NO: 72492 - DNA, 30 bp, Artificial Sequence
  Description of Artificial Sequence: Synthetic oligonucleotide
ctgtatatccttcaaagacccagcccctgc

SEQ ID NO: 72493 - DNA, 31 bp, Artificial Sequence
  Description of Artificial Sequence: Synthetic oligonucleotide
tgtatatccttcaaagacccagcccctgcag

SEQ ID NO: 72494 - DNA, 30 bp, Artificial Sequence
  Description of Artificial Sequence: Synthetic oligonucleotide
gtatatccttcaaagacccagcccctgcag

SEQ ID NO: 72495 - DNA, 30 bp, Artificial Sequence
  Description of Artificial Sequence: Synthetic oligonucleotide
tatatccttcaaagacccagcccctgcagc

SEQ ID NO: 72496 - DNA, 29 bp, Artificial Sequence
  Description of Artificial Sequence: Synthetic oligonucleotide
atatccttcaaagacccagcccctgcagc

SEQ ID NO: 72497 - DNA, 29 bp, Artificial Sequence
  Description of Artificial Sequence: Synthetic oligonucleotide
caggcagcattgaagtcaggtggttcctg

SEQ ID NO: 72498 - DNA, 31 bp, Artificial Sequence
  Description of Artificial Sequence: Synthetic oligonucleotide
aggcagcattgaagtcaggtggttcctgaac

SEQ ID NO: 72499 - DNA, 30 bp, Artificial Sequence
  Description of Artificial Sequence: Synthetic oligonucleotide
ggcagcattgaagtcaggtggttcctgaac

SEQ ID NO: 72500 - DNA, 30 bp, Artificial Sequence
  Description of Artificial Sequence: Synthetic oligonucleotide
gcagcattgaagtcaggtggttcctgaacg

SEQ ID NO: 72501 - DNA, 30 bp, Artificial Sequence
  Description of Artificial Sequence: Synthetic oligonucleotide
cagcattgaagtcaggtggttcctgaacgg

SEQ ID NO: 72502 - DNA, 30 bp, Artificial Sequence
  Description of Artificial Sequence: Synthetic oligonucleotide
agcattgaagtcaggtggttcctgaacggc

SEQ ID NO: 72503 - DNA, 29 bp, Artificial Sequence
  Description of Artificial Sequence: Synthetic oligonucleotide
gcattgaagtcaggtggttcctgaacggc

SEQ ID NO: 72504 - DNA, 29 bp, Artificial Sequence
  Description of Artificial Sequence: Synthetic oligonucleotide
cattgaagtcaggtggttcctgaacggcc

SEQ ID NO: 72505 - DNA, 30 bp, Artificial Sequence
  Description of Artificial Sequence: Synthetic oligonucleotide
attgaagtcaggtggttcctgaacggccag

SEQ ID NO: 72506 - DNA, 29 bp, Artificial Sequence
  Description of Artificial Sequence: Synthetic oligonucleotide
ttgaagtcaggtggttcctgaacggccag

SEQ ID NO: 72507 - DNA, 28 bp, Artificial Sequence
  Description of Artificial Sequence: Synthetic oligonucleotide
tgaagtcaggtggttcctgaacggccag

SEQ ID NO: 72508 - DNA, 27 bp, Artificial Sequence
  Description of Artificial Sequence: Synthetic oligonucleotide
gaagtcaggtggttcctgaacggccag

SEQ ID NO: 72509 - DNA, 27 bp, Artificial Sequence
  Description of Artificial Sequence: Synthetic oligonucleotide
aagtcaggtggttcctgaacggccagg

SEQ ID NO: 72510 - DNA, 27 bp, Artificial Sequence
  Description of Artificial Sequence: Synthetic oligonucleotide
agtcaggtggttcctgaacggccagga

SEQ ID NO: 72511 - DNA, 27 bp, Artificial Sequence
  Description of Artificial Sequence: Synthetic oligonucleotide
gtcaggtggttcctgaacggccaggaa

SEQ ID NO: 72512 - DNA, 27 bp, Artificial Sequence
  Description of Artificial Sequence: Synthetic oligonucleotide
tcaggtggttcctgaacggccaggaag

SEQ ID NO: 72513 - DNA, 27 bp, Artificial Sequence
  Description of Artificial Sequence: Synthetic oligonucleotide
caggtggttcctgaacggccaggaaga

SEQ ID NO: 72514 - DNA, 27 bp, Artificial Sequence
  Description of Artificial Sequence: Synthetic oligonucleotide
aggtggttcctgaacggccaggaagag

SEQ ID NO: 72515 - DNA, 27 bp, Artificial Sequence
  Description of Artificial Sequence: Synthetic oligonucleotide
ggtggttcctgaacggccaggaagaga

SEQ ID NO: 72516 - DNA, 28 bp, Artificial Sequence
  Description of Artificial Sequence: Synthetic oligonucleotide
gtggttcctgaacggccaggaagagaag

SEQ ID NO: 72517 - DNA, 28 bp, Artificial Sequence
  Description of Artificial Sequence: Synthetic oligonucleotide
tggttcctgaacggccaggaagagaagg

SEQ ID NO: 72518 - DNA, 27 bp, Artificial Sequence
  Description of Artificial Sequence: Synthetic oligonucleotide
ggttcctgaacggccaggaagagaagg

SEQ ID NO: 72519 - DNA, 27 bp, Artificial Sequence
  Description of Artificial Sequence: Synthetic oligonucleotide
gttcctgaacggccaggaagagaaggc

SEQ ID NO: 72520 - DNA, 28 bp, Artificial Sequence
  Description of Artificial Sequence: Synthetic oligonucleotide
ttcctgaacggccaggaagagaaggctg

SEQ ID NO: 72521 - DNA, 27 bp, Artificial Sequence
  Description of Artificial Sequence: Synthetic oligonucleotide
tcctgaacggccaggaagagaaggctg

SEQ ID NO: 72522 - DNA, 26 bp, Artificial Sequence
  Description of Artificial Sequence: Synthetic oligonucleotide
cctgaacggccaggaagagaaggctg

SEQ ID NO: 72523 - DNA, 26 bp, Artificial Sequence
  Description of Artificial Sequence: Synthetic oligonucleotide
ctgaacggccaggaagagaaggctgg

SEQ ID NO: 72524 - DNA, 27 bp, Artificial Sequence
  Description of Artificial Sequence: Synthetic oligonucleotide
tgaacggccaggaagagaaggctggga

SEQ ID NO: 72525 - DNA, 27 bp, Artificial Sequence
  Description of Artificial Sequence: Synthetic oligonucleotide
gaacggccaggaagagaaggctgggat

SEQ ID NO: 72526 - DNA, 27 bp, Artificial Sequence
  Description of Artificial Sequence: Synthetic oligonucleotide
aacggccaggaagagaaggctgggatg

SEQ ID NO: 72527 - DNA, 26 bp, Artificial Sequence
  Description of Artificial Sequence: Synthetic oligonucleotide
acggccaggaagagaaggctgggatg

SEQ ID NO: 72528 - DNA, 25 bp, Artificial Sequence
  Description of Artificial Sequence: Synthetic oligonucleotide
cggccaggaagagaaggctgggatg

SEQ ID NO: 72529 - DNA, 26 bp, Artificial Sequence
  Description of Artificial Sequence: Synthetic oligonucleotide
ggccaggaagagaaggctgggatggt

SEQ ID NO: 72530 - DNA, 27 bp, Artificial Sequence
  Description of Artificial Sequence: Synthetic oligonucleotide
gccaggaagagaaggctgggatggtgt

SEQ ID NO: 72531 - DNA, 27 bp, Artificial Sequence
  Description of Artificial Sequence: Synthetic oligonucleotide
ccaggaagagaaggctgggatggtgtc

SEQ ID NO: 72532 - DNA, 27 bp, Artificial Sequence
  Description of Artificial Sequence: Synthetic oligonucleotide
caggaagagaaggctgggatggtgtcc

SEQ ID NO: 72533 - DNA, 28 bp, Artificial Sequence
  Description of Artificial Sequence: Synthetic oligonucleotide
aggaagagaaggctgggatggtgtccac

SEQ ID NO: 72534 - DNA, 27 bp, Artificial Sequence
  Description of Artificial Sequence: Synthetic oligonucleotide
ggaagagaaggctgggatggtgtccac

SEQ ID NO: 72535 - DNA, 28 bp, Artificial Sequence
  Description of Artificial Sequence: Synthetic oligonucleotide
gaagagaaggctgggatggtgtccacag

SEQ ID NO: 72536 - DNA, 28 bp, Artificial Sequence
  Description of Artificial Sequence: Synthetic oligonucleotide
aagagaaggctgggatggtgtccacagg

SEQ ID NO: 72537 - DNA, 27 bp, Artificial Sequence
  Description of Artificial Sequence: Synthetic oligonucleotide
agagaaggctgggatggtgtccacagg

SEQ ID NO: 72538 - DNA, 26 bp, Artificial Sequence
  Description of Artificial Sequence: Synthetic oligonucleotide
gagaaggctgggatggtgtccacagg

SEQ ID NO: 72539 - DNA, 26 bp, Artificial Sequence
  Description of Artificial Sequence: Synthetic oligonucleotide
agaaggctgggatggtgtccacaggc

SEQ ID NO: 72540 - DNA, 25 bp, Artificial Sequence
  Description of Artificial Sequence: Synthetic oligonucleotide
gaaggctgggatggtgtccacaggc

SEQ ID NO: 72541 - DNA, 26 bp, Artificial Sequence
  Description of Artificial Sequence: Synthetic oligonucleotide
aaggctgggatggtgtccacaggcct

SEQ ID NO: 72542 - DNA, 25 bp, Artificial Sequence
  Description of Artificial Sequence: Synthetic oligonucleotide
aggctgggatggtgtccacaggcct

SEQ ID NO: 72543 - DNA, 24 bp, Artificial Sequence
  Description of Artificial Sequence: Synthetic oligonucleotide
ggctgggatggtgtccacaggcct

SEQ ID NO: 72544 - DNA, 26 bp, Artificial Sequence
  Description of Artificial Sequence: Synthetic oligonucleotide
gctgggatggtgtccacaggcctgat

SEQ ID NO: 72545 - DNA, 26 bp, Artificial Sequence
  Description of Artificial Sequence: Synthetic oligonucleotide
ctgggatggtgtccacaggcctgatc

SEQ ID NO: 72546 - DNA, 27 bp, Artificial Sequence
  Description of Artificial Sequence: Synthetic oligonucleotide
tgggatggtgtccacaggcctgatcca

SEQ ID NO: 72547 - DNA, 26 bp, Artificial Sequence
  Description of Artificial Sequence: Synthetic oligonucleotide
gggatggtgtccacaggcctgatcca

SEQ ID NO: 72548 - DNA, 27 bp, Artificial Sequence
  Description of Artificial Sequence: Synthetic oligonucleotide
ggatggtgtccacaggcctgatccaga

SEQ ID NO: 72549 - DNA, 29 bp, Artificial Sequence
  Description of Artificial Sequence: Synthetic oligonucleotide
gatggtgtccacaggcctgatccagaatg

SEQ ID NO: 72550 - DNA, 29 bp, Artificial Sequence
  Description of Artificial Sequence: Synthetic oligonucleotide
atggtgtccacaggcctgatccagaatgg

SEQ ID NO: 72551 - DNA, 30 bp, Artificial Sequence
  Description of Artificial Sequence: Synthetic oligonucleotide
cctggtgatgctggaaacagttcctcgaag

SEQ ID NO: 72552 - DNA, 31 bp, Artificial Sequence
  Description of Artificial Sequence: Synthetic oligonucleotide
ctggtgatgctggaaacagttcctcgaagtg

SEQ ID NO: 72553 - DNA, 31 bp, Artificial Sequence
  Description of Artificial Sequence: Synthetic oligonucleotide
tggtgatgctggaaacagttcctcgaagtgg

SEQ ID NO: 72554 - DNA, 30 bp, Artificial Sequence
  Description of Artificial Sequence: Synthetic oligonucleotide
ggtgatgctggaaacagttcctcgaagtgg

SEQ ID NO: 72555 - DNA, 31 bp, Artificial Sequence
  Description of Artificial Sequence: Synthetic oligonucleotide
gtgatgctggaaacagttcctcgaagtggag

SEQ ID NO: 72556 - DNA, 32 bp, Artificial Sequence
  Description of Artificial Sequence: Synthetic oligonucleotide
tgatgctggaaacagttcctcgaagtggagag

SEQ ID NO: 72557 - DNA, 31 bp, Artificial Sequence
  Description of Artificial Sequence: Synthetic oligonucleotide
gatgctggaaacagttcctcgaagtggagag

SEQ ID NO: 72558 - DNA, 31 bp, Artificial Sequence
  Description of Artificial Sequence: Synthetic oligonucleotide
atgctggaaacagttcctcgaagtggagagg

SEQ ID NO: 72559 - DNA, 30 bp, Artificial Sequence
  Description of Artificial Sequence: Synthetic oligonucleotide
tgctggaaacagttcctcgaagtggagagg

SEQ ID NO: 72560 - DNA, 29 bp, Artificial Sequence
  Description of Artificial Sequence: Synthetic oligonucleotide
gctggaaacagttcctcgaagtggagagg

SEQ ID NO: 72561 - DNA, 33 bp, Artificial Sequence
  Description of Artificial Sequence: Synthetic oligonucleotide
ctggaaacagttcctcgaagtggagaggtttac

SEQ ID NO: 72562 - DNA, 34 bp, Artificial Sequence
  Description of Artificial Sequence: Synthetic oligonucleotide
tggaaacagttcctcgaagtggagaggtttacac

SEQ ID NO: 72563 - DNA, 33 bp, Artificial Sequence
  Description of Artificial Sequence: Synthetic oligonucleotide
ggaaacagttcctcgaagtggagaggtttacac

SEQ ID NO: 72564 - DNA, 33 bp, Artificial Sequence
  Description of Artificial Sequence: Synthetic oligonucleotide
gaaacagttcctcgaagtggagaggtttacacc

SEQ ID NO: 72565 - DNA, 34 bp, Artificial Sequence
  Description of Artificial Sequence: Synthetic oligonucleotide
aaacagttcctcgaagtggagaggtttacacctg

SEQ ID NO: 72566 - DNA, 33 bp, Artificial Sequence
  Description of Artificial Sequence: Synthetic oligonucleotide
aacagttcctcgaagtggagaggtttacacctg

SEQ ID NO: 72567 - DNA, 32 bp, Artificial Sequence
  Description of Artificial Sequence: Synthetic oligonucleotide
acagttcctcgaagtggagaggtttacacctg

SEQ ID NO: 72568 - DNA, 31 bp, Artificial Sequence
  Description of Artificial Sequence: Synthetic oligonucleotide
cagttcctcgaagtggagaggtttacacctg

SEQ ID NO: 72569 - DNA, 31 bp, Artificial Sequence
  Description of Artificial Sequence: Synthetic oligonucleotide
agttcctcgaagtggagaggtttacacctgc

SEQ ID NO: 72570 - DNA, 30 bp, Artificial Sequence
  Description of Artificial Sequence: Synthetic oligonucleotide
gttcctcgaagtggagaggtttacacctgc

SEQ ID NO: 72571 - DNA, 30 bp, Artificial Sequence
  Description of Artificial Sequence: Synthetic oligonucleotide
ttcctcgaagtggagaggtttacacctgcc

SEQ ID NO: 72572 - DNA, 29 bp, Artificial Sequence
  Description of Artificial Sequence: Synthetic oligonucleotide
tcctcgaagtggagaggtttacacctgcc

SEQ ID NO: 72573 - DNA, 28 bp, Artificial Sequence
  Description of Artificial Sequence: Synthetic oligonucleotide
cctcgaagtggagaggtttacacctgcc

SEQ ID NO: 72574 - DNA, 30 bp, Artificial Sequence
  Description of Artificial Sequence: Synthetic oligonucleotide
ctcgaagtggagaggtttacacctgccaag

SEQ ID NO: 72575 - DNA, 31 bp, Artificial Sequence
  Description of Artificial Sequence: Synthetic oligonucleotide
tcgaagtggagaggtttacacctgccaagtg

SEQ ID NO: 72576 - DNA, 30 bp, Artificial Sequence
  Description of Artificial Sequence: Synthetic oligonucleotide
cgaagtggagaggtttacacctgccaagtg

SEQ ID NO: 72577 - DNA, 30 bp, Artificial Sequence
  Description of Artificial Sequence: Synthetic oligonucleotide
gaagtggagaggtttacacctgccaagtgg

SEQ ID NO: 72578 - DNA, 31 bp, Artificial Sequence
  Description of Artificial Sequence: Synthetic oligonucleotide
aagtggagaggtttacacctgccaagtggag

SEQ ID NO: 72579 - DNA, 30 bp, Artificial Sequence
  Description of Artificial Sequence: Synthetic oligonucleotide
tggacacctactgcagacacaactacggag

SEQ ID NO: 72580 - DNA, 29 bp, Artificial Sequence
  Description of Artificial Sequence: Synthetic oligonucleotide
ggacacctactgcagacacaactacggag

SEQ ID NO: 72581 - DNA, 31 bp, Artificial Sequence
  Description of Artificial Sequence: Synthetic oligonucleotide
gacacctactgcagacacaactacggagttg

SEQ ID NO: 72582 - DNA, 32 bp, Artificial Sequence
  Description of Artificial Sequence: Synthetic oligonucleotide
acacctactgcagacacaactacggagttgtg

SEQ ID NO: 72583 - DNA, 31 bp, Artificial Sequence
  Description of Artificial Sequence: Synthetic oligonucleotide
cacctactgcagacacaactacggagttgtg

SEQ ID NO: 72584 - DNA, 31 bp, Artificial Sequence
  Description of Artificial Sequence: Synthetic oligonucleotide
acctactgcagacacaactacggagttgtgg

SEQ ID NO: 72585 - DNA, 30 bp, Artificial Sequence
  Description of Artificial Sequence: Synthetic oligonucleotide
cctactgcagacacaactacggagttgtgg

SEQ ID NO: 72586 - DNA, 31 bp, Artificial Sequence
  Description of Artificial Sequence: Synthetic oligonucleotide
ctactgcagacacaactacggagttgtggag

SEQ ID NO: 72587 - DNA, 32 bp, Artificial Sequence
  Description of Artificial Sequence: Synthetic oligonucleotide
tactgcagacacaactacggagttgtggagag

SEQ ID NO: 72588 - DNA, 31 bp, Artificial Sequence
  Description of Artificial Sequence: Synthetic oligonucleotide
actgcagacacaactacggagttgtggagag

SEQ ID NO: 72589 - DNA, 30 bp, Artificial Sequence
  Description of Artificial Sequence: Synthetic oligonucleotide
ctgcagacacaactacggagttgtggagag

SEQ ID NO: 72590 - DNA, 30 bp, Artificial Sequence
  Description of Artificial Sequence: Synthetic oligonucleotide
tgcagacacaactacggagttgtggagagc

SEQ ID NO: 72591 - DNA, 29 bp, Artificial Sequence
  Description of Artificial Sequence: Synthetic oligonucleotide
gcagacacaactacggagttgtggagagc

SEQ ID NO: 72592 - DNA, 31 bp, Artificial Sequence
  Description of Artificial Sequence: Synthetic oligonucleotide
cagacacaactacggagttgtggagagcttc

SEQ ID NO: 72593 - DNA, 32 bp, Artificial Sequence
  Description of Artificial Sequence: Synthetic oligonucleotide
agacacaactacggagttgtggagagcttcac

SEQ ID NO: 72594 - DNA, 31 bp, Artificial Sequence
  Description of Artificial Sequence: Synthetic oligonucleotide
gacacaactacggagttgtggagagcttcac

SEQ ID NO: 72595 - DNA, 32 bp, Artificial Sequence
  Description of Artificial Sequence: Synthetic oligonucleotide
acacaactacggagttgtggagagcttcacag

SEQ ID NO: 72596 - DNA, 31 bp, Artificial Sequence
  Description of Artificial Sequence: Synthetic oligonucleotide
cacaactacggagttgtggagagcttcacag

SEQ ID NO: 72597 - DNA, 32 bp, Artificial Sequence
  Description of Artificial Sequence: Synthetic oligonucleotide
acaactacggagttgtggagagcttcacagtg

SEQ ID NO: 72598 - DNA, 31 bp, Artificial Sequence
  Description of Artificial Sequence: Synthetic oligonucleotide
caactacggagttgtggagagcttcacagtg

SEQ ID NO: 72599 - DNA, 31 bp, Artificial Sequence
  Description of Artificial Sequence: Synthetic oligonucleotide
aactacggagttgtggagagcttcacagtgc

SEQ ID NO: 72600 - DNA, 30 bp, Artificial Sequence
  Description of Artificial Sequence: Synthetic oligonucleotide
actacggagttgtggagagcttcacagtgc

SEQ ID NO: 72601 - DNA, 29 bp, Artificial Sequence
  Description of Artificial Sequence: Synthetic oligonucleotide
ctacggagttgtggagagcttcacagtgc

SEQ ID NO: 72602 - DNA, 30 bp, Artificial Sequence
  Description of Artificial Sequence: Synthetic oligonucleotide
tacggagttgtggagagcttcacagtgcag

SEQ ID NO: 72603 - DNA, 29 bp, Artificial Sequence
  Description of Artificial Sequence: Synthetic oligonucleotide
acggagttgtggagagcttcacagtgcag

SEQ ID NO: 72604 - DNA, 28 bp, Artificial Sequence
  Description of Artificial Sequence: Synthetic oligonucleotide
cggagttgtggagagcttcacagtgcag

SEQ ID NO: 72605 - DNA, 28 bp, Artificial Sequence
  Description of Artificial Sequence: Synthetic oligonucleotide
ggagttgtggagagcttcacagtgcagc

SEQ ID NO: 72606 - DNA, 28 bp, Artificial Sequence
  Description of Artificial Sequence: Synthetic oligonucleotide
gagttgtggagagcttcacagtgcagcg

SEQ ID NO: 72607 - DNA, 28 bp, Artificial Sequence
  Description of Artificial Sequence: Synthetic oligonucleotide
agttgtggagagcttcacagtgcagcgg

SEQ ID NO: 72608 - DNA, 33 bp, Artificial Sequence
  Description of Artificial Sequence: Synthetic oligonucleotide
cctaagagggagtgtcatttcttcaatgggacc

SEQ ID NO: 72609 - DNA, 33 bp, Artificial Sequence
  Description of Artificial Sequence: Synthetic oligonucleotide
ctaagagggagtgtcatttcttcaatgggaccg

SEQ ID NO: 72610 - DNA, 34 bp, Artificial Sequence
  Description of Artificial Sequence: Synthetic oligonucleotide
taagagggagtgtcatttcttcaatgggaccgag

SEQ ID NO: 72611 - DNA, 33 bp, Artificial Sequence
  Description of Artificial Sequence: Synthetic oligonucleotide
aagagggagtgtcatttcttcaatgggaccgag

SEQ ID NO: 72612 - DNA, 32 bp, Artificial Sequence
  Description of Artificial Sequence: Synthetic oligonucleotide
agagggagtgtcatttcttcaatgggaccgag

SEQ ID NO: 72613 - DNA, 31 bp, Artificial Sequence
  Description of Artificial Sequence: Synthetic oligonucleotide
gagggagtgtcatttcttcaatgggaccgag

SEQ ID NO: 72614 - DNA, 31 bp, Artificial Sequence
  Description of Artificial Sequence: Synthetic oligonucleotide
agggagtgtcatttcttcaatgggaccgagc

SEQ ID NO: 72615 - DNA, 30 bp, Artificial Sequence
  Description of Artificial Sequence: Synthetic oligonucleotide
gggagtgtcatttcttcaatgggaccgagc

SEQ ID NO: 72616 - DNA, 30 bp, Artificial Sequence
  Description of Artificial Sequence: Synthetic oligonucleotide
ggagtgtcatttcttcaatgggaccgagcg

SEQ ID NO: 72617 - DNA, 30 bp, Artificial Sequence
  Description of Artificial Sequence: Synthetic oligonucleotide
gagtgtcatttcttcaatgggaccgagcgg

SEQ ID NO: 72618 - DNA, 30 bp, Artificial Sequence
  Description of Artificial Sequence: Synthetic oligonucleotide
agtgtcatttcttcaatgggaccgagcggg

SEQ ID NO: 72619 - DNA, 29 bp, Artificial Sequence
  Description of Artificial Sequence: Synthetic oligonucleotide
gtgtcatttcttcaatgggaccgagcggg

SEQ ID NO: 72620 - DNA, 30 bp, Artificial Sequence
  Description of Artificial Sequence: Synthetic oligonucleotide
tgtcatttcttcaatgggaccgagcgggtg

SEQ ID NO: 72621 - DNA, 29 bp, Artificial Sequence
  Description of Artificial Sequence: Synthetic oligonucleotide
gtcatttcttcaatgggaccgagcgggtg

SEQ ID NO: 72622 - DNA, 29 bp, Artificial Sequence
  Description of Artificial Sequence: Synthetic oligonucleotide
tcatttcttcaatgggaccgagcgggtgc

SEQ ID NO: 72623 - DNA, 28 bp, Artificial Sequence
  Description of Artificial Sequence: Synthetic oligonucleotide
catttcttcaatgggaccgagcgggtgc

SEQ ID NO: 72624 - DNA, 28 bp, Artificial Sequence
  Description of Artificial Sequence: Synthetic oligonucleotide
atttcttcaatgggaccgagcgggtgcg

SEQ ID NO: 72625 - DNA, 27 bp, Artificial Sequence
  Description of Artificial Sequence: Synthetic oligonucleotide
tttcttcaatgggaccgagcgggtgcg

SEQ ID NO: 72626 - DNA, 26 bp, Artificial Sequence
  Description of Artificial Sequence: Synthetic oligonucleotide
ttcttcaatgggaccgagcgggtgcg

SEQ ID NO: 72627 - DNA, 25 bp, Artificial Sequence
  Description of Artificial Sequence: Synthetic oligonucleotide
tcttcaatgggaccgagcgggtgcg

SEQ ID NO: 72628 - DNA, 24 bp, Artificial Sequence
  Description of Artificial Sequence: Synthetic oligonucleotide
cttcaatgggaccgagcgggtgcg

SEQ ID NO: 72629 - DNA, 26 bp, Artificial Sequence
  Description of Artificial Sequence: Synthetic oligonucleotide
ttcaatgggaccgagcgggtgcggtt

SEQ ID NO: 72630 - DNA, 25 bp, Artificial Sequence
  Description of Artificial Sequence: Synthetic oligonucleotide
tcaatgggaccgagcgggtgcggtt

SEQ ID NO: 72631 - DNA, 24 bp, Artificial Sequence
  Description of Artificial Sequence: Synthetic oligonucleotide
caatgggaccgagcgggtgcggtt

SEQ ID NO: 72632 - DNA, 24 bp, Artificial Sequence
  Description of Artificial Sequence: Synthetic oligonucleotide
aatgggaccgagcgggtgcggttc

SEQ ID NO: 72633 - DNA, 23 bp, Artificial Sequence
  Description of Artificial Sequence: Synthetic oligonucleotide
atgggaccgagcgggtgcggttc

SEQ ID NO: 72634 - DNA, 22 bp, Artificial Sequence
  Description of Artificial Sequence: Synthetic oligonucleotide
tgggaccgagcgggtgcggttc

SEQ ID NO: 72635 - DNA, 21 bp, Artificial Sequence
  Description of Artificial Sequence: Synthetic oligonucleotide
gggaccgagcgggtgcggttc

SEQ ID NO: 72636 - DNA, 22 bp, Artificial Sequence
  Description of Artificial Sequence: Synthetic oligonucleotide
ggaccgagcgggtgcggttcct

SEQ ID NO: 72637 - DNA, 22 bp, Artificial Sequence
  Description of Artificial Sequence: Synthetic oligonucleotide
gaccgagcgggtgcggttcctg

SEQ ID NO: 72638 - DNA, 23 bp, Artificial Sequence
  Description of Artificial Sequence: Synthetic oligonucleotide
accgagcgggtgcggttcctgga

SEQ ID NO: 72639 - DNA, 22 bp, Artificial Sequence
  Description of Artificial Sequence: Synthetic oligonucleotide
ccgagcgggtgcggttcctgga

SEQ ID NO: 72640 - DNA, 23 bp, Artificial Sequence
  Description of Artificial Sequence: Synthetic oligonucleotide
cgagcgggtgcggttcctggaca

SEQ ID NO: 72641 - DNA, 25 bp, Artificial Sequence
  Description of Artificial Sequence: Synthetic oligonucleotide
agctggggcggcctgacgctgaata

SEQ ID NO: 72642 - DNA, 24 bp, Artificial Sequence
  Description of Artificial Sequence: Synthetic oligonucleotide
gctggggcggcctgacgctgaata

SEQ ID NO: 72643 - DNA, 25 bp, Artificial Sequence
  Description of Artificial Sequence: Synthetic oligonucleotide
ctggggcggcctgacgctgaatact

SEQ ID NO: 72644 - DNA, 25 bp, Artificial Sequence
  Description of Artificial Sequence: Synthetic oligonucleotide
tggggcggcctgacgctgaatactg

SEQ ID NO: 72645 - DNA, 24 bp, Artificial Sequence
  Description of Artificial Sequence: Synthetic oligonucleotide
ggggcggcctgacgctgaatactg

SEQ ID NO: 72646 - DNA, 26 bp, Artificial Sequence
  Description of Artificial Sequence: Synthetic oligonucleotide
gggcggcctgacgctgaatactggaa

SEQ ID NO: 72647 - DNA, 27 bp, Artificial Sequence
  Description of Artificial Sequence: Synthetic oligonucleotide
ggcggcctgacgctgaatactggaaca

SEQ ID NO: 72648 - DNA, 27 bp, Artificial Sequence
  Description of Artificial Sequence: Synthetic oligonucleotide
gcggcctgacgctgaatactggaacag

SEQ ID NO: 72649 - DNA, 27 bp, Artificial Sequence
  Description of Artificial Sequence: Synthetic oligonucleotide
cggcctgacgctgaatactggaacagc

SEQ ID NO: 72650 - DNA, 27 bp, Artificial Sequence
  Description of Artificial Sequence: Synthetic oligonucleotide
ggcctgacgctgaatactggaacagcc

SEQ ID NO: 72651 - DNA, 28 bp, Artificial Sequence
  Description of Artificial Sequence: Synthetic oligonucleotide
gcctgacgctgaatactggaacagccag

SEQ ID NO: 72652 - DNA, 30 bp, Artificial Sequence
  Description of Artificial Sequence: Synthetic oligonucleotide
cctgacgctgaatactggaacagccagaag

SEQ ID NO: 72653 - DNA, 30 bp, Artificial Sequence
  Description of Artificial Sequence: Synthetic oligonucleotide
ctgacgctgaatactggaacagccagaagg

SEQ ID NO: 72654 - DNA, 31 bp, Artificial Sequence
  Description of Artificial Sequence: Synthetic oligonucleotide
tgacgctgaatactggaacagccagaaggac

SEQ ID NO: 72655 - DNA, 30 bp, Artificial Sequence
  Description of Artificial Sequence: Synthetic oligonucleotide
gacgctgaatactggaacagccagaaggac

SEQ ID NO: 72656 - DNA, 32 bp, Artificial Sequence
  Description of Artificial Sequence: Synthetic oligonucleotide
acgctgaatactggaacagccagaaggacatc

SEQ ID NO: 72657 - DNA, 31 bp, Artificial Sequence
  Description of Artificial Sequence: Synthetic oligonucleotide
cgctgaatactggaacagccagaaggacatc

SEQ ID NO: 72658 - DNA, 31 bp, Artificial Sequence
  Description of Artificial Sequence: Synthetic oligonucleotide
gctgaatactggaacagccagaaggacatcc

SEQ ID NO: 72659 - DNA, 32 bp, Artificial Sequence
  Description of Artificial Sequence: Synthetic oligonucleotide
ctgaatactggaacagccagaaggacatcctg

SEQ ID NO: 72660 - DNA, 32 bp, Artificial Sequence
  Description of Artificial Sequence: Synthetic oligonucleotide
tgaatactggaacagccagaaggacatcctgg

SEQ ID NO: 72661 - DNA, 31 bp, Artificial Sequence
  Description of Artificial Sequence: Synthetic oligonucleotide
gaatactggaacagccagaaggacatcctgg

SEQ ID NO: 72662 - DNA, 32 bp, Artificial Sequence
  Description of Artificial Sequence: Synthetic oligonucleotide
aatactggaacagccagaaggacatcctggag

SEQ ID NO: 72663 - DNA, 31 bp, Artificial Sequence
  Description of Artificial Sequence: Synthetic oligonucleotide
atactggaacagccagaaggacatcctggag

SEQ ID NO: 72664 - DNA, 23 bp, Artificial Sequence
  Description of Artificial Sequence: Synthetic oligonucleotide
acatcctggagcaggcgcgggct

SEQ ID NO: 72665 - DNA, 22 bp, Artificial Sequence
  Description of Artificial Sequence: Synthetic oligonucleotide
catcctggagcaggcgcgggct

SEQ ID NO: 72666 - DNA, 22 bp, Artificial Sequence
  Description of Artificial Sequence: Synthetic oligonucleotide
atcctggagcaggcgcgggctg

SEQ ID NO: 72667 - DNA, 21 bp, Artificial Sequence
  Description of Artificial Sequence: Synthetic oligonucleotide
tcctggagcaggcgcgggctg

SEQ ID NO: 72668 - DNA, 20 bp, Artificial Sequence
  Description of Artificial Sequence: Synthetic oligonucleotide
cctggagcaggcgcgggctg

SEQ ID NO: 72669 - DNA, 20 bp, Artificial Sequence
  Description of Artificial Sequence: Synthetic oligonucleotide
ctggagcaggcgcgggctgc

SEQ ID NO: 72670 - DNA, 20 bp, Artificial Sequence
  Description of Artificial Sequence: Synthetic oligonucleotide
tggagcaggcgcgggctgcg

SEQ ID NO: 72671 - DNA, 20 bp, Artificial Sequence
  Description of Artificial Sequence: Synthetic oligonucleotide
ggagcaggcgcgggctgcgt

SEQ ID NO: 72672 - DNA, 20 bp, Artificial Sequence
  Description of Artificial Sequence: Synthetic oligonucleotide
gagcaggcgcgggctgcggt

SEQ ID NO: 72673 - DNA, 20 bp, Artificial Sequence
  Description of Artificial Sequence: Synthetic oligonucleotide
agcaggcgcgggctgcggtg

SEQ ID NO: 72674 - DNA, 20 bp, Artificial Sequence
  Description of Artificial Sequence: Synthetic oligonucleotide
gcaggcgcgggctgcggtgt

SEQ ID NO: 72675 - DNA, 20 bp, Artificial Sequence
  Description of Artificial Sequence: Synthetic oligonucleotide
caggcgcgggctgcggtgga

SEQ ID NO: 72676 - DNA, 21 bp, Artificial Sequence
  Description of Artificial Sequence: Synthetic oligonucleotide
aggcgcgggctgcggtggaca

SEQ ID NO: 72677 - DNA, 20 bp, Artificial Sequence
  Description of Artificial Sequence: Synthetic oligonucleotide
ggcgcgggctgcggtggaca

SEQ ID NO: 72678 - DNA, 20 bp, Artificial Sequence
  Description of Artificial Sequence: Synthetic oligonucleotide
gcgcgggctgcggtggacac

SEQ ID NO: 72679 - DNA, 22 bp, Artificial Sequence
  Description of Artificial Sequence: Synthetic oligonucleotide
cgcgggctgcggtggacaccta

SEQ ID NO: 72680 - DNA, 25 bp, Artificial Sequence
  Description of Artificial Sequence: Synthetic oligonucleotide
gcttcgacagcgacgtcggggagtt

SEQ ID NO: 72681 - DNA, 25 bp, Artificial Sequence
  Description of Artificial Sequence: Synthetic oligonucleotide
cttcgacagcgacgtcggggagttc

SEQ ID NO: 72682 - DNA, 25 bp, Artificial Sequence
  Description of Artificial Sequence: Synthetic oligonucleotide
ttcgacagcgacgtcggggagttcc

SEQ ID NO: 72683 - DNA, 24 bp, Artificial Sequence
  Description of Artificial Sequence: Synthetic oligonucleotide
tcgacagcgacgtcggggagttcc

SEQ ID NO: 72684 - DNA, 23 bp, Artificial Sequence
  Description of Artificial Sequence: Synthetic oligonucleotide
cgacagcgacgtcggggagttcc

SEQ ID NO: 72685 - DNA, 23 bp, Artificial Sequence
  Description of Artificial Sequence: Synthetic oligonucleotide
gacagcgacgtcggggagttccg

SEQ ID NO: 72686 - DNA, 23 bp, Artificial Sequence
  Description of Artificial Sequence: Synthetic oligonucleotide
acagcgacgtcggggagttccgg

SEQ ID NO: 72687 - DNA, 22 bp, Artificial Sequence
  Description of Artificial Sequence: Synthetic oligonucleotide
cagcgacgtcggggagttccgg

SEQ ID NO: 72688 - DNA, 22 bp, Artificial Sequence
  Description of Artificial Sequence: Synthetic oligonucleotide
agcgacgtcggggagttccggg

SEQ ID NO: 72689 - DNA, 21 bp, Artificial Sequence
  Description of Artificial Sequence: Synthetic oligonucleotide
gcgacgtcggggagttccggg

SEQ ID NO: 72690 - DNA, 21 bp, Artificial Sequence
  Description of Artificial Sequence: Synthetic oligonucleotide
cgacgtcggggagttccgggc

SEQ ID NO: 72691 - DNA, 21 bp, Artificial Sequence
  Description of Artificial Sequence: Synthetic oligonucleotide
gacgtcggggagttccgggcg

SEQ ID NO: 72692 - DNA, 22 bp, Artificial Sequence
  Description of Artificial Sequence: Synthetic oligonucleotide
acgtcggggagttccgggcggt

SEQ ID NO: 72693 - DNA, 21 bp, Artificial Sequence
  Description of Artificial Sequence: Synthetic oligonucleotide
cgtcggggagttccgggcggt

SEQ ID NO: 72694 - DNA, 22 bp, Artificial Sequence
  Description of Artificial Sequence: Synthetic oligonucleotide
gtcggggagttccgggcggtga

SEQ ID NO: 72695 - DNA, 22 bp, Artificial Sequence
  Description of Artificial Sequence: Synthetic oligonucleotide
tcggggagttccgggcggtgac

SEQ ID NO: 72696 - DNA, 21 bp, Artificial Sequence
  Description of Artificial Sequence: Synthetic oligonucleotide
cggggagttccgggcggtgac

SEQ ID NO: 72697 - DNA, 26 bp, Artificial Sequence
  Description of Artificial Sequence: Synthetic oligonucleotide
cgcttcgacagcgatgtgggggagtt

SEQ ID NO: 72698 - DNA, 26 bp, Artificial Sequence
  Description of Artificial Sequence: Synthetic oligonucleotide
gcttcgacagcgatgtgggggagttc

SEQ ID NO: 72699 - DNA, 26 bp, Artificial Sequence
  Description of Artificial Sequence: Synthetic oligonucleotide
cttcgacagcgatgtgggggagttcc

SEQ ID NO: 72700 - DNA, 26 bp, Artificial Sequence
  Description of Artificial Sequence: Synthetic oligonucleotide
ttcgacagcgatgtgggggagttccg

SEQ ID NO: 72701 - DNA, 25 bp, Artificial Sequence
  Description of Artificial Sequence: Synthetic oligonucleotide
tcgacagcgatgtgggggagttccg

SEQ ID NO: 72702 - DNA, 24 bp, Artificial Sequence
  Description of Artificial Sequence: Synthetic oligonucleotide
cgacagcgatgtgggggagttccg

SEQ ID NO: 72703 - DNA, 24 bp, Artificial Sequence
  Description of Artificial Sequence: Synthetic oligonucleotide
gacagcgatgtgggggagttccgg

SEQ ID NO: 72704 - DNA, 24 bp, Artificial Sequence
  Description of Artificial Sequence: Synthetic oligonucleotide
acagcgatgtgggggagttccggg

SEQ ID NO: 72705 - DNA, 23 bp, Artificial Sequence
  Description of Artificial Sequence: Synthetic oligonucleotide
cagcgatgtgggggagttccggg

SEQ ID NO: 72706 - DNA, 23 bp, Artificial Sequence
  Description of Artificial Sequence: Synthetic oligonucleotide
agcgatgtgggggagttccgggc

SEQ ID NO: 72707 - DNA, 22 bp, Artificial Sequence
  Description of Artificial Sequence: Synthetic oligonucleotide
gcgatgtgggggagttccgggc

SEQ ID NO: 72708 - DNA, 22 bp, Artificial Sequence
  Description of Artificial Sequence: Synthetic oligonucleotide
cgatgtgggggagttccgggcg

SEQ ID NO: 72709 - DNA, 23 bp, Artificial Sequence
  Description of Artificial Sequence: Synthetic oligonucleotide
gatgtgggggagttccgggcggt

SEQ ID NO: 72710 - DNA, 24 bp, Artificial Sequence
  Description of Artificial Sequence: Synthetic oligonucleotide
atgtgggggagttccgggcggtga

SEQ ID NO: 72711 - DNA, 23 bp, Artificial Sequence
  Description of Artificial Sequence: Synthetic oligonucleotide
tgtgggggagttccgggcggtga

SEQ ID NO: 72712 - DNA, 29 bp, Artificial Sequence
  Description of Artificial Sequence: Synthetic oligonucleotide
gggtgcggttcctggacagatacttctac

SEQ ID NO: 72713 - DNA, 31 bp, Artificial Sequence
  Description of Artificial Sequence: Synthetic oligonucleotide
ggtgcggttcctggacagatacttctacaac

SEQ ID NO: 72714 - DNA, 31 bp, Artificial Sequence
  Description of Artificial Sequence: Synthetic oligonucleotide
gtgcggttcctggacagatacttctacaacc

SEQ ID NO: 72715 - DNA, 32 bp, Artificial Sequence
  Description of Artificial Sequence: Synthetic oligonucleotide
tgcggttcctggacagatacttctacaaccag

SEQ ID NO: 72716 - DNA, 31 bp, Artificial Sequence
  Description of Artificial Sequence: Synthetic oligonucleotide
gcggttcctggacagatacttctacaaccag

SEQ ID NO: 72717 - DNA, 31 bp, Artificial Sequence
  Description of Artificial Sequence: Synthetic oligonucleotide
cggttcctggacagatacttctacaaccagg

SEQ ID NO: 72718 - DNA, 32 bp, Artificial Sequence
  Description of Artificial Sequence: Synthetic oligonucleotide
ggttcctggacagatacttctacaaccaggag

SEQ ID NO: 72719 - DNA, 32 bp, Artificial Sequence
  Description of Artificial Sequence: Synthetic oligonucleotide
gttcctggacagatacttctacaaccaggagg

SEQ ID NO: 72720 - DNA, 33 bp, Artificial Sequence
  Description of Artificial Sequence: Synthetic oligonucleotide
ttcctggacagatacttctacaaccaggaggag

SEQ ID NO: 72721 - DNA, 32 bp, Artificial Sequence
  Description of Artificial Sequence: Synthetic oligonucleotide
tcctggacagatacttctacaaccaggaggag

SEQ ID NO: 72722 - DNA, 31 bp, Artificial Sequence
  Description of Artificial Sequence: Synthetic oligonucleotide
cctggacagatacttctacaaccaggaggag

SEQ ID NO: 72723 - DNA, 32 bp, Artificial Sequence
  Description of Artificial Sequence: Synthetic oligonucleotide
ctggacagatacttctacaaccaggaggagtc

SEQ ID NO: 72724 - DNA, 32 bp, Artificial Sequence
  Description of Artificial Sequence: Synthetic oligonucleotide
tggacagatacttctacaaccaggaggagtcc

SEQ ID NO: 72725 - DNA, 31 bp, Artificial Sequence
  Description of Artificial Sequence: Synthetic oligonucleotide
ggacagatacttctacaaccaggaggagtcc

SEQ ID NO: 72726 - DNA, 31 bp, Artificial Sequence
  Description of Artificial Sequence: Synthetic oligonucleotide
gacagatacttctacaaccaggaggagtccg

SEQ ID NO: 72727 - DNA, 32 bp, Artificial Sequence
  Description of Artificial Sequence: Synthetic oligonucleotide
acagatacttctacaaccaggaggagtccgtg

SEQ ID NO: 72728 - DNA, 31 bp, Artificial Sequence
  Description of Artificial Sequence: Synthetic oligonucleotide
cagatacttctacaaccaggaggagtccgtg

SEQ ID NO: 72729 - DNA, 31 bp, Artificial Sequence
  Description of Artificial Sequence: Synthetic oligonucleotide
agatacttctacaaccaggaggagtccgtgc

SEQ ID NO: 72730 - DNA, 30 bp, Artificial Sequence
  Description of Artificial Sequence: Synthetic oligonucleotide
gatacttctacaaccaggaggagtccgtgc

SEQ ID NO: 72731 - DNA, 30 bp, Artificial Sequence
  Description of Artificial Sequence: Synthetic oligonucleotide
atacttctacaaccaggaggagtccgtgcg

SEQ ID NO: 72732 - DNA, 29 bp, Artificial Sequence
  Description of Artificial Sequence: Synthetic oligonucleotide
tacttctacaaccaggaggagtccgtgcg

SEQ ID NO: 72733 - DNA, 28 bp, Artificial Sequence
  Description of Artificial Sequence: Synthetic oligonucleotide
acttctacaaccaggaggagtccgtgcg

SEQ ID NO: 72734 - DNA, 27 bp, Artificial Sequence
  Description of Artificial Sequence: Synthetic oligonucleotide
cttctacaaccaggaggagtccgtgcg

SEQ ID NO: 72735 - DNA, 27 bp, Artificial Sequence
  Description of Artificial Sequence: Synthetic oligonucleotide
ttctacaaccaggaggagtccgtgcgc

SEQ ID NO: 72736 - DNA, 27 bp, Artificial Sequence
  Description of Artificial Sequence: Synthetic oligonucleotide
tctacaaccaggaggagtccgtgcgct

SEQ ID NO: 72737 - DNA, 27 bp, Artificial Sequence
  Description of Artificial Sequence: Synthetic oligonucleotide
ctacaaccaggaggagtccgtgcgctt

SEQ ID NO: 72738 - DNA, 27 bp, Artificial Sequence
  Description of Artificial Sequence: Synthetic oligonucleotide
tacaaccaggaggagtccgtgcgcttc

SEQ ID NO: 72739 - DNA, 26 bp, Artificial Sequence
  Description of Artificial Sequence: Synthetic oligonucleotide
acaaccaggaggagtccgtgcgcttc

SEQ ID NO: 72740 - DNA, 25 bp, Artificial Sequence
  Description of Artificial Sequence: Synthetic oligonucleotide
caaccaggaggagtccgtgcgcttc

SEQ ID NO: 72741 - DNA, 27 bp, Artificial Sequence
  Description of Artificial Sequence: Synthetic oligonucleotide
ccgcggtggacacctactgcagacata

SEQ ID NO: 72742 - DNA, 28 bp, Artificial Sequence
  Description of Artificial Sequence: Synthetic oligonucleotide
cgcggtggacacctactgcagacataac

SEQ ID NO: 72743 - DNA, 30 bp, Artificial Sequence
  Description of Artificial Sequence: Synthetic oligonucleotide
gcggtggacacctactgcagacataactac

SEQ ID NO: 72744 - DNA, 30 bp, Artificial Sequence
  Description of Artificial Sequence: Synthetic oligonucleotide
cggtggacacctactgcagacataactacg

SEQ ID NO: 72745 - DNA, 30 bp, Artificial Sequence
  Description of Artificial Sequence: Synthetic oligonucleotide
ggtggacacctactgcagacataactacgg

SEQ ID NO: 72746 - DNA, 30 bp, Artificial Sequence
  Description of Artificial Sequence: Synthetic oligonucleotide
gtggacacctactgcagacataactacggg

SEQ ID NO: 72747 - DNA, 30 bp, Artificial Sequence
  Description of Artificial Sequence: Synthetic oligonucleotide
tggacacctactgcagacataactacgggg

SEQ ID NO: 72748 - DNA, 29 bp, Artificial Sequence
  Description of Artificial Sequence: Synthetic oligonucleotide
ggacacctactgcagacataactacgggg

SEQ ID NO: 72749 - DNA, 31 bp, Artificial Sequence
  Description of Artificial Sequence: Synthetic oligonucleotide
gacacctactgcagacataactacggggttg

SEQ ID NO: 72750 - DNA, 32 bp, Artificial Sequence
  Description of Artificial Sequence: Synthetic oligonucleotide
acacctactgcagacataactacggggttgtg

SEQ ID NO: 72751 - DNA, 31 bp, Artificial Sequence
  Description of Artificial Sequence: Synthetic oligonucleotide
cacctactgcagacataactacggggttgtg

SEQ ID NO: 72752 - DNA, 31 bp, Artificial Sequence
  Description of Artificial Sequence: Synthetic oligonucleotide
acctactgcagacataactacggggttgtgg

SEQ ID NO: 72753 - DNA, 30 bp, Artificial Sequence
  Description of Artificial Sequence: Synthetic oligonucleotide
cctactgcagacataactacggggttgtgg

SEQ ID NO: 72754 - DNA, 31 bp, Artificial Sequence
  Description of Artificial Sequence: Synthetic oligonucleotide
ctactgcagacataactacggggttgtggag

SEQ ID NO: 72755 - DNA, 32 bp, Artificial Sequence
  Description of Artificial Sequence: Synthetic oligonucleotide
tactgcagacataactacggggttgtggagag

SEQ ID NO: 72756 - DNA, 31 bp, Artificial Sequence
  Description of Artificial Sequence: Synthetic oligonucleotide
actgcagacataactacggggttgtggagag

SEQ ID NO: 72757 - DNA, 30 bp, Artificial Sequence
  Description of Artificial Sequence: Synthetic oligonucleotide
ctgcagacataactacggggttgtggagag

SEQ ID NO: 72758 - DNA, 30 bp, Artificial Sequence
  Description of Artificial Sequence: Synthetic oligonucleotide
tgcagacataactacggggttgtggagagc

SEQ ID NO: 72759 - DNA, 29 bp, Artificial Sequence
  Description of Artificial Sequence: Synthetic oligonucleotide
gcagacataactacggggttgtggagagc

SEQ ID NO: 72760 - DNA, 31 bp, Artificial Sequence
  Description of Artificial Sequence: Synthetic oligonucleotide
cagacataactacggggttgtggagagcttc

SEQ ID NO: 72761 - DNA, 32 bp, Artificial Sequence
  Description of Artificial Sequence: Synthetic oligonucleotide
agacataactacggggttgtggagagcttcac

SEQ ID NO: 72762 - DNA, 31 bp, Artificial Sequence
  Description of Artificial Sequence: Synthetic oligonucleotide
gacataactacggggttgtggagagcttcac

SEQ ID NO: 72763 - DNA, 32 bp, Artificial Sequence
  Description of Artificial Sequence: Synthetic oligonucleotide
acataactacggggttgtggagagcttcacag

SEQ ID NO: 72764 - DNA, 31 bp, Artificial Sequence
  Description of Artificial Sequence: Synthetic oligonucleotide
cataactacggggttgtggagagcttcacag

SEQ ID NO: 72765 - DNA, 32 bp, Artificial Sequence
  Description of Artificial Sequence: Synthetic oligonucleotide
ataactacggggttgtggagagcttcacagtg

SEQ ID NO: 72766 - DNA, 31 bp, Artificial Sequence
  Description of Artificial Sequence: Synthetic oligonucleotide
taactacggggttgtggagagcttcacagtg

SEQ ID NO: 72767 - DNA, 33 bp, Artificial Sequence
  Description of Artificial Sequence: Synthetic oligonucleotide
gggtgcggttcctggacagatacttctataatc

SEQ ID NO: 72768 - DNA, 34 bp, Artificial Sequence
  Description of Artificial Sequence: Synthetic oligonucleotide
ggtgcggttcctggacagatacttctataatcag

SEQ ID NO: 72769 - DNA, 34 bp, Artificial Sequence
  Description of Artificial Sequence: Synthetic oligonucleotide
gtgcggttcctggacagatacttctataatcagg

SEQ ID NO: 72770 - DNA, 35 bp, Artificial Sequence
  Description of Artificial Sequence: Synthetic oligonucleotide
tgcggttcctggacagatacttctataatcaggag

SEQ ID NO: 72771 - DNA, 34 bp, Artificial Sequence
  Description of Artificial Sequence: Synthetic oligonucleotide
gcggttcctggacagatacttctataatcaggag

SEQ ID NO: 72772 - DNA, 34 bp, Artificial Sequence
  Description of Artificial Sequence: Synthetic oligonucleotide
cggttcctggacagatacttctataatcaggagg

SEQ ID NO: 72773 - DNA, 35 bp, Artificial Sequence
  Description of Artificial Sequence: Synthetic oligonucleotide
ggttcctggacagatacttctataatcaggaggag

SEQ ID NO: 72774 - DNA, 36 bp, Artificial Sequence
  Description of Artificial Sequence: Synthetic oligonucleotide
gttcctggacagatacttctataatcaggaggagtc

SEQ ID NO: 72775 - DNA, 36 bp, Artificial Sequence
  Description of Artificial Sequence: Synthetic oligonucleotide
ttcctggacagatacttctataatcaggaggagtcc

SEQ ID NO: 72776 - DNA, 35 bp, Artificial Sequence
  Description of Artificial Sequence: Synthetic oligonucleotide
tcctggacagatacttctataatcaggaggagtcc

SEQ ID NO: 72777 - DNA, 34 bp, Artificial Sequence
  Description of Artificial Sequence: Synthetic oligonucleotide
cctggacagatacttctataatcaggaggagtcc

SEQ ID NO: 72778 - DNA, 34 bp, Artificial Sequence
  Description of Artificial Sequence: Synthetic oligonucleotide
ctggacagatacttctataatcaggaggagtccg

SEQ ID NO: 72779 - DNA, 35 bp, Artificial Sequence
  Description of Artificial Sequence: Synthetic oligonucleotide
tggacagatacttctataatcaggaggagtccgtg

SEQ ID NO: 72780 - DNA, 34 bp, Artificial Sequence
  Description of Artificial Sequence: Synthetic oligonucleotide
ggacagatacttctataatcaggaggagtccgtg

SEQ ID NO: 72781 - DNA, 34 bp, Artificial Sequence
  Description of Artificial Sequence: Synthetic oligonucleotide
gacagatacttctataatcaggaggagtccgtgc

SEQ ID NO: 72782 - DNA, 34 bp, Artificial Sequence
  Description of Artificial Sequence: Synthetic oligonucleotide
acagatacttctataatcaggaggagtccgtgcg

SEQ ID NO: 72783 - DNA, 33 bp, Artificial Sequence
  Description of Artificial Sequence: Synthetic oligonucleotide
cagatacttctataatcaggaggagtccgtgcg

SEQ ID NO: 72784 - DNA, 33 bp, Artificial Sequence
  Description of Artificial Sequence: Synthetic oligonucleotide
agatacttctataatcaggaggagtccgtgcgc

SEQ ID NO: 72785 - DNA, 32 bp, Artificial Sequence
  Description of Artificial Sequence: Synthetic oligonucleotide
gatacttctataatcaggaggagtccgtgcgc

SEQ ID NO: 72786 - DNA, 34 bp, Artificial Sequence
  Description of Artificial Sequence: Synthetic oligonucleotide
atacttctataatcaggaggagtccgtgcgcttc

SEQ ID NO: 72787 - DNA, 33 bp, Artificial Sequence
  Description of Artificial Sequence: Synthetic oligonucleotide
tacttctataatcaggaggagtccgtgcgcttc

SEQ ID NO: 72788 - DNA, 32 bp, Artificial Sequence
  Description of Artificial Sequence: Synthetic oligonucleotide
acttctataatcaggaggagtccgtgcgcttc

SEQ ID NO: 72789 - DNA, 31 bp, Artificial Sequence
  Description of Artificial Sequence: Synthetic oligonucleotide
cttctataatcaggaggagtccgtgcgcttc

SEQ ID NO: 72790 - DNA, 31 bp, Artificial Sequence
  Description of Artificial Sequence: Synthetic oligonucleotide
ttctataatcaggaggagtccgtgcgcttcg

SEQ ID NO: 72791 - DNA, 30 bp, Artificial Sequence
  Description of Artificial Sequence: Synthetic oligonucleotide
tctataatcaggaggagtccgtgcgcttcg

SEQ ID NO: 72792 - DNA, 29 bp, Artificial Sequence
  Description of Artificial Sequence: Synthetic oligonucleotide
ctataatcaggaggagtccgtgcgcttcg

SEQ ID NO: 72793 - DNA, 30 bp, Artificial Sequence
  Description of Artificial Sequence: Synthetic oligonucleotide
tataatcaggaggagtccgtgcgcttcgac

SEQ ID NO: 72794 - DNA, 29 bp, Artificial Sequence
  Description of Artificial Sequence: Synthetic oligonucleotide
ataatcaggaggagtccgtgcgcttcgac

SEQ ID NO: 72795 - DNA, 28 bp, Artificial Sequence
  Description of Artificial Sequence: Synthetic oligonucleotide
taatcaggaggagtccgtgcgcttcgac

SEQ ID NO: 72796 - DNA, 27 bp, Artificial Sequence
  Description of Artificial Sequence: Synthetic oligonucleotide
aatcaggaggagtccgtgcgcttcgac

SEQ ID NO: 72797 - DNA, 27 bp, Artificial Sequence
  Description of Artificial Sequence: Synthetic oligonucleotide
atcaggaggagtccgtgcgcttcgaca

SEQ ID NO: 72798 - DNA, 26 bp, Artificial Sequence
  Description of Artificial Sequence: Synthetic oligonucleotide
tcaggaggagtccgtgcgcttcgaca

SEQ ID NO: 72799 - DNA, 31 bp, Artificial Sequence
  Description of Artificial Sequence: Synthetic oligonucleotide
gctgagtactggaacagccagaaggacattc

SEQ ID NO: 72800 - DNA, 32 bp, Artificial Sequence
  Description of Artificial Sequence: Synthetic oligonucleotide
ctgagtactggaacagccagaaggacattctg

SEQ ID NO: 72801 - DNA, 32 bp, Artificial Sequence
  Description of Artificial Sequence: Synthetic oligonucleotide
tgagtactggaacagccagaaggacattctgg

SEQ ID NO: 72802 - DNA, 31 bp, Artificial Sequence
  Description of Artificial Sequence: Synthetic oligonucleotide
gagtactggaacagccagaaggacattctgg

SEQ ID NO: 72803 - DNA, 32 bp, Artificial Sequence
  Description of Artificial Sequence: Synthetic oligonucleotide
agtactggaacagccagaaggacattctggag

SEQ ID NO: 72804 - DNA, 31 bp, Artificial Sequence
  Description of Artificial Sequence: Synthetic oligonucleotide
gtactggaacagccagaaggacattctggag

SEQ ID NO: 72805 - DNA, 31 bp, Artificial Sequence
  Description of Artificial Sequence: Synthetic oligonucleotide
tactggaacagccagaaggacattctggagc

SEQ ID NO: 72806 - DNA, 30 bp, Artificial Sequence
  Description of Artificial Sequence: Synthetic oligonucleotide
actggaacagccagaaggacattctggagc

SEQ ID NO: 72807 - DNA, 29 bp, Artificial Sequence
  Description of Artificial Sequence: Synthetic oligonucleotide
ctggaacagccagaaggacattctggagc

SEQ ID NO: 72808 - DNA, 30 bp, Artificial Sequence
  Description of Artificial Sequence: Synthetic oligonucleotide
tggaacagccagaaggacattctggagcag

SEQ ID NO: 72809 - DNA, 29 bp, Artificial Sequence
  Description of Artificial Sequence: Synthetic oligonucleotide
ggaacagccagaaggacattctggagcag

SEQ ID NO: 72810 - DNA, 29 bp, Artificial Sequence
  Description of Artificial Sequence: Synthetic oligonucleotide
gaacagccagaaggacattctggagcagg

SEQ ID NO: 72811 - DNA, 29 bp, Artificial Sequence
  Description of Artificial Sequence: Synthetic oligonucleotide
aacagccagaaggacattctggagcaggc

SEQ ID NO: 72812 - DNA, 28 bp, Artificial Sequence
  Description of Artificial Sequence: Synthetic oligonucleotide
acagccagaaggacattctggagcaggc

SEQ ID NO: 72813 - DNA, 27 bp, Artificial Sequence
  Description of Artificial Sequence: Synthetic oligonucleotide
cagccagaaggacattctggagcaggc

SEQ ID NO: 72814 - DNA, 27 bp, Artificial Sequence
  Description of Artificial Sequence: Synthetic oligonucleotide
agccagaaggacattctggagcaggcg

SEQ ID NO: 72815 - DNA, 26 bp, Artificial Sequence
  Description of Artificial Sequence: Synthetic oligonucleotide
gccagaaggacattctggagcaggcg

SEQ ID NO: 72816 - DNA, 26 bp, Artificial Sequence
  Description of Artificial Sequence: Synthetic oligonucleotide
ccagaaggacattctggagcaggcgc

SEQ ID NO: 72817 - DNA, 26 bp, Artificial Sequence
  Description of Artificial Sequence: Synthetic oligonucleotide
cagaaggacattctggagcaggcgcg

SEQ ID NO: 72818 - DNA, 26 bp, Artificial Sequence
  Description of Artificial Sequence: Synthetic oligonucleotide
agaaggacattctggagcaggcgcgg

SEQ ID NO: 72819 - DNA, 25 bp, Artificial Sequence
  Description of Artificial Sequence: Synthetic oligonucleotide
gaaggacattctggagcaggcgcgg

SEQ ID NO: 72820 - DNA, 25 bp, Artificial Sequence
  Description of Artificial Sequence: Synthetic oligonucleotide
aaggacattctggagcaggcgcggg

SEQ ID NO: 72821 - DNA, 24 bp, Artificial Sequence
  Description of Artificial Sequence: Synthetic oligonucleotide
aggacattctggagcaggcgcggg

SEQ ID NO: 72822 - DNA, 23 bp, Artificial Sequence
  Description of Artificial Sequence: Synthetic oligonucleotide
ggacattctggagcaggcgcggg

SEQ ID NO: 72823 - DNA, 23 bp, Artificial Sequence
  Description of Artificial Sequence: Synthetic oligonucleotide
gacattctggagcaggcgcgggc

SEQ ID NO: 72824 - DNA, 23 bp, Artificial Sequence
  Description of Artificial Sequence: Synthetic oligonucleotide
acattctggagcaggcgcgggcc

SEQ ID NO: 72825 - DNA, 22 bp, Artificial Sequence
  Description of Artificial Sequence: Synthetic oligonucleotide
cattctggagcaggcgcgggcc

SEQ ID NO: 72826 - DNA, 22 bp, Artificial Sequence
  Description of Artificial Sequence: Synthetic oligonucleotide
attctggagcaggcgcgggccg

SEQ ID NO: 72827 - DNA, 21 bp, Artificial Sequence
  Description of Artificial Sequence: Synthetic oligonucleotide
ttctggagcaggcgcgggccg

SEQ ID NO: 72828 - DNA, 20 bp, Artificial Sequence
  Description of Artificial Sequence: Synthetic oligonucleotide
tctggagcaggcgcgggccg

SEQ ID NO: 72829 - DNA, 27 bp, Artificial Sequence
  Description of Artificial Sequence: Synthetic oligonucleotide
gggtgcggttcctggacagacacttct

SEQ ID NO: 72830 - DNA, 31 bp, Artificial Sequence
  Description of Artificial Sequence: Synthetic oligonucleotide
ggtgcggttcctggacagacacttctataac

SEQ ID NO: 72831 - DNA, 31 bp, Artificial Sequence
  Description of Artificial Sequence: Synthetic oligonucleotide
gtgcggttcctggacagacacttctataacc

SEQ ID NO: 72832 - DNA, 32 bp, Artificial Sequence
  Description of Artificial Sequence: Synthetic oligonucleotide
tgcggttcctggacagacacttctataaccag

SEQ ID NO: 72833 - DNA, 31 bp, Artificial Sequence
  Description of Artificial Sequence: Synthetic oligonucleotide
gcggttcctggacagacacttctataaccag

SEQ ID NO: 72834 - DNA, 31 bp, Artificial Sequence
  Description of Artificial Sequence: Synthetic oligonucleotide
cggttcctggacagacacttctataaccagg

SEQ ID NO: 72835 - DNA, 32 bp, Artificial Sequence
  Description of Artificial Sequence: Synthetic oligonucleotide
ggttcctggacagacacttctataaccaggag

SEQ ID NO: 72836 - DNA, 32 bp, Artificial Sequence
  Description of Artificial Sequence: Synthetic oligonucleotide
gttcctggacagacacttctataaccaggagg

SEQ ID NO: 72837 - DNA, 33 bp, Artificial Sequence
  Description of Artificial Sequence: Synthetic oligonucleotide
ttcctggacagacacttctataaccaggaggag

SEQ ID NO: 72838 - DNA, 32 bp, Artificial Sequence
  Description of Artificial Sequence: Synthetic oligonucleotide
tcctggacagacacttctataaccaggaggag

SEQ ID NO: 72839 - DNA, 31 bp, Artificial Sequence
  Description of Artificial Sequence: Synthetic oligonucleotide
cctggacagacacttctataaccaggaggag

SEQ ID NO: 72840 - DNA, 32 bp, Artificial Sequence
  Description of Artificial Sequence: Synthetic oligonucleotide
ctggacagacacttctataaccaggaggagtc

SEQ ID NO: 72841 - DNA, 32 bp, Artificial Sequence
  Description of Artificial Sequence: Synthetic oligonucleotide
tggacagacacttctataaccaggaggagtcc
